United States Patent 7,341,835 (METHODS OF ANALYSIS OF ALTERNATIVE SPLICING IN MOUSE) - sequence listing, part 2

SEQ ID NO: 39521 - DNA, 25 bp, Mus musculus
gctatgtgatcgctggctattacca

SEQ ID NO: 39522 - DNA, 25 bp, Mus musculus
gctatgtgcgcaccgactacactct

SEQ ID NO: 39523 - DNA, 25 bp, Mus musculus
gctatgttcgaatctcagggtgaag

SEQ ID NO: 39524 - DNA, 25 bp, Mus musculus
gctattaatcagaagctgggtgaca

SEQ ID NO: 39525 - DNA, 25 bp, Mus musculus
gctattacaaggagacctctggcct

SEQ ID NO: 39526 - DNA, 25 bp, Mus musculus
gctattacggctacggccccggcta

SEQ ID NO: 39527 - DNA, 25 bp, Mus musculus
gctattactgtgattgcctcccggg

SEQ ID NO: 39528 - DNA, 25 bp, Mus musculus
gctattccgcatagaccaggtgccc

SEQ ID NO: 39529 - DNA, 25 bp, Mus musculus
gctattcctgcatcaattacaagtt

SEQ ID NO: 39530 - DNA, 25 bp, Mus musculus
gctattcgattagctgtggcttaca

SEQ ID NO: 39531 - DNA, 25 bp, Mus musculus
gctattctagactcagttgagttga

SEQ ID NO: 39532 - DNA, 25 bp, Mus musculus
gctattctgaaactcactacgtagg

SEQ ID NO: 39533 - DNA, 25 bp, Mus musculus
gctattctgctgcttcataggacca

SEQ ID NO: 39534 - DNA, 25 bp, Mus musculus
gctattgagaacattacccttgcgg

SEQ ID NO: 39535 - DNA, 25 bp, Mus musculus
gctattgatgacataccttttggaa

SEQ ID NO: 39536 - DNA, 25 bp, Mus musculus
gctatttgccaaaaggaaacagact

SEQ ID NO: 39537 - DNA, 25 bp, Mus musculus
gctatttgctgtagagttatcccaa

SEQ ID NO: 39538 - DNA, 25 bp, Mus musculus
gctatttgctgttgagttatcccaa

SEQ ID NO: 39539 - DNA, 25 bp, Mus musculus
gctcaaactcatggcacactatggg

SEQ ID NO: 39540 - DNA, 25 bp, Mus musculus
gctcaaagagcccagtatcaagtgt

SEQ ID NO: 39541 - DNA, 25 bp, Mus musculus
gctcaaagataaaaaatgtcggtgg

SEQ ID NO: 39542 - DNA, 25 bp, Mus musculus
gctcaaagataataaatgtcggtgg

SEQ ID NO: 39543 - DNA, 25 bp, Mus musculus
gctcaaagccctgggtcgcttggaa

SEQ ID NO: 39544 - DNA, 25 bp, Mus musculus
gctcaacatgttccagaccctcaag

SEQ ID NO: 39545 - DNA, 25 bp, Mus musculus
gctcaacgagaccaggtgtcagtac

SEQ ID NO: 39546 - DNA, 25 bp, Mus musculus
gctcaactctcttataaaaaagtcc

SEQ ID NO: 39547 - DNA, 25 bp, Mus musculus
gctcaagagcagaaaagcagcgccc

SEQ ID NO: 39548 - DNA, 25 bp, Mus musculus
gctcaagaggactccttgtctccct

SEQ ID NO: 39549 - DNA, 25 bp, Mus musculus
gctcaagagtataagcatcttcctg

SEQ ID NO: 39550 - DNA, 25 bp, Mus musculus
gctcaagatgaatcgggcactggat

SEQ ID NO: 39551 - DNA, 25 bp, Mus musculus
gctcaagccgtacaccttgtgaagg

SEQ ID NO: 39552 - DNA, 25 bp, Mus musculus
gctcaaggaagaattggcaagtgct

SEQ ID NO: 39553 - DNA, 25 bp, Mus musculus
gctcaaggacttcaccctgaagctg

SEQ ID NO: 39554 - DNA, 25 bp, Mus musculus
gctcaaggagcaggatggatctcga

SEQ ID NO: 39555 - DNA, 25 bp, Mus musculus
gctcaaggaggctatggaacaacag

SEQ ID NO: 39556 - DNA, 25 bp, Mus musculus
gctcaaggccttgtcactgaagttt

SEQ ID NO: 39557 - DNA, 25 bp, Mus musculus
gctcaagtacactttgggatttgtt

SEQ ID NO: 39558 - DNA, 25 bp, Mus musculus
gctcaatgtctgctttcggaactac

SEQ ID NO: 39559 - DNA, 25 bp, Mus musculus
gctcaattcggcagccaagcttgca

SEQ ID NO: 39560 - DNA, 25 bp, Mus musculus
gctcacagaaaacaggaagcccttt

SEQ ID NO: 39561 - DNA, 25 bp, Mus musculus
gctcacagatgtgcccagggaagct

SEQ ID NO: 39562 - DNA, 25 bp, Mus musculus
gctcacagttagctgcctttttctg

SEQ ID NO: 39563 - DNA, 25 bp, Mus musculus
gctcacagtttgtaccagcattgaa

SEQ ID NO: 39564 - DNA, 25 bp, Mus musculus
gctcacccatgacatcagcctggag

SEQ ID NO: 39565 - DNA, 25 bp, Mus musculus
gctcaccctctacctgacaaatggt

SEQ ID NO: 39566 - DNA, 25 bp, Mus musculus
gctcaccgtctccaagaagatactc

SEQ ID NO: 39567 - DNA, 25 bp, Mus musculus
gctcacctcatggatgtggccggaa

SEQ ID NO: 39568 - DNA, 25 bp, Mus musculus
gctcacctgtgctcaaaccaaatca

SEQ ID NO: 39569 - DNA, 25 bp, Mus musculus
gctcacgaagtaggttttggatgca

SEQ ID NO: 39570 - DNA, 25 bp, Mus musculus
gctcacggaccgtgccagagattga

SEQ ID NO: 39571 - DNA, 25 bp, Mus musculus
gctcacgttcctgtgcagctgcgag

SEQ ID NO: 39572 - DNA, 25 bp, Mus musculus
gctcactgctgatgaagatatttca

SEQ ID NO: 39573 - DNA, 25 bp, Mus musculus
gctcagaaaccagcaatgctgtcat

SEQ ID NO: 39574 - DNA, 25 bp, Mus musculus
gctcagaaactctcctcaggcgatg

SEQ ID NO: 39575 - DNA, 25 bp, Mus musculus
gctcagaagtcagccgcctggtggt

SEQ ID NO: 39576 - DNA, 25 bp, Mus musculus
gctcagaatggtggacgacggctct

SEQ ID NO: 39577 - DNA, 25 bp, Mus musculus
gctcagacatacaagttggagacct

SEQ ID NO: 39578 - DNA, 25 bp, Mus musculus
gctcagacatcagtatcggttgtga

SEQ ID NO: 39579 - DNA, 25 bp, Mus musculus
gctcagaccgttcttggaactggaa

SEQ ID NO: 39580 - DNA, 25 bp, Mus musculus
gctcagacctggatgcagtcctctt

SEQ ID NO: 39581 - DNA, 25 bp, Mus musculus
gctcagactgtaaaagatcctagaa

SEQ ID NO: 39582 - DNA, 25 bp, Mus musculus
gctcagagaaataatgaggacgttt

SEQ ID NO: 39583 - DNA, 25 bp, Mus musculus
gctcagagaattagcggataacagg

SEQ ID NO: 39584 - DNA, 25 bp, Mus musculus
gctcagaggcacatcagtgacctgt

SEQ ID NO: 39585 - DNA, 25 bp, Mus musculus
gctcagaggttgctggatgtcatct

SEQ ID NO: 39586 - DNA, 25 bp, Mus musculus
gctcagagtctgtccaaggcatgca

SEQ ID NO: 39587 - DNA, 25 bp, Mus musculus
gctcagataagctctcaggaaggga

SEQ ID NO: 39588 - DNA, 25 bp, Mus musculus
gctcagatctccaaagccctggtgg

SEQ ID NO: 39589 - DNA, 25 bp, Mus musculus
gctcagatggtagctgtaaaacatc

SEQ ID NO: 39590 - DNA, 25 bp, Mus musculus
gctcagattcatacaaggtcggtga

SEQ ID NO: 39591 - DNA, 25 bp, Mus musculus
gctcagattcattcaaggtcggtga

SEQ ID NO: 39592 - DNA, 25 bp, Mus musculus
gctcagattgcagatatactgtcaa

SEQ ID NO: 39593 - DNA, 25 bp, Mus musculus
gctcagcagagtggaaccagcagac

SEQ ID NO: 39594 - DNA, 25 bp, Mus musculus
gctcagccaccaaaagtaactacct

SEQ ID NO: 39595 - DNA, 25 bp, Mus musculus
gctcagccattacaacctgactggg

SEQ ID NO: 39596 - DNA, 25 bp, Mus musculus
gctcagccctcggacattaacagat

SEQ ID NO: 39597 - DNA, 25 bp, Mus musculus
gctcagccgaatagaccagaggcat

SEQ ID NO: 39598 - DNA, 25 bp, Mus musculus
gctcagccggccatttcagaatcag

SEQ ID NO: 39599 - DNA, 25 bp, Mus musculus
gctcagcgccaccttggaggagaat

SEQ ID NO: 39600 - DNA, 25 bp, Mus musculus
gctcagctaagaaatacgtcccgcc

SEQ ID NO: 39601 - DNA, 25 bp, Mus musculus
gctcagctcattttcctttgcagag

SEQ ID NO: 39602 - DNA, 25 bp, Mus musculus
gctcagctccatgggccgcaatggg

SEQ ID NO: 39603 - DNA, 25 bp, Mus musculus
gctcagctcctttagtaaagagaga

SEQ ID NO: 39604 - DNA, 25 bp, Mus musculus
gctcaggaagcctctctgggtacct

SEQ ID NO: 39605 - DNA, 25 bp, Mus musculus
gctcaggactgcacgcacacgtgag

SEQ ID NO: 39606 - DNA, 25 bp, Mus musculus
gctcaggagcgtctggccacagctc

SEQ ID NO: 39607 - DNA, 25 bp, Mus musculus
gctcaggagctacttgatgaaattg

SEQ ID NO: 39608 - DNA, 25 bp, Mus musculus
gctcaggagtcctgatctagctgtg

SEQ ID NO: 39609 - DNA, 25 bp, Mus musculus
gctcaggatccgagggaagcacgtc

SEQ ID NO: 39610 - DNA, 25 bp, Mus musculus
gctcaggattttgtgagtgtaagac

SEQ ID NO: 39611 - DNA, 25 bp, Mus musculus
gctcaggcaataaaggatccgggcc

SEQ ID NO: 39612 - DNA, 25 bp, Mus musculus
gctcagggaaggatcgcatttcatg

SEQ ID NO: 39613 - DNA, 25 bp, Mus musculus
gctcagggcaaatgggaaggctaaa

SEQ ID NO: 39614 - DNA, 25 bp, Mus musculus
gctcagtcaccattgtccaaactca

SEQ ID NO: 39615 - DNA, 25 bp, Mus musculus
gctcagtcacctcagcagcgagtca

SEQ ID NO: 39616 - DNA, 25 bp, Mus musculus
gctcagtctcctgggtggactacca

SEQ ID NO: 39617 - DNA, 25 bp, Mus musculus
gctcagtgaaaagaactccgcagaa

SEQ ID NO: 39618 - DNA, 25 bp, Mus musculus
gctcagtgaagaaagtactggtgca

SEQ ID NO: 39619 - DNA, 25 bp, Mus musculus
gctcagtgcacccatgcactgctga

SEQ ID NO: 39620 - DNA, 25 bp, Mus musculus
gctcagtgcaccgatgcactgctga

SEQ ID NO: 39621 - DNA, 25 bp, Mus musculus
gctcagtgccctgcggctgtctgaa

SEQ ID NO: 39622 - DNA, 25 bp, Mus musculus
gctcagtgtgtgctacagcgctgct

SEQ ID NO: 39623 - DNA, 25 bp, Mus musculus
gctcagtttaacacgcctatgcagt

SEQ ID NO: 39624 - DNA, 25 bp, Mus musculus
gctcataaacgactttgggagagag

SEQ ID NO: 39625 - DNA, 25 bp, Mus musculus
gctcataaagattgccctgtaactg

SEQ ID NO: 39626 - DNA, 25 bp, Mus musculus
gctcatacaacactgctaggtttgg

SEQ ID NO: 39627 - DNA, 25 bp, Mus musculus
gctcatagcccgtaccgtcatttct

SEQ ID NO: 39628 - DNA, 25 bp, Mus musculus
gctcatagttcttgctaacgccatt

SEQ ID NO: 39629 - DNA, 25 bp, Mus musculus
gctcatatgtttgagaggcttgtcc

SEQ ID NO: 39630 - DNA, 25 bp, Mus musculus
gctcatcaagaagacctgaattctg

SEQ ID NO: 39631 - DNA, 25 bp, Mus musculus
gctcatcactgtgtgaactcaaagg

SEQ ID NO: 39632 - DNA, 25 bp, Mus musculus
gctcatcagtatgtggccagagcac

SEQ ID NO: 39633 - DNA, 25 bp, Mus musculus
gctcatccgtactttcgtcatgctt

SEQ ID NO: 39634 - DNA, 25 bp, Mus musculus
gctcatctcgatttgactgcaactc

SEQ ID NO: 39635 - DNA, 25 bp, Mus musculus
gctcatctgtctgctggagtatccc

SEQ ID NO: 39636 - DNA, 25 bp, Mus musculus
gctcatctgtggatactgccgtacc

SEQ ID NO: 39637 - DNA, 25 bp, Mus musculus
gctcatgaaacaaaccagactgttt

SEQ ID NO: 39638 - DNA, 25 bp, Mus musculus
gctcatgagaatcattgatgaaaga

SEQ ID NO: 39639 - DNA, 25 bp, Mus musculus
gctcatgagtttgttcaatgaaaac

SEQ ID NO: 39640 - DNA, 25 bp, Mus musculus
gctcatgcgcattgagttcaagaag

SEQ ID NO: 39641 - DNA, 25 bp, Mus musculus
gctcatgctgatcggccttttgaag

SEQ ID NO: 39642 - DNA, 25 bp, Mus musculus
gctcatgctgatgggccttttgaag

SEQ ID NO: 39643 - DNA, 25 bp, Mus musculus
gctcatggcctgatggtgctgcctg

SEQ ID NO: 39644 - DNA, 25 bp, Mus musculus
gctcatgtgtttgacaacgtgtgga

SEQ ID NO: 39645 - DNA, 25 bp, Mus musculus
gctcattaaccaatcttagcagctc

SEQ ID NO: 39646 - DNA, 25 bp, Mus musculus
gctcattaggaggaaggaaacaaag

SEQ ID NO: 39647 - DNA, 25 bp, Mus musculus
gctcattcacctaaataagattgat

SEQ ID NO: 39648 - DNA, 25 bp, Mus musculus
gctcattcctgacttcagtctcacg

SEQ ID NO: 39649 - DNA, 25 bp, Mus musculus
gctcattttaagactcgttggaacc

SEQ ID NO: 39650 - DNA, 25 bp, Mus musculus
gctcattttccctgtacagcagaga

SEQ ID NO: 39651 - DNA, 25 bp, Mus musculus
gctcattttctactctctacaaatg

SEQ ID NO: 39652 - DNA, 25 bp, Mus musculus
gctccaaagagcttgaggaattctg

SEQ ID NO: 39653 - DNA, 25 bp, Mus musculus
gctccaacaggggatgttcttcttg

SEQ ID NO: 39654 - DNA, 25 bp, Mus musculus
gctccaactgttgtaaatgctgcag

SEQ ID NO: 39655 - DNA, 25 bp, Mus musculus
gctccaatgcagaagtgctggctct

SEQ ID NO: 39656 - DNA, 25 bp, Mus musculus
gctccacaagggacacggtgacatg

SEQ ID NO: 39657 - DNA, 25 bp, Mus musculus
gctccacaagggtcacggtgacatg

SEQ ID NO: 39658 - DNA, 25 bp, Mus musculus
gctccacagaaggttaatgacactg

SEQ ID NO: 39659 - DNA, 25 bp, Mus musculus
gctccacagatgagaacacagacag

SEQ ID NO: 39660 - DNA, 25 bp, Mus musculus
gctccacagtgtgtacagatgaacg

SEQ ID NO: 39661 - DNA, 25 bp, Mus musculus
gctccacatagctgcccactatggg

SEQ ID NO: 39662 - DNA, 25 bp, Mus musculus
gctccaccccagacaactgttgtga

SEQ ID NO: 39663 - DNA, 25 bp, Mus musculus
gctccacgttctcgctgcctgagga

SEQ ID NO: 39664 - DNA, 25 bp, Mus musculus
gctccactgtgacaagctgcatgtg

SEQ ID NO: 39665 - DNA, 25 bp, Mus musculus
gctccagaacccctggtcatggata

SEQ ID NO: 39666 - DNA, 25 bp, Mus musculus
gctccagatcagaccgacagctctg

SEQ ID NO: 39667 - DNA, 25 bp, Mus musculus
gctccagcaattgcagtggcctgta

SEQ ID NO: 39668 - DNA, 25 bp, Mus musculus
gctccagcgggcttgcatgatcaga

SEQ ID NO: 39669 - DNA, 25 bp, Mus musculus
gctccagctagcttgaacttgcagc

SEQ ID NO: 39670 - DNA, 25 bp, Mus musculus
gctccagctgcagtcagactcagaa

SEQ ID NO: 39671 - DNA, 25 bp, Mus musculus
gctccaggagtctgggttacctgat

SEQ ID NO: 39672 - DNA, 25 bp, Mus musculus
gctccaggagtgaaggcatgatgca

SEQ ID NO: 39673 - DNA, 25 bp, Mus musculus
gctccaggtaccacctactcggata

SEQ ID NO: 39674 - DNA, 25 bp, Mus musculus
gctccaggtacctcctactcggata

SEQ ID NO: 39675 - DNA, 25 bp, Mus musculus
gctccagtcacgcaggctgcctggt

SEQ ID NO: 39676 - DNA, 25 bp, Mus musculus
gctccagtggcattgggaagtgcat

SEQ ID NO: 39677 - DNA, 25 bp, Mus musculus
gctccagtttctgctagatgactca

SEQ ID NO: 39678 - DNA, 25 bp, Mus musculus
gctccatagcaagaatgtgtgccct

SEQ ID NO: 39679 - DNA, 25 bp, Mus musculus
gctccatattacacagtatgcgatt

SEQ ID NO: 39680 - DNA, 25 bp, Mus musculus
gctccatcaaggtggtatcctgcta

SEQ ID NO: 39681 - DNA, 25 bp, Mus musculus
gctccatgaagtattatgcactgtg

SEQ ID NO: 39682 - DNA, 25 bp, Mus musculus
gctccatgagcagtgctgggaacag

SEQ ID NO: 39683 - DNA, 25 bp, Mus musculus
gctccatgggagcactgaacaccct

SEQ ID NO: 39684 - DNA, 25 bp, Mus musculus
gctcccaaattagctttgtcaacag

SEQ ID NO: 39685 - DNA, 25 bp, Mus musculus
gctcccaatcttataaccttttctg

SEQ ID NO: 39686 - DNA, 25 bp, Mus musculus
gctcccagaacctggaaaggattct

SEQ ID NO: 39687 - DNA, 25 bp, Mus musculus
gctcccagcatgaccagtgtcctgg

SEQ ID NO: 39688 - DNA, 25 bp, Mus musculus
gctcccagcatttatgaacatgaag

SEQ ID NO: 39689 - DNA, 25 bp, Mus musculus
gctcccagttccattgttgacaatc

SEQ ID NO: 39690 - DNA, 25 bp, Mus musculus
gctcccatgattctgaatggagtgt

SEQ ID NO: 39691 - DNA, 25 bp, Mus musculus
gctcccatgccaatatctggacact

SEQ ID NO: 39692 - DNA, 25 bp, Mus musculus
gctcccgagagggattcaaagggca

SEQ ID NO: 39693 - DNA, 25 bp, Mus musculus
gctcccgcctttctgaagggcagag

SEQ ID NO: 39694 - DNA, 25 bp, Mus musculus
gctccctcaggcgtgcaaaaggaac

SEQ ID NO: 39695 - DNA, 25 bp, Mus musculus
gctccctgggtgtcatggtgcactg

SEQ ID NO: 39696 - DNA, 25 bp, Mus musculus
gctccctggtgctataccactgaca

SEQ ID NO: 39697 - DNA, 25 bp, Mus musculus
gctccctgtgagctgtgtggctaca

SEQ ID NO: 39698 - DNA, 25 bp, Mus musculus
gctcccttatgtccatcttcacatg

SEQ ID NO: 39699 - DNA, 25 bp, Mus musculus
gctcccttatgtgcatcttcacatg

SEQ ID NO: 39700 - DNA, 25 bp, Mus musculus
gctcccttcaatggtgtgcttctgg

SEQ ID NO: 39701 - DNA, 25 bp, Mus musculus
gctcccttgtggctggacagcagct

SEQ ID NO: 39702 - DNA, 25 bp, Mus musculus
gctccgacaagtgtctcattctctg

SEQ ID NO: 39703 - DNA, 25 bp, Mus musculus
gctccgaggcatccagcaagcagag

SEQ ID NO: 39704 - DNA, 25 bp, Mus musculus
gctccgaggcatgcagcaagcagag

SEQ ID NO: 39705 - DNA, 25 bp, Mus musculus
gctccgatggcgtggttgtactcta

SEQ ID NO: 39706 - DNA, 25 bp, Mus musculus
gctccgcgccgtttgctggagaaag

SEQ ID NO: 39707 - DNA, 25 bp, Mus musculus
gctccgctcgtgagtgttcactccg

SEQ ID NO: 39708 - DNA, 25 bp, Mus musculus
gctccgctcgtgtgtgttcactccg

SEQ ID NO: 39709 - DNA, 25 bp, Mus musculus
gctccggagcaacccagctttgaac

SEQ ID NO: 39710 - DNA, 25 bp, Mus musculus
gctccggccattggatgttgaattc

SEQ ID NO: 39711 - DNA, 25 bp, Mus musculus
gctccggcctgagctaagtcagctg

SEQ ID NO: 39712 - DNA, 25 bp, Mus musculus
gctccgggtgaaggtcagctatcta

SEQ ID NO: 39713 - DNA, 25 bp, Mus musculus
gctccgtacgcaaggaagacattca

SEQ ID NO: 39714 - DNA, 25 bp, Mus musculus
gctccgtggcttcctgctgcagaac

SEQ ID NO: 39715 - DNA, 25 bp, Mus musculus
gctccgtgtgaacaacaaacatgtg

SEQ ID NO: 39716 - DNA, 25 bp, Mus musculus
gctccgtgtgaagaacaaacatgtg

SEQ ID NO: 39717 - DNA, 25 bp, Mus musculus
gctcctaaagcaaatgccaccattg

SEQ ID NO: 39718 - DNA, 25 bp, Mus musculus
gctcctacagcaatgagccgcagtt

SEQ ID NO: 39719 - DNA, 25 bp, Mus musculus
gctcctactaccaaggagacagcta

SEQ ID NO: 39720 - DNA, 25 bp, Mus musculus
gctcctagacacaaaccggtatctt

SEQ ID NO: 39721 - DNA, 25 bp, Mus musculus
gctcctatcattgccgtgactcgaa

SEQ ID NO: 39722 - DNA, 25 bp, Mus musculus
gctcctatctagaagtggctgcatc

SEQ ID NO: 39723 - DNA, 25 bp, Mus musculus
gctcctcagcagtagactccacaga

SEQ ID NO: 39724 - DNA, 25 bp, Mus musculus
gctcctcattgcagttccctgaaga

SEQ ID NO: 39725 - DNA, 25 bp, Mus musculus
gctcctccatgcctgtgctgaagtc

SEQ ID NO: 39726 - DNA, 25 bp, Mus musculus
gctcctcctacgctgacttttggct

SEQ ID NO: 39727 - DNA, 25 bp, Mus musculus
gctcctgaagccctttttgatagag

SEQ ID NO: 39728 - DNA, 25 bp, Mus musculus
gctcctgacaggatttgttcacaat

SEQ ID NO: 39729 - DNA, 25 bp, Mus musculus
gctcctgagattcctagggagaatc

SEQ ID NO: 39730 - DNA, 25 bp, Mus musculus
gctcctgaggagcatcgtcaggtct

SEQ ID NO: 39731 - DNA, 25 bp, Mus musculus
gctcctgagggttcaattattcaac

SEQ ID NO: 39732 - DNA, 25 bp, Mus musculus
gctcctggacaaccgaaaactggaa

SEQ ID NO: 39733 - DNA, 25 bp, Mus musculus
gctcctggccagacgggtcacactg

SEQ ID NO: 39734 - DNA, 25 bp, Mus musculus
gctcctgtctttgagcagaagtcag

SEQ ID NO: 39735 - DNA, 25 bp, Mus musculus
gctcctgttcatggagagttcgaat

SEQ ID NO: 39736 - DNA, 25 bp, Mus musculus
gctcctgttcggtttccagcactga

SEQ ID NO: 39737 - DNA, 25 bp, Mus musculus
gctccttctcctccaaggactgtga

SEQ ID NO: 39738 - DNA, 25 bp, Mus musculus
gctccttctcctgcaaggactgtga

SEQ ID NO: 39739 - DNA, 25 bp, Mus musculus
gctccttgatctcccgtctgtttta

SEQ ID NO: 39740 - DNA, 25 bp, Mus musculus
gctccttgatctgccgtctgtttta

SEQ ID NO: 39741 - DNA, 25 bp, Mus musculus
gctccttgctttgggacatcatacg

SEQ ID NO: 39742 - DNA, 25 bp, Mus musculus
gctccttggagtcagtaataaaatg

SEQ ID NO: 39743 - DNA, 25 bp, Mus musculus
gctccttggtagatgtttatagtca

SEQ ID NO: 39744 - DNA, 25 bp, Mus musculus
gctccttgtagcgatgctgcaggcc

SEQ ID NO: 39745 - DNA, 25 bp, Mus musculus
gctcctttcaagtacctaagtcctg

SEQ ID NO: 39746 - DNA, 25 bp, Mus musculus
gctcgaagaactggcaaagcaggcc

SEQ ID NO: 39747 - DNA, 25 bp, Mus musculus
gctcgacaggacttggagtgtgaca

SEQ ID NO: 39748 - DNA, 25 bp, Mus musculus
gctcgacttcggcaatttccaaggc

SEQ ID NO: 39749 - DNA, 25 bp, Mus musculus
gctcgaggactggtgcttgaaaatg

SEQ ID NO: 39750 - DNA, 25 bp, Mus musculus
gctcgaggcattggcattcaggtca

SEQ ID NO: 39751 - DNA, 25 bp, Mus musculus
gctcgagtctctaaaggtcttacac

SEQ ID NO: 39752 - DNA, 25 bp, Mus musculus
gctcgagttgtacctgtaccccttc

SEQ ID NO: 39753 - DNA, 25 bp, Mus musculus
gctcgcatacagaccgacactgggt

SEQ ID NO: 39754 - DNA, 25 bp, Mus musculus
gctcgctcgtggctacccatgacta

SEQ ID NO: 39755 - DNA, 25 bp, Mus musculus
gctcgctctatatctgctgttaaaa

SEQ ID NO: 39756 - DNA, 25 bp, Mus musculus
gctcgctgctttgccggcttgttaa

SEQ ID NO: 39757 - DNA, 25 bp, Mus musculus
gctcggaatgagctctttgctctta

SEQ ID NO: 39758 - DNA, 25 bp, Mus musculus
gctcggagatcctcagtctgttaga

SEQ ID NO: 39759 - DNA, 25 bp, Mus musculus
gctcggatatttcagtttcagaatt

SEQ ID NO: 39760 - DNA, 25 bp, Mus musculus
gctcggcaacaggaacatcactgtg

SEQ ID NO: 39761 - DNA, 25 bp, Mus musculus
gctcggcactgctctgcagcaacag

SEQ ID NO: 39762 - DNA, 25 bp, Mus musculus
gctcggccgtgcatggcatcttcaa

SEQ ID NO: 39763 - DNA, 25 bp, Mus musculus
gctcggcgctatggccttaaggata

SEQ ID NO: 39764 - DNA, 25 bp, Mus musculus
gctcggctcctgactactgaccaga

SEQ ID NO: 39765 - DNA, 25 bp, Mus musculus
gctcgggcagccagaccgaacaagc

SEQ ID NO: 39766 - DNA, 25 bp, Mus musculus
gctcgggccaagatccgtgtcacct

SEQ ID NO: 39767 - DNA, 25 bp, Mus musculus
gctcgggccagtgctttaaagatga

SEQ ID NO: 39768 - DNA, 25 bp, Mus musculus
gctcgggctggttaaatgacttgct

SEQ ID NO: 39769 - DNA, 25 bp, Mus musculus
gctcggtgtgcaatagaaaatgtac

SEQ ID NO: 39770 - DNA, 25 bp, Mus musculus
gctcggttcctcacgctctgcggag

SEQ ID NO: 39771 - DNA, 25 bp, Mus musculus
gctcggttcctctcgctctgcggag

SEQ ID NO: 39772 - DNA, 25 bp, Mus musculus
gctcggttgtcctacatgcgggtga

SEQ ID NO: 39773 - DNA, 25 bp, Mus musculus
gctcgtaaaggcacttctctatgga

SEQ ID NO: 39774 - DNA, 25 bp, Mus musculus
gctcgtaccactccgagtgtgatcg

SEQ ID NO: 39775 - DNA, 25 bp, Mus musculus
gctcgtaccactgcgagtgtgatcg

SEQ ID NO: 39776 - DNA, 25 bp, Mus musculus
gctcgtccctcaactgcatgagaga

SEQ ID NO: 39777 - DNA, 25 bp, Mus musculus
gctcgtgggtgacacatacacactc

SEQ ID NO: 39778 - DNA, 25 bp, Mus musculus
gctcgttaactttcagcagagtgaa

SEQ ID NO: 39779 - DNA, 25 bp, Mus musculus
gctcgttagtggctccagtgtgact

SEQ ID NO: 39780 - DNA, 25 bp, Mus musculus
gctcgttgatcttttaacccctaag

SEQ ID NO: 39781 - DNA, 25 bp, Mus musculus
gctctaagcaatgagattctgggcc

SEQ ID NO: 39782 - DNA, 25 bp, Mus musculus
gctctaaggacattctcctgatgga

SEQ ID NO: 39783 - DNA, 25 bp, Mus musculus
gctctaaggccctgtgctcagctct

SEQ ID NO: 39784 - DNA, 25 bp, Mus musculus
gctctaatacttgatgttcctctgg

SEQ ID NO: 39785 - DNA, 25 bp, Mus musculus
gctctaatggaacagatagcacacc

SEQ ID NO: 39786 - DNA, 25 bp, Mus musculus
gctctacgtggcctgcttggagaca

SEQ ID NO: 39787 - DNA, 25 bp, Mus musculus
gctctactgtccagaaagttactca

SEQ ID NO: 39788 - DNA, 25 bp, Mus musculus
gctctacttggctgtgtgcatcggg

SEQ ID NO: 39789 - DNA, 25 bp, Mus musculus
gctctagagaccatgaatggcagtc

SEQ ID NO: 39790 - DNA, 25 bp, Mus musculus
gctctagaggcggacatgaccaagt

SEQ ID NO: 39791 - DNA, 25 bp, Mus musculus
gctctagatcacataaggcacttca

SEQ ID NO: 39792 - DNA, 25 bp, Mus musculus
gctctagctaaccagttcctggctc

SEQ ID NO: 39793 - DNA, 25 bp, Mus musculus
gctctagctggatggacaaaacctg

SEQ ID NO: 39794 - DNA, 25 bp, Mus musculus
gctctaggaatctaaagatgaaaag

SEQ ID NO: 39795 - DNA, 25 bp, Mus musculus
gctctagggatcttaatggctggga

SEQ ID NO: 39796 - DNA, 25 bp, Mus musculus
gctctataggactgccaatgaagcc

SEQ ID NO: 39797 - DNA, 25 bp, Mus musculus
gctctatggagacctaaagcatcta

SEQ ID NO: 39798 - DNA, 25 bp, Mus musculus
gctctcaaagatgcccaggagaaac

SEQ ID NO: 39799 - DNA, 25 bp, Mus musculus
gctctcaatatagtacaaagtttca

SEQ ID NO: 39800 - DNA, 25 bp, Mus musculus
gctctcaccacacagcagaaactgg

SEQ ID NO: 39801 - DNA, 25 bp, Mus musculus
gctctcacgggcagtgcaggaacac

SEQ ID NO: 39802 - DNA, 25 bp, Mus musculus
gctctcaggaatggcaaaaacctta

SEQ ID NO: 39803 - DNA, 25 bp, Mus musculus
gctctcatggttgctgctcagaaag

SEQ ID NO: 39804 - DNA, 25 bp, Mus musculus
gctctccacctcctgactgttgatg

SEQ ID NO: 39805 - DNA, 25 bp, Mus musculus
gctctccatggacaggtatggcaaa

SEQ ID NO: 39806 - DNA, 25 bp, Mus musculus
gctctccatggagaggtatggcaaa

SEQ ID NO: 39807 - DNA, 25 bp, Mus musculus
gctctcccttctggacattcgaata

SEQ ID NO: 39808 - DNA, 25 bp, Mus musculus
gctctcggacaaaaagaggctgaaa

SEQ ID NO: 39809 - DNA, 25 bp, Mus musculus
gctctcgggatcagccttcacttgt

SEQ ID NO: 39810 - DNA, 25 bp, Mus musculus
gctctcgtagactgctataaaccaa

SEQ ID NO: 39811 - DNA, 25 bp, Mus musculus
gctctctagcaaggctgtgtacttc

SEQ ID NO: 39812 - DNA, 25 bp, Mus musculus
gctctctaggaagataaggttttca

SEQ ID NO: 39813 - DNA, 25 bp, Mus musculus
gctctctatattgtgtcgcacttct

SEQ ID NO: 39814 - DNA, 25 bp, Mus musculus
gctctctcatggttgggctcagtgg

SEQ ID NO: 39815 - DNA, 25 bp, Mus musculus
gctctctgaccttgattgggatgct

SEQ ID NO: 39816 - DNA, 25 bp, Mus musculus
gctctctgactctgcaggatggtgg

SEQ ID NO: 39817 - DNA, 25 bp, Mus musculus
gctctctgattgtaatccgtgggca

SEQ ID NO: 39818 - DNA, 25 bp, Mus musculus
gctctctggaacacatgcttggtca

SEQ ID NO: 39819 - DNA, 25 bp, Mus musculus
gctctctggtccactcaaggaggag

SEQ ID NO: 39820 - DNA, 25 bp, Mus musculus
gctctctggtttgaacaagatggtg

SEQ ID NO: 39821 - DNA, 25 bp, Mus musculus
gctctcttcttcctcagcgaccgtg

SEQ ID NO: 39822 - DNA, 25 bp, Mus musculus
gctctgaaagctagcaacctaaaac

SEQ ID NO: 39823 - DNA, 25 bp, Mus musculus
gctctgaaatataaaactgtcaagc

SEQ ID NO: 39824 - DNA, 25 bp, Mus musculus
gctctgaaatcaggctcagcggctg

SEQ ID NO: 39825 - DNA, 25 bp, Mus musculus
gctctgacagccgaggaactggcaa

SEQ ID NO: 39826 - DNA, 25 bp, Mus musculus
gctctgacgctagggcttgggacta

SEQ ID NO: 39827 - DNA, 25 bp, Mus musculus
gctctgactacagctacgacagcaa

SEQ ID NO: 39828 - DNA, 25 bp, Mus musculus
gctctgacttggacgggcatcctgt

SEQ ID NO: 39829 - DNA, 25 bp, Mus musculus
gctctgacttgtacaaaagatctag

SEQ ID NO: 39830 - DNA, 25 bp, Mus musculus
gctctgagaagctctttgccccggc

SEQ ID NO: 39831 - DNA, 25 bp, Mus musculus
gctctgagacagagactgggtccag

SEQ ID NO: 39832 - DNA, 25 bp, Mus musculus
gctctgaggagtatttgcagcgtcg

SEQ ID NO: 39833 - DNA, 25 bp, Mus musculus
gctctgagttaattggccctgctga

SEQ ID NO: 39834 - DNA, 25 bp, Mus musculus
gctctgatagtaagcctggccctct

SEQ ID NO: 39835 - DNA, 25 bp, Mus musculus
gctctgattgtgacaggaggccagt

SEQ ID NO: 39836 - DNA, 25 bp, Mus musculus
gctctgcaggcctgcaaactggagt

SEQ ID NO: 39837 - DNA, 25 bp, Mus musculus
gctctgcctatgctgccttcaacaa

SEQ ID NO: 39838 - DNA, 25 bp, Mus musculus
gctctgcctggaccactggtttgca

SEQ ID NO: 39839 - DNA, 25 bp, Mus musculus
gctctgcgctttccagaaagcgctt

SEQ ID NO: 39840 - DNA, 25 bp, Mus musculus
gctctgcggataaagagagacttgc

SEQ ID NO: 39841 - DNA, 25 bp, Mus musculus
gctctgcggccttcagcgaggagca

SEQ ID NO: 39842 - DNA, 25 bp, Mus musculus
gctctgctcttctggacaatgtgga

SEQ ID NO: 39843 - DNA, 25 bp, Mus musculus
gctctgctgatgagcttttcaagca

SEQ ID NO: 39844 - DNA, 25 bp, Mus musculus
gctctgctgcaatgtgcttatccag

SEQ ID NO: 39845 - DNA, 25 bp, Mus musculus
gctctgctgtggagtttcctttgat

SEQ ID NO: 39846 - DNA, 25 bp, Mus musculus
gctctggaaagaacgctggagcaga

SEQ ID NO: 39847 - DNA, 25 bp, Mus musculus
gctctggaaaggacctgtcacccag

SEQ ID NO: 39848 - DNA, 25 bp, Mus musculus
gctctggaaaggtcttccccactag

SEQ ID NO: 39849 - DNA, 25 bp, Mus musculus
gctctggaacctcatccgtctggtc

SEQ ID NO: 39850 - DNA, 25 bp, Mus musculus
gctctggaacggcaagtctttgact

SEQ ID NO: 39851 - DNA, 25 bp, Mus musculus
gctctggaatccagccgattcggga

SEQ ID NO: 39852 - DNA, 25 bp, Mus musculus
gctctggacatgttgaccaagatga

SEQ ID NO: 39853 - DNA, 25 bp, Mus musculus
gctctggaccagcagcctgaggtct

SEQ ID NO: 39854 - DNA, 25 bp, Mus musculus
gctctggacccattctggttcagaa

SEQ ID NO: 39855 - DNA, 25 bp, Mus musculus
gctctggactgctgctggcctctga

SEQ ID NO: 39856 - DNA, 25 bp, Mus musculus
gctctggacttgtgtgtccctccct

SEQ ID NO: 39857 - DNA, 25 bp, Mus musculus
gctctggaggagagtcagccagcta

SEQ ID NO: 39858 - DNA, 25 bp, Mus musculus
gctctggagggcaagaatatcatta

SEQ ID NO: 39859 - DNA, 25 bp, Mus musculus
gctctggcaccacagaaggcacctt

SEQ ID NO: 39860 - DNA, 25 bp, Mus musculus
gctctgggcattatcatctgggcaa

SEQ ID NO: 39861 - DNA, 25 bp, Mus musculus
gctctgggccactgtaacgaactca

SEQ ID NO: 39862 - DNA, 25 bp, Mus musculus
gctctggtgctgactgcagacgcca

SEQ ID NO: 39863 - DNA, 25 bp, Mus musculus
gctctggttcaaaccaagacaatta

SEQ ID NO: 39864 - DNA, 25 bp, Mus musculus
gctctggtttaaagcaagcgtttgc

SEQ ID NO: 39865 - DNA, 25 bp, Mus musculus
gctctggtttcagacggagtgttga

SEQ ID NO: 39866 - DNA, 25 bp, Mus musculus
gctctgtcagtagtggtgagaccct

SEQ ID NO: 39867 - DNA, 25 bp, Mus musculus
gctctgtcctgactggaatctgctg

SEQ ID NO: 39868 - DNA, 25 bp, Mus musculus
gctctgtgattgactggatgataaa

SEQ ID NO: 39869 - DNA, 25 bp, Mus musculus
gctctgtgtcagagaatgctcatgt

SEQ ID NO: 39870 - DNA, 25 bp, Mus musculus
gctctgtgtgctcatcccgaagtga

SEQ ID NO: 39871 - DNA, 25 bp, Mus musculus
gctctgtgttacatgagggcctgca

SEQ ID NO: 39872 - DNA, 25 bp, Mus musculus
gctctgttcaaatctggctcagatt

SEQ ID NO: 39873 - DNA, 25 bp, Mus musculus
gctctgttggctcacgaagtaggtt

SEQ ID NO: 39874 - DNA, 25 bp, Mus musculus
gctctgttggtatagaggagtaagc

SEQ ID NO: 39875 - DNA, 25 bp, Mus musculus
gctctgtttctggaagccagtggaa

SEQ ID NO: 39876 - DNA, 25 bp, Mus musculus
gctcttaagcatcgtggcgctggtt

SEQ ID NO: 39877 - DNA, 25 bp, Mus musculus
gctcttaagtgcaaggtgcccacag

SEQ ID NO: 39878 - DNA, 25 bp, Mus musculus
gctcttattctccacagtcaccgag

SEQ ID NO: 39879 - DNA, 25 bp, Mus musculus
gctcttattgagtttgctgctgtca

SEQ ID NO: 39880 - DNA, 25 bp, Mus musculus
gctcttcaggaagcttagtaatcct

SEQ ID NO: 39881 - DNA, 25 bp, Mus musculus
gctcttcatcctcaaaccattctga

SEQ ID NO: 39882 - DNA, 25 bp, Mus musculus
gctcttcatgatcctttggctcaaa

SEQ ID NO: 39883 - DNA, 25 bp, Mus musculus
gctcttccaggaccatggcttcttc

SEQ ID NO: 39884 - DNA, 25 bp, Mus musculus
gctcttccatgacagcttactacca

SEQ ID NO: 39885 - DNA, 25 bp, Mus musculus
gctcttcccaagtgccaccgatgtt

SEQ ID NO: 39886 - DNA, 25 bp, Mus musculus
gctcttcccacgaatgtcactgtga

SEQ ID NO: 39887 - DNA, 25 bp, Mus musculus
gctcttcctccatgtcttccattga

SEQ ID NO: 39888 - DNA, 25 bp, Mus musculus
gctcttcgaggacgagtttgtccat

SEQ ID NO: 39889 - DNA, 25 bp, Mus musculus
gctcttcggcaccattcaataccgg

SEQ ID NO: 39890 - DNA, 25 bp, Mus musculus
gctcttcgtctgtgtcctactcatg

SEQ ID NO: 39891 - DNA, 25 bp, Mus musculus
gctcttctggatcagatgatagcag

SEQ ID NO: 39892 - DNA, 25 bp, Mus musculus
gctcttctggatgcttgatgatgga

SEQ ID NO: 39893 - DNA, 25 bp, Mus musculus
gctcttctttgggatgctgtttacc

SEQ ID NO: 39894 - DNA, 25 bp, Mus musculus
gctcttgaacccacgggcactgcag

SEQ ID NO: 39895 - DNA, 25 bp, Mus musculus
gctcttgagctttctgcactaattg

SEQ ID NO: 39896 - DNA, 25 bp, Mus musculus
gctcttggaaagacatgtcgccttg

SEQ ID NO: 39897 - DNA, 25 bp, Mus musculus
gctcttggagatttcagggaaactg

SEQ ID NO: 39898 - DNA, 25 bp, Mus musculus
gctcttgggaactacacgtgggcca

SEQ ID NO: 39899 - DNA, 25 bp, Mus musculus
gctcttgtgaacctagaaaaggcac

SEQ ID NO: 39900 - DNA, 25 bp, Mus musculus
gctcttgttgggatgtgcgtaaacg

SEQ ID NO: 39901 - DNA, 25 bp, Mus musculus
gctctttaatgacagcgacagccca

SEQ ID NO: 39902 - DNA, 25 bp, Mus musculus
gctctttcctcagcgcagaagaggg

SEQ ID NO: 39903 - DNA, 25 bp, Mus musculus
gctctttcttgtggatatatcacac

SEQ ID NO: 39904 - DNA, 25 bp, Mus musculus
gctctttgaagcctttaaaatcccg

SEQ ID NO: 39905 - DNA, 25 bp, Mus musculus
gctctttgcacttggtgccctctgg

SEQ ID NO: 39906 - DNA, 25 bp, Mus musculus
gctctttgccattggttcccagcta

SEQ ID NO: 39907 - DNA, 25 bp, Mus musculus
gctctttgccgacatcctcaacgat

SEQ ID NO: 39908 - DNA, 25 bp, Mus musculus
gctctttggccttaaaatgacttaa

SEQ ID NO: 39909 - DNA, 25 bp, Mus musculus
gctctttgtcaagcagctaagtata

SEQ ID NO: 39910 - DNA, 25 bp, Mus musculus
gctcttttatcagacacgtagttgc

SEQ ID NO: 39911 - DNA, 25 bp, Mus musculus
gctcttttcagcagcttaagtggga

SEQ ID NO: 39912 - DNA, 25 bp, Mus musculus
gctgaaaagagacagcggccagtac

SEQ ID NO: 39913 - DNA, 25 bp, Mus musculus
gctgaaaagcaaggatgccctgcga

SEQ ID NO: 39914 - DNA, 25 bp, Mus musculus
gctgaaaattgttaccaacaacttg

SEQ ID NO: 39915 - DNA, 25 bp, Mus musculus
gctgaaagaggccaagcacattgct

SEQ ID NO: 39916 - DNA, 25 bp, Mus musculus
gctgaaaggatgctcatgtttgatc

SEQ ID NO: 39917 - DNA, 25 bp, Mus musculus
gctgaaaggtccttgtacaaccacc

SEQ ID NO: 39918 - DNA, 25 bp, Mus musculus
gctgaaatcaaagtccgggaggcca

SEQ ID NO: 39919 - DNA, 25 bp, Mus musculus
gctgaaatcagagtccacacagtgg

SEQ ID NO: 39920 - DNA, 25 bp, Mus musculus
gctgaaatgcttcctggagtccttc

SEQ ID NO: 39921 - DNA, 25 bp, Mus musculus
gctgaacaagaagagggccataccc

SEQ ID NO: 39922 - DNA, 25 bp, Mus musculus
gctgaaccccagaatgcagacatcg

SEQ ID NO: 39923 - DNA, 25 bp, Mus musculus
gctgaaccggaagttgacaaccttc

SEQ ID NO: 39924 - DNA, 25 bp, Mus musculus
gctgaacgactctactattccatga

SEQ ID NO: 39925 - DNA, 25 bp, Mus musculus
gctgaacgaggctcgcacagtcttc

SEQ ID NO: 39926 - DNA, 25 bp, Mus musculus
gctgaacgatctctgcatgatgctc

SEQ ID NO: 39927 - DNA, 25 bp, Mus musculus
gctgaacgattctcaagggctggga

SEQ ID NO: 39928 - DNA, 25 bp, Mus musculus
gctgaacggatgctaacatcttcct

SEQ ID NO: 39929 - DNA, 25 bp, Mus musculus
gctgaacgtcacagcaacaggcgcg

SEQ ID NO: 39930 - DNA, 25 bp, Mus musculus
gctgaactgatgtacatcaacgagg

SEQ ID NO: 39931 - DNA, 25 bp, Mus musculus
gctgaagacgcaacttacatacatc

SEQ ID NO: 39932 - DNA, 25 bp, Mus musculus
gctgaagagacctgtcacttctgag

SEQ ID NO: 39933 - DNA, 25 bp, Mus musculus
gctgaagatgctgaccggaagtatg

SEQ ID NO: 39934 - DNA, 25 bp, Mus musculus
gctgaagatggcctgtgcccagcct

SEQ ID NO: 39935 - DNA, 25 bp, Mus musculus
gctgaagatgttcccagaacagcag

SEQ ID NO: 39936 - DNA, 25 bp, Mus musculus
gctgaagcagatcgagaaggaatac

SEQ ID NO: 39937 - DNA, 25 bp, Mus musculus
gctgaagcatcttaccatcgtgagc

SEQ ID NO: 39938 - DNA, 25 bp, Mus musculus
gctgaagccaggaaccagagttgct

SEQ ID NO: 39939 - DNA, 25 bp, Mus musculus
gctgaagccctatgtggccatattt

SEQ ID NO: 39940 - DNA, 25 bp, Mus musculus
gctgaagcggctaaagaaacatgtg

SEQ ID NO: 39941 - DNA, 25 bp, Mus musculus
gctgaagcgggtccgaatctccctg

SEQ ID NO: 39942 - DNA, 25 bp, Mus musculus
gctgaagctgacgtagcttctctga

SEQ ID NO: 39943 - DNA, 25 bp, Mus musculus
gctgaagctgcagaacttgaacccc

SEQ ID NO: 39944 - DNA, 25 bp, Mus musculus
gctgaagctgttccgacattactac

SEQ ID NO: 39945 - DNA, 25 bp, Mus musculus
gctgaaggactgtccactgcagttt

SEQ ID NO: 39946 - DNA, 25 bp, Mus musculus
gctgaaggagcagcacctaagaagg

SEQ ID NO: 39947 - DNA, 25 bp, Mus musculus
gctgaaggaggtcgccttgctcaca

SEQ ID NO: 39948 - DNA, 25 bp, Mus musculus
gctgaaggctaagatggagaacatg

SEQ ID NO: 39949 - DNA, 25 bp, Mus musculus
gctgaaggctggctgcaacctgaaa

SEQ ID NO: 39950 - DNA, 25 bp, Mus musculus
gctgaagggaggaagctcacgggac

SEQ ID NO: 39951 - DNA, 25 bp, Mus musculus
gctgaaggtaaggaagaggacacac

SEQ ID NO: 39952 - DNA, 25 bp, Mus musculus
gctgaaggtcaagtgtctgaacaac

SEQ ID NO: 39953 - DNA, 25 bp, Mus musculus
gctgaagtatgcagttctgggtaaa

SEQ ID NO: 39954 - DNA, 25 bp, Mus musculus
gctgaagtctcttcaatgcctgcct

SEQ ID NO: 39955 - DNA, 25 bp, Mus musculus
gctgaatagaagtggtgaacactgg

SEQ ID NO: 39956 - DNA, 25 bp, Mus musculus
gctgaatggaagaaaaaggcagaga

SEQ ID NO: 39957 - DNA, 25 bp, Mus musculus
gctgaatggagtccagccacctgag

SEQ ID NO: 39958 - DNA, 25 bp, Mus musculus
gctgaatggtaacctatccccaggc

SEQ ID NO: 39959 - DNA, 25 bp, Mus musculus
gctgaatgtccctgtgcgccagcaa

SEQ ID NO: 39960 - DNA, 25 bp, Mus musculus
gctgaatgtgggagtagttttcctc

SEQ ID NO: 39961 - DNA, 25 bp, Mus musculus
gctgaattcatcagaatatggcgaa

SEQ ID NO: 39962 - DNA, 25 bp, Mus musculus
gctgaattgttagaacactgtaatg

SEQ ID NO: 39963 - DNA, 25 bp, Mus musculus
gctgacaaacccttggcactgagtg

SEQ ID NO: 39964 - DNA, 25 bp, Mus musculus
gctgacaaagtccttcgatgggaaa

SEQ ID NO: 39965 - DNA, 25 bp, Mus musculus
gctgacaacacacacgttacccttg

SEQ ID NO: 39966 - DNA, 25 bp, Mus musculus
gctgacaacacagacgttacccttg

SEQ ID NO: 39967 - DNA, 25 bp, Mus musculus
gctgacacagttcgtgaccctcggg

SEQ ID NO: 39968 - DNA, 25 bp, Mus musculus
gctgacactgtccttctctcgtcaa

SEQ ID NO: 39969 - DNA, 25 bp, Mus musculus
gctgacagctgcagacctggttcca

SEQ ID NO: 39970 - DNA, 25 bp, Mus musculus
gctgacagttgaagaacgaaacctt

SEQ ID NO: 39971 - DNA, 25 bp, Mus musculus
gctgacagtttccaggcagaggaat

SEQ ID NO: 39972 - DNA, 25 bp, Mus musculus
gctgacatcaaagaattgggagtca

SEQ ID NO: 39973 - DNA, 25 bp, Mus musculus
gctgacatcaatgcagtgaatgagc

SEQ ID NO: 39974 - DNA, 25 bp, Mus musculus
gctgacatgaatgactttggcactg

SEQ ID NO: 39975 - DNA, 25 bp, Mus musculus
gctgacatgattgccagaaatggat

SEQ ID NO: 39976 - DNA, 25 bp, Mus musculus
gctgacattatctcatccacagaca

SEQ ID NO: 39977 - DNA, 25 bp, Mus musculus
gctgacattgacatcgacactgtag

SEQ ID NO: 39978 - DNA, 25 bp, Mus musculus
gctgaccaagttgcaggcagtgaag

SEQ ID NO: 39979 - DNA, 25 bp, Mus musculus
gctgaccaattcttttgaccttgaa

SEQ ID NO: 39980 - DNA, 25 bp, Mus musculus
gctgaccagggcaacctgacctata

SEQ ID NO: 39981 - DNA, 25 bp, Mus musculus
gctgaccatatgttgtttgattgcg

SEQ ID NO: 39982 - DNA, 25 bp, Mus musculus
gctgaccatcttagctgcaaagcca

SEQ ID NO: 39983 - DNA, 25 bp, Mus musculus
gctgaccatctttgctgcaaagcca

SEQ ID NO: 39984 - DNA, 25 bp, Mus musculus
gctgaccatgcgtctgagaattcct

SEQ ID NO: 39985 - DNA, 25 bp, Mus musculus
gctgacccagcatcgtcaacatttt

SEQ ID NO: 39986 - DNA, 25 bp, Mus musculus
gctgacccagctgtatgagcaggcc

SEQ ID NO: 39987 - DNA, 25 bp, Mus musculus
gctgaccccactggagcctttggga

SEQ ID NO: 39988 - DNA, 25 bp, Mus musculus
gctgacccggatctgtgatgacctc

SEQ ID NO: 39989 - DNA, 25 bp, Mus musculus
gctgaccgaggactgaccactcgac

SEQ ID NO: 39990 - DNA, 25 bp, Mus musculus
gctgaccgcatcctgtgtaagctgt

SEQ ID NO: 39991 - DNA, 25 bp, Mus musculus
gctgacctatcttcagaatcctgag

SEQ ID NO: 39992 - DNA, 25 bp, Mus musculus
gctgacctcacctacaatgttgtgg

SEQ ID NO: 39993 - DNA, 25 bp, Mus musculus
gctgacctcatcgagtccatgctga

SEQ ID NO: 39994 - DNA, 25 bp, Mus musculus
gctgaccttcaaagtgattgagcag

SEQ ID NO: 39995 - DNA, 25 bp, Mus musculus
gctgaccttggatagctcaatacca

SEQ ID NO: 39996 - DNA, 25 bp, Mus musculus
gctgacctttctgctctatgcaagc

SEQ ID NO: 39997 - DNA, 25 bp, Mus musculus
gctgacctttggatacctagtgctg

SEQ ID NO: 39998 - DNA, 25 bp, Mus musculus
gctgacgaatgacagttgtcaaaat

SEQ ID NO: 39999 - DNA, 25 bp, Mus musculus
gctgacgcctgtgcatgtggctgcc

SEQ ID NO: 40000 - DNA, 25 bp, Mus musculus
gctgacgctccagagtgaactgaca

SEQ ID NO: 40001 - DNA, 25 bp, Mus musculus
gctgacgctttcgacattggctcct

SEQ ID NO: 40002 - DNA, 25 bp, Mus musculus
gctgacggaggtgcatgtgactggt

SEQ ID NO: 40003 - DNA, 25 bp, Mus musculus
gctgacggttgctgtggactcctat

SEQ ID NO: 40004 - DNA, 25 bp, Mus musculus
gctgactagaggtgtttctggccca

SEQ ID NO: 40005 - DNA, 25 bp, Mus musculus
gctgactctgaaaagccctgcctat

SEQ ID NO: 40006 - DNA, 25 bp, Mus musculus
gctgactgcagacgccatgtccaaa

SEQ ID NO: 40007 - DNA, 25 bp, Mus musculus
gctgactgcagcagggcttcactca

SEQ ID NO: 40008 - DNA, 25 bp, Mus musculus
gctgactgtgaatgacatagacatc

SEQ ID NO: 40009 - DNA, 25 bp, Mus musculus
gctgactgtggcaaagaagcagtgt

SEQ ID NO: 40010 - DNA, 25 bp, Mus musculus
gctgacttcaatgccgttgagtata

SEQ ID NO: 40011 - DNA, 25 bp, Mus musculus
gctgacttccttctccagcatgtga

SEQ ID NO: 40012 - DNA, 25 bp, Mus musculus
gctgacttggaactcctttgtggtc

SEQ ID NO: 40013 - DNA, 25 bp, Mus musculus
gctgacttgggagtctgtgcacaaa

SEQ ID NO: 40014 - DNA, 25 bp, Mus musculus
gctgagaacatcaagcgactcctgt

SEQ ID NO: 40015 - DNA, 25 bp, Mus musculus
gctgagaagatcctcaccatcttta

SEQ ID NO: 40016 - DNA, 25 bp, Mus musculus
gctgagaagcagtttgaggactcct

SEQ ID NO: 40017 - DNA, 25 bp, Mus musculus
gctgagaaggagagcgcttctgttc

SEQ ID NO: 40018 - DNA, 25 bp, Mus musculus
gctgagacaagagggcccctggatc

SEQ ID NO: 40019 - DNA, 25 bp, Mus musculus
gctgagacacatgcaccgctctggg

SEQ ID NO: 40020 - DNA, 25 bp, Mus musculus
gctgagacttgtgcacacggttgga

SEQ ID NO: 40021 - DNA, 25 bp, Mus musculus
gctgagagaccagcagaaagtcctt

SEQ ID NO: 40022 - DNA, 25 bp, Mus musculus
gctgagagcctgaaggaaacctttg

SEQ ID NO: 40023 - DNA, 25 bp, Mus musculus
gctgagagggttttaatcttggaaa

SEQ ID NO: 40024 - DNA, 25 bp, Mus musculus
gctgagagtgtaacagagatgccta

SEQ ID NO: 40025 - DNA, 25 bp, Mus musculus
gctgagatcgagaatgccaagtgcc

SEQ ID NO: 40026 - DNA, 25 bp, Mus musculus
gctgagatgaactacaagacccaag

SEQ ID NO: 40027 - DNA, 25 bp, Mus musculus
gctgagcagcatcacatgcgggcaa

SEQ ID NO: 40028 - DNA, 25 bp, Mus musculus
gctgagcagctagagaagaatagac

SEQ ID NO: 40029 - DNA, 25 bp, Mus musculus
gctgagcagctctcgggatcagcct

SEQ ID NO: 40030 - DNA, 25 bp, Mus musculus
gctgagcattctctatgtgaaactg

SEQ ID NO: 40031 - DNA, 25 bp, Mus musculus
gctgagccttctccttctgggcaac

SEQ ID NO: 40032 - DNA, 25 bp, Mus musculus
gctgagctatgacaagagagcaaac

SEQ ID NO: 40033 - DNA, 25 bp, Mus musculus
gctgagctcactgtaatggtgttga

SEQ ID NO: 40034 - DNA, 25 bp, Mus musculus
gctgagctctctgggccccaaagaa

SEQ ID NO: 40035 - DNA, 25 bp, Mus musculus
gctgagctgtctcaacaacctcttc

SEQ ID NO: 40036 - DNA, 25 bp, Mus musculus
gctgaggagacccaaaactctttgc

SEQ ID NO: 40037 - DNA, 25 bp, Mus musculus
gctgaggagctcatactgtggaaag

SEQ ID NO: 40038 - DNA, 25 bp, Mus musculus
gctgaggatgacctttcgctcatgg

SEQ ID NO: 40039 - DNA, 25 bp, Mus musculus
gctgaggcaagccaagtgatcatta

SEQ ID NO: 40040 - DNA, 25 bp, Mus musculus
gctgaggcagctttccatggacggc

SEQ ID NO: 40041 - DNA, 25 bp, Mus musculus
gctgaggcaggaggcaatcctccat

SEQ ID NO: 40042 - DNA, 25 bp, Mus musculus
gctgaggccaaccagcagcagactc

SEQ ID NO: 40043 - DNA, 25 bp, Mus musculus
gctgagggagcggtattacccctcc

SEQ ID NO: 40044 - DNA, 25 bp, Mus musculus
gctgaggtcgaagagatgtgcaata

SEQ ID NO: 40045 - DNA, 25 bp, Mus musculus
gctgaggtctctcaaactgtttgca

SEQ ID NO: 40046 - DNA, 25 bp, Mus musculus
gctgagtacactcatttctatggtg

SEQ ID NO: 40047 - DNA, 25 bp, Mus musculus
gctgagtaccgtgaaaccatctcca

SEQ ID NO: 40048 - DNA, 25 bp, Mus musculus
gctgagtccagaactactgagacag

SEQ ID NO: 40049 - DNA, 25 bp, Mus musculus
gctgagtccgcagcactcagactat

SEQ ID NO: 40050 - DNA, 25 bp, Mus musculus
gctgagtcttagtgcaatgcctgtg

SEQ ID NO: 40051 - DNA, 25 bp, Mus musculus
gctgagtgctgacctcctgcatctt

SEQ ID NO: 40052 - DNA, 25 bp, Mus musculus
gctgagtgctgagctcctgcatctt

SEQ ID NO: 40053 - DNA, 25 bp, Mus musculus
gctgagtgcttcatggctgtctcct

SEQ ID NO: 40054 - DNA, 25 bp, Mus musculus
gctgagtggattgccatccgtgtat

SEQ ID NO: 40055 - DNA, 25 bp, Mus musculus
gctgagtgtcaacttcaggaaggca

SEQ ID NO: 40056 - DNA, 25 bp, Mus musculus
gctgagttccgtgatgtaggtgatt

SEQ ID NO: 40057 - DNA, 25 bp, Mus musculus
gctgataagaaatgcctctgaagaa

SEQ ID NO: 40058 - DNA, 25 bp, Mus musculus
gctgataatgctgtgaacaagaaac

SEQ ID NO: 40059 - DNA, 25 bp, Mus musculus
gctgatacgaaacgaggagccaaga

SEQ ID NO: 40060 - DNA, 25 bp, Mus musculus
gctgatacgaaaggaggagccaaga

SEQ ID NO: 40061 - DNA, 25 bp, Mus musculus
gctgatactgacattttgaacatgc

SEQ ID NO: 40062 - DNA, 25 bp, Mus musculus
gctgatactgactttttgaacatgc

SEQ ID NO: 40063 - DNA, 25 bp, Mus musculus
gctgatactgcctggtctcatctcc

SEQ ID NO: 40064 - DNA, 25 bp, Mus musculus
gctgatagacataaggaatgactat

SEQ ID NO: 40065 - DNA, 25 bp, Mus musculus
gctgatagtctctgcccatcaactt

SEQ ID NO: 40066 - DNA, 25 bp, Mus musculus
gctgatcatgaagctgacagagcct

SEQ ID NO: 40067 - DNA, 25 bp, Mus musculus
gctgatccagaacatggaccgcgtg

SEQ ID NO: 40068 - DNA, 25 bp, Mus musculus
gctgatcctagaaaggcagggccat

SEQ ID NO: 40069 - DNA, 25 bp, Mus musculus
gctgatctcttcgttatgagctggc

SEQ ID NO: 40070 - DNA, 25 bp, Mus musculus
gctgatcttaggcatcgacttacag

SEQ ID NO: 40071 - DNA, 25 bp, Mus musculus
gctgatgaaaccctgcagcatgctt

SEQ ID NO: 40072 - DNA, 25 bp, Mus musculus
gctgatgaacatgttctcattgggt

SEQ ID NO: 40073 - DNA, 25 bp, Mus musculus
gctgatgaagtggaaaagtccagca

SEQ ID NO: 40074 - DNA, 25 bp, Mus musculus
gctgatgacaaacctgaagaccacc

SEQ ID NO: 40075 - DNA, 25 bp, Mus musculus
gctgatgacaacaaacgtgtggctg

SEQ ID NO: 40076 - DNA, 25 bp, Mus musculus
gctgatgacaagaatcggcgtaatt

SEQ ID NO: 40077 - DNA, 25 bp, Mus musculus
gctgatgagaaagcccgggagtcca

SEQ ID NO: 40078 - DNA, 25 bp, Mus musculus
gctgatgcagatgttcctccctttc

SEQ ID NO: 40079 - DNA, 25 bp, Mus musculus
gctgatgccataaagttggagcgga

SEQ ID NO: 40080 - DNA, 25 bp, Mus musculus
gctgatgcgcccatccaacaaagca

SEQ ID NO: 40081 - DNA, 25 bp, Mus musculus
gctgatgcggatctcatcaatgcag

SEQ ID NO: 40082 - DNA, 25 bp, Mus musculus
gctgatgctccttggagtcagtaat

SEQ ID NO: 40083 - DNA, 25 bp, Mus musculus
gctgatgctcttctccacgatctgg

SEQ ID NO: 40084 - DNA, 25 bp, Mus musculus
gctgatgctcttgtccacgatctgg

SEQ ID NO: 40085 - DNA, 25 bp, Mus musculus
gctgatgctgctttaccttgtagga

SEQ ID NO: 40086 - DNA, 25 bp, Mus musculus
gctgatgctgggatcctgcattacc

SEQ ID NO: 40087 - DNA, 25 bp, Mus musculus
gctgatggatgctgggccagacccc

SEQ ID NO: 40088 - DNA, 25 bp, Mus musculus
gctgatggattctggacgagctcca

SEQ ID NO: 40089 - DNA, 25 bp, Mus musculus
gctgatggctgacgtccacttcatc

SEQ ID NO: 40090 - DNA, 25 bp, Mus musculus
gctgatgggctccttcatttcagga

SEQ ID NO: 40091 - DNA, 25 bp, Mus musculus
gctgatgtcccagtatgtggagtca

SEQ ID NO: 40092 - DNA, 25 bp, Mus musculus
gctgatgtcctgaggcagattaaca

SEQ ID NO: 40093 - DNA, 25 bp, Mus musculus
gctgatgtcctgtggcagattaaca

SEQ ID NO: 40094 - DNA, 25 bp, Mus musculus
gctgatgtcgtcgtcatgatgctgg

SEQ ID NO: 40095 - DNA, 25 bp, Mus musculus
gctgatgttcctcgaaaccagtgca

SEQ ID NO: 40096 - DNA, 25 bp, Mus musculus
gctgatgttcctggaaaccagtgca

SEQ ID NO: 40097 - DNA, 25 bp, Mus musculus
gctgattcacagatttccgcctcgt

SEQ ID NO: 40098 - DNA, 25 bp, Mus musculus
gctgattgagtatgacaagctgcgg

SEQ ID NO: 40099 - DNA, 25 bp, Mus musculus
gctgattgatcacagtcaagactgg

SEQ ID NO: 40100 - DNA, 25 bp, Mus musculus
gctgattgcagacagcgacacgccg

SEQ ID NO: 40101 - DNA, 25 bp, Mus musculus
gctgattggctctcctaattttggg

SEQ ID NO: 40102 - DNA, 25 bp, Mus musculus
gctgatttatcgctgtataatgagt

SEQ ID NO: 40103 - DNA, 25 bp, Mus musculus
gctgatttgcctcggatggaacacc

SEQ ID NO: 40104 - DNA, 25 bp, Mus musculus
gctgattttgttgaggaccaggaag

SEQ ID NO: 40105 - DNA, 25 bp, Mus musculus
gctgcaaagctcaatatcccaacaa

SEQ ID NO: 40106 - DNA, 25 bp, Mus musculus
gctgcaaaggcttggccgacttctg

SEQ ID NO: 40107 - DNA, 25 bp, Mus musculus
gctgcaacctatttcaggacatttt

SEQ ID NO: 40108 - DNA, 25 bp, Mus musculus
gctgcaactggacgagacctgtgct

SEQ ID NO: 40109 - DNA, 25 bp, Mus musculus
gctgcaagaacatcaaacctcagtg

SEQ ID NO: 40110 - DNA, 25 bp, Mus musculus
gctgcaattttgagacacaatctgc

SEQ ID NO: 40111 - DNA, 25 bp, Mus musculus
gctgcacaacgaagaccaaatggcc

SEQ ID NO: 40112 - DNA, 25 bp, Mus musculus
gctgcacaagaagcacagggagtgt

SEQ ID NO: 40113 - DNA, 25 bp, Mus musculus
gctgcacactctagaaacccagtgg

SEQ ID NO: 40114 - DNA, 25 bp, Mus musculus
gctgcacagcagaggtaatcctgta

SEQ ID NO: 40115 - DNA, 25 bp, Mus musculus
gctgcacattccaatttaccaagtg

SEQ ID NO: 40116 - DNA, 25 bp, Mus musculus
gctgcaccaacgacaccatttgctt

SEQ ID NO: 40117 - DNA, 25 bp, Mus musculus
gctgcaccacatatctaccaaaatt

SEQ ID NO: 40118 - DNA, 25 bp, Mus musculus
gctgcaccactgaaacaatcctgag

SEQ ID NO: 40119 - DNA, 25 bp, Mus musculus
gctgcaccagcgctcctgttcggtt

SEQ ID NO: 40120 - DNA, 25 bp, Mus musculus
gctgcacctactactatgaactctg

SEQ ID NO: 40121 - DNA, 25 bp, Mus musculus
gctgcactaaagcaaagcttgcctc

SEQ ID NO: 40122 - DNA, 25 bp, Mus musculus
gctgcactggacctccacaactatg

SEQ ID NO: 40123 - DNA, 25 bp, Mus musculus
gctgcagaaatgaaggccctctggc

SEQ ID NO: 40124 - DNA, 25 bp, Mus musculus
gctgcagaagagtgcgtctcccgat

SEQ ID NO: 40125 - DNA, 25 bp, Mus musculus
gctgcagaataaattcaaagctagc

SEQ ID NO: 40126 - DNA, 25 bp, Mus musculus
gctgcagacctggttccaatcttca

SEQ ID NO: 40127 - DNA, 25 bp, Mus musculus
gctgcagagatcctgagcgacaaca

SEQ ID NO: 40128 - DNA, 25 bp, Mus musculus
gctgcagagtgatagtagtggcccc

SEQ ID NO: 40129 - DNA, 25 bp, Mus musculus
gctgcagatcattacagagaaaagt

SEQ ID NO: 40130 - DNA, 25 bp, Mus musculus
gctgcagatgccacattggctgctt

SEQ ID NO: 40131 - DNA, 25 bp, Mus musculus
gctgcagattggagtcaagtctgag

SEQ ID NO: 40132 - DNA, 25 bp, Mus musculus
gctgcagcaaccagattaaaaggaa

SEQ ID NO: 40133 - DNA, 25 bp, Mus musculus
gctgcagcaagagaaaccatttaaa

SEQ ID NO: 40134 - DNA, 25 bp, Mus musculus
gctgcagcaagagaagcgccagttg

SEQ ID NO: 40135 - DNA, 25 bp, Mus musculus
gctgcagcaggctgtccaggcttgc

SEQ ID NO: 40136 - DNA, 25 bp, Mus musculus
gctgcagcaggggttttaactcttc

SEQ ID NO: 40137 - DNA, 25 bp, Mus musculus
gctgcagcagggtgacccatcgtca

SEQ ID NO: 40138 - DNA, 25 bp, Mus musculus
gctgcagcccacctcgtggcgttag

SEQ ID NO: 40139 - DNA, 25 bp, Mus musculus
gctgcagcccaggaccaagttagag

SEQ ID NO: 40140 - DNA, 25 bp, Mus musculus
gctgcagccctggaaacattacatt

SEQ ID NO: 40141 - DNA, 25 bp, Mus musculus
gctgcagccgtagtagtttacgata

SEQ ID NO: 40142 - DNA, 25 bp, Mus musculus
gctgcagccgtgagggctcctcaca

SEQ ID NO: 40143 - DNA, 25 bp, Mus musculus
gctgcagctaactgccttgggaaga

SEQ ID NO: 40144 - DNA, 25 bp, Mus musculus
gctgcagctcccagaatcaaaaaat

SEQ ID NO: 40145 - DNA, 25 bp, Mus musculus
gctgcagcttctattgccaacattg

SEQ ID NO: 40146 - DNA, 25 bp, Mus musculus
gctgcaggccctgaaagttcaagca

SEQ ID NO: 40147 - DNA, 25 bp, Mus musculus
gctgcagggcttggctaacctcaaa

SEQ ID NO: 40148 - DNA, 25 bp, Mus musculus
gctgcaggtgagagcctcctcactt

SEQ ID NO: 40149 - DNA, 25 bp, Mus musculus
gctgcagtaatgtcaatgtgactgt

SEQ ID NO: 40150 - DNA, 25 bp, Mus musculus
gctgcagtacacctatgaggaacgc

SEQ ID NO: 40151 - DNA, 25 bp, Mus musculus
gctgcagtgctcagtgctagtgcct

SEQ ID NO: 40152 - DNA, 25 bp, Mus musculus
gctgcagttgacagtcaggtgaccc

SEQ ID NO: 40153 - DNA, 25 bp, Mus musculus
gctgcatatgggatcctagagaaga

SEQ ID NO: 40154 - DNA, 25 bp, Mus musculus
gctgcatcaagtgacaatatcatgg

SEQ ID NO: 40155 - DNA, 25 bp, Mus musculus
gctgcatcccaacgacaaagtcatg

SEQ ID NO: 40156 - DNA, 25 bp, Mus musculus
gctgcatcctggactgccagcctgg

SEQ ID NO: 40157 - DNA, 25 bp, Mus musculus
gctgcatcctggtctgccagcctgg

SEQ ID NO: 40158 - DNA, 25 bp, Mus musculus
gctgcatgtaccatcttaaagaaga

SEQ ID NO: 40159 - DNA, 25 bp, Mus musculus
gctgcatgtgcacctgcaacaggtg

SEQ ID NO: 40160 - DNA, 25 bp, Mus musculus
gctgcatttgaggtattctttgaag

SEQ ID NO: 40161 - DNA, 25 bp, Mus musculus
gctgccaaaggcatgccacttcgat

SEQ ID NO: 40162 - DNA, 25 bp, Mus musculus
gctgccaacatgacaccatcctggg

SEQ ID NO: 40163 - DNA, 25 bp, Mus musculus
gctgccaactttgagaacttatctg

SEQ ID NO: 40164 - DNA, 25 bp, Mus musculus
gctgccaagcttgataaacccgagt

SEQ ID NO: 40165 - DNA, 25 bp, Mus musculus
gctgccaagggctatagaagtgtgc

SEQ ID NO: 40166 - DNA, 25 bp, Mus musculus
gctgccaagggtgtcaacaaagagt

SEQ ID NO: 40167 - DNA, 25 bp, Mus musculus
gctgccacaaagactgtaaagtgct

SEQ ID NO: 40168 - DNA, 25 bp, Mus musculus
gctgccacagaaactccaaagagct

SEQ ID NO: 40169 - DNA, 25 bp, Mus musculus
gctgccactgttcgccaggttacgt

SEQ ID NO: 40170 - DNA, 25 bp, Mus musculus
gctgccactgttggccaggttacgt

SEQ ID NO: 40171 - DNA, 25 bp, Mus musculus
gctgccagagaaatatccctctgct

SEQ ID NO: 40172 - DNA, 25 bp, Mus musculus
gctgccagcatcacaattggctttg

SEQ ID NO: 40173 - DNA, 25 bp, Mus musculus
gctgccagcgtccacttcatctgtg

SEQ ID NO: 40174 - DNA, 25 bp, Mus musculus
gctgccaggattatcttgtgattat

SEQ ID NO: 40175 - DNA, 25 bp, Mus musculus
gctgccagtcttggcatcttcgaag

SEQ ID NO: 40176 - DNA, 25 bp, Mus musculus
gctgccagtttgtagtcaagccgat

SEQ ID NO: 40177 - DNA, 25 bp, Mus musculus
gctgccatggaattcttacaagaac

SEQ ID NO: 40178 - DNA, 25 bp, Mus musculus
gctgccatttatcaaccttctctgc

SEQ ID NO: 40179 - DNA, 25 bp, Mus musculus
gctgcccaaactaactccatggtga

SEQ ID NO: 40180 - DNA, 25 bp, Mus musculus
gctgcccaggatcgacaacatcaaa

SEQ ID NO: 40181 - DNA, 25 bp, Mus musculus
gctgcccaggatggacaacatcaaa

SEQ ID NO: 40182 - DNA, 25 bp, Mus musculus
gctgcccatcgactttccagaagaa

SEQ ID NO: 40183 - DNA, 25 bp, Mus musculus
gctgccccacacatagagaaggaga

SEQ ID NO: 40184 - DNA, 25 bp, Mus musculus
gctgccccactttgtggatgccgaa

SEQ ID NO: 40185 - DNA, 25 bp, Mus musculus
gctgccccgagtcggtgtgtgacca

SEQ ID NO: 40186 - DNA, 25 bp, Mus musculus
gctgccccgagtgggtgtgtgacca

SEQ ID NO: 40187 - DNA, 25 bp, Mus musculus
gctgcccgaagaccccagcatgatg

SEQ ID NO: 40188 - DNA, 25 bp, Mus musculus
gctgcccggtgccatttgttccctg

SEQ ID NO: 40189 - DNA, 25 bp, Mus musculus
gctgccctaagaccgtttccctgga

SEQ ID NO: 40190 - DNA, 25 bp, Mus musculus
gctgccctcagcagtgtcaccatgt

SEQ ID NO: 40191 - DNA, 25 bp, Mus musculus
gctgccctctgagaactacacggag

SEQ ID NO: 40192 - DNA, 25 bp, Mus musculus
gctgccctctgcctgaaggttctgc

SEQ ID NO: 40193 - DNA, 25 bp, Mus musculus
gctgccctctggcaagattgtggct

SEQ ID NO: 40194 - DNA, 25 bp, Mus musculus
gctgccctgaagactttcccctgca

SEQ ID NO: 40195 - DNA, 25 bp, Mus musculus
gctgccctgaagctggaaccttcca

SEQ ID NO: 40196 - DNA, 25 bp, Mus musculus
gctgccctgaatgctgactttaata

SEQ ID NO: 40197 - DNA, 25 bp, Mus musculus
gctgccctgagacagctgcggtcac

SEQ ID NO: 40198 - DNA, 25 bp, Mus musculus
gctgccctgagagagctgcggtcac

SEQ ID NO: 40199 - DNA, 25 bp, Mus musculus
gctgccctgagctggatcaattggt

SEQ ID NO: 40200 - DNA, 25 bp, Mus musculus
gctgccctgctaaaacatggacttg

SEQ ID NO: 40201 - DNA, 25 bp, Mus musculus
gctgcccttcagatacactcctggt

SEQ ID NO: 40202 - DNA, 25 bp, Mus musculus
gctgcccttcagttacactcctggt

SEQ ID NO: 40203 - DNA, 25 bp, Mus musculus
gctgcccttgtgttgatttttatgg

SEQ ID NO: 40204 - DNA, 25 bp, Mus musculus
gctgccgagacgtatgccaatatca

SEQ ID NO: 40205 - DNA, 25 bp, Mus musculus
gctgccgagatcatggctgtcctgt

SEQ ID NO: 40206 - DNA, 25 bp, Mus musculus
gctgccggttcctggaaagaacttt

SEQ ID NO: 40207 - DNA, 25 bp, Mus musculus
gctgccgtccgttagtcctggagtc

SEQ ID NO: 40208 - DNA, 25 bp, Mus musculus
gctgccgtcctgtgaccttgctcgg

SEQ ID NO: 40209 - DNA, 25 bp, Mus musculus
gctgccgtggctacagcttggcctg

SEQ ID NO: 40210 - DNA, 25 bp, Mus musculus
gctgcctccttctgcagcggaagat

SEQ ID NO: 40211 - DNA, 25 bp, Mus musculus
gctgcctctatggaaacacatgtag

SEQ ID NO: 40212 - DNA, 25 bp, Mus musculus
gctgcctctcttttttgtttctgga

SEQ ID NO: 40213 - DNA, 25 bp, Mus musculus
gctgcctctgcgtacaaggccctgt

SEQ ID NO: 40214 - DNA, 25 bp, Mus musculus
gctgcctctggccatgagataattg

SEQ ID NO: 40215 - DNA, 25 bp, Mus musculus
gctgcctcttacctagattcctgag

SEQ ID NO: 40216 - DNA, 25 bp, Mus musculus
gctgcctgattttggattctcacaa

SEQ ID NO: 40217 - DNA, 25 bp, Mus musculus
gctgcctgccagtttgcttttattg

SEQ ID NO: 40218 - DNA, 25 bp, Mus musculus
gctgcctggtcctcacggaagtgct

SEQ ID NO: 40219 - DNA, 25 bp, Mus musculus
gctgcctgtcgcctggataataaag

SEQ ID NO: 40220 - DNA, 25 bp, Mus musculus
gctgcctgtggtgtactgataaaca

SEQ ID NO: 40221 - DNA, 25 bp, Mus musculus
gctgccttataagaggattttgaga

SEQ ID NO: 40222 - DNA, 25 bp, Mus musculus
gctgccttcatgtctttggactgac

SEQ ID NO: 40223 - DNA, 25 bp, Mus musculus
gctgccttgcctgtaactcaacaaa

SEQ ID NO: 40224 - DNA, 25 bp, Mus musculus
gctgcctttcaaatctatagatcac

SEQ ID NO: 40225 - DNA, 25 bp, Mus musculus
gctgcctttcagtaaaccggcctca

SEQ ID NO: 40226 - DNA, 25 bp, Mus musculus
gctgcctttgtcctagctatgctca

SEQ ID NO: 40227 - DNA, 25 bp, Mus musculus
gctgcgagtgtcacccgccctggga

SEQ ID NO: 40228 - DNA, 25 bp, Mus musculus
gctgcgatgcctgtataacccaggg

SEQ ID NO: 40229 - DNA, 25 bp, Mus musculus
gctgcgattctacagctactacaag

SEQ ID NO: 40230 - DNA, 25 bp, Mus musculus
gctgcgcagagttctggatgaaatc

SEQ ID NO: 40231 - DNA, 25 bp, Mus musculus
gctgcgccaacctggtagagagcat

SEQ ID NO: 40232 - DNA, 25 bp, Mus musculus
gctgcgcctgtcgtttctgctcggt

SEQ ID NO: 40233 - DNA, 25 bp, Mus musculus
gctgcggaagaaaactgcctggcca

SEQ ID NO: 40234 - DNA, 25 bp, Mus musculus
gctgcggaagaatactgcctggcca

SEQ ID NO: 40235 - DNA, 25 bp, Mus musculus
gctgcggagctcaagtcgaaaagtt

SEQ ID NO: 40236 - DNA, 25 bp, Mus musculus
gctgcggagctctagtcgaaaagtt

SEQ ID NO: 40237 - DNA, 25 bp, Mus musculus
gctgcggcgtcagatgaagaatatc

SEQ ID NO: 40238 - DNA, 25 bp, Mus musculus
gctgcggtactgtgacagaagccat

SEQ ID NO: 40239 - DNA, 25 bp, Mus musculus
gctgcggtgttgctaatgcacatgc

SEQ ID NO: 40240 - DNA, 25 bp, Mus musculus
gctgcggttcagatttcttttcgaa

SEQ ID NO: 40241 - DNA, 25 bp, Mus musculus
gctgctaaagcttccaaatctgaaa

SEQ ID NO: 40242 - DNA, 25 bp, Mus musculus
gctgctaaaggataaaagacataaa

SEQ ID NO: 40243 - DNA, 25 bp, Mus musculus
gctgctacagaagggttacggcttg

SEQ ID NO: 40244 - DNA, 25 bp, Mus musculus
gctgctacccatggcttagatgaag

SEQ ID NO: 40245 - DNA, 25 bp, Mus musculus
gctgctagacatggccaaaggcatt

SEQ ID NO: 40246 - DNA, 25 bp, Mus musculus
gctgctagctccattgaccaattta

SEQ ID NO: 40247 - DNA, 25 bp, Mus musculus
gctgctatacagaaatagtctctgg

SEQ ID NO: 40248 - DNA, 25 bp, Mus musculus
gctgctatgtcagatgtccctgctg

SEQ ID NO: 40249 - DNA, 25 bp, Mus musculus
gctgctattgaaagagagtatgcac

SEQ ID NO: 40250 - DNA, 25 bp, Mus musculus
gctgctcaaaaaggagagtccgagt

SEQ ID NO: 40251 - DNA, 25 bp, Mus musculus
gctgctcacagtgctcatagccttt

SEQ ID NO: 40252 - DNA, 25 bp, Mus musculus
gctgctcacattcacggattttctg

SEQ ID NO: 40253 - DNA, 25 bp, Mus musculus
gctgctcactcattataaaagtgat

SEQ ID NO: 40254 - DNA, 25 bp, Mus musculus
gctgctcagagaagttgatcatcca

SEQ ID NO: 40255 - DNA, 25 bp, Mus musculus
gctgctcagagaattagcggataac

SEQ ID NO: 40256 - DNA, 25 bp, Mus musculus
gctgctcagagatgttgatcatcca

SEQ ID NO: 40257 - DNA, 25 bp, Mus musculus
gctgctcagagggattctacgggaa

SEQ ID NO: 40258 - DNA, 25 bp, Mus musculus
gctgctcagctttgccttaggtgga

SEQ ID NO: 40259 - DNA, 25 bp, Mus musculus
gctgctcagtctcgtgggtgcacaa

SEQ ID NO: 40260 - DNA, 25 bp, Mus musculus
gctgctcatcaagaagacctgaatt

SEQ ID NO: 40261 - DNA, 25 bp, Mus musculus
gctgctcattgtgctggtagagacc

SEQ ID NO: 40262 - DNA, 25 bp, Mus musculus
gctgctccaatgacagagatacctg

SEQ ID NO: 40263 - DNA, 25 bp, Mus musculus
gctgctccagcctggcggacagcat

SEQ ID NO: 40264 - DNA, 25 bp, Mus musculus
gctgctcccgcctttctgaagggca

SEQ ID NO: 40265 - DNA, 25 bp, Mus musculus
gctgctccggatccatccgacgggt

SEQ ID NO: 40266 - DNA, 25 bp, Mus musculus
gctgctccggatgcatccgacgggt

SEQ ID NO: 40267 - DNA, 25 bp, Mus musculus
gctgctcctgagtagaaacgcgaat

SEQ ID NO: 40268 - DNA, 25 bp, Mus musculus
gctgctcctggaggcaaatccgtag

SEQ ID NO: 40269 - DNA, 25 bp, Mus musculus
gctgctctaccaaaacatgcaggag

SEQ ID NO: 40270 - DNA, 25 bp, Mus musculus
gctgctctgagactcactgtcagat

SEQ ID NO: 40271 - DNA, 25 bp, Mus musculus
gctgctctgcttgtttgatgagaag

SEQ ID NO: 40272 - DNA, 25 bp, Mus musculus
gctgctcttcgaggacgagtttgtc

SEQ ID NO: 40273 - DNA, 25 bp, Mus musculus
gctgctcttcggcagtgatggctac

SEQ ID NO: 40274 - DNA, 25 bp, Mus musculus
gctgctgaatcacaggccgatgact

SEQ ID NO: 40275 - DNA, 25 bp, Mus musculus
gctgctgaatgaagtcatgggaact

SEQ ID NO: 40276 - DNA, 25 bp, Mus musculus
gctgctgacattgacatcgacactg

SEQ ID NO: 40277 - DNA, 25 bp, Mus musculus
gctgctgaccatcttagctgcaaag

SEQ ID NO: 40278 - DNA, 25 bp, Mus musculus
gctgctgaccatgttagctgcaaag

SEQ ID NO: 40279 - DNA, 25 bp, Mus musculus
gctgctgaccgagagacagctgagt

SEQ ID NO: 40280 - DNA, 25 bp, Mus musculus
gctgctgacttcattcgagctggaa

SEQ ID NO: 40281 - DNA, 25 bp, Mus musculus
gctgctgagataagtttgaagaaat

SEQ ID NO: 40282 - DNA, 25 bp, Mus musculus
gctgctgagctcaaccatgcacagg

SEQ ID NO: 40283 - DNA, 25 bp, Mus musculus
gctgctgaggtggagcgggaccggc

SEQ ID NO: 40284 - DNA, 25 bp, Mus musculus
gctgctgcacattccaatttaccaa

SEQ ID NO: 40285 - DNA, 25 bp, Mus musculus
gctgctgcccgaaacgacttggagg

SEQ ID NO: 40286 - DNA, 25 bp, Mus musculus
gctgctgcgctcaactctttcctgt

SEQ ID NO: 40287 - DNA, 25 bp, Mus musculus
gctgctgctatgtcagatgtccctg

SEQ ID NO: 40288 - DNA, 25 bp, Mus musculus
gctgctgctcagtctttaaatgtac

SEQ ID NO: 40289 - DNA, 25 bp, Mus musculus
gctgctgctgaaagactttgactct

SEQ ID NO: 40290 - DNA, 25 bp, Mus musculus
gctgctgctgaagggctttggcaaa

SEQ ID NO: 40291 - DNA, 25 bp, Mus musculus
gctgctgctgggaatcagcggcctc

SEQ ID NO: 40292 - DNA, 25 bp, Mus musculus
gctgctggaccttgcccagaaacac

SEQ ID NO: 40293 - DNA, 25 bp, Mus musculus
gctgctggcactggcagactatgtg

SEQ ID NO: 40294 - DNA, 25 bp, Mus musculus
gctgctggcctttgctggttattca

SEQ ID NO: 40295 - DNA, 25 bp, Mus musculus
gctgctggctgaacacaagacgacc

SEQ ID NO: 40296 - DNA, 25 bp, Mus musculus
gctgctgggaatcagcggcctcctc

SEQ ID NO: 40297 - DNA, 25 bp, Mus musculus
gctgctgggaatgcgcaaacctgga

SEQ ID NO: 40298 - DNA, 25 bp, Mus musculus
gctgctgggcaactcggttgtcaca

SEQ ID NO: 40299 - DNA, 25 bp, Mus musculus
gctgctgggctggtatgccgccaat

SEQ ID NO: 40300 - DNA, 25 bp, Mus musculus
gctgctggtgctgaaagctgctcac

SEQ ID NO: 40301 - DNA, 25 bp, Mus musculus
gctgctgtaacagaagctgaaaatc

SEQ ID NO: 40302 - DNA, 25 bp, Mus musculus
gctgctgtatgatcctgagaaagat

SEQ ID NO: 40303 - DNA, 25 bp, Mus musculus
gctgctgtattgacatagcgttggc

SEQ ID NO: 40304 - DNA, 25 bp, Mus musculus
gctgctgtcaactatttcaccaaca

SEQ ID NO: 40305 - DNA, 25 bp, Mus musculus
gctgctgtcagcgtcacttctaaaa

SEQ ID NO: 40306 - DNA, 25 bp, Mus musculus
gctgctgtctttgacaagttcatca

SEQ ID NO: 40307 - DNA, 25 bp, Mus musculus
gctgctgtgaagaagccaactggca

SEQ ID NO: 40308 - DNA, 25 bp, Mus musculus
gctgctgtgggaacatcttgtgcca

SEQ ID NO: 40309 - DNA, 25 bp, Mus musculus
gctgcttagctggtgaatgaaggat

SEQ ID NO: 40310 - DNA, 25 bp, Mus musculus
gctgcttagcttgtccctaggaaaa

SEQ ID NO: 40311 - DNA, 25 bp, Mus musculus
gctgcttagtcgtgttttcaagacc

SEQ ID NO: 40312 - DNA, 25 bp, Mus musculus
gctgcttataagactcacgggcaca

SEQ ID NO: 40313 - DNA, 25 bp, Mus musculus
gctgcttcactctggcttagacctt

SEQ ID NO: 40314 - DNA, 25 bp, Mus musculus
gctgcttcagacagcactgttccag

SEQ ID NO: 40315 - DNA, 25 bp, Mus musculus
gctgcttccgcccataagaaagatg

SEQ ID NO: 40316 - DNA, 25 bp, Mus musculus
gctgcttctgcagggaaggttatca

SEQ ID NO: 40317 - DNA, 25 bp, Mus musculus
gctgcttggctggatctgctcaatt

SEQ ID NO: 40318 - DNA, 25 bp, Mus musculus
gctgctttcagttgattgtgtaaaa

SEQ ID NO: 40319 - DNA, 25 bp, Mus musculus
gctgctttctggcttatttacagac

SEQ ID NO: 40320 - DNA, 25 bp, Mus musculus
gctgctttggctagacttagctgga

SEQ ID NO: 40321 - DNA, 25 bp, Mus musculus
gctgctttggttgacttgggccttt

SEQ ID NO: 40322 - DNA, 25 bp, Mus musculus
gctgctttgtttctgcctttaaagt

SEQ ID NO: 40323 - DNA, 25 bp, Mus musculus
gctgcttttggactacggttgtcag

SEQ ID NO: 40324 - DNA, 25 bp, Mus musculus
gctggaaaaagctgccgagctgctg

SEQ ID NO: 40325 - DNA, 25 bp, Mus musculus
gctggaaaacttcgcacttgtagac

SEQ ID NO: 40326 - DNA, 25 bp, Mus musculus
gctggaaacagacaccttcaaactg

SEQ ID NO: 40327 - DNA, 25 bp, Mus musculus
gctggaaacctgttcctggatcccc

SEQ ID NO: 40328 - DNA, 25 bp, Mus musculus
gctggaaaggaatttacaaacaaga

SEQ ID NO: 40329 - DNA, 25 bp, Mus musculus
gctggaaaggtcgtctcggagacta

SEQ ID NO: 40330 - DNA, 25 bp, Mus musculus
gctggaaatgatggcaagcagttgt

SEQ ID NO: 40331 - DNA, 25 bp, Mus musculus
gctggaaatgtttcttgtatctctc

SEQ ID NO: 40332 - DNA, 25 bp, Mus musculus
gctggaacaggctatccctgtgcgg

SEQ ID NO: 40333 - DNA, 25 bp, Mus musculus
gctggaacccacacatgaggaggac

SEQ ID NO: 40334 - DNA, 25 bp, Mus musculus
gctggaacctcaaggccctcaggac

SEQ ID NO: 40335 - DNA, 25 bp, Mus musculus
gctggaacctcatggccctcaggac

SEQ ID NO: 40336 - DNA, 25 bp, Mus musculus
gctggaacgcttctatgaccctgaa

SEQ ID NO: 40337 - DNA, 25 bp, Mus musculus
gctggaacttccaatgagctcttgg

SEQ ID NO: 40338 - DNA, 25 bp, Mus musculus
gctggaagaggctggataaaatact

SEQ ID NO: 40339 - DNA, 25 bp, Mus musculus
gctggaagatgtggctgacatgaac

SEQ ID NO: 40340 - DNA, 25 bp, Mus musculus
gctggaagcccctacctcattggct

SEQ ID NO: 40341 - DNA, 25 bp, Mus musculus
gctggaagggatcgatcacaacccc

SEQ ID NO: 40342 - DNA, 25 bp, Mus musculus
gctggaagttctgatgttccattga

SEQ ID NO: 40343 - DNA, 25 bp, Mus musculus
gctggaagttctgcaatgaagctac

SEQ ID NO: 40344 - DNA, 25 bp, Mus musculus
gctggaatatcttgacaaactcgga

SEQ ID NO: 40345 - DNA, 25 bp, Mus musculus
gctggaatatgagcagctgctgaat

SEQ ID NO: 40346 - DNA, 25 bp, Mus musculus
gctggaatccatagcagacatgaag

SEQ ID NO: 40347 - DNA, 25 bp, Mus musculus
gctggaatgaagtaactcaagatga

SEQ ID NO: 40348 - DNA, 25 bp, Mus musculus
gctggaatggcaaaggcaaaagcag

SEQ ID NO: 40349 - DNA, 25 bp, Mus musculus
gctggaatggcataggcaaaagcag

SEQ ID NO: 40350 - DNA, 25 bp, Mus musculus
gctggaattctctccattatctctg

SEQ ID NO: 40351 - DNA, 25 bp, Mus musculus
gctggacaacttatccaaacctgtg

SEQ ID NO: 40352 - DNA, 25 bp, Mus musculus
gctggacaacttttccaaacctgtg

SEQ ID NO: 40353 - DNA, 25 bp, Mus musculus
gctggacaatttgcttaatatggcc

SEQ ID NO: 40354 - DNA, 25 bp, Mus musculus
gctggacagattcgccaatcagatt

SEQ ID NO: 40355 - DNA, 25 bp, Mus musculus
gctggacagtggacgacaccacttt

SEQ ID NO: 40356 - DNA, 25 bp, Mus musculus
gctggaccacgctctcaacgatatg

SEQ ID NO: 40357 - DNA, 25 bp, Mus musculus
gctggacccatgagaaacagatggg

SEQ ID NO: 40358 - DNA, 25 bp, Mus musculus
gctggacgaactcaagcgcttcttt

SEQ ID NO: 40359 - DNA, 25 bp, Mus musculus
gctggacgacatgaccaagaacgat

SEQ ID NO: 40360 - DNA, 25 bp, Mus musculus
gctggacgatgagaatgtgtgcata

SEQ ID NO: 40361 - DNA, 25 bp, Mus musculus
gctggacggagacgtgtacccacct

SEQ ID NO: 40362 - DNA, 25 bp, Mus musculus
gctggacggagaggtgtacccacct

SEQ ID NO: 40363 - DNA, 25 bp, Mus musculus
gctggactacctgagctatgctgtc

SEQ ID NO: 40364 - DNA, 25 bp, Mus musculus
gctggacttgccgaggtgtgccaaa

SEQ ID NO: 40365 - DNA, 25 bp, Mus musculus
gctggagaaactctcagccttggac

SEQ ID NO: 40366 - DNA, 25 bp, Mus musculus
gctggagaaagaacatagctgacct

SEQ ID NO: 40367 - DNA, 25 bp, Mus musculus
gctggagaagaatcggttatgaatc

SEQ ID NO: 40368 - DNA, 25 bp, Mus musculus
gctggagacacagatggcctcaaat

SEQ ID NO: 40369 - DNA, 25 bp, Mus musculus
gctggagaccagtgtgagcactggc

SEQ ID NO: 40370 - DNA, 25 bp, Mus musculus
gctggagactctcttcgtgcaccga

SEQ ID NO: 40371 - DNA, 25 bp, Mus musculus
gctggagagactgcatgtaagctcg

SEQ ID NO: 40372 - DNA, 25 bp, Mus musculus
gctggagagcccaagcctaatagac

SEQ ID NO: 40373 - DNA, 25 bp, Mus musculus
gctggagagtctggcaaaagcacca

SEQ ID NO: 40374 - DNA, 25 bp, Mus musculus
gctggagatgcagatggagaaacta

SEQ ID NO: 40375 - DNA, 25 bp, Mus musculus
gctggagcgcccaggacgctatcta

SEQ ID NO: 40376 - DNA, 25 bp, Mus musculus
gctggagcgccctggacgctatcta

SEQ ID NO: 40377 - DNA, 25 bp, Mus musculus
gctggagcgccgctgtgccactttt

SEQ ID NO: 40378 - DNA, 25 bp, Mus musculus
gctggagctacagacatttgtggct

SEQ ID NO: 40379 - DNA, 25 bp, Mus musculus
gctggagctacctccttagactgta

SEQ ID NO: 40380 - DNA, 25 bp, Mus musculus
gctggaggtcttattacaaaatcaa

SEQ ID NO: 40381 - DNA, 25 bp, Mus musculus
gctggagtatgggagtccctacgcc

SEQ ID NO: 40382 - DNA, 25 bp, Mus musculus
gctggagtctgttccctgtgagaca

SEQ ID NO: 40383 - DNA, 25 bp, Mus musculus
gctggagtgatctgcaagtgctacc

SEQ ID NO: 40384 - DNA, 25 bp, Mus musculus
gctggagtgtcagtgctcccgtatt

SEQ ID NO: 40385 - DNA, 25 bp, Mus musculus
gctggataccagcaccatgacatgg

SEQ ID NO: 40386 - DNA, 25 bp, Mus musculus
gctggatatgttttaccggcactgg

SEQ ID NO: 40387 - DNA, 25 bp, Mus musculus
gctggatcacaagatcagagggccg

SEQ ID NO: 40388 - DNA, 25 bp, Mus musculus
gctggatcaggcaagctccagcaca

SEQ ID NO: 40389 - DNA, 25 bp, Mus musculus
gctggatcatgtcattaatgggtcc

SEQ ID NO: 40390 - DNA, 25 bp, Mus musculus
gctggatccaaacaaaccaataagg

SEQ ID NO: 40391 - DNA, 25 bp, Mus musculus
gctggatcccatgaaggtgaaggct

SEQ ID NO: 40392 - DNA, 25 bp, Mus musculus
gctggatcggcaactcatcagactg

SEQ ID NO: 40393 - DNA, 25 bp, Mus musculus
gctggatctaatcagacaatggttg

SEQ ID NO: 40394 - DNA, 25 bp, Mus musculus
gctggatctccagcgagcagatgct

SEQ ID NO: 40395 - DNA, 25 bp, Mus musculus
gctggatgaggaagacttgtgctat

SEQ ID NO: 40396 - DNA, 25 bp, Mus musculus
gctggatgaggatgacttgtgctat

SEQ ID NO: 40397 - DNA, 25 bp, Mus musculus
gctggatgccgcgagcgaatacgct

SEQ ID NO: 40398 - DNA, 25 bp, Mus musculus
gctggatgcctcagatctgacgtgg

SEQ ID NO: 40399 - DNA, 25 bp, Mus musculus
gctggatgggaaccaggaccttatc

SEQ ID NO: 40400 - DNA, 25 bp, Mus musculus
gctggattgatccttgacgacccca

SEQ ID NO: 40401 - DNA, 25 bp, Mus musculus
gctggattgatctccacagattgga

SEQ ID NO: 40402 - DNA, 25 bp, Mus musculus
gctggattggcccatgaatcacatc

SEQ ID NO: 40403 - DNA, 25 bp, Mus musculus
gctggattggccgatgaatcacatc

SEQ ID NO: 40404 - DNA, 25 bp, Mus musculus
gctggcaaacggactgttgcttccc

SEQ ID NO: 40405 - DNA, 25 bp, Mus musculus
gctggcaagtttgacatcatcccaa

SEQ ID NO: 40406 - DNA, 25 bp, Mus musculus
gctggcaatcatccagattcactga

SEQ ID NO: 40407 - DNA, 25 bp, Mus musculus
gctggcaccacagaatctgggcaac

SEQ ID NO: 40408 - DNA, 25 bp, Mus musculus
gctggcaggcacaagctgcagaaat

SEQ ID NO: 40409 - DNA, 25 bp, Mus musculus
gctggcatcgccatctacgtcaggt

SEQ ID NO: 40410 - DNA, 25 bp, Mus musculus
gctggccactccagtgcctattcta

SEQ ID NO: 40411 - DNA, 25 bp, Mus musculus
gctggccagcgatgtcctctatagg

SEQ ID NO: 40412 - DNA, 25 bp, Mus musculus
gctggcccagagtttgtggaggtga

SEQ ID NO: 40413 - DNA, 25 bp, Mus musculus
gctggccctgtttccggacaagagt

SEQ ID NO: 40414 - DNA, 25 bp, Mus musculus
gctggcccttagtttgagccgagag

SEQ ID NO: 40415 - DNA, 25 bp, Mus musculus
gctggccgaggagtacctggacatt

SEQ ID NO: 40416 - DNA, 25 bp, Mus musculus
gctggccgccagctacatagacttc

SEQ ID NO: 40417 - DNA, 25 bp, Mus musculus
gctggccgccaggtacatagacttc

SEQ ID NO: 40418 - DNA, 25 bp, Mus musculus
gctggcctacaactcacgctataga

SEQ ID NO: 40419 - DNA, 25 bp, Mus musculus
gctggcctataaagactatatctaa

SEQ ID NO: 40420 - DNA, 25 bp, Mus musculus
gctggccttcatctactccgtggtg

SEQ ID NO: 40421 - DNA, 25 bp, Mus musculus
gctggcgacatctttgacatgctgc

SEQ ID NO: 40422 - DNA, 25 bp, Mus musculus
gctggcgacttcaccaaccacaatg

SEQ ID NO: 40423 - DNA, 25 bp, Mus musculus
gctggcggagaaaaaggccacagat

SEQ ID NO: 40424 - DNA, 25 bp, Mus musculus
gctggcggatgagcagtcacacaaa

SEQ ID NO: 40425 - DNA, 25 bp, Mus musculus
gctggcggtgattcagtatagcctg

SEQ ID NO: 40426 - DNA, 25 bp, Mus musculus
gctggcggtggtgtacatattcagc

SEQ ID NO: 40427 - DNA, 25 bp, Mus musculus
gctggcgtgtcaaaagcagaaacgc

SEQ ID NO: 40428 - DNA, 25 bp, Mus musculus
gctggctaagtctgaccctatggtg

SEQ ID NO: 40429 - DNA, 25 bp, Mus musculus
gctggctactgtttgggtaccaccc

SEQ ID NO: 40430 - DNA, 25 bp, Mus musculus
gctggctagggctgctcccgccttt

SEQ ID NO: 40431 - DNA, 25 bp, Mus musculus
gctggctataggagccaccgagagc

SEQ ID NO: 40432 - DNA, 25 bp, Mus musculus
gctggctatgattacctagctctga

SEQ ID NO: 40433 - DNA, 25 bp, Mus musculus
gctggctcacaggtttgaggagacc

SEQ ID NO: 40434 - DNA, 25 bp, Mus musculus
gctggctcagcaaggtgaatatagt

SEQ ID NO: 40435 - DNA, 25 bp, Mus musculus
gctggctcaggcaataaaggatccg

SEQ ID NO: 40436 - DNA, 25 bp, Mus musculus
gctggctcaggcaattaaagaggcc

SEQ ID NO: 40437 - DNA, 25 bp, Mus musculus
gctggctcccaatcttataaccttt

SEQ ID NO: 40438 - DNA, 25 bp, Mus musculus
gctggctctagagaccatgaatggc

SEQ ID NO: 40439 - DNA, 25 bp, Mus musculus
gctggctctcactgaccctcgagat

SEQ ID NO: 40440 - DNA, 25 bp, Mus musculus
gctggctctggtttaaagcaagcgt

SEQ ID NO: 40441 - DNA, 25 bp, Mus musculus
gctggctgagttacggagtcttgaa

SEQ ID NO: 40442 - DNA, 25 bp, Mus musculus
gctggctgctaaaggataaaagaca

SEQ ID NO: 40443 - DNA, 25 bp, Mus musculus
gctggctgggatgagcctcaccatt

SEQ ID NO: 40444 - DNA, 25 bp, Mus musculus
gctggctgtatccatggcctcagca

SEQ ID NO: 40445 - DNA, 25 bp, Mus musculus
gctggcttccacttcgggcttcgtt

SEQ ID NO: 40446 - DNA, 25 bp, Mus musculus
gctggcttccagaacattgttgatg

SEQ ID NO: 40447 - DNA, 25 bp, Mus musculus
gctggcttgcagctgatgcttacgc

SEQ ID NO: 40448 - DNA, 25 bp, Mus musculus
gctggctttcctttacctctttgtc

SEQ ID NO: 40449 - DNA, 25 bp, Mus musculus
gctggctttgggtacggactcccca

SEQ ID NO: 40450 - DNA, 25 bp, Mus musculus
gctggcttttagcaattcctgtccc

SEQ ID NO: 40451 - DNA, 25 bp, Mus musculus
gctggcttttaggaattcctgtccc

SEQ ID NO: 40452 - DNA, 25 bp, Mus musculus
gctgggaacccgatgacaacccgat

SEQ ID NO: 40453 - DNA, 25 bp, Mus musculus
gctgggaagcctgaacctaatgcag

SEQ ID NO: 40454 - DNA, 25 bp, Mus musculus
gctgggaaggatgtggttttacatc

SEQ ID NO: 40455 - DNA, 25 bp, Mus musculus
gctgggaagggactacacaaactct

SEQ ID NO: 40456 - DNA, 25 bp, Mus musculus
gctgggaagtgcttaggagtctacc

SEQ ID NO: 40457 - DNA, 25 bp, Mus musculus
gctgggaatgcgttattacccaaag

SEQ ID NO: 40458 - DNA, 25 bp, Mus musculus
gctgggaattttcgccaccgttctc

SEQ ID NO: 40459 - DNA, 25 bp, Mus musculus
gctgggacaagagggaccctgtcaa

SEQ ID NO: 40460 - DNA, 25 bp, Mus musculus
gctgggacaagtttacaggctgctg

SEQ ID NO: 40461 - DNA, 25 bp, Mus musculus
gctgggacgacctggagtttctcag

SEQ ID NO: 40462 - DNA, 25 bp, Mus musculus
gctgggactattccactgccccaga

SEQ ID NO: 40463 - DNA, 25 bp, Mus musculus
gctgggagaacatcaaggctcggac

SEQ ID NO: 40464 - DNA, 25 bp, Mus musculus
gctgggagcattagtactcttgact

SEQ ID NO: 40465 - DNA, 25 bp, Mus musculus
gctgggagctactctgtgaagcatc

SEQ ID NO: 40466 - DNA, 25 bp, Mus musculus
gctgggaggatctggctccagaatc

SEQ ID NO: 40467 - DNA, 25 bp, Mus musculus
gctgggaggtgcaccagcgcttcaa

SEQ ID NO: 40468 - DNA, 25 bp, Mus musculus
gctgggagtcctactccaatgtgag

SEQ ID NO: 40469 - DNA, 25 bp, Mus musculus
gctgggagtccttctccaatgtgag

SEQ ID NO: 40470 - DNA, 25 bp, Mus musculus
gctgggatccctgctttcagcctga

SEQ ID NO: 40471 - DNA, 25 bp, Mus musculus
gctgggatctgtcctactgtcctct

SEQ ID NO: 40472 - DNA, 25 bp, Mus musculus
gctgggatgacagacaggtccaccc

SEQ ID NO: 40473 - DNA, 25 bp, Mus musculus
gctgggcctgaagcatgcccggaaa

SEQ ID NO: 40474 - DNA, 25 bp, Mus musculus
gctgggccttcacgcagtgctatgt

SEQ ID NO: 40475 - DNA, 25 bp, Mus musculus
gctgggccttcaggcagtgctatgt

SEQ ID NO: 40476 - DNA, 25 bp, Mus musculus
gctgggcgaattgcagaattcttcc

SEQ ID NO: 40477 - DNA, 25 bp, Mus musculus
gctgggcgctcttcaatgggcacca

SEQ ID NO: 40478 - DNA, 25 bp, Mus musculus
gctgggcggatgactccatgaagat

SEQ ID NO: 40479 - DNA, 25 bp, Mus musculus
gctgggctaggctcatctgtggccc

SEQ ID NO: 40480 - DNA, 25 bp, Mus musculus
gctgggctctacaacagtgccctac

SEQ ID NO: 40481 - DNA, 25 bp, Mus musculus
gctgggctgttgtctccatatcaga

SEQ ID NO: 40482 - DNA, 25 bp, Mus musculus
gctgggcttcagctgtgccaacaag

SEQ ID NO: 40483 - DNA, 25 bp, Mus musculus
gctgggcttcctggctgtgctgact

SEQ ID NO: 40484 - DNA, 25 bp, Mus musculus
gctgggcttctgctgatcattctga

SEQ ID NO: 40485 - DNA, 25 bp, Mus musculus
gctgggctttgtcatctactggttt

SEQ ID NO: 40486 - DNA, 25 bp, Mus musculus
gctgggtaccagctgtctgaagaca

SEQ ID NO: 40487 - DNA, 25 bp, Mus musculus
gctgggtagttttccgaagatacac

SEQ ID NO: 40488 - DNA, 25 bp, Mus musculus
gctgggtatcgccacattgactgtg

SEQ ID NO: 40489 - DNA, 25 bp, Mus musculus
gctgggtcaaaaaacatacctatga

SEQ ID NO: 40490 - DNA, 25 bp, Mus musculus
gctgggtcatatcttcaccacggga

SEQ ID NO: 40491 - DNA, 25 bp, Mus musculus
gctgggtcccacttcaaaagatctg

SEQ ID NO: 40492 - DNA, 25 bp, Mus musculus
gctgggtcttcatgagacagaggat

SEQ ID NO: 40493 - DNA, 25 bp, Mus musculus
gctgggtcttctcgccagagacact

SEQ ID NO: 40494 - DNA, 25 bp, Mus musculus
gctgggtgcaggcagaattcttcac

SEQ ID NO: 40495 - DNA, 25 bp, Mus musculus
gctgggtgccacacgaaaaatattg

SEQ ID NO: 40496 - DNA, 25 bp, Mus musculus
gctgggttacatggaccccacagag

SEQ ID NO: 40497 - DNA, 25 bp, Mus musculus
gctgggttcttcagacttccctgag

SEQ ID NO: 40498 - DNA, 25 bp, Mus musculus
gctggtaatgaagaggatgtgttcc

SEQ ID NO: 40499 - DNA, 25 bp, Mus musculus
gctggtacctgcagatcatccgctt

SEQ ID NO: 40500 - DNA, 25 bp, Mus musculus
gctggtagcaagaagaaggctccca

SEQ ID NO: 40501 - DNA, 25 bp, Mus musculus
gctggtagctgcaccattgtttgag

SEQ ID NO: 40502 - DNA, 25 bp, Mus musculus
gctggtagtggttcacacagaagac

SEQ ID NO: 40503 - DNA, 25 bp, Mus musculus
gctggtataccgaatagaagccggg

SEQ ID NO: 40504 - DNA, 25 bp, Mus musculus
gctggtattttgaaggactctatcc

SEQ ID NO: 40505 - DNA, 25 bp, Mus musculus
gctggtcaccagtgacgtgctcacc

SEQ ID NO: 40506 - DNA, 25 bp, Mus musculus
gctggtcagatctcaccaaatcgac

SEQ ID NO: 40507 - DNA, 25 bp, Mus musculus
gctggtcaggagtatgctgccaaga

SEQ ID NO: 40508 - DNA, 25 bp, Mus musculus
gctggtcatgaaattactaagtgga

SEQ ID NO: 40509 - DNA, 25 bp, Mus musculus
gctggtccccagtcatcaaggatgt

SEQ ID NO: 40510 - DNA, 25 bp, Mus musculus
gctggtcccttacaaactgatccgg

SEQ ID NO: 40511 - DNA, 25 bp, Mus musculus
gctggtcgtcctacgaaaaaggcgg

SEQ ID NO: 40512 - DNA, 25 bp, Mus musculus
gctggtcgtttgatgataaggaaat

SEQ ID NO: 40513 - DNA, 25 bp, Mus musculus
gctggtctcaaacgaagagattctg

SEQ ID NO: 40514 - DNA, 25 bp, Mus musculus
gctggtctgccctgatgggaagaca

SEQ ID NO: 40515 - DNA, 25 bp, Mus musculus
gctggtgagtttgacccaatgatcc

SEQ ID NO: 40516 - DNA, 25 bp, Mus musculus
gctggtgcccttgaaggagaccatt

SEQ ID NO: 40517 - DNA, 25 bp, Mus musculus
gctggtggaagacattgccaagcaa

SEQ ID NO: 40518 - DNA, 25 bp, Mus musculus
gctggtggacaagaacatcttctcc

SEQ ID NO: 40519 - DNA, 25 bp, Mus musculus
gctggtggagtcttaccaccatgga

SEQ ID NO: 40520 - DNA, 25 bp, Mus musculus
gctggtggcaccactcagtgaggat

SEQ ID NO: 40521 - DNA, 25 bp, Mus musculus
gctggtggcattcttcaggaagaca

SEQ ID NO: 40522 - DNA, 25 bp, Mus musculus
gctggtgtcactgcaaaagaaactc

SEQ ID NO: 40523 - DNA, 25 bp, Mus musculus
gctggtgtctgaaaacagtcgagaa

SEQ ID NO: 40524 - DNA, 25 bp, Mus musculus
gctggtgttgtcaaataccgaggag

SEQ ID NO: 40525 - DNA, 25 bp, Mus musculus
gctggttacatgaaattaatagtca

SEQ ID NO: 40526 - DNA, 25 bp, Mus musculus
gctggttccgactcgtctttgcaga

SEQ ID NO: 40527 - DNA, 25 bp, Mus musculus
gctggttctccattaatcatgtcac

SEQ ID NO: 40528 - DNA, 25 bp, Mus musculus
gctggttgagtgaaatggatgtacc

SEQ ID NO: 40529 - DNA, 25 bp, Mus musculus
gctggttgctctcatcccttatgga

SEQ ID NO: 40530 - DNA, 25 bp, Mus musculus
gctggttggaagcttgtccaatgcc

SEQ ID NO: 40531 - DNA, 25 bp, Mus musculus
gctggtttggacaagatgtctaagg

SEQ ID NO: 40532 - DNA, 25 bp, Mus musculus
gctgtaaaatccagaatattagaag

SEQ ID NO: 40533 - DNA, 25 bp, Mus musculus
gctgtaacagtacaagctgggcatg

SEQ ID NO: 40534 - DNA, 25 bp, Mus musculus
gctgtaactgttctcatcgtaggat

SEQ ID NO: 40535 - DNA, 25 bp, Mus musculus
gctgtaatcaaactccgagagctaa

SEQ ID NO: 40536 - DNA, 25 bp, Mus musculus
gctgtacaaagaagttaaatagcta

SEQ ID NO: 40537 - DNA, 25 bp, Mus musculus
gctgtacagaagcagtgaacttggc

SEQ ID NO: 40538 - DNA, 25 bp, Mus musculus
gctgtacatctctttgtgctggtgt

SEQ ID NO: 40539 - DNA, 25 bp, Mus musculus
gctgtaccactgcagtctgcttcca

SEQ ID NO: 40540 - DNA, 25 bp, Mus musculus
gctgtaccccaaggaggacaaggaa

SEQ ID NO: 40541 - DNA, 25 bp, Mus musculus
gctgtaccgcagcacaactctttga

SEQ ID NO: 40542 - DNA, 25 bp, Mus musculus
gctgtacctgtcaaccaggctttgt

SEQ ID NO: 40543 - DNA, 25 bp, Mus musculus
gctgtacgggcagaccacaggaaag

SEQ ID NO: 40544 - DNA, 25 bp, Mus musculus
gctgtacggtgacatcgatgcttta

SEQ ID NO: 40545 - DNA, 25 bp, Mus musculus
gctgtacggtgagatcgatgcttta

SEQ ID NO: 40546 - DNA, 25 bp, Mus musculus
gctgtactgcagattgacaatgcca

SEQ ID NO: 40547 - DNA, 25 bp, Mus musculus
gctgtactgcctgaagatctatggc

SEQ ID NO: 40548 - DNA, 25 bp, Mus musculus
gctgtactgcgggagaaattctgag

SEQ ID NO: 40549 - DNA, 25 bp, Mus musculus
gctgtactggtcatgcaggatccta

SEQ ID NO: 40550 - DNA, 25 bp, Mus musculus
gctgtagaaattgaacctgagccag

SEQ ID NO: 40551 - DNA, 25 bp, Mus musculus
gctgtagacctcttccgtaatgcgg

SEQ ID NO: 40552 - DNA, 25 bp, Mus musculus
gctgtagatctctccgatccaacag

SEQ ID NO: 40553 - DNA, 25 bp, Mus musculus
gctgtagccggctcagatacacctg

SEQ ID NO: 40554 - DNA, 25 bp, Mus musculus
gctgtataatgtgttaagaagaggc

SEQ ID NO: 40555 - DNA, 25 bp, Mus musculus
gctgtatcctgctcggaggactctt

SEQ ID NO: 40556 - DNA, 25 bp, Mus musculus
gctgtatggactggcatcaggagta

SEQ ID NO: 40557 - DNA, 25 bp, Mus musculus
gctgtatgtctaggttgtgaggcca

SEQ ID NO: 40558 - DNA, 25 bp, Mus musculus
gctgtattcaagaatggtgtttctc

SEQ ID NO: 40559 - DNA, 25 bp, Mus musculus
gctgtatttctgtttccggatttaa

SEQ ID NO: 40560 - DNA, 25 bp, Mus musculus
gctgtcaaccctttctttggaaatc

SEQ ID NO: 40561 - DNA, 25 bp, Mus musculus
gctgtcaagaaacataacctaacta

SEQ ID NO: 40562 - DNA, 25 bp, Mus musculus
gctgtcaagaacaaggtaccacccc

SEQ ID NO: 40563 - DNA, 25 bp, Mus musculus
gctgtcaaggacagccattgtcctg

SEQ ID NO: 40564 - DNA, 25 bp, Mus musculus
gctgtcagatgtctttctgcttgac

SEQ ID NO: 40565 - DNA, 25 bp, Mus musculus
gctgtcagcagccatgtgtcctgca

SEQ ID NO: 40566 - DNA, 25 bp, Mus musculus
gctgtcaggaggatgaagtagcaca

SEQ ID NO: 40567 - DNA, 25 bp, Mus musculus
gctgtcaggttgtagctccgtcaga

SEQ ID NO: 40568 - DNA, 25 bp, Mus musculus
gctgtcatagcatctcctctcggag

SEQ ID NO: 40569 - DNA, 25 bp, Mus musculus
gctgtcatagtgctggccccaatgt

SEQ ID NO: 40570 - DNA, 25 bp, Mus musculus
gctgtcatcattggcatcaccataa

SEQ ID NO: 40571 - DNA, 25 bp, Mus musculus
gctgtcatctgcctgggagttcgct

SEQ ID NO: 40572 - DNA, 25 bp, Mus musculus
gctgtcatcttttgaaacggaattc

SEQ ID NO: 40573 - DNA, 25 bp, Mus musculus
gctgtcatggagtactagctactga

SEQ ID NO: 40574 - DNA, 25 bp, Mus musculus
gctgtcattgccgtcctggctctaa

SEQ ID NO: 40575 - DNA, 25 bp, Mus musculus
gctgtccacatctccctacgaagat

SEQ ID NO: 40576 - DNA, 25 bp, Mus musculus
gctgtccacatgagcgacacataca

SEQ ID NO: 40577 - DNA, 25 bp, Mus musculus
gctgtccacatggaaccacaagggt

SEQ ID NO: 40578 - DNA, 25 bp, Mus musculus
gctgtccactgccagcaggtcaaag

SEQ ID NO: 40579 - DNA, 25 bp, Mus musculus
gctgtccagcagtacctagaagaga

SEQ ID NO: 40580 - DNA, 25 bp, Mus musculus
gctgtccaggagaaaccagttgctt

SEQ ID NO: 40581 - DNA, 25 bp, Mus musculus
gctgtccaggtttattgctgctgga

SEQ ID NO: 40582 - DNA, 25 bp, Mus musculus
gctgtcccagaagcttgcccaggtt

SEQ ID NO: 40583 - DNA, 25 bp, Mus musculus
gctgtcccaggtgcagtgcctgatc

SEQ ID NO: 40584 - DNA, 25 bp, Mus musculus
gctgtccgtgatgctggctatgaaa

SEQ ID NO: 40585 - DNA, 25 bp, Mus musculus
gctgtcctcacctggaacaatgaga

SEQ ID NO: 40586 - DNA, 25 bp, Mus musculus
gctgtcctcactagacaccctagaa

SEQ ID NO: 40587 - DNA, 25 bp, Mus musculus
gctgtcctgcacatgccaggtgctt

SEQ ID NO: 40588 - DNA, 25 bp, Mus musculus
gctgtccttcactgggagcactcag

SEQ ID NO: 40589 - DNA, 25 bp, Mus musculus
gctgtccttgtatgtagctgatgag

SEQ ID NO: 40590 - DNA, 25 bp, Mus musculus
gctgtctattacagggtgtgtcccc

SEQ ID NO: 40591 - DNA, 25 bp, Mus musculus
gctgtctcctatgtccgagatgatg

SEQ ID NO: 40592 - DNA, 25 bp, Mus musculus
gctgtctctcccttcgggatgttgg

SEQ ID NO: 40593 - DNA, 25 bp, Mus musculus
gctgtctgactatgaagtatgcaaa

SEQ ID NO: 40594 - DNA, 25 bp, Mus musculus
gctgtctgcagagcgcctcagcaga

SEQ ID NO: 40595 - DNA, 25 bp, Mus musculus
gctgtctgcgcaggacctcagggac

SEQ ID NO: 40596 - DNA, 25 bp, Mus musculus
gctgtctggcaactatttcctgctg

SEQ ID NO: 40597 - DNA, 25 bp, Mus musculus
gctgtctgtgtgagactggcttcca

SEQ ID NO: 40598 - DNA, 25 bp, Mus musculus
gctgtctgtgtgtgactggcttcca

SEQ ID NO: 40599 - DNA, 25 bp, Mus musculus
gctgtcttcaaccaccaagggaatt

SEQ ID NO: 40600 - DNA, 25 bp, Mus musculus
gctgtcttcaatcacttcatcagtg

SEQ ID NO: 40601 - DNA, 25 bp, Mus musculus
gctgtcttccctcagatactaaagg

SEQ ID NO: 40602 - DNA, 25 bp, Mus musculus
gctgtcttcttcaggaaagcctgga

SEQ ID NO: 40603 - DNA, 25 bp, Mus musculus
gctgtcttggaaagaattagccgat

SEQ ID NO: 40604 - DNA, 25 bp, Mus musculus
gctgtgaagcctccagcaaacaagt

SEQ ID NO: 40605 - DNA, 25 bp, Mus musculus
gctgtgaaggccactctggtgctct

SEQ ID NO: 40606 - DNA, 25 bp, Mus musculus
gctgtgaatcccgagctcttcatta

SEQ ID NO: 40607 - DNA, 25 bp, Mus musculus
gctgtgaatggttaaaagagatttc

SEQ ID NO: 40608 - DNA, 25 bp, Mus musculus
gctgtgaattccatgttttcactgg

SEQ ID NO: 40609 - DNA, 25 bp, Mus musculus
gctgtgaccactgaatcacattgga

SEQ ID NO: 40610 - DNA, 25 bp, Mus musculus
gctgtgacccgtatgggcatatatg

SEQ ID NO: 40611 - DNA, 25 bp, Mus musculus
gctgtgacctcgatctttaagaacc

SEQ ID NO: 40612 - DNA, 25 bp, Mus musculus
gctgtgacgccctcgctgcaggagc

SEQ ID NO: 40613 - DNA, 25 bp, Mus musculus
gctgtgagcacttctctcagtggag

SEQ ID NO: 40614 - DNA, 25 bp, Mus musculus
gctgtgagcgcctgctttggactca

SEQ ID NO: 40615 - DNA, 25 bp, Mus musculus
gctgtgaggagaacattcaagacag

SEQ ID NO: 40616 - DNA, 25 bp, Mus musculus
gctgtgagtgatcgcagtcctgccc

SEQ ID NO: 40617 - DNA, 25 bp, Mus musculus
gctgtgatcaacattcagagtcgat

SEQ ID NO: 40618 - DNA, 25 bp, Mus musculus
gctgtgattcctaccgaagctgcca

SEQ ID NO: 40619 - DNA, 25 bp, Mus musculus
gctgtgcaaggtgtgatcaggccca

SEQ ID NO: 40620 - DNA, 25 bp, Mus musculus
gctgtgcacttcacccaggacgagt

SEQ ID NO: 40621 - DNA, 25 bp, Mus musculus
gctgtgcatagccaagacgttctcc

SEQ ID NO: 40622 - DNA, 25 bp, Mus musculus
gctgtgcatccaaagtaccaagaga

SEQ ID NO: 40623 - DNA, 25 bp, Mus musculus
gctgtgccaagctccacagccagcg

SEQ ID NO: 40624 - DNA, 25 bp, Mus musculus
gctgtgccaggctgacttctagagt

SEQ ID NO: 40625 - DNA, 25 bp, Mus musculus
gctgtgccaggctttgcataaacca

SEQ ID NO: 40626 - DNA, 25 bp, Mus musculus
gctgtgccccaagactgggacgttt

SEQ ID NO: 40627 - DNA, 25 bp, Mus musculus
gctgtgcgcaggaactcctgttctt

SEQ ID NO: 40628 - DNA, 25 bp, Mus musculus
gctgtgcggaaagttgtgacttcct

SEQ ID NO: 40629 - DNA, 25 bp, Mus musculus
gctgtgcggttctctgaagaggaat

SEQ ID NO: 40630 - DNA, 25 bp, Mus musculus
gctgtgcgtctccatgtccgggtta

SEQ ID NO: 40631 - DNA, 25 bp, Mus musculus
gctgtgctcctatctagaagtggct

SEQ ID NO: 40632 - DNA, 25 bp, Mus musculus
gctgtgctgactgaagccatgctgg

SEQ ID NO: 40633 - DNA, 25 bp, Mus musculus
gctgtgctggctgctaaaggataaa

SEQ ID NO: 40634 - DNA, 25 bp, Mus musculus
gctgtgctggtcacagccactctct

SEQ ID NO: 40635 - DNA, 25 bp, Mus musculus
gctgtgctgtatgccaaggctctgg

SEQ ID NO: 40636 - DNA, 25 bp, Mus musculus
gctgtgctgtcatcaggttctggcg

SEQ ID NO: 40637 - DNA, 25 bp, Mus musculus
gctgtgcttctcactacgctacgtg

SEQ ID NO: 40638 - DNA, 25 bp, Mus musculus
gctgtggaaaagtcacacaactatg

SEQ ID NO: 40639 - DNA, 25 bp, Mus musculus
gctgtggaattacgtccctggactc

SEQ ID NO: 40640 - DNA, 25 bp, Mus musculus
gctgtggacatcgagcatgcggaca

SEQ ID NO: 40641 - DNA, 25 bp, Mus musculus
gctgtggactcctatttctggcgat

SEQ ID NO: 40642 - DNA, 25 bp, Mus musculus
gctgtggagaacaacactctaagca

SEQ ID NO: 40643 - DNA, 25 bp, Mus musculus
gctgtggagagttgctcagaagtca

SEQ ID NO: 40644 - DNA, 25 bp, Mus musculus
gctgtggcagtattcaggaccggcc

SEQ ID NO: 40645 - DNA, 25 bp, Mus musculus
gctgtggcagtttcctcaaatggtc

SEQ ID NO: 40646 - DNA, 25 bp, Mus musculus
gctgtggcatgtttatttctactga

SEQ ID NO: 40647 - DNA, 25 bp, Mus musculus
gctgtggccactggaagactctcag

SEQ ID NO: 40648 - DNA, 25 bp, Mus musculus
gctgtggccctgagaaagatcacgt

SEQ ID NO: 40649 - DNA, 25 bp, Mus musculus
gctgtggccgatcccatacctgctg

SEQ ID NO: 40650 - DNA, 25 bp, Mus musculus
gctgtggccgtcaacccttgtgatg

SEQ ID NO: 40651 - DNA, 25 bp, Mus musculus
gctgtggctggtcatgaaattacta

SEQ ID NO: 40652 - DNA, 25 bp, Mus musculus
gctgtggtacccaaggaccttcgaa

SEQ ID NO: 40653 - DNA, 25 bp, Mus musculus
gctgtggtagctccgcacccagatg

SEQ ID NO: 40654 - DNA, 25 bp, Mus musculus
gctgtggtccatggaaaaagcttga

SEQ ID NO: 40655 - DNA, 25 bp, Mus musculus
gctgtggtcggagaatctctgagac

SEQ ID NO: 40656 - DNA, 25 bp, Mus musculus
gctgtggttttgtgcatcagttgaa

SEQ ID NO: 40657 - DNA, 25 bp, Mus musculus
gctgtgtaccgcttcaccaaatatc

SEQ ID NO: 40658 - DNA, 25 bp, Mus musculus
gctgtgtcacattccctgtgttaca

SEQ ID NO: 40659 - DNA, 25 bp, Mus musculus
gctgtgtcccgggatgagttcttat

SEQ ID NO: 40660 - DNA, 25 bp, Mus musculus
gctgtgtctacaaaatggaagattt

SEQ ID NO: 40661 - DNA, 25 bp, Mus musculus
gctgtgtgaatgagcgccttgccga

SEQ ID NO: 40662 - DNA, 25 bp, Mus musculus
gctgtgtgagttgctgaagtatgca

SEQ ID NO: 40663 - DNA, 25 bp, Mus musculus
gctgtgttcacgctgcctcagtttc

SEQ ID NO: 40664 - DNA, 25 bp, Mus musculus
gctgtgttcacggtgcctcagtttc

SEQ ID NO: 40665 - DNA, 25 bp, Mus musculus
gctgtgttggaggatacattgccag

SEQ ID NO: 40666 - DNA, 25 bp, Mus musculus
gctgtgtttggtggaatctattgtc

SEQ ID NO: 40667 - DNA, 25 bp, Mus musculus
gctgttaaagtgtcatctgacaaca

SEQ ID NO: 40668 - DNA, 25 bp, Mus musculus
gctgttaactactttgatttcttgg

SEQ ID NO: 40669 - DNA, 25 bp, Mus musculus
gctgttaccatcagcttgagtctcc

SEQ ID NO: 40670 - DNA, 25 bp, Mus musculus
gctgttatcaatcggatgaggagcc

SEQ ID NO: 40671 - DNA, 25 bp, Mus musculus
gctgttcaagtctctaagcttgtgg

SEQ ID NO: 40672 - DNA, 25 bp, Mus musculus
gctgttcattgttgtagacaaggaa

SEQ ID NO: 40673 - DNA, 25 bp, Mus musculus
gctgttccgacattactacgtcatg

SEQ ID NO: 40674 - DNA, 25 bp, Mus musculus
gctgttccgtaatctcaccccaaga

SEQ ID NO: 40675 - DNA, 25 bp, Mus musculus
gctgttcctatcaagatgggagctc

SEQ ID NO: 40676 - DNA, 25 bp, Mus musculus
gctgttcctgcccaagagtgtatct

SEQ ID NO: 40677 - DNA, 25 bp, Mus musculus
gctgttcgactctcctgtgccaaat

SEQ ID NO: 40678 - DNA, 25 bp, Mus musculus
gctgttctggctgaggccatctatg

SEQ ID NO: 40679 - DNA, 25 bp, Mus musculus
gctgttcttcgagtggctgggcctt

SEQ ID NO: 40680 - DNA, 25 bp, Mus musculus
gctgttcttgtgtcttctgcggcga

SEQ ID NO: 40681 - DNA, 25 bp, Mus musculus
gctgttgaaacaggaacaatctctt

SEQ ID NO: 40682 - DNA, 25 bp, Mus musculus
gctgttgagttaacccaacttaaag

SEQ ID NO: 40683 - DNA, 25 bp, Mus musculus
gctgttgagttatcccaacttaaag

SEQ ID NO: 40684 - DNA, 25 bp, Mus musculus
gctgttgccaagtgtttgccgccat

SEQ ID NO: 40685 - DNA, 25 bp, Mus musculus
gctgttgggcctgttggaaacttca

SEQ ID NO: 40686 - DNA, 25 bp, Mus musculus
gctgttggtagtaagtccgggtata

SEQ ID NO: 40687 - DNA, 25 bp, Mus musculus
gctgttggtgtgcagcaactacacc

SEQ ID NO: 40688 - DNA, 25 bp, Mus musculus
gctgttgtagtctccggtgcaggaa

SEQ ID NO: 40689 - DNA, 25 bp, Mus musculus
gctgttgtcatagggctgagcccta

SEQ ID NO: 40690 - DNA, 25 bp, Mus musculus
gctgttgtctctaaggccgccattt

SEQ ID NO: 40691 - DNA, 25 bp, Mus musculus
gctgtttaaaactacagttcctctt

SEQ ID NO: 40692 - DNA, 25 bp, Mus musculus
gctgtttacatcatttgctaaagta

SEQ ID NO: 40693 - DNA, 25 bp, Mus musculus
gctgtttcatgatgacacccactca

SEQ ID NO: 40694 - DNA, 25 bp, Mus musculus
gctgtttccacagcttccaggaaga

SEQ ID NO: 40695 - DNA, 25 bp, Mus musculus
gctgtttcctctgggactataacct

SEQ ID NO: 40696 - DNA, 25 bp, Mus musculus
gctgtttcctgtggcctataacctc

SEQ ID NO: 40697 - DNA, 25 bp, Mus musculus
gctgtttctacaggggcgtctgcta

SEQ ID NO: 40698 - DNA, 25 bp, Mus musculus
gctgtttctataggtccaacgtcgg

SEQ ID NO: 40699 - DNA, 25 bp, Mus musculus
gctgtttgaagagcttgtgcgagcc

SEQ ID NO: 40700 - DNA, 25 bp, Mus musculus
gctgtttgaagtggagaaaatagat

SEQ ID NO: 40701 - DNA, 25 bp, Mus musculus
gctgttttagagacaagcactccag

SEQ ID NO: 40702 - DNA, 25 bp, Mus musculus
gcttaaaatcccttggccctgagaa

SEQ ID NO: 40703 - DNA, 25 bp, Mus musculus
gcttaacaacattgggctatccgag

SEQ ID NO: 40704 - DNA, 25 bp, Mus musculus
gcttaagagatttggaactgtttgg

SEQ ID NO: 40705 - DNA, 25 bp, Mus musculus
gcttaagcaggtagtgccaggacat

SEQ ID NO: 40706 - DNA, 25 bp, Mus musculus
gcttaaggaactttccaggaagcca

SEQ ID NO: 40707 - DNA, 25 bp, Mus musculus
gcttaaggctccttgctttgggaca

SEQ ID NO: 40708 - DNA, 25 bp, Mus musculus
gcttaagtgggactcactccagtaa

SEQ ID NO: 40709 - DNA, 25 bp, Mus musculus
gcttaatatggcctatggcgtaaag

SEQ ID NO: 40710 - DNA, 25 bp, Mus musculus
gcttaattaacctcctactgacggg

SEQ ID NO: 40711 - DNA, 25 bp, Mus musculus
gcttacaagacagtgacagacatgg

SEQ ID NO: 40712 - DNA, 25 bp, Mus musculus
gcttacaattacttttcggattatc

SEQ ID NO: 40713 - DNA, 25 bp, Mus musculus
gcttacacgttttagccattcaagg

SEQ ID NO: 40714 - DNA, 25 bp, Mus musculus
gcttacagtccaagccgaatgtccc

SEQ ID NO: 40715 - DNA, 25 bp, Mus musculus
gcttacattttcagtgaatgtcaca

SEQ ID NO: 40716 - DNA, 25 bp, Mus musculus
gcttacattttctgtgaatgtcaca

SEQ ID NO: 40717 - DNA, 25 bp, Mus musculus
gcttaccagccctatggagtatcca

SEQ ID NO: 40718 - DNA, 25 bp, Mus musculus
gcttacctctagatacactacttgt

SEQ ID NO: 40719 - DNA, 25 bp, Mus musculus
gcttactaattgcttatcagatgcc

SEQ ID NO: 40720 - DNA, 25 bp, Mus musculus
gcttactaattggttatcagatgcc

SEQ ID NO: 40721 - DNA, 25 bp, Mus musculus
gcttacttagacatcttggacactg

SEQ ID NO: 40722 - DNA, 25 bp, Mus musculus
gcttagaaaatctacagagggtcct

SEQ ID NO: 40723 - DNA, 25 bp, Mus musculus
gcttagaacaaaactgcttccgttc

SEQ ID NO: 40724 - DNA, 25 bp, Mus musculus
gcttagatatttgttagagtctaaa

SEQ ID NO: 40725 - DNA, 25 bp, Mus musculus
gcttagcaggcaaggctatagctcc

SEQ ID NO: 40726 - DNA, 25 bp, Mus musculus
gcttagcggcagttgtggcctcctg

SEQ ID NO: 40727 - DNA, 25 bp, Mus musculus
gcttagctggtgaatgaaggatgac

SEQ ID NO: 40728 - DNA, 25 bp, Mus musculus
gcttagcttcattgtagagatactt

SEQ ID NO: 40729 - DNA, 25 bp, Mus musculus
gcttaggagtctaccagacagagtc

SEQ ID NO: 40730 - DNA, 25 bp, Mus musculus
gcttagtaaccatcccagtgcaggg

SEQ ID NO: 40731 - DNA, 25 bp, Mus musculus
gcttataaaacccaggtgaggattg

SEQ ID NO: 40732 - DNA, 25 bp, Mus musculus
gcttataaacaacaggcttcttgca

SEQ ID NO: 40733 - DNA, 25 bp, Mus musculus
gcttataaatgcctttgctcctgcc

SEQ ID NO: 40734 - DNA, 25 bp, Mus musculus
gcttataatatctggcatggattcc

SEQ ID NO: 40735 - DNA, 25 bp, Mus musculus
gcttatacgatgaaaatattgtacg

SEQ ID NO: 40736 - DNA, 25 bp, Mus musculus
gcttatcaaaacactgtgtcatgta

SEQ ID NO: 40737 - DNA, 25 bp, Mus musculus
gcttatcaaaactctgtgtcatgta

SEQ ID NO: 40738 - DNA, 25 bp, Mus musculus
gcttatccgctggaggtgaccaaac

SEQ ID NO: 40739 - DNA, 25 bp, Mus musculus
gcttatcctgcccaccaggattatc

SEQ ID NO: 40740 - DNA, 25 bp, Mus musculus
gcttatcgacctcaacagcctgttg

SEQ ID NO: 40741 - DNA, 25 bp, Mus musculus
gcttatctcattaacaggatgccaa

SEQ ID NO: 40742 - DNA, 25 bp, Mus musculus
gcttatcttcttctacatttttgct

SEQ ID NO: 40743 - DNA, 25 bp, Mus musculus
gcttatgctgttcgaggcaataaat

SEQ ID NO: 40744 - DNA, 25 bp, Mus musculus
gcttatgtcagagacttgaggcttc

SEQ ID NO: 40745 - DNA, 25 bp, Mus musculus
gcttattcccgggaaaagcgcgagt

SEQ ID NO: 40746 - DNA, 25 bp, Mus musculus
gcttattgtaacttggctcattgcc

SEQ ID NO: 40747 - DNA, 25 bp, Mus musculus
gcttatttcagaagtctagggagaa

SEQ ID NO: 40748 - DNA, 25 bp, Mus musculus
gcttcaaaaagtactgttggtgtta

SEQ ID NO: 40749 - DNA, 25 bp, Mus musculus
gcttcaaaaagttctgttggtgtta

SEQ ID NO: 40750 - DNA, 25 bp, Mus musculus
gcttcaaaacaaacccttgtggctc

SEQ ID NO: 40751 - DNA, 25 bp, Mus musculus
gcttcaacaagcaagagtttggctg

SEQ ID NO: 40752 - DNA, 25 bp, Mus musculus
gcttcaagaaacagtcgtttgtctt

SEQ ID NO: 40753 - DNA, 25 bp, Mus musculus
gcttcaagaaagaagtttgtagagg

SEQ ID NO: 40754 - DNA, 25 bp, Mus musculus
gcttcaagaccttcgagggcatcta

SEQ ID NO: 40755 - DNA, 25 bp, Mus musculus
gcttcaagagacgtaagtcctccaa

SEQ ID NO: 40756 - DNA, 25 bp, Mus musculus
gcttcaagcagttggacactacact

SEQ ID NO: 40757 - DNA, 25 bp, Mus musculus
gcttcacaggagtgaataagcactg

SEQ ID NO: 40758 - DNA, 25 bp, Mus musculus
gcttcaccacagcagcatacctgcg

SEQ ID NO: 40759 - DNA, 25 bp, Mus musculus
gcttcaccaggccaccgaagagcag

SEQ ID NO: 40760 - DNA, 25 bp, Mus musculus
gcttcaccctgccttttcgtggctg

SEQ ID NO: 40761 - DNA, 25 bp, Mus musculus
gcttcacgcagctggacgactctgt

SEQ ID NO: 40762 - DNA, 25 bp, Mus musculus
gcttcacgctgcagggcttggctaa

SEQ ID NO: 40763 - DNA, 25 bp, Mus musculus
gcttcacggtctttgacaacgggca

SEQ ID NO: 40764 - DNA, 25 bp, Mus musculus
gcttcactgggatgcgtgctcacct

SEQ ID NO: 40765 - DNA, 25 bp, Mus musculus
gcttcagaattagccattgctgcca

SEQ ID NO: 40766 - DNA, 25 bp, Mus musculus
gcttcagacatttcagaggacaggc

SEQ ID NO: 40767 - DNA, 25 bp, Mus musculus
gcttcagagacagtttaagtacaac

SEQ ID NO: 40768 - DNA, 25 bp, Mus musculus
gcttcagagagcctgggccccactg

SEQ ID NO: 40769 - DNA, 25 bp, Mus musculus
gcttcagcagataatgcgtctgacg

SEQ ID NO: 40770 - DNA, 25 bp, Mus musculus
gcttcagccatacgccgtggactta

SEQ ID NO: 40771 - DNA, 25 bp, Mus musculus
gcttcagccataggccgtggactta

SEQ ID NO: 40772 - DNA, 25 bp, Mus musculus
gcttcagcccagcatacagactgct

SEQ ID NO: 40773 - DNA, 25 bp, Mus musculus
gcttcagccctggtacccgatagag

SEQ ID NO: 40774 - DNA, 25 bp, Mus musculus
gcttcaggacatgtgtgggctacct

SEQ ID NO: 40775 - DNA, 25 bp, Mus musculus
gcttcaggcagtatgtgtcacacag

SEQ ID NO: 40776 - DNA, 25 bp, Mus musculus
gcttcagtgaccagtaaaaacctgc

SEQ ID NO: 40777 - DNA, 25 bp, Mus musculus
gcttcagtgatgtccgcacaggcca

SEQ ID NO: 40778 - DNA, 25 bp, Mus musculus
gcttcagtgctttgccagagtgatg

SEQ ID NO: 40779 - DNA, 25 bp, Mus musculus
gcttcagtggacataccacaccttc

SEQ ID NO: 40780 - DNA, 25 bp, Mus musculus
gcttcatatggctgagaagactaaa

SEQ ID NO: 40781 - DNA, 25 bp, Mus musculus
gcttcatcaagcatgtcaggccatc

SEQ ID NO: 40782 - DNA, 25 bp, Mus musculus
gcttcatctgcctggtcttggtcac

SEQ ID NO: 40783 - DNA, 25 bp, Mus musculus
gcttcatgaggctcgttttaagaaa

SEQ ID NO: 40784 - DNA, 25 bp, Mus musculus
gcttcatggaatagccaatgaagac

SEQ ID NO: 40785 - DNA, 25 bp, Mus musculus
gcttcatggaattgccaatgaagac

SEQ ID NO: 40786 - DNA, 25 bp, Mus musculus
gcttcatgttgtgctgatgctggtc

SEQ ID NO: 40787 - DNA, 25 bp, Mus musculus
gcttccaaagtgatggtgcagtgca

SEQ ID NO: 40788 - DNA, 25 bp, Mus musculus
gcttccaagcagcatcggctgaaac

SEQ ID NO: 40789 - DNA, 25 bp, Mus musculus
gcttccaatctcctgtaatcctaaa

SEQ ID NO: 40790 - DNA, 25 bp, Mus musculus
gcttccagaaatcctgcagaattct

SEQ ID NO: 40791 - DNA, 25 bp, Mus musculus
gcttccagaattgtgtttgagagga

SEQ ID NO: 40792 - DNA, 25 bp, Mus musculus
gcttccagactgtaacataagtcac

SEQ ID NO: 40793 - DNA, 25 bp, Mus musculus
gcttccagagctcggccaacagcta

SEQ ID NO: 40794 - DNA, 25 bp, Mus musculus
gcttccagagctgggccaacagcta

SEQ ID NO: 40795 - DNA, 25 bp, Mus musculus
gcttccagctaaggacgctacactg

SEQ ID NO: 40796 - DNA, 25 bp, Mus musculus
gcttccagctggacaatggcaccat

SEQ ID NO: 40797 - DNA, 25 bp, Mus musculus
gcttccagctggtcaatggcaccat

SEQ ID NO: 40798 - DNA, 25 bp, Mus musculus
gcttccaggatgagctccctaacag

SEQ ID NO: 40799 - DNA, 25 bp, Mus musculus
gcttccaggtatccagccttggctg

SEQ ID NO: 40800 - DNA, 25 bp, Mus musculus
gcttccagtagaacgatagctccct

SEQ ID NO: 40801 - DNA, 25 bp, Mus musculus
gcttccataagacagcatctggcat

SEQ ID NO: 40802 - DNA, 25 bp, Mus musculus
gcttccattctaaaggtgccaggaa

SEQ ID NO: 40803 - DNA, 25 bp, Mus musculus
gcttcccagccgtggactgctgtct

SEQ ID NO: 40804 - DNA, 25 bp, Mus musculus
gcttcccagcgagaaggatggaaag

SEQ ID NO: 40805 - DNA, 25 bp, Mus musculus
gcttcccatgtggaggtcaacccag

SEQ ID NO: 40806 - DNA, 25 bp, Mus musculus
gcttccctgcttctggaatgtgcag

SEQ ID NO: 40807 - DNA, 25 bp, Mus musculus
gcttccctgcttgtggaatgtgcag

SEQ ID NO: 40808 - DNA, 25 bp, Mus musculus
gcttccctggccatgcgtggtttag

SEQ ID NO: 40809 - DNA, 25 bp, Mus musculus
gcttccctggttgtaaacgtggcta

SEQ ID NO: 40810 - DNA, 25 bp, Mus musculus
gcttcccttgggtggccttctttgc

SEQ ID NO: 40811 - DNA, 25 bp, Mus musculus
gcttcccttgtgagtcaggattatg

SEQ ID NO: 40812 - DNA, 25 bp, Mus musculus
gcttccggtaagtgcgagcagcacc

SEQ ID NO: 40813 - DNA, 25 bp, Mus musculus
gcttccggtgaagaatgaatacccc

SEQ ID NO: 40814 - DNA, 25 bp, Mus musculus
gcttccgttccaaaaagatggcatc

SEQ ID NO: 40815 - DNA, 25 bp, Mus musculus
gcttcctaccttagagagttgggtg

SEQ ID NO: 40816 - DNA, 25 bp, Mus musculus
gcttcctataactcaccaattgggc

SEQ ID NO: 40817 - DNA, 25 bp, Mus musculus
gcttcctcagcatggtgaacactga

SEQ ID NO: 40818 - DNA, 25 bp, Mus musculus
gcttcctcagggagaacaagtttga

SEQ ID NO: 40819 - DNA, 25 bp, Mus musculus
gcttcctctaccatctgggagataa

SEQ ID NO: 40820 - DNA, 25 bp, Mus musculus
gcttcctgatttcaatgcactagac

SEQ ID NO: 40821 - DNA, 25 bp, Mus musculus
gcttcctgcaggtcttctctgtgaa

SEQ ID NO: 40822 - DNA, 25 bp, Mus musculus
gcttcctgctcctgttttccaacat

SEQ ID NO: 40823 - DNA, 25 bp, Mus musculus
gcttcctggaaacatacgttgttgc

SEQ ID NO: 40824 - DNA, 25 bp, Mus musculus
gcttcctggatgtaagcacaggatt

SEQ ID NO: 40825 - DNA, 25 bp, Mus musculus
gcttcctggtacttgtcaaacccaa

SEQ ID NO: 40826 - DNA, 25 bp, Mus musculus
gcttccttcagtggtgttggtagta

SEQ ID NO: 40827 - DNA, 25 bp, Mus musculus
gcttccttggcctttatacccttgg

SEQ ID NO: 40828 - DNA, 25 bp, Mus musculus
gcttcctttgggtggaagaggagaa

SEQ ID NO: 40829 - DNA, 25 bp, Mus musculus
gcttcgaagtgaactagaaagagag

SEQ ID NO: 40830 - DNA, 25 bp, Mus musculus
gcttcgacgggctgctaggctttcc

SEQ ID NO: 40831 - DNA, 25 bp, Mus musculus
gcttcgagacctggttacccagcag

SEQ ID NO: 40832 - DNA, 25 bp, Mus musculus
gcttcgagatgtcattgcccagtgt

SEQ ID NO: 40833 - DNA, 25 bp, Mus musculus
gcttcgagattcctacactgcactg

SEQ ID NO: 40834 - DNA, 25 bp, Mus musculus
gcttcgagtgtgtcatggccagctc

SEQ ID NO: 40835 - DNA, 25 bp, Mus musculus
gcttcgcagaatccgggctgaatct

SEQ ID NO: 40836 - DNA, 25 bp, Mus musculus
gcttcgctttgttcacgaggcacca

SEQ ID NO: 40837 - DNA, 25 bp, Mus musculus
gcttcggaattcactgcggcccagc

SEQ ID NO: 40838 - DNA, 25 bp, Mus musculus
gcttcggaattctctgcggcccagc

SEQ ID NO: 40839 - DNA, 25 bp, Mus musculus
gcttcggacgtcaaggtattgccat

SEQ ID NO: 40840 - DNA, 25 bp, Mus musculus
gcttcgggacctccacatttcagaa

SEQ ID NO: 40841 - DNA, 25 bp, Mus musculus
gcttcgggacctgcacatttcagaa

SEQ ID NO: 40842 - DNA, 25 bp, Mus musculus
gcttcgtccacaaaagcggaaaaag

SEQ ID NO: 40843 - DNA, 25 bp, Mus musculus
gcttcgtcgacacagtacttctggt

SEQ ID NO: 40844 - DNA, 25 bp, Mus musculus
gcttcgtggtcacactgtgatcctg

SEQ ID NO: 40845 - DNA, 25 bp, Mus musculus
gcttcgtggtgccactcagcaaatt

SEQ ID NO: 40846 - DNA, 25 bp, Mus musculus
gcttcgtgtctgacaagagacccca

SEQ ID NO: 40847 - DNA, 25 bp, Mus musculus
gcttctaaacctactggtcccagag

SEQ ID NO: 40848 - DNA, 25 bp, Mus musculus
gcttctaaagccagggatggtgcca

SEQ ID NO: 40849 - DNA, 25 bp, Mus musculus
gcttctactgggaggaccggctgct

SEQ ID NO: 40850 - DNA, 25 bp, Mus musculus
gcttctatacttccctaggcggtca

SEQ ID NO: 40851 - DNA, 25 bp, Mus musculus
gcttctatattaccatggaggagta

SEQ ID NO: 40852 - DNA, 25 bp, Mus musculus
gcttctatgccttatacacaacctt

SEQ ID NO: 40853 - DNA, 25 bp, Mus musculus
gcttctatggcagctggtaaatggg

SEQ ID NO: 40854 - DNA, 25 bp, Mus musculus
gcttctattgccaacattgttaaaa

SEQ ID NO: 40855 - DNA, 25 bp, Mus musculus
gcttctatttctggaggcctgggat

SEQ ID NO: 40856 - DNA, 25 bp, Mus musculus
gcttctcaacttggaggagtactac

SEQ ID NO: 40857 - DNA, 25 bp, Mus musculus
gcttctccagaaaaagttacataag

SEQ ID NO: 40858 - DNA, 25 bp, Mus musculus
gcttctcccttttctggatgctgga

SEQ ID NO: 40859 - DNA, 25 bp, Mus musculus
gcttctcgcctgacagcctggcgag

SEQ ID NO: 40860 - DNA, 25 bp, Mus musculus
gcttctctgcctcaccgattttctg

SEQ ID NO: 40861 - DNA, 25 bp, Mus musculus
gcttctctggaaaactatgctcctc

SEQ ID NO: 40862 - DNA, 25 bp, Mus musculus
gcttctctgtgtctaccatgcacca

SEQ ID NO: 40863 - DNA, 25 bp, Mus musculus
gcttctgaagaaaatctcctcagag

SEQ ID NO: 40864 - DNA, 25 bp, Mus musculus
gcttctgaatgaaagcgggcctgct

SEQ ID NO: 40865 - DNA, 25 bp, Mus musculus
gcttctgaccccatgccagtgttgt

SEQ ID NO: 40866 - DNA, 25 bp, Mus musculus
gcttctgacgaagacgagcgcttgt

SEQ ID NO: 40867 - DNA, 25 bp, Mus musculus
gcttctgctacgctgtcgacactgg

SEQ ID NO: 40868 - DNA, 25 bp, Mus musculus
gcttctgctatatcatcagattcca

SEQ ID NO: 40869 - DNA, 25 bp, Mus musculus
gcttctggaagatgattggactgga

SEQ ID NO: 40870 - DNA, 25 bp, Mus musculus
gcttctggacaaccttcggaagatg

SEQ ID NO: 40871 - DNA, 25 bp, Mus musculus
gcttctggacaagcttcggaagatg

SEQ ID NO: 40872 - DNA, 25 bp, Mus musculus
gcttctggactacagcctgcacaag

SEQ ID NO: 40873 - DNA, 25 bp, Mus musculus
gcttctggtgaaattgcattatgca

SEQ ID NO: 40874 - DNA, 25 bp, Mus musculus
gcttctggtgaatttgcattatgca

SEQ ID NO: 40875 - DNA, 25 bp, Mus musculus
gcttctggtgagcactggagccatc

SEQ ID NO: 40876 - DNA, 25 bp, Mus musculus
gcttctgtggcctccagattgcgac

SEQ ID NO: 40877 - DNA, 25 bp, Mus musculus
gcttctgttctcctccgagaagtcg

SEQ ID NO: 40878 - DNA, 25 bp, Mus musculus
gcttcttaccgcacagctctgaaac

SEQ ID NO: 40879 - DNA, 25 bp, Mus musculus
gcttcttattggagaggcttcattt

SEQ ID NO: 40880 - DNA, 25 bp, Mus musculus
gcttcttcagagtttgctacttctc

SEQ ID NO: 40881 - DNA, 25 bp, Mus musculus
gcttcttcagatggcgcaagtctca

SEQ ID NO: 40882 - DNA, 25 bp, Mus musculus
gcttctttgagtaccgagcgtacag

SEQ ID NO: 40883 - DNA, 25 bp, Mus musculus
gcttctttttcaacatgctcttcgt

SEQ ID NO: 40884 - DNA, 25 bp, Mus musculus
gcttgaaaacttcaagaacagtcta

SEQ ID NO: 40885 - DNA, 25 bp, Mus musculus
gcttgaagaagaattgaaaacggtg

SEQ ID NO: 40886 - DNA, 25 bp, Mus musculus
gcttgaagcctatgagcccgtgtgt

SEQ ID NO: 40887 - DNA, 25 bp, Mus musculus
gcttgaaggaggctgcaactatgac

SEQ ID NO: 40888 - DNA, 25 bp, Mus musculus
gcttgaaggagtctacagagaatta

SEQ ID NO: 40889 - DNA, 25 bp, Mus musculus
gcttgaagtcgcaagtctcctgctg

SEQ ID NO: 40890 - DNA, 25 bp, Mus musculus
gcttgaatcaacaagatttgtgact

SEQ ID NO: 40891 - DNA, 25 bp, Mus musculus
gcttgacaaagtcagcattgttcaa

SEQ ID NO: 40892 - DNA, 25 bp, Mus musculus
gcttgacaacgcacccctttatcag

SEQ ID NO: 40893 - DNA, 25 bp, Mus musculus
gcttgacaacgctcccctttatcag

SEQ ID NO: 40894 - DNA, 25 bp, Mus musculus
gcttgacaactgaacttggaataaa

SEQ ID NO: 40895 - DNA, 25 bp, Mus musculus
gcttgacaactgtacttggaataaa

SEQ ID NO: 40896 - DNA, 25 bp, Mus musculus
gcttgacaagaacaaactacaggcg

SEQ ID NO: 40897 - DNA, 25 bp, Mus musculus
gcttgaccagaaacagcagtcgtca

SEQ ID NO: 40898 - DNA, 25 bp, Mus musculus
gcttgacgggccaagacaatgacat

SEQ ID NO: 40899 - DNA, 25 bp, Mus musculus
gcttgactcgactgaaattgagaca

SEQ ID NO: 40900 - DNA, 25 bp, Mus musculus
gcttgactgcctgccataacggtgg

SEQ ID NO: 40901 - DNA, 25 bp, Mus musculus
gcttgactgctgtcttttctcagac

SEQ ID NO: 40902 - DNA, 25 bp, Mus musculus
gcttgagaaggccaacctcctggac

SEQ ID NO: 40903 - DNA, 25 bp, Mus musculus
gcttgagactctgctgtcctctgca

SEQ ID NO: 40904 - DNA, 25 bp, Mus musculus
gcttgagccaaaccgggtctctctt

SEQ ID NO: 40905 - DNA, 25 bp, Mus musculus
gcttgagtcccagaatcagctgctg

SEQ ID NO: 40906 - DNA, 25 bp, Mus musculus
gcttgatgccaacacacagaggaga

SEQ ID NO: 40907 - DNA, 25 bp, Mus musculus
gcttgatgccaagacacagaggaga

SEQ ID NO: 40908 - DNA, 25 bp, Mus musculus
gcttgattggcatcgctttaactta

SEQ ID NO: 40909 - DNA, 25 bp, Mus musculus
gcttgcaaaacagagaaattcctgg

SEQ ID NO: 40910 - DNA, 25 bp, Mus musculus
gcttgcagaaatcacgctggatccc

SEQ ID NO: 40911 - DNA, 25 bp, Mus musculus
gcttgcagaaatcccagaaggctac

SEQ ID NO: 40912 - DNA, 25 bp, Mus musculus
gcttgcagctgatgcttacgctccc

SEQ ID NO: 40913 - DNA, 25 bp, Mus musculus
gcttgcatcgcctatatccggctca

SEQ ID NO: 40914 - DNA, 25 bp, Mus musculus
gcttgcatgatcagaagaaagggaa

SEQ ID NO: 40915 - DNA, 25 bp, Mus musculus
gcttgccacagaagtgctctactgc

SEQ ID NO: 40916 - DNA, 25 bp, Mus musculus
gcttgcccaaacctcatgagataga

SEQ ID NO: 40917 - DNA, 25 bp, Mus musculus
gcttgcccaggttggcacgaagctc

SEQ ID NO: 40918 - DNA, 25 bp, Mus musculus
gcttgccctccatgtatagttaccc

SEQ ID NO: 40919 - DNA, 25 bp, Mus musculus
gcttgccgggactattggacctatc

SEQ ID NO: 40920 - DNA, 25 bp, Mus musculus
gcttgcctctcagcaagaaaagagg

SEQ ID NO: 40921 - DNA, 25 bp, Mus musculus
gcttgcctgcctaggtctgctttgg

SEQ ID NO: 40922 - DNA, 25 bp, Mus musculus
gcttgcgagaaggtcggcatgcaaa

SEQ ID NO: 40923 - DNA, 25 bp, Mus musculus
gcttgcgctgcagacagtgtggaca

SEQ ID NO: 40924 - DNA, 25 bp, Mus musculus
gcttgcttctaccttatgggccata

SEQ ID NO: 40925 - DNA, 25 bp, Mus musculus
gcttgctttgtttgaactgagccga

SEQ ID NO: 40926 - DNA, 25 bp, Mus musculus
gcttggaagttgcaaacttattgaa

SEQ ID NO: 40927 - DNA, 25 bp, Mus musculus
gcttggaatttgctatacctcacag

SEQ ID NO: 40928 - DNA, 25 bp, Mus musculus
gcttggactatacgacactgcagga

SEQ ID NO: 40929 - DNA, 25 bp, Mus musculus
gcttggagacttggacacgggtcct

SEQ ID NO: 40930 - DNA, 25 bp, Mus musculus
gcttggaggaaacaatgccattatt

SEQ ID NO: 40931 - DNA, 25 bp, Mus musculus
gcttggaggagatcctgtcagcctg

SEQ ID NO: 40932 - DNA, 25 bp, Mus musculus
gcttggatcgttatgaatctcgtga

SEQ ID NO: 40933 - DNA, 25 bp, Mus musculus
gcttggatctaggacaagctggatc

SEQ ID NO: 40934 - DNA, 25 bp, Mus musculus
gcttggattctagtcacaggtgtag

SEQ ID NO: 40935 - DNA, 25 bp, Mus musculus
gcttggcatggcctgttagtgctcc

SEQ ID NO: 40936 - DNA, 25 bp, Mus musculus
gcttggcattcttcttccgactggt

SEQ ID NO: 40937 - DNA, 25 bp, Mus musculus
gcttggcctcagaacccgatggcct

SEQ ID NO: 40938 - DNA, 25 bp, Mus musculus
gcttggcctgctgtcgtttagttga

SEQ ID NO: 40939 - DNA, 25 bp, Mus musculus
gcttggctactctacactagttggt

SEQ ID NO: 40940 - DNA, 25 bp, Mus musculus
gcttggctggtgttgtcaaataccg

SEQ ID NO: 40941 - DNA, 25 bp, Mus musculus
gcttggctttgagcgatttcatgca

SEQ ID NO: 40942 - DNA, 25 bp, Mus musculus
gcttgggaatgatgtcagctgctcc

SEQ ID NO: 40943 - DNA, 25 bp, Mus musculus
gcttgggacattcttcacttccatt

SEQ ID NO: 40944 - DNA, 25 bp, Mus musculus
gcttgggactccttgcatgtgcggc

SEQ ID NO: 40945 - DNA, 25 bp, Mus musculus
gcttgggagccttttggtatctgca

SEQ ID NO: 40946 - DNA, 25 bp, Mus musculus
gcttgggcacctctccatgctgcta

SEQ ID NO: 40947 - DNA, 25 bp, Mus musculus
gcttgggcgccatggaactcattca

SEQ ID NO: 40948 - DNA, 25 bp, Mus musculus
gcttggtagagattcctgctgttac

SEQ ID NO: 40949 - DNA, 25 bp, Mus musculus
gcttggtcttttgctccatacacat

SEQ ID NO: 40950 - DNA, 25 bp, Mus musculus
gcttggtgagaagggataagattga

SEQ ID NO: 40951 - DNA, 25 bp, Mus musculus
gcttgtaaaactcaaagagccgagt

SEQ ID NO: 40952 - DNA, 25 bp, Mus musculus
gcttgtcagaagctattttaagtac

SEQ ID NO: 40953 - DNA, 25 bp, Mus musculus
gcttgtcagggcctgagaaccgctc

SEQ ID NO: 40954 - DNA, 25 bp, Mus musculus
gcttgtcatctaagcactttggagg

SEQ ID NO: 40955 - DNA, 25 bp, Mus musculus
gcttgtccatgcgatcgtgcctgga

SEQ ID NO: 40956 - DNA, 25 bp, Mus musculus
gcttgtcccgaagagggactggcct

SEQ ID NO: 40957 - DNA, 25 bp, Mus musculus
gcttgtcgccctctgagtggaacca

SEQ ID NO: 40958 - DNA, 25 bp, Mus musculus
gcttgtcgccctgtgagtggaacca

SEQ ID NO: 40959 - DNA, 25 bp, Mus musculus
gcttgtgccactcaggctatcgtaa

SEQ ID NO: 40960 - DNA, 25 bp, Mus musculus
gcttgtgggtccctgtggagtggga

SEQ ID NO: 40961 - DNA, 25 bp, Mus musculus
gcttgtgtgggcagctatctggaaa

SEQ ID NO: 40962 - DNA, 25 bp, Mus musculus
gcttgtgtgggctgctatctggaaa

SEQ ID NO: 40963 - DNA, 25 bp, Mus musculus
gcttgtgtgtaaccaagaaggcagc

SEQ ID NO: 40964 - DNA, 25 bp, Mus musculus
gcttgtgttgaatcccgaacctgca

SEQ ID NO: 40965 - DNA, 25 bp, Mus musculus
gcttgttaataaaagacatctgcaa

SEQ ID NO: 40966 - DNA, 25 bp, Mus musculus
gcttgttgctgataaagacttttcc

SEQ ID NO: 40967 - DNA, 25 bp, Mus musculus
gcttgttggagcttggaggaaacaa

SEQ ID NO: 40968 - DNA, 25 bp, Mus musculus
gcttgttggttcagtgtcgccgcgc

SEQ ID NO: 40969 - DNA, 25 bp, Mus musculus
gcttgttggttctgtgtcgccgcgc

SEQ ID NO: 40970 - DNA, 25 bp, Mus musculus
gcttgtttacccagagcctttggaa

SEQ ID NO: 40971 - DNA, 25 bp, Mus musculus
gcttgtttcatgctttcccaaatgg

SEQ ID NO: 40972 - DNA, 25 bp, Mus musculus
gcttgtttgatgagaagcgtcatga

SEQ ID NO: 40973 - DNA, 25 bp, Mus musculus
gctttaaagaagctgacggccactg

SEQ ID NO: 40974 - DNA, 25 bp, Mus musculus
gctttaaagatgagagcaagaactc

SEQ ID NO: 40975 - DNA, 25 bp, Mus musculus
gctttaacctgctgcccacggagca

SEQ ID NO: 40976 - DNA, 25 bp, Mus musculus
gctttaaggaacagaatgctgaaga

SEQ ID NO: 40977 - DNA, 25 bp, Mus musculus
gctttaataatgtcaatgaggctga

SEQ ID NO: 40978 - DNA, 25 bp, Mus musculus
gctttaatgaaaagcaacctttgga

SEQ ID NO: 40979 - DNA, 25 bp, Mus musculus
gctttacacacctgaaccaaatgga

SEQ ID NO: 40980 - DNA, 25 bp, Mus musculus
gctttacagcaatcagaagtgacca

SEQ ID NO: 40981 - DNA, 25 bp, Mus musculus
gctttacatgatgctagtgatgaga

SEQ ID NO: 40982 - DNA, 25 bp, Mus musculus
gctttacccgagaggcttcacctgt

SEQ ID NO: 40983 - DNA, 25 bp, Mus musculus
gctttacccttatgttgaagaaatg

SEQ ID NO: 40984 - DNA, 25 bp, Mus musculus
gctttaccttgtaggaggtgggact

SEQ ID NO: 40985 - DNA, 25 bp, Mus musculus
gctttactctggacataaatactgc

SEQ ID NO: 40986 - DNA, 25 bp, Mus musculus
gctttagaaactgtgatatgtcctt

SEQ ID NO: 40987 - DNA, 25 bp, Mus musculus
gctttagaccaacagcaaagaattg

SEQ ID NO: 40988 - DNA, 25 bp, Mus musculus
gctttagaccaagagcaaagaattg

SEQ ID NO: 40989 - DNA, 25 bp, Mus musculus
gctttagccctcagtgctgtgaccc

SEQ ID NO: 40990 - DNA, 25 bp, Mus musculus
gctttagccctcgatgtcccggaga

SEQ ID NO: 40991 - DNA, 25 bp, Mus musculus
gctttatagatcagaatttcagtcc

SEQ ID NO: 40992 - DNA, 25 bp, Mus musculus
gctttatggatttcggaatttcgga

SEQ ID NO: 40993 - DNA, 25 bp, Mus musculus
gctttcaagaaagctgacccccaag

SEQ ID NO: 40994 - DNA, 25 bp, Mus musculus
gctttcaagcgtttagggactggga

SEQ ID NO: 40995 - DNA, 25 bp, Mus musculus
gctttcaagctcatccgtactttcg

SEQ ID NO: 40996 - DNA, 25 bp, Mus musculus
gctttcactaccagaatctatcacc

SEQ ID NO: 40997 - DNA, 25 bp, Mus musculus
gctttcactcttcaccagtgaccaa

SEQ ID NO: 40998 - DNA, 25 bp, Mus musculus
gctttcagccattacagtgtttatg

SEQ ID NO: 40999 - DNA, 25 bp, Mus musculus
gctttcagcctgatggatatgagca

SEQ ID NO: 41000 - DNA, 25 bp, Mus musculus
gctttcagctgtcgaaactcacccg

SEQ ID NO: 41001 - DNA, 25 bp, Mus musculus
gctttcatgacgttgacgctgttcc

SEQ ID NO: 41002 - DNA, 25 bp, Mus musculus
gctttcattgtgtttatcgcggcat

SEQ ID NO: 41003 - DNA, 25 bp, Mus musculus
gctttccacgtagcagtcagcctta

SEQ ID NO: 41004 - DNA, 25 bp, Mus musculus
gctttccagaaagcgcttcacgctg

SEQ ID NO: 41005 - DNA, 25 bp, Mus musculus
gctttcccagtagaagatgtagcta

SEQ ID NO: 41006 - DNA, 25 bp, Mus musculus
gctttcccagtgaggaagtccttac

SEQ ID NO: 41007 - DNA, 25 bp, Mus musculus
gctttcccgacgagaacttcacact

SEQ ID NO: 41008 - DNA, 25 bp, Mus musculus
gctttcctacacagttattcattag

SEQ ID NO: 41009 - DNA, 25 bp, Mus musculus
gctttcctacactgttattcattag

SEQ ID NO: 41010 - DNA, 25 bp, Mus musculus
gctttcctgcgacagtatggccaga

SEQ ID NO: 41011 - DNA, 25 bp, Mus musculus
gctttccttccaagggttagctgag

SEQ ID NO: 41012 - DNA, 25 bp, Mus musculus
gctttccttgcctgctatgccatgg

SEQ ID NO: 41013 - DNA, 25 bp, Mus musculus
gctttccttgctgtatctcttgtca

SEQ ID NO: 41014 - DNA, 25 bp, Mus musculus
gctttcctttgataaggatgccatg

SEQ ID NO: 41015 - DNA, 25 bp, Mus musculus
gctttcctttgggtactgcatttgg

SEQ ID NO: 41016 - DNA, 25 bp, Mus musculus
gctttcgacattggctcctttgatg

SEQ ID NO: 41017 - DNA, 25 bp, Mus musculus
gctttcggaacaggatgactttgcc

SEQ ID NO: 41018 - DNA, 25 bp, Mus musculus
gctttcggccgacgtttatgtgcta

SEQ ID NO: 41019 - DNA, 25 bp, Mus musculus
gctttcgtgccccaaacttggtggt

SEQ ID NO: 41020 - DNA, 25 bp, Mus musculus
gctttctcccggacacagtccttat

SEQ ID NO: 41021 - DNA, 25 bp, Mus musculus
gctttctcctgtcataaactcatta

SEQ ID NO: 41022 - DNA, 25 bp, Mus musculus
gctttctggaactgacagagctcaa

SEQ ID NO: 41023 - DNA, 25 bp, Mus musculus
gctttcttagcacaagcaccggcga

SEQ ID NO: 41024 - DNA, 25 bp, Mus musculus
gctttcttcgccctcgctatcgggt

SEQ ID NO: 41025 - DNA, 25 bp, Mus musculus
gctttctttgtgcttcgcttcctca

SEQ ID NO: 41026 - DNA, 25 bp, Mus musculus
gctttgaaccatagagcctgcctat

SEQ ID NO: 41027 - DNA, 25 bp, Mus musculus
gctttgacctcagcagctaccgaga

SEQ ID NO: 41028 - DNA, 25 bp, Mus musculus
gctttgacgagaaggaagtgattga

SEQ ID NO: 41029 - DNA, 25 bp, Mus musculus
gctttgacgatgacgtattgcccac

SEQ ID NO: 41030 - DNA, 25 bp, Mus musculus
gctttgacgatgtcgtattgcccac

SEQ ID NO: 41031 - DNA, 25 bp, Mus musculus
gctttgactatgattactaccaaga

SEQ ID NO: 41032 - DNA, 25 bp, Mus musculus
gctttgagacctgccgcgttgtgcg

SEQ ID NO: 41033 - DNA, 25 bp, Mus musculus
gctttgagcgatttcatgcattaat

SEQ ID NO: 41034 - DNA, 25 bp, Mus musculus
gctttgaggccatcaactcacagtt

SEQ ID NO: 41035 - DNA, 25 bp, Mus musculus
gctttgagggcgacagactgcgcct

SEQ ID NO: 41036 - DNA, 25 bp, Mus musculus
gctttgagggctaccagctggatgc

SEQ ID NO: 41037 - DNA, 25 bp, Mus musculus
gctttgagggcttccagctggatgc

SEQ ID NO: 41038 - DNA, 25 bp, Mus musculus
gctttgaggtggaggccataatcaa

SEQ ID NO: 41039 - DNA, 25 bp, Mus musculus
gctttgagtacgatgacccacgctt

SEQ ID NO: 41040 - DNA, 25 bp, Mus musculus
gctttgagtggacatgataaaacag

SEQ ID NO: 41041 - DNA, 25 bp, Mus musculus
gctttgatgcccatcatagggtggg

SEQ ID NO: 41042 - DNA, 25 bp, Mus musculus
gctttgatgcttaaccatgtctgcc

SEQ ID NO: 41043 - DNA, 25 bp, Mus musculus
gctttgattaaagatggcttccttg

SEQ ID NO: 41044 - DNA, 25 bp, Mus musculus
gctttgcaaggaaggagattctata

SEQ ID NO: 41045 - DNA, 25 bp, Mus musculus
gctttgcaagtgtgcactaagtaag

SEQ ID NO: 41046 - DNA, 25 bp, Mus musculus
gctttgcaccttgcacgacatttta

SEQ ID NO: 41047 - DNA, 25 bp, Mus musculus
gctttgcagagaaaagacacaagaa

SEQ ID NO: 41048 - DNA, 25 bp, Mus musculus
gctttgcagcaaatgcccatgctgg

SEQ ID NO: 41049 - DNA, 25 bp, Mus musculus
gctttgcaggagaccagattcctaa

SEQ ID NO: 41050 - DNA, 25 bp, Mus musculus
gctttgccaacttcgatgccttcag

SEQ ID NO: 41051 - DNA, 25 bp, Mus musculus
gctttgccttcacgactcgagctga

SEQ ID NO: 41052 - DNA, 25 bp, Mus musculus
gctttgccttcaggactcgagctga

SEQ ID NO: 41053 - DNA, 25 bp, Mus musculus
gctttgcggatggaacccggtgacc

SEQ ID NO: 41054 - DNA, 25 bp, Mus musculus
gctttgctaggctcagtcgacacag

SEQ ID NO: 41055 - DNA, 25 bp, Mus musculus
gctttgctccagacacaaaggacct

SEQ ID NO: 41056 - DNA, 25 bp, Mus musculus
gctttgctcctacagcagttgcaag

SEQ ID NO: 41057 - DNA, 25 bp, Mus musculus
gctttgctgatgaagaaagttacag

SEQ ID NO: 41058 - DNA, 25 bp, Mus musculus
gctttgctgatgtagaaagttacag

SEQ ID NO: 41059 - DNA, 25 bp, Mus musculus
gctttgctggatgagcctcagatcc

SEQ ID NO: 41060 - DNA, 25 bp, Mus musculus
gctttgctgtaatcaaactccgaga

SEQ ID NO: 41061 - DNA, 25 bp, Mus musculus
gctttggaaaaagtcgctctaattc

SEQ ID NO: 41062 - DNA, 25 bp, Mus musculus
gctttggactatctacattctggaa

SEQ ID NO: 41063 - DNA, 25 bp, Mus musculus
gctttggagatcctctctcaccttt

SEQ ID NO: 41064 - DNA, 25 bp, Mus musculus
gctttggatatgaccacactaacca

SEQ ID NO: 41065 - DNA, 25 bp, Mus musculus
gctttggattcagaagccatcccac

SEQ ID NO: 41066 - DNA, 25 bp, Mus musculus
gctttggcaccgtcttcgcgggaca

SEQ ID NO: 41067 - DNA, 25 bp, Mus musculus
gctttggcagaatgggtcagccgca

SEQ ID NO: 41068 - DNA, 25 bp, Mus musculus
gctttggccagcagggctgtgctca

SEQ ID NO: 41069 - DNA, 25 bp, Mus musculus
gctttggctgcgatttaagtactac

SEQ ID NO: 41070 - DNA, 25 bp, Mus musculus
gctttgggaaaatagtaccacattg

SEQ ID NO: 41071 - DNA, 25 bp, Mus musculus
gctttgggacagatgctgtcatcta

SEQ ID NO: 41072 - DNA, 25 bp, Mus musculus
gctttgggacatcatacgcctttta

SEQ ID NO: 41073 - DNA, 25 bp, Mus musculus
gctttgggatacctctcagtgtgtc

SEQ ID NO: 41074 - DNA, 25 bp, Mus musculus
gctttgggcccgtttctgatgttga

SEQ ID NO: 41075 - DNA, 25 bp, Mus musculus
gctttggtacaacactgtcctgaac

SEQ ID NO: 41076 - DNA, 25 bp, Mus musculus
gctttggtcaaaaagcatgcccaga

SEQ ID NO: 41077 - DNA, 25 bp, Mus musculus
gctttggtctccagccaggctgcct

SEQ ID NO: 41078 - DNA, 25 bp, Mus musculus
gctttggtgggcaccgtattcgcct

SEQ ID NO: 41079 - DNA, 25 bp, Mus musculus
gctttggtgtctttggccaggcctg

SEQ ID NO: 41080 - DNA, 25 bp, Mus musculus
gctttggttgacttgggcctttata

SEQ ID NO: 41081 - DNA, 25 bp, Mus musculus
gctttgtgatccctaactccacaaa

SEQ ID NO: 41082 - DNA, 25 bp, Mus musculus
gctttgtgccccaactcatgatcct

SEQ ID NO: 41083 - DNA, 25 bp, Mus musculus
gctttgtggcggctgtgatcaccat

SEQ ID NO: 41084 - DNA, 25 bp, Mus musculus
gctttgtggctgtgctgtcatcagg

SEQ ID NO: 41085 - DNA, 25 bp, Mus musculus
gctttgttcccctgaagagttcaca

SEQ ID NO: 41086 - DNA, 25 bp, Mus musculus
gctttgttggctgacccagctccag

SEQ ID NO: 41087 - DNA, 25 bp, Mus musculus
gctttgttggtgattgtatcgcttg

SEQ ID NO: 41088 - DNA, 25 bp, Mus musculus
gcttttaagaaatgcagatcaccat

SEQ ID NO: 41089 - DNA, 25 bp, Mus musculus
gcttttacaaccctgaagtgcgaga

SEQ ID NO: 41090 - DNA, 25 bp, Mus musculus
gcttttagacatatccaaatggttg

SEQ ID NO: 41091 - DNA, 25 bp, Mus musculus
gcttttagacatttccaaatggttg

SEQ ID NO: 41092 - DNA, 25 bp, Mus musculus
gcttttagcaatacctgtccctcct

SEQ ID NO: 41093 - DNA, 25 bp, Mus musculus
gcttttagcaattcctgtccctcct

SEQ ID NO: 41094 - DNA, 25 bp, Mus musculus
gcttttaggacatcacttaactttg

SEQ ID NO: 41095 - DNA, 25 bp, Mus musculus
gcttttcaactacaacaaagttctc

SEQ ID NO: 41096 - DNA, 25 bp, Mus musculus
gcttttcatcctactataaaggagg

SEQ ID NO: 41097 - DNA, 25 bp, Mus musculus
gcttttcctgtttactgaccctgag

SEQ ID NO: 41098 - DNA, 25 bp, Mus musculus
gcttttcgagctcaagcccagatct

SEQ ID NO: 41099 - DNA, 25 bp, Mus musculus
gcttttctccttcgcccaggctgtg

SEQ ID NO: 41100 - DNA, 25 bp, Mus musculus
gcttttctgtgtacaatcacaggtt

SEQ ID NO: 41101 - DNA, 25 bp, Mus musculus
gcttttcttacagctcctgggtcta

SEQ ID NO: 41102 - DNA, 25 bp, Mus musculus
gcttttcttggcacttcttcttcca

SEQ ID NO: 41103 - DNA, 25 bp, Mus musculus
gcttttctttactgttcactgtgtc

SEQ ID NO: 41104 - DNA, 25 bp, Mus musculus
gcttttgaagttattccaggaatct

SEQ ID NO: 41105 - DNA, 25 bp, Mus musculus
gcttttgccaagagtcagctatttg

SEQ ID NO: 41106 - DNA, 25 bp, Mus musculus
gcttttgcctgtacactggcttcct

SEQ ID NO: 41107 - DNA, 25 bp, Mus musculus
gcttttgtggaaaacatcactgtct

SEQ ID NO: 41108 - DNA, 25 bp, Mus musculus
gcttttgtggctacaggaaccaatc

SEQ ID NO: 41109 - DNA, 25 bp, Mus musculus
gcttttgttatatgatacagtccag

SEQ ID NO: 41110 - DNA, 25 bp, Mus musculus
gcttttgttttactgccttaatggg

SEQ ID NO: 41111 - DNA, 25 bp, Mus musculus
gctttttatgtccaggagtcctgca

SEQ ID NO: 41112 - DNA, 25 bp, Mus musculus
gctttttatgtcgaggagtcctgca

SEQ ID NO: 41113 - DNA, 25 bp, Mus musculus
gctttttcctgtaccacatccatct

SEQ ID NO: 41114 - DNA, 25 bp, Mus musculus
gctttttgaaggttccagggctgca

SEQ ID NO: 41115 - DNA, 25 bp, Mus musculus
gctttttgcaaagcccagcatagaa

SEQ ID NO: 41116 - DNA, 25 bp, Mus musculus
gctttttgccatgatgtgctcacca

SEQ ID NO: 41117 - DNA, 25 bp, Mus musculus
gctttttgtcctccaggaaaccaga

SEQ ID NO: 41118 - DNA, 25 bp, Mus musculus
gctttttgtgcaaatgcatgctgac

SEQ ID NO: 41119 - DNA, 25 bp, Mus musculus
gcttttttgatctatcgggctgctc

SEQ ID NO: 41120 - DNA, 25 bp, Mus musculus
gcttttttgcgaactgcatcgagga

SEQ ID NO: 41121 - DNA, 25 bp, Mus musculus
ggaaaaacagcagattacgcctttg

SEQ ID NO: 41122 - DNA, 25 bp, Mus musculus
ggaaaaagctatgtattctgctgaa

SEQ ID NO: 41123 - DNA, 25 bp, Mus musculus
ggaaaaatggccattgtccatctag

SEQ ID NO: 41124 - DNA, 25 bp, Mus musculus
ggaaaaattcgggtacagagtctga

SEQ ID NO: 41125 - DNA, 25 bp, Mus musculus
ggaaaacaaaaatcacgaaacaatg

SEQ ID NO: 41126 - DNA, 25 bp, Mus musculus
ggaaaacactcaacatctcaccgtc

SEQ ID NO: 41127 - DNA, 25 bp, Mus musculus
ggaaaacagacccacaggccccaag

SEQ ID NO: 41128 - DNA, 25 bp, Mus musculus
ggaaaacatcactgtcttggagaat

SEQ ID NO: 41129 - DNA, 25 bp, Mus musculus
ggaaaaccagatcctcacccgagat

SEQ ID NO: 41130 - DNA, 25 bp, Mus musculus
ggaaaaccgagaaaaaatgaagcag

SEQ ID NO: 41131 - DNA, 25 bp, Mus musculus
ggaaaacctcagcatgtcacctcat

SEQ ID NO: 41132 - DNA, 25 bp, Mus musculus
ggaaaactcatcataccaggttatt

SEQ ID NO: 41133 - DNA, 25 bp, Mus musculus
ggaaaactgaacacaaatcagtaca

SEQ ID NO: 41134 - DNA, 25 bp, Mus musculus
ggaaaagaatcttgtgtcctttaga

SEQ ID NO: 41135 - DNA, 25 bp, Mus musculus
ggaaaagactcgaccaagatctcgg

SEQ ID NO: 41136 - DNA, 25 bp, Mus musculus
ggaaaagactgtggtatatgaaact

SEQ ID NO: 41137 - DNA, 25 bp, Mus musculus
ggaaaagcaatattcggcctccgcg

SEQ ID NO: 41138 - DNA, 25 bp, Mus musculus
ggaaaagccgaagttcgaggacaca

SEQ ID NO: 41139 - DNA, 25 bp, Mus musculus
ggaaaaggcccttgactacatcaaa

SEQ ID NO: 41140 - DNA, 25 bp, Mus musculus
ggaaaaggccttacaccagtataca

SEQ ID NO: 41141 - DNA, 25 bp, Mus musculus
ggaaaaggctctagggctgcagata

SEQ ID NO: 41142 - DNA, 25 bp, Mus musculus
ggaaaagggcttcacaatcaatgag

SEQ ID NO: 41143 - DNA, 25 bp, Mus musculus
ggaaaagggcttcatgtccaacaag

SEQ ID NO: 41144 - DNA, 25 bp, Mus musculus
ggaaaaggtgaagatctgataagaa

SEQ ID NO: 41145 - DNA, 25 bp, Mus musculus
ggaaaagtatgtcctggagctacag

SEQ ID NO: 41146 - DNA, 25 bp, Mus musculus
ggaaaagtctgttgaacaaagagaa

SEQ ID NO: 41147 - DNA, 25 bp, Mus musculus
ggaaaatcacctataagaacctggg

SEQ ID NO: 41148 - DNA, 25 bp, Mus musculus
ggaaaatcatctgcccggcatgtgg

SEQ ID NO: 41149 - DNA, 25 bp, Mus musculus
ggaaaatcgcattctgctgtacgcg

SEQ ID NO: 41150 - DNA, 25 bp, Mus musculus
ggaaaatcggattccagatccgagt

SEQ ID NO: 41151 - DNA, 25 bp, Mus musculus
ggaaaatctacgtctgaaaccacag

SEQ ID NO: 41152 - DNA, 25 bp, Mus musculus
ggaaaatctcccgaggagctgtata

SEQ ID NO: 41153 - DNA, 25 bp, Mus musculus
ggaaaatgagcacctgatggaagac

SEQ ID NO: 41154 - DNA, 25 bp, Mus musculus
ggaaaatgtgtgtaatgccacactc

SEQ ID NO: 41155 - DNA, 25 bp, Mus musculus
ggaaaattgtcggtgatctggcctc

SEQ ID NO: 41156 - DNA, 25 bp, Mus musculus
ggaaacaaatcagaagcagctacag

SEQ ID NO: 41157 - DNA, 25 bp, Mus musculus
ggaaacaaattccagagctgactcc

SEQ ID NO: 41158 - DNA, 25 bp, Mus musculus
ggaaacaatcccttggcaagagcgc

SEQ ID NO: 41159 - DNA, 25 bp, Mus musculus
ggaaacacggccttacacatcgcat

SEQ ID NO: 41160 - DNA, 25 bp, Mus musculus
ggaaacactctcttcccagatatac

SEQ ID NO: 41161 - DNA, 25 bp, Mus musculus
ggaaacagtttacagtcatcacatg

SEQ ID NO: 41162 - DNA, 25 bp, Mus musculus
ggaaacatcagccagacatgctgct

SEQ ID NO: 41163 - DNA, 25 bp, Mus musculus
ggaaaccacccagcaagattttttg

SEQ ID NO: 41164 - DNA, 25 bp, Mus musculus
ggaaaccatctgcaccaatggaagg

SEQ ID NO: 41165 - DNA, 25 bp, Mus musculus
ggaaacccaagccacattggaagta

SEQ ID NO: 41166 - DNA, 25 bp, Mus musculus
ggaaacccaagcgacattggaagta

SEQ ID NO: 41167 - DNA, 25 bp, Mus musculus
ggaaacccacaacagtatggacagt

SEQ ID NO: 41168 - DNA, 25 bp, Mus musculus
ggaaacccagaaggacacttgtctt

SEQ ID NO: 41169 - DNA, 25 bp, Mus musculus
ggaaaccccagagcccagaaattca

SEQ ID NO: 41170 - DNA, 25 bp, Mus musculus
ggaaaccctggtatttctacagcag

SEQ ID NO: 41171 - DNA, 25 bp, Mus musculus
ggaaaccgtatgagcctgtgttcac

SEQ ID NO: 41172 - DNA, 25 bp, Mus musculus
ggaaacctggcccagaaccaaatgt

SEQ ID NO: 41173 - DNA, 25 bp, Mus musculus
ggaaaccttttctgcatcgtgggag

SEQ ID NO: 41174 - DNA, 25 bp, Mus musculus
ggaaacgccaggagcccctcatggt

SEQ ID NO: 41175 - DNA, 25 bp, Mus musculus
ggaaacgtaatgttttgcagttcag

SEQ ID NO: 41176 - DNA, 25 bp, Mus musculus
ggaaactctcgaaggacattctggg

SEQ ID NO: 41177 - DNA, 25 bp, Mus musculus
ggaaactgaggcatctaatatgaag

SEQ ID NO: 41178 - DNA, 25 bp, Mus musculus
ggaaactgccccttttcacagaggc

SEQ ID NO: 41179 - DNA, 25 bp, Mus musculus
ggaaactgggctcacctggaccaac

SEQ ID NO: 41180 - DNA, 25 bp, Mus musculus
ggaaacttagggaacaatagcacag

SEQ ID NO: 41181 - DNA, 25 bp, Mus musculus
ggaaacttcatgtccgtagtcttca

SEQ ID NO: 41182 - DNA, 25 bp, Mus musculus
ggaaacttccatggtgaatacccag

SEQ ID NO: 41183 - DNA, 25 bp, Mus musculus
ggaaagaacatatgagcttggcctg

SEQ ID NO: 41184 - DNA, 25 bp, Mus musculus
ggaaagaagtttgactacagggcct

SEQ ID NO: 41185 - DNA, 25 bp, Mus musculus
ggaaagaatggaagacgaaatttgc

SEQ ID NO: 41186 - DNA, 25 bp, Mus musculus
ggaaagacatgtcgccttgcctgtc

SEQ ID NO: 41187 - DNA, 25 bp, Mus musculus
ggaaagacctcgatcccaacaacgt

SEQ ID NO: 41188 - DNA, 25 bp, Mus musculus
ggaaagacgaaagcgtaatcacaga

SEQ ID NO: 41189 - DNA, 25 bp, Mus musculus
ggaaagacttcagtccctatgacta

SEQ ID NO: 41190 - DNA, 25 bp, Mus musculus
ggaaagagacaaggcgggcagatgg

SEQ ID NO: 41191 - DNA, 25 bp, Mus musculus
ggaaagagcatctaagaaccaagaa

SEQ ID NO: 41192 - DNA, 25 bp, Mus musculus
ggaaagataggaaggaagaaacaga

SEQ ID NO: 41193 - DNA, 25 bp, Mus musculus
ggaaagcacagaatgtctgaaggaa

SEQ ID NO: 41194 - DNA, 25 bp, Mus musculus
ggaaagcccttttcagctccctgct

SEQ ID NO: 41195 - DNA, 25 bp, Mus musculus
ggaaagccgaagactcttcagacag

SEQ ID NO: 41196 - DNA, 25 bp, Mus musculus
ggaaagccgagtcccgctgtcagcc

SEQ ID NO: 41197 - DNA, 25 bp, Mus musculus
ggaaagccgagtgccgctgtcagcc

SEQ ID NO: 41198 - DNA, 25 bp, Mus musculus
ggaaagcctggaacaccatactact

SEQ ID NO: 41199 - DNA, 25 bp, Mus musculus
ggaaagcctggttgttcccaccaag

SEQ ID NO: 41200 - DNA, 25 bp, Mus musculus
ggaaagcgatgatgactcccggcct

SEQ ID NO: 41201 - DNA, 25 bp, Mus musculus
ggaaagctacatcctgcaaatcagt

SEQ ID NO: 41202 - DNA, 25 bp, Mus musculus
ggaaagctatacgtacaatggcaag

SEQ ID NO: 41203 - DNA, 25 bp, Mus musculus
ggaaagctccgaatgaggtcccatt

SEQ ID NO: 41204 - DNA, 25 bp, Mus musculus
ggaaagctgacatagtgcaacaact

SEQ ID NO: 41205 - DNA, 25 bp, Mus musculus
ggaaagctggacttctgcagcgccc

SEQ ID NO: 41206 - DNA, 25 bp, Mus musculus
ggaaaggaatatccacacaggagaa

SEQ ID NO: 41207 - DNA, 25 bp, Mus musculus
ggaaaggacacgactctatggtgag

SEQ ID NO: 41208 - DNA, 25 bp, Mus musculus
ggaaaggccataatatttctgaagg

SEQ ID NO: 41209 - DNA, 25 bp, Mus musculus
ggaaaggccttcactaggcccctgg

SEQ ID NO: 41210 - DNA, 25 bp, Mus musculus
ggaaaggccttctctaggcccctgg

SEQ ID NO: 41211 - DNA, 25 bp, Mus musculus
ggaaaggtgcttttacatctcacat

SEQ ID NO: 41212 - DNA, 25 bp, Mus musculus
ggaaagtccaaaggctatggttttg

SEQ ID NO: 41213 - DNA, 25 bp, Mus musculus
ggaaagtgcgagattcatcctgaac

SEQ ID NO: 41214 - DNA, 25 bp, Mus musculus
ggaaagtgcgagtttcatcctgaac

SEQ ID NO: 41215 - DNA, 25 bp, Mus musculus
ggaaagtgtcaaaactacagaaagc

SEQ ID NO: 41216 - DNA, 25 bp, Mus musculus
ggaaagtgttaccatactttcaggg

SEQ ID NO: 41217 - DNA, 25 bp, Mus musculus
ggaaagttctagcttcaggaatgca

SEQ ID NO: 41218 - DNA, 25 bp, Mus musculus
ggaaagttctaggttcaggaatgca

SEQ ID NO: 41219 - DNA, 25 bp, Mus musculus
ggaaagttgccttgtggcagctatg

SEQ ID NO: 41220 - DNA, 25 bp, Mus musculus
ggaaataaacttcactcaagagctt

SEQ ID NO: 41221 - DNA, 25 bp, Mus musculus
ggaaataaacttgactcaagagctt

SEQ ID NO: 41222 - DNA, 25 bp, Mus musculus
ggaaataaatctacgaatgttgctg

SEQ ID NO: 41223 - DNA, 25 bp, Mus musculus
ggaaataattgttgaccagaagcag

SEQ ID NO: 41224 - DNA, 25 bp, Mus musculus
ggaaatatgtcactgcaagtgggct

SEQ ID NO: 41225 - DNA, 25 bp, Mus musculus
ggaaatcattcatcgacccagtatc

SEQ ID NO: 41226 - DNA, 25 bp, Mus musculus
ggaaatccctcgagaatccctgcag

SEQ ID NO: 41227 - DNA, 25 bp, Mus musculus
ggaaatcctcaaggattcaaccagg

SEQ ID NO: 41228 - DNA, 25 bp, Mus musculus
ggaaatcctcagcttcaagaacaaa

SEQ ID NO: 41229 - DNA, 25 bp, Mus musculus
ggaaatcgtcccctacaacatggct

SEQ ID NO: 41230 - DNA, 25 bp, Mus musculus
ggaaatctccgtggaaaagtcactt

SEQ ID NO: 41231 - DNA, 25 bp, Mus musculus
ggaaatctctgcaccccaactgttg

SEQ ID NO: 41232 - DNA, 25 bp, Mus musculus
ggaaatgccactaaagagttcatcg

SEQ ID NO: 41233 - DNA, 25 bp, Mus musculus
ggaaatgctcataaaatcatggaga

SEQ ID NO: 41234 - DNA, 25 bp, Mus musculus
ggaaatggaacacctacatttctaa

SEQ ID NO: 41235 - DNA, 25 bp, Mus musculus
ggaaatggaatttgatcaggataga

SEQ ID NO: 41236 - DNA, 25 bp, Mus musculus
ggaaatgggcaaaattcacagagca

SEQ ID NO: 41237 - DNA, 25 bp, Mus musculus
ggaaatgggcaatattcacagagca

SEQ ID NO: 41238 - DNA, 25 bp, Mus musculus
ggaaatgtaggaaccagactggcgt

SEQ ID NO: 41239 - DNA, 25 bp, Mus musculus
ggaaatgtaggatccagactggcgt

SEQ ID NO: 41240 - DNA, 25 bp, Mus musculus
ggaaatgtcttctttcattcaccac

SEQ ID NO: 41241 - DNA, 25 bp, Mus musculus
ggaaatgtcttgaaagaggcacgca

SEQ ID NO: 41242 - DNA, 25 bp, Mus musculus
ggaaatgtgtaccacgccaagggca

SEQ ID NO: 41243 - DNA, 25 bp, Mus musculus
ggaaattatacagggatgtgacatt

SEQ ID NO: 41244 - DNA, 25 bp, Mus musculus
ggaaattcatcaggatccactttgg

SEQ ID NO: 41245 - DNA, 25 bp, Mus musculus
ggaaattcccgttctcgtagcagta

SEQ ID NO: 41246 - DNA, 25 bp, Mus musculus
ggaaattctgcagtctgtttatgag

SEQ ID NO: 41247 - DNA, 25 bp, Mus musculus
ggaaattgagcaggtggacatgcta

SEQ ID NO: 41248 - DNA, 25 bp, Mus musculus
ggaacaaaaagacaccagtttgact

SEQ ID NO: 41249 - DNA, 25 bp, Mus musculus
ggaacaaagaatcggcctggcaatg

SEQ ID NO: 41250 - DNA, 25 bp, Mus musculus
ggaacaaagccgacgacagccgaat

SEQ ID NO: 41251 - DNA, 25 bp, Mus musculus
ggaacaacaggtacaccgcctgctg

SEQ ID NO: 41252 - DNA, 25 bp, Mus musculus
ggaacaacccctttctctaagctga

SEQ ID NO: 41253 - DNA, 25 bp, Mus musculus
ggaacaagtgaattccatggtggac

SEQ ID NO: 41254 - DNA, 25 bp, Mus musculus
ggaacaagtggtcaaccaagcccct

SEQ ID NO: 41255 - DNA, 25 bp, Mus musculus
ggaacaagtgtttgagtcgcctcag

SEQ ID NO: 41256 - DNA, 25 bp, Mus musculus
ggaacaatgttgcaagccgttgaaa

SEQ ID NO: 41257 - DNA, 25 bp, Mus musculus
ggaacaattggatttcatgatggag

SEQ ID NO: 41258 - DNA, 25 bp, Mus musculus
ggaacacactgtgggaactgccacg

SEQ ID NO: 41259 - DNA, 25 bp, Mus musculus
ggaacacagccccaggtacaaactg

SEQ ID NO: 41260 - DNA, 25 bp, Mus musculus
ggaacacaggactgccgttttggat

SEQ ID NO: 41261 - DNA, 25 bp, Mus musculus
ggaacacatgactaggaccctgagg

SEQ ID NO: 41262 - DNA, 25 bp, Mus musculus
ggaacacatggtgaacaccatccag

SEQ ID NO: 41263 - DNA, 25 bp, Mus musculus
ggaacaccggtctaggaagcagaag

SEQ ID NO: 41264 - DNA, 25 bp, Mus musculus
ggaacacggcccattttgtgggaag

SEQ ID NO: 41265 - DNA, 25 bp, Mus musculus
ggaacagcagcgtgggcaagacatc

SEQ ID NO: 41266 - DNA, 25 bp, Mus musculus
ggaacagcattcacacagcatcacc

SEQ ID NO: 41267 - DNA, 25 bp, Mus musculus
ggaacaggaaggagtttgagacact

SEQ ID NO: 41268 - DNA, 25 bp, Mus musculus
ggaacaggatgactttgccaatatc

SEQ ID NO: 41269 - DNA, 25 bp, Mus musculus
ggaacaggccttcctggtcagcctc

SEQ ID NO: 41270 - DNA, 25 bp, Mus musculus
ggaacaggctcaagccacttcggtg

SEQ ID NO: 41271 - DNA, 25 bp, Mus musculus
ggaacaggctggcaagagctcaaca

SEQ ID NO: 41272 - DNA, 25 bp, Mus musculus
ggaacaggtccacgcagttattgga

SEQ ID NO: 41273 - DNA, 25 bp, Mus musculus
ggaacaggtctcacactgcctgaga

SEQ ID NO: 41274 - DNA, 25 bp, Mus musculus
ggaacaggtctctcactgcctgaga

SEQ ID NO: 41275 - DNA, 25 bp, Mus musculus
ggaacagtacaagaaggagcgaaag

SEQ ID NO: 41276 - DNA, 25 bp, Mus musculus
ggaacagtccaatttctatcttcaa

SEQ ID NO: 41277 - DNA, 25 bp, Mus musculus
ggaacagtcttcaagagagccttga

SEQ ID NO: 41278 - DNA, 25 bp, Mus musculus
ggaacagtgactcttcgggcctcgt

SEQ ID NO: 41279 - DNA, 25 bp, Mus musculus
ggaacagtgctgtgtggcctgaccc

SEQ ID NO: 41280 - DNA, 25 bp, Mus musculus
ggaacagttctatgtcaccagagag

SEQ ID NO: 41281 - DNA, 25 bp, Mus musculus
ggaacagtttgtctgtgcacacacg

SEQ ID NO: 41282 - DNA, 25 bp, Mus musculus
ggaacatcaccttgggtccgaaatc

SEQ ID NO: 41283 - DNA, 25 bp, Mus musculus
ggaacatctcaaagaacacgtccct

SEQ ID NO: 41284 - DNA, 25 bp, Mus musculus
ggaacatgagggaggtcacctcccc

SEQ ID NO: 41285 - DNA, 25 bp, Mus musculus
ggaacatgatgaacaaagctaggag

SEQ ID NO: 41286 - DNA, 25 bp, Mus musculus
ggaacatggaagtaaccagaaccct

SEQ ID NO: 41287 - DNA, 25 bp, Mus musculus
ggaacatggtgtatacccacacaca

SEQ ID NO: 41288 - DNA, 25 bp, Mus musculus
ggaacatttgctttctccgagggca

SEQ ID NO: 41289 - DNA, 25 bp, Mus musculus
ggaaccaactcagattcacagacag

SEQ ID NO: 41290 - DNA, 25 bp, Mus musculus
ggaaccacaaaatctgcgggcagtc

SEQ ID NO: 41291 - DNA, 25 bp, Mus musculus
ggaaccacagacatcctggaaaaag

SEQ ID NO: 41292 - DNA, 25 bp, Mus musculus
ggaaccacatctttggaccttcaga

SEQ ID NO: 41293 - DNA, 25 bp, Mus musculus
ggaaccactgcttaccttggtaaag

SEQ ID NO: 41294 - DNA, 25 bp, Mus musculus
ggaaccagaacaactgcggctgaac

SEQ ID NO: 41295 - DNA, 25 bp, Mus musculus
ggaaccataatgataagcttatcaa

SEQ ID NO: 41296 - DNA, 25 bp, Mus musculus
ggaaccataatgttaagcttatcaa

SEQ ID NO: 41297 - DNA, 25 bp, Mus musculus
ggaacccaactctgctccacagtga

SEQ ID NO: 41298 - DNA, 25 bp, Mus musculus
ggaacccacacatgaggaggacctc

SEQ ID NO: 41299 - DNA, 25 bp, Mus musculus
ggaacccagcaaggcggtgcctgat

SEQ ID NO: 41300 - DNA, 25 bp, Mus musculus
ggaacccatcactgtggatcagaca

SEQ ID NO: 41301 - DNA, 25 bp, Mus musculus
ggaacccatgtcttccctcagcagt

SEQ ID NO: 41302 - DNA, 25 bp, Mus musculus
ggaacccctggtagtcagctctcta

SEQ ID NO: 41303 - DNA, 25 bp, Mus musculus
ggaaccctcacctgcagtgagccag

SEQ ID NO: 41304 - DNA, 25 bp, Mus musculus
ggaaccctcctgactatcgagggca

SEQ ID NO: 41305 - DNA, 25 bp, Mus musculus
ggaaccctgaggctgtcccgcctga

SEQ ID NO: 41306 - DNA, 25 bp, Mus musculus
ggaaccctgctatctgctgagaaac

SEQ ID NO: 41307 - DNA, 25 bp, Mus musculus
ggaaccctggtccaagatattttca

SEQ ID NO: 41308 - DNA, 25 bp, Mus musculus
ggaaccctgttatgacatctaccgg

SEQ ID NO: 41309 - DNA, 25 bp, Mus musculus
ggaacccttttattataattcacag

SEQ ID NO: 41310 - DNA, 25 bp, Mus musculus
ggaaccgaccgggagacaggattct

SEQ ID NO: 41311 - DNA, 25 bp, Mus musculus
ggaaccgtcttcagagagccaatca

SEQ ID NO: 41312 - DNA, 25 bp, Mus musculus
ggaaccgtgtgctaggctggtccac

SEQ ID NO: 41313 - DNA, 25 bp, Mus musculus
ggaacctagctcagattcatacaag

SEQ ID NO: 41314 - DNA, 25 bp, Mus musculus
ggaacctagctctgattcatacaag

SEQ ID NO: 41315 - DNA, 25 bp, Mus musculus
ggaacctccagtaagccagatttgg

SEQ ID NO: 41316 - DNA, 25 bp, Mus musculus
ggaacctgatttgagatcaattctt

SEQ ID NO: 41317 - DNA, 25 bp, Mus musculus
ggaacctgcctcttcttggtggcgt

SEQ ID NO: 41318 - DNA, 25 bp, Mus musculus
ggaacctgctctcaatatagtacaa

SEQ ID NO: 41319 - DNA, 25 bp, Mus musculus
ggaaccttggatacccatgctggta

SEQ ID NO: 41320 - DNA, 25 bp, Mus musculus
ggaaccttggattcccatgctggta

SEQ ID NO: 41321 - DNA, 25 bp, Mus musculus
ggaacctttccaagtgctccctttg

SEQ ID NO: 41322 - DNA, 25 bp, Mus musculus
ggaacctttgctgcaggaggctaca

SEQ ID NO: 41323 - DNA, 25 bp, Mus musculus
ggaacgacattggtgccactgtcca

SEQ ID NO: 41324 - DNA, 25 bp, Mus musculus
ggaacgagcctggaaccaaagtgca

SEQ ID NO: 41325 - DNA, 25 bp, Mus musculus
ggaacgcccaggtacctttggctct

SEQ ID NO: 41326 - DNA, 25 bp, Mus musculus
ggaacgcctgcttatcctgaaagta

SEQ ID NO: 41327 - DNA, 25 bp, Mus musculus
ggaacgcctggcagtcgctcgcgca

SEQ ID NO: 41328 - DNA, 25 bp, Mus musculus
ggaacgccttggaccttttcagaca

SEQ ID NO: 41329 - DNA, 25 bp, Mus musculus
ggaacgctgcgcctctgggatctca

SEQ ID NO: 41330 - DNA, 25 bp, Mus musculus
ggaacgctgtcctcacctggaacaa

SEQ ID NO: 41331 - DNA, 25 bp, Mus musculus
ggaacgcttccgctgtaacatcgac

SEQ ID NO: 41332 - DNA, 25 bp, Mus musculus
ggaacggaaactacagaaggcagtg

SEQ ID NO: 41333 - DNA, 25 bp, Mus musculus
ggaacggaaactctgcctccagcat

SEQ ID NO: 41334 - DNA, 25 bp, Mus musculus
ggaacggagcaagatgctgctgtcc

SEQ ID NO: 41335 - DNA, 25 bp, Mus musculus
ggaacggatcatcaagcgagccgcc

SEQ ID NO: 41336 - DNA, 25 bp, Mus musculus
ggaacggctgcagtacacctatgag

SEQ ID NO: 41337 - DNA, 25 bp, Mus musculus
ggaacgggcatgttgtctttgcaca

SEQ ID NO: 41338 - DNA, 25 bp, Mus musculus
ggaacgggcatgtttaaggaactct

SEQ ID NO: 41339 - DNA, 25 bp, Mus musculus
ggaacgggccgataacgagaagcta

SEQ ID NO: 41340 - DNA, 25 bp, Mus musculus
ggaactacctacaccagtggacatg

SEQ ID NO: 41341 - DNA, 25 bp, Mus musculus
ggaactacgcaatcgggtgcgccat

SEQ ID NO: 41342 - DNA, 25 bp, Mus musculus
ggaactactccatcatcaactggca

SEQ ID NO: 41343 - DNA, 25 bp, Mus musculus
ggaactatcctaatgtaccccagta

SEQ ID NO: 41344 - DNA, 25 bp, Mus musculus
ggaactcaccagatactctagcctg

SEQ ID NO: 41345 - DNA, 25 bp, Mus musculus
ggaactcagaaccacagaaaacgga

SEQ ID NO: 41346 - DNA, 25 bp, Mus musculus
ggaactcagcatttagaccgggttg

SEQ ID NO: 41347 - DNA, 25 bp, Mus musculus
ggaactcagtgaatattgccctggg

SEQ ID NO: 41348 - DNA, 25 bp, Mus musculus
ggaactcagtgatctgccagcttct

SEQ ID NO: 41349 - DNA, 25 bp, Mus musculus
ggaactcatgtgaccctgtaccagc

SEQ ID NO: 41350 - DNA, 25 bp, Mus musculus
ggaactcccaaaacgtcggcaatgg

SEQ ID NO: 41351 - DNA, 25 bp, Mus musculus
ggaactcctcttggatgtcttgtca

SEQ ID NO: 41352 - DNA, 25 bp, Mus musculus
ggaactccttttgaagcacggtgca

SEQ ID NO: 41353 - DNA, 25 bp, Mus musculus
ggaactcggccttgatttctgccgt

SEQ ID NO: 41354 - DNA, 25 bp, Mus musculus
ggaactctgtgagccggagagaaaa

SEQ ID NO: 41355 - DNA, 25 bp, Mus musculus
ggaactctgtgtagaccacgctgtc

SEQ ID NO: 41356 - DNA, 25 bp, Mus musculus
ggaactgacagtggtacttggtcaa

SEQ ID NO: 41357 - DNA, 25 bp, Mus musculus
ggaactgcaggcactgtctccgagt

SEQ ID NO: 41358 - DNA, 25 bp, Mus musculus
ggaactgctaatcaaccatgggaag

SEQ ID NO: 41359 - DNA, 25 bp, Mus musculus
ggaactggaaattctgagctgccat

SEQ ID NO: 41360 - DNA, 25 bp, Mus musculus
ggaactggcaagatcctgcacccag

SEQ ID NO: 41361 - DNA, 25 bp, Mus musculus
ggaactggcaatgttgttgtgagcc

SEQ ID NO: 41362 - DNA, 25 bp, Mus musculus
ggaactggcatcaccacacgagtta

SEQ ID NO: 41363 - DNA, 25 bp, Mus musculus
ggaactggcatctccacacgagtta

SEQ ID NO: 41364 - DNA, 25 bp, Mus musculus
ggaactggcctaactacctgtgaca

SEQ ID NO: 41365 - DNA, 25 bp, Mus musculus
ggaactgggaaagacctcgatccca

SEQ ID NO: 41366 - DNA, 25 bp, Mus musculus
ggaactgtcctgatggtgacctcca

SEQ ID NO: 41367 - DNA, 25 bp, Mus musculus
ggaactgtcctgttggtgacctcca

SEQ ID NO: 41368 - DNA, 25 bp, Mus musculus
ggaactgttcagagctcgccctatg

SEQ ID NO: 41369 - DNA, 25 bp, Mus musculus
ggaactgttcagtgctcgccctatg

SEQ ID NO: 41370 - DNA, 25 bp, Mus musculus
ggaactgttgcagcctctctcaggc

SEQ ID NO: 41371 - DNA, 25 bp, Mus musculus
ggaacttcaggaccttccaacacag

SEQ ID NO: 41372 - DNA, 25 bp, Mus musculus
ggaacttccccatcgatgtgacctt

SEQ ID NO: 41373 - DNA, 25 bp, Mus musculus
ggaacttccttggaactcaccagat

SEQ ID NO: 41374 - DNA, 25 bp, Mus musculus
ggaacttcgactgggccaccttgct

SEQ ID NO: 41375 - DNA, 25 bp, Mus musculus
ggaacttcgtgcagtatgcctgctt

SEQ ID NO: 41376 - DNA, 25 bp, Mus musculus
ggaacttgcacagtgacatcatctg

SEQ ID NO: 41377 - DNA, 25 bp, Mus musculus
ggaacttggacttctggcgccagct

SEQ ID NO: 41378 - DNA, 25 bp, Mus musculus
ggaacttgttctataatcgttgtgc

SEQ ID NO: 41379 - DNA, 25 bp, Mus musculus
ggaactttcagcaccggcgccaagt

SEQ ID NO: 41380 - DNA, 25 bp, Mus musculus
ggaactttctttggtctctgctgtc

SEQ ID NO: 41381 - DNA, 25 bp, Mus musculus
ggaagaaaaacacccctgagcagca

SEQ ID NO: 41382 - DNA, 25 bp, Mus musculus
ggaagaaaacatctcagtagcagct

SEQ ID NO: 41383 - DNA, 25 bp, Mus musculus
ggaagaaacacctccaaagacccat

SEQ ID NO: 41384 - DNA, 25 bp, Mus musculus
ggaagaaagagggaaatcactgtca

SEQ ID NO: 41385 - DNA, 25 bp, Mus musculus
ggaagaaatatgttagatgcccttg

SEQ ID NO: 41386 - DNA, 25 bp, Mus musculus
ggaagaaatcggcaaaaggctcagc

SEQ ID NO: 41387 - DNA, 25 bp, Mus musculus
ggaagaaattccaatgagcaatatg

SEQ ID NO: 41388 - DNA, 25 bp, Mus musculus
ggaagaacacaatggctacccttct

SEQ ID NO: 41389 - DNA, 25 bp, Mus musculus
ggaagaagacaaatccaaggacaat

SEQ ID NO: 41390 - DNA, 25 bp, Mus musculus
ggaagaagatagagaccatcaccat

SEQ ID NO: 41391 - DNA, 25 bp, Mus musculus
ggaagaaggagtaagctactgcttt

SEQ ID NO: 41392 - DNA, 25 bp, Mus musculus
ggaagaagtttcagtggcctgcaag

SEQ ID NO: 41393 - DNA, 25 bp, Mus musculus
ggaagacaacaaccgttcacattgg

SEQ ID NO: 41394 - DNA, 25 bp, Mus musculus
ggaagacaccataccttatgcctta

SEQ ID NO: 41395 - DNA, 25 bp, Mus musculus
ggaagacagtgcaaaattgaaattc

SEQ ID NO: 41396 - DNA, 25 bp, Mus musculus
ggaagacatgctgcaggccctgaaa

SEQ ID NO: 41397 - DNA, 25 bp, Mus musculus
ggaagaccaccttaggaacagattg

SEQ ID NO: 41398 - DNA, 25 bp, Mus musculus
ggaagacccaccctgactatgtgag

SEQ ID NO: 41399 - DNA, 25 bp, Mus musculus
ggaagaccccgcagaagaagaggac

SEQ ID NO: 41400 - DNA, 25 bp, Mus musculus
ggaagacccggaaatcagacaaaag

SEQ ID NO: 41401 - DNA, 25 bp, Mus musculus
ggaagacctgtttgatatgtgcaga

SEQ ID NO: 41402 - DNA, 25 bp, Mus musculus
ggaagaccttgccaatcccggtcca

SEQ ID NO: 41403 - DNA, 25 bp, Mus musculus
ggaagacgacctgtgtgtgccacag

SEQ ID NO: 41404 - DNA, 25 bp, Mus musculus
ggaagacgactgaggctccctgttc

SEQ ID NO: 41405 - DNA, 25 bp, Mus musculus
ggaagacggtcaccatgatgccacc

SEQ ID NO: 41406 - DNA, 25 bp, Mus musculus
ggaagactccactgaacaccaaatg

SEQ ID NO: 41407 - DNA, 25 bp, Mus musculus
ggaagactgccctgatggaggcaaa

SEQ ID NO: 41408 - DNA, 25 bp, Mus musculus
ggaagacttccagaagaagagacca

SEQ ID NO: 41409 - DNA, 25 bp, Mus musculus
ggaagactttacacccttctcgcta

SEQ ID NO: 41410 - DNA, 25 bp, Mus musculus
ggaagagaaacaaaacaccagtgtt

SEQ ID NO: 41411 - DNA, 25 bp, Mus musculus
ggaagagatatttttgcacagagaa

SEQ ID NO: 41412 - DNA, 25 bp, Mus musculus
ggaagagcccgactgtcaaaaacag

SEQ ID NO: 41413 - DNA, 25 bp, Mus musculus
ggaagaggagttctcccctctgaag

SEQ ID NO: 41414 - DNA, 25 bp, Mus musculus
ggaagaggcagaagtcatcaaccaa

SEQ ID NO: 41415 - DNA, 25 bp, Mus musculus
ggaagaggcattagatgccctgaaa

SEQ ID NO: 41416 - DNA, 25 bp, Mus musculus
ggaagaggcatttgatgccctgaaa

SEQ ID NO: 41417 - DNA, 25 bp, Mus musculus
ggaagagggatttcatggaaacaaa

SEQ ID NO: 41418 - DNA, 25 bp, Mus musculus
ggaagaggtgactttcatctatcag

SEQ ID NO: 41419 - DNA, 25 bp, Mus musculus
ggaagaggtttaatgatccagcaca

SEQ ID NO: 41420 - DNA, 25 bp, Mus musculus
ggaagaggtttattgatccagcaca

SEQ ID NO: 41421 - DNA, 25 bp, Mus musculus
ggaagagtctgttgggagttttcac

SEQ ID NO: 41422 - DNA, 25 bp, Mus musculus
ggaagataaggttttcaacactgcc

SEQ ID NO: 41423 - DNA, 25 bp, Mus musculus
ggaagatagctgtcaccaggataac

SEQ ID NO: 41424 - DNA, 25 bp, Mus musculus
ggaagatatcctttgacccccagga

SEQ ID NO: 41425 - DNA, 25 bp, Mus musculus
ggaagatctaggagattcagcatca

SEQ ID NO: 41426 - DNA, 25 bp, Mus musculus
ggaagatcttcctggagagaatgaa

SEQ ID NO: 41427 - DNA, 25 bp, Mus musculus
ggaagatggagaaccgtgactaccg

SEQ ID NO: 41428 - DNA, 25 bp, Mus musculus
ggaagatgggaagttacaacaaaca

SEQ ID NO: 41429 - DNA, 25 bp, Mus musculus
ggaagatttgataatgcagatagga

SEQ ID NO: 41430 - DNA, 25 bp, Mus musculus
ggaagattttccacatcgacaccaa

SEQ ID NO: 41431 - DNA, 25 bp, Mus musculus
ggaagcaagggctggaacagttcat

SEQ ID NO: 41432 - DNA, 25 bp, Mus musculus
ggaagcacaccctctcatatgtgga

SEQ ID NO: 41433 - DNA, 25 bp, Mus musculus
ggaagcactgaagcaacacaaaacc

SEQ ID NO: 41434 - DNA, 25 bp, Mus musculus
ggaagcactgactccctggaccaag

SEQ ID NO: 41435 - DNA, 25 bp, Mus musculus
ggaagcagaaaccacagcaaatgtg

SEQ ID NO: 41436 - DNA, 25 bp, Mus musculus
ggaagcagagaaaatgttcaagggc

SEQ ID NO: 41437 - DNA, 25 bp, Mus musculus
ggaagcagccgccatgggcttcact

SEQ ID NO: 41438 - DNA, 25 bp, Mus musculus
ggaagcagcgctcttcccaagcagc

SEQ ID NO: 41439 - DNA, 25 bp, Mus musculus
ggaagcatctagaggctgtgcagaa

SEQ ID NO: 41440 - DNA, 25 bp, Mus musculus
ggaagcatgctcctcttacacgttt

SEQ ID NO: 41441 - DNA, 25 bp, Mus musculus
ggaagccaagctcgccaagattaag

SEQ ID NO: 41442 - DNA, 25 bp, Mus musculus
ggaagccactgctctgcacacagct

SEQ ID NO: 41443 - DNA, 25 bp, Mus musculus
ggaagccagtggatttcaaaaagat

SEQ ID NO: 41444 - DNA, 25 bp, Mus musculus
ggaagcccaactatagcgagctgca

SEQ ID NO: 41445 - DNA, 25 bp, Mus musculus
ggaagcccaactttagcgagctgca

SEQ ID NO: 41446 - DNA, 25 bp, Mus musculus
ggaagcccagaaagatgcatccatc

SEQ ID NO: 41447 - DNA, 25 bp, Mus musculus
ggaagccctctccatgggagctcga

SEQ ID NO: 41448 - DNA, 25 bp, Mus musculus
ggaagccctctggatcagcagttaa

SEQ ID NO: 41449 - DNA, 25 bp, Mus musculus
ggaagccctttgttccggagaacag

SEQ ID NO: 41450 - DNA, 25 bp, Mus musculus
ggaagccgctttcccgacgagaact

SEQ ID NO: 41451 - DNA, 25 bp, Mus musculus
ggaagccgtgccttaatgctttttc

SEQ ID NO: 41452 - DNA, 25 bp, Mus musculus
ggaagcctcaccgaagggaaggtca

SEQ ID NO: 41453 - DNA, 25 bp, Mus musculus
ggaagcctctggtcattcaactatt

SEQ ID NO: 41454 - DNA, 25 bp, Mus musculus
ggaagcctggcaagttctctgtcgg

SEQ ID NO: 41455 - DNA, 25 bp, Mus musculus
ggaagcctgtcatgattgtgataga

SEQ ID NO: 41456 - DNA, 25 bp, Mus musculus
ggaagcgcatgctacgtgaccagac

SEQ ID NO: 41457 - DNA, 25 bp, Mus musculus
ggaagcgctactggcccttctggag

SEQ ID NO: 41458 - DNA, 25 bp, Mus musculus
ggaagcggctgtccatccctggcct

SEQ ID NO: 41459 - DNA, 25 bp, Mus musculus
ggaagctaaaagatgaccagaccct

SEQ ID NO: 41460 - DNA, 25 bp, Mus musculus
ggaagctaccttgatgtccctggta

SEQ ID NO: 41461 - DNA, 25 bp, Mus musculus
ggaagctcaccgtgggacccacatg

SEQ ID NO: 41462 - DNA, 25 bp, Mus musculus
ggaagctctaaggaaaaccacggag

SEQ ID NO: 41463 - DNA, 25 bp, Mus musculus
ggaagctgaaattctccagcaaaac

SEQ ID NO: 41464 - DNA, 25 bp, Mus musculus
ggaagctgatagattgaaaggacat

SEQ ID NO: 41465 - DNA, 25 bp, Mus musculus
ggaagctgggaaaaaagaatcttga

SEQ ID NO: 41466 - DNA, 25 bp, Mus musculus
ggaagcttagtaatcctgacatatt

SEQ ID NO: 41467 - DNA, 25 bp, Mus musculus
ggaagcttccagacatgccatcatg

SEQ ID NO: 41468 - DNA, 25 bp, Mus musculus
ggaagcttccatggctgtcagctgc

SEQ ID NO: 41469 - DNA, 25 bp, Mus musculus
ggaaggaaaagtgttatcgctgcag

SEQ ID NO: 41470 - DNA, 25 bp, Mus musculus
ggaaggaaaggaccttatcacgaag

SEQ ID NO: 41471 - DNA, 25 bp, Mus musculus
ggaaggaacaaagcattgattacac

SEQ ID NO: 41472 - DNA, 25 bp, Mus musculus
ggaaggaagattttggaaacctgca

SEQ ID NO: 41473 - DNA, 25 bp, Mus musculus
ggaaggacaaagcaaaatctacctg

SEQ ID NO: 41474 - DNA, 25 bp, Mus musculus
ggaaggacattacggagcgcctcat

SEQ ID NO: 41475 - DNA, 25 bp, Mus musculus
ggaaggagagaaccgcctccccagc

SEQ ID NO: 41476 - DNA, 25 bp, Mus musculus
ggaaggagcaattctaccgctacta

SEQ ID NO: 41477 - DNA, 25 bp, Mus musculus
ggaaggagccaaagtctgcctgatg

SEQ ID NO: 41478 - DNA, 25 bp, Mus musculus
ggaaggaggatcacccatcaaatat

SEQ ID NO: 41479 - DNA, 25 bp, Mus musculus
ggaaggagtgctcttattctccaca

SEQ ID NO: 41480 - DNA, 25 bp, Mus musculus
ggaaggataaggagcagaaacaaac

SEQ ID NO: 41481 - DNA, 25 bp, Mus musculus
ggaaggatcgcatttcatgtgtgtg

SEQ ID NO: 41482 - DNA, 25 bp, Mus musculus
ggaaggattacaagaggacagtatt

SEQ ID NO: 41483 - DNA, 25 bp, Mus musculus
ggaaggatttttgatgatgtgtcca

SEQ ID NO: 41484 - DNA, 25 bp, Mus musculus
ggaaggcaaacattcacctgaagca

SEQ ID NO: 41485 - DNA, 25 bp, Mus musculus
ggaaggcaacaggtgtcacagcacg

SEQ ID NO: 41486 - DNA, 25 bp, Mus musculus
ggaaggcaatcccacttatggcctt

SEQ ID NO: 41487 - DNA, 25 bp, Mus musculus
ggaaggcaatccgacttatggcctt

SEQ ID NO: 41488 - DNA, 25 bp, Mus musculus
ggaaggcacaggactcctgaaaaaa

SEQ ID NO: 41489 - DNA, 25 bp, Mus musculus
ggaaggccaaagacaagcaggtggt

SEQ ID NO: 41490 - DNA, 25 bp, Mus musculus
ggaaggccctgtgccctgattgtta

SEQ ID NO: 41491 - DNA, 25 bp, Mus musculus
ggaaggcctttagtcccactaccat

SEQ ID NO: 41492 - DNA, 25 bp, Mus musculus
ggaaggcgctcttgactctgctgaa

SEQ ID NO: 41493 - DNA, 25 bp, Mus musculus
ggaaggctccagcagatccagcctt

SEQ ID NO: 41494 - DNA, 25 bp, Mus musculus
ggaagggcatcatctccggctctgt

SEQ ID NO: 41495 - DNA, 25 bp, Mus musculus
ggaagggctctctgaggtctgagga

SEQ ID NO: 41496 - DNA, 25 bp, Mus musculus
ggaagggctcttccttacctccagc

SEQ ID NO: 41497 - DNA, 25 bp, Mus musculus
ggaaggtaacgttctttcagccaga

SEQ ID NO: 41498 - DNA, 25 bp, Mus musculus
ggaaggtgactctgattctcatagc

SEQ ID NO: 41499 - DNA, 25 bp, Mus musculus
ggaaggtttagactatctgcacaga

SEQ ID NO: 41500 - DNA, 25 bp, Mus musculus
ggaagtacatgtgccggatcatagt

SEQ ID NO: 41501 - DNA, 25 bp, Mus musculus
ggaagtattaagagatccaattaag

SEQ ID NO: 41502 - DNA, 25 bp, Mus musculus
ggaagtcacgctgaacaaacaggtg

SEQ ID NO: 41503 - DNA, 25 bp, Mus musculus
ggaagtcacttctggagttagccag

SEQ ID NO: 41504 - DNA, 25 bp, Mus musculus
ggaagtcagacatatgaaactgagg

SEQ ID NO: 41505 - DNA, 25 bp, Mus musculus
ggaagtccccattgttcaaactgag

SEQ ID NO: 41506 - DNA, 25 bp, Mus musculus
ggaagtcgagttccagcgtgcacct

SEQ ID NO: 41507 - DNA, 25 bp, Mus musculus
ggaagtctctccacccagaatggca

SEQ ID NO: 41508 - DNA, 25 bp, Mus musculus
ggaagtctgcaatgaccccaaggtg

SEQ ID NO: 41509 - DNA, 25 bp, Mus musculus
ggaagtctggcaacaaaataatgag

SEQ ID NO: 41510 - DNA, 25 bp, Mus musculus
ggaagtgaccatggacaccagtgaa

SEQ ID NO: 41511 - DNA, 25 bp, Mus musculus
ggaagtgactttcacctcagaatag

SEQ ID NO: 41512 - DNA, 25 bp, Mus musculus
ggaagtgcatcttcatacaccacca

SEQ ID NO: 41513 - DNA, 25 bp, Mus musculus
ggaagtggaaaagaaggcgatcatt

SEQ ID NO: 41514 - DNA, 25 bp, Mus musculus
ggaagtggacactccccacgctaca

SEQ ID NO: 41515 - DNA, 25 bp, Mus musculus
ggaagtgtaccttgacctgctgaag

SEQ ID NO: 41516 - DNA, 25 bp, Mus musculus
ggaagtgtgcaagaactatgctgag

SEQ ID NO: 41517 - DNA, 25 bp, Mus musculus
ggaagtgtgtgccttatgctgtcat

SEQ ID NO: 41518 - DNA, 25 bp, Mus musculus
ggaagtgtttttaaagcaatacata

SEQ ID NO: 41519 - DNA, 25 bp, Mus musculus
ggaagttacaacaaacatagctggg

SEQ ID NO: 41520 - DNA, 25 bp, Mus musculus
ggaagttatggtattgctggcgaaa

SEQ ID NO: 41521 - DNA, 25 bp, Mus musculus
ggaagtttgcttggtttagtcactc

SEQ ID NO: 41522 - DNA, 25 bp, Mus musculus
ggaataaaaaggacgtttcagtgct

SEQ ID NO: 41523 - DNA, 25 bp, Mus musculus
ggaataaaccaaagaaaacagcaca

SEQ ID NO: 41524 - DNA, 25 bp, Mus musculus
ggaataacaatgatgtcaaaccgca

SEQ ID NO: 41525 - DNA, 25 bp, Mus musculus
ggaataatacctccaaaaggctgtt

SEQ ID NO: 41526 - DNA, 25 bp, Mus musculus
ggaatacaaaggaggaggcaaagca

SEQ ID NO: 41527 - DNA, 25 bp, Mus musculus
ggaatacacaggaactacagtacag

SEQ ID NO: 41528 - DNA, 25 bp, Mus musculus
ggaatacactcagaagcttgccaaa

SEQ ID NO: 41529 - DNA, 25 bp, Mus musculus
ggaatacctccgagcccggaggcca

SEQ ID NO: 41530 - DNA, 25 bp, Mus musculus
ggaatacgaggagttttcagcaaca

SEQ ID NO: 41531 - DNA, 25 bp, Mus musculus
ggaatactctgggtgtctgcaagta

SEQ ID NO: 41532 - DNA, 25 bp, Mus musculus
ggaatacttaaacgacctgaaacag

SEQ ID NO: 41533 - DNA, 25 bp, Mus musculus
ggaatacttggttgtcctcccagga

SEQ ID NO: 41534 - DNA, 25 bp, Mus musculus
ggaatagccttgactctttcggagg

SEQ ID NO: 41535 - DNA, 25 bp, Mus musculus
ggaatagtcgaaccgatcacaagtg

SEQ ID NO: 41536 - DNA, 25 bp, Mus musculus
ggaatatatctcagacggtgaagaa

SEQ ID NO: 41537 - DNA, 25 bp, Mus musculus
ggaatatccacacaggagaatcgat

SEQ ID NO: 41538 - DNA, 25 bp, Mus musculus
ggaatatcttgacaaactcggaaaa

SEQ ID NO: 41539 - DNA, 25 bp, Mus musculus
ggaatatgaagaccatcccgatgag

SEQ ID NO: 41540 - DNA, 25 bp, Mus musculus
ggaatatgtcgacttagagagagaa

SEQ ID NO: 41541 - DNA, 25 bp, Mus musculus
ggaatatgtctccagtcctccagga

SEQ ID NO: 41542 - DNA, 25 bp, Mus musculus
ggaatatgttctagaccccacacca

SEQ ID NO: 41543 - DNA, 25 bp, Mus musculus
ggaatcaaagcttcccttttacttg

SEQ ID NO: 41544 - DNA, 25 bp, Mus musculus
ggaatcagagcctcttcctggctgg

SEQ ID NO: 41545 - DNA, 25 bp, Mus musculus
ggaatcagcggcctcctcttcattt

SEQ ID NO: 41546 - DNA, 25 bp, Mus musculus
ggaatcatccgctgtcctgatggca

SEQ ID NO: 41547 - DNA, 25 bp, Mus musculus
ggaatcatggcattgctggcctcta

SEQ ID NO: 41548 - DNA, 25 bp, Mus musculus
ggaatccaaaatgctacaaagaagt

SEQ ID NO: 41549 - DNA, 25 bp, Mus musculus
ggaatccaactactccatccatctg

SEQ ID NO: 41550 - DNA, 25 bp, Mus musculus
ggaatccatggtccatgcagacaca

SEQ ID NO: 41551 - DNA, 25 bp, Mus musculus
ggaatcccaacattacattccaaag

SEQ ID NO: 41552 - DNA, 25 bp, Mus musculus
ggaatccctgaagaaactgctcggg

SEQ ID NO: 41553 - DNA, 25 bp, Mus musculus
ggaatcctgctgatggaccctcaga

SEQ ID NO: 41554 - DNA, 25 bp, Mus musculus
ggaatctattgtcttcgccattcag

SEQ ID NO: 41555 - DNA, 25 bp, Mus musculus
ggaatctccgaagcatgaaagcaag

SEQ ID NO: 41556 - DNA, 25 bp, Mus musculus
ggaatctgctctcacgaggccttcc

SEQ ID NO: 41557 - DNA, 25 bp, Mus musculus
ggaatctggtcaagtggttgcaatt

SEQ ID NO: 41558 - DNA, 25 bp, Mus musculus
ggaatcttgacttcctcaagccttt

SEQ ID NO: 41559 - DNA, 25 bp, Mus musculus
ggaatgaagtaactcaagatgagca

SEQ ID NO: 41560 - DNA, 25 bp, Mus musculus
ggaatgacctgactaacttcactag

SEQ ID NO: 41561 - DNA, 25 bp, Mus musculus
ggaatgagaaagtgacgcagtctga

SEQ ID NO: 41562 - DNA, 25 bp, Mus musculus
ggaatgagccacagccccgagctgg

SEQ ID NO: 41563 - DNA, 25 bp, Mus musculus
ggaatgagctcaccgaaatgaagcg

SEQ ID NO: 41564 - DNA, 25 bp, Mus musculus
ggaatgagtcctgccctatgaatac

SEQ ID NO: 41565 - DNA, 25 bp, Mus musculus
ggaatgatgccacagatgatgcccc

SEQ ID NO: 41566 - DNA, 25 bp, Mus musculus
ggaatgcaatttcggcgccagctcc

SEQ ID NO: 41567 - DNA, 25 bp, Mus musculus
ggaatgcaatttgggcgccagctcc

SEQ ID NO: 41568 - DNA, 25 bp, Mus musculus
ggaatgcaccaagtacaaagtcagc

SEQ ID NO: 41569 - DNA, 25 bp, Mus musculus
ggaatgcagggatgaagtagtttta

SEQ ID NO: 41570 - DNA, 25 bp, Mus musculus
ggaatgcagtcggatttttggtgaa

SEQ ID NO: 41571 - DNA, 25 bp, Mus musculus
ggaatgccacctattttgactatgc

SEQ ID NO: 41572 - DNA, 25 bp, Mus musculus
ggaatgcggcatacagaatcagtgg

SEQ ID NO: 41573 - DNA, 25 bp, Mus musculus
ggaatgcggcattcagaatcagtgg

SEQ ID NO: 41574 - DNA, 25 bp, Mus musculus
ggaatgcgttattacccaaagacaa

SEQ ID NO: 41575 - DNA, 25 bp, Mus musculus
ggaatgctgcacaggaccccgggca

SEQ ID NO: 41576 - DNA, 25 bp, Mus musculus
ggaatgctgggatttggaagcttat

SEQ ID NO: 41577 - DNA, 25 bp, Mus musculus
ggaatgctttggtgtctcatttgga

SEQ ID NO: 41578 - DNA, 25 bp, Mus musculus
ggaatggactagtcggtccccacgg

SEQ ID NO: 41579 - DNA, 25 bp, Mus musculus
ggaatggccctcagtacttctaaca

SEQ ID NO: 41580 - DNA, 25 bp, Mus musculus
ggaatggccctctgtacttctaaca

SEQ ID NO: 41581 - DNA, 25 bp, Mus musculus
ggaatggccgcctcctcgtcttcgt

SEQ ID NO: 41582 - DNA, 25 bp, Mus musculus
ggaatggcctgcgaaatccatcaaa

SEQ ID NO: 41583 - DNA, 25 bp, Mus musculus
ggaatggggtccctgactgcctctc

SEQ ID NO: 41584 - DNA, 25 bp, Mus musculus
ggaatggtctagcagcttatcgagc

SEQ ID NO: 41585 - DNA, 25 bp, Mus musculus
ggaatggtctttgaagctatagaca

SEQ ID NO: 41586 - DNA, 25 bp, Mus musculus
ggaatgtcagcacctcaacagaaag

SEQ ID NO: 41587 - DNA, 25 bp, Mus musculus
ggaatgtcttcattatctgcttcta

SEQ ID NO: 41588 - DNA, 25 bp, Mus musculus
ggaatgttgctgatcataagaaagg

SEQ ID NO: 41589 - DNA, 25 bp, Mus musculus
ggaattaaaattccaagcactttga

SEQ ID NO: 41590 - DNA, 25 bp, Mus musculus
ggaattaaagttctaccagagggct

SEQ ID NO: 41591 - DNA, 25 bp, Mus musculus
ggaattactacgtccgggctgccct

SEQ ID NO: 41592 - DNA, 25 bp, Mus musculus
ggaattagaacaattaggcgagttc

SEQ ID NO: 41593 - DNA, 25 bp, Mus musculus
ggaattagaacatttaggcgagttc

SEQ ID NO: 41594 - DNA, 25 bp, Mus musculus
ggaattagcacacgcaactctcatg

SEQ ID NO: 41595 - DNA, 25 bp, Mus musculus
ggaattagcacaggcaactctcatg

SEQ ID NO: 41596 - DNA, 25 bp, Mus musculus
ggaattatatgcagatgaccctaag

SEQ ID NO: 41597 - DNA, 25 bp, Mus musculus
ggaattatgactaagccaaggaaaa

SEQ ID NO: 41598 - DNA, 25 bp, Mus musculus
ggaattattagctgtggcacaacac

SEQ ID NO: 41599 - DNA, 25 bp, Mus musculus
ggaattccctgtacgacatggcccg

SEQ ID NO: 41600 - DNA, 25 bp, Mus musculus
ggaattcctcaaatattttggaacg

SEQ ID NO: 41601 - DNA, 25 bp, Mus musculus
ggaattcctctataaatggttctaa

SEQ ID NO: 41602 - DNA, 25 bp, Mus musculus
ggaattcctgtcaaggattgctcca

SEQ ID NO: 41603 - DNA, 25 bp, Mus musculus
ggaattccttgtccaacagttgtac

SEQ ID NO: 41604 - DNA, 25 bp, Mus musculus
ggaattcgaatctttggaggcactc

SEQ ID NO: 41605 - DNA, 25 bp, Mus musculus
ggaattctcagtctatcaagataca

SEQ ID NO: 41606 - DNA, 25 bp, Mus musculus
ggaattctctccattatctctgaaa

SEQ ID NO: 41607 - DNA, 25 bp, Mus musculus
ggaattctgctaagtcacagagaca

SEQ ID NO: 41608 - DNA, 25 bp, Mus musculus
ggaattgctcccagcatccgtacca

SEQ ID NO: 41609 - DNA, 25 bp, Mus musculus
ggaattgctgccagcgtccacttca

SEQ ID NO: 41610 - DNA, 25 bp, Mus musculus
ggaattggaccagggcatcgatccc

SEQ ID NO: 41611 - DNA, 25 bp, Mus musculus
ggaattggactcacaggatctgggc

SEQ ID NO: 41612 - DNA, 25 bp, Mus musculus
ggaattggcgccctccttaccctag

SEQ ID NO: 41613 - DNA, 25 bp, Mus musculus
ggaattggttcaatttcctgttcag

SEQ ID NO: 41614 - DNA, 25 bp, Mus musculus
ggaattggttcattttcctgttcag

SEQ ID NO: 41615 - DNA, 25 bp, Mus musculus
ggaattggttgcatttagtactgag

SEQ ID NO: 41616 - DNA, 25 bp, Mus musculus
ggaatttcagccagtttctctgctg

SEQ ID NO: 41617 - DNA, 25 bp, Mus musculus
ggaatttgaggctccccttgtcaca

SEQ ID NO: 41618 - DNA, 25 bp, Mus musculus
ggaatttgatggcttcctcagacgc

SEQ ID NO: 41619 - DNA, 25 bp, Mus musculus
ggaatttgtgtatcaaagtaacgga

SEQ ID NO: 41620 - DNA, 25 bp, Mus musculus
ggaattttaattaggacatgggact

SEQ ID NO: 41621 - DNA, 25 bp, Mus musculus
ggaattttcgccaccgttctccgag

SEQ ID NO: 41622 - DNA, 25 bp, Mus musculus
ggacaaaactgaaaacacagcctat

SEQ ID NO: 41623 - DNA, 25 bp, Mus musculus
ggacaaacagagacacctagagatt

SEQ ID NO: 41624 - DNA, 25 bp, Mus musculus
ggacaaacataacgagcccaaccct

SEQ ID NO: 41625 - DNA, 25 bp, Mus musculus
ggacaaacataaggagcccaaccct

SEQ ID NO: 41626 - DNA, 25 bp, Mus musculus
ggacaaacctctgcgacatgataac

SEQ ID NO: 41627 - DNA, 25 bp, Mus musculus
ggacaaactagctggctaaactcat

SEQ ID NO: 41628 - DNA, 25 bp, Mus musculus
ggacaaagccttcaaggaacagctg

SEQ ID NO: 41629 - DNA, 25 bp, Mus musculus
ggacaaagggccctgacattagagt

SEQ ID NO: 41630 - DNA, 25 bp, Mus musculus
ggacaaatccgagcagtaccacaca

SEQ ID NO: 41631 - DNA, 25 bp, Mus musculus
ggacaaatcctgactggatgttttt

SEQ ID NO: 41632 - DNA, 25 bp, Mus musculus
ggacaaatccttctcccttcgacag

SEQ ID NO: 41633 - DNA, 25 bp, Mus musculus
ggacaaatgggccagcctctcaggc

SEQ ID NO: 41634 - DNA, 25 bp, Mus musculus
ggacaacatcaaacagcaccaacca

SEQ ID NO: 41635 - DNA, 25 bp, Mus musculus
ggacaacatcaatcagcaccaacca

SEQ ID NO: 41636 - DNA, 25 bp, Mus musculus
ggacaacattacagactctgccaag

SEQ ID NO: 41637 - DNA, 25 bp, Mus musculus
ggacaacattcgctccatctttgga

SEQ ID NO: 41638 - DNA, 25 bp, Mus musculus
ggacaacctcaagatccgggacgtg

SEQ ID NO: 41639 - DNA, 25 bp, Mus musculus
ggacaacctctaccgccatgctgtg

SEQ ID NO: 41640 - DNA, 25 bp, Mus musculus
ggacaacctgcaagagtcttccacc

SEQ ID NO: 41641 - DNA, 25 bp, Mus musculus
ggacaacgaccttctcgtcactgag

SEQ ID NO: 41642 - DNA, 25 bp, Mus musculus
ggacaacttatccaaacctgtggct

SEQ ID NO: 41643 - DNA, 25 bp, Mus musculus
ggacaacttatcgaaacctgtggct

SEQ ID NO: 41644 - DNA, 25 bp, Mus musculus
ggacaagaacacagctttgtaactg

SEQ ID NO: 41645 - DNA, 25 bp, Mus musculus
ggacaagaacattgggcccctagta

SEQ ID NO: 41646 - DNA, 25 bp, Mus musculus
ggacaagcattaaacatgcttggag

SEQ ID NO: 41647 - DNA, 25 bp, Mus musculus
ggacaaggaaaatcgcattctgctg

SEQ ID NO: 41648 - DNA, 25 bp, Mus musculus
ggacaaggaatactacgagcccatg

SEQ ID NO: 41649 - DNA, 25 bp, Mus musculus
ggacaaggaatagtacgagcccatg

SEQ ID NO: 41650 - DNA, 25 bp, Mus musculus
ggacaaggacccctgctctgtgctc

SEQ ID NO: 41651 - DNA, 25 bp, Mus musculus
ggacaaggtccccagtatggccagc

SEQ ID NO: 41652 - DNA, 25 bp, Mus musculus
ggacaagtatgctgcaagtgagaac

SEQ ID NO: 41653 - DNA, 25 bp, Mus musculus
ggacaagtgcctgcccgtgtactat

SEQ ID NO: 41654 - DNA, 25 bp, Mus musculus
ggacaagtgtttccggaagtgcatc

SEQ ID NO: 41655 - DNA, 25 bp, Mus musculus
ggacaagttcaagcagattcagagg

SEQ ID NO: 41656 - DNA, 25 bp, Mus musculus
ggacaagttcacaacggcctgtaat

SEQ ID NO: 41657 - DNA, 25 bp, Mus musculus
ggacaatagccaccagtcttagcag

SEQ ID NO: 41658 - DNA, 25 bp, Mus musculus
ggacaatagtggtgagaaaacagac

SEQ ID NO: 41659 - DNA, 25 bp, Mus musculus
ggacaatatgcttttggcagaaggg

SEQ ID NO: 41660 - DNA, 25 bp, Mus musculus
ggacaatcaccacggcctactatcg

SEQ ID NO: 41661 - DNA, 25 bp, Mus musculus
ggacaatcacttaggtattacagag

SEQ ID NO: 41662 - DNA, 25 bp, Mus musculus
ggacaatcggttcagtttactgata

SEQ ID NO: 41663 - DNA, 25 bp, Mus musculus
ggacaattcccgcaatgcccctttg

SEQ ID NO: 41664 - DNA, 25 bp, Mus musculus
ggacaattcccggaatgcccctttg

SEQ ID NO: 41665 - DNA, 25 bp, Mus musculus
ggacaatttgcttaatatggcctat

SEQ ID NO: 41666 - DNA, 25 bp, Mus musculus
ggacaattttctagcccacactatc

SEQ ID NO: 41667 - DNA, 25 bp, Mus musculus
ggacacacaacgctgcaaaatgcaa

SEQ ID NO: 41668 - DNA, 25 bp, Mus musculus
ggacacagacccttgcggaagctga

SEQ ID NO: 41669 - DNA, 25 bp, Mus musculus
ggacacagggaaagttcccactggg

SEQ ID NO: 41670 - DNA, 25 bp, Mus musculus
ggacacagggaatgttcccactggg

SEQ ID NO: 41671 - DNA, 25 bp, Mus musculus
ggacacatacaatattcctttagac

SEQ ID NO: 41672 - DNA, 25 bp, Mus musculus
ggacacatgaaacagatccaatcta

SEQ ID NO: 41673 - DNA, 25 bp, Mus musculus
ggacacatgaaagagatccaatcta

SEQ ID NO: 41674 - DNA, 25 bp, Mus musculus
ggacacatgacaatagccattctaa

SEQ ID NO: 41675 - DNA, 25 bp, Mus musculus
ggacacattcatgtttgagggtcat

SEQ ID NO: 41676 - DNA, 25 bp, Mus musculus
ggacaccacactgtcctactataag

SEQ ID NO: 41677 - DNA, 25 bp, Mus musculus
ggacaccacttcagaggccccagag

SEQ ID NO: 41678 - DNA, 25 bp, Mus musculus
ggacaccatgcagatcattctacag

SEQ ID NO: 41679 - DNA, 25 bp, Mus musculus
ggacacccaaccagcccaaaggagt

SEQ ID NO: 41680 - DNA, 25 bp, Mus musculus
ggacacccaaggatggcactgattg

SEQ ID NO: 41681 - DNA, 25 bp, Mus musculus
ggacaccccactgcaggtttcaggg

SEQ ID NO: 41682 - DNA, 25 bp, Mus musculus
ggacacccctcacagtgctcaatgg

SEQ ID NO: 41683 - DNA, 25 bp, Mus musculus
ggacaccgccctgttatatttaagg

SEQ ID NO: 41684 - DNA, 25 bp, Mus musculus
ggacacctactcatgagatgtttgt

SEQ ID NO: 41685 - DNA, 25 bp, Mus musculus
ggacacctgctcatttccttctctg

SEQ ID NO: 41686 - DNA, 25 bp, Mus musculus
ggacactactgggtgggcattgaca

SEQ ID NO: 41687 - DNA, 25 bp, Mus musculus
ggacactagaggagctcctgaagcc

SEQ ID NO: 41688 - DNA, 25 bp, Mus musculus
ggacactctttgaagtctctcatga

SEQ ID NO: 41689 - DNA, 25 bp, Mus musculus
ggacactggaggaccaggccaatga

SEQ ID NO: 41690 - DNA, 25 bp, Mus musculus
ggacactggcactgactacttggca

SEQ ID NO: 41691 - DNA, 25 bp, Mus musculus
ggacactggtactggtccgacggca

SEQ ID NO: 41692 - DNA, 25 bp, Mus musculus
ggacacttcagggatactctcatga

SEQ ID NO: 41693 - DNA, 25 bp, Mus musculus
ggacacttggtacacccacagcctt

SEQ ID NO: 41694 - DNA, 25 bp, Mus musculus
ggacagaaaacatcagctgccctgt

SEQ ID NO: 41695 - DNA, 25 bp, Mus musculus
ggacagaactagaggaaatggactt

SEQ ID NO: 41696 - DNA, 25 bp, Mus musculus
ggacagacaatacaagtggtttatg

SEQ ID NO: 41697 - DNA, 25 bp, Mus musculus
ggacagactctgttctacaaaccag

SEQ ID NO: 41698 - DNA, 25 bp, Mus musculus
ggacagagctactgatgccaatgtg

SEQ ID NO: 41699 - DNA, 25 bp, Mus musculus
ggacagagctccctctcagtcttta

SEQ ID NO: 41700 - DNA, 25 bp, Mus musculus
ggacagaggaggttgctgcctggct

SEQ ID NO: 41701 - DNA, 25 bp, Mus musculus
ggacagattcccctctgcttatgag

SEQ ID NO: 41702 - DNA, 25 bp, Mus musculus
ggacagattgtgatgccacgaggca

SEQ ID NO: 41703 - DNA, 25 bp, Mus musculus
ggacagcaaaatgcccgccatggta

SEQ ID NO: 41704 - DNA, 25 bp, Mus musculus
ggacagcaagatacagcccacactt

SEQ ID NO: 41705 - DNA, 25 bp, Mus musculus
ggacagcacagtagatctggcctaa

SEQ ID NO: 41706 - DNA, 25 bp, Mus musculus
ggacagcaggcattaccaatttttg

SEQ ID NO: 41707 - DNA, 25 bp, Mus musculus
ggacagcatctgctataacctacag

SEQ ID NO: 41708 - DNA, 25 bp, Mus musculus
ggacagccattgtcctgacctccag

SEQ ID NO: 41709 - DNA, 25 bp, Mus musculus
ggacagcctattagctattgatgca

SEQ ID NO: 41710 - DNA, 25 bp, Mus musculus
ggacagcgacctgtccgattacggg

SEQ ID NO: 41711 - DNA, 25 bp, Mus musculus
ggacagctagtgtgcatgtgcctac

SEQ ID NO: 41712 - DNA, 25 bp, Mus musculus
ggacagctggacaccattctaccaa

SEQ ID NO: 41713 - DNA, 25 bp, Mus musculus
ggacagctgtatgcctacgactgga

SEQ ID NO: 41714 - DNA, 25 bp, Mus musculus
ggacaggagctcgttagtggctcca

SEQ ID NO: 41715 - DNA, 25 bp, Mus musculus
ggacaggcacgaggatgcccataga

SEQ ID NO: 41716 - DNA, 25 bp, Mus musculus
ggacaggcgccatcgtggatgtccc

SEQ ID NO: 41717 - DNA, 25 bp, Mus musculus
ggacaggtggtcttttctgagacag

SEQ ID NO: 41718 - DNA, 25 bp, Mus musculus
ggacagtcaaaggttcagaagtaga

SEQ ID NO: 41719 - DNA, 25 bp, Mus musculus
ggacagtccactcaggcttactcag

SEQ ID NO: 41720 - DNA, 25 bp, Mus musculus
ggacagtgatcattctaacctgcaa

SEQ ID NO: 41721 - DNA, 25 bp, Mus musculus
ggacagtgccttttctaacctggag

SEQ ID NO: 41722 - DNA, 25 bp, Mus musculus
ggacagtgctatgctagaatacctg

SEQ ID NO: 41723 - DNA, 25 bp, Mus musculus
ggacagtggcacaatgacatctaag

SEQ ID NO: 41724 - DNA, 25 bp, Mus musculus
ggacagtgggcaaggctgacatttt

SEQ ID NO: 41725 - DNA, 25 bp, Mus musculus
ggacagttaaaggtaaattcgatga

SEQ ID NO: 41726 - DNA, 25 bp, Mus musculus
ggacagttctaccatccagatcaga

SEQ ID NO: 41727 - DNA, 25 bp, Mus musculus
ggacagttgtcattggcatcatcgc

SEQ ID NO: 41728 - DNA, 25 bp, Mus musculus
ggacagtttccaagaaatctgccta

SEQ ID NO: 41729 - DNA, 25 bp, Mus musculus
ggacagtttccatgaaatctgccta

SEQ ID NO: 41730 - DNA, 25 bp, Mus musculus
ggacagtttggtgccagctcttcag

SEQ ID NO: 41731 - DNA, 25 bp, Mus musculus
ggacataaacaatacgggaaccgag

SEQ ID NO: 41732 - DNA, 25 bp, Mus musculus
ggacataatgcaaaacattgacctg

SEQ ID NO: 41733 - DNA, 25 bp, Mus musculus
ggacatacacctacatctccagata

SEQ ID NO: 41734 - DNA, 25 bp, Mus musculus
ggacatatcagactgatccaaagca

SEQ ID NO: 41735 - DNA, 25 bp, Mus musculus
ggacatatcagagtgatccaaagca

SEQ ID NO: 41736 - DNA, 25 bp, Mus musculus
ggacatatctgagttccctcaagaa

SEQ ID NO: 41737 - DNA, 25 bp, Mus musculus
ggacatatgccccagagtgatatag

SEQ ID NO: 41738 - DNA, 25 bp, Mus musculus
ggacatatgcccgagagtgatatag

SEQ ID NO: 41739 - DNA, 25 bp, Mus musculus
ggacatattaactcttacctgaagc

SEQ ID NO: 41740 - DNA, 25 bp, Mus musculus
ggacatcaactggataccgatggga

SEQ ID NO: 41741 - DNA, 25 bp, Mus musculus
ggacatcagaattctctgcccctgt

SEQ ID NO: 41742 - DNA, 25 bp, Mus musculus
ggacatcatcacagtggcagctggt

SEQ ID NO: 41743 - DNA, 25 bp, Mus musculus
ggacatcatcactgtggcagctggt

SEQ ID NO: 41744 - DNA, 25 bp, Mus musculus
ggacatccgaagaaacctggctgat

SEQ ID NO: 41745 - DNA, 25 bp, Mus musculus
ggacatccttctccacacaggcgat

SEQ ID NO: 41746 - DNA, 25 bp, Mus musculus
ggacatcggactacttaccaagccg

SEQ ID NO: 41747 - DNA, 25 bp, Mus musculus
ggacatcggacttcttaccaagccg

SEQ ID NO: 41748 - DNA, 25 bp, Mus musculus
ggacatcgtcctccatgtttttaag

SEQ ID NO: 41749 - DNA, 25 bp, Mus musculus
ggacatctccttgggatcctaaaga

SEQ ID NO: 41750 - DNA, 25 bp, Mus musculus
ggacatctgagcgagtgactctgat

SEQ ID NO: 41751 - DNA, 25 bp, Mus musculus
ggacatctggaagaaattcgagctg

SEQ ID NO: 41752 - DNA, 25 bp, Mus musculus
ggacatctgtgagcatgctgtatga

SEQ ID NO: 41753 - DNA, 25 bp, Mus musculus
ggacatgaagaacaccacatgccag

SEQ ID NO: 41754 - DNA, 25 bp, Mus musculus
ggacatgactcaacggtgcacagtc

SEQ ID NO: 41755 - DNA, 25 bp, Mus musculus
ggacatgcatcgtcccctggactct

SEQ ID NO: 41756 - DNA, 25 bp, Mus musculus
ggacatggacgcagcctcctcactg

SEQ ID NO: 41757 - DNA, 25 bp, Mus musculus
ggacatgtaaatatcgtgtcacagc

SEQ ID NO: 41758 - DNA, 25 bp, Mus musculus
ggacatgtgacagcagtaacactag

SEQ ID NO: 41759 - DNA, 25 bp, Mus musculus
ggacatgtgtgagatctgcaggctt

SEQ ID NO: 41760 - DNA, 25 bp, Mus musculus
ggacattagagatcacccagtgcag

SEQ ID NO: 41761 - DNA, 25 bp, Mus musculus
ggacattatcctcagggtgcccatc

SEQ ID NO: 41762 - DNA, 25 bp, Mus musculus
ggacattctgacctcaaggcattca

SEQ ID NO: 41763 - DNA, 25 bp, Mus musculus
ggacattgcatcagggatggccata

SEQ ID NO: 41764 - DNA, 25 bp, Mus musculus
ggacattgttctctacctgtgtgac

SEQ ID NO: 41765 - DNA, 25 bp, Mus musculus
ggacatttactcagaaacctcagga

SEQ ID NO: 41766 - DNA, 25 bp, Mus musculus
ggacatttatcaggaaagcataccg

SEQ ID NO: 41767 - DNA, 25 bp, Mus musculus
ggacatttggatgtaaacccatcca

SEQ ID NO: 41768 - DNA, 25 bp, Mus musculus
ggacattttctataagaattccttg

SEQ ID NO: 41769 - DNA, 25 bp, Mus musculus
ggaccaaacgagacacagtgaaagg

SEQ ID NO: 41770 - DNA, 25 bp, Mus musculus
ggaccaacaagcactagtgccagtg

SEQ ID NO: 41771 - DNA, 25 bp, Mus musculus
ggaccaagcccatcaccattggcag

SEQ ID NO: 41772 - DNA, 25 bp, Mus musculus
ggaccaagccgctgggcatgtgact

SEQ ID NO: 41773 - DNA, 25 bp, Mus musculus
ggaccaagtgatgctcaaagccatg

SEQ ID NO: 41774 - DNA, 25 bp, Mus musculus
ggaccaagtttgcacatccctgcca

SEQ ID NO: 41775 - DNA, 25 bp, Mus musculus
ggaccacctagagagaactgccagt

SEQ ID NO: 41776 - DNA, 25 bp, Mus musculus
ggaccacgctctcaacgatatgact

SEQ ID NO: 41777 - DNA, 25 bp, Mus musculus
ggaccacttgattgaacgcctgtac

SEQ ID NO: 41778 - DNA, 25 bp, Mus musculus
ggaccagagacgacttaagcgcgag

SEQ ID NO: 41779 - DNA, 25 bp, Mus musculus
ggaccagatttttgactgcccaata

SEQ ID NO: 41780 - DNA, 25 bp, Mus musculus
ggaccagcagaatctaccctacggt

SEQ ID NO: 41781 - DNA, 25 bp, Mus musculus
ggaccagcagcctgaggtctccaag

SEQ ID NO: 41782 - DNA, 25 bp, Mus musculus
ggaccaggaagtgtgcaagaactat

SEQ ID NO: 41783 - DNA, 25 bp, Mus musculus
ggaccaggacatacaggaacatcat

SEQ ID NO: 41784 - DNA, 25 bp, Mus musculus
ggaccaggataatgccatcattcgt

SEQ ID NO: 41785 - DNA, 25 bp, Mus musculus
ggaccaggccccattttatcacttg

SEQ ID NO: 41786 - DNA, 25 bp, Mus musculus
ggaccaggctgaaaacatatgcgaa

SEQ ID NO: 41787 - DNA, 25 bp, Mus musculus
ggaccagtgggactgagcccaaaat

SEQ ID NO: 41788 - DNA, 25 bp, Mus musculus
ggaccatagaagagttgaaagaacc

SEQ ID NO: 41789 - DNA, 25 bp, Mus musculus
ggaccatcacctgtgtcctggagac

SEQ ID NO: 41790 - DNA, 25 bp, Mus musculus
ggaccatcagggaaacatctatgtt

SEQ ID NO: 41791 - DNA, 25 bp, Mus musculus
ggaccatctgcgaccaccggaggga

SEQ ID NO: 41792 - DNA, 25 bp, Mus musculus
ggaccatgacgggacccggagctca

SEQ ID NO: 41793 - DNA, 25 bp, Mus musculus
ggaccatgccagaagtgcttcttct

SEQ ID NO: 41794 - DNA, 25 bp, Mus musculus
ggaccatggagcacagacaccagtt

SEQ ID NO: 41795 - DNA, 25 bp, Mus musculus
ggaccattcctgcagacacagcctt

SEQ ID NO: 41796 - DNA, 25 bp, Mus musculus
ggaccatttttcagatttagccttc

SEQ ID NO: 41797 - DNA, 25 bp, Mus musculus
ggacccaaacaggagacattcacct

SEQ ID NO: 41798 - DNA, 25 bp, Mus musculus
ggacccaacagtactctgatcatca

SEQ ID NO: 41799 - DNA, 25 bp, Mus musculus
ggacccaacatcctttgatccagaa

SEQ ID NO: 41800 - DNA, 25 bp, Mus musculus
ggacccaactatctgcagatacctg

SEQ ID NO: 41801 - DNA, 25 bp, Mus musculus
ggacccacatcccttaagcagcaga

SEQ ID NO: 41802 - DNA, 25 bp, Mus musculus
ggacccaccaagcaaacccgatgag

SEQ ID NO: 41803 - DNA, 25 bp, Mus musculus
ggacccagaaatggccgccaagcta

SEQ ID NO: 41804 - DNA, 25 bp, Mus musculus
ggacccagccaatgatacctttgac

SEQ ID NO: 41805 - DNA, 25 bp, Mus musculus
ggacccagccgtaggcaagacggcc

SEQ ID NO: 41806 - DNA, 25 bp, Mus musculus
ggacccatttccagaagaactacac

SEQ ID NO: 41807 - DNA, 25 bp, Mus musculus
ggaccccacaggacttcacatactg

SEQ ID NO: 41808 - DNA, 25 bp, Mus musculus
ggaccccagcgctaacttctacggg

SEQ ID NO: 41809 - DNA, 25 bp, Mus musculus
ggacccctggttgccttgatcatct

SEQ ID NO: 41810 - DNA, 25 bp, Mus musculus
ggacccgaatccctggctgcagatc

SEQ ID NO: 41811 - DNA, 25 bp, Mus musculus
ggacccgtccatttttactgcacag

SEQ ID NO: 41812 - DNA, 25 bp, Mus musculus
ggaccctccagtgccagattacatg

SEQ ID NO: 41813 - DNA, 25 bp, Mus musculus
ggaccctccgtctgagatcgaaagg

SEQ ID NO: 41814 - DNA, 25 bp, Mus musculus
ggaccctggctgttacccagagaag

SEQ ID NO: 41815 - DNA, 25 bp, Mus musculus
ggaccctgggaccacaacgcacttg

SEQ ID NO: 41816 - DNA, 25 bp, Mus musculus
ggaccctgggacgacaacgcacttg

SEQ ID NO: 41817 - DNA, 25 bp, Mus musculus
ggaccctgtcaaccagggactgaca

SEQ ID NO: 41818 - DNA, 25 bp, Mus musculus
ggacccttccctctctgagcttgag

SEQ ID NO: 41819 - DNA, 25 bp, Mus musculus
ggacccttgaccatgcacttcttga

SEQ ID NO: 41820 - DNA, 25 bp, Mus musculus
ggaccgccagagcaaacaaacgctc

SEQ ID NO: 41821 - DNA, 25 bp, Mus musculus
ggaccggctcatcgagccactcaga

SEQ ID NO: 41822 - DNA, 25 bp, Mus musculus
ggaccgggatctgcaatctctgaga

SEQ ID NO: 41823 - DNA, 25 bp, Mus musculus
ggaccgtgcccagtgacaacatttg

SEQ ID NO: 41824 - DNA, 25 bp, Mus musculus
ggaccgtttggctctggccaccagc

SEQ ID NO: 41825 - DNA, 25 bp, Mus musculus
ggacctacaaattggagcaaatcaa

SEQ ID NO: 41826 - DNA, 25 bp, Mus musculus
ggacctagagctgctgatccagacg

SEQ ID NO: 41827 - DNA, 25 bp, Mus musculus
ggacctagaggaggagctgaaaatt

SEQ ID NO: 41828 - DNA, 25 bp, Mus musculus
ggacctaggaaacgccagtcttctc

SEQ ID NO: 41829 - DNA, 25 bp, Mus musculus
ggacctatgtgctgcaggacaacag

SEQ ID NO: 41830 - DNA, 25 bp, Mus musculus
ggacctattatttctgcaccgatac

SEQ ID NO: 41831 - DNA, 25 bp, Mus musculus
ggacctatttgagagctgcggccac

SEQ ID NO: 41832 - DNA, 25 bp, Mus musculus
ggacctcaggagtaaaggtgttgct

SEQ ID NO: 41833 - DNA, 25 bp, Mus musculus
ggacctcagggcattccaggtgcag

SEQ ID NO: 41834 - DNA, 25 bp, Mus musculus
ggacctctaaaacgtgagcctgcat

SEQ ID NO: 41835 - DNA, 25 bp, Mus musculus
ggacctctaatttgtaatactcagg

SEQ ID NO: 41836 - DNA, 25 bp, Mus musculus
ggacctgaaccacgaggccgcagca

SEQ ID NO: 41837 - DNA, 25 bp, Mus musculus
ggacctgacgtcagtgcgcttcacg

SEQ ID NO: 41838 - DNA, 25 bp, Mus musculus
ggacctgatctcacagaatctgaaa

SEQ ID NO: 41839 - DNA, 25 bp, Mus musculus
ggacctgcatgtgtacgagatcccc

SEQ ID NO: 41840 - DNA, 25 bp, Mus musculus
ggacctgcgaacaggggacgtccca

SEQ ID NO: 41841 - DNA, 25 bp, Mus musculus
ggacctgcgccatctagggaaggat

SEQ ID NO: 41842 - DNA, 25 bp, Mus musculus
ggacctggacccagtcagctcagca

SEQ ID NO: 41843 - DNA, 25 bp, Mus musculus
ggacctggcagaggaaaatttgaag

SEQ ID NO: 41844 - DNA, 25 bp, Mus musculus
ggacctggtgaaagttctgagaaag

SEQ ID NO: 41845 - DNA, 25 bp, Mus musculus
ggacctgtacttccctgatagggtt

SEQ ID NO: 41846 - DNA, 25 bp, Mus musculus
ggacctgtatccactccccatatgg

SEQ ID NO: 41847 - DNA, 25 bp, Mus musculus
ggacctgtatcctctccccatatgg

SEQ ID NO: 41848 - DNA, 25 bp, Mus musculus
ggacctgtattcagagtgaacttca

SEQ ID NO: 41849 - DNA, 25 bp, Mus musculus
ggacctgtattctgagtgaacttca

SEQ ID NO: 41850 - DNA, 25 bp, Mus musculus
ggaccttaataggatctgcctgcag

SEQ ID NO: 41851 - DNA, 25 bp, Mus musculus
ggaccttcacttgggcatgttcctg

SEQ ID NO: 41852 - DNA, 25 bp, Mus musculus
ggaccttccaacacagtgcagacag

SEQ ID NO: 41853 - DNA, 25 bp, Mus musculus
ggaccttcgacagattgaactggct

SEQ ID NO: 41854 - DNA, 25 bp, Mus musculus
ggaccttctaccatgaacagctcga

SEQ ID NO: 41855 - DNA, 25 bp, Mus musculus
ggaccttgaagccaggcctgatgat

SEQ ID NO: 41856 - DNA, 25 bp, Mus musculus
ggaccttgagaggaatgacggctct

SEQ ID NO: 41857 - DNA, 25 bp, Mus musculus
ggaccttgcgtctttgcttttgtga

SEQ ID NO: 41858 - DNA, 25 bp, Mus musculus
ggaccttgttgagcctttcctgcgt

SEQ ID NO: 41859 - DNA, 25 bp, Mus musculus
ggacgaccagccatccatctttgag

SEQ ID NO: 41860 - DNA, 25 bp, Mus musculus
ggacgagtgctgctgtccagccaac

SEQ ID NO: 41861 - DNA, 25 bp, Mus musculus
ggacgagtgctggtgtccagccaac

SEQ ID NO: 41862 - DNA, 25 bp, Mus musculus
ggacgatccgtaaggctcagaacct

SEQ ID NO: 41863 - DNA, 25 bp, Mus musculus
ggacgatcgccttaagcagctccag

SEQ ID NO: 41864 - DNA, 25 bp, Mus musculus
ggacgatgacaagttccccgtgtgc

SEQ ID NO: 41865 - DNA, 25 bp, Mus musculus
ggacgattgtgactgtcatcctgaa

SEQ ID NO: 41866 - DNA, 25 bp, Mus musculus
ggacgcatgaatgggtttattgacc

SEQ ID NO: 41867 - DNA, 25 bp, Mus musculus
ggacgcatggaatatctcgtgaaat

SEQ ID NO: 41868 - DNA, 25 bp, Mus musculus
ggacgccgccgttggcaagacgtct

SEQ ID NO: 41869 - DNA, 25 bp, Mus musculus
ggacgctggacaagtacgggattct

SEQ ID NO: 41870 - DNA, 25 bp, Mus musculus
ggacggaaatcctgcatttcataga

SEQ ID NO: 41871 - DNA, 25 bp, Mus musculus
ggacggacagctgaaattaaaaagc

SEQ ID NO: 41872 - DNA, 25 bp, Mus musculus
ggacggagtaaaatacgctgctgag

SEQ ID NO: 41873 - DNA, 25 bp, Mus musculus
ggacggcatccctttgccttcatgc

SEQ ID NO: 41874 - DNA, 25 bp, Mus musculus
ggacggccacaagatgaccagaaca

SEQ ID NO: 41875 - DNA, 25 bp, Mus musculus
ggacggcctcatccctatgacagta

SEQ ID NO: 41876 - DNA, 25 bp, Mus musculus
ggacggcttcagtgtcatcctggac

SEQ ID NO: 41877 - DNA, 25 bp, Mus musculus
ggacgggaccactgcgtacattcac

SEQ ID NO: 41878 - DNA, 25 bp, Mus musculus
ggacgggctggccttcaatgcactc

SEQ ID NO: 41879 - DNA, 25 bp, Mus musculus
ggacggtcataagcatccacacgtt

SEQ ID NO: 41880 - DNA, 25 bp, Mus musculus
ggacggtgttaagtcgccatcatca

SEQ ID NO: 41881 - DNA, 25 bp, Mus musculus
ggacgtactggtgccgaagaaagca

SEQ ID NO: 41882 - DNA, 25 bp, Mus musculus
ggacgtcatatccagcagtaccata

SEQ ID NO: 41883 - DNA, 25 bp, Mus musculus
ggacgtggatacttacctgacctca

SEQ ID NO: 41884 - DNA, 25 bp, Mus musculus
ggacgttttacatccaggtcatgac

SEQ ID NO: 41885 - DNA, 25 bp, Mus musculus
ggactaaaacgtcaaagacttactg

SEQ ID NO: 41886 - DNA, 25 bp, Mus musculus
ggactaagctgattttatcagcagc

SEQ ID NO: 41887 - DNA, 25 bp, Mus musculus
ggactaatcaacaaggtcaagtcac

SEQ ID NO: 41888 - DNA, 25 bp, Mus musculus
ggactacactgttgaagacctggca

SEQ ID NO: 41889 - DNA, 25 bp, Mus musculus
ggactacagcatgccagtgatgtga

SEQ ID NO: 41890 - DNA, 25 bp, Mus musculus
ggactacattccctacccaagtgtc

SEQ ID NO: 41891 - DNA, 25 bp, Mus musculus
ggactaccagcagctaatagaagac

SEQ ID NO: 41892 - DNA, 25 bp, Mus musculus
ggactaccctcttataccagttggc

SEQ ID NO: 41893 - DNA, 25 bp, Mus musculus
ggactagaaggagcggttcccacct

SEQ ID NO: 41894 - DNA, 25 bp, Mus musculus
ggactagctcatctcatggccctgg

SEQ ID NO: 41895 - DNA, 25 bp, Mus musculus
ggactataaagagggaaattcctgc

SEQ ID NO: 41896 - DNA, 25 bp, Mus musculus
ggactatgacttcagccagctccag

SEQ ID NO: 41897 - DNA, 25 bp, Mus musculus
ggactatgacttgagccagctccag

SEQ ID NO: 41898 - DNA, 25 bp, Mus musculus
ggactatgcagttcttgctgcagaa

SEQ ID NO: 41899 - DNA, 25 bp, Mus musculus
ggactatgtgcagaaaacctactct

SEQ ID NO: 41900 - DNA, 25 bp, Mus musculus
ggactattcacggatcattgagcgt

SEQ ID NO: 41901 - DNA, 25 bp, Mus musculus
ggactatttttggaagccagataaa

SEQ ID NO: 41902 - DNA, 25 bp, Mus musculus
ggactcaaatgttgccttggaaaag

SEQ ID NO: 41903 - DNA, 25 bp, Mus musculus
ggactcagagctagaagacttatgc

SEQ ID NO: 41904 - DNA, 25 bp, Mus musculus
ggactcagctcaacatgttccagac

SEQ ID NO: 41905 - DNA, 25 bp, Mus musculus
ggactcagctccgaattacgtatag

SEQ ID NO: 41906 - DNA, 25 bp, Mus musculus
ggactccaagctcctggccatgaag

SEQ ID NO: 41907 - DNA, 25 bp, Mus musculus
ggactccacccatgggctggctggc

SEQ ID NO: 41908 - DNA, 25 bp, Mus musculus
ggactccgagttactgccatcaaaa

SEQ ID NO: 41909 - DNA, 25 bp, Mus musculus
ggactcctctgataaaatgcctaat

SEQ ID NO: 41910 - DNA, 25 bp, Mus musculus
ggactcctgaaaaaaaagtgccgca

SEQ ID NO: 41911 - DNA, 25 bp, Mus musculus
ggactcgcctcacaaaagttacatg

SEQ ID NO: 41912 - DNA, 25 bp, Mus musculus
ggactcggggcttgcacatgctttt

SEQ ID NO: 41913 - DNA, 25 bp, Mus musculus
ggactcgttagaaaagtcaaacact

SEQ ID NO: 41914 - DNA, 25 bp, Mus musculus
ggactctacccaaagaatgggtttg

SEQ ID NO: 41915 - DNA, 25 bp, Mus musculus
ggactctacgcttttcgagctcaag

SEQ ID NO: 41916 - DNA, 25 bp, Mus musculus
ggactctccaaggtgtcaggagatg

SEQ ID NO: 41917 - DNA, 25 bp, Mus musculus
ggactctgaccaagtagcgcagagt

SEQ ID NO: 41918 - DNA, 25 bp, Mus musculus
ggactctgaggagaatgaccatcag

SEQ ID NO: 41919 - DNA, 25 bp, Mus musculus
ggactctgcccttctaagtaaacgg

SEQ ID NO: 41920 - DNA, 25 bp, Mus musculus
ggactctttaccacagcccgctttg

SEQ ID NO: 41921 - DNA, 25 bp, Mus musculus
ggactgaaaggaatagtcgaaccga

SEQ ID NO: 41922 - DNA, 25 bp, Mus musculus
ggactgaaaggaggtcttcaagaat

SEQ ID NO: 41923 - DNA, 25 bp, Mus musculus
ggactgaagaacacctctgtcttcg

SEQ ID NO: 41924 - DNA, 25 bp, Mus musculus
ggactgaagttcagagggacattgc

SEQ ID NO: 41925 - DNA, 25 bp, Mus musculus
ggactgaccccgacaggcatattaa

SEQ ID NO: 41926 - DNA, 25 bp, Mus musculus
ggactgatgcagacatgcccatgga

SEQ ID NO: 41927 - DNA, 25 bp, Mus musculus
ggactgcaatgaccagaataaaccc

SEQ ID NO: 41928 - DNA, 25 bp, Mus musculus
ggactgcacatcacacctgtcttaa

SEQ ID NO: 41929 - DNA, 25 bp, Mus musculus
ggactgcaccggaagccattcaata

SEQ ID NO: 41930 - DNA, 25 bp, Mus musculus
ggactgcactcttccactgtaccag

SEQ ID NO: 41931 - DNA, 25 bp, Mus musculus
ggactgcccaagaaacccgagatta

SEQ ID NO: 41932 - DNA, 25 bp, Mus musculus
ggactgcccaagtaacccgagatta

SEQ ID NO: 41933 - DNA, 25 bp, Mus musculus
ggactgccgagaccccagcaaaagt

SEQ ID NO: 41934 - DNA, 25 bp, Mus musculus
ggactgcctatcagagcctgccaaa

SEQ ID NO: 41935 - DNA, 25 bp, Mus musculus
ggactgcgtccctgcttctgagagg

SEQ ID NO: 41936 - DNA, 25 bp, Mus musculus
ggactgctgaacttgctcaatgatt

SEQ ID NO: 41937 - DNA, 25 bp, Mus musculus
ggactgctgacctttggatacctag

SEQ ID NO: 41938 - DNA, 25 bp, Mus musculus
ggactggaaaaattcgggtacagag

SEQ ID NO: 41939 - DNA, 25 bp, Mus musculus
ggactggcccggactggaataaaca

SEQ ID NO: 41940 - DNA, 25 bp, Mus musculus
ggactggcccggtctggaataaaca

SEQ ID NO: 41941 - DNA, 25 bp, Mus musculus
ggactggctccagccggaagtgcac

SEQ ID NO: 41942 - DNA, 25 bp, Mus musculus
ggactggcttatcccaaaacagact

SEQ ID NO: 41943 - DNA, 25 bp, Mus musculus
ggactgggaggcacagctgcaccaa

SEQ ID NO: 41944 - DNA, 25 bp, Mus musculus
ggactgggctccctcttgctattcc

SEQ ID NO: 41945 - DNA, 25 bp, Mus musculus
ggactgggtgctgactgctgcacat

SEQ ID NO: 41946 - DNA, 25 bp, Mus musculus
ggactgtaaggaagcataccatgaa

SEQ ID NO: 41947 - DNA, 25 bp, Mus musculus
ggactgtccagcaggttaaccagga

SEQ ID NO: 41948 - DNA, 25 bp, Mus musculus
ggactgtgcaagtgacgggacttta

SEQ ID NO: 41949 - DNA, 25 bp, Mus musculus
ggactgttcccactcacatgaacga

SEQ ID NO: 41950 - DNA, 25 bp, Mus musculus
ggacttaaggcccattcaggaggaa

SEQ ID NO: 41951 - DNA, 25 bp, Mus musculus
ggacttaccaacctgcgagattgca

SEQ ID NO: 41952 - DNA, 25 bp, Mus musculus
ggacttaccccaattacactgtgtg

SEQ ID NO: 41953 - DNA, 25 bp, Mus musculus
ggacttactaatcatacatctagtg

SEQ ID NO: 41954 - DNA, 25 bp, Mus musculus
ggacttatctcgactgcccggccaa

SEQ ID NO: 41955 - DNA, 25 bp, Mus musculus
ggacttcaagacgacagttctggag

SEQ ID NO: 41956 - DNA, 25 bp, Mus musculus
ggacttcacgtactctggccgaaag

SEQ ID NO: 41957 - DNA, 25 bp, Mus musculus
ggacttcagacgcagagcgagccct

SEQ ID NO: 41958 - DNA, 25 bp, Mus musculus
ggacttcatagcttcctacgacacc

SEQ ID NO: 41959 - DNA, 25 bp, Mus musculus
ggacttccgtttgcagaacagtaca

SEQ ID NO: 41960 - DNA, 25 bp, Mus musculus
ggacttcctgctcaaggccatcatg

SEQ ID NO: 41961 - DNA, 25 bp, Mus musculus
ggacttcttcattgacctgcggctg

SEQ ID NO: 41962 - DNA, 25 bp, Mus musculus
ggacttcttggatggcagcgccagt

SEQ ID NO: 41963 - DNA, 25 bp, Mus musculus
ggacttcttgtcacctgataaccct

SEQ ID NO: 41964 - DNA, 25 bp, Mus musculus
ggacttcttgtctcctgataaccct

SEQ ID NO: 41965 - DNA, 25 bp, Mus musculus
ggacttgaaaattaaagcacatgtc

SEQ ID NO: 41966 - DNA, 25 bp, Mus musculus
ggacttgaatgtgacagagtacatg

SEQ ID NO: 41967 - DNA, 25 bp, Mus musculus
ggacttgagattggttgatgctaca

SEQ ID NO: 41968 - DNA, 25 bp, Mus musculus
ggacttgaggacaaatcgtgtcttg

SEQ ID NO: 41969 - DNA, 25 bp, Mus musculus
ggacttgatcaacttctgccttagc

SEQ ID NO: 41970 - DNA, 25 bp, Mus musculus
ggacttgattaataacaaattggca

SEQ ID NO: 41971 - DNA, 25 bp, Mus musculus
ggacttggaagaatttggtgaaaat

SEQ ID NO: 41972 - DNA, 25 bp, Mus musculus
ggacttggacaagtatgacatcatg

SEQ ID NO: 41973 - DNA, 25 bp, Mus musculus
ggacttgttcaaggatcccagacta

SEQ ID NO: 41974 - DNA, 25 bp, Mus musculus
ggactttcagttaccttgacgatgt

SEQ ID NO: 41975 - DNA, 25 bp, Mus musculus
ggactttctgaagggcatgctgcag

SEQ ID NO: 41976 - DNA, 25 bp, Mus musculus
ggactttgaccctgccatcaatgag

SEQ ID NO: 41977 - DNA, 25 bp, Mus musculus
ggactttgatgtggctaatgacatc

SEQ ID NO: 41978 - DNA, 25 bp, Mus musculus
ggacttttaagtgtcaccactgtga

SEQ ID NO: 41979 - DNA, 25 bp, Mus musculus
ggacttttggcactcttatatcgac

SEQ ID NO: 41980 - DNA, 25 bp, Mus musculus
ggagaaaagtcccaccgtacacaga

SEQ ID NO: 41981 - DNA, 25 bp, Mus musculus
ggagaaaatggagccaataaacact

SEQ ID NO: 41982 - DNA, 25 bp, Mus musculus
ggagaaaattcctatggtctagata

SEQ ID NO: 41983 - DNA, 25 bp, Mus musculus
ggagaaacccttccagaggaagtag

SEQ ID NO: 41984 - DNA, 25 bp, Mus musculus
ggagaaactgaaacaagctaagaag

SEQ ID NO: 41985 - DNA, 25 bp, Mus musculus
ggagaaactgaatcaagctaagaag

SEQ ID NO: 41986 - DNA, 25 bp, Mus musculus
ggagaaagcagccatcatccaccag

SEQ ID NO: 41987 - DNA, 25 bp, Mus musculus
ggagaaagcattggtctcatctgtc

SEQ ID NO: 41988 - DNA, 25 bp, Mus musculus
ggagaaaggcgagttccagattctt

SEQ ID NO: 41989 - DNA, 25 bp, Mus musculus
ggagaaattccatcacctcagctaa

SEQ ID NO: 41990 - DNA, 25 bp, Mus musculus
ggagaacactgtactcagagcagca

SEQ ID NO: 41991 - DNA, 25 bp, Mus musculus
ggagaacagcaatttatttatatag

SEQ ID NO: 41992 - DNA, 25 bp, Mus musculus
ggagaacagcgagtgctccccaaag

SEQ ID NO: 41993 - DNA, 25 bp, Mus musculus
ggagaacagctcgagccgggaaaac

SEQ ID NO: 41994 - DNA, 25 bp, Mus musculus
ggagaacatgaatctcagcaaaaag

SEQ ID NO: 41995 - DNA, 25 bp, Mus musculus
ggagaaccatcaggagattttgaaa

SEQ ID NO: 41996 - DNA, 25 bp, Mus musculus
ggagaacccagcacatgctgatggg

SEQ ID NO: 41997 - DNA, 25 bp, Mus musculus
ggagaacccagctcatgctgatggg

SEQ ID NO: 41998 - DNA, 25 bp, Mus musculus
ggagaactaccacaatgtggcctcg

SEQ ID NO: 41999 - DNA, 25 bp, Mus musculus
ggagaactacttccccttccagtgg

SEQ ID NO: 42000 - DNA, 25 bp, Mus musculus
ggagaactccagctttgaggccatc

SEQ ID NO: 42001 - DNA, 25 bp, Mus musculus
ggagaactgaagaaggccctacatt

SEQ ID NO: 42002 - DNA, 25 bp, Mus musculus
ggagaactttgagcctctctatgac

SEQ ID NO: 42003 - DNA, 25 bp, Mus musculus
ggagaagacgatgacctcagactca

SEQ ID NO: 42004 - DNA, 25 bp, Mus musculus
ggagaagacggctcagcccaatgga

SEQ ID NO: 42005 - DNA, 25 bp, Mus musculus
ggagaagacttgtggcagagaaaaa

SEQ ID NO: 42006 - DNA, 25 bp, Mus musculus
ggagaagagccttgtcctgcaggcc

SEQ ID NO: 42007 - DNA, 25 bp, Mus musculus
ggagaagattctaaatgtggatgag

SEQ ID NO: 42008 - DNA, 25 bp, Mus musculus
ggagaagattttcgagccagcatag

SEQ ID NO: 42009 - DNA, 25 bp, Mus musculus
ggagaagcaggaggaaatcctctcc

SEQ ID NO: 42010 - DNA, 25 bp, Mus musculus
ggagaagcctagtagaactcccagc

SEQ ID NO: 42011 - DNA, 25 bp, Mus musculus
ggagaagcctcatcaaccagggagc

SEQ ID NO: 42012 - DNA, 25 bp, Mus musculus
ggagaagctgcctcttacctagatt

SEQ ID NO: 42013 - DNA, 25 bp, Mus musculus
ggagaagctgcgctctgacctgtcc

SEQ ID NO: 42014 - DNA, 25 bp, Mus musculus
ggagaagctgctgcatctgggcccc

SEQ ID NO: 42015 - DNA, 25 bp, Mus musculus
ggagaaggatggtcacaaagatcca

SEQ ID NO: 42016 - DNA, 25 bp, Mus musculus
ggagaaggccagtaacatcgtcatg

SEQ ID NO: 42017 - DNA, 25 bp, Mus musculus
ggagaaggtgccctgtaattctcag

SEQ ID NO: 42018 - DNA, 25 bp, Mus musculus
ggagaaggtggacatcatcatcagc

SEQ ID NO: 42019 - DNA, 25 bp, Mus musculus
ggagaagtcaataaagaagccagcc

SEQ ID NO: 42020 - DNA, 25 bp, Mus musculus
ggagaagtccactggtacaactcaa

SEQ ID NO: 42021 - DNA, 25 bp, Mus musculus
ggagaagtgtcagctggagatcaac

SEQ ID NO: 42022 - DNA, 25 bp, Mus musculus
ggagaagttggcgatcaaggacctc

SEQ ID NO: 42023 - DNA, 25 bp, Mus musculus
ggagaatatgagtacagcccagtcg

SEQ ID NO: 42024 - DNA, 25 bp, Mus musculus
ggagaatcacgctatcatgggtgtg

SEQ ID NO: 42025 - DNA, 25 bp, Mus musculus
ggagaatgacaagcttcagctggaa

SEQ ID NO: 42026 - DNA, 25 bp, Mus musculus
ggagaattactagccacaggagata

SEQ ID NO: 42027 - DNA, 25 bp, Mus musculus
ggagacaaagcaagtctaaaggctt

SEQ ID NO: 42028 - DNA, 25 bp, Mus musculus
ggagacaaattcaaaacaccagcga

SEQ ID NO: 42029 - DNA, 25 bp, Mus musculus
ggagacacatgtggtaaagatagac

SEQ ID NO: 42030 - DNA, 25 bp, Mus musculus
ggagacaggacaagcattaaacatg

SEQ ID NO: 42031 - DNA, 25 bp, Mus musculus
ggagacattccccttctcggagtgc

SEQ ID NO: 42032 - DNA, 25 bp, Mus musculus
ggagaccaaccaactcctcagaaac

SEQ ID NO: 42033 - DNA, 25 bp, Mus musculus
ggagaccaacgagaggaacctcgca

SEQ ID NO: 42034 - DNA, 25 bp, Mus musculus
ggagaccagattcctaagtactgtt

SEQ ID NO: 42035 - DNA, 25 bp, Mus musculus
ggagaccagggtgctgtccagcacc

SEQ ID NO: 42036 - DNA, 25 bp, Mus musculus
ggagaccattgtcaagccagactat

SEQ ID NO: 42037 - DNA, 25 bp, Mus musculus
ggagacccaaggcacacaaacaatt

SEQ ID NO: 42038 - DNA, 25 bp, Mus musculus
ggagaccccacatgctacaagcaca

SEQ ID NO: 42039 - DNA, 25 bp, Mus musculus
ggagacccgggttttcatcttctct

SEQ ID NO: 42040 - DNA, 25 bp, Mus musculus
ggagacccttaaccctgtgtacgtg

SEQ ID NO: 42041 - DNA, 25 bp, Mus musculus
ggagacccttcaagctctctatgag

SEQ ID NO: 42042 - DNA, 25 bp, Mus musculus
ggagacctatcctctgcctctgcta

SEQ ID NO: 42043 - DNA, 25 bp, Mus musculus
ggagacctccgatgctaagagcact

SEQ ID NO: 42044 - DNA, 25 bp, Mus musculus
ggagaccttaccacttgaagatggg

SEQ ID NO: 42045 - DNA, 25 bp, Mus musculus
ggagacctttgagacgctgcacaac

SEQ ID NO: 42046 - DNA, 25 bp, Mus musculus
ggagacgcatgacagtcccttctgt

SEQ ID NO: 42047 - DNA, 25 bp, Mus musculus
ggagacggtacattacagaattagc

SEQ ID NO: 42048 - DNA, 25 bp, Mus musculus
ggagactcaccactagaagacgatg

SEQ ID NO: 42049 - DNA, 25 bp, Mus musculus
ggagactccacacagaattctttaa

SEQ ID NO: 42050 - DNA, 25 bp, Mus musculus
ggagactcgggcgtcggcaaaacct

SEQ ID NO: 42051 - DNA, 25 bp, Mus musculus
ggagactctcttcgtgcaccgattc

SEQ ID NO: 42052 - DNA, 25 bp, Mus musculus
ggagactctgttgaccaacattcag

SEQ ID NO: 42053 - DNA, 25 bp, Mus musculus
ggagactcttcaattgagctagaat

SEQ ID NO: 42054 - DNA, 25 bp, Mus musculus
ggagactcttccattcagacacctt

SEQ ID NO: 42055 - DNA, 25 bp, Mus musculus
ggagactgaccttgccccaagtcac

SEQ ID NO: 42056 - DNA, 25 bp, Mus musculus
ggagactgcaatgggtttgctcaat

SEQ ID NO: 42057 - DNA, 25 bp, Mus musculus
ggagagaaaagaaacttgctcttga

SEQ ID NO: 42058 - DNA, 25 bp, Mus musculus
ggagagaactccagaaagtgaagaa

SEQ ID NO: 42059 - DNA, 25 bp, Mus musculus
ggagagaagggtacactcggtttat

SEQ ID NO: 42060 - DNA, 25 bp, Mus musculus
ggagagaattcagctccagtttaaa

SEQ ID NO: 42061 - DNA, 25 bp, Mus musculus
ggagagacattatcagaatttaaag

SEQ ID NO: 42062 - DNA, 25 bp, Mus musculus
ggagagaccaagtccctgtggttcc

SEQ ID NO: 42063 - DNA, 25 bp, Mus musculus
ggagagactctacccgaaaacaaga

SEQ ID NO: 42064 - DNA, 25 bp, Mus musculus
ggagagagaagcgtctatagccaag

SEQ ID NO: 42065 - DNA, 25 bp, Mus musculus
ggagagagcgcatggagcccaccta

SEQ ID NO: 42066 - DNA, 25 bp, Mus musculus
ggagagagtttctgcattacaaaga

SEQ ID NO: 42067 - DNA, 25 bp, Mus musculus
ggagagatatagtgagcagatgact

SEQ ID NO: 42068 - DNA, 25 bp, Mus musculus
ggagagatctgctcgacaggacttg

SEQ ID NO: 42069 - DNA, 25 bp, Mus musculus
ggagagcagaggagttatgttatac

SEQ ID NO: 42070 - DNA, 25 bp, Mus musculus
ggagagcatgaatttgaagccctca

SEQ ID NO: 42071 - DNA, 25 bp, Mus musculus
ggagagcctctctataatgccgtgg

SEQ ID NO: 42072 - DNA, 25 bp, Mus musculus
ggagagccttattcatcgcttgcaa

SEQ ID NO: 42073 - DNA, 25 bp, Mus musculus
ggagagcgtcatcgataacccctat

SEQ ID NO: 42074 - DNA, 25 bp, Mus musculus
ggagagcgtgtaagtatgagaaccc

SEQ ID NO: 42075 - DNA, 25 bp, Mus musculus
ggagagcttcaagaaacagtcgttt

SEQ ID NO: 42076 - DNA, 25 bp, Mus musculus
ggagagcttgacaccttcatagtaa

SEQ ID NO: 42077 - DNA, 25 bp, Mus musculus
ggagagctttacctggaatattaca

SEQ ID NO: 42078 - DNA, 25 bp, Mus musculus
ggagaggaagtccaagtctatcatt

SEQ ID NO: 42079 - DNA, 25 bp, Mus musculus
ggagaggaccctacgggatctacga

SEQ ID NO: 42080 - DNA, 25 bp, Mus musculus
ggagaggcaatctgcccaaggagtc

SEQ ID NO: 42081 - DNA, 25 bp, Mus musculus
ggagaggcctgtccctcagcagatt

SEQ ID NO: 42082 - DNA, 25 bp, Mus musculus
ggagaggctccatcaaggtggtatc

SEQ ID NO: 42083 - DNA, 25 bp, Mus musculus
ggagaggtactctctgtatgaggac

SEQ ID NO: 42084 - DNA, 25 bp, Mus musculus
ggagagtacacacatcacaaagatc

SEQ ID NO: 42085 - DNA, 25 bp, Mus musculus
ggagagtatgtactcacattcaact

SEQ ID NO: 42086 - DNA, 25 bp, Mus musculus
ggagagtggctttcaggaacgtcaa

SEQ ID NO: 42087 - DNA, 25 bp, Mus musculus
ggagagttctcaggcagcctcggcc

SEQ ID NO: 42088 - DNA, 25 bp, Mus musculus
ggagataataatgctgttgatgacc

SEQ ID NO: 42089 - DNA, 25 bp, Mus musculus
ggagataatcggacattcacactga

SEQ ID NO: 42090 - DNA, 25 bp, Mus musculus
ggagataatcggtcattcacactga

SEQ ID NO: 42091 - DNA, 25 bp, Mus musculus
ggagataccccttgctcttgctgca

SEQ ID NO: 42092 - DNA, 25 bp, Mus musculus
ggagatactgaggagcccttctagg

SEQ ID NO: 42093 - DNA, 25 bp, Mus musculus
ggagatacttcaaatataccgtagc

SEQ ID NO: 42094 - DNA, 25 bp, Mus musculus
ggagatattctagcctccagcttct

SEQ ID NO: 42095 - DNA, 25 bp, Mus musculus
ggagatcaaaaagagccggcgtcac

SEQ ID NO: 42096 - DNA, 25 bp, Mus musculus
ggagatcaacttcaacacactgcag

SEQ ID NO: 42097 - DNA, 25 bp, Mus musculus
ggagatcattatctactgcaccggg

SEQ ID NO: 42098 - DNA, 25 bp, Mus musculus
ggagatccagcttgtccctgccttg

SEQ ID NO: 42099 - DNA, 25 bp, Mus musculus
ggagatcctctctcacctttgcaat

SEQ ID NO: 42100 - DNA, 25 bp, Mus musculus
ggagatgactccatccggtacccat

SEQ ID NO: 42101 - DNA, 25 bp, Mus musculus
ggagatgacttgattgtgaccccgt

SEQ ID NO: 42102 - DNA, 25 bp, Mus musculus
ggagatgatgagctgccccacatcc

SEQ ID NO: 42103 - DNA, 25 bp, Mus musculus
ggagatgcaggaggcctttttccaa

SEQ ID NO: 42104 - DNA, 25 bp, Mus musculus
ggagatgccacccaagtttatatag

SEQ ID NO: 42105 - DNA, 25 bp, Mus musculus
ggagatgccatccaagacgtcagtg

SEQ ID NO: 42106 - DNA, 25 bp, Mus musculus
ggagatgcctgacttcaattggaag

SEQ ID NO: 42107 - DNA, 25 bp, Mus musculus
ggagatgcgaaaaaacgtttattca

SEQ ID NO: 42108 - DNA, 25 bp, Mus musculus
ggagatgcgctctccaatggcatca

SEQ ID NO: 42109 - DNA, 25 bp, Mus musculus
ggagatgcgtcaactcccctggctc

SEQ ID NO: 42110 - DNA, 25 bp, Mus musculus
ggagatgcgtcatctcccctggctc

SEQ ID NO: 42111 - DNA, 25 bp, Mus musculus
ggagatgctggtacttgttttcaaa

SEQ ID NO: 42112 - DNA, 25 bp, Mus musculus
ggagatggacacttctgaggcaaag

SEQ ID NO: 42113 - DNA, 25 bp, Mus musculus
ggagattcccatccacgtttctgtc

SEQ ID NO: 42114 - DNA, 25 bp, Mus musculus
ggagattgctcttctccggaccaca

SEQ ID NO: 42115 - DNA, 25 bp, Mus musculus
ggagattggcaacccagagcctgtt

SEQ ID NO: 42116 - DNA, 25 bp, Mus musculus
ggagatttcagggaaactggtacag

SEQ ID NO: 42117 - DNA, 25 bp, Mus musculus
ggagcaaaaaacaagtatttccaag

SEQ ID NO: 42118 - DNA, 25 bp, Mus musculus
ggagcaaaaaactagtatttccaag

SEQ ID NO: 42119 - DNA, 25 bp, Mus musculus
ggagcaaaactgattgcacagaaat

SEQ ID NO: 42120 - DNA, 25 bp, Mus musculus
ggagcaaattctctcttggaccttg

SEQ ID NO: 42121 - DNA, 25 bp, Mus musculus
ggagcaaccatgaaacttggagagc

SEQ ID NO: 42122 - DNA, 25 bp, Mus musculus
ggagcaacggcttctgtcatctatg

SEQ ID NO: 42123 - DNA, 25 bp, Mus musculus
ggagcaactagaggtatttcaaaga

SEQ ID NO: 42124 - DNA, 25 bp, Mus musculus
ggagcaactggtggatggtttccta

SEQ ID NO: 42125 - DNA, 25 bp, Mus musculus
ggagcaagggagaagttctgtatat

SEQ ID NO: 42126 - DNA, 25 bp, Mus musculus
ggagcaatcctgtcattaggaggta

SEQ ID NO: 42127 - DNA, 25 bp, Mus musculus
ggagcacaacattgtggcaccgtat

SEQ ID NO: 42128 - DNA, 25 bp, Mus musculus
ggagcacaaccaagtcaccgagact

SEQ ID NO: 42129 - DNA, 25 bp, Mus musculus
ggagcacaccaaatccaggatcact

SEQ ID NO: 42130 - DNA, 25 bp, Mus musculus
ggagcacagataagggaagttcttt

SEQ ID NO: 42131 - DNA, 25 bp, Mus musculus
ggagcacagatatgggaagttcttt

SEQ ID NO: 42132 - DNA, 25 bp, Mus musculus
ggagcacaggaagagacacgagcca

SEQ ID NO: 42133 - DNA, 25 bp, Mus musculus
ggagcacatgcctagcctcaggctg

SEQ ID NO: 42134 - DNA, 25 bp, Mus musculus
ggagcaccatgcctttcgcctgggc

SEQ ID NO: 42135 - DNA, 25 bp, Mus musculus
ggagcaccatgcgtttcgcctgggc

SEQ ID NO: 42136 - DNA, 25 bp, Mus musculus
ggagcacctgcttctcgcctgacag

SEQ ID NO: 42137 - DNA, 25 bp, Mus musculus
ggagcacgatgctgtgctcagtctg

SEQ ID NO: 42138 - DNA, 25 bp, Mus musculus
ggagcacgcagctgaacaagaagag

SEQ ID NO: 42139 - DNA, 25 bp, Mus musculus
ggagcacgttgctgcaaagctcaat

SEQ ID NO: 42140 - DNA, 25 bp, Mus musculus
ggagcactgaaggttggcaccattt

SEQ ID NO: 42141 - DNA, 25 bp, Mus musculus
ggagcactgatgatatatttttaca

SEQ ID NO: 42142 - DNA, 25 bp, Mus musculus
ggagcactgcacataatctgaaaag

SEQ ID NO: 42143 - DNA, 25 bp, Mus musculus
ggagcactgcacttaatctgaaaag

SEQ ID NO: 42144 - DNA, 25 bp, Mus musculus
ggagcagaccagtattgcaagtttt

SEQ ID NO: 42145 - DNA, 25 bp, Mus musculus
ggagcagatccagagcactgtggac

SEQ ID NO: 42146 - DNA, 25 bp, Mus musculus
ggagcagcacgcagatggaattata

SEQ ID NO: 42147 - DNA, 25 bp, Mus musculus
ggagcagcaggcagtagaatttatg

SEQ ID NO: 42148 - DNA, 25 bp, Mus musculus
ggagcagcagttccactgaacccgt

SEQ ID NO: 42149 - DNA, 25 bp, Mus musculus
ggagcagcatgagggtcagcactac

SEQ ID NO: 42150 - DNA, 25 bp, Mus musculus
ggagcagccccggatacaggtgact

SEQ ID NO: 42151 - DNA, 25 bp, Mus musculus
ggagcagcgccttaccacaaatacc

SEQ ID NO: 42152 - DNA, 25 bp, Mus musculus
ggagcagcgtgccattgatctctat

SEQ ID NO: 42153 - DNA, 25 bp, Mus musculus
ggagcagctgcctgcaaggttccta

SEQ ID NO: 42154 - DNA, 25 bp, Mus musculus
ggagcaggatcacccctgtcagatg

SEQ ID NO: 42155 - DNA, 25 bp, Mus musculus
ggagcagtcaggttcacaagaaaag

SEQ ID NO: 42156 - DNA, 25 bp, Mus musculus
ggagcagttccataggcagatccgg

SEQ ID NO: 42157 - DNA, 25 bp, Mus musculus
ggagcataggtgtcataatgttcat

SEQ ID NO: 42158 - DNA, 25 bp, Mus musculus
ggagcatcgcattggaggctataag

SEQ ID NO: 42159 - DNA, 25 bp, Mus musculus
ggagcatctctaatgtccagcaatg

SEQ ID NO: 42160 - DNA, 25 bp, Mus musculus
ggagcatgcagaccctctgctgaag

SEQ ID NO: 42161 - DNA, 25 bp, Mus musculus
ggagcatgcccgcactaaggagctt

SEQ ID NO: 42162 - DNA, 25 bp, Mus musculus
ggagcatgctactaacatgtgcaaa

SEQ ID NO: 42163 - DNA, 25 bp, Mus musculus
ggagcatgtgcggatggtcatcatc

SEQ ID NO: 42164 - DNA, 25 bp, Mus musculus
ggagcattatcctgggaatacagct

SEQ ID NO: 42165 - DNA, 25 bp, Mus musculus
ggagcattggctgctgacattgaca

SEQ ID NO: 42166 - DNA, 25 bp, Mus musculus
ggagcattgtatacgattagctaac

SEQ ID NO: 42167 - DNA, 25 bp, Mus musculus
ggagcattgtttaacccagcgctgg

SEQ ID NO: 42168 - DNA, 25 bp, Mus musculus
ggagcatttccagctcgactgaaga

SEQ ID NO: 42169 - DNA, 25 bp, Mus musculus
ggagccaaagtctgcctgatgtctc

SEQ ID NO: 42170 - DNA, 25 bp, Mus musculus
ggagccaacttgaggcgttacaatg

SEQ ID NO: 42171 - DNA, 25 bp, Mus musculus
ggagccaaggttatctcaacagcac

SEQ ID NO: 42172 - DNA, 25 bp, Mus musculus
ggagccaccatacagagtacctagg

SEQ ID NO: 42173 - DNA, 25 bp, Mus musculus
ggagccagaagagtgttgatgccct

SEQ ID NO: 42174 - DNA, 25 bp, Mus musculus
ggagccagcacagcctcgtcgtgga

SEQ ID NO: 42175 - DNA, 25 bp, Mus musculus
ggagccagccgtaggcattgcacat

SEQ ID NO: 42176 - DNA, 25 bp, Mus musculus
ggagccagccgttggcattgcacat

SEQ ID NO: 42177 - DNA, 25 bp, Mus musculus
ggagccagcgcagctgctgagaatt

SEQ ID NO: 42178 - DNA, 25 bp, Mus musculus
ggagccaggctaaggacattttcta

SEQ ID NO: 42179 - DNA, 25 bp, Mus musculus
ggagccagtgtcagagttactcaaa

SEQ ID NO: 42180 - DNA, 25 bp, Mus musculus
ggagccatggataactttcacctga

SEQ ID NO: 42181 - DNA, 25 bp, Mus musculus
ggagccatgttgcacgatatggtca

SEQ ID NO: 42182 - DNA, 25 bp, Mus musculus
ggagcccactgttcctgtaaccacg

SEQ ID NO: 42183 - DNA, 25 bp, Mus musculus
ggagcccaggaagtctttaatgagc

SEQ ID NO: 42184 - DNA, 25 bp, Mus musculus
ggagcccatgaacatatccatcatt

SEQ ID NO: 42185 - DNA, 25 bp, Mus musculus
ggagccccgtcaccaagtctgttat

SEQ ID NO: 42186 - DNA, 25 bp, Mus musculus
ggagcccctgatcaagttcaaactg

SEQ ID NO: 42187 - DNA, 25 bp, Mus musculus
ggagcccgcttcctggatgtacacg

SEQ ID NO: 42188 - DNA, 25 bp, Mus musculus
ggagcccggcacagctgtcttcttc

SEQ ID NO: 42189 - DNA, 25 bp, Mus musculus
ggagccctattgtgccgacatcacc

SEQ ID NO: 42190 - DNA, 25 bp, Mus musculus
ggagccctgctggactggatgctat

SEQ ID NO: 42191 - DNA, 25 bp, Mus musculus
ggagccctggggaactgtcttcatg

SEQ ID NO: 42192 - DNA, 25 bp, Mus musculus
ggagccctgttcctggccattggcc

SEQ ID NO: 42193 - DNA, 25 bp, Mus musculus
ggagccgaaagcgtgtttgcaaatg

SEQ ID NO: 42194 - DNA, 25 bp, Mus musculus
ggagccgcattgaccaagcccagaa

SEQ ID NO: 42195 - DNA, 25 bp, Mus musculus
ggagccggctgcattgcttagattt

SEQ ID NO: 42196 - DNA, 25 bp, Mus musculus
ggagcctcaaatatcgggccatgag

SEQ ID NO: 42197 - DNA, 25 bp, Mus musculus
ggagcctctaaaggctgggcctttc

SEQ ID NO: 42198 - DNA, 25 bp, Mus musculus
ggagcctgcaccctgactggagtta

SEQ ID NO: 42199 - DNA, 25 bp, Mus musculus
ggagcctggacaattggacaaacca

SEQ ID NO: 42200 - DNA, 25 bp, Mus musculus
ggagcctggacatttggacaaacca

SEQ ID NO: 42201 - DNA, 25 bp, Mus musculus
ggagcctgtatatggatacactcct

SEQ ID NO: 42202 - DNA, 25 bp, Mus musculus
ggagcctttgcctacatagtcaatt

SEQ ID NO: 42203 - DNA, 25 bp, Mus musculus
ggagcctttggcatcttggcatccc

SEQ ID NO: 42204 - DNA, 25 bp, Mus musculus
ggagcgactccagttcacacttgca

SEQ ID NO: 42205 - DNA, 25 bp, Mus musculus
ggagcgagtgaagcccagaatcaag

SEQ ID NO: 42206 - DNA, 25 bp, Mus musculus
ggagcgcatgttacgcctggtgaac

SEQ ID NO: 42207 - DNA, 25 bp, Mus musculus
ggagcgcatgtttcgcctggtgaac

SEQ ID NO: 42208 - DNA, 25 bp, Mus musculus
ggagcgctttgcagcaaatgcccat

SEQ ID NO: 42209 - DNA, 25 bp, Mus musculus
ggagcggaccccattttcattgatg

SEQ ID NO: 42210 - DNA, 25 bp, Mus musculus
ggagcggattcgaatcaacgggaaa

SEQ ID NO: 42211 - DNA, 25 bp, Mus musculus
ggagcgtcagacttaacaggaagct

SEQ ID NO: 42212 - DNA, 25 bp, Mus musculus
ggagcgtcagctcctccagagactc

SEQ ID NO: 42213 - DNA, 25 bp, Mus musculus
ggagcgtcctgctgtctcggacaca

SEQ ID NO: 42214 - DNA, 25 bp, Mus musculus
ggagcgtcggtgtgattctctttga

SEQ ID NO: 42215 - DNA, 25 bp, Mus musculus
ggagctaacccagaaggtggcccag

SEQ ID NO: 42216 - DNA, 25 bp, Mus musculus
ggagctaacgtgtctcttcatgcag

SEQ ID NO: 42217 - DNA, 25 bp, Mus musculus
ggagctaagaaccatacctgccttc

SEQ ID NO: 42218 - DNA, 25 bp, Mus musculus
ggagctaagaagattcatctgggtg

SEQ ID NO: 42219 - DNA, 25 bp, Mus musculus
ggagctaagctttatcctgctgcag

SEQ ID NO: 42220 - DNA, 25 bp, Mus musculus
ggagctaagttcgaaagatgctcaa

SEQ ID NO: 42221 - DNA, 25 bp, Mus musculus
ggagctacagtcagacttcctcagg

SEQ ID NO: 42222 - DNA, 25 bp, Mus musculus
ggagctacctggtgactcaggccca

SEQ ID NO: 42223 - DNA, 25 bp, Mus musculus
ggagctagctagaacaagtaaacaa

SEQ ID NO: 42224 - DNA, 25 bp, Mus musculus
ggagctatgctaacccatgaaaatg

SEQ ID NO: 42225 - DNA, 25 bp, Mus musculus
ggagctatggtccacgctttcctca

SEQ ID NO: 42226 - DNA, 25 bp, Mus musculus
ggagctcaccagctaggcagcactc

SEQ ID NO: 42227 - DNA, 25 bp, Mus musculus
ggagctcacgaacccaatttttcct

SEQ ID NO: 42228 - DNA, 25 bp, Mus musculus
ggagctcagaaaggcgcaaaggaaa

SEQ ID NO: 42229 - DNA, 25 bp, Mus musculus
ggagctcagcccttgtgttgtgcca

SEQ ID NO: 42230 - DNA, 25 bp, Mus musculus
ggagctcagctatctagccacagtg

SEQ ID NO: 42231 - DNA, 25 bp, Mus musculus
ggagctcagtgagtcccctcggtta

SEQ ID NO: 42232 - DNA, 25 bp, Mus musculus
ggagctcatcaaagcccagaaggtg

SEQ ID NO: 42233 - DNA, 25 bp, Mus musculus
ggagctcctctgtttaccagagggt

SEQ ID NO: 42234 - DNA, 25 bp, Mus musculus
ggagctcctggacaaccgaaaactg

SEQ ID NO: 42235 - DNA, 25 bp, Mus musculus
ggagctcgccccattggtagcagct

SEQ ID NO: 42236 - DNA, 25 bp, Mus musculus
ggagctcggagaagactctgctttt

SEQ ID NO: 42237 - DNA, 25 bp, Mus musculus
ggagctcggaggacactaagcagat

SEQ ID NO: 42238 - DNA, 25 bp, Mus musculus
ggagctcttaagtgcaaggtgccca

SEQ ID NO: 42239 - DNA, 25 bp, Mus musculus
ggagctcttttagagatccctgcag

SEQ ID NO: 42240 - DNA, 25 bp, Mus musculus
ggagctgaaaattgttaccaacaac

SEQ ID NO: 42241 - DNA, 25 bp, Mus musculus
ggagctgaagtacacaggaaatgcc

SEQ ID NO: 42242 - DNA, 25 bp, Mus musculus
ggagctgacagaaaacattgttaca

SEQ ID NO: 42243 - DNA, 25 bp, Mus musculus
ggagctgacggttcacctttctgtc

SEQ ID NO: 42244 - DNA, 25 bp, Mus musculus
ggagctgactgcctatcatccctgt

SEQ ID NO: 42245 - DNA, 25 bp, Mus musculus
ggagctgatccacgactacttggac

SEQ ID NO: 42246 - DNA, 25 bp, Mus musculus
ggagctgcagccactgagccagcgc

SEQ ID NO: 42247 - DNA, 25 bp, Mus musculus
ggagctgcctggacctcacttgcta

SEQ ID NO: 42248 - DNA, 25 bp, Mus musculus
ggagctgcggttcatcatctatacc

SEQ ID NO: 42249 - DNA, 25 bp, Mus musculus
ggagctgctgcaggctcctctacag

SEQ ID NO: 42250 - DNA, 25 bp, Mus musculus
ggagctggaccacgctctcaacgat

SEQ ID NO: 42251 - DNA, 25 bp, Mus musculus
ggagctgtccaggtttattgctgct

SEQ ID NO: 42252 - DNA, 25 bp, Mus musculus
ggagctgtcctacctgaacgtcact

SEQ ID NO: 42253 - DNA, 25 bp, Mus musculus
ggagctgtgatatctcagatgtggc

SEQ ID NO: 42254 - DNA, 25 bp, Mus musculus
ggagctgtgatgtgaagttccctat

SEQ ID NO: 42255 - DNA, 25 bp, Mus musculus
ggagctgttgttaactagcccaaag

SEQ ID NO: 42256 - DNA, 25 bp, Mus musculus
ggagctgttttctgtgaagagcctc

SEQ ID NO: 42257 - DNA, 25 bp, Mus musculus
ggagcttagtacatcatctttgtca

SEQ ID NO: 42258 - DNA, 25 bp, Mus musculus
ggagcttgcagaaatcacgctggat

SEQ ID NO: 42259 - DNA, 25 bp, Mus musculus
ggagcttggaggaaacaatgccatt

SEQ ID NO: 42260 - DNA, 25 bp, Mus musculus
ggagctttggaatggtctttgaagc

SEQ ID NO: 42261 - DNA, 25 bp, Mus musculus
ggagcttttccctgcacctgatggt

SEQ ID NO: 42262 - DNA, 25 bp, Mus musculus
ggagctttttctgctatggatatga

SEQ ID NO: 42263 - DNA, 25 bp, Mus musculus
ggaggaaacaatcccttggcaagag

SEQ ID NO: 42264 - DNA, 25 bp, Mus musculus
ggaggaaacttccatggtgaatacc

SEQ ID NO: 42265 - DNA, 25 bp, Mus musculus
ggaggaaagagcttcgaaattacag

SEQ ID NO: 42266 - DNA, 25 bp, Mus musculus
ggaggaaccagaagaatcattgaac

SEQ ID NO: 42267 - DNA, 25 bp, Mus musculus
ggaggaacgactgggccttcaagta

SEQ ID NO: 42268 - DNA, 25 bp, Mus musculus
ggaggaactatacccagcatctgga

SEQ ID NO: 42269 - DNA, 25 bp, Mus musculus
ggaggaagccaaacaatccgcagaa

SEQ ID NO: 42270 - DNA, 25 bp, Mus musculus
ggaggaagcgcctgtatcttctcac

SEQ ID NO: 42271 - DNA, 25 bp, Mus musculus
ggaggaaggttaaagccctgtatga

SEQ ID NO: 42272 - DNA, 25 bp, Mus musculus
ggaggaaggttatagccctgtatga

SEQ ID NO: 42273 - DNA, 25 bp, Mus musculus
ggaggaattttcagccccgctggaa

SEQ ID NO: 42274 - DNA, 25 bp, Mus musculus
ggaggacaagatcccactgctggtc

SEQ ID NO: 42275 - DNA, 25 bp, Mus musculus
ggaggacaaggaaaatcgcattctg

SEQ ID NO: 42276 - DNA, 25 bp, Mus musculus
ggaggacatctttccatgtttaaca

SEQ ID NO: 42277 - DNA, 25 bp, Mus musculus
ggaggaccacctttttggcaatcta

SEQ ID NO: 42278 - DNA, 25 bp, Mus musculus
ggaggacctctcttctcctcgggct

SEQ ID NO: 42279 - DNA, 25 bp, Mus musculus
ggaggacgcagcttgcatcgcctat

SEQ ID NO: 42280 - DNA, 25 bp, Mus musculus
ggaggacgctccatgtcctggaagc

SEQ ID NO: 42281 - DNA, 25 bp, Mus musculus
ggaggactaatcaacaaggtcaagt

SEQ ID NO: 42282 - DNA, 25 bp, Mus musculus
ggaggactacattccctacccaagt

SEQ ID NO: 42283 - DNA, 25 bp, Mus musculus
ggaggactcactggagcagagcccc

SEQ ID NO: 42284 - DNA, 25 bp, Mus musculus
ggaggacttcaagacgacagttctg

SEQ ID NO: 42285 - DNA, 25 bp, Mus musculus
ggaggagaagacgatgacctcagac

SEQ ID NO: 42286 - DNA, 25 bp, Mus musculus
ggaggagaccgagaaacagacttgt

SEQ ID NO: 42287 - DNA, 25 bp, Mus musculus
ggaggagcagtgtaaggcattcccc

SEQ ID NO: 42288 - DNA, 25 bp, Mus musculus
ggaggagcctcaggagtcttcccct

SEQ ID NO: 42289 - DNA, 25 bp, Mus musculus
ggaggagcgccttaaacgcaccatg

SEQ ID NO: 42290 - DNA, 25 bp, Mus musculus
ggaggaggactacattccctaccca

SEQ ID NO: 42291 - DNA, 25 bp, Mus musculus
ggaggaggagcaacaagctctgacc

SEQ ID NO: 42292 - DNA, 25 bp, Mus musculus
ggaggaggccactgttaccaagtcc

SEQ ID NO: 42293 - DNA, 25 bp, Mus musculus
ggaggagtaacggaagccctcaatg

SEQ ID NO: 42294 - DNA, 25 bp, Mus musculus
ggaggagtctgttctggaacctgct

SEQ ID NO: 42295 - DNA, 25 bp, Mus musculus
ggaggagttaacagggcaaaagcaa

SEQ ID NO: 42296 - DNA, 25 bp, Mus musculus
ggaggagttaactgggcaaaagcaa

SEQ ID NO: 42297 - DNA, 25 bp, Mus musculus
ggaggatacaaagcgaaaattcatt

SEQ ID NO: 42298 - DNA, 25 bp, Mus musculus
ggaggatagtagttgtgacaaaaac

SEQ ID NO: 42299 - DNA, 25 bp, Mus musculus
ggaggatcaattgcagccttataga

SEQ ID NO: 42300 - DNA, 25 bp, Mus musculus
ggaggatgaaccctctgcccaacac

SEQ ID NO: 42301 - DNA, 25 bp, Mus musculus
ggaggatgttcggactgtagactca

SEQ ID NO: 42302 - DNA, 25 bp, Mus musculus
ggaggatttttcagattctagatgg

SEQ ID NO: 42303 - DNA, 25 bp, Mus musculus
ggaggcaatcctccatccttggctg

SEQ ID NO: 42304 - DNA, 25 bp, Mus musculus
ggaggcaccaaagcaagacgcacct

SEQ ID NO: 42305 - DNA, 25 bp, Mus musculus
ggaggcacctttcccagatcataca

SEQ ID NO: 42306 - DNA, 25 bp, Mus musculus
ggaggcagactgtataatcttttct

SEQ ID NO: 42307 - DNA, 25 bp, Mus musculus
ggaggcagcaggcaccgccatcaac

SEQ ID NO: 42308 - DNA, 25 bp, Mus musculus
ggaggcagccaggatttaataaaca

SEQ ID NO: 42309 - DNA, 25 bp, Mus musculus
ggaggcagtgttgtgcatcctcagt

SEQ ID NO: 42310 - DNA, 25 bp, Mus musculus
ggaggcatatcaactgtcgttctaa

SEQ ID NO: 42311 - DNA, 25 bp, Mus musculus
ggaggccaacctggccgtcctgaaa

SEQ ID NO: 42312 - DNA, 25 bp, Mus musculus
ggaggccaagaacccagctgacctg

SEQ ID NO: 42313 - DNA, 25 bp, Mus musculus
ggaggccacaaccttccacaaagag

SEQ ID NO: 42314 - DNA, 25 bp, Mus musculus
ggaggccatgcatatcttaaggaat

SEQ ID NO: 42315 - DNA, 25 bp, Mus musculus
ggaggccctcatcttcgacaacaag

SEQ ID NO: 42316 - DNA, 25 bp, Mus musculus
ggaggccctggataacgtgttcttc

SEQ ID NO: 42317 - DNA, 25 bp, Mus musculus
ggaggcctctcaatcggttcagttg

SEQ ID NO: 42318 - DNA, 25 bp, Mus musculus
ggaggcctgactacccttgcctgct

SEQ ID NO: 42319 - DNA, 25 bp, Mus musculus
ggaggccttcactgatggacatata

SEQ ID NO: 42320 - DNA, 25 bp, Mus musculus
ggaggcgccttgtctttatacactg

SEQ ID NO: 42321 - DNA, 25 bp, Mus musculus
ggaggctaagaaaatggatgtgtac

SEQ ID NO: 42322 - DNA, 25 bp, Mus musculus
ggaggctacagcaccacaactgact

SEQ ID NO: 42323 - DNA, 25 bp, Mus musculus
ggaggctgacctctatggacttcat

SEQ ID NO: 42324 - DNA, 25 bp, Mus musculus
ggaggctgtcctatgacaccaccac

SEQ ID NO: 42325 - DNA, 25 bp, Mus musculus
ggaggcttataaacaacaggcttct

SEQ ID NO: 42326 - DNA, 25 bp, Mus musculus
ggaggctttttcaggaaccgctgat

SEQ ID NO: 42327 - DNA, 25 bp, Mus musculus
ggagggaaaacaggcctggtgaagg

SEQ ID NO: 42328 - DNA, 25 bp, Mus musculus
ggagggaaagacagaagtccttgca

SEQ ID NO: 42329 - DNA, 25 bp, Mus musculus
ggagggaaagtacagaccaccttct

SEQ ID NO: 42330 - DNA, 25 bp, Mus musculus
ggagggacctggacacgatttcaga

SEQ ID NO: 42331 - DNA, 25 bp, Mus musculus
ggagggagcagaaatcggctcaaca

SEQ ID NO: 42332 - DNA, 25 bp, Mus musculus
ggagggaggctgtcctatgacacca

SEQ ID NO: 42333 - DNA, 25 bp, Mus musculus
ggagggatgcgattccacggcaact

SEQ ID NO: 42334 - DNA, 25 bp, Mus musculus
ggagggcaggtagcctttctccagt

SEQ ID NO: 42335 - DNA, 25 bp, Mus musculus
ggagggccattcctgccatgtgcca

SEQ ID NO: 42336 - DNA, 25 bp, Mus musculus
ggagggctgattttcgagaaccgaa

SEQ ID NO: 42337 - DNA, 25 bp, Mus musculus
ggagggtcaccactgctttataaca

SEQ ID NO: 42338 - DNA, 25 bp, Mus musculus
ggagggtcaggagcctctctacttc

SEQ ID NO: 42339 - DNA, 25 bp, Mus musculus
ggaggtaaatgcaggattggcccat

SEQ ID NO: 42340 - DNA, 25 bp, Mus musculus
ggaggtaaatgctggattggcccat

SEQ ID NO: 42341 - DNA, 25 bp, Mus musculus
ggaggtaacatctgtgctctcctgc

SEQ ID NO: 42342 - DNA, 25 bp, Mus musculus
ggaggtacaactggctcctcggtga

SEQ ID NO: 42343 - DNA, 25 bp, Mus musculus
ggaggtactataattcttctggatg

SEQ ID NO: 42344 - DNA, 25 bp, Mus musculus
ggaggtatactacctaattcgttct

SEQ ID NO: 42345 - DNA, 25 bp, Mus musculus
ggaggtatactagctaattcgttct

SEQ ID NO: 42346 - DNA, 25 bp, Mus musculus
ggaggtatcgcgttccattggagat

SEQ ID NO: 42347 - DNA, 25 bp, Mus musculus
ggaggtcactatagcaactgtcatg

SEQ ID NO: 42348 - DNA, 25 bp, Mus musculus
ggaggtcatgttcgcccctcaagaa

SEQ ID NO: 42349 - DNA, 25 bp, Mus musculus
ggaggtcctttcctcactgatgaga

SEQ ID NO: 42350 - DNA, 25 bp, Mus musculus
ggaggtctaccatttcaccttggag

SEQ ID NO: 42351 - DNA, 25 bp, Mus musculus
ggaggtctcaattctgggttcatga

SEQ ID NO: 42352 - DNA, 25 bp, Mus musculus
ggaggtctcagtttggcagatgata

SEQ ID NO: 42353 - DNA, 25 bp, Mus musculus
ggaggtcttcacttcagaaacccaa

SEQ ID NO: 42354 - DNA, 25 bp, Mus musculus
ggaggtctttctagctgggaactga

SEQ ID NO: 42355 - DNA, 25 bp, Mus musculus
ggaggtctttcttgctgggaactga

SEQ ID NO: 42356 - DNA, 25 bp, Mus musculus
ggaggtgaatgcagctgacgctttc

SEQ ID NO: 42357 - DNA, 25 bp, Mus musculus
ggaggtgaccaaacttatctactgc

SEQ ID NO: 42358 - DNA, 25 bp, Mus musculus
ggaggtgaccccacactgcgggacc

SEQ ID NO: 42359 - DNA, 25 bp, Mus musculus
ggaggtgactcatccaaattccatg

SEQ ID NO: 42360 - DNA, 25 bp, Mus musculus
ggaggtgccagaagatttacgacaa

SEQ ID NO: 42361 - DNA, 25 bp, Mus musculus
ggaggtgcttggtcattccattgca

SEQ ID NO: 42362 - DNA, 25 bp, Mus musculus
ggaggttcagaagtttgtcacacag

SEQ ID NO: 42363 - DNA, 25 bp, Mus musculus
ggaggttgccccatgcaccagcgat

SEQ ID NO: 42364 - DNA, 25 bp, Mus musculus
ggaggttgccccttgcaccagcgat

SEQ ID NO: 42365 - DNA, 25 bp, Mus musculus
ggagtaacaaaactcccactgccct

SEQ ID NO: 42366 - DNA, 25 bp, Mus musculus
ggagtaacgagtctcacacagaaaa

SEQ ID NO: 42367 - DNA, 25 bp, Mus musculus
ggagtaactaccataactagtcaag

SEQ ID NO: 42368 - DNA, 25 bp, Mus musculus
ggagtaatccagtttggcccctata

SEQ ID NO: 42369 - DNA, 25 bp, Mus musculus
ggagtagacttggaccggactgtcc

SEQ ID NO: 42370 - DNA, 25 bp, Mus musculus
ggagtagagagaatcttctaccttg

SEQ ID NO: 42371 - DNA, 25 bp, Mus musculus
ggagtagtaggctcagcgtttgaca

SEQ ID NO: 42372 - DNA, 25 bp, Mus musculus
ggagtatccatctccagttaactcg

SEQ ID NO: 42373 - DNA, 25 bp, Mus musculus
ggagtatttgcagcgtcgatcccag

SEQ ID NO: 42374 - DNA, 25 bp, Mus musculus
ggagtcaaagtggacacaagagacc

SEQ ID NO: 42375 - DNA, 25 bp, Mus musculus
ggagtcaacagaagcacaaagtttg

SEQ ID NO: 42376 - DNA, 25 bp, Mus musculus
ggagtcaacatatcaatggagcaag

SEQ ID NO: 42377 - DNA, 25 bp, Mus musculus
ggagtcaaccatacatgtatgcagg

SEQ ID NO: 42378 - DNA, 25 bp, Mus musculus
ggagtcacacagcactaaggcaaag

SEQ ID NO: 42379 - DNA, 25 bp, Mus musculus
ggagtcagaacgcacgtgctaacag

SEQ ID NO: 42380 - DNA, 25 bp, Mus musculus
ggagtcagcagaaagtgaacgatgc

SEQ ID NO: 42381 - DNA, 25 bp, Mus musculus
ggagtcatcccgcagatttctctga

SEQ ID NO: 42382 - DNA, 25 bp, Mus musculus
ggagtcatgctgctgtaaagcagaa

SEQ ID NO: 42383 - DNA, 25 bp, Mus musculus
ggagtccactaagtttgaatcttgc

SEQ ID NO: 42384 - DNA, 25 bp, Mus musculus
ggagtccagtcccttgccattcctt

SEQ ID NO: 42385 - DNA, 25 bp, Mus musculus
ggagtccatcagcatgcctcagaca

SEQ ID NO: 42386 - DNA, 25 bp, Mus musculus
ggagtcccgaggacacggatcctct

SEQ ID NO: 42387 - DNA, 25 bp, Mus musculus
ggagtcccgaggtcacggatcctct

SEQ ID NO: 42388 - DNA, 25 bp, Mus musculus
ggagtcctgccccataaacattgag

SEQ ID NO: 42389 - DNA, 25 bp, Mus musculus
ggagtccttcgcctccatgctgaga

SEQ ID NO: 42390 - DNA, 25 bp, Mus musculus
ggagtccttctccaatgtgagctac

SEQ ID NO: 42391 - DNA, 25 bp, Mus musculus
ggagtccttctcgaatgtgagctac

SEQ ID NO: 42392 - DNA, 25 bp, Mus musculus
ggagtcgaccacaccaaaatgagtc

SEQ ID NO: 42393 - DNA, 25 bp, Mus musculus
ggagtcgactcaggctgagaattac

SEQ ID NO: 42394 - DNA, 25 bp, Mus musculus
ggagtcgctttacagcaatcagaag

SEQ ID NO: 42395 - DNA, 25 bp, Mus musculus
ggagtctaccagacagagtcaccac

SEQ ID NO: 42396 - DNA, 25 bp, Mus musculus
ggagtctctcgcactggtttcccct

SEQ ID NO: 42397 - DNA, 25 bp, Mus musculus
ggagtctctcgctctggtttcccct

SEQ ID NO: 42398 - DNA, 25 bp, Mus musculus
ggagtctgaacccagcatcgttagg

SEQ ID NO: 42399 - DNA, 25 bp, Mus musculus
ggagtctgatattgaaagttaccac

SEQ ID NO: 42400 - DNA, 25 bp, Mus musculus
ggagtctgcaccctggtcctctgtg

SEQ ID NO: 42401 - DNA, 25 bp, Mus musculus
ggagtctgctgtccatttgaaaatg

SEQ ID NO: 42402 - DNA, 25 bp, Mus musculus
ggagtctgtgttacaaaacaactac

SEQ ID NO: 42403 - DNA, 25 bp, Mus musculus
ggagtctgttccagctagaactgta

SEQ ID NO: 42404 - DNA, 25 bp, Mus musculus
ggagtcttacccctatgaagcgaag

SEQ ID NO: 42405 - DNA, 25 bp, Mus musculus
ggagtgaaaccgacctggactgcat

SEQ ID NO: 42406 - DNA, 25 bp, Mus musculus
ggagtgaaatgcaaagtccttcgca

SEQ ID NO: 42407 - DNA, 25 bp, Mus musculus
ggagtgaagtcttttccatggacat

SEQ ID NO: 42408 - DNA, 25 bp, Mus musculus
ggagtgacctctcagaaaactatga

SEQ ID NO: 42409 - DNA, 25 bp, Mus musculus
ggagtgagcatgctcaacgtgttcc

SEQ ID NO: 42410 - DNA, 25 bp, Mus musculus
ggagtgatcaagatgaggaagtctc

SEQ ID NO: 42411 - DNA, 25 bp, Mus musculus
ggagtgcctctccatcacctcgaaa

SEQ ID NO: 42412 - DNA, 25 bp, Mus musculus
ggagtgcgtcccctgatgacatcaa

SEQ ID NO: 42413 - DNA, 25 bp, Mus musculus
ggagtgctcttattctccacagtca

SEQ ID NO: 42414 - DNA, 25 bp, Mus musculus
ggagtgcttccgagccatcctggat

SEQ ID NO: 42415 - DNA, 25 bp, Mus musculus
ggagtgctttcccacactgtaactc

SEQ ID NO: 42416 - DNA, 25 bp, Mus musculus
ggagtggacaagtgcccaggaacca

SEQ ID NO: 42417 - DNA, 25 bp, Mus musculus
ggagtggcagtaccaaataaaaact

SEQ ID NO: 42418 - DNA, 25 bp, Mus musculus
ggagtggcccctgctgatagtcgtc

SEQ ID NO: 42419 - DNA, 25 bp, Mus musculus
ggagtggctctctccttgtgcagcc

SEQ ID NO: 42420 - DNA, 25 bp, Mus musculus
ggagtgggaaacaatcagaagtttt

SEQ ID NO: 42421 - DNA, 25 bp, Mus musculus
ggagtgtacagtcatcccttagctg

SEQ ID NO: 42422 - DNA, 25 bp, Mus musculus
ggagtgtaccctctgccagtgcaag

SEQ ID NO: 42423 - DNA, 25 bp, Mus musculus
ggagtgtactcaacccaagtgggct

SEQ ID NO: 42424 - DNA, 25 bp, Mus musculus
ggagtgtcatgaatacttccgaccc

SEQ ID NO: 42425 - DNA, 25 bp, Mus musculus
ggagtgtccacttagaagcctcaca

SEQ ID NO: 42426 - DNA, 25 bp, Mus musculus
ggagtgtgcgctacaaccactctca

SEQ ID NO: 42427 - DNA, 25 bp, Mus musculus
ggagttaaagacactgctgccaagc

SEQ ID NO: 42428 - DNA, 25 bp, Mus musculus
ggagttaaatacctgtgtattccag

SEQ ID NO: 42429 - DNA, 25 bp, Mus musculus
ggagttatgatcagacctgcagcca

SEQ ID NO: 42430 - DNA, 25 bp, Mus musculus
ggagttcagagcactttcactacct

SEQ ID NO: 42431 - DNA, 25 bp, Mus musculus
ggagttcagctttaatgtcttgcct

SEQ ID NO: 42432 - DNA, 25 bp, Mus musculus
ggagttcatcaaccccatctttgag

SEQ ID NO: 42433 - DNA, 25 bp, Mus musculus
ggagttccatgacaagagcccagaa

SEQ ID NO: 42434 - DNA, 25 bp, Mus musculus
ggagttccatgagaagagcccagaa

SEQ ID NO: 42435 - DNA, 25 bp, Mus musculus
ggagttcccctacaccatgcttctg

SEQ ID NO: 42436 - DNA, 25 bp, Mus musculus
ggagttcctatcctcccaaggagtt

SEQ ID NO: 42437 - DNA, 25 bp, Mus musculus
ggagttcctggatgtcacgagtatc

SEQ ID NO: 42438 - DNA, 25 bp, Mus musculus
ggagttcgagtacaacgccactgac

SEQ ID NO: 42439 - DNA, 25 bp, Mus musculus
ggagttcgagtagaacgccactgac

SEQ ID NO: 42440 - DNA, 25 bp, Mus musculus
ggagttcgctcggagaccatttctg

SEQ ID NO: 42441 - DNA, 25 bp, Mus musculus
ggagttctacatgaggaccttcagc

SEQ ID NO: 42442 - DNA, 25 bp, Mus musculus
ggagttctaccgctgtctggtccag

SEQ ID NO: 42443 - DNA, 25 bp, Mus musculus
ggagttctccaacaagattgccaag

SEQ ID NO: 42444 - DNA, 25 bp, Mus musculus
ggagttcttattagcaaatcaccca

SEQ ID NO: 42445 - DNA, 25 bp, Mus musculus
ggagttctttgtcaaccccatgcga

SEQ ID NO: 42446 - DNA, 25 bp, Mus musculus
ggagttgcagtattatctcactacg

SEQ ID NO: 42447 - DNA, 25 bp, Mus musculus
ggagttgctagatcgttcgaagtca

SEQ ID NO: 42448 - DNA, 25 bp, Mus musculus
ggagttggtggaatgcttccaaaag

SEQ ID NO: 42449 - DNA, 25 bp, Mus musculus
ggagtttatcgacttcggcatggac

SEQ ID NO: 42450 - DNA, 25 bp, Mus musculus
ggagtttcagaaaggccccgcattc

SEQ ID NO: 42451 - DNA, 25 bp, Mus musculus
ggagtttgaactacggaaagccaag

SEQ ID NO: 42452 - DNA, 25 bp, Mus musculus
ggagtttgagacactctgctcggag

SEQ ID NO: 42453 - DNA, 25 bp, Mus musculus
ggagtttgatgttcctatcggttct

SEQ ID NO: 42454 - DNA, 25 bp, Mus musculus
ggagtttggaattagtccttcagac

SEQ ID NO: 42455 - DNA, 25 bp, Mus musculus
ggagtttggcttcctcatgcccgag

SEQ ID NO: 42456 - DNA, 25 bp, Mus musculus
ggagtttgtaatagctgccactgac

SEQ ID NO: 42457 - DNA, 25 bp, Mus musculus
ggagtttgtccttttccgagcggct

SEQ ID NO: 42458 - DNA, 25 bp, Mus musculus
ggagttttatcctgtattcatcgta

SEQ ID NO: 42459 - DNA, 25 bp, Mus musculus
ggagttttcccctggatccaagaag

SEQ ID NO: 42460 - DNA, 25 bp, Mus musculus
ggagttttcgattgtgggtcctaag

SEQ ID NO: 42461 - DNA, 25 bp, Mus musculus
ggataaaagacataaatggtcccac

SEQ ID NO: 42462 - DNA, 25 bp, Mus musculus
ggataaaagcaagactctacacatc

SEQ ID NO: 42463 - DNA, 25 bp, Mus musculus
ggataaactctacagaacgccaaga

SEQ ID NO: 42464 - DNA, 25 bp, Mus musculus
ggataaaggtaactctgtgccagca

SEQ ID NO: 42465 - DNA, 25 bp, Mus musculus
ggataacacggagaaagagaggact

SEQ ID NO: 42466 - DNA, 25 bp, Mus musculus
ggataaccacgaaatgactaatcag

SEQ ID NO: 42467 - DNA, 25 bp, Mus musculus
ggataactcagtcataactgttttc

SEQ ID NO: 42468 - DNA, 25 bp, Mus musculus
ggataactgagtcgcgcccgcttcc

SEQ ID NO: 42469 - DNA, 25 bp, Mus musculus
ggataacttccactaccaacacagt

SEQ ID NO: 42470 - DNA, 25 bp, Mus musculus
ggataacttccagtaccaacacagt

SEQ ID NO: 42471 - DNA, 25 bp, Mus musculus
ggataagagtatggagtgtccccac

SEQ ID NO: 42472 - DNA, 25 bp, Mus musculus
ggataagcatgtttatgggagccaa

SEQ ID NO: 42473 - DNA, 25 bp, Mus musculus
ggataagccttctgagatagtagat

SEQ ID NO: 42474 - DNA, 25 bp, Mus musculus
ggataagctggaacagatctatgaa

SEQ ID NO: 42475 - DNA, 25 bp, Mus musculus
ggataaggcccatcgcaatcagtgc

SEQ ID NO: 42476 - DNA, 25 bp, Mus musculus
ggataataagtgattactccagccc

SEQ ID NO: 42477 - DNA, 25 bp, Mus musculus
ggataatgccatcattcgtcctctg

SEQ ID NO: 42478 - DNA, 25 bp, Mus musculus
ggataatgtcagtgaatgggaagaa

SEQ ID NO: 42479 - DNA, 25 bp, Mus musculus
ggatacaagttgatgacttcttacc

SEQ ID NO: 42480 - DNA, 25 bp, Mus musculus
ggatacacagttgggtttcagaaca

SEQ ID NO: 42481 - DNA, 25 bp, Mus musculus
ggatacattgtctcttcggagcctt

SEQ ID NO: 42482 - DNA, 25 bp, Mus musculus
ggataccaccagatcattccagcca

SEQ ID NO: 42483 - DNA, 25 bp, Mus musculus
ggataccagcaccatgacatggact

SEQ ID NO: 42484 - DNA, 25 bp, Mus musculus
ggataccagtatgggcacaaaaaga

SEQ ID NO: 42485 - DNA, 25 bp, Mus musculus
ggataccatcaagcccaattgcctg

SEQ ID NO: 42486 - DNA, 25 bp, Mus musculus
ggataccatctacgtccatgagaag

SEQ ID NO: 42487 - DNA, 25 bp, Mus musculus
ggataccatggtggaaattcccgtt

SEQ ID NO: 42488 - DNA, 25 bp, Mus musculus
ggatacccaggaggaacacgtccta

SEQ ID NO: 42489 - DNA, 25 bp, Mus musculus
ggataccccgcttctactgggagga

SEQ ID NO: 42490 - DNA, 25 bp, Mus musculus
ggataccctatttgtgcccctgttg

SEQ ID NO: 42491 - DNA, 25 bp, Mus musculus
ggatacctataaaaagggccttgat

SEQ ID NO: 42492 - DNA, 25 bp, Mus musculus
ggatactctcatgaacttggtccag

SEQ ID NO: 42493 - DNA, 25 bp, Mus musculus
ggatactgcttggagcccaagaaag

SEQ ID NO: 42494 - DNA, 25 bp, Mus musculus
ggatagcgtttccaagaaaatgaga

SEQ ID NO: 42495 - DNA, 25 bp, Mus musculus
ggataggtcctacaccttgaacaga

SEQ ID NO: 42496 - DNA, 25 bp, Mus musculus
ggatagtacctccaatctctgtgta

SEQ ID NO: 42497 - DNA, 25 bp, Mus musculus
ggatagtctgccacccgaggaccac

SEQ ID NO: 42498 - DNA, 25 bp, Mus musculus
ggatagtttactagtccagtatgga

SEQ ID NO: 42499 - DNA, 25 bp, Mus musculus
ggatatacaatcgtacaacacttac

SEQ ID NO: 42500 - DNA, 25 bp, Mus musculus
ggatatatcccaagtaattacgtca

SEQ ID NO: 42501 - DNA, 25 bp, Mus musculus
ggatatccaagaaatggatctcact

SEQ ID NO: 42502 - DNA, 25 bp, Mus musculus
ggatatccccgaggattctgttcca

SEQ ID NO: 42503 - DNA, 25 bp, Mus musculus
ggatatccctatgagatacagctgc

SEQ ID NO: 42504 - DNA, 25 bp, Mus musculus
ggatatcctttcactctgcatggtt

SEQ ID NO: 42505 - DNA, 25 bp, Mus musculus
ggatatgaccacactaaccatcatg

SEQ ID NO: 42506 - DNA, 25 bp, Mus musculus
ggatatgaccggtataaaatggtgg

SEQ ID NO: 42507 - DNA, 25 bp, Mus musculus
ggatatgactcaactgctggacagg

SEQ ID NO: 42508 - DNA, 25 bp, Mus musculus
ggatatgagaccgtgcttggaagaa

SEQ ID NO: 42509 - DNA, 25 bp, Mus musculus
ggatatgatgtctctgaacagccag

SEQ ID NO: 42510 - DNA, 25 bp, Mus musculus
ggatatggccgaatatttcttccct

SEQ ID NO: 42511 - DNA, 25 bp, Mus musculus
ggatattcaaatgggtgcctgtgac

SEQ ID NO: 42512 - DNA, 25 bp, Mus musculus
ggatattctaaaaaccaagccgtcg

SEQ ID NO: 42513 - DNA, 25 bp, Mus musculus
ggatattgtcctgagtattacttag

SEQ ID NO: 42514 - DNA, 25 bp, Mus musculus
ggatatttgtgataaggttggccaa

SEQ ID NO: 42515 - DNA, 25 bp, Mus musculus
ggatcaactgtttcaaagtgtacac

SEQ ID NO: 42516 - DNA, 25 bp, Mus musculus
ggatcaagtccagcacatggaacta

SEQ ID NO: 42517 - DNA, 25 bp, Mus musculus
ggatcaatggctatcccaacgagta

SEQ ID NO: 42518 - DNA, 25 bp, Mus musculus
ggatcaatggctttcccaacgagta

SEQ ID NO: 42519 - DNA, 25 bp, Mus musculus
ggatcacacccgtgccatcatactg

SEQ ID NO: 42520 - DNA, 25 bp, Mus musculus
ggatcacagtcgctctggctgccgc

SEQ ID NO: 42521 - DNA, 25 bp, Mus musculus
ggatcacccctgtcagatgattctg

SEQ ID NO: 42522 - DNA, 25 bp, Mus musculus
ggatcacccgagcatgcgaatcttg

SEQ ID NO: 42523 - DNA, 25 bp, Mus musculus
ggatcactcctgtatactatctagt

SEQ ID NO: 42524 - DNA, 25 bp, Mus musculus
ggatcagaacccatactatggagga

SEQ ID NO: 42525 - DNA, 25 bp, Mus musculus
ggatcagaatggcactacatcgcca

SEQ ID NO: 42526 - DNA, 25 bp, Mus musculus
ggatcagataaacataggcaatgcc

SEQ ID NO: 42527 - DNA, 25 bp, Mus musculus
ggatcagcagttaacatgggctctg

SEQ ID NO: 42528 - DNA, 25 bp, Mus musculus
ggatcagcccgatggtacaagctag

SEQ ID NO: 42529 - DNA, 25 bp, Mus musculus
ggatcagctactccttgccacagga

SEQ ID NO: 42530 - DNA, 25 bp, Mus musculus
ggatcagctggagaaagtgctccct

SEQ ID NO: 42531 - DNA, 25 bp, Mus musculus
ggatcaggaaaaaattcccccacat

SEQ ID NO: 42532 - DNA, 25 bp, Mus musculus
ggatcagtactaaaacccgattctg

SEQ ID NO: 42533 - DNA, 25 bp, Mus musculus
ggatcagtatgaagctccactttaa

SEQ ID NO: 42534 - DNA, 25 bp, Mus musculus
ggatcagtatgatgctccactttaa

SEQ ID NO: 42535 - DNA, 25 bp, Mus musculus
ggatcatagttcatttcatgtggga

SEQ ID NO: 42536 - DNA, 25 bp, Mus musculus
ggatcatctcatcaaaggaaggctt

SEQ ID NO: 42537 - DNA, 25 bp, Mus musculus
ggatcattgagcgtctcttaaagct

SEQ ID NO: 42538 - DNA, 25 bp, Mus musculus
ggatccaaagctaccctctgatggg

SEQ ID NO: 42539 - DNA, 25 bp, Mus musculus
ggatccaagaggctgttttcgtttg

SEQ ID NO: 42540 - DNA, 25 bp, Mus musculus
ggatccacaaatgctaaagaattgt

SEQ ID NO: 42541 - DNA, 25 bp, Mus musculus
ggatccacagaacatcacctggctg

SEQ ID NO: 42542 - DNA, 25 bp, Mus musculus
ggatccaccacatggggagtttgag

SEQ ID NO: 42543 - DNA, 25 bp, Mus musculus
ggatccacggcacccttatttattg

SEQ ID NO: 42544 - DNA, 25 bp, Mus musculus
ggatccagcagtttcggaagaatga

SEQ ID NO: 42545 - DNA, 25 bp, Mus musculus
ggatccatgccagaaacaagcctgt

SEQ ID NO: 42546 - DNA, 25 bp, Mus musculus
ggatcccagactatcccaaagccag

SEQ ID NO: 42547 - DNA, 25 bp, Mus musculus
ggatcccagccgagttctggtgaag

SEQ ID NO: 42548 - DNA, 25 bp, Mus musculus
ggatcccagtccctaagtagaagat

SEQ ID NO: 42549 - DNA, 25 bp, Mus musculus
ggatcccatagccatctgtagcctg

SEQ ID NO: 42550 - DNA, 25 bp, Mus musculus
ggatcccatagccttgaggaccagc

SEQ ID NO: 42551 - DNA, 25 bp, Mus musculus
ggatcccatccctttgttctgactg

SEQ ID NO: 42552 - DNA, 25 bp, Mus musculus
ggatccccgaaaccctcacaatgat

SEQ ID NO: 42553 - DNA, 25 bp, Mus musculus
ggatccctgctgctccagaatgtca

SEQ ID NO: 42554 - DNA, 25 bp, Mus musculus
ggatccctgctttcagcctgatgga

SEQ ID NO: 42555 - DNA, 25 bp, Mus musculus
ggatccctgtcatcaataaggtgga

SEQ ID NO: 42556 - DNA, 25 bp, Mus musculus
ggatccggacacgatttccagaggg

SEQ ID NO: 42557 - DNA, 25 bp, Mus musculus
ggatccgggtccttagaaccctctg

SEQ ID NO: 42558 - DNA, 25 bp, Mus musculus
ggatccgtcaagcatccggaagtat

SEQ ID NO: 42559 - DNA, 25 bp, Mus musculus
ggatccgtcaaggatccggaagtat

SEQ ID NO: 42560 - DNA, 25 bp, Mus musculus
ggatcctactctaccattacatgca

SEQ ID NO: 42561 - DNA, 25 bp, Mus musculus
ggatcctagatacgccattacagca

SEQ ID NO: 42562 - DNA, 25 bp, Mus musculus
ggatcctaggatagaaaatccacac

SEQ ID NO: 42563 - DNA, 25 bp, Mus musculus
ggatcctatgctgcagtgagggtcc

SEQ ID NO: 42564 - DNA, 25 bp, Mus musculus
ggatcctcatccagtttgcatttag

SEQ ID NO: 42565 - DNA, 25 bp, Mus musculus
ggatcctcccaaagctggaccaaac

SEQ ID NO: 42566 - DNA, 25 bp, Mus musculus
ggatcctctcccaagtcccttgggt

SEQ ID NO: 42567 - DNA, 25 bp, Mus musculus
ggatcctctccctagtcccttgggt

SEQ ID NO: 42568 - DNA, 25 bp, Mus musculus
ggatcctctctctccacagactttg

SEQ ID NO: 42569 - DNA, 25 bp, Mus musculus
ggatcctgatccatgaacgtctaga

SEQ ID NO: 42570 - DNA, 25 bp, Mus musculus
ggatcctgatccttgaacgtctaga

SEQ ID NO: 42571 - DNA, 25 bp, Mus musculus
ggatcctgcatgttaatgggtttaa

SEQ ID NO: 42572 - DNA, 25 bp, Mus musculus
ggatcctgcccgttggatggtgcct

SEQ ID NO: 42573 - DNA, 25 bp, Mus musculus
ggatcctgccggctgaagctgaact

SEQ ID NO: 42574 - DNA, 25 bp, Mus musculus
ggatcctggcacttgtctgggaact

SEQ ID NO: 42575 - DNA, 25 bp, Mus musculus
ggatccttctactgtgtcaaccaca

SEQ ID NO: 42576 - DNA, 25 bp, Mus musculus
ggatccttgcatgctcttgggtgac

SEQ ID NO: 42577 - DNA, 25 bp, Mus musculus
ggatcgattgcctctgattcttgaa

SEQ ID NO: 42578 - DNA, 25 bp, Mus musculus
ggatcgcaaagcacgcctagcatgt

SEQ ID NO: 42579 - DNA, 25 bp, Mus musculus
ggatcgcaagactccgccacattaa

SEQ ID NO: 42580 - DNA, 25 bp, Mus musculus
ggatcgccactgtcatccaggcagc

SEQ ID NO: 42581 - DNA, 25 bp, Mus musculus
ggatcggcggcctcactatcgctgg

SEQ ID NO: 42582 - DNA, 25 bp, Mus musculus
ggatcggctgacctggcttatccag

SEQ ID NO: 42583 - DNA, 25 bp, Mus musculus
ggatcgtaggtggtctgattcagaa

SEQ ID NO: 42584 - DNA, 25 bp, Mus musculus
ggatctaagcccatgtacacacctg

SEQ ID NO: 42585 - DNA, 25 bp, Mus musculus
ggatctatgggcctgctttgaacca

SEQ ID NO: 42586 - DNA, 25 bp, Mus musculus
ggatctcatcaggatatcactgaag

SEQ ID NO: 42587 - DNA, 25 bp, Mus musculus
ggatctccagaaagactttgcacag

SEQ ID NO: 42588 - DNA, 25 bp, Mus musculus
ggatctcggcgggtcttcctttcga

SEQ ID NO: 42589 - DNA, 25 bp, Mus musculus
ggatctgaaagtgacaagcattaca

SEQ ID NO: 42590 - DNA, 25 bp, Mus musculus
ggatctgaagaggtcccctgcaaca

SEQ ID NO: 42591 - DNA, 25 bp, Mus musculus
ggatctgcaatctctgagatgacag

SEQ ID NO: 42592 - DNA, 25 bp, Mus musculus
ggatctgcaggactggctcctttac

SEQ ID NO: 42593 - DNA, 25 bp, Mus musculus
ggatctgcgatctgcgagcgcctgc

SEQ ID NO: 42594 - DNA, 25 bp, Mus musculus
ggatctgggcttggaaatgcctcag

SEQ ID NO: 42595 - DNA, 25 bp, Mus musculus
ggatctgggttgatgcagaagaaac

SEQ ID NO: 42596 - DNA, 25 bp, Mus musculus
ggatctgggttgttgcagaagaaac

SEQ ID NO: 42597 - DNA, 25 bp, Mus musculus
ggatctgtgtggcagacccctatga

SEQ ID NO: 42598 - DNA, 25 bp, Mus musculus
ggatcttagacggaagcctgggctt

SEQ ID NO: 42599 - DNA, 25 bp, Mus musculus
ggatcttagcaacgtccagtccaag

SEQ ID NO: 42600 - DNA, 25 bp, Mus musculus
ggatcttcatctcccccaagtctgt

SEQ ID NO: 42601 - DNA, 25 bp, Mus musculus
ggatcttcgagactttgttaggagc

SEQ ID NO: 42602 - DNA, 25 bp, Mus musculus
ggatcttgacaagctctatgagttg

SEQ ID NO: 42603 - DNA, 25 bp, Mus musculus
ggatgaaacgcagacaacagataag

SEQ ID NO: 42604 - DNA, 25 bp, Mus musculus
ggatgaaaggcggatacttggacca

SEQ ID NO: 42605 - DNA, 25 bp, Mus musculus
ggatgaaatcacacaacttgcaagt

SEQ ID NO: 42606 - DNA, 25 bp, Mus musculus
ggatgaaattgatgagaagacctgg

SEQ ID NO: 42607 - DNA, 25 bp, Mus musculus
ggatgaagatctcacgcccggatgt

SEQ ID NO: 42608 - DNA, 25 bp, Mus musculus
ggatgaagatctgacgcccggatgt

SEQ ID NO: 42609 - DNA, 25 bp, Mus musculus
ggatgaagccaagagtgaagcccag

SEQ ID NO: 42610 - DNA, 25 bp, Mus musculus
ggatgaagccatacggttcctggta

SEQ ID NO: 42611 - DNA, 25 bp, Mus musculus
ggatgaagctgaacgatctctgcat

SEQ ID NO: 42612 - DNA, 25 bp, Mus musculus
ggatgaagtagcacatactaaatgc

SEQ ID NO: 42613 - DNA, 25 bp, Mus musculus
ggatgaatcccagtcgctgttacgg

SEQ ID NO: 42614 - DNA, 25 bp, Mus musculus
ggatgaatttgacctcatagatcat

SEQ ID NO: 42615 - DNA, 25 bp, Mus musculus
ggatgacacttggaggcacacctgt

SEQ ID NO: 42616 - DNA, 25 bp, Mus musculus
ggatgaccgcagtgtctgccccaca

SEQ ID NO: 42617 - DNA, 25 bp, Mus musculus
ggatgacctgcctccattgtctccg

SEQ ID NO: 42618 - DNA, 25 bp, Mus musculus
ggatgacgcctgacattttacggga

SEQ ID NO: 42619 - DNA, 25 bp, Mus musculus
ggatgacgcctgtcattttacggga

SEQ ID NO: 42620 - DNA, 25 bp, Mus musculus
ggatgacgcggaacttgccacacgt

SEQ ID NO: 42621 - DNA, 25 bp, Mus musculus
ggatgactaccatttccttaacctg

SEQ ID NO: 42622 - DNA, 25 bp, Mus musculus
ggatgactcaaagtctaacctggtt

SEQ ID NO: 42623 - DNA, 25 bp, Mus musculus
ggatgactcgagatgatgacgacga

SEQ ID NO: 42624 - DNA, 25 bp, Mus musculus
ggatgactctaacaagctcgggaag

SEQ ID NO: 42625 - DNA, 25 bp, Mus musculus
ggatgactctttgcctgatgacact

SEQ ID NO: 42626 - DNA, 25 bp, Mus musculus
ggatgactgccggagaactttccag

SEQ ID NO: 42627 - DNA, 25 bp, Mus musculus
ggatgactggaaagccccactcacc

SEQ ID NO: 42628 - DNA, 25 bp, Mus musculus
ggatgacttcaagggttccttctgc

SEQ ID NO: 42629 - DNA, 25 bp, Mus musculus
ggatgagatcgctctggacaaggac

SEQ ID NO: 42630 - DNA, 25 bp, Mus musculus
ggatgagcaagtccgtgccagcatt

SEQ ID NO: 42631 - DNA, 25 bp, Mus musculus
ggatgagcagtcacacaaagagcat

SEQ ID NO: 42632 - DNA, 25 bp, Mus musculus
ggatgatgaaatcgaggtaaatgct

SEQ ID NO: 42633 - DNA, 25 bp, Mus musculus
ggatgatgaaatggaggtaaatgct

SEQ ID NO: 42634 - DNA, 25 bp, Mus musculus
ggatgatgacaaaaaagacgacaag

SEQ ID NO: 42635 - DNA, 25 bp, Mus musculus
ggatgatgtgcgctgctccaatcag

SEQ ID NO: 42636 - DNA, 25 bp, Mus musculus
ggatgattattggagctatgactac

SEQ ID NO: 42637 - DNA, 25 bp, Mus musculus
ggatgatttagataccgttcctgtg

SEQ ID NO: 42638 - DNA, 25 bp, Mus musculus
ggatgcaagaaatgccctgggcagc

SEQ ID NO: 42639 - DNA, 25 bp, Mus musculus
ggatgcacccatgattgagccgctg

SEQ ID NO: 42640 - DNA, 25 bp, Mus musculus
ggatgcactgaatactcgccgaggc

SEQ ID NO: 42641 - DNA, 25 bp, Mus musculus
ggatgcagccagatctgtcttcctc

SEQ ID NO: 42642 - DNA, 25 bp, Mus musculus
ggatgcagctccaatgggctacgac

SEQ ID NO: 42643 - DNA, 25 bp, Mus musculus
ggatgcagctgccaatcagggtaaa

SEQ ID NO: 42644 - DNA, 25 bp, Mus musculus
ggatgcaggcactggggcttcatct

SEQ ID NO: 42645 - DNA, 25 bp, Mus musculus
ggatgccaatggatcccgagatttt

SEQ ID NO: 42646 - DNA, 25 bp, Mus musculus
ggatgccacggactgtaccgccgca

SEQ ID NO: 42647 - DNA, 25 bp, Mus musculus
ggatgcccgggtagttaaagacatg

SEQ ID NO: 42648 - DNA, 25 bp, Mus musculus
ggatgccgaacccagtccctgttct

SEQ ID NO: 42649 - DNA, 25 bp, Mus musculus
ggatgccgctatggagaccttttct

SEQ ID NO: 42650 - DNA, 25 bp, Mus musculus
ggatgcctgccctcgtaagcatcag

SEQ ID NO: 42651 - DNA, 25 bp, Mus musculus
ggatgcgatcctactatcatgggta

SEQ ID NO: 42652 - DNA, 25 bp, Mus musculus
ggatgcgctcctttggcatgatccc

SEQ ID NO: 42653 - DNA, 25 bp, Mus musculus
ggatgcggccttggcagcacctgct

SEQ ID NO: 42654 - DNA, 25 bp, Mus musculus
ggatgcgtgctcacctcttgcaaag

SEQ ID NO: 42655 - DNA, 25 bp, Mus musculus
ggatgctatcccattccagactgca

SEQ ID NO: 42656 - DNA, 25 bp, Mus musculus
ggatgctcattcatgcccactgaaa

SEQ ID NO: 42657 - DNA, 25 bp, Mus musculus
ggatgctgaagttactaaggccaag

SEQ ID NO: 42658 - DNA, 25 bp, Mus musculus
ggatgctgagacctttctgctgcag

SEQ ID NO: 42659 - DNA, 25 bp, Mus musculus
ggatgctgatctggactcctccgtg

SEQ ID NO: 42660 - DNA, 25 bp, Mus musculus
ggatgctgccgggaagaccaccatc

SEQ ID NO: 42661 - DNA, 25 bp, Mus musculus
ggatgctgctgagggccttccttca

SEQ ID NO: 42662 - DNA, 25 bp, Mus musculus
ggatgctggctactctttttaagga

SEQ ID NO: 42663 - DNA, 25 bp, Mus musculus
ggatgctgttccaaccatttttgat

SEQ ID NO: 42664 - DNA, 25 bp, Mus musculus
ggatgctttatacgctgcccagcgt

SEQ ID NO: 42665 - DNA, 25 bp, Mus musculus
ggatggaaatcccaaccaaggcaag

SEQ ID NO: 42666 - DNA, 25 bp, Mus musculus
ggatggaacccgaggttctggatat

SEQ ID NO: 42667 - DNA, 25 bp, Mus musculus
ggatggacacttctcacactacaaa

SEQ ID NO: 42668 - DNA, 25 bp, Mus musculus
ggatggaccatagttactcctccaa

SEQ ID NO: 42669 - DNA, 25 bp, Mus musculus
ggatggaccctgtgaagcagtacta

SEQ ID NO: 42670 - DNA, 25 bp, Mus musculus
ggatggactctgttcctgtcaccca

SEQ ID NO: 42671 - DNA, 25 bp, Mus musculus
ggatggagtccagaaatctaatatc

SEQ ID NO: 42672 - DNA, 25 bp, Mus musculus
ggatggatccgctcaatccgaggat

SEQ ID NO: 42673 - DNA, 25 bp, Mus musculus
ggatggatcgttcctgctctgatgc

SEQ ID NO: 42674 - DNA, 25 bp, Mus musculus
ggatggatctcacttgacaaggtgc

SEQ ID NO: 42675 - DNA, 25 bp, Mus musculus
ggatggatgtttgggaactcatgtc

SEQ ID NO: 42676 - DNA, 25 bp, Mus musculus
ggatggattttatggtgcagacatt

SEQ ID NO: 42677 - DNA, 25 bp, Mus musculus
ggatggcaaacaccaagaccttaag

SEQ ID NO: 42678 - DNA, 25 bp, Mus musculus
ggatggcaggcatcatctgacccag

SEQ ID NO: 42679 - DNA, 25 bp, Mus musculus
ggatggcagttagacctcaagagga

SEQ ID NO: 42680 - DNA, 25 bp, Mus musculus
ggatggccatagaacagatgtgcta

SEQ ID NO: 42681 - DNA, 25 bp, Mus musculus
ggatggccgcaggagtcttgccaca

SEQ ID NO: 42682 - DNA, 25 bp, Mus musculus
ggatggccttcttggacaatccaac

SEQ ID NO: 42683 - DNA, 25 bp, Mus musculus
ggatggcgtccttcgggcacttccc

SEQ ID NO: 42684 - DNA, 25 bp, Mus musculus
ggatggctgcagcttcatatgatca

SEQ ID NO: 42685 - DNA, 25 bp, Mus musculus
ggatggcttcttcagagtttgctac

SEQ ID NO: 42686 - DNA, 25 bp, Mus musculus
ggatgggcaggagcttctctctgca

SEQ ID NO: 42687 - DNA, 25 bp, Mus musculus
ggatgggttactgcctcttctacga

SEQ ID NO: 42688 - DNA, 25 bp, Mus musculus
ggatggtccaccagcctgaagaaag

SEQ ID NO: 42689 - DNA, 25 bp, Mus musculus
ggatggtctgcgactgcgaaaaccc

SEQ ID NO: 42690 - DNA, 25 bp, Mus musculus
ggatggtggtatatcagacagcatt

SEQ ID NO: 42691 - DNA, 25 bp, Mus musculus
ggatggttgcttgggacttgtcttc

SEQ ID NO: 42692 - DNA, 25 bp, Mus musculus
ggatgtattaaacttgatgagctca

SEQ ID NO: 42693 - DNA, 25 bp, Mus musculus
ggatgtcaagcaaatttttggacag

SEQ ID NO: 42694 - DNA, 25 bp, Mus musculus
ggatgtcacgagtatccgagatact

SEQ ID NO: 42695 - DNA, 25 bp, Mus musculus
ggatgtcactgaagacttctctgaa

SEQ ID NO: 42696 - DNA, 25 bp, Mus musculus
ggatgtccaacctgtcttctctgcc

SEQ ID NO: 42697 - DNA, 25 bp, Mus musculus
ggatgtccaccatggccagggcatc

SEQ ID NO: 42698 - DNA, 25 bp, Mus musculus
ggatgtcccattggtcattgaaact

SEQ ID NO: 42699 - DNA, 25 bp, Mus musculus
ggatgtcgaagtggccagattttga

SEQ ID NO: 42700 - DNA, 25 bp, Mus musculus
ggatgtcttctctgacggccccact

SEQ ID NO: 42701 - DNA, 25 bp, Mus musculus
ggatgtcttttataacctgtgtact

SEQ ID NO: 42702 - DNA, 25 bp, Mus musculus
ggatgtgcacgaaggacagcccctt

SEQ ID NO: 42703 - DNA, 25 bp, Mus musculus
ggatgtgcacgatggacagcccctt

SEQ ID NO: 42704 - DNA, 25 bp, Mus musculus
ggatgtgcccagtggataaggccca

SEQ ID NO: 42705 - DNA, 25 bp, Mus musculus
ggatgtgctcacctatgtcaaactg

SEQ ID NO: 42706 - DNA, 25 bp, Mus musculus
ggatgtggtcgtgcctgttccacag

SEQ ID NO: 42707 - DNA, 25 bp, Mus musculus
ggatgttagataactggagttacca

SEQ ID NO: 42708 - DNA, 25 bp, Mus musculus
ggatgttatgacacctatgcggcag

SEQ ID NO: 42709 - DNA, 25 bp, Mus musculus
ggatgttatgactcctatgcggcag

SEQ ID NO: 42710 - DNA, 25 bp, Mus musculus
ggatgttattctgtgagagaccccg

SEQ ID NO: 42711 - DNA, 25 bp, Mus musculus
ggatgttcccttctccattgtctac

SEQ ID NO: 42712 - DNA, 25 bp, Mus musculus
ggatgttgggacagtcatctgtcca

SEQ ID NO: 42713 - DNA, 25 bp, Mus musculus
ggatgtttaggtccctaagcttcct

SEQ ID NO: 42714 - DNA, 25 bp, Mus musculus
ggatgtttgaacaccatcaattccc

SEQ ID NO: 42715 - DNA, 25 bp, Mus musculus
ggattaaatgtcactctcaccatca

SEQ ID NO: 42716 - DNA, 25 bp, Mus musculus
ggattacaagcatggcaccctgcgc

SEQ ID NO: 42717 - DNA, 25 bp, Mus musculus
ggattacccacctcttacggcctat

SEQ ID NO: 42718 - DNA, 25 bp, Mus musculus
ggattagagaatcagacatggcagc

SEQ ID NO: 42719 - DNA, 25 bp, Mus musculus
ggattagagaatgagacatggcagc

SEQ ID NO: 42720 - DNA, 25 bp, Mus musculus
ggattatctacaatatctacctgga

SEQ ID NO: 42721 - DNA, 25 bp, Mus musculus
ggattatgaccctgtggaaagcaag

SEQ ID NO: 42722 - DNA, 25 bp, Mus musculus
ggattatgcccgtactcatcgtaaa

SEQ ID NO: 42723 - DNA, 25 bp, Mus musculus
ggattatggccgcatagccctggta

SEQ ID NO: 42724 - DNA, 25 bp, Mus musculus
ggattcaatacctcattcctgggta

SEQ ID NO: 42725 - DNA, 25 bp, Mus musculus
ggattcaccccgtgtctaccatggt

SEQ ID NO: 42726 - DNA, 25 bp, Mus musculus
ggattcactccatgcacccagcatt

SEQ ID NO: 42727 - DNA, 25 bp, Mus musculus
ggattcagcatagaagaacagtctt

SEQ ID NO: 42728 - DNA, 25 bp, Mus musculus
ggattcaggcgaataccactgtgta

SEQ ID NO: 42729 - DNA, 25 bp, Mus musculus
ggattcatctcggagcactcggcac

SEQ ID NO: 42730 - DNA, 25 bp, Mus musculus
ggattcatctcggtgcctcatgcag

SEQ ID NO: 42731 - DNA, 25 bp, Mus musculus
ggattccaatgctggttaccccagc

SEQ ID NO: 42732 - DNA, 25 bp, Mus musculus
ggattccacaactatctcctcaaag

SEQ ID NO: 42733 - DNA, 25 bp, Mus musculus
ggattccagagagaaaatgggacct

SEQ ID NO: 42734 - DNA, 25 bp, Mus musculus
ggattccagcttcacttcttccttg

SEQ ID NO: 42735 - DNA, 25 bp, Mus musculus
ggattccatggctttgcaccttgca

SEQ ID NO: 42736 - DNA, 25 bp, Mus musculus
ggattcccacatcaaagaaaagctg

SEQ ID NO: 42737 - DNA, 25 bp, Mus musculus
ggattccgaagaccccgggctctgt

SEQ ID NO: 42738 - DNA, 25 bp, Mus musculus
ggattcctcttctggccagcaactt

SEQ ID NO: 42739 - DNA, 25 bp, Mus musculus
ggattcctgcatgccaacacaatgg

SEQ ID NO: 42740 - DNA, 25 bp, Mus musculus
ggattcggcttctttttcaacatgc

SEQ ID NO: 42741 - DNA, 25 bp, Mus musculus
ggattctactcatgacctgaggtca

SEQ ID NO: 42742 - DNA, 25 bp, Mus musculus
ggattctagctcgtgccttaaagga

SEQ ID NO: 42743 - DNA, 25 bp, Mus musculus
ggattctaggacctcctcgaaataa

SEQ ID NO: 42744 - DNA, 25 bp, Mus musculus
ggattctatgtctggctgccttata

SEQ ID NO: 42745 - DNA, 25 bp, Mus musculus
ggattctcacaagcaagtgcacggg

SEQ ID NO: 42746 - DNA, 25 bp, Mus musculus
ggattctcctgatgaacttcctgta

SEQ ID NO: 42747 - DNA, 25 bp, Mus musculus
ggattctctcatttctgccttcaca

SEQ ID NO: 42748 - DNA, 25 bp, Mus musculus
ggattctgaagacaaaaagctttgg

SEQ ID NO: 42749 - DNA, 25 bp, Mus musculus
ggattctgcctctgtcaagatcaaa

SEQ ID NO: 42750 - DNA, 25 bp, Mus musculus
ggattctggacgagctccaaaggag

SEQ ID NO: 42751 - DNA, 25 bp, Mus musculus
ggattctgggcacatgtctgtccgc

SEQ ID NO: 42752 - DNA, 25 bp, Mus musculus
ggattctgggttgtctgttttgtaa

SEQ ID NO: 42753 - DNA, 25 bp, Mus musculus
ggattctttatgcagctgaggatga

SEQ ID NO: 42754 - DNA, 25 bp, Mus musculus
ggattgaatgcactccatcttgctt

SEQ ID NO: 42755 - DNA, 25 bp, Mus musculus
ggattgcccagctggtcttcaccag

SEQ ID NO: 42756 - DNA, 25 bp, Mus musculus
ggattgccgggcagcggacattcct

SEQ ID NO: 42757 - DNA, 25 bp, Mus musculus
ggattgccgtcagtgccgctgcttg

SEQ ID NO: 42758 - DNA, 25 bp, Mus musculus
ggattgctccacagcacaagctaca

SEQ ID NO: 42759 - DNA, 25 bp, Mus musculus
ggattgctctttggctgctccactg

SEQ ID NO: 42760 - DNA, 25 bp, Mus musculus
ggattggactccatgatctgtcact

SEQ ID NO: 42761 - DNA, 25 bp, Mus musculus
ggattggagagagcctgaaacccgc

SEQ ID NO: 42762 - DNA, 25 bp, Mus musculus
ggattggatggctgatccctggaat

SEQ ID NO: 42763 - DNA, 25 bp, Mus musculus
ggattggcagaacccgaggccaaac

SEQ ID NO: 42764 - DNA, 25 bp, Mus musculus
ggattggcccatcaatcacatctaa

SEQ ID NO: 42765 - DNA, 25 bp, Mus musculus
ggattggcccatgaatcacatctaa

SEQ ID NO: 42766 - DNA, 25 bp, Mus musculus
ggattggccgcaagttatcatctga

SEQ ID NO: 42767 - DNA, 25 bp, Mus musculus
ggattggccgctaccgcatgatcaa

SEQ ID NO: 42768 - DNA, 25 bp, Mus musculus
ggattggccgcttccgcatgatcaa

SEQ ID NO: 42769 - DNA, 25 bp, Mus musculus
ggattggctttttgcgcctcattac

SEQ ID NO: 42770 - DNA, 25 bp, Mus musculus
ggattgtaccctcgatccccttctg

SEQ ID NO: 42771 - DNA, 25 bp, Mus musculus
ggattgtcgccactgcacatggcca

SEQ ID NO: 42772 - DNA, 25 bp, Mus musculus
ggattgtggttgtaagccttgcata

SEQ ID NO: 42773 - DNA, 25 bp, Mus musculus
ggattgttcgctgcatcatccaaaa

SEQ ID NO: 42774 - DNA, 25 bp, Mus musculus
ggattgttgcattggagcatgatac

SEQ ID NO: 42775 - DNA, 25 bp, Mus musculus
ggatttaacactcacagaccagact

SEQ ID NO: 42776 - DNA, 25 bp, Mus musculus
ggatttacacaacgcaagatctctg

SEQ ID NO: 42777 - DNA, 25 bp, Mus musculus
ggatttacacaaggcaagatctctg

SEQ ID NO: 42778 - DNA, 25 bp, Mus musculus
ggatttacacgaaatataaattgtc

SEQ ID NO: 42779 - DNA, 25 bp, Mus musculus
ggatttacacgatatataaattgtc

SEQ ID NO: 42780 - DNA, 25 bp, Mus musculus
ggatttaggacccatcactaaaaga

SEQ ID NO: 42781 - DNA, 25 bp, Mus musculus
ggatttatggttgccgaatgcttgg

SEQ ID NO: 42782 - DNA, 25 bp, Mus musculus
ggatttattcagaagctctccactg

SEQ ID NO: 42783 - DNA, 25 bp, Mus musculus
ggatttcaagatacgaactatagag

SEQ ID NO: 42784 - DNA, 25 bp, Mus musculus
ggatttcacagcatacggtggtgtg

SEQ ID NO: 42785 - DNA, 25 bp, Mus musculus
ggatttcacccgagcccgcatgaac

SEQ ID NO: 42786 - DNA, 25 bp, Mus musculus
ggatttcagccccataaaccctgag

SEQ ID NO: 42787 - DNA, 25 bp, Mus musculus
ggatttcaggtttcgtaatgttgca

SEQ ID NO: 42788 - DNA, 25 bp, Mus musculus
ggatttcccgatggatgctcattca

SEQ ID NO: 42789 - DNA, 25 bp, Mus musculus
ggatttccttctgtgccacagctag

SEQ ID NO: 42790 - DNA, 25 bp, Mus musculus
ggatttctggttgcagcaagatgac

SEQ ID NO: 42791 - DNA, 25 bp, Mus musculus
ggatttgatggagagcctggacctc

SEQ ID NO: 42792 - DNA, 25 bp, Mus musculus
ggatttggaatggtctgagcctcag

SEQ ID NO: 42793 - DNA, 25 bp, Mus musculus
ggatttggacaatagccaccagtct

SEQ ID NO: 42794 - DNA, 25 bp, Mus musculus
ggatttggagaagcccacccagtgt

SEQ ID NO: 42795 - DNA, 25 bp, Mus musculus
ggatttgttgtgatctgcgctctgc

SEQ ID NO: 42796 - DNA, 25 bp, Mus musculus
ggattttaaagacggtcccactctg

SEQ ID NO: 42797 - DNA, 25 bp, Mus musculus
ggattttccaagtcaagaccgactg

SEQ ID NO: 42798 - DNA, 25 bp, Mus musculus
ggattttccttccatacggccccag

SEQ ID NO: 42799 - DNA, 25 bp, Mus musculus
ggattttctatgctctggccaccca

SEQ ID NO: 42800 - DNA, 25 bp, Mus musculus
ggattttgccaagaatgcatgaaga

SEQ ID NO: 42801 - DNA, 25 bp, Mus musculus
ggatttttaaaagacctcgatgaag

SEQ ID NO: 42802 - DNA, 25 bp, Mus musculus
ggatttttcagattctagatggaac

SEQ ID NO: 42803 - DNA, 25 bp, Mus musculus
ggcaaaaacaactttttggaggatg

SEQ ID NO: 42804 - DNA, 25 bp, Mus musculus
ggcaaaacagaaaaaggttcatagt

SEQ ID NO: 42805 - DNA, 25 bp, Mus musculus
ggcaaaacagaataaggttcatagt

SEQ ID NO: 42806 - DNA, 25 bp, Mus musculus
ggcaaaacgcctccaccgggaggct

SEQ ID NO: 42807 - DNA, 25 bp, Mus musculus
ggcaaaacgctgacactaacctctt

SEQ ID NO: 42808 - DNA, 25 bp, Mus musculus
ggcaaaacggccgtcactgcagctg

SEQ ID NO: 42809 - DNA, 25 bp, Mus musculus
ggcaaaactcccaacattccttgct

SEQ ID NO: 42810 - DNA, 25 bp, Mus musculus
ggcaaaagcctttggcctacaagcc

SEQ ID NO: 42811 - DNA, 25 bp, Mus musculus
ggcaaaaggagttagctgcctccct

SEQ ID NO: 42812 - DNA, 25 bp, Mus musculus
ggcaaaaggtgtcgcttccgcaata

SEQ ID NO: 42813 - DNA, 25 bp, Mus musculus
ggcaaaaggtgtggcttccgcaata

SEQ ID NO: 42814 - DNA, 25 bp, Mus musculus
ggcaaaatttggaatctgcgagagt

SEQ ID NO: 42815 - DNA, 25 bp, Mus musculus
ggcaaaatttggtatctgcgagagt

SEQ ID NO: 42816 - DNA, 25 bp, Mus musculus
ggcaaacaccaagaccttaagtaca

SEQ ID NO: 42817 - DNA, 25 bp, Mus musculus
ggcaaacagtgtgtcaaccgcatca

SEQ ID NO: 42818 - DNA, 25 bp, Mus musculus
ggcaaacgctacaagaattccttgg

SEQ ID NO: 42819 - DNA, 25 bp, Mus musculus
ggcaaactgcataaagagattggtc

SEQ ID NO: 42820 - DNA, 25 bp, Mus musculus
ggcaaagaacttgcatcaagatcag

SEQ ID NO: 42821 - DNA, 25 bp, Mus musculus
ggcaaagacaaagcagggcccgaga

SEQ ID NO: 42822 - DNA, 25 bp, Mus musculus
ggcaaagacggcttccgcttcttca

SEQ ID NO: 42823 - DNA, 25 bp, Mus musculus
ggcaaagactccaaagcaacgcgtt

SEQ ID NO: 42824 - DNA, 25 bp, Mus musculus
ggcaaagagtatatacctgctgaca

SEQ ID NO: 42825 - DNA, 25 bp, Mus musculus
ggcaaagatccatttgccccttcct

SEQ ID NO: 42826 - DNA, 25 bp, Mus musculus
ggcaaagatgacgtttatgatcgta

SEQ ID NO: 42827 - DNA, 25 bp, Mus musculus
ggcaaagctggcctcaaagctgtga

SEQ ID NO: 42828 - DNA, 25 bp, Mus musculus
ggcaaaggacaaaataccaaaatgg

SEQ ID NO: 42829 - DNA, 25 bp, Mus musculus
ggcaaaggacccagctttccagagc

SEQ ID NO: 42830 - DNA, 25 bp, Mus musculus
ggcaaaggatgttcgagagattgat

SEQ ID NO: 42831 - DNA, 25 bp, Mus musculus
ggcaaaggctatgaagccaagacac

SEQ ID NO: 42832 - DNA, 25 bp, Mus musculus
ggcaaaggtgtcctagaaatggcca

SEQ ID NO: 42833 - DNA, 25 bp, Mus musculus
ggcaaagtatatccatttcagaggg

SEQ ID NO: 42834 - DNA, 25 bp, Mus musculus
ggcaaataaactcatgatttctgaa

SEQ ID NO: 42835 - DNA, 25 bp, Mus musculus
ggcaaatcccaaatgatctccagtg

SEQ ID NO: 42836 - DNA, 25 bp, Mus musculus
ggcaaatctatctgcagaggcgggc

SEQ ID NO: 42837 - DNA, 25 bp, Mus musculus
ggcaaatcttgcatgcttcatcagt

SEQ ID NO: 42838 - DNA, 25 bp, Mus musculus
ggcaaatcttgcttgcttcatcagt

SEQ ID NO: 42839 - DNA, 25 bp, Mus musculus
ggcaaatgaggagatcgcccaggta

SEQ ID NO: 42840 - DNA, 25 bp, Mus musculus
ggcaaattttttgcaagcccatgag

SEQ ID NO: 42841 - DNA, 25 bp, Mus musculus
ggcaacaaagaatcaaatgagagca

SEQ ID NO: 42842 - DNA, 25 bp, Mus musculus
ggcaacaagtccgacctggaggagc

SEQ ID NO: 42843 - DNA, 25 bp, Mus musculus
ggcaacaatagtttcactggaagac

SEQ ID NO: 42844 - DNA, 25 bp, Mus musculus
ggcaacagaaaatgcttcaactagc

SEQ ID NO: 42845 - DNA, 25 bp, Mus musculus
ggcaacagatcagctccagccagga

SEQ ID NO: 42846 - DNA, 25 bp, Mus musculus
ggcaacagggacagctaactgttaa

SEQ ID NO: 42847 - DNA, 25 bp, Mus musculus
ggcaacagggactgctaactgttaa

SEQ ID NO: 42848 - DNA, 25 bp, Mus musculus
ggcaaccattttacaatagtctggg

SEQ ID NO: 42849 - DNA, 25 bp, Mus musculus
ggcaacctgacctatacaggcctct

SEQ ID NO: 42850 - DNA, 25 bp, Mus musculus
ggcaacctttggcaccgcatctatg

SEQ ID NO: 42851 - DNA, 25 bp, Mus musculus
ggcaacgagttgaacatcactcacg

SEQ ID NO: 42852 - DNA, 25 bp, Mus musculus
ggcaacgcctttacaccatacgtgg

SEQ ID NO: 42853 - DNA, 25 bp, Mus musculus
ggcaacggcatcaatgtcctcaaaa

SEQ ID NO: 42854 - DNA, 25 bp, Mus musculus
ggcaactcacgcacagtcaaatcag

SEQ ID NO: 42855 - DNA, 25 bp, Mus musculus
ggcaactccctctgctgcctttgag

SEQ ID NO: 42856 - DNA, 25 bp, Mus musculus
ggcaactcggttgtcacagacctgt

SEQ ID NO: 42857 - DNA, 25 bp, Mus musculus
ggcaactggaaagtccaaaggctat

SEQ ID NO: 42858 - DNA, 25 bp, Mus musculus
ggcaactggaggaaccttcatcgtg

SEQ ID NO: 42859 - DNA, 25 bp, Mus musculus
ggcaagacagactacttcttgagca

SEQ ID NO: 42860 - DNA, 25 bp, Mus musculus
ggcaagacagtggtcgagagcgggc

SEQ ID NO: 42861 - DNA, 25 bp, Mus musculus
ggcaagaccctgtccctgaactcta

SEQ ID NO: 42862 - DNA, 25 bp, Mus musculus
ggcaagagatgcaagtgaaggcaaa

SEQ ID NO: 42863 - DNA, 25 bp, Mus musculus
ggcaagagtcagtatcttctgggcg

SEQ ID NO: 42864 - DNA, 25 bp, Mus musculus
ggcaagatgaacctgcttatcacca

SEQ ID NO: 42865 - DNA, 25 bp, Mus musculus
ggcaagatgacaacaacaggcatgc

SEQ ID NO: 42866 - DNA, 25 bp, Mus musculus
ggcaagcaagttggcccaggtcacc

SEQ ID NO: 42867 - DNA, 25 bp, Mus musculus
ggcaagcagtctcagcccgcaaaat

SEQ ID NO: 42868 - DNA, 25 bp, Mus musculus
ggcaagccaagtgatcattaataaa

SEQ ID NO: 42869 - DNA, 25 bp, Mus musculus
ggcaagccattgctcaaggctgtga

SEQ ID NO: 42870 - DNA, 25 bp, Mus musculus
ggcaagccccggcattcactgtact

SEQ ID NO: 42871 - DNA, 25 bp, Mus musculus
ggcaagctgcccagtcatgtcggca

SEQ ID NO: 42872 - DNA, 25 bp, Mus musculus
ggcaagctggcaaacggactgttgc

SEQ ID NO: 42873 - DNA, 25 bp, Mus musculus
ggcaaggccagaaaggaggcaacac

SEQ ID NO: 42874 - DNA, 25 bp, Mus musculus
ggcaaggccagataggaggcaacac

SEQ ID NO: 42875 - DNA, 25 bp, Mus musculus
ggcaaggcgatctcctgtcaggctc

SEQ ID NO: 42876 - DNA, 25 bp, Mus musculus
ggcaagtgctgaatattctccagat

SEQ ID NO: 42877 - DNA, 25 bp, Mus musculus
ggcaagtgtttaactggactcactg

SEQ ID NO: 42878 - DNA, 25 bp, Mus musculus
ggcaagtttcactgtgtgtgtaaaa

SEQ ID NO: 42879 - DNA, 25 bp, Mus musculus
ggcaagtttgacatcatcccaacca

SEQ ID NO: 42880 - DNA, 25 bp, Mus musculus
ggcaataaaggatccgggcccaaca

SEQ ID NO: 42881 - DNA, 25 bp, Mus musculus
ggcaataggttagcgacgtttctta

SEQ ID NO: 42882 - DNA, 25 bp, Mus musculus
ggcaatcatccagattcactgaggg

SEQ ID NO: 42883 - DNA, 25 bp, Mus musculus
ggcaatcccactaatggcctttcaa

SEQ ID NO: 42884 - DNA, 25 bp, Mus musculus
ggcaatcccacttatggcctttcaa

SEQ ID NO: 42885 - DNA, 25 bp, Mus musculus
ggcaatgcaaagatgaccctgggaa

SEQ ID NO: 42886 - DNA, 25 bp, Mus musculus
ggcaatgcatggtccagcatcagtg

SEQ ID NO: 42887 - DNA, 25 bp, Mus musculus
ggcaatgctttcaagaaagctgacc

SEQ ID NO: 42888 - DNA, 25 bp, Mus musculus
ggcaatgtgctgatccacttcccct

SEQ ID NO: 42889 - DNA, 25 bp, Mus musculus
ggcaatgttcaggaaacctaccgct

SEQ ID NO: 42890 - DNA, 25 bp, Mus musculus
ggcaattcattgatagcaggaaagg

SEQ ID NO: 42891 - DNA, 25 bp, Mus musculus
ggcaattgggctgacttttcttatg

SEQ ID NO: 42892 - DNA, 25 bp, Mus musculus
ggcacaaacaaagaccctcaagaaa

SEQ ID NO: 42893 - DNA, 25 bp, Mus musculus
ggcacaaatactggcatgatgcttt

SEQ ID NO: 42894 - DNA, 25 bp, Mus musculus
ggcacaaatgaaagagtttgaggcc

SEQ ID NO: 42895 - DNA, 25 bp, Mus musculus
ggcacaaccttgtctggtggccaga

SEQ ID NO: 42896 - DNA, 25 bp, Mus musculus
ggcacaagaagtaccctaccaaagg

SEQ ID NO: 42897 - DNA, 25 bp, Mus musculus
ggcacaagccagattgagaaatttc

SEQ ID NO: 42898 - DNA, 25 bp, Mus musculus
ggcacaagcctggaagagtttccta

SEQ ID NO: 42899 - DNA, 25 bp, Mus musculus
ggcacaaggatgctttcctgaaaaa

SEQ ID NO: 42900 - DNA, 25 bp, Mus musculus
ggcacaagtcagtggaagatctgtg

SEQ ID NO: 42901 - DNA, 25 bp, Mus musculus
ggcacaagtggacggtggcgcacag

SEQ ID NO: 42902 - DNA, 25 bp, Mus musculus
ggcacaatgcaggaaaggatcacca

SEQ ID NO: 42903 - DNA, 25 bp, Mus musculus
ggcacaatgtctcacccctatctga

SEQ ID NO: 42904 - DNA, 25 bp, Mus musculus
ggcacaatgtcttcaagcgccacag

SEQ ID NO: 42905 - DNA, 25 bp, Mus musculus
ggcacaattcctgatatgattgcag

SEQ ID NO: 42906 - DNA, 25 bp, Mus musculus
ggcacacaaacaattggtagctgga

SEQ ID NO: 42907 - DNA, 25 bp, Mus musculus
ggcacacacaactgccaggcaggct

SEQ ID NO: 42908 - DNA, 25 bp, Mus musculus
ggcacacagcaggtggcagacttga

SEQ ID NO: 42909 - DNA, 25 bp, Mus musculus
ggcacaccccaaggagaagtccaaa

SEQ ID NO: 42910 - DNA, 25 bp, Mus musculus
ggcacacgaaacttccaggactttg

SEQ ID NO: 42911 - DNA, 25 bp, Mus musculus
ggcacacgcctcagccttggtacag

SEQ ID NO: 42912 - DNA, 25 bp, Mus musculus
ggcacactgattgaggacctcctga

SEQ ID NO: 42913 - DNA, 25 bp, Mus musculus
ggcacacttgccgagaggatccgtg

SEQ ID NO: 42914 - DNA, 25 bp, Mus musculus
ggcacagaacccagctggaaggtcc

SEQ ID NO: 42915 - DNA, 25 bp, Mus musculus
ggcacagaaccctgctggaaggtcc

SEQ ID NO: 42916 - DNA, 25 bp, Mus musculus
ggcacagaagagaccgctgatgttg

SEQ ID NO: 42917 - DNA, 25 bp, Mus musculus
ggcacagagtctgtccagcagtctg

SEQ ID NO: 42918 - DNA, 25 bp, Mus musculus
ggcacagatcaattcctcaatgact

SEQ ID NO: 42919 - DNA, 25 bp, Mus musculus
ggcacagcagcatgatgcggtacga

SEQ ID NO: 42920 - DNA, 25 bp, Mus musculus
ggcacagcggagtgaaaagcattcc

SEQ ID NO: 42921 - DNA, 25 bp, Mus musculus
ggcacaggcggcacgcagaaagcta

SEQ ID NO: 42922 - DNA, 25 bp, Mus musculus
ggcacagtacaaaaagagcttcagc

SEQ ID NO: 42923 - DNA, 25 bp, Mus musculus
ggcacagtcagtggcgtcctgctag

SEQ ID NO: 42924 - DNA, 25 bp, Mus musculus
ggcacagttaacaacatcattcaag

SEQ ID NO: 42925 - DNA, 25 bp, Mus musculus
ggcacatacctgaagtggattttct

SEQ ID NO: 42926 - DNA, 25 bp, Mus musculus
ggcacatagccaactgcaggttcag

SEQ ID NO: 42927 - DNA, 25 bp, Mus musculus
ggcacatcagtgacctgtacgaaga

SEQ ID NO: 42928 - DNA, 25 bp, Mus musculus
ggcacatctgctggataacacggag

SEQ ID NO: 42929 - DNA, 25 bp, Mus musculus
ggcacatgaccgatctgatttacgc

SEQ ID NO: 42930 - DNA, 25 bp, Mus musculus
ggcaccaagaatagagatgtcccag

SEQ ID NO: 42931 - DNA, 25 bp, Mus musculus
ggcaccaaggacagagcaaagtacg

SEQ ID NO: 42932 - DNA, 25 bp, Mus musculus
ggcaccaagtctgtctttgggcaga

SEQ ID NO: 42933 - DNA, 25 bp, Mus musculus
ggcaccacaggtttgagcattttga

SEQ ID NO: 42934 - DNA, 25 bp, Mus musculus
ggcaccaccgctttagaagggtctc

SEQ ID NO: 42935 - DNA, 25 bp, Mus musculus
ggcaccagcctcacgtggcatgact

SEQ ID NO: 42936 - DNA, 25 bp, Mus musculus
ggcaccagctggaatccgcaagaat

SEQ ID NO: 42937 - DNA, 25 bp, Mus musculus
ggcaccatcctctaacaggccaatt

SEQ ID NO: 42938 - DNA, 25 bp, Mus musculus
ggcaccatctcaggagcggaagaac

SEQ ID NO: 42939 - DNA, 25 bp, Mus musculus
ggcaccatgacagatcctgacggaa

SEQ ID NO: 42940 - DNA, 25 bp, Mus musculus
ggcacccactttattcagaggcatg

SEQ ID NO: 42941 - DNA, 25 bp, Mus musculus
ggcacccatgagttgtgacaagtca

SEQ ID NO: 42942 - DNA, 25 bp, Mus musculus
ggcacccattgaggtgaagacgaag

SEQ ID NO: 42943 - DNA, 25 bp, Mus musculus
ggcaccccactgtgctctcctttgg

SEQ ID NO: 42944 - DNA, 25 bp, Mus musculus
ggcacccttatttattgaccagaca

SEQ ID NO: 42945 - DNA, 25 bp, Mus musculus
ggcaccggaagctgagaactccaca

SEQ ID NO: 42946 - DNA, 25 bp, Mus musculus
ggcacctatacttcccagaccatga

SEQ ID NO: 42947 - DNA, 25 bp, Mus musculus
ggcacctcagtcaagtctacctgca

SEQ ID NO: 42948 - DNA, 25 bp, Mus musculus
ggcacctcccgccatgttaatgtgg

SEQ ID NO: 42949 - DNA, 25 bp, Mus musculus
ggcacctctccatgctgctagacgt

SEQ ID NO: 42950 - DNA, 25 bp, Mus musculus
ggcacctgaatttcaccaacaacat

SEQ ID NO: 42951 - DNA, 25 bp, Mus musculus
ggcacctgatgagtacattgagaaa

SEQ ID NO: 42952 - DNA, 25 bp, Mus musculus
ggcacctgcagaagctatacctgaa

SEQ ID NO: 42953 - DNA, 25 bp, Mus musculus
ggcacctgcttgacgggccaagaca

SEQ ID NO: 42954 - DNA, 25 bp, Mus musculus
ggcaccttctacatgtgcaaagaag

SEQ ID NO: 42955 - DNA, 25 bp, Mus musculus
ggcacctttcccagatcatacaaca

SEQ ID NO: 42956 - DNA, 25 bp, Mus musculus
ggcacctttgctggtacctgtgagg

SEQ ID NO: 42957 - DNA, 25 bp, Mus musculus
ggcacgaccagttcaagcggcgcct

SEQ ID NO: 42958 - DNA, 25 bp, Mus musculus
ggcacgagcaggaattggcgtttac

SEQ ID NO: 42959 - DNA, 25 bp, Mus musculus
ggcacgattcggctcgactgtttca

SEQ ID NO: 42960 - DNA, 25 bp, Mus musculus
ggcacgccttgtcgtcctgctgcga

SEQ ID NO: 42961 - DNA, 25 bp, Mus musculus
ggcacggcccctctctctgttgagg

SEQ ID NO: 42962 - DNA, 25 bp, Mus musculus
ggcacgggtcctagtagcagtgtca

SEQ ID NO: 42963 - DNA, 25 bp, Mus musculus
ggcacgtgactgacttacatctaga

SEQ ID NO: 42964 - DNA, 25 bp, Mus musculus
ggcacgtgctgtctctagggctcct

SEQ ID NO: 42965 - DNA, 25 bp, Mus musculus
ggcacgtgtccatgtgctggagacc

SEQ ID NO: 42966 - DNA, 25 bp, Mus musculus
ggcactaaatctaaaatcctgcaga

SEQ ID NO: 42967 - DNA, 25 bp, Mus musculus
ggcactcaaaccacctacagtatgt

SEQ ID NO: 42968 - DNA, 25 bp, Mus musculus
ggcactcagctcttcatgaactaca

SEQ ID NO: 42969 - DNA, 25 bp, Mus musculus
ggcactcagttaccgagccacgtca

SEQ ID NO: 42970 - DNA, 25 bp, Mus musculus
ggcactcctgggtcatcaaagtaca

SEQ ID NO: 42971 - DNA, 25 bp, Mus musculus
ggcactccttcacattcttctcgga

SEQ ID NO: 42972 - DNA, 25 bp, Mus musculus
ggcactccttgtctatgacatcacc

SEQ ID NO: 42973 - DNA, 25 bp, Mus musculus
ggcactccttgtgtatgacatcacc

SEQ ID NO: 42974 - DNA, 25 bp, Mus musculus
ggcactgacactgtgccgagagtgt

SEQ ID NO: 42975 - DNA, 25 bp, Mus musculus
ggcactgagaacctcatcctcttgg

SEQ ID NO: 42976 - DNA, 25 bp, Mus musculus
ggcactgatcagagaaagcaagcga

SEQ ID NO: 42977 - DNA, 25 bp, Mus musculus
ggcactgatggaattggaaaagcat

SEQ ID NO: 42978 - DNA, 25 bp, Mus musculus
ggcactgatggaggacactatgacg

SEQ ID NO: 42979 - DNA, 25 bp, Mus musculus
ggcactgatgtacacagacactgtg

SEQ ID NO: 42980 - DNA, 25 bp, Mus musculus
ggcactggaatcctagcaacagatc

SEQ ID NO: 42981 - DNA, 25 bp, Mus musculus
ggcactggctctgacgctagggctt

SEQ ID NO: 42982 - DNA, 25 bp, Mus musculus
ggcactgtcaatgagatctataaaa

SEQ ID NO: 42983 - DNA, 25 bp, Mus musculus
ggcactgtgacgtttctggctggca

SEQ ID NO: 42984 - DNA, 25 bp, Mus musculus
ggcactgtggcagcgtaccgattgc

SEQ ID NO: 42985 - DNA, 25 bp, Mus musculus
ggcacttacgagtgccgggccagca

SEQ ID NO: 42986 - DNA, 25 bp, Mus musculus
ggcacttactgtctaaaccaacaga

SEQ ID NO: 42987 - DNA, 25 bp, Mus musculus
ggcacttactgtgtaaaccaacaga

SEQ ID NO: 42988 - DNA, 25 bp, Mus musculus
ggcacttctacccaacattaacatc

SEQ ID NO: 42989 - DNA, 25 bp, Mus musculus
ggcacttgcttttccagagcagaaa

SEQ ID NO: 42990 - DNA, 25 bp, Mus musculus
ggcactttaccaaactcaacagaat

SEQ ID NO: 42991 - DNA, 25 bp, Mus musculus
ggcactttcatcatctcactcactg

SEQ ID NO: 42992 - DNA, 25 bp, Mus musculus
ggcactttcggcatgactactcact

SEQ ID NO: 42993 - DNA, 25 bp, Mus musculus
ggcactttggagtcagtttacatcg

SEQ ID NO: 42994 - DNA, 25 bp, Mus musculus
ggcagaaacagcagctcaccaagac

SEQ ID NO: 42995 - DNA, 25 bp, Mus musculus
ggcagaaagaaatttggcacctcct

SEQ ID NO: 42996 - DNA, 25 bp, Mus musculus
ggcagaacatgttttgctgtacctc

SEQ ID NO: 42997 - DNA, 25 bp, Mus musculus
ggcagaactgctctctcatttttcg

SEQ ID NO: 42998 - DNA, 25 bp, Mus musculus
ggcagaagacctatctgcatttgag

SEQ ID NO: 42999 - DNA, 25 bp, Mus musculus
ggcagaagaggctcccgagagtcct

SEQ ID NO: 43000 - DNA, 25 bp, Mus musculus
ggcagaagcaatagaagatagagaa

SEQ ID NO: 43001 - DNA, 25 bp, Mus musculus
ggcagaagccacctctcaacagcat

SEQ ID NO: 43002 - DNA, 25 bp, Mus musculus
ggcagaagcggatacgggccaccac

SEQ ID NO: 43003 - DNA, 25 bp, Mus musculus
ggcagaaggctggagcattcacctg

SEQ ID NO: 43004 - DNA, 25 bp, Mus musculus
ggcagaatacagagaaagctctgac

SEQ ID NO: 43005 - DNA, 25 bp, Mus musculus
ggcagaatcagcacccctgggaatt

SEQ ID NO: 43006 - DNA, 25 bp, Mus musculus
ggcagaattgctgagccctgcagtt

SEQ ID NO: 43007 - DNA, 25 bp, Mus musculus
ggcagacaaggtagcttcactctct

SEQ ID NO: 43008 - DNA, 25 bp, Mus musculus
ggcagacacctcacactattgtcct

SEQ ID NO: 43009 - DNA, 25 bp, Mus musculus
ggcagacaggctagctgatgaacat

SEQ ID NO: 43010 - DNA, 25 bp, Mus musculus
ggcagacatttttattctgatggac

SEQ ID NO: 43011 - DNA, 25 bp, Mus musculus
ggcagaccacgctcacggtggaata

SEQ ID NO: 43012 - DNA, 25 bp, Mus musculus
ggcagaccatgcagttatctgaggt

SEQ ID NO: 43013 - DNA, 25 bp, Mus musculus
ggcagaccctgtcaatataactcca

SEQ ID NO: 43014 - DNA, 25 bp, Mus musculus
ggcagaccctgtgaatataactcca

SEQ ID NO: 43015 - DNA, 25 bp, Mus musculus
ggcagaccttattcgcaagggaatc

SEQ ID NO: 43016 - DNA, 25 bp, Mus musculus
ggcagactatgtggtcaacacctac

SEQ ID NO: 43017 - DNA, 25 bp, Mus musculus
ggcagactcaatcaaaatttgccac

SEQ ID NO: 43018 - DNA, 25 bp, Mus musculus
ggcagactggcagcgtctgtaaatt

SEQ ID NO: 43019 - DNA, 25 bp, Mus musculus
ggcagacttggagacatagtccctc

SEQ ID NO: 43020 - DNA, 25 bp, Mus musculus
ggcagagaccaggaaccaagtcgct

SEQ ID NO: 43021 - DNA, 25 bp, Mus musculus
ggcagagatgacctccatcttgcga

SEQ ID NO: 43022 - DNA, 25 bp, Mus musculus
ggcagagattagcagttccaaattt

SEQ ID NO: 43023 - DNA, 25 bp, Mus musculus
ggcagaggtgccatccagtttgtca

SEQ ID NO: 43024 - DNA, 25 bp, Mus musculus
ggcagaggttgatgtctgatgtctc

SEQ ID NO: 43025 - DNA, 25 bp, Mus musculus
ggcagagtgtacagcaagtgtacta

SEQ ID NO: 43026 - DNA, 25 bp, Mus musculus
ggcagagtgtcttttggcgctttct

SEQ ID NO: 43027 - DNA, 25 bp, Mus musculus
ggcagatctcctcagtctgtcctca

SEQ ID NO: 43028 - DNA, 25 bp, Mus musculus
ggcagatgtagcacgcctgctgtcc

SEQ ID NO: 43029 - DNA, 25 bp, Mus musculus
ggcagatgtcgtgccaaagactgca

SEQ ID NO: 43030 - DNA, 25 bp, Mus musculus
ggcagattaacaaaacagtagttgg

SEQ ID NO: 43031 - DNA, 25 bp, Mus musculus
ggcagattaacataacagtagttgg

SEQ ID NO: 43032 - DNA, 25 bp, Mus musculus
ggcagattcgaaaccgaggcttgga

SEQ ID NO: 43033 - DNA, 25 bp, Mus musculus
ggcagcaatccctacaccactgtta

SEQ ID NO: 43034 - DNA, 25 bp, Mus musculus
ggcagcaatgaacatagtcaacttc

SEQ ID NO: 43035 - DNA, 25 bp, Mus musculus
ggcagcacatgagcgagcaattctc

SEQ ID NO: 43036 - DNA, 25 bp, Mus musculus
ggcagcacggcagggtcataaaaat

SEQ ID NO: 43037 - DNA, 25 bp, Mus musculus
ggcagcactgatagaatagagaatt

SEQ ID NO: 43038 - DNA, 25 bp, Mus musculus
ggcagcagagtttatacagcagcag

SEQ ID NO: 43039 - DNA, 25 bp, Mus musculus
ggcagcagcaaatcctattgagtct

SEQ ID NO: 43040 - DNA, 25 bp, Mus musculus
ggcagcagcttatcgacctcaacag

SEQ ID NO: 43041 - DNA, 25 bp, Mus musculus
ggcagcagtggctacttcagcagca

SEQ ID NO: 43042 - DNA, 25 bp, Mus musculus
ggcagcatcactatctgccctacta

SEQ ID NO: 43043 - DNA, 25 bp, Mus musculus
ggcagcatcagctacagccagcctg

SEQ ID NO: 43044 - DNA, 25 bp, Mus musculus
ggcagcatctccctcaggacagaag

SEQ ID NO: 43045 - DNA, 25 bp, Mus musculus
ggcagcatcttcagcaagttcacct

SEQ ID NO: 43046 - DNA, 25 bp, Mus musculus
ggcagcattcgatgaaccttctaag

SEQ ID NO: 43047 - DNA, 25 bp, Mus musculus
ggcagccaaatacggaaagcttgaa

SEQ ID NO: 43048 - DNA, 25 bp, Mus musculus
ggcagccaatgggaaactatggtcc

SEQ ID NO: 43049 - DNA, 25 bp, Mus musculus
ggcagccaccacgtgctccgcaaag

SEQ ID NO: 43050 - DNA, 25 bp, Mus musculus
ggcagccagcaatcacagttctctt

SEQ ID NO: 43051 - DNA, 25 bp, Mus musculus
ggcagccaggatttaataaacaaca

SEQ ID NO: 43052 - DNA, 25 bp, Mus musculus
ggcagcctgccatgactcggattct

SEQ ID NO: 43053 - DNA, 25 bp, Mus musculus
ggcagcgagggcacctttccaacta

SEQ ID NO: 43054 - DNA, 25 bp, Mus musculus
ggcagcgccagttacaagaacctca

SEQ ID NO: 43055 - DNA, 25 bp, Mus musculus
ggcagcgctgtgagaacagcaccag

SEQ ID NO: 43056 - DNA, 25 bp, Mus musculus
ggcagcgctgtgtgaacagcaccag

SEQ ID NO: 43057 - DNA, 25 bp, Mus musculus
ggcagcgggaattctacagagacgt

SEQ ID NO: 43058 - DNA, 25 bp, Mus musculus
ggcagcgtcaaacccaggactggat

SEQ ID NO: 43059 - DNA, 25 bp, Mus musculus
ggcagcgtggacattctcaggctga

SEQ ID NO: 43060 - DNA, 25 bp, Mus musculus
ggcagctatgagatgctcgtttccc

SEQ ID NO: 43061 - DNA, 25 bp, Mus musculus
ggcagctcagtgagcaccggaagct

SEQ ID NO: 43062 - DNA, 25 bp, Mus musculus
ggcagctctcgtgttcatattctcc

SEQ ID NO: 43063 - DNA, 25 bp, Mus musculus
ggcagctgaacggtctccagagcag

SEQ ID NO: 43064 - DNA, 25 bp, Mus musculus
ggcagctggtggagtcagacctcaa

SEQ ID NO: 43065 - DNA, 25 bp, Mus musculus
ggcagcttcagttcattccatcaga

SEQ ID NO: 43066 - DNA, 25 bp, Mus musculus
ggcagcttccttttagaggagacga

SEQ ID NO: 43067 - DNA, 25 bp, Mus musculus
ggcagcttgactcgactgaaattga

SEQ ID NO: 43068 - DNA, 25 bp, Mus musculus
ggcagctttcgaggccgaataccga

SEQ ID NO: 43069 - DNA, 25 bp, Mus musculus
ggcagcttttgagtgtatgtataca

SEQ ID NO: 43070 - DNA, 25 bp, Mus musculus
ggcagctttttcacctagccagcag

SEQ ID NO: 43071 - DNA, 25 bp, Mus musculus
ggcaggaacagctgactcattagta

SEQ ID NO: 43072 - DNA, 25 bp, Mus musculus
ggcaggaagcgatcacatcctataa

SEQ ID NO: 43073 - DNA, 25 bp, Mus musculus
ggcaggagagctggtacttacctct

SEQ ID NO: 43074 - DNA, 25 bp, Mus musculus
ggcaggatagcatgtgccaatgtcc

SEQ ID NO: 43075 - DNA, 25 bp, Mus musculus
ggcaggcagcaaagcagctgcgtcc

SEQ ID NO: 43076 - DNA, 25 bp, Mus musculus
ggcaggcctatgatctccagagtga

SEQ ID NO: 43077 - DNA, 25 bp, Mus musculus
ggcagggatgaattccctggacaag

SEQ ID NO: 43078 - DNA, 25 bp, Mus musculus
ggcagggtcaaacatttgcagacac

SEQ ID NO: 43079 - DNA, 25 bp, Mus musculus
ggcagggtcaaagatttgcagacac

SEQ ID NO: 43080 - DNA, 25 bp, Mus musculus
ggcaggtagaccacttactctttca

SEQ ID NO: 43081 - DNA, 25 bp, Mus musculus
ggcaggtagcctttctccagtcagc

SEQ ID NO: 43082 - DNA, 25 bp, Mus musculus
ggcaggtgcactgccgactgcctta

SEQ ID NO: 43083 - DNA, 25 bp, Mus musculus
ggcaggtggtgtacaagtgtcccaa

SEQ ID NO: 43084 - DNA, 25 bp, Mus musculus
ggcaggttctcgatacatagctggg

SEQ ID NO: 43085 - DNA, 25 bp, Mus musculus
ggcagtacagcaggaatgagcccct

SEQ ID NO: 43086 - DNA, 25 bp, Mus musculus
ggcagtagctcgtctgagccagaca

SEQ ID NO: 43087 - DNA, 25 bp, Mus musculus
ggcagtattcattcaacaggccctg

SEQ ID NO: 43088 - DNA, 25 bp, Mus musculus
ggcagtattctgatcaacccacaaa

SEQ ID NO: 43089 - DNA, 25 bp, Mus musculus
ggcagtatttgtccctagacccaag

SEQ ID NO: 43090 - DNA, 25 bp, Mus musculus
ggcagtatttgtgcctagacccaag

SEQ ID NO: 43091 - DNA, 25 bp, Mus musculus
ggcagtcagggacgtgcctacctct

SEQ ID NO: 43092 - DNA, 25 bp, Mus musculus
ggcagtccatcatcaatgctctcaa

SEQ ID NO: 43093 - DNA, 25 bp, Mus musculus
ggcagtcccaagaaatgttttgaag

SEQ ID NO: 43094 - DNA, 25 bp, Mus musculus
ggcagtcccgtcactatggcaggaa

SEQ ID NO: 43095 - DNA, 25 bp, Mus musculus
ggcagtctattagaaggttcctgta

SEQ ID NO: 43096 - DNA, 25 bp, Mus musculus
ggcagtctgactctgctggaaaacc

SEQ ID NO: 43097 - DNA, 25 bp, Mus musculus
ggcagtctgggaagtcacgtgacaa

SEQ ID NO: 43098 - DNA, 25 bp, Mus musculus
ggcagtctgtgcacgtcatttgtgg

SEQ ID NO: 43099 - DNA, 25 bp, Mus musculus
ggcagtgaaatccatgtttcacacg

SEQ ID NO: 43100 - DNA, 25 bp, Mus musculus
ggcagtgacatccatgccctcgtca

SEQ ID NO: 43101 - DNA, 25 bp, Mus musculus
ggcagtgagagcatcaccttcctca

SEQ ID NO: 43102 - DNA, 25 bp, Mus musculus
ggcagtgcccaaaggaaatgccact

SEQ ID NO: 43103 - DNA, 25 bp, Mus musculus
ggcagtgctgccgtgtcctccgttg

SEQ ID NO: 43104 - DNA, 25 bp, Mus musculus
ggcagtgctgttcagcttcctcttg

SEQ ID NO: 43105 - DNA, 25 bp, Mus musculus
ggcagtgcttgacaaagagaatatt

SEQ ID NO: 43106 - DNA, 25 bp, Mus musculus
ggcagtgcttgagaaagagaatatt

SEQ ID NO: 43107 - DNA, 25 bp, Mus musculus
ggcagtggtagacctaaccagatca

SEQ ID NO: 43108 - DNA, 25 bp, Mus musculus
ggcagttcactacacggtcggctgt

SEQ ID NO: 43109 - DNA, 25 bp, Mus musculus
ggcagttccccacgcatggctttca

SEQ ID NO: 43110 - DNA, 25 bp, Mus musculus
ggcagttctaccagaaccgcaagtg

SEQ ID NO: 43111 - DNA, 25 bp, Mus musculus
ggcagtttcacagcctttgacagaa

SEQ ID NO: 43112 - DNA, 25 bp, Mus musculus
ggcagtttcctcaaatggtcaccga

SEQ ID NO: 43113 - DNA, 25 bp, Mus musculus
ggcataacgctcacacttcccattg

SEQ ID NO: 43114 - DNA, 25 bp, Mus musculus
ggcataaggagcattatcctgggaa

SEQ ID NO: 43115 - DNA, 25 bp, Mus musculus
ggcataatccatcatacccagagcc

SEQ ID NO: 43116 - DNA, 25 bp, Mus musculus
ggcatacacaggcaaatactttgac

SEQ ID NO: 43117 - DNA, 25 bp, Mus musculus
ggcatacaccagaaaacgctgtcct

SEQ ID NO: 43118 - DNA, 25 bp, Mus musculus
ggcataccacctggcagtattctga

SEQ ID NO: 43119 - DNA, 25 bp, Mus musculus
ggcatacctgctcatagcttacagc

SEQ ID NO: 43120 - DNA, 25 bp, Mus musculus
ggcatactgcgagccctgctacatt

SEQ ID NO: 43121 - DNA, 25 bp, Mus musculus
ggcatagagcgtccctttgtcctga

SEQ ID NO: 43122 - DNA, 25 bp, Mus musculus
ggcatagtccttgccctcaaaagag

SEQ ID NO: 43123 - DNA, 25 bp, Mus musculus
ggcatataacttgctgtgtgtggtg

SEQ ID NO: 43124 - DNA, 25 bp, Mus musculus
ggcatatctgcactacagtcctcag

SEQ ID NO: 43125 - DNA, 25 bp, Mus musculus
ggcatatgctacaagccagcaaatt

SEQ ID NO: 43126 - DNA, 25 bp, Mus musculus
ggcatatggtgctgggctcttgtca

SEQ ID NO: 43127 - DNA, 25 bp, Mus musculus
ggcatattgtgagagctgctatgtg

SEQ ID NO: 43128 - DNA, 25 bp, Mus musculus
ggcatcaagtatcgccggaatgaac

SEQ ID NO: 43129 - DNA, 25 bp, Mus musculus
ggcatcaccataaccgttggataat

SEQ ID NO: 43130 - DNA, 25 bp, Mus musculus
ggcatcacgttctacaacaaatggc

SEQ ID NO: 43131 - DNA, 25 bp, Mus musculus
ggcatcactggcatagttggagaca

SEQ ID NO: 43132 - DNA, 25 bp, Mus musculus
ggcatcagatttctgttacgaatgt

SEQ ID NO: 43133 - DNA, 25 bp, Mus musculus
ggcatcagcctgcagtgcaaagaca

SEQ ID NO: 43134 - DNA, 25 bp, Mus musculus
ggcatccacactccctgtctgttgg

SEQ ID NO: 43135 - DNA, 25 bp, Mus musculus
ggcatccctctagagaacaactaat

SEQ ID NO: 43136 - DNA, 25 bp, Mus musculus
ggcatccgccctgccattaatgtgg

SEQ ID NO: 43137 - DNA, 25 bp, Mus musculus
ggcatccgttgctagctaagaaact

SEQ ID NO: 43138 - DNA, 25 bp, Mus musculus
ggcatcctcaactttgctgcctaca

SEQ ID NO: 43139 - DNA, 25 bp, Mus musculus
ggcatcctgtgaaaatactcttaat

SEQ ID NO: 43140 - DNA, 25 bp, Mus musculus
ggcatccttaagcaagccatagaca

SEQ ID NO: 43141 - DNA, 25 bp, Mus musculus
ggcatcgacttacagaagaaataac

SEQ ID NO: 43142 - DNA, 25 bp, Mus musculus
ggcatcgacttcaaggtcaagacgg

SEQ ID NO: 43143 - DNA, 25 bp, Mus musculus
ggcatcgatctcaaagcatttctcg

SEQ ID NO: 43144 - DNA, 25 bp, Mus musculus
ggcatcgccatctacgtcaggtcag

SEQ ID NO: 43145 - DNA, 25 bp, Mus musculus
ggcatcgcctaacacatggtgacag

SEQ ID NO: 43146 - DNA, 25 bp, Mus musculus
ggcatcggacagtgggccttcctcc

SEQ ID NO: 43147 - DNA, 25 bp, Mus musculus
ggcatcggcttctctgttggcctct

SEQ ID NO: 43148 - DNA, 25 bp, Mus musculus
ggcatcggtggctttacttcttcga

SEQ ID NO: 43149 - DNA, 25 bp, Mus musculus
ggcatcgtctacaaacccatttcag

SEQ ID NO: 43150 - DNA, 25 bp, Mus musculus
ggcatcgtgagctttggttccagta

SEQ ID NO: 43151 - DNA, 25 bp, Mus musculus
ggcatcgtttgcattactatttaaa

SEQ ID NO: 43152 - DNA, 25 bp, Mus musculus
ggcatctaagaaatttgccgttaaa

SEQ ID NO: 43153 - DNA, 25 bp, Mus musculus
ggcatctccattgtgggccaaagca

SEQ ID NO: 43154 - DNA, 25 bp, Mus musculus
ggcatctgccaccatggttggctga

SEQ ID NO: 43155 - DNA, 25 bp, Mus musculus
ggcatctgcctcatcttaatagtca

SEQ ID NO: 43156 - DNA, 25 bp, Mus musculus
ggcatctggagaggacgatcccttt

SEQ ID NO: 43157 - DNA, 25 bp, Mus musculus
ggcatctgtatcattgtgggcacca

SEQ ID NO: 43158 - DNA, 25 bp, Mus musculus
ggcatcttctgatacccgtcagtca

SEQ ID NO: 43159 - DNA, 25 bp, Mus musculus
ggcatcttggattctagcccgaatt

SEQ ID NO: 43160 - DNA, 25 bp, Mus musculus
ggcatctttgtctcccctaagggtg

SEQ ID NO: 43161 - DNA, 25 bp, Mus musculus
ggcatgaaccatatcaaccaagaca

SEQ ID NO: 43162 - DNA, 25 bp, Mus musculus
ggcatgacggtttgagctctcgtgc

SEQ ID NO: 43163 - DNA, 25 bp, Mus musculus
ggcatgaggatgtagctgcgttcct

SEQ ID NO: 43164 - DNA, 25 bp, Mus musculus
ggcatgataaggcacaccataaggc

SEQ ID NO: 43165 - DNA, 25 bp, Mus musculus
ggcatgataagggacaccataaggc

SEQ ID NO: 43166 - DNA, 25 bp, Mus musculus
ggcatgatgctttgtaacatgtcca

SEQ ID NO: 43167 - DNA, 25 bp, Mus musculus
ggcatgcagtatctaatgtatggga

SEQ ID NO: 43168 - DNA, 25 bp, Mus musculus
ggcatgcctggatgtccctgccctg

SEQ ID NO: 43169 - DNA, 25 bp, Mus musculus
ggcatgctcacatagacgctgtaaa

SEQ ID NO: 43170 - DNA, 25 bp, Mus musculus
ggcatgctcccagttccattgttga

SEQ ID NO: 43171 - DNA, 25 bp, Mus musculus
ggcatgcttgtgtggtctccttatc

SEQ ID NO: 43172 - DNA, 25 bp, Mus musculus
ggcatggattccttttagcagagca

SEQ ID NO: 43173 - DNA, 25 bp, Mus musculus
ggcatggccgtttcttccacctgga

SEQ ID NO: 43174 - DNA, 25 bp, Mus musculus
ggcatggcgctcacgcttctttgag

SEQ ID NO: 43175 - DNA, 25 bp, Mus musculus
ggcatgtcctctgctggccttggag

SEQ ID NO: 43176 - DNA, 25 bp, Mus musculus
ggcatgtgctttgcagcctcagaaa

SEQ ID NO: 43177 - DNA, 25 bp, Mus musculus
ggcatgtgtttcttttggtcctaag

SEQ ID NO: 43178 - DNA, 25 bp, Mus musculus
ggcatgttcccgtcatctcagatcc

SEQ ID NO: 43179 - DNA, 25 bp, Mus musculus
ggcatgttcttccttgccactgctc

SEQ ID NO: 43180 - DNA, 25 bp, Mus musculus
ggcatgttgtcaggagacctcccat

SEQ ID NO: 43181 - DNA, 25 bp, Mus musculus
ggcattaagtacactcacgtccttg

SEQ ID NO: 43182 - DNA, 25 bp, Mus musculus
ggcattacgactataacctccaggt

SEQ ID NO: 43183 - DNA, 25 bp, Mus musculus
ggcattactaaacgaaccaccagat

SEQ ID NO: 43184 - DNA, 25 bp, Mus musculus
ggcattactagtctctaccacaaga

SEQ ID NO: 43185 - DNA, 25 bp, Mus musculus
ggcattatgttcagaggcaaggaga

SEQ ID NO: 43186 - DNA, 25 bp, Mus musculus
ggcattcaagcattccctagaccca

SEQ ID NO: 43187 - DNA, 25 bp, Mus musculus
ggcattcaaggttcccgaggaattc

SEQ ID NO: 43188 - DNA, 25 bp, Mus musculus
ggcattcaatgcatctcttcaagac

SEQ ID NO: 43189 - DNA, 25 bp, Mus musculus
ggcattcacacttctcttgaaagtg

SEQ ID NO: 43190 - DNA, 25 bp, Mus musculus
ggcattcactgtacttcattggcta

SEQ ID NO: 43191 - DNA, 25 bp, Mus musculus
ggcattcagatcatgacagtgggaa

SEQ ID NO: 43192 - DNA, 25 bp, Mus musculus
ggcattcctataattaatgtcaaca

SEQ ID NO: 43193 - DNA, 25 bp, Mus musculus
ggcattctgatcattctggaggcat

SEQ ID NO: 43194 - DNA, 25 bp, Mus musculus
ggcattgaatcccatgtgagccatc

SEQ ID NO: 43195 - DNA, 25 bp, Mus musculus
ggcattgaatgttcagtatggcttc

SEQ ID NO: 43196 - DNA, 25 bp, Mus musculus
ggcattgactatgagatagtgccca

SEQ ID NO: 43197 - DNA, 25 bp, Mus musculus
ggcattgagcaggtccggatacact

SEQ ID NO: 43198 - DNA, 25 bp, Mus musculus
ggcattgagtctaccatagagcaga

SEQ ID NO: 43199 - DNA, 25 bp, Mus musculus
ggcattgcatatggcggctcggtcc

SEQ ID NO: 43200 - DNA, 25 bp, Mus musculus
ggcattgcccgttgcacacacaagg

SEQ ID NO: 43201 - DNA, 25 bp, Mus musculus
ggcattgctggcctctacaagggac

SEQ ID NO: 43202 - DNA, 25 bp, Mus musculus
ggcattggcatttcccttgatggca

SEQ ID NO: 43203 - DNA, 25 bp, Mus musculus
ggcattgtcctccacccagctggat

SEQ ID NO: 43204 - DNA, 25 bp, Mus musculus
ggcatttctgctgttaatgaggtca

SEQ ID NO: 43205 - DNA, 25 bp, Mus musculus
ggcatttgactggaacacgcccaag

SEQ ID NO: 43206 - DNA, 25 bp, Mus musculus
ggcatttgcaccttatgcctgtggt

SEQ ID NO: 43207 - DNA, 25 bp, Mus musculus
ggcattttgtcgcttatccagtctt

SEQ ID NO: 43208 - DNA, 25 bp, Mus musculus
ggccaaactcgagccagagaggata

SEQ ID NO: 43209 - DNA, 25 bp, Mus musculus
ggccaaagataacttcaccttcaaa

SEQ ID NO: 43210 - DNA, 25 bp, Mus musculus
ggccaaagtcttcctcatctatgag

SEQ ID NO: 43211 - DNA, 25 bp, Mus musculus
ggccaaagttataaccactgtcctg

SEQ ID NO: 43212 - DNA, 25 bp, Mus musculus
ggccaacaatagaaggttcaactct

SEQ ID NO: 43213 - DNA, 25 bp, Mus musculus
ggccaacaatcctagtaagaaatac

SEQ ID NO: 43214 - DNA, 25 bp, Mus musculus
ggccaacagtactgtcacttgtgaa

SEQ ID NO: 43215 - DNA, 25 bp, Mus musculus
ggccaaccaatccacattgtgtacg

SEQ ID NO: 43216 - DNA, 25 bp, Mus musculus
ggccaaccaatcgacattgtgtacg

SEQ ID NO: 43217 - DNA, 25 bp, Mus musculus
ggccaaccgtttgcagaccaggaat

SEQ ID NO: 43218 - DNA, 25 bp, Mus musculus
ggccaacttagcatttatacgaggg

SEQ ID NO: 43219 - DNA, 25 bp, Mus musculus
ggccaagaatgacagcgagcagttt

SEQ ID NO: 43220 - DNA, 25 bp, Mus musculus
ggccaagatcaaaaagcaacctcag

SEQ ID NO: 43221 - DNA, 25 bp, Mus musculus
ggccaagatcaataagcaacctcag

SEQ ID NO: 43222 - DNA, 25 bp, Mus musculus
ggccaagatgtcctgctgtttattg

SEQ ID NO: 43223 - DNA, 25 bp, Mus musculus
ggccaagattaggtactacatcttt

SEQ ID NO: 43224 - DNA, 25 bp, Mus musculus
ggccaagcatggagatcctggtgat

SEQ ID NO: 43225 - DNA, 25 bp, Mus musculus
ggccaagcatggtgatcctggtgat

SEQ ID NO: 43226 - DNA, 25 bp, Mus musculus
ggccaagcctacgaggtcgacttca

SEQ ID NO: 43227 - DNA, 25 bp, Mus musculus
ggccaaggaagacccggaaatcaga

SEQ ID NO: 43228 - DNA, 25 bp, Mus musculus
ggccaagggacatacttcctaaggc

SEQ ID NO: 43229 - DNA, 25 bp, Mus musculus
ggccaagtccacatagcaagctgca

SEQ ID NO: 43230 - DNA, 25 bp, Mus musculus
ggccaagttctgctatgctgataag

SEQ ID NO: 43231 - DNA, 25 bp, Mus musculus
ggccaatcaaagtccttacccagaa

SEQ ID NO: 43232 - DNA, 25 bp, Mus musculus
ggccaatcctgatgctaccctgagg

SEQ ID NO: 43233 - DNA, 25 bp, Mus musculus
ggccaatggccagtacacccaagat

SEQ ID NO: 43234 - DNA, 25 bp, Mus musculus
ggccaattggactgggctctttaat

SEQ ID NO: 43235 - DNA, 25 bp, Mus musculus
ggccacaaatgttcttgcaaaccct

SEQ ID NO: 43236 - DNA, 25 bp, Mus musculus
ggccacaacagatctggtgcccatg

SEQ ID NO: 43237 - DNA, 25 bp, Mus musculus
ggccacaagaagagaaatatcctgt

SEQ ID NO: 43238 - DNA, 25 bp, Mus musculus
ggccacacgcatatcatcaatgtct

SEQ ID NO: 43239 - DNA, 25 bp, Mus musculus
ggccacagcagaagagatatgtttg

SEQ ID NO: 43240 - DNA, 25 bp, Mus musculus
ggccacagccttccacagtaaaatg

SEQ ID NO: 43241 - DNA, 25 bp, Mus musculus
ggccacagtatctagaggaagcccc

SEQ ID NO: 43242 - DNA, 25 bp, Mus musculus
ggccacatgccaagattacccgtat

SEQ ID NO: 43243 - DNA, 25 bp, Mus musculus
ggccacatgtacaccagcagcctgg

SEQ ID NO: 43244 - DNA, 25 bp, Mus musculus
ggccacattcacaagaagggaagaa

SEQ ID NO: 43245 - DNA, 25 bp, Mus musculus
ggccaccaaagcactgtagaagaca

SEQ ID NO: 43246 - DNA, 25 bp, Mus musculus
ggccaccatttctgaaatcaagacc

SEQ ID NO: 43247 - DNA, 25 bp, Mus musculus
ggccaccattttgggcatctatttt

SEQ ID NO: 43248 - DNA, 25 bp, Mus musculus
ggccaccgtaaaaccgcttcatttg

SEQ ID NO: 43249 - DNA, 25 bp, Mus musculus
ggccacgatgtaatcaaacttcttt

SEQ ID NO: 43250 - DNA, 25 bp, Mus musculus
ggccacgccgggaagacgatcatcc

SEQ ID NO: 43251 - DNA, 25 bp, Mus musculus
ggccacggtcgaccatcaagaaaac

SEQ ID NO: 43252 - DNA, 25 bp, Mus musculus
ggccacggtcgagcatcaagaaaac

SEQ ID NO: 43253 - DNA, 25 bp, Mus musculus
ggccacgtcagaaacaacagcctgt

SEQ ID NO: 43254 - DNA, 25 bp, Mus musculus
ggccacgttgctgttaaaccgagcg

SEQ ID NO: 43255 - DNA, 25 bp, Mus musculus
ggccactatggaggcttattccagg

SEQ ID NO: 43256 - DNA, 25 bp, Mus musculus
ggccactccaatcggtgcagttata

SEQ ID NO: 43257 - DNA, 25 bp, Mus musculus
ggccactcttacaaccacagacaga

SEQ ID NO: 43258 - DNA, 25 bp, Mus musculus
ggccactgcattgatatttatgctt

SEQ ID NO: 43259 - DNA, 25 bp, Mus musculus
ggccactgtcgtcttgggaaaagaa

SEQ ID NO: 43260 - DNA, 25 bp, Mus musculus
ggccactgtcgtgttgggaaaagaa

SEQ ID NO: 43261 - DNA, 25 bp, Mus musculus
ggccacttctttttcaacatcaaca

SEQ ID NO: 43262 - DNA, 25 bp, Mus musculus
ggccactttgcttccattgatgcgg

SEQ ID NO: 43263 - DNA, 25 bp, Mus musculus
ggccagaaaaagctgcttataagac

SEQ ID NO: 43264 - DNA, 25 bp, Mus musculus
ggccagaaaggacgcaacacatctc

SEQ ID NO: 43265 - DNA, 25 bp, Mus musculus
ggccagaaaggaggcaacacatctc

SEQ ID NO: 43266 - DNA, 25 bp, Mus musculus
ggccagaacggcatgtgtaactgca

SEQ ID NO: 43267 - DNA, 25 bp, Mus musculus
ggccagaacggcttgtgtaactgca

SEQ ID NO: 43268 - DNA, 25 bp, Mus musculus
ggccagaaggaatggaaaaattttg

SEQ ID NO: 43269 - DNA, 25 bp, Mus musculus
ggccagaaggctgtcgaacccttgt

SEQ ID NO: 43270 - DNA, 25 bp, Mus musculus
ggccagaagtaggtatttggtccct

SEQ ID NO: 43271 - DNA, 25 bp, Mus musculus
ggccagacaagagcactgaatctcc

SEQ ID NO: 43272 - DNA, 25 bp, Mus musculus
ggccagacctgcagagaaactcagc

SEQ ID NO: 43273 - DNA, 25 bp, Mus musculus
ggccagagcattggcactgtgccca

SEQ ID NO: 43274 - DNA, 25 bp, Mus musculus
ggccagaggacgtttgagtttcagc

SEQ ID NO: 43275 - DNA, 25 bp, Mus musculus
ggccagatgggtccagcttcaacat

SEQ ID NO: 43276 - DNA, 25 bp, Mus musculus
ggccagcacggattccccctggtat

SEQ ID NO: 43277 - DNA, 25 bp, Mus musculus
ggccagcacgttcaatatttgatgg

SEQ ID NO: 43278 - DNA, 25 bp, Mus musculus
ggccagcacttctatgctgtggaga

SEQ ID NO: 43279 - DNA, 25 bp, Mus musculus
ggccagcagagtatgaccccaaggc

SEQ ID NO: 43280 - DNA, 25 bp, Mus musculus
ggccagcattttccgagtactgtaa

SEQ ID NO: 43281 - DNA, 25 bp, Mus musculus
ggccagcccaagaaccaggaaagtt

SEQ ID NO: 43282 - DNA, 25 bp, Mus musculus
ggccagccccgagggtactgttttg

SEQ ID NO: 43283 - DNA, 25 bp, Mus musculus
ggccagcgcaaaaatctccggtgtt

SEQ ID NO: 43284 - DNA, 25 bp, Mus musculus
ggccagcgcaaatatctccggtgtt

SEQ ID NO: 43285 - DNA, 25 bp, Mus musculus
ggccagctctgcaagggccagtcct

SEQ ID NO: 43286 - DNA, 25 bp, Mus musculus
ggccagctgacaacttacctgcttt

SEQ ID NO: 43287 - DNA, 25 bp, Mus musculus
ggccagctttcagccattacagtgt

SEQ ID NO: 43288 - DNA, 25 bp, Mus musculus
ggccagctttgtttcataaatgatg

SEQ ID NO: 43289 - DNA, 25 bp, Mus musculus
ggccaggaaggaggctgtgactgat

SEQ ID NO: 43290 - DNA, 25 bp, Mus musculus
ggccaggaggacctactgcaagtat

SEQ ID NO: 43291 - DNA, 25 bp, Mus musculus
ggccaggctgaagctgttccgacat

SEQ ID NO: 43292 - DNA, 25 bp, Mus musculus
ggccaggctgtgtgaagttatcgaa

SEQ ID NO: 43293 - DNA, 25 bp, Mus musculus
ggccaggcttttcttacagctcctg

SEQ ID NO: 43294 - DNA, 25 bp, Mus musculus
ggccagggcatccagtatatcttca

SEQ ID NO: 43295 - DNA, 25 bp, Mus musculus
ggccagtacacccaagatctcacat

SEQ ID NO: 43296 - DNA, 25 bp, Mus musculus
ggccagtgaacgttgtgaatgtgta

SEQ ID NO: 43297 - DNA, 25 bp, Mus musculus
ggccagtgcacctttgacccaatgg

SEQ ID NO: 43298 - DNA, 25 bp, Mus musculus
ggccagtgtggcagccgtagggagg

SEQ ID NO: 43299 - DNA, 25 bp, Mus musculus
ggccataatgacatatgtgtccagc

SEQ ID NO: 43300 - DNA, 25 bp, Mus musculus
ggccatagccacaatgcttaactgc

SEQ ID NO: 43301 - DNA, 25 bp, Mus musculus
ggccatagtggagaatctgttgact

SEQ ID NO: 43302 - DNA, 25 bp, Mus musculus
ggccatcaaagtaatctcccggaac

SEQ ID NO: 43303 - DNA, 25 bp, Mus musculus
ggccatcatgacttacgtgtcctgc

SEQ ID NO: 43304 - DNA, 25 bp, Mus musculus
ggccatcatgcgcaccatgtggttt

SEQ ID NO: 43305 - DNA, 25 bp, Mus musculus
ggccatcatggagaaggactgtcaa

SEQ ID NO: 43306 - DNA, 25 bp, Mus musculus
ggccatccagaaagccagggagtgt

SEQ ID NO: 43307 - DNA, 25 bp, Mus musculus
ggccatcgagttgaaccccggcaat

SEQ ID NO: 43308 - DNA, 25 bp, Mus musculus
ggccatcgtaaaagccatggcctcc

SEQ ID NO: 43309 - DNA, 25 bp, Mus musculus
ggccatcgtctgagccggatacaat

SEQ ID NO: 43310 - DNA, 25 bp, Mus musculus
ggccatcgtctgtgccggatacaat

SEQ ID NO: 43311 - DNA, 25 bp, Mus musculus
ggccatcttctcaacactttctgtc

SEQ ID NO: 43312 - DNA, 25 bp, Mus musculus
ggccatgagaacttcgagctgatta

SEQ ID NO: 43313 - DNA, 25 bp, Mus musculus
ggccatgagataattgtgcagtatt

SEQ ID NO: 43314 - DNA, 25 bp, Mus musculus
ggccatgataggacacaccgactca

SEQ ID NO: 43315 - DNA, 25 bp, Mus musculus
ggccatgcagctcccattttatatg

SEQ ID NO: 43316 - DNA, 25 bp, Mus musculus
ggccatgcatatcttaaggaatggt

SEQ ID NO: 43317 - DNA, 25 bp, Mus musculus
ggccatggactttacgccagaggag

SEQ ID NO: 43318 - DNA, 25 bp, Mus musculus
ggccatggcataaggagcattatcc

SEQ ID NO: 43319 - DNA, 25 bp, Mus musculus
ggccatggccatgggcagcgtggag

SEQ ID NO: 43320 - DNA, 25 bp, Mus musculus
ggccatggctgctggccctgtttgt

SEQ ID NO: 43321 - DNA, 25 bp, Mus musculus
ggccatgtctgcaggtccccagctg

SEQ ID NO: 43322 - DNA, 25 bp, Mus musculus
ggccatgtttacagccatcgacgag

SEQ ID NO: 43323 - DNA, 25 bp, Mus musculus
ggccatgtttgtctacactaagcag

SEQ ID NO: 43324 - DNA, 25 bp, Mus musculus
ggccattatcagaatgccctatacc

SEQ ID NO: 43325 - DNA, 25 bp, Mus musculus
ggccattcacccagttatacaacct

SEQ ID NO: 43326 - DNA, 25 bp, Mus musculus
ggccattcctttcccagacgttgag

SEQ ID NO: 43327 - DNA, 25 bp, Mus musculus
ggccattgaagctgagggagccaca

SEQ ID NO: 43328 - DNA, 25 bp, Mus musculus
ggccattgtccatctagaagggaag

SEQ ID NO: 43329 - DNA, 25 bp, Mus musculus
ggccattgtgcacactctgccagtg

SEQ ID NO: 43330 - DNA, 25 bp, Mus musculus
ggccattgttttgaagaacacctgg

SEQ ID NO: 43331 - DNA, 25 bp, Mus musculus
ggccatttcagaatcagacccatgc

SEQ ID NO: 43332 - DNA, 25 bp, Mus musculus
ggccattttcctttgcaccgtgcaa

SEQ ID NO: 43333 - DNA, 25 bp, Mus musculus
ggccattttgttcttcctcctgcat

SEQ ID NO: 43334 - DNA, 25 bp, Mus musculus
ggcccaaaaactgcgactggcttat

SEQ ID NO: 43335 - DNA, 25 bp, Mus musculus
ggcccaaacctttcataattccagg

SEQ ID NO: 43336 - DNA, 25 bp, Mus musculus
ggcccaaacgcaagttcgagcctgg

SEQ ID NO: 43337 - DNA, 25 bp, Mus musculus
ggcccaaagatttacagttggagga

SEQ ID NO: 43338 - DNA, 25 bp, Mus musculus
ggcccaacatcatcacacttgcaga

SEQ ID NO: 43339 - DNA, 25 bp, Mus musculus
ggcccaagactttttccagcgctgg

SEQ ID NO: 43340 - DNA, 25 bp, Mus musculus
ggcccaagctggagaaacggccccg

SEQ ID NO: 43341 - DNA, 25 bp, Mus musculus
ggcccaatatgtcaagacctctgat

SEQ ID NO: 43342 - DNA, 25 bp, Mus musculus
ggcccaatccctaaaatagactcag

SEQ ID NO: 43343 - DNA, 25 bp, Mus musculus
ggcccacatctctcaagcagcaaag

SEQ ID NO: 43344 - DNA, 25 bp, Mus musculus
ggcccacggagcaatacagtgacat

SEQ ID NO: 43345 - DNA, 25 bp, Mus musculus
ggcccacgtcccagggagaacgtat

SEQ ID NO: 43346 - DNA, 25 bp, Mus musculus
ggcccactgtgcagcctgtgacctt

SEQ ID NO: 43347 - DNA, 25 bp, Mus musculus
ggcccagaaccaaatgtacaccctg

SEQ ID NO: 43348 - DNA, 25 bp, Mus musculus
ggcccagaagaatatgtgagcaggc

SEQ ID NO: 43349 - DNA, 25 bp, Mus musculus
ggcccagaaggagcgctgcgtcatt

SEQ ID NO: 43350 - DNA, 25 bp, Mus musculus
ggcccagaggatccgcctatttcct

SEQ ID NO: 43351 - DNA, 25 bp, Mus musculus
ggcccagcagagaaaagattctatt

SEQ ID NO: 43352 - DNA, 25 bp, Mus musculus
ggcccagccacggaaaatagggaag

SEQ ID NO: 43353 - DNA, 25 bp, Mus musculus
ggcccagctgggactattccactgc

SEQ ID NO: 43354 - DNA, 25 bp, Mus musculus
ggcccaggaacatgtagttgcccaa

SEQ ID NO: 43355 - DNA, 25 bp, Mus musculus
ggcccaggagcagggatggttgctt

SEQ ID NO: 43356 - DNA, 25 bp, Mus musculus
ggcccaggctaatgaacagaggtat

SEQ ID NO: 43357 - DNA, 25 bp, Mus musculus
ggcccaggctgttgccactcaagag

SEQ ID NO: 43358 - DNA, 25 bp, Mus musculus
ggcccaggttggagccaacgtgcaa

SEQ ID NO: 43359 - DNA, 25 bp, Mus musculus
ggcccagtgagtacatggaggttcc

SEQ ID NO: 43360 - DNA, 25 bp, Mus musculus
ggcccatctaccgtggaaaaccagt

SEQ ID NO: 43361 - DNA, 25 bp, Mus musculus
ggcccatgaatcacatctaatgctg

SEQ ID NO: 43362 - DNA, 25 bp, Mus musculus
ggcccatgaatctcatctaatgctg

SEQ ID NO: 43363 - DNA, 25 bp, Mus musculus
ggcccatgctaagtattttctttac

SEQ ID NO: 43364 - DNA, 25 bp, Mus musculus
ggcccatggaagacaaaagagagca

SEQ ID NO: 43365 - DNA, 25 bp, Mus musculus
ggcccatggcaagaaagtgataact

SEQ ID NO: 43366 - DNA, 25 bp, Mus musculus
ggcccatggcattgtggtaacagat

SEQ ID NO: 43367 - DNA, 25 bp, Mus musculus
ggcccatgggccagtcccagcggta

SEQ ID NO: 43368 - DNA, 25 bp, Mus musculus
ggcccatgtggatgctcagacaaag

SEQ ID NO: 43369 - DNA, 25 bp, Mus musculus
ggccccaaagcccaaagtgaatcct

SEQ ID NO: 43370 - DNA, 25 bp, Mus musculus
ggccccaaaggacatgacattttta

SEQ ID NO: 43371 - DNA, 25 bp, Mus musculus
ggccccactgcgagagctgcaggca

SEQ ID NO: 43372 - DNA, 25 bp, Mus musculus
ggccccactggtgagtctggatgaa

SEQ ID NO: 43373 - DNA, 25 bp, Mus musculus
ggccccaggcttctttaatctggaa

SEQ ID NO: 43374 - DNA, 25 bp, Mus musculus
ggccccaggtgtcctccagtgcaga

SEQ ID NO: 43375 - DNA, 25 bp, Mus musculus
ggccccgtaaattggaaggatgcac

SEQ ID NO: 43376 - DNA, 25 bp, Mus musculus
ggccccgtccctcattcaatgaaga

SEQ ID NO: 43377 - DNA, 25 bp, Mus musculus
ggcccctagtaaagaccatcatgac

SEQ ID NO: 43378 - DNA, 25 bp, Mus musculus
ggcccctctgtttggtgatttctga

SEQ ID NO: 43379 - DNA, 25 bp, Mus musculus
ggcccctgctcctgaaatcagtgac

SEQ ID NO: 43380 - DNA, 25 bp, Mus musculus
ggcccctgctgttgagtgcacaaga

SEQ ID NO: 43381 - DNA, 25 bp, Mus musculus
ggcccctgtgctgttattgcacctg

SEQ ID NO: 43382 - DNA, 25 bp, Mus musculus
ggcccgaaagcagcttgaagcctat

SEQ ID NO: 43383 - DNA, 25 bp, Mus musculus
ggcccgagagatcttggactcccgt

SEQ ID NO: 43384 - DNA, 25 bp, Mus musculus
ggcccggagcacagtaacattcagc

SEQ ID NO: 43385 - DNA, 25 bp, Mus musculus
ggcccgggatgtgtggatgctgctc

SEQ ID NO: 43386 - DNA, 25 bp, Mus musculus
ggcccggtgtccaatgtgctgtcct

SEQ ID NO: 43387 - DNA, 25 bp, Mus musculus
ggcccgtggccgtgggcatctctct

SEQ ID NO: 43388 - DNA, 25 bp, Mus musculus
ggccctcagtacaattcgtctctca

SEQ ID NO: 43389 - DNA, 25 bp, Mus musculus
ggccctcatggactgcatgaacaag

SEQ ID NO: 43390 - DNA, 25 bp, Mus musculus
ggccctcccattccagaagcagatg

SEQ ID NO: 43391 - DNA, 25 bp, Mus musculus
ggccctctacctctcagatgcagaa

SEQ ID NO: 43392 - DNA, 25 bp, Mus musculus
ggccctctacctgtcagatgcagaa

SEQ ID NO: 43393 - DNA, 25 bp, Mus musculus
ggccctctggaattcgagagaatat

SEQ ID NO: 43394 - DNA, 25 bp, Mus musculus
ggccctgaaccgagccatgagagaa

SEQ ID NO: 43395 - DNA, 25 bp, Mus musculus
ggccctgaacctacatggcatgata

SEQ ID NO: 43396 - DNA, 25 bp, Mus musculus
ggccctgaaccttcatggcatgata

SEQ ID NO: 43397 - DNA, 25 bp, Mus musculus
ggccctgaaggctgtctctgactgg

SEQ ID NO: 43398 - DNA, 25 bp, Mus musculus
ggccctgaatacaattcttctctca

SEQ ID NO: 43399 - DNA, 25 bp, Mus musculus
ggccctgaatgcaacatgaacaaaa

SEQ ID NO: 43400 - DNA, 25 bp, Mus musculus
ggccctgatcttcattactctcctg

SEQ ID NO: 43401 - DNA, 25 bp, Mus musculus
ggccctgatggcaccaagtctgtct

SEQ ID NO: 43402 - DNA, 25 bp, Mus musculus
ggccctgcgcaagaagcatgctgac

SEQ ID NO: 43403 - DNA, 25 bp, Mus musculus
ggccctgctcagactgcccaagaag

SEQ ID NO: 43404 - DNA, 25 bp, Mus musculus
ggccctggcactcatgaagacacgg

SEQ ID NO: 43405 - DNA, 25 bp, Mus musculus
ggccctggtagtgttttcattcaag

SEQ ID NO: 43406 - DNA, 25 bp, Mus musculus
ggccctgtacctctatcccattttt

SEQ ID NO: 43407 - DNA, 25 bp, Mus musculus
ggccctgtcctggtggaagatacct

SEQ ID NO: 43408 - DNA, 25 bp, Mus musculus
ggccctgtcggtgacacgtcggaca

SEQ ID NO: 43409 - DNA, 25 bp, Mus musculus
ggcccttacctgaagctctgctgtg

SEQ ID NO: 43410 - DNA, 25 bp, Mus musculus
ggcccttattctcttctgtgattat

SEQ ID NO: 43411 - DNA, 25 bp, Mus musculus
ggcccttcgacaaaatggacgtgat

SEQ ID NO: 43412 - DNA, 25 bp, Mus musculus
ggcccttgactacatcaaaaatgga

SEQ ID NO: 43413 - DNA, 25 bp, Mus musculus
ggcccttggcaatgttcggactgtg

SEQ ID NO: 43414 - DNA, 25 bp, Mus musculus
ggcccttgtggataagcacaaagtc

SEQ ID NO: 43415 - DNA, 25 bp, Mus musculus
ggccctttatcctatgcaccagcag

SEQ ID NO: 43416 - DNA, 25 bp, Mus musculus
ggccctttgaagacattcagttctg

SEQ ID NO: 43417 - DNA, 25 bp, Mus musculus
ggccgaaaacttgaacaaccaatga

SEQ ID NO: 43418 - DNA, 25 bp, Mus musculus
ggccgaaaagagagaaacatccgaa

SEQ ID NO: 43419 - DNA, 25 bp, Mus musculus
ggccgaaaggctgagcctgcgcagt

SEQ ID NO: 43420 - DNA, 25 bp, Mus musculus
ggccgaaagttgaggctctccagaa

SEQ ID NO: 43421 - DNA, 25 bp, Mus musculus
ggccgactatgtggtcccagctcag

SEQ ID NO: 43422 - DNA, 25 bp, Mus musculus
ggccgactgtctatgatgcgtctca

SEQ ID NO: 43423 - DNA, 25 bp, Mus musculus
ggccgagcggctgctcagagaatta

SEQ ID NO: 43424 - DNA, 25 bp, Mus musculus
ggccgagtatgggatgacaagtcct

SEQ ID NO: 43425 - DNA, 25 bp, Mus musculus
ggccgatcaacagtgctaatcgaga

SEQ ID NO: 43426 - DNA, 25 bp, Mus musculus
ggccgatcgccaatggtgagctttg

SEQ ID NO: 43427 - DNA, 25 bp, Mus musculus
ggccgattccgacatcactgaactg

SEQ ID NO: 43428 - DNA, 25 bp, Mus musculus
ggccgatttccagggaaaggtgtct

SEQ ID NO: 43429 - DNA, 25 bp, Mus musculus
ggccgcacgggcagcagtgatcacc

SEQ ID NO: 43430 - DNA, 25 bp, Mus musculus
ggccgcacgggctgcagtgatcacc

SEQ ID NO: 43431 - DNA, 25 bp, Mus musculus
ggccgcaggagtcttgccacagaat

SEQ ID NO: 43432 - DNA, 25 bp, Mus musculus
ggccgcataggctacatctttgctc

SEQ ID NO: 43433 - DNA, 25 bp, Mus musculus
ggccgcatgagtggcaatcctgatg

SEQ ID NO: 43434 - DNA, 25 bp, Mus musculus
ggccgccattcttggtgataagaca

SEQ ID NO: 43435 - DNA, 25 bp, Mus musculus
ggccgcctcctttggctggacagaa

SEQ ID NO: 43436 - DNA, 25 bp, Mus musculus
ggccgcgggcttcgccagtggcgtg

SEQ ID NO: 43437 - DNA, 25 bp, Mus musculus
ggccgcgggcttggccagtggcgtg

SEQ ID NO: 43438 - DNA, 25 bp, Mus musculus
ggccgcttcctcagcatggtgaaca

SEQ ID NO: 43439 - DNA, 25 bp, Mus musculus
ggccgcttctatgcctttggtagag

SEQ ID NO: 43440 - DNA, 25 bp, Mus musculus
ggccggcaagagtcagtatcttctg

SEQ ID NO: 43441 - DNA, 25 bp, Mus musculus
ggccggcagaaaatgcgcaaggtca

SEQ ID NO: 43442 - DNA, 25 bp, Mus musculus
ggccggccacaacagatctggtgcc

SEQ ID NO: 43443 - DNA, 25 bp, Mus musculus
ggccggccgtgattattcctcctcg

SEQ ID NO: 43444 - DNA, 25 bp, Mus musculus
ggccgggaacataatttcacacgtc

SEQ ID NO: 43445 - DNA, 25 bp, Mus musculus
ggccgggcgagagccgaagcaatgt

SEQ ID NO: 43446 - DNA, 25 bp, Mus musculus
ggccggtccaagatcacattcctct

SEQ ID NO: 43447 - DNA, 25 bp, Mus musculus
ggccggtcgagtgcagttcacactt

SEQ ID NO: 43448 - DNA, 25 bp, Mus musculus
ggccggtgaaccagtttgactatca

SEQ ID NO: 43449 - DNA, 25 bp, Mus musculus
ggccggtgtacaaacagcgtggtca

SEQ ID NO: 43450 - DNA, 25 bp, Mus musculus
ggccgtatcatctttgcctggtgga

SEQ ID NO: 43451 - DNA, 25 bp, Mus musculus
ggccgtcctccctgtcatgttgctg

SEQ ID NO: 43452 - DNA, 25 bp, Mus musculus
ggccgtgacctcatgattgttttgc

SEQ ID NO: 43453 - DNA, 25 bp, Mus musculus
ggccgtgagaccagttgttagcatt

SEQ ID NO: 43454 - DNA, 25 bp, Mus musculus
ggccgtgatcaccaagcaggaagat

SEQ ID NO: 43455 - DNA, 25 bp, Mus musculus
ggccgtgattattcctcctcgcaaa

SEQ ID NO: 43456 - DNA, 25 bp, Mus musculus
ggccgtgcttcagactctttatatc

SEQ ID NO: 43457 - DNA, 25 bp, Mus musculus
ggccgtggctactttacctctctgt

SEQ ID NO: 43458 - DNA, 25 bp, Mus musculus
ggccgttgacttctctccggatgag

SEQ ID NO: 43459 - DNA, 25 bp, Mus musculus
ggccgtttgatgatggagctccacc

SEQ ID NO: 43460 - DNA, 25 bp, Mus musculus
ggccgtttggccactttgaaggtgc

SEQ ID NO: 43461 - DNA, 25 bp, Mus musculus
ggcctaagcaagaatccgctttttg

SEQ ID NO: 43462 - DNA, 25 bp, Mus musculus
ggcctaagttggttccagagtcaca

SEQ ID NO: 43463 - DNA, 25 bp, Mus musculus
ggcctaatgcacaatcaagcaacaa

SEQ ID NO: 43464 - DNA, 25 bp, Mus musculus
ggcctacagacgacaggaatacgag

SEQ ID NO: 43465 - DNA, 25 bp, Mus musculus
ggcctacagattgggtaccgtagca

SEQ ID NO: 43466 - DNA, 25 bp, Mus musculus
ggcctacagcaacctgggcaatgct

SEQ ID NO: 43467 - DNA, 25 bp, Mus musculus
ggcctacctgtttatcttcaactgg

SEQ ID NO: 43468 - DNA, 25 bp, Mus musculus
ggcctacgacaaatccaaacacttc

SEQ ID NO: 43469 - DNA, 25 bp, Mus musculus
ggcctacgccttaccgaagctgatt

SEQ ID NO: 43470 - DNA, 25 bp, Mus musculus
ggcctatagagatcacatatcgagc

SEQ ID NO: 43471 - DNA, 25 bp, Mus musculus
ggcctatccggccacataagaacat

SEQ ID NO: 43472 - DNA, 25 bp, Mus musculus
ggcctatgaggagctcctggacaac

SEQ ID NO: 43473 - DNA, 25 bp, Mus musculus
ggcctatgcagactatcatgacctc

SEQ ID NO: 43474 - DNA, 25 bp, Mus musculus
ggcctatggctttcccttaccagta

SEQ ID NO: 43475 - DNA, 25 bp, Mus musculus
ggcctcaaaacggagggcaataggt

SEQ ID NO: 43476 - DNA, 25 bp, Mus musculus
ggcctcaaacttactgtgtcaccaa

SEQ ID NO: 43477 - DNA, 25 bp, Mus musculus
ggcctcaatgagagaagcccctgtc

SEQ ID NO: 43478 - DNA, 25 bp, Mus musculus
ggcctcacgggaatgcagcagccat

SEQ ID NO: 43479 - DNA, 25 bp, Mus musculus
ggcctcacgggattgcagcagccat

SEQ ID NO: 43480 - DNA, 25 bp, Mus musculus
ggcctcactctgctcatcagcttgg

SEQ ID NO: 43481 - DNA, 25 bp, Mus musculus
ggcctcagatctggatcttttcctg

SEQ ID NO: 43482 - DNA, 25 bp, Mus musculus
ggcctcaggcacattatagtcaaac

SEQ ID NO: 43483 - DNA, 25 bp, Mus musculus
ggcctcagtgtccaaggctgcttcc

SEQ ID NO: 43484 - DNA, 25 bp, Mus musculus
ggcctcagtttgaagatgtgcagat

SEQ ID NO: 43485 - DNA, 25 bp, Mus musculus
ggcctcatccctatgacagtaactc

SEQ ID NO: 43486 - DNA, 25 bp, Mus musculus
ggcctcatgctgcatccgtcaagga

SEQ ID NO: 43487 - DNA, 25 bp, Mus musculus
ggcctcatgctggatccgtcaagga

SEQ ID NO: 43488 - DNA, 25 bp, Mus musculus
ggcctccaacgtgtaagtaaagctt

SEQ ID NO: 43489 - DNA, 25 bp, Mus musculus
ggcctccacttcctcggtcttatga

SEQ ID NO: 43490 - DNA, 25 bp, Mus musculus
ggcctccagagatattgccagtgac

SEQ ID NO: 43491 - DNA, 25 bp, Mus musculus
ggcctccctagtcgatggcactgca

SEQ ID NO: 43492 - DNA, 25 bp, Mus musculus
ggcctcctcaatccccactgtggaa

SEQ ID NO: 43493 - DNA, 25 bp, Mus musculus
ggcctcctccacctattgacaatgg

SEQ ID NO: 43494 - DNA, 25 bp, Mus musculus
ggcctcctggagttccgggcataga

SEQ ID NO: 43495 - DNA, 25 bp, Mus musculus
ggcctcgaaatcagagcctttgaga

SEQ ID NO: 43496 - DNA, 25 bp, Mus musculus
ggcctcgaaatctgagcctttgaga

SEQ ID NO: 43497 - DNA, 25 bp, Mus musculus
ggcctcgaactgtggtcctcctgtc

SEQ ID NO: 43498 - DNA, 25 bp, Mus musculus
ggcctcgctgtgatatgtatgacgt

SEQ ID NO: 43499 - DNA, 25 bp, Mus musculus
ggcctcgtgtacctccagtcattgt

SEQ ID NO: 43500 - DNA, 25 bp, Mus musculus
ggcctcgtgtgatcatccaactcca

SEQ ID NO: 43501 - DNA, 25 bp, Mus musculus
ggcctctcaccttctaattataatt

SEQ ID NO: 43502 - DNA, 25 bp, Mus musculus
ggcctctgagactcccagcatgaag

SEQ ID NO: 43503 - DNA, 25 bp, Mus musculus
ggcctctgcctcaacacggagggct

SEQ ID NO: 43504 - DNA, 25 bp, Mus musculus
ggcctctgcctctacacggagggct

SEQ ID NO: 43505 - DNA, 25 bp, Mus musculus
ggcctctgtcagtgtttggtttgga

SEQ ID NO: 43506 - DNA, 25 bp, Mus musculus
ggcctctgtggagccctattgtgcc

SEQ ID NO: 43507 - DNA, 25 bp, Mus musculus
ggcctctgtgtacttcaatgtcatc

SEQ ID NO: 43508 - DNA, 25 bp, Mus musculus
ggcctctgtgttcttataggatgct

SEQ ID NO: 43509 - DNA, 25 bp, Mus musculus
ggcctcttagaagagaaatacagat

SEQ ID NO: 43510 - DNA, 25 bp, Mus musculus
ggcctgaaagtattagctgcaagat

SEQ ID NO: 43511 - DNA, 25 bp, Mus musculus
ggcctgaacatctcggcagacaatg

SEQ ID NO: 43512 - DNA, 25 bp, Mus musculus
ggcctgaactgggagataactctgg

SEQ ID NO: 43513 - DNA, 25 bp, Mus musculus
ggcctgagcgtagttgtgacaacac

SEQ ID NO: 43514 - DNA, 25 bp, Mus musculus
ggcctgagctaagtcagctggacca

SEQ ID NO: 43515 - DNA, 25 bp, Mus musculus
ggcctgcaagttattccaaacacag

SEQ ID NO: 43516 - DNA, 25 bp, Mus musculus
ggcctgcatcaattgagcgagttca

SEQ ID NO: 43517 - DNA, 25 bp, Mus musculus
ggcctgccggctgaagaagtgctta

SEQ ID NO: 43518 - DNA, 25 bp, Mus musculus
ggcctgcctcatcagcctgggctat

SEQ ID NO: 43519 - DNA, 25 bp, Mus musculus
ggcctgcctcctcggtacatgatgc

SEQ ID NO: 43520 - DNA, 25 bp, Mus musculus
ggcctgcctttgactcattgctgtc

SEQ ID NO: 43521 - DNA, 25 bp, Mus musculus
ggcctgctcttgaaaaaaccaacgg

SEQ ID NO: 43522 - DNA, 25 bp, Mus musculus
ggcctgctgtcgtttagttgatcta

SEQ ID NO: 43523 - DNA, 25 bp, Mus musculus
ggcctggacatcatctgcgcttatg

SEQ ID NO: 43524 - DNA, 25 bp, Mus musculus
ggcctggactattatactggagtga

SEQ ID NO: 43525 - DNA, 25 bp, Mus musculus
ggcctggactcaggatctgcctcgt

SEQ ID NO: 43526 - DNA, 25 bp, Mus musculus
ggcctggagtacaacatgttcttct

SEQ ID NO: 43527 - DNA, 25 bp, Mus musculus
ggcctggatatctatgtgacacagc

SEQ ID NO: 43528 - DNA, 25 bp, Mus musculus
ggcctggccagggatatcaacaaca

SEQ ID NO: 43529 - DNA, 25 bp, Mus musculus
ggcctggccggattcatcactgcat

SEQ ID NO: 43530 - DNA, 25 bp, Mus musculus
ggcctggcctatctgaatggttcac

SEQ ID NO: 43531 - DNA, 25 bp, Mus musculus
ggcctggctttcaacatcctgggaa

SEQ ID NO: 43532 - DNA, 25 bp, Mus musculus
ggcctgggcagtgcccgtaatagca

SEQ ID NO: 43533 - DNA, 25 bp, Mus musculus
ggcctgggccttttacttcgatcca

SEQ ID NO: 43534 - DNA, 25 bp, Mus musculus
ggcctgtaggccttttcttgattga

SEQ ID NO: 43535 - DNA, 25 bp, Mus musculus
ggcctgtccctcagcagatttagct

SEQ ID NO: 43536 - DNA, 25 bp, Mus musculus
ggcctgtgctctctaggaagataag

SEQ ID NO: 43537 - DNA, 25 bp, Mus musculus
ggcctgtgtcagaaatgcgtcttca

SEQ ID NO: 43538 - DNA, 25 bp, Mus musculus
ggcctgttgctcaagagtgcactgt

SEQ ID NO: 43539 - DNA, 25 bp, Mus musculus
ggcctgttggaaacttcaactccag

SEQ ID NO: 43540 - DNA, 25 bp, Mus musculus
ggccttaaaccggacaccacttatg

SEQ ID NO: 43541 - DNA, 25 bp, Mus musculus
ggccttaatgttgactttgaatctg

SEQ ID NO: 43542 - DNA, 25 bp, Mus musculus
ggccttatgtttatgacctaattgc

SEQ ID NO: 43543 - DNA, 25 bp, Mus musculus
ggccttcaaagaatcacgaatgtgg

SEQ ID NO: 43544 - DNA, 25 bp, Mus musculus
ggccttcaccatctcctatgtgtac

SEQ ID NO: 43545 - DNA, 25 bp, Mus musculus
ggccttcagatcctcttatctcagc

SEQ ID NO: 43546 - DNA, 25 bp, Mus musculus
ggccttcaggcactgctatgtcaaa

SEQ ID NO: 43547 - DNA, 25 bp, Mus musculus
ggccttcaggcagtgctatgtcaaa

SEQ ID NO: 43548 - DNA, 25 bp, Mus musculus
ggccttcatcattgccgtcatttat

SEQ ID NO: 43549 - DNA, 25 bp, Mus musculus
ggccttcatgatgttggaccttcca

SEQ ID NO: 43550 - DNA, 25 bp, Mus musculus
ggccttcccagcagtggccttgctt

SEQ ID NO: 43551 - DNA, 25 bp, Mus musculus
ggccttcggaacagatgtataccct

SEQ ID NO: 43552 - DNA, 25 bp, Mus musculus
ggccttctgatagctccgtgcagcg

SEQ ID NO: 43553 - DNA, 25 bp, Mus musculus
ggccttctggattctatcactaata

SEQ ID NO: 43554 - DNA, 25 bp, Mus musculus
ggccttgaatcgcaggacttggaaa

SEQ ID NO: 43555 - DNA, 25 bp, Mus musculus
ggccttgagctctgacattaagaaa

SEQ ID NO: 43556 - DNA, 25 bp, Mus musculus
ggccttgattgcttcgtcctgaacc

SEQ ID NO: 43557 - DNA, 25 bp, Mus musculus
ggccttgggccaatggatcagcttt

SEQ ID NO: 43558 - DNA, 25 bp, Mus musculus
ggccttggtccacggcatcctggaa

SEQ ID NO: 43559 - DNA, 25 bp, Mus musculus
ggcctttatccagctggctgcaaag

SEQ ID NO: 43560 - DNA, 25 bp, Mus musculus
ggcctttcctgttaacaccacgact

SEQ ID NO: 43561 - DNA, 25 bp, Mus musculus
ggcctttctcagttcctgtgccaac

SEQ ID NO: 43562 - DNA, 25 bp, Mus musculus
ggcctttctgtccagcgctctgttt

SEQ ID NO: 43563 - DNA, 25 bp, Mus musculus
ggcctttgaaagtgacctggctgca

SEQ ID NO: 43564 - DNA, 25 bp, Mus musculus
ggcctttgaagatctggctctcttc

SEQ ID NO: 43565 - DNA, 25 bp, Mus musculus
ggcctttgcaggtacctgtgctcag

SEQ ID NO: 43566 - DNA, 25 bp, Mus musculus
ggcctttgctaacttcgatccttgc

SEQ ID NO: 43567 - DNA, 25 bp, Mus musculus
ggcctttggcttcctcggacccaag

SEQ ID NO: 43568 - DNA, 25 bp, Mus musculus
ggccttttaaattagcctgccagga

SEQ ID NO: 43569 - DNA, 25 bp, Mus musculus
ggccttttacttcgatccaagcaga

SEQ ID NO: 43570 - DNA, 25 bp, Mus musculus
ggccttttcatatgtccttgtaaca

SEQ ID NO: 43571 - DNA, 25 bp, Mus musculus
ggccttttccttactgacattctga

SEQ ID NO: 43572 - DNA, 25 bp, Mus musculus
ggccttttgtaaagcccagcatgcc

SEQ ID NO: 43573 - DNA, 25 bp, Mus musculus
ggcgaaaaaatcttctcattctgat

SEQ ID NO: 43574 - DNA, 25 bp, Mus musculus
ggcgaaaatccagcgtctccgtgaa

SEQ ID NO: 43575 - DNA, 25 bp, Mus musculus
ggcgaactttctgaccgagtataca

SEQ ID NO: 43576 - DNA, 25 bp, Mus musculus
ggcgaagtgcaccaccattgaacct

SEQ ID NO: 43577 - DNA, 25 bp, Mus musculus
ggcgaatcgccaggactttcagctg

SEQ ID NO: 43578 - DNA, 25 bp, Mus musculus
ggcgacattcccaagcagtactacg

SEQ ID NO: 43579 - DNA, 25 bp, Mus musculus
ggcgacctgtacatctgggatgtga

SEQ ID NO: 43580 - DNA, 25 bp, Mus musculus
ggcgactatcgggaccaggactatc

SEQ ID NO: 43581 - DNA, 25 bp, Mus musculus
ggcgacttcaccaaccacaatggca

SEQ ID NO: 43582 - DNA, 25 bp, Mus musculus
ggcgacttccagtcaagtggatggc

SEQ ID NO: 43583 - DNA, 25 bp, Mus musculus
ggcgagaaacctgccgtgaacctga

SEQ ID NO: 43584 - DNA, 25 bp, Mus musculus
ggcgagaacgtccaagaggctttca

SEQ ID NO: 43585 - DNA, 25 bp, Mus musculus
ggcgagaacgtcgaagaggctttca

SEQ ID NO: 43586 - DNA, 25 bp, Mus musculus
ggcgagaactgcataaaggccttca

SEQ ID NO: 43587 - DNA, 25 bp, Mus musculus
ggcgagacttatggccagagacgtc

SEQ ID NO: 43588 - DNA, 25 bp, Mus musculus
ggcgagctccatggaccactcatga

SEQ ID NO: 43589 - DNA, 25 bp, Mus musculus
ggcgaggactctcctgcctattcaa

SEQ ID NO: 43590 - DNA, 25 bp, Mus musculus
ggcgaggatgcaaattttggaagat

SEQ ID NO: 43591 - DNA, 25 bp, Mus musculus
ggcgagtgcctcaacagcctgggct

SEQ ID NO: 43592 - DNA, 25 bp, Mus musculus
ggcgagtgcctctacagcctgggct

SEQ ID NO: 43593 - DNA, 25 bp, Mus musculus
ggcgagttccagattcttcttgatg

SEQ ID NO: 43594 - DNA, 25 bp, Mus musculus
ggcgagttcctcgaagtcacatgca

SEQ ID NO: 43595 - DNA, 25 bp, Mus musculus
ggcgatccaggatgcttaactagag

SEQ ID NO: 43596 - DNA, 25 bp, Mus musculus
ggcgatctccgaggtgacttttcga

SEQ ID NO: 43597 - DNA, 25 bp, Mus musculus
ggcgatggtcacttatttgaagatg

SEQ ID NO: 43598 - DNA, 25 bp, Mus musculus
ggcgatttaccagtgacttctgggt

SEQ ID NO: 43599 - DNA, 25 bp, Mus musculus
ggcgatttcgttacttctcacgctc

SEQ ID NO: 43600 - DNA, 25 bp, Mus musculus
ggcgatttcgtttcttctcacgctc

SEQ ID NO: 43601 - DNA, 25 bp, Mus musculus
ggcgcaaaggaaattgctgaaggtt

SEQ ID NO: 43602 - DNA, 25 bp, Mus musculus
ggcgcaagatgcaggtgtatcataa

SEQ ID NO: 43603 - DNA, 25 bp, Mus musculus
ggcgcacaggtgcagcaagtactca

SEQ ID NO: 43604 - DNA, 25 bp, Mus musculus
ggcgcactgtgagtttcttctcctg

SEQ ID NO: 43605 - DNA, 25 bp, Mus musculus
ggcgcagacggcatgtatgataaac

SEQ ID NO: 43606 - DNA, 25 bp, Mus musculus
ggcgcatccaccaggagagtgagct

SEQ ID NO: 43607 - DNA, 25 bp, Mus musculus
ggcgcatccttgattggcatgtggc

SEQ ID NO: 43608 - DNA, 25 bp, Mus musculus
ggcgccacctaatggcagcatttca

SEQ ID NO: 43609 - DNA, 25 bp, Mus musculus
ggcgccaggttccatccaaggtgat

SEQ ID NO: 43610 - DNA, 25 bp, Mus musculus
ggcgccttggttacatctcggtggt

SEQ ID NO: 43611 - DNA, 25 bp, Mus musculus
ggcgcgagtgctcaaactcaaggat

SEQ ID NO: 43612 - DNA, 25 bp, Mus musculus
ggcgcgcccaaggtttaccaggaga

SEQ ID NO: 43613 - DNA, 25 bp, Mus musculus
ggcgcggtgagaagaaagccatcaa

SEQ ID NO: 43614 - DNA, 25 bp, Mus musculus
ggcgcgtcccgtcttttctgagaca

SEQ ID NO: 43615 - DNA, 25 bp, Mus musculus
ggcgctagctaagtgtgagaagtac

SEQ ID NO: 43616 - DNA, 25 bp, Mus musculus
ggcgctcatcctcgaggacagacct

SEQ ID NO: 43617 - DNA, 25 bp, Mus musculus
ggcgctgattctgaacaaccacatt

SEQ ID NO: 43618 - DNA, 25 bp, Mus musculus
ggcgctgcccaaagacagactaaag

SEQ ID NO: 43619 - DNA, 25 bp, Mus musculus
ggcgctttgatgtggctgctgaaca

SEQ ID NO: 43620 - DNA, 25 bp, Mus musculus
ggcgctttgttgaattctactactg

SEQ ID NO: 43621 - DNA, 25 bp, Mus musculus
ggcggaagccaatcatttcattgat

SEQ ID NO: 43622 - DNA, 25 bp, Mus musculus
ggcggaagctcgatgtctctgtgaa

SEQ ID NO: 43623 - DNA, 25 bp, Mus musculus
ggcggacgtgaagaacttgatttct

SEQ ID NO: 43624 - DNA, 25 bp, Mus musculus
ggcggactccgacgcccgctatttg

SEQ ID NO: 43625 - DNA, 25 bp, Mus musculus
ggcggactccgaggcccgctatttg

SEQ ID NO: 43626 - DNA, 25 bp, Mus musculus
ggcggagcaggagtcccagccaact

SEQ ID NO: 43627 - DNA, 25 bp, Mus musculus
ggcggataagcacgaattgctcagt

SEQ ID NO: 43628 - DNA, 25 bp, Mus musculus
ggcggatcacagtcgctctggctgc

SEQ ID NO: 43629 - DNA, 25 bp, Mus musculus
ggcggatcagaatggcactacatcg

SEQ ID NO: 43630 - DNA, 25 bp, Mus musculus
ggcggcaatctgctcccagttgtgc

SEQ ID NO: 43631 - DNA, 25 bp, Mus musculus
ggcggcacaggcacagtcccactgg

SEQ ID NO: 43632 - DNA, 25 bp, Mus musculus
ggcggcagcgcattgaccctgtgct

SEQ ID NO: 43633 - DNA, 25 bp, Mus musculus
ggcggccaaggcctccagagatatt

SEQ ID NO: 43634 - DNA, 25 bp, Mus musculus
ggcggccattctcatcttctcggag

SEQ ID NO: 43635 - DNA, 25 bp, Mus musculus
ggcggctactcaggtggaaagatta

SEQ ID NO: 43636 - DNA, 25 bp, Mus musculus
ggcggctatgattatactgggtata

SEQ ID NO: 43637 - DNA, 25 bp, Mus musculus
ggcggctcctatgatgaacacactg

SEQ ID NO: 43638 - DNA, 25 bp, Mus musculus
ggcggctcctcgacttcactttcat

SEQ ID NO: 43639 - DNA, 25 bp, Mus musculus
ggcggctctgtaacagccgggcacc

SEQ ID NO: 43640 - DNA, 25 bp, Mus musculus
ggcggctgtgatcaccattgtgttc

SEQ ID NO: 43641 - DNA, 25 bp, Mus musculus
ggcggctttcctaactttctgagca

SEQ ID NO: 43642 - DNA, 25 bp, Mus musculus
ggcggtcgccttcttccaagtgtta

SEQ ID NO: 43643 - DNA, 25 bp, Mus musculus
ggcggtcgccttgttccaagtgtta

SEQ ID NO: 43644 - DNA, 25 bp, Mus musculus
ggcggtgtccatgtacacaaggaca

SEQ ID NO: 43645 - DNA, 25 bp, Mus musculus
ggcgtaagctgaagcctcaggcaca

SEQ ID NO: 43646 - DNA, 25 bp, Mus musculus
ggcgtacacaggctccaagtgcaca

SEQ ID NO: 43647 - DNA, 25 bp, Mus musculus
ggcgtacacagggtccaagtgcaca

SEQ ID NO: 43648 - DNA, 25 bp, Mus musculus
ggcgtacagttccagctcatgtgga

SEQ ID NO: 43649 - DNA, 25 bp, Mus musculus
ggcgtatgagaaaaacaagaattac

SEQ ID NO: 43650 - DNA, 25 bp, Mus musculus
ggcgtccaaagaagctatatcagca

SEQ ID NO: 43651 - DNA, 25 bp, Mus musculus
ggcgtcctgctagtcacaccaaata

SEQ ID NO: 43652 - DNA, 25 bp, Mus musculus
ggcgtctgagtaccccaaccttggc

SEQ ID NO: 43653 - DNA, 25 bp, Mus musculus
ggcgtctgctacgagaaagctgttc

SEQ ID NO: 43654 - DNA, 25 bp, Mus musculus
ggcgtcttccaccatcgggcctttg

SEQ ID NO: 43655 - DNA, 25 bp, Mus musculus
ggcgtcttgcccctcgcaggatagc

SEQ ID NO: 43656 - DNA, 25 bp, Mus musculus
ggcgtgaacctcagcaagtttagca

SEQ ID NO: 43657 - DNA, 25 bp, Mus musculus
ggcgtgatgtcactactttcttctc

SEQ ID NO: 43658 - DNA, 25 bp, Mus musculus
ggcgtgcaggtgtacaagcacacag

SEQ ID NO: 43659 - DNA, 25 bp, Mus musculus
ggcgtgcctaggacaatgcttcagt

SEQ ID NO: 43660 - DNA, 25 bp, Mus musculus
ggcgtgcctctcatgaccctgaatg

SEQ ID NO: 43661 - DNA, 25 bp, Mus musculus
ggcgtggacctcaccgtcctgctga

SEQ ID NO: 43662 - DNA, 25 bp, Mus musculus
ggcgtggatgtgtctcaagtgactt

SEQ ID NO: 43663 - DNA, 25 bp, Mus musculus
ggcgtgtgcgtagaatcgagatttc

SEQ ID NO: 43664 - DNA, 25 bp, Mus musculus
ggcgtgtgtacaagtccctctgtcc

SEQ ID NO: 43665 - DNA, 25 bp, Mus musculus
ggcgttagctgattattctattaaa

SEQ ID NO: 43666 - DNA, 25 bp, Mus musculus
ggcgttcacctgcattaccagcgcg

SEQ ID NO: 43667 - DNA, 25 bp, Mus musculus
ggcgttccagctgtttgacaaagct

SEQ ID NO: 43668 - DNA, 25 bp, Mus musculus
ggcgttgggctcttcacgaggaccc

SEQ ID NO: 43669 - DNA, 25 bp, Mus musculus
ggcgttgtgaaacccgacattgtgt

SEQ ID NO: 43670 - DNA, 25 bp, Mus musculus
ggcgttgttctctacactggcagag

SEQ ID NO: 43671 - DNA, 25 bp, Mus musculus
ggcgtttccgtaaagaatatctgct

SEQ ID NO: 43672 - DNA, 25 bp, Mus musculus
ggcgtttctcactcatgacgctgcg

SEQ ID NO: 43673 - DNA, 25 bp, Mus musculus
ggcgttttttctatcagcggctggt

SEQ ID NO: 43674 - DNA, 25 bp, Mus musculus
ggctaaagcagagccggagccctct

SEQ ID NO: 43675 - DNA, 25 bp, Mus musculus
ggctaaagggcataagtgaccgttt

SEQ ID NO: 43676 - DNA, 25 bp, Mus musculus
ggctaaattcatgggttccccagaa

SEQ ID NO: 43677 - DNA, 25 bp, Mus musculus
ggctaacaagctttgccagagtttc

SEQ ID NO: 43678 - DNA, 25 bp, Mus musculus
ggctaactacaagctacggttcaca

SEQ ID NO: 43679 - DNA, 25 bp, Mus musculus
ggctaagagaaaatggccagcattt

SEQ ID NO: 43680 - DNA, 25 bp, Mus musculus
ggctaagggcacttctacccaacat

SEQ ID NO: 43681 - DNA, 25 bp, Mus musculus
ggctaagtctgaccctatggtgcag

SEQ ID NO: 43682 - DNA, 25 bp, Mus musculus
ggctaagtgctttttgcaaagccca

SEQ ID NO: 43683 - DNA, 25 bp, Mus musculus
ggctaatatggatgggtcccagcga

SEQ ID NO: 43684 - DNA, 25 bp, Mus musculus
ggctaatcaagagtgaaaaacctga

SEQ ID NO: 43685 - DNA, 25 bp, Mus musculus
ggctacaaactttctagcgcatgag

SEQ ID NO: 43686 - DNA, 25 bp, Mus musculus
ggctacaatctcagcatagagcatt

SEQ ID NO: 43687 - DNA, 25 bp, Mus musculus
ggctacacagagatgtgatgcagga

SEQ ID NO: 43688 - DNA, 25 bp, Mus musculus
ggctacaccgtgaaaggcatccaga

SEQ ID NO: 43689 - DNA, 25 bp, Mus musculus
ggctacacctacacgagctcagaca

SEQ ID NO: 43690 - DNA, 25 bp, Mus musculus
ggctacacctactcgagctcagaca

SEQ ID NO: 43691 - DNA, 25 bp, Mus musculus
ggctacagcaacatccctaatcctg

SEQ ID NO: 43692 - DNA, 25 bp, Mus musculus
ggctacatccctgaacactgggagt

SEQ ID NO: 43693 - DNA, 25 bp, Mus musculus
ggctacatgccagcgcgggcagatt

SEQ ID NO: 43694 - DNA, 25 bp, Mus musculus
ggctaccatcacctgctgctttatg

SEQ ID NO: 43695 - DNA, 25 bp, Mus musculus
ggctacccacagacggaaggcttgc

SEQ ID NO: 43696 - DNA, 25 bp, Mus musculus
ggctacccaggaagtagcactacac

SEQ ID NO: 43697 - DNA, 25 bp, Mus musculus
ggctaccgccagtactgggtggtat

SEQ ID NO: 43698 - DNA, 25 bp, Mus musculus
ggctacctgattcccacagtctgtg

SEQ ID NO: 43699 - DNA, 25 bp, Mus musculus
ggctacctggaggatgaacacgcag

SEQ ID NO: 43700 - DNA, 25 bp, Mus musculus
ggctacctttagtgtaaatattcaa

SEQ ID NO: 43701 - DNA, 25 bp, Mus musculus
ggctacgactggacgctggtgccca

SEQ ID NO: 43702 - DNA, 25 bp, Mus musculus
ggctacgcagatcaaaacctattcc

SEQ ID NO: 43703 - DNA, 25 bp, Mus musculus
ggctacggcaactactggaaccagg

SEQ ID NO: 43704 - DNA, 25 bp, Mus musculus
ggctacgggcgaacctacttcagct

SEQ ID NO: 43705 - DNA, 25 bp, Mus musculus
ggctactcatatgattgtgtcctga

SEQ ID NO: 43706 - DNA, 25 bp, Mus musculus
ggctactgccaatgctggattttta

SEQ ID NO: 43707 - DNA, 25 bp, Mus musculus
ggctactggttggagatctttgaca

SEQ ID NO: 43708 - DNA, 25 bp, Mus musculus
ggctacttccctacagctgctaatc

SEQ ID NO: 43709 - DNA, 25 bp, Mus musculus
ggctactttacctctctgttattca

SEQ ID NO: 43710 - DNA, 25 bp, Mus musculus
ggctagacagctgaaccctcgaggg

SEQ ID NO: 43711 - DNA, 25 bp, Mus musculus
ggctagactagccagtcaattccaa

SEQ ID NO: 43712 - DNA, 25 bp, Mus musculus
ggctaggccagctgagctgcatgtc

SEQ ID NO: 43713 - DNA, 25 bp, Mus musculus
ggctaggctcatctgtggccccgct

SEQ ID NO: 43714 - DNA, 25 bp, Mus musculus
ggctagtgaataccatgtccttgct

SEQ ID NO: 43715 - DNA, 25 bp, Mus musculus
ggctagtgagaataagagctttgac

SEQ ID NO: 43716 - DNA, 25 bp, Mus musculus
ggctagtgggccttcaggagtcagt

SEQ ID NO: 43717 - DNA, 25 bp, Mus musculus
ggctagtgtcacctttcctgaggga

SEQ ID NO: 43718 - DNA, 25 bp, Mus musculus
ggctatagacctgggtgtgaattcc

SEQ ID NO: 43719 - DNA, 25 bp, Mus musculus
ggctatagagcacccgaagacttcg

SEQ ID NO: 43720 - DNA, 25 bp, Mus musculus
ggctatagctcctattccactggag

SEQ ID NO: 43721 - DNA, 25 bp, Mus musculus
ggctatagtcttcaaaatggtcaag

SEQ ID NO: 43722 - DNA, 25 bp, Mus musculus
ggctatcagaaattcacatgttgtg

SEQ ID NO: 43723 - DNA, 25 bp, Mus musculus
ggctatcccatgtctgcggcttcag

SEQ ID NO: 43724 - DNA, 25 bp, Mus musculus
ggctatgaagccaagacacacaaag

SEQ ID NO: 43725 - DNA, 25 bp, Mus musculus
ggctatgctgtgtgccgcgccatct

SEQ ID NO: 43726 - DNA, 25 bp, Mus musculus
ggctatggcggctacgactactcgc

SEQ ID NO: 43727 - DNA, 25 bp, Mus musculus
ggctatggctttacaggaagagaat

SEQ ID NO: 43728 - DNA, 25 bp, Mus musculus
ggctattaccaagctaatgagcgtg

SEQ ID NO: 43729 - DNA, 25 bp, Mus musculus
ggctcaaaagtcaaatttctacctg

SEQ ID NO: 43730 - DNA, 25 bp, Mus musculus
ggctcaacaaggacctacgacattt

SEQ ID NO: 43731 - DNA, 25 bp, Mus musculus
ggctcaacagagataacctttaccc

SEQ ID NO: 43732 - DNA, 25 bp, Mus musculus
ggctcaacgtctgggccgagtagcc

SEQ ID NO: 43733 - DNA, 25 bp, Mus musculus
ggctcaagaagcattgtcctcacaa

SEQ ID NO: 43734 - DNA, 25 bp, Mus musculus
ggctcaagattaccattcccaatgc

SEQ ID NO: 43735 - DNA, 25 bp, Mus musculus
ggctcaaggcatcctggagtataaa

SEQ ID NO: 43736 - DNA, 25 bp, Mus musculus
ggctcaaggcatgctggagtataaa

SEQ ID NO: 43737 - DNA, 25 bp, Mus musculus
ggctcaatgaccacggcaagaactg

SEQ ID NO: 43738 - DNA, 25 bp, Mus musculus
ggctcaatgagcctcgctatgccac

SEQ ID NO: 43739 - DNA, 25 bp, Mus musculus
ggctcacaagattcatgtgtatgaa

SEQ ID NO: 43740 - DNA, 25 bp, Mus musculus
ggctcacagtggaatctgcactcga

SEQ ID NO: 43741 - DNA, 25 bp, Mus musculus
ggctcacggctgatgacttcagact

SEQ ID NO: 43742 - DNA, 25 bp, Mus musculus
ggctcagaagactgtctcagggaca

SEQ ID NO: 43743 - DNA, 25 bp, Mus musculus
ggctcagaggcctccaggtgtgttt

SEQ ID NO: 43744 - DNA, 25 bp, Mus musculus
ggctcagatcttgggaattgatatc

SEQ ID NO: 43745 - DNA, 25 bp, Mus musculus
ggctcagcagcactcttgcaagatg

SEQ ID NO: 43746 - DNA, 25 bp, Mus musculus
ggctcagcagggacgtgcatacgct

SEQ ID NO: 43747 - DNA, 25 bp, Mus musculus
ggctcagccccgagacaacgaagct

SEQ ID NO: 43748 - DNA, 25 bp, Mus musculus
ggctcaggagtcctgatctagctgt

SEQ ID NO: 43749 - DNA, 25 bp, Mus musculus
ggctcaggcccttggactgggcact

SEQ ID NO: 43750 - DNA, 25 bp, Mus musculus
ggctcagtcattcttggtggatttt

SEQ ID NO: 43751 - DNA, 25 bp, Mus musculus
ggctcagtgagctctgcaacgtgct

SEQ ID NO: 43752 - DNA, 25 bp, Mus musculus
ggctcagtggtttgacatccctaca

SEQ ID NO: 43753 - DNA, 25 bp, Mus musculus
ggctcatcaggagtcgactcaggct

SEQ ID NO: 43754 - DNA, 25 bp, Mus musculus
ggctcatccaaaatagaggaagcat

SEQ ID NO: 43755 - DNA, 25 bp, Mus musculus
ggctcatcctgttaacacagagtgc

SEQ ID NO: 43756 - DNA, 25 bp, Mus musculus
ggctcatctctatcaccaaattagt

SEQ ID NO: 43757 - DNA, 25 bp, Mus musculus
ggctcatctgatggccagggctctg

SEQ ID NO: 43758 - DNA, 25 bp, Mus musculus
ggctcatgagaatcattgatgaaag

SEQ ID NO: 43759 - DNA, 25 bp, Mus musculus
ggctcatgcatctgacacttgctct

SEQ ID NO: 43760 - DNA, 25 bp, Mus musculus
ggctcatgccagaaaccgagactta

SEQ ID NO: 43761 - DNA, 25 bp, Mus musculus
ggctcatgccagtaaccgagactta

SEQ ID NO: 43762 - DNA, 25 bp, Mus musculus
ggctcattgggcagcttttgctcca

SEQ ID NO: 43763 - DNA, 25 bp, Mus musculus
ggctccaagcgtggcttcttcagaa

SEQ ID NO: 43764 - DNA, 25 bp, Mus musculus
ggctccaccctgaagatacactaca

SEQ ID NO: 43765 - DNA, 25 bp, Mus musculus
ggctccagagggacaccggacacag

SEQ ID NO: 43766 - DNA, 25 bp, Mus musculus
ggctccagcgctacgcagtaaacag

SEQ ID NO: 43767 - DNA, 25 bp, Mus musculus
ggctccagtcccttgagagaggtgt

SEQ ID NO: 43768 - DNA, 25 bp, Mus musculus
ggctccagtggtccagaatctttta

SEQ ID NO: 43769 - DNA, 25 bp, Mus musculus
ggctccatattacacagtatgcgat

SEQ ID NO: 43770 - DNA, 25 bp, Mus musculus
ggctccatcagctaacggaaacact

SEQ ID NO: 43771 - DNA, 25 bp, Mus musculus
ggctccatttcctttactacttcca

SEQ ID NO: 43772 - DNA, 25 bp, Mus musculus
ggctcccgtaccattatactctacg

SEQ ID NO: 43773 - DNA, 25 bp, Mus musculus
ggctcccgtattctgctgcaatcct

SEQ ID NO: 43774 - DNA, 25 bp, Mus musculus
ggctccctccagacagggggatcat

SEQ ID NO: 43775 - DNA, 25 bp, Mus musculus
ggctccctcggcctgatgacatctg

SEQ ID NO: 43776 - DNA, 25 bp, Mus musculus
ggctcccttctcaggatgatcctgg

SEQ ID NO: 43777 - DNA, 25 bp, Mus musculus
ggctccgggatcctgatgtgttcca

SEQ ID NO: 43778 - DNA, 25 bp, Mus musculus
ggctcctaccaaggccttggaacag

SEQ ID NO: 43779 - DNA, 25 bp, Mus musculus
ggctcctcgggcctttgctcataga

SEQ ID NO: 43780 - DNA, 25 bp, Mus musculus
ggctcctgaagaagtccttcctttc

SEQ ID NO: 43781 - DNA, 25 bp, Mus musculus
ggctcctgactactgaccagaacaa

SEQ ID NO: 43782 - DNA, 25 bp, Mus musculus
ggctcctgcccagggtcaaaaggca

SEQ ID NO: 43783 - DNA, 25 bp, Mus musculus
ggctcctgctactgcaggcctgcgg

SEQ ID NO: 43784 - DNA, 25 bp, Mus musculus
ggctcctgttcgctgctttcatgat

SEQ ID NO: 43785 - DNA, 25 bp, Mus musculus
ggctccttgacctgggacttactaa

SEQ ID NO: 43786 - DNA, 25 bp, Mus musculus
ggctccttttggcattccttgtaat

SEQ ID NO: 43787 - DNA, 25 bp, Mus musculus
ggctcgacacttctttctgcaagga

SEQ ID NO: 43788 - DNA, 25 bp, Mus musculus
ggctcgagtgatgccagcttacatg

SEQ ID NO: 43789 - DNA, 25 bp, Mus musculus
ggctcgcactgcaccgacgttaatg

SEQ ID NO: 43790 - DNA, 25 bp, Mus musculus
ggctcgcagagcagacctttagtcc

SEQ ID NO: 43791 - DNA, 25 bp, Mus musculus
ggctcgccctgattggttgctccac

SEQ ID NO: 43792 - DNA, 25 bp, Mus musculus
ggctcgggtctgtcctccccatatg

SEQ ID NO: 43793 - DNA, 25 bp, Mus musculus
ggctcgtgggtttcagcttcttcct

SEQ ID NO: 43794 - DNA, 25 bp, Mus musculus
ggctctatgagctctgtgatgtcta

SEQ ID NO: 43795 - DNA, 25 bp, Mus musculus
ggctctcatcaccactcaggaggaa

SEQ ID NO: 43796 - DNA, 25 bp, Mus musculus
ggctctcatcatctgcaacaaaaag

SEQ ID NO: 43797 - DNA, 25 bp, Mus musculus
ggctctcatcatgtgcaacaaaaag

SEQ ID NO: 43798 - DNA, 25 bp, Mus musculus
ggctctcatgtgcaggatcctagga

SEQ ID NO: 43799 - DNA, 25 bp, Mus musculus
ggctctccactttggccgtgtttat

SEQ ID NO: 43800 - DNA, 25 bp, Mus musculus
ggctctcctaattttgggtacaggt

SEQ ID NO: 43801 - DNA, 25 bp, Mus musculus
ggctctcctggaagggtataacaag

SEQ ID NO: 43802 - DNA, 25 bp, Mus musculus
ggctctctgatggacgactacttgg

SEQ ID NO: 43803 - DNA, 25 bp, Mus musculus
ggctctctggtccactcaaggagga

SEQ ID NO: 43804 - DNA, 25 bp, Mus musculus
ggctctctgtggaaatctacgaccg

SEQ ID NO: 43805 - DNA, 25 bp, Mus musculus
ggctctcttcttctatgaccagcat

SEQ ID NO: 43806 - DNA, 25 bp, Mus musculus
ggctctgaaatcagatcctcatgct

SEQ ID NO: 43807 - DNA, 25 bp, Mus musculus
ggctctgaaatcaggctcagcggct

SEQ ID NO: 43808 - DNA, 25 bp, Mus musculus
ggctctgaaatctgatcctcatgct

SEQ ID NO: 43809 - DNA, 25 bp, Mus musculus
ggctctgaccagtgcgcagctgcag

SEQ ID NO: 43810 - DNA, 25 bp, Mus musculus
ggctctgagaagctctttgccccgg

SEQ ID NO: 43811 - DNA, 25 bp, Mus musculus
ggctctgagcacactgtgaacaaaa

SEQ ID NO: 43812 - DNA, 25 bp, Mus musculus
ggctctgagcgtgtatcacaacagt

SEQ ID NO: 43813 - DNA, 25 bp, Mus musculus
ggctctgcaactgcgagcacagtgg

SEQ ID NO: 43814 - DNA, 25 bp, Mus musculus
ggctctgccacgtccatcctggaaa

SEQ ID NO: 43815 - DNA, 25 bp, Mus musculus
ggctctgccagtcacgtgcagcaga

SEQ ID NO: 43816 - DNA, 25 bp, Mus musculus
ggctctgccatcagcaggaagcttg

SEQ ID NO: 43817 - DNA, 25 bp, Mus musculus
ggctctgccatttaaagttgtgatc

SEQ ID NO: 43818 - DNA, 25 bp, Mus musculus
ggctctgccgattgttactgaactg

SEQ ID NO: 43819 - DNA, 25 bp, Mus musculus
ggctctggacgaccatcaccatctt

SEQ ID NO: 43820 - DNA, 25 bp, Mus musculus
ggctctggcataggacaggttccca

SEQ ID NO: 43821 - DNA, 25 bp, Mus musculus
ggctctgtcgccatctacatagctt

SEQ ID NO: 43822 - DNA, 25 bp, Mus musculus
ggctctgtgaggttattcgagtaca

SEQ ID NO: 43823 - DNA, 25 bp, Mus musculus
ggctcttcgccctttactgcctggg

SEQ ID NO: 43824 - DNA, 25 bp, Mus musculus
ggctcttcggtttctcctgggcttc

SEQ ID NO: 43825 - DNA, 25 bp, Mus musculus
ggctctttctgtggtcttgcccgtc

SEQ ID NO: 43826 - DNA, 25 bp, Mus musculus
ggctctttcttgtggatatatcaca

SEQ ID NO: 43827 - DNA, 25 bp, Mus musculus
ggctgaaaacatatgcgaagctccc

SEQ ID NO: 43828 - DNA, 25 bp, Mus musculus
ggctgaaaatagaccccgtgaatgg

SEQ ID NO: 43829 - DNA, 25 bp, Mus musculus
ggctgaaaatagtccccgtgaatgg

SEQ ID NO: 43830 - DNA, 25 bp, Mus musculus
ggctgaaacacctgatcgtgacccc

SEQ ID NO: 43831 - DNA, 25 bp, Mus musculus
ggctgaactcgatcccaaacaggtg

SEQ ID NO: 43832 - DNA, 25 bp, Mus musculus
ggctgaagacaacctgaaccttctg

SEQ ID NO: 43833 - DNA, 25 bp, Mus musculus
ggctgaagcagagcatcctaaggtc

SEQ ID NO: 43834 - DNA, 25 bp, Mus musculus
ggctgaagccatacagaaaataata

SEQ ID NO: 43835 - DNA, 25 bp, Mus musculus
ggctgaagctgttccgacattacta

SEQ ID NO: 43836 - DNA, 25 bp, Mus musculus
ggctgaaggcttgtgagtctggaca

SEQ ID NO: 43837 - DNA, 25 bp, Mus musculus
ggctgaagtgctaaatgaccctgag

SEQ ID NO: 43838 - DNA, 25 bp, Mus musculus
ggctgaatggtaacctatccccagg

SEQ ID NO: 43839 - DNA, 25 bp, Mus musculus
ggctgacaaccatcgaagcatcgaa

SEQ ID NO: 43840 - DNA, 25 bp, Mus musculus
ggctgacacccctacagtaccatgt

SEQ ID NO: 43841 - DNA, 25 bp, Mus musculus
ggctgacatcaatgcagtgaatgag

SEQ ID NO: 43842 - DNA, 25 bp, Mus musculus
ggctgacatgaatgactttggcact

SEQ ID NO: 43843 - DNA, 25 bp, Mus musculus
ggctgacatgattgccagaaatgga

SEQ ID NO: 43844 - DNA, 25 bp, Mus musculus
ggctgacattgcctcgatcgacagt

SEQ ID NO: 43845 - DNA, 25 bp, Mus musculus
ggctgaccaaggtcgcctccttgac

SEQ ID NO: 43846 - DNA, 25 bp, Mus musculus
ggctgaccatcaagccccaaggatc

SEQ ID NO: 43847 - DNA, 25 bp, Mus musculus
ggctgaccatgcgtctgagaattcc

SEQ ID NO: 43848 - DNA, 25 bp, Mus musculus
ggctgaccccactggagcctttggg

SEQ ID NO: 43849 - DNA, 25 bp, Mus musculus
ggctgaccctgacacctgctatggg

SEQ ID NO: 43850 - DNA, 25 bp, Mus musculus
ggctgacctggcttatccagtagtg

SEQ ID NO: 43851 - DNA, 25 bp, Mus musculus
ggctgacgattccacagataaccca

SEQ ID NO: 43852 - DNA, 25 bp, Mus musculus
ggctgactgtgaatgacatagacat

SEQ ID NO: 43853 - DNA, 25 bp, Mus musculus
ggctgacttcatcccttctctgtac

SEQ ID NO: 43854 - DNA, 25 bp, Mus musculus
ggctgagaaatacctcgatatcccc

SEQ ID NO: 43855 - DNA, 25 bp, Mus musculus
ggctgagaagttgtcaccaaatccc

SEQ ID NO: 43856 - DNA, 25 bp, Mus musculus
ggctgagagatcctgacataaaccc

SEQ ID NO: 43857 - DNA, 25 bp, Mus musculus
ggctgagcaagttctctgtcactaa

SEQ ID NO: 43858 - DNA, 25 bp, Mus musculus
ggctgagcccatccaggaactgcta

SEQ ID NO: 43859 - DNA, 25 bp, Mus musculus
ggctgagctccctacagctatttag

SEQ ID NO: 43860 - DNA, 25 bp, Mus musculus
ggctgaggatagtactgagaaagaa

SEQ ID NO: 43861 - DNA, 25 bp, Mus musculus
ggctgaggcagccatgttccaccgt

SEQ ID NO: 43862 - DNA, 25 bp, Mus musculus
ggctgagtcttaaggacatggattt

SEQ ID NO: 43863 - DNA, 25 bp, Mus musculus
ggctgagtgtcctcggtgcttccga

SEQ ID NO: 43864 - DNA, 25 bp, Mus musculus
ggctgatattcaccgcactctggta

SEQ ID NO: 43865 - DNA, 25 bp, Mus musculus
ggctgatccctggaatggacaaagg

SEQ ID NO: 43866 - DNA, 25 bp, Mus musculus
ggctgatgacggttctattgattac

SEQ ID NO: 43867 - DNA, 25 bp, Mus musculus
ggctgatgattccttttcctgtgag

SEQ ID NO: 43868 - DNA, 25 bp, Mus musculus
ggctgatggcaaaaaggctagaaga

SEQ ID NO: 43869 - DNA, 25 bp, Mus musculus
ggctgatggctctactgtcggcaca

SEQ ID NO: 43870 - DNA, 25 bp, Mus musculus
ggctgattccgatcacattcctgac

SEQ ID NO: 43871 - DNA, 25 bp, Mus musculus
ggctgattttcgagaaccgaatgca

SEQ ID NO: 43872 - DNA, 25 bp, Mus musculus
ggctgcaactatgactatatcctgg

SEQ ID NO: 43873 - DNA, 25 bp, Mus musculus
ggctgcaactggacgagacctgtgc

SEQ ID NO: 43874 - DNA, 25 bp, Mus musculus
ggctgcaagcagaagattattgatc

SEQ ID NO: 43875 - DNA, 25 bp, Mus musculus
ggctgcaccctatggacgccattta

SEQ ID NO: 43876 - DNA, 25 bp, Mus musculus
ggctgcacttctacaacaagtggtt

SEQ ID NO: 43877 - DNA, 25 bp, Mus musculus
ggctgcagaaaacttcaccctcttg

SEQ ID NO: 43878 - DNA, 25 bp, Mus musculus
ggctgcagatcgacttaatgaagaa

SEQ ID NO: 43879 - DNA, 25 bp, Mus musculus
ggctgcagatggaggccattgctct

SEQ ID NO: 43880 - DNA, 25 bp, Mus musculus
ggctgcaggtggagttcatcaaccc

SEQ ID NO: 43881 - DNA, 25 bp, Mus musculus
ggctgcatgaatgccaagccatgct

SEQ ID NO: 43882 - DNA, 25 bp, Mus musculus
ggctgcatgctgcatggcccgctct

SEQ ID NO: 43883 - DNA, 25 bp, Mus musculus
ggctgcatgcttttgggtgattttc

SEQ ID NO: 43884 - DNA, 25 bp, Mus musculus
ggctgcattgcttagatttggttca

SEQ ID NO: 43885 - DNA, 25 bp, Mus musculus
ggctgccaatgtcatcgggcccaag

SEQ ID NO: 43886 - DNA, 25 bp, Mus musculus
ggctgccactcgatatgaacccgtg

SEQ ID NO: 43887 - DNA, 25 bp, Mus musculus
ggctgccatgtttaatggtaattat

SEQ ID NO: 43888 - DNA, 25 bp, Mus musculus
ggctgcccaggaccattgctgactt

SEQ ID NO: 43889 - DNA, 25 bp, Mus musculus
ggctgccctgcgtgactacgagacg

SEQ ID NO: 43890 - DNA, 25 bp, Mus musculus
ggctgccttcaggaacgaaaaatag

SEQ ID NO: 43891 - DNA, 25 bp, Mus musculus
ggctgccttgcctgtaactcaacaa

SEQ ID NO: 43892 - DNA, 25 bp, Mus musculus
ggctgcgacaggtcagctacattcg

SEQ ID NO: 43893 - DNA, 25 bp, Mus musculus
ggctgcggatgctgctcaaggccaa

SEQ ID NO: 43894 - DNA, 25 bp, Mus musculus
ggctgctaggtctgcccctgcctga

SEQ ID NO: 43895 - DNA, 25 bp, Mus musculus
ggctgctattgaaagagagtatgca

SEQ ID NO: 43896 - DNA, 25 bp, Mus musculus
ggctgctctgagactcactgtcaga

SEQ ID NO: 43897 - DNA, 25 bp, Mus musculus
ggctgctgacattgacatcgacact

SEQ ID NO: 43898 - DNA, 25 bp, Mus musculus
ggctgctgaccaacttagctgcaaa

SEQ ID NO: 43899 - DNA, 25 bp, Mus musculus
ggctgctgaccatcttagctgcaaa

SEQ ID NO: 43900 - DNA, 25 bp, Mus musculus
ggctgctgagctcaaccatgcacag

SEQ ID NO: 43901 - DNA, 25 bp, Mus musculus
ggctgctggaacacagtccggtgct

SEQ ID NO: 43902 - DNA, 25 bp, Mus musculus
ggctgcttccagatgcaccttgcaa

SEQ ID NO: 43903 - DNA, 25 bp, Mus musculus
ggctggaaaccatcttgcatctttg

SEQ ID NO: 43904 - DNA, 25 bp, Mus musculus
ggctggaacaatgccatagctctga

SEQ ID NO: 43905 - DNA, 25 bp, Mus musculus
ggctggaacatttacgcttcggtca

SEQ ID NO: 43906 - DNA, 25 bp, Mus musculus
ggctggaagatctacaacacatgtg

SEQ ID NO: 43907 - DNA, 25 bp, Mus musculus
ggctggaaggccttgtgctgaccca

SEQ ID NO: 43908 - DNA, 25 bp, Mus musculus
ggctggaagggatcgatcacaaccc

SEQ ID NO: 43909 - DNA, 25 bp, Mus musculus
ggctggaatcactgatattgtggtg

SEQ ID NO: 43910 - DNA, 25 bp, Mus musculus
ggctggacaagtatgctgcaagtga

SEQ ID NO: 43911 - DNA, 25 bp, Mus musculus
ggctggacagaaaacatcagctgcc

SEQ ID NO: 43912 - DNA, 25 bp, Mus musculus
ggctggacgctaacctcactgtggt

SEQ ID NO: 43913 - DNA, 25 bp, Mus musculus
ggctggactgcactcttccactgta

SEQ ID NO: 43914 - DNA, 25 bp, Mus musculus
ggctggagagactgcatgtaagctc

SEQ ID NO: 43915 - DNA, 25 bp, Mus musculus
ggctggagagcccaagcctaataga

SEQ ID NO: 43916 - DNA, 25 bp, Mus musculus
ggctggagcacctcagtctctgtga

SEQ ID NO: 43917 - DNA, 25 bp, Mus musculus
ggctggagcgactggcatacctgct

SEQ ID NO: 43918 - DNA, 25 bp, Mus musculus
ggctggagggtcctttcaacattga

SEQ ID NO: 43919 - DNA, 25 bp, Mus musculus
ggctggagggtcgtttcaacattga

SEQ ID NO: 43920 - DNA, 25 bp, Mus musculus
ggctggagtcagttttcatttcaag

SEQ ID NO: 43921 - DNA, 25 bp, Mus musculus
ggctggagtgtcagtgctcccgtat

SEQ ID NO: 43922 - DNA, 25 bp, Mus musculus
ggctggatccaaacaaaccaataag

SEQ ID NO: 43923 - DNA, 25 bp, Mus musculus
ggctggatcgaatcatcagggtctg

SEQ ID NO: 43924 - DNA, 25 bp, Mus musculus
ggctggatctgctcaatttgggaga

SEQ ID NO: 43925 - DNA, 25 bp, Mus musculus
ggctggatggccacacaggctgcac

SEQ ID NO: 43926 - DNA, 25 bp, Mus musculus
ggctggcaaccgaatgctggcccag

SEQ ID NO: 43927 - DNA, 25 bp, Mus musculus
ggctggccatagactggatagatga

SEQ ID NO: 43928 - DNA, 25 bp, Mus musculus
ggctggcccctgagacagctttcat

SEQ ID NO: 43929 - DNA, 25 bp, Mus musculus
ggctggccctgcagacatctgactg

SEQ ID NO: 43930 - DNA, 25 bp, Mus musculus
ggctggccggacgtgtgccactaat

SEQ ID NO: 43931 - DNA, 25 bp, Mus musculus
ggctggcctggaatatacttgattt

SEQ ID NO: 43932 - DNA, 25 bp, Mus musculus
ggctggccttcaatgcactcatcca

SEQ ID NO: 43933 - DNA, 25 bp, Mus musculus
ggctggcggcactgatgtacacaga

SEQ ID NO: 43934 - DNA, 25 bp, Mus musculus
ggctggctaagtctgaccctatggt

SEQ ID NO: 43935 - DNA, 25 bp, Mus musculus
ggctggctattcatcactttgaaaa

SEQ ID NO: 43936 - DNA, 25 bp, Mus musculus
ggctggctctggtttaaagcaagcg

SEQ ID NO: 43937 - DNA, 25 bp, Mus musculus
ggctggctgcaacctgaaaatcact

SEQ ID NO: 43938 - DNA, 25 bp, Mus musculus
ggctggctttgaattggactgatcc

SEQ ID NO: 43939 - DNA, 25 bp, Mus musculus
ggctggctttgcaggagaccagatt

SEQ ID NO: 43940 - DNA, 25 bp, Mus musculus
ggctggtaccttaccttagtgcagt

SEQ ID NO: 43941 - DNA, 25 bp, Mus musculus
ggctggtactggatcctatcatcat

SEQ ID NO: 43942 - DNA, 25 bp, Mus musculus
ggctggtagtggttcacacagaaga

SEQ ID NO: 43943 - DNA, 25 bp, Mus musculus
ggctggtctcaaacgaagagattct

SEQ ID NO: 43944 - DNA, 25 bp, Mus musculus
ggctggttctccattaatcatgtca

SEQ ID NO: 43945 - DNA, 25 bp, Mus musculus
ggctggttctgagaccacccgaatg

SEQ ID NO: 43946 - DNA, 25 bp, Mus musculus
ggctggttcttggagcatgcagacc

SEQ ID NO: 43947 - DNA, 25 bp, Mus musculus
ggctggtttataacccaagagatct

SEQ ID NO: 43948 - DNA, 25 bp, Mus musculus
ggctggttttaacccagcgctctga

SEQ ID NO: 43949 - DNA, 25 bp, Mus musculus
ggctgtaccgtatgtcattgtcccc

SEQ ID NO: 43950 - DNA, 25 bp, Mus musculus
ggctgtacgggagccgcatatttgt

SEQ ID NO: 43951 - DNA, 25 bp, Mus musculus
ggctgtagcagtgccagatttggaa

SEQ ID NO: 43952 - DNA, 25 bp, Mus musculus
ggctgtccataaacataaacatgag

SEQ ID NO: 43953 - DNA, 25 bp, Mus musculus
ggctgtcccattctagatgaggata

SEQ ID NO: 43954 - DNA, 25 bp, Mus musculus
ggctgtcctaaaccctgattaccgg

SEQ ID NO: 43955 - DNA, 25 bp, Mus musculus
ggctgtcctggagctactcagtgtg

SEQ ID NO: 43956 - DNA, 25 bp, Mus musculus
ggctgtcgaacccttgtatacagag

SEQ ID NO: 43957 - DNA, 25 bp, Mus musculus
ggctgtcgagaatcttaaagcacaa

SEQ ID NO: 43958 - DNA, 25 bp, Mus musculus
ggctgtctcctgtgcaacatgtcaa

SEQ ID NO: 43959 - DNA, 25 bp, Mus musculus
ggctgtctctgccagtcactcttaa

SEQ ID NO: 43960 - DNA, 25 bp, Mus musculus
ggctgtgaactaacttgatttccca

SEQ ID NO: 43961 - DNA, 25 bp, Mus musculus
ggctgtgaatattctcttggactga

SEQ ID NO: 43962 - DNA, 25 bp, Mus musculus
ggctgtgactttcggcacctggaca

SEQ ID NO: 43963 - DNA, 25 bp, Mus musculus
ggctgtgactttgggcacctggaca

SEQ ID NO: 43964 - DNA, 25 bp, Mus musculus
ggctgtgcaactgctggaggattac

SEQ ID NO: 43965 - DNA, 25 bp, Mus musculus
ggctgtgcacttcacccaggacgag

SEQ ID NO: 43966 - DNA, 25 bp, Mus musculus
ggctgtgccccaagactgggacgtt

SEQ ID NO: 43967 - DNA, 25 bp, Mus musculus
ggctgtgctacactgccatcagatg

SEQ ID NO: 43968 - DNA, 25 bp, Mus musculus
ggctgtgctgtatgccaaggctctg

SEQ ID NO: 43969 - DNA, 25 bp, Mus musculus
ggctgtgggcttccccatgatgatt

SEQ ID NO: 43970 - DNA, 25 bp, Mus musculus
ggctgtggtggatatctatcattcc

SEQ ID NO: 43971 - DNA, 25 bp, Mus musculus
ggctgtgttcgactaccacaagaag

SEQ ID NO: 43972 - DNA, 25 bp, Mus musculus
ggctgttgctccagtaatggacgga

SEQ ID NO: 43973 - DNA, 25 bp, Mus musculus
ggctgtttatttcgttcatccaaca

SEQ ID NO: 43974 - DNA, 25 bp, Mus musculus
ggctgtttctcatggagccttcctg

SEQ ID NO: 43975 - DNA, 25 bp, Mus musculus
ggctgtttgctctatggaccgccag

SEQ ID NO: 43976 - DNA, 25 bp, Mus musculus
ggctgttttgacaatgggaagcact

SEQ ID NO: 43977 - DNA, 25 bp, Mus musculus
ggcttaagacccacgggctacactt

SEQ ID NO: 43978 - DNA, 25 bp, Mus musculus
ggcttaagccaaccctacgacagat

SEQ ID NO: 43979 - DNA, 25 bp, Mus musculus
ggcttacaaaaaggagctggaggaa

SEQ ID NO: 43980 - DNA, 25 bp, Mus musculus
ggcttacatacctagaaactcatca

SEQ ID NO: 43981 - DNA, 25 bp, Mus musculus
ggcttactcaacttccaggcaccat

SEQ ID NO: 43982 - DNA, 25 bp, Mus musculus
ggcttagaagtatctgatgtttcca

SEQ ID NO: 43983 - DNA, 25 bp, Mus musculus
ggcttaggataaagaggagttattc

SEQ ID NO: 43984 - DNA, 25 bp, Mus musculus
ggcttataaagactcgcttacagct

SEQ ID NO: 43985 - DNA, 25 bp, Mus musculus
ggcttatcttaaaatgaccacaaaa

SEQ ID NO: 43986 - DNA, 25 bp, Mus musculus
ggcttatgaccctgacgaacgaatt

SEQ ID NO: 43987 - DNA, 25 bp, Mus musculus
ggcttcagggagacagagaaatcct

SEQ ID NO: 43988 - DNA, 25 bp, Mus musculus
ggcttcagtgataagattaaagtca

SEQ ID NO: 43989 - DNA, 25 bp, Mus musculus
ggcttcataacggattctaacggaa

SEQ ID NO: 43990 - DNA, 25 bp, Mus musculus
ggcttcatgatctgccacgtgctca

SEQ ID NO: 43991 - DNA, 25 bp, Mus musculus
ggcttcatgtccaacaagcacgtgt

SEQ ID NO: 43992 - DNA, 25 bp, Mus musculus
ggcttccagggccttcagcttgtat

SEQ ID NO: 43993 - DNA, 25 bp, Mus musculus
ggcttccatatcaaatcttccccga

SEQ ID NO: 43994 - DNA, 25 bp, Mus musculus
ggcttcccatcaccgagtggccatg

SEQ ID NO: 43995 - DNA, 25 bp, Mus musculus
ggcttcccattaaaggccagcatgc

SEQ ID NO: 43996 - DNA, 25 bp, Mus musculus
ggcttccccacagtcagattgctgt

SEQ ID NO: 43997 - DNA, 25 bp, Mus musculus
ggcttccctgggactaagtctccga

SEQ ID NO: 43998 - DNA, 25 bp, Mus musculus
ggcttccgaaaagtagtccacattg

SEQ ID NO: 43999 - DNA, 25 bp, Mus musculus
ggcttccgctgtcgcctgtctagaa

SEQ ID NO: 44000 - DNA, 25 bp, Mus musculus
ggcttccgtggttgcacagtttggc

SEQ ID NO: 44001 - DNA, 25 bp, Mus musculus
ggcttcctactatgaaatttcagtc

SEQ ID NO: 44002 - DNA, 25 bp, Mus musculus
ggcttcctactggtcgctgcttgca

SEQ ID NO: 44003 - DNA, 25 bp, Mus musculus
ggcttcctcaacgtgaatgacctag

SEQ ID NO: 44004 - DNA, 25 bp, Mus musculus
ggcttcctcctgtggagaaacagca

SEQ ID NO: 44005 - DNA, 25 bp, Mus musculus
ggcttcctcgtttggctatgatgtg

SEQ ID NO: 44006 - DNA, 25 bp, Mus musculus
ggcttcctggagagtctacacgcca

SEQ ID NO: 44007 - DNA, 25 bp, Mus musculus
ggcttcctggatgtaagcacaggat

SEQ ID NO: 44008 - DNA, 25 bp, Mus musculus
ggcttcggtgatgccgcactcatca

SEQ ID NO: 44009 - DNA, 25 bp, Mus musculus
ggcttcggtgccctgatgactcagc

SEQ ID NO: 44010 - DNA, 25 bp, Mus musculus
ggcttctcatcgcagtcaatcttgg

SEQ ID NO: 44011 - DNA, 25 bp, Mus musculus
ggcttctcatcggagtcaatcttgg

SEQ ID NO: 44012 - DNA, 25 bp, Mus musculus
ggcttctcttcttccactgggaaag

SEQ ID NO: 44013 - DNA, 25 bp, Mus musculus
ggcttctgaccccatgccagtgttg

SEQ ID NO: 44014 - DNA, 25 bp, Mus musculus
ggcttctgattttggatctgcgtgc

SEQ ID NO: 44015 - DNA, 25 bp, Mus musculus
ggcttctgcaactttatgcacctac

SEQ ID NO: 44016 - DNA, 25 bp, Mus musculus
ggcttctgcagaagagctcctggca

SEQ ID NO: 44017 - DNA, 25 bp, Mus musculus
ggcttctgctggcaatgatgacatc

SEQ ID NO: 44018 - DNA, 25 bp, Mus musculus
ggcttctgcttctgccgcagtctct

SEQ ID NO: 44019 - DNA, 25 bp, Mus musculus
ggcttctgtcccaaggaaggacaga

SEQ ID NO: 44020 - DNA, 25 bp, Mus musculus
ggcttctgtggcctccagattgcga

SEQ ID NO: 44021 - DNA, 25 bp, Mus musculus
ggcttcttcaagagaaataagaaag

SEQ ID NO: 44022 - DNA, 25 bp, Mus musculus
ggcttcttttggacttttggagcag

SEQ ID NO: 44023 - DNA, 25 bp, Mus musculus
ggcttctttttcaacatgctcttcg

SEQ ID NO: 44024 - DNA, 25 bp, Mus musculus
ggcttgaataccataacttcttaac

SEQ ID NO: 44025 - DNA, 25 bp, Mus musculus
ggcttgagcctataattgaagatgc

SEQ ID NO: 44026 - DNA, 25 bp, Mus musculus
ggcttgcaattttgtaaagctggaa

SEQ ID NO: 44027 - DNA, 25 bp, Mus musculus
ggcttgcctcggctcacatggtgct

SEQ ID NO: 44028 - DNA, 25 bp, Mus musculus
ggcttgctctctctcggattatgaa

SEQ ID NO: 44029 - DNA, 25 bp, Mus musculus
ggcttgctgcatttggagaatgcca

SEQ ID NO: 44030 - DNA, 25 bp, Mus musculus
ggcttggaacctgtctgctttgaaa

SEQ ID NO: 44031 - DNA, 25 bp, Mus musculus
ggcttggagtcgatgcccttggact

SEQ ID NO: 44032 - DNA, 25 bp, Mus musculus
ggcttggcctttacaactcctgttg

SEQ ID NO: 44033 - DNA, 25 bp, Mus musculus
ggcttgggaggcaaggccactatca

SEQ ID NO: 44034 - DNA, 25 bp, Mus musculus
ggcttgggcccagtcttctgaggct

SEQ ID NO: 44035 - DNA, 25 bp, Mus musculus
ggcttgggcttcacacactgtcaga

SEQ ID NO: 44036 - DNA, 25 bp, Mus musculus
ggcttgggcttctcacactgtcaga

SEQ ID NO: 44037 - DNA, 25 bp, Mus musculus
ggcttgggcttcttcctggttctgc

SEQ ID NO: 44038 - DNA, 25 bp, Mus musculus
ggcttgggtgcaactgaaagagcaa

SEQ ID NO: 44039 - DNA, 25 bp, Mus musculus
ggcttggtccatgtctcctctaggt

SEQ ID NO: 44040 - DNA, 25 bp, Mus musculus
ggcttgtccccaacacctttcatga

SEQ ID NO: 44041 - DNA, 25 bp, Mus musculus
ggcttgtcggctgtctcttcaccat

SEQ ID NO: 44042 - DNA, 25 bp, Mus musculus
ggcttgtcggttggcaaatgattgc

SEQ ID NO: 44043 - DNA, 25 bp, Mus musculus
ggcttgtctgtgactgaggtcagct

SEQ ID NO: 44044 - DNA, 25 bp, Mus musculus
ggcttgtgactgaacttacccttga

SEQ ID NO: 44045 - DNA, 25 bp, Mus musculus
ggcttgtgctgaagtcagaagacaa

SEQ ID NO: 44046 - DNA, 25 bp, Mus musculus
ggctttaagctcacatgccagtgct

SEQ ID NO: 44047 - DNA, 25 bp, Mus musculus
ggctttaccgctctcatggttgctg

SEQ ID NO: 44048 - DNA, 25 bp, Mus musculus
ggctttactgctactattacagagt

SEQ ID NO: 44049 - DNA, 25 bp, Mus musculus
ggctttaggtgtcaaactattaaca

SEQ ID NO: 44050 - DNA, 25 bp, Mus musculus
ggctttcactcttcaccagtgacca

SEQ ID NO: 44051 - DNA, 25 bp, Mus musculus
ggctttcctggaactggttctctag

SEQ ID NO: 44052 - DNA, 25 bp, Mus musculus
ggctttccttaatgatgaagtttgg

SEQ ID NO: 44053 - DNA, 25 bp, Mus musculus
ggctttctgagactatgactctgga

SEQ ID NO: 44054 - DNA, 25 bp, Mus musculus
ggctttcttgcatatccgaagagta

SEQ ID NO: 44055 - DNA, 25 bp, Mus musculus
ggctttgaaaatgacagagtgactg

SEQ ID NO: 44056 - DNA, 25 bp, Mus musculus
ggctttgaagacaaatcggcctatg

SEQ ID NO: 44057 - DNA, 25 bp, Mus musculus
ggctttgaatcatggtgaagagcag

SEQ ID NO: 44058 - DNA, 25 bp, Mus musculus
ggctttgacatgcaagaggttgttc

SEQ ID NO: 44059 - DNA, 25 bp, Mus musculus
ggctttgaggaaccttacccaggca

SEQ ID NO: 44060 - DNA, 25 bp, Mus musculus
ggctttgagtatggctcccagctgc

SEQ ID NO: 44061 - DNA, 25 bp, Mus musculus
ggctttgcataaaccaagagacagt

SEQ ID NO: 44062 - DNA, 25 bp, Mus musculus
ggctttgccaccaggcaggtggcta

SEQ ID NO: 44063 - DNA, 25 bp, Mus musculus
ggctttgcccccaatatcctggaga

SEQ ID NO: 44064 - DNA, 25 bp, Mus musculus
ggctttgctcacagaaacgtttaca

SEQ ID NO: 44065 - DNA, 25 bp, Mus musculus
ggctttgctgcagttcatcttcctt

SEQ ID NO: 44066 - DNA, 25 bp, Mus musculus
ggctttggcaaagacggcttccgct

SEQ ID NO: 44067 - DNA, 25 bp, Mus musculus
ggctttggtgtctttggccaggcct

SEQ ID NO: 44068 - DNA, 25 bp, Mus musculus
ggctttgttggctgacccagctcca

SEQ ID NO: 44069 - DNA, 25 bp, Mus musculus
ggcttttaatgcagccgataaagtc

SEQ ID NO: 44070 - DNA, 25 bp, Mus musculus
ggcttttcagaccaagcttatccca

SEQ ID NO: 44071 - DNA, 25 bp, Mus musculus
ggcttttccgtgcaatcagtttgga

SEQ ID NO: 44072 - DNA, 25 bp, Mus musculus
ggcttttcttacagctcctgggtct

SEQ ID NO: 44073 - DNA, 25 bp, Mus musculus
ggcttttgatggctcaggcgattcc

SEQ ID NO: 44074 - DNA, 25 bp, Mus musculus
ggctttttcagctttcccgtggaca

SEQ ID NO: 44075 - DNA, 25 bp, Mus musculus
ggctttttctgtactgacaacagcg

SEQ ID NO: 44076 - DNA, 25 bp, Mus musculus
ggctttttggcttcactggcacgga

SEQ ID NO: 44077 - DNA, 25 bp, Mus musculus
ggcttttttctaataacctcatgta

SEQ ID NO: 44078 - DNA, 25 bp, Mus musculus
ggcttttttggtcccatttgtgaga

SEQ ID NO: 44079 - DNA, 25 bp, Mus musculus
gggaaaaaactcgactgtatatgga

SEQ ID NO: 44080 - DNA, 25 bp, Mus musculus
gggaaaaaatcaggagagacagtct

SEQ ID NO: 44081 - DNA, 25 bp, Mus musculus
gggaaaaagacctccttctcattgt

SEQ ID NO: 44082 - DNA, 25 bp, Mus musculus
gggaaaaagtcagtggcccataaca

SEQ ID NO: 44083 - DNA, 25 bp, Mus musculus
gggaaaacaccattgaaggagagcc

SEQ ID NO: 44084 - DNA, 25 bp, Mus musculus
gggaaaacaccttcctgctcaagtt

SEQ ID NO: 44085 - DNA, 25 bp, Mus musculus
gggaaaactgcaattttggagcaac

SEQ ID NO: 44086 - DNA, 25 bp, Mus musculus
gggaaaagaagaccttacaatcaag

SEQ ID NO: 44087 - DNA, 25 bp, Mus musculus
gggaaaagaagagcttacaatcaag

SEQ ID NO: 44088 - DNA, 25 bp, Mus musculus
gggaaaagagtgaagagagtcttct

SEQ ID NO: 44089 - DNA, 25 bp, Mus musculus
gggaaaagcaacttcacatagatgc

SEQ ID NO: 44090 - DNA, 25 bp, Mus musculus
gggaaaataaccacagtcacacctc

SEQ ID NO: 44091 - DNA, 25 bp, Mus musculus
gggaaaatgcctacccgtgcagctc

SEQ ID NO: 44092 - DNA, 25 bp, Mus musculus
gggaaaatgccttcccgtgcagctc

SEQ ID NO: 44093 - DNA, 25 bp, Mus musculus
gggaaacatcattcagaaacacgcc

SEQ ID NO: 44094 - DNA, 25 bp, Mus musculus
gggaaaccaatcagccccgagctct

SEQ ID NO: 44095 - DNA, 25 bp, Mus musculus
gggaaaccctttcagctttcacatc

SEQ ID NO: 44096 - DNA, 25 bp, Mus musculus
gggaaaccctttgagctttcacatc

SEQ ID NO: 44097 - DNA, 25 bp, Mus musculus
gggaaacctccgcatcagtgtttcc

SEQ ID NO: 44098 - DNA, 25 bp, Mus musculus
gggaaacgtgtacttgaagttcagt

SEQ ID NO: 44099 - DNA, 25 bp, Mus musculus
gggaaactgtttgattctacaattg

SEQ ID NO: 44100 - DNA, 25 bp, Mus musculus
gggaaagaccaccagtatccgacac

SEQ ID NO: 44101 - DNA, 25 bp, Mus musculus
gggaaagactggacacaccagggca

SEQ ID NO: 44102 - DNA, 25 bp, Mus musculus
gggaaagatacagaagatgggacct

SEQ ID NO: 44103 - DNA, 25 bp, Mus musculus
gggaaagcatccacagtcaccaagg

SEQ ID NO: 44104 - DNA, 25 bp, Mus musculus
gggaaagcatttttgcggcagcttc

SEQ ID NO: 44105 - DNA, 25 bp, Mus musculus
gggaaagcctttggattatactgaa

SEQ ID NO: 44106 - DNA, 25 bp, Mus musculus
gggaaagcttccagcccaactgtaa

SEQ ID NO: 44107 - DNA, 25 bp, Mus musculus
gggaaagcttcctgcccaactgtaa

SEQ ID NO: 44108 - DNA, 25 bp, Mus musculus
gggaaatacaattgaaccaagcact

SEQ ID NO: 44109 - DNA, 25 bp, Mus musculus
gggaaatcgatcatgtgcacatttt

SEQ ID NO: 44110 - DNA, 25 bp, Mus musculus
gggaaatgacagaaggagactattg

SEQ ID NO: 44111 - DNA, 25 bp, Mus musculus
gggaaatgcacaccagagactagta

SEQ ID NO: 44112 - DNA, 25 bp, Mus musculus
gggaaattaacaccatcggatgcag

SEQ ID NO: 44113 - DNA, 25 bp, Mus musculus
gggaaattcatcaggatccactttg

SEQ ID NO: 44114 - DNA, 25 bp, Mus musculus
gggaaattgaccacagcacagtaca

SEQ ID NO: 44115 - DNA, 25 bp, Mus musculus
gggaacagaaataggaaagacactg

SEQ ID NO: 44116 - DNA, 25 bp, Mus musculus
gggaacagcgcttctacgagtcact

SEQ ID NO: 44117 - DNA, 25 bp, Mus musculus
gggaacaggcatcccgaccactgtc

SEQ ID NO: 44118 - DNA, 25 bp, Mus musculus
gggaacagtcaggaaaagtcacctt

SEQ ID NO: 44119 - DNA, 25 bp, Mus musculus
gggaacatggttgaccagcacagcc

SEQ ID NO: 44120 - DNA, 25 bp, Mus musculus
gggaaccacacaggctggaagatac

SEQ ID NO: 44121 - DNA, 25 bp, Mus musculus
gggaacccccatcaaatgcgggcag

SEQ ID NO: 44122 - DNA, 25 bp, Mus musculus
gggaaccgcttcacggtctttgaca

SEQ ID NO: 44123 - DNA, 25 bp, Mus musculus
gggaacctagaagctgtcctgaact

SEQ ID NO: 44124 - DNA, 25 bp, Mus musculus
gggaacctgactatccagggaagcg

SEQ ID NO: 44125 - DNA, 25 bp, Mus musculus
gggaacctgtctctcctaaatgaga

SEQ ID NO: 44126 - DNA, 25 bp, Mus musculus
gggaacggaagcatttggaatctca

SEQ ID NO: 44127 - DNA, 25 bp, Mus musculus
gggaactacaagcatccagcagcta

SEQ ID NO: 44128 - DNA, 25 bp, Mus musculus
gggaactacaaggatccagcagcta

SEQ ID NO: 44129 - DNA, 25 bp, Mus musculus
gggaactatatctctgcctgacaag

SEQ ID NO: 44130 - DNA, 25 bp, Mus musculus
gggaactcaacctaggacttctgca

SEQ ID NO: 44131 - DNA, 25 bp, Mus musculus
gggaactcatgtcccaggaatgcag

SEQ ID NO: 44132 - DNA, 25 bp, Mus musculus
gggaacttcgatgaattgtactggc

SEQ ID NO: 44133 - DNA, 25 bp, Mus musculus
gggaagaatgcatccatctgaattt

SEQ ID NO: 44134 - DNA, 25 bp, Mus musculus
gggaagaccagcaagtccgggtcct

SEQ ID NO: 44135 - DNA, 25 bp, Mus musculus
gggaagacgacctgtgtgtgccaca

SEQ ID NO: 44136 - DNA, 25 bp, Mus musculus
gggaagactcggaccaaactgacag

SEQ ID NO: 44137 - DNA, 25 bp, Mus musculus
gggaagactgtcacgatttcacctt

SEQ ID NO: 44138 - DNA, 25 bp, Mus musculus
gggaagacttgatgaatctaccaca

SEQ ID NO: 44139 - DNA, 25 bp, Mus musculus
gggaagaggtcaacaagtttcattt

SEQ ID NO: 44140 - DNA, 25 bp, Mus musculus
gggaagataataaaaagccctatgt

SEQ ID NO: 44141 - DNA, 25 bp, Mus musculus
gggaagatgcgagtgcacaagatca

SEQ ID NO: 44142 - DNA, 25 bp, Mus musculus
gggaagatgtgagagatttcactaa

SEQ ID NO: 44143 - DNA, 25 bp, Mus musculus
gggaagcactatcagataaatcagc

SEQ ID NO: 44144 - DNA, 25 bp, Mus musculus
gggaagcactgactccctggaccaa

SEQ ID NO: 44145 - DNA, 25 bp, Mus musculus
gggaagcactgcatccttgatgtct

SEQ ID NO: 44146 - DNA, 25 bp, Mus musculus
gggaagcagatcacttgctcacatg

SEQ ID NO: 44147 - DNA, 25 bp, Mus musculus
gggaagccaagcacatctgaaagag

SEQ ID NO: 44148 - DNA, 25 bp, Mus musculus
gggaagccaatgttgatgccgccac

SEQ ID NO: 44149 - DNA, 25 bp, Mus musculus
gggaagcccgacaacagcgctttgc

SEQ ID NO: 44150 - DNA, 25 bp, Mus musculus
gggaagcgagaagtcgcctttgaaa

SEQ ID NO: 44151 - DNA, 25 bp, Mus musculus
gggaagctgaggagacccaaaactc

SEQ ID NO: 44152 - DNA, 25 bp, Mus musculus
gggaaggccttgttgcagaatttca

SEQ ID NO: 44153 - DNA, 25 bp, Mus musculus
gggaaggtgtacttggctaaagata

SEQ ID NO: 44154 - DNA, 25 bp, Mus musculus
gggaaggttcgcctcatgatcactg

SEQ ID NO: 44155 - DNA, 25 bp, Mus musculus
gggaagtaacaggagtgactctcac

SEQ ID NO: 44156 - DNA, 25 bp, Mus musculus
gggaagtaacattgtggttagcaca

SEQ ID NO: 44157 - DNA, 25 bp, Mus musculus
gggaagtagccactgcacaacaagc

SEQ ID NO: 44158 - DNA, 25 bp, Mus musculus
gggaagtattccaccagcctctatg

SEQ ID NO: 44159 - DNA, 25 bp, Mus musculus
gggaagtcacttctggagttagcca

SEQ ID NO: 44160 - DNA, 25 bp, Mus musculus
gggaagtgaccaagtgttctcatcc

SEQ ID NO: 44161 - DNA, 25 bp, Mus musculus
gggaagtgcttaggagtctaccaga

SEQ ID NO: 44162 - DNA, 25 bp, Mus musculus
gggaagttctggaagccgtccgata

SEQ ID NO: 44163 - DNA, 25 bp, Mus musculus
gggaatatatatgtaaggtctccaa

SEQ ID NO: 44164 - DNA, 25 bp, Mus musculus
gggaatatatctcagacggtgaaga

SEQ ID NO: 44165 - DNA, 25 bp, Mus musculus
gggaatatcccagaagcaatagctt

SEQ ID NO: 44166 - DNA, 25 bp, Mus musculus
gggaatatgactgggccctgcaagc

SEQ ID NO: 44167 - DNA, 25 bp, Mus musculus
gggaatcacaagatccatcctgaat

SEQ ID NO: 44168 - DNA, 25 bp, Mus musculus
gggaatcagtaaaccatggcatcta

SEQ ID NO: 44169 - DNA, 25 bp, Mus musculus
gggaatccagacatggctgctgaca

SEQ ID NO: 44170 - DNA, 25 bp, Mus musculus
gggaatccgcaggagggcaagcagg

SEQ ID NO: 44171 - DNA, 25 bp, Mus musculus
gggaatctctgtcacccttctggga

SEQ ID NO: 44172 - DNA, 25 bp, Mus musculus
gggaatcttgacttcctcaagcctt

SEQ ID NO: 44173 - DNA, 25 bp, Mus musculus
gggaatgagacagtagcagccgttt

SEQ ID NO: 44174 - DNA, 25 bp, Mus musculus
gggaatgatgtcagctgctccaccc

SEQ ID NO: 44175 - DNA, 25 bp, Mus musculus
gggaatggtctagcagcttatcgag

SEQ ID NO: 44176 - DNA, 25 bp, Mus musculus
gggaatgtatgatttgccacatctg

SEQ ID NO: 44177 - DNA, 25 bp, Mus musculus
gggaatgtgaacaaatacatagtgc

SEQ ID NO: 44178 - DNA, 25 bp, Mus musculus
gggaattcccaaaaacactgcacga

SEQ ID NO: 44179 - DNA, 25 bp, Mus musculus
gggaattcctttgctgtacctggag

SEQ ID NO: 44180 - DNA, 25 bp, Mus musculus
gggaatttgtgaatgccaccttcat

SEQ ID NO: 44181 - DNA, 25 bp, Mus musculus
gggaatttgtgattgccaccttcat

SEQ ID NO: 44182 - DNA, 25 bp, Mus musculus
gggacaaatataagctgagcaagaa

SEQ ID NO: 44183 - DNA, 25 bp, Mus musculus
gggacaaccaattccgaaaagaatg

SEQ ID NO: 44184 - DNA, 25 bp, Mus musculus
gggacaactggatcgacccctggac

SEQ ID NO: 44185 - DNA, 25 bp, Mus musculus
gggacaagtcatccccaacgggatt

SEQ ID NO: 44186 - DNA, 25 bp, Mus musculus
gggacaagtcatctgggatccacta

SEQ ID NO: 44187 - DNA, 25 bp, Mus musculus
gggacaagtcatgcccaacgggatt

SEQ ID NO: 44188 - DNA, 25 bp, Mus musculus
gggacaagtggtgtttgccactcag

SEQ ID NO: 44189 - DNA, 25 bp, Mus musculus
gggacaagtttacaggctgctgctc

SEQ ID NO: 44190 - DNA, 25 bp, Mus musculus
gggacacaggaatgctgccaaggtc

SEQ ID NO: 44191 - DNA, 25 bp, Mus musculus
gggacacagtcaccagctcagagca

SEQ ID NO: 44192 - DNA, 25 bp, Mus musculus
gggacacatacaatattcctttaga

SEQ ID NO: 44193 - DNA, 25 bp, Mus musculus
gggacacatccttgcctcagaatgt

SEQ ID NO: 44194 - DNA, 25 bp, Mus musculus
gggacaccaaatctgtcaaggaaca

SEQ ID NO: 44195 - DNA, 25 bp, Mus musculus
gggacaccatgcagatcattctaca

SEQ ID NO: 44196 - DNA, 25 bp, Mus musculus
gggacaccctcttcagtttggcgcc

SEQ ID NO: 44197 - DNA, 25 bp, Mus musculus
gggacaccgccctgttatatttaag

SEQ ID NO: 44198 - DNA, 25 bp, Mus musculus
gggacacggaaatgacacagcagga

SEQ ID NO: 44199 - DNA, 25 bp, Mus musculus
gggacactaagcctcagcctgttga

SEQ ID NO: 44200 - DNA, 25 bp, Mus musculus
gggacactccaacacatgaagactt

SEQ ID NO: 44201 - DNA, 25 bp, Mus musculus
gggacactcctgtttgccttctata

SEQ ID NO: 44202 - DNA, 25 bp, Mus musculus
gggacactgacaagtatctcgggcc

SEQ ID NO: 44203 - DNA, 25 bp, Mus musculus
gggacagaagactccagctacaatg

SEQ ID NO: 44204 - DNA, 25 bp, Mus musculus
gggacagacctttgaccgtcgctca

SEQ ID NO: 44205 - DNA, 25 bp, Mus musculus
gggacagatgacaggtcaatcagaa

SEQ ID NO: 44206 - DNA, 25 bp, Mus musculus
gggacagatgactggtcaatcagaa

SEQ ID NO: 44207 - DNA, 25 bp, Mus musculus
gggacagcacgaagtcacgcaacaa

SEQ ID NO: 44208 - DNA, 25 bp, Mus musculus
gggacagcagaagaagccgtttggg

SEQ ID NO: 44209 - DNA, 25 bp, Mus musculus
gggacagccgctagaataatagcag

SEQ ID NO: 44210 - DNA, 25 bp, Mus musculus
gggacagccttcttcatgtacaatg

SEQ ID NO: 44211 - DNA, 25 bp, Mus musculus
gggacagccttgtttccccatagcc

SEQ ID NO: 44212 - DNA, 25 bp, Mus musculus
gggacaggaacactgcaaatctatt

SEQ ID NO: 44213 - DNA, 25 bp, Mus musculus
gggacaggaacagtgcaaatctatt

SEQ ID NO: 44214 - DNA, 25 bp, Mus musculus
gggacagtcatctgtccatcagatg

SEQ ID NO: 44215 - DNA, 25 bp, Mus musculus
gggacagtggaagtcctcactgctt

SEQ ID NO: 44216 - DNA, 25 bp, Mus musculus
gggacatacttcctaaggctcttca

SEQ ID NO: 44217 - DNA, 25 bp, Mus musculus
gggacatatcctccgccctgaggac

SEQ ID NO: 44218 - DNA, 25 bp, Mus musculus
gggacatcattcttctgatgctgcc

SEQ ID NO: 44219 - DNA, 25 bp, Mus musculus
gggacatcgaccacatcagctttga

SEQ ID NO: 44220 - DNA, 25 bp, Mus musculus
gggacatcgacctcatcagctttga

SEQ ID NO: 44221 - DNA, 25 bp, Mus musculus
gggacatggcaaaacgctgacacta

SEQ ID NO: 44222 - DNA, 25 bp, Mus musculus
gggacatgtgatcctgttgagcaca

SEQ ID NO: 44223 - DNA, 25 bp, Mus musculus
gggacatgttcatgaacatgcagag

SEQ ID NO: 44224 - DNA, 25 bp, Mus musculus
gggacattgctgaccgcttcaacgt

SEQ ID NO: 44225 - DNA, 25 bp, Mus musculus
gggaccaagaacctacgcatccagt

SEQ ID NO: 44226 - DNA, 25 bp, Mus musculus
gggaccaagaacgtacgcatccagt

SEQ ID NO: 44227 - DNA, 25 bp, Mus musculus
gggaccacagtagagccaccgacag

SEQ ID NO: 44228 - DNA, 25 bp, Mus musculus
gggaccactgcgtacattcaccagg

SEQ ID NO: 44229 - DNA, 25 bp, Mus musculus
gggaccactggccaccaggactgtt

SEQ ID NO: 44230 - DNA, 25 bp, Mus musculus
gggaccaggaagagcggcaggacta

SEQ ID NO: 44231 - DNA, 25 bp, Mus musculus
gggaccaggattgttgacaagtgta

SEQ ID NO: 44232 - DNA, 25 bp, Mus musculus
gggaccagggccagattgcccagaa

SEQ ID NO: 44233 - DNA, 25 bp, Mus musculus
gggaccatcatttttattccagaaa

SEQ ID NO: 44234 - DNA, 25 bp, Mus musculus
gggaccatcgtctacaagactgaca

SEQ ID NO: 44235 - DNA, 25 bp, Mus musculus
gggaccatgatgtctggcagagacc

SEQ ID NO: 44236 - DNA, 25 bp, Mus musculus
gggacccaagtcctcgcggctgctt

SEQ ID NO: 44237 - DNA, 25 bp, Mus musculus
gggacccagccaaggaggtttccag

SEQ ID NO: 44238 - DNA, 25 bp, Mus musculus
gggacccaggctaggacccaatgtg

SEQ ID NO: 44239 - DNA, 25 bp, Mus musculus
gggacccatttagtggcaaagatcc

SEQ ID NO: 44240 - DNA, 25 bp, Mus musculus
gggaccccataagacagcagtgtaa

SEQ ID NO: 44241 - DNA, 25 bp, Mus musculus
gggaccccattggacgttacaagtg

SEQ ID NO: 44242 - DNA, 25 bp, Mus musculus
gggacccctgtggaacgatccagaa

SEQ ID NO: 44243 - DNA, 25 bp, Mus musculus
gggaccctcccgacatacaatggct

SEQ ID NO: 44244 - DNA, 25 bp, Mus musculus
gggaccctggtgctacaccacagat

SEQ ID NO: 44245 - DNA, 25 bp, Mus musculus
gggacccttatcatcgtcaatagcg

SEQ ID NO: 44246 - DNA, 25 bp, Mus musculus
gggaccgactcagagtgacctctga

SEQ ID NO: 44247 - DNA, 25 bp, Mus musculus
gggaccgggacgaggccattgccaa

SEQ ID NO: 44248 - DNA, 25 bp, Mus musculus
gggaccgtgcagctaacgactaccc

SEQ ID NO: 44249 - DNA, 25 bp, Mus musculus
gggaccgtggttcgttccagcacaa

SEQ ID NO: 44250 - DNA, 25 bp, Mus musculus
gggacctacagaggaagccattcta

SEQ ID NO: 44251 - DNA, 25 bp, Mus musculus
gggacctatgtgctgcaggacaaca

SEQ ID NO: 44252 - DNA, 25 bp, Mus musculus
gggacctcttcctagaaacatttgc

SEQ ID NO: 44253 - DNA, 25 bp, Mus musculus
gggacctcttgcttcaggttctgca

SEQ ID NO: 44254 - DNA, 25 bp, Mus musculus
gggacctgaagctgctctttgaata

SEQ ID NO: 44255 - DNA, 25 bp, Mus musculus
gggacctgacacactgggccttgtt

SEQ ID NO: 44256 - DNA, 25 bp, Mus musculus
gggacctggacttcacgtactctgg

SEQ ID NO: 44257 - DNA, 25 bp, Mus musculus
gggacctggcctacagacgacagga

SEQ ID NO: 44258 - DNA, 25 bp, Mus musculus
gggacctgggacaggcactgctcat

SEQ ID NO: 44259 - DNA, 25 bp, Mus musculus
gggacctgggctatgtatacctcaa

SEQ ID NO: 44260 - DNA, 25 bp, Mus musculus
gggacctgggcttctgtggcctcca

SEQ ID NO: 44261 - DNA, 25 bp, Mus musculus
gggacctgtcaccagactgcagact

SEQ ID NO: 44262 - DNA, 25 bp, Mus musculus
gggacctgttcattggaccgaaagc

SEQ ID NO: 44263 - DNA, 25 bp, Mus musculus
gggaccttgtccttcaggatgcttc

SEQ ID NO: 44264 - DNA, 25 bp, Mus musculus
gggacctttactctttgatgatctt

SEQ ID NO: 44265 - DNA, 25 bp, Mus musculus
gggacgatgccagttcttgcctaat

SEQ ID NO: 44266 - DNA, 25 bp, Mus musculus
gggacgattgtgactgtcatcctga

SEQ ID NO: 44267 - DNA, 25 bp, Mus musculus
gggacgcacctgtgtcaggccagct

SEQ ID NO: 44268 - DNA, 25 bp, Mus musculus
gggacgcatgggtaacttgcacacc

SEQ ID NO: 44269 - DNA, 25 bp, Mus musculus
gggacgccctcctgcagatgatcac

SEQ ID NO: 44270 - DNA, 25 bp, Mus musculus
gggacgtcccaaggtctgggactct

SEQ ID NO: 44271 - DNA, 25 bp, Mus musculus
gggacgtctgcagtgccttggatct

SEQ ID NO: 44272 - DNA, 25 bp, Mus musculus
gggacgtggtggacaagtttgtggg

SEQ ID NO: 44273 - DNA, 25 bp, Mus musculus
gggacgttttctgaagttatgaaga

SEQ ID NO: 44274 - DNA, 25 bp, Mus musculus
gggactatggaaagatacaaggaac

SEQ ID NO: 44275 - DNA, 25 bp, Mus musculus
gggactattggacctatcacggctc

SEQ ID NO: 44276 - DNA, 25 bp, Mus musculus
gggactatttttggaagccagataa

SEQ ID NO: 44277 - DNA, 25 bp, Mus musculus
gggactcacgggactggatgcaact

SEQ ID NO: 44278 - DNA, 25 bp, Mus musculus
gggactcaggctcaagaggactcct

SEQ ID NO: 44279 - DNA, 25 bp, Mus musculus
gggactcctctcgaaacgttatcat

SEQ ID NO: 44280 - DNA, 25 bp, Mus musculus
gggactcctcttcgtcggcagtgac

SEQ ID NO: 44281 - DNA, 25 bp, Mus musculus
gggactccttgcatgtgcggcctct

SEQ ID NO: 44282 - DNA, 25 bp, Mus musculus
gggactccttggttcagctaatgca

SEQ ID NO: 44283 - DNA, 25 bp, Mus musculus
gggactctcacgaagacaccagtgc

SEQ ID NO: 44284 - DNA, 25 bp, Mus musculus
gggactgagccttcttttccccact

SEQ ID NO: 44285 - DNA, 25 bp, Mus musculus
gggactgaggtcagcttcagagaaa

SEQ ID NO: 44286 - DNA, 25 bp, Mus musculus
gggactggttccaagaagcgcgttc

SEQ ID NO: 44287 - DNA, 25 bp, Mus musculus
gggactgtcacaacgtgtctgtgtt

SEQ ID NO: 44288 - DNA, 25 bp, Mus musculus
gggactgtcatgaagattggcattg

SEQ ID NO: 44289 - DNA, 25 bp, Mus musculus
gggactgtgctcatattccactgcc

SEQ ID NO: 44290 - DNA, 25 bp, Mus musculus
gggactgtggctgcctcgctctgtc

SEQ ID NO: 44291 - DNA, 25 bp, Mus musculus
gggacttaagtgtgactggtttaca

SEQ ID NO: 44292 - DNA, 25 bp, Mus musculus
gggacttacatctatttggaccaaa

SEQ ID NO: 44293 - DNA, 25 bp, Mus musculus
gggacttcagaggaatattcactca

SEQ ID NO: 44294 - DNA, 25 bp, Mus musculus
gggacttcagtaccagggcaaccca

SEQ ID NO: 44295 - DNA, 25 bp, Mus musculus
gggacttcctcaggtatcattacaa

SEQ ID NO: 44296 - DNA, 25 bp, Mus musculus
gggacttgagctagagccacaacac

SEQ ID NO: 44297 - DNA, 25 bp, Mus musculus
gggacttgagcttgagccacaacac

SEQ ID NO: 44298 - DNA, 25 bp, Mus musculus
gggacttgcagcttttctctatgga

SEQ ID NO: 44299 - DNA, 25 bp, Mus musculus
gggagaaatgctgttaccataacta

SEQ ID NO: 44300 - DNA, 25 bp, Mus musculus
gggagaacgaagatgagctctcttt

SEQ ID NO: 44301 - DNA, 25 bp, Mus musculus
gggagaacgaagttgagctctcttt

SEQ ID NO: 44302 - DNA, 25 bp, Mus musculus
gggagaacgtatgcagattctccag

SEQ ID NO: 44303 - DNA, 25 bp, Mus musculus
gggagaactacgatttgaaaatcca

SEQ ID NO: 44304 - DNA, 25 bp, Mus musculus
gggagaagcgaatgcctgaagactt

SEQ ID NO: 44305 - DNA, 25 bp, Mus musculus
gggagaaggatggtcacaaagatcc

SEQ ID NO: 44306 - DNA, 25 bp, Mus musculus
gggagaaggatgtcttttcagaagc

SEQ ID NO: 44307 - DNA, 25 bp, Mus musculus
gggagaagtttttccacaccacagt

SEQ ID NO: 44308 - DNA, 25 bp, Mus musculus
gggagaatccaaatactacaggagg

SEQ ID NO: 44309 - DNA, 25 bp, Mus musculus
gggagaatccagatttgataccaat

SEQ ID NO: 44310 - DNA, 25 bp, Mus musculus
gggagacaacacacctgtccttgag

SEQ ID NO: 44311 - DNA, 25 bp, Mus musculus
gggagacaacactcctgtccttgag

SEQ ID NO: 44312 - DNA, 25 bp, Mus musculus
gggagacaaggtgaccaggtcaaat

SEQ ID NO: 44313 - DNA, 25 bp, Mus musculus
gggagacaccactgtcataagttct

SEQ ID NO: 44314 - DNA, 25 bp, Mus musculus
gggagacatcccgatacagacagca

SEQ ID NO: 44315 - DNA, 25 bp, Mus musculus
gggagacatttagtgaacgctcttc

SEQ ID NO: 44316 - DNA, 25 bp, Mus musculus
gggagaccatgggaatccccaccat

SEQ ID NO: 44317 - DNA, 25 bp, Mus musculus
gggagaccctgaccctacagaagca

SEQ ID NO: 44318 - DNA, 25 bp, Mus musculus
gggagacctcatgtccttcctggtg

SEQ ID NO: 44319 - DNA, 25 bp, Mus musculus
gggagactaccagacttcaccattg

SEQ ID NO: 44320 - DNA, 25 bp, Mus musculus
gggagactggctgctgcacctacta

SEQ ID NO: 44321 - DNA, 25 bp, Mus musculus
gggagagacacatacaatagagacc

SEQ ID NO: 44322 - DNA, 25 bp, Mus musculus
gggagagcacggtcagaactattgc

SEQ ID NO: 44323 - DNA, 25 bp, Mus musculus
gggagagccatcattgacctcttcc

SEQ ID NO: 44324 - DNA, 25 bp, Mus musculus
gggagagccgaaatgccagcgaccc

SEQ ID NO: 44325 - DNA, 25 bp, Mus musculus
gggagataactctggacactggcag

SEQ ID NO: 44326 - DNA, 25 bp, Mus musculus
gggagataatcgcacattcacactg

SEQ ID NO: 44327 - DNA, 25 bp, Mus musculus
gggagataatcggacattcacactg

SEQ ID NO: 44328 - DNA, 25 bp, Mus musculus
gggagatcgacctcaacgagtggct

SEQ ID NO: 44329 - DNA, 25 bp, Mus musculus
gggagatcgttgttttcaggataga

SEQ ID NO: 44330 - DNA, 25 bp, Mus musculus
gggagatctatgaccgctatggccg

SEQ ID NO: 44331 - DNA, 25 bp, Mus musculus
gggagatgcagcctccctgcataga

SEQ ID NO: 44332 - DNA, 25 bp, Mus musculus
gggagatttcacaaatcttcgaagg

SEQ ID NO: 44333 - DNA, 25 bp, Mus musculus
gggagatttggctggctattcatca

SEQ ID NO: 44334 - DNA, 25 bp, Mus musculus
gggagcacatgcctagcctcaggct

SEQ ID NO: 44335 - DNA, 25 bp, Mus musculus
gggagcacatggtgccttctgacca

SEQ ID NO: 44336 - DNA, 25 bp, Mus musculus
gggagcagctgctcacgaccattgc

SEQ ID NO: 44337 - DNA, 25 bp, Mus musculus
gggagcatgccttagacccttccgc

SEQ ID NO: 44338 - DNA, 25 bp, Mus musculus
gggagcattagtactcttgactcat

SEQ ID NO: 44339 - DNA, 25 bp, Mus musculus
gggagcattcccatagaaactgctg

SEQ ID NO: 44340 - DNA, 25 bp, Mus musculus
gggagccaaccaggggaacttcaga

SEQ ID NO: 44341 - DNA, 25 bp, Mus musculus
gggagccacagctcccctgacagag

SEQ ID NO: 44342 - DNA, 25 bp, Mus musculus
gggagcccagtgacgtcgctacata

SEQ ID NO: 44343 - DNA, 25 bp, Mus musculus
gggagcccagtgtcgtcgctacata

SEQ ID NO: 44344 - DNA, 25 bp, Mus musculus
gggagcccataagtagcgaacactt

SEQ ID NO: 44345 - DNA, 25 bp, Mus musculus
gggagcccctttctagacttcacgg

SEQ ID NO: 44346 - DNA, 25 bp, Mus musculus
gggagcccctttgtagacttcacgg

SEQ ID NO: 44347 - DNA, 25 bp, Mus musculus
gggagcccgctatgtgcgcaccgac

SEQ ID NO: 44348 - DNA, 25 bp, Mus musculus
gggagcccgtgcatgtgctagacaa

SEQ ID NO: 44349 - DNA, 25 bp, Mus musculus
gggagccgatgcagaccggcatcaa

SEQ ID NO: 44350 - DNA, 25 bp, Mus musculus
gggagccgcctgaagccaagagctt

SEQ ID NO: 44351 - DNA, 25 bp, Mus musculus
gggagcctagaggaagccaaacagt

SEQ ID NO: 44352 - DNA, 25 bp, Mus musculus
gggagcctcacaggagcattgttta

SEQ ID NO: 44353 - DNA, 25 bp, Mus musculus
gggagcctcatctgctttatctgcc

SEQ ID NO: 44354 - DNA, 25 bp, Mus musculus
gggagcctctggtcctcagaaaagc

SEQ ID NO: 44355 - DNA, 25 bp, Mus musculus
gggagcctgtgcacggcggccgcgg

SEQ ID NO: 44356 - DNA, 25 bp, Mus musculus
gggagcctgtgctcggcggccgcgg

SEQ ID NO: 44357 - DNA, 25 bp, Mus musculus
gggagccttcccatccaactttgtg

SEQ ID NO: 44358 - DNA, 25 bp, Mus musculus
gggagcggctgaaacacctgatcgt

SEQ ID NO: 44359 - DNA, 25 bp, Mus musculus
gggagcgtcagctcctccagagact

SEQ ID NO: 44360 - DNA, 25 bp, Mus musculus
gggagctaatcagattctgtcgtgc

SEQ ID NO: 44361 - DNA, 25 bp, Mus musculus
gggagctccgctggaatgccaccta

SEQ ID NO: 44362 - DNA, 25 bp, Mus musculus
gggagctgccctttgaaaaccgtgg

SEQ ID NO: 44363 - DNA, 25 bp, Mus musculus
gggagctgtgaagcctccagcaaac

SEQ ID NO: 44364 - DNA, 25 bp, Mus musculus
gggagctgtgcttctcactacgcta

SEQ ID NO: 44365 - DNA, 25 bp, Mus musculus
gggagctgtttctagtgacctcact

SEQ ID NO: 44366 - DNA, 25 bp, Mus musculus
gggaggaaccaattattacattgaa

SEQ ID NO: 44367 - DNA, 25 bp, Mus musculus
gggaggaatctgttctatgtctgcc

SEQ ID NO: 44368 - DNA, 25 bp, Mus musculus
gggaggagaggatctaattctgcaa

SEQ ID NO: 44369 - DNA, 25 bp, Mus musculus
gggaggagttagatgccctcaagtt

SEQ ID NO: 44370 - DNA, 25 bp, Mus musculus
gggaggataccagagagaacactgt

SEQ ID NO: 44371 - DNA, 25 bp, Mus musculus
gggaggatccgtacccacacaagtt

SEQ ID NO: 44372 - DNA, 25 bp, Mus musculus
gggaggccttttcctatcagaacat

SEQ ID NO: 44373 - DNA, 25 bp, Mus musculus
gggaggcgatcatagcttcctctat

SEQ ID NO: 44374 - DNA, 25 bp, Mus musculus
gggaggcttgcttctaccttatggg

SEQ ID NO: 44375 - DNA, 25 bp, Mus musculus
gggagggccgagtcacctgatctaa

SEQ ID NO: 44376 - DNA, 25 bp, Mus musculus
gggagggtccagtgctttcaagctc

SEQ ID NO: 44377 - DNA, 25 bp, Mus musculus
gggaggtcacctcccctttgaggct

SEQ ID NO: 44378 - DNA, 25 bp, Mus musculus
gggaggtccatctacggaagccgct

SEQ ID NO: 44379 - DNA, 25 bp, Mus musculus
gggaggtcgtggacaaactctttga

SEQ ID NO: 44380 - DNA, 25 bp, Mus musculus
gggaggtgcaccagcgcttcaacag

SEQ ID NO: 44381 - DNA, 25 bp, Mus musculus
gggaggtgctctgtggaactaagtg

SEQ ID NO: 44382 - DNA, 25 bp, Mus musculus
gggagtagccatatctgcaggtttc

SEQ ID NO: 44383 - DNA, 25 bp, Mus musculus
gggagtatattgaagccagttacat

SEQ ID NO: 44384 - DNA, 25 bp, Mus musculus
gggagtatggatgactgtgtccttc

SEQ ID NO: 44385 - DNA, 25 bp, Mus musculus
gggagtatgtgtgtaaggtttccaa

SEQ ID NO: 44386 - DNA, 25 bp, Mus musculus
gggagtcacctgtgagtcagccgca

SEQ ID NO: 44387 - DNA, 25 bp, Mus musculus
gggagtcgggtctatctgcaaacat

SEQ ID NO: 44388 - DNA, 25 bp, Mus musculus
gggagtgatagtccaatcacaggct

SEQ ID NO: 44389 - DNA, 25 bp, Mus musculus
gggagtgccccaaacagtcagtagt

SEQ ID NO: 44390 - DNA, 25 bp, Mus musculus
gggagtgcctcaagtatcggctcgt

SEQ ID NO: 44391 - DNA, 25 bp, Mus musculus
gggagtgcctccagccatgtctgca

SEQ ID NO: 44392 - DNA, 25 bp, Mus musculus
gggagtgtctgagtcttctgtaaac

SEQ ID NO: 44393 - DNA, 25 bp, Mus musculus
gggagtgttactcacagcaaagcag

SEQ ID NO: 44394 - DNA, 25 bp, Mus musculus
gggagtgttaggacatttaaaagca

SEQ ID NO: 44395 - DNA, 25 bp, Mus musculus
gggagttcaataatgtcaactgttc

SEQ ID NO: 44396 - DNA, 25 bp, Mus musculus
gggagttcaatattgtcaactgttc

SEQ ID NO: 44397 - DNA, 25 bp, Mus musculus
gggagttcattcaggaacctgctaa

SEQ ID NO: 44398 - DNA, 25 bp, Mus musculus
gggagttctttccattgcccaagtc

SEQ ID NO: 44399 - DNA, 25 bp, Mus musculus
gggagttgacgttcacacccggctg

SEQ ID NO: 44400 - DNA, 25 bp, Mus musculus
gggagttgcagaaaagcctcatgtt

SEQ ID NO: 44401 - DNA, 25 bp, Mus musculus
gggagttggcaagttctgaagccca

SEQ ID NO: 44402 - DNA, 25 bp, Mus musculus
gggagtttatcgacttcggcatgga

SEQ ID NO: 44403 - DNA, 25 bp, Mus musculus
gggagtttcagaaaggccccgcatt

SEQ ID NO: 44404 - DNA, 25 bp, Mus musculus
gggagtttgcccctgacaacaggca

SEQ ID NO: 44405 - DNA, 25 bp, Mus musculus
gggataaactgaagatcaacatcga

SEQ ID NO: 44406 - DNA, 25 bp, Mus musculus
gggataacttccactaccaacacag

SEQ ID NO: 44407 - DNA, 25 bp, Mus musculus
gggataacttcctctaccaacacag

SEQ ID NO: 44408 - DNA, 25 bp, Mus musculus
gggataaggcgggacatttctttga

SEQ ID NO: 44409 - DNA, 25 bp, Mus musculus
gggataagttcagaaacagactcga

SEQ ID NO: 44410 - DNA, 25 bp, Mus musculus
gggatacacagttgggtttcagaac

SEQ ID NO: 44411 - DNA, 25 bp, Mus musculus
gggatacactcttagaatacgtgta

SEQ ID NO: 44412 - DNA, 25 bp, Mus musculus
gggatacagatccatcagttcttca

SEQ ID NO: 44413 - DNA, 25 bp, Mus musculus
gggatacgattgccggtgtccccat

SEQ ID NO: 44414 - DNA, 25 bp, Mus musculus
gggatactatcaccataaagacaca

SEQ ID NO: 44415 - DNA, 25 bp, Mus musculus
gggatactgcttggagcccaagaaa

SEQ ID NO: 44416 - DNA, 25 bp, Mus musculus
gggatagcagatccttctcaaagta

SEQ ID NO: 44417 - DNA, 25 bp, Mus musculus
gggatatccctggttgaggacttgt

SEQ ID NO: 44418 - DNA, 25 bp, Mus musculus
gggatatcctttcactctgcatggt

SEQ ID NO: 44419 - DNA, 25 bp, Mus musculus
gggatatgaccggtataaaatggtg

SEQ ID NO: 44420 - DNA, 25 bp, Mus musculus
gggatcaaggcctagtagctccaag

SEQ ID NO: 44421 - DNA, 25 bp, Mus musculus
gggatcaccccacatctggtgcaaa

SEQ ID NO: 44422 - DNA, 25 bp, Mus musculus
gggatcaccccagatctggtgcaaa

SEQ ID NO: 44423 - DNA, 25 bp, Mus musculus
gggatcaccgtctttcaacacttgg

SEQ ID NO: 44424 - DNA, 25 bp, Mus musculus
gggatcatactccttctggtgcagg

SEQ ID NO: 44425 - DNA, 25 bp, Mus musculus
gggatcatcacaaagaagaacattt

SEQ ID NO: 44426 - DNA, 25 bp, Mus musculus
gggatcatcatactcacctatgtgc

SEQ ID NO: 44427 - DNA, 25 bp, Mus musculus
gggatcatcttcatctctcggttct

SEQ ID NO: 44428 - DNA, 25 bp, Mus musculus
gggatccacaccactcaaaaatgct

SEQ ID NO: 44429 - DNA, 25 bp, Mus musculus
gggatccagagcttttgaagttatt

SEQ ID NO: 44430 - DNA, 25 bp, Mus musculus
gggatcccacgtacatgggagtgca

SEQ ID NO: 44431 - DNA, 25 bp, Mus musculus
gggatccgaacaagctcagaatgaa

SEQ ID NO: 44432 - DNA, 25 bp, Mus musculus
gggatcctgttaacatgcaggtcca

SEQ ID NO: 44433 - DNA, 25 bp, Mus musculus
gggatcgaagacagaacctgctgga

SEQ ID NO: 44434 - DNA, 25 bp, Mus musculus
gggatcgattgcctctgattcttga

SEQ ID NO: 44435 - DNA, 25 bp, Mus musculus
gggatcgtttgcatcgggcccaatg

SEQ ID NO: 44436 - DNA, 25 bp, Mus musculus
gggatctaccctctgtgttttcaag

SEQ ID NO: 44437 - DNA, 25 bp, Mus musculus
gggatctaccctgtgtgttttcaag

SEQ ID NO: 44438 - DNA, 25 bp, Mus musculus
gggatctcacagatagcatctaaga

SEQ ID NO: 44439 - DNA, 25 bp, Mus musculus
gggatctccttttcctcacgaaccg

SEQ ID NO: 44440 - DNA, 25 bp, Mus musculus
gggatctgacacccctagacagcct

SEQ ID NO: 44441 - DNA, 25 bp, Mus musculus
gggatctgacgctggaacccctggc

SEQ ID NO: 44442 - DNA, 25 bp, Mus musculus
gggatctgcacccaactctgattct

SEQ ID NO: 44443 - DNA, 25 bp, Mus musculus
gggatctgctcagcagacactcaca

SEQ ID NO: 44444 - DNA, 25 bp, Mus musculus
gggatctgctggaagtcacatctgg

SEQ ID NO: 44445 - DNA, 25 bp, Mus musculus
gggatctgctgtgcatagccaagac

SEQ ID NO: 44446 - DNA, 25 bp, Mus musculus
gggatctggcctgagcctgtccttg

SEQ ID NO: 44447 - DNA, 25 bp, Mus musculus
gggatcttcgagactttgttaggag

SEQ ID NO: 44448 - DNA, 25 bp, Mus musculus
gggatgaaacgcagacaacagataa

SEQ ID NO: 44449 - DNA, 25 bp, Mus musculus
gggatgaatttgacctcatagatca

SEQ ID NO: 44450 - DNA, 25 bp, Mus musculus
gggatgacaagcctgccttcagaaa

SEQ ID NO: 44451 - DNA, 25 bp, Mus musculus
gggatgacagacaggtccacccaag

SEQ ID NO: 44452 - DNA, 25 bp, Mus musculus
gggatgagagagtcctaccacagtg

SEQ ID NO: 44453 - DNA, 25 bp, Mus musculus
gggatgagcaacaatacccctcagt

SEQ ID NO: 44454 - DNA, 25 bp, Mus musculus
gggatgagccccttcgtcggccagt

SEQ ID NO: 44455 - DNA, 25 bp, Mus musculus
gggatgaggtccatccatcctccta

SEQ ID NO: 44456 - DNA, 25 bp, Mus musculus
gggatgatattcctagtgcccttcg

SEQ ID NO: 44457 - DNA, 25 bp, Mus musculus
gggatgatgagcaatctatacaaat

SEQ ID NO: 44458 - DNA, 25 bp, Mus musculus
gggatgcaacaacggatcaatatat

SEQ ID NO: 44459 - DNA, 25 bp, Mus musculus
gggatgccaatggatcccgagattt

SEQ ID NO: 44460 - DNA, 25 bp, Mus musculus
gggatgccacggactgtaccgccgc

SEQ ID NO: 44461 - DNA, 25 bp, Mus musculus
gggatgccaggcaatgcatggtcca

SEQ ID NO: 44462 - DNA, 25 bp, Mus musculus
gggatgcccaagacccgagagtatc

SEQ ID NO: 44463 - DNA, 25 bp, Mus musculus
gggatgcccgcacaaaacagctgag

SEQ ID NO: 44464 - DNA, 25 bp, Mus musculus
gggatgcctttcgaagccacacctt

SEQ ID NO: 44465 - DNA, 25 bp, Mus musculus
gggatgcgattccacggcaactttg

SEQ ID NO: 44466 - DNA, 25 bp, Mus musculus
gggatgctcaatcagcagttgacac

SEQ ID NO: 44467 - DNA, 25 bp, Mus musculus
gggatgctctagcagatgaagccac

SEQ ID NO: 44468 - DNA, 25 bp, Mus musculus
gggatggaggactaatcaacaaggt

SEQ ID NO: 44469 - DNA, 25 bp, Mus musculus
gggatggcactttaaccccactgtc

SEQ ID NO: 44470 - DNA, 25 bp, Mus musculus
gggatggccaacacttctgggaaat

SEQ ID NO: 44471 - DNA, 25 bp, Mus musculus
gggatggccagctcctacggctcag

SEQ ID NO: 44472 - DNA, 25 bp, Mus musculus
gggatggcgtgatgtcactactttc

SEQ ID NO: 44473 - DNA, 25 bp, Mus musculus
gggatggtgccagccctttcatttc

SEQ ID NO: 44474 - DNA, 25 bp, Mus musculus
gggatgtccttgagatcttgaagca

SEQ ID NO: 44475 - DNA, 25 bp, Mus musculus
gggatgtccttgtgatcttgaagca

SEQ ID NO: 44476 - DNA, 25 bp, Mus musculus
gggatgtgctttggctgcgatttaa

SEQ ID NO: 44477 - DNA, 25 bp, Mus musculus
gggatgtggtagttgtcactgtcca

SEQ ID NO: 44478 - DNA, 25 bp, Mus musculus
gggatgttagccgtaatcaacctta

SEQ ID NO: 44479 - DNA, 25 bp, Mus musculus
gggatgtttccaaaggcttcctcaa

SEQ ID NO: 44480 - DNA, 25 bp, Mus musculus
gggattacatgacaccagagcagag

SEQ ID NO: 44481 - DNA, 25 bp, Mus musculus
gggattcaatacctcattcctgggt

SEQ ID NO: 44482 - DNA, 25 bp, Mus musculus
gggattcagaatttgtgcagctaca

SEQ ID NO: 44483 - DNA, 25 bp, Mus musculus
gggattcccacatcaaagaaaagct

SEQ ID NO: 44484 - DNA, 25 bp, Mus musculus
gggattccgggcttgagctcctacc

SEQ ID NO: 44485 - DNA, 25 bp, Mus musculus
gggattcggcttctttttcaacatg

SEQ ID NO: 44486 - DNA, 25 bp, Mus musculus
gggattcgtgtttgtgctgtccagc

SEQ ID NO: 44487 - DNA, 25 bp, Mus musculus
gggattctcatcaacagtcaaggtg

SEQ ID NO: 44488 - DNA, 25 bp, Mus musculus
gggattgagaccttcctatagccaa

SEQ ID NO: 44489 - DNA, 25 bp, Mus musculus
gggattgatatcctggtctccaatg

SEQ ID NO: 44490 - DNA, 25 bp, Mus musculus
gggattgatgctgccatcgccaatg

SEQ ID NO: 44491 - DNA, 25 bp, Mus musculus
gggattgcaagaccaaaggtttggg

SEQ ID NO: 44492 - DNA, 25 bp, Mus musculus
gggattgcccttccaagcattaagg

SEQ ID NO: 44493 - DNA, 25 bp, Mus musculus
gggattgcgactcactgctcgaacc

SEQ ID NO: 44494 - DNA, 25 bp, Mus musculus
gggattggaattggcgccctcctta

SEQ ID NO: 44495 - DNA, 25 bp, Mus musculus
gggattggattacccacctcttacg

SEQ ID NO: 44496 - DNA, 25 bp, Mus musculus
gggatttcagatgcatgctatcgcc

SEQ ID NO: 44497 - DNA, 25 bp, Mus musculus
gggatttccctccacgcctggagca

SEQ ID NO: 44498 - DNA, 25 bp, Mus musculus
gggatttccctcgacgcctggagca

SEQ ID NO: 44499 - DNA, 25 bp, Mus musculus
gggatttccctctttattgccacca

SEQ ID NO: 44500 - DNA, 25 bp, Mus musculus
gggattttaggcatacctgaccaca

SEQ ID NO: 44501 - DNA, 25 bp, Mus musculus
gggattttccacctagcggctatgg

SEQ ID NO: 44502 - DNA, 25 bp, Mus musculus
gggattttggctcaaaagtcaaatt

SEQ ID NO: 44503 - DNA, 25 bp, Mus musculus
gggcaaaaacatccttaggaatgct

SEQ ID NO: 44504 - DNA, 25 bp, Mus musculus
gggcaaaaccattgccaccaatcca

SEQ ID NO: 44505 - DNA, 25 bp, Mus musculus
gggcaaaacgctggcattacttcag

SEQ ID NO: 44506 - DNA, 25 bp, Mus musculus
gggcaaacagctttcctggaatgct

SEQ ID NO: 44507 - DNA, 25 bp, Mus musculus
gggcaaacatatcccaagtcaaggc

SEQ ID NO: 44508 - DNA, 25 bp, Mus musculus
gggcaaagagcctgatgaaactgtg

SEQ ID NO: 44509 - DNA, 25 bp, Mus musculus
gggcaaatccacctttgtgaagtta

SEQ ID NO: 44510 - DNA, 25 bp, Mus musculus
gggcaaatccgatcacgccgatcca

SEQ ID NO: 44511 - DNA, 25 bp, Mus musculus
gggcaacaacccagaagtccaggtt

SEQ ID NO: 44512 - DNA, 25 bp, Mus musculus
gggcaacaaccctgaagtccaggtt

SEQ ID NO: 44513 - DNA, 25 bp, Mus musculus
gggcaacaccaactggaaaactttg

SEQ ID NO: 44514 - DNA, 25 bp, Mus musculus
gggcaaccacaaccaggaactgact

SEQ ID NO: 44515 - DNA, 25 bp, Mus musculus
gggcaaccacaagcaggaactgact

SEQ ID NO: 44516 - DNA, 25 bp, Mus musculus
gggcaaccggatgggcacctctcat

SEQ ID NO: 44517 - DNA, 25 bp, Mus musculus
gggcaactgctgcatccagctccag

SEQ ID NO: 44518 - DNA, 25 bp, Mus musculus
gggcaagattgtctgcctgtgcacc

SEQ ID NO: 44519 - DNA, 25 bp, Mus musculus
gggcaagcaagttggcccaggtcac

SEQ ID NO: 44520 - DNA, 25 bp, Mus musculus
gggcaagcttgatccttatgattcc

SEQ ID NO: 44521 - DNA, 25 bp, Mus musculus
gggcaaggacctcttccacagagcc

SEQ ID NO: 44522 - DNA, 25 bp, Mus musculus
gggcaagttctgttggatatagtct

SEQ ID NO: 44523 - DNA, 25 bp, Mus musculus
gggcaatgccagtgatgtcatcctg

SEQ ID NO: 44524 - DNA, 25 bp, Mus musculus
gggcaatgtcattccaaaccctgct

SEQ ID NO: 44525 - DNA, 25 bp, Mus musculus
gggcaattatctcgtggcttctgaa

SEQ ID NO: 44526 - DNA, 25 bp, Mus musculus
gggcaattcattgatagcaggaaag

SEQ ID NO: 44527 - DNA, 25 bp, Mus musculus
gggcaattgggctgacttttcttat

SEQ ID NO: 44528 - DNA, 25 bp, Mus musculus
gggcaatttgaccacccaaatgtcg

SEQ ID NO: 44529 - DNA, 25 bp, Mus musculus
gggcacaaacacactggtggagaat

SEQ ID NO: 44530 - DNA, 25 bp, Mus musculus
gggcacaaacactctggtggagaat

SEQ ID NO: 44531 - DNA, 25 bp, Mus musculus
gggcacacgccctggttggtatccc

SEQ ID NO: 44532 - DNA, 25 bp, Mus musculus
gggcacatagccaactgcaggttca

SEQ ID NO: 44533 - DNA, 25 bp, Mus musculus
gggcacattgactaccgctgctgta

SEQ ID NO: 44534 - DNA, 25 bp, Mus musculus
gggcaccaccacaaggcgatttgtc

SEQ ID NO: 44535 - DNA, 25 bp, Mus musculus
gggcaccataccacctatacagaat

SEQ ID NO: 44536 - DNA, 25 bp, Mus musculus
gggcaccatacctcctatacagaat

SEQ ID NO: 44537 - DNA, 25 bp, Mus musculus
gggcacccttaatgagacaaggcat

SEQ ID NO: 44538 - DNA, 25 bp, Mus musculus
gggcaccggattccctggaaaatat

SEQ ID NO: 44539 - DNA, 25 bp, Mus musculus
gggcacctagatgttgtcaaatacc

SEQ ID NO: 44540 - DNA, 25 bp, Mus musculus
gggcacctgatgagtacattgagaa

SEQ ID NO: 44541 - DNA, 25 bp, Mus musculus
gggcacctttctaatccgcgacagc

SEQ ID NO: 44542 - DNA, 25 bp, Mus musculus
gggcacctttcttatccgcgacagc

SEQ ID NO: 44543 - DNA, 25 bp, Mus musculus
gggcactaccactgcagtggcatct

SEQ ID NO: 44544 - DNA, 25 bp, Mus musculus
gggcactcagaaggagactatcccc

SEQ ID NO: 44545 - DNA, 25 bp, Mus musculus
gggcactccttgactatgacatcac

SEQ ID NO: 44546 - DNA, 25 bp, Mus musculus
gggcactccttgtctatgacatcac

SEQ ID NO: 44547 - DNA, 25 bp, Mus musculus
gggcactgaagatgaactggacaaa

SEQ ID NO: 44548 - DNA, 25 bp, Mus musculus
gggcactgtctaatcactaataaag

SEQ ID NO: 44549 - DNA, 25 bp, Mus musculus
gggcacttaagtgcaccttctctgc

SEQ ID NO: 44550 - DNA, 25 bp, Mus musculus
gggcacttgcttttccagagcagaa

SEQ ID NO: 44551 - DNA, 25 bp, Mus musculus
gggcagaacgaattcagtgacatca

SEQ ID NO: 44552 - DNA, 25 bp, Mus musculus
gggcagaatcccttctgctgtaggc

SEQ ID NO: 44553 - DNA, 25 bp, Mus musculus
gggcagagatccttgaagtgttgca

SEQ ID NO: 44554 - DNA, 25 bp, Mus musculus
gggcagaggtgcagcagacacccaa

SEQ ID NO: 44555 - DNA, 25 bp, Mus musculus
gggcagatagcaggcaccactcgag

SEQ ID NO: 44556 - DNA, 25 bp, Mus musculus
gggcagcacggcttttccatggaga

SEQ ID NO: 44557 - DNA, 25 bp, Mus musculus
gggcagcatcagctacagccagcct

SEQ ID NO: 44558 - DNA, 25 bp, Mus musculus
gggcagcatcatcaagagcctgagg

SEQ ID NO: 44559 - DNA, 25 bp, Mus musculus
gggcagccaggagaatctggacaat

SEQ ID NO: 44560 - DNA, 25 bp, Mus musculus
gggcagccatcttcctgacctgact

SEQ ID NO: 44561 - DNA, 25 bp, Mus musculus
gggcagccgagatcacctgtttaaa

SEQ ID NO: 44562 - DNA, 25 bp, Mus musculus
gggcagcctgaacttatgatgagat

SEQ ID NO: 44563 - DNA, 25 bp, Mus musculus
gggcagcgctgtctgaacagcacca

SEQ ID NO: 44564 - DNA, 25 bp, Mus musculus
gggcagcgctgtgtgaacagcacca

SEQ ID NO: 44565 - DNA, 25 bp, Mus musculus
gggcagcggccttcataccatgggt

SEQ ID NO: 44566 - DNA, 25 bp, Mus musculus
gggcagctacctctgcacctgcagg

SEQ ID NO: 44567 - DNA, 25 bp, Mus musculus
gggcagctacctgtgcacctgcagg

SEQ ID NO: 44568 - DNA, 25 bp, Mus musculus
gggcagctatgagatgctcgtttcc

SEQ ID NO: 44569 - DNA, 25 bp, Mus musculus
gggcagctcaaattatttctgcagc

SEQ ID NO: 44570 - DNA, 25 bp, Mus musculus
gggcagctcccaatgtcttcaaaga

SEQ ID NO: 44571 - DNA, 25 bp, Mus musculus
gggcagctcttggaaagacatgtcg

SEQ ID NO: 44572 - DNA, 25 bp, Mus musculus
gggcagctgcctttgtagccaagag

SEQ ID NO: 44573 - DNA, 25 bp, Mus musculus
gggcagctggactatgctgaccatg

SEQ ID NO: 44574 - DNA, 25 bp, Mus musculus
gggcaggactgcacctactgctcac

SEQ ID NO: 44575 - DNA, 25 bp, Mus musculus
gggcaggcatccttagtctttgatg

SEQ ID NO: 44576 - DNA, 25 bp, Mus musculus
gggcaggcttcaggcagatccccaa

SEQ ID NO: 44577 - DNA, 25 bp, Mus musculus
gggcagggcagctactcctcctact

SEQ ID NO: 44578 - DNA, 25 bp, Mus musculus
gggcagggctagtcaactttctacc

SEQ ID NO: 44579 - DNA, 25 bp, Mus musculus
gggcaggtagcctttctccagtcag

SEQ ID NO: 44580 - DNA, 25 bp, Mus musculus
gggcagtaaactcttggcctcaaga

SEQ ID NO: 44581 - DNA, 25 bp, Mus musculus
gggcagtacagccaactacctaggc

SEQ ID NO: 44582 - DNA, 25 bp, Mus musculus
gggcagtcagggacgtgcctacctc

SEQ ID NO: 44583 - DNA, 25 bp, Mus musculus
gggcagttctacctggacctctatc

SEQ ID NO: 44584 - DNA, 25 bp, Mus musculus
gggcagttgaaaatatacagattaa

SEQ ID NO: 44585 - DNA, 25 bp, Mus musculus
gggcagttgaaattatacagattaa

SEQ ID NO: 44586 - DNA, 25 bp, Mus musculus
gggcagttgggagccttcccatcca

SEQ ID NO: 44587 - DNA, 25 bp, Mus musculus
gggcataactaaccccgaaggcaag

SEQ ID NO: 44588 - DNA, 25 bp, Mus musculus
gggcatactttagtgtccgaaattt

SEQ ID NO: 44589 - DNA, 25 bp, Mus musculus
gggcatagccaatcagatgctctta

SEQ ID NO: 44590 - DNA, 25 bp, Mus musculus
gggcatatcaagtttttaaccaaag

SEQ ID NO: 44591 - DNA, 25 bp, Mus musculus
gggcatatccctacccctgacaaag

SEQ ID NO: 44592 - DNA, 25 bp, Mus musculus
gggcatcccgtctccgaactgtatg

SEQ ID NO: 44593 - DNA, 25 bp, Mus musculus
gggcatcccttaggacagtccatgt

SEQ ID NO: 44594 - DNA, 25 bp, Mus musculus
gggcatcctctttggttaccgacac

SEQ ID NO: 44595 - DNA, 25 bp, Mus musculus
gggcatcctggcatgcattatgcac

SEQ ID NO: 44596 - DNA, 25 bp, Mus musculus
gggcatcgccttgttccaagggctc

SEQ ID NO: 44597 - DNA, 25 bp, Mus musculus
gggcatctacattggctccatcatg

SEQ ID NO: 44598 - DNA, 25 bp, Mus musculus
gggcatctatgaggacatgggcaaa

SEQ ID NO: 44599 - DNA, 25 bp, Mus musculus
gggcatcttcccagcagtgtttgtg

SEQ ID NO: 44600 - DNA, 25 bp, Mus musculus
gggcatcttccctgcagtgtttgtg

SEQ ID NO: 44601 - DNA, 25 bp, Mus musculus
gggcatgcagtatctaatgtatggg

SEQ ID NO: 44602 - DNA, 25 bp, Mus musculus
gggcatgcgaaagctgctcttctga

SEQ ID NO: 44603 - DNA, 25 bp, Mus musculus
gggcatggtagtcagcaccttctct

SEQ ID NO: 44604 - DNA, 25 bp, Mus musculus
gggcatggttatccacctggcctgc

SEQ ID NO: 44605 - DNA, 25 bp, Mus musculus
gggcatgttgtcaacatccttggct

SEQ ID NO: 44606 - DNA, 25 bp, Mus musculus
gggcatgttgtctacatccttggct

SEQ ID NO: 44607 - DNA, 25 bp, Mus musculus
gggcatgtttaaggaactctggaag

SEQ ID NO: 44608 - DNA, 25 bp, Mus musculus
gggcattgacatcagccctgccatg

SEQ ID NO: 44609 - DNA, 25 bp, Mus musculus
gggcattgagctggcctatcttcaa

SEQ ID NO: 44610 - DNA, 25 bp, Mus musculus
gggcattggaattcctagcaggaca

SEQ ID NO: 44611 - DNA, 25 bp, Mus musculus
gggcatttccagacagttgcatcct

SEQ ID NO: 44612 - DNA, 25 bp, Mus musculus
gggcattttagcacagcacgtacag

SEQ ID NO: 44613 - DNA, 25 bp, Mus musculus
gggccaaaagaattcgcctggaaga

SEQ ID NO: 44614 - DNA, 25 bp, Mus musculus
gggccaaagacgaacgcaagcggtt

SEQ ID NO: 44615 - DNA, 25 bp, Mus musculus
gggccaaagtcttcctcatctatga

SEQ ID NO: 44616 - DNA, 25 bp, Mus musculus
gggccaacagctacccatatacagc

SEQ ID NO: 44617 - DNA, 25 bp, Mus musculus
gggccaacagcttcccatatacagc

SEQ ID NO: 44618 - DNA, 25 bp, Mus musculus
gggccaagatgtcctgctgtttatt

SEQ ID NO: 44619 - DNA, 25 bp, Mus musculus
gggccaatccgagcctatatccttg

SEQ ID NO: 44620 - DNA, 25 bp, Mus musculus
gggccaatgccatcctgggtgtgtc

SEQ ID NO: 44621 - DNA, 25 bp, Mus musculus
gggccacaagttacattacccgatg

SEQ ID NO: 44622 - DNA, 25 bp, Mus musculus
gggccacagcctgaatgagaatgtt

SEQ ID NO: 44623 - DNA, 25 bp, Mus musculus
gggccacagcggtcatcatgctcgt

SEQ ID NO: 44624 - DNA, 25 bp, Mus musculus
gggccacagtatctagaggaagccc

SEQ ID NO: 44625 - DNA, 25 bp, Mus musculus
gggccacatccgtgcagatagagat

SEQ ID NO: 44626 - DNA, 25 bp, Mus musculus
gggccacattatcttagttccagaa

SEQ ID NO: 44627 - DNA, 25 bp, Mus musculus
gggccaccactttcttgttgatgag

SEQ ID NO: 44628 - DNA, 25 bp, Mus musculus
gggccacggataccatgaacgacgt

SEQ ID NO: 44629 - DNA, 25 bp, Mus musculus
gggccacggcatcagcgctgcactt

SEQ ID NO: 44630 - DNA, 25 bp, Mus musculus
gggccacggccaaaggccagtctga

SEQ ID NO: 44631 - DNA, 25 bp, Mus musculus
gggccacggcggtgaagtcatttca

SEQ ID NO: 44632 - DNA, 25 bp, Mus musculus
gggccacgtgtaccataaactggcg

SEQ ID NO: 44633 - DNA, 25 bp, Mus musculus
gggccactggcttggctgacaccat

SEQ ID NO: 44634 - DNA, 25 bp, Mus musculus
gggccacttggctgcgtccacactg

SEQ ID NO: 44635 - DNA, 25 bp, Mus musculus
gggccagaacaatgactcgggagtt

SEQ ID NO: 44636 - DNA, 25 bp, Mus musculus
gggccagagagttcaccacaagtaa

SEQ ID NO: 44637 - DNA, 25 bp, Mus musculus
gggccagagtgacctcaactgcctt

SEQ ID NO: 44638 - DNA, 25 bp, Mus musculus
gggccagatgcatttcgctttgaga

SEQ ID NO: 44639 - DNA, 25 bp, Mus musculus
gggccagatggaagccatcccctgc

SEQ ID NO: 44640 - DNA, 25 bp, Mus musculus
gggccagcatgcatcttccttcgac

SEQ ID NO: 44641 - DNA, 25 bp, Mus musculus
gggccagccacaatctagaagtggt

SEQ ID NO: 44642 - DNA, 25 bp, Mus musculus
gggccagccacattctagaagtggt

SEQ ID NO: 44643 - DNA, 25 bp, Mus musculus
gggccaggcagcttcttctcgagag

SEQ ID NO: 44644 - DNA, 25 bp, Mus musculus
gggccaggctggaactacgcaatcg

SEQ ID NO: 44645 - DNA, 25 bp, Mus musculus
gggccaggtcataggtttcatcagc

SEQ ID NO: 44646 - DNA, 25 bp, Mus musculus
gggccagttccataagcagattgct

SEQ ID NO: 44647 - DNA, 25 bp, Mus musculus
gggccagttgaccttcaacatggag

SEQ ID NO: 44648 - DNA, 25 bp, Mus musculus
gggccagttggcttggataaaatgt

SEQ ID NO: 44649 - DNA, 25 bp, Mus musculus
gggccatacacttgtggaatctgct

SEQ ID NO: 44650 - DNA, 25 bp, Mus musculus
gggccatcttctcaacactttctgt

SEQ ID NO: 44651 - DNA, 25 bp, Mus musculus
gggccattgttttgaagaacacctg

SEQ ID NO: 44652 - DNA, 25 bp, Mus musculus
gggcccaacacgtacattctctgta

SEQ ID NO: 44653 - DNA, 25 bp, Mus musculus
gggcccaacagtggatctgccatta

SEQ ID NO: 44654 - DNA, 25 bp, Mus musculus
gggcccaggcctgggaacctgttct

SEQ ID NO: 44655 - DNA, 25 bp, Mus musculus
gggcccatgtccctgatgctgctaa

SEQ ID NO: 44656 - DNA, 25 bp, Mus musculus
gggcccatgtgacgtcatgttccaa

SEQ ID NO: 44657 - DNA, 25 bp, Mus musculus
gggcccatgtggatgctcagacaaa

SEQ ID NO: 44658 - DNA, 25 bp, Mus musculus
gggccccagtcttccactcttggag

SEQ ID NO: 44659 - DNA, 25 bp, Mus musculus
gggccccatatctcagccctggaat

SEQ ID NO: 44660 - DNA, 25 bp, Mus musculus
gggcccctacctatggttttacatg

SEQ ID NO: 44661 - DNA, 25 bp, Mus musculus
gggcccctcaccaggaattactacg

SEQ ID NO: 44662 - DNA, 25 bp, Mus musculus
gggcccctggatcacaggactcaag

SEQ ID NO: 44663 - DNA, 25 bp, Mus musculus
gggccccttagtaacatccatggaa

SEQ ID NO: 44664 - DNA, 25 bp, Mus musculus
gggcccgtgcttccaatctcctgta

SEQ ID NO: 44665 - DNA, 25 bp, Mus musculus
gggccctaacctctaagccttatgc

SEQ ID NO: 44666 - DNA, 25 bp, Mus musculus
gggccctaaggcaggatgatagaca

SEQ ID NO: 44667 - DNA, 25 bp, Mus musculus
gggccctagctactggtgtcagaac

SEQ ID NO: 44668 - DNA, 25 bp, Mus musculus
gggccctatcacttcaacgtcctgg

SEQ ID NO: 44669 - DNA, 25 bp, Mus musculus
gggccctcaagtgtctcagctgtca

SEQ ID NO: 44670 - DNA, 25 bp, Mus musculus
gggccctgacattagagtcaattga

SEQ ID NO: 44671 - DNA, 25 bp, Mus musculus
gggccctgtctcatcatatgggccg

SEQ ID NO: 44672 - DNA, 25 bp, Mus musculus
gggccctgtgctgctccactacaga

SEQ ID NO: 44673 - DNA, 25 bp, Mus musculus
gggccgaggcatagataagaccaat

SEQ ID NO: 44674 - DNA, 25 bp, Mus musculus
gggccgagtagccaagctcttaagc

SEQ ID NO: 44675 - DNA, 25 bp, Mus musculus
gggccgatcaacagtgctaatcgag

SEQ ID NO: 44676 - DNA, 25 bp, Mus musculus
gggccgcaccgtcactgccgttatt

SEQ ID NO: 44677 - DNA, 25 bp, Mus musculus
gggccgcagtttttctcatgatcga

SEQ ID NO: 44678 - DNA, 25 bp, Mus musculus
gggccgccatgttccagaagcacat

SEQ ID NO: 44679 - DNA, 25 bp, Mus musculus
gggccgcctttgtctacctggctga

SEQ ID NO: 44680 - DNA, 25 bp, Mus musculus
gggccgcggagaagtccattactat

SEQ ID NO: 44681 - DNA, 25 bp, Mus musculus
gggccggaagcagaacctgcgttta

SEQ ID NO: 44682 - DNA, 25 bp, Mus musculus
gggccgtcatcatagccagcgaaga

SEQ ID NO: 44683 - DNA, 25 bp, Mus musculus
gggcctaagtcctccagttgtgaga

SEQ ID NO: 44684 - DNA, 25 bp, Mus musculus
gggcctaatagcaaacagtctattt

SEQ ID NO: 44685 - DNA, 25 bp, Mus musculus
gggcctacgctcttactatgagacc

SEQ ID NO: 44686 - DNA, 25 bp, Mus musculus
gggcctatagagatcacatatcgag

SEQ ID NO: 44687 - DNA, 25 bp, Mus musculus
gggcctatgatgtatggcaagctgc

SEQ ID NO: 44688 - DNA, 25 bp, Mus musculus
gggcctatttctgttgctatggacg

SEQ ID NO: 44689 - DNA, 25 bp, Mus musculus
gggcctcagcccttcacttcgaaag

SEQ ID NO: 44690 - DNA, 25 bp, Mus musculus
gggcctcagtgtatccgtgtctaac

SEQ ID NO: 44691 - DNA, 25 bp, Mus musculus
gggcctcagttctaggtgacaagct

SEQ ID NO: 44692 - DNA, 25 bp, Mus musculus
gggcctcatcttggatatttgtgat

SEQ ID NO: 44693 - DNA, 25 bp, Mus musculus
gggcctcattgacattctgacacag

SEQ ID NO: 44694 - DNA, 25 bp, Mus musculus
gggcctccatctggactggagccaa

SEQ ID NO: 44695 - DNA, 25 bp, Mus musculus
gggcctccggcttctgctacgctgt

SEQ ID NO: 44696 - DNA, 25 bp, Mus musculus
gggcctcctacaagacggtcagatt

SEQ ID NO: 44697 - DNA, 25 bp, Mus musculus
gggcctcctgataaccccggctttg

SEQ ID NO: 44698 - DNA, 25 bp, Mus musculus
gggcctctcaccttctaattataat

SEQ ID NO: 44699 - DNA, 25 bp, Mus musculus
gggcctctgccgcatcatgggcaat

SEQ ID NO: 44700 - DNA, 25 bp, Mus musculus
gggcctctggatcctcaacatggat

SEQ ID NO: 44701 - DNA, 25 bp, Mus musculus
gggcctctggccttgaaaatcgctg

SEQ ID NO: 44702 - DNA, 25 bp, Mus musculus
gggcctgctattcccctgagttcaa

SEQ ID NO: 44703 - DNA, 25 bp, Mus musculus
gggcctgggccaccacgcattttgc

SEQ ID NO: 44704 - DNA, 25 bp, Mus musculus
gggcctgtccttcctctgggtagcc

SEQ ID NO: 44705 - DNA, 25 bp, Mus musculus
gggccttcaagtaacaccactatgg

SEQ ID NO: 44706 - DNA, 25 bp, Mus musculus
gggccttcaccaataccctaagaag

SEQ ID NO: 44707 - DNA, 25 bp, Mus musculus
gggccttcaccattaccctaagaag

SEQ ID NO: 44708 - DNA, 25 bp, Mus musculus
gggccttcatcattgccgtcattta

SEQ ID NO: 44709 - DNA, 25 bp, Mus musculus
gggccttcatgatcccattcctcat

SEQ ID NO: 44710 - DNA, 25 bp, Mus musculus
gggccttcctgatccgagagagcga

SEQ ID NO: 44711 - DNA, 25 bp, Mus musculus
gggccttcctgtccggaaccttcat

SEQ ID NO: 44712 - DNA, 25 bp, Mus musculus
gggccttctgtatgttcagcaaaga

SEQ ID NO: 44713 - DNA, 25 bp, Mus musculus
gggcctttggactatgagcagcaga

SEQ ID NO: 44714 - DNA, 25 bp, Mus musculus
gggcgaatccccatccgcctggaga

SEQ ID NO: 44715 - DNA, 25 bp, Mus musculus
gggcgacagctcagtgaagtcttca

SEQ ID NO: 44716 - DNA, 25 bp, Mus musculus
gggcgaccaacaggccaattggact

SEQ ID NO: 44717 - DNA, 25 bp, Mus musculus
gggcgacctttaccataggatgaag

SEQ ID NO: 44718 - DNA, 25 bp, Mus musculus
gggcgcaaacccagaaaccagctgg

SEQ ID NO: 44719 - DNA, 25 bp, Mus musculus
gggcgcacacaaccaccttatttcg

SEQ ID NO: 44720 - DNA, 25 bp, Mus musculus
gggcgcacatctccagactctttag

SEQ ID NO: 44721 - DNA, 25 bp, Mus musculus
gggcgcacatctgcagactctttag

SEQ ID NO: 44722 - DNA, 25 bp, Mus musculus
gggcgcagtaccagcctcagcgacg

SEQ ID NO: 44723 - DNA, 25 bp, Mus musculus
gggcgcagtacctgcctcagcgacg

SEQ ID NO: 44724 - DNA, 25 bp, Mus musculus
gggcgcatcaccaagtggaagtatc

SEQ ID NO: 44725 - DNA, 25 bp, Mus musculus
gggcgccattgctgattcacagatt

SEQ ID NO: 44726 - DNA, 25 bp, Mus musculus
gggcgctttgttgaattctactact

SEQ ID NO: 44727 - DNA, 25 bp, Mus musculus
gggcggactgagacaatcctgcaga

SEQ ID NO: 44728 - DNA, 25 bp, Mus musculus
gggcggactgagtcaatcctgcaga

SEQ ID NO: 44729 - DNA, 25 bp, Mus musculus
gggcgtagatctgctaaaatttgat

SEQ ID NO: 44730 - DNA, 25 bp, Mus musculus
gggcgtagtccatcgggacctaaag

SEQ ID NO: 44731 - DNA, 25 bp, Mus musculus
gggcgtccaaagaagctatatcagc

SEQ ID NO: 44732 - DNA, 25 bp, Mus musculus
gggcgtcggcaaaacctgtttcctg

SEQ ID NO: 44733 - DNA, 25 bp, Mus musculus
gggcgtcgtcgtccgatcccaactt

SEQ ID NO: 44734 - DNA, 25 bp, Mus musculus
gggcgtcgtcgtgcgatcccaactt

SEQ ID NO: 44735 - DNA, 25 bp, Mus musculus
gggcgtgatatgcacccaggcccac

SEQ ID NO: 44736 - DNA, 25 bp, Mus musculus
gggctaaactctcaggcaagccaag

SEQ ID NO: 44737 - DNA, 25 bp, Mus musculus
gggctaacccagacaacgtgaccct

SEQ ID NO: 44738 - DNA, 25 bp, Mus musculus
gggctaataggcctcattggtcccc

SEQ ID NO: 44739 - DNA, 25 bp, Mus musculus
gggctaatcaaccatggttacatgg

SEQ ID NO: 44740 - DNA, 25 bp, Mus musculus
gggctacaagatcctggcagcctgc

SEQ ID NO: 44741 - DNA, 25 bp, Mus musculus
gggctacatcaagcctcatgttgac

SEQ ID NO: 44742 - DNA, 25 bp, Mus musculus
gggctaccctatccccttggatctg

SEQ ID NO: 44743 - DNA, 25 bp, Mus musculus
gggctacctgattcttgaagaagac

SEQ ID NO: 44744 - DNA, 25 bp, Mus musculus
gggctacctgcatctcatctgcaca

SEQ ID NO: 44745 - DNA, 25 bp, Mus musculus
gggctacgtgactctcctagaagaa

SEQ ID NO: 44746 - DNA, 25 bp, Mus musculus
gggctactgcatccccaacaaggac

SEQ ID NO: 44747 - DNA, 25 bp, Mus musculus
gggctactggattgaaggcaccaac

SEQ ID NO: 44748 - DNA, 25 bp, Mus musculus
gggctactggtttgtcctcactgca

SEQ ID NO: 44749 - DNA, 25 bp, Mus musculus
gggctagacatcatcaccaataagg

SEQ ID NO: 44750 - DNA, 25 bp, Mus musculus
gggctagtcaactttctacccacct

SEQ ID NO: 44751 - DNA, 25 bp, Mus musculus
gggctataggtatgcctggcttgac

SEQ ID NO: 44752 - DNA, 25 bp, Mus musculus
gggctatcacacagtccttcaaggg

SEQ ID NO: 44753 - DNA, 25 bp, Mus musculus
gggctatgggtcatcgctggcttcc

SEQ ID NO: 44754 - DNA, 25 bp, Mus musculus
gggctatgtaaacccggatctgcta

SEQ ID NO: 44755 - DNA, 25 bp, Mus musculus
gggctatttgatcgtgccaccttag

SEQ ID NO: 44756 - DNA, 25 bp, Mus musculus
gggctatttgatggtgccaccttag

SEQ ID NO: 44757 - DNA, 25 bp, Mus musculus
gggctcaatttgtgcactgggacag

SEQ ID NO: 44758 - DNA, 25 bp, Mus musculus
gggctcacaacatcaaggctaagga

SEQ ID NO: 44759 - DNA, 25 bp, Mus musculus
gggctcacatcacaactgcttcagt

SEQ ID NO: 44760 - DNA, 25 bp, Mus musculus
gggctcacgaagttaacctccagga

SEQ ID NO: 44761 - DNA, 25 bp, Mus musculus
gggctcagatgacagaccgtcacgg

SEQ ID NO: 44762 - DNA, 25 bp, Mus musculus
gggctcaggacatccgaagaaacct

SEQ ID NO: 44763 - DNA, 25 bp, Mus musculus
gggctcaggtagaagcaaaagctaa

SEQ ID NO: 44764 - DNA, 25 bp, Mus musculus
gggctcagtaaatctccctccatgg

SEQ ID NO: 44765 - DNA, 25 bp, Mus musculus
gggctcatcttaatgcctacagcac

SEQ ID NO: 44766 - DNA, 25 bp, Mus musculus
gggctccacccgatcatctctgggt

SEQ ID NO: 44767 - DNA, 25 bp, Mus musculus
gggctcccagggaatatcagtgatc

SEQ ID NO: 44768 - DNA, 25 bp, Mus musculus
gggctcccagggtatatcagtgatc

SEQ ID NO: 44769 - DNA, 25 bp, Mus musculus
gggctccctcagtaccgtagttact

SEQ ID NO: 44770 - DNA, 25 bp, Mus musculus
gggctcccttctataactacctagg

SEQ ID NO: 44771 - DNA, 25 bp, Mus musculus
gggctcccttctttaactacctagg

SEQ ID NO: 44772 - DNA, 25 bp, Mus musculus
gggctccgtacgcaaggaagacatt

SEQ ID NO: 44773 - DNA, 25 bp, Mus musculus
gggctcctctgatgaccacggctct

SEQ ID NO: 44774 - DNA, 25 bp, Mus musculus
gggctcgcctgttcagagtaaagtg

SEQ ID NO: 44775 - DNA, 25 bp, Mus musculus
gggctctatctggtcagcttcattt

SEQ ID NO: 44776 - DNA, 25 bp, Mus musculus
gggctctccaacatcgctttcaact

SEQ ID NO: 44777 - DNA, 25 bp, Mus musculus
gggctctctgacacacagtcgcagg

SEQ ID NO: 44778 - DNA, 25 bp, Mus musculus
gggctctgactacagctacgacagc

SEQ ID NO: 44779 - DNA, 25 bp, Mus musculus
gggctctgagaagctctttgccccg

SEQ ID NO: 44780 - DNA, 25 bp, Mus musculus
gggctctgcaacatctgcacttgga

SEQ ID NO: 44781 - DNA, 25 bp, Mus musculus
gggctctgcaattggtcaggtttaa

SEQ ID NO: 44782 - DNA, 25 bp, Mus musculus
gggctctgcatcctctgctgtgtca

SEQ ID NO: 44783 - DNA, 25 bp, Mus musculus
gggctctggacgaccatcaccatct

SEQ ID NO: 44784 - DNA, 25 bp, Mus musculus
gggctcttgtcatcctttggagaat

SEQ ID NO: 44785 - DNA, 25 bp, Mus musculus
gggctctttactatctggctgcttt

SEQ ID NO: 44786 - DNA, 25 bp, Mus musculus
gggctgaacttttgcatctggaaag

SEQ ID NO: 44787 - DNA, 25 bp, Mus musculus
gggctgaagagctgattgctgcctt

SEQ ID NO: 44788 - DNA, 25 bp, Mus musculus
gggctgaagctactaatttggaaga

SEQ ID NO: 44789 - DNA, 25 bp, Mus musculus
gggctgaagtttaaccatctcaata

SEQ ID NO: 44790 - DNA, 25 bp, Mus musculus
gggctgaatccgagaaacctaaccg

SEQ ID NO: 44791 - DNA, 25 bp, Mus musculus
gggctgaatggtaacctatccccag

SEQ ID NO: 44792 - DNA, 25 bp, Mus musculus
gggctgacgtgaacatcaaggacaa

SEQ ID NO: 44793 - DNA, 25 bp, Mus musculus
gggctgataaactcccatggaatta

SEQ ID NO: 44794 - DNA, 25 bp, Mus musculus
gggctgcacccttcaacaactggat

SEQ ID NO: 44795 - DNA, 25 bp, Mus musculus
gggctgcccctctgcgatgttgtca

SEQ ID NO: 44796 - DNA, 25 bp, Mus musculus
gggctgccctgcgtgactacgagac

SEQ ID NO: 44797 - DNA, 25 bp, Mus musculus
gggctgcctgactgcttcgacaaga

SEQ ID NO: 44798 - DNA, 25 bp, Mus musculus
gggctgctaacaacttttatgtatg

SEQ ID NO: 44799 - DNA, 25 bp, Mus musculus
gggctgctatgtcgcctcacttgct

SEQ ID NO: 44800 - DNA, 25 bp, Mus musculus
gggctgctcatagttcttgctaacg

SEQ ID NO: 44801 - DNA, 25 bp, Mus musculus
gggctgctctcttcatcggatgggc

SEQ ID NO: 44802 - DNA, 25 bp, Mus musculus
gggctgcttattatgctcactatta

SEQ ID NO: 44803 - DNA, 25 bp, Mus musculus
gggctgcttgagtaccaacaccacc

SEQ ID NO: 44804 - DNA, 25 bp, Mus musculus
gggctggaatatcttgacaaactcg

SEQ ID NO: 44805 - DNA, 25 bp, Mus musculus
gggctggatcgaatcatcagggtct

SEQ ID NO: 44806 - DNA, 25 bp, Mus musculus
gggctggcatttatccataaacacg

SEQ ID NO: 44807 - DNA, 25 bp, Mus musculus
gggctggccactccagtgcctattc

SEQ ID NO: 44808 - DNA, 25 bp, Mus musculus
gggctggccctacaaatcttagaac

SEQ ID NO: 44809 - DNA, 25 bp, Mus musculus
gggctggccctagaaatcttagaac

SEQ ID NO: 44810 - DNA, 25 bp, Mus musculus
gggctggtcattctatgcattatcc

SEQ ID NO: 44811 - DNA, 25 bp, Mus musculus
gggctggtgagagccgcccagagca

SEQ ID NO: 44812 - DNA, 25 bp, Mus musculus
gggctggtggcatgttgtcctcaac

SEQ ID NO: 44813 - DNA, 25 bp, Mus musculus
gggctggttgaccatcaacaatatc

SEQ ID NO: 44814 - DNA, 25 bp, Mus musculus
gggctgtaaacagaggagccaacag

SEQ ID NO: 44815 - DNA, 25 bp, Mus musculus
gggctgtacatgctcttcctgcttg

SEQ ID NO: 44816 - DNA, 25 bp, Mus musculus
gggctgtcattctgaaattcagtct

SEQ ID NO: 44817 - DNA, 25 bp, Mus musculus
gggctgtctgttcactctgcccaga

SEQ ID NO: 44818 - DNA, 25 bp, Mus musculus
gggctgtctgttgactctgcccaga

SEQ ID NO: 44819 - DNA, 25 bp, Mus musculus
gggctgtgacccgtatgggcatata

SEQ ID NO: 44820 - DNA, 25 bp, Mus musculus
gggctgtgccatccataattctgta

SEQ ID NO: 44821 - DNA, 25 bp, Mus musculus
gggctgttaaatggttgattctgga

SEQ ID NO: 44822 - DNA, 25 bp, Mus musculus
gggcttaagacccacgggctacact

SEQ ID NO: 44823 - DNA, 25 bp, Mus musculus
gggcttagtccttggctctcaggac

SEQ ID NO: 44824 - DNA, 25 bp, Mus musculus
gggcttatttagtgccaatgattgg

SEQ ID NO: 44825 - DNA, 25 bp, Mus musculus
gggcttcactgacgatcacaaacag

SEQ ID NO: 44826 - DNA, 25 bp, Mus musculus
gggcttcagagaagcctcccttcca

SEQ ID NO: 44827 - DNA, 25 bp, Mus musculus
gggcttcatctgacagacccaagtc

SEQ ID NO: 44828 - DNA, 25 bp, Mus musculus
gggcttccacctagtactgatttca

SEQ ID NO: 44829 - DNA, 25 bp, Mus musculus
gggcttccattagacgcagcagtga

SEQ ID NO: 44830 - DNA, 25 bp, Mus musculus
gggcttcggagcctttgccttcttc

SEQ ID NO: 44831 - DNA, 25 bp, Mus musculus
gggcttctcagtggcagtctgttag

SEQ ID NO: 44832 - DNA, 25 bp, Mus musculus
gggcttcttccctgtgcgctgttgc

SEQ ID NO: 44833 - DNA, 25 bp, Mus musculus
gggcttgagttgctctttccagatg

SEQ ID NO: 44834 - DNA, 25 bp, Mus musculus
gggcttgctagaactcaagtccatg

SEQ ID NO: 44835 - DNA, 25 bp, Mus musculus
gggcttgtccaagaataagctgaag

SEQ ID NO: 44836 - DNA, 25 bp, Mus musculus
gggcttgtccccaggtttgctgtac

SEQ ID NO: 44837 - DNA, 25 bp, Mus musculus
gggcttgttccgtcaggccatgtct

SEQ ID NO: 44838 - DNA, 25 bp, Mus musculus
gggctttatagatcagaatttcagt

SEQ ID NO: 44839 - DNA, 25 bp, Mus musculus
gggctttctataacaatgtccttgg

SEQ ID NO: 44840 - DNA, 25 bp, Mus musculus
gggctttctatacagttgacaagga

SEQ ID NO: 44841 - DNA, 25 bp, Mus musculus
gggctttctccgagttgtatcagcg

SEQ ID NO: 44842 - DNA, 25 bp, Mus musculus
gggctttgcttgtctgctattgaga

SEQ ID NO: 44843 - DNA, 25 bp, Mus musculus
gggctttggagatcctctctcacct

SEQ ID NO: 44844 - DNA, 25 bp, Mus musculus
gggctttggtttgagagcaacaaga

SEQ ID NO: 44845 - DNA, 25 bp, Mus musculus
gggctttgtctgttgctgcctctgc

SEQ ID NO: 44846 - DNA, 25 bp, Mus musculus
gggctttgtgcaccctcggttgctc

SEQ ID NO: 44847 - DNA, 25 bp, Mus musculus
ggggagacccagcaaaagaaaagct

SEQ ID NO: 44848 - DNA, 25 bp, Mus musculus
gggggccacacaggctaagctccag

SEQ ID NO: 44849 - DNA, 25 bp, Mus musculus
gggtaaagaatctcctgatatgact

SEQ ID NO: 44850 - DNA, 25 bp, Mus musculus
gggtaacctcctgcaggacatcgtc

SEQ ID NO: 44851 - DNA, 25 bp, Mus musculus
gggtaactatccatcatggcacaga

SEQ ID NO: 44852 - DNA, 25 bp, Mus musculus
gggtaactctatcggactctcccat

SEQ ID NO: 44853 - DNA, 25 bp, Mus musculus
gggtaatcgaggagtacctagcttt

SEQ ID NO: 44854 - DNA, 25 bp, Mus musculus
gggtaatgcatttaaaagggcagta

SEQ ID NO: 44855 - DNA, 25 bp, Mus musculus
gggtaattagtgatggctctgagtt

SEQ ID NO: 44856 - DNA, 25 bp, Mus musculus
gggtacacagactagctctccacac

SEQ ID NO: 44857 - DNA, 25 bp, Mus musculus
gggtacactcggtttatcctgatag

SEQ ID NO: 44858 - DNA, 25 bp, Mus musculus
gggtacatcctatagaaactgactg

SEQ ID NO: 44859 - DNA, 25 bp, Mus musculus
gggtacatgttcatatggaatggtg

SEQ ID NO: 44860 - DNA, 25 bp, Mus musculus
gggtaccagaccatggtcaccctct

SEQ ID NO: 44861 - DNA, 25 bp, Mus musculus
gggtacccagtcagaaactgaggcc

SEQ ID NO: 44862 - DNA, 25 bp, Mus musculus
gggtaccgcttgacaactgtacttg

SEQ ID NO: 44863 - DNA, 25 bp, Mus musculus
gggtaccgcttgtcaactgtacttg

SEQ ID NO: 44864 - DNA, 25 bp, Mus musculus
gggtacctccactctgctagtctgg

SEQ ID NO: 44865 - DNA, 25 bp, Mus musculus
gggtactcctaggacttttatacag

SEQ ID NO: 44866 - DNA, 25 bp, Mus musculus
gggtagaactcactgccacccgtaa

SEQ ID NO: 44867 - DNA, 25 bp, Mus musculus
gggtagagctcctgcacctgaacaa

SEQ ID NO: 44868 - DNA, 25 bp, Mus musculus
gggtagctcacacacatctccttta

SEQ ID NO: 44869 - DNA, 25 bp, Mus musculus
gggtagttttccgaagatacactga

SEQ ID NO: 44870 - DNA, 25 bp, Mus musculus
gggtatatgggcatagccaatcaga

SEQ ID NO: 44871 - DNA, 25 bp, Mus musculus
gggtatcaatcttgccctggagcca

SEQ ID NO: 44872 - DNA, 25 bp, Mus musculus
gggtatcagaaccttcccaacactg

SEQ ID NO: 44873 - DNA, 25 bp, Mus musculus
gggtatcagtgcttcgtgagcttct

SEQ ID NO: 44874 - DNA, 25 bp, Mus musculus
gggtatcatggcctactcatcagct

SEQ ID NO: 44875 - DNA, 25 bp, Mus musculus
gggtatcctgctgaacgccaactgg

SEQ ID NO: 44876 - DNA, 25 bp, Mus musculus
gggtatcttcatcaagtacaaggag

SEQ ID NO: 44877 - DNA, 25 bp, Mus musculus
gggtatgacctacagtcagaccgaa

SEQ ID NO: 44878 - DNA, 25 bp, Mus musculus
gggtatggacccatcatttctagtc

SEQ ID NO: 44879 - DNA, 25 bp, Mus musculus
gggtattgtgcaccctccttctctc

SEQ ID NO: 44880 - DNA, 25 bp, Mus musculus
gggtattttgtgattcagacctatc

SEQ ID NO: 44881 - DNA, 25 bp, Mus musculus
gggtcaacaagcagctgcatctggt

SEQ ID NO: 44882 - DNA, 25 bp, Mus musculus
gggtcaacaggacaaacctctgcga

SEQ ID NO: 44883 - DNA, 25 bp, Mus musculus
gggtcaacttcttcggcttactcaa

SEQ ID NO: 44884 - DNA, 25 bp, Mus musculus
gggtcaagtcatctgcagttttgca

SEQ ID NO: 44885 - DNA, 25 bp, Mus musculus
gggtcaagtcatgtgcagttttgca

SEQ ID NO: 44886 - DNA, 25 bp, Mus musculus
gggtcacacgttacatgctgctcta

SEQ ID NO: 44887 - DNA, 25 bp, Mus musculus
gggtcacaggtgacgcccaactgtt

SEQ ID NO: 44888 - DNA, 25 bp, Mus musculus
gggtcacatctgtgcctgatatcag

SEQ ID NO: 44889 - DNA, 25 bp, Mus musculus
gggtcaccacattgcaaaacttgat

SEQ ID NO: 44890 - DNA, 25 bp, Mus musculus
gggtcaccagcacaacgaaaactac

SEQ ID NO: 44891 - DNA, 25 bp, Mus musculus
gggtcacccaggacttcggcacggc

SEQ ID NO: 44892 - DNA, 25 bp, Mus musculus
gggtcacccctctaaagatagcttc

SEQ ID NO: 44893 - DNA, 25 bp, Mus musculus
gggtcactctcagacgacgctgcat

SEQ ID NO: 44894 - DNA, 25 bp, Mus musculus
gggtcactgcggctcaagccgtaca

SEQ ID NO: 44895 - DNA, 25 bp, Mus musculus
gggtcactgtgtgaacacccggctg

SEQ ID NO: 44896 - DNA, 25 bp, Mus musculus
gggtcacttacctccctgtgcagaa

SEQ ID NO: 44897 - DNA, 25 bp, Mus musculus
gggtcagaatgttaccaaaagagcc

SEQ ID NO: 44898 - DNA, 25 bp, Mus musculus
gggtcagatctccaactacgtggca

SEQ ID NO: 44899 - DNA, 25 bp, Mus musculus
gggtcagtgatccagccagctttgc

SEQ ID NO: 44900 - DNA, 25 bp, Mus musculus
gggtcatcaaggacaagtatggcaa

SEQ ID NO: 44901 - DNA, 25 bp, Mus musculus
gggtcatggaaaatctcccgaggag

SEQ ID NO: 44902 - DNA, 25 bp, Mus musculus
gggtcatggtcactgcaagtgtatc

SEQ ID NO: 44903 - DNA, 25 bp, Mus musculus
gggtcatttttgctaccgccgccgc

SEQ ID NO: 44904 - DNA, 25 bp, Mus musculus
gggtccaaatgtgatctcaacggga

SEQ ID NO: 44905 - DNA, 25 bp, Mus musculus
gggtccaacttctttgctccgctgc

SEQ ID NO: 44906 - DNA, 25 bp, Mus musculus
gggtccacatgcatggcgtctaatg

SEQ ID NO: 44907 - DNA, 25 bp, Mus musculus
gggtccaccataagtacaacagtga

SEQ ID NO: 44908 - DNA, 25 bp, Mus musculus
gggtccactaagactctcacctttg

SEQ ID NO: 44909 - DNA, 25 bp, Mus musculus
gggtccaggtcagcaatcaatcttt

SEQ ID NO: 44910 - DNA, 25 bp, Mus musculus
gggtccatttaaacacacggttgat

SEQ ID NO: 44911 - DNA, 25 bp, Mus musculus
gggtcccactgtacacacagaagga

SEQ ID NO: 44912 - DNA, 25 bp, Mus musculus
gggtcccacttcaaaagatctggat

SEQ ID NO: 44913 - DNA, 25 bp, Mus musculus
gggtccccatctcagtcacgggcat

SEQ ID NO: 44914 - DNA, 25 bp, Mus musculus
gggtcccctactcttggaaccagca

SEQ ID NO: 44915 - DNA, 25 bp, Mus musculus
gggtcccgagacaagaccataaagt

SEQ ID NO: 44916 - DNA, 25 bp, Mus musculus
gggtcccttcaccatcatgattcag

SEQ ID NO: 44917 - DNA, 25 bp, Mus musculus
gggtccgcctcactaactgttgtga

SEQ ID NO: 44918 - DNA, 25 bp, Mus musculus
gggtcctagtggaacaatgccccaa

SEQ ID NO: 44919 - DNA, 25 bp, Mus musculus
gggtcctatctaaggaagcctttga

SEQ ID NO: 44920 - DNA, 25 bp, Mus musculus
gggtcctcaaagatggcttcaccta

SEQ ID NO: 44921 - DNA, 25 bp, Mus musculus
gggtcctctgcttgccagtgctgaa

SEQ ID NO: 44922 - DNA, 25 bp, Mus musculus
gggtcctctgtgaacttgctcagga

SEQ ID NO: 44923 - DNA, 25 bp, Mus musculus
gggtcctgacctactggttcatctt

SEQ ID NO: 44924 - DNA, 25 bp, Mus musculus
gggtcctggacttggatgacttcaa

SEQ ID NO: 44925 - DNA, 25 bp, Mus musculus
gggtcctggattgaatcaaatggag

SEQ ID NO: 44926 - DNA, 25 bp, Mus musculus
gggtccttcctaactgatagcagct

SEQ ID NO: 44927 - DNA, 25 bp, Mus musculus
gggtcctttgactcaatcacaccta

SEQ ID NO: 44928 - DNA, 25 bp, Mus musculus
gggtcctttgccaacagcagctcag

SEQ ID NO: 44929 - DNA, 25 bp, Mus musculus
gggtcgaacactatctgcaatctcc

SEQ ID NO: 44930 - DNA, 25 bp, Mus musculus
gggtcgactcctgctgtcactagag

SEQ ID NO: 44931 - DNA, 25 bp, Mus musculus
gggtcgattgtcaatatcattgtcc

SEQ ID NO: 44932 - DNA, 25 bp, Mus musculus
gggtcgcatccctggcagtttgagt

SEQ ID NO: 44933 - DNA, 25 bp, Mus musculus
gggtcgcattcacctcttgccagat

SEQ ID NO: 44934 - DNA, 25 bp, Mus musculus
gggtcggataacagattccaatata

SEQ ID NO: 44935 - DNA, 25 bp, Mus musculus
gggtcgtctactgaagctggcaagt

SEQ ID NO: 44936 - DNA, 25 bp, Mus musculus
gggtctaattaaggcctacctatct

SEQ ID NO: 44937 - DNA, 25 bp, Mus musculus
gggtctacaccaatcctagcggcat

SEQ ID NO: 44938 - DNA, 25 bp, Mus musculus
gggtctaccctaccctcatggagcc

SEQ ID NO: 44939 - DNA, 25 bp, Mus musculus
gggtctacgggcactgtctaatcac

SEQ ID NO: 44940 - DNA, 25 bp, Mus musculus
gggtctataggcctcatccttctca

SEQ ID NO: 44941 - DNA, 25 bp, Mus musculus
gggtctccgagtatgagttgccaga

SEQ ID NO: 44942 - DNA, 25 bp, Mus musculus
gggtctcctcacactggcttggttc

SEQ ID NO: 44943 - DNA, 25 bp, Mus musculus
gggtctctccacattgtccagacat

SEQ ID NO: 44944 - DNA, 25 bp, Mus musculus
gggtctgaacacactcctagaaggg

SEQ ID NO: 44945 - DNA, 25 bp, Mus musculus
gggtctgctgagtccgcagcactca

SEQ ID NO: 44946 - DNA, 25 bp, Mus musculus
gggtctggaaaaagaggctttaatt

SEQ ID NO: 44947 - DNA, 25 bp, Mus musculus
gggtctggaaaatgaggctttaatt

SEQ ID NO: 44948 - DNA, 25 bp, Mus musculus
gggtctggcctcctcacttgtgcct

SEQ ID NO: 44949 - DNA, 25 bp, Mus musculus
gggtctgtatgaagcagcacaagaa

SEQ ID NO: 44950 - DNA, 25 bp, Mus musculus
gggtctgtttcctgccatacactgg

SEQ ID NO: 44951 - DNA, 25 bp, Mus musculus
gggtcttcttaatcgcctgcatggt

SEQ ID NO: 44952 - DNA, 25 bp, Mus musculus
gggtcttggagagtcatgcaaaacc

SEQ ID NO: 44953 - DNA, 25 bp, Mus musculus
gggtcttgtttgagaaccagctgct

SEQ ID NO: 44954 - DNA, 25 bp, Mus musculus
gggtctttgcctagatgcagtcgtt

SEQ ID NO: 44955 - DNA, 25 bp, Mus musculus
gggtgaagcgctgttcctgacactc

SEQ ID NO: 44956 - DNA, 25 bp, Mus musculus
gggtgaatcggcacttccacatgat

SEQ ID NO: 44957 - DNA, 25 bp, Mus musculus
gggtgaatgtgatcgccatggtcac

SEQ ID NO: 44958 - DNA, 25 bp, Mus musculus
gggtgacaccaccaccttgtacagt

SEQ ID NO: 44959 - DNA, 25 bp, Mus musculus
gggtgacaccacgaccttgtacagt

SEQ ID NO: 44960 - DNA, 25 bp, Mus musculus
gggtgactgtgggtgatacctccct

SEQ ID NO: 44961 - DNA, 25 bp, Mus musculus
gggtgagaacagtttgcttccagcc

SEQ ID NO: 44962 - DNA, 25 bp, Mus musculus
gggtgagcatcttctctatttccag

SEQ ID NO: 44963 - DNA, 25 bp, Mus musculus
gggtgataacgatagcatttttcaa

SEQ ID NO: 44964 - DNA, 25 bp, Mus musculus
gggtgatcccaactgtgtcactatc

SEQ ID NO: 44965 - DNA, 25 bp, Mus musculus
gggtgatccgcagggattccaaaat

SEQ ID NO: 44966 - DNA, 25 bp, Mus musculus
gggtgatctgctttgcctgtttcct

SEQ ID NO: 44967 - DNA, 25 bp, Mus musculus
gggtgatgactacaaaagccatgtg

SEQ ID NO: 44968 - DNA, 25 bp, Mus musculus
gggtgatgagacaaagctagaatga

SEQ ID NO: 44969 - DNA, 25 bp, Mus musculus
gggtgatgtgcaactaattaaaggc

SEQ ID NO: 44970 - DNA, 25 bp, Mus musculus
gggtgattctcaacatctcctcagc

SEQ ID NO: 44971 - DNA, 25 bp, Mus musculus
gggtgattctgcgaccagggcccta

SEQ ID NO: 44972 - DNA, 25 bp, Mus musculus
gggtgattttgaactccagatcaag

SEQ ID NO: 44973 - DNA, 25 bp, Mus musculus
gggtgcaacagtagccagaggacac

SEQ ID NO: 44974 - DNA, 25 bp, Mus musculus
gggtgcaactgaaagagcaagaagt

SEQ ID NO: 44975 - DNA, 25 bp, Mus musculus
gggtgcaggccctggaccaacacct

SEQ ID NO: 44976 - DNA, 25 bp, Mus musculus
gggtgcaggccctttccctcattgc

SEQ ID NO: 44977 - DNA, 25 bp, Mus musculus
gggtgcagtggaggattacttcatc

SEQ ID NO: 44978 - DNA, 25 bp, Mus musculus
gggtgcagtttacgtctacattaac

SEQ ID NO: 44979 - DNA, 25 bp, Mus musculus
gggtgccacagctgtaccgaaacta

SEQ ID NO: 44980 - DNA, 25 bp, Mus musculus
gggtgccagcattcggttcagcccc

SEQ ID NO: 44981 - DNA, 25 bp, Mus musculus
gggtgcccatccatgatatcgctgc

SEQ ID NO: 44982 - DNA, 25 bp, Mus musculus
gggtgccctctcaggctctgccatg

SEQ ID NO: 44983 - DNA, 25 bp, Mus musculus
gggtgcctcagaagaccatccagga

SEQ ID NO: 44984 - DNA, 25 bp, Mus musculus
gggtgctacatgtgtgctttcagag

SEQ ID NO: 44985 - DNA, 25 bp, Mus musculus
gggtgctcggactgggctccctctt

SEQ ID NO: 44986 - DNA, 25 bp, Mus musculus
gggtgctcttcatcccttaccaaag

SEQ ID NO: 44987 - DNA, 25 bp, Mus musculus
gggtggacagcgactaccatgatga

SEQ ID NO: 44988 - DNA, 25 bp, Mus musculus
gggtggaccggctcatcgagccact

SEQ ID NO: 44989 - DNA, 25 bp, Mus musculus
gggtggatgtagaaagacaagtttt

SEQ ID NO: 44990 - DNA, 25 bp, Mus musculus
gggtggcacccgagccaatcaacca

SEQ ID NO: 44991 - DNA, 25 bp, Mus musculus
gggtggcccttgtttctcttggtca

SEQ ID NO: 44992 - DNA, 25 bp, Mus musculus
gggtggcttcctacctggtgtccca

SEQ ID NO: 44993 - DNA, 25 bp, Mus musculus
gggtggtcctctctctggaccctac

SEQ ID NO: 44994 - DNA, 25 bp, Mus musculus
gggtggtgaccatccgcacagtata

SEQ ID NO: 44995 - DNA, 25 bp, Mus musculus
gggtgtaattgatcccagggccaat

SEQ ID NO: 44996 - DNA, 25 bp, Mus musculus
gggtgtcactgtgtcccaatatgac

SEQ ID NO: 44997 - DNA, 25 bp, Mus musculus
gggtgtcattacaccactattggac

SEQ ID NO: 44998 - DNA, 25 bp, Mus musculus
gggtgtccgtgctctgcaagaacac

SEQ ID NO: 44999 - DNA, 25 bp, Mus musculus
gggtgtcgtttgaccaggccaataa

SEQ ID NO: 45000 - DNA, 25 bp, Mus musculus
gggtgtgagttcagttcccggccac

SEQ ID NO: 45001 - DNA, 25 bp, Mus musculus
gggtgtgctgatttctctctgtaat

SEQ ID NO: 45002 - DNA, 25 bp, Mus musculus
gggtgtggattcttgcagacaagaa

SEQ ID NO: 45003 - DNA, 25 bp, Mus musculus
gggtgtgtgtcagtgctaacatttc

SEQ ID NO: 45004 - DNA, 25 bp, Mus musculus
gggtgtgttttactaagcatcgtct

SEQ ID NO: 45005 - DNA, 25 bp, Mus musculus
gggtgttgacttcgctttgcatcag

SEQ ID NO: 45006 - DNA, 25 bp, Mus musculus
gggtgttgcatgctgcccctccctg

SEQ ID NO: 45007 - DNA, 25 bp, Mus musculus
gggtgttgctggacccagcctgcca

SEQ ID NO: 45008 - DNA, 25 bp, Mus musculus
gggtgtttcgctgaagtgtggcttg

SEQ ID NO: 45009 - DNA, 25 bp, Mus musculus
gggttaaatctcttgaaactggagt

SEQ ID NO: 45010 - DNA, 25 bp, Mus musculus
gggttacaaagatccattcctcagt

SEQ ID NO: 45011 - DNA, 25 bp, Mus musculus
gggttacaccatctacaagacgcag

SEQ ID NO: 45012 - DNA, 25 bp, Mus musculus
gggttacatggaccccacagagccc

SEQ ID NO: 45013 - DNA, 25 bp, Mus musculus
gggttaccggcagatctcagccttg

SEQ ID NO: 45014 - DNA, 25 bp, Mus musculus
gggttagcatcttagcagtgtattc

SEQ ID NO: 45015 - DNA, 25 bp, Mus musculus
gggttagggaatgagtcctgcccta

SEQ ID NO: 45016 - DNA, 25 bp, Mus musculus
gggttatcctatcttgtggatgatc

SEQ ID NO: 45017 - DNA, 25 bp, Mus musculus
gggttatgatattggcaacgacccc

SEQ ID NO: 45018 - DNA, 25 bp, Mus musculus
gggttatgcaacaaggcatgtggtt

SEQ ID NO: 45019 - DNA, 25 bp, Mus musculus
gggttattagcactggcacactgat

SEQ ID NO: 45020 - DNA, 25 bp, Mus musculus
gggttcacagagagcaagctgaatt

SEQ ID NO: 45021 - DNA, 25 bp, Mus musculus
gggttcagaaactcccctagcatct

SEQ ID NO: 45022 - DNA, 25 bp, Mus musculus
gggttcagcttccaagtaccttctg

SEQ ID NO: 45023 - DNA, 25 bp, Mus musculus
gggttcaggctgtgatctatcatgg

SEQ ID NO: 45024 - DNA, 25 bp, Mus musculus
gggttcatgagcagcactgccttct

SEQ ID NO: 45025 - DNA, 25 bp, Mus musculus
gggttccacaggctgcgtccagtct

SEQ ID NO: 45026 - DNA, 25 bp, Mus musculus
gggttccaggctcactactactcta

SEQ ID NO: 45027 - DNA, 25 bp, Mus musculus
gggttccatctcctaacttgtccat

SEQ ID NO: 45028 - DNA, 25 bp, Mus musculus
gggttcccatcataagcaacgaagt

SEQ ID NO: 45029 - DNA, 25 bp, Mus musculus
gggttccgcaacatgagcctttcct

SEQ ID NO: 45030 - DNA, 25 bp, Mus musculus
gggttcctatcgctgccactgttcg

SEQ ID NO: 45031 - DNA, 25 bp, Mus musculus
gggttcctatcggtgccactgttcg

SEQ ID NO: 45032 - DNA, 25 bp, Mus musculus
gggttcctattcctacacacaggtg

SEQ ID NO: 45033 - DNA, 25 bp, Mus musculus
gggttctactgtggagatgactcca

SEQ ID NO: 45034 - DNA, 25 bp, Mus musculus
gggttctccagtccttcgacccgtg

SEQ ID NO: 45035 - DNA, 25 bp, Mus musculus
gggttctgacagctgcccattgcct

SEQ ID NO: 45036 - DNA, 25 bp, Mus musculus
gggttctgtagcaggcttcactcgg

SEQ ID NO: 45037 - DNA, 25 bp, Mus musculus
gggttcttattggtgtgggccacac

SEQ ID NO: 45038 - DNA, 25 bp, Mus musculus
gggttcttcaaacttcaactcaggc

SEQ ID NO: 45039 - DNA, 25 bp, Mus musculus
gggttcttcaagtgcacctaaccta

SEQ ID NO: 45040 - DNA, 25 bp, Mus musculus
gggttcttctttgggagctgctgac

SEQ ID NO: 45041 - DNA, 25 bp, Mus musculus
gggttctttccgtggccgcaaggct

SEQ ID NO: 45042 - DNA, 25 bp, Mus musculus
gggttgagacaactgttgcaagcct

SEQ ID NO: 45043 - DNA, 25 bp, Mus musculus
gggttgcaccaactacgcgaggctt

SEQ ID NO: 45044 - DNA, 25 bp, Mus musculus
gggttgcagcacactctcacggacc

SEQ ID NO: 45045 - DNA, 25 bp, Mus musculus
gggttggaatgcaatttcggcgcca

SEQ ID NO: 45046 - DNA, 25 bp, Mus musculus
gggttggaatgctatttcggcgcca

SEQ ID NO: 45047 - DNA, 25 bp, Mus musculus
gggttgtacaaatctgacacagagc

SEQ ID NO: 45048 - DNA, 25 bp, Mus musculus
gggttgtagccctcttcaaggtctg

SEQ ID NO: 45049 - DNA, 25 bp, Mus musculus
gggttgtcatcagcaagattctgga

SEQ ID NO: 45050 - DNA, 25 bp, Mus musculus
gggttgtcctgagaaccatgacttc

SEQ ID NO: 45051 - DNA, 25 bp, Mus musculus
gggttgtcgtcctccactggattta

SEQ ID NO: 45052 - DNA, 25 bp, Mus musculus
gggttgtctgaaggaggacctctcc

SEQ ID NO: 45053 - DNA, 25 bp, Mus musculus
gggttgttcgttgggtccttgtcat

SEQ ID NO: 45054 - DNA, 25 bp, Mus musculus
gggtttagttctcaggaaacaatgt

SEQ ID NO: 45055 - DNA, 25 bp, Mus musculus
gggtttatattctcgaaatctatga

SEQ ID NO: 45056 - DNA, 25 bp, Mus musculus
gggtttatcacgctaagtgtctgag

SEQ ID NO: 45057 - DNA, 25 bp, Mus musculus
gggtttattcctctcccgctagctg

SEQ ID NO: 45058 - DNA, 25 bp, Mus musculus
gggtttcaacggctgtgacagccca

SEQ ID NO: 45059 - DNA, 25 bp, Mus musculus
gggtttcaccaagagccttaatgcc

SEQ ID NO: 45060 - DNA, 25 bp, Mus musculus
gggtttccagaagtgtaagccatgt

SEQ ID NO: 45061 - DNA, 25 bp, Mus musculus
gggtttccctcttcttagagcctgt

SEQ ID NO: 45062 - DNA, 25 bp, Mus musculus
gggtttcccttacagccctgctggt

SEQ ID NO: 45063 - DNA, 25 bp, Mus musculus
gggtttctcacaggattcctcttta

SEQ ID NO: 45064 - DNA, 25 bp, Mus musculus
gggtttctgaagtcgtcctaatgtg

SEQ ID NO: 45065 - DNA, 25 bp, Mus musculus
gggtttctgaccacacagcagtgct

SEQ ID NO: 45066 - DNA, 25 bp, Mus musculus
gggtttctgcgtcttcatgtgcata

SEQ ID NO: 45067 - DNA, 25 bp, Mus musculus
gggtttgcacatccctccgctgact

SEQ ID NO: 45068 - DNA, 25 bp, Mus musculus
gggtttggctctgctcttctggaca

SEQ ID NO: 45069 - DNA, 25 bp, Mus musculus
gggtttgtgatggttccaatggctc

SEQ ID NO: 45070 - DNA, 25 bp, Mus musculus
gggttttactgccaactctgtgagg

SEQ ID NO: 45071 - DNA, 25 bp, Mus musculus
gggttttagttgatgccagacatag

SEQ ID NO: 45072 - DNA, 25 bp, Mus musculus
gggttttgcacaccctactcggtgg

SEQ ID NO: 45073 - DNA, 25 bp, Mus musculus
gggttttgctacagtcagaaggact

SEQ ID NO: 45074 - DNA, 25 bp, Mus musculus
gggttttgctactgtcagaaggact

SEQ ID NO: 45075 - DNA, 25 bp, Mus musculus
ggtaaaacaccattgtggagcatga

SEQ ID NO: 45076 - DNA, 25 bp, Mus musculus
ggtaaaactccaccagggattgctt

SEQ ID NO: 45077 - DNA, 25 bp, Mus musculus
ggtaaaagacgagttcagtgacctt

SEQ ID NO: 45078 - DNA, 25 bp, Mus musculus
ggtaaaagctataagcagcaaagtc

SEQ ID NO: 45079 - DNA, 25 bp, Mus musculus
ggtaaaatggaaggaataaccacat

SEQ ID NO: 45080 - DNA, 25 bp, Mus musculus
ggtaaagaggaagcattgaaaatcc

SEQ ID NO: 45081 - DNA, 25 bp, Mus musculus
ggtaaagattttcaagctattgcag

SEQ ID NO: 45082 - DNA, 25 bp, Mus musculus
ggtaaatgctggattggcccatgaa

SEQ ID NO: 45083 - DNA, 25 bp, Mus musculus
ggtaaatgctggtttggcccatgaa

SEQ ID NO: 45084 - DNA, 25 bp, Mus musculus
ggtaaatgtttgctgtaagaaagtc

SEQ ID NO: 45085 - DNA, 25 bp, Mus musculus
ggtaacaacttctgcgcgggcagtc

SEQ ID NO: 45086 - DNA, 25 bp, Mus musculus
ggtaacaccaaggaactgtcacaat

SEQ ID NO: 45087 - DNA, 25 bp, Mus musculus
ggtaacacgcagtctccattgtgag

SEQ ID NO: 45088 - DNA, 25 bp, Mus musculus
ggtaacagagtgatttggtatgctg

SEQ ID NO: 45089 - DNA, 25 bp, Mus musculus
ggtaacagctagcagtcgccactat

SEQ ID NO: 45090 - DNA, 25 bp, Mus musculus
ggtaacatggtgatagctcccaagg

SEQ ID NO: 45091 - DNA, 25 bp, Mus musculus
ggtaacctctatcactgggttgtca

SEQ ID NO: 45092 - DNA, 25 bp, Mus musculus
ggtaacggctgcttctgtagaacaa

SEQ ID NO: 45093 - DNA, 25 bp, Mus musculus
ggtaacgttctttcagccagacgac

SEQ ID NO: 45094 - DNA, 25 bp, Mus musculus
ggtaactcgtcctcatgcgttggaa

SEQ ID NO: 45095 - DNA, 25 bp, Mus musculus
ggtaactgacaaagtgaaaaagcac

SEQ ID NO: 45096 - DNA, 25 bp, Mus musculus
ggtaacttctctatcaccctgcgca

SEQ ID NO: 45097 - DNA, 25 bp, Mus musculus
ggtaagaagaagacaatcggtcaga

SEQ ID NO: 45098 - DNA, 25 bp, Mus musculus
ggtaagaagtatggagaaacggcta

SEQ ID NO: 45099 - DNA, 25 bp, Mus musculus
ggtaagaccaccctgacagcggcca

SEQ ID NO: 45100 - DNA, 25 bp, Mus musculus
ggtaagagatctgacctatctaagg

SEQ ID NO: 45101 - DNA, 25 bp, Mus musculus
ggtaagagggagaccaaagttatca

SEQ ID NO: 45102 - DNA, 25 bp, Mus musculus
ggtaagcgaaacagactcagatttg

SEQ ID NO: 45103 - DNA, 25 bp, Mus musculus
ggtaaggaaagctgttctgggcagg

SEQ ID NO: 45104 - DNA, 25 bp, Mus musculus
ggtaaggaatcatcagagccactca

SEQ ID NO: 45105 - DNA, 25 bp, Mus musculus
ggtaatcctcgtggggaacaagtgt

SEQ ID NO: 45106 - DNA, 25 bp, Mus musculus
ggtaatcctgtaaggtgtgatcagc

SEQ ID NO: 45107 - DNA, 25 bp, Mus musculus
ggtaatgaggattttgccaagaatg

SEQ ID NO: 45108 - DNA, 25 bp, Mus musculus
ggtaattagcttcagaccctggact

SEQ ID NO: 45109 - DNA, 25 bp, Mus musculus
ggtacaaattgcaatcctgtccatg

SEQ ID NO: 45110 - DNA, 25 bp, Mus musculus
ggtacaacactgtcctgaacaaaag

SEQ ID NO: 45111 - DNA, 25 bp, Mus musculus
ggtacaacctctccgtggtgaacgc

SEQ ID NO: 45112 - DNA, 25 bp, Mus musculus
ggtacaaccttcatccctggactgc

SEQ ID NO: 45113 - DNA, 25 bp, Mus musculus
ggtacaacgagatgcccgcagaatg

SEQ ID NO: 45114 - DNA, 25 bp, Mus musculus
ggtacaagctagtgatgcacacacc

SEQ ID NO: 45115 - DNA, 25 bp, Mus musculus
ggtacaatgccaagatctccttcgg

SEQ ID NO: 45116 - DNA, 25 bp, Mus musculus
ggtacaatgtattagaattcagcag

SEQ ID NO: 45117 - DNA, 25 bp, Mus musculus
ggtacacgcagctctgtgactggtg

SEQ ID NO: 45118 - DNA, 25 bp, Mus musculus
ggtacacttttgcaccaagcgcctc

SEQ ID NO: 45119 - DNA, 25 bp, Mus musculus
ggtacagaggagtttcaacaaagaa

SEQ ID NO: 45120 - DNA, 25 bp, Mus musculus
ggtacagggcctgcagacattaacc

SEQ ID NO: 45121 - DNA, 25 bp, Mus musculus
ggtacagttcaagatcaagaggcac

SEQ ID NO: 45122 - DNA, 25 bp, Mus musculus
ggtacattcatccttaaaacacgtg

SEQ ID NO: 45123 - DNA, 25 bp, Mus musculus
ggtacattcgcctctcaggtgacac

SEQ ID NO: 45124 - DNA, 25 bp, Mus musculus
ggtacattgcagttctgaagaagac

SEQ ID NO: 45125 - DNA, 25 bp, Mus musculus
ggtaccaacaatgtcacttcacacg

SEQ ID NO: 45126 - DNA, 25 bp, Mus musculus
ggtaccacagcgacgaacaaaagct

SEQ ID NO: 45127 - DNA, 25 bp, Mus musculus
ggtaccagccgtgtcggacttggaa

SEQ ID NO: 45128 - DNA, 25 bp, Mus musculus
ggtaccatcatgcatctttagtcta

SEQ ID NO: 45129 - DNA, 25 bp, Mus musculus
ggtaccatcatggatctttagtcta

SEQ ID NO: 45130 - DNA, 25 bp, Mus musculus
ggtacccaaagagccatccaaggaa

SEQ ID NO: 45131 - DNA, 25 bp, Mus musculus
ggtaccccacttatgaggtggagga

SEQ ID NO: 45132 - DNA, 25 bp, Mus musculus
ggtacccggcaattcaggatgagag

SEQ ID NO: 45133 - DNA, 25 bp, Mus musculus
ggtaccgaagttggcttccaccagt

SEQ ID NO: 45134 - DNA, 25 bp, Mus musculus
ggtaccgcctgcactttctgcctga

SEQ ID NO: 45135 - DNA, 25 bp, Mus musculus
ggtaccggcgtgtgtacaagtccct

SEQ ID NO: 45136 - DNA, 25 bp, Mus musculus
ggtaccgttcccttgtcgggcacag

SEQ ID NO: 45137 - DNA, 25 bp, Mus musculus
ggtacctccgtgacctcatcagcaa

SEQ ID NO: 45138 - DNA, 25 bp, Mus musculus
ggtacctgacaatgatgagcagttt

SEQ ID NO: 45139 - DNA, 25 bp, Mus musculus
ggtacctgaccatcagttgccctga

SEQ ID NO: 45140 - DNA, 25 bp, Mus musculus
ggtacctgtgaggttggctcctcca

SEQ ID NO: 45141 - DNA, 25 bp, Mus musculus
ggtaccttcctaggcctaggcacgg

SEQ ID NO: 45142 - DNA, 25 bp, Mus musculus
ggtaccttggatgatggtgaataca

SEQ ID NO: 45143 - DNA, 25 bp, Mus musculus
ggtacctttggctctcaccgtcctg

SEQ ID NO: 45144 - DNA, 25 bp, Mus musculus
ggtacgagatgctcacgctctcgaa

SEQ ID NO: 45145 - DNA, 25 bp, Mus musculus
ggtacgaggaagtaaaccatgccac

SEQ ID NO: 45146 - DNA, 25 bp, Mus musculus
ggtacggacactagaggagctcctg

SEQ ID NO: 45147 - DNA, 25 bp, Mus musculus
ggtacgggctgtgctttggcccgga

SEQ ID NO: 45148 - DNA, 25 bp, Mus musculus
ggtacgtcttcaaggcagcatgctg

SEQ ID NO: 45149 - DNA, 25 bp, Mus musculus
ggtactaaacttcttcaacaatcag

SEQ ID NO: 45150 - DNA, 25 bp, Mus musculus
ggtactacaatgtgtatgccaagaa

SEQ ID NO: 45151 - DNA, 25 bp, Mus musculus
ggtactaccaccgtggccatgtgga

SEQ ID NO: 45152 - DNA, 25 bp, Mus musculus
ggtactaccctgaattagcagccca

SEQ ID NO: 45153 - DNA, 25 bp, Mus musculus
ggtactacctacaagcgagatttta

SEQ ID NO: 45154 - DNA, 25 bp, Mus musculus
ggtactcattatgtagctccagcta

SEQ ID NO: 45155 - DNA, 25 bp, Mus musculus
ggtactccacctcttgcatagagct

SEQ ID NO: 45156 - DNA, 25 bp, Mus musculus
ggtactcgttatatgtgacaggaag

SEQ ID NO: 45157 - DNA, 25 bp, Mus musculus
ggtactctctgtatgaggacaaagg

SEQ ID NO: 45158 - DNA, 25 bp, Mus musculus
ggtactgaccgatttcggcctttgc

SEQ ID NO: 45159 - DNA, 25 bp, Mus musculus
ggtactgcatttgggccccttttcg

SEQ ID NO: 45160 - DNA, 25 bp, Mus musculus
ggtactgccgaggagtcaatgcaat

SEQ ID NO: 45161 - DNA, 25 bp, Mus musculus
ggtactggtctctttggctgctggt

SEQ ID NO: 45162 - DNA, 25 bp, Mus musculus
ggtacttctcctggctcagggcaag

SEQ ID NO: 45163 - DNA, 25 bp, Mus musculus
ggtagaaagagaggacaaggaggag

SEQ ID NO: 45164 - DNA, 25 bp, Mus musculus
ggtagaagaagaagggatacacagt

SEQ ID NO: 45165 - DNA, 25 bp, Mus musculus
ggtagagatgttgcttgacagatcc

SEQ ID NO: 45166 - DNA, 25 bp, Mus musculus
ggtagatacctgtagtagcacaacc

SEQ ID NO: 45167 - DNA, 25 bp, Mus musculus
ggtagatcaagagtggagtcagacc

SEQ ID NO: 45168 - DNA, 25 bp, Mus musculus
ggtagatcgagctggcacgttcaag

SEQ ID NO: 45169 - DNA, 25 bp, Mus musculus
ggtagatctggagcatgacccctca

SEQ ID NO: 45170 - DNA, 25 bp, Mus musculus
ggtagatgccaatgaagttccaatt

SEQ ID NO: 45171 - DNA, 25 bp, Mus musculus
ggtagatgccattgaccccaccagg

SEQ ID NO: 45172 - DNA, 25 bp, Mus musculus
ggtagatggaaaaccagtgaatctg

SEQ ID NO: 45173 - DNA, 25 bp, Mus musculus
ggtagattctccagatcacaaacga

SEQ ID NO: 45174 - DNA, 25 bp, Mus musculus
ggtagcaatataaagaatctcatgg

SEQ ID NO: 45175 - DNA, 25 bp, Mus musculus
ggtagcacatgtcaacagtgtcccc

SEQ ID NO: 45176 - DNA, 25 bp, Mus musculus
ggtagcacatgtgaacagtgtcccc

SEQ ID NO: 45177 - DNA, 25 bp, Mus musculus
ggtagcagcagttctaagacaccat

SEQ ID NO: 45178 - DNA, 25 bp, Mus musculus
ggtagcagctacagtggctccagtt

SEQ ID NO: 45179 - DNA, 25 bp, Mus musculus
ggtagcagtttgcacgatgaacttg

SEQ ID NO: 45180 - DNA, 25 bp, Mus musculus
ggtagccctggaactccgaggctga

SEQ ID NO: 45181 - DNA, 25 bp, Mus musculus
ggtagctaccgagagataaacccag

SEQ ID NO: 45182 - DNA, 25 bp, Mus musculus
ggtagctccagccactgacaagcaa

SEQ ID NO: 45183 - DNA, 25 bp, Mus musculus
ggtagctcctcctcctattgaatca

SEQ ID NO: 45184 - DNA, 25 bp, Mus musculus
ggtaggaccgaaaatcctctgcaag

SEQ ID NO: 45185 - DNA, 25 bp, Mus musculus
ggtaggactacagcatgccagtgat

SEQ ID NO: 45186 - DNA, 25 bp, Mus musculus
ggtaggcaagcttcacacccagcct

SEQ ID NO: 45187 - DNA, 25 bp, Mus musculus
ggtaggcttaaccagaccaagagaa

SEQ ID NO: 45188 - DNA, 25 bp, Mus musculus
ggtagtctgaatgtgaatccgttaa

SEQ ID NO: 45189 - DNA, 25 bp, Mus musculus
ggtagtgctggcctccttcctgctt

SEQ ID NO: 45190 - DNA, 25 bp, Mus musculus
ggtagtgcttccttctgcttagtag

SEQ ID NO: 45191 - DNA, 25 bp, Mus musculus
ggtagttaaagacatggcaactgga

SEQ ID NO: 45192 - DNA, 25 bp, Mus musculus
ggtatagctaccatttttcaaagtc

SEQ ID NO: 45193 - DNA, 25 bp, Mus musculus
ggtatataaagatgattaccaatat

SEQ ID NO: 45194 - DNA, 25 bp, Mus musculus
ggtatatcagacagcattcagacaa

SEQ ID NO: 45195 - DNA, 25 bp, Mus musculus
ggtatatgaaactttgttgacaaga

SEQ ID NO: 45196 - DNA, 25 bp, Mus musculus
ggtatatggctgacatgattgccag

SEQ ID NO: 45197 - DNA, 25 bp, Mus musculus
ggtatatgtagtctcttgctgccat

SEQ ID NO: 45198 - DNA, 25 bp, Mus musculus
ggtatcaaggtggagaaacagatct

SEQ ID NO: 45199 - DNA, 25 bp, Mus musculus
ggtatcacattgagacgctgcattt

SEQ ID NO: 45200 - DNA, 25 bp, Mus musculus
ggtatcagagcaacgccacagaatg

SEQ ID NO: 45201 - DNA, 25 bp, Mus musculus
ggtatcagagcatcgccacagaatg

SEQ ID NO: 45202 - DNA, 25 bp, Mus musculus
ggtatcagtgcttcgtgagcttctt

SEQ ID NO: 45203 - DNA, 25 bp, Mus musculus
ggtatcagtggattggccgcaagtt

SEQ ID NO: 45204 - DNA, 25 bp, Mus musculus
ggtatccagtgtgacaggacagttg

SEQ ID NO: 45205 - DNA, 25 bp, Mus musculus
ggtatccctcctaagctcccaggat

SEQ ID NO: 45206 - DNA, 25 bp, Mus musculus
ggtatcctgctactgctccccaagg

SEQ ID NO: 45207 - DNA, 25 bp, Mus musculus
ggtatcctgctgaacgccaactggg

SEQ ID NO: 45208 - DNA, 25 bp, Mus musculus
ggtatcctgtcttggtagtgaatgg

SEQ ID NO: 45209 - DNA, 25 bp, Mus musculus
ggtatcgcccaagcttcgtgtctga

SEQ ID NO: 45210 - DNA, 25 bp, Mus musculus
ggtatcttattttcctgtggaggca

SEQ ID NO: 45211 - DNA, 25 bp, Mus musculus
ggtatgatcattaccattgggcaag

SEQ ID NO: 45212 - DNA, 25 bp, Mus musculus
ggtatgcaaaatccactacggaggc

SEQ ID NO: 45213 - DNA, 25 bp, Mus musculus
ggtatgctttagaccaagagcaaag

SEQ ID NO: 45214 - DNA, 25 bp, Mus musculus
ggtatgctttagtccaagagcaaag

SEQ ID NO: 45215 - DNA, 25 bp, Mus musculus
ggtatggcaacactccatttctgtt

SEQ ID NO: 45216 - DNA, 25 bp, Mus musculus
ggtatggctatagagcacccgaaga

SEQ ID NO: 45217 - DNA, 25 bp, Mus musculus
ggtattaaaaatcaattgctagagc

SEQ ID NO: 45218 - DNA, 25 bp, Mus musculus
ggtattactcagatacaaatgaaag

SEQ ID NO: 45219 - DNA, 25 bp, Mus musculus
ggtattactcagttacaaatgaaag

SEQ ID NO: 45220 - DNA, 25 bp, Mus musculus
ggtattagaagacgctcaaacacag

SEQ ID NO: 45221 - DNA, 25 bp, Mus musculus
ggtattcagagagggccctggcact

SEQ ID NO: 45222 - DNA, 25 bp, Mus musculus
ggtattcagcctggatccacagtcc

SEQ ID NO: 45223 - DNA, 25 bp, Mus musculus
ggtattctaactcgtagcagtcctg

SEQ ID NO: 45224 - DNA, 25 bp, Mus musculus
ggtattctgactcctgggaccttct

SEQ ID NO: 45225 - DNA, 25 bp, Mus musculus
ggtattttgaaggactctatcccac

SEQ ID NO: 45226 - DNA, 25 bp, Mus musculus
ggtattttgcctatgaatcctagga

SEQ ID NO: 45227 - DNA, 25 bp, Mus musculus
ggtcaaaaggcaagcatggtccaga

SEQ ID NO: 45228 - DNA, 25 bp, Mus musculus
ggtcaaaggataatctctaaacatt

SEQ ID NO: 45229 - DNA, 25 bp, Mus musculus
ggtcaacaaacctcacagtctcccc

SEQ ID NO: 45230 - DNA, 25 bp, Mus musculus
ggtcaacatggctgggcctgaagaa

SEQ ID NO: 45231 - DNA, 25 bp, Mus musculus
ggtcaacctgttgatggccattttg

SEQ ID NO: 45232 - DNA, 25 bp, Mus musculus
ggtcaaccttttctgagtctaccca

SEQ ID NO: 45233 - DNA, 25 bp, Mus musculus
ggtcaactggctgtcactaatatac

SEQ ID NO: 45234 - DNA, 25 bp, Mus musculus
ggtcaagacggtctaccgacatgac

SEQ ID NO: 45235 - DNA, 25 bp, Mus musculus
ggtcaagatcgccacaaccagagct

SEQ ID NO: 45236 - DNA, 25 bp, Mus musculus
ggtcaagcataagcagtgctttctc

SEQ ID NO: 45237 - DNA, 25 bp, Mus musculus
ggtcaaggttacatcccagtggaag

SEQ ID NO: 45238 - DNA, 25 bp, Mus musculus
ggtcaaggttacttcccagtggaag

SEQ ID NO: 45239 - DNA, 25 bp, Mus musculus
ggtcaagttcgggaacaagacgttg

SEQ ID NO: 45240 - DNA, 25 bp, Mus musculus
ggtcaatgcatcctacaccaaactg

SEQ ID NO: 45241 - DNA, 25 bp, Mus musculus
ggtcaatttacagcgcaagatacat

SEQ ID NO: 45242 - DNA, 25 bp, Mus musculus
ggtcacacacatgtagtcccagcta

SEQ ID NO: 45243 - DNA, 25 bp, Mus musculus
ggtcacagactgcatttccgccatg

SEQ ID NO: 45244 - DNA, 25 bp, Mus musculus
ggtcacagccttacttaaaccctgg

SEQ ID NO: 45245 - DNA, 25 bp, Mus musculus
ggtcacagcctttcttaaaccctgg

SEQ ID NO: 45246 - DNA, 25 bp, Mus musculus
ggtcacagtacctacctcaaatggt

SEQ ID NO: 45247 - DNA, 25 bp, Mus musculus
ggtcacatgacatttcacctagtgc

SEQ ID NO: 45248 - DNA, 25 bp, Mus musculus
ggtcacatggcttgctcgaggcccc

SEQ ID NO: 45249 - DNA, 25 bp, Mus musculus
ggtcaccagcccctctggagaatat

SEQ ID NO: 45250 - DNA, 25 bp, Mus musculus
ggtcaccatgaccatgtcctccatt

SEQ ID NO: 45251 - DNA, 25 bp, Mus musculus
ggtcaccatggagcactctgcgaag

SEQ ID NO: 45252 - DNA, 25 bp, Mus musculus
ggtcacccagcaagtcagttgtaga

SEQ ID NO: 45253 - DNA, 25 bp, Mus musculus
ggtcacccttgtcagctcctccttg

SEQ ID NO: 45254 - DNA, 25 bp, Mus musculus
ggtcaccgctagaagagattgttga

SEQ ID NO: 45255 - DNA, 25 bp, Mus musculus
ggtcacctgcagtaccagccaaaaa

SEQ ID NO: 45256 - DNA, 25 bp, Mus musculus
ggtcaccttttaccatccaagtgcc

SEQ ID NO: 45257 - DNA, 25 bp, Mus musculus
ggtcacgatccaaatctcggtctcg

SEQ ID NO: 45258 - DNA, 25 bp, Mus musculus
ggtcacgtacaaggaccaggcacct

SEQ ID NO: 45259 - DNA, 25 bp, Mus musculus
ggtcacgtggtactgaccgatttcg

SEQ ID NO: 45260 - DNA, 25 bp, Mus musculus
ggtcacgtttggaagaaccatcaac

SEQ ID NO: 45261 - DNA, 25 bp, Mus musculus
ggtcactcaagtataagactcctga

SEQ ID NO: 45262 - DNA, 25 bp, Mus musculus
ggtcactcgcaacgatatcccaggg

SEQ ID NO: 45263 - DNA, 25 bp, Mus musculus
ggtcactcgcaaggatatcccaggg

SEQ ID NO: 45264 - DNA, 25 bp, Mus musculus
ggtcagaaaggatcttacttccagg

SEQ ID NO: 45265 - DNA, 25 bp, Mus musculus
ggtcagaactattgctatggatggc

SEQ ID NO: 45266 - DNA, 25 bp, Mus musculus
ggtcagaaggacaactggagcttgc

SEQ ID NO: 45267 - DNA, 25 bp, Mus musculus
ggtcagagaagctccgataacgtct

SEQ ID NO: 45268 - DNA, 25 bp, Mus musculus
ggtcagagtccatcacagagagcag

SEQ ID NO: 45269 - DNA, 25 bp, Mus musculus
ggtcagcaactgcagcctacagatt

SEQ ID NO: 45270 - DNA, 25 bp, Mus musculus
ggtcagcagatgctcttccagaaga

SEQ ID NO: 45271 - DNA, 25 bp, Mus musculus
ggtcagcagcccagagaggcccaag

SEQ ID NO: 45272 - DNA, 25 bp, Mus musculus
ggtcagccgcagacaggcctttacc

SEQ ID NO: 45273 - DNA, 25 bp, Mus musculus
ggtcagcctctacaagttcatgaag

SEQ ID NO: 45274 - DNA, 25 bp, Mus musculus
ggtcagctacattcgctgggaaggt

SEQ ID NO: 45275 - DNA, 25 bp, Mus musculus
ggtcaggaacgtttccgtagcctca

SEQ ID NO: 45276 - DNA, 25 bp, Mus musculus
ggtcaggagtatgctgccaagatta

SEQ ID NO: 45277 - DNA, 25 bp, Mus musculus
ggtcagtagcatcggctatcccatg

SEQ ID NO: 45278 - DNA, 25 bp, Mus musculus
ggtcagtcctgcttctgggacccaa

SEQ ID NO: 45279 - DNA, 25 bp, Mus musculus
ggtcagttagaggacaacctgcaag

SEQ ID NO: 45280 - DNA, 25 bp, Mus musculus
ggtcataaatacaaacgtgggcaag

SEQ ID NO: 45281 - DNA, 25 bp, Mus musculus
ggtcataatcagcagagttctctct

SEQ ID NO: 45282 - DNA, 25 bp, Mus musculus
ggtcatatcttcaccacgggattca

SEQ ID NO: 45283 - DNA, 25 bp, Mus musculus
ggtcatcagaacatcacagctgatt

SEQ ID NO: 45284 - DNA, 25 bp, Mus musculus
ggtcatccactcacatcttaaaaaa

SEQ ID NO: 45285 - DNA, 25 bp, Mus musculus
ggtcatccactgtccgagtcacatc

SEQ ID NO: 45286 - DNA, 25 bp, Mus musculus
ggtcatcgctggcttcctgaccttc

SEQ ID NO: 45287 - DNA, 25 bp, Mus musculus
ggtcatcgggtaattaatctggcca

SEQ ID NO: 45288 - DNA, 25 bp, Mus musculus
ggtcatctccctggtttttgctgtc

SEQ ID NO: 45289 - DNA, 25 bp, Mus musculus
ggtcatgaatcggttcagcccctct

SEQ ID NO: 45290 - DNA, 25 bp, Mus musculus
ggtcatggactctaaacctctgcag

SEQ ID NO: 45291 - DNA, 25 bp, Mus musculus
ggtcatgggtgtgcccgaaaacgtt

SEQ ID NO: 45292 - DNA, 25 bp, Mus musculus
ggtcatgtagggataaaaagaactg

SEQ ID NO: 45293 - DNA, 25 bp, Mus musculus
ggtcatgtttcccacccacaaatta

SEQ ID NO: 45294 - DNA, 25 bp, Mus musculus
ggtcattaaaaagtgtgctgagaag

SEQ ID NO: 45295 - DNA, 25 bp, Mus musculus
ggtcattagtgttcccagaggcaga

SEQ ID NO: 45296 - DNA, 25 bp, Mus musculus
ggtcattatcgttattgtgatgctc

SEQ ID NO: 45297 - DNA, 25 bp, Mus musculus
ggtcattcctaccttgatcttctca

SEQ ID NO: 45298 - DNA, 25 bp, Mus musculus
ggtcattctatgcattatccattgc

SEQ ID NO: 45299 - DNA, 25 bp, Mus musculus
ggtccaacatcaacgaggtgatagc

SEQ ID NO: 45300 - DNA, 25 bp, Mus musculus
ggtccaacatctggctggccgcagt

SEQ ID NO: 45301 - DNA, 25 bp, Mus musculus
ggtccaagacctttatgaaacaatg

SEQ ID NO: 45302 - DNA, 25 bp, Mus musculus
ggtccaagatcacattcctcttaca

SEQ ID NO: 45303 - DNA, 25 bp, Mus musculus
ggtccacacccaagttttatgttcg

SEQ ID NO: 45304 - DNA, 25 bp, Mus musculus
ggtccacatgcatggcgtctaatga

SEQ ID NO: 45305 - DNA, 25 bp, Mus musculus
ggtccaccagactggcagctcttct

SEQ ID NO: 45306 - DNA, 25 bp, Mus musculus
ggtccaccagcgtgctcgctagagg

SEQ ID NO: 45307 - DNA, 25 bp, Mus musculus
ggtccaccaggaacacaacttcgtc

SEQ ID NO: 45308 - DNA, 25 bp, Mus musculus
ggtccacgatgtataattcctagtg

SEQ ID NO: 45309 - DNA, 25 bp, Mus musculus
ggtccagaaagaacctaaagaagca

SEQ ID NO: 45310 - DNA, 25 bp, Mus musculus
ggtccagaatcttttactgtctacc

SEQ ID NO: 45311 - DNA, 25 bp, Mus musculus
ggtccagagtacattagcagccgca

SEQ ID NO: 45312 - DNA, 25 bp, Mus musculus
ggtccagagttgaagttcccctaat

SEQ ID NO: 45313 - DNA, 25 bp, Mus musculus
ggtccagcaccaagcgcgcgatgca

SEQ ID NO: 45314 - DNA, 25 bp, Mus musculus
ggtccagcacgtaatgacagtgtca

SEQ ID NO: 45315 - DNA, 25 bp, Mus musculus
ggtccagcagcaagcctatggagtg

SEQ ID NO: 45316 - DNA, 25 bp, Mus musculus
ggtccagcatttccaccaaaggtgg

SEQ ID NO: 45317 - DNA, 25 bp, Mus musculus
ggtccagcccttcaggcaacgtctt

SEQ ID NO: 45318 - DNA, 25 bp, Mus musculus
ggtccaggaatgctaccagagcgat

SEQ ID NO: 45319 - DNA, 25 bp, Mus musculus
ggtccaggagcttaactgcctcttg

SEQ ID NO: 45320 - DNA, 25 bp, Mus musculus
ggtccaggcctgtgcatatgtgagt

SEQ ID NO: 45321 - DNA, 25 bp, Mus musculus
ggtccagtccatagctgtgcccaga

SEQ ID NO: 45322 - DNA, 25 bp, Mus musculus
ggtccagtgctttcaagctcccaca

SEQ ID NO: 45323 - DNA, 25 bp, Mus musculus
ggtccatacaccgaataagagcaaa

SEQ ID NO: 45324 - DNA, 25 bp, Mus musculus
ggtccatgaactactgggcataaac

SEQ ID NO: 45325 - DNA, 25 bp, Mus musculus
ggtccatggtggctgatattcaccg

SEQ ID NO: 45326 - DNA, 25 bp, Mus musculus
ggtccatgtctcctctaggtcagcg

SEQ ID NO: 45327 - DNA, 25 bp, Mus musculus
ggtccatgtgcaaaaggacagacca

SEQ ID NO: 45328 - DNA, 25 bp, Mus musculus
ggtccatttgatagcctagaagaaa

SEQ ID NO: 45329 - DNA, 25 bp, Mus musculus
ggtcccacctggcatctctcaagaa

SEQ ID NO: 45330 - DNA, 25 bp, Mus musculus
ggtcccagaatgacagctgcctaca

SEQ ID NO: 45331 - DNA, 25 bp, Mus musculus
ggtcccataggagcagacctggctg

SEQ ID NO: 45332 - DNA, 25 bp, Mus musculus
ggtcccatctggacgtttcctccaa

SEQ ID NO: 45333 - DNA, 25 bp, Mus musculus
ggtcccatctgtccgtttgctggaa

SEQ ID NO: 45334 - DNA, 25 bp, Mus musculus
ggtcccattctgtgagtccaactta

SEQ ID NO: 45335 - DNA, 25 bp, Mus musculus
ggtccccaacatgaaccgtgtgaca

SEQ ID NO: 45336 - DNA, 25 bp, Mus musculus
ggtccccacggcaacgaagttcagc

SEQ ID NO: 45337 - DNA, 25 bp, Mus musculus
ggtccccagtcatcaaggatgtgat

SEQ ID NO: 45338 - DNA, 25 bp, Mus musculus
ggtccccatctcagtcacgggcatt

SEQ ID NO: 45339 - DNA, 25 bp, Mus musculus
ggtcccctgcaaaaccttatagaca

SEQ ID NO: 45340 - DNA, 25 bp, Mus musculus
ggtcccgtaggcaaggacaaggaca

SEQ ID NO: 45341 - DNA, 25 bp, Mus musculus
ggtccctcagcactggaggctcaga

SEQ ID NO: 45342 - DNA, 25 bp, Mus musculus
ggtccctctgcagtcttagctggaa

SEQ ID NO: 45343 - DNA, 25 bp, Mus musculus
ggtccctgcagactcggactccagt

SEQ ID NO: 45344 - DNA, 25 bp, Mus musculus
ggtccctgctctttcacttcaagga

SEQ ID NO: 45345 - DNA, 25 bp, Mus musculus
ggtccctggtggaagacaacaaccg

SEQ ID NO: 45346 - DNA, 25 bp, Mus musculus
ggtccgaaatccagaactgtctcaa

SEQ ID NO: 45347 - DNA, 25 bp, Mus musculus
ggtccgacttttgagatcacaggcc

SEQ ID NO: 45348 - DNA, 25 bp, Mus musculus
ggtccgagagcccatcttcaagatt

SEQ ID NO: 45349 - DNA, 25 bp, Mus musculus
ggtccgaggcatcattcctgaagaa

SEQ ID NO: 45350 - DNA, 25 bp, Mus musculus
ggtccgcatccgctacatgggcgaa

SEQ ID NO: 45351 - DNA, 25 bp, Mus musculus
ggtccgcctcactaactgttgtgaa

SEQ ID NO: 45352 - DNA, 25 bp, Mus musculus
ggtccgctgcaaaccgaatggcttt

SEQ ID NO: 45353 - DNA, 25 bp, Mus musculus
ggtccggatcagacccatgctgatt

SEQ ID NO: 45354 - DNA, 25 bp, Mus musculus
ggtccggtgttcctgcagaaatgcc

SEQ ID NO: 45355 - DNA, 25 bp, Mus musculus
ggtccgtatcacataggattaccga

SEQ ID NO: 45356 - DNA, 25 bp, Mus musculus
ggtccgttttactatatgaagcagc

SEQ ID NO: 45357 - DNA, 25 bp, Mus musculus
ggtcctacaggaacaccagggaagc

SEQ ID NO: 45358 - DNA, 25 bp, Mus musculus
ggtcctagaggtcaggcatcgccta

SEQ ID NO: 45359 - DNA, 25 bp, Mus musculus
ggtcctatgaatatccttcgactta

SEQ ID NO: 45360 - DNA, 25 bp, Mus musculus
ggtcctatttgactaccaacccgag

SEQ ID NO: 45361 - DNA, 25 bp, Mus musculus
ggtcctccaaccttgtcgggatgaa

SEQ ID NO: 45362 - DNA, 25 bp, Mus musculus
ggtcctccctaatctactcaaagca

SEQ ID NO: 45363 - DNA, 25 bp, Mus musculus
ggtcctccgtgagagcaacaaatgc

SEQ ID NO: 45364 - DNA, 25 bp, Mus musculus
ggtcctcgaagcaccatggcatgaa

SEQ ID NO: 45365 - DNA, 25 bp, Mus musculus
ggtcctctaagagagtacaggaaca

SEQ ID NO: 45366 - DNA, 25 bp, Mus musculus
ggtcctctaggttctccgtgaaaat

SEQ ID NO: 45367 - DNA, 25 bp, Mus musculus
ggtcctgaagcatggcagccatccc

SEQ ID NO: 45368 - DNA, 25 bp, Mus musculus
ggtcctgaattctctgggtctggag

SEQ ID NO: 45369 - DNA, 25 bp, Mus musculus
ggtcctgagcctgccaaacctggag

SEQ ID NO: 45370 - DNA, 25 bp, Mus musculus
ggtcctgagcgcatgtatattgata

SEQ ID NO: 45371 - DNA, 25 bp, Mus musculus
ggtcctgagtcgtgctctgttggta

SEQ ID NO: 45372 - DNA, 25 bp, Mus musculus
ggtcctgatgtagtacagaaactac

SEQ ID NO: 45373 - DNA, 25 bp, Mus musculus
ggtcctgctactcgctcgtgccaag

SEQ ID NO: 45374 - DNA, 25 bp, Mus musculus
ggtcctggaaacacctgcatggttt

SEQ ID NO: 45375 - DNA, 25 bp, Mus musculus
ggtcctggctgttgttgaagagtct

SEQ ID NO: 45376 - DNA, 25 bp, Mus musculus
ggtcctgggtggcatgttcttcctt

SEQ ID NO: 45377 - DNA, 25 bp, Mus musculus
ggtcctggtcgtcctctacagaagg

SEQ ID NO: 45378 - DNA, 25 bp, Mus musculus
ggtcctggtgtcttcgtcgcggctt

SEQ ID NO: 45379 - DNA, 25 bp, Mus musculus
ggtcctgtaaacaagattcaaaaca

SEQ ID NO: 45380 - DNA, 25 bp, Mus musculus
ggtcctgtctcggtggcgagtattt

SEQ ID NO: 45381 - DNA, 25 bp, Mus musculus
ggtccttaccttgttcctggcgctg

SEQ ID NO: 45382 - DNA, 25 bp, Mus musculus
ggtccttcgcacaataaaagcagcc

SEQ ID NO: 45383 - DNA, 25 bp, Mus musculus
ggtcctttgcctcattcgcccagga

SEQ ID NO: 45384 - DNA, 25 bp, Mus musculus
ggtcctttgcctgattcgcccagga

SEQ ID NO: 45385 - DNA, 25 bp, Mus musculus
ggtcgaattacacacgcaagactgg

SEQ ID NO: 45386 - DNA, 25 bp, Mus musculus
ggtcgacaaatcagaaccaattggg

SEQ ID NO: 45387 - DNA, 25 bp, Mus musculus
ggtcgagaagtgagcacaacttggt

SEQ ID NO: 45388 - DNA, 25 bp, Mus musculus
ggtcgagtgcagttcacactttcct

SEQ ID NO: 45389 - DNA, 25 bp, Mus musculus
ggtcgatccagaagtgccacaatgg

SEQ ID NO: 45390 - DNA, 25 bp, Mus musculus
ggtcgcagtcgacaacatcagacgt

SEQ ID NO: 45391 - DNA, 25 bp, Mus musculus
ggtcgcatggtgaagcaccagtgct

SEQ ID NO: 45392 - DNA, 25 bp, Mus musculus
ggtcgctatgttccaggaacttcag

SEQ ID NO: 45393 - DNA, 25 bp, Mus musculus
ggtcgctctggatatccaggcctac

SEQ ID NO: 45394 - DNA, 25 bp, Mus musculus
ggtcggcctcgcaccagtcagtcag

SEQ ID NO: 45395 - DNA, 25 bp, Mus musculus
ggtcggcggatcagaatggcactac

SEQ ID NO: 45396 - DNA, 25 bp, Mus musculus
ggtcgggaaatcagcctctgggaac

SEQ ID NO: 45397 - DNA, 25 bp, Mus musculus
ggtcggtcgggtaagaacagctcca

SEQ ID NO: 45398 - DNA, 25 bp, Mus musculus
ggtcggtcgggttagaacagctcca

SEQ ID NO: 45399 - DNA, 25 bp, Mus musculus
ggtcgtcctaccaatgtgatgtgct

SEQ ID NO: 45400 - DNA, 25 bp, Mus musculus
ggtcgtcgtacagaatgccacggtc

SEQ ID NO: 45401 - DNA, 25 bp, Mus musculus
ggtcgtctctacctgttcagcttca

SEQ ID NO: 45402 - DNA, 25 bp, Mus musculus
ggtcgtggacttcctgctcaaggcc

SEQ ID NO: 45403 - DNA, 25 bp, Mus musculus
ggtcgtgtgagcacctcattatggt

SEQ ID NO: 45404 - DNA, 25 bp, Mus musculus
ggtcgttcatgagccatgagctgcg

SEQ ID NO: 45405 - DNA, 25 bp, Mus musculus
ggtctaaatgcctcctccgagtatg

SEQ ID NO: 45406 - DNA, 25 bp, Mus musculus
ggtctaaatgtcctgactaactgtg

SEQ ID NO: 45407 - DNA, 25 bp, Mus musculus
ggtctaacctctatcgggtctgcta

SEQ ID NO: 45408 - DNA, 25 bp, Mus musculus
ggtctaatgccaggaacagcataca

SEQ ID NO: 45409 - DNA, 25 bp, Mus musculus
ggtctacaaactctaaaacaaatgg

SEQ ID NO: 45410 - DNA, 25 bp, Mus musculus
ggtctaccgacatgacaagaggatc

SEQ ID NO: 45411 - DNA, 25 bp, Mus musculus
ggtctacgctcacctgtgcaacgtg

SEQ ID NO: 45412 - DNA, 25 bp, Mus musculus
ggtctacgctcagctgtgcaacgtg

SEQ ID NO: 45413 - DNA, 25 bp, Mus musculus
ggtctactggcttcaccctgccttt

SEQ ID NO: 45414 - DNA, 25 bp, Mus musculus
ggtctagctcccgaggtggccgatc

SEQ ID NO: 45415 - DNA, 25 bp, Mus musculus
ggtctagtaaagagtccgccttccg

SEQ ID NO: 45416 - DNA, 25 bp, Mus musculus
ggtctatttcaccacgtcactgcct

SEQ ID NO: 45417 - DNA, 25 bp, Mus musculus
ggtctcaaacgaagagattctgtct

SEQ ID NO: 45418 - DNA, 25 bp, Mus musculus
ggtctcaagctgttccgtaatctca

SEQ ID NO: 45419 - DNA, 25 bp, Mus musculus
ggtctcactccatgtcgcttcactg

SEQ ID NO: 45420 - DNA, 25 bp, Mus musculus
ggtctcagccttttctcatccgatg

SEQ ID NO: 45421 - DNA, 25 bp, Mus musculus
ggtctcaggttagatccttgcacag

SEQ ID NO: 45422 - DNA, 25 bp, Mus musculus
ggtctcatctgtccgtcagagaatg

SEQ ID NO: 45423 - DNA, 25 bp, Mus musculus
ggtctcattatgcaggctaggctga

SEQ ID NO: 45424 - DNA, 25 bp, Mus musculus
ggtctcatttcccagtgtgacattg

SEQ ID NO: 45425 - DNA, 25 bp, Mus musculus
ggtctccaaggtcacaaagttcatt

SEQ ID NO: 45426 - DNA, 25 bp, Mus musculus
ggtctccacggagcagggctctgca

SEQ ID NO: 45427 - DNA, 25 bp, Mus musculus
ggtctccactcaatggctcagcaca

SEQ ID NO: 45428 - DNA, 25 bp, Mus musculus
ggtctccagggctacaaatctgcct

SEQ ID NO: 45429 - DNA, 25 bp, Mus musculus
ggtctccagggttgtcttcatctac

SEQ ID NO: 45430 - DNA, 25 bp, Mus musculus
ggtctccatgtctccacagtcgctg

SEQ ID NO: 45431 - DNA, 25 bp, Mus musculus
ggtctccccaacagctgacagtttc

SEQ ID NO: 45432 - DNA, 25 bp, Mus musculus
ggtctcccggctgtttgcctatatg

SEQ ID NO: 45433 - DNA, 25 bp, Mus musculus
ggtctccttatcacagtatcccaga

SEQ ID NO: 45434 - DNA, 25 bp, Mus musculus
ggtctcggatagtggctttcggaca

SEQ ID NO: 45435 - DNA, 25 bp, Mus musculus
ggtctcgtttttggcctctgtgtac

SEQ ID NO: 45436 - DNA, 25 bp, Mus musculus
ggtctctccacattgtccagacatt

SEQ ID NO: 45437 - DNA, 25 bp, Mus musculus
ggtctctgaaaagcaccttacacat

SEQ ID NO: 45438 - DNA, 25 bp, Mus musculus
ggtctctgggcgcttcttcctacta

SEQ ID NO: 45439 - DNA, 25 bp, Mus musculus
ggtctctgtgtctgcagccaccctg

SEQ ID NO: 45440 - DNA, 25 bp, Mus musculus
ggtctcttacaaagtccaagcgctc

SEQ ID NO: 45441 - DNA, 25 bp, Mus musculus
ggtctgaaaccgcatctgcttgtcc

SEQ ID NO: 45442 - DNA, 25 bp, Mus musculus
ggtctgaaccaaccttccagtgact

SEQ ID NO: 45443 - DNA, 25 bp, Mus musculus
ggtctgaaccaagcttccagtgact

SEQ ID NO: 45444 - DNA, 25 bp, Mus musculus
ggtctgaattaagaagctaagctgg

SEQ ID NO: 45445 - DNA, 25 bp, Mus musculus
ggtctgactacagaaacatcattgg

SEQ ID NO: 45446 - DNA, 25 bp, Mus musculus
ggtctgcacagcacccacacataag

SEQ ID NO: 45447 - DNA, 25 bp, Mus musculus
ggtctgcagcccatagtgaaccaca

SEQ ID NO: 45448 - DNA, 25 bp, Mus musculus
ggtctgcagggtatagcacagccat

SEQ ID NO: 45449 - DNA, 25 bp, Mus musculus
ggtctgcatttgctaaggcaaagcc

SEQ ID NO: 45450 - DNA, 25 bp, Mus musculus
ggtctgcctattggcttctccttgc

SEQ ID NO: 45451 - DNA, 25 bp, Mus musculus
ggtctgcgctaaacaactcaacgag

SEQ ID NO: 45452 - DNA, 25 bp, Mus musculus
ggtctgcgctaatcaactcaacgag

SEQ ID NO: 45453 - DNA, 25 bp, Mus musculus
ggtctgctcccagccgtgatgatga

SEQ ID NO: 45454 - DNA, 25 bp, Mus musculus
ggtctgctgagtccgcagcactcag

SEQ ID NO: 45455 - DNA, 25 bp, Mus musculus
ggtctgctgttaaaaggttttctat

SEQ ID NO: 45456 - DNA, 25 bp, Mus musculus
ggtctggaccacatcgctgagaaca

SEQ ID NO: 45457 - DNA, 25 bp, Mus musculus
ggtctggaggaaaacttccataaag

SEQ ID NO: 45458 - DNA, 25 bp, Mus musculus
ggtctggttttgcagccttgatgtt

SEQ ID NO: 45459 - DNA, 25 bp, Mus musculus
ggtctgtcctccatgtttgggaaca

SEQ ID NO: 45460 - DNA, 25 bp, Mus musculus
ggtctgtcctgtccatgttccacag

SEQ ID NO: 45461 - DNA, 25 bp, Mus musculus
ggtctgtcctgtgcatgttccacag

SEQ ID NO: 45462 - DNA, 25 bp, Mus musculus
ggtctgtggacaaagaccactgcga

SEQ ID NO: 45463 - DNA, 25 bp, Mus musculus
ggtcttaaacagttacatgagaacc

SEQ ID NO: 45464 - DNA, 25 bp, Mus musculus
ggtcttactgtttactccttgaact

SEQ ID NO: 45465 - DNA, 25 bp, Mus musculus
ggtcttaggcagacacaaagaaagc

SEQ ID NO: 45466 - DNA, 25 bp, Mus musculus
ggtcttaggcagtcacaaagaaagc

SEQ ID NO: 45467 - DNA, 25 bp, Mus musculus
ggtcttatgactttacagagcagcc

SEQ ID NO: 45468 - DNA, 25 bp, Mus musculus
ggtcttcaatgtagtcccctggatg

SEQ ID NO: 45469 - DNA, 25 bp, Mus musculus
ggtcttcaccccaaaggatggcagc

SEQ ID NO: 45470 - DNA, 25 bp, Mus musculus
ggtcttcacccgtgtgtctgcctat

SEQ ID NO: 45471 - DNA, 25 bp, Mus musculus
ggtcttcacctggatcatggcgttg

SEQ ID NO: 45472 - DNA, 25 bp, Mus musculus
ggtcttcagtgggtgcccaaggaca

SEQ ID NO: 45473 - DNA, 25 bp, Mus musculus
ggtcttccagacagactatgggcag

SEQ ID NO: 45474 - DNA, 25 bp, Mus musculus
ggtcttccgcaggattgcgaagttc

SEQ ID NO: 45475 - DNA, 25 bp, Mus musculus
ggtcttcgtcgaaaggtccagtcaa

SEQ ID NO: 45476 - DNA, 25 bp, Mus musculus
ggtcttctacctctccatcaatgca

SEQ ID NO: 45477 - DNA, 25 bp, Mus musculus
ggtcttctcgccagagacactcagg

SEQ ID NO: 45478 - DNA, 25 bp, Mus musculus
ggtcttgaatttaggacagtcctcc

SEQ ID NO: 45479 - DNA, 25 bp, Mus musculus
ggtcttgacaatgttcacaaacaga

SEQ ID NO: 45480 - DNA, 25 bp, Mus musculus
ggtcttgactgccttgctggatcat

SEQ ID NO: 45481 - DNA, 25 bp, Mus musculus
ggtcttgattccatcaccttctaca

SEQ ID NO: 45482 - DNA, 25 bp, Mus musculus
ggtcttgcccttccccaagacggag

SEQ ID NO: 45483 - DNA, 25 bp, Mus musculus
ggtcttgccgtgagcccttgtgtgt

SEQ ID NO: 45484 - DNA, 25 bp, Mus musculus
ggtcttgggccctcagggcaaaaga

SEQ ID NO: 45485 - DNA, 25 bp, Mus musculus
ggtctttatgtatggacacaaagaa

SEQ ID NO: 45486 - DNA, 25 bp, Mus musculus
ggtctttcaggttagtcctagcaag

SEQ ID NO: 45487 - DNA, 25 bp, Mus musculus
ggtctttccccatcccaacagaatg

SEQ ID NO: 45488 - DNA, 25 bp, Mus musculus
ggtctttgggactcaaacctggaat

SEQ ID NO: 45489 - DNA, 25 bp, Mus musculus
ggtgaaaaatttggacccttcgctg

SEQ ID NO: 45490 - DNA, 25 bp, Mus musculus
ggtgaaaaccaaggtaccttggatg

SEQ ID NO: 45491 - DNA, 25 bp, Mus musculus
ggtgaaagagcaacgaaaccattgc

SEQ ID NO: 45492 - DNA, 25 bp, Mus musculus
ggtgaaaggcctgtgtcagaaatgc

SEQ ID NO: 45493 - DNA, 25 bp, Mus musculus
ggtgaaattcccaaagagcagtgga

SEQ ID NO: 45494 - DNA, 25 bp, Mus musculus
ggtgaacagataccagcctgaagtc

SEQ ID NO: 45495 - DNA, 25 bp, Mus musculus
ggtgaaccacccaaagatagtagct

SEQ ID NO: 45496 - DNA, 25 bp, Mus musculus
ggtgaaccagacagtgttcctggct

SEQ ID NO: 45497 - DNA, 25 bp, Mus musculus
ggtgaacgaagaaggcactgcctgt

SEQ ID NO: 45498 - DNA, 25 bp, Mus musculus
ggtgaacgaagatggcactgcctgt

SEQ ID NO: 45499 - DNA, 25 bp, Mus musculus
ggtgaactagcctcctatgatatgc

SEQ ID NO: 45500 - DNA, 25 bp, Mus musculus
ggtgaactgacccagatgcccacta

SEQ ID NO: 45501 - DNA, 25 bp, Mus musculus
ggtgaactgaccgagatgcccacta

SEQ ID NO: 45502 - DNA, 25 bp, Mus musculus
ggtgaactttagtaccaaatagcta

SEQ ID NO: 45503 - DNA, 25 bp, Mus musculus
ggtgaagaaactccacacagcaaca

SEQ ID NO: 45504 - DNA, 25 bp, Mus musculus
ggtgaagaactacctggcatctact

SEQ ID NO: 45505 - DNA, 25 bp, Mus musculus
ggtgaagagcattacaggcagttac

SEQ ID NO: 45506 - DNA, 25 bp, Mus musculus
ggtgaagatctgataagaatgagga

SEQ ID NO: 45507 - DNA, 25 bp, Mus musculus
ggtgaagatgacacctttctaacag

SEQ ID NO: 45508 - DNA, 25 bp, Mus musculus
ggtgaagcaccgaaacaaaaagcca

SEQ ID NO: 45509 - DNA, 25 bp, Mus musculus
ggtgaagcaccgtaacaaaaagcca

SEQ ID NO: 45510 - DNA, 25 bp, Mus musculus
ggtgaagcataaacttatagcgtgg

SEQ ID NO: 45511 - DNA, 25 bp, Mus musculus
ggtgaagcctttggccgcttctctc

SEQ ID NO: 45512 - DNA, 25 bp, Mus musculus
ggtgaaggccccaggctctcagctt

SEQ ID NO: 45513 - DNA, 25 bp, Mus musculus
ggtgaaggcgactatctggatgact

SEQ ID NO: 45514 - DNA, 25 bp, Mus musculus
ggtgaagtgctaaaacagttaacag

SEQ ID NO: 45515 - DNA, 25 bp, Mus musculus
ggtgaagttcctcgccaagtttggt

SEQ ID NO: 45516 - DNA, 25 bp, Mus musculus
ggtgaatatagtgaggccatcccaa

SEQ ID NO: 45517 - DNA, 25 bp, Mus musculus
ggtgaatctgaggagcagatccaga

SEQ ID NO: 45518 - DNA, 25 bp, Mus musculus
ggtgaatctgcttccatggaaaagg

SEQ ID NO: 45519 - DNA, 25 bp, Mus musculus
ggtgaatgcagctgacgctttcgac

SEQ ID NO: 45520 - DNA, 25 bp, Mus musculus
ggtgaatggattctctaacaactac

SEQ ID NO: 45521 - DNA, 25 bp, Mus musculus
ggtgaatggcttgcctcggctcaca

SEQ ID NO: 45522 - DNA, 25 bp, Mus musculus
ggtgaatgggtatctttcccggaat

SEQ ID NO: 45523 - DNA, 25 bp, Mus musculus
ggtgaatgtggcctccctgctccag

SEQ ID NO: 45524 - DNA, 25 bp, Mus musculus
ggtgaattcagatctggtggtgtct

SEQ ID NO: 45525 - DNA, 25 bp, Mus musculus
ggtgaattctggtaattacgtggag

SEQ ID NO: 45526 - DNA, 25 bp, Mus musculus
ggtgacaaacaagatgccctggact

SEQ ID NO: 45527 - DNA, 25 bp, Mus musculus
ggtgacaccctcaggagacaagagt

SEQ ID NO: 45528 - DNA, 25 bp, Mus musculus
ggtgacaccgtggaggaagctttct

SEQ ID NO: 45529 - DNA, 25 bp, Mus musculus
ggtgacagactatggagcttttatc

SEQ ID NO: 45530 - DNA, 25 bp, Mus musculus
ggtgacatcagcaacgcggtgataa

SEQ ID NO: 45531 - DNA, 25 bp, Mus musculus
ggtgaccaatgagcccatcttagca

SEQ ID NO: 45532 - DNA, 25 bp, Mus musculus
ggtgaccatcacctttgccactgac

SEQ ID NO: 45533 - DNA, 25 bp, Mus musculus
ggtgaccattaaacgttctgctcga

SEQ ID NO: 45534 - DNA, 25 bp, Mus musculus
ggtgaccattaatcgttctgctcga

SEQ ID NO: 45535 - DNA, 25 bp, Mus musculus
ggtgacccagaaggaaatctgtgac

SEQ ID NO: 45536 - DNA, 25 bp, Mus musculus
ggtgaccccagggacaacggatcag

SEQ ID NO: 45537 - DNA, 25 bp, Mus musculus
ggtgaccccatcactatcattgagg

SEQ ID NO: 45538 - DNA, 25 bp, Mus musculus
ggtgaccctgctgtctgactatgaa

SEQ ID NO: 45539 - DNA, 25 bp, Mus musculus
ggtgacccttttaatgggactgatt

SEQ ID NO: 45540 - DNA, 25 bp, Mus musculus
ggtgacctaaatcctcggacggacg

SEQ ID NO: 45541 - DNA, 25 bp, Mus musculus
ggtgacctaccccaagctttgtgat

SEQ ID NO: 45542 - DNA, 25 bp, Mus musculus
ggtgaccttcagcttcgaaaactgg

SEQ ID NO: 45543 - DNA, 25 bp, Mus musculus
ggtgacgactgtaccacctgtgtct

SEQ ID NO: 45544 - DNA, 25 bp, Mus musculus
ggtgacgcctctaaagagtcatggc

SEQ ID NO: 45545 - DNA, 25 bp, Mus musculus
ggtgactcggcctcgtgtacctcca

SEQ ID NO: 45546 - DNA, 25 bp, Mus musculus
ggtgactctgattctcatagctgtc

SEQ ID NO: 45547 - DNA, 25 bp, Mus musculus
ggtgactgactgagtttggaagcct

SEQ ID NO: 45548 - DNA, 25 bp, Mus musculus
ggtgactgatttttaagaaatcggc

SEQ ID NO: 45549 - DNA, 25 bp, Mus musculus
ggtgactttcatctatcagaaactc

SEQ ID NO: 45550 - DNA, 25 bp, Mus musculus
ggtgagaacagtttgcttccagcct

SEQ ID NO: 45551 - DNA, 25 bp, Mus musculus
ggtgagacgcaggttccctcgtcaa

SEQ ID NO: 45552 - DNA, 25 bp, Mus musculus
ggtgagatcaccaaggagaagcttc

SEQ ID NO: 45553 - DNA, 25 bp, Mus musculus
ggtgagatcctctccgaagaggaac

SEQ ID NO: 45554 - DNA, 25 bp, Mus musculus
ggtgagatctgtttgaacagtatgc

SEQ ID NO: 45555 - DNA, 25 bp, Mus musculus
ggtgagatctttggcagtttatata

SEQ ID NO: 45556 - DNA, 25 bp, Mus musculus
ggtgagatgaacagattttgccagg

SEQ ID NO: 45557 - DNA, 25 bp, Mus musculus
ggtgagattgcctctacctttgatc

SEQ ID NO: 45558 - DNA, 25 bp, Mus musculus
ggtgagcaagactggcaagcacatt

SEQ ID NO: 45559 - DNA, 25 bp, Mus musculus
ggtgagcaagagtagagtccagttc

SEQ ID NO: 45560 - DNA, 25 bp, Mus musculus
ggtgagcagactactccatttgcac

SEQ ID NO: 45561 - DNA, 25 bp, Mus musculus
ggtgagcatcttctctatttccagc

SEQ ID NO: 45562 - DNA, 25 bp, Mus musculus
ggtgagccatcagttccagaatata

SEQ ID NO: 45563 - DNA, 25 bp, Mus musculus
ggtgagctcattctcttacaacagc

SEQ ID NO: 45564 - DNA, 25 bp, Mus musculus
ggtgaggacccctggtaccagaaag

SEQ ID NO: 45565 - DNA, 25 bp, Mus musculus
ggtgaggactccaccagtctggtgc

SEQ ID NO: 45566 - DNA, 25 bp, Mus musculus
ggtgaggactgatggacatacatta

SEQ ID NO: 45567 - DNA, 25 bp, Mus musculus
ggtgaggcccatggcctcattaccg

SEQ ID NO: 45568 - DNA, 25 bp, Mus musculus
ggtgaggtcacatgcccaaggccca

SEQ ID NO: 45569 - DNA, 25 bp, Mus musculus
ggtgagtcagcacccggccagaatc

SEQ ID NO: 45570 - DNA, 25 bp, Mus musculus
ggtgagttcttaagctcactcatgt

SEQ ID NO: 45571 - DNA, 25 bp, Mus musculus
ggtgagttggtgaaaacagaagact

SEQ ID NO: 45572 - DNA, 25 bp, Mus musculus
ggtgatacacagcagaatcgttagc

SEQ ID NO: 45573 - DNA, 25 bp, Mus musculus
ggtgatacctccctgaggatattca

SEQ ID NO: 45574 - DNA, 25 bp, Mus musculus
ggtgatagctcccaagggtgtctct

SEQ ID NO: 45575 - DNA, 25 bp, Mus musculus
ggtgatatcacattggtcattccta

SEQ ID NO: 45576 - DNA, 25 bp, Mus musculus
ggtgatcaacgaggagtacaaaata

SEQ ID NO: 45577 - DNA, 25 bp, Mus musculus
ggtgatcaccgcttttggtccagga

SEQ ID NO: 45578 - DNA, 25 bp, Mus musculus
ggtgatcacggctcagcaagcgact

SEQ ID NO: 45579 - DNA, 25 bp, Mus musculus
ggtgatccagaggacttttgtcaag

SEQ ID NO: 45580 - DNA, 25 bp, Mus musculus
ggtgatccagccattggctcaggcc

SEQ ID NO: 45581 - DNA, 25 bp, Mus musculus
ggtgatcctgcctacaccagaggag

SEQ ID NO: 45582 - DNA, 25 bp, Mus musculus
ggtgatctaccaacgtccattgcgg

SEQ ID NO: 45583 - DNA, 25 bp, Mus musculus
ggtgatctctaacaagacgaaggaa

SEQ ID NO: 45584 - DNA, 25 bp, Mus musculus
ggtgatctctaagaagacgaaggaa

SEQ ID NO: 45585 - DNA, 25 bp, Mus musculus
ggtgatctgctttgcctgtttcctc

SEQ ID NO: 45586 - DNA, 25 bp, Mus musculus
ggtgatgaccaagtaccagaccagt

SEQ ID NO: 45587 - DNA, 25 bp, Mus musculus
ggtgatgactacaaaagccatgtga

SEQ ID NO: 45588 - DNA, 25 bp, Mus musculus
ggtgatgccaccctttatgagatga

SEQ ID NO: 45589 - DNA, 25 bp, Mus musculus
ggtgatgctacagaccacgtgcgct

SEQ ID NO: 45590 - DNA, 25 bp, Mus musculus
ggtgatgctccgaggctcaggcatc

SEQ ID NO: 45591 - DNA, 25 bp, Mus musculus
ggtgatgctgcccaactcccctgag

SEQ ID NO: 45592 - DNA, 25 bp, Mus musculus
ggtgatggcattttcccaaaaagcc

SEQ ID NO: 45593 - DNA, 25 bp, Mus musculus
ggtgatggcggaagccaatcatttc

SEQ ID NO: 45594 - DNA, 25 bp, Mus musculus
ggtgatgtaacaattctacctaaat

SEQ ID NO: 45595 - DNA, 25 bp, Mus musculus
ggtgatgtcagttccaatatttcca

SEQ ID NO: 45596 - DNA, 25 bp, Mus musculus
ggtgatgttacacggaataaagtca

SEQ ID NO: 45597 - DNA, 25 bp, Mus musculus
ggtgatgttcacctgcccattgctt

SEQ ID NO: 45598 - DNA, 25 bp, Mus musculus
ggtgatgtttgtgtctgtgttctgc

SEQ ID NO: 45599 - DNA, 25 bp, Mus musculus
ggtgattatcacatccgtctatgtt

SEQ ID NO: 45600 - DNA, 25 bp, Mus musculus
ggtgattatcacttccgtctatgtt

SEQ ID NO: 45601 - DNA, 25 bp, Mus musculus
ggtgattctgctgctgaccaattct

SEQ ID NO: 45602 - DNA, 25 bp, Mus musculus
ggtgattctggccatccggaaagct

SEQ ID NO: 45603 - DNA, 25 bp, Mus musculus
ggtgcaactgaaagagcaagaagtg

SEQ ID NO: 45604 - DNA, 25 bp, Mus musculus
ggtgcaataactcccagcttccagt

SEQ ID NO: 45605 - DNA, 25 bp, Mus musculus
ggtgcaccagctacaacccaaacga

SEQ ID NO: 45606 - DNA, 25 bp, Mus musculus
ggtgcaccgtatcctactagagaaa

SEQ ID NO: 45607 - DNA, 25 bp, Mus musculus
ggtgcaccgtatgctactagagaaa

SEQ ID NO: 45608 - DNA, 25 bp, Mus musculus
ggtgcacctgctgattcggtaccgc

SEQ ID NO: 45609 - DNA, 25 bp, Mus musculus
ggtgcacgcctcattgctcatgctg

SEQ ID NO: 45610 - DNA, 25 bp, Mus musculus
ggtgcacgtccgtgttctggcctca

SEQ ID NO: 45611 - DNA, 25 bp, Mus musculus
ggtgcactcgctgaagctgctggca

SEQ ID NO: 45612 - DNA, 25 bp, Mus musculus
ggtgcagaaccatgctgacctgctg

SEQ ID NO: 45613 - DNA, 25 bp, Mus musculus
ggtgcagagattccgtccagacttc

SEQ ID NO: 45614 - DNA, 25 bp, Mus musculus
ggtgcagagcatgtatatctttaag

SEQ ID NO: 45615 - DNA, 25 bp, Mus musculus
ggtgcagagttccagtacctctaca

SEQ ID NO: 45616 - DNA, 25 bp, Mus musculus
ggtgcagatcgacaatgccaagctg

SEQ ID NO: 45617 - DNA, 25 bp, Mus musculus
ggtgcagcaagtactcaacattgag

SEQ ID NO: 45618 - DNA, 25 bp, Mus musculus
ggtgcagcatttacagaaggcgttt

SEQ ID NO: 45619 - DNA, 25 bp, Mus musculus
ggtgcagctcatctgtggatactgc

SEQ ID NO: 45620 - DNA, 25 bp, Mus musculus
ggtgcagctgggtttgacaaaccct

SEQ ID NO: 45621 - DNA, 25 bp, Mus musculus
ggtgcagctttcagaaaactcgagt

SEQ ID NO: 45622 - DNA, 25 bp, Mus musculus
ggtgcaggaaagatgttcacttcag

SEQ ID NO: 45623 - DNA, 25 bp, Mus musculus
ggtgcaggccatccgccgtgtcatc

SEQ ID NO: 45624 - DNA, 25 bp, Mus musculus
ggtgcagtcaaagccatagcctcgg

SEQ ID NO: 45625 - DNA, 25 bp, Mus musculus
ggtgcagtggaggattacttcatcg

SEQ ID NO: 45626 - DNA, 25 bp, Mus musculus
ggtgcatcaacaaggaaggctcctt

SEQ ID NO: 45627 - DNA, 25 bp, Mus musculus
ggtgcatcaacatggaaggctcctt

SEQ ID NO: 45628 - DNA, 25 bp, Mus musculus
ggtgcatccaatttttcaactttac

SEQ ID NO: 45629 - DNA, 25 bp, Mus musculus
ggtgcatgacctgacaaaggttgtc

SEQ ID NO: 45630 - DNA, 25 bp, Mus musculus
ggtgcatgctaagtaggaagtctag

SEQ ID NO: 45631 - DNA, 25 bp, Mus musculus
ggtgcattcagcctttggtgatcct

SEQ ID NO: 45632 - DNA, 25 bp, Mus musculus
ggtgcattccagtcaaaaacagagc

SEQ ID NO: 45633 - DNA, 25 bp, Mus musculus
ggtgccaacctctgacaaaggccgc

SEQ ID NO: 45634 - DNA, 25 bp, Mus musculus
ggtgccaagctcaggcctcagaagg

SEQ ID NO: 45635 - DNA, 25 bp, Mus musculus
ggtgccaccgcagtctttaacactg

SEQ ID NO: 45636 - DNA, 25 bp, Mus musculus
ggtgccactgatacccaggctggtg

SEQ ID NO: 45637 - DNA, 25 bp, Mus musculus
ggtgccactgtcaaacctgcatgtg

SEQ ID NO: 45638 - DNA, 25 bp, Mus musculus
ggtgccacttccatttctaactcta

SEQ ID NO: 45639 - DNA, 25 bp, Mus musculus
ggtgccagaaaaggatcggatcctc

SEQ ID NO: 45640 - DNA, 25 bp, Mus musculus
ggtgccagagtggttgcctttgaaa

SEQ ID NO: 45641 - DNA, 25 bp, Mus musculus
ggtgccagcaactagctgcatatgg

SEQ ID NO: 45642 - DNA, 25 bp, Mus musculus
ggtgccagccctttcatttcaagta

SEQ ID NO: 45643 - DNA, 25 bp, Mus musculus
ggtgccagcgttttcatcttttctc

SEQ ID NO: 45644 - DNA, 25 bp, Mus musculus
ggtgccatccagtttgtcacacagt

SEQ ID NO: 45645 - DNA, 25 bp, Mus musculus
ggtgccatgcgcacagtatctgaaa

SEQ ID NO: 45646 - DNA, 25 bp, Mus musculus
ggtgccatttgttccctggtttgtg

SEQ ID NO: 45647 - DNA, 25 bp, Mus musculus
ggtgcccacaggagatccagccttg

SEQ ID NO: 45648 - DNA, 25 bp, Mus musculus
ggtgcccagcccagattggcagact

SEQ ID NO: 45649 - DNA, 25 bp, Mus musculus
ggtgcccagccctcggtagaggctc

SEQ ID NO: 45650 - DNA, 25 bp, Mus musculus
ggtgcccatggtaatatcggtttaa

SEQ ID NO: 45651 - DNA, 25 bp, Mus musculus
ggtgcccattcctttggttgctaca

SEQ ID NO: 45652 - DNA, 25 bp, Mus musculus
ggtgccctgtaattctcagttggaa

SEQ ID NO: 45653 - DNA, 25 bp, Mus musculus
ggtgcccttctacattggttacttt

SEQ ID NO: 45654 - DNA, 25 bp, Mus musculus
ggtgccgtccatcttcgcggctgca

SEQ ID NO: 45655 - DNA, 25 bp, Mus musculus
ggtgcctaccactatgctgtctatt

SEQ ID NO: 45656 - DNA, 25 bp, Mus musculus
ggtgcctcttttctgcctaaaagca

SEQ ID NO: 45657 - DNA, 25 bp, Mus musculus
ggtgcctggcgccagacaatccaat

SEQ ID NO: 45658 - DNA, 25 bp, Mus musculus
ggtgcctggcgcgagacaatccaat

SEQ ID NO: 45659 - DNA, 25 bp, Mus musculus
ggtgcctggtacagatctgcgacaa

SEQ ID NO: 45660 - DNA, 25 bp, Mus musculus
ggtgcgaagatcgatgccaagacca

SEQ ID NO: 45661 - DNA, 25 bp, Mus musculus
ggtgcgagatccacagctagtgcgc

SEQ ID NO: 45662 - DNA, 25 bp, Mus musculus
ggtgcgcactgtccttcactctgtc

SEQ ID NO: 45663 - DNA, 25 bp, Mus musculus
ggtgcggatttcaaagcccaagacg

SEQ ID NO: 45664 - DNA, 25 bp, Mus musculus
ggtgcggttttcagcattccagttg

SEQ ID NO: 45665 - DNA, 25 bp, Mus musculus
ggtgctaagaaaccatggcatggtc

SEQ ID NO: 45666 - DNA, 25 bp, Mus musculus
ggtgctacatgtgtgctttcagagc

SEQ ID NO: 45667 - DNA, 25 bp, Mus musculus
ggtgctactacgctactatgagtct

SEQ ID NO: 45668 - DNA, 25 bp, Mus musculus
ggtgctaggaaatgacctcgggtcc

SEQ ID NO: 45669 - DNA, 25 bp, Mus musculus
ggtgctatccctggtattagggctt

SEQ ID NO: 45670 - DNA, 25 bp, Mus musculus
ggtgctcacttcgtccagctgtgct

SEQ ID NO: 45671 - DNA, 25 bp, Mus musculus
ggtgctccactcagttctgctgagg

SEQ ID NO: 45672 - DNA, 25 bp, Mus musculus
ggtgctccctggaacaagtgatccg

SEQ ID NO: 45673 - DNA, 25 bp, Mus musculus
ggtgctccgtgtcggcagtaaacct

SEQ ID NO: 45674 - DNA, 25 bp, Mus musculus
ggtgctctgagccacagtgcgcttc

SEQ ID NO: 45675 - DNA, 25 bp, Mus musculus
ggtgctctggacatgttgaccaaga

SEQ ID NO: 45676 - DNA, 25 bp, Mus musculus
ggtgctgaaagcttacgtcatggag

SEQ ID NO: 45677 - DNA, 25 bp, Mus musculus
ggtgctgaatctccaatcagctcat

SEQ ID NO: 45678 - DNA, 25 bp, Mus musculus
ggtgctgaccattgttcccacagtg

SEQ ID NO: 45679 - DNA, 25 bp, Mus musculus
ggtgctgaggaacggccaaacatct

SEQ ID NO: 45680 - DNA, 25 bp, Mus musculus
ggtgctgaggaagggccaaacatct

SEQ ID NO: 45681 - DNA, 25 bp, Mus musculus
ggtgctgatacttttcaagcaaaaa

SEQ ID NO: 45682 - DNA, 25 bp, Mus musculus
ggtgctgcagagcatcaccaactcc

SEQ ID NO: 45683 - DNA, 25 bp, Mus musculus
ggtgctgccaaaccagagatacaat

SEQ ID NO: 45684 - DNA, 25 bp, Mus musculus
ggtgctggaagaagtgaatgcaatc

SEQ ID NO: 45685 - DNA, 25 bp, Mus musculus
ggtgctggctgcctcatcacagaag

SEQ ID NO: 45686 - DNA, 25 bp, Mus musculus
ggtgctgggtgatcctcgtgtataa

SEQ ID NO: 45687 - DNA, 25 bp, Mus musculus
ggtgctgtagatctctccgatccaa

SEQ ID NO: 45688 - DNA, 25 bp, Mus musculus
ggtgctgtctagattggctgaaata

SEQ ID NO: 45689 - DNA, 25 bp, Mus musculus
ggtgctgtgctcacactatatgtgg

SEQ ID NO: 45690 - DNA, 25 bp, Mus musculus
ggtgctgttatcaatcggatgagga

SEQ ID NO: 45691 - DNA, 25 bp, Mus musculus
ggtgcttactattcctcagtcccct

SEQ ID NO: 45692 - DNA, 25 bp, Mus musculus
ggtgcttggtcttttgctccataca

SEQ ID NO: 45693 - DNA, 25 bp, Mus musculus
ggtgcttgttgctcatactaactgg

SEQ ID NO: 45694 - DNA, 25 bp, Mus musculus
ggtggaaacatcagatgaggagatc

SEQ ID NO: 45695 - DNA, 25 bp, Mus musculus
ggtggaactactctgccgtggttaa

SEQ ID NO: 45696 - DNA, 25 bp, Mus musculus
ggtggaacttatatgctagtgaagc

SEQ ID NO: 45697 - DNA, 25 bp, Mus musculus
ggtggaagacaacaaccgttcacat

SEQ ID NO: 45698 - DNA, 25 bp, Mus musculus
ggtggaagagctggccctgacacaa

SEQ ID NO: 45699 - DNA, 25 bp, Mus musculus
ggtggaagatacctgtctgtgcttt

SEQ ID NO: 45700 - DNA, 25 bp, Mus musculus
ggtggaagctgtcaaagtacatagc

SEQ ID NO: 45701 - DNA, 25 bp, Mus musculus
ggtggaagtctccaagacagtaaag

SEQ ID NO: 45702 - DNA, 25 bp, Mus musculus
ggtggaatagcctaagtgatggcca

SEQ ID NO: 45703 - DNA, 25 bp, Mus musculus
ggtggaatagtcattccattctgta

SEQ ID NO: 45704 - DNA, 25 bp, Mus musculus
ggtggaatccctgaagaaactgctc

SEQ ID NO: 45705 - DNA, 25 bp, Mus musculus
ggtggaatctattgtcttcgccatt

SEQ ID NO: 45706 - DNA, 25 bp, Mus musculus
ggtggaatgcttccaaaagatatcc

SEQ ID NO: 45707 - DNA, 25 bp, Mus musculus
ggtggacaaatccttctcccttcga

SEQ ID NO: 45708 - DNA, 25 bp, Mus musculus
ggtggacaagctgacattaacatct

SEQ ID NO: 45709 - DNA, 25 bp, Mus musculus
ggtggacagcaagccctggtgaact

SEQ ID NO: 45710 - DNA, 25 bp, Mus musculus
ggtggacagtcaaaggttcagaagt

SEQ ID NO: 45711 - DNA, 25 bp, Mus musculus
ggtggacatacagcacttcctgcca

SEQ ID NO: 45712 - DNA, 25 bp, Mus musculus
ggtggaccacatgaacctcctgaag

SEQ ID NO: 45713 - DNA, 25 bp, Mus musculus
ggtggaccacctgataactttgcag

SEQ ID NO: 45714 - DNA, 25 bp, Mus musculus
ggtggaccgataagtactagaaaag

SEQ ID NO: 45715 - DNA, 25 bp, Mus musculus
ggtggacggaccaaaagccatcgat

SEQ ID NO: 45716 - DNA, 25 bp, Mus musculus
ggtggactatcaacccctgaaaggt

SEQ ID NO: 45717 - DNA, 25 bp, Mus musculus
ggtggactcagtactggctgctgac

SEQ ID NO: 45718 - DNA, 25 bp, Mus musculus
ggtggactgcccaattcttcttccc

SEQ ID NO: 45719 - DNA, 25 bp, Mus musculus
ggtggagagcaaccgtacccgcatc

SEQ ID NO: 45720 - DNA, 25 bp, Mus musculus
ggtggagcccatcctgaactgcagc

SEQ ID NO: 45721 - DNA, 25 bp, Mus musculus
ggtggagcccatgctgaactgcagc

SEQ ID NO: 45722 - DNA, 25 bp, Mus musculus
ggtggagccctctgtacttcaagtc

SEQ ID NO: 45723 - DNA, 25 bp, Mus musculus
ggtggagcctgtggcacacaaagac

SEQ ID NO: 45724 - DNA, 25 bp, Mus musculus
ggtggaggcagcaccaggtacctcc

SEQ ID NO: 45725 - DNA, 25 bp, Mus musculus
ggtggaggcagctccaggtacctcc

SEQ ID NO: 45726 - DNA, 25 bp, Mus musculus
ggtggagtactaccagtgtcactca

SEQ ID NO: 45727 - DNA, 25 bp, Mus musculus
ggtggagtcttaccaccatggacct

SEQ ID NO: 45728 - DNA, 25 bp, Mus musculus
ggtggatatctatcattccaggtta

SEQ ID NO: 45729 - DNA, 25 bp, Mus musculus
ggtggatcgctttaacctgctgccc

SEQ ID NO: 45730 - DNA, 25 bp, Mus musculus
ggtggatggtttcctagcctttcaa

SEQ ID NO: 45731 - DNA, 25 bp, Mus musculus
ggtggatgtgcctgccgcagacctt

SEQ ID NO: 45732 - DNA, 25 bp, Mus musculus
ggtggattcaggcaaccctacccat

SEQ ID NO: 45733 - DNA, 25 bp, Mus musculus
ggtggattttatcacattctgtacc

SEQ ID NO: 45734 - DNA, 25 bp, Mus musculus
ggtggcaagtccatctgcctcacta

SEQ ID NO: 45735 - DNA, 25 bp, Mus musculus
ggtggcaattttggaccaggaccag

SEQ ID NO: 45736 - DNA, 25 bp, Mus musculus
ggtggcacaactctaagaccaccca

SEQ ID NO: 45737 - DNA, 25 bp, Mus musculus
ggtggcacacaaaacctttcaccgt

SEQ ID NO: 45738 - DNA, 25 bp, Mus musculus
ggtggcacatctgtacgcacggcag

SEQ ID NO: 45739 - DNA, 25 bp, Mus musculus
ggtggcacttttgaccgcttgcaca

SEQ ID NO: 45740 - DNA, 25 bp, Mus musculus
ggtggcagccttttgtcatcagcaa

SEQ ID NO: 45741 - DNA, 25 bp, Mus musculus
ggtggcagctctaagaaccttggtg

SEQ ID NO: 45742 - DNA, 25 bp, Mus musculus
ggtggcatctctggcatatttaaat

SEQ ID NO: 45743 - DNA, 25 bp, Mus musculus
ggtggcatgttgtcctcaaccttga

SEQ ID NO: 45744 - DNA, 25 bp, Mus musculus
ggtggccaacaactgggttctgaca

SEQ ID NO: 45745 - DNA, 25 bp, Mus musculus
ggtggccacatgatgtaccctagtc

SEQ ID NO: 45746 - DNA, 25 bp, Mus musculus
ggtggccagcaagttcatcacgttg

SEQ ID NO: 45747 - DNA, 25 bp, Mus musculus
ggtggcccaggaacacaaagctcat

SEQ ID NO: 45748 - DNA, 25 bp, Mus musculus
ggtggccccaaaggacatgacattt

SEQ ID NO: 45749 - DNA, 25 bp, Mus musculus
ggtggccctaagtttattcatctga

SEQ ID NO: 45750 - DNA, 25 bp, Mus musculus
ggtggcctaggccaaggtcaccctt

SEQ ID NO: 45751 - DNA, 25 bp, Mus musculus
ggtggcctgtatcccagagcaagat

SEQ ID NO: 45752 - DNA, 25 bp, Mus musculus
ggtggccttccctgacaccaagaag

SEQ ID NO: 45753 - DNA, 25 bp, Mus musculus
ggtggccttgattgcttcgtcctga

SEQ ID NO: 45754 - DNA, 25 bp, Mus musculus
ggtggcgaggatcatgacatcttca

SEQ ID NO: 45755 - DNA, 25 bp, Mus musculus
ggtggcgaggatgatgacatcttca

SEQ ID NO: 45756 - DNA, 25 bp, Mus musculus
ggtggcggacaatcggttcagttta

SEQ ID NO: 45757 - DNA, 25 bp, Mus musculus
ggtggcgttccagctgtttgacaaa

SEQ ID NO: 45758 - DNA, 25 bp, Mus musculus
ggtggctaacttcctgcttgtcaac

SEQ ID NO: 45759 - DNA, 25 bp, Mus musculus
ggtggctagcatgaccaagcctact

SEQ ID NO: 45760 - DNA, 25 bp, Mus musculus
ggtggctattcttgcatctgtcgtc

SEQ ID NO: 45761 - DNA, 25 bp, Mus musculus
ggtggctcgagatgtgccccgccac

SEQ ID NO: 45762 - DNA, 25 bp, Mus musculus
ggtggctctcatgctgggaacaagt

SEQ ID NO: 45763 - DNA, 25 bp, Mus musculus
ggtggctctttgactgccttaccag

SEQ ID NO: 45764 - DNA, 25 bp, Mus musculus
ggtggctggatccaaacaaaccaat

SEQ ID NO: 45765 - DNA, 25 bp, Mus musculus
ggtggctgtaataagattctaagag

SEQ ID NO: 45766 - DNA, 25 bp, Mus musculus
ggtggcttactccatccatagccaa

SEQ ID NO: 45767 - DNA, 25 bp, Mus musculus
ggtggcttccgtggttgcacagttt

SEQ ID NO: 45768 - DNA, 25 bp, Mus musculus
ggtggcttcctacctggtgtcccac

SEQ ID NO: 45769 - DNA, 25 bp, Mus musculus
ggtgggaactcggtttcttgagtca

SEQ ID NO: 45770 - DNA, 25 bp, Mus musculus
ggtgggaatcatcactgccttcaat

SEQ ID NO: 45771 - DNA, 25 bp, Mus musculus
ggtgggaggaaccaattattacatt

SEQ ID NO: 45772 - DNA, 25 bp, Mus musculus
ggtgggagtcattcacatttatggg

SEQ ID NO: 45773 - DNA, 25 bp, Mus musculus
ggtgggcaatcttcctgttgccgtg

SEQ ID NO: 45774 - DNA, 25 bp, Mus musculus
ggtgggcccaacatcatcacacttg

SEQ ID NO: 45775 - DNA, 25 bp, Mus musculus
ggtgggtattgtgcaccctccttct

SEQ ID NO: 45776 - DNA, 25 bp, Mus musculus
ggtgggtcagctgccgccacttcta

SEQ ID NO: 45777 - DNA, 25 bp, Mus musculus
ggtgggtgttgcatgctgcccctcc

SEQ ID NO: 45778 - DNA, 25 bp, Mus musculus
ggtggtaactccttgctgggcaaga

SEQ ID NO: 45779 - DNA, 25 bp, Mus musculus
ggtggtacttcctccgcctattatc

SEQ ID NO: 45780 - DNA, 25 bp, Mus musculus
ggtggtagagtctggtcacctgact

SEQ ID NO: 45781 - DNA, 25 bp, Mus musculus
ggtggtatatcagacagcattcaga

SEQ ID NO: 45782 - DNA, 25 bp, Mus musculus
ggtggtatcctgctactgctcccca

SEQ ID NO: 45783 - DNA, 25 bp, Mus musculus
ggtggtcaagctgaaagagccctgt

SEQ ID NO: 45784 - DNA, 25 bp, Mus musculus
ggtggtcactgaaggcctgctaagc

SEQ ID NO: 45785 - DNA, 25 bp, Mus musculus
ggtggtcctcttggaggccctctca

SEQ ID NO: 45786 - DNA, 25 bp, Mus musculus
ggtggtcgctatgttccaggaactt

SEQ ID NO: 45787 - DNA, 25 bp, Mus musculus
ggtggtctgcaagccgatgagcaac

SEQ ID NO: 45788 - DNA, 25 bp, Mus musculus
ggtggtgacgactgtaccacctgtg

SEQ ID NO: 45789 - DNA, 25 bp, Mus musculus
ggtggtgactctgtgccagccaaac

SEQ ID NO: 45790 - DNA, 25 bp, Mus musculus
ggtggtgcagaaagctgctcagact

SEQ ID NO: 45791 - DNA, 25 bp, Mus musculus
ggtggtgcagagcatgtatatcttt

SEQ ID NO: 45792 - DNA, 25 bp, Mus musculus
ggtggtggagtcttccaggctatca

SEQ ID NO: 45793 - DNA, 25 bp, Mus musculus
ggtggtgtctgcaatatggatatac

SEQ ID NO: 45794 - DNA, 25 bp, Mus musculus
ggtggtgtgtacagacttcaccaca

SEQ ID NO: 45795 - DNA, 25 bp, Mus musculus
ggtggttatgctgcgtaccgctatg

SEQ ID NO: 45796 - DNA, 25 bp, Mus musculus
ggtggttctcaaatacaggcatgtt

SEQ ID NO: 45797 - DNA, 25 bp, Mus musculus
ggtggttgtgcactatatccaatgt

SEQ ID NO: 45798 - DNA, 25 bp, Mus musculus
ggtggttttactctgtaatctgaag

SEQ ID NO: 45799 - DNA, 25 bp, Mus musculus
ggtgtaaaaggacttcccctgatga

SEQ ID NO: 45800 - DNA, 25 bp, Mus musculus
ggtgtaaaatggtgcttcaggccgt

SEQ ID NO: 45801 - DNA, 25 bp, Mus musculus
ggtgtaaccgctgatgatgtaaaga

SEQ ID NO: 45802 - DNA, 25 bp, Mus musculus
ggtgtacaagtgtcccaagtgctgc

SEQ ID NO: 45803 - DNA, 25 bp, Mus musculus
ggtgtacacaatagcatccagattt

SEQ ID NO: 45804 - DNA, 25 bp, Mus musculus
ggtgtacacaattgcatccagattt

SEQ ID NO: 45805 - DNA, 25 bp, Mus musculus
ggtgtacacgttggcagagcaccga

SEQ ID NO: 45806 - DNA, 25 bp, Mus musculus
ggtgtacagctctgcccaggacagt

SEQ ID NO: 45807 - DNA, 25 bp, Mus musculus
ggtgtacatgactgcacatgcctaa

SEQ ID NO: 45808 - DNA, 25 bp, Mus musculus
ggtgtacccaccatccgtggaacag

SEQ ID NO: 45809 - DNA, 25 bp, Mus musculus
ggtgtacccaccttccgtggaacag

SEQ ID NO: 45810 - DNA, 25 bp, Mus musculus
ggtgtaccccactatacctgtctgg

SEQ ID NO: 45811 - DNA, 25 bp, Mus musculus
ggtgtacgaccctctcatggaaccc

SEQ ID NO: 45812 - DNA, 25 bp, Mus musculus
ggtgtactgataaacagaacccttc

SEQ ID NO: 45813 - DNA, 25 bp, Mus musculus
ggtgtagcgaccaatcggaaatcat

SEQ ID NO: 45814 - DNA, 25 bp, Mus musculus
ggtgtagctcaggacttcatcaaag

SEQ ID NO: 45815 - DNA, 25 bp, Mus musculus
ggtgtagctgccttctacaaaggct

SEQ ID NO: 45816 - DNA, 25 bp, Mus musculus
ggtgtaggtataccgacaattaatt

SEQ ID NO: 45817 - DNA, 25 bp, Mus musculus
ggtgtatcctgctgttatggttctc

SEQ ID NO: 45818 - DNA, 25 bp, Mus musculus
ggtgtattgcaccattcccgtttta

SEQ ID NO: 45819 - DNA, 25 bp, Mus musculus
ggtgtcaaccccaactctcgtggag

SEQ ID NO: 45820 - DNA, 25 bp, Mus musculus
ggtgtcaactttaggactttgtgca

SEQ ID NO: 45821 - DNA, 25 bp, Mus musculus
ggtgtcactgcactcagttgctggc

SEQ ID NO: 45822 - DNA, 25 bp, Mus musculus
ggtgtcagatcctacttctcatcaa

SEQ ID NO: 45823 - DNA, 25 bp, Mus musculus
ggtgtcagcctctgtccacttggca

SEQ ID NO: 45824 - DNA, 25 bp, Mus musculus
ggtgtcagtggagccacagacctcc

SEQ ID NO: 45825 - DNA, 25 bp, Mus musculus
ggtgtcatcctttgaacatgctggc

SEQ ID NO: 45826 - DNA, 25 bp, Mus musculus
ggtgtcatgctagacaaagatcttt

SEQ ID NO: 45827 - DNA, 25 bp, Mus musculus
ggtgtccaatgtgctgtccttacag

SEQ ID NO: 45828 - DNA, 25 bp, Mus musculus
ggtgtccagggatatcgccagtgat

SEQ ID NO: 45829 - DNA, 25 bp, Mus musculus
ggtgtccagttccaaaaccaaagtg

SEQ ID NO: 45830 - DNA, 25 bp, Mus musculus
ggtgtcctctgggaccacagtgtcc

SEQ ID NO: 45831 - DNA, 25 bp, Mus musculus
ggtgtccttaccagaagtccaggct

SEQ ID NO: 45832 - DNA, 25 bp, Mus musculus
ggtgtccttctacaccttccgtgag

SEQ ID NO: 45833 - DNA, 25 bp, Mus musculus
ggtgtcgctgcgcttgtcaccatca

SEQ ID NO: 45834 - DNA, 25 bp, Mus musculus
ggtgtcggagctagccacggtcatt

SEQ ID NO: 45835 - DNA, 25 bp, Mus musculus
ggtgtctacagaagtcacaacttag

SEQ ID NO: 45836 - DNA, 25 bp, Mus musculus
ggtgtctccagacaagggctgacaa

SEQ ID NO: 45837 - DNA, 25 bp, Mus musculus
ggtgtctctgagaccactgcaatca

SEQ ID NO: 45838 - DNA, 25 bp, Mus musculus
ggtgtctgtccccaagatagcacta

SEQ ID NO: 45839 - DNA, 25 bp, Mus musculus
ggtgtcttcacacacagctccttta

SEQ ID NO: 45840 - DNA, 25 bp, Mus musculus
ggtgtctttgtcaacgggcggccac

SEQ ID NO: 45841 - DNA, 25 bp, Mus musculus
ggtgtgaaaacacccctggatccta

SEQ ID NO: 45842 - DNA, 25 bp, Mus musculus
ggtgtgaacctgaggccttcatttg

SEQ ID NO: 45843 - DNA, 25 bp, Mus musculus
ggtgtgaatttcgactttctcggag

SEQ ID NO: 45844 - DNA, 25 bp, Mus musculus
ggtgtgacaaccatcctccctttgt

SEQ ID NO: 45845 - DNA, 25 bp, Mus musculus
ggtgtgaggccagtgcacctttgac

SEQ ID NO: 45846 - DNA, 25 bp, Mus musculus
ggtgtgatccctccaaactcagttc

SEQ ID NO: 45847 - DNA, 25 bp, Mus musculus
ggtgtgattcgcagaagtagaaaga

SEQ ID NO: 45848 - DNA, 25 bp, Mus musculus
ggtgtgcacactgtgccgctgcctt

SEQ ID NO: 45849 - DNA, 25 bp, Mus musculus
ggtgtgcagccaaatcacctgccat

SEQ ID NO: 45850 - DNA, 25 bp, Mus musculus
ggtgtgcagtactcggctgccctga

SEQ ID NO: 45851 - DNA, 25 bp, Mus musculus
ggtgtgccagacaagagccatgaag

SEQ ID NO: 45852 - DNA, 25 bp, Mus musculus
ggtgtgctgtatttctgtttccgga

SEQ ID NO: 45853 - DNA, 25 bp, Mus musculus
ggtgtggaacttccccatcgatgtg

SEQ ID NO: 45854 - DNA, 25 bp, Mus musculus
ggtgtggagaggtcccaagaaacat

SEQ ID NO: 45855 - DNA, 25 bp, Mus musculus
ggtgtggagtgtgcgctacaaccac

SEQ ID NO: 45856 - DNA, 25 bp, Mus musculus
ggtgtggatgatgagcaaacctctc

SEQ ID NO: 45857 - DNA, 25 bp, Mus musculus
ggtgtggccctgactcttggcagac

SEQ ID NO: 45858 - DNA, 25 bp, Mus musculus
ggtgtgggcacagtacaaaaagagc

SEQ ID NO: 45859 - DNA, 25 bp, Mus musculus
ggtgtggtgacaagtagaccctctg

SEQ ID NO: 45860 - DNA, 25 bp, Mus musculus
ggtgtgtcacctgtgcatagagcag

SEQ ID NO: 45861 - DNA, 25 bp, Mus musculus
ggtgtgtccccaggatcatttctgg

SEQ ID NO: 45862 - DNA, 25 bp, Mus musculus
ggtgtgtctcatccaggagtcaaag

SEQ ID NO: 45863 - DNA, 25 bp, Mus musculus
ggtgtgtggagctccatccaccctg

SEQ ID NO: 45864 - DNA, 25 bp, Mus musculus
ggtgtgtttgacgtggacaagaaaa

SEQ ID NO: 45865 - DNA, 25 bp, Mus musculus
ggtgtgttttactaagcatcgtctt

SEQ ID NO: 45866 - DNA, 25 bp, Mus musculus
ggtgttaaaactctcccaaataatg

SEQ ID NO: 45867 - DNA, 25 bp, Mus musculus
ggtgttaaaactgtcccaaataatg

SEQ ID NO: 45868 - DNA, 25 bp, Mus musculus
ggtgttaacaccacggacaaagaga

SEQ ID NO: 45869 - DNA, 25 bp, Mus musculus
ggtgttaaccacaagagtctttacg

SEQ ID NO: 45870 - DNA, 25 bp, Mus musculus
ggtgttaagccctagtgcaggagcc

SEQ ID NO: 45871 - DNA, 25 bp, Mus musculus
ggtgttaggcaccatcttgtagccc

SEQ ID NO: 45872 - DNA, 25 bp, Mus musculus
ggtgttcacagaatatgagcagatt

SEQ ID NO: 45873 - DNA, 25 bp, Mus musculus
ggtgttcagagagccctacaatgtg

SEQ ID NO: 45874 - DNA, 25 bp, Mus musculus
ggtgttcagcaaaatccaagccgat

SEQ ID NO: 45875 - DNA, 25 bp, Mus musculus
ggtgttccagtgatggcaatcagag

SEQ ID NO: 45876 - DNA, 25 bp, Mus musculus
ggtgttccgtcttccctgctcaaga

SEQ ID NO: 45877 - DNA, 25 bp, Mus musculus
ggtgttcgacatccacgtgattgac

SEQ ID NO: 45878 - DNA, 25 bp, Mus musculus
ggtgttctctacttcactgggagtg

SEQ ID NO: 45879 - DNA, 25 bp, Mus musculus
ggtgttcttcagagcttgagagtcc

SEQ ID NO: 45880 - DNA, 25 bp, Mus musculus
ggtgttgcatgctgcccctccctga

SEQ ID NO: 45881 - DNA, 25 bp, Mus musculus
ggtgttggacacctatgacttcgtg

SEQ ID NO: 45882 - DNA, 25 bp, Mus musculus
ggtgttggcgctgattgcagtcatc

SEQ ID NO: 45883 - DNA, 25 bp, Mus musculus
ggtgtttccatctctgaccacagga

SEQ ID NO: 45884 - DNA, 25 bp, Mus musculus
ggtgtttctaaatggttacagcaca

SEQ ID NO: 45885 - DNA, 25 bp, Mus musculus
ggtgttttccacaccgaatatggag

SEQ ID NO: 45886 - DNA, 25 bp, Mus musculus
ggttaaagactgcatccatactgtg

SEQ ID NO: 45887 - DNA, 25 bp, Mus musculus
ggttaaagggaatgacctcattaca

SEQ ID NO: 45888 - DNA, 25 bp, Mus musculus
ggttaaatctcttgaaactggagtt

SEQ ID NO: 45889 - DNA, 25 bp, Mus musculus
ggttaaattgatctccctgtggaaa

SEQ ID NO: 45890 - DNA, 25 bp, Mus musculus
ggttaagcatatcttactgtcggag

SEQ ID NO: 45891 - DNA, 25 bp, Mus musculus
ggttaagctattttctcaaagtcac

SEQ ID NO: 45892 - DNA, 25 bp, Mus musculus
ggttacacatcattttggaatgact

SEQ ID NO: 45893 - DNA, 25 bp, Mus musculus
ggttacatggagttccctgtcctag

SEQ ID NO: 45894 - DNA, 25 bp, Mus musculus
ggttacattccgaaaagcaaatggg

SEQ ID NO: 45895 - DNA, 25 bp, Mus musculus
ggttaccaagtgacaaggtgtttct

SEQ ID NO: 45896 - DNA, 25 bp, Mus musculus
ggttaccatcacaatcatgcctact

SEQ ID NO: 45897 - DNA, 25 bp, Mus musculus
ggttaccgcaacagaatgctgctca

SEQ ID NO: 45898 - DNA, 25 bp, Mus musculus
ggttacctgatgcagatccctctca

SEQ ID NO: 45899 - DNA, 25 bp, Mus musculus
ggttacctggaatgtcttcattatc

SEQ ID NO: 45900 - DNA, 25 bp, Mus musculus
ggttacctgggagcttttcgccctg

SEQ ID NO: 45901 - DNA, 25 bp, Mus musculus
ggttaccttgtcagatggaactgga

SEQ ID NO: 45902 - DNA, 25 bp, Mus musculus
ggttacgctgcatgtgcacctgcaa

SEQ ID NO: 45903 - DNA, 25 bp, Mus musculus
ggttacgtaggcttcagtcttggag

SEQ ID NO: 45904 - DNA, 25 bp, Mus musculus
ggttacgtgtctgagcaccttcatg

SEQ ID NO: 45905 - DNA, 25 bp, Mus musculus
ggttactgcctcttctacgagtcca

SEQ ID NO: 45906 - DNA, 25 bp, Mus musculus
ggttagaacacctgcaggagaaaac

SEQ ID NO: 45907 - DNA, 25 bp, Mus musculus
ggttagatcaaaattgtctccatca

SEQ ID NO: 45908 - DNA, 25 bp, Mus musculus
ggttagatcactgcccagcgtctgt

SEQ ID NO: 45909 - DNA, 25 bp, Mus musculus
ggttagctgagttggcacatcgaga

SEQ ID NO: 45910 - DNA, 25 bp, Mus musculus
ggttagctggccctgatggcaccaa

SEQ ID NO: 45911 - DNA, 25 bp, Mus musculus
ggttagtcaccgaaggacacctgtc

SEQ ID NO: 45912 - DNA, 25 bp, Mus musculus
ggttatagcagctgccgccaaacac

SEQ ID NO: 45913 - DNA, 25 bp, Mus musculus
ggttatattatgatagcaacagaga

SEQ ID NO: 45914 - DNA, 25 bp, Mus musculus
ggttatattatgttagcaacagaga

SEQ ID NO: 45915 - DNA, 25 bp, Mus musculus
ggttatcactctcacgaccattgga

SEQ ID NO: 45916 - DNA, 25 bp, Mus musculus
ggttatcactctgacgaccattgga

SEQ ID NO: 45917 - DNA, 25 bp, Mus musculus
ggttatcagcaaccgtcgtatcctg

SEQ ID NO: 45918 - DNA, 25 bp, Mus musculus
ggttatcatccaagaactgtcccag

SEQ ID NO: 45919 - DNA, 25 bp, Mus musculus
ggttatccaggagctaatcagtaca

SEQ ID NO: 45920 - DNA, 25 bp, Mus musculus
ggttatgaatcaagccaaggtgtct

SEQ ID NO: 45921 - DNA, 25 bp, Mus musculus
ggttatgctgcgtaccgctatgccc

SEQ ID NO: 45922 - DNA, 25 bp, Mus musculus
ggttatggattgagaacaagttgct

SEQ ID NO: 45923 - DNA, 25 bp, Mus musculus
ggttattgttagactcactgaaccc

SEQ ID NO: 45924 - DNA, 25 bp, Mus musculus
ggttcaaaaagagcccagaagagat

SEQ ID NO: 45925 - DNA, 25 bp, Mus musculus
ggttcaaacagagactccagttggt

SEQ ID NO: 45926 - DNA, 25 bp, Mus musculus
ggttcaacgcaaagttcgccgtgga

SEQ ID NO: 45927 - DNA, 25 bp, Mus musculus
ggttcaagtataccagctactgagc

SEQ ID NO: 45928 - DNA, 25 bp, Mus musculus
ggttcaatcagaaactgttccggca

SEQ ID NO: 45929 - DNA, 25 bp, Mus musculus
ggttcacagacacatctattatcct

SEQ ID NO: 45930 - DNA, 25 bp, Mus musculus
ggttcacagatgatacctttgatcc

SEQ ID NO: 45931 - DNA, 25 bp, Mus musculus
ggttcactgcagtcctggctattcc

SEQ ID NO: 45932 - DNA, 25 bp, Mus musculus
ggttcagaactcacaaggacccttg

SEQ ID NO: 45933 - DNA, 25 bp, Mus musculus
ggttcagaactttcaagatgaaact

SEQ ID NO: 45934 - DNA, 25 bp, Mus musculus
ggttcagaagtagacacctgactgc

SEQ ID NO: 45935 - DNA, 25 bp, Mus musculus
ggttcagaagtttgtcacacagtgc

SEQ ID NO: 45936 - DNA, 25 bp, Mus musculus
ggttcagaatctacttacatcctgg

SEQ ID NO: 45937 - DNA, 25 bp, Mus musculus
ggttcagatgaatacctggtatgca

SEQ ID NO: 45938 - DNA, 25 bp, Mus musculus
ggttcagatggcaaagatgatccaa

SEQ ID NO: 45939 - DNA, 25 bp, Mus musculus
ggttcagcatcgcagacaagaagcg

SEQ ID NO: 45940 - DNA, 25 bp, Mus musculus
ggttcagccatctgcagcagactgt

SEQ ID NO: 45941 - DNA, 25 bp, Mus musculus
ggttcagcttccaagtaccttctgc

SEQ ID NO: 45942 - DNA, 25 bp, Mus musculus
ggttcaggagagcttgacaccttca

SEQ ID NO: 45943 - DNA, 25 bp, Mus musculus
ggttcaggagatttgggacccaaag

SEQ ID NO: 45944 - DNA, 25 bp, Mus musculus
ggttcaggagcttgattcctagcta

SEQ ID NO: 45945 - DNA, 25 bp, Mus musculus
ggttcagtcttatatgatggtcctc

SEQ ID NO: 45946 - DNA, 25 bp, Mus musculus
ggttcatagttcaacttgtgttggt

SEQ ID NO: 45947 - DNA, 25 bp, Mus musculus
ggttcatagttctacttgtgttggt

SEQ ID NO: 45948 - DNA, 25 bp, Mus musculus
ggttcatcaaggtccgggagacgat

SEQ ID NO: 45949 - DNA, 25 bp, Mus musculus
ggttcatctccgaccgccttatcag

SEQ ID NO: 45950 - DNA, 25 bp, Mus musculus
ggttcatgtcacagcataaattgtc

SEQ ID NO: 45951 - DNA, 25 bp, Mus musculus
ggttccaagagaatggcacttgctt

SEQ ID NO: 45952 - DNA, 25 bp, Mus musculus
ggttccaagcgtgtcttgagatcac

SEQ ID NO: 45953 - DNA, 25 bp, Mus musculus
ggttccaaggacaatattaagcatg

SEQ ID NO: 45954 - DNA, 25 bp, Mus musculus
ggttccagagcatgcatgcttccta

SEQ ID NO: 45955 - DNA, 25 bp, Mus musculus
ggttccagagtcacattctccactg

SEQ ID NO: 45956 - DNA, 25 bp, Mus musculus
ggttccaggtgcctaccactgaggt

SEQ ID NO: 45957 - DNA, 25 bp, Mus musculus
ggttccattgactgaactacgtccc

SEQ ID NO: 45958 - DNA, 25 bp, Mus musculus
ggttcccagctatctccggaacagg

SEQ ID NO: 45959 - DNA, 25 bp, Mus musculus
ggttcccagttccacagctagctat

SEQ ID NO: 45960 - DNA, 25 bp, Mus musculus
ggttccccagaaatcaacgagacca

SEQ ID NO: 45961 - DNA, 25 bp, Mus musculus
ggttccctaacccatgcatcctctg

SEQ ID NO: 45962 - DNA, 25 bp, Mus musculus
ggttccctcgtcaacctcggatgat

SEQ ID NO: 45963 - DNA, 25 bp, Mus musculus
ggttccctctcgatagaccagactg

SEQ ID NO: 45964 - DNA, 25 bp, Mus musculus
ggttccctcttctgggatgctctac

SEQ ID NO: 45965 - DNA, 25 bp, Mus musculus
ggttccgatttggacaggatcagct

SEQ ID NO: 45966 - DNA, 25 bp, Mus musculus
ggttcctaccgcagcatcctggact

SEQ ID NO: 45967 - DNA, 25 bp, Mus musculus
ggttcctaccgctgcatcctggact

SEQ ID NO: 45968 - DNA, 25 bp, Mus musculus
ggttcctattggctcctgactctct

SEQ ID NO: 45969 - DNA, 25 bp, Mus musculus
ggttcctcaatagaccaaggcagca

SEQ ID NO: 45970 - DNA, 25 bp, Mus musculus
ggttcctctagatctcattaaatgc

SEQ ID NO: 45971 - DNA, 25 bp, Mus musculus
ggttcctctcgcactgcggagactg

SEQ ID NO: 45972 - DNA, 25 bp, Mus musculus
ggttcctctcgctctgcggagactg

SEQ ID NO: 45973 - DNA, 25 bp, Mus musculus
ggttcctgctggacttcatctcctg

SEQ ID NO: 45974 - DNA, 25 bp, Mus musculus
ggttcctggaagatgttaggcatgc

SEQ ID NO: 45975 - DNA, 25 bp, Mus musculus
ggttcctggaagttgttaggcatgc

SEQ ID NO: 45976 - DNA, 25 bp, Mus musculus
ggttcctggcttgcagtgagtactg

SEQ ID NO: 45977 - DNA, 25 bp, Mus musculus
ggttcctggcttgtcggctgtctct

SEQ ID NO: 45978 - DNA, 25 bp, Mus musculus
ggttcgaaactgtcctcatttcaag

SEQ ID NO: 45979 - DNA, 25 bp, Mus musculus
ggttcgaagaagtctcagccctgtg

SEQ ID NO: 45980 - DNA, 25 bp, Mus musculus
ggttcgcctcatgatcactggagcc

SEQ ID NO: 45981 - DNA, 25 bp, Mus musculus
ggttcgtggccaagctgtacatgaa

SEQ ID NO: 45982 - DNA, 25 bp, Mus musculus
ggttctacagcaatgctccacagca

SEQ ID NO: 45983 - DNA, 25 bp, Mus musculus
ggttctacattccaccgtgtggtta

SEQ ID NO: 45984 - DNA, 25 bp, Mus musculus
ggttctacccgttacatatccttca

SEQ ID NO: 45985 - DNA, 25 bp, Mus musculus
ggttctactgcggtctgtggattgt

SEQ ID NO: 45986 - DNA, 25 bp, Mus musculus
ggttctactgtgtttcgagctattt

SEQ ID NO: 45987 - DNA, 25 bp, Mus musculus
ggttctatgcaaccactttaccggc

SEQ ID NO: 45988 - DNA, 25 bp, Mus musculus
ggttctatgcaagcactttaccggc

SEQ ID NO: 45989 - DNA, 25 bp, Mus musculus
ggttctcaaatacaggcatgttgat

SEQ ID NO: 45990 - DNA, 25 bp, Mus musculus
ggttctcatgactccaccctgtgca

SEQ ID NO: 45991 - DNA, 25 bp, Mus musculus
ggttctccaggccttggccatcatg

SEQ ID NO: 45992 - DNA, 25 bp, Mus musculus
ggttctccagtccttcgacccgtga

SEQ ID NO: 45993 - DNA, 25 bp, Mus musculus
ggttctccgttcttcctgacttcag

SEQ ID NO: 45994 - DNA, 25 bp, Mus musculus
ggttctctaaatgccatgtggtatg

SEQ ID NO: 45995 - DNA, 25 bp, Mus musculus
ggttctctagaccatgctagcgtca

SEQ ID NO: 45996 - DNA, 25 bp, Mus musculus
ggttctctagccatcggagtcccga

SEQ ID NO: 45997 - DNA, 25 bp, Mus musculus
ggttctctagccttcggagtcccga

SEQ ID NO: 45998 - DNA, 25 bp, Mus musculus
ggttctctgcccaatgttaaccaga

SEQ ID NO: 45999 - DNA, 25 bp, Mus musculus
ggttctcttactgttgaaagactaa

SEQ ID NO: 46000 - DNA, 25 bp, Mus musculus
ggttctcttcaaatgctgccaggga

SEQ ID NO: 46001 - DNA, 25 bp, Mus musculus
ggttctgacctcgtccgggcttcta

SEQ ID NO: 46002 - DNA, 25 bp, Mus musculus
ggttctggatttaggacccatcact

SEQ ID NO: 46003 - DNA, 25 bp, Mus musculus
ggttctggcttaccggctctctgtg

SEQ ID NO: 46004 - DNA, 25 bp, Mus musculus
ggttctgtagcaggcttcactcggt

SEQ ID NO: 46005 - DNA, 25 bp, Mus musculus
ggttctgtcatgtttctctttgaag

SEQ ID NO: 46006 - DNA, 25 bp, Mus musculus
ggttctgttacctcaccatcgccat

SEQ ID NO: 46007 - DNA, 25 bp, Mus musculus
ggttcttaatcagcctttggatgca

SEQ ID NO: 46008 - DNA, 25 bp, Mus musculus
ggttcttcaaacttcaactcaggcg

SEQ ID NO: 46009 - DNA, 25 bp, Mus musculus
ggttcttcatatggatcagaaccca

SEQ ID NO: 46010 - DNA, 25 bp, Mus musculus
ggttcttctccaaaaaattattgct

SEQ ID NO: 46011 - DNA, 25 bp, Mus musculus
ggttcttgttctgagtgccgataaa

SEQ ID NO: 46012 - DNA, 25 bp, Mus musculus
ggttctttccgtggccgcaaggctg

SEQ ID NO: 46013 - DNA, 25 bp, Mus musculus
ggttgaacttccaacacttgaacct

SEQ ID NO: 46014 - DNA, 25 bp, Mus musculus
ggttgaagctctttggagtactcca

SEQ ID NO: 46015 - DNA, 25 bp, Mus musculus
ggttgacacaaaaactgctcttctg

SEQ ID NO: 46016 - DNA, 25 bp, Mus musculus
ggttgacacactgaaggtcgtgacg

SEQ ID NO: 46017 - DNA, 25 bp, Mus musculus
ggttgactctccagacctcattcat

SEQ ID NO: 46018 - DNA, 25 bp, Mus musculus
ggttgagaaccaggagttaagaaca

SEQ ID NO: 46019 - DNA, 25 bp, Mus musculus
ggttgagacaactgttgcaagcctc

SEQ ID NO: 46020 - DNA, 25 bp, Mus musculus
ggttgagcaagtctctgattttgag

SEQ ID NO: 46021 - DNA, 25 bp, Mus musculus
ggttgatcacacaaaactgtcagca

SEQ ID NO: 46022 - DNA, 25 bp, Mus musculus
ggttgatcacactaaactgtcagca

SEQ ID NO: 46023 - DNA, 25 bp, Mus musculus
ggttgattattaccctgatctttgt

SEQ ID NO: 46024 - DNA, 25 bp, Mus musculus
ggttgatttgttctgctcctggatt

SEQ ID NO: 46025 - DNA, 25 bp, Mus musculus
ggttgcaacattatacctactgatt

SEQ ID NO: 46026 - DNA, 25 bp, Mus musculus
ggttgcaccaactacgcgaggcttt

SEQ ID NO: 46027 - DNA, 25 bp, Mus musculus
ggttgcattgtgataattacgtggg

SEQ ID NO: 46028 - DNA, 25 bp, Mus musculus
ggttgcatttagtactgagtcacca

SEQ ID NO: 46029 - DNA, 25 bp, Mus musculus
ggttgcccacaggattgacttggcc

SEQ ID NO: 46030 - DNA, 25 bp, Mus musculus
ggttgctatgcaacgacgggcctaa

SEQ ID NO: 46031 - DNA, 25 bp, Mus musculus
ggttgctccaaaatcacaaagtttg

SEQ ID NO: 46032 - DNA, 25 bp, Mus musculus
ggttgctcccgatggctccaggtta

SEQ ID NO: 46033 - DNA, 25 bp, Mus musculus
ggttgctctcatcccttatggagac

SEQ ID NO: 46034 - DNA, 25 bp, Mus musculus
ggttgctggatgtcatctctgtatg

SEQ ID NO: 46035 - DNA, 25 bp, Mus musculus
ggttgctgtcggaggcctttgtcat

SEQ ID NO: 46036 - DNA, 25 bp, Mus musculus
ggttgctgtctccaggaatatgcag

SEQ ID NO: 46037 - DNA, 25 bp, Mus musculus
ggttggaaaccaccacagttctatc

SEQ ID NO: 46038 - DNA, 25 bp, Mus musculus
ggttggaaaccagcacagttctatc

SEQ ID NO: 46039 - DNA, 25 bp, Mus musculus
ggttggacagcatacggccacaaaa

SEQ ID NO: 46040 - DNA, 25 bp, Mus musculus
ggttggacagcctattagctattga

SEQ ID NO: 46041 - DNA, 25 bp, Mus musculus
ggttggagccaacgtgcaatcacag

SEQ ID NO: 46042 - DNA, 25 bp, Mus musculus
ggttggcaccattttatctgggttc

SEQ ID NO: 46043 - DNA, 25 bp, Mus musculus
ggttggccagtttttctctcttctg

SEQ ID NO: 46044 - DNA, 25 bp, Mus musculus
ggttggctcctccacatctcaggat

SEQ ID NO: 46045 - DNA, 25 bp, Mus musculus
ggttgggaaattaacaccatcggat

SEQ ID NO: 46046 - DNA, 25 bp, Mus musculus
ggttgggaggtcgacaaatcagaac

SEQ ID NO: 46047 - DNA, 25 bp, Mus musculus
ggttgggagtctaatggcccttcac

SEQ ID NO: 46048 - DNA, 25 bp, Mus musculus
ggttgggatcacaccaccacagcca

SEQ ID NO: 46049 - DNA, 25 bp, Mus musculus
ggttgggcagcttcaggaagccctc

SEQ ID NO: 46050 - DNA, 25 bp, Mus musculus
ggttgggcctagagaagatctatgc

SEQ ID NO: 46051 - DNA, 25 bp, Mus musculus
ggttggtggctgtgttcgactacca

SEQ ID NO: 46052 - DNA, 25 bp, Mus musculus
ggttgtaagccttgcatatgtacag

SEQ ID NO: 46053 - DNA, 25 bp, Mus musculus
ggttgtaccttgaagctggtattgg

SEQ ID NO: 46054 - DNA, 25 bp, Mus musculus
ggttgtatgtcaacatgctccggaa

SEQ ID NO: 46055 - DNA, 25 bp, Mus musculus
ggttgtcctatgatgaagcctttgc

SEQ ID NO: 46056 - DNA, 25 bp, Mus musculus
ggttgtctgacgctggctttaagct

SEQ ID NO: 46057 - DNA, 25 bp, Mus musculus
ggttgtctgtttacagaagaggaac

SEQ ID NO: 46058 - DNA, 25 bp, Mus musculus
ggttgtgatactgccctgaatgtga

SEQ ID NO: 46059 - DNA, 25 bp, Mus musculus
ggttgtgatctggaatatgtctcca

SEQ ID NO: 46060 - DNA, 25 bp, Mus musculus
ggttgtggaccatagaagagttgaa

SEQ ID NO: 46061 - DNA, 25 bp, Mus musculus
ggttgtggccccaaagcccaaagtg

SEQ ID NO: 46062 - DNA, 25 bp, Mus musculus
ggttgtggcgctgcccaaagacaga

SEQ ID NO: 46063 - DNA, 25 bp, Mus musculus
ggttgtgggacatccacgaagagat

SEQ ID NO: 46064 - DNA, 25 bp, Mus musculus
ggttgtgtgcatgccatatcgacag

SEQ ID NO: 46065 - DNA, 25 bp, Mus musculus
ggttgtgtttaccatgaagaacgca

SEQ ID NO: 46066 - DNA, 25 bp, Mus musculus
ggttgttaccatggtgatggccagt

SEQ ID NO: 46067 - DNA, 25 bp, Mus musculus
ggttgtttaccactcggcacaaatt

SEQ ID NO: 46068 - DNA, 25 bp, Mus musculus
ggttgtttatcctctggggctacag

SEQ ID NO: 46069 - DNA, 25 bp, Mus musculus
ggtttaaagataattataatgcgga

SEQ ID NO: 46070 - DNA, 25 bp, Mus musculus
ggtttacaggaacaggagtacagct

SEQ ID NO: 46071 - DNA, 25 bp, Mus musculus
ggtttaccatcaagagatcagggtc

SEQ ID NO: 46072 - DNA, 25 bp, Mus musculus
ggtttagtgcttcgaccaacagctg

SEQ ID NO: 46073 - DNA, 25 bp, Mus musculus
ggtttagttgattatctagaccaca

SEQ ID NO: 46074 - DNA, 25 bp, Mus musculus
ggtttataacccaagagatcttcct

SEQ ID NO: 46075 - DNA, 25 bp, Mus musculus
ggtttatcctgatagttcctctcca

SEQ ID NO: 46076 - DNA, 25 bp, Mus musculus
ggtttatgagagacactgtgctcag

SEQ ID NO: 46077 - DNA, 25 bp, Mus musculus
ggtttatgattctaccatctccaga

SEQ ID NO: 46078 - DNA, 25 bp, Mus musculus
ggtttatggcagtcgcatgacaggt

SEQ ID NO: 46079 - DNA, 25 bp, Mus musculus
ggtttattcagcacaactggtgacc

SEQ ID NO: 46080 - DNA, 25 bp, Mus musculus
ggtttattcagctcaactggtgacc

SEQ ID NO: 46081 - DNA, 25 bp, Mus musculus
ggtttattcctctcccgctagctgt

SEQ ID NO: 46082 - DNA, 25 bp, Mus musculus
ggtttattggcacgccttggactca

SEQ ID NO: 46083 - DNA, 25 bp, Mus musculus
ggtttcactccagatgaactgctaa

SEQ ID NO: 46084 - DNA, 25 bp, Mus musculus
ggtttcagcttcttcctgttccctg

SEQ ID NO: 46085 - DNA, 25 bp, Mus musculus
ggtttcataatgcagggcaatgtca

SEQ ID NO: 46086 - DNA, 25 bp, Mus musculus
ggtttcatagcccagagctgtctgg

SEQ ID NO: 46087 - DNA, 25 bp, Mus musculus
ggtttcatatccagatcaccagaga

SEQ ID NO: 46088 - DNA, 25 bp, Mus musculus
ggtttcatcaagttgtaccccacaa

SEQ ID NO: 46089 - DNA, 25 bp, Mus musculus
ggtttcattgtactaccaaagtgag

SEQ ID NO: 46090 - DNA, 25 bp, Mus musculus
ggtttccaggtgacagacacgattc

SEQ ID NO: 46091 - DNA, 25 bp, Mus musculus
ggtttccctcttcttagagcctgtg

SEQ ID NO: 46092 - DNA, 25 bp, Mus musculus
ggtttcctattgtgcctctcttcca

SEQ ID NO: 46093 - DNA, 25 bp, Mus musculus
ggtttcgaacttatctacactcaag

SEQ ID NO: 46094 - DNA, 25 bp, Mus musculus
ggtttcgctttctctgcagtgacag

SEQ ID NO: 46095 - DNA, 25 bp, Mus musculus
ggtttcgtctactacccagagctgg

SEQ ID NO: 46096 - DNA, 25 bp, Mus musculus
ggtttctatgtcaacacgttccaga

SEQ ID NO: 46097 - DNA, 25 bp, Mus musculus
ggtttctccgcgcttcctaccttag

SEQ ID NO: 46098 - DNA, 25 bp, Mus musculus
ggtttctctactgcatggcccttta

SEQ ID NO: 46099 - DNA, 25 bp, Mus musculus
ggtttctgatctagtggcctttctc

SEQ ID NO: 46100 - DNA, 25 bp, Mus musculus
ggtttctgctgaattctgaatctgt

SEQ ID NO: 46101 - DNA, 25 bp, Mus musculus
ggtttctgctgatttctgaatctgt

SEQ ID NO: 46102 - DNA, 25 bp, Mus musculus
ggtttctgctggacaagctggccaa

SEQ ID NO: 46103 - DNA, 25 bp, Mus musculus
ggtttctgttacaagctgtgaatca

SEQ ID NO: 46104 - DNA, 25 bp, Mus musculus
ggtttcttgagtcagttattaccac

SEQ ID NO: 46105 - DNA, 25 bp, Mus musculus
ggtttgaatatgaaggcacacccct

SEQ ID NO: 46106 - DNA, 25 bp, Mus musculus
ggtttgagctctcgtgcccgcagtc

SEQ ID NO: 46107 - DNA, 25 bp, Mus musculus
ggtttgatgcctggtctttgctcca

SEQ ID NO: 46108 - DNA, 25 bp, Mus musculus
ggtttgcactgcttccccagaacag

SEQ ID NO: 46109 - DNA, 25 bp, Mus musculus
ggtttgccaaagtacacatcctgta

SEQ ID NO: 46110 - DNA, 25 bp, Mus musculus
ggtttgccacaaaatcctctttcca

SEQ ID NO: 46111 - DNA, 25 bp, Mus musculus
ggtttgccatccacaaatgcagagc

SEQ ID NO: 46112 - DNA, 25 bp, Mus musculus
ggtttgcctggtggagcacagtaaa

SEQ ID NO: 46113 - DNA, 25 bp, Mus musculus
ggtttgcttatttaagagtgctgga

SEQ ID NO: 46114 - DNA, 25 bp, Mus musculus
ggtttggaatgatgaagtccctgca

SEQ ID NO: 46115 - DNA, 25 bp, Mus musculus
ggtttggatccagctcgagtcaacg

SEQ ID NO: 46116 - DNA, 25 bp, Mus musculus
ggtttgggttttgatgagatccgac

SEQ ID NO: 46117 - DNA, 25 bp, Mus musculus
ggtttggtgagcagactgtcttccc

SEQ ID NO: 46118 - DNA, 25 bp, Mus musculus
ggtttggtttgcagaatccttctga

SEQ ID NO: 46119 - DNA, 25 bp, Mus musculus
ggtttgtaatgcaccaaccacatgc

SEQ ID NO: 46120 - DNA, 25 bp, Mus musculus
ggtttgtaccagaagtcctccctca

SEQ ID NO: 46121 - DNA, 25 bp, Mus musculus
ggtttgtctgcatctcagacacaca

SEQ ID NO: 46122 - DNA, 25 bp, Mus musculus
ggtttgtgatggttccaatggctct

SEQ ID NO: 46123 - DNA, 25 bp, Mus musculus
ggtttgttctcctctgtatttactc

SEQ ID NO: 46124 - DNA, 25 bp, Mus musculus
ggttttaacccagcgctctgaccta

SEQ ID NO: 46125 - DNA, 25 bp, Mus musculus
ggttttaactgcgagagcaagcctg

SEQ ID NO: 46126 - DNA, 25 bp, Mus musculus
ggttttacagacagccctcattaca

SEQ ID NO: 46127 - DNA, 25 bp, Mus musculus
ggttttacatctgcccacagacggg

SEQ ID NO: 46128 - DNA, 25 bp, Mus musculus
ggttttagttgatgccagacatagt

SEQ ID NO: 46129 - DNA, 25 bp, Mus musculus
ggttttatgaagagacagaatgtag

SEQ ID NO: 46130 - DNA, 25 bp, Mus musculus
ggttttcaagacatggagtgtgtgc

SEQ ID NO: 46131 - DNA, 25 bp, Mus musculus
ggttttcatggtgcccttctacatt

SEQ ID NO: 46132 - DNA, 25 bp, Mus musculus
ggttttccgcatccagctccataca

SEQ ID NO: 46133 - DNA, 25 bp, Mus musculus
ggttttccgcatgcagctccataca

SEQ ID NO: 46134 - DNA, 25 bp, Mus musculus
ggttttctattgctgaagcctctga

SEQ ID NO: 46135 - DNA, 25 bp, Mus musculus
ggttttctgtcttctgcaagacagg

SEQ ID NO: 46136 - DNA, 25 bp, Mus musculus
ggttttgaacagaagcgtagctctt

SEQ ID NO: 46137 - DNA, 25 bp, Mus musculus
ggttttgatgccacgtgttctctgg

SEQ ID NO: 46138 - DNA, 25 bp, Mus musculus
ggttttgtaggctgtgccctcagct

SEQ ID NO: 46139 - DNA, 25 bp, Mus musculus
ggtttttcatgggtgcagctttcag

SEQ ID NO: 46140 - DNA, 25 bp, Mus musculus
gtaaaacaccattgtggagcatgat

SEQ ID NO: 46141 - DNA, 25 bp, Mus musculus
gtaaaacctctctccctgcctggga

SEQ ID NO: 46142 - DNA, 25 bp, Mus musculus
gtaaaagagggacccctgcgtcctg

SEQ ID NO: 46143 - DNA, 25 bp, Mus musculus
gtaaaagtaactcgagaaagaatct

SEQ ID NO: 46144 - DNA, 25 bp, Mus musculus
gtaaacaaacagttggaaggacctg

SEQ ID NO: 46145 - DNA, 25 bp, Mus musculus
gtaaacaacccgagccacccgatga

SEQ ID NO: 46146 - DNA, 25 bp, Mus musculus
gtaaaccccagcaacctggtgcctg

SEQ ID NO: 46147 - DNA, 25 bp, Mus musculus
gtaaaccccagctacctggtgcctg

SEQ ID NO: 46148 - DNA, 25 bp, Mus musculus
gtaaaccccaggatcagcaatctca

SEQ ID NO: 46149 - DNA, 25 bp, Mus musculus
gtaaacctgcccaaacacgtggact

SEQ ID NO: 46150 - DNA, 25 bp, Mus musculus
gtaaactgactgtggcttctggtct

SEQ ID NO: 46151 - DNA, 25 bp, Mus musculus
gtaaactgcttgacaaagtcagcat

SEQ ID NO: 46152 - DNA, 25 bp, Mus musculus
gtaaagaaaacgtgcccagaagcag

SEQ ID NO: 46153 - DNA, 25 bp, Mus musculus
gtaaagaacaaaatcttcactgcag

SEQ ID NO: 46154 - DNA, 25 bp, Mus musculus
gtaaagaatatctgctacccagtct

SEQ ID NO: 46155 - DNA, 25 bp, Mus musculus
gtaaagcagtgtgttccgttggcag

SEQ ID NO: 46156 - DNA, 25 bp, Mus musculus
gtaaagccagcagcgtcatgtgcag

SEQ ID NO: 46157 - DNA, 25 bp, Mus musculus
gtaaagccagccctgaggtccggca

SEQ ID NO: 46158 - DNA, 25 bp, Mus musculus
gtaaagcgaactgacaagataactg

SEQ ID NO: 46159 - DNA, 25 bp, Mus musculus
gtaaagctggccaacccgcactcag

SEQ ID NO: 46160 - DNA, 25 bp, Mus musculus
gtaaagcttggagaagcctgaaaag

SEQ ID NO: 46161 - DNA, 25 bp, Mus musculus
gtaaaggccaccaccaaggatgcat

SEQ ID NO: 46162 - DNA, 25 bp, Mus musculus
gtaaaggccggcgagtgcagcctca

SEQ ID NO: 46163 - DNA, 25 bp, Mus musculus
gtaaagggaccttcggcttgagaga

SEQ ID NO: 46164 - DNA, 25 bp, Mus musculus
gtaaagtcttttctgctacaatggg

SEQ ID NO: 46165 - DNA, 25 bp, Mus musculus
gtaaagtggaccagacctcagcctc

SEQ ID NO: 46166 - DNA, 25 bp, Mus musculus
gtaaatcattgtcacctaaatggca

SEQ ID NO: 46167 - DNA, 25 bp, Mus musculus
gtaaatccaaactgctatgcaaaag

SEQ ID NO: 46168 - DNA, 25 bp, Mus musculus
gtaaatgaaatcgtggagaccaaca

SEQ ID NO: 46169 - DNA, 25 bp, Mus musculus
gtaaatgagatcaacttcgagaaca

SEQ ID NO: 46170 - DNA, 25 bp, Mus musculus
gtaaatggatgctgcaacttcaagg

SEQ ID NO: 46171 - DNA, 25 bp, Mus musculus
gtaaatgtgccagcaacacaaggag

SEQ ID NO: 46172 - DNA, 25 bp, Mus musculus
gtaaatgtgttcgtcccaccacggg

SEQ ID NO: 46173 - DNA, 25 bp, Mus musculus
gtaacaagccgatggattcctctca

SEQ ID NO: 46174 - DNA, 25 bp, Mus musculus
gtaacacaagtagcgagacagccag

SEQ ID NO: 46175 - DNA, 25 bp, Mus musculus
gtaacaccttttgaccacaacatag

SEQ ID NO: 46176 - DNA, 25 bp, Mus musculus
gtaacactagtgctaccactgcctc

SEQ ID NO: 46177 - DNA, 25 bp, Mus musculus
gtaacactcacaaacttagaggatg

SEQ ID NO: 46178 - DNA, 25 bp, Mus musculus
gtaacactttcagggaagatttgga

SEQ ID NO: 46179 - DNA, 25 bp, Mus musculus
gtaacaggcgctccttctcagaccg

SEQ ID NO: 46180 - DNA, 25 bp, Mus musculus
gtaacatcgtcatgctgaggatgct

SEQ ID NO: 46181 - DNA, 25 bp, Mus musculus
gtaacatgacctacaatatgcaggc

SEQ ID NO: 46182 - DNA, 25 bp, Mus musculus
gtaacatggtgatagctcccaaggg

SEQ ID NO: 46183 - DNA, 25 bp, Mus musculus
gtaacattgtccgaagtaccctgat

SEQ ID NO: 46184 - DNA, 25 bp, Mus musculus
gtaaccaactgcatgatcctccggg

SEQ ID NO: 46185 - DNA, 25 bp, Mus musculus
gtaaccattcaataccgcctgggta

SEQ ID NO: 46186 - DNA, 25 bp, Mus musculus
gtaacccctctaaatttctcagtgt

SEQ ID NO: 46187 - DNA, 25 bp, Mus musculus
gtaaccgagctctctgttttcttcg

SEQ ID NO: 46188 - DNA, 25 bp, Mus musculus
gtaaccgctgctcctgtttccactg

SEQ ID NO: 46189 - DNA, 25 bp, Mus musculus
gtaaccttcttcagctcgtttcaag

SEQ ID NO: 46190 - DNA, 25 bp, Mus musculus
gtaacgaccccgtggccagagccat

SEQ ID NO: 46191 - DNA, 25 bp, Mus musculus
gtaacgtacaccaaggagtatgagg

SEQ ID NO: 46192 - DNA, 25 bp, Mus musculus
gtaacgtacttcactattaaatgga

SEQ ID NO: 46193 - DNA, 25 bp, Mus musculus
gtaacgtgaaagactccagctgcca

SEQ ID NO: 46194 - DNA, 25 bp, Mus musculus
gtaactaaatgaccatggaatctgg

SEQ ID NO: 46195 - DNA, 25 bp, Mus musculus
gtaactcatccaagttcaccaggca

SEQ ID NO: 46196 - DNA, 25 bp, Mus musculus
gtaactctgtgccagcaaatcttgg

SEQ ID NO: 46197 - DNA, 25 bp, Mus musculus
gtaactgaaaattgcaacttgctag

SEQ ID NO: 46198 - DNA, 25 bp, Mus musculus
gtaactgccatgcagaagaagtctg

SEQ ID NO: 46199 - DNA, 25 bp, Mus musculus
gtaactgtgaggtgcctcggcccag

SEQ ID NO: 46200 - DNA, 25 bp, Mus musculus
gtaacttctggaagggccgcgtgcc

SEQ ID NO: 46201 - DNA, 25 bp, Mus musculus
gtaacttgcacacctgggatggccc

SEQ ID NO: 46202 - DNA, 25 bp, Mus musculus
gtaactttgaaacagtacatcacat

SEQ ID NO: 46203 - DNA, 25 bp, Mus musculus
gtaagaaataaacctgacagtacac

SEQ ID NO: 46204 - DNA, 25 bp, Mus musculus
gtaagaaatccagtctcactgaaga

SEQ ID NO: 46205 - DNA, 25 bp, Mus musculus
gtaagaagggtttcatcttccagat

SEQ ID NO: 46206 - DNA, 25 bp, Mus musculus
gtaagaccacactgacgcagtcagt

SEQ ID NO: 46207 - DNA, 25 bp, Mus musculus
gtaagaccagctgtgcgcaggaact

SEQ ID NO: 46208 - DNA, 25 bp, Mus musculus
gtaagagggagaccaaagttatcaa

SEQ ID NO: 46209 - DNA, 25 bp, Mus musculus
gtaagccactctccatcctgcaaga

SEQ ID NO: 46210 - DNA, 25 bp, Mus musculus
gtaagccccaatccttcccttattg

SEQ ID NO: 46211 - DNA, 25 bp, Mus musculus
gtaagccctctgtcgccaacgtcat

SEQ ID NO: 46212 - DNA, 25 bp, Mus musculus
gtaagctgaagcctcaggcacagcc

SEQ ID NO: 46213 - DNA, 25 bp, Mus musculus
gtaagggatggcgtgatgtcactac

SEQ ID NO: 46214 - DNA, 25 bp, Mus musculus
gtaagggctggctgaccgtcagcaa

SEQ ID NO: 46215 - DNA, 25 bp, Mus musculus
gtaagtcatgtaatacatccttgcc

SEQ ID NO: 46216 - DNA, 25 bp, Mus musculus
gtaagtctacgtgggaacggaagca

SEQ ID NO: 46217 - DNA, 25 bp, Mus musculus
gtaagtgcaagtgggcgctcaacag

SEQ ID NO: 46218 - DNA, 25 bp, Mus musculus
gtaagtgcagaaaactgaaggcact

SEQ ID NO: 46219 - DNA, 25 bp, Mus musculus
gtaagttggcgttccgctcaggaga

SEQ ID NO: 46220 - DNA, 25 bp, Mus musculus
gtaataatcttcagtagccaagatg

SEQ ID NO: 46221 - DNA, 25 bp, Mus musculus
gtaatactgagcctgatcatttgca

SEQ ID NO: 46222 - DNA, 25 bp, Mus musculus
gtaatcccagcatgtcttcgcagag

SEQ ID NO: 46223 - DNA, 25 bp, Mus musculus
gtaatcccatcacaagctttcaggg

SEQ ID NO: 46224 - DNA, 25 bp, Mus musculus
gtaatcctgtaaggtgtgatcagca

SEQ ID NO: 46225 - DNA, 25 bp, Mus musculus
gtaatcgcggtcctgctactcgctc

SEQ ID NO: 46226 - DNA, 25 bp, Mus musculus
gtaatctccgaggatgtctgcagcc

SEQ ID NO: 46227 - DNA, 25 bp, Mus musculus
gtaatgatggcttcgtccccacgga

SEQ ID NO: 46228 - DNA, 25 bp, Mus musculus
gtaatggaaaagcagccgaccgcat

SEQ ID NO: 46229 - DNA, 25 bp, Mus musculus
gtaatggatgctccgcgccgtttgc

SEQ ID NO: 46230 - DNA, 25 bp, Mus musculus
gtaattgtaagattgtactccaagc

SEQ ID NO: 46231 - DNA, 25 bp, Mus musculus
gtaattgtcgtcactgtggcctttg

SEQ ID NO: 46232 - DNA, 25 bp, Mus musculus
gtaatttccaaacgctgaaccatga

SEQ ID NO: 46233 - DNA, 25 bp, Mus musculus
gtacaaaatgaagccaagacacctt

SEQ ID NO: 46234 - DNA, 25 bp, Mus musculus
gtacaaagaagacccttggctctgg

SEQ ID NO: 46235 - DNA, 25 bp, Mus musculus
gtacaaaggtgccaccaaagaccaa

SEQ ID NO: 46236 - DNA, 25 bp, Mus musculus
gtacaaaggtgcgaccaaagaccaa

SEQ ID NO: 46237 - DNA, 25 bp, Mus musculus
gtacaaccagataaacctgcaagtc

SEQ ID NO: 46238 - DNA, 25 bp, Mus musculus
gtacaacccacgcagctctggaaga

SEQ ID NO: 46239 - DNA, 25 bp, Mus musculus
gtacaaccccggcagtgagagcatc

SEQ ID NO: 46240 - DNA, 25 bp, Mus musculus
gtacaactctagtatctaatcacag

SEQ ID NO: 46241 - DNA, 25 bp, Mus musculus
gtacaactgtaaccgctataatgag

SEQ ID NO: 46242 - DNA, 25 bp, Mus musculus
gtacaagtacaagtccagcggccat

SEQ ID NO: 46243 - DNA, 25 bp, Mus musculus
gtacaatcctgagaacttggctacc

SEQ ID NO: 46244 - DNA, 25 bp, Mus musculus
gtacaatggcgtcttggtaaaaaca

SEQ ID NO: 46245 - DNA, 25 bp, Mus musculus
gtacaatggcgtgttggtaaaaaca

SEQ ID NO: 46246 - DNA, 25 bp, Mus musculus
gtacaatttcttcactggctgccct

SEQ ID NO: 46247 - DNA, 25 bp, Mus musculus
gtacacaaaggaccgaatgcagcca

SEQ ID NO: 46248 - DNA, 25 bp, Mus musculus
gtacacaccctcagaggcaggcaat

SEQ ID NO: 46249 - DNA, 25 bp, Mus musculus
gtacacactaaaccacaatctgcat

SEQ ID NO: 46250 - DNA, 25 bp, Mus musculus
gtacacagagcagggaagatgatta

SEQ ID NO: 46251 - DNA, 25 bp, Mus musculus
gtacacagcctccagccaacgggag

SEQ ID NO: 46252 - DNA, 25 bp, Mus musculus
gtacacagcctcgagccaacgggag

SEQ ID NO: 46253 - DNA, 25 bp, Mus musculus
gtacacaggaaatgccagtgccctg

SEQ ID NO: 46254 - DNA, 25 bp, Mus musculus
gtacacaggtttctgttacaagctg

SEQ ID NO: 46255 - DNA, 25 bp, Mus musculus
gtacaccaagtgcatgcagtgcccg

SEQ ID NO: 46256 - DNA, 25 bp, Mus musculus
gtacaccccaacaaggcctctgggt

SEQ ID NO: 46257 - DNA, 25 bp, Mus musculus
gtacacgaccgtgatacccctgatt

SEQ ID NO: 46258 - DNA, 25 bp, Mus musculus
gtacactcacgtccttgtgcagcct

SEQ ID NO: 46259 - DNA, 25 bp, Mus musculus
gtacactggcttcctcttccactgg

SEQ ID NO: 46260 - DNA, 25 bp, Mus musculus
gtacagaacttcacatcagatcctt

SEQ ID NO: 46261 - DNA, 25 bp, Mus musculus
gtacagacacaagcgggccagcaaa

SEQ ID NO: 46262 - DNA, 25 bp, Mus musculus
gtacagagtatactgtgacatgaaa

SEQ ID NO: 46263 - DNA, 25 bp, Mus musculus
gtacagcaataaccttcaagaggac

SEQ ID NO: 46264 - DNA, 25 bp, Mus musculus
gtacagccacatactggaatccgag

SEQ ID NO: 46265 - DNA, 25 bp, Mus musculus
gtacagcggcctgcagagtcccggt

SEQ ID NO: 46266 - DNA, 25 bp, Mus musculus
gtacagctactggacaaggaatggg

SEQ ID NO: 46267 - DNA, 25 bp, Mus musculus
gtacaggtcccagaatgacagctgc

SEQ ID NO: 46268 - DNA, 25 bp, Mus musculus
gtacagtagcccctcttcaaagtgg

SEQ ID NO: 46269 - DNA, 25 bp, Mus musculus
gtacagtagcccgtcttcaaagtgg

SEQ ID NO: 46270 - DNA, 25 bp, Mus musculus
gtacagtgggtggacgtcacacgcc

SEQ ID NO: 46271 - DNA, 25 bp, Mus musculus
gtacagttcaagatcaagaggcaca

SEQ ID NO: 46272 - DNA, 25 bp, Mus musculus
gtacagttggaaacattgagtattc

SEQ ID NO: 46273 - DNA, 25 bp, Mus musculus
gtacatatcaaaaacaccatgtagg

SEQ ID NO: 46274 - DNA, 25 bp, Mus musculus
gtacatccgcctcactccagatatg

SEQ ID NO: 46275 - DNA, 25 bp, Mus musculus
gtacatcgtcctaatcctctgcggg

SEQ ID NO: 46276 - DNA, 25 bp, Mus musculus
gtacatcgtccttatcctctgcggg

SEQ ID NO: 46277 - DNA, 25 bp, Mus musculus
gtacatctctttgtgctggtgttga

SEQ ID NO: 46278 - DNA, 25 bp, Mus musculus
gtacatctgcccataccagcacagg

SEQ ID NO: 46279 - DNA, 25 bp, Mus musculus
gtacatgactgcacatgcctaagga

SEQ ID NO: 46280 - DNA, 25 bp, Mus musculus
gtacatgcgccgcaggaagcccgac

SEQ ID NO: 46281 - DNA, 25 bp, Mus musculus
gtacatggcccttctgtgtacatgg

SEQ ID NO: 46282 - DNA, 25 bp, Mus musculus
gtacatgtatatcaggtactgctgt

SEQ ID NO: 46283 - DNA, 25 bp, Mus musculus
gtacatgtcatcatactccatgaag

SEQ ID NO: 46284 - DNA, 25 bp, Mus musculus
gtacatgtgccggatcatagttcat

SEQ ID NO: 46285 - DNA, 25 bp, Mus musculus
gtacattgaaaacagagatgtggcc

SEQ ID NO: 46286 - DNA, 25 bp, Mus musculus
gtacattgggatgcggaatgagcaa

SEQ ID NO: 46287 - DNA, 25 bp, Mus musculus
gtacatttgcagtctagggcacgtt

SEQ ID NO: 46288 - DNA, 25 bp, Mus musculus
gtaccaaaactttgatgtcttcatg

SEQ ID NO: 46289 - DNA, 25 bp, Mus musculus
gtaccaaccctattgccagcatctt

SEQ ID NO: 46290 - DNA, 25 bp, Mus musculus
gtaccacacactgggagggaatgcc

SEQ ID NO: 46291 - DNA, 25 bp, Mus musculus
gtaccacctggacagctacgagcaa

SEQ ID NO: 46292 - DNA, 25 bp, Mus musculus
gtaccacgagctgatgaagcatgcg

SEQ ID NO: 46293 - DNA, 25 bp, Mus musculus
gtaccactgcgaccaggatccctgg

SEQ ID NO: 46294 - DNA, 25 bp, Mus musculus
gtaccagacactgcagcaatctcaa

SEQ ID NO: 46295 - DNA, 25 bp, Mus musculus
gtaccaggaggtgatgaactccaag

SEQ ID NO: 46296 - DNA, 25 bp, Mus musculus
gtaccagtacttgaaacgaactgga

SEQ ID NO: 46297 - DNA, 25 bp, Mus musculus
gtaccagtttgcctcctgctccaag

SEQ ID NO: 46298 - DNA, 25 bp, Mus musculus
gtacccagactcatggtatcgtgat

SEQ ID NO: 46299 - DNA, 25 bp, Mus musculus
gtacccagtattacgacatgcgctg

SEQ ID NO: 46300 - DNA, 25 bp, Mus musculus
gtaccccgccgtgttcaatgacatt

SEQ ID NO: 46301 - DNA, 25 bp, Mus musculus
gtaccctgccacagagaaacacctg

SEQ ID NO: 46302 - DNA, 25 bp, Mus musculus
gtaccctggctaaagcagagccgga

SEQ ID NO: 46303 - DNA, 25 bp, Mus musculus
gtaccgaaagaaggctctgcagtgg

SEQ ID NO: 46304 - DNA, 25 bp, Mus musculus
gtaccgcggagtgcgtcccctgatg

SEQ ID NO: 46305 - DNA, 25 bp, Mus musculus
gtaccgggctttcatttttatgctg

SEQ ID NO: 46306 - DNA, 25 bp, Mus musculus
gtaccgttagtacaatctgcccggg

SEQ ID NO: 46307 - DNA, 25 bp, Mus musculus
gtaccgttgtcagcacacagcgttc

SEQ ID NO: 46308 - DNA, 25 bp, Mus musculus
gtacctacctcaaatggtgaccaaa

SEQ ID NO: 46309 - DNA, 25 bp, Mus musculus
gtacctagtaatcaatatttccaga

SEQ ID NO: 46310 - DNA, 25 bp, Mus musculus
gtacctcacagtggcattgagcagg

SEQ ID NO: 46311 - DNA, 25 bp, Mus musculus
gtacctcctactcggataccatctg

SEQ ID NO: 46312 - DNA, 25 bp, Mus musculus
gtacctcctactgggataccatctg

SEQ ID NO: 46313 - DNA, 25 bp, Mus musculus
gtacctctacatccatcattgtcag

SEQ ID NO: 46314 - DNA, 25 bp, Mus musculus
gtacctctggtccagaactttttca

SEQ ID NO: 46315 - DNA, 25 bp, Mus musculus
gtacctgagatttcccccgacacat

SEQ ID NO: 46316 - DNA, 25 bp, Mus musculus
gtacctgagccaggacactgtatcg

SEQ ID NO: 46317 - DNA, 25 bp, Mus musculus
gtacctgtggatgccagattccctg

SEQ ID NO: 46318 - DNA, 25 bp, Mus musculus
gtacctgtttgtgaggcaaaaatac

SEQ ID NO: 46319 - DNA, 25 bp, Mus musculus
gtaccttgaggatccagacaaccag

SEQ ID NO: 46320 - DNA, 25 bp, Mus musculus
gtaccttgattcagagagaaggcag

SEQ ID NO: 46321 - DNA, 25 bp, Mus musculus
gtacgagatgaacaaagccttctcc

SEQ ID NO: 46322 - DNA, 25 bp, Mus musculus
gtacgagcatccatcggtcctgagc

SEQ ID NO: 46323 - DNA, 25 bp, Mus musculus
gtacgccagtgaacaagaagacccc

SEQ ID NO: 46324 - DNA, 25 bp, Mus musculus
gtacggacactagaggagctcctga

SEQ ID NO: 46325 - DNA, 25 bp, Mus musculus
gtacggagccttgttaccaacctct

SEQ ID NO: 46326 - DNA, 25 bp, Mus musculus
gtacggatgaaatccatgttcgcga

SEQ ID NO: 46327 - DNA, 25 bp, Mus musculus
gtacggctgaaacaccggaagctcc

SEQ ID NO: 46328 - DNA, 25 bp, Mus musculus
gtacggtcagaatagagatgtttcg

SEQ ID NO: 46329 - DNA, 25 bp, Mus musculus
gtacggtggcctacggcctggactc

SEQ ID NO: 46330 - DNA, 25 bp, Mus musculus
gtacgtccacggtcggaatggcgct

SEQ ID NO: 46331 - DNA, 25 bp, Mus musculus
gtacgtggatcacataaaaatttca

SEQ ID NO: 46332 - DNA, 25 bp, Mus musculus
gtacgtggatcagataaaaatttca

SEQ ID NO: 46333 - DNA, 25 bp, Mus musculus
gtacgttctgtttcacggcctctcg

SEQ ID NO: 46334 - DNA, 25 bp, Mus musculus
gtactaaaacccgattctgatcaac

SEQ ID NO: 46335 - DNA, 25 bp, Mus musculus
gtactacctccttaatgctgcttct

SEQ ID NO: 46336 - DNA, 25 bp, Mus musculus
gtactacttgtcctcggcacactcg

SEQ ID NO: 46337 - DNA, 25 bp, Mus musculus
gtactataccaactgcttcctaaga

SEQ ID NO: 46338 - DNA, 25 bp, Mus musculus
gtactcattatgtagctccagctag

SEQ ID NO: 46339 - DNA, 25 bp, Mus musculus
gtactccatgcagtcatcgcctaag

SEQ ID NO: 46340 - DNA, 25 bp, Mus musculus
gtactcctgagcactaacacataca

SEQ ID NO: 46341 - DNA, 25 bp, Mus musculus
gtactcggcacaggcggaagcgcaa

SEQ ID NO: 46342 - DNA, 25 bp, Mus musculus
gtactctctctatagctgactagag

SEQ ID NO: 46343 - DNA, 25 bp, Mus musculus
gtactctttgatcatatgggttgtc

SEQ ID NO: 46344 - DNA, 25 bp, Mus musculus
gtactgcaagtcagttggctacccc

SEQ ID NO: 46345 - DNA, 25 bp, Mus musculus
gtactgcccaagagcctctaccgta

SEQ ID NO: 46346 - DNA, 25 bp, Mus musculus
gtactgccctttccagttatgaagc

SEQ ID NO: 46347 - DNA, 25 bp, Mus musculus
gtactgcttaagaagcacattttag

SEQ ID NO: 46348 - DNA, 25 bp, Mus musculus
gtactgggccaatttcgcaagaaat

SEQ ID NO: 46349 - DNA, 25 bp, Mus musculus
gtactgtgggagaaagctgcaagac

SEQ ID NO: 46350 - DNA, 25 bp, Mus musculus
gtacttcaactcctgtgacttacag

SEQ ID NO: 46351 - DNA, 25 bp, Mus musculus
gtacttcctggactctaccttggaa

SEQ ID NO: 46352 - DNA, 25 bp, Mus musculus
gtacttcgatcaccagcaccctggt

SEQ ID NO: 46353 - DNA, 25 bp, Mus musculus
gtactttcgtcatgcttacacatgt

SEQ ID NO: 46354 - DNA, 25 bp, Mus musculus
gtactttgaggacaacacactgacg

SEQ ID NO: 46355 - DNA, 25 bp, Mus musculus
gtagaaaaaaagtcagtggccaagc

SEQ ID NO: 46356 - DNA, 25 bp, Mus musculus
gtagaaaattcattagaaccagcag

SEQ ID NO: 46357 - DNA, 25 bp, Mus musculus
gtagaaacctttgcccaccttatag

SEQ ID NO: 46358 - DNA, 25 bp, Mus musculus
gtagaaagtccctcaaggttgacgt

SEQ ID NO: 46359 - DNA, 25 bp, Mus musculus
gtagaacatatggtagtggatcccc

SEQ ID NO: 46360 - DNA, 25 bp, Mus musculus
gtagaagaagaagggatacacagtt

SEQ ID NO: 46361 - DNA, 25 bp, Mus musculus
gtagaagaagatttggagctcccac

SEQ ID NO: 46362 - DNA, 25 bp, Mus musculus
gtagaagcgcttcccaagccttgcc

SEQ ID NO: 46363 - DNA, 25 bp, Mus musculus
gtagaagtatccttcctgagcctca

SEQ ID NO: 46364 - DNA, 25 bp, Mus musculus
gtagaagtggtcagctgcagacagt

SEQ ID NO: 46365 - DNA, 25 bp, Mus musculus
gtagaatccgtacgatttcgttctg

SEQ ID NO: 46366 - DNA, 25 bp, Mus musculus
gtagaatgggaaactaacagagatg

SEQ ID NO: 46367 - DNA, 25 bp, Mus musculus
gtagacacctatcccaatgaggaga

SEQ ID NO: 46368 - DNA, 25 bp, Mus musculus
gtagacatgaaacagcccctgatcc

SEQ ID NO: 46369 - DNA, 25 bp, Mus musculus
gtagaccagcgtgatctgctccgac

SEQ ID NO: 46370 - DNA, 25 bp, Mus musculus
gtagacccacaacttgtagatggac

SEQ ID NO: 46371 - DNA, 25 bp, Mus musculus
gtagaccctgactttgaggaagaat

SEQ ID NO: 46372 - DNA, 25 bp, Mus musculus
gtagactaggctggtttataaccca

SEQ ID NO: 46373 - DNA, 25 bp, Mus musculus
gtagacttctataatgctgatgagc

SEQ ID NO: 46374 - DNA, 25 bp, Mus musculus
gtagacttctattatgctgatgagc

SEQ ID NO: 46375 - DNA, 25 bp, Mus musculus
gtagagaagcaactctcatcctaca

SEQ ID NO: 46376 - DNA, 25 bp, Mus musculus
gtagagaagccccagccaatgaaga

SEQ ID NO: 46377 - DNA, 25 bp, Mus musculus
gtagagaggctgcaacacacatatg

SEQ ID NO: 46378 - DNA, 25 bp, Mus musculus
gtagagagtacagcccatgggttga

SEQ ID NO: 46379 - DNA, 25 bp, Mus musculus
gtagagcctgaggagaccacgtcca

SEQ ID NO: 46380 - DNA, 25 bp, Mus musculus
gtagagcctgcagtgatggtgacct

SEQ ID NO: 46381 - DNA, 25 bp, Mus musculus
gtagagctggattaaaacacaggag

SEQ ID NO: 46382 - DNA, 25 bp, Mus musculus
gtagagtccagttctcctggattgt

SEQ ID NO: 46383 - DNA, 25 bp, Mus musculus
gtagatattgtcatagatgcaggag

SEQ ID NO: 46384 - DNA, 25 bp, Mus musculus
gtagatctggcctaatggcagagta

SEQ ID NO: 46385 - DNA, 25 bp, Mus musculus
gtagattggcaaaatataggacact

SEQ ID NO: 46386 - DNA, 25 bp, Mus musculus
gtagatttccagtggccccattgat

SEQ ID NO: 46387 - DNA, 25 bp, Mus musculus
gtagcaatatcctaacagttgagaa

SEQ ID NO: 46388 - DNA, 25 bp, Mus musculus
gtagcacatactaaatgcacatgtg

SEQ ID NO: 46389 - DNA, 25 bp, Mus musculus
gtagcagcaagaacctcgaccatgg

SEQ ID NO: 46390 - DNA, 25 bp, Mus musculus
gtagcatagaactgccaaaggcaag

SEQ ID NO: 46391 - DNA, 25 bp, Mus musculus
gtagccatgggcactggttccctct

SEQ ID NO: 46392 - DNA, 25 bp, Mus musculus
gtagcccggatcctaacccatgagg

SEQ ID NO: 46393 - DNA, 25 bp, Mus musculus
gtagccctgagtacccacagccata

SEQ ID NO: 46394 - DNA, 25 bp, Mus musculus
gtagctactgaaaggctcttcattg

SEQ ID NO: 46395 - DNA, 25 bp, Mus musculus
gtagctgaaataaagaataggacca

SEQ ID NO: 46396 - DNA, 25 bp, Mus musculus
gtagctgcactaggaaacacatggg

SEQ ID NO: 46397 - DNA, 25 bp, Mus musculus
gtagctgttctagacccaccacggg

SEQ ID NO: 46398 - DNA, 25 bp, Mus musculus
gtagcttctccataacagcacctgc

SEQ ID NO: 46399 - DNA, 25 bp, Mus musculus
gtagcttctgtggaagtacaaataa

SEQ ID NO: 46400 - DNA, 25 bp, Mus musculus
gtagctttgccttcttaccatcagg

SEQ ID NO: 46401 - DNA, 25 bp, Mus musculus
gtaggagacaaaggcactcagctgt

SEQ ID NO: 46402 - DNA, 25 bp, Mus musculus
gtaggcaagactcgttccctcttca

SEQ ID NO: 46403 - DNA, 25 bp, Mus musculus
gtaggcaagactggttccctcttca

SEQ ID NO: 46404 - DNA, 25 bp, Mus musculus
gtaggccaggctggcatcagaccca

SEQ ID NO: 46405 - DNA, 25 bp, Mus musculus
gtagggccagaaggaatggaaaaat

SEQ ID NO: 46406 - DNA, 25 bp, Mus musculus
gtagggcttaccagcagatcttgga

SEQ ID NO: 46407 - DNA, 25 bp, Mus musculus
gtaggtcaatctccctacaccagcg

SEQ ID NO: 46408 - DNA, 25 bp, Mus musculus
gtaggtcgaatgtgcatctatcaga

SEQ ID NO: 46409 - DNA, 25 bp, Mus musculus
gtaggtgcacgcctcattgctcatg

SEQ ID NO: 46410 - DNA, 25 bp, Mus musculus
gtaggtgtacatgactgcacatgcc

SEQ ID NO: 46411 - DNA, 25 bp, Mus musculus
gtagtaccgttgtcagcacacagcg

SEQ ID NO: 46412 - DNA, 25 bp, Mus musculus
gtagtagcacaacccttaacgagga

SEQ ID NO: 46413 - DNA, 25 bp, Mus musculus
gtagtatgggatgctagtactggaa

SEQ ID NO: 46414 - DNA, 25 bp, Mus musculus
gtagtcagccgtaacaagctcacgc

SEQ ID NO: 46415 - DNA, 25 bp, Mus musculus
gtagtccaaccaaattctcagtctg

SEQ ID NO: 46416 - DNA, 25 bp, Mus musculus
gtagtcgatacccttttgactctcc

SEQ ID NO: 46417 - DNA, 25 bp, Mus musculus
gtagtctcttccagcactctcctga

SEQ ID NO: 46418 - DNA, 25 bp, Mus musculus
gtagtgcgctggctcaatgagcaaa

SEQ ID NO: 46419 - DNA, 25 bp, Mus musculus
gtagtgctgccctaatcccactggc

SEQ ID NO: 46420 - DNA, 25 bp, Mus musculus
gtagtggaatacaaaaccagttggg

SEQ ID NO: 46421 - DNA, 25 bp, Mus musculus
gtagttggccaacaagcaacagaag

SEQ ID NO: 46422 - DNA, 25 bp, Mus musculus
gtagtttacaagagcccctcagagt

SEQ ID NO: 46423 - DNA, 25 bp, Mus musculus
gtataacaaagaagaccctacgtct

SEQ ID NO: 46424 - DNA, 25 bp, Mus musculus
gtataacacctttggagaggctctg

SEQ ID NO: 46425 - DNA, 25 bp, Mus musculus
gtataagaacatcagaactacgcct

SEQ ID NO: 46426 - DNA, 25 bp, Mus musculus
gtataatgaccagctcaccagggcc

SEQ ID NO: 46427 - DNA, 25 bp, Mus musculus
gtataatggacaagcactgcacctg

SEQ ID NO: 46428 - DNA, 25 bp, Mus musculus
gtatacagccatcgccagtccagga

SEQ ID NO: 46429 - DNA, 25 bp, Mus musculus
gtatacctgccgacccgagagtacc

SEQ ID NO: 46430 - DNA, 25 bp, Mus musculus
gtataggcagagtgtcttttggcgc

SEQ ID NO: 46431 - DNA, 25 bp, Mus musculus
gtatagtcctagcacggtatgggcc

SEQ ID NO: 46432 - DNA, 25 bp, Mus musculus
gtatatcaggtactgctgtgatgat

SEQ ID NO: 46433 - DNA, 25 bp, Mus musculus
gtatatcccatgcatcatgacagtg

SEQ ID NO: 46434 - DNA, 25 bp, Mus musculus
gtatatcccgaagctacgcaaagaa

SEQ ID NO: 46435 - DNA, 25 bp, Mus musculus
gtatatccgagacaaccacagcaag

SEQ ID NO: 46436 - DNA, 25 bp, Mus musculus
gtatattctttacacaagtcctcaa

SEQ ID NO: 46437 - DNA, 25 bp, Mus musculus
gtatcaaagtaacggatgatctagt

SEQ ID NO: 46438 - DNA, 25 bp, Mus musculus
gtatcaagagccagtgtatggcaat

SEQ ID NO: 46439 - DNA, 25 bp, Mus musculus
gtatcaccgcaggatcgatgctcta

SEQ ID NO: 46440 - DNA, 25 bp, Mus musculus
gtatcagtgcttcgtgagcttcttt

SEQ ID NO: 46441 - DNA, 25 bp, Mus musculus
gtatcatcatcacttcatcacaaga

SEQ ID NO: 46442 - DNA, 25 bp, Mus musculus
gtatcatcctgtatggccagagcat

SEQ ID NO: 46443 - DNA, 25 bp, Mus musculus
gtatccagaggaaaacactccccag

SEQ ID NO: 46444 - DNA, 25 bp, Mus musculus
gtatcccaaggaggtccaagacctt

SEQ ID NO: 46445 - DNA, 25 bp, Mus musculus
gtatccggccacaggtgccaatggc

SEQ ID NO: 46446 - DNA, 25 bp, Mus musculus
gtatccggccactggtgccaatggc

SEQ ID NO: 46447 - DNA, 25 bp, Mus musculus
gtatccgtgtctaactcctttctca

SEQ ID NO: 46448 - DNA, 25 bp, Mus musculus
gtatcctgctgaacgccaactgggt

SEQ ID NO: 46449 - DNA, 25 bp, Mus musculus
gtatcgccactttgaccagcacact

SEQ ID NO: 46450 - DNA, 25 bp, Mus musculus
gtatcggctcgtgggctcccaggaa

SEQ ID NO: 46451 - DNA, 25 bp, Mus musculus
gtatcgtgcgcccaagctctggaac

SEQ ID NO: 46452 - DNA, 25 bp, Mus musculus
gtatcgtgtccaggtccggtactct

SEQ ID NO: 46453 - DNA, 25 bp, Mus musculus
gtatcgtttgagcagatcctcagcc

SEQ ID NO: 46454 - DNA, 25 bp, Mus musculus
gtatctactttatccagccacactc

SEQ ID NO: 46455 - DNA, 25 bp, Mus musculus
gtatctcttttgaatacagtacaat

SEQ ID NO: 46456 - DNA, 25 bp, Mus musculus
gtatctgaatcccaaggtgggcagc

SEQ ID NO: 46457 - DNA, 25 bp, Mus musculus
gtatctgcattatcgacggcgccgc

SEQ ID NO: 46458 - DNA, 25 bp, Mus musculus
gtatctgtcagctaaagggccctct

SEQ ID NO: 46459 - DNA, 25 bp, Mus musculus
gtatgaccaggccaccagaggacag

SEQ ID NO: 46460 - DNA, 25 bp, Mus musculus
gtatgacctgccatattcagtaaga

SEQ ID NO: 46461 - DNA, 25 bp, Mus musculus
gtatgacggtgccagcctcaccatg

SEQ ID NO: 46462 - DNA, 25 bp, Mus musculus
gtatgagaacccgactaatggcagt

SEQ ID NO: 46463 - DNA, 25 bp, Mus musculus
gtatgagaacgtggatgaagactcc

SEQ ID NO: 46464 - DNA, 25 bp, Mus musculus
gtatgagaagatccccagctgtgca

SEQ ID NO: 46465 - DNA, 25 bp, Mus musculus
gtatgagctttagttctgaacatca

SEQ ID NO: 46466 - DNA, 25 bp, Mus musculus
gtatgaggtagacgacattgatgaa

SEQ ID NO: 46467 - DNA, 25 bp, Mus musculus
gtatgagtcagagctgtccctgcgg

SEQ ID NO: 46468 - DNA, 25 bp, Mus musculus
gtatgatctggacactcagcacgcc

SEQ ID NO: 46469 - DNA, 25 bp, Mus musculus
gtatgcaccaccacgacttcagctt

SEQ ID NO: 46470 - DNA, 25 bp, Mus musculus
gtatgccaacattgacatcctcaga

SEQ ID NO: 46471 - DNA, 25 bp, Mus musculus
gtatgcccatcactccagcacattg

SEQ ID NO: 46472 - DNA, 25 bp, Mus musculus
gtatgccttgcgtgcctgagttcca

SEQ ID NO: 46473 - DNA, 25 bp, Mus musculus
gtatgctgcaagtgagaacgtattt

SEQ ID NO: 46474 - DNA, 25 bp, Mus musculus
gtatggagacgcagccctgagacag

SEQ ID NO: 46475 - DNA, 25 bp, Mus musculus
gtatggagacgctgccctgagacag

SEQ ID NO: 46476 - DNA, 25 bp, Mus musculus
gtatggccaaaaagcacttatgaag

SEQ ID NO: 46477 - DNA, 25 bp, Mus musculus
gtatggcttcccttctgcacacaag

SEQ ID NO: 46478 - DNA, 25 bp, Mus musculus
gtatggtgacctggccaactggatg

SEQ ID NO: 46479 - DNA, 25 bp, Mus musculus
gtatgtcctgcaagttttaaagaaa

SEQ ID NO: 46480 - DNA, 25 bp, Mus musculus
gtatgtctctgatattttcagaggg

SEQ ID NO: 46481 - DNA, 25 bp, Mus musculus
gtatgtggtccgaagcagctccaag

SEQ ID NO: 46482 - DNA, 25 bp, Mus musculus
gtatgtgtatcctcctctgccctca

SEQ ID NO: 46483 - DNA, 25 bp, Mus musculus
gtatgtgtcacacagcgactcccaa

SEQ ID NO: 46484 - DNA, 25 bp, Mus musculus
gtattacaagtacttccatcctaag

SEQ ID NO: 46485 - DNA, 25 bp, Mus musculus
gtattacagagtggccctttgcagg

SEQ ID NO: 46486 - DNA, 25 bp, Mus musculus
gtattacgtccttcctgggcagaca

SEQ ID NO: 46487 - DNA, 25 bp, Mus musculus
gtattcaacctatacagagctatgc

SEQ ID NO: 46488 - DNA, 25 bp, Mus musculus
gtattcatgctagcctggaccattt

SEQ ID NO: 46489 - DNA, 25 bp, Mus musculus
gtattccagcggcagacacaccatc

SEQ ID NO: 46490 - DNA, 25 bp, Mus musculus
gtattccaggtgcacaatccagtca

SEQ ID NO: 46491 - DNA, 25 bp, Mus musculus
gtattcccatctgtcagcagcactt

SEQ ID NO: 46492 - DNA, 25 bp, Mus musculus
gtattccttttttgtagccatgggc

SEQ ID NO: 46493 - DNA, 25 bp, Mus musculus
gtattcgcctctacctgtccgtgct

SEQ ID NO: 46494 - DNA, 25 bp, Mus musculus
gtattcggcaccaacgtgatggtga

SEQ ID NO: 46495 - DNA, 25 bp, Mus musculus
gtattctcatactagactccctgaa

SEQ ID NO: 46496 - DNA, 25 bp, Mus musculus
gtattctgctatgccttgagcccgg

SEQ ID NO: 46497 - DNA, 25 bp, Mus musculus
gtattctggagggactgagggccca

SEQ ID NO: 46498 - DNA, 25 bp, Mus musculus
gtattctgggaaaatctgctgttta

SEQ ID NO: 46499 - DNA, 25 bp, Mus musculus
gtattcttgtacatgctgacatcaa

SEQ ID NO: 46500 - DNA, 25 bp, Mus musculus
gtattcttgtacttgctgacatcaa

SEQ ID NO: 46501 - DNA, 25 bp, Mus musculus
gtattgacctcatggacatggcctc

SEQ ID NO: 46502 - DNA, 25 bp, Mus musculus
gtattgaggctctgaaacaagtaac

SEQ ID NO: 46503 - DNA, 25 bp, Mus musculus
gtattgagtccttgtgtcatcgtca

SEQ ID NO: 46504 - DNA, 25 bp, Mus musculus
gtattgcgactttctgggctctggg

SEQ ID NO: 46505 - DNA, 25 bp, Mus musculus
gtattggattgctgtgttgaacaca

SEQ ID NO: 46506 - DNA, 25 bp, Mus musculus
gtattgtaacagctgaagtctcttc

SEQ ID NO: 46507 - DNA, 25 bp, Mus musculus
gtattgtattcttcccaccactgag

SEQ ID NO: 46508 - DNA, 25 bp, Mus musculus
gtatttatacctcaagatgggaaga

SEQ ID NO: 46509 - DNA, 25 bp, Mus musculus
gtatttcgagcacgctatatagccc

SEQ ID NO: 46510 - DNA, 25 bp, Mus musculus
gtatttctgcctcggccggccgtga

SEQ ID NO: 46511 - DNA, 25 bp, Mus musculus
gtatttgaagtgatgctggctacag

SEQ ID NO: 46512 - DNA, 25 bp, Mus musculus
gtatttgctctgctcttaaaacaag

SEQ ID NO: 46513 - DNA, 25 bp, Mus musculus
gtatttggtcccttggagctgtgag

SEQ ID NO: 46514 - DNA, 25 bp, Mus musculus
gtatttgttgatggtcagtctgtca

SEQ ID NO: 46515 - DNA, 25 bp, Mus musculus
gtattttcctcaagtcccatgactt

SEQ ID NO: 46516 - DNA, 25 bp, Mus musculus
gtcaaaagagcaccagcagctccct

SEQ ID NO: 46517 - DNA, 25 bp, Mus musculus
gtcaaaattctgaaagacaacctgg

SEQ ID NO: 46518 - DNA, 25 bp, Mus musculus
gtcaaacaaaactcagctgtgaact

SEQ ID NO: 46519 - DNA, 25 bp, Mus musculus
gtcaaacactaagctgatcgaagag

SEQ ID NO: 46520 - DNA, 25 bp, Mus musculus
gtcaaacagcggatggtacccatgg

SEQ ID NO: 46521 - DNA, 25 bp, Mus musculus
gtcaaagggtgaaacaaagttcatg

SEQ ID NO: 46522 - DNA, 25 bp, Mus musculus
gtcaaatatgtctgccttctctcaa

SEQ ID NO: 46523 - DNA, 25 bp, Mus musculus
gtcaaatcactgaagcgacccctcg

SEQ ID NO: 46524 - DNA, 25 bp, Mus musculus
gtcaaatgcacaacagggaaaatat

SEQ ID NO: 46525 - DNA, 25 bp, Mus musculus
gtcaaatgcctagattagttctgtg

SEQ ID NO: 46526 - DNA, 25 bp, Mus musculus
gtcaacaaagagttcactgtgaaca

SEQ ID NO: 46527 - DNA, 25 bp, Mus musculus
gtcaacaactccaatggctcccgta

SEQ ID NO: 46528 - DNA, 25 bp, Mus musculus
gtcaacacgttctcaattttcaagg

SEQ ID NO: 46529 - DNA, 25 bp, Mus musculus
gtcaaccccgacttggaggagccac

SEQ ID NO: 46530 - DNA, 25 bp, Mus musculus
gtcaaccgcagcgtgtcagaccagt

SEQ ID NO: 46531 - DNA, 25 bp, Mus musculus
gtcaaccttccttgctcctttcaag

SEQ ID NO: 46532 - DNA, 25 bp, Mus musculus
gtcaactttgtagtgtgccagctct

SEQ ID NO: 46533 - DNA, 25 bp, Mus musculus
gtcaagattctgagctccccatggt

SEQ ID NO: 46534 - DNA, 25 bp, Mus musculus
gtcaagcaaggccatgagccagcca

SEQ ID NO: 46535 - DNA, 25 bp, Mus musculus
gtcaagcagacatctctatgtactc

SEQ ID NO: 46536 - DNA, 25 bp, Mus musculus
gtcaagctccgagggcagcctttct

SEQ ID NO: 46537 - DNA, 25 bp, Mus musculus
gtcaagctggagtgcaaccccacag

SEQ ID NO: 46538 - DNA, 25 bp, Mus musculus
gtcaaggagaaatgaattctaccat

SEQ ID NO: 46539 - DNA, 25 bp, Mus musculus
gtcaaggaggccatgcatatcttaa

SEQ ID NO: 46540 - DNA, 25 bp, Mus musculus
gtcaaggcaccattctgaatcagag

SEQ ID NO: 46541 - DNA, 25 bp, Mus musculus
gtcaaggctttgacatgcaagaggt

SEQ ID NO: 46542 - DNA, 25 bp, Mus musculus
gtcaaggtgggagacccctgtcaga

SEQ ID NO: 46543 - DNA, 25 bp, Mus musculus
gtcaagtaatgaacatggccgcctt

SEQ ID NO: 46544 - DNA, 25 bp, Mus musculus
gtcaagttgttaccatcgcgcctac

SEQ ID NO: 46545 - DNA, 25 bp, Mus musculus
gtcaatatggagaggcacccagccc

SEQ ID NO: 46546 - DNA, 25 bp, Mus musculus
gtcaatcactgagaaaacgtctttt

SEQ ID NO: 46547 - DNA, 25 bp, Mus musculus
gtcaatcgaacagactcagattaag

SEQ ID NO: 46548 - DNA, 25 bp, Mus musculus
gtcaatgggtcagaaactccttttc

SEQ ID NO: 46549 - DNA, 25 bp, Mus musculus
gtcaattttctgctgcagcattctg

SEQ ID NO: 46550 - DNA, 25 bp, Mus musculus
gtcacaaacagtataaactacattg

SEQ ID NO: 46551 - DNA, 25 bp, Mus musculus
gtcacaaacagtttaaactacattg

SEQ ID NO: 46552 - DNA, 25 bp, Mus musculus
gtcacaaacctacagccatgccagt

SEQ ID NO: 46553 - DNA, 25 bp, Mus musculus
gtcacaagcagtaggaattctaatg

SEQ ID NO: 46554 - DNA, 25 bp, Mus musculus
gtcacaagtgcccaacatgcctagc

SEQ ID NO: 46555 - DNA, 25 bp, Mus musculus
gtcacacaaataagcctcaggcatt

SEQ ID NO: 46556 - DNA, 25 bp, Mus musculus
gtcacacaaattagtctccacctgc

SEQ ID NO: 46557 - DNA, 25 bp, Mus musculus
gtcacacaagctaaagacgggccat

SEQ ID NO: 46558 - DNA, 25 bp, Mus musculus
gtcacactgtcattcgaaaaacaag

SEQ ID NO: 46559 - DNA, 25 bp, Mus musculus
gtcacagacaggaaatcttggcagt

SEQ ID NO: 46560 - DNA, 25 bp, Mus musculus
gtcacagagccaggtgctttgcgga

SEQ ID NO: 46561 - DNA, 25 bp, Mus musculus
gtcacagcaaaaagtattacgtcct

SEQ ID NO: 46562 - DNA, 25 bp, Mus musculus
gtcacagctagtaaatggagccagg

SEQ ID NO: 46563 - DNA, 25 bp, Mus musculus
gtcacagctctggaacggcaagtct

SEQ ID NO: 46564 - DNA, 25 bp, Mus musculus
gtcacagggaagaaatccaacaact

SEQ ID NO: 46565 - DNA, 25 bp, Mus musculus
gtcacagtacctacctcaaatggtg

SEQ ID NO: 46566 - DNA, 25 bp, Mus musculus
gtcacagtcgtcgatgccagcttct

SEQ ID NO: 46567 - DNA, 25 bp, Mus musculus
gtcacatctgtcaaactacttgaaa

SEQ ID NO: 46568 - DNA, 25 bp, Mus musculus
gtcaccaacaacctcaagtctcttg

SEQ ID NO: 46569 - DNA, 25 bp, Mus musculus
gtcaccaacccaggatctttgaggg

SEQ ID NO: 46570 - DNA, 25 bp, Mus musculus
gtcaccaacctaaacaatgcatttg

SEQ ID NO: 46571 - DNA, 25 bp, Mus musculus
gtcaccaagaatgggcagaagcgag

SEQ ID NO: 46572 - DNA, 25 bp, Mus musculus
gtcaccactgtgatgccacatttaa

SEQ ID NO: 46573 - DNA, 25 bp, Mus musculus
gtcaccagctttgggcccgtttctg

SEQ ID NO: 46574 - DNA, 25 bp, Mus musculus
gtcaccatcatcaccgtgccaatag

SEQ ID NO: 46575 - DNA, 25 bp, Mus musculus
gtcaccatggcaaccttgtccctgg

SEQ ID NO: 46576 - DNA, 25 bp, Mus musculus
gtcaccattgtccaaactcagaggc

SEQ ID NO: 46577 - DNA, 25 bp, Mus musculus
gtcacccagcaagtcagttgtagag

SEQ ID NO: 46578 - DNA, 25 bp, Mus musculus
gtcacccgctgggaggatctggctc

SEQ ID NO: 46579 - DNA, 25 bp, Mus musculus
gtcaccctgctgatcatgaagctga

SEQ ID NO: 46580 - DNA, 25 bp, Mus musculus
gtcaccctgctgattgccttcatct

SEQ ID NO: 46581 - DNA, 25 bp, Mus musculus
gtcaccgatcaggttcatgtaccat

SEQ ID NO: 46582 - DNA, 25 bp, Mus musculus
gtcaccgcgctgagcgtttacctca

SEQ ID NO: 46583 - DNA, 25 bp, Mus musculus
gtcacctcaagattcccaagggctc

SEQ ID NO: 46584 - DNA, 25 bp, Mus musculus
gtcacctgcagtaccagccaaaaag

SEQ ID NO: 46585 - DNA, 25 bp, Mus musculus
gtcacctggctagcagcttgggcca

SEQ ID NO: 46586 - DNA, 25 bp, Mus musculus
gtcacgctggagttcagggcacagc

SEQ ID NO: 46587 - DNA, 25 bp, Mus musculus
gtcacggaggtacaaccccggcagt

SEQ ID NO: 46588 - DNA, 25 bp, Mus musculus
gtcacggagtgacgtcacaaactct

SEQ ID NO: 46589 - DNA, 25 bp, Mus musculus
gtcacggtgagatgagacagatttc

SEQ ID NO: 46590 - DNA, 25 bp, Mus musculus
gtcacgtgacttctatcatacttgc

SEQ ID NO: 46591 - DNA, 25 bp, Mus musculus
gtcacgtgtccatgtggcctgcaca

SEQ ID NO: 46592 - DNA, 25 bp, Mus musculus
gtcactaaataagcttccacgacag

SEQ ID NO: 46593 - DNA, 25 bp, Mus musculus
gtcactctcttctgattctcctcaa

SEQ ID NO: 46594 - DNA, 25 bp, Mus musculus
gtcactggatttacacaaggcaaga

SEQ ID NO: 46595 - DNA, 25 bp, Mus musculus
gtcactggattttcacaaggcaaga

SEQ ID NO: 46596 - DNA, 25 bp, Mus musculus
gtcactggcagtgcccagtttgcag

SEQ ID NO: 46597 - DNA, 25 bp, Mus musculus
gtcactgggaaatggtgggcccact

SEQ ID NO: 46598 - DNA, 25 bp, Mus musculus
gtcacttgtccagaacacagattca

SEQ ID NO: 46599 - DNA, 25 bp, Mus musculus
gtcagaaaccaaatttgactctggt

SEQ ID NO: 46600 - DNA, 25 bp, Mus musculus
gtcagaaacgatggcagccctggca

SEQ ID NO: 46601 - DNA, 25 bp, Mus musculus
gtcagaacaaacacaattaccaatg

SEQ ID NO: 46602 - DNA, 25 bp, Mus musculus
gtcagaacagattcgggagttaaga

SEQ ID NO: 46603 - DNA, 25 bp, Mus musculus
gtcagaactattgctatggatggca

SEQ ID NO: 46604 - DNA, 25 bp, Mus musculus
gtcagaagaaggctgctattgaaag

SEQ ID NO: 46605 - DNA, 25 bp, Mus musculus
gtcagaagcacgcagccttaagcct

SEQ ID NO: 46606 - DNA, 25 bp, Mus musculus
gtcagaagcggtccactgtggctca

SEQ ID NO: 46607 - DNA, 25 bp, Mus musculus
gtcagacatatgaaactgaggagag

SEQ ID NO: 46608 - DNA, 25 bp, Mus musculus
gtcagacatgcatccaagaagacag

SEQ ID NO: 46609 - DNA, 25 bp, Mus musculus
gtcagaccaagccacctactatggc

SEQ ID NO: 46610 - DNA, 25 bp, Mus musculus
gtcagacctcttcttttacgaacat

SEQ ID NO: 46611 - DNA, 25 bp, Mus musculus
gtcagactctgccaagcagttcttg

SEQ ID NO: 46612 - DNA, 25 bp, Mus musculus
gtcagagatggctcctgcccagggt

SEQ ID NO: 46613 - DNA, 25 bp, Mus musculus
gtcagagcaaccaactgcgacctgg

SEQ ID NO: 46614 - DNA, 25 bp, Mus musculus
gtcagagccttggatcctccctggg

SEQ ID NO: 46615 - DNA, 25 bp, Mus musculus
gtcagagctgccaccttcgatggaa

SEQ ID NO: 46616 - DNA, 25 bp, Mus musculus
gtcagagtacacctgtaagccagct

SEQ ID NO: 46617 - DNA, 25 bp, Mus musculus
gtcagattgctgtacttgtgttcca

SEQ ID NO: 46618 - DNA, 25 bp, Mus musculus
gtcagcacataaacccgtctcctgg

SEQ ID NO: 46619 - DNA, 25 bp, Mus musculus
gtcagcactgaatgggcagctccca

SEQ ID NO: 46620 - DNA, 25 bp, Mus musculus
gtcagcagatgccacctccaaggtt

SEQ ID NO: 46621 - DNA, 25 bp, Mus musculus
gtcagcatactgtcaaccttccttg

SEQ ID NO: 46622 - DNA, 25 bp, Mus musculus
gtcagcattcaaagccacctacggg

SEQ ID NO: 46623 - DNA, 25 bp, Mus musculus
gtcagccaacgcttgaagtttcata

SEQ ID NO: 46624 - DNA, 25 bp, Mus musculus
gtcagcccagttcaatcattgcagg

SEQ ID NO: 46625 - DNA, 25 bp, Mus musculus
gtcagccgcagagtccagctcagat

SEQ ID NO: 46626 - DNA, 25 bp, Mus musculus
gtcagcctagagaagcagcacggga

SEQ ID NO: 46627 - DNA, 25 bp, Mus musculus
gtcagcgacccggatgccaagggat

SEQ ID NO: 46628 - DNA, 25 bp, Mus musculus
gtcagctacaccacaaatgcatcca

SEQ ID NO: 46629 - DNA, 25 bp, Mus musculus
gtcagctcctccagagactccagtg

SEQ ID NO: 46630 - DNA, 25 bp, Mus musculus
gtcagctgccatgtacaaagagatt

SEQ ID NO: 46631 - DNA, 25 bp, Mus musculus
gtcagctgtgcctaccgtgctagcc

SEQ ID NO: 46632 - DNA, 25 bp, Mus musculus
gtcagcttctccttctgttcttctg

SEQ ID NO: 46633 - DNA, 25 bp, Mus musculus
gtcaggaatggttccttctcatcca

SEQ ID NO: 46634 - DNA, 25 bp, Mus musculus
gtcaggacccagctcccgagagatc

SEQ ID NO: 46635 - DNA, 25 bp, Mus musculus
gtcaggacccggatgcaggcacaag

SEQ ID NO: 46636 - DNA, 25 bp, Mus musculus
gtcaggacccttctgggaaggcctt

SEQ ID NO: 46637 - DNA, 25 bp, Mus musculus
gtcaggagacgaagcagagagcaca

SEQ ID NO: 46638 - DNA, 25 bp, Mus musculus
gtcaggattccaagcccctttgcct

SEQ ID NO: 46639 - DNA, 25 bp, Mus musculus
gtcagggccaaaactggaaccaagg

SEQ ID NO: 46640 - DNA, 25 bp, Mus musculus
gtcaggtatcctgcccagatactgg

SEQ ID NO: 46641 - DNA, 25 bp, Mus musculus
gtcaggtgaagagctttggaaaaag

SEQ ID NO: 46642 - DNA, 25 bp, Mus musculus
gtcaggtgacaggaagcagagtaca

SEQ ID NO: 46643 - DNA, 25 bp, Mus musculus
gtcaggtggctgtttgcttgtcatc

SEQ ID NO: 46644 - DNA, 25 bp, Mus musculus
gtcagtctgtctgcacgtagctcag

SEQ ID NO: 46645 - DNA, 25 bp, Mus musculus
gtcagtgaatgcttgtgaaaagacc

SEQ ID NO: 46646 - DNA, 25 bp, Mus musculus
gtcagtgagaacaggagcaaccaga

SEQ ID NO: 46647 - DNA, 25 bp, Mus musculus
gtcagtgcttcgcaagatggaaaat

SEQ ID NO: 46648 - DNA, 25 bp, Mus musculus
gtcagtggaagctctgtcaccggat

SEQ ID NO: 46649 - DNA, 25 bp, Mus musculus
gtcagtggacctgcctgggctcaaa

SEQ ID NO: 46650 - DNA, 25 bp, Mus musculus
gtcagtgtcacaaaaccatttatgt

SEQ ID NO: 46651 - DNA, 25 bp, Mus musculus
gtcagtgtcacataaccatttatgt

SEQ ID NO: 46652 - DNA, 25 bp, Mus musculus
gtcagttaacatccattcccggcta

SEQ ID NO: 46653 - DNA, 25 bp, Mus musculus
gtcataaatacaaacgtgggcaaga

SEQ ID NO: 46654 - DNA, 25 bp, Mus musculus
gtcataagcatccacacgtttgccg

SEQ ID NO: 46655 - DNA, 25 bp, Mus musculus
gtcataatgattacggttatcagca

SEQ ID NO: 46656 - DNA, 25 bp, Mus musculus
gtcataccgtgcactccagggagca

SEQ ID NO: 46657 - DNA, 25 bp, Mus musculus
gtcatagcagcactaacaattctgt

SEQ ID NO: 46658 - DNA, 25 bp, Mus musculus
gtcatatacaggtcttagcaagaaa

SEQ ID NO: 46659 - DNA, 25 bp, Mus musculus
gtcatatccagtggcctggaccgag

SEQ ID NO: 46660 - DNA, 25 bp, Mus musculus
gtcatatttcccacgttgttcatgg

SEQ ID NO: 46661 - DNA, 25 bp, Mus musculus
gtcatcatcaacgaggccagcggca

SEQ ID NO: 46662 - DNA, 25 bp, Mus musculus
gtcatcatcattggcctgagcgtag

SEQ ID NO: 46663 - DNA, 25 bp, Mus musculus
gtcatcatccccattagacaccggg

SEQ ID NO: 46664 - DNA, 25 bp, Mus musculus
gtcatcatcccctttagacaccggg

SEQ ID NO: 46665 - DNA, 25 bp, Mus musculus
gtcatcatgagggaattccgatcag

SEQ ID NO: 46666 - DNA, 25 bp, Mus musculus
gtcatcatgtggcactaacacccgt

SEQ ID NO: 46667 - DNA, 25 bp, Mus musculus
gtcatccattagagcggtaatcaag

SEQ ID NO: 46668 - DNA, 25 bp, Mus musculus
gtcatccattagtgcggtaatcaag

SEQ ID NO: 46669 - DNA, 25 bp, Mus musculus
gtcatccggcctctgtcagtgtttg

SEQ ID NO: 46670 - DNA, 25 bp, Mus musculus
gtcatcctcatgtacaccttctgca

SEQ ID NO: 46671 - DNA, 25 bp, Mus musculus
gtcatcggaaatccgggaactggca

SEQ ID NO: 46672 - DNA, 25 bp, Mus musculus
gtcatcggaaatgcgggaactggca

SEQ ID NO: 46673 - DNA, 25 bp, Mus musculus
gtcatcgtcctcgtcagcatcgccg

SEQ ID NO: 46674 - DNA, 25 bp, Mus musculus
gtcatctcaaatatgcctgctcagg

SEQ ID NO: 46675 - DNA, 25 bp, Mus musculus
gtcatctcagatccctagctggaag

SEQ ID NO: 46676 - DNA, 25 bp, Mus musculus
gtcatgacgcatggctgaatgtggc

SEQ ID NO: 46677 - DNA, 25 bp, Mus musculus
gtcatgactgatgccgccatttttg

SEQ ID NO: 46678 - DNA, 25 bp, Mus musculus
gtcatgagtgcctagcgcccttggt

SEQ ID NO: 46679 - DNA, 25 bp, Mus musculus
gtcatgattgacgtgcccaacaaat

SEQ ID NO: 46680 - DNA, 25 bp, Mus musculus
gtcatgattgccatctgtgtctctg

SEQ ID NO: 46681 - DNA, 25 bp, Mus musculus
gtcatgcacctaggcggccagacag

SEQ ID NO: 46682 - DNA, 25 bp, Mus musculus
gtcatggaaaatctcccgaggagct

SEQ ID NO: 46683 - DNA, 25 bp, Mus musculus
gtcatggaacagcagactctgtcca

SEQ ID NO: 46684 - DNA, 25 bp, Mus musculus
gtcatggaccaacacaagctcagca

SEQ ID NO: 46685 - DNA, 25 bp, Mus musculus
gtcatggctgcatgcattttcttcc

SEQ ID NO: 46686 - DNA, 25 bp, Mus musculus
gtcatggtcactgcaagtgtatcca

SEQ ID NO: 46687 - DNA, 25 bp, Mus musculus
gtcatggtgcactgggccctccgtg

SEQ ID NO: 46688 - DNA, 25 bp, Mus musculus
gtcatggtggccctgcagcactttg

SEQ ID NO: 46689 - DNA, 25 bp, Mus musculus
gtcatggtttattggcacgccttgg

SEQ ID NO: 46690 - DNA, 25 bp, Mus musculus
gtcatgtcgggcttcgacgacccgg

SEQ ID NO: 46691 - DNA, 25 bp, Mus musculus
gtcatgtgcagtattgcaaactcac

SEQ ID NO: 46692 - DNA, 25 bp, Mus musculus
gtcatgtgcagttttgcaaactcac

SEQ ID NO: 46693 - DNA, 25 bp, Mus musculus
gtcatgtgggcgtttgtgagtccac

SEQ ID NO: 46694 - DNA, 25 bp, Mus musculus
gtcattaaagcgatagaagaaggtt

SEQ ID NO: 46695 - DNA, 25 bp, Mus musculus
gtcattaattcgcttagcagaagcc

SEQ ID NO: 46696 - DNA, 25 bp, Mus musculus
gtcattcaatattaacagggttgca

SEQ ID NO: 46697 - DNA, 25 bp, Mus musculus
gtcattcagctgctctccacagaaa

SEQ ID NO: 46698 - DNA, 25 bp, Mus musculus
gtcattcccaaaagcaagttcgtct

SEQ ID NO: 46699 - DNA, 25 bp, Mus musculus
gtcattctcacccagatagagaggg

SEQ ID NO: 46700 - DNA, 25 bp, Mus musculus
gtcattgaaacggaaaaaactctct

SEQ ID NO: 46701 - DNA, 25 bp, Mus musculus
gtcattgattacaacggcgagcgga

SEQ ID NO: 46702 - DNA, 25 bp, Mus musculus
gtcattttgccaaaattagtcacag

SEQ ID NO: 46703 - DNA, 25 bp, Mus musculus
gtcattttgccataattagtcacag

SEQ ID NO: 46704 - DNA, 25 bp, Mus musculus
gtccaaagaagctatatcagcagaa

SEQ ID NO: 46705 - DNA, 25 bp, Mus musculus
gtccaaagcagacacgaccacaggg

SEQ ID NO: 46706 - DNA, 25 bp, Mus musculus
gtccaacaagaagccggagctgctg

SEQ ID NO: 46707 - DNA, 25 bp, Mus musculus
gtccaacgtcggaaatggaagctga

SEQ ID NO: 46708 - DNA, 25 bp, Mus musculus
gtccaactgtgagctgcttaagaag

SEQ ID NO: 46709 - DNA, 25 bp, Mus musculus
gtccaattggttccaagacccgcag

SEQ ID NO: 46710 - DNA, 25 bp, Mus musculus
gtccacagcaaaggattgaagctag

SEQ ID NO: 46711 - DNA, 25 bp, Mus musculus
gtccacagtttcgaattcaaagcat

SEQ ID NO: 46712 - DNA, 25 bp, Mus musculus
gtccacatgcatggcgtctaatgag

SEQ ID NO: 46713 - DNA, 25 bp, Mus musculus
gtccaccaatcgcaaactagaacgg

SEQ ID NO: 46714 - DNA, 25 bp, Mus musculus
gtccaccaatgtaagaaaactcacc

SEQ ID NO: 46715 - DNA, 25 bp, Mus musculus
gtccaccatgattgacgggagtggt

SEQ ID NO: 46716 - DNA, 25 bp, Mus musculus
gtccacctgaagatcaggaaaagaa

SEQ ID NO: 46717 - DNA, 25 bp, Mus musculus
gtccacggaacaccaataagagaag

SEQ ID NO: 46718 - DNA, 25 bp, Mus musculus
gtccacggcatcctggaagggatcc

SEQ ID NO: 46719 - DNA, 25 bp, Mus musculus
gtccagaaattacaacagaagatat

SEQ ID NO: 46720 - DNA, 25 bp, Mus musculus
gtccagaactggattgagttactta

SEQ ID NO: 46721 - DNA, 25 bp, Mus musculus
gtccagcaagactagaagagcagga

SEQ ID NO: 46722 - DNA, 25 bp, Mus musculus
gtccagcaaggaggtagaatctttt

SEQ ID NO: 46723 - DNA, 25 bp, Mus musculus
gtccagcatcagtgtggaggacctc

SEQ ID NO: 46724 - DNA, 25 bp, Mus musculus
gtccagcatgtctacatttcttgaa

SEQ ID NO: 46725 - DNA, 25 bp, Mus musculus
gtccagccttccttttggaggagtg

SEQ ID NO: 46726 - DNA, 25 bp, Mus musculus
gtccagctagctgggacaagtttac

SEQ ID NO: 46727 - DNA, 25 bp, Mus musculus
gtccagcttcatcaagcatgtcagg

SEQ ID NO: 46728 - DNA, 25 bp, Mus musculus
gtccaggacacagaccgccaagtgt

SEQ ID NO: 46729 - DNA, 25 bp, Mus musculus
gtccagggcagcctctctggtgcat

SEQ ID NO: 46730 - DNA, 25 bp, Mus musculus
gtccagggtcaacaagcagctgcat

SEQ ID NO: 46731 - DNA, 25 bp, Mus musculus
gtccaggtccagaaagaacctaaag

SEQ ID NO: 46732 - DNA, 25 bp, Mus musculus
gtccaggtgtctgtgcctatcatca

SEQ ID NO: 46733 - DNA, 25 bp, Mus musculus
gtccagtaaatctccaaaacgaaag

SEQ ID NO: 46734 - DNA, 25 bp, Mus musculus
gtccagtcttcgacatctactaaaa

SEQ ID NO: 46735 - DNA, 25 bp, Mus musculus
gtccagtgttacaatggctatagtc

SEQ ID NO: 46736 - DNA, 25 bp, Mus musculus
gtccagtttcccttgtgggaatcct

SEQ ID NO: 46737 - DNA, 25 bp, Mus musculus
gtccatgctggatgagagcagcctc

SEQ ID NO: 46738 - DNA, 25 bp, Mus musculus
gtccatggagctacaggtacaggca

SEQ ID NO: 46739 - DNA, 25 bp, Mus musculus
gtccatggtgagacgctgtggctct

SEQ ID NO: 46740 - DNA, 25 bp, Mus musculus
gtccattcacacagcctggctgatc

SEQ ID NO: 46741 - DNA, 25 bp, Mus musculus
gtcccaaattggttagtgaagtcct

SEQ ID NO: 46742 - DNA, 25 bp, Mus musculus
gtcccaagtccaagatccctgcaag

SEQ ID NO: 46743 - DNA, 25 bp, Mus musculus
gtcccacagtggagaacaagacggg

SEQ ID NO: 46744 - DNA, 25 bp, Mus musculus
gtcccacctgcatagtttgcttaag

SEQ ID NO: 46745 - DNA, 25 bp, Mus musculus
gtcccagagaaagtttcttccaact

SEQ ID NO: 46746 - DNA, 25 bp, Mus musculus
gtcccaggtcgctggcaggctcagc

SEQ ID NO: 46747 - DNA, 25 bp, Mus musculus
gtcccaggtgaactgacccagatgc

SEQ ID NO: 46748 - DNA, 25 bp, Mus musculus
gtcccaggtgaagtgacccagatgc

SEQ ID NO: 46749 - DNA, 25 bp, Mus musculus
gtcccagtgcctgtgtattctggcc

SEQ ID NO: 46750 - DNA, 25 bp, Mus musculus
gtcccatcataaggatccctaacag

SEQ ID NO: 46751 - DNA, 25 bp, Mus musculus
gtcccatggtagagggctggttcca

SEQ ID NO: 46752 - DNA, 25 bp, Mus musculus
gtcccattgaccctgcagcctgggt

SEQ ID NO: 46753 - DNA, 25 bp, Mus musculus
gtccccaagacttcctgcagaagaa

SEQ ID NO: 46754 - DNA, 25 bp, Mus musculus
gtccccaggtgcatccaatttttca

SEQ ID NO: 46755 - DNA, 25 bp, Mus musculus
gtccccagtgtatgaaatcccttgg

SEQ ID NO: 46756 - DNA, 25 bp, Mus musculus
gtccccatcctactgtggcactaag

SEQ ID NO: 46757 - DNA, 25 bp, Mus musculus
gtccccattctgtactaacagacga

SEQ ID NO: 46758 - DNA, 25 bp, Mus musculus
gtccccgagaatggcaagggtccct

SEQ ID NO: 46759 - DNA, 25 bp, Mus musculus
gtccccgagccacggcatacaggtg

SEQ ID NO: 46760 - DNA, 25 bp, Mus musculus
gtccccgagtctactcagtgtccat

SEQ ID NO: 46761 - DNA, 25 bp, Mus musculus
gtccccgctccctggagaatgtgct

SEQ ID NO: 46762 - DNA, 25 bp, Mus musculus
gtccccgctgtccatgaagcagctg

SEQ ID NO: 46763 - DNA, 25 bp, Mus musculus
gtccccgctgtcgatgaagcagctg

SEQ ID NO: 46764 - DNA, 25 bp, Mus musculus
gtccccttggatcttcacacagctg

SEQ ID NO: 46765 - DNA, 25 bp, Mus musculus
gtcccgatcacatagcaagaatccc

SEQ ID NO: 46766 - DNA, 25 bp, Mus musculus
gtcccggcagcgaaggcagaaaaaa

SEQ ID NO: 46767 - DNA, 25 bp, Mus musculus
gtcccgggatgagttcttatggaag

SEQ ID NO: 46768 - DNA, 25 bp, Mus musculus
gtcccgggccacaaatgttcttgca

SEQ ID NO: 46769 - DNA, 25 bp, Mus musculus
gtcccgtcgttatgactggtgaagg

SEQ ID NO: 46770 - DNA, 25 bp, Mus musculus
gtcccgtggccatagcagagctcgg

SEQ ID NO: 46771 - DNA, 25 bp, Mus musculus
gtcccgtgtcggatctgctgcccaa

SEQ ID NO: 46772 - DNA, 25 bp, Mus musculus
gtccctaagtagaagatctggcagg

SEQ ID NO: 46773 - DNA, 25 bp, Mus musculus
gtccctcgttagtgtggctgtcaca

SEQ ID NO: 46774 - DNA, 25 bp, Mus musculus
gtccctctccatgaaagttgtcaac

SEQ ID NO: 46775 - DNA, 25 bp, Mus musculus
gtccctctgccggaacatggagtat

SEQ ID NO: 46776 - DNA, 25 bp, Mus musculus
gtccctgccttacagctccagtatg

SEQ ID NO: 46777 - DNA, 25 bp, Mus musculus
gtccctgctgcccagacaagtgctg

SEQ ID NO: 46778 - DNA, 25 bp, Mus musculus
gtccctggaagctcctgcagcagct

SEQ ID NO: 46779 - DNA, 25 bp, Mus musculus
gtccctggagacctccttgcatgag

SEQ ID NO: 46780 - DNA, 25 bp, Mus musculus
gtcccttccatagtgatgcttcctg

SEQ ID NO: 46781 - DNA, 25 bp, Mus musculus
gtcccttttgctcgatatctggcca

SEQ ID NO: 46782 - DNA, 25 bp, Mus musculus
gtccgagaccgcatgtggctcaaga

SEQ ID NO: 46783 - DNA, 25 bp, Mus musculus
gtccgagtcacatcatccctgtgcg

SEQ ID NO: 46784 - DNA, 25 bp, Mus musculus
gtccgcctcactaactgttgtgaaa

SEQ ID NO: 46785 - DNA, 25 bp, Mus musculus
gtccgcctggccaatatcctgaagg

SEQ ID NO: 46786 - DNA, 25 bp, Mus musculus
gtccgcctggcctatatcctgaagg

SEQ ID NO: 46787 - DNA, 25 bp, Mus musculus
gtccgcttccgccactggttcgtgg

SEQ ID NO: 46788 - DNA, 25 bp, Mus musculus
gtccgggtctcaccacaagatgcca

SEQ ID NO: 46789 - DNA, 25 bp, Mus musculus
gtccggtgctgcagagcatcaccaa

SEQ ID NO: 46790 - DNA, 25 bp, Mus musculus
gtccggtgctggaatgggaccctcc

SEQ ID NO: 46791 - DNA, 25 bp, Mus musculus
gtccgtatcacataggattaccgaa

SEQ ID NO: 46792 - DNA, 25 bp, Mus musculus
gtcctaaacctggaagggacattag

SEQ ID NO: 46793 - DNA, 25 bp, Mus musculus
gtcctaaatttctaccaatacaacg

SEQ ID NO: 46794 - DNA, 25 bp, Mus musculus
gtcctacaggaacaccagggaagcc

SEQ ID NO: 46795 - DNA, 25 bp, Mus musculus
gtcctacagtctgcttgcaatactt

SEQ ID NO: 46796 - DNA, 25 bp, Mus musculus
gtcctacattgtccttctgatccag

SEQ ID NO: 46797 - DNA, 25 bp, Mus musculus
gtcctaccaagccacttttcacagg

SEQ ID NO: 46798 - DNA, 25 bp, Mus musculus
gtcctaccacagtgaaactcaaagt

SEQ ID NO: 46799 - DNA, 25 bp, Mus musculus
gtcctacggctctgttggctcacga

SEQ ID NO: 46800 - DNA, 25 bp, Mus musculus
gtcctagaagtttctgaggcccttc

SEQ ID NO: 46801 - DNA, 25 bp, Mus musculus
gtcctagctgaagttgatcatgagt

SEQ ID NO: 46802 - DNA, 25 bp, Mus musculus
gtcctatgtgtacgctgaagagccc

SEQ ID NO: 46803 - DNA, 25 bp, Mus musculus
gtcctcagaaaagccaagggactca

SEQ ID NO: 46804 - DNA, 25 bp, Mus musculus
gtcctcatcgcactgcaggaagcca

SEQ ID NO: 46805 - DNA, 25 bp, Mus musculus
gtcctccaggaaaccagaagccctg

SEQ ID NO: 46806 - DNA, 25 bp, Mus musculus
gtcctcccacgtcggaagggccttg

SEQ ID NO: 46807 - DNA, 25 bp, Mus musculus
gtcctccgttgactcctttacgcag

SEQ ID NO: 46808 - DNA, 25 bp, Mus musculus
gtcctcgatatgtcagacgatgaag

SEQ ID NO: 46809 - DNA, 25 bp, Mus musculus
gtcctcgcccttatctgatggtaga

SEQ ID NO: 46810 - DNA, 25 bp, Mus musculus
gtcctctgagcgacaagtgcagccg

SEQ ID NO: 46811 - DNA, 25 bp, Mus musculus
gtcctgaacaaaagttccaactggg

SEQ ID NO: 46812 - DNA, 25 bp, Mus musculus
gtcctgaactccctggataagatca

SEQ ID NO: 46813 - DNA, 25 bp, Mus musculus
gtcctgactggaatctgctgtgtgg

SEQ ID NO: 46814 - DNA, 25 bp, Mus musculus
gtcctgaggacataggccctcccat

SEQ ID NO: 46815 - DNA, 25 bp, Mus musculus
gtcctgagtcccctaggtaccagaa

SEQ ID NO: 46816 - DNA, 25 bp, Mus musculus
gtcctgatgaagttgtagggccaga

SEQ ID NO: 46817 - DNA, 25 bp, Mus musculus
gtcctgcagctgctttccttcctgt

SEQ ID NO: 46818 - DNA, 25 bp, Mus musculus
gtcctgccaacatcgagtctataaa

SEQ ID NO: 46819 - DNA, 25 bp, Mus musculus
gtcctgccccataaacattgaggaa

SEQ ID NO: 46820 - DNA, 25 bp, Mus musculus
gtcctgcctatcagctgagttccag

SEQ ID NO: 46821 - DNA, 25 bp, Mus musculus
gtcctgcctatctgctgagttccag

SEQ ID NO: 46822 - DNA, 25 bp, Mus musculus
gtcctgctcacagtttgtaccagca

SEQ ID NO: 46823 - DNA, 25 bp, Mus musculus
gtcctgctgtgtgggagctggccga

SEQ ID NO: 46824 - DNA, 25 bp, Mus musculus
gtcctggacttgtgtgctgctcctg

SEQ ID NO: 46825 - DNA, 25 bp, Mus musculus
gtcctggagcagctcaatgtcatca

SEQ ID NO: 46826 - DNA, 25 bp, Mus musculus
gtcctggagtgtcctttttggtgca

SEQ ID NO: 46827 - DNA, 25 bp, Mus musculus
gtcctggatgacctccgccaacatt

SEQ ID NO: 46828 - DNA, 25 bp, Mus musculus
gtcctggcaacgtggcagccttaca

SEQ ID NO: 46829 - DNA, 25 bp, Mus musculus
gtcctggcagggtcagctgcaagaa

SEQ ID NO: 46830 - DNA, 25 bp, Mus musculus
gtcctggccagatcctacagcggag

SEQ ID NO: 46831 - DNA, 25 bp, Mus musculus
gtcctggccataaagggccgcgcca

SEQ ID NO: 46832 - DNA, 25 bp, Mus musculus
gtcctggtactcattatgtagctcc

SEQ ID NO: 46833 - DNA, 25 bp, Mus musculus
gtcctgtaaacaagattcaaaacag

SEQ ID NO: 46834 - DNA, 25 bp, Mus musculus
gtcctgtatttgtccctaaaggaat

SEQ ID NO: 46835 - DNA, 25 bp, Mus musculus
gtcctgtcagcaacagtgcttcaca

SEQ ID NO: 46836 - DNA, 25 bp, Mus musculus
gtcctgtcatcctcacgtatcacga

SEQ ID NO: 46837 - DNA, 25 bp, Mus musculus
gtcctgtcgagtggataagccttct

SEQ ID NO: 46838 - DNA, 25 bp, Mus musculus
gtcctgtctcggtggcgagtatttg

SEQ ID NO: 46839 - DNA, 25 bp, Mus musculus
gtcctgtgaccttgctcggcgctat

SEQ ID NO: 46840 - DNA, 25 bp, Mus musculus
gtcctgttacagaagtgaaaactga

SEQ ID NO: 46841 - DNA, 25 bp, Mus musculus
gtccttcaaacatgacaaaccagaa

SEQ ID NO: 46842 - DNA, 25 bp, Mus musculus
gtccttcactgggagcactcaggtg

SEQ ID NO: 46843 - DNA, 25 bp, Mus musculus
gtccttcagaggactcaggctgcct

SEQ ID NO: 46844 - DNA, 25 bp, Mus musculus
gtccttcctaactgatagcagctct

SEQ ID NO: 46845 - DNA, 25 bp, Mus musculus
gtccttcgaagacgaccaggagccc

SEQ ID NO: 46846 - DNA, 25 bp, Mus musculus
gtccttctgactttatcaagccggg

SEQ ID NO: 46847 - DNA, 25 bp, Mus musculus
gtccttcttaaaggatgtctgtgag

SEQ ID NO: 46848 - DNA, 25 bp, Mus musculus
gtccttctttgcacaaacatctcgg

SEQ ID NO: 46849 - DNA, 25 bp, Mus musculus
gtccttgccctggagctcctggaaa

SEQ ID NO: 46850 - DNA, 25 bp, Mus musculus
gtccttggctcccttctcaggatga

SEQ ID NO: 46851 - DNA, 25 bp, Mus musculus
gtcctttctacaatatcagaatctg

SEQ ID NO: 46852 - DNA, 25 bp, Mus musculus
gtccttttaggatgcggccttggca

SEQ ID NO: 46853 - DNA, 25 bp, Mus musculus
gtccttttctgtgttacagtgccct

SEQ ID NO: 46854 - DNA, 25 bp, Mus musculus
gtcgaaagtcatagccggtgcaagc

SEQ ID NO: 46855 - DNA, 25 bp, Mus musculus
gtcgaagcttgagaagtctcccaag

SEQ ID NO: 46856 - DNA, 25 bp, Mus musculus
gtcgaatccgggacaccgtcctgct

SEQ ID NO: 46857 - DNA, 25 bp, Mus musculus
gtcgaccagggcctagccttttgct

SEQ ID NO: 46858 - DNA, 25 bp, Mus musculus
gtcgactcaggctgagaattactta

SEQ ID NO: 46859 - DNA, 25 bp, Mus musculus
gtcgagaaagctcggacgaccacgc

SEQ ID NO: 46860 - DNA, 25 bp, Mus musculus
gtcgagatttcaggttgcaacatta

SEQ ID NO: 46861 - DNA, 25 bp, Mus musculus
gtcgagcatcaacaaaaccgtcctt

SEQ ID NO: 46862 - DNA, 25 bp, Mus musculus
gtcgagcatcaagaaaaccgtcctt

SEQ ID NO: 46863 - DNA, 25 bp, Mus musculus
gtcgagctagaggagccccttccaa

SEQ ID NO: 46864 - DNA, 25 bp, Mus musculus
gtcgatactgacaccatctggaacg

SEQ ID NO: 46865 - DNA, 25 bp, Mus musculus
gtcgatgccagcttcttcttgaaat

SEQ ID NO: 46866 - DNA, 25 bp, Mus musculus
gtcgcagactcccttcgaggcgctt

SEQ ID NO: 46867 - DNA, 25 bp, Mus musculus
gtcgcagcgctctggcacctggcgt

SEQ ID NO: 46868 - DNA, 25 bp, Mus musculus
gtcgccaatggaatgtacccctgcc

SEQ ID NO: 46869 - DNA, 25 bp, Mus musculus
gtcgccaccacccatagaatcaaag

SEQ ID NO: 46870 - DNA, 25 bp, Mus musculus
gtcgccatcatcatcttgtcaggaa

SEQ ID NO: 46871 - DNA, 25 bp, Mus musculus
gtcgccatttaaacgagtattccta

SEQ ID NO: 46872 - DNA, 25 bp, Mus musculus
gtcgcccgggacttcctgtaccagg

SEQ ID NO: 46873 - DNA, 25 bp, Mus musculus
gtcgcctgatcctgttcaagttgaa

SEQ ID NO: 46874 - DNA, 25 bp, Mus musculus
gtcgccttgctcacacgggactgac

SEQ ID NO: 46875 - DNA, 25 bp, Mus musculus
gtcgcggctattgcctagacggctg

SEQ ID NO: 46876 - DNA, 25 bp, Mus musculus
gtcgctaaccatggcgtctggagat

SEQ ID NO: 46877 - DNA, 25 bp, Mus musculus
gtcgctatgcatttcagatctggaa

SEQ ID NO: 46878 - DNA, 25 bp, Mus musculus
gtcgctgtcttaaataatcacgaac

SEQ ID NO: 46879 - DNA, 25 bp, Mus musculus
gtcgctgtggttcccctccgatctg

SEQ ID NO: 46880 - DNA, 25 bp, Mus musculus
gtcgcttaccgccagatgtctctgt

SEQ ID NO: 46881 - DNA, 25 bp, Mus musculus
gtcgcttctgcggtaccatgcaggt

SEQ ID NO: 46882 - DNA, 25 bp, Mus musculus
gtcggaagggccttgcactggaccc

SEQ ID NO: 46883 - DNA, 25 bp, Mus musculus
gtcggacatcaaataagaatccaat

SEQ ID NO: 46884 - DNA, 25 bp, Mus musculus
gtcggagtgacctctcagaaaacta

SEQ ID NO: 46885 - DNA, 25 bp, Mus musculus
gtcggataacagattccaatataag

SEQ ID NO: 46886 - DNA, 25 bp, Mus musculus
gtcggatgctctgggccacattctg

SEQ ID NO: 46887 - DNA, 25 bp, Mus musculus
gtcggcatccaccataagcatttgt

SEQ ID NO: 46888 - DNA, 25 bp, Mus musculus
gtcggcctggtagccaagggtcttc

SEQ ID NO: 46889 - DNA, 25 bp, Mus musculus
gtcgggatataagcccagaagagat

SEQ ID NO: 46890 - DNA, 25 bp, Mus musculus
gtcgggtcagagcaaccaactgcga

SEQ ID NO: 46891 - DNA, 25 bp, Mus musculus
gtcgggtgggcgagatcccaccacc

SEQ ID NO: 46892 - DNA, 25 bp, Mus musculus
gtcggtgatcgagaagcagtgctct

SEQ ID NO: 46893 - DNA, 25 bp, Mus musculus
gtcggtgtcagaagcaaggcagcct

SEQ ID NO: 46894 - DNA, 25 bp, Mus musculus
gtcggtgtttagctatcaagtggca

SEQ ID NO: 46895 - DNA, 25 bp, Mus musculus
gtcgtccgtactgccctttcataaa

SEQ ID NO: 46896 - DNA, 25 bp, Mus musculus
gtcgtcctgtcgagtggataagcct

SEQ ID NO: 46897 - DNA, 25 bp, Mus musculus
gtcgtcgtacagaatgccacggtcc

SEQ ID NO: 46898 - DNA, 25 bp, Mus musculus
gtcgtctttgatactggctcctcta

SEQ ID NO: 46899 - DNA, 25 bp, Mus musculus
gtcgtgcagactttccgagacctgg

SEQ ID NO: 46900 - DNA, 25 bp, Mus musculus
gtcgtgttcagtgtcacaaccgttg

SEQ ID NO: 46901 - DNA, 25 bp, Mus musculus
gtcgttataggcatttccgtgggac

SEQ ID NO: 46902 - DNA, 25 bp, Mus musculus
gtcgttctcgtaccactggcatctg

SEQ ID NO: 46903 - DNA, 25 bp, Mus musculus
gtcgtttatatgctatgcaaactgg

SEQ ID NO: 46904 - DNA, 25 bp, Mus musculus
gtctaaagctaagccaaacggcaag

SEQ ID NO: 46905 - DNA, 25 bp, Mus musculus
gtctaactgagcgtgctctgcaagg

SEQ ID NO: 46906 - DNA, 25 bp, Mus musculus
gtctaagccgactcgcttatgctgg

SEQ ID NO: 46907 - DNA, 25 bp, Mus musculus
gtctaagcttgatccaaaggcaatg

SEQ ID NO: 46908 - DNA, 25 bp, Mus musculus
gtctaaggtacaaattgcaatcctg

SEQ ID NO: 46909 - DNA, 25 bp, Mus musculus
gtctacacccggctcaagtcacggg

SEQ ID NO: 46910 - DNA, 25 bp, Mus musculus
gtctacacggatggctgttgctcca

SEQ ID NO: 46911 - DNA, 25 bp, Mus musculus
gtctacagctacctgaataagcttc

SEQ ID NO: 46912 - DNA, 25 bp, Mus musculus
gtctacaggaatgcctgggagcaga

SEQ ID NO: 46913 - DNA, 25 bp, Mus musculus
gtctaccgcatcctccgggaggccg

SEQ ID NO: 46914 - DNA, 25 bp, Mus musculus
gtctacgtgggaacggaagcatttg

SEQ ID NO: 46915 - DNA, 25 bp, Mus musculus
gtctactacccagagctgggtgcag

SEQ ID NO: 46916 - DNA, 25 bp, Mus musculus
gtctactgtatactctcacctattg

SEQ ID NO: 46917 - DNA, 25 bp, Mus musculus
gtctactgtatagtctcacctattg

SEQ ID NO: 46918 - DNA, 25 bp, Mus musculus
gtctacttcaacacctgcagcaggg

SEQ ID NO: 46919 - DNA, 25 bp, Mus musculus
gtctacttggtcgtggtggattata

SEQ ID NO: 46920 - DNA, 25 bp, Mus musculus
gtctaggagactgtgaagtccaggc

SEQ ID NO: 46921 - DNA, 25 bp, Mus musculus
gtctagggcacgttacaccagtgag

SEQ ID NO: 46922 - DNA, 25 bp, Mus musculus
gtctagtcatatacaggtcttagca

SEQ ID NO: 46923 - DNA, 25 bp, Mus musculus
gtctagtgatagaattaaaaaacca

SEQ ID NO: 46924 - DNA, 25 bp, Mus musculus
gtctatatagatgcctagatcatga

SEQ ID NO: 46925 - DNA, 25 bp, Mus musculus
gtctatggaaatgcaagacctagca

SEQ ID NO: 46926 - DNA, 25 bp, Mus musculus
gtctatgtatggagccgtcgcagcc

SEQ ID NO: 46927 - DNA, 25 bp, Mus musculus
gtctattagctcctgtcgcccacgt

SEQ ID NO: 46928 - DNA, 25 bp, Mus musculus
gtctcaatccatagaagtcttggac

SEQ ID NO: 46929 - DNA, 25 bp, Mus musculus
gtctcacataacatgacagctccaa

SEQ ID NO: 46930 - DNA, 25 bp, Mus musculus
gtctcactgcatggagccagaggtg

SEQ ID NO: 46931 - DNA, 25 bp, Mus musculus
gtctcacttctgaatgccaccttct

SEQ ID NO: 46932 - DNA, 25 bp, Mus musculus
gtctcagcaatctgttccggaggaa

SEQ ID NO: 46933 - DNA, 25 bp, Mus musculus
gtctcagcatagagaacactctgtg

SEQ ID NO: 46934 - DNA, 25 bp, Mus musculus
gtctcagcatcagaggagcccagga

SEQ ID NO: 46935 - DNA, 25 bp, Mus musculus
gtctcaggagactacagtatctcat

SEQ ID NO: 46936 - DNA, 25 bp, Mus musculus
gtctcatgttccatcatatcagcca

SEQ ID NO: 46937 - DNA, 25 bp, Mus musculus
gtctcattatgcaggctaggctgac

SEQ ID NO: 46938 - DNA, 25 bp, Mus musculus
gtctccaacgacagtggcatctacg

SEQ ID NO: 46939 - DNA, 25 bp, Mus musculus
gtctccacaaatgaagccagtccag

SEQ ID NO: 46940 - DNA, 25 bp, Mus musculus
gtctccacaccgaagagccaagtca

SEQ ID NO: 46941 - DNA, 25 bp, Mus musculus
gtctccagctgatgatttgtccctg

SEQ ID NO: 46942 - DNA, 25 bp, Mus musculus
gtctccatctaatctcaaagcgagg

SEQ ID NO: 46943 - DNA, 25 bp, Mus musculus
gtctccattttgacagtgccagcag

SEQ ID NO: 46944 - DNA, 25 bp, Mus musculus
gtctccctgcggactcaacctgaga

SEQ ID NO: 46945 - DNA, 25 bp, Mus musculus
gtctccctgtcctgcaagtcaatca

SEQ ID NO: 46946 - DNA, 25 bp, Mus musculus
gtctccgtcattagaaacaacagga

SEQ ID NO: 46947 - DNA, 25 bp, Mus musculus
gtctcctcacactggcttggttcct

SEQ ID NO: 46948 - DNA, 25 bp, Mus musculus
gtctcctcccgaccagagaagcttg

SEQ ID NO: 46949 - DNA, 25 bp, Mus musculus
gtctcctcgaagatagactctcatg

SEQ ID NO: 46950 - DNA, 25 bp, Mus musculus
gtctcctgacttatggccgccgcat

SEQ ID NO: 46951 - DNA, 25 bp, Mus musculus
gtctcctggtcacggcgcctggaat

SEQ ID NO: 46952 - DNA, 25 bp, Mus musculus
gtctcctgtacaagcagtttctctg

SEQ ID NO: 46953 - DNA, 25 bp, Mus musculus
gtctcgagtcatggctgagcccatc

SEQ ID NO: 46954 - DNA, 25 bp, Mus musculus
gtctcggacactgggcctagattct

SEQ ID NO: 46955 - DNA, 25 bp, Mus musculus
gtctcggatagtggctttcggacag

SEQ ID NO: 46956 - DNA, 25 bp, Mus musculus
gtctcgtaatctacttaaggaccag

SEQ ID NO: 46957 - DNA, 25 bp, Mus musculus
gtctcgtcatttaagaacacgcaag

SEQ ID NO: 46958 - DNA, 25 bp, Mus musculus
gtctcgttagcagccagtggagcgt

SEQ ID NO: 46959 - DNA, 25 bp, Mus musculus
gtctctaactggtttggcaacaaaa

SEQ ID NO: 46960 - DNA, 25 bp, Mus musculus
gtctctacgccaagtattttcaagg

SEQ ID NO: 46961 - DNA, 25 bp, Mus musculus
gtctctacgccatgtattttcaagg

SEQ ID NO: 46962 - DNA, 25 bp, Mus musculus
gtctctacgtgtccaaaggcttcaa

SEQ ID NO: 46963 - DNA, 25 bp, Mus musculus
gtctctacgtgtgcaaaggcttcaa

SEQ ID NO: 46964 - DNA, 25 bp, Mus musculus
gtctctagcatcaactcacggtttg

SEQ ID NO: 46965 - DNA, 25 bp, Mus musculus
gtctctcatgaccactacagatgaa

SEQ ID NO: 46966 - DNA, 25 bp, Mus musculus
gtctctccacccagaatggcaacgg

SEQ ID NO: 46967 - DNA, 25 bp, Mus musculus
gtctctccagtgttcccgcttcagg

SEQ ID NO: 46968 - DNA, 25 bp, Mus musculus
gtctctctaaggaagcagagcggaa

SEQ ID NO: 46969 - DNA, 25 bp, Mus musculus
gtctctctactatgactacgaaccc

SEQ ID NO: 46970 - DNA, 25 bp, Mus musculus
gtctctcttcagtacctcagggatg

SEQ ID NO: 46971 - DNA, 25 bp, Mus musculus
gtctctggctcaccacagcttgggt

SEQ ID NO: 46972 - DNA, 25 bp, Mus musculus
gtctctggggcctttcatatccacg

SEQ ID NO: 46973 - DNA, 25 bp, Mus musculus
gtctctgtcacgtgccccggacgtt

SEQ ID NO: 46974 - DNA, 25 bp, Mus musculus
gtctgaagagtctcctgtgtgtgtc

SEQ ID NO: 46975 - DNA, 25 bp, Mus musculus
gtctgaagtcttgcctgtccgaggg

SEQ ID NO: 46976 - DNA, 25 bp, Mus musculus
gtctgacaagacacaggtcctaaat

SEQ ID NO: 46977 - DNA, 25 bp, Mus musculus
gtctgaccttaagcccagcatcgaa

SEQ ID NO: 46978 - DNA, 25 bp, Mus musculus
gtctgacgctgatcactctggctct

SEQ ID NO: 46979 - DNA, 25 bp, Mus musculus
gtctgactctgctggaaaaccctcc

SEQ ID NO: 46980 - DNA, 25 bp, Mus musculus
gtctgaggcgattcctggcctgccc

SEQ ID NO: 46981 - DNA, 25 bp, Mus musculus
gtctgagttcttccatgcagagctg

SEQ ID NO: 46982 - DNA, 25 bp, Mus musculus
gtctgatattgaaagttaccacttc

SEQ ID NO: 46983 - DNA, 25 bp, Mus musculus
gtctgattcagaaggacgtgccaag

SEQ ID NO: 46984 - DNA, 25 bp, Mus musculus
gtctgcacagcacccacacataagt

SEQ ID NO: 46985 - DNA, 25 bp, Mus musculus
gtctgcagcgacagcaacaactggg

SEQ ID NO: 46986 - DNA, 25 bp, Mus musculus
gtctgccactgcaatgccggctact

SEQ ID NO: 46987 - DNA, 25 bp, Mus musculus
gtctgccatagcctgtgcttttcat

SEQ ID NO: 46988 - DNA, 25 bp, Mus musculus
gtctgcccactgaatagtaatcaca

SEQ ID NO: 46989 - DNA, 25 bp, Mus musculus
gtctgccctggaactgataatgagc

SEQ ID NO: 46990 - DNA, 25 bp, Mus musculus
gtctgcccttcgaccccaagaaagt

SEQ ID NO: 46991 - DNA, 25 bp, Mus musculus
gtctgccggctggagagcacaactt

SEQ ID NO: 46992 - DNA, 25 bp, Mus musculus
gtctgcctactgaaccactacaaag

SEQ ID NO: 46993 - DNA, 25 bp, Mus musculus
gtctgcctgtgtgcctccaggataa

SEQ ID NO: 46994 - DNA, 25 bp, Mus musculus
gtctgccttgaccatgatctctgcc

SEQ ID NO: 46995 - DNA, 25 bp, Mus musculus
gtctgcgaccgccagttcgactgcg

SEQ ID NO: 46996 - DNA, 25 bp, Mus musculus
gtctgctaaataaacaggaaactct

SEQ ID NO: 46997 - DNA, 25 bp, Mus musculus
gtctgctccgagacagctacgggcg

SEQ ID NO: 46998 - DNA, 25 bp, Mus musculus
gtctgctctccctgaacctgtctgt

SEQ ID NO: 46999 - DNA, 25 bp, Mus musculus
gtctgctggtaggacatcatgttca

SEQ ID NO: 47000 - DNA, 25 bp, Mus musculus
gtctgcttcagactttgaacagcaa

SEQ ID NO: 47001 - DNA, 25 bp, Mus musculus
gtctggagacccttcgcctgaagct

SEQ ID NO: 47002 - DNA, 25 bp, Mus musculus
gtctggagcgaaaccaagcgtcttc

SEQ ID NO: 47003 - DNA, 25 bp, Mus musculus
gtctggcaggatcaaagcctttctc

SEQ ID NO: 47004 - DNA, 25 bp, Mus musculus
gtctggcgttcttctgctctgcaaa

SEQ ID NO: 47005 - DNA, 25 bp, Mus musculus
gtctggctccagtgccggcagccat

SEQ ID NO: 47006 - DNA, 25 bp, Mus musculus
gtctgggcgcacagcgctgcacctg

SEQ ID NO: 47007 - DNA, 25 bp, Mus musculus
gtctgggcgtcatcatcattggcct

SEQ ID NO: 47008 - DNA, 25 bp, Mus musculus
gtctggtcagcccagccgaaaggcc

SEQ ID NO: 47009 - DNA, 25 bp, Mus musculus
gtctggtcagccgagccgaaaggcc

SEQ ID NO: 47010 - DNA, 25 bp, Mus musculus
gtctgtaaacgttctgtccctccta

SEQ ID NO: 47011 - DNA, 25 bp, Mus musculus
gtctgtatactctgtgtgagcctgg

SEQ ID NO: 47012 - DNA, 25 bp, Mus musculus
gtctgtcaggactggctgatgattc

SEQ ID NO: 47013 - DNA, 25 bp, Mus musculus
gtctgtccgcagctcgcagtggtcc

SEQ ID NO: 47014 - DNA, 25 bp, Mus musculus
gtctgtcctgcacgaagtcacttaa

SEQ ID NO: 47015 - DNA, 25 bp, Mus musculus
gtctgtgaagcctcagtgctcccag

SEQ ID NO: 47016 - DNA, 25 bp, Mus musculus
gtctgtgacgagaagctactacaga

SEQ ID NO: 47017 - DNA, 25 bp, Mus musculus
gtctgtgacgagtagctactacaga

SEQ ID NO: 47018 - DNA, 25 bp, Mus musculus
gtctgtgcacaaagagaacttcctg

SEQ ID NO: 47019 - DNA, 25 bp, Mus musculus
gtctgtgcacacacgggtatcatct

SEQ ID NO: 47020 - DNA, 25 bp, Mus musculus
gtctgtgcacttgtttttgtgtcac

SEQ ID NO: 47021 - DNA, 25 bp, Mus musculus
gtctgtggcattcctgcttcgtgaa

SEQ ID NO: 47022 - DNA, 25 bp, Mus musculus
gtctgtggcattgctgcttcgtgaa

SEQ ID NO: 47023 - DNA, 25 bp, Mus musculus
gtctgtgttcctggctcccagtgtg

SEQ ID NO: 47024 - DNA, 25 bp, Mus musculus
gtctgttccagacggatcaaagcct

SEQ ID NO: 47025 - DNA, 25 bp, Mus musculus
gtctgttccagagggatcaaagcct

SEQ ID NO: 47026 - DNA, 25 bp, Mus musculus
gtctgttgatggacttctcagttgg

SEQ ID NO: 47027 - DNA, 25 bp, Mus musculus
gtctgttgctgcctctgcgtacaag

SEQ ID NO: 47028 - DNA, 25 bp, Mus musculus
gtctgttgggtcctcagggacacca

SEQ ID NO: 47029 - DNA, 25 bp, Mus musculus
gtctgttttattactcctggtgcga

SEQ ID NO: 47030 - DNA, 25 bp, Mus musculus
gtctgttttatttctcctggtgcga

SEQ ID NO: 47031 - DNA, 25 bp, Mus musculus
gtctgtttttccacttgtccgtctg

SEQ ID NO: 47032 - DNA, 25 bp, Mus musculus
gtcttaaaaaatgctggaggctggg

SEQ ID NO: 47033 - DNA, 25 bp, Mus musculus
gtcttaaataatcacgaacagctag

SEQ ID NO: 47034 - DNA, 25 bp, Mus musculus
gtcttagaactcacacagaaatcag

SEQ ID NO: 47035 - DNA, 25 bp, Mus musculus
gtcttatctcctctgggcaaggacc

SEQ ID NO: 47036 - DNA, 25 bp, Mus musculus
gtcttattttccagaatgttttgag

SEQ ID NO: 47037 - DNA, 25 bp, Mus musculus
gtcttcacacaacgaactagaaaag

SEQ ID NO: 47038 - DNA, 25 bp, Mus musculus
gtcttcagaaagatccttccaaaag

SEQ ID NO: 47039 - DNA, 25 bp, Mus musculus
gtcttcagaagagcgaagttctgcg

SEQ ID NO: 47040 - DNA, 25 bp, Mus musculus
gtcttcagaggtgaccggcagcctt

SEQ ID NO: 47041 - DNA, 25 bp, Mus musculus
gtcttcagcaatatcctccagcact

SEQ ID NO: 47042 - DNA, 25 bp, Mus musculus
gtcttcagcctattatcaaaacgga

SEQ ID NO: 47043 - DNA, 25 bp, Mus musculus
gtcttcagcttcctatttacctgga

SEQ ID NO: 47044 - DNA, 25 bp, Mus musculus
gtcttcagggtctcaagatctacag

SEQ ID NO: 47045 - DNA, 25 bp, Mus musculus
gtcttccaacacagtcttgaaaagg

SEQ ID NO: 47046 - DNA, 25 bp, Mus musculus
gtcttccactcttggagctcacaca

SEQ ID NO: 47047 - DNA, 25 bp, Mus musculus
gtcttccctcttttcgcccaagaag

SEQ ID NO: 47048 - DNA, 25 bp, Mus musculus
gtcttcgcatactgcctctgctggg

SEQ ID NO: 47049 - DNA, 25 bp, Mus musculus
gtcttcgccattcagtacagtgcct

SEQ ID NO: 47050 - DNA, 25 bp, Mus musculus
gtcttcggcaaagcggaagtttgca

SEQ ID NO: 47051 - DNA, 25 bp, Mus musculus
gtcttctttagctgccgctccatca

SEQ ID NO: 47052 - DNA, 25 bp, Mus musculus
gtcttctttctgatcacaagtcatg

SEQ ID NO: 47053 - DNA, 25 bp, Mus musculus
gtcttgaatttaggacagtcctcct

SEQ ID NO: 47054 - DNA, 25 bp, Mus musculus
gtcttgagaatcttccctggaagct

SEQ ID NO: 47055 - DNA, 25 bp, Mus musculus
gtcttgattccaaatcctgcaccag

SEQ ID NO: 47056 - DNA, 25 bp, Mus musculus
gtcttgcaatggctcttcagtcttt

SEQ ID NO: 47057 - DNA, 25 bp, Mus musculus
gtcttgccgtcactaagccatactt

SEQ ID NO: 47058 - DNA, 25 bp, Mus musculus
gtcttgcctcagcatatgcatctaa

SEQ ID NO: 47059 - DNA, 25 bp, Mus musculus
gtcttggagccactaacttgggcaa

SEQ ID NO: 47060 - DNA, 25 bp, Mus musculus
gtcttgggcatctcacggcctcatt

SEQ ID NO: 47061 - DNA, 25 bp, Mus musculus
gtcttgtgagaaagtatatgaactc

SEQ ID NO: 47062 - DNA, 25 bp, Mus musculus
gtcttgtgatatgcctgtatttgag

SEQ ID NO: 47063 - DNA, 25 bp, Mus musculus
gtctttacaaatccgccacaagttg

SEQ ID NO: 47064 - DNA, 25 bp, Mus musculus
gtctttgacccactgcgcttttctc

SEQ ID NO: 47065 - DNA, 25 bp, Mus musculus
gtctttgacgatggtgagatgaaca

SEQ ID NO: 47066 - DNA, 25 bp, Mus musculus
gtctttgatgactctgaagctattg

SEQ ID NO: 47067 - DNA, 25 bp, Mus musculus
gtctttgggttttctgtccgctcag

SEQ ID NO: 47068 - DNA, 25 bp, Mus musculus
gtctttgtagacatcgattccatca

SEQ ID NO: 47069 - DNA, 25 bp, Mus musculus
gtctttgtagacttcgattccatca

SEQ ID NO: 47070 - DNA, 25 bp, Mus musculus
gtctttgtgccagcatgccttctgc

SEQ ID NO: 47071 - DNA, 25 bp, Mus musculus
gtgaaaacatgattctgatagcggc

SEQ ID NO: 47072 - DNA, 25 bp, Mus musculus
gtgaaaagaactccgcagaaaccaa

SEQ ID NO: 47073 - DNA, 25 bp, Mus musculus
gtgaaaagctacctcctcccggata

SEQ ID NO: 47074 - DNA, 25 bp, Mus musculus
gtgaaaatcatctttgatcttggaa

SEQ ID NO: 47075 - DNA, 25 bp, Mus musculus
gtgaaacagaattcccttaagaaat

SEQ ID NO: 47076 - DNA, 25 bp, Mus musculus
gtgaaaccaacccctgggcccatgt

SEQ ID NO: 47077 - DNA, 25 bp, Mus musculus
gtgaaaccatctccaacttgctcca

SEQ ID NO: 47078 - DNA, 25 bp, Mus musculus
gtgaaacccagctcctccaaatagt

SEQ ID NO: 47079 - DNA, 25 bp, Mus musculus
gtgaaacctcacaatgtcatgatag

SEQ ID NO: 47080 - DNA, 25 bp, Mus musculus
gtgaaacgcttcaacagtgctaatg

SEQ ID NO: 47081 - DNA, 25 bp, Mus musculus
gtgaaactgtctctctgaccttggg

SEQ ID NO: 47082 - DNA, 25 bp, Mus musculus
gtgaaagagcaatccacacacctgg

SEQ ID NO: 47083 - DNA, 25 bp, Mus musculus
gtgaaagcacccagcagagtagcca

SEQ ID NO: 47084 - DNA, 25 bp, Mus musculus
gtgaaatccatgtttcacacgcaga

SEQ ID NO: 47085 - DNA, 25 bp, Mus musculus
gtgaaatcgccctgtggtccctggt

SEQ ID NO: 47086 - DNA, 25 bp, Mus musculus
gtgaaatgaagagaattgcagcaga

SEQ ID NO: 47087 - DNA, 25 bp, Mus musculus
gtgaaattagccttagaacatctta

SEQ ID NO: 47088 - DNA, 25 bp, Mus musculus
gtgaaatttgaagctcagaagaaac

SEQ ID NO: 47089 - DNA, 25 bp, Mus musculus
gtgaacacagaacgctccttccatt

SEQ ID NO: 47090 - DNA, 25 bp, Mus musculus
gtgaacacagaaggctccttccatt

SEQ ID NO: 47091 - DNA, 25 bp, Mus musculus
gtgaacaccgggaaactggagacca

SEQ ID NO: 47092 - DNA, 25 bp, Mus musculus
gtgaacctgacccagacaagctcct

SEQ ID NO: 47093 - DNA, 25 bp, Mus musculus
gtgaacctgagtgcttctctaggca

SEQ ID NO: 47094 - DNA, 25 bp, Mus musculus
gtgaacctgtcagacaaatgaaagc

SEQ ID NO: 47095 - DNA, 25 bp, Mus musculus
gtgaacgaagcttttgcccctcagt

SEQ ID NO: 47096 - DNA, 25 bp, Mus musculus
gtgaacgacgactgtcataccgtgc

SEQ ID NO: 47097 - DNA, 25 bp, Mus musculus
gtgaacgcaaggtgcctgcctcccg

SEQ ID NO: 47098 - DNA, 25 bp, Mus musculus
gtgaactgaaacaattttggtatgc

SEQ ID NO: 47099 - DNA, 25 bp, Mus musculus
gtgaactgaaactattttggtatgc

SEQ ID NO: 47100 - DNA, 25 bp, Mus musculus
gtgaactgcggacctggacctagca

SEQ ID NO: 47101 - DNA, 25 bp, Mus musculus
gtgaactgcggagctggacctagca

SEQ ID NO: 47102 - DNA, 25 bp, Mus musculus
gtgaactgtcccactgtcggcttcc

SEQ ID NO: 47103 - DNA, 25 bp, Mus musculus
gtgaacttcgagatgtttacagtgc

SEQ ID NO: 47104 - DNA, 25 bp, Mus musculus
gtgaacttgctcaggacaaggaggc

SEQ ID NO: 47105 - DNA, 25 bp, Mus musculus
gtgaagaaactgctgtacaaagaag

SEQ ID NO: 47106 - DNA, 25 bp, Mus musculus
gtgaagactcggctccagtcccttg

SEQ ID NO: 47107 - DNA, 25 bp, Mus musculus
gtgaagagaaacatcctaggaattc

SEQ ID NO: 47108 - DNA, 25 bp, Mus musculus
gtgaagatgacacctttctaacagc

SEQ ID NO: 47109 - DNA, 25 bp, Mus musculus
gtgaagcaacccatagaacccggga

SEQ ID NO: 47110 - DNA, 25 bp, Mus musculus
gtgaagccaccaccacgggattcaa

SEQ ID NO: 47111 - DNA, 25 bp, Mus musculus
gtgaagccagcacagtcctgaagta

SEQ ID NO: 47112 - DNA, 25 bp, Mus musculus
gtgaagccgagcttgcagaaatccc

SEQ ID NO: 47113 - DNA, 25 bp, Mus musculus
gtgaagcctccagcaaacaagtacc

SEQ ID NO: 47114 - DNA, 25 bp, Mus musculus
gtgaagcctccgctgagacgctctg

SEQ ID NO: 47115 - DNA, 25 bp, Mus musculus
gtgaagctccacgacgagaccctga

SEQ ID NO: 47116 - DNA, 25 bp, Mus musculus
gtgaaggaaaagtcctgagcgtgaa

SEQ ID NO: 47117 - DNA, 25 bp, Mus musculus
gtgaaggaactaggcgaccgggcgg

SEQ ID NO: 47118 - DNA, 25 bp, Mus musculus
gtgaaggagaaagcattggtctcat

SEQ ID NO: 47119 - DNA, 25 bp, Mus musculus
gtgaaggagattaaatcttatctca

SEQ ID NO: 47120 - DNA, 25 bp, Mus musculus
gtgaaggccttaggcacccagggca

SEQ ID NO: 47121 - DNA, 25 bp, Mus musculus
gtgaaggtccccaaagcagctgccg

SEQ ID NO: 47122 - DNA, 25 bp, Mus musculus
gtgaaggtcccctaagcagctgccg

SEQ ID NO: 47123 - DNA, 25 bp, Mus musculus
gtgaagtatcttttcttttcctggc

SEQ ID NO: 47124 - DNA, 25 bp, Mus musculus
gtgaagtcggccagcctgagcaaga

SEQ ID NO: 47125 - DNA, 25 bp, Mus musculus
gtgaagtgctaaaacagttaacaga

SEQ ID NO: 47126 - DNA, 25 bp, Mus musculus
gtgaataatccaggtggctgcagtg

SEQ ID NO: 47127 - DNA, 25 bp, Mus musculus
gtgaatacccttcaccctggcagta

SEQ ID NO: 47128 - DNA, 25 bp, Mus musculus
gtgaatacctcaaaagcccgaccaa

SEQ ID NO: 47129 - DNA, 25 bp, Mus musculus
gtgaatagcagtgggcatgctgcac

SEQ ID NO: 47130 - DNA, 25 bp, Mus musculus
gtgaatatactgtaatgacagctca

SEQ ID NO: 47131 - DNA, 25 bp, Mus musculus
gtgaatgtgcgggagaaggccaagc

SEQ ID NO: 47132 - DNA, 25 bp, Mus musculus
gtgaatttgtagttgaagttaagtc

SEQ ID NO: 47133 - DNA, 25 bp, Mus musculus
gtgaattttttatgtctcctcatga

SEQ ID NO: 47134 - DNA, 25 bp, Mus musculus
gtgacaaaacatgccaacaaagggt

SEQ ID NO: 47135 - DNA, 25 bp, Mus musculus
gtgacaagtagaccctctgcaaggc

SEQ ID NO: 47136 - DNA, 25 bp, Mus musculus
gtgacaatgaccatgcgatacctgc

SEQ ID NO: 47137 - DNA, 25 bp, Mus musculus
gtgacacaagcatcatcaaacaact

SEQ ID NO: 47138 - DNA, 25 bp, Mus musculus
gtgacactcctgaaagcctcagagg

SEQ ID NO: 47139 - DNA, 25 bp, Mus musculus
gtgacagaaaagacgaacatacttc

SEQ ID NO: 47140 - DNA, 25 bp, Mus musculus
gtgacagactatggagcttttatca

SEQ ID NO: 47141 - DNA, 25 bp, Mus musculus
gtgacagagtacatgtgtggagatc

SEQ ID NO: 47142 - DNA, 25 bp, Mus musculus
gtgacagccatcacaggtttgtcca

SEQ ID NO: 47143 - DNA, 25 bp, Mus musculus
gtgacaggaagtgaagctcattcaa

SEQ ID NO: 47144 - DNA, 25 bp, Mus musculus
gtgacataaacatcgcgtccttaga

SEQ ID NO: 47145 - DNA, 25 bp, Mus musculus
gtgacataccgcgtagtccaggtga

SEQ ID NO: 47146 - DNA, 25 bp, Mus musculus
gtgacatcacaatgctacccacatt

SEQ ID NO: 47147 - DNA, 25 bp, Mus musculus
gtgacatttgcaacccgaacccctg

SEQ ID NO: 47148 - DNA, 25 bp, Mus musculus
gtgaccatatcctaccttcccttgg

SEQ ID NO: 47149 - DNA, 25 bp, Mus musculus
gtgaccattaatcgttctgctcgac

SEQ ID NO: 47150 - DNA, 25 bp, Mus musculus
gtgaccattaatggttctgctcgac

SEQ ID NO: 47151 - DNA, 25 bp, Mus musculus
gtgaccccaaaggagctatgctaac

SEQ ID NO: 47152 - DNA, 25 bp, Mus musculus
gtgacccgcccacttggtgtaaaag

SEQ ID NO: 47153 - DNA, 25 bp, Mus musculus
gtgaccctcagaccagcccagagat

SEQ ID NO: 47154 - DNA, 25 bp, Mus musculus
gtgaccctctgaagctcatctgcct

SEQ ID NO: 47155 - DNA, 25 bp, Mus musculus
gtgaccctgctgtctgactatgaag

SEQ ID NO: 47156 - DNA, 25 bp, Mus musculus
gtgacccttaccctgttcagctgat

SEQ ID NO: 47157 - DNA, 25 bp, Mus musculus
gtgacctcgatctttaagaaccttg

SEQ ID NO: 47158 - DNA, 25 bp, Mus musculus
gtgacctctctttccccagcaataa

SEQ ID NO: 47159 - DNA, 25 bp, Mus musculus
gtgacctgtgttttcgtgtgtatca

SEQ ID NO: 47160 - DNA, 25 bp, Mus musculus
gtgaccttggacaagctccctctgt

SEQ ID NO: 47161 - DNA, 25 bp, Mus musculus
gtgaccttggagaagctcccacccg

SEQ ID NO: 47162 - DNA, 25 bp, Mus musculus
gtgacgaccctcctgcgagctgtgt

SEQ ID NO: 47163 - DNA, 25 bp, Mus musculus
gtgacgctgactgcggagaccgaat

SEQ ID NO: 47164 - DNA, 25 bp, Mus musculus
gtgactactgcccatgtccgcagag

SEQ ID NO: 47165 - DNA, 25 bp, Mus musculus
gtgactcaagtgcaagaggtagtct

SEQ ID NO: 47166 - DNA, 25 bp, Mus musculus
gtgactcatattctcaatgttgcat

SEQ ID NO: 47167 - DNA, 25 bp, Mus musculus
gtgactcatccaaattccatgccag

SEQ ID NO: 47168 - DNA, 25 bp, Mus musculus
gtgactccaatgaagtaagagggcc

SEQ ID NO: 47169 - DNA, 25 bp, Mus musculus
gtgactccctacagccctgtacaaa

SEQ ID NO: 47170 - DNA, 25 bp, Mus musculus
gtgactcctctttgtccgaggtgca

SEQ ID NO: 47171 - DNA, 25 bp, Mus musculus
gtgactctcctattccatctgtttc

SEQ ID NO: 47172 - DNA, 25 bp, Mus musculus
gtgactctggcagctcgggactcag

SEQ ID NO: 47173 - DNA, 25 bp, Mus musculus
gtgactctgggtttaacaaacagag

SEQ ID NO: 47174 - DNA, 25 bp, Mus musculus
gtgactgtaacctcgaacacctggc

SEQ ID NO: 47175 - DNA, 25 bp, Mus musculus
gtgactgtcatcctgaatttctgcc

SEQ ID NO: 47176 - DNA, 25 bp, Mus musculus
gtgactgtgaatgagtggcctgatc

SEQ ID NO: 47177 - DNA, 25 bp, Mus musculus
gtgacttacagcagccggagctacc

SEQ ID NO: 47178 - DNA, 25 bp, Mus musculus
gtgacttattacacctcctttgtgg

SEQ ID NO: 47179 - DNA, 25 bp, Mus musculus
gtgacttcttatgatcctctacgga

SEQ ID NO: 47180 - DNA, 25 bp, Mus musculus
gtgactttctctctactgtaggagg

SEQ ID NO: 47181 - DNA, 25 bp, Mus musculus
gtgactttgcagttccctgaccagt

SEQ ID NO: 47182 - DNA, 25 bp, Mus musculus
gtgagaacagtcctggttcctaccg

SEQ ID NO: 47183 - DNA, 25 bp, Mus musculus
gtgagaacagtcgtggttcctaccg

SEQ ID NO: 47184 - DNA, 25 bp, Mus musculus
gtgagaagccatactcctgctccca

SEQ ID NO: 47185 - DNA, 25 bp, Mus musculus
gtgagaagccattctcctgctccca

SEQ ID NO: 47186 - DNA, 25 bp, Mus musculus
gtgagagccccgaggtggacgaggc

SEQ ID NO: 47187 - DNA, 25 bp, Mus musculus
gtgagaggctcccagcctttcacct

SEQ ID NO: 47188 - DNA, 25 bp, Mus musculus
gtgagcaaatacagtgacgggaagc

SEQ ID NO: 47189 - DNA, 25 bp, Mus musculus
gtgagcaaatactgtgacgggaagc

SEQ ID NO: 47190 - DNA, 25 bp, Mus musculus
gtgagcaattgcaggctgagcagaa

SEQ ID NO: 47191 - DNA, 25 bp, Mus musculus
gtgagcagtcccaacggaccagact

SEQ ID NO: 47192 - DNA, 25 bp, Mus musculus
gtgagcatgccaactcttagcttcc

SEQ ID NO: 47193 - DNA, 25 bp, Mus musculus
gtgagcatgctcaacgtgttcctca

SEQ ID NO: 47194 - DNA, 25 bp, Mus musculus
gtgagcattcggtggatttactaaa

SEQ ID NO: 47195 - DNA, 25 bp, Mus musculus
gtgagctttttcacaggctacctga

SEQ ID NO: 47196 - DNA, 25 bp, Mus musculus
gtgaggaaaatcttgccccctgctt

SEQ ID NO: 47197 - DNA, 25 bp, Mus musculus
gtgaggacacttgtgtctacccaga

SEQ ID NO: 47198 - DNA, 25 bp, Mus musculus
gtgaggagctgcagccactgagcca

SEQ ID NO: 47199 - DNA, 25 bp, Mus musculus
gtgaggagttctacgaagcttcgcc

SEQ ID NO: 47200 - DNA, 25 bp, Mus musculus
gtgaggatcccatttaaactctgtg

SEQ ID NO: 47201 - DNA, 25 bp, Mus musculus
gtgaggatgcaagcaactcctatat

SEQ ID NO: 47202 - DNA, 25 bp, Mus musculus
gtgaggcagctcagacgcccagtcg

SEQ ID NO: 47203 - DNA, 25 bp, Mus musculus
gtgaggccaagtctatccagaacag

SEQ ID NO: 47204 - DNA, 25 bp, Mus musculus
gtgaggccagtgcacctttgaccca

SEQ ID NO: 47205 - DNA, 25 bp, Mus musculus
gtgagggagaaagtaattggatcat

SEQ ID NO: 47206 - DNA, 25 bp, Mus musculus
gtgaggtgacactggaagacaccag

SEQ ID NO: 47207 - DNA, 25 bp, Mus musculus
gtgaggtgctgatacccccacacga

SEQ ID NO: 47208 - DNA, 25 bp, Mus musculus
gtgaggtggccttgattgcttcgtc

SEQ ID NO: 47209 - DNA, 25 bp, Mus musculus
gtgaggttattcgagtacatgagca

SEQ ID NO: 47210 - DNA, 25 bp, Mus musculus
gtgagtatgtggagccccacgaatt

SEQ ID NO: 47211 - DNA, 25 bp, Mus musculus
gtgagtgagcagattgtcattggca

SEQ ID NO: 47212 - DNA, 25 bp, Mus musculus
gtgagtgccacgctggccctgacct

SEQ ID NO: 47213 - DNA, 25 bp, Mus musculus
gtgagttctttctgcactggtgctt

SEQ ID NO: 47214 - DNA, 25 bp, Mus musculus
gtgataaatgcacatggttcaaaat

SEQ ID NO: 47215 - DNA, 25 bp, Mus musculus
gtgatacccattgaagaatttcaag

SEQ ID NO: 47216 - DNA, 25 bp, Mus musculus
gtgatactcctctgcacccactggg

SEQ ID NO: 47217 - DNA, 25 bp, Mus musculus
gtgatagcagctccttgctctgtta

SEQ ID NO: 47218 - DNA, 25 bp, Mus musculus
gtgatagccaagtacccacacaaaa

SEQ ID NO: 47219 - DNA, 25 bp, Mus musculus
gtgatagctcccaagggtgtctctc

SEQ ID NO: 47220 - DNA, 25 bp, Mus musculus
gtgatattttcagagttacattgga

SEQ ID NO: 47221 - DNA, 25 bp, Mus musculus
gtgatcagcactggccacgacaagt

SEQ ID NO: 47222 - DNA, 25 bp, Mus musculus
gtgatcattggcacgaagactatcc

SEQ ID NO: 47223 - DNA, 25 bp, Mus musculus
gtgatccagccattggctcaggcct

SEQ ID NO: 47224 - DNA, 25 bp, Mus musculus
gtgatccctgtataccaggcacctc

SEQ ID NO: 47225 - DNA, 25 bp, Mus musculus
gtgatcctggagcagatcctcttca

SEQ ID NO: 47226 - DNA, 25 bp, Mus musculus
gtgatctgctccgacaagtgtctca

SEQ ID NO: 47227 - DNA, 25 bp, Mus musculus
gtgatctgctttgcctgtttcctct

SEQ ID NO: 47228 - DNA, 25 bp, Mus musculus
gtgatctgtaaatcggatgctccaa

SEQ ID NO: 47229 - DNA, 25 bp, Mus musculus
gtgatgactacaaaagccatgtgaa

SEQ ID NO: 47230 - DNA, 25 bp, Mus musculus
gtgatgagcaatagcctgccatgtc

SEQ ID NO: 47231 - DNA, 25 bp, Mus musculus
gtgatgagcacaccacggagaagcc

SEQ ID NO: 47232 - DNA, 25 bp, Mus musculus
gtgatgaggagggactgctaacaca

SEQ ID NO: 47233 - DNA, 25 bp, Mus musculus
gtgatgatggagaactaccacaatg

SEQ ID NO: 47234 - DNA, 25 bp, Mus musculus
gtgatgcacacccagtgtcattcca

SEQ ID NO: 47235 - DNA, 25 bp, Mus musculus
gtgatgcccaacaagggccccagtc

SEQ ID NO: 47236 - DNA, 25 bp, Mus musculus
gtgatgccgtcaccaggaacatctt

SEQ ID NO: 47237 - DNA, 25 bp, Mus musculus
gtgatgcctgctttacatgatgcta

SEQ ID NO: 47238 - DNA, 25 bp, Mus musculus
gtgatgctgcccaactcccctgagg

SEQ ID NO: 47239 - DNA, 25 bp, Mus musculus
gtgatgcttggagagaccaaccccg

SEQ ID NO: 47240 - DNA, 25 bp, Mus musculus
gtgatggactcttgctctcctagaa

SEQ ID NO: 47241 - DNA, 25 bp, Mus musculus
gtgatggagtcttcagcttcctatt

SEQ ID NO: 47242 - DNA, 25 bp, Mus musculus
gtgattagaaattctagccatctcc

SEQ ID NO: 47243 - DNA, 25 bp, Mus musculus
gtgattattataccttcagccctgg

SEQ ID NO: 47244 - DNA, 25 bp, Mus musculus
gtgattcacaagatgctgctctcca

SEQ ID NO: 47245 - DNA, 25 bp, Mus musculus
gtgattctgctcatcctggttttca

SEQ ID NO: 47246 - DNA, 25 bp, Mus musculus
gtgattgagctggagaagcatatct

SEQ ID NO: 47247 - DNA, 25 bp, Mus musculus
gtgcaaatgcatgctgacattactg

SEQ ID NO: 47248 - DNA, 25 bp, Mus musculus
gtgcaacaagcaacaaagacaccca

SEQ ID NO: 47249 - DNA, 25 bp, Mus musculus
gtgcaacatcccaggtaacttcatg

SEQ ID NO: 47250 - DNA, 25 bp, Mus musculus
gtgcaactgaaagagcaagaagtgc

SEQ ID NO: 47251 - DNA, 25 bp, Mus musculus
gtgcaagccatatatgtcctgaagg

SEQ ID NO: 47252 - DNA, 25 bp, Mus musculus
gtgcaagggaccgagagccacaaca

SEQ ID NO: 47253 - DNA, 25 bp, Mus musculus
gtgcaaggtgtgatcaggcccatga

SEQ ID NO: 47254 - DNA, 25 bp, Mus musculus
gtgcaaggtgttctccaagaccaga

SEQ ID NO: 47255 - DNA, 25 bp, Mus musculus
gtgcaagtaggatgtttagcaaccc

SEQ ID NO: 47256 - DNA, 25 bp, Mus musculus
gtgcacacacgggtatcatctttca

SEQ ID NO: 47257 - DNA, 25 bp, Mus musculus
gtgcacacagtgtgcccactcctgt

SEQ ID NO: 47258 - DNA, 25 bp, Mus musculus
gtgcacagagatctaaagctggaaa

SEQ ID NO: 47259 - DNA, 25 bp, Mus musculus
gtgcaccatgtttccagattcgatg

SEQ ID NO: 47260 - DNA, 25 bp, Mus musculus
gtgcacccgtgcactgcagcatgtt

SEQ ID NO: 47261 - DNA, 25 bp, Mus musculus
gtgcaccctcggttgctcagcgtgc

SEQ ID NO: 47262 - DNA, 25 bp, Mus musculus
gtgcaccctgaagccggaggccgat

SEQ ID NO: 47263 - DNA, 25 bp, Mus musculus
gtgcactgcctgttgcccatgtctt

SEQ ID NO: 47264 - DNA, 25 bp, Mus musculus
gtgcactgtgtaggcctgttgccca

SEQ ID NO: 47265 - DNA, 25 bp, Mus musculus
gtgcagaaagctgctcagactgcct

SEQ ID NO: 47266 - DNA, 25 bp, Mus musculus
gtgcagaattcacaagatccagtcc

SEQ ID NO: 47267 - DNA, 25 bp, Mus musculus
gtgcagacaaaatggaatccaacta

SEQ ID NO: 47268 - DNA, 25 bp, Mus musculus
gtgcagagaggtgaaatacgattat

SEQ ID NO: 47269 - DNA, 25 bp, Mus musculus
gtgcagaggaacatgggcagtcccc

SEQ ID NO: 47270 - DNA, 25 bp, Mus musculus
gtgcagatcgacaatgccaagctgg

SEQ ID NO: 47271 - DNA, 25 bp, Mus musculus
gtgcagatgctgaaaaagacagtga

SEQ ID NO: 47272 - DNA, 25 bp, Mus musculus
gtgcagccagcctatgatgtcctat

SEQ ID NO: 47273 - DNA, 25 bp, Mus musculus
gtgcagcccactccatcattgtcat

SEQ ID NO: 47274 - DNA, 25 bp, Mus musculus
gtgcagctcagtcacctcagcagcg

SEQ ID NO: 47275 - DNA, 25 bp, Mus musculus
gtgcagctcatctgtggatactgcc

SEQ ID NO: 47276 - DNA, 25 bp, Mus musculus
gtgcagctgcccaggttcccacgga

SEQ ID NO: 47277 - DNA, 25 bp, Mus musculus
gtgcaggaaccactgaagcctcagc

SEQ ID NO: 47278 - DNA, 25 bp, Mus musculus
gtgcaggaccagacagacatcatct

SEQ ID NO: 47279 - DNA, 25 bp, Mus musculus
gtgcaggcagcatcgtcttgaaggt

SEQ ID NO: 47280 - DNA, 25 bp, Mus musculus
gtgcagggcgcaagctgagcctctt

SEQ ID NO: 47281 - DNA, 25 bp, Mus musculus
gtgcagtatgaccaccccaatcaca

SEQ ID NO: 47282 - DNA, 25 bp, Mus musculus
gtgcagttttgcaaactcactgtcc

SEQ ID NO: 47283 - DNA, 25 bp, Mus musculus
gtgcagttttgctaactcactgtcc

SEQ ID NO: 47284 - DNA, 25 bp, Mus musculus
gtgcatcagtgaaggtcagaagtac

SEQ ID NO: 47285 - DNA, 25 bp, Mus musculus
gtgcatcatgggagaaatgatcaaa

SEQ ID NO: 47286 - DNA, 25 bp, Mus musculus
gtgcatcctgagctctacgtggaca

SEQ ID NO: 47287 - DNA, 25 bp, Mus musculus
gtgcatgagttggtgtccggagacc

SEQ ID NO: 47288 - DNA, 25 bp, Mus musculus
gtgcatgcaagcaggcaaaatattc

SEQ ID NO: 47289 - DNA, 25 bp, Mus musculus
gtgcattaagtactttgaccagtgg

SEQ ID NO: 47290 - DNA, 25 bp, Mus musculus
gtgcattatgggagaaatggtttgc

SEQ ID NO: 47291 - DNA, 25 bp, Mus musculus
gtgccaaccacgtgctgaagggaaa

SEQ ID NO: 47292 - DNA, 25 bp, Mus musculus
gtgccaactcgtttgctgtcacgtg

SEQ ID NO: 47293 - DNA, 25 bp, Mus musculus
gtgccaagctcaggcctcagaaggt

SEQ ID NO: 47294 - DNA, 25 bp, Mus musculus
gtgccaaggcaaactacaggctcat

SEQ ID NO: 47295 - DNA, 25 bp, Mus musculus
gtgccaatagttctgctgagcaaag

SEQ ID NO: 47296 - DNA, 25 bp, Mus musculus
gtgccaatgattggcaatgcaaaac

SEQ ID NO: 47297 - DNA, 25 bp, Mus musculus
gtgccaattgagacttcctgcccag

SEQ ID NO: 47298 - DNA, 25 bp, Mus musculus
gtgccaccaaagaccaaaaacgaag

SEQ ID NO: 47299 - DNA, 25 bp, Mus musculus
gtgccaccaaagtccaaaaacgaag

SEQ ID NO: 47300 - DNA, 25 bp, Mus musculus
gtgccactataaatacccttttcag

SEQ ID NO: 47301 - DNA, 25 bp, Mus musculus
gtgccactcagcaaattctggatga

SEQ ID NO: 47302 - DNA, 25 bp, Mus musculus
gtgccactgcactgtgtggatcaga

SEQ ID NO: 47303 - DNA, 25 bp, Mus musculus
gtgccactgcttcaacaaataccgg

SEQ ID NO: 47304 - DNA, 25 bp, Mus musculus
gtgccacttctcgtaaacggaaaga

SEQ ID NO: 47305 - DNA, 25 bp, Mus musculus
gtgccagatctagagaaagcatcgt

SEQ ID NO: 47306 - DNA, 25 bp, Mus musculus
gtgccagctacacccaaacatgctg

SEQ ID NO: 47307 - DNA, 25 bp, Mus musculus
gtgccaggacatatgatcacctgaa

SEQ ID NO: 47308 - DNA, 25 bp, Mus musculus
gtgccaggtccgcatccgctacatg

SEQ ID NO: 47309 - DNA, 25 bp, Mus musculus
gtgccagtctgggtgccaaaggcca

SEQ ID NO: 47310 - DNA, 25 bp, Mus musculus
gtgccagtggccctctggttccaga

SEQ ID NO: 47311 - DNA, 25 bp, Mus musculus
gtgccatagcgttgctgtttctcca

SEQ ID NO: 47312 - DNA, 25 bp, Mus musculus
gtgccatcaaggtatttaaaacaac

SEQ ID NO: 47313 - DNA, 25 bp, Mus musculus
gtgcccaaatctgcggatgaccgag

SEQ ID NO: 47314 - DNA, 25 bp, Mus musculus
gtgcccaaggaaaacatactcctgg

SEQ ID NO: 47315 - DNA, 25 bp, Mus musculus
gtgcccacagaccatattgctcctg

SEQ ID NO: 47316 - DNA, 25 bp, Mus musculus
gtgcccacagcgacgaagagatgga

SEQ ID NO: 47317 - DNA, 25 bp, Mus musculus
gtgcccactcatgatggatttggag

SEQ ID NO: 47318 - DNA, 25 bp, Mus musculus
gtgcccatcagcttcaaggacttgg

SEQ ID NO: 47319 - DNA, 25 bp, Mus musculus
gtgccccatcttggcttcaagcaga

SEQ ID NO: 47320 - DNA, 25 bp, Mus musculus
gtgccccattattgaccctgcctgg

SEQ ID NO: 47321 - DNA, 25 bp, Mus musculus
gtgccccgttttactgaagattcag

SEQ ID NO: 47322 - DNA, 25 bp, Mus musculus
gtgcccgaagcaagcccaaggtggt

SEQ ID NO: 47323 - DNA, 25 bp, Mus musculus
gtgcccgagctctgccaccatgtag

SEQ ID NO: 47324 - DNA, 25 bp, Mus musculus
gtgcccgctgacattatctcatcca

SEQ ID NO: 47325 - DNA, 25 bp, Mus musculus
gtgccctaccctcattgtgcatggg

SEQ ID NO: 47326 - DNA, 25 bp, Mus musculus
gtgccctccaggatccacacagtta

SEQ ID NO: 47327 - DNA, 25 bp, Mus musculus
gtgccctgagcattgcagaatcttg

SEQ ID NO: 47328 - DNA, 25 bp, Mus musculus
gtgcccttatgcatgagttatcaaa

SEQ ID NO: 47329 - DNA, 25 bp, Mus musculus
gtgccgagtgccttcccaatgctca

SEQ ID NO: 47330 - DNA, 25 bp, Mus musculus
gtgccggatcatagttcatttcatg

SEQ ID NO: 47331 - DNA, 25 bp, Mus musculus
gtgccgggctccgttcagacactga

SEQ ID NO: 47332 - DNA, 25 bp, Mus musculus
gtgcctaccgcccaggtgctgagat

SEQ ID NO: 47333 - DNA, 25 bp, Mus musculus
gtgcctatagcattagctctggaat

SEQ ID NO: 47334 - DNA, 25 bp, Mus musculus
gtgcctattgaaagagactcactct

SEQ ID NO: 47335 - DNA, 25 bp, Mus musculus
gtgcctcacatcaagacgagctgta

SEQ ID NO: 47336 - DNA, 25 bp, Mus musculus
gtgcctcacgcctcatgagaagaca

SEQ ID NO: 47337 - DNA, 25 bp, Mus musculus
gtgcctcagcagtatagcagttcag

SEQ ID NO: 47338 - DNA, 25 bp, Mus musculus
gtgcctccaggataataatggacta

SEQ ID NO: 47339 - DNA, 25 bp, Mus musculus
gtgcctgccacgctgggtaccagct

SEQ ID NO: 47340 - DNA, 25 bp, Mus musculus
gtgcctgctcttccccatgagggaa

SEQ ID NO: 47341 - DNA, 25 bp, Mus musculus
gtgcctgtggacgaggcccgaggca

SEQ ID NO: 47342 - DNA, 25 bp, Mus musculus
gtgcctgtgtattctggccctgtcc

SEQ ID NO: 47343 - DNA, 25 bp, Mus musculus
gtgccttcaggatgtagagaaaatg

SEQ ID NO: 47344 - DNA, 25 bp, Mus musculus
gtgcctttgcgccagtgaccttgag

SEQ ID NO: 47345 - DNA, 25 bp, Mus musculus
gtgcctttgcgcgagtgaccttgag

SEQ ID NO: 47346 - DNA, 25 bp, Mus musculus
gtgcctttgtcaacgccagacagga

SEQ ID NO: 47347 - DNA, 25 bp, Mus musculus
gtgcgaccctggcattctgggctcc

SEQ ID NO: 47348 - DNA, 25 bp, Mus musculus
gtgcgcagtgccctcctcgtgaaac

SEQ ID NO: 47349 - DNA, 25 bp, Mus musculus
gtgcgcccaagctctggaacctcat

SEQ ID NO: 47350 - DNA, 25 bp, Mus musculus
gtgcgctttcccagaccttcgtgcg

SEQ ID NO: 47351 - DNA, 25 bp, Mus musculus
gtgcgctttccctgaccttcgtgcg

SEQ ID NO: 47352 - DNA, 25 bp, Mus musculus
gtgcggaggtgcaccgccctgacct

SEQ ID NO: 47353 - DNA, 25 bp, Mus musculus
gtgcggatcccacccttctcagtga

SEQ ID NO: 47354 - DNA, 25 bp, Mus musculus
gtgcgggaagaggtgactttcatct

SEQ ID NO: 47355 - DNA, 25 bp, Mus musculus
gtgcggtcccagcataccacacatg

SEQ ID NO: 47356 - DNA, 25 bp, Mus musculus
gtgcgtataactgtgcccagctaac

SEQ ID NO: 47357 - DNA, 25 bp, Mus musculus
gtgcgtcccctgatgacatcaagaa

SEQ ID NO: 47358 - DNA, 25 bp, Mus musculus
gtgcgtggcccatgggccagtccca

SEQ ID NO: 47359 - DNA, 25 bp, Mus musculus
gtgcgtggtgtacccctcggttcca

SEQ ID NO: 47360 - DNA, 25 bp, Mus musculus
gtgctaacagcagcataggacattt

SEQ ID NO: 47361 - DNA, 25 bp, Mus musculus
gtgctacagtttgaaggccaaaatt

SEQ ID NO: 47362 - DNA, 25 bp, Mus musculus
gtgctaccagcaagaaatgatcagt

SEQ ID NO: 47363 - DNA, 25 bp, Mus musculus
gtgctagatgcctggagccagagtt

SEQ ID NO: 47364 - DNA, 25 bp, Mus musculus
gtgctaggcctaggcgcctgctcta

SEQ ID NO: 47365 - DNA, 25 bp, Mus musculus
gtgctcaccttttctcctcactgat

SEQ ID NO: 47366 - DNA, 25 bp, Mus musculus
gtgctcacttcgtccagctgtgctg

SEQ ID NO: 47367 - DNA, 25 bp, Mus musculus
gtgctcagctctggtgatgaccctg

SEQ ID NO: 47368 - DNA, 25 bp, Mus musculus
gtgctcatcccgaagtgacctgcca

SEQ ID NO: 47369 - DNA, 25 bp, Mus musculus
gtgctcatctgtctgctggagtatc

SEQ ID NO: 47370 - DNA, 25 bp, Mus musculus
gtgctccaatgagaagggttacttc

SEQ ID NO: 47371 - DNA, 25 bp, Mus musculus
gtgctccaggaattcaactctctgt

SEQ ID NO: 47372 - DNA, 25 bp, Mus musculus
gtgctcccggaagccagaaactttc

SEQ ID NO: 47373 - DNA, 25 bp, Mus musculus
gtgctcccttgcattgttcatctgc

SEQ ID NO: 47374 - DNA, 25 bp, Mus musculus
gtgctcgcttcctcacccgtggtgt

SEQ ID NO: 47375 - DNA, 25 bp, Mus musculus
gtgctcgtagctctattttccatga

SEQ ID NO: 47376 - DNA, 25 bp, Mus musculus
gtgctctacttcttcatgctgctga

SEQ ID NO: 47377 - DNA, 25 bp, Mus musculus
gtgctctatgcacgtgcctatacta

SEQ ID NO: 47378 - DNA, 25 bp, Mus musculus
gtgctctgcccgtgtgcagacgccg

SEQ ID NO: 47379 - DNA, 25 bp, Mus musculus
gtgctctgcgaggtggccggctggg

SEQ ID NO: 47380 - DNA, 25 bp, Mus musculus
gtgctctgtcctgactggaatctgc

SEQ ID NO: 47381 - DNA, 25 bp, Mus musculus
gtgctcttattctccacagtcaccg

SEQ ID NO: 47382 - DNA, 25 bp, Mus musculus
gtgctcttttacctcgttaggatcg

SEQ ID NO: 47383 - DNA, 25 bp, Mus musculus
gtgctgaagaactcgctccctgtgc

SEQ ID NO: 47384 - DNA, 25 bp, Mus musculus
gtgctgatgcaaacgcggttacccg

SEQ ID NO: 47385 - DNA, 25 bp, Mus musculus
gtgctgcagccccagaaatccgctg

SEQ ID NO: 47386 - DNA, 25 bp, Mus musculus
gtgctgccagagaaatatccctctg

SEQ ID NO: 47387 - DNA, 25 bp, Mus musculus
gtgctgcccaggatggacaacatca

SEQ ID NO: 47388 - DNA, 25 bp, Mus musculus
gtgctgcccaggttggacaacatca

SEQ ID NO: 47389 - DNA, 25 bp, Mus musculus
gtgctgccgtgtcctccgttgactc

SEQ ID NO: 47390 - DNA, 25 bp, Mus musculus
gtgctgcctcagaagtggaccgaag

SEQ ID NO: 47391 - DNA, 25 bp, Mus musculus
gtgctgcgcacctgcggcagccttg

SEQ ID NO: 47392 - DNA, 25 bp, Mus musculus
gtgctgctcgagaaggagctgcttc

SEQ ID NO: 47393 - DNA, 25 bp, Mus musculus
gtgctgctgaagtcctccacggaga

SEQ ID NO: 47394 - DNA, 25 bp, Mus musculus
gtgctggacctttcccaccaatcag

SEQ ID NO: 47395 - DNA, 25 bp, Mus musculus
gtgctggagacctcagaccgaggct

SEQ ID NO: 47396 - DNA, 25 bp, Mus musculus
gtgctggcttcggtaggagacacag

SEQ ID NO: 47397 - DNA, 25 bp, Mus musculus
gtgctgggacccaagtcctcgcggc

SEQ ID NO: 47398 - DNA, 25 bp, Mus musculus
gtgctgggccagcacccagtcctga

SEQ ID NO: 47399 - DNA, 25 bp, Mus musculus
gtgctgggccaggacccagtcctga

SEQ ID NO: 47400 - DNA, 25 bp, Mus musculus
gtgctgtcctcccttaaacatggcc

SEQ ID NO: 47401 - DNA, 25 bp, Mus musculus
gtgctgtggaactcacccgccgcct

SEQ ID NO: 47402 - DNA, 25 bp, Mus musculus
gtgctgtggatggagcaggtactga

SEQ ID NO: 47403 - DNA, 25 bp, Mus musculus
gtgcttagttcaaaccattcatctg

SEQ ID NO: 47404 - DNA, 25 bp, Mus musculus
gtgcttcatcgctcctacctagacg

SEQ ID NO: 47405 - DNA, 25 bp, Mus musculus
gtgcttccaatctcctgtaatccta

SEQ ID NO: 47406 - DNA, 25 bp, Mus musculus
gtgcttccttctgcttagtagaggg

SEQ ID NO: 47407 - DNA, 25 bp, Mus musculus
gtgcttcgaccaacagctgccacgg

SEQ ID NO: 47408 - DNA, 25 bp, Mus musculus
gtgcttctcactgtaccttggcagg

SEQ ID NO: 47409 - DNA, 25 bp, Mus musculus
gtgcttgatctgtgtgctgctcctg

SEQ ID NO: 47410 - DNA, 25 bp, Mus musculus
gtgcttgcctctccctcagggtggc

SEQ ID NO: 47411 - DNA, 25 bp, Mus musculus
gtgctttccgttggactgcttgccg

SEQ ID NO: 47412 - DNA, 25 bp, Mus musculus
gtggaaaaagtcactactcactcag

SEQ ID NO: 47413 - DNA, 25 bp, Mus musculus
gtggaaaaatcacatccatagtaaa

SEQ ID NO: 47414 - DNA, 25 bp, Mus musculus
gtggaaaattcaccgtcgccattgc

SEQ ID NO: 47415 - DNA, 25 bp, Mus musculus
gtggaaacagaaagaggtttcagaa

SEQ ID NO: 47416 - DNA, 25 bp, Mus musculus
gtggaaacttcacagcattttcgta

SEQ ID NO: 47417 - DNA, 25 bp, Mus musculus
gtggaacacgactccatccggctgc

SEQ ID NO: 47418 - DNA, 25 bp, Mus musculus
gtggaacagagatgccagaccttct

SEQ ID NO: 47419 - DNA, 25 bp, Mus musculus
gtggaacatctcaaagaacacgtcc

SEQ ID NO: 47420 - DNA, 25 bp, Mus musculus
gtggaaccacttaggaagcatctag

SEQ ID NO: 47421 - DNA, 25 bp, Mus musculus
gtggaaccaggaaccactgttctgc

SEQ ID NO: 47422 - DNA, 25 bp, Mus musculus
gtggaacggctgcagtacacctatg

SEQ ID NO: 47423 - DNA, 25 bp, Mus musculus
gtggaactcccaaaacgtcggcaat

SEQ ID NO: 47424 - DNA, 25 bp, Mus musculus
gtggaagacggcttgtggcaggtgc

SEQ ID NO: 47425 - DNA, 25 bp, Mus musculus
gtggaagccactgctctgcacacag

SEQ ID NO: 47426 - DNA, 25 bp, Mus musculus
gtggaaggaaacagcaaaggcacct

SEQ ID NO: 47427 - DNA, 25 bp, Mus musculus
gtggaagtgactggccacgctcatg

SEQ ID NO: 47428 - DNA, 25 bp, Mus musculus
gtggaatagcctaagtgatggccag

SEQ ID NO: 47429 - DNA, 25 bp, Mus musculus
gtggaatattttgcactggatcttc

SEQ ID NO: 47430 - DNA, 25 bp, Mus musculus
gtggaatgagaaagtgacgcagtct

SEQ ID NO: 47431 - DNA, 25 bp, Mus musculus
gtggaatgagccagcagcatgccga

SEQ ID NO: 47432 - DNA, 25 bp, Mus musculus
gtggaattacgtccctggactcacc

SEQ ID NO: 47433 - DNA, 25 bp, Mus musculus
gtggacaaatccttctcccttcgac

SEQ ID NO: 47434 - DNA, 25 bp, Mus musculus
gtggacaaccttagagcctcacctt

SEQ ID NO: 47435 - DNA, 25 bp, Mus musculus
gtggacaatgccaagttcacgatgg

SEQ ID NO: 47436 - DNA, 25 bp, Mus musculus
gtggacaggtggtcttttctgagac

SEQ ID NO: 47437 - DNA, 25 bp, Mus musculus
gtggacatcaatcgcaatcaagtgg

SEQ ID NO: 47438 - DNA, 25 bp, Mus musculus
gtggacatcaatggcaatcaagtgg

SEQ ID NO: 47439 - DNA, 25 bp, Mus musculus
gtggacatgccagggtatggctata

SEQ ID NO: 47440 - DNA, 25 bp, Mus musculus
gtggacattgcatcagggatggcca

SEQ ID NO: 47441 - DNA, 25 bp, Mus musculus
gtggaccacctagtgctgaccgttg

SEQ ID NO: 47442 - DNA, 25 bp, Mus musculus
gtggaccagcacacagtgaccttgc

SEQ ID NO: 47443 - DNA, 25 bp, Mus musculus
gtggacccaacagtactctgatcat

SEQ ID NO: 47444 - DNA, 25 bp, Mus musculus
gtggacgaggcgtttgccctgaccc

SEQ ID NO: 47445 - DNA, 25 bp, Mus musculus
gtggacgatcgccttaagcagctcc

SEQ ID NO: 47446 - DNA, 25 bp, Mus musculus
gtggacgctggccatgccttcctca

SEQ ID NO: 47447 - DNA, 25 bp, Mus musculus
gtggactatgacagtgcccggcacc

SEQ ID NO: 47448 - DNA, 25 bp, Mus musculus
gtggagaagacaaaagtcggttgtc

SEQ ID NO: 47449 - DNA, 25 bp, Mus musculus
gtggagaaggtggacatcatcatca

SEQ ID NO: 47450 - DNA, 25 bp, Mus musculus
gtggagacatctgcaaagacccgcg

SEQ ID NO: 47451 - DNA, 25 bp, Mus musculus
gtggagaccaggctaatcagcaagg

SEQ ID NO: 47452 - DNA, 25 bp, Mus musculus
gtggagatcaaaaagagccggcgtc

SEQ ID NO: 47453 - DNA, 25 bp, Mus musculus
gtggagatcccagccacagtcactg

SEQ ID NO: 47454 - DNA, 25 bp, Mus musculus
gtggagcaactagaggtatttcaaa

SEQ ID NO: 47455 - DNA, 25 bp, Mus musculus
gtggagccctattgtgccgacatca

SEQ ID NO: 47456 - DNA, 25 bp, Mus musculus
gtggagctcggtaccttgaggatcc

SEQ ID NO: 47457 - DNA, 25 bp, Mus musculus
gtggaggaacttaggaaaaccaatg

SEQ ID NO: 47458 - DNA, 25 bp, Mus musculus
gtggaggacccgaagaactgcatca

SEQ ID NO: 47459 - DNA, 25 bp, Mus musculus
gtggaggattacttcatcgccaatg

SEQ ID NO: 47460 - DNA, 25 bp, Mus musculus
gtggaggatttttcagattctagat

SEQ ID NO: 47461 - DNA, 25 bp, Mus musculus
gtggaggccaagaacccagctgacc

SEQ ID NO: 47462 - DNA, 25 bp, Mus musculus
gtggaggccctgcacgcctacgtct

SEQ ID NO: 47463 - DNA, 25 bp, Mus musculus
gtggagggcttcacccacgactgga

SEQ ID NO: 47464 - DNA, 25 bp, Mus musculus
gtggaggtgactgtgcccactgagc

SEQ ID NO: 47465 - DNA, 25 bp, Mus musculus
gtggagtcttaccaccatggacctg

SEQ ID NO: 47466 - DNA, 25 bp, Mus musculus
gtggagttccttatacagcgttacc

SEQ ID NO: 47467 - DNA, 25 bp, Mus musculus
gtggataacactcccaagaccttgg

SEQ ID NO: 47468 - DNA, 25 bp, Mus musculus
gtggataccctatttgtgcccctgt

SEQ ID NO: 47469 - DNA, 25 bp, Mus musculus
gtggatacccttcgccatgttatca

SEQ ID NO: 47470 - DNA, 25 bp, Mus musculus
gtggatacttcctcctggacccgag

SEQ ID NO: 47471 - DNA, 25 bp, Mus musculus
gtggatcaacttcgctgcctcagtc

SEQ ID NO: 47472 - DNA, 25 bp, Mus musculus
gtggatcagctggagaaagtgctcc

SEQ ID NO: 47473 - DNA, 25 bp, Mus musculus
gtggatcattatgaaaaccctcgga

SEQ ID NO: 47474 - DNA, 25 bp, Mus musculus
gtggatcctgattgcctcctccctg

SEQ ID NO: 47475 - DNA, 25 bp, Mus musculus
gtggatcgatacagcacccctgcca

SEQ ID NO: 47476 - DNA, 25 bp, Mus musculus
gtggatctgcagcagcaaatcatga

SEQ ID NO: 47477 - DNA, 25 bp, Mus musculus
gtggatgacttggacactcaggaga

SEQ ID NO: 47478 - DNA, 25 bp, Mus musculus
gtggatgctgaagccttagtagctc

SEQ ID NO: 47479 - DNA, 25 bp, Mus musculus
gtggatggctttcaaaccagcaagg

SEQ ID NO: 47480 - DNA, 25 bp, Mus musculus
gtggatgtcttctctgacggcccca

SEQ ID NO: 47481 - DNA, 25 bp, Mus musculus
gtggattaaatgtcactctcaccat

SEQ ID NO: 47482 - DNA, 25 bp, Mus musculus
gtggattcaggcaaccctacccatc

SEQ ID NO: 47483 - DNA, 25 bp, Mus musculus
gtggattctgaatcccagaaacgga

SEQ ID NO: 47484 - DNA, 25 bp, Mus musculus
gtggattgcactgccaacacaaaca

SEQ ID NO: 47485 - DNA, 25 bp, Mus musculus
gtggcaaaagccattccccatccag

SEQ ID NO: 47486 - DNA, 25 bp, Mus musculus
gtggcaacagaacggttgaaccttt

SEQ ID NO: 47487 - DNA, 25 bp, Mus musculus
gtggcaattttggaccaggaccagg

SEQ ID NO: 47488 - DNA, 25 bp, Mus musculus
gtggcacctgcttgacgggccaaga

SEQ ID NO: 47489 - DNA, 25 bp, Mus musculus
gtggcactactgtacagaaagcaag

SEQ ID NO: 47490 - DNA, 25 bp, Mus musculus
gtggcactgatggaattggaaaagc

SEQ ID NO: 47491 - DNA, 25 bp, Mus musculus
gtggcactggcctatgccaaggcag

SEQ ID NO: 47492 - DNA, 25 bp, Mus musculus
gtggcagagatccatttcacataat

SEQ ID NO: 47493 - DNA, 25 bp, Mus musculus
gtggcaggtggcgacagaacctata

SEQ ID NO: 47494 - DNA, 25 bp, Mus musculus
gtggcataatccatcatacccagag

SEQ ID NO: 47495 - DNA, 25 bp, Mus musculus
gtggccaacaagaaaagtcaggacc

SEQ ID NO: 47496 - DNA, 25 bp, Mus musculus
gtggccaataggttgactggaaatt

SEQ ID NO: 47497 - DNA, 25 bp, Mus musculus
gtggccaccctgacggctgcctgtg

SEQ ID NO: 47498 - DNA, 25 bp, Mus musculus
gtggccacggtgaagtacggttcaa

SEQ ID NO: 47499 - DNA, 25 bp, Mus musculus
gtggccactttgtggccctcaagag

SEQ ID NO: 47500 - DNA, 25 bp, Mus musculus
gtggccagaagcacctgggcttgcc

SEQ ID NO: 47501 - DNA, 25 bp, Mus musculus
gtggccagaagcagcgcctagccat

SEQ ID NO: 47502 - DNA, 25 bp, Mus musculus
gtggccagggaaacaggcgcttaaa

SEQ ID NO: 47503 - DNA, 25 bp, Mus musculus
gtggccagggaatcaggcgcttaaa

SEQ ID NO: 47504 - DNA, 25 bp, Mus musculus
gtggccatcaaagtaatctcccgga

SEQ ID NO: 47505 - DNA, 25 bp, Mus musculus
gtggcccacggcaacggagagaact

SEQ ID NO: 47506 - DNA, 25 bp, Mus musculus
gtggcccagccatgctgaaaccaaa

SEQ ID NO: 47507 - DNA, 25 bp, Mus musculus
gtggcccaggaacacaaagctcata

SEQ ID NO: 47508 - DNA, 25 bp, Mus musculus
gtggcccaggtgctcaagtcttccg

SEQ ID NO: 47509 - DNA, 25 bp, Mus musculus
gtggcccctgctgttgagtgcacaa

SEQ ID NO: 47510 - DNA, 25 bp, Mus musculus
gtggcccggagtttgctggatactc

SEQ ID NO: 47511 - DNA, 25 bp, Mus musculus
gtggccctcagcagtcggcgtcttt

SEQ ID NO: 47512 - DNA, 25 bp, Mus musculus
gtggccggcaagagtcagtatcttc

SEQ ID NO: 47513 - DNA, 25 bp, Mus musculus
gtggcctaggactcattgtgtggac

SEQ ID NO: 47514 - DNA, 25 bp, Mus musculus
gtggcctcgcgctgtgagtatacaa

SEQ ID NO: 47515 - DNA, 25 bp, Mus musculus
gtggcctgcacacagaggcttccca

SEQ ID NO: 47516 - DNA, 25 bp, Mus musculus
gtggcctggcctatctgaatggttc

SEQ ID NO: 47517 - DNA, 25 bp, Mus musculus
gtggccttctcatgctcctgctttt

SEQ ID NO: 47518 - DNA, 25 bp, Mus musculus
gtggccttgattgcttcgtcctgaa

SEQ ID NO: 47519 - DNA, 25 bp, Mus musculus
gtggccttgccagaacagatatagt

SEQ ID NO: 47520 - DNA, 25 bp, Mus musculus
gtggcgatgctgaaagccttgtacc

SEQ ID NO: 47521 - DNA, 25 bp, Mus musculus
gtggcgctacttccgagactacttt

SEQ ID NO: 47522 - DNA, 25 bp, Mus musculus
gtggcgggctacatcacctacctgt

SEQ ID NO: 47523 - DNA, 25 bp, Mus musculus
gtggctacagtgagccagtatttcc

SEQ ID NO: 47524 - DNA, 25 bp, Mus musculus
gtggctacccaactcttaagatctt

SEQ ID NO: 47525 - DNA, 25 bp, Mus musculus
gtggctacccatgactactatcggc

SEQ ID NO: 47526 - DNA, 25 bp, Mus musculus
gtggctaccccacaatcaagttctt

SEQ ID NO: 47527 - DNA, 25 bp, Mus musculus
gtggctatgacagagaatacttgaa

SEQ ID NO: 47528 - DNA, 25 bp, Mus musculus
gtggctctaccatctctacatcaaa

SEQ ID NO: 47529 - DNA, 25 bp, Mus musculus
gtggctctgcaacacaacagtctaa

SEQ ID NO: 47530 - DNA, 25 bp, Mus musculus
gtggctcttcatcatttcccagcag

SEQ ID NO: 47531 - DNA, 25 bp, Mus musculus
gtggctcttcatgatttcccagcag

SEQ ID NO: 47532 - DNA, 25 bp, Mus musculus
gtggctgacactaaagactttgtag

SEQ ID NO: 47533 - DNA, 25 bp, Mus musculus
gtggctgaggcaaagactccaaagc

SEQ ID NO: 47534 - DNA, 25 bp, Mus musculus
gtggctgcattgttcaaccatttga

SEQ ID NO: 47535 - DNA, 25 bp, Mus musculus
gtggctgccgcatggaacgtctgca

SEQ ID NO: 47536 - DNA, 25 bp, Mus musculus
gtggctgcgtttgcccagtttggtt

SEQ ID NO: 47537 - DNA, 25 bp, Mus musculus
gtggctggatccaaacaaaccaata

SEQ ID NO: 47538 - DNA, 25 bp, Mus musculus
gtggctgtcatctgcctgggagttc

SEQ ID NO: 47539 - DNA, 25 bp, Mus musculus
gtggctgtcggcctgcagatttcaa

SEQ ID NO: 47540 - DNA, 25 bp, Mus musculus
gtggctgtgaatggcgttcacctgc

SEQ ID NO: 47541 - DNA, 25 bp, Mus musculus
gtggctgtgcacttcacccaggacg

SEQ ID NO: 47542 - DNA, 25 bp, Mus musculus
gtggcttattagatcacttctcaac

SEQ ID NO: 47543 - DNA, 25 bp, Mus musculus
gtggcttcccgcagattgagattaa

SEQ ID NO: 47544 - DNA, 25 bp, Mus musculus
gtggcttcttccgtcggaacagtcc

SEQ ID NO: 47545 - DNA, 25 bp, Mus musculus
gtggctttcatgacgttgacgctgt

SEQ ID NO: 47546 - DNA, 25 bp, Mus musculus
gtgggaacagcctccaggataccaa

SEQ ID NO: 47547 - DNA, 25 bp, Mus musculus
gtgggaagtctgtgctcctctttgg

SEQ ID NO: 47548 - DNA, 25 bp, Mus musculus
gtgggaatcgataaagacaaaccca

SEQ ID NO: 47549 - DNA, 25 bp, Mus musculus
gtgggacacagacccctcagtgctc

SEQ ID NO: 47550 - DNA, 25 bp, Mus musculus
gtgggacatggacgcagcctcctca

SEQ ID NO: 47551 - DNA, 25 bp, Mus musculus
gtgggaccattttcataaggaatct

SEQ ID NO: 47552 - DNA, 25 bp, Mus musculus
gtgggagcccagagtcgtcgctaca

SEQ ID NO: 47553 - DNA, 25 bp, Mus musculus
gtgggagcccagtgtcgtcgctaca

SEQ ID NO: 47554 - DNA, 25 bp, Mus musculus
gtgggagcccgaagaaaatattctg

SEQ ID NO: 47555 - DNA, 25 bp, Mus musculus
gtgggataacctgggctctctgaca

SEQ ID NO: 47556 - DNA, 25 bp, Mus musculus
gtgggatctcatcaggatatcactg

SEQ ID NO: 47557 - DNA, 25 bp, Mus musculus
gtgggatgaagcactacagctaacc

SEQ ID NO: 47558 - DNA, 25 bp, Mus musculus
gtgggattcccactaactacaaggg

SEQ ID NO: 47559 - DNA, 25 bp, Mus musculus
gtgggcagaagcagcgcatcgccat

SEQ ID NO: 47560 - DNA, 25 bp, Mus musculus
gtgggcatgtccctaaagattcaga

SEQ ID NO: 47561 - DNA, 25 bp, Mus musculus
gtgggccgtgttccataagttcaaa

SEQ ID NO: 47562 - DNA, 25 bp, Mus musculus
gtgggccgtgttgcataagttcaaa

SEQ ID NO: 47563 - DNA, 25 bp, Mus musculus
gtgggcctgatagcgagcactgcca

SEQ ID NO: 47564 - DNA, 25 bp, Mus musculus
gtgggctagttatgccccggatcct

SEQ ID NO: 47565 - DNA, 25 bp, Mus musculus
gtgggctctgagaagctctttgccc

SEQ ID NO: 47566 - DNA, 25 bp, Mus musculus
gtgggctctgtgcagtgggccggca

SEQ ID NO: 47567 - DNA, 25 bp, Mus musculus
gtgggggccacatcctccttctcag

SEQ ID NO: 47568 - DNA, 25 bp, Mus musculus
gtgggtacaggagtcgccctagtta

SEQ ID NO: 47569 - DNA, 25 bp, Mus musculus
gtgggtattgtgcaccctccttctc

SEQ ID NO: 47570 - DNA, 25 bp, Mus musculus
gtgggtcaacaaacaccttatcaag

SEQ ID NO: 47571 - DNA, 25 bp, Mus musculus
gtgggtgacatcaccatcctggtga

SEQ ID NO: 47572 - DNA, 25 bp, Mus musculus
gtgggtgacctaccccaagctttgt

SEQ ID NO: 47573 - DNA, 25 bp, Mus musculus
gtgggtgttgcatgctgcccctccc

SEQ ID NO: 47574 - DNA, 25 bp, Mus musculus
gtgggttctgtagcaggcttcactc

SEQ ID NO: 47575 - DNA, 25 bp, Mus musculus
gtggtaatgataccattgatgaaga

SEQ ID NO: 47576 - DNA, 25 bp, Mus musculus
gtggtacagttcaagatcaagaggc

SEQ ID NO: 47577 - DNA, 25 bp, Mus musculus
gtggtaccggcgtgtgtacaagtcc

SEQ ID NO: 47578 - DNA, 25 bp, Mus musculus
gtggtaccggtggattccaaacgct

SEQ ID NO: 47579 - DNA, 25 bp, Mus musculus
gtggtagcagctacagtggctccag

SEQ ID NO: 47580 - DNA, 25 bp, Mus musculus
gtggtatatcagacagcattcagac

SEQ ID NO: 47581 - DNA, 25 bp, Mus musculus
gtggtatcctcatgacactggcatg

SEQ ID NO: 47582 - DNA, 25 bp, Mus musculus
gtggtatctcacaacacagccgatt

SEQ ID NO: 47583 - DNA, 25 bp, Mus musculus
gtggtattctaactccttggctcag

SEQ ID NO: 47584 - DNA, 25 bp, Mus musculus
gtggtcaagcaaggccatgagccag

SEQ ID NO: 47585 - DNA, 25 bp, Mus musculus
gtggtcaaggtcttctctctagctg

SEQ ID NO: 47586 - DNA, 25 bp, Mus musculus
gtggtcaccatggagcactctgcga

SEQ ID NO: 47587 - DNA, 25 bp, Mus musculus
gtggtcaccctggatgccctgtctg

SEQ ID NO: 47588 - DNA, 25 bp, Mus musculus
gtggtcacgctgaagaaaatgctgc

SEQ ID NO: 47589 - DNA, 25 bp, Mus musculus
gtggtcataaatacaaacgtgggca

SEQ ID NO: 47590 - DNA, 25 bp, Mus musculus
gtggtccaccttactttttatcctg

SEQ ID NO: 47591 - DNA, 25 bp, Mus musculus
gtggtccttcagcaccatcagcagc

SEQ ID NO: 47592 - DNA, 25 bp, Mus musculus
gtggtcgagccgctctacatagaag

SEQ ID NO: 47593 - DNA, 25 bp, Mus musculus
gtggtcgtgcctgttccacagagcc

SEQ ID NO: 47594 - DNA, 25 bp, Mus musculus
gtggtcgttataggcatttccgtgg

SEQ ID NO: 47595 - DNA, 25 bp, Mus musculus
gtggtctacttcaccgcatcgatgc

SEQ ID NO: 47596 - DNA, 25 bp, Mus musculus
gtggtctatttcaccacgtcactgc

SEQ ID NO: 47597 - DNA, 25 bp, Mus musculus
gtggtcttgaatttaggacagtcct

SEQ ID NO: 47598 - DNA, 25 bp, Mus musculus
gtggtgacgactgtaccacctgtgt

SEQ ID NO: 47599 - DNA, 25 bp, Mus musculus
gtggtgacgttcctcatgtctgccc

SEQ ID NO: 47600 - DNA, 25 bp, Mus musculus
gtggtgactctgtgccagccaaacc

SEQ ID NO: 47601 - DNA, 25 bp, Mus musculus
gtggtgcagagcatgtatatcttta

SEQ ID NO: 47602 - DNA, 25 bp, Mus musculus
gtggtgcagatcgacaatgccaagc

SEQ ID NO: 47603 - DNA, 25 bp, Mus musculus
gtggtgccactcagcaaattctgga

SEQ ID NO: 47604 - DNA, 25 bp, Mus musculus
gtggtgcccatggtaatatcggttt

SEQ ID NO: 47605 - DNA, 25 bp, Mus musculus
gtggtgctggttcctctccacacca

SEQ ID NO: 47606 - DNA, 25 bp, Mus musculus
gtggtggaggagagctacttcaaca

SEQ ID NO: 47607 - DNA, 25 bp, Mus musculus
gtggtggagtcttccaggctatcaa

SEQ ID NO: 47608 - DNA, 25 bp, Mus musculus
gtggtggccttgaatcgcaggactt

SEQ ID NO: 47609 - DNA, 25 bp, Mus musculus
gtggtggtcgctatgttccaggaac

SEQ ID NO: 47610 - DNA, 25 bp, Mus musculus
gtggtggtgcagagcatgtatatct

SEQ ID NO: 47611 - DNA, 25 bp, Mus musculus
gtggttaccatcacaatcatgccta

SEQ ID NO: 47612 - DNA, 25 bp, Mus musculus
gtggttagaaacgtgtattacaagt

SEQ ID NO: 47613 - DNA, 25 bp, Mus musculus
gtggttatcctcacctgctccctgt

SEQ ID NO: 47614 - DNA, 25 bp, Mus musculus
gtggttatctccacaggcgcctcag

SEQ ID NO: 47615 - DNA, 25 bp, Mus musculus
gtggttatctcctcaggcgcctcag

SEQ ID NO: 47616 - DNA, 25 bp, Mus musculus
gtggttccatcaccttccaaaatgt

SEQ ID NO: 47617 - DNA, 25 bp, Mus musculus
gtggttctcagcttgtggcgttaaa

SEQ ID NO: 47618 - DNA, 25 bp, Mus musculus
gtggttctgtgtttcacgttcaagc

SEQ ID NO: 47619 - DNA, 25 bp, Mus musculus
gtggttgctccaaaatcacaaagtt

SEQ ID NO: 47620 - DNA, 25 bp, Mus musculus
gtggttgctgtctccaggaatatgc

SEQ ID NO: 47621 - DNA, 25 bp, Mus musculus
gtggttgtaagccttgcatatgtac

SEQ ID NO: 47622 - DNA, 25 bp, Mus musculus
gtggtttcacctccctgccgctgtg

SEQ ID NO: 47623 - DNA, 25 bp, Mus musculus
gtggtttcacctgcctgccgctgtg

SEQ ID NO: 47624 - DNA, 25 bp, Mus musculus
gtggtttcactccagatgaactgct

SEQ ID NO: 47625 - DNA, 25 bp, Mus musculus
gtgtaaatatccctgcctctccatt

SEQ ID NO: 47626 - DNA, 25 bp, Mus musculus
gtgtaaatcattgtcacctaaatgg

SEQ ID NO: 47627 - DNA, 25 bp, Mus musculus
gtgtaaatgcagttgaatatggcac

SEQ ID NO: 47628 - DNA, 25 bp, Mus musculus
gtgtacacaccaccggccatgaaag

SEQ ID NO: 47629 - DNA, 25 bp, Mus musculus
gtgtacacgtacatccaggagttct

SEQ ID NO: 47630 - DNA, 25 bp, Mus musculus
gtgtacagtcatcccttagctgtgg

SEQ ID NO: 47631 - DNA, 25 bp, Mus musculus
gtgtacatccaccatttcgaccgca

SEQ ID NO: 47632 - DNA, 25 bp, Mus musculus
gtgtacatgactgcacatgcctaag

SEQ ID NO: 47633 - DNA, 25 bp, Mus musculus
gtgtagaccacgctgtcctcgagct

SEQ ID NO: 47634 - DNA, 25 bp, Mus musculus
gtgtagatggccgagatggaatacc

SEQ ID NO: 47635 - DNA, 25 bp, Mus musculus
gtgtagcccggatcctaacccatga

SEQ ID NO: 47636 - DNA, 25 bp, Mus musculus
gtgtagtactaaaccaagcctttgg

SEQ ID NO: 47637 - DNA, 25 bp, Mus musculus
gtgtagtggatcagaccaaagatgg

SEQ ID NO: 47638 - DNA, 25 bp, Mus musculus
gtgtagttggccaacaagcaacaga

SEQ ID NO: 47639 - DNA, 25 bp, Mus musculus
gtgtatatcaaaacacagtttcgtg

SEQ ID NO: 47640 - DNA, 25 bp, Mus musculus
gtgtatcatccctactctgcagata

SEQ ID NO: 47641 - DNA, 25 bp, Mus musculus
gtgtatctgcacagtggtcgccccc

SEQ ID NO: 47642 - DNA, 25 bp, Mus musculus
gtgtatgcccagctgtgcccagcac

SEQ ID NO: 47643 - DNA, 25 bp, Mus musculus
gtgtatgcccaggtgtgcccagcac

SEQ ID NO: 47644 - DNA, 25 bp, Mus musculus
gtgtcaaacgctaccgccagagcat

SEQ ID NO: 47645 - DNA, 25 bp, Mus musculus
gtgtcaaacgcttccgccagagcat

SEQ ID NO: 47646 - DNA, 25 bp, Mus musculus
gtgtcaacgtgaggctggaagactt

SEQ ID NO: 47647 - DNA, 25 bp, Mus musculus
gtgtcacaaccgttgacctgaaaag

SEQ ID NO: 47648 - DNA, 25 bp, Mus musculus
gtgtcacagtacaagaaacaaaaga

SEQ ID NO: 47649 - DNA, 25 bp, Mus musculus
gtgtcaccaaaatctacaactacta

SEQ ID NO: 47650 - DNA, 25 bp, Mus musculus
gtgtcaccaccccaataaacttaga

SEQ ID NO: 47651 - DNA, 25 bp, Mus musculus
gtgtcaccgaccttgccttcaaagt

SEQ ID NO: 47652 - DNA, 25 bp, Mus musculus
gtgtcactcactcaaggaaagcttc

SEQ ID NO: 47653 - DNA, 25 bp, Mus musculus
gtgtcactgggctgaatggtaacct

SEQ ID NO: 47654 - DNA, 25 bp, Mus musculus
gtgtcagaccagttctatcgctaca

SEQ ID NO: 47655 - DNA, 25 bp, Mus musculus
gtgtccactcccctagcctatagtt

SEQ ID NO: 47656 - DNA, 25 bp, Mus musculus
gtgtcccaatgtcgctctgacccaa

SEQ ID NO: 47657 - DNA, 25 bp, Mus musculus
gtgtccccatgacttctctctcgga

SEQ ID NO: 47658 - DNA, 25 bp, Mus musculus
gtgtccctctccatgaaagttgtca

SEQ ID NO: 47659 - DNA, 25 bp, Mus musculus
gtgtccgcaaatatggtaaagattt

SEQ ID NO: 47660 - DNA, 25 bp, Mus musculus
gtgtccggaagtggcttcccgcaga

SEQ ID NO: 47661 - DNA, 25 bp, Mus musculus
gtgtcctcaacaatgacacccctga

SEQ ID NO: 47662 - DNA, 25 bp, Mus musculus
gtgtcctcaatacccatccatgttg

SEQ ID NO: 47663 - DNA, 25 bp, Mus musculus
gtgtcctctcctaccggcgatttcg

SEQ ID NO: 47664 - DNA, 25 bp, Mus musculus
gtgtcctctccttccggcgatttcg

SEQ ID NO: 47665 - DNA, 25 bp, Mus musculus
gtgtcctctggaagcccagcagctt

SEQ ID NO: 47666 - DNA, 25 bp, Mus musculus
gtgtcctgctcctggtgctggtggc

SEQ ID NO: 47667 - DNA, 25 bp, Mus musculus
gtgtcctggagacacggagccccaa

SEQ ID NO: 47668 - DNA, 25 bp, Mus musculus
gtgtcctggagcagctcaatgtcat

SEQ ID NO: 47669 - DNA, 25 bp, Mus musculus
gtgtcgacttcgcaaatgccgccag

SEQ ID NO: 47670 - DNA, 25 bp, Mus musculus
gtgtcgctgtgctcaggtctccagg

SEQ ID NO: 47671 - DNA, 25 bp, Mus musculus
gtgtcggacgacactgaggacacag

SEQ ID NO: 47672 - DNA, 25 bp, Mus musculus
gtgtcgtggaggtgtctttgactcc

SEQ ID NO: 47673 - DNA, 25 bp, Mus musculus
gtgtcgtgtctggagaaggaaacca

SEQ ID NO: 47674 - DNA, 25 bp, Mus musculus
gtgtctaagcactggatccgggccc

SEQ ID NO: 47675 - DNA, 25 bp, Mus musculus
gtgtctatgctcagctcatggttca

SEQ ID NO: 47676 - DNA, 25 bp, Mus musculus
gtgtctcaagcaaaaccatgaggag

SEQ ID NO: 47677 - DNA, 25 bp, Mus musculus
gtgtctccagctcctctcaaaagga

SEQ ID NO: 47678 - DNA, 25 bp, Mus musculus
gtgtctcctaccagcattcacacag

SEQ ID NO: 47679 - DNA, 25 bp, Mus musculus
gtgtctctggttggtttcctcttcc

SEQ ID NO: 47680 - DNA, 25 bp, Mus musculus
gtgtctgaacaaccttgcggcctca

SEQ ID NO: 47681 - DNA, 25 bp, Mus musculus
gtgtctgagtcttctgtaaacaaga

SEQ ID NO: 47682 - DNA, 25 bp, Mus musculus
gtgtctgcatactcttcacctagcc

SEQ ID NO: 47683 - DNA, 25 bp, Mus musculus
gtgtctgccactgcaatgccggcta

SEQ ID NO: 47684 - DNA, 25 bp, Mus musculus
gtgtctggaataacgggtcctcact

SEQ ID NO: 47685 - DNA, 25 bp, Mus musculus
gtgtctgtaaacgttctgtccctcc

SEQ ID NO: 47686 - DNA, 25 bp, Mus musculus
gtgtctgtggcttccctgggactaa

SEQ ID NO: 47687 - DNA, 25 bp, Mus musculus
gtgtctgtgttcctggctcccagtg

SEQ ID NO: 47688 - DNA, 25 bp, Mus musculus
gtgtcttctgtagtattaccaggag

SEQ ID NO: 47689 - DNA, 25 bp, Mus musculus
gtgtcttgcagggagatggaacaca

SEQ ID NO: 47690 - DNA, 25 bp, Mus musculus
gtgtgaaagcctccttcccttcagc

SEQ ID NO: 47691 - DNA, 25 bp, Mus musculus
gtgtgaacacagaaggctccttcca

SEQ ID NO: 47692 - DNA, 25 bp, Mus musculus
gtgtgaacacagtaggctccttcca

SEQ ID NO: 47693 - DNA, 25 bp, Mus musculus
gtgtgaacatggctacgcctcatcg

SEQ ID NO: 47694 - DNA, 25 bp, Mus musculus
gtgtgaacccatagtgcctccacca

SEQ ID NO: 47695 - DNA, 25 bp, Mus musculus
gtgtgaagcgatagcccgtaaccct

SEQ ID NO: 47696 - DNA, 25 bp, Mus musculus
gtgtgacaaaatctccttggagaga

SEQ ID NO: 47697 - DNA, 25 bp, Mus musculus
gtgtgacaacgggttttcaccacct

SEQ ID NO: 47698 - DNA, 25 bp, Mus musculus
gtgtgacagccgtgccaactgcatc

SEQ ID NO: 47699 - DNA, 25 bp, Mus musculus
gtgtgaccagtaccgcaccatcctg

SEQ ID NO: 47700 - DNA, 25 bp, Mus musculus
gtgtgactctccatatcaacttatt

SEQ ID NO: 47701 - DNA, 25 bp, Mus musculus
gtgtgactctgggtttaacaaacag

SEQ ID NO: 47702 - DNA, 25 bp, Mus musculus
gtgtgagaaggaggctcatctacag

SEQ ID NO: 47703 - DNA, 25 bp, Mus musculus
gtgtgaggccagtgcacctttgacc

SEQ ID NO: 47704 - DNA, 25 bp, Mus musculus
gtgtgagtcaccagtagagaccgta

SEQ ID NO: 47705 - DNA, 25 bp, Mus musculus
gtgtgagtgccatccgtgagcgcct

SEQ ID NO: 47706 - DNA, 25 bp, Mus musculus
gtgtgatcaatgctatgtttgccaa

SEQ ID NO: 47707 - DNA, 25 bp, Mus musculus
gtgtgatcctcctgtcccagctgct

SEQ ID NO: 47708 - DNA, 25 bp, Mus musculus
gtgtgatcggcctctgtgctgcccg

SEQ ID NO: 47709 - DNA, 25 bp, Mus musculus
gtgtgatctcactctcaggagagca

SEQ ID NO: 47710 - DNA, 25 bp, Mus musculus
gtgtgatgggtccaatggatctttc

SEQ ID NO: 47711 - DNA, 25 bp, Mus musculus
gtgtgattgtacacgcacgggctac

SEQ ID NO: 47712 - DNA, 25 bp, Mus musculus
gtgtgattgtactcgcacgggctac

SEQ ID NO: 47713 - DNA, 25 bp, Mus musculus
gtgtgcagtacgtggagacatctgc

SEQ ID NO: 47714 - DNA, 25 bp, Mus musculus
gtgtgcatgccatatcgacagatag

SEQ ID NO: 47715 - DNA, 25 bp, Mus musculus
gtgtgcatgtgcctaccgcccaggt

SEQ ID NO: 47716 - DNA, 25 bp, Mus musculus
gtgtgcccaaggaaaacatactcct

SEQ ID NO: 47717 - DNA, 25 bp, Mus musculus
gtgtgcccagcgagtatacctaccg

SEQ ID NO: 47718 - DNA, 25 bp, Mus musculus
gtgtgcccctgaagtgacccagcct

SEQ ID NO: 47719 - DNA, 25 bp, Mus musculus
gtgtgcctccaggataataatggac

SEQ ID NO: 47720 - DNA, 25 bp, Mus musculus
gtgtgctcccttatgtccatcttca

SEQ ID NO: 47721 - DNA, 25 bp, Mus musculus
gtgtgctcccttttgtccatcttca

SEQ ID NO: 47722 - DNA, 25 bp, Mus musculus
gtgtgctgtgtttggtggaatctat

SEQ ID NO: 47723 - DNA, 25 bp, Mus musculus
gtgtggaccacctagtgctgaccgt

SEQ ID NO: 47724 - DNA, 25 bp, Mus musculus
gtgtggacccagctacccgttagcg

SEQ ID NO: 47725 - DNA, 25 bp, Mus musculus
gtgtggactgtgtcaataagacaga

SEQ ID NO: 47726 - DNA, 25 bp, Mus musculus
gtgtggagaagacagcatgaacttc

SEQ ID NO: 47727 - DNA, 25 bp, Mus musculus
gtgtggagcatccagccccgactgt

SEQ ID NO: 47728 - DNA, 25 bp, Mus musculus
gtgtggaggtacaactggctcctcg

SEQ ID NO: 47729 - DNA, 25 bp, Mus musculus
gtgtggagttcctgcctgcgaacaa

SEQ ID NO: 47730 - DNA, 25 bp, Mus musculus
gtgtggcaccttaaatcgtcttcga

SEQ ID NO: 47731 - DNA, 25 bp, Mus musculus
gtgtggcacctttaatcgtcttcga

SEQ ID NO: 47732 - DNA, 25 bp, Mus musculus
gtgtggcccaccagtgttaccatgg

SEQ ID NO: 47733 - DNA, 25 bp, Mus musculus
gtgtggcgctatgggtttcagtccc

SEQ ID NO: 47734 - DNA, 25 bp, Mus musculus
gtgtggctcatagcccgtaccgtca

SEQ ID NO: 47735 - DNA, 25 bp, Mus musculus
gtgtgggaacaagcagttcttcgct

SEQ ID NO: 47736 - DNA, 25 bp, Mus musculus
gtgtgggccgcctcagcccctgtgt

SEQ ID NO: 47737 - DNA, 25 bp, Mus musculus
gtgtgggctcctactcctgcctctg

SEQ ID NO: 47738 - DNA, 25 bp, Mus musculus
gtgtgggctccttctcctgcctctg

SEQ ID NO: 47739 - DNA, 25 bp, Mus musculus
gtgtgggtgtggacttcattgacca

SEQ ID NO: 47740 - DNA, 25 bp, Mus musculus
gtgtggtacacctgtgctaacctgc

SEQ ID NO: 47741 - DNA, 25 bp, Mus musculus
gtgtggtaccacagcgacgaacaaa

SEQ ID NO: 47742 - DNA, 25 bp, Mus musculus
gtgtggtcacgtgtccatgtggcct

SEQ ID NO: 47743 - DNA, 25 bp, Mus musculus
gtgtggtccggtgttcctgcagaaa

SEQ ID NO: 47744 - DNA, 25 bp, Mus musculus
gtgtggtctccttatcacagtatcc

SEQ ID NO: 47745 - DNA, 25 bp, Mus musculus
gtgtggtgaccctgctgtctgacta

SEQ ID NO: 47746 - DNA, 25 bp, Mus musculus
gtgtggtggcctgattgcttttgcc

SEQ ID NO: 47747 - DNA, 25 bp, Mus musculus
gtgtggttgaactgcccacttccct

SEQ ID NO: 47748 - DNA, 25 bp, Mus musculus
gtgtgtaaagccaacgagccctgca

SEQ ID NO: 47749 - DNA, 25 bp, Mus musculus
gtgtgtacaagtccctctgtcccgt

SEQ ID NO: 47750 - DNA, 25 bp, Mus musculus
gtgtgtccagtcgaagcaccttcca

SEQ ID NO: 47751 - DNA, 25 bp, Mus musculus
gtgtgtcggcgagaagcgtatcatc

SEQ ID NO: 47752 - DNA, 25 bp, Mus musculus
gtgtgtgatcaatgctatgtttgcc

SEQ ID NO: 47753 - DNA, 25 bp, Mus musculus
gtgtgtgccttatgctgtcatcgaa

SEQ ID NO: 47754 - DNA, 25 bp, Mus musculus
gtgtgtggccaaggaacggaaccca

SEQ ID NO: 47755 - DNA, 25 bp, Mus musculus
gtgtgttatccacgctgctgcctca

SEQ ID NO: 47756 - DNA, 25 bp, Mus musculus
gtgttattgtaaccctttgggctca

SEQ ID NO: 47757 - DNA, 25 bp, Mus musculus
gtgttcaaatgcaagctattccaga

SEQ ID NO: 47758 - DNA, 25 bp, Mus musculus
gtgttcaacccactcttctggaatg

SEQ ID NO: 47759 - DNA, 25 bp, Mus musculus
gtgttcaatttcctactcctgacat

SEQ ID NO: 47760 - DNA, 25 bp, Mus musculus
gtgttcacaatcctgttatgacaag

SEQ ID NO: 47761 - DNA, 25 bp, Mus musculus
gtgttcccttctctaggcacttcgg

SEQ ID NO: 47762 - DNA, 25 bp, Mus musculus
gtgttccgaaagctgcccttccagg

SEQ ID NO: 47763 - DNA, 25 bp, Mus musculus
gtgttcgaatttgctctaggaatct

SEQ ID NO: 47764 - DNA, 25 bp, Mus musculus
gtgttctttggcatttcccactggt

SEQ ID NO: 47765 - DNA, 25 bp, Mus musculus
gtgttctttggcttttcccactggt

SEQ ID NO: 47766 - DNA, 25 bp, Mus musculus
gtgttgacttcgctttgcatcaggg

SEQ ID NO: 47767 - DNA, 25 bp, Mus musculus
gtgttgcaaaagctgttgaatgccc

SEQ ID NO: 47768 - DNA, 25 bp, Mus musculus
gtgttgcccaatccctacatgatcc

SEQ ID NO: 47769 - DNA, 25 bp, Mus musculus
gtgttgcccaatgcctacatgatcc

SEQ ID NO: 47770 - DNA, 25 bp, Mus musculus
gtgttgcccaccaaccccgaggaga

SEQ ID NO: 47771 - DNA, 25 bp, Mus musculus
gtgttgcgcacagtccctctgctag

SEQ ID NO: 47772 - DNA, 25 bp, Mus musculus
gtgttggtcattgcccaccggctta

SEQ ID NO: 47773 - DNA, 25 bp, Mus musculus
gtgttgtaaaacatccagccttaga

SEQ ID NO: 47774 - DNA, 25 bp, Mus musculus
gtgttgtaaaacttcctccagggat

SEQ ID NO: 47775 - DNA, 25 bp, Mus musculus
gtgttgtacacttcctgaagatcag

SEQ ID NO: 47776 - DNA, 25 bp, Mus musculus
gtgtttaactggactcactggagtg

SEQ ID NO: 47777 - DNA, 25 bp, Mus musculus
gtgtttctgtctgtgcccatttgga

SEQ ID NO: 47778 - DNA, 25 bp, Mus musculus
gtgtttgccaacaacgaccccttct

SEQ ID NO: 47779 - DNA, 25 bp, Mus musculus
gtgtttggatttgtgacaacatctc

SEQ ID NO: 47780 - DNA, 25 bp, Mus musculus
gtgtttggtaccaggaaggcctgca

SEQ ID NO: 47781 - DNA, 25 bp, Mus musculus
gtgtttgtggctgtcctggatatca

SEQ ID NO: 47782 - DNA, 25 bp, Mus musculus
gtgttttcagaaagttgcagcagaa

SEQ ID NO: 47783 - DNA, 25 bp, Mus musculus
gtgttttccattgtaccctgtgtgc

SEQ ID NO: 47784 - DNA, 25 bp, Mus musculus
gtgttttctattacgtgcattgact

SEQ ID NO: 47785 - DNA, 25 bp, Mus musculus
gttaaaaaagacattgagtgacgta

SEQ ID NO: 47786 - DNA, 25 bp, Mus musculus
gttaaaagtggctccgccagcctgg

SEQ ID NO: 47787 - DNA, 25 bp, Mus musculus
gttaaaataattcccgtgaagacag

SEQ ID NO: 47788 - DNA, 25 bp, Mus musculus
gttaaacatcttatcctggtggatc

SEQ ID NO: 47789 - DNA, 25 bp, Mus musculus
gttaaacgatggataaatgaagccc

SEQ ID NO: 47790 - DNA, 25 bp, Mus musculus
gttaaagagtctttcaaggatgatc

SEQ ID NO: 47791 - DNA, 25 bp, Mus musculus
gttaaagcaacaaatggaccaagat

SEQ ID NO: 47792 - DNA, 25 bp, Mus musculus
gttaaagcctccattctccatgaag

SEQ ID NO: 47793 - DNA, 25 bp, Mus musculus
gttaaaggaaaaccttacagctcag

SEQ ID NO: 47794 - DNA, 25 bp, Mus musculus
gttaaaggaaaagcttacagctcag

SEQ ID NO: 47795 - DNA, 25 bp, Mus musculus
gttaaatacctgtgtattccagcgg

SEQ ID NO: 47796 - DNA, 25 bp, Mus musculus
gttaacaagcaggaaacctggatga

SEQ ID NO: 47797 - DNA, 25 bp, Mus musculus
gttaacaagcctgctctgacaaagg

SEQ ID NO: 47798 - DNA, 25 bp, Mus musculus
gttaacaccacggacaaagagattg

SEQ ID NO: 47799 - DNA, 25 bp, Mus musculus
gttaaccacagcgaggacacagcaa

SEQ ID NO: 47800 - DNA, 25 bp, Mus musculus
gttaacttcggctgaatcacaacca

SEQ ID NO: 47801 - DNA, 25 bp, Mus musculus
gttaagaggttgctccagggacaca

SEQ ID NO: 47802 - DNA, 25 bp, Mus musculus
gttaagattaactcttcagacaacg

SEQ ID NO: 47803 - DNA, 25 bp, Mus musculus
gttaagatttcttcagcctcctgat

SEQ ID NO: 47804 - DNA, 25 bp, Mus musculus
gttaagccctagtgcaggagccaca

SEQ ID NO: 47805 - DNA, 25 bp, Mus musculus
gttaagccgagaccggaagtactgc

SEQ ID NO: 47806 - DNA, 25 bp, Mus musculus
gttaagctggcactggccgtttttg

SEQ ID NO: 47807 - DNA, 25 bp, Mus musculus
gttaaggaggatacactttccacag

SEQ ID NO: 47808 - DNA, 25 bp, Mus musculus
gttaataagaatggccatgctgtgc

SEQ ID NO: 47809 - DNA, 25 bp, Mus musculus
gttaatatccgacaaagggataact

SEQ ID NO: 47810 - DNA, 25 bp, Mus musculus
gttaatgaggacacttactctgggt

SEQ ID NO: 47811 - DNA, 25 bp, Mus musculus
gttaatggagccagctacccatact

SEQ ID NO: 47812 - DNA, 25 bp, Mus musculus
gttaatggagcctgctacccatact

SEQ ID NO: 47813 - DNA, 25 bp, Mus musculus
gttaattctaggaggatcaccttac

SEQ ID NO: 47814 - DNA, 25 bp, Mus musculus
gttaattggccctgctgaagcttac

SEQ ID NO: 47815 - DNA, 25 bp, Mus musculus
gttacaaaacaactactgctttggg

SEQ ID NO: 47816 - DNA, 25 bp, Mus musculus
gttacaacctgccatattcattcat

SEQ ID NO: 47817 - DNA, 25 bp, Mus musculus
gttacaagcatatctcccattcagg

SEQ ID NO: 47818 - DNA, 25 bp, Mus musculus
gttacaagctgtgaatcagaaaaat

SEQ ID NO: 47819 - DNA, 25 bp, Mus musculus
gttacaagtaacgtccagagtcatc

SEQ ID NO: 47820 - DNA, 25 bp, Mus musculus
gttacaatggctgggcacactccat

SEQ ID NO: 47821 - DNA, 25 bp, Mus musculus
gttacaccctgcagccaatatccag

SEQ ID NO: 47822 - DNA, 25 bp, Mus musculus
gttacagagtcccagatcctaatta

SEQ ID NO: 47823 - DNA, 25 bp, Mus musculus
gttacagatcttatagcagtcggtt

SEQ ID NO: 47824 - DNA, 25 bp, Mus musculus
gttacagatggtttctaactgccgt

SEQ ID NO: 47825 - DNA, 25 bp, Mus musculus
gttacagctccgtggtccaggcctt

SEQ ID NO: 47826 - DNA, 25 bp, Mus musculus
gttacaggccctacgacgagggtct

SEQ ID NO: 47827 - DNA, 25 bp, Mus musculus
gttacagggatagcagtgtcttgca

SEQ ID NO: 47828 - DNA, 25 bp, Mus musculus
gttacaggtaaactaaaacagcact

SEQ ID NO: 47829 - DNA, 25 bp, Mus musculus
gttacagtctctagcttcgccatgt

SEQ ID NO: 47830 - DNA, 25 bp, Mus musculus
gttacatatccttcagtggcataga

SEQ ID NO: 47831 - DNA, 25 bp, Mus musculus
gttacatcggccctctgtccaggga

SEQ ID NO: 47832 - DNA, 25 bp, Mus musculus
gttacattgcccctgctttgtgcga

SEQ ID NO: 47833 - DNA, 25 bp, Mus musculus
gttaccaacagctcatggacttgaa

SEQ ID NO: 47834 - DNA, 25 bp, Mus musculus
gttaccagctcgctctcattggcgg

SEQ ID NO: 47835 - DNA, 25 bp, Mus musculus
gttaccagctcggtctcattggcgg

SEQ ID NO: 47836 - DNA, 25 bp, Mus musculus
gttaccatcacaatcatgcctactt

SEQ ID NO: 47837 - DNA, 25 bp, Mus musculus
gttaccccaactatgttgcagaatg

SEQ ID NO: 47838 - DNA, 25 bp, Mus musculus
gttacccggcaagggattgcgtccg

SEQ ID NO: 47839 - DNA, 25 bp, Mus musculus
gttaccggcgccagcgtcctggcta

SEQ ID NO: 47840 - DNA, 25 bp, Mus musculus
gttacctcaccatcgccatattggg

SEQ ID NO: 47841 - DNA, 25 bp, Mus musculus
gttacctctttccttagcggcagag

SEQ ID NO: 47842 - DNA, 25 bp, Mus musculus
gttacgaatgtgttggtgagccacc

SEQ ID NO: 47843 - DNA, 25 bp, Mus musculus
gttacgtcaatatggagaggcaccc

SEQ ID NO: 47844 - DNA, 25 bp, Mus musculus
gttactacatctctcctttctgcag

SEQ ID NO: 47845 - DNA, 25 bp, Mus musculus
gttactatccgtcccagaaccaggg

SEQ ID NO: 47846 - DNA, 25 bp, Mus musculus
gttactatccgtgccagaaccaggg

SEQ ID NO: 47847 - DNA, 25 bp, Mus musculus
gttactcatgaaaactcacccggag

SEQ ID NO: 47848 - DNA, 25 bp, Mus musculus
gttactctctcagtgctcagccggg

SEQ ID NO: 47849 - DNA, 25 bp, Mus musculus
gttactgactgctgtgcccctggtc

SEQ ID NO: 47850 - DNA, 25 bp, Mus musculus
gttactgatgtcaaggagaaactga

SEQ ID NO: 47851 - DNA, 25 bp, Mus musculus
gttactgatgtctaggagaaactga

SEQ ID NO: 47852 - DNA, 25 bp, Mus musculus
gttactggtattatagaaaatcagg

SEQ ID NO: 47853 - DNA, 25 bp, Mus musculus
gttactgtgacaaccgtcccaactt

SEQ ID NO: 47854 - DNA, 25 bp, Mus musculus
gttagaacacctgcaggagaaaacc

SEQ ID NO: 47855 - DNA, 25 bp, Mus musculus
gttagcagctgaattgttagaacac

SEQ ID NO: 47856 - DNA, 25 bp, Mus musculus
gttagcatcttagcagtgtattcca

SEQ ID NO: 47857 - DNA, 25 bp, Mus musculus
gttagcgatgcaactaagttaaggc

SEQ ID NO: 47858 - DNA, 25 bp, Mus musculus
gttagcgttcctcagctcctcattg

SEQ ID NO: 47859 - DNA, 25 bp, Mus musculus
gttagctaaagaacaccctcatgtt

SEQ ID NO: 47860 - DNA, 25 bp, Mus musculus
gttagctcttgccaaacctccttca

SEQ ID NO: 47861 - DNA, 25 bp, Mus musculus
gttagctgcctttttctgacacctg

SEQ ID NO: 47862 - DNA, 25 bp, Mus musculus
gttaggtagccccaacagaagctcg

SEQ ID NO: 47863 - DNA, 25 bp, Mus musculus
gttataggctccagttcactcctca

SEQ ID NO: 47864 - DNA, 25 bp, Mus musculus
gttatagtgcctcgcggagagaaaa

SEQ ID NO: 47865 - DNA, 25 bp, Mus musculus
gttatccattgcaaagacctgcggg

SEQ ID NO: 47866 - DNA, 25 bp, Mus musculus
gttatcccagacttaaataaagaga

SEQ ID NO: 47867 - DNA, 25 bp, Mus musculus
gttatccctggcagtcgatgggctg

SEQ ID NO: 47868 - DNA, 25 bp, Mus musculus
gttatcggagctccacagtattttg

SEQ ID NO: 47869 - DNA, 25 bp, Mus musculus
gttatctcggagctaatcagcacgg

SEQ ID NO: 47870 - DNA, 25 bp, Mus musculus
gttatcttcaagttccatcccaaag

SEQ ID NO: 47871 - DNA, 25 bp, Mus musculus
gttatgaatgaagtggagaaagccc

SEQ ID NO: 47872 - DNA, 25 bp, Mus musculus
gttatgacacctatgcggcagacat

SEQ ID NO: 47873 - DNA, 25 bp, Mus musculus
gttatgacacctttgcggcagacat

SEQ ID NO: 47874 - DNA, 25 bp, Mus musculus
gttatgagaaaatgccagaagagtt

SEQ ID NO: 47875 - DNA, 25 bp, Mus musculus
gttatgatgggacccacctctgtgg

SEQ ID NO: 47876 - DNA, 25 bp, Mus musculus
gttatgctgcgtaccgctatgccca

SEQ ID NO: 47877 - DNA, 25 bp, Mus musculus
gttatggaatactctgggtgtctgc

SEQ ID NO: 47878 - DNA, 25 bp, Mus musculus
gttatggacgtcatatccagcagta

SEQ ID NO: 47879 - DNA, 25 bp, Mus musculus
gttatggaggatatgactacactgg

SEQ ID NO: 47880 - DNA, 25 bp, Mus musculus
gttatggattgagaacaagttgctt

SEQ ID NO: 47881 - DNA, 25 bp, Mus musculus
gttatggcagccatcccaatggtcc

SEQ ID NO: 47882 - DNA, 25 bp, Mus musculus
gttatggcttgccaatttctcgtct

SEQ ID NO: 47883 - DNA, 25 bp, Mus musculus
gttatggcttgcgaatttctcgtct

SEQ ID NO: 47884 - DNA, 25 bp, Mus musculus
gttattatatgccttgttttctgtc

SEQ ID NO: 47885 - DNA, 25 bp, Mus musculus
gttattatctagtggcaaatcctac

SEQ ID NO: 47886 - DNA, 25 bp, Mus musculus
gttattcagacaccacatccatcgg

SEQ ID NO: 47887 - DNA, 25 bp, Mus musculus
gttattcattagaccaagtgtccat

SEQ ID NO: 47888 - DNA, 25 bp, Mus musculus
gttattcattagtccaagtgtccat

SEQ ID NO: 47889 - DNA, 25 bp, Mus musculus
gttattctggacaatggcgccagcc

SEQ ID NO: 47890 - DNA, 25 bp, Mus musculus
gttattgagttcatagccagagaaa

SEQ ID NO: 47891 - DNA, 25 bp, Mus musculus
gttattgttagactcactgaaccca

SEQ ID NO: 47892 - DNA, 25 bp, Mus musculus
gttcaaaagactatccagctcaatg

SEQ ID NO: 47893 - DNA, 25 bp, Mus musculus
gttcaaatccatccaatcttttgga

SEQ ID NO: 47894 - DNA, 25 bp, Mus musculus
gttcaacaacgagctgatggctgac

SEQ ID NO: 47895 - DNA, 25 bp, Mus musculus
gttcaacactcaattgaggtcccag

SEQ ID NO: 47896 - DNA, 25 bp, Mus musculus
gttcaacactcatttgaggtcccag

SEQ ID NO: 47897 - DNA, 25 bp, Mus musculus
gttcaaccagatgtggactgcctag

SEQ ID NO: 47898 - DNA, 25 bp, Mus musculus
gttcaacgggcaggctgtgcatgcc

SEQ ID NO: 47899 - DNA, 25 bp, Mus musculus
gttcaacgggcagggcgccagcttc

SEQ ID NO: 47900 - DNA, 25 bp, Mus musculus
gttcaactcagactttgcacatata

SEQ ID NO: 47901 - DNA, 25 bp, Mus musculus
gttcaactcagagtttgcacatata

SEQ ID NO: 47902 - DNA, 25 bp, Mus musculus
gttcaactctctttttgagtatccg

SEQ ID NO: 47903 - DNA, 25 bp, Mus musculus
gttcaagaatgtgcccatccaagca

SEQ ID NO: 47904 - DNA, 25 bp, Mus musculus
gttcaagatatcaagtatgaacccc

SEQ ID NO: 47905 - DNA, 25 bp, Mus musculus
gttcaagattggctcccaagaatca

SEQ ID NO: 47906 - DNA, 25 bp, Mus musculus
gttcaaggtcaccacaaagttccgg

SEQ ID NO: 47907 - DNA, 25 bp, Mus musculus
gttcaagtacttccaaagaatgacc

SEQ ID NO: 47908 - DNA, 25 bp, Mus musculus
gttcaagttaagagctcagacatac

SEQ ID NO: 47909 - DNA, 25 bp, Mus musculus
gttcaagttgcaaaccacaagcgag

SEQ ID NO: 47910 - DNA, 25 bp, Mus musculus
gttcaataaccaaaaatcccaagat

SEQ ID NO: 47911 - DNA, 25 bp, Mus musculus
gttcaatcagaacaacggaaatatc

SEQ ID NO: 47912 - DNA, 25 bp, Mus musculus
gttcacaaacagagagtggctgaag

SEQ ID NO: 47913 - DNA, 25 bp, Mus musculus
gttcacaaccattcatacctccagg

SEQ ID NO: 47914 - DNA, 25 bp, Mus musculus
gttcacagggaagtcgcctggaaaa

SEQ ID NO: 47915 - DNA, 25 bp, Mus musculus
gttcacagtcagtgtggaccatcgg

SEQ ID NO: 47916 - DNA, 25 bp, Mus musculus
gttcacatccagctcatttgataaa

SEQ ID NO: 47917 - DNA, 25 bp, Mus musculus
gttcaccgggacctggaagcccaga

SEQ ID NO: 47918 - DNA, 25 bp, Mus musculus
gttcacctgtgacactgatatagct

SEQ ID NO: 47919 - DNA, 25 bp, Mus musculus
gttcactatcgttgttcacatggcc

SEQ ID NO: 47920 - DNA, 25 bp, Mus musculus
gttcactcaagacaccttcagaggg

SEQ ID NO: 47921 - DNA, 25 bp, Mus musculus
gttcactgcagtcctggctattcca

SEQ ID NO: 47922 - DNA, 25 bp, Mus musculus
gttcagaacagggatgcgaggctca

SEQ ID NO: 47923 - DNA, 25 bp, Mus musculus
gttcagattctggagatgccatcca

SEQ ID NO: 47924 - DNA, 25 bp, Mus musculus
gttcagcacatcagtgcagccgtgg

SEQ ID NO: 47925 - DNA, 25 bp, Mus musculus
gttcagcaccgaaaaggagatcctg

SEQ ID NO: 47926 - DNA, 25 bp, Mus musculus
gttcagcagctccacagaacagagc

SEQ ID NO: 47927 - DNA, 25 bp, Mus musculus
gttcagcaggttaagctggcactgg

SEQ ID NO: 47928 - DNA, 25 bp, Mus musculus
gttcagcatcgcagacaagaagcgc

SEQ ID NO: 47929 - DNA, 25 bp, Mus musculus
gttcagccgctgtcctgggagaacg

SEQ ID NO: 47930 - DNA, 25 bp, Mus musculus
gttcagcctacttcagacctcacag

SEQ ID NO: 47931 - DNA, 25 bp, Mus musculus
gttcaggcaagcagtccatattgtc

SEQ ID NO: 47932 - DNA, 25 bp, Mus musculus
gttcaggcagccctatgcaaaccca

SEQ ID NO: 47933 - DNA, 25 bp, Mus musculus
gttcagggcatgtcctttatagctg

SEQ ID NO: 47934 - DNA, 25 bp, Mus musculus
gttcaggtgcaggaggccaacaatg

SEQ ID NO: 47935 - DNA, 25 bp, Mus musculus
gttcagtgacaaagttcaacctgaa

SEQ ID NO: 47936 - DNA, 25 bp, Mus musculus
gttcatagagatgagtgttgagcag

SEQ ID NO: 47937 - DNA, 25 bp, Mus musculus
gttcatatgattgaacatgcacaga

SEQ ID NO: 47938 - DNA, 25 bp, Mus musculus
gttcatccaagtgccacgggaacgg

SEQ ID NO: 47939 - DNA, 25 bp, Mus musculus
gttcatctaccctcatgagcagcga

SEQ ID NO: 47940 - DNA, 25 bp, Mus musculus
gttcatgaagaatgcccatgtcaca

SEQ ID NO: 47941 - DNA, 25 bp, Mus musculus
gttcatgaaggagcgacacacgccc

SEQ ID NO: 47942 - DNA, 25 bp, Mus musculus
gttcatgccgatcttagtaactacg

SEQ ID NO: 47943 - DNA, 25 bp, Mus musculus
gttcatggagaatggagccctggat

SEQ ID NO: 47944 - DNA, 25 bp, Mus musculus
gttcatggatgtgcagacatgtgaa

SEQ ID NO: 47945 - DNA, 25 bp, Mus musculus
gttcattagtgataaagatgcctca

SEQ ID NO: 47946 - DNA, 25 bp, Mus musculus
gttcattgttgagggcttaagagat

SEQ ID NO: 47947 - DNA, 25 bp, Mus musculus
gttcattgttgtagacaaggaaagg

SEQ ID NO: 47948 - DNA, 25 bp, Mus musculus
gttcattttgctggcttgcgacggg

SEQ ID NO: 47949 - DNA, 25 bp, Mus musculus
gttccaaaggactaaaatcgcagtt

SEQ ID NO: 47950 - DNA, 25 bp, Mus musculus
gttccaaagggtgccctgttgctgg

SEQ ID NO: 47951 - DNA, 25 bp, Mus musculus
gttccaagctggattctcgccgtcg

SEQ ID NO: 47952 - DNA, 25 bp, Mus musculus
gttccaagctggtttctcgccgtcg

SEQ ID NO: 47953 - DNA, 25 bp, Mus musculus
gttccaatcttcaatggatttttaa

SEQ ID NO: 47954 - DNA, 25 bp, Mus musculus
gttccacattcctcataggtggtat

SEQ ID NO: 47955 - DNA, 25 bp, Mus musculus
gttccaccaagagaatcaaggcagt

SEQ ID NO: 47956 - DNA, 25 bp, Mus musculus
gttccaccgggatgtccaacctgtc

SEQ ID NO: 47957 - DNA, 25 bp, Mus musculus
gttccaccgtctgctgtttgaagag

SEQ ID NO: 47958 - DNA, 25 bp, Mus musculus
gttccagactatcaggctgaaagtt

SEQ ID NO: 47959 - DNA, 25 bp, Mus musculus
gttccagagacttgcaaatgcctat

SEQ ID NO: 47960 - DNA, 25 bp, Mus musculus
gttccagatgcctgaagtttcccca

SEQ ID NO: 47961 - DNA, 25 bp, Mus musculus
gttccagattcttcttgatgccctg

SEQ ID NO: 47962 - DNA, 25 bp, Mus musculus
gttccagcagaagacgtggtccaga

SEQ ID NO: 47963 - DNA, 25 bp, Mus musculus
gttccagctggaccctcacctaggg

SEQ ID NO: 47964 - DNA, 25 bp, Mus musculus
gttccaggaggatgtgagccaccta

SEQ ID NO: 47965 - DNA, 25 bp, Mus musculus
gttccaggcagcagtcagcgtcatt

SEQ ID NO: 47966 - DNA, 25 bp, Mus musculus
gttccataagcagattgctgtcatg

SEQ ID NO: 47967 - DNA, 25 bp, Mus musculus
gttccatatcctataagtaccacag

SEQ ID NO: 47968 - DNA, 25 bp, Mus musculus
gttccatgaaacgttcccggtgctt

SEQ ID NO: 47969 - DNA, 25 bp, Mus musculus
gttccatgaatattcagtgtgcgtg

SEQ ID NO: 47970 - DNA, 25 bp, Mus musculus
gttccattggacagacagtttctca

SEQ ID NO: 47971 - DNA, 25 bp, Mus musculus
gttcccaagagttcctgtttctcct

SEQ ID NO: 47972 - DNA, 25 bp, Mus musculus
gttcccacatcggtcagagaaagat

SEQ ID NO: 47973 - DNA, 25 bp, Mus musculus
gttcccacctctcggaggacaacgg

SEQ ID NO: 47974 - DNA, 25 bp, Mus musculus
gttcccagtggaaaaagccgtacct

SEQ ID NO: 47975 - DNA, 25 bp, Mus musculus
gttcccagtggataaagccgtacct

SEQ ID NO: 47976 - DNA, 25 bp, Mus musculus
gttcccataacaactgctttcaagc

SEQ ID NO: 47977 - DNA, 25 bp, Mus musculus
gttccccagacaccatctatgagga

SEQ ID NO: 47978 - DNA, 25 bp, Mus musculus
gttcccctccgatctggcagagctg

SEQ ID NO: 47979 - DNA, 25 bp, Mus musculus
gttccctagaagacctttgcccagg

SEQ ID NO: 47980 - DNA, 25 bp, Mus musculus
gttccctcatcggatcttacaacag

SEQ ID NO: 47981 - DNA, 25 bp, Mus musculus
gttcccttctctaggcacttcggag

SEQ ID NO: 47982 - DNA, 25 bp, Mus musculus
gttccgagggcttccagaaacccag

SEQ ID NO: 47983 - DNA, 25 bp, Mus musculus
gttccgatcgactatggtgcccaca

SEQ ID NO: 47984 - DNA, 25 bp, Mus musculus
gttccgccaggtacggctgaaacac

SEQ ID NO: 47985 - DNA, 25 bp, Mus musculus
gttccggcggctctatgacatggta

SEQ ID NO: 47986 - DNA, 25 bp, Mus musculus
gttccgtgtggatcgcaaggacgac

SEQ ID NO: 47987 - DNA, 25 bp, Mus musculus
gttcctagagattatggctcccatg

SEQ ID NO: 47988 - DNA, 25 bp, Mus musculus
gttcctattcctacacacaggtggg

SEQ ID NO: 47989 - DNA, 25 bp, Mus musculus
gttcctcctccgcaggcacacagag

SEQ ID NO: 47990 - DNA, 25 bp, Mus musculus
gttcctctagaagggcaagagatgc

SEQ ID NO: 47991 - DNA, 25 bp, Mus musculus
gttcctctgtgtcttacatgataag

SEQ ID NO: 47992 - DNA, 25 bp, Mus musculus
gttcctctgtgtgttacatgataag

SEQ ID NO: 47993 - DNA, 25 bp, Mus musculus
gttcctgaactttaagaggctacag

SEQ ID NO: 47994 - DNA, 25 bp, Mus musculus
gttcctgagagcaagctccgaacca

SEQ ID NO: 47995 - DNA, 25 bp, Mus musculus
gttcctgctcttcgcagtgtccctg

SEQ ID NO: 47996 - DNA, 25 bp, Mus musculus
gttcctgctcttttcaaagcttcca

SEQ ID NO: 47997 - DNA, 25 bp, Mus musculus
gttcctggaagaagttaggcatgca

SEQ ID NO: 47998 - DNA, 25 bp, Mus musculus
gttcctggaagatgttaggcatgca

SEQ ID NO: 47999 - DNA, 25 bp, Mus musculus
gttcctggaatgttaattgtaccaa

SEQ ID NO: 48000 - DNA, 25 bp, Mus musculus
gttcctgggcaaaggtcatctatgg

SEQ ID NO: 48001 - DNA, 25 bp, Mus musculus
gttcctgtgccaacagctttagttg

SEQ ID NO: 48002 - DNA, 25 bp, Mus musculus
gttccttactgaatatagaagtcac

SEQ ID NO: 48003 - DNA, 25 bp, Mus musculus
gttccttctgcaaccagggcccgta

SEQ ID NO: 48004 - DNA, 25 bp, Mus musculus
gttccttgttcccatatcaagcgtc

SEQ ID NO: 48005 - DNA, 25 bp, Mus musculus
gttcgaatttgctctaggaatctaa

SEQ ID NO: 48006 - DNA, 25 bp, Mus musculus
gttcgacatcagtcagcagaacagt

SEQ ID NO: 48007 - DNA, 25 bp, Mus musculus
gttcgactgctttgtttatggccca

SEQ ID NO: 48008 - DNA, 25 bp, Mus musculus
gttcgagaaattcaagccgccatta

SEQ ID NO: 48009 - DNA, 25 bp, Mus musculus
gttcgataaagaatggcccttgtgg

SEQ ID NO: 48010 - DNA, 25 bp, Mus musculus
gttcgcaccacagagacccaagtgt

SEQ ID NO: 48011 - DNA, 25 bp, Mus musculus
gttcgctgcatcatccaaaatgaag

SEQ ID NO: 48012 - DNA, 25 bp, Mus musculus
gttcggagagggtactgcggctgcc

SEQ ID NO: 48013 - DNA, 25 bp, Mus musculus
gttcggtggcattaagtacactcac

SEQ ID NO: 48014 - DNA, 25 bp, Mus musculus
gttcgtaagttgtgcccacggtgcc

SEQ ID NO: 48015 - DNA, 25 bp, Mus musculus
gttcgtgatttgtgtggcgggcacc

SEQ ID NO: 48016 - DNA, 25 bp, Mus musculus
gttctaacgttcctgaggctaaggg

SEQ ID NO: 48017 - DNA, 25 bp, Mus musculus
gttctacatgaggaccttcagccat

SEQ ID NO: 48018 - DNA, 25 bp, Mus musculus
gttctacatggcctatgcagactat

SEQ ID NO: 48019 - DNA, 25 bp, Mus musculus
gttctacattccaccgtgtggttaa

SEQ ID NO: 48020 - DNA, 25 bp, Mus musculus
gttctaccacagacccgctatgtgg

SEQ ID NO: 48021 - DNA, 25 bp, Mus musculus
gttctaggcccttacacaagtgtct

SEQ ID NO: 48022 - DNA, 25 bp, Mus musculus
gttctaggcgcctgtgaacagccag

SEQ ID NO: 48023 - DNA, 25 bp, Mus musculus
gttctatagtccaccaatgtaagaa

SEQ ID NO: 48024 - DNA, 25 bp, Mus musculus
gttctatctgtacttcacccttgtg

SEQ ID NO: 48025 - DNA, 25 bp, Mus musculus
gttctattgtgcacactggcaaaca

SEQ ID NO: 48026 - DNA, 25 bp, Mus musculus
gttctcaaacagtgatgaggctgta

SEQ ID NO: 48027 - DNA, 25 bp, Mus musculus
gttctcaagccattccagatgcctg

SEQ ID NO: 48028 - DNA, 25 bp, Mus musculus
gttctcaaggagctgtttggtcacc

SEQ ID NO: 48029 - DNA, 25 bp, Mus musculus
gttctcaggattcagaccaaagaag

SEQ ID NO: 48030 - DNA, 25 bp, Mus musculus
gttctccaacacaacccatgagacc

SEQ ID NO: 48031 - DNA, 25 bp, Mus musculus
gttctccagagccatgaatgagctg

SEQ ID NO: 48032 - DNA, 25 bp, Mus musculus
gttctccagcggagcctctgatcct

SEQ ID NO: 48033 - DNA, 25 bp, Mus musculus
gttctcctgttggactgttttaaag

SEQ ID NO: 48034 - DNA, 25 bp, Mus musculus
gttctctacctgtgtgacacctcca

SEQ ID NO: 48035 - DNA, 25 bp, Mus musculus
gttctctgccctgcgcaactgtttg

SEQ ID NO: 48036 - DNA, 25 bp, Mus musculus
gttctcttgccacatcaggttccca

SEQ ID NO: 48037 - DNA, 25 bp, Mus musculus
gttctgacttccctagcatggagga

SEQ ID NO: 48038 - DNA, 25 bp, Mus musculus
gttctgagaccacccgaatgcccag

SEQ ID NO: 48039 - DNA, 25 bp, Mus musculus
gttctgcaataaagcctccatcagg

SEQ ID NO: 48040 - DNA, 25 bp, Mus musculus
gttctgcagtacagccacatactgg

SEQ ID NO: 48041 - DNA, 25 bp, Mus musculus
gttctgcattgcaccatgaccctgg

SEQ ID NO: 48042 - DNA, 25 bp, Mus musculus
gttctgccttagatcttcgtcttag

SEQ ID NO: 48043 - DNA, 25 bp, Mus musculus
gttctgcgacagagcatcagtcaca

SEQ ID NO: 48044 - DNA, 25 bp, Mus musculus
gttctgctcattaatcaccacgagt

SEQ ID NO: 48045 - DNA, 25 bp, Mus musculus
gttctggaacctgctctcaatatag

SEQ ID NO: 48046 - DNA, 25 bp, Mus musculus
gttctggaatacttaaacgacctga

SEQ ID NO: 48047 - DNA, 25 bp, Mus musculus
gttctggctggacttctcgaagctg

SEQ ID NO: 48048 - DNA, 25 bp, Mus musculus
gttctgggacacacggaatgtcacc

SEQ ID NO: 48049 - DNA, 25 bp, Mus musculus
gttctgtacctcacttgggaatcag

SEQ ID NO: 48050 - DNA, 25 bp, Mus musculus
gttctgtcaacaggcttcagatgaa

SEQ ID NO: 48051 - DNA, 25 bp, Mus musculus
gttctgtctgataaacatctaccct

SEQ ID NO: 48052 - DNA, 25 bp, Mus musculus
gttctgtgtttcacgttcaagcctg

SEQ ID NO: 48053 - DNA, 25 bp, Mus musculus
gttcttagaagagcaatatggacaa

SEQ ID NO: 48054 - DNA, 25 bp, Mus musculus
gttcttatcaatggagctatgctta

SEQ ID NO: 48055 - DNA, 25 bp, Mus musculus
gttcttcaaccaccacatgttcgtg

SEQ ID NO: 48056 - DNA, 25 bp, Mus musculus
gttcttcaagtctgctctacaagcc

SEQ ID NO: 48057 - DNA, 25 bp, Mus musculus
gttcttccatgcagagctgagaaga

SEQ ID NO: 48058 - DNA, 25 bp, Mus musculus
gttcttcccgaaaagagatcaccaa

SEQ ID NO: 48059 - DNA, 25 bp, Mus musculus
gttcttcctaccagtaagagcagcc

SEQ ID NO: 48060 - DNA, 25 bp, Mus musculus
gttcttctcgtccaagcagtcctcg

SEQ ID NO: 48061 - DNA, 25 bp, Mus musculus
gttcttctggatcccgtttgtgtac

SEQ ID NO: 48062 - DNA, 25 bp, Mus musculus
gttcttctgtctaaacaccaggtgt

SEQ ID NO: 48063 - DNA, 25 bp, Mus musculus
gttcttgaacatcatcccattgaga

SEQ ID NO: 48064 - DNA, 25 bp, Mus musculus
gttcttgcccctacattattcctta

SEQ ID NO: 48065 - DNA, 25 bp, Mus musculus
gttcttgcctaatgaggccactcat

SEQ ID NO: 48066 - DNA, 25 bp, Mus musculus
gttcttgtttcctgagcttcctgag

SEQ ID NO: 48067 - DNA, 25 bp, Mus musculus
gttctttcaagccaagtcgctggga

SEQ ID NO: 48068 - DNA, 25 bp, Mus musculus
gttctttcagccagacgacgaagtg

SEQ ID NO: 48069 - DNA, 25 bp, Mus musculus
gttctttggcttatcccactggtca

SEQ ID NO: 48070 - DNA, 25 bp, Mus musculus
gttctttggcttttcccactggtca

SEQ ID NO: 48071 - DNA, 25 bp, Mus musculus
gttgaacagagtagcacggctgccc

SEQ ID NO: 48072 - DNA, 25 bp, Mus musculus
gttgaacctttgcacacatgaaaca

SEQ ID NO: 48073 - DNA, 25 bp, Mus musculus
gttgaacgacatgtggacaattggc

SEQ ID NO: 48074 - DNA, 25 bp, Mus musculus
gttgaactgcccacttccctttcta

SEQ ID NO: 48075 - DNA, 25 bp, Mus musculus
gttgaagatctgaaactccgtcttc

SEQ ID NO: 48076 - DNA, 25 bp, Mus musculus
gttgaagatgtcgagtgcaccatgt

SEQ ID NO: 48077 - DNA, 25 bp, Mus musculus
gttgaagctcattttaagactcgtt

SEQ ID NO: 48078 - DNA, 25 bp, Mus musculus
gttgaagggctccattgaactctcc

SEQ ID NO: 48079 - DNA, 25 bp, Mus musculus
gttgaattttgcaaatccacctgtc

SEQ ID NO: 48080 - DNA, 25 bp, Mus musculus
gttgacaaaggcacagcagaaggag

SEQ ID NO: 48081 - DNA, 25 bp, Mus musculus
gttgacaaccatacctgcaggtctg

SEQ ID NO: 48082 - DNA, 25 bp, Mus musculus
gttgacaaccttaaccaccacaatc

SEQ ID NO: 48083 - DNA, 25 bp, Mus musculus
gttgacaatctactctgcaaccaag

SEQ ID NO: 48084 - DNA, 25 bp, Mus musculus
gttgacaggcttcagaaagctccgg

SEQ ID NO: 48085 - DNA, 25 bp, Mus musculus
gttgacatggatccgctcagagccc

SEQ ID NO: 48086 - DNA, 25 bp, Mus musculus
gttgaccagtccctccataccaatg

SEQ ID NO: 48087 - DNA, 25 bp, Mus musculus
gttgaccatcaacaatatcagcttg

SEQ ID NO: 48088 - DNA, 25 bp, Mus musculus
gttgaccgcaccacaactcatcagt

SEQ ID NO: 48089 - DNA, 25 bp, Mus musculus
gttgaccttggtgtctacctgatgc

SEQ ID NO: 48090 - DNA, 25 bp, Mus musculus
gttgacgttgatgcaaattcattaa

SEQ ID NO: 48091 - DNA, 25 bp, Mus musculus
gttgactatcagtgccagaagtatt

SEQ ID NO: 48092 - DNA, 25 bp, Mus musculus
gttgactgcattcagccagtgccaa

SEQ ID NO: 48093 - DNA, 25 bp, Mus musculus
gttgactggtcttcaggaagccctg

SEQ ID NO: 48094 - DNA, 25 bp, Mus musculus
gttgacttgggcctttatataggat

SEQ ID NO: 48095 - DNA, 25 bp, Mus musculus
gttgagacaactgttgcaagcctca

SEQ ID NO: 48096 - DNA, 25 bp, Mus musculus
gttgagcagcaacttcacgagcatt

SEQ ID NO: 48097 - DNA, 25 bp, Mus musculus
gttgagccaccctcatggaagggag

SEQ ID NO: 48098 - DNA, 25 bp, Mus musculus
gttgagccgggcacagaaacacagc

SEQ ID NO: 48099 - DNA, 25 bp, Mus musculus
gttgagctgctcacacaccaagctg

SEQ ID NO: 48100 - DNA, 25 bp, Mus musculus
gttgaggaggaaaaccgtgctctgc

SEQ ID NO: 48101 - DNA, 25 bp, Mus musculus
gttgaggaggaataccgtgctctgc

SEQ ID NO: 48102 - DNA, 25 bp, Mus musculus
gttgaggcactgaagatggagaact

SEQ ID NO: 48103 - DNA, 25 bp, Mus musculus
gttgaggcttgaataccataacttc

SEQ ID NO: 48104 - DNA, 25 bp, Mus musculus
gttgagtcagatcttcaggaaataa

SEQ ID NO: 48105 - DNA, 25 bp, Mus musculus
gttgatattccacaaggaagaagtg

SEQ ID NO: 48106 - DNA, 25 bp, Mus musculus
gttgatattccagaaggaagaagtg

SEQ ID NO: 48107 - DNA, 25 bp, Mus musculus
gttgatcagtgtatccagaagtttt

SEQ ID NO: 48108 - DNA, 25 bp, Mus musculus
gttgatcgtgtcctgagctgaagat

SEQ ID NO: 48109 - DNA, 25 bp, Mus musculus
gttgatctggagacaagtgcggttc

SEQ ID NO: 48110 - DNA, 25 bp, Mus musculus
gttgatgaagaacagactccaattc

SEQ ID NO: 48111 - DNA, 25 bp, Mus musculus
gttgatgactgctggctgtacttcc

SEQ ID NO: 48112 - DNA, 25 bp, Mus musculus
gttgatgccatttagagtggaaagc

SEQ ID NO: 48113 - DNA, 25 bp, Mus musculus
gttgatgcgctacccaccaggtgtc

SEQ ID NO: 48114 - DNA, 25 bp, Mus musculus
gttgatgcgctagccaccaggtgtc

SEQ ID NO: 48115 - DNA, 25 bp, Mus musculus
gttgatggacttctcagttggcttc

SEQ ID NO: 48116 - DNA, 25 bp, Mus musculus
gttgattgcacggatggtgagaaat

SEQ ID NO: 48117 - DNA, 25 bp, Mus musculus
gttgcaaaatctactccctgaaggc

SEQ ID NO: 48118 - DNA, 25 bp, Mus musculus
gttgcaagtgattcttctgatagag

SEQ ID NO: 48119 - DNA, 25 bp, Mus musculus
gttgcagacattatgttacatcacc

SEQ ID NO: 48120 - DNA, 25 bp, Mus musculus
gttgcagattcccaaggcttgattg

SEQ ID NO: 48121 - DNA, 25 bp, Mus musculus
gttgcagcagaaatcctgggaatca

SEQ ID NO: 48122 - DNA, 25 bp, Mus musculus
gttgcagccagcacccttaggaatg

SEQ ID NO: 48123 - DNA, 25 bp, Mus musculus
gttgcagccagctcccttaggaatg

SEQ ID NO: 48124 - DNA, 25 bp, Mus musculus
gttgcagccagtcttagtcactgtt

SEQ ID NO: 48125 - DNA, 25 bp, Mus musculus
gttgcagcccatccgcttcgtgaag

SEQ ID NO: 48126 - DNA, 25 bp, Mus musculus
gttgcaggagaaacttcagtcttgg

SEQ ID NO: 48127 - DNA, 25 bp, Mus musculus
gttgcagggaatggaacaattatat

SEQ ID NO: 48128 - DNA, 25 bp, Mus musculus
gttgcagtattatctcactacggag

SEQ ID NO: 48129 - DNA, 25 bp, Mus musculus
gttgccaaagtggaagactattatc

SEQ ID NO: 48130 - DNA, 25 bp, Mus musculus
gttgccaactctgccttactaaaag

SEQ ID NO: 48131 - DNA, 25 bp, Mus musculus
gttgccacctaccatagagccatca

SEQ ID NO: 48132 - DNA, 25 bp, Mus musculus
gttgccagtgttgtggtctccttct

SEQ ID NO: 48133 - DNA, 25 bp, Mus musculus
gttgccatggcatcctactacgaga

SEQ ID NO: 48134 - DNA, 25 bp, Mus musculus
gttgcccacaggattgacttggcct

SEQ ID NO: 48135 - DNA, 25 bp, Mus musculus
gttgccctatgcaagctactttgga

SEQ ID NO: 48136 - DNA, 25 bp, Mus musculus
gttgccctatgctagctactttgga

SEQ ID NO: 48137 - DNA, 25 bp, Mus musculus
gttgcgagtggcactgcccagtgtc

SEQ ID NO: 48138 - DNA, 25 bp, Mus musculus
gttgcgcacagtccctctgctagca

SEQ ID NO: 48139 - DNA, 25 bp, Mus musculus
gttgcgcttacagcaggaggccatg

SEQ ID NO: 48140 - DNA, 25 bp, Mus musculus
gttgcggatgaaggacaacgacctt

SEQ ID NO: 48141 - DNA, 25 bp, Mus musculus
gttgcggtgtgcacactgtgccgct

SEQ ID NO: 48142 - DNA, 25 bp, Mus musculus
gttgctaatgcacatgcctgctgag

SEQ ID NO: 48143 - DNA, 25 bp, Mus musculus
gttgctacaggcactggaatgcaga

SEQ ID NO: 48144 - DNA, 25 bp, Mus musculus
gttgctagctgtaggactaggtgtt

SEQ ID NO: 48145 - DNA, 25 bp, Mus musculus
gttgctccaccccagacaactgttg

SEQ ID NO: 48146 - DNA, 25 bp, Mus musculus
gttgctgatcataagaaaggagcaa

SEQ ID NO: 48147 - DNA, 25 bp, Mus musculus
gttgctgattatgaagctacaacat

SEQ ID NO: 48148 - DNA, 25 bp, Mus musculus
gttgctgcagctcgtccctcaactg

SEQ ID NO: 48149 - DNA, 25 bp, Mus musculus
gttgctgccttcatggtggagccca

SEQ ID NO: 48150 - DNA, 25 bp, Mus musculus
gttgctgctgtctccatcttgacac

SEQ ID NO: 48151 - DNA, 25 bp, Mus musculus
gttgctgggaatccttgcccaatct

SEQ ID NO: 48152 - DNA, 25 bp, Mus musculus
gttgctgggaattttcgccaccgtt

SEQ ID NO: 48153 - DNA, 25 bp, Mus musculus
gttgcttagcaacaaaaggtcacaa

SEQ ID NO: 48154 - DNA, 25 bp, Mus musculus
gttgcttccataagacagcatctgg

SEQ ID NO: 48155 - DNA, 25 bp, Mus musculus
gttgcttcctacctcaagacaaagg

SEQ ID NO: 48156 - DNA, 25 bp, Mus musculus
gttgctttcactaccagaatctatc

SEQ ID NO: 48157 - DNA, 25 bp, Mus musculus
gttggaaatgaccttcacggtccaa

SEQ ID NO: 48158 - DNA, 25 bp, Mus musculus
gttggaagaactcacagctagtttg

SEQ ID NO: 48159 - DNA, 25 bp, Mus musculus
gttggaagacctgtttgatatgtgc

SEQ ID NO: 48160 - DNA, 25 bp, Mus musculus
gttggaatgctgaagcggctaaaga

SEQ ID NO: 48161 - DNA, 25 bp, Mus musculus
gttggaattcgaggaactaatatag

SEQ ID NO: 48162 - DNA, 25 bp, Mus musculus
gttggacactgtcccaacttataaa

SEQ ID NO: 48163 - DNA, 25 bp, Mus musculus
gttggacagtctggctcagcagact

SEQ ID NO: 48164 - DNA, 25 bp, Mus musculus
gttggacattcttcgggacacccag

SEQ ID NO: 48165 - DNA, 25 bp, Mus musculus
gttggacctcatgcaccagggtgca

SEQ ID NO: 48166 - DNA, 25 bp, Mus musculus
gttggacctccataaccccaaggat

SEQ ID NO: 48167 - DNA, 25 bp, Mus musculus
gttggaccttccatccagtgttcgg

SEQ ID NO: 48168 - DNA, 25 bp, Mus musculus
gttggactgactggaggaccccgaa

SEQ ID NO: 48169 - DNA, 25 bp, Mus musculus
gttggagacacatgtggtaaagata

SEQ ID NO: 48170 - DNA, 25 bp, Mus musculus
gttggagcttggaggaaacaatgcc

SEQ ID NO: 48171 - DNA, 25 bp, Mus musculus
gttggagttcaaggtactcgttata

SEQ ID NO: 48172 - DNA, 25 bp, Mus musculus
gttggataacatgctgctggctgag

SEQ ID NO: 48173 - DNA, 25 bp, Mus musculus
gttggatcatggtagggctcagtaa

SEQ ID NO: 48174 - DNA, 25 bp, Mus musculus
gttggatgattttgatgagtacacc

SEQ ID NO: 48175 - DNA, 25 bp, Mus musculus
gttggattgatctctgaaagagaac

SEQ ID NO: 48176 - DNA, 25 bp, Mus musculus
gttggcaagaatttggctcccgtat

SEQ ID NO: 48177 - DNA, 25 bp, Mus musculus
gttggcaagttctgaagcccacatc

SEQ ID NO: 48178 - DNA, 25 bp, Mus musculus
gttggcattgcacatccatccactc

SEQ ID NO: 48179 - DNA, 25 bp, Mus musculus
gttggcattgcagatccatccactc

SEQ ID NO: 48180 - DNA, 25 bp, Mus musculus
gttggcctcaattactccatgttta

SEQ ID NO: 48181 - DNA, 25 bp, Mus musculus
gttggctatcaacctgggctaccgg

SEQ ID NO: 48182 - DNA, 25 bp, Mus musculus
gttggctcctccatgcctgtgctga

SEQ ID NO: 48183 - DNA, 25 bp, Mus musculus
gttggctgaaatgcttcctggagtc

SEQ ID NO: 48184 - DNA, 25 bp, Mus musculus
gttggctttaggtcatctctttgta

SEQ ID NO: 48185 - DNA, 25 bp, Mus musculus
gttgggacagtcatctgtccatcag

SEQ ID NO: 48186 - DNA, 25 bp, Mus musculus
gttgggagtctaatggcccttcaca

SEQ ID NO: 48187 - DNA, 25 bp, Mus musculus
gttgggagtttatcgacttcggcat

SEQ ID NO: 48188 - DNA, 25 bp, Mus musculus
gttgggatagtctacagaaattgat

SEQ ID NO: 48189 - DNA, 25 bp, Mus musculus
gttgggccgtatcatctttgcctgg

SEQ ID NO: 48190 - DNA, 25 bp, Mus musculus
gttgggctctgtcatcatctataag

SEQ ID NO: 48191 - DNA, 25 bp, Mus musculus
gttgggttctgtatccagtgtaaca

SEQ ID NO: 48192 - DNA, 25 bp, Mus musculus
gttggtacagaggagtttcaacaaa

SEQ ID NO: 48193 - DNA, 25 bp, Mus musculus
gttggtagagctccacagaaggtta

SEQ ID NO: 48194 - DNA, 25 bp, Mus musculus
gttggtatataaaaatgctactgcc

SEQ ID NO: 48195 - DNA, 25 bp, Mus musculus
gttggtattcttctagaagacatcg

SEQ ID NO: 48196 - DNA, 25 bp, Mus musculus
gttggtcttgacgatattatggatg

SEQ ID NO: 48197 - DNA, 25 bp, Mus musculus
gttggtgacctcagtccagaaatca

SEQ ID NO: 48198 - DNA, 25 bp, Mus musculus
gttggtgccgctcccgcttctgctg

SEQ ID NO: 48199 - DNA, 25 bp, Mus musculus
gttggtgccgctgccgcttctgctg

SEQ ID NO: 48200 - DNA, 25 bp, Mus musculus
gttggtgcgctacctgttggctaat

SEQ ID NO: 48201 - DNA, 25 bp, Mus musculus
gttggtgtgcagcaactacacccca

SEQ ID NO: 48202 - DNA, 25 bp, Mus musculus
gttggtgttcacactgtgccatggg

SEQ ID NO: 48203 - DNA, 25 bp, Mus musculus
gttggtttgccatccacaaatgcag

SEQ ID NO: 48204 - DNA, 25 bp, Mus musculus
gttgtaaaacttcctccagggatgg

SEQ ID NO: 48205 - DNA, 25 bp, Mus musculus
gttgtaacagcggaagacgcactta

SEQ ID NO: 48206 - DNA, 25 bp, Mus musculus
gttgtacaagatcaccattctgctg

SEQ ID NO: 48207 - DNA, 25 bp, Mus musculus
gttgtacacccctcctgcctttgag

SEQ ID NO: 48208 - DNA, 25 bp, Mus musculus
gttgtagctgcccattaaagacagg

SEQ ID NO: 48209 - DNA, 25 bp, Mus musculus
gttgtatgaagacagaagtctctac

SEQ ID NO: 48210 - DNA, 25 bp, Mus musculus
gttgtatttcaaggctaagggcgga

SEQ ID NO: 48211 - DNA, 25 bp, Mus musculus
gttgtcaccctgctgaaatctgtcc

SEQ ID NO: 48212 - DNA, 25 bp, Mus musculus
gttgtcaccctggtgaaatctgtcc

SEQ ID NO: 48213 - DNA, 25 bp, Mus musculus
gttgtcagcaagcaaattatataac

SEQ ID NO: 48214 - DNA, 25 bp, Mus musculus
gttgtcagcacacagcgttcacaag

SEQ ID NO: 48215 - DNA, 25 bp, Mus musculus
gttgtcaggagacctcccattcata

SEQ ID NO: 48216 - DNA, 25 bp, Mus musculus
gttgtccagggcagcctctctggtg

SEQ ID NO: 48217 - DNA, 25 bp, Mus musculus
gttgtcccaataaccagctacgaca

SEQ ID NO: 48218 - DNA, 25 bp, Mus musculus
gttgtcccaggccaaagactgtcca

SEQ ID NO: 48219 - DNA, 25 bp, Mus musculus
gttgtcccaggcgaaagactgtcca

SEQ ID NO: 48220 - DNA, 25 bp, Mus musculus
gttgtcccatacgaggagaatcgag

SEQ ID NO: 48221 - DNA, 25 bp, Mus musculus
gttgtgactacactatggtagctcc

SEQ ID NO: 48222 - DNA, 25 bp, Mus musculus
gttgtgactgaaaattcaatgtggc

SEQ ID NO: 48223 - DNA, 25 bp, Mus musculus
gttgtgatggagctcactgtcacca

SEQ ID NO: 48224 - DNA, 25 bp, Mus musculus
gttgtgattcatccctggcctcgga

SEQ ID NO: 48225 - DNA, 25 bp, Mus musculus
gttgtgcccagcttcatctccacag

SEQ ID NO: 48226 - DNA, 25 bp, Mus musculus
gttgtggatcattatgaaaaccctc

SEQ ID NO: 48227 - DNA, 25 bp, Mus musculus
gttgtggtttggtttgcagaatcct

SEQ ID NO: 48228 - DNA, 25 bp, Mus musculus
gttgtgtagcctgaccctgaagaag

SEQ ID NO: 48229 - DNA, 25 bp, Mus musculus
gttgttacagatcttatagcagtcg

SEQ ID NO: 48230 - DNA, 25 bp, Mus musculus
gttgttacatcgtgttgtggaacag

SEQ ID NO: 48231 - DNA, 25 bp, Mus musculus
gttgttaccctgtgtcgctgtgctc

SEQ ID NO: 48232 - DNA, 25 bp, Mus musculus
gttgttagcagacttctgacgccca

SEQ ID NO: 48233 - DNA, 25 bp, Mus musculus
gttgttatctcctctgatggtcagt

SEQ ID NO: 48234 - DNA, 25 bp, Mus musculus
gttgttcaggctgacattgcctcga

SEQ ID NO: 48235 - DNA, 25 bp, Mus musculus
gttgtttagactgccgtctgcactt

SEQ ID NO: 48236 - DNA, 25 bp, Mus musculus
gttgtttctggtcccggtctcatcc

SEQ ID NO: 48237 - DNA, 25 bp, Mus musculus
gttgtttttgcctcaccgaagaagt

SEQ ID NO: 48238 - DNA, 25 bp, Mus musculus
gtttaaaagcctgcaaaatcagagc

SEQ ID NO: 48239 - DNA, 25 bp, Mus musculus
gtttaaactggaccaaggctctcag

SEQ ID NO: 48240 - DNA, 25 bp, Mus musculus
gtttaaactggagcaaggctctcag

SEQ ID NO: 48241 - DNA, 25 bp, Mus musculus
gtttaaccatctcaataccaaccag

SEQ ID NO: 48242 - DNA, 25 bp, Mus musculus
gtttaagaagttgacgaaggccgtg

SEQ ID NO: 48243 - DNA, 25 bp, Mus musculus
gtttaagtacaaccaacttctccag

SEQ ID NO: 48244 - DNA, 25 bp, Mus musculus
gtttaatcttgttcagcgaacagca

SEQ ID NO: 48245 - DNA, 25 bp, Mus musculus
gtttacaatcaacaatgagactggg

SEQ ID NO: 48246 - DNA, 25 bp, Mus musculus
gtttacaatcaagaatgagactggg

SEQ ID NO: 48247 - DNA, 25 bp, Mus musculus
gtttacagccatcgacgagctcctg

SEQ ID NO: 48248 - DNA, 25 bp, Mus musculus
gtttacatctcggaaatcgcctacc

SEQ ID NO: 48249 - DNA, 25 bp, Mus musculus
gtttacatgaggaaccacaaagccc

SEQ ID NO: 48250 - DNA, 25 bp, Mus musculus
gtttacatgaggtaccacaaagccc

SEQ ID NO: 48251 - DNA, 25 bp, Mus musculus
gtttaccaggagacgtcggagatgc

SEQ ID NO: 48252 - DNA, 25 bp, Mus musculus
gtttacctatttccactccatgcac

SEQ ID NO: 48253 - DNA, 25 bp, Mus musculus
gtttactagtccagtatggagtggt

SEQ ID NO: 48254 - DNA, 25 bp, Mus musculus
gtttactggatgttctaacaaaagg

SEQ ID NO: 48255 - DNA, 25 bp, Mus musculus
gtttagaagataaccagctgggacc

SEQ ID NO: 48256 - DNA, 25 bp, Mus musculus
gtttagactgccgtctgcacttaac

SEQ ID NO: 48257 - DNA, 25 bp, Mus musculus
gtttagccttccagttagccatcct

SEQ ID NO: 48258 - DNA, 25 bp, Mus musculus
gtttagctatcaagtggcatccacg

SEQ ID NO: 48259 - DNA, 25 bp, Mus musculus
gtttagcttcttcagtagctgagag

SEQ ID NO: 48260 - DNA, 25 bp, Mus musculus
gtttaggacactgcatttactcaaa

SEQ ID NO: 48261 - DNA, 25 bp, Mus musculus
gtttatcactaatgagcgctttggg

SEQ ID NO: 48262 - DNA, 25 bp, Mus musculus
gtttatcactccgaaaggaaggaga

SEQ ID NO: 48263 - DNA, 25 bp, Mus musculus
gtttatcccatcacgggtggattca

SEQ ID NO: 48264 - DNA, 25 bp, Mus musculus
gtttatccttccacaatcatcctca

SEQ ID NO: 48265 - DNA, 25 bp, Mus musculus
gtttatcggagccagcctgcttacc

SEQ ID NO: 48266 - DNA, 25 bp, Mus musculus
gtttatctgagcaggctggacctct

SEQ ID NO: 48267 - DNA, 25 bp, Mus musculus
gtttatctgcaaggtgctcccacag

SEQ ID NO: 48268 - DNA, 25 bp, Mus musculus
gtttatcttcaactgggcatgctca

SEQ ID NO: 48269 - DNA, 25 bp, Mus musculus
gtttatgagtgcgaggtcgtccctg

SEQ ID NO: 48270 - DNA, 25 bp, Mus musculus
gtttatgatccatctctgtgagaag

SEQ ID NO: 48271 - DNA, 25 bp, Mus musculus
gtttatgggactgtcttccacatca

SEQ ID NO: 48272 - DNA, 25 bp, Mus musculus
gtttatgggagccaagctatggatt

SEQ ID NO: 48273 - DNA, 25 bp, Mus musculus
gtttatgttcccgataccctgggag

SEQ ID NO: 48274 - DNA, 25 bp, Mus musculus
gtttattcctctcccgctagctgtc

SEQ ID NO: 48275 - DNA, 25 bp, Mus musculus
gtttattttagaagagctgaacatc

SEQ ID NO: 48276 - DNA, 25 bp, Mus musculus
gtttcaaatgatatatcctgcccag

SEQ ID NO: 48277 - DNA, 25 bp, Mus musculus
gtttcaacaaagaagcctaatgtaa

SEQ ID NO: 48278 - DNA, 25 bp, Mus musculus
gtttcaacagaaggcgcaaatactt

SEQ ID NO: 48279 - DNA, 25 bp, Mus musculus
gtttcaacctcttggaccgagagct

SEQ ID NO: 48280 - DNA, 25 bp, Mus musculus
gtttcactcagtcaaatcccaaatc

SEQ ID NO: 48281 - DNA, 25 bp, Mus musculus
gtttcacttggccagtgcagactgg

SEQ ID NO: 48282 - DNA, 25 bp, Mus musculus
gtttcagatagaagatacaaagctg

SEQ ID NO: 48283 - DNA, 25 bp, Mus musculus
gtttcagcattaaaaactctccagg

SEQ ID NO: 48284 - DNA, 25 bp, Mus musculus
gtttcagtgtgtccgaccttgcccc

SEQ ID NO: 48285 - DNA, 25 bp, Mus musculus
gtttcatattgccagagaagataca

SEQ ID NO: 48286 - DNA, 25 bp, Mus musculus
gtttccaaaggcttcctcaacgtga

SEQ ID NO: 48287 - DNA, 25 bp, Mus musculus
gtttccactggtatcttccagttag

SEQ ID NO: 48288 - DNA, 25 bp, Mus musculus
gtttccagagcatcagcgagccaca

SEQ ID NO: 48289 - DNA, 25 bp, Mus musculus
gtttccaggagcaccacctccagga

SEQ ID NO: 48290 - DNA, 25 bp, Mus musculus
gtttccaggagctccacctccagga

SEQ ID NO: 48291 - DNA, 25 bp, Mus musculus
gtttccaggtgacagacacgattca

SEQ ID NO: 48292 - DNA, 25 bp, Mus musculus
gtttccatcttacatacctacatag

SEQ ID NO: 48293 - DNA, 25 bp, Mus musculus
gtttcccacaaaacagcatatccag

SEQ ID NO: 48294 - DNA, 25 bp, Mus musculus
gtttccccagaagtggttagatcaa

SEQ ID NO: 48295 - DNA, 25 bp, Mus musculus
gtttcccgtgcttgtgacctctgac

SEQ ID NO: 48296 - DNA, 25 bp, Mus musculus
gtttccctcaaagactgtagctcag

SEQ ID NO: 48297 - DNA, 25 bp, Mus musculus
gtttccctcaccctgatagaaagga

SEQ ID NO: 48298 - DNA, 25 bp, Mus musculus
gtttccctcttcttagagcctgtgc

SEQ ID NO: 48299 - DNA, 25 bp, Mus musculus
gtttcccttgaaatcccatcctgct

SEQ ID NO: 48300 - DNA, 25 bp, Mus musculus
gtttccgtggacgatcgccttaagc

SEQ ID NO: 48301 - DNA, 25 bp, Mus musculus
gtttcctcagcagcaacgtcagttt

SEQ ID NO: 48302 - DNA, 25 bp, Mus musculus
gtttcctcctgccatcaaagtgcta

SEQ ID NO: 48303 - DNA, 25 bp, Mus musculus
gtttcctgcctttggactataaaga

SEQ ID NO: 48304 - DNA, 25 bp, Mus musculus
gtttccttctcttattgctctggct

SEQ ID NO: 48305 - DNA, 25 bp, Mus musculus
gtttcctttgattggtgcgctacag

SEQ ID NO: 48306 - DNA, 25 bp, Mus musculus
gtttcctttgccaagtcatccttct

SEQ ID NO: 48307 - DNA, 25 bp, Mus musculus
gtttcgaattcaaagcattgtaagg

SEQ ID NO: 48308 - DNA, 25 bp, Mus musculus
gtttcgagattccacgttctatctg

SEQ ID NO: 48309 - DNA, 25 bp, Mus musculus
gtttcgagcggctgacacgggcact

SEQ ID NO: 48310 - DNA, 25 bp, Mus musculus
gtttctaagtatggtgacctggcca

SEQ ID NO: 48311 - DNA, 25 bp, Mus musculus
gtttctagacagaccctcacctggg

SEQ ID NO: 48312 - DNA, 25 bp, Mus musculus
gtttctagatccagacatgtactct

SEQ ID NO: 48313 - DNA, 25 bp, Mus musculus
gtttctaggacaccgccttcatcag

SEQ ID NO: 48314 - DNA, 25 bp, Mus musculus
gtttctatcattccacccctgttca

SEQ ID NO: 48315 - DNA, 25 bp, Mus musculus
gtttctcccaccacaaatggcactg

SEQ ID NO: 48316 - DNA, 25 bp, Mus musculus
gtttctcggcttctcatcgcagtca

SEQ ID NO: 48317 - DNA, 25 bp, Mus musculus
gtttctcggcttgtcatcgcagtca

SEQ ID NO: 48318 - DNA, 25 bp, Mus musculus
gtttctctagagatcccacaggtta

SEQ ID NO: 48319 - DNA, 25 bp, Mus musculus
gtttctctgagagccacggccgaga

SEQ ID NO: 48320 - DNA, 25 bp, Mus musculus
gtttctctgcccagcggcttagagg

SEQ ID NO: 48321 - DNA, 25 bp, Mus musculus
gtttctctgcctaccgcacagcaat

SEQ ID NO: 48322 - DNA, 25 bp, Mus musculus
gtttctcttcgtccctcctgaaaag

SEQ ID NO: 48323 - DNA, 25 bp, Mus musculus
gtttctgaacttggcttggagtctg

SEQ ID NO: 48324 - DNA, 25 bp, Mus musculus
gtttctgaggcccttctcttgttag

SEQ ID NO: 48325 - DNA, 25 bp, Mus musculus
gtttctgccagctctacctgaatga

SEQ ID NO: 48326 - DNA, 25 bp, Mus musculus
gtttctgtcacttgtgtgatggtca

SEQ ID NO: 48327 - DNA, 25 bp, Mus musculus
gtttctgttacaagctgtgaatcag

SEQ ID NO: 48328 - DNA, 25 bp, Mus musculus
gtttctgttctcctacgccgctgct

SEQ ID NO: 48329 - DNA, 25 bp, Mus musculus
gtttctgttgatgccatttagagtg

SEQ ID NO: 48330 - DNA, 25 bp, Mus musculus
gtttcttccaaataatcaagccaag

SEQ ID NO: 48331 - DNA, 25 bp, Mus musculus
gtttcttcgggatcatcttcacctc

SEQ ID NO: 48332 - DNA, 25 bp, Mus musculus
gtttcttctgttcaagttgcaaacc

SEQ ID NO: 48333 - DNA, 25 bp, Mus musculus
gtttctttggagtgggtcgttgtca

SEQ ID NO: 48334 - DNA, 25 bp, Mus musculus
gtttcttttaggaagagcaccatat

SEQ ID NO: 48335 - DNA, 25 bp, Mus musculus
gtttgaaaactacagctcagagttg

SEQ ID NO: 48336 - DNA, 25 bp, Mus musculus
gtttgaaatggccaactcacctgat

SEQ ID NO: 48337 - DNA, 25 bp, Mus musculus
gtttgaacagttccagagacttgca

SEQ ID NO: 48338 - DNA, 25 bp, Mus musculus
gtttgaagatatcaggcccagttgc

SEQ ID NO: 48339 - DNA, 25 bp, Mus musculus
gtttgaagctggctccacaagggac

SEQ ID NO: 48340 - DNA, 25 bp, Mus musculus
gtttgaagctgggtccacaagggac

SEQ ID NO: 48341 - DNA, 25 bp, Mus musculus
gtttgaccaggccaataacctgctg

SEQ ID NO: 48342 - DNA, 25 bp, Mus musculus
gtttgaccaggtaaaccttgagctg

SEQ ID NO: 48343 - DNA, 25 bp, Mus musculus
gtttgaccgggaacagcacactctg

SEQ ID NO: 48344 - DNA, 25 bp, Mus musculus
gtttgactaagcagcctgaagaagt

SEQ ID NO: 48345 - DNA, 25 bp, Mus musculus
gtttgactctgctgagctagcaatg

SEQ ID NO: 48346 - DNA, 25 bp, Mus musculus
gtttgacttactggctgagcttgaa

SEQ ID NO: 48347 - DNA, 25 bp, Mus musculus
gtttgagatccttgtaaaacatgcc

SEQ ID NO: 48348 - DNA, 25 bp, Mus musculus
gtttgagcaacgcatgcgcactgct

SEQ ID NO: 48349 - DNA, 25 bp, Mus musculus
gtttgaggactcctgccgagtgtac

SEQ ID NO: 48350 - DNA, 25 bp, Mus musculus
gtttgaggatgaagacctttcggag

SEQ ID NO: 48351 - DNA, 25 bp, Mus musculus
gtttgaggccaacccataggcgaca

SEQ ID NO: 48352 - DNA, 25 bp, Mus musculus
gtttgagtgggatctgcccctggat

SEQ ID NO: 48353 - DNA, 25 bp, Mus musculus
gtttgatcccaagggccatcacgtg

SEQ ID NO: 48354 - DNA, 25 bp, Mus musculus
gtttgatccccagaaaggcttttgg

SEQ ID NO: 48355 - DNA, 25 bp, Mus musculus
gtttgatctgtggatgaaatgaatc

SEQ ID NO: 48356 - DNA, 25 bp, Mus musculus
gtttgatgttcctatcggttctcga

SEQ ID NO: 48357 - DNA, 25 bp, Mus musculus
gtttgattcacaaactgttctaaag

SEQ ID NO: 48358 - DNA, 25 bp, Mus musculus
gtttgattcccaagagttcctccga

SEQ ID NO: 48359 - DNA, 25 bp, Mus musculus
gtttgatttcccacagttcagcaca

SEQ ID NO: 48360 - DNA, 25 bp, Mus musculus
gtttgcagtccctaaaaattacaag

SEQ ID NO: 48361 - DNA, 25 bp, Mus musculus
gtttgccacaaaatcctctttccag

SEQ ID NO: 48362 - DNA, 25 bp, Mus musculus
gtttgccatcttcaacacagagcag

SEQ ID NO: 48363 - DNA, 25 bp, Mus musculus
gtttgccctgttccttcccttgtga

SEQ ID NO: 48364 - DNA, 25 bp, Mus musculus
gtttgccgaagatgcaggtcattag

SEQ ID NO: 48365 - DNA, 25 bp, Mus musculus
gtttgccttcttagcacaacacttc

SEQ ID NO: 48366 - DNA, 25 bp, Mus musculus
gtttgccttctttgcacaacacttc

SEQ ID NO: 48367 - DNA, 25 bp, Mus musculus
gtttgctaatccatcaagctcgggc

SEQ ID NO: 48368 - DNA, 25 bp, Mus musculus
gtttgctgcatgctgcatgacaccc

SEQ ID NO: 48369 - DNA, 25 bp, Mus musculus
gtttgctgtcgtcatctattttcag

SEQ ID NO: 48370 - DNA, 25 bp, Mus musculus
gtttgcttaagcacggacaaaggca

SEQ ID NO: 48371 - DNA, 25 bp, Mus musculus
gtttggacccctgatactttcttca

SEQ ID NO: 48372 - DNA, 25 bp, Mus musculus
gtttggagaccgtttttaagatcag

SEQ ID NO: 48373 - DNA, 25 bp, Mus musculus
gtttggagtggcctacgacagcaat

SEQ ID NO: 48374 - DNA, 25 bp, Mus musculus
gtttggatggtgcaacggattttaa

SEQ ID NO: 48375 - DNA, 25 bp, Mus musculus
gtttggattgtcgtgggcatcctca

SEQ ID NO: 48376 - DNA, 25 bp, Mus musculus
gtttggcagccctcctacttttggg

SEQ ID NO: 48377 - DNA, 25 bp, Mus musculus
gtttggcccctataagcaactgttc

SEQ ID NO: 48378 - DNA, 25 bp, Mus musculus
gtttggcctcacaaggactaccctc

SEQ ID NO: 48379 - DNA, 25 bp, Mus musculus
gtttggcggtctggtgctcagccca

SEQ ID NO: 48380 - DNA, 25 bp, Mus musculus
gtttggctccttccggtctgtgctc

SEQ ID NO: 48381 - DNA, 25 bp, Mus musculus
gtttggctctggcaccacagaaggc

SEQ ID NO: 48382 - DNA, 25 bp, Mus musculus
gtttggctgccccagtgagactgat

SEQ ID NO: 48383 - DNA, 25 bp, Mus musculus
gtttggctgcccgagtgagactgat

SEQ ID NO: 48384 - DNA, 25 bp, Mus musculus
gtttgggccacaactgaagaatgag

SEQ ID NO: 48385 - DNA, 25 bp, Mus musculus
gtttgggcggacttcctacaatcag

SEQ ID NO: 48386 - DNA, 25 bp, Mus musculus
gtttgggctgataaactcccatgga

SEQ ID NO: 48387 - DNA, 25 bp, Mus musculus
gtttgggtgcttttgggtttcagct

SEQ ID NO: 48388 - DNA, 25 bp, Mus musculus
gtttggtatgcctcatcaactgtgc

SEQ ID NO: 48389 - DNA, 25 bp, Mus musculus
gtttggtcacatgaagattgtagcc

SEQ ID NO: 48390 - DNA, 25 bp, Mus musculus
gtttggtcatctccgttctccattg

SEQ ID NO: 48391 - DNA, 25 bp, Mus musculus
gtttggtcgcaagaatgtgctgttt

SEQ ID NO: 48392 - DNA, 25 bp, Mus musculus
gtttggtggaaaaacacacaccaag

SEQ ID NO: 48393 - DNA, 25 bp, Mus musculus
gtttgtacaactaaggccacaccag

SEQ ID NO: 48394 - DNA, 25 bp, Mus musculus
gtttgtacaacttaggccacaccag

SEQ ID NO: 48395 - DNA, 25 bp, Mus musculus
gtttgtacagcgcaatgcctcgaga

SEQ ID NO: 48396 - DNA, 25 bp, Mus musculus
gtttgtaccagcattgaaaattggc

SEQ ID NO: 48397 - DNA, 25 bp, Mus musculus
gtttgtatggagagactctaccaga

SEQ ID NO: 48398 - DNA, 25 bp, Mus musculus
gtttgtatggcaggtgcctcagcca

SEQ ID NO: 48399 - DNA, 25 bp, Mus musculus
gtttgtatttaagggccccagcagt

SEQ ID NO: 48400 - DNA, 25 bp, Mus musculus
gtttgtccatgttgtggccatctcc

SEQ ID NO: 48401 - DNA, 25 bp, Mus musculus
gtttgtccctgattctgatgatatt

SEQ ID NO: 48402 - DNA, 25 bp, Mus musculus
gtttgtcctcactgcagaaagcctg

SEQ ID NO: 48403 - DNA, 25 bp, Mus musculus
gtttgtctgcctgtgctcattatag

SEQ ID NO: 48404 - DNA, 25 bp, Mus musculus
gtttgtctgtgcacacacgggtatc

SEQ ID NO: 48405 - DNA, 25 bp, Mus musculus
gtttgtctttacctgtctctctgtc

SEQ ID NO: 48406 - DNA, 25 bp, Mus musculus
gtttgtgatggttccaatggctctt

SEQ ID NO: 48407 - DNA, 25 bp, Mus musculus
gtttgtgcttcaggaatgaaagcca

SEQ ID NO: 48408 - DNA, 25 bp, Mus musculus
gtttgttccagactatcaggctgaa

SEQ ID NO: 48409 - DNA, 25 bp, Mus musculus
gttttaaaatgcctggagtcaatgg

SEQ ID NO: 48410 - DNA, 25 bp, Mus musculus
gttttaaatgcacagagagcaggat

SEQ ID NO: 48411 - DNA, 25 bp, Mus musculus
gttttaactgcttgccgatagcagc

SEQ ID NO: 48412 - DNA, 25 bp, Mus musculus
gttttaagctcccagaaaagtgaat

SEQ ID NO: 48413 - DNA, 25 bp, Mus musculus
gttttacagaagatgctcagaccag

SEQ ID NO: 48414 - DNA, 25 bp, Mus musculus
gttttacatgctgcgggccgccaca

SEQ ID NO: 48415 - DNA, 25 bp, Mus musculus
gttttactaagcatcgtctttcagc

SEQ ID NO: 48416 - DNA, 25 bp, Mus musculus
gttttactcaaacatatcagccctg

SEQ ID NO: 48417 - DNA, 25 bp, Mus musculus
gttttactgcaatcactgcaacaaa

SEQ ID NO: 48418 - DNA, 25 bp, Mus musculus
gttttactgtgactatggagttgtg

SEQ ID NO: 48419 - DNA, 25 bp, Mus musculus
gttttatacgttcctgatcctgaat

SEQ ID NO: 48420 - DNA, 25 bp, Mus musculus
gttttatcagcttgtaagtaccgag

SEQ ID NO: 48421 - DNA, 25 bp, Mus musculus
gttttatctgtgcaaccattctctg

SEQ ID NO: 48422 - DNA, 25 bp, Mus musculus
gttttatgttcgagccccaggaaga

SEQ ID NO: 48423 - DNA, 25 bp, Mus musculus
gttttattcaatagagttcggacaa

SEQ ID NO: 48424 - DNA, 25 bp, Mus musculus
gttttatttatccaaccacctgcga

SEQ ID NO: 48425 - DNA, 25 bp, Mus musculus
gttttcaagcagcacaaactgaacc

SEQ ID NO: 48426 - DNA, 25 bp, Mus musculus
gttttcactggaagagttacaagtg

SEQ ID NO: 48427 - DNA, 25 bp, Mus musculus
gttttcagatagaagctttgcccag

SEQ ID NO: 48428 - DNA, 25 bp, Mus musculus
gttttcagctatccttgtaactgtc

SEQ ID NO: 48429 - DNA, 25 bp, Mus musculus
gttttcaggcttggagttccagggt

SEQ ID NO: 48430 - DNA, 25 bp, Mus musculus
gttttccaaggcagtggccctccga

SEQ ID NO: 48431 - DNA, 25 bp, Mus musculus
gttttccaaggctgtggccctccga

SEQ ID NO: 48432 - DNA, 25 bp, Mus musculus
gttttccagactccaaactatcatg

SEQ ID NO: 48433 - DNA, 25 bp, Mus musculus
gttttccgaagatacactgacttct

SEQ ID NO: 48434 - DNA, 25 bp, Mus musculus
gttttcgattgtgggtcctaagtcg

SEQ ID NO: 48435 - DNA, 25 bp, Mus musculus
gttttcgggttgcatagtgtttcca

SEQ ID NO: 48436 - DNA, 25 bp, Mus musculus
gttttcttgtacgagttccagcata

SEQ ID NO: 48437 - DNA, 25 bp, Mus musculus
gttttgactggaacttggtgttcaa

SEQ ID NO: 48438 - DNA, 25 bp, Mus musculus
gttttgcctcaattctgggattaaa

SEQ ID NO: 48439 - DNA, 25 bp, Mus musculus
gttttggcagcctgatcgcttttgc

SEQ ID NO: 48440 - DNA, 25 bp, Mus musculus
gttttgggaacactccagactggaa

SEQ ID NO: 48441 - DNA, 25 bp, Mus musculus
gttttgtcgctaacctctcagttca

SEQ ID NO: 48442 - DNA, 25 bp, Mus musculus
gttttgtgcatcagttgaacccatt

SEQ ID NO: 48443 - DNA, 25 bp, Mus musculus
gtttttccgagtggaccatggcctt

SEQ ID NO: 48444 - DNA, 25 bp, Mus musculus
gtttttcgctccagggtcatcgccg

SEQ ID NO: 48445 - DNA, 25 bp, Mus musculus
gtttttctcactggatctctgcata

SEQ ID NO: 48446 - DNA, 25 bp, Mus musculus
gtttttctcagcacagatgaagatg

SEQ ID NO: 48447 - DNA, 25 bp, Mus musculus
gtttttctcagctcagatgaagatg

SEQ ID NO: 48448 - DNA, 25 bp, Mus musculus
gtttttctcttgtgccttttggaag

SEQ ID NO: 48449 - DNA, 25 bp, Mus musculus
gtttttggaggtcctttcctcactg

SEQ ID NO: 48450 - DNA, 25 bp, Mus musculus
gtttttgttaattctaggaggatca

SEQ ID NO: 48451 - DNA, 25 bp, Mus musculus
gttttttgcctcctcaatggaggga

SEQ ID NO: 48452 - DNA, 25 bp, Mus musculus
taaaaaacaagaagcagatgagttg

SEQ ID NO: 48453 - DNA, 25 bp, Mus musculus
taaaaaacgatgaaggcactgtata

SEQ ID NO: 48454 - DNA, 25 bp, Mus musculus
taaaaaagctggtggctagactgca

SEQ ID NO: 48455 - DNA, 25 bp, Mus musculus
taaaaaatacattaagggcctggtg

SEQ ID NO: 48456 - DNA, 25 bp, Mus musculus
taaaaaatcaaagtcgcaccctgcc

SEQ ID NO: 48457 - DNA, 25 bp, Mus musculus
taaaaaattctcaatggacagacag

SEQ ID NO: 48458 - DNA, 25 bp, Mus musculus
taaaaacaatgaatgacctgtccag

SEQ ID NO: 48459 - DNA, 25 bp, Mus musculus
taaaaacagacctacagatggccct

SEQ ID NO: 48460 - DNA, 25 bp, Mus musculus
taaaaacatggaagtttcccagctc

SEQ ID NO: 48461 - DNA, 25 bp, Mus musculus
taaaaacctgcctcctagtggtact

SEQ ID NO: 48462 - DNA, 25 bp, Mus musculus
taaaaacgagtttgcccagagatca

SEQ ID NO: 48463 - DNA, 25 bp, Mus musculus
taaaaacggaacttgaagcgtctca

SEQ ID NO: 48464 - DNA, 25 bp, Mus musculus
taaaaactttgtctaaggttcagtg

SEQ ID NO: 48465 - DNA, 25 bp, Mus musculus
taaaaagagttcaggatctggtgac

SEQ ID NO: 48466 - DNA, 25 bp, Mus musculus
taaaaagccctatgtggctaaactg

SEQ ID NO: 48467 - DNA, 25 bp, Mus musculus
taaaaagccgccaagctgcaatatc

SEQ ID NO: 48468 - DNA, 25 bp, Mus musculus
taaaaagccgcctagctgcaatatc

SEQ ID NO: 48469 - DNA, 25 bp, Mus musculus
taaaaagcgggaaggatttgagttg

SEQ ID NO: 48470 - DNA, 25 bp, Mus musculus
taaaaaggaaacactgacccctgct

SEQ ID NO: 48471 - DNA, 25 bp, Mus musculus
taaaaaggaagtgagcccctgtgag

SEQ ID NO: 48472 - DNA, 25 bp, Mus musculus
taaaaaggacgtttcagtgctttgg

SEQ ID NO: 48473 - DNA, 25 bp, Mus musculus
taaaaaggtgcagcgctgtgaaggc

SEQ ID NO: 48474 - DNA, 25 bp, Mus musculus
taaaaagtattgtaacagctgaagt

SEQ ID NO: 48475 - DNA, 25 bp, Mus musculus
taaaaatacgccaggacagtgtcac

SEQ ID NO: 48476 - DNA, 25 bp, Mus musculus
taaaaatctttgcagacctgatagt

SEQ ID NO: 48477 - DNA, 25 bp, Mus musculus
taaaaatgacctctagccccatggg

SEQ ID NO: 48478 - DNA, 25 bp, Mus musculus
taaaaatgccagcacggataactca

SEQ ID NO: 48479 - DNA, 25 bp, Mus musculus
taaaaatgccagcactgataacact

SEQ ID NO: 48480 - DNA, 25 bp, Mus musculus
taaaaatggtgtcctagaagaggcg

SEQ ID NO: 48481 - DNA, 25 bp, Mus musculus
taaaaatgttggaaccggattggtg

SEQ ID NO: 48482 - DNA, 25 bp, Mus musculus
taaaaattcagacggtcaagcaagt

SEQ ID NO: 48483 - DNA, 25 bp, Mus musculus
taaaaatttcaacataacgtgtcca

SEQ ID NO: 48484 - DNA, 25 bp, Mus musculus
taaaaatttcaagataacgtgtcca

SEQ ID NO: 48485 - DNA, 25 bp, Mus musculus
taaaacacaggagctgtcagcagcc

SEQ ID NO: 48486 - DNA, 25 bp, Mus musculus
taaaacaccattgtggagcatgatt

SEQ ID NO: 48487 - DNA, 25 bp, Mus musculus
taaaacatgggaaccacacatgtgg

SEQ ID NO: 48488 - DNA, 25 bp, Mus musculus
taaaaccaatatggtcgacctgtgc

SEQ ID NO: 48489 - DNA, 25 bp, Mus musculus
taaaaccacagcaagtactggtgtg

SEQ ID NO: 48490 - DNA, 25 bp, Mus musculus
taaaaccatggcgaacttaaccaga

SEQ ID NO: 48491 - DNA, 25 bp, Mus musculus
taaaaccgactctgaagaaaaagag

SEQ ID NO: 48492 - DNA, 25 bp, Mus musculus
taaaaccgcttcatttggcaacatt

SEQ ID NO: 48493 - DNA, 25 bp, Mus musculus
taaaaccggtaagatcaagtgccta

SEQ ID NO: 48494 - DNA, 25 bp, Mus musculus
taaaacctatgatgagggctttgag

SEQ ID NO: 48495 - DNA, 25 bp, Mus musculus
taaaactagtttgagccgtagagga

SEQ ID NO: 48496 - DNA, 25 bp, Mus musculus
taaaactatgtaaatccatggcggg

SEQ ID NO: 48497 - DNA, 25 bp, Mus musculus
taaaactgcaaacagaaaccaggtg

SEQ ID NO: 48498 - DNA, 25 bp, Mus musculus
taaaactgcaaagagaaaccaggtg

SEQ ID NO: 48499 - DNA, 25 bp, Mus musculus
taaaactggcccacacctaccgaag

SEQ ID NO: 48500 - DNA, 25 bp, Mus musculus
taaaacttacgcagctggttgcaga

SEQ ID NO: 48501 - DNA, 25 bp, Mus musculus
taaaacttacgctgctggttgcaga

SEQ ID NO: 48502 - DNA, 25 bp, Mus musculus
taaaacttgaaattctcaacaggac

SEQ ID NO: 48503 - DNA, 25 bp, Mus musculus
taaaagaacttaccaagcagtatga

SEQ ID NO: 48504 - DNA, 25 bp, Mus musculus
taaaagaagacagctcagaagcttc

SEQ ID NO: 48505 - DNA, 25 bp, Mus musculus
taaaagaagagagtacctttatcag

SEQ ID NO: 48506 - DNA, 25 bp, Mus musculus
taaaagaagttgtgattcatccctg

SEQ ID NO: 48507 - DNA, 25 bp, Mus musculus
taaaagacataaatggtcccaccca

SEQ ID NO: 48508 - DNA, 25 bp, Mus musculus
taaaagagatgtttccaggctttcg

SEQ ID NO: 48509 - DNA, 25 bp, Mus musculus
taaaagagtcaatcactgagaaaac

SEQ ID NO: 48510 - DNA, 25 bp, Mus musculus
taaaagagtttttcaggagggacag

SEQ ID NO: 48511 - DNA, 25 bp, Mus musculus
taaaagataaaccagaaggcagcgc

SEQ ID NO: 48512 - DNA, 25 bp, Mus musculus
taaaagatactgcaatgcacatgtc

SEQ ID NO: 48513 - DNA, 25 bp, Mus musculus
taaaagatcctagaacagtttacgg

SEQ ID NO: 48514 - DNA, 25 bp, Mus musculus
taaaagatgaccagacccttgactt

SEQ ID NO: 48515 - DNA, 25 bp, Mus musculus
taaaagatgcaacaatattggagaa

SEQ ID NO: 48516 - DNA, 25 bp, Mus musculus
taaaagatgtgatggagaagttatc

SEQ ID NO: 48517 - DNA, 25 bp, Mus musculus
taaaagattctgatgtcgaaggtgg

SEQ ID NO: 48518 - DNA, 25 bp, Mus musculus
taaaagcacgggaaccattagcgtc

SEQ ID NO: 48519 - DNA, 25 bp, Mus musculus
taaaagcagccttggtgaagaaaga

SEQ ID NO: 48520 - DNA, 25 bp, Mus musculus
taaaagcagctttatagatgataac

SEQ ID NO: 48521 - DNA, 25 bp, Mus musculus
taaaagcctgcaaaatcagagcccc

SEQ ID NO: 48522 - DNA, 25 bp, Mus musculus
taaaaggaatcctgaccaatgggct

SEQ ID NO: 48523 - DNA, 25 bp, Mus musculus
taaaaggcgcgagagaatggatgat

SEQ ID NO: 48524 - DNA, 25 bp, Mus musculus
taaaagggaacttgagatgagcaaa

SEQ ID NO: 48525 - DNA, 25 bp, Mus musculus
taaaagtacacacggactttctccg

SEQ ID NO: 48526 - DNA, 25 bp, Mus musculus
taaaagtctcacttctgaatgccac

SEQ ID NO: 48527 - DNA, 25 bp, Mus musculus
taaaagtcttcatcgggtctccctg

SEQ ID NO: 48528 - DNA, 25 bp, Mus musculus
taaaagtgtccctctccatgaaagt

SEQ ID NO: 48529 - DNA, 25 bp, Mus musculus
taaaagttgacctgtttagagaaga

SEQ ID NO: 48530 - DNA, 25 bp, Mus musculus
taaaatagtagatgaggaggagtac

SEQ ID NO: 48531 - DNA, 25 bp, Mus musculus
taaaatataccaggatttccacagg

SEQ ID NO: 48532 - DNA, 25 bp, Mus musculus
taaaatcaggtggttaccgcaacag

SEQ ID NO: 48533 - DNA, 25 bp, Mus musculus
taaaatccctaagagcaagcgccaa

SEQ ID NO: 48534 - DNA, 25 bp, Mus musculus
taaaatcgcagttaatagctcgcct

SEQ ID NO: 48535 - DNA, 25 bp, Mus musculus
taaaatcgctgcatgtatgagaaat

SEQ ID NO: 48536 - DNA, 25 bp, Mus musculus
taaaatcttgtcctaggaagaaagg

SEQ ID NO: 48537 - DNA, 25 bp, Mus musculus
taaaatgactgagctcttccaatcc

SEQ ID NO: 48538 - DNA, 25 bp, Mus musculus
taaaatgagctttatagtacacaca

SEQ ID NO: 48539 - DNA, 25 bp, Mus musculus
taaaatgagtatgaaaacgggcagt

SEQ ID NO: 48540 - DNA, 25 bp, Mus musculus
taaaatgcctggagtcaatgggtca

SEQ ID NO: 48541 - DNA, 25 bp, Mus musculus
taaaatgctacagaccaaagatggc

SEQ ID NO: 48542 - DNA, 25 bp, Mus musculus
taaaatgcttcctgcagttccaggc

SEQ ID NO: 48543 - DNA, 25 bp, Mus musculus
taaaatggcagtgcgcctagctggt

SEQ ID NO: 48544 - DNA, 25 bp, Mus musculus
taaaatggtcgtcccttccatggcc

SEQ ID NO: 48545 - DNA, 25 bp, Mus musculus
taaaatgtcagatatcctggcggag

SEQ ID NO: 48546 - DNA, 25 bp, Mus musculus
taaaatttcaagagagtcgtggata

SEQ ID NO: 48547 - DNA, 25 bp, Mus musculus
taaacaaaactgacctgatttctgt

SEQ ID NO: 48548 - DNA, 25 bp, Mus musculus
taaacaaacagttggaaggacctga

SEQ ID NO: 48549 - DNA, 25 bp, Mus musculus
taaacaaagccctggacttcatcgc

SEQ ID NO: 48550 - DNA, 25 bp, Mus musculus
taaacaaagtgcagatgtgccagct

SEQ ID NO: 48551 - DNA, 25 bp, Mus musculus
taaacaaagttcctgtactcaaaga

SEQ ID NO: 48552 - DNA, 25 bp, Mus musculus
taaacaacagcttctcttccttcat

SEQ ID NO: 48553 - DNA, 25 bp, Mus musculus
taaacaaggacaacactggctggag

SEQ ID NO: 48554 - DNA, 25 bp, Mus musculus
taaacaatcttgattcctgttgccg

SEQ ID NO: 48555 - DNA, 25 bp, Mus musculus
taaacaattggaacaggtccacgca

SEQ ID NO: 48556 - DNA, 25 bp, Mus musculus
taaacacactgcaatttctgtgtcc

SEQ ID NO: 48557 - DNA, 25 bp, Mus musculus
taaacacagtcatttgcgtgagctg

SEQ ID NO: 48558 - DNA, 25 bp, Mus musculus
taaacaccaggtgttggctgccctg

SEQ ID NO: 48559 - DNA, 25 bp, Mus musculus
taaacaccattctcagcactggcct

SEQ ID NO: 48560 - DNA, 25 bp, Mus musculus
taaacactgggcgtccatgcatgtc

SEQ ID NO: 48561 - DNA, 25 bp, Mus musculus
taaacacttgtgtctcccagttgtg

SEQ ID NO: 48562 - DNA, 25 bp, Mus musculus
taaacagagcagcagtgcagtgcca

SEQ ID NO: 48563 - DNA, 25 bp, Mus musculus
taaacagagttcttcgcaacctggc

SEQ ID NO: 48564 - DNA, 25 bp, Mus musculus
taaacaggacactcctgctctgcct

SEQ ID NO: 48565 - DNA, 25 bp, Mus musculus
taaacaggtgatccaccctaaccag

SEQ ID NO: 48566 - DNA, 25 bp, Mus musculus
taaacagtaaagctgtcaaggacag

SEQ ID NO: 48567 - DNA, 25 bp, Mus musculus
taaacagtgcagaccccggtgtgtt

SEQ ID NO: 48568 - DNA, 25 bp, Mus musculus
taaacataaacatgagatgacactg

SEQ ID NO: 48569 - DNA, 25 bp, Mus musculus
taaacatcgagagcttctccagtcg

SEQ ID NO: 48570 - DNA, 25 bp, Mus musculus
taaacatcgcgtccttagataaaga

SEQ ID NO: 48571 - DNA, 25 bp, Mus musculus
taaacatctaccctaagtgccttgg

SEQ ID NO: 48572 - DNA, 25 bp, Mus musculus
taaacatgcccttagcgcaggctac

SEQ ID NO: 48573 - DNA, 25 bp, Mus musculus
taaacatggcctctttagtgggcag

SEQ ID NO: 48574 - DNA, 25 bp, Mus musculus
taaacattgtgcatggtgacctcaa

SEQ ID NO: 48575 - DNA, 25 bp, Mus musculus
taaacattgtgcttggtgacctcaa

SEQ ID NO: 48576 - DNA, 25 bp, Mus musculus
taaaccaaagaaaacagcacatgtg

SEQ ID NO: 48577 - DNA, 25 bp, Mus musculus
taaaccaagaggtgatggcgcctgg

SEQ ID NO: 48578 - DNA, 25 bp, Mus musculus
taaaccacagaagtctcgggctacc

SEQ ID NO: 48579 - DNA, 25 bp, Mus musculus
taaaccaccatatgaacatccaaaa

SEQ ID NO: 48580 - DNA, 25 bp, Mus musculus
taaaccacgaggatcctaagacgca

SEQ ID NO: 48581 - DNA, 25 bp, Mus musculus
taaaccagaaggcagcgctagtgtc

SEQ ID NO: 48582 - DNA, 25 bp, Mus musculus
taaaccagtcaagtccaaaaaactg

SEQ ID NO: 48583 - DNA, 25 bp, Mus musculus
taaaccatccttgctacagcctaga

SEQ ID NO: 48584 - DNA, 25 bp, Mus musculus
taaacccaggatagcaggattagca

SEQ ID NO: 48585 - DNA, 25 bp, Mus musculus
taaaccccacagttcatgtagaaga

SEQ ID NO: 48586 - DNA, 25 bp, Mus musculus
taaacccctgagcattctgcatatg

SEQ ID NO: 48587 - DNA, 25 bp, Mus musculus
taaacccgaaacctcactatggatg

SEQ ID NO: 48588 - DNA, 25 bp, Mus musculus
taaacccgtgtcaagccgtgtaagc

SEQ ID NO: 48589 - DNA, 25 bp, Mus musculus
taaaccctcacgtccacgtgattgg

SEQ ID NO: 48590 - DNA, 25 bp, Mus musculus
taaaccctgagtgtccctgtcccac

SEQ ID NO: 48591 - DNA, 25 bp, Mus musculus
taaaccctgattaccggcaggaaat

SEQ ID NO: 48592 - DNA, 25 bp, Mus musculus
taaaccgagagtgtgtgcgtgggct

SEQ ID NO: 48593 - DNA, 25 bp, Mus musculus
taaaccgagctggttctggggtcac

SEQ ID NO: 48594 - DNA, 25 bp, Mus musculus
taaaccggcctcagaagtgatcagc

SEQ ID NO: 48595 - DNA, 25 bp, Mus musculus
taaacctactcaaggagtccagcca

SEQ ID NO: 48596 - DNA, 25 bp, Mus musculus
taaacctgacagtacactttcacag

SEQ ID NO: 48597 - DNA, 25 bp, Mus musculus
taaacctgcagttaatgtcccacgg

SEQ ID NO: 48598 - DNA, 25 bp, Mus musculus
taaacctgccaagtacttctcggag

SEQ ID NO: 48599 - DNA, 25 bp, Mus musculus
taaacctgctgcctgtagaagcaga

SEQ ID NO: 48600 - DNA, 25 bp, Mus musculus
taaacctggaagtctggcaacaaaa

SEQ ID NO: 48601 - DNA, 25 bp, Mus musculus
taaacctggcagtgttaaaactgaa

SEQ ID NO: 48602 - DNA, 25 bp, Mus musculus
taaaccttagagacagccaagtcct

SEQ ID NO: 48603 - DNA, 25 bp, Mus musculus
taaacgaagtttcttcttcccacat

SEQ ID NO: 48604 - DNA, 25 bp, Mus musculus
taaacgacacaatagagcttcggga

SEQ ID NO: 48605 - DNA, 25 bp, Mus musculus
taaacgacctgaaacagtactggaa

SEQ ID NO: 48606 - DNA, 25 bp, Mus musculus
taaacgatggataaatgaagcccaa

SEQ ID NO: 48607 - DNA, 25 bp, Mus musculus
taaacgcagatgtgcagtctgaggc

SEQ ID NO: 48608 - DNA, 25 bp, Mus musculus
taaacgccttcataccaaaggatct

SEQ ID NO: 48609 - DNA, 25 bp, Mus musculus
taaacgctgtgcatccaaagtacca

SEQ ID NO: 48610 - DNA, 25 bp, Mus musculus
taaacggagatgcttatatttccca

SEQ ID NO: 48611 - DNA, 25 bp, Mus musculus
taaacgtggctagtgactgccgctt

SEQ ID NO: 48612 - DNA, 25 bp, Mus musculus
taaacgttgaagctcgctgtactgc

SEQ ID NO: 48613 - DNA, 25 bp, Mus musculus
taaactatcgtgacaaagctgctga

SEQ ID NO: 48614 - DNA, 25 bp, Mus musculus
taaactcccatggaattattgcaca

SEQ ID NO: 48615 - DNA, 25 bp, Mus musculus
taaactctcaggcaagccaagatgg

SEQ ID NO: 48616 - DNA, 25 bp, Mus musculus
taaactcttggcacttgcggtggct

SEQ ID NO: 48617 - DNA, 25 bp, Mus musculus
taaactcttggcctcaagacaaggt

SEQ ID NO: 48618 - DNA, 25 bp, Mus musculus
taaactcttggctcttgcggtggct

SEQ ID NO: 48619 - DNA, 25 bp, Mus musculus
taaactgaaggaacagtacaagaag

SEQ ID NO: 48620 - DNA, 25 bp, Mus musculus
taaactgaatcaggtttccaacaac

SEQ ID NO: 48621 - DNA, 25 bp, Mus musculus
taaactgaccttcttggagtgagaa

SEQ ID NO: 48622 - DNA, 25 bp, Mus musculus
taaactgcttgacaaagtcagcatt

SEQ ID NO: 48623 - DNA, 25 bp, Mus musculus
taaactggcagctttagcttcagac

SEQ ID NO: 48624 - DNA, 25 bp, Mus musculus
taaactggccaatgaagaagcaaag

SEQ ID NO: 48625 - DNA, 25 bp, Mus musculus
taaactgggtacctatgaagtgtct

SEQ ID NO: 48626 - DNA, 25 bp, Mus musculus
taaacttacctgttggatcaaaagc

SEQ ID NO: 48627 - DNA, 25 bp, Mus musculus
taaacttatagcgtgggaacgtact

SEQ ID NO: 48628 - DNA, 25 bp, Mus musculus
taaacttcagatacgaaatatcccg

SEQ ID NO: 48629 - DNA, 25 bp, Mus musculus
taaacttcccggtgagccgccgctg

SEQ ID NO: 48630 - DNA, 25 bp, Mus musculus
taaacttcctgcatccaaatcatca

SEQ ID NO: 48631 - DNA, 25 bp, Mus musculus
taaacttcctgcttccaaatcatca

SEQ ID NO: 48632 - DNA, 25 bp, Mus musculus
taaacttgcctttgagcgttaagcc

SEQ ID NO: 48633 - DNA, 25 bp, Mus musculus
taaacttggtgaccaaatggccatg

SEQ ID NO: 48634 - DNA, 25 bp, Mus musculus
taaagaaaacgtgcccagaagcaga

SEQ ID NO: 48635 - DNA, 25 bp, Mus musculus
taaagaaaattgacattccgtctgt

SEQ ID NO: 48636 - DNA, 25 bp, Mus musculus
taaagaaagaagtagccagagagag

SEQ ID NO: 48637 - DNA, 25 bp, Mus musculus
taaagaaaggacaatggccattcct

SEQ ID NO: 48638 - DNA, 25 bp, Mus musculus
taaagaaattgctcgagactccatc

SEQ ID NO: 48639 - DNA, 25 bp, Mus musculus
taaagaacaaggctatggcaagcta

SEQ ID NO: 48640 - DNA, 25 bp, Mus musculus
taaagaacacctgttggagcagtcc

SEQ ID NO: 48641 - DNA, 25 bp, Mus musculus
taaagaacgcttacgcagaatccat

SEQ ID NO: 48642 - DNA, 25 bp, Mus musculus
taaagaacggacctcaggcttcacc

SEQ ID NO: 48643 - DNA, 25 bp, Mus musculus
taaagaactgttgaagacgaaggtt

SEQ ID NO: 48644 - DNA, 25 bp, Mus musculus
taaagaagaaagctgcagtgaggca

SEQ ID NO: 48645 - DNA, 25 bp, Mus musculus
taaagaagaatttgagctccatccc

SEQ ID NO: 48646 - DNA, 25 bp, Mus musculus
taaagaagagcctgccaaccacagg

SEQ ID NO: 48647 - DNA, 25 bp, Mus musculus
taaagaagcccaggacgacctggtg

SEQ ID NO: 48648 - DNA, 25 bp, Mus musculus
taaagaagcgagcaaataaagcagc

SEQ ID NO: 48649 - DNA, 25 bp, Mus musculus
taaagaaggttaattaggttctcag

SEQ ID NO: 48650 - DNA, 25 bp, Mus musculus
taaagaatggcagcgagtgatctca

SEQ ID NO: 48651 - DNA, 25 bp, Mus musculus
taaagacaaagacttccaaggtctc

SEQ ID NO: 48652 - DNA, 25 bp, Mus musculus
taaagacaatggaggcatgcttgtg

SEQ ID NO: 48653 - DNA, 25 bp, Mus musculus
taaagacacgggtttctcacaggat

SEQ ID NO: 48654 - DNA, 25 bp, Mus musculus
taaagacacttaataccatgaggtg

SEQ ID NO: 48655 - DNA, 25 bp, Mus musculus
taaagacacttattaccatgaggtg

SEQ ID NO: 48656 - DNA, 25 bp, Mus musculus
taaagacagggcttatgaagtccct

SEQ ID NO: 48657 - DNA, 25 bp, Mus musculus
taaagaccaggctctgtttcccgtg

SEQ ID NO: 48658 - DNA, 25 bp, Mus musculus
taaagacctcggatgttaggatgaa

SEQ ID NO: 48659 - DNA, 25 bp, Mus musculus
taaagacgcgctcactcagcgcctg

SEQ ID NO: 48660 - DNA, 25 bp, Mus musculus
taaagactatatctaaagctccatc

SEQ ID NO: 48661 - DNA, 25 bp, Mus musculus
taaagactcgcttacagcttgatgc

SEQ ID NO: 48662 - DNA, 25 bp, Mus musculus
taaagactggacctcaagtgggtct

SEQ ID NO: 48663 - DNA, 25 bp, Mus musculus
taaagacttcaacggagatttcaga

SEQ ID NO: 48664 - DNA, 25 bp, Mus musculus
taaagacttcttccgcctctttccg

SEQ ID NO: 48665 - DNA, 25 bp, Mus musculus
taaagagaaggaaatctcagtctcc

SEQ ID NO: 48666 - DNA, 25 bp, Mus musculus
taaagagacagaaatcacaccagag

SEQ ID NO: 48667 - DNA, 25 bp, Mus musculus
taaagagacatcagtagcatatctt

SEQ ID NO: 48668 - DNA, 25 bp, Mus musculus
taaagagactagagaccatggagcg

SEQ ID NO: 48669 - DNA, 25 bp, Mus musculus
taaagagagagataagactgcgccc

SEQ ID NO: 48670 - DNA, 25 bp, Mus musculus
taaagagaggcttacttccgatgca

SEQ ID NO: 48671 - DNA, 25 bp, Mus musculus
taaagagcaacagaggcagagactg

SEQ ID NO: 48672 - DNA, 25 bp, Mus musculus
taaagaggaagactataaatctggc

SEQ ID NO: 48673 - DNA, 25 bp, Mus musculus
taaagaggctgagagtgtaacagag

SEQ ID NO: 48674 - DNA, 25 bp, Mus musculus
taaagagtatggacaagtagaatcc

SEQ ID NO: 48675 - DNA, 25 bp, Mus musculus
taaagagtcctcagccagtgagggc

SEQ ID NO: 48676 - DNA, 25 bp, Mus musculus
taaagagtgagacttttcccatctc

SEQ ID NO: 48677 - DNA, 25 bp, Mus musculus
taaagagtgagagttttcccatctc

SEQ ID NO: 48678 - DNA, 25 bp, Mus musculus
taaagagttccatcctttaccagta

SEQ ID NO: 48679 - DNA, 25 bp, Mus musculus
taaagataaaagaaagttgtcctgg

SEQ ID NO: 48680 - DNA, 25 bp, Mus musculus
taaagatcactacagttgttcaaca

SEQ ID NO: 48681 - DNA, 25 bp, Mus musculus
taaagatctttcatctctgtgatgg

SEQ ID NO: 48682 - DNA, 25 bp, Mus musculus
taaagatgaagaggagcaaactggc

SEQ ID NO: 48683 - DNA, 25 bp, Mus musculus
taaagatgatgaaccagctgtaaag

SEQ ID NO: 48684 - DNA, 25 bp, Mus musculus
taaagatgcactgcagttggcacaa

SEQ ID NO: 48685 - DNA, 25 bp, Mus musculus
taaagatgctaaagtctaagaatgc

SEQ ID NO: 48686 - DNA, 25 bp, Mus musculus
taaagatggcttccttgtttactca

SEQ ID NO: 48687 - DNA, 25 bp, Mus musculus
taaagatgggaaaaccccactacat

SEQ ID NO: 48688 - DNA, 25 bp, Mus musculus
taaagatgttcctcagttccggata

SEQ ID NO: 48689 - DNA, 25 bp, Mus musculus
taaagattgccctgtaactgccatg

SEQ ID NO: 48690 - DNA, 25 bp, Mus musculus
taaagcaaagcaaactgagtcgtgt

SEQ ID NO: 48691 - DNA, 25 bp, Mus musculus
taaagcaaatgccaccattgaagtg

SEQ ID NO: 48692 - DNA, 25 bp, Mus musculus
taaagcaagactgagaaatgcattc

SEQ ID NO: 48693 - DNA, 25 bp, Mus musculus
taaagcaaggcatgtcgatgaggga

SEQ ID NO: 48694 - DNA, 25 bp, Mus musculus
taaagcaagttgaggcactgaagat

SEQ ID NO: 48695 - DNA, 25 bp, Mus musculus
taaagcaccattcattgcagagaga

SEQ ID NO: 48696 - DNA, 25 bp, Mus musculus
taaagcaccgagtcaaaagcatggt

SEQ ID NO: 48697 - DNA, 25 bp, Mus musculus
taaagcagaaataaaggctgccaaa

SEQ ID NO: 48698 - DNA, 25 bp, Mus musculus
taaagcatgcactgcactgcaccat

SEQ ID NO: 48699 - DNA, 25 bp, Mus musculus
taaagcatgctagtgattcaagttc

SEQ ID NO: 48700 - DNA, 25 bp, Mus musculus
taaagcatgtataccaaaaacacag

SEQ ID NO: 48701 - DNA, 25 bp, Mus musculus
taaagcatgtattccaaaaacacag

SEQ ID NO: 48702 - DNA, 25 bp, Mus musculus
taaagcatgttaaggagactcagcc

SEQ ID NO: 48703 - DNA, 25 bp, Mus musculus
taaagcattcagtttgacgagcaaa

SEQ ID NO: 48704 - DNA, 25 bp, Mus musculus
taaagccaatggaggtgtcagtgga

SEQ ID NO: 48705 - DNA, 25 bp, Mus musculus
taaagccctgtaagattttcttggg

SEQ ID NO: 48706 - DNA, 25 bp, Mus musculus
taaagccctgtatgattttcttggg

SEQ ID NO: 48707 - DNA, 25 bp, Mus musculus
taaagccgtaccaggtgtttggaca

SEQ ID NO: 48708 - DNA, 25 bp, Mus musculus
taaagccgtacctggtgtttggaca

SEQ ID NO: 48709 - DNA, 25 bp, Mus musculus
taaagccttccacccaaagcagtgc

SEQ ID NO: 48710 - DNA, 25 bp, Mus musculus
taaagccttgttccgcacgcccttt

SEQ ID NO: 48711 - DNA, 25 bp, Mus musculus
taaagcgcttgcagcaaacgtctgg

SEQ ID NO: 48712 - DNA, 25 bp, Mus musculus
taaagctataaattcagcattggct

SEQ ID NO: 48713 - DNA, 25 bp, Mus musculus
taaagctataccaacagaatgtgcc

SEQ ID NO: 48714 - DNA, 25 bp, Mus musculus
taaagctccctaggctattccgcat

SEQ ID NO: 48715 - DNA, 25 bp, Mus musculus
taaagctcggcagattatgaaccag

SEQ ID NO: 48716 - DNA, 25 bp, Mus musculus
taaagctcggtactgccatctagga

SEQ ID NO: 48717 - DNA, 25 bp, Mus musculus
taaagctcggtagtgccatctagga

SEQ ID NO: 48718 - DNA, 25 bp, Mus musculus
taaagctgacatgttcaagcaacag

SEQ ID NO: 48719 - DNA, 25 bp, Mus musculus
taaagctgctcaaagaccgtggcat

SEQ ID NO: 48720 - DNA, 25 bp, Mus musculus
taaagctgctgttatggtccatcag

SEQ ID NO: 48721 - DNA, 25 bp, Mus musculus
taaagctgcttcgacatgagaaccg

SEQ ID NO: 48722 - DNA, 25 bp, Mus musculus
taaagctggaagatgtggctgacat

SEQ ID NO: 48723 - DNA, 25 bp, Mus musculus
taaagctggctgacatcaacgggcc

SEQ ID NO: 48724 - DNA, 25 bp, Mus musculus
taaagctgtaccctgtttcgtgcca

SEQ ID NO: 48725 - DNA, 25 bp, Mus musculus
taaagctgtgaaaatgaccctgaag

SEQ ID NO: 48726 - DNA, 25 bp, Mus musculus
taaagctgtggaattacgtccctgg

SEQ ID NO: 48727 - DNA, 25 bp, Mus musculus
taaagcttccaaatctgaaaaggaa

SEQ ID NO: 48728 - DNA, 25 bp, Mus musculus
taaaggaaccgtcagagggtgccct

SEQ ID NO: 48729 - DNA, 25 bp, Mus musculus
taaaggaagaacgaaaatatctgga

SEQ ID NO: 48730 - DNA, 25 bp, Mus musculus
taaaggaagctcagagcctggtacc

SEQ ID NO: 48731 - DNA, 25 bp, Mus musculus
taaaggacattgttctctacctgtg

SEQ ID NO: 48732 - DNA, 25 bp, Mus musculus
taaaggaccagtctcactgcatgga

SEQ ID NO: 48733 - DNA, 25 bp, Mus musculus
taaaggagccatcaaatttgtactc

SEQ ID NO: 48734 - DNA, 25 bp, Mus musculus
taaaggaggattcgagcagaaaatg

SEQ ID NO: 48735 - DNA, 25 bp, Mus musculus
taaaggatagcgtttccaagaaaat

SEQ ID NO: 48736 - DNA, 25 bp, Mus musculus
taaaggatccaaagaaggctcttca

SEQ ID NO: 48737 - DNA, 25 bp, Mus musculus
taaaggatgatgaaagaaggcagag

SEQ ID NO: 48738 - DNA, 25 bp, Mus musculus
taaaggattaacatgaccaaagatg

SEQ ID NO: 48739 - DNA, 25 bp, Mus musculus
taaaggatttggtagaaataagcct

SEQ ID NO: 48740 - DNA, 25 bp, Mus musculus
taaaggcaaagttctcctgagtaaa

SEQ ID NO: 48741 - DNA, 25 bp, Mus musculus
taaaggcagactggcagcgtctgta

SEQ ID NO: 48742 - DNA, 25 bp, Mus musculus
taaaggcagatgtcgtgccaaagac

SEQ ID NO: 48743 - DNA, 25 bp, Mus musculus
taaaggcatcggacagtgggccttc

SEQ ID NO: 48744 - DNA, 25 bp, Mus musculus
taaaggccaagctccatgtgatgca

SEQ ID NO: 48745 - DNA, 25 bp, Mus musculus
taaaggccacagaaccacaaaactg

SEQ ID NO: 48746 - DNA, 25 bp, Mus musculus
taaaggccgcgctcactctagggga

SEQ ID NO: 48747 - DNA, 25 bp, Mus musculus
taaaggccttcatagactgctgcaa

SEQ ID NO: 48748 - DNA, 25 bp, Mus musculus
taaaggcgcaaatgcctccaaccct

SEQ ID NO: 48749 - DNA, 25 bp, Mus musculus
taaaggctgcagaaaacttcaccct

SEQ ID NO: 48750 - DNA, 25 bp, Mus musculus
taaaggctgggcctttctgcatcac

SEQ ID NO: 48751 - DNA, 25 bp, Mus musculus
taaaggcttacaaaaaggagctgga

SEQ ID NO: 48752 - DNA, 25 bp, Mus musculus
taaagggattatcgccagcagcatt

SEQ ID NO: 48753 - DNA, 25 bp, Mus musculus
taaagggcccctgaacggtgatact

SEQ ID NO: 48754 - DNA, 25 bp, Mus musculus
taaagggctgctgctttgctggatg

SEQ ID NO: 48755 - DNA, 25 bp, Mus musculus
taaagggtctaatgccaggaacagc

SEQ ID NO: 48756 - DNA, 25 bp, Mus musculus
taaaggtaaacagccttggtccgca

SEQ ID NO: 48757 - DNA, 25 bp, Mus musculus
taaaggtactgagaaaagagagtca

SEQ ID NO: 48758 - DNA, 25 bp, Mus musculus
taaaggtagagacactggcatggac

SEQ ID NO: 48759 - DNA, 25 bp, Mus musculus
taaaggtagagagcgggaccattcc

SEQ ID NO: 48760 - DNA, 25 bp, Mus musculus
taaaggtatcaggaagataacagaa

SEQ ID NO: 48761 - DNA, 25 bp, Mus musculus
taaaggtcatctcctatggaaatga

SEQ ID NO: 48762 - DNA, 25 bp, Mus musculus
taaaggtgggttagctggccctgat

SEQ ID NO: 48763 - DNA, 25 bp, Mus musculus
taaagtaaatgaaatcgtggagacc

SEQ ID NO: 48764 - DNA, 25 bp, Mus musculus
taaagtacaagagaagagaactgcc

SEQ ID NO: 48765 - DNA, 25 bp, Mus musculus
taaagtatttgaagtgatgctggct

SEQ ID NO: 48766 - DNA, 25 bp, Mus musculus
taaagtcaactttgctacctggaac

SEQ ID NO: 48767 - DNA, 25 bp, Mus musculus
taaagtcatccacttgctggtcttg

SEQ ID NO: 48768 - DNA, 25 bp, Mus musculus
taaagtcattaacaagcactccact

SEQ ID NO: 48769 - DNA, 25 bp, Mus musculus
taaagtccagagtactttagtcctg

SEQ ID NO: 48770 - DNA, 25 bp, Mus musculus
taaagtcgggcaaatgccccgtgga

SEQ ID NO: 48771 - DNA, 25 bp, Mus musculus
taaagtctaagagtggaggaagaac

SEQ ID NO: 48772 - DNA, 25 bp, Mus musculus
taaagtctacttggtcgtggtggat

SEQ ID NO: 48773 - DNA, 25 bp, Mus musculus
taaagtctggatcctgttctcacat

SEQ ID NO: 48774 - DNA, 25 bp, Mus musculus
taaagtgaaagacaggatagaagaa

SEQ ID NO: 48775 - DNA, 25 bp, Mus musculus
taaagtgaagtttgaggtgcagagc

SEQ ID NO: 48776 - DNA, 25 bp, Mus musculus
taaagtgactcagtgcaggcaggcc

SEQ ID NO: 48777 - DNA, 25 bp, Mus musculus
taaagtgcccacgttctcctgttgt

SEQ ID NO: 48778 - DNA, 25 bp, Mus musculus
taaagtgcttcatttcaacagctga

SEQ ID NO: 48779 - DNA, 25 bp, Mus musculus
taaagtggagcttccgagaactgag

SEQ ID NO: 48780 - DNA, 25 bp, Mus musculus
taaagtgtgatatctgtgggatcgt

SEQ ID NO: 48781 - DNA, 25 bp, Mus musculus
taaagtgtgtagaagccgagattgc

SEQ ID NO: 48782 - DNA, 25 bp, Mus musculus
taaagtgtgtatacggaagagagac

SEQ ID NO: 48783 - DNA, 25 bp, Mus musculus
taaagtgtttcaagagtcaaggagg

SEQ ID NO: 48784 - DNA, 25 bp, Mus musculus
taaagttcaagaatgtgcccatcca

SEQ ID NO: 48785 - DNA, 25 bp, Mus musculus
taaagttcaagttaagagctcagac

SEQ ID NO: 48786 - DNA, 25 bp, Mus musculus
taaagttctaccagagggctgctaa

SEQ ID NO: 48787 - DNA, 25 bp, Mus musculus
taaagttctaggcactttcccaaag

SEQ ID NO: 48788 - DNA, 25 bp, Mus musculus
taaagttctagggactttcccaaag

SEQ ID NO: 48789 - DNA, 25 bp, Mus musculus
taaagttgctgggaatccttgccca

SEQ ID NO: 48790 - DNA, 25 bp, Mus musculus
taaagtttgcagctcaatggatgag

SEQ ID NO: 48791 - DNA, 25 bp, Mus musculus
taaataaacgccttcataccaaagg

SEQ ID NO: 48792 - DNA, 25 bp, Mus musculus
taaataagattgatccccacgtacc

SEQ ID NO: 48793 - DNA, 25 bp, Mus musculus
taaataatagatctatgcccataac

SEQ ID NO: 48794 - DNA, 25 bp, Mus musculus
taaataatagatgtatgcccataac

SEQ ID NO: 48795 - DNA, 25 bp, Mus musculus
taaatacaaacgtgggcaagaagaa

SEQ ID NO: 48796 - DNA, 25 bp, Mus musculus
taaatacctgtgtattccagcggca

SEQ ID NO: 48797 - DNA, 25 bp, Mus musculus
taaatacggagaggcagaacatgtt

SEQ ID NO: 48798 - DNA, 25 bp, Mus musculus
taaatactgaagaactgcgcacact

SEQ ID NO: 48799 - DNA, 25 bp, Mus musculus
taaatactgcctatgccaggttgag

SEQ ID NO: 48800 - DNA, 25 bp, Mus musculus
taaatagctccaatgcagaagtgct

SEQ ID NO: 48801 - DNA, 25 bp, Mus musculus
taaataggatttacaagcccttgga

SEQ ID NO: 48802 - DNA, 25 bp, Mus musculus
taaataggtggtttgaagcggagct

SEQ ID NO: 48803 - DNA, 25 bp, Mus musculus
taaatagtacagctacgtcctcccg

SEQ ID NO: 48804 - DNA, 25 bp, Mus musculus
taaatagtatgtgcacagaactgag

SEQ ID NO: 48805 - DNA, 25 bp, Mus musculus
taaatatactgatgcaacttggtgt

SEQ ID NO: 48806 - DNA, 25 bp, Mus musculus
taaatatcgtgtcacagctaatgca

SEQ ID NO: 48807 - DNA, 25 bp, Mus musculus
taaatatgaaggaatggcaggacgg

SEQ ID NO: 48808 - DNA, 25 bp, Mus musculus
taaatattagaacactgacagatga

SEQ ID NO: 48809 - DNA, 25 bp, Mus musculus
taaatcaagttaaaatgtctccaga

SEQ ID NO: 48810 - DNA, 25 bp, Mus musculus
taaatcacacaaaaatccagcagaa

SEQ ID NO: 48811 - DNA, 25 bp, Mus musculus
taaatcacaccagtgcgtgagcgcg

SEQ ID NO: 48812 - DNA, 25 bp, Mus musculus
taaatcaggccattgaacgaaatgc

SEQ ID NO: 48813 - DNA, 25 bp, Mus musculus
taaatccaagtcctgcaagtgaaca

SEQ ID NO: 48814 - DNA, 25 bp, Mus musculus
taaatccacattcttggatgcctgg

SEQ ID NO: 48815 - DNA, 25 bp, Mus musculus
taaatccacgtaagatcatccgcat

SEQ ID NO: 48816 - DNA, 25 bp, Mus musculus
taaatccagagtcttgagcccaggc

SEQ ID NO: 48817 - DNA, 25 bp, Mus musculus
taaatcgcagcttatcacaaggcac

SEQ ID NO: 48818 - DNA, 25 bp, Mus musculus
taaatcgtcctattcagctgcaaca

SEQ ID NO: 48819 - DNA, 25 bp, Mus musculus
taaatctaaaatcctgcagagaaca

SEQ ID NO: 48820 - DNA, 25 bp, Mus musculus
taaatctccaaaacgaaagtccagc

SEQ ID NO: 48821 - DNA, 25 bp, Mus musculus
taaatctccagacctctttgtggga

SEQ ID NO: 48822 - DNA, 25 bp, Mus musculus
taaatctgagaacctgggccaggga

SEQ ID NO: 48823 - DNA, 25 bp, Mus musculus
taaatgaaaaccctcagcttacgga

SEQ ID NO: 48824 - DNA, 25 bp, Mus musculus
taaatgaaatcagctgtggcgcccg

SEQ ID NO: 48825 - DNA, 25 bp, Mus musculus
taaatgaaatcgtggagaccaacag

SEQ ID NO: 48826 - DNA, 25 bp, Mus musculus
taaatgaagagtgcaccgaaatgac

SEQ ID NO: 48827 - DNA, 25 bp, Mus musculus
taaatgaatacctgacgaaagggcc

SEQ ID NO: 48828 - DNA, 25 bp, Mus musculus
taaatgaccttacaccctttgccac

SEQ ID NO: 48829 - DNA, 25 bp, Mus musculus
taaatgacgtgccactgcactgtgt

SEQ ID NO: 48830 - DNA, 25 bp, Mus musculus
taaatgactcaagtgtaacagtgca

SEQ ID NO: 48831 - DNA, 25 bp, Mus musculus
taaatgactgtggactagtgagcat

SEQ ID NO: 48832 - DNA, 25 bp, Mus musculus
taaatgacttgctcagcgtcccatg

SEQ ID NO: 48833 - DNA, 25 bp, Mus musculus
taaatgagaccgtaccccatcacct

SEQ ID NO: 48834 - DNA, 25 bp, Mus musculus
taaatgataacaccgcacctgttgg

SEQ ID NO: 48835 - DNA, 25 bp, Mus musculus
taaatgatgacagtgatatttctgc

SEQ ID NO: 48836 - DNA, 25 bp, Mus musculus
taaatgcaaagaactccacctgcgg

SEQ ID NO: 48837 - DNA, 25 bp, Mus musculus
taaatgcaaatgtgaacagcttcca

SEQ ID NO: 48838 - DNA, 25 bp, Mus musculus
taaatgcacagagagcaggatacaa

SEQ ID NO: 48839 - DNA, 25 bp, Mus musculus
taaatgcacatggttcaaaattccc

SEQ ID NO: 48840 - DNA, 25 bp, Mus musculus
taaatgcacctgagtgtaggtgaca

SEQ ID NO: 48841 - DNA, 25 bp, Mus musculus
taaatgcagaatagacttaccagtc

SEQ ID NO: 48842 - DNA, 25 bp, Mus musculus
taaatgcattggagattactccgga

SEQ ID NO: 48843 - DNA, 25 bp, Mus musculus
taaatgccttgcagtgggaaatgga

SEQ ID NO: 48844 - DNA, 25 bp, Mus musculus
taaatgcgagttccagtgtgacatc

SEQ ID NO: 48845 - DNA, 25 bp, Mus musculus
taaatgcggagcgactggagagact

SEQ ID NO: 48846 - DNA, 25 bp, Mus musculus
taaatgctcacaaagcaagaggctc

SEQ ID NO: 48847 - DNA, 25 bp, Mus musculus
taaatgctcacatagcaagaggctc

SEQ ID NO: 48848 - DNA, 25 bp, Mus musculus
taaatggaacagttaactggaagac

SEQ ID NO: 48849 - DNA, 25 bp, Mus musculus
taaatggacttgctgtcaaacttca

SEQ ID NO: 48850 - DNA, 25 bp, Mus musculus
taaatggagccaggattccagccag

SEQ ID NO: 48851 - DNA, 25 bp, Mus musculus
taaatggagtctgagcagctgttcc

SEQ ID NO: 48852 - DNA, 25 bp, Mus musculus
taaatggattgacatccacaaccca

SEQ ID NO: 48853 - DNA, 25 bp, Mus musculus
taaatggcgtgtgcgtagaatcgag

SEQ ID NO: 48854 - DNA, 25 bp, Mus musculus
taaatggtggaatatgcaaggatga

SEQ ID NO: 48855 - DNA, 25 bp, Mus musculus
taaatgtcctgactaactgtgcatc

SEQ ID NO: 48856 - DNA, 25 bp, Mus musculus
taaatgtcggtgctaaatatgtaaa

SEQ ID NO: 48857 - DNA, 25 bp, Mus musculus
taaatgtcggtggtaaatatgtaaa

SEQ ID NO: 48858 - DNA, 25 bp, Mus musculus
taaattaattcacttgaccgcgggt

SEQ ID NO: 48859 - DNA, 25 bp, Mus musculus
taaattaattcagttgaccgcgggt

SEQ ID NO: 48860 - DNA, 25 bp, Mus musculus
taaattcagcattggctcagagagt

SEQ ID NO: 48861 - DNA, 25 bp, Mus musculus
taaattcatgaagcaattgtcccct

SEQ ID NO: 48862 - DNA, 25 bp, Mus musculus
taaattcctggtccttgtgccgaag

SEQ ID NO: 48863 - DNA, 25 bp, Mus musculus
taaattcctggtgcttgtgccgaag

SEQ ID NO: 48864 - DNA, 25 bp, Mus musculus
taaattcgatgaaatggagaaacac

SEQ ID NO: 48865 - DNA, 25 bp, Mus musculus
taaattctgcaccaagcagcggacc

SEQ ID NO: 48866 - DNA, 25 bp, Mus musculus
taaattcttggtcatcggaaatgcg

SEQ ID NO: 48867 - DNA, 25 bp, Mus musculus
taaattcttggtgatcggaaatgcg

SEQ ID NO: 48868 - DNA, 25 bp, Mus musculus
taaattgacaaacggccagccacat

SEQ ID NO: 48869 - DNA, 25 bp, Mus musculus
taaattgacaaagggccagccacat

SEQ ID NO: 48870 - DNA, 25 bp, Mus musculus
taaattggataaaatacacgggtga

SEQ ID NO: 48871 - DNA, 25 bp, Mus musculus
taaattgtcagccaaagccagtgct

SEQ ID NO: 48872 - DNA, 25 bp, Mus musculus
taaattttgatgatgctccggtaac

SEQ ID NO: 48873 - DNA, 25 bp, Mus musculus
taacaaacataaccaggcaacaggg

SEQ ID NO: 48874 - DNA, 25 bp, Mus musculus
taacaaacataagcaggcaacaggg

SEQ ID NO: 48875 - DNA, 25 bp, Mus musculus
taacaaagatactggagtactgact

SEQ ID NO: 48876 - DNA, 25 bp, Mus musculus
taacaaatccactagttcgagaagc

SEQ ID NO: 48877 - DNA, 25 bp, Mus musculus
taacaacactctgttcctggttctg

SEQ ID NO: 48878 - DNA, 25 bp, Mus musculus
taacaacagtcctttccacgtctct

SEQ ID NO: 48879 - DNA, 25 bp, Mus musculus
taacaaccttctacctccagcagat

SEQ ID NO: 48880 - DNA, 25 bp, Mus musculus
taacaaccttcttcctccagcagat

SEQ ID NO: 48881 - DNA, 25 bp, Mus musculus
taacaactgctttcaagctcatccg

SEQ ID NO: 48882 - DNA, 25 bp, Mus musculus
taacaagatcttcggtgtgacaacc

SEQ ID NO: 48883 - DNA, 25 bp, Mus musculus
taacaagcaggaaacctggatgaag

SEQ ID NO: 48884 - DNA, 25 bp, Mus musculus
taacaagccgatggattcctctcat

SEQ ID NO: 48885 - DNA, 25 bp, Mus musculus
taacaagcgcaagcatcagggtttg

SEQ ID NO: 48886 - DNA, 25 bp, Mus musculus
taacaagcggatcctgcagctctgc

SEQ ID NO: 48887 - DNA, 25 bp, Mus musculus
taacaagctcgggaagaaggtgatc

SEQ ID NO: 48888 - DNA, 25 bp, Mus musculus
taacaagctgacatatgggaccatg

SEQ ID NO: 48889 - DNA, 25 bp, Mus musculus
taacaaggagaaaggcatatgagaa

SEQ ID NO: 48890 - DNA, 25 bp, Mus musculus
taacaaggagccatagcaagcacca

SEQ ID NO: 48891 - DNA, 25 bp, Mus musculus
taacaagtggtggaatagcctaagt

SEQ ID NO: 48892 - DNA, 25 bp, Mus musculus
taacaataaagttgctgggaatcct

SEQ ID NO: 48893 - DNA, 25 bp, Mus musculus
taacaatcaagatggtacatgctga

SEQ ID NO: 48894 - DNA, 25 bp, Mus musculus
taacaatgaaagcacagtgcagcag

SEQ ID NO: 48895 - DNA, 25 bp, Mus musculus
taacaatgatgtcaaaccgcaggga

SEQ ID NO: 48896 - DNA, 25 bp, Mus musculus
taacaatgcagcctctgtccattca

SEQ ID NO: 48897 - DNA, 25 bp, Mus musculus
taacaatgtgttcaaaggctaccta

SEQ ID NO: 48898 - DNA, 25 bp, Mus musculus
taacacatacacacaaggatttgga

SEQ ID NO: 48899 - DNA, 25 bp, Mus musculus
taacacatgatcctgtcatccttac

SEQ ID NO: 48900 - DNA, 25 bp, Mus musculus
taacaccaatgtgaccagcagtgga

SEQ ID NO: 48901 - DNA, 25 bp, Mus musculus
taacaccacggacaaagagattgag

SEQ ID NO: 48902 - DNA, 25 bp, Mus musculus
taacaccactaaccaggaaagctgg

SEQ ID NO: 48903 - DNA, 25 bp, Mus musculus
taacaccagatttgttgtggacccg

SEQ ID NO: 48904 - DNA, 25 bp, Mus musculus
taacaccaggtctgagagacaaaag

SEQ ID NO: 48905 - DNA, 25 bp, Mus musculus
taacaccagttctctcaggacaaat

SEQ ID NO: 48906 - DNA, 25 bp, Mus musculus
taacaccatcggatgcagttctgcc

SEQ ID NO: 48907 - DNA, 25 bp, Mus musculus
taacaccctattggacaaagcagtg

SEQ ID NO: 48908 - DNA, 25 bp, Mus musculus
taacaccgcacctgttgggaacaga

SEQ ID NO: 48909 - DNA, 25 bp, Mus musculus
taacacctttggagaggctctgaag

SEQ ID NO: 48910 - DNA, 25 bp, Mus musculus
taacacgcagtctccattgtgagcc

SEQ ID NO: 48911 - DNA, 25 bp, Mus musculus
taacacggactggtattctaactcg

SEQ ID NO: 48912 - DNA, 25 bp, Mus musculus
taacactaggagaatgcagcgaagg

SEQ ID NO: 48913 - DNA, 25 bp, Mus musculus
taacactcacagaccagactctgag

SEQ ID NO: 48914 - DNA, 25 bp, Mus musculus
taacactggcataggactccaagcc

SEQ ID NO: 48915 - DNA, 25 bp, Mus musculus
taacactggcattggactccaagcc

SEQ ID NO: 48916 - DNA, 25 bp, Mus musculus
taacactgtcatggctgttttcaca

SEQ ID NO: 48917 - DNA, 25 bp, Mus musculus
taacactgtcctggcaacgtggcag

SEQ ID NO: 48918 - DNA, 25 bp, Mus musculus
taacactgtttgttattgtgcctgt

SEQ ID NO: 48919 - DNA, 25 bp, Mus musculus
taacagaagatacctggctcactgc

SEQ ID NO: 48920 - DNA, 25 bp, Mus musculus
taacagacaaagacaaggacggcat

SEQ ID NO: 48921 - DNA, 25 bp, Mus musculus
taacagacaaagtcaaggacggcat

SEQ ID NO: 48922 - DNA, 25 bp, Mus musculus
taacagacgactttaaaggtgtgga

SEQ ID NO: 48923 - DNA, 25 bp, Mus musculus
taacagacgcaccttgtttaacagg

SEQ ID NO: 48924 - DNA, 25 bp, Mus musculus
taacagagaccaggcctgggttgac

SEQ ID NO: 48925 - DNA, 25 bp, Mus musculus
taacagagctcgagtttctgcacca

SEQ ID NO: 48926 - DNA, 25 bp, Mus musculus
taacagagctcgtgtttctgcacca

SEQ ID NO: 48927 - DNA, 25 bp, Mus musculus
taacagagtcctattcacagaaggg

SEQ ID NO: 48928 - DNA, 25 bp, Mus musculus
taacagatcgggtgaaccgtggccg

SEQ ID NO: 48929 - DNA, 25 bp, Mus musculus
taacagcagcccattgggattccgc

SEQ ID NO: 48930 - DNA, 25 bp, Mus musculus
taacagccaaaggaaaaggccgagg

SEQ ID NO: 48931 - DNA, 25 bp, Mus musculus
taacagcctgcgttgggctagtgtc

SEQ ID NO: 48932 - DNA, 25 bp, Mus musculus
taacagcggaagacgcacttaacta

SEQ ID NO: 48933 - DNA, 25 bp, Mus musculus
taacagctagcagtcgccactatgt

SEQ ID NO: 48934 - DNA, 25 bp, Mus musculus
taacagctctgactgtgggcagcag

SEQ ID NO: 48935 - DNA, 25 bp, Mus musculus
taacagctctgagtgtgggcagcag

SEQ ID NO: 48936 - DNA, 25 bp, Mus musculus
taacagctctgggatgcacagctcc

SEQ ID NO: 48937 - DNA, 25 bp, Mus musculus
taacagctgaagtctcttcaatgcc

SEQ ID NO: 48938 - DNA, 25 bp, Mus musculus
taacaggagccttggagacggtaca

SEQ ID NO: 48939 - DNA, 25 bp, Mus musculus
taacaggccggtcgagtgcagttca

SEQ ID NO: 48940 - DNA, 25 bp, Mus musculus
taacaggcctacaactgatgtccag

SEQ ID NO: 48941 - DNA, 25 bp, Mus musculus
taacagggttgcagcgcaggctgtt

SEQ ID NO: 48942 - DNA, 25 bp, Mus musculus
taacaggtctcagagaggccactga

SEQ ID NO: 48943 - DNA, 25 bp, Mus musculus
taacagtattcagtctcggctctcc

SEQ ID NO: 48944 - DNA, 25 bp, Mus musculus
taacagtccaacagctaatggctca

SEQ ID NO: 48945 - DNA, 25 bp, Mus musculus
taacagtccagattgtgtgctcact

SEQ ID NO: 48946 - DNA, 25 bp, Mus musculus
taacagtggctaggaagtctgggat

SEQ ID NO: 48947 - DNA, 25 bp, Mus musculus
taacagttacttataaacacggcct

SEQ ID NO: 48948 - DNA, 25 bp, Mus musculus
taacataaactagtgatcgatcccc

SEQ ID NO: 48949 - DNA, 25 bp, Mus musculus
taacatacaagagatgagagctcgg

SEQ ID NO: 48950 - DNA, 25 bp, Mus musculus
taacatcaactttggtggactgccc

SEQ ID NO: 48951 - DNA, 25 bp, Mus musculus
taacatcaccccactccaaagagaa

SEQ ID NO: 48952 - DNA, 25 bp, Mus musculus
taacatccattctgtttagtgggca

SEQ ID NO: 48953 - DNA, 25 bp, Mus musculus
taacatcgactgtgtggaggacccg

SEQ ID NO: 48954 - DNA, 25 bp, Mus musculus
taacatcgccagaattaaacctcac

SEQ ID NO: 48955 - DNA, 25 bp, Mus musculus
taacatcgccagtattaaacctcac

SEQ ID NO: 48956 - DNA, 25 bp, Mus musculus
taacatctctacagaattttagcag

SEQ ID NO: 48957 - DNA, 25 bp, Mus musculus
taacatctggttggacagcctatta

SEQ ID NO: 48958 - DNA, 25 bp, Mus musculus
taacatgagcttgccaattgacgcc

SEQ ID NO: 48959 - DNA, 25 bp, Mus musculus
taacatgcaggtccagattcagttg

SEQ ID NO: 48960 - DNA, 25 bp, Mus musculus
taacatgctgtaccccaaggaggac

SEQ ID NO: 48961 - DNA, 25 bp, Mus musculus
taacatggctcattgtgaatcacat

SEQ ID NO: 48962 - DNA, 25 bp, Mus musculus
taacatggtgatagctcccaagggt

SEQ ID NO: 48963 - DNA, 25 bp, Mus musculus
taacatgtacttattatggatggtc

SEQ ID NO: 48964 - DNA, 25 bp, Mus musculus
taacatgtcaaactctggagatttg

SEQ ID NO: 48965 - DNA, 25 bp, Mus musculus
taacatgtctcacgaggatcctgga

SEQ ID NO: 48966 - DNA, 25 bp, Mus musculus
taacatgtctggagcgaaaccaagc

SEQ ID NO: 48967 - DNA, 25 bp, Mus musculus
taacatgttcaacccgactctggag

SEQ ID NO: 48968 - DNA, 25 bp, Mus musculus
taacattgccggtggacttccaggg

SEQ ID NO: 48969 - DNA, 25 bp, Mus musculus
taacattgcgtggtctattgatggc

SEQ ID NO: 48970 - DNA, 25 bp, Mus musculus
taacattggaagtagaggtccactc

SEQ ID NO: 48971 - DNA, 25 bp, Mus musculus
taaccaacgaggatgcaaatgatac

SEQ ID NO: 48972 - DNA, 25 bp, Mus musculus
taaccaagataatgagcaccccttg

SEQ ID NO: 48973 - DNA, 25 bp, Mus musculus
taaccaagggatgctaggaagccaa

SEQ ID NO: 48974 - DNA, 25 bp, Mus musculus
taaccaatcttagcagctcctctgg

SEQ ID NO: 48975 - DNA, 25 bp, Mus musculus
taaccacatatagcaaacatgaatg

SEQ ID NO: 48976 - DNA, 25 bp, Mus musculus
taaccaccctgatttaagaaggatc

SEQ ID NO: 48977 - DNA, 25 bp, Mus musculus
taaccacgaaatgactaatcaggag

SEQ ID NO: 48978 - DNA, 25 bp, Mus musculus
taaccactgggacctggagttgctg

SEQ ID NO: 48979 - DNA, 25 bp, Mus musculus
taaccagaagctacggctctctcct

SEQ ID NO: 48980 - DNA, 25 bp, Mus musculus
taaccagacgatatgtttgcggttg

SEQ ID NO: 48981 - DNA, 25 bp, Mus musculus
taaccagatatgaacctccaagaaa

SEQ ID NO: 48982 - DNA, 25 bp, Mus musculus
taaccagatatgtacctccaagaaa

SEQ ID NO: 48983 - DNA, 25 bp, Mus musculus
taaccagccagcttggcacagttaa

SEQ ID NO: 48984 - DNA, 25 bp, Mus musculus
taaccagctacgacactgcaggctc

SEQ ID NO: 48985 - DNA, 25 bp, Mus musculus
taaccagctgactgtggcaaagaag

SEQ ID NO: 48986 - DNA, 25 bp, Mus musculus
taaccaggcaacagggactgctaac

SEQ ID NO: 48987 - DNA, 25 bp, Mus musculus
taaccaggcaactgggactgctaac

SEQ ID NO: 48988 - DNA, 25 bp, Mus musculus
taaccaggccagtgccctggttttc

SEQ ID NO: 48989 - DNA, 25 bp, Mus musculus
taaccaggccataatggtggtgcct

SEQ ID NO: 48990 - DNA, 25 bp, Mus musculus
taaccaggccattatggtggtgcct

SEQ ID NO: 48991 - DNA, 25 bp, Mus musculus
taaccaggtgactgaaatcaaacac

SEQ ID NO: 48992 - DNA, 25 bp, Mus musculus
taaccagtgaccagttcctcttctt

SEQ ID NO: 48993 - DNA, 25 bp, Mus musculus
taaccagttagctggcctttaacca

SEQ ID NO: 48994 - DNA, 25 bp, Mus musculus
taaccatatgccaatgcagggacct

SEQ ID NO: 48995 - DNA, 25 bp, Mus musculus
taaccatgatgtggtcgagccgctc

SEQ ID NO: 48996 - DNA, 25 bp, Mus musculus
taaccatgcacacaaggtggccaag

SEQ ID NO: 48997 - DNA, 25 bp, Mus musculus
taaccatggcgtctggagatgacag

SEQ ID NO: 48998 - DNA, 25 bp, Mus musculus
taaccatgtaaaagctaaaaagcaa

SEQ ID NO: 48999 - DNA, 25 bp, Mus musculus
taacccaaggctaaagggcataagt

SEQ ID NO: 49000 - DNA, 25 bp, Mus musculus
taacccagagaaatatgccgccttc

SEQ ID NO: 49001 - DNA, 25 bp, Mus musculus
taacccagagagtagctccgctggg

SEQ ID NO: 49002 - DNA, 25 bp, Mus musculus
taacccagcgctctgacctaaagtg

SEQ ID NO: 49003 - DNA, 25 bp, Mus musculus
taacccagcttgtgaatgggagagg

SEQ ID NO: 49004 - DNA, 25 bp, Mus musculus
taacccagctttactatgaaggcgt

SEQ ID NO: 49005 - DNA, 25 bp, Mus musculus
taacccaggaagattggcgggccca

SEQ ID NO: 49006 - DNA, 25 bp, Mus musculus
taacccagggaagtcctacggcatt

SEQ ID NO: 49007 - DNA, 25 bp, Mus musculus
taacccaggtggagtggaccaagaa

SEQ ID NO: 49008 - DNA, 25 bp, Mus musculus
taacccatcaggaagatagctaaag

SEQ ID NO: 49009 - DNA, 25 bp, Mus musculus
taacccatcttggatgcaataccag

SEQ ID NO: 49010 - DNA, 25 bp, Mus musculus
taacccatgaggctggaatcactga

SEQ ID NO: 49011 - DNA, 25 bp, Mus musculus
taaccccagggcagccatgggcaac

SEQ ID NO: 49012 - DNA, 25 bp, Mus musculus
taaccccggagagcagagtgatggt

SEQ ID NO: 49013 - DNA, 25 bp, Mus musculus
taacccctccagtatcagcatggct

SEQ ID NO: 49014 - DNA, 25 bp, Mus musculus
taacccctgtgctccgaagatctta

SEQ ID NO: 49015 - DNA, 25 bp, Mus musculus
taacccctttaatgagtactccaag

SEQ ID NO: 49016 - DNA, 25 bp, Mus musculus
taacccggtggtatcgggcaccaga

SEQ ID NO: 49017 - DNA, 25 bp, Mus musculus
taacccgtatggcaagatatctaca

SEQ ID NO: 49018 - DNA, 25 bp, Mus musculus
taaccctaacaagcgcaagcatcag

SEQ ID NO: 49019 - DNA, 25 bp, Mus musculus
taaccctcagcctcaaagtcagatg

SEQ ID NO: 49020 - DNA, 25 bp, Mus musculus
taaccctcggctatatggcagaagc

SEQ ID NO: 49021 - DNA, 25 bp, Mus musculus
taaccctgatcctttccgtgatgat

SEQ ID NO: 49022 - DNA, 25 bp, Mus musculus
taaccctggacctcggaagtctatg

SEQ ID NO: 49023 - DNA, 25 bp, Mus musculus
taaccctgtgggacatctcagagcg

SEQ ID NO: 49024 - DNA, 25 bp, Mus musculus
taaccctgtgtacgtgccctgtgtg

SEQ ID NO: 49025 - DNA, 25 bp, Mus musculus
taacccttacatggattctccacaa

SEQ ID NO: 49026 - DNA, 25 bp, Mus musculus
taacccttgcccatgtgacattggt

SEQ ID NO: 49027 - DNA, 25 bp, Mus musculus
taaccgctataatgaggatgatgca

SEQ ID NO: 49028 - DNA, 25 bp, Mus musculus
taaccgctgctcctgtttccactgg

SEQ ID NO: 49029 - DNA, 25 bp, Mus musculus
taaccggactggcaaaccggaagct

SEQ ID NO: 49030 - DNA, 25 bp, Mus musculus
taaccggagtggcaaatatctagcc

SEQ ID NO: 49031 - DNA, 25 bp, Mus musculus
taaccggagtgggaaatatctagcc

SEQ ID NO: 49032 - DNA, 25 bp, Mus musculus
taaccggtgccactatgttcccaag

SEQ ID NO: 49033 - DNA, 25 bp, Mus musculus
taaccgtgccacaaaaactggtctc

SEQ ID NO: 49034 - DNA, 25 bp, Mus musculus
taaccgtggagtagtttatctgggc

SEQ ID NO: 49035 - DNA, 25 bp, Mus musculus
taaccgtgtgaaattagccttagaa

SEQ ID NO: 49036 - DNA, 25 bp, Mus musculus
taacctaactaaaaggtggctcatg

SEQ ID NO: 49037 - DNA, 25 bp, Mus musculus
taacctacaggattatgcccgtact

SEQ ID NO: 49038 - DNA, 25 bp, Mus musculus
taacctatatatcgccggacgcctc

SEQ ID NO: 49039 - DNA, 25 bp, Mus musculus
taacctcagtgtaaaggataactgg

SEQ ID NO: 49040 - DNA, 25 bp, Mus musculus
taacctcagtgttaaggataactgg

SEQ ID NO: 49041 - DNA, 25 bp, Mus musculus
taacctcatgtaattggaccaaggc

SEQ ID NO: 49042 - DNA, 25 bp, Mus musculus
taacctccgtgctttcaatgtgaca

SEQ ID NO: 49043 - DNA, 25 bp, Mus musculus
taacctctattctgcttctgctgcc

SEQ ID NO: 49044 - DNA, 25 bp, Mus musculus
taacctctcagttcagcggcaattc

SEQ ID NO: 49045 - DNA, 25 bp, Mus musculus
taacctctttcttgagaaggctctg

SEQ ID NO: 49046 - DNA, 25 bp, Mus musculus
taacctgcaagggtccaacctgtgt

SEQ ID NO: 49047 - DNA, 25 bp, Mus musculus
taacctgcccaagacttctgttgtc

SEQ ID NO: 49048 - DNA, 25 bp, Mus musculus
taacctgctgatagagcctgctcgc

SEQ ID NO: 49049 - DNA, 25 bp, Mus musculus
taacctgcttcatcagagtttgacc

SEQ ID NO: 49050 - DNA, 25 bp, Mus musculus
taacctggaccagtagagctggatt

SEQ ID NO: 49051 - DNA, 25 bp, Mus musculus
taacctggactcaattatggatcag

SEQ ID NO: 49052 - DNA, 25 bp, Mus musculus
taacctggagaaaaacagcaccaag

SEQ ID NO: 49053 - DNA, 25 bp, Mus musculus
taacctgggctctctgacacacagt

SEQ ID NO: 49054 - DNA, 25 bp, Mus musculus
taacctgtccacagtgccgagtgcc

SEQ ID NO: 49055 - DNA, 25 bp, Mus musculus
taaccttcaagaggacatttactca

SEQ ID NO: 49056 - DNA, 25 bp, Mus musculus
taaccttcattaactgtgcctatgt

SEQ ID NO: 49057 - DNA, 25 bp, Mus musculus
taacctttgtggatggccgctctct

SEQ ID NO: 49058 - DNA, 25 bp, Mus musculus
taacgacattctgccagaccagagc

SEQ ID NO: 49059 - DNA, 25 bp, Mus musculus
taacgaccagtctcaatatatccac

SEQ ID NO: 49060 - DNA, 25 bp, Mus musculus
taacgagaagctagaggagcagccg

SEQ ID NO: 49061 - DNA, 25 bp, Mus musculus
taacgagccacttccatgatctcca

SEQ ID NO: 49062 - DNA, 25 bp, Mus musculus
taacgagccttataacttcatatca

SEQ ID NO: 49063 - DNA, 25 bp, Mus musculus
taacgagcgtaatgctggagcaggt

SEQ ID NO: 49064 - DNA, 25 bp, Mus musculus
taacgaggctggctacttcaatgag

SEQ ID NO: 49065 - DNA, 25 bp, Mus musculus
taacgaggtgacaccctcaggagac

SEQ ID NO: 49066 - DNA, 25 bp, Mus musculus
taacgagttgggatatccccgagga

SEQ ID NO: 49067 - DNA, 25 bp, Mus musculus
taacgcccgaggcaaaggccaccaa

SEQ ID NO: 49068 - DNA, 25 bp, Mus musculus
taacgctcacacttcccattgtctt

SEQ ID NO: 49069 - DNA, 25 bp, Mus musculus
taacgctgcatgcagtgggtactcc

SEQ ID NO: 49070 - DNA, 25 bp, Mus musculus
taacggaagccctcaatgaacggga

SEQ ID NO: 49071 - DNA, 25 bp, Mus musculus
taacggaccttctaccatgaacagc

SEQ ID NO: 49072 - DNA, 25 bp, Mus musculus
taacggaggcctgatggattttgct

SEQ ID NO: 49073 - DNA, 25 bp, Mus musculus
taacggataaggaccgcaccaaagg

SEQ ID NO: 49074 - DNA, 25 bp, Mus musculus
taacggattctaacggaagacactg

SEQ ID NO: 49075 - DNA, 25 bp, Mus musculus
taacggcaccatcaagcagtgggag

SEQ ID NO: 49076 - DNA, 25 bp, Mus musculus
taacggtcagcacttcattttggag

SEQ ID NO: 49077 - DNA, 25 bp, Mus musculus
taacggttatgacggagactattgt

SEQ ID NO: 49078 - DNA, 25 bp, Mus musculus
taacgtcatcatggcaaatcatgtc

SEQ ID NO: 49079 - DNA, 25 bp, Mus musculus
taacgtgaaagactccagctgccaa

SEQ ID NO: 49080 - DNA, 25 bp, Mus musculus
taacgtggagaaggtgccctgtaat

SEQ ID NO: 49081 - DNA, 25 bp, Mus musculus
taacgtgtacatgagaccttgggag

SEQ ID NO: 49082 - DNA, 25 bp, Mus musculus
taacgtgtcccagtcaaatatgtct

SEQ ID NO: 49083 - DNA, 25 bp, Mus musculus
taacgttctttcagccagacgacga

SEQ ID NO: 49084 - DNA, 25 bp, Mus musculus
taacgtttgtcttcacagggactgg

SEQ ID NO: 49085 - DNA, 25 bp, Mus musculus
taactaagagatatgcccggaaaca

SEQ ID NO: 49086 - DNA, 25 bp, Mus musculus
taactacaagctacggttcacagtg

SEQ ID NO: 49087 - DNA, 25 bp, Mus musculus
taactaccataactagtcaagtttg

SEQ ID NO: 49088 - DNA, 25 bp, Mus musculus
taactaccatttacaaagagaactg

SEQ ID NO: 49089 - DNA, 25 bp, Mus musculus
taactacctgtgacatgagtgctga

SEQ ID NO: 49090 - DNA, 25 bp, Mus musculus
taactacggttacgatgcctgtgct

SEQ ID NO: 49091 - DNA, 25 bp, Mus musculus
taactactagctctaagccactggg

SEQ ID NO: 49092 - DNA, 25 bp, Mus musculus
taactagagcctgaggtgcaatctc

SEQ ID NO: 49093 - DNA, 25 bp, Mus musculus
taactagcccaaagtacagattctg

SEQ ID NO: 49094 - DNA, 25 bp, Mus musculus
taactatgaataagatgaagctgct

SEQ ID NO: 49095 - DNA, 25 bp, Mus musculus
taactattatgatcaaggatatgga

SEQ ID NO: 49096 - DNA, 25 bp, Mus musculus
taactattggaatcaaggctatggc

SEQ ID NO: 49097 - DNA, 25 bp, Mus musculus
taactcaaaggacaaactagctggc

SEQ ID NO: 49098 - DNA, 25 bp, Mus musculus
taactcaagatgagcaagctaaaag

SEQ ID NO: 49099 - DNA, 25 bp, Mus musculus
taactcagaattgtcggatgagcag

SEQ ID NO: 49100 - DNA, 25 bp, Mus musculus
taactccagaatctaccaaaacggg

SEQ ID NO: 49101 - DNA, 25 bp, Mus musculus
taactccagaatgtaccaaaacggg

SEQ ID NO: 49102 - DNA, 25 bp, Mus musculus
taactcggagactccagcaggagcg

SEQ ID NO: 49103 - DNA, 25 bp, Mus musculus
taactcgtagcagtcctgcttcaac

SEQ ID NO: 49104 - DNA, 25 bp, Mus musculus
taactctaaagaagacgatgtctgc

SEQ ID NO: 49105 - DNA, 25 bp, Mus musculus
taactctgctggaggcattattgtc

SEQ ID NO: 49106 - DNA, 25 bp, Mus musculus
taactctgctgtttgctgcatgctg

SEQ ID NO: 49107 - DNA, 25 bp, Mus musculus
taactgacaaactcatgatggatgg

SEQ ID NO: 49108 - DNA, 25 bp, Mus musculus
taactgaccccactgttgacaaacg

SEQ ID NO: 49109 - DNA, 25 bp, Mus musculus
taactgagaaaattagagccccagg

SEQ ID NO: 49110 - DNA, 25 bp, Mus musculus
taactgagcgtgctctgcaaggctg

SEQ ID NO: 49111 - DNA, 25 bp, Mus musculus
taactgaggccgtgaggctcagcaa

SEQ ID NO: 49112 - DNA, 25 bp, Mus musculus
taactgatactacgtcccacggaag

SEQ ID NO: 49113 - DNA, 25 bp, Mus musculus
taactgatactaggtcccacggaag

SEQ ID NO: 49114 - DNA, 25 bp, Mus musculus
taactgattcaagcatcggcctgag

SEQ ID NO: 49115 - DNA, 25 bp, Mus musculus
taactgcagagcgtgaaatggtgct

SEQ ID NO: 49116 - DNA, 25 bp, Mus musculus
taactgcagatatctacctaatcga

SEQ ID NO: 49117 - DNA, 25 bp, Mus musculus
taactgcatatggtactcccattca

SEQ ID NO: 49118 - DNA, 25 bp, Mus musculus
taactgcatccggtgtgaaaaaggc

SEQ ID NO: 49119 - DNA, 25 bp, Mus musculus
taactgccattgaattagcaaccgg

SEQ ID NO: 49120 - DNA, 25 bp, Mus musculus
taactgcctattgagctgtaccatg

SEQ ID NO: 49121 - DNA, 25 bp, Mus musculus
taactgccttgggaagagctccacc

SEQ ID NO: 49122 - DNA, 25 bp, Mus musculus
taactgcggcatcgagatctactac

SEQ ID NO: 49123 - DNA, 25 bp, Mus musculus
taactggagatactttgagcaaagt

SEQ ID NO: 49124 - DNA, 25 bp, Mus musculus
taactggagtgaaagacgccatcga

SEQ ID NO: 49125 - DNA, 25 bp, Mus musculus
taactggtgtgacagaaaaggacct

SEQ ID NO: 49126 - DNA, 25 bp, Mus musculus
taactggtgtgagagaaaaggacct

SEQ ID NO: 49127 - DNA, 25 bp, Mus musculus
taactgtcaagacaacagtgacgag

SEQ ID NO: 49128 - DNA, 25 bp, Mus musculus
taactgtgacaaagaacattagaag

SEQ ID NO: 49129 - DNA, 25 bp, Mus musculus
taactgtgagatctgtaacaagtcc

SEQ ID NO: 49130 - DNA, 25 bp, Mus musculus
taactgtgatttccgatagccggcc

SEQ ID NO: 49131 - DNA, 25 bp, Mus musculus
taactgtgcatctccgagtttgctg

SEQ ID NO: 49132 - DNA, 25 bp, Mus musculus
taactgttctactggttcgactgct

SEQ ID NO: 49133 - DNA, 25 bp, Mus musculus
taactgttctcatcgtaggatttgc

SEQ ID NO: 49134 - DNA, 25 bp, Mus musculus
taacttacacccaaagtgcccctga

SEQ ID NO: 49135 - DNA, 25 bp, Mus musculus
taacttacagtcctctctgaagact

SEQ ID NO: 49136 - DNA, 25 bp, Mus musculus
taacttagcactagtaaagcctgaa

SEQ ID NO: 49137 - DNA, 25 bp, Mus musculus
taacttagcacttgtaaagcctgaa

SEQ ID NO: 49138 - DNA, 25 bp, Mus musculus
taacttatacctcctgggaagatgc

SEQ ID NO: 49139 - DNA, 25 bp, Mus musculus
taacttcagatacacacaacgtagc

SEQ ID NO: 49140 - DNA, 25 bp, Mus musculus
taacttcagcaagcgccttggtctt

SEQ ID NO: 49141 - DNA, 25 bp, Mus musculus
taacttcagtctcaatgtggtggag

SEQ ID NO: 49142 - DNA, 25 bp, Mus musculus
taacttcatgtgcagcaacgggcgg

SEQ ID NO: 49143 - DNA, 25 bp, Mus musculus
taacttccccatatgcagcatcctg

SEQ ID NO: 49144 - DNA, 25 bp, Mus musculus
taacttctgccaaggtggctgtgaa

SEQ ID NO: 49145 - DNA, 25 bp, Mus musculus
taacttggccatgatgaaccccagc

SEQ ID NO: 49146 - DNA, 25 bp, Mus musculus
taacttgggttctgctgacatccag

SEQ ID NO: 49147 - DNA, 25 bp, Mus musculus
taactttaaagggaaactgatcatg

SEQ ID NO: 49148 - DNA, 25 bp, Mus musculus
taactttcgaaaatagtgcggatgc

SEQ ID NO: 49149 - DNA, 25 bp, Mus musculus
taactttcggcctgtttctccgtgg

SEQ ID NO: 49150 - DNA, 25 bp, Mus musculus
taactttcttctagaggaatacgga

SEQ ID NO: 49151 - DNA, 25 bp, Mus musculus
taactttgagaaacctgtggtcatg

SEQ ID NO: 49152 - DNA, 25 bp, Mus musculus
taactttgcactccgacgtgtcacc

SEQ ID NO: 49153 - DNA, 25 bp, Mus musculus
taacttttcagagccaatctctgcg

SEQ ID NO: 49154 - DNA, 25 bp, Mus musculus
taagaaaagcagtgagagcgtaaaa

SEQ ID NO: 49155 - DNA, 25 bp, Mus musculus
taagaaagatcattacgatgccacc

SEQ ID NO: 49156 - DNA, 25 bp, Mus musculus
taagaaagggttgtttctcacagac

SEQ ID NO: 49157 - DNA, 25 bp, Mus musculus
taagaaaggtgcctcctggcctacc

SEQ ID NO: 49158 - DNA, 25 bp, Mus musculus
taagaaatacgtcccgccacgcttg

SEQ ID NO: 49159 - DNA, 25 bp, Mus musculus
taagaaatcggcaacacggaagctg

SEQ ID NO: 49160 - DNA, 25 bp, Mus musculus
taagaaatcttggtaagcgaaacag

SEQ ID NO: 49161 - DNA, 25 bp, Mus musculus
taagaaatgcctctgaagaatgttt

SEQ ID NO: 49162 - DNA, 25 bp, Mus musculus
taagaaattcggtcatgccaggcat

SEQ ID NO: 49163 - DNA, 25 bp, Mus musculus
taagaaattcttggagagtggtggc

SEQ ID NO: 49164 - DNA, 25 bp, Mus musculus
taagaacacgcttgggaatggacac

SEQ ID NO: 49165 - DNA, 25 bp, Mus musculus
taagaacatgagagcgcacgccctg

SEQ ID NO: 49166 - DNA, 25 bp, Mus musculus
taagaaccatacctgccttcatgac

SEQ ID NO: 49167 - DNA, 25 bp, Mus musculus
taagaaccttggtgggaaatcacga

SEQ ID NO: 49168 - DNA, 25 bp, Mus musculus
taagaactatggcttctacggctgc

SEQ ID NO: 49169 - DNA, 25 bp, Mus musculus
taagaactcaacatgtggatctggg

SEQ ID NO: 49170 - DNA, 25 bp, Mus musculus
taagaactcaacttgtggatctggg

SEQ ID NO: 49171 - DNA, 25 bp, Mus musculus
taagaactgtcatcatgtagtagcc

SEQ ID NO: 49172 - DNA, 25 bp, Mus musculus
taagaagaaattgcacccaacattt

SEQ ID NO: 49173 - DNA, 25 bp, Mus musculus
taagaagaagacaatcggtcagaag

SEQ ID NO: 49174 - DNA, 25 bp, Mus musculus
taagaagacaagatgcccatggtca

SEQ ID NO: 49175 - DNA, 25 bp, Mus musculus
taagaagaggctataaggaatggtt

SEQ ID NO: 49176 - DNA, 25 bp, Mus musculus
taagaagattcatctgggtgaagat

SEQ ID NO: 49177 - DNA, 25 bp, Mus musculus
taagaagcacattttagttatgtct

SEQ ID NO: 49178 - DNA, 25 bp, Mus musculus
taagaagcagatgcccattggaggg

SEQ ID NO: 49179 - DNA, 25 bp, Mus musculus
taagaagccgcagagaagagtgaat

SEQ ID NO: 49180 - DNA, 25 bp, Mus musculus
taagaagcttcatgaggctcgtttt

SEQ ID NO: 49181 - DNA, 25 bp, Mus musculus
taagaaggccctggagcaaggcatg

SEQ ID NO: 49182 - DNA, 25 bp, Mus musculus
taagaaggtgtcagaccccttggaa

SEQ ID NO: 49183 - DNA, 25 bp, Mus musculus
taagaagtatggagaaacggctaat

SEQ ID NO: 49184 - DNA, 25 bp, Mus musculus
taagaagttagacttgtcagattgg

SEQ ID NO: 49185 - DNA, 25 bp, Mus musculus
taagaagttagagttgtcagattgg

SEQ ID NO: 49186 - DNA, 25 bp, Mus musculus
taagaagttgacgaaggccgtgtgt

SEQ ID NO: 49187 - DNA, 25 bp, Mus musculus
taagaataattgaacctaacgaggt

SEQ ID NO: 49188 - DNA, 25 bp, Mus musculus
taagaatcaacagtttgaaatggcc

SEQ ID NO: 49189 - DNA, 25 bp, Mus musculus
taagaatcgtgaacctgtcagacaa

SEQ ID NO: 49190 - DNA, 25 bp, Mus musculus
taagaatcgttcaattggagcagca

SEQ ID NO: 49191 - DNA, 25 bp, Mus musculus
taagaatctggtggccatgggctgc

SEQ ID NO: 49192 - DNA, 25 bp, Mus musculus
taagaatttactcacaaggaagatc

SEQ ID NO: 49193 - DNA, 25 bp, Mus musculus
taagaatttactgacaaggaagatc

SEQ ID NO: 49194 - DNA, 25 bp, Mus musculus
taagacaacaagtggaggcgcatcc

SEQ ID NO: 49195 - DNA, 25 bp, Mus musculus
taagacaaccaaaaagctgcatgag

SEQ ID NO: 49196 - DNA, 25 bp, Mus musculus
taagacaagacctacagaacagtgg

SEQ ID NO: 49197 - DNA, 25 bp, Mus musculus
taagacacatccctaagcagaaact

SEQ ID NO: 49198 - DNA, 25 bp, Mus musculus
taagacaccttctgaccatgaagaa

SEQ ID NO: 49199 - DNA, 25 bp, Mus musculus
taagacaggtggaccatcctgtggc

SEQ ID NO: 49200 - DNA, 25 bp, Mus musculus
taagacagtcctacagggtccctac

SEQ ID NO: 49201 - DNA, 25 bp, Mus musculus
taagacagtccttcagggtccctac

SEQ ID NO: 49202 - DNA, 25 bp, Mus musculus
taagacattgtcacggagtgacgtc

SEQ ID NO: 49203 - DNA, 25 bp, Mus musculus
taagaccaatggtgtccctgagcag

SEQ ID NO: 49204 - DNA, 25 bp, Mus musculus
taagaccacggagccagtgtcagag

SEQ ID NO: 49205 - DNA, 25 bp, Mus musculus
taagaccagctgtgcgcaggaactc

SEQ ID NO: 49206 - DNA, 25 bp, Mus musculus
taagaccattcgaagcttcctgtcc

SEQ ID NO: 49207 - DNA, 25 bp, Mus musculus
taagaccccagttttgatgaaccca

SEQ ID NO: 49208 - DNA, 25 bp, Mus musculus
taagaccggcaaactgatctcactg

SEQ ID NO: 49209 - DNA, 25 bp, Mus musculus
taagacctaatgcagctgcgttgtg

SEQ ID NO: 49210 - DNA, 25 bp, Mus musculus
taagacctaatggagctgcgttgtg

SEQ ID NO: 49211 - DNA, 25 bp, Mus musculus
taagactatagacaaaccagcctgg

SEQ ID NO: 49212 - DNA, 25 bp, Mus musculus
taagactgaagcgtcgactgattcc

SEQ ID NO: 49213 - DNA, 25 bp, Mus musculus
taagactggatacttgaatgtcacc

SEQ ID NO: 49214 - DNA, 25 bp, Mus musculus
taagactggatagttgaatgtcacc

SEQ ID NO: 49215 - DNA, 25 bp, Mus musculus
taagacttgcaaagtcagcgttcac

SEQ ID NO: 49216 - DNA, 25 bp, Mus musculus
taagacttgctagaaccaacctgac

SEQ ID NO: 49217 - DNA, 25 bp, Mus musculus
taagactttgaacccgacgcaggct

SEQ ID NO: 49218 - DNA, 25 bp, Mus musculus
taagagaaaactcatatgctcggtg

SEQ ID NO: 49219 - DNA, 25 bp, Mus musculus
taagagaaggcaaaacctcctaagc

SEQ ID NO: 49220 - DNA, 25 bp, Mus musculus
taagagaaggcataacctcctaagc

SEQ ID NO: 49221 - DNA, 25 bp, Mus musculus
taagagactgaagcgaattgtcttc

SEQ ID NO: 49222 - DNA, 25 bp, Mus musculus
taagagagaccttgcttctcacgtc

SEQ ID NO: 49223 - DNA, 25 bp, Mus musculus
taagagagactgaggagagaagaca

SEQ ID NO: 49224 - DNA, 25 bp, Mus musculus
taagagatcacggattagtcaacct

SEQ ID NO: 49225 - DNA, 25 bp, Mus musculus
taagagatctgacctatctaaggat

SEQ ID NO: 49226 - DNA, 25 bp, Mus musculus
taagagcaccgaagccatcagctcg

SEQ ID NO: 49227 - DNA, 25 bp, Mus musculus
taagagcagatgctgccaacatgac

SEQ ID NO: 49228 - DNA, 25 bp, Mus musculus
taagagcagccaaatgatcaccttc

SEQ ID NO: 49229 - DNA, 25 bp, Mus musculus
taagagcagcgttaggaattcagaa

SEQ ID NO: 49230 - DNA, 25 bp, Mus musculus
taagagcaggccttacatcaggcag

SEQ ID NO: 49231 - DNA, 25 bp, Mus musculus
taagagccggagttctctcaagtgc

SEQ ID NO: 49232 - DNA, 25 bp, Mus musculus
taagagccttatacataaacccctg

SEQ ID NO: 49233 - DNA, 25 bp, Mus musculus
taagagctgcctggtgctgaaaggt

SEQ ID NO: 49234 - DNA, 25 bp, Mus musculus
taagagctgcgaccccaaaggccca

SEQ ID NO: 49235 - DNA, 25 bp, Mus musculus
taagagctggagtccggcacgccgt

SEQ ID NO: 49236 - DNA, 25 bp, Mus musculus
taagaggaagaaagtcatctctacc

SEQ ID NO: 49237 - DNA, 25 bp, Mus musculus
taagaggacaagcaaaccagacgat

SEQ ID NO: 49238 - DNA, 25 bp, Mus musculus
taagaggagaaatagcaggacctcc

SEQ ID NO: 49239 - DNA, 25 bp, Mus musculus
taagaggcgacttgccaaacgggag

SEQ ID NO: 49240 - DNA, 25 bp, Mus musculus
taagagggagaccaaagttatcaag

SEQ ID NO: 49241 - DNA, 25 bp, Mus musculus
taagagggaggcactgtttctaaac

SEQ ID NO: 49242 - DNA, 25 bp, Mus musculus
taagagggattatggagtccagctg

SEQ ID NO: 49243 - DNA, 25 bp, Mus musculus
taagagggccaagctcctcagcagt

SEQ ID NO: 49244 - DNA, 25 bp, Mus musculus
taagagtcccaacttgtccaaacat

SEQ ID NO: 49245 - DNA, 25 bp, Mus musculus
taagagtcctccctcatattgggca

SEQ ID NO: 49246 - DNA, 25 bp, Mus musculus
taagagtgacgaagaagctgcctgt

SEQ ID NO: 49247 - DNA, 25 bp, Mus musculus
taagagtgacgatgaagctgcctgt

SEQ ID NO: 49248 - DNA, 25 bp, Mus musculus
taagataatggaagtccctgttata

SEQ ID NO: 49249 - DNA, 25 bp, Mus musculus
taagatactttcaccaagagcttcc

SEQ ID NO: 49250 - DNA, 25 bp, Mus musculus
taagatagctgagatcaagtctctg

SEQ ID NO: 49251 - DNA, 25 bp, Mus musculus
taagatatcctgactttgaagattc

SEQ ID NO: 49252 - DNA, 25 bp, Mus musculus
taagatcaatgaagagactccactg

SEQ ID NO: 49253 - DNA, 25 bp, Mus musculus
taagatcaccaagaaaatcacctcg

SEQ ID NO: 49254 - DNA, 25 bp, Mus musculus
taagatcagtccagaagacacacat

SEQ ID NO: 49255 - DNA, 25 bp, Mus musculus
taagatccagttggctcctggacag

SEQ ID NO: 49256 - DNA, 25 bp, Mus musculus
taagatctggtatgaacatcggctc

SEQ ID NO: 49257 - DNA, 25 bp, Mus musculus
taagatgaagaacagtaccaagccc

SEQ ID NO: 49258 - DNA, 25 bp, Mus musculus
taagatgaagaagagtaccaagccc

SEQ ID NO: 49259 - DNA, 25 bp, Mus musculus
taagatgaccagctgcagctacgtg

SEQ ID NO: 49260 - DNA, 25 bp, Mus musculus
taagatgaccaggtgcagctacgtg

SEQ ID NO: 49261 - DNA, 25 bp, Mus musculus
taagatgagtcctccgttccatccc

SEQ ID NO: 49262 - DNA, 25 bp, Mus musculus
taagatgcccgtggagaagacggct

SEQ ID NO: 49263 - DNA, 25 bp, Mus musculus
taagatgcgtcaaagaagatctgac

SEQ ID NO: 49264 - DNA, 25 bp, Mus musculus
taagatgcttagtgaagcagctgga

SEQ ID NO: 49265 - DNA, 25 bp, Mus musculus
taagatgcttccatgaacagcagac

SEQ ID NO: 49266 - DNA, 25 bp, Mus musculus
taagatggcgggagatgataaacat

SEQ ID NO: 49267 - DNA, 25 bp, Mus musculus
taagatgtcacaataagatccccag

SEQ ID NO: 49268 - DNA, 25 bp, Mus musculus
taagatgtcagaggtcaaggatgga

SEQ ID NO: 49269 - DNA, 25 bp, Mus musculus
taagattcgtatcatggctcagctc

SEQ ID NO: 49270 - DNA, 25 bp, Mus musculus
taagattgccaagttgctgaagcca

SEQ ID NO: 49271 - DNA, 25 bp, Mus musculus
taagcaaaggaagcagagtgtgtac

SEQ ID NO: 49272 - DNA, 25 bp, Mus musculus
taagcaaccttgcacaggctctctg

SEQ ID NO: 49273 - DNA, 25 bp, Mus musculus
taagcaacgaaggttccctccagga

SEQ ID NO: 49274 - DNA, 25 bp, Mus musculus
taagcaacttgctcagcacccagct

SEQ ID NO: 49275 - DNA, 25 bp, Mus musculus
taagcaagccatagacaagatgcag

SEQ ID NO: 49276 - DNA, 25 bp, Mus musculus
taagcaagtacctgttgagtcagat

SEQ ID NO: 49277 - DNA, 25 bp, Mus musculus
taagcacaaagtcaagcggcagcga

SEQ ID NO: 49278 - DNA, 25 bp, Mus musculus
taagcacaatgtagagaatagcagt

SEQ ID NO: 49279 - DNA, 25 bp, Mus musculus
taagcacaccgatgaagagttcctg

SEQ ID NO: 49280 - DNA, 25 bp, Mus musculus
taagcaccagaggagtagtgtttct

SEQ ID NO: 49281 - DNA, 25 bp, Mus musculus
taagcaccctgaaaggatttatggc

SEQ ID NO: 49282 - DNA, 25 bp, Mus musculus
taagcaccgttacagagaatgaaac

SEQ ID NO: 49283 - DNA, 25 bp, Mus musculus
taagcacgctattgcagttatttgg

SEQ ID NO: 49284 - DNA, 25 bp, Mus musculus
taagcactttggaggtgcatacagg

SEQ ID NO: 49285 - DNA, 25 bp, Mus musculus
taagcactttgtcgttcaggtgcag

SEQ ID NO: 49286 - DNA, 25 bp, Mus musculus
taagcagacagctaaatggagtctg

SEQ ID NO: 49287 - DNA, 25 bp, Mus musculus
taagcagactgctgccaggtgggcc

SEQ ID NO: 49288 - DNA, 25 bp, Mus musculus
taagcagagcaagcgtaagacgtca

SEQ ID NO: 49289 - DNA, 25 bp, Mus musculus
taagcagattgctgtcatgagaggc

SEQ ID NO: 49290 - DNA, 25 bp, Mus musculus
taagcagcagaggagcaccaggatc

SEQ ID NO: 49291 - DNA, 25 bp, Mus musculus
taagcagctaaagcacagacctcct

SEQ ID NO: 49292 - DNA, 25 bp, Mus musculus
taagcagctgggacaccacattgga

SEQ ID NO: 49293 - DNA, 25 bp, Mus musculus
taagcaggacagtgccttttctaac

SEQ ID NO: 49294 - DNA, 25 bp, Mus musculus
taagcaggagcatcgcattggaggc

SEQ ID NO: 49295 - DNA, 25 bp, Mus musculus
taagcagggatatgtgacaaatact

SEQ ID NO: 49296 - DNA, 25 bp, Mus musculus
taagcagttagaaaagattgggcag

SEQ ID NO: 49297 - DNA, 25 bp, Mus musculus
taagcatatcttactgtcggagcag

SEQ ID NO: 49298 - DNA, 25 bp, Mus musculus
taagcatccaaatgaaacagacggc

SEQ ID NO: 49299 - DNA, 25 bp, Mus musculus
taagcatctctctggagtatccaga

SEQ ID NO: 49300 - DNA, 25 bp, Mus musculus
taagcatgtgcctgactgggtttgg

SEQ ID NO: 49301 - DNA, 25 bp, Mus musculus
taagcatttgtgtatcacgtccctg

SEQ ID NO: 49302 - DNA, 25 bp, Mus musculus
taagccaaacggcaagaaacctgct

SEQ ID NO: 49303 - DNA, 25 bp, Mus musculus
taagccaagaaatcagcctgccaag

SEQ ID NO: 49304 - DNA, 25 bp, Mus musculus
taagccaagagctgaggattcaggc

SEQ ID NO: 49305 - DNA, 25 bp, Mus musculus
taagccagcagcactggagcaaggt

SEQ ID NO: 49306 - DNA, 25 bp, Mus musculus
taagccagcagctctggagcaaggt

SEQ ID NO: 49307 - DNA, 25 bp, Mus musculus
taagccagtgcaaggagtgtacctc

SEQ ID NO: 49308 - DNA, 25 bp, Mus musculus
taagccagtgggagccctaaatgcg

SEQ ID NO: 49309 - DNA, 25 bp, Mus musculus
taagccatatgattggtacaggacc

SEQ ID NO: 49310 - DNA, 25 bp, Mus musculus
taagccatggcctatcagttataca

SEQ ID NO: 49311 - DNA, 25 bp, Mus musculus
taagccattcatgccgccaattttc

SEQ ID NO: 49312 - DNA, 25 bp, Mus musculus
taagcccacacgaggctggctgcat

SEQ ID NO: 49313 - DNA, 25 bp, Mus musculus
taagcccatcgacaagaaggcacct

SEQ ID NO: 49314 - DNA, 25 bp, Mus musculus
taagccctcttctggaccagagcac

SEQ ID NO: 49315 - DNA, 25 bp, Mus musculus
taagccctggtgatggcttcagccc

SEQ ID NO: 49316 - DNA, 25 bp, Mus musculus
taagccgactcgcttatgctggctg

SEQ ID NO: 49317 - DNA, 25 bp, Mus musculus
taagccgagaattttcgggatacgt

SEQ ID NO: 49318 - DNA, 25 bp, Mus musculus
taagccgggacacttccagaacact

SEQ ID NO: 49319 - DNA, 25 bp, Mus musculus
taagccgggacagttccagaacact

SEQ ID NO: 49320 - DNA, 25 bp, Mus musculus
taagcctcagcaaagagcacaaccc

SEQ ID NO: 49321 - DNA, 25 bp, Mus musculus
taagcctcagcctgttgactcctgg

SEQ ID NO: 49322 - DNA, 25 bp, Mus musculus
taagcctcgaagcagccttgccctt

SEQ ID NO: 49323 - DNA, 25 bp, Mus musculus
taagcctgggaccatacgaggagac

SEQ ID NO: 49324 - DNA, 25 bp, Mus musculus
taagcctttctgaggatccctgctg

SEQ ID NO: 49325 - DNA, 25 bp, Mus musculus
taagcgaaacagactcagatttggg

SEQ ID NO: 49326 - DNA, 25 bp, Mus musculus
taagcgaagcagactggcagaagaa

SEQ ID NO: 49327 - DNA, 25 bp, Mus musculus
taagcgagttcaagttatcaagaat

SEQ ID NO: 49328 - DNA, 25 bp, Mus musculus
taagcgagttcatgttatcaagaat

SEQ ID NO: 49329 - DNA, 25 bp, Mus musculus
taagcgcaaagcactgaagttgaat

SEQ ID NO: 49330 - DNA, 25 bp, Mus musculus
taagcgcgcctaccgagaactagtt

SEQ ID NO: 49331 - DNA, 25 bp, Mus musculus
taagcggaaagtttatgagtgcgag

SEQ ID NO: 49332 - DNA, 25 bp, Mus musculus
taagcggaatggacccgccttttgg

SEQ ID NO: 49333 - DNA, 25 bp, Mus musculus
taagcggcacgaagtaaagagcgac

SEQ ID NO: 49334 - DNA, 25 bp, Mus musculus
taagcgggactttatgctgatcaca

SEQ ID NO: 49335 - DNA, 25 bp, Mus musculus
taagcgtaaaactcctgtgatgaag

SEQ ID NO: 49336 - DNA, 25 bp, Mus musculus
taagctaaaaaagctgagtgaagac

SEQ ID NO: 49337 - DNA, 25 bp, Mus musculus
taagctaggcagacccagatctata

SEQ ID NO: 49338 - DNA, 25 bp, Mus musculus
taagctatgatgtggttaaacgatg

SEQ ID NO: 49339 - DNA, 25 bp, Mus musculus
taagctattttctcaaagtcacagc

SEQ ID NO: 49340 - DNA, 25 bp, Mus musculus
taagctcactcatgtggttctggat

SEQ ID NO: 49341 - DNA, 25 bp, Mus musculus
taagctccagcaactggaggccctg

SEQ ID NO: 49342 - DNA, 25 bp, Mus musculus
taagctcccaggatgcctcctctgg

SEQ ID NO: 49343 - DNA, 25 bp, Mus musculus
taagctcgacttcggcaatttccaa

SEQ ID NO: 49344 - DNA, 25 bp, Mus musculus
taagctctcaggaagggacagaggc

SEQ ID NO: 49345 - DNA, 25 bp, Mus musculus
taagctctggctgaggaatatctac

SEQ ID NO: 49346 - DNA, 25 bp, Mus musculus
taagctgaagaaacaactgaggaac

SEQ ID NO: 49347 - DNA, 25 bp, Mus musculus
taagctgaagccaggaaccagagtt

SEQ ID NO: 49348 - DNA, 25 bp, Mus musculus
taagctgaagcctcaggcacagcct

SEQ ID NO: 49349 - DNA, 25 bp, Mus musculus
taagctgaatgtccctgtgcgccag

SEQ ID NO: 49350 - DNA, 25 bp, Mus musculus
taagctgaggtggagactaccttct

SEQ ID NO: 49351 - DNA, 25 bp, Mus musculus
taagctgattttatcagcagctcct

SEQ ID NO: 49352 - DNA, 25 bp, Mus musculus
taagctgctctatatccgcctggcg

SEQ ID NO: 49353 - DNA, 25 bp, Mus musculus
taagctggcactggccgtttttgtg

SEQ ID NO: 49354 - DNA, 25 bp, Mus musculus
taagctggtcatcatcgagagcgac

SEQ ID NO: 49355 - DNA, 25 bp, Mus musculus
taagctgtaataggaccatccatcc

SEQ ID NO: 49356 - DNA, 25 bp, Mus musculus
taagctgtacatcttctggccactt

SEQ ID NO: 49357 - DNA, 25 bp, Mus musculus
taagctgtgccgatggcataaatgg

SEQ ID NO: 49358 - DNA, 25 bp, Mus musculus
taagcttagtttagctggattaaca

SEQ ID NO: 49359 - DNA, 25 bp, Mus musculus
taagcttagttttgctggattaaca

SEQ ID NO: 49360 - DNA, 25 bp, Mus musculus
taagcttcaagctggcaaaatggta

SEQ ID NO: 49361 - DNA, 25 bp, Mus musculus
taagcttctgtagttggagtggcaa

SEQ ID NO: 49362 - DNA, 25 bp, Mus musculus
taagcttgaaggaatatcctgggcc

SEQ ID NO: 49363 - DNA, 25 bp, Mus musculus
taagcttgatccaaaggcaatgaag

SEQ ID NO: 49364 - DNA, 25 bp, Mus musculus
taagcttggtagacgttgtgatatg

SEQ ID NO: 49365 - DNA, 25 bp, Mus musculus
taagctttactctgaacaaagagcc

SEQ ID NO: 49366 - DNA, 25 bp, Mus musculus
taagcttttagaaatacaaatcgag

SEQ ID NO: 49367 - DNA, 25 bp, Mus musculus
taaggaaaatgagacatctccaccg

SEQ ID NO: 49368 - DNA, 25 bp, Mus musculus
taaggaacacccaaggcaaaagtat

SEQ ID NO: 49369 - DNA, 25 bp, Mus musculus
taaggaacttctagataaccaatgg

SEQ ID NO: 49370 - DNA, 25 bp, Mus musculus
taaggaagaactgtgactaagctgc

SEQ ID NO: 49371 - DNA, 25 bp, Mus musculus
taaggaagctctggtttcagacgga

SEQ ID NO: 49372 - DNA, 25 bp, Mus musculus
taaggaaggactcctcctctggtgc

SEQ ID NO: 49373 - DNA, 25 bp, Mus musculus
taaggaagtagttaagcctgtgccc

SEQ ID NO: 49374 - DNA, 25 bp, Mus musculus
taaggaagtcttcacagaacaagct

SEQ ID NO: 49375 - DNA, 25 bp, Mus musculus
taaggaataccttcccagcggtctc

SEQ ID NO: 49376 - DNA, 25 bp, Mus musculus
taaggaatcagctgccatgaaaact

SEQ ID NO: 49377 - DNA, 25 bp, Mus musculus
taaggaatccaaaatgctacaaaga

SEQ ID NO: 49378 - DNA, 25 bp, Mus musculus
taaggaatctggtcaagtggttgca

SEQ ID NO: 49379 - DNA, 25 bp, Mus musculus
taaggacaacttcacagcagcgggt

SEQ ID NO: 49380 - DNA, 25 bp, Mus musculus
taaggacagtggctgcccagagact

SEQ ID NO: 49381 - DNA, 25 bp, Mus musculus
taaggaccaaccttcttgatcttga

SEQ ID NO: 49382 - DNA, 25 bp, Mus musculus
taaggacgtccaccactattacacc

SEQ ID NO: 49383 - DNA, 25 bp, Mus musculus
taaggactgaggacccattatcagc

SEQ ID NO: 49384 - DNA, 25 bp, Mus musculus
taaggacttgaacatggatgtgtcc

SEQ ID NO: 49385 - DNA, 25 bp, Mus musculus
taaggactttatcgtggcatctgac

SEQ ID NO: 49386 - DNA, 25 bp, Mus musculus
taaggactttatggtggcatctgac

SEQ ID NO: 49387 - DNA, 25 bp, Mus musculus
taaggagaaatcagagctctttggc

SEQ ID NO: 49388 - DNA, 25 bp, Mus musculus
taaggagaagcccacaaccgccctt

SEQ ID NO: 49389 - DNA, 25 bp, Mus musculus
taaggagaagtttgatgccaccatg

SEQ ID NO: 49390 - DNA, 25 bp, Mus musculus
taaggagacaattgggtcccacaag

SEQ ID NO: 49391 - DNA, 25 bp, Mus musculus
taaggagactgccacacagagtgtt

SEQ ID NO: 49392 - DNA, 25 bp, Mus musculus
taaggagagtatccaaacccttggc

SEQ ID NO: 49393 - DNA, 25 bp, Mus musculus
taaggagcattatcctgggaataca

SEQ ID NO: 49394 - DNA, 25 bp, Mus musculus
taaggagccacagtttctgcagaac

SEQ ID NO: 49395 - DNA, 25 bp, Mus musculus
taaggagccttgcactacaaagggc

SEQ ID NO: 49396 - DNA, 25 bp, Mus musculus
taaggagctctccatccagattgat

SEQ ID NO: 49397 - DNA, 25 bp, Mus musculus
taaggagcttgaacagagcctgctc

SEQ ID NO: 49398 - DNA, 25 bp, Mus musculus
taaggaggatacactttccacaggt

SEQ ID NO: 49399 - DNA, 25 bp, Mus musculus
taaggaggctggaggcctttgaaca

SEQ ID NO: 49400 - DNA, 25 bp, Mus musculus
taaggagtgccccttcctgcacatc

SEQ ID NO: 49401 - DNA, 25 bp, Mus musculus
taaggatacatctcggcgaatagga

SEQ ID NO: 49402 - DNA, 25 bp, Mus musculus
taaggatccctaacaggttcttgag

SEQ ID NO: 49403 - DNA, 25 bp, Mus musculus
taaggatcggactcttttatatgga

SEQ ID NO: 49404 - DNA, 25 bp, Mus musculus
taaggatgactggaaagccccactc

SEQ ID NO: 49405 - DNA, 25 bp, Mus musculus
taaggatgctgtaaccagaagatgg

SEQ ID NO: 49406 - DNA, 25 bp, Mus musculus
taaggatggccatataaaaattacg

SEQ ID NO: 49407 - DNA, 25 bp, Mus musculus
taaggatgtgatcctactgacagcc

SEQ ID NO: 49408 - DNA, 25 bp, Mus musculus
taaggattggaaaatcctccatagg

SEQ ID NO: 49409 - DNA, 25 bp, Mus musculus
taaggatttccttctgtgccacagc

SEQ ID NO: 49410 - DNA, 25 bp, Mus musculus
taaggcaaagcctgaaagtccttgg

SEQ ID NO: 49411 - DNA, 25 bp, Mus musculus
taaggcacaaacaaagaccctcaag

SEQ ID NO: 49412 - DNA, 25 bp, Mus musculus
taaggcacaaagttccgtaccagct

SEQ ID NO: 49413 - DNA, 25 bp, Mus musculus
taaggcacatacctgaagtggattt

SEQ ID NO: 49414 - DNA, 25 bp, Mus musculus
taaggcactcccacttatagtagga

SEQ ID NO: 49415 - DNA, 25 bp, Mus musculus
taaggcagaccagtgaggactcaag

SEQ ID NO: 49416 - DNA, 25 bp, Mus musculus
taaggcagagactagcaaggataag

SEQ ID NO: 49417 - DNA, 25 bp, Mus musculus
taaggcagccggagctcggcccctg

SEQ ID NO: 49418 - DNA, 25 bp, Mus musculus
taaggcaggatgatagacacctgag

SEQ ID NO: 49419 - DNA, 25 bp, Mus musculus
taaggccaagacatgtaccatcatc

SEQ ID NO: 49420 - DNA, 25 bp, Mus musculus
taaggccaagctttgcacaccggtt

SEQ ID NO: 49421 - DNA, 25 bp, Mus musculus
taaggcctttcctatcccagaatca

SEQ ID NO: 49422 - DNA, 25 bp, Mus musculus
taaggcctttgtcacaccttcagtg

SEQ ID NO: 49423 - DNA, 25 bp, Mus musculus
taaggcgccctcagtttttcaactc

SEQ ID NO: 49424 - DNA, 25 bp, Mus musculus
taaggcggacacactgacgcctcct

SEQ ID NO: 49425 - DNA, 25 bp, Mus musculus
taaggctccttgctttgggacatca

SEQ ID NO: 49426 - DNA, 25 bp, Mus musculus
taaggctctcctggaagggtataac

SEQ ID NO: 49427 - DNA, 25 bp, Mus musculus
taaggctggaccaacatggcatctg

SEQ ID NO: 49428 - DNA, 25 bp, Mus musculus
taaggctggcatccaaataattctg

SEQ ID NO: 49429 - DNA, 25 bp, Mus musculus
taagggacacatgttggcagatgtc

SEQ ID NO: 49430 - DNA, 25 bp, Mus musculus
taagggactatgtttctctgagcac

SEQ ID NO: 49431 - DNA, 25 bp, Mus musculus
taagggagattgctcttctccggac

SEQ ID NO: 49432 - DNA, 25 bp, Mus musculus
taagggaggctttggcaccgtcttc

SEQ ID NO: 49433 - DNA, 25 bp, Mus musculus
taagggatggcgtgatgtcactact

SEQ ID NO: 49434 - DNA, 25 bp, Mus musculus
taagggattatggacctgtacttcc

SEQ ID NO: 49435 - DNA, 25 bp, Mus musculus
taagggcactccctcagtgaaccac

SEQ ID NO: 49436 - DNA, 25 bp, Mus musculus
taagggcattagattgcttggagcc

SEQ ID NO: 49437 - DNA, 25 bp, Mus musculus
taagggccacagtccctgcttagcc

SEQ ID NO: 49438 - DNA, 25 bp, Mus musculus
taagggctatcaacccagaaaacgg

SEQ ID NO: 49439 - DNA, 25 bp, Mus musculus
taagggctatgcctggatttcccca

SEQ ID NO: 49440 - DNA, 25 bp, Mus musculus
taagggctcagaagactgtctcagg

SEQ ID NO: 49441 - DNA, 25 bp, Mus musculus
taagggtcccaacattgtactcagc

SEQ ID NO: 49442 - DNA, 25 bp, Mus musculus
taagggtgaacaagaggactggcca

SEQ ID NO: 49443 - DNA, 25 bp, Mus musculus
taagggtgaactagcctcctatgat

SEQ ID NO: 49444 - DNA, 25 bp, Mus musculus
taaggtaaggtgacttagccctgct

SEQ ID NO: 49445 - DNA, 25 bp, Mus musculus
taaggtcacctatactctgctccgg

SEQ ID NO: 49446 - DNA, 25 bp, Mus musculus
taaggtcaccttctgtgagatgaag

SEQ ID NO: 49447 - DNA, 25 bp, Mus musculus
taaggtcaggtgtacgaccctctca

SEQ ID NO: 49448 - DNA, 25 bp, Mus musculus
taaggtcatggctgataaaactcca

SEQ ID NO: 49449 - DNA, 25 bp, Mus musculus
taaggtgattctggccatccggaaa

SEQ ID NO: 49450 - DNA, 25 bp, Mus musculus
taaggtggactgcaccggaagccat

SEQ ID NO: 49451 - DNA, 25 bp, Mus musculus
taaggtggtcttttcccagcaggaa

SEQ ID NO: 49452 - DNA, 25 bp, Mus musculus
taaggtgtggaacaaccaattcctt

SEQ ID NO: 49453 - DNA, 25 bp, Mus musculus
taaggtttcacttggccagtgcaga

SEQ ID NO: 49454 - DNA, 25 bp, Mus musculus
taagtaaagcttggagaagcctgaa

SEQ ID NO: 49455 - DNA, 25 bp, Mus musculus
taagtaactaacgaaatgagcctgg

SEQ ID NO: 49456 - DNA, 25 bp, Mus musculus
taagtacaaaatggcaaatggtggc

SEQ ID NO: 49457 - DNA, 25 bp, Mus musculus
taagtacactcacgtccttgtgcag

SEQ ID NO: 49458 - DNA, 25 bp, Mus musculus
taagtacagctataagtgtgacaac

SEQ ID NO: 49459 - DNA, 25 bp, Mus musculus
taagtacccaccagtgaccaacaga

SEQ ID NO: 49460 - DNA, 25 bp, Mus musculus
taagtacccagatagtcaccaaccc

SEQ ID NO: 49461 - DNA, 25 bp, Mus musculus
taagtactattattcgtgaagcaaa

SEQ ID NO: 49462 - DNA, 25 bp, Mus musculus
taagtagatttccaatgagatgtgc

SEQ ID NO: 49463 - DNA, 25 bp, Mus musculus
taagtagatttcgaatgagatgtgc

SEQ ID NO: 49464 - DNA, 25 bp, Mus musculus
taagtagcgaacactttcatcgtgc

SEQ ID NO: 49465 - DNA, 25 bp, Mus musculus
taagtatgagcttgtttacccagag

SEQ ID NO: 49466 - DNA, 25 bp, Mus musculus
taagtatggtgacctggccaactgg

SEQ ID NO: 49467 - DNA, 25 bp, Mus musculus
taagtattgggagacctggctgcag

SEQ ID NO: 49468 - DNA, 25 bp, Mus musculus
taagtcaccatcagctagtaagagc

SEQ ID NO: 49469 - DNA, 25 bp, Mus musculus
taagtcagataagctcccagaagag

SEQ ID NO: 49470 - DNA, 25 bp, Mus musculus
taagtcagattatgtgtctgcatac

SEQ ID NO: 49471 - DNA, 25 bp, Mus musculus
taagtcagccaatagcccagatggg

SEQ ID NO: 49472 - DNA, 25 bp, Mus musculus
taagtcattacactgaaagcggtac

SEQ ID NO: 49473 - DNA, 25 bp, Mus musculus
taagtcattacagtgaaagcggtac

SEQ ID NO: 49474 - DNA, 25 bp, Mus musculus
taagtccagaacagcctatttgccg

SEQ ID NO: 49475 - DNA, 25 bp, Mus musculus
taagtcccgcctgccaagaagtatg

SEQ ID NO: 49476 - DNA, 25 bp, Mus musculus
taagtccctttatggaccgctctgc

SEQ ID NO: 49477 - DNA, 25 bp, Mus musculus
taagtcctggcaccacaaacacaga

SEQ ID NO: 49478 - DNA, 25 bp, Mus musculus
taagtctccgaagtatgtatggccg

SEQ ID NO: 49479 - DNA, 25 bp, Mus musculus
taagtcttcattggctcctctcggg

SEQ ID NO: 49480 - DNA, 25 bp, Mus musculus
taagtgaacgggataaaagagcaga

SEQ ID NO: 49481 - DNA, 25 bp, Mus musculus
taagtgaccccaacaagttacaaga

SEQ ID NO: 49482 - DNA, 25 bp, Mus musculus
taagtgacctgcgaaatcagatcta

SEQ ID NO: 49483 - DNA, 25 bp, Mus musculus
taagtgatcagagccgcttcgccaa

SEQ ID NO: 49484 - DNA, 25 bp, Mus musculus
taagtgcacagtttgcaatgaagct

SEQ ID NO: 49485 - DNA, 25 bp, Mus musculus
taagtgcatcttcggaaaaataatg

SEQ ID NO: 49486 - DNA, 25 bp, Mus musculus
taagtgcccatccaggacccaaact

SEQ ID NO: 49487 - DNA, 25 bp, Mus musculus
taagtgcccgaagtgtaagtccaac

SEQ ID NO: 49488 - DNA, 25 bp, Mus musculus
taagtgctcccggaagccagaaact

SEQ ID NO: 49489 - DNA, 25 bp, Mus musculus
taagtgcttagttcaaaccattcat

SEQ ID NO: 49490 - DNA, 25 bp, Mus musculus
taagtggacccttgtcatcaaaact

SEQ ID NO: 49491 - DNA, 25 bp, Mus musculus
taagtggagtggagaaaactcatat

SEQ ID NO: 49492 - DNA, 25 bp, Mus musculus
taagtgggaaagtacaaacagttct

SEQ ID NO: 49493 - DNA, 25 bp, Mus musculus
taagtgtactactgaactgtacgca

SEQ ID NO: 49494 - DNA, 25 bp, Mus musculus
taagtgtgaggtcagcaactgcagc

SEQ ID NO: 49495 - DNA, 25 bp, Mus musculus
taagtgtggcagtagctttggcatc

SEQ ID NO: 49496 - DNA, 25 bp, Mus musculus
taagtgttccatgtgcgacactgtg

SEQ ID NO: 49497 - DNA, 25 bp, Mus musculus
taagttacggagaggaagcctggca

SEQ ID NO: 49498 - DNA, 25 bp, Mus musculus
taagttactgtcttgcaaggtgact

SEQ ID NO: 49499 - DNA, 25 bp, Mus musculus
taagttatagaacatcattcagtga

SEQ ID NO: 49500 - DNA, 25 bp, Mus musculus
taagttctctacctctgaggctaca

SEQ ID NO: 49501 - DNA, 25 bp, Mus musculus
taagttcttagacttcaagatccag

SEQ ID NO: 49502 - DNA, 25 bp, Mus musculus
taagttgacatggatccgctcagag

SEQ ID NO: 49503 - DNA, 25 bp, Mus musculus
taagttgacctctgagcagttgcag

SEQ ID NO: 49504 - DNA, 25 bp, Mus musculus
taagttggttccagagtcacattct

SEQ ID NO: 49505 - DNA, 25 bp, Mus musculus
taagtttaccaaatctggtctcaaa

SEQ ID NO: 49506 - DNA, 25 bp, Mus musculus
taagtttgaatcttgctgaacctgt

SEQ ID NO: 49507 - DNA, 25 bp, Mus musculus
taagtttgagttggcctgtttagcc

SEQ ID NO: 49508 - DNA, 25 bp, Mus musculus
taataaaaatattcaaggcgctgca

SEQ ID NO: 49509 - DNA, 25 bp, Mus musculus
taataaaaccagagagcctcaccag

SEQ ID NO: 49510 - DNA, 25 bp, Mus musculus
taataaaatatagtaggtctgcaga

SEQ ID NO: 49511 - DNA, 25 bp, Mus musculus
taataaagagggatccgaacaagct

SEQ ID NO: 49512 - DNA, 25 bp, Mus musculus
taataaaggaggactaactcagccc

SEQ ID NO: 49513 - DNA, 25 bp, Mus musculus
taataacatgctgtaccccaaggag

SEQ ID NO: 49514 - DNA, 25 bp, Mus musculus
taataaccagccgtatcttagcgag

SEQ ID NO: 49515 - DNA, 25 bp, Mus musculus
taataacccacgaccagggcaactg

SEQ ID NO: 49516 - DNA, 25 bp, Mus musculus
taataactggagatactttgagcaa

SEQ ID NO: 49517 - DNA, 25 bp, Mus musculus
taataatgagcaaatgtggcaggaa

SEQ ID NO: 49518 - DNA, 25 bp, Mus musculus
taataatgctgttgatgaccgaggt

SEQ ID NO: 49519 - DNA, 25 bp, Mus musculus
taataatgcttgtgccactcaggct

SEQ ID NO: 49520 - DNA, 25 bp, Mus musculus
taatacacaccaaaaccacccagat

SEQ ID NO: 49521 - DNA, 25 bp, Mus musculus
taatacagtgtcctcaatacccatc

SEQ ID NO: 49522 - DNA, 25 bp, Mus musculus
taatacagttggtgggaccatgacg

SEQ ID NO: 49523 - DNA, 25 bp, Mus musculus
taataccaccgacaaggaaatggag

SEQ ID NO: 49524 - DNA, 25 bp, Mus musculus
taataccagagaagaattcacttag

SEQ ID NO: 49525 - DNA, 25 bp, Mus musculus
taataccgctcctggttggcggaga

SEQ ID NO: 49526 - DNA, 25 bp, Mus musculus
taatacctccaaaaggctgtttgct

SEQ ID NO: 49527 - DNA, 25 bp, Mus musculus
taatactacaggagtccagaaccca

SEQ ID NO: 49528 - DNA, 25 bp, Mus musculus
taatactcaggccaacagtactgtc

SEQ ID NO: 49529 - DNA, 25 bp, Mus musculus
taatactcatgactctaccgccaag

SEQ ID NO: 49530 - DNA, 25 bp, Mus musculus
taatactgacagagggcaagggcaa

SEQ ID NO: 49531 - DNA, 25 bp, Mus musculus
taatactgttgttattcgaccccag

SEQ ID NO: 49532 - DNA, 25 bp, Mus musculus
taatacttgatgttcctctgggtgt

SEQ ID NO: 49533 - DNA, 25 bp, Mus musculus
taatagaagacatcgtgcgtgatgg

SEQ ID NO: 49534 - DNA, 25 bp, Mus musculus
taatagagagagctatccagattgg

SEQ ID NO: 49535 - DNA, 25 bp, Mus musculus
taatagcaaacagtctatttcggcg

SEQ ID NO: 49536 - DNA, 25 bp, Mus musculus
taatagctactctttcccagtgtaa

SEQ ID NO: 49537 - DNA, 25 bp, Mus musculus
taatagctcgcctaacaaagcagct

SEQ ID NO: 49538 - DNA, 25 bp, Mus musculus
taataggaccatccatccactgaaa

SEQ ID NO: 49539 - DNA, 25 bp, Mus musculus
taataggtccatgtctgagctgccg

SEQ ID NO: 49540 - DNA, 25 bp, Mus musculus
taatagttgttcctctctacctggt

SEQ ID NO: 49541 - DNA, 25 bp, Mus musculus
taatatactttgtgttatccatccc

SEQ ID NO: 49542 - DNA, 25 bp, Mus musculus
taatatcaaacacgtcccgggtgga

SEQ ID NO: 49543 - DNA, 25 bp, Mus musculus
taatatcaacagcaatggcagcatt

SEQ ID NO: 49544 - DNA, 25 bp, Mus musculus
taatatcaagtacgaagactgcgag

SEQ ID NO: 49545 - DNA, 25 bp, Mus musculus
taatatccgacaaagggataactca

SEQ ID NO: 49546 - DNA, 25 bp, Mus musculus
taatatgcgatggaaacttctacag

SEQ ID NO: 49547 - DNA, 25 bp, Mus musculus
taatatggaccatctcagacacggc

SEQ ID NO: 49548 - DNA, 25 bp, Mus musculus
taatattaaacctggaagtctggca

SEQ ID NO: 49549 - DNA, 25 bp, Mus musculus
taatattaagaaattcggtcatgcc

SEQ ID NO: 49550 - DNA, 25 bp, Mus musculus
taatatttcttgcaaggtaggcaag

SEQ ID NO: 49551 - DNA, 25 bp, Mus musculus
taatatttcttggaaggtaggcaag

SEQ ID NO: 49552 - DNA, 25 bp, Mus musculus
taatcaaacttctttatgaaggtgg

SEQ ID NO: 49553 - DNA, 25 bp, Mus musculus
taatcaaagaaatttccataatgca

SEQ ID NO: 49554 - DNA, 25 bp, Mus musculus
taatcaagagtgaaaaacctgaaga

SEQ ID NO: 49555 - DNA, 25 bp, Mus musculus
taatcaatcctaccaatgctgacat

SEQ ID NO: 49556 - DNA, 25 bp, Mus musculus
taatcacagtttatctcacagacag

SEQ ID NO: 49557 - DNA, 25 bp, Mus musculus
taatcaccttgatctggacctggag

SEQ ID NO: 49558 - DNA, 25 bp, Mus musculus
taatcacgaacagctagttcagcta

SEQ ID NO: 49559 - DNA, 25 bp, Mus musculus
taatcacgcgtcaaattgctcacga

SEQ ID NO: 49560 - DNA, 25 bp, Mus musculus
taatcacggtagaatccagagccct

SEQ ID NO: 49561 - DNA, 25 bp, Mus musculus
taatcactcaacttctgtcatgaga

SEQ ID NO: 49562 - DNA, 25 bp, Mus musculus
taatcactgcctatctccaactgca

SEQ ID NO: 49563 - DNA, 25 bp, Mus musculus
taatcagcacggttagacagtgcac

SEQ ID NO: 49564 - DNA, 25 bp, Mus musculus
taatcagcagcattgaacagaagga

SEQ ID NO: 49565 - DNA, 25 bp, Mus musculus
taatcagccagagtgcacagaagca

SEQ ID NO: 49566 - DNA, 25 bp, Mus musculus
taatcagccttaagctgtgtgtttt

SEQ ID NO: 49567 - DNA, 25 bp, Mus musculus
taatcagcttcaagtccatggagga

SEQ ID NO: 49568 - DNA, 25 bp, Mus musculus
taatcagggtgaagtgaacgtgcca

SEQ ID NO: 49569 - DNA, 25 bp, Mus musculus
taatcagtacagttaggcagtgcac

SEQ ID NO: 49570 - DNA, 25 bp, Mus musculus
taatcagtagttccagggtgttccg

SEQ ID NO: 49571 - DNA, 25 bp, Mus musculus
taatcagtgtggagaagactgtaaa

SEQ ID NO: 49572 - DNA, 25 bp, Mus musculus
taatcatagcaattctggaggaggc

SEQ ID NO: 49573 - DNA, 25 bp, Mus musculus
taatcatccagtggaacccttgcct

SEQ ID NO: 49574 - DNA, 25 bp, Mus musculus
taatcatcggccaaaacgatcatca

SEQ ID NO: 49575 - DNA, 25 bp, Mus musculus
taatcatgattggagatggagctac

SEQ ID NO: 49576 - DNA, 25 bp, Mus musculus
taatcatggaaggagccacacaagc

SEQ ID NO: 49577 - DNA, 25 bp, Mus musculus
taatcattggcttgtcggttggcaa

SEQ ID NO: 49578 - DNA, 25 bp, Mus musculus
taatccagatacttgttgaagtgct

SEQ ID NO: 49579 - DNA, 25 bp, Mus musculus
taatccagcgctgtaccactaaacg

SEQ ID NO: 49580 - DNA, 25 bp, Mus musculus
taatccagtccacatctgaagagaa

SEQ ID NO: 49581 - DNA, 25 bp, Mus musculus
taatccattagaaaacactgctgct

SEQ ID NO: 49582 - DNA, 25 bp, Mus musculus
taatcccactggcacaagaatctcc

SEQ ID NO: 49583 - DNA, 25 bp, Mus musculus
taatcccctatgttggcaccattac

SEQ ID NO: 49584 - DNA, 25 bp, Mus musculus
taatcccctatttgctggaaatcct

SEQ ID NO: 49585 - DNA, 25 bp, Mus musculus
taatcccctttgtggagactgcaat

SEQ ID NO: 49586 - DNA, 25 bp, Mus musculus
taatccctgccggtgctacagagtg

SEQ ID NO: 49587 - DNA, 25 bp, Mus musculus
taatccgtgggcatgtccctaaaga

SEQ ID NO: 49588 - DNA, 25 bp, Mus musculus
taatcctgaccagccatggagaggt

SEQ ID NO: 49589 - DNA, 25 bp, Mus musculus
taatcctgcctcatacgccgaggct

SEQ ID NO: 49590 - DNA, 25 bp, Mus musculus
taatcctggtgttttccatcataag

SEQ ID NO: 49591 - DNA, 25 bp, Mus musculus
taatcctgtaaggtgtgatcagcag

SEQ ID NO: 49592 - DNA, 25 bp, Mus musculus
taatccttcaaaagaatactgcctc

SEQ ID NO: 49593 - DNA, 25 bp, Mus musculus
taatcgaggagaacataaaaatggt

SEQ ID NO: 49594 - DNA, 25 bp, Mus musculus
taatcgcaattgcaaaaggcagctc

SEQ ID NO: 49595 - DNA, 25 bp, Mus musculus
taatcgcaattggaaaaggcagctc

SEQ ID NO: 49596 - DNA, 25 bp, Mus musculus
taatcgcatgaaaacctatgacacg

SEQ ID NO: 49597 - DNA, 25 bp, Mus musculus
taatcgcggtcctgctactcgctcg

SEQ ID NO: 49598 - DNA, 25 bp, Mus musculus
taatcggaggcaatgagatcagtcc

SEQ ID NO: 49599 - DNA, 25 bp, Mus musculus
taatcggatagttctgaatggcatc

SEQ ID NO: 49600 - DNA, 25 bp, Mus musculus
taatcggcacgctgcttctcctcat

SEQ ID NO: 49601 - DNA, 25 bp, Mus musculus
taatcgttctgcacgactgttctga

SEQ ID NO: 49602 - DNA, 25 bp, Mus musculus
taatcgttctgctcgactgttctga

SEQ ID NO: 49603 - DNA, 25 bp, Mus musculus
taatcgttgtgctaagttcatccat

SEQ ID NO: 49604 - DNA, 25 bp, Mus musculus
taatctacagtagccaagaattcat

SEQ ID NO: 49605 - DNA, 25 bp, Mus musculus
taatctactcaaagcaccccttcat

SEQ ID NO: 49606 - DNA, 25 bp, Mus musculus
taatctaggaaatcccacagagcca

SEQ ID NO: 49607 - DNA, 25 bp, Mus musculus
taatctcaaagcgaggtcaccggct

SEQ ID NO: 49608 - DNA, 25 bp, Mus musculus
taatctcccggaaccgtgtgctagg

SEQ ID NO: 49609 - DNA, 25 bp, Mus musculus
taatctccgtttctctacacagaac

SEQ ID NO: 49610 - DNA, 25 bp, Mus musculus
taatctcggctgtgttttcaatgca

SEQ ID NO: 49611 - DNA, 25 bp, Mus musculus
taatctgaaaagaccagaggaggct

SEQ ID NO: 49612 - DNA, 25 bp, Mus musculus
taatctgaaaagtccagaggaggct

SEQ ID NO: 49613 - DNA, 25 bp, Mus musculus
taatctgaagcctgcaaagatgcgg

SEQ ID NO: 49614 - DNA, 25 bp, Mus musculus
taatctgcagaaatcgggacaccct

SEQ ID NO: 49615 - DNA, 25 bp, Mus musculus
taatctgcagaatggcggccatgct

SEQ ID NO: 49616 - DNA, 25 bp, Mus musculus
taatctgcagaattcgggacaccct

SEQ ID NO: 49617 - DNA, 25 bp, Mus musculus
taatctggaacgacagtatcacctg

SEQ ID NO: 49618 - DNA, 25 bp, Mus musculus
taatctggaacgtcagtatcacctg

SEQ ID NO: 49619 - DNA, 25 bp, Mus musculus
taatctggcaggaatgtatgggaag

SEQ ID NO: 49620 - DNA, 25 bp, Mus musculus
taatctgtccttcagcattgctgct

SEQ ID NO: 49621 - DNA, 25 bp, Mus musculus
taatctgttggatagcaaattacaa

SEQ ID NO: 49622 - DNA, 25 bp, Mus musculus
taatcttcgtgtgctccgctcaatc

SEQ ID NO: 49623 - DNA, 25 bp, Mus musculus
taatcttggaaacaatgattgggct

SEQ ID NO: 49624 - DNA, 25 bp, Mus musculus
taatgaaaattgtgccaaagcctac

SEQ ID NO: 49625 - DNA, 25 bp, Mus musculus
taatgaacactgcaaccatctctcc

SEQ ID NO: 49626 - DNA, 25 bp, Mus musculus
taatgaacactggaaccatctctcc

SEQ ID NO: 49627 - DNA, 25 bp, Mus musculus
taatgaacagtgtggtcacgtgtcc

SEQ ID NO: 49628 - DNA, 25 bp, Mus musculus
taatgaactattgaaaagccctgca

SEQ ID NO: 49629 - DNA, 25 bp, Mus musculus
taatgaagaacgtcaaactctgagc

SEQ ID NO: 49630 - DNA, 25 bp, Mus musculus
taatgaagaagcatcggatccgggc

SEQ ID NO: 49631 - DNA, 25 bp, Mus musculus
taatgaagaccctggagactctaag

SEQ ID NO: 49632 - DNA, 25 bp, Mus musculus
taatgaagggctggaatatcttgac

SEQ ID NO: 49633 - DNA, 25 bp, Mus musculus
taatgaaggtgaccacataccgtgt

SEQ ID NO: 49634 - DNA, 25 bp, Mus musculus
taatgacacagggttcgtggatatc

SEQ ID NO: 49635 - DNA, 25 bp, Mus musculus
taatgacacctgtatcagaagatga

SEQ ID NO: 49636 - DNA, 25 bp, Mus musculus
taatgacactgagggaacgacacat

SEQ ID NO: 49637 - DNA, 25 bp, Mus musculus
taatgacagcagtgagacccgctct

SEQ ID NO: 49638 - DNA, 25 bp, Mus musculus
taatgacattttggccagctgttcg

SEQ ID NO: 49639 - DNA, 25 bp, Mus musculus
taatgaccgacctgcttcagtggca

SEQ ID NO: 49640 - DNA, 25 bp, Mus musculus
taatgacctgaacctggctttggac

SEQ ID NO: 49641 - DNA, 25 bp, Mus musculus
taatgacctgatccaacgtttgcaa

SEQ ID NO: 49642 - DNA, 25 bp, Mus musculus
taatgactggagacctactgtagta

SEQ ID NO: 49643 - DNA, 25 bp, Mus musculus
taatgagatgaggacagtattccag

SEQ ID NO: 49644 - DNA, 25 bp, Mus musculus
taatgagcaaatgtggcaggaaaaa

SEQ ID NO: 49645 - DNA, 25 bp, Mus musculus
taatgagcaagtaccgagagcagat

SEQ ID NO: 49646 - DNA, 25 bp, Mus musculus
taatgagcacagctgattagcagat

SEQ ID NO: 49647 - DNA, 25 bp, Mus musculus
taatgagctaccttgtgagtatgtg

SEQ ID NO: 49648 - DNA, 25 bp, Mus musculus
taatgagctgaaggagagtaggtcc

SEQ ID NO: 49649 - DNA, 25 bp, Mus musculus
taatgaggtcatggttttggtaaag

SEQ ID NO: 49650 - DNA, 25 bp, Mus musculus
taatgaggtttgcatgaaggattcc

SEQ ID NO: 49651 - DNA, 25 bp, Mus musculus
taatgaggtttggatgaaggattcc

SEQ ID NO: 49652 - DNA, 25 bp, Mus musculus
taatgagttaaaggaccagattcag

SEQ ID NO: 49653 - DNA, 25 bp, Mus musculus
taatgataaactcaccagtgtgttt

SEQ ID NO: 49654 - DNA, 25 bp, Mus musculus
taatgatcacccaccgtgggcacgg

SEQ ID NO: 49655 - DNA, 25 bp, Mus musculus
taatgatcagcaggacttagtggag

SEQ ID NO: 49656 - DNA, 25 bp, Mus musculus
taatgatgaagggacacttgggccc

SEQ ID NO: 49657 - DNA, 25 bp, Mus musculus
taatgatgaggaagatggacctcag

SEQ ID NO: 49658 - DNA, 25 bp, Mus musculus
taatgatgaggatgatggacctcag

SEQ ID NO: 49659 - DNA, 25 bp, Mus musculus
taatgattgccctgaccgtggcagg

SEQ ID NO: 49660 - DNA, 25 bp, Mus musculus
taatgattgctccaccagtttccgt

SEQ ID NO: 49661 - DNA, 25 bp, Mus musculus
taatgattgtaagcgggcacaagag

SEQ ID NO: 49662 - DNA, 25 bp, Mus musculus
taatgcagagtaaagatgatagcct

SEQ ID NO: 49663 - DNA, 25 bp, Mus musculus
taatgcagatggagaggcagtctat

SEQ ID NO: 49664 - DNA, 25 bp, Mus musculus
taatgcagctttctttgatacaaca

SEQ ID NO: 49665 - DNA, 25 bp, Mus musculus
taatgcagggcaatgtcattccaaa

SEQ ID NO: 49666 - DNA, 25 bp, Mus musculus
taatgcagtccagtttgccagtctt

SEQ ID NO: 49667 - DNA, 25 bp, Mus musculus
taatgccacactcacggaagatgtc

SEQ ID NO: 49668 - DNA, 25 bp, Mus musculus
taatgccagcaataatagagagcta

SEQ ID NO: 49669 - DNA, 25 bp, Mus musculus
taatgcccaggttatcctggctgga

SEQ ID NO: 49670 - DNA, 25 bp, Mus musculus
taatgcccgaaggagcggacacggt

SEQ ID NO: 49671 - DNA, 25 bp, Mus musculus
taatgcccgtgtgcgactttggcag

SEQ ID NO: 49672 - DNA, 25 bp, Mus musculus
taatgcccgttggaccacagaggag

SEQ ID NO: 49673 - DNA, 25 bp, Mus musculus
taatgcctacagcactcgagagcac

SEQ ID NO: 49674 - DNA, 25 bp, Mus musculus
taatgccttcaacgtgggtgatgac

SEQ ID NO: 49675 - DNA, 25 bp, Mus musculus
taatgcgcgaagagactgaactgaa

SEQ ID NO: 49676 - DNA, 25 bp, Mus musculus
taatgcggaatttctagaagataga

SEQ ID NO: 49677 - DNA, 25 bp, Mus musculus
taatgcggagcagcacgcagatgga

SEQ ID NO: 49678 - DNA, 25 bp, Mus musculus
taatgctagatgagaagcgcgtgat

SEQ ID NO: 49679 - DNA, 25 bp, Mus musculus
taatgctgactttgcaaaatgaccc

SEQ ID NO: 49680 - DNA, 25 bp, Mus musculus
taatgctggaaataagcttggtaga

SEQ ID NO: 49681 - DNA, 25 bp, Mus musculus
taatgctggagtggtgcccagccca

SEQ ID NO: 49682 - DNA, 25 bp, Mus musculus
taatgctgttgatgaccgaggtctc

SEQ ID NO: 49683 - DNA, 25 bp, Mus musculus
taatggaacccctggtagtcagctc

SEQ ID NO: 49684 - DNA, 25 bp, Mus musculus
taatggaacgtcatctgtgattgtc

SEQ ID NO: 49685 - DNA, 25 bp, Mus musculus
taatggaactatatgggtatccaca

SEQ ID NO: 49686 - DNA, 25 bp, Mus musculus
taatggaactatttgggtatccaca

SEQ ID NO: 49687 - DNA, 25 bp, Mus musculus
taatggaactccttttgaagcacgg

SEQ ID NO: 49688 - DNA, 25 bp, Mus musculus
taatggaagtccctgttataaagat

SEQ ID NO: 49689 - DNA, 25 bp, Mus musculus
taatggaatcctacgccttcttctg

SEQ ID NO: 49690 - DNA, 25 bp, Mus musculus
taatggaattctcagtctatcaaga

SEQ ID NO: 49691 - DNA, 25 bp, Mus musculus
taatggacaaaccatgcccgttgct

SEQ ID NO: 49692 - DNA, 25 bp, Mus musculus
taatggacaaatgggccagcctctc

SEQ ID NO: 49693 - DNA, 25 bp, Mus musculus
taatggactccgatgaagacgacgc

SEQ ID NO: 49694 - DNA, 25 bp, Mus musculus
taatggactccgttgaagacgacgc

SEQ ID NO: 49695 - DNA, 25 bp, Mus musculus
taatggacttagatgtggagcaact

SEQ ID NO: 49696 - DNA, 25 bp, Mus musculus
taatggagccagctacccatactaa

SEQ ID NO: 49697 - DNA, 25 bp, Mus musculus
taatggagccaggtacccatactaa

SEQ ID NO: 49698 - DNA, 25 bp, Mus musculus
taatggatgcagtgggaagtaacat

SEQ ID NO: 49699 - DNA, 25 bp, Mus musculus
taatggcactgactcagcctcccat

SEQ ID NO: 49700 - DNA, 25 bp, Mus musculus
taatggcagagaagcggcccctagg

SEQ ID NO: 49701 - DNA, 25 bp, Mus musculus
taatggcataccctgtactgggctg

SEQ ID NO: 49702 - DNA, 25 bp, Mus musculus
taatggcataccgtgtactgggctg

SEQ ID NO: 49703 - DNA, 25 bp, Mus musculus
taatggccagcaaaatctggactcc

SEQ ID NO: 49704 - DNA, 25 bp, Mus musculus
taatggctccagtgccaatatccca

SEQ ID NO: 49705 - DNA, 25 bp, Mus musculus
taatgggaaccaaaagacaagagtg

SEQ ID NO: 49706 - DNA, 25 bp, Mus musculus
taatgggatttgtggccagagtcca

SEQ ID NO: 49707 - DNA, 25 bp, Mus musculus
taatgggcattaagagtgacgatga

SEQ ID NO: 49708 - DNA, 25 bp, Mus musculus
taatgggcattatgagtgacgatga

SEQ ID NO: 49709 - DNA, 25 bp, Mus musculus
taatgggtcctgcttccaaggcctg

SEQ ID NO: 49710 - DNA, 25 bp, Mus musculus
taatggtaaaatgaggagacccggg

SEQ ID NO: 49711 - DNA, 25 bp, Mus musculus
taatggtacacgatgcctcaaagag

SEQ ID NO: 49712 - DNA, 25 bp, Mus musculus
taatggtcaccgtctgcagaccttt

SEQ ID NO: 49713 - DNA, 25 bp, Mus musculus
taatggtcatagcagcactaacaat

SEQ ID NO: 49714 - DNA, 25 bp, Mus musculus
taatggtggagggacattaccagcg

SEQ ID NO: 49715 - DNA, 25 bp, Mus musculus
taatggttctctgcacaaatgtgac

SEQ ID NO: 49716 - DNA, 25 bp, Mus musculus
taatgtacagcggacacgccgtcca

SEQ ID NO: 49717 - DNA, 25 bp, Mus musculus
taatgtacgtttctctgcctaccgc

SEQ ID NO: 49718 - DNA, 25 bp, Mus musculus
taatgtcatgttcccctgcatcagc

SEQ ID NO: 49719 - DNA, 25 bp, Mus musculus
taatgtccacagtttcgaattcaaa

SEQ ID NO: 49720 - DNA, 25 bp, Mus musculus
taatgtgacagctacagccatgatg

SEQ ID NO: 49721 - DNA, 25 bp, Mus musculus
taatgtgacatactggcccctctgg

SEQ ID NO: 49722 - DNA, 25 bp, Mus musculus
taatgtgatcagcttccactgttac

SEQ ID NO: 49723 - DNA, 25 bp, Mus musculus
taatgtgggacttatccagcccggg

SEQ ID NO: 49724 - DNA, 25 bp, Mus musculus
taatgtgttaagaagaggctataag

SEQ ID NO: 49725 - DNA, 25 bp, Mus musculus
taatgtttacaaattgcctcaatca

SEQ ID NO: 49726 - DNA, 25 bp, Mus musculus
taatgtttacaatttgcctcaatca

SEQ ID NO: 49727 - DNA, 25 bp, Mus musculus
taatgtttagaaaactgtggacggc

SEQ ID NO: 49728 - DNA, 25 bp, Mus musculus
taattaaaggcagactggcagcgtc

SEQ ID NO: 49729 - DNA, 25 bp, Mus musculus
taattaaccctcagactgcctagtg

SEQ ID NO: 49730 - DNA, 25 bp, Mus musculus
taattaaggcctacctatctggaac

SEQ ID NO: 49731 - DNA, 25 bp, Mus musculus
taattacaaaacagggaatgtggca

SEQ ID NO: 49732 - DNA, 25 bp, Mus musculus
taattaccaaattgccacttcctgc

SEQ ID NO: 49733 - DNA, 25 bp, Mus musculus
taattacgtcacagggaagaaatcc

SEQ ID NO: 49734 - DNA, 25 bp, Mus musculus
taattagaaagataaggccccgtgc

SEQ ID NO: 49735 - DNA, 25 bp, Mus musculus
taattagggagtatttggaattcaa

SEQ ID NO: 49736 - DNA, 25 bp, Mus musculus
taattatagtagcacgcaggagccc

SEQ ID NO: 49737 - DNA, 25 bp, Mus musculus
taattatcctcgcttcagtgttcct

SEQ ID NO: 49738 - DNA, 25 bp, Mus musculus
taattatctgcactgtgatgcctgg

SEQ ID NO: 49739 - DNA, 25 bp, Mus musculus
taattatgatgtctgccagagttgc

SEQ ID NO: 49740 - DNA, 25 bp, Mus musculus
taattattacagatgagcagatgag

SEQ ID NO: 49741 - DNA, 25 bp, Mus musculus
taattatttgggatagctatacgac

SEQ ID NO: 49742 - DNA, 25 bp, Mus musculus
taattcaggtagcttttttcacctg

SEQ ID NO: 49743 - DNA, 25 bp, Mus musculus
taattcaggtgtagaatggaaaaac

SEQ ID NO: 49744 - DNA, 25 bp, Mus musculus
taattccaatcatcttacaaaactg

SEQ ID NO: 49745 - DNA, 25 bp, Mus musculus
taattccaatcttactgctgtaagc

SEQ ID NO: 49746 - DNA, 25 bp, Mus musculus
taattcctagtgtgataaaaagagc

SEQ ID NO: 49747 - DNA, 25 bp, Mus musculus
taattcgagcctctgcagctctaga

SEQ ID NO: 49748 - DNA, 25 bp, Mus musculus
taattcgcttagcagaagcccatgc

SEQ ID NO: 49749 - DNA, 25 bp, Mus musculus
taattctatcgggatatcctttcac

SEQ ID NO: 49750 - DNA, 25 bp, Mus musculus
taattctcagttggaaatagaagga

SEQ ID NO: 49751 - DNA, 25 bp, Mus musculus
taattctgaagttgcttgaactggg

SEQ ID NO: 49752 - DNA, 25 bp, Mus musculus
taattcttctggatgggcagtgcct

SEQ ID NO: 49753 - DNA, 25 bp, Mus musculus
taattcttcttcaaacttggcatcc

SEQ ID NO: 49754 - DNA, 25 bp, Mus musculus
taattcttgggattgggtcacacgt

SEQ ID NO: 49755 - DNA, 25 bp, Mus musculus
taattgaacctaacgaggtgacacc

SEQ ID NO: 49756 - DNA, 25 bp, Mus musculus
taattgaattagctttgagaggaag

SEQ ID NO: 49757 - DNA, 25 bp, Mus musculus
taattgatcccagggccaatcctac

SEQ ID NO: 49758 - DNA, 25 bp, Mus musculus
taattgcaaatatatcaccattggc

SEQ ID NO: 49759 - DNA, 25 bp, Mus musculus
taattgcaacaattcttaaggaggt

SEQ ID NO: 49760 - DNA, 25 bp, Mus musculus
taattgcagagctttgggatgccgg

SEQ ID NO: 49761 - DNA, 25 bp, Mus musculus
taattgccttggaacctgaccgtcc

SEQ ID NO: 49762 - DNA, 25 bp, Mus musculus
taattgctgtgtccaatcactatgg

SEQ ID NO: 49763 - DNA, 25 bp, Mus musculus
taattgcttcctctaccatctggga

SEQ ID NO: 49764 - DNA, 25 bp, Mus musculus
taattggaccaaggcagagttgcta

SEQ ID NO: 49765 - DNA, 25 bp, Mus musculus
taattggagagaacatgacttgaag

SEQ ID NO: 49766 - DNA, 25 bp, Mus musculus
taattggatcatgcacgcactgagg

SEQ ID NO: 49767 - DNA, 25 bp, Mus musculus
taattggccaacgtatgaactatgg

SEQ ID NO: 49768 - DNA, 25 bp, Mus musculus
taattgtaagattgtactccaagcc

SEQ ID NO: 49769 - DNA, 25 bp, Mus musculus
taattgtccttttaggatgcggcct

SEQ ID NO: 49770 - DNA, 25 bp, Mus musculus
taattgtcgtcactgtggcctttgt

SEQ ID NO: 49771 - DNA, 25 bp, Mus musculus
taatttatgaattgactgcccagtg

SEQ ID NO: 49772 - DNA, 25 bp, Mus musculus
taatttattatccaaacaaaggcac

SEQ ID NO: 49773 - DNA, 25 bp, Mus musculus
taatttattatcgaaacaaaggcac

SEQ ID NO: 49774 - DNA, 25 bp, Mus musculus
taatttcacaaagttcaccctggga

SEQ ID NO: 49775 - DNA, 25 bp, Mus musculus
taatttcacacgtcccaatgagaag

SEQ ID NO: 49776 - DNA, 25 bp, Mus musculus
taatttcagagagtactcccatagc

SEQ ID NO: 49777 - DNA, 25 bp, Mus musculus
taatttccagtatgtgggcgcctct

SEQ ID NO: 49778 - DNA, 25 bp, Mus musculus
taatttgcctcaccaccaaaacggc

SEQ ID NO: 49779 - DNA, 25 bp, Mus musculus
taatttggaagaattccactgtcgt

SEQ ID NO: 49780 - DNA, 25 bp, Mus musculus
taatttggaagatagctgtcaccag

SEQ ID NO: 49781 - DNA, 25 bp, Mus musculus
taattttatccccactaactgtgat

SEQ ID NO: 49782 - DNA, 25 bp, Mus musculus
taattttctctgacatccttgttgt

SEQ ID NO: 49783 - DNA, 25 bp, Mus musculus
taattttgagactcctgaagctgaa

SEQ ID NO: 49784 - DNA, 25 bp, Mus musculus
taattttgcactcaccaacccagag

SEQ ID NO: 49785 - DNA, 25 bp, Mus musculus
taattttgggtacaggtcagttcac

SEQ ID NO: 49786 - DNA, 25 bp, Mus musculus
taatttttgtctcctgttctgtctg

SEQ ID NO: 49787 - DNA, 25 bp, Mus musculus
tacaaaaacaagatgatggtgtgcc

SEQ ID NO: 49788 - DNA, 25 bp, Mus musculus
tacaaaaatatacaaggcttcagcc

SEQ ID NO: 49789 - DNA, 25 bp, Mus musculus
tacaaaacagccttgggaaccagat

SEQ ID NO: 49790 - DNA, 25 bp, Mus musculus
tacaaaacatcggtgggcgacaact

SEQ ID NO: 49791 - DNA, 25 bp, Mus musculus
tacaaaagagccaagtgcctgctgc

SEQ ID NO: 49792 - DNA, 25 bp, Mus musculus
tacaaaagcatggtttccatagcag

SEQ ID NO: 49793 - DNA, 25 bp, Mus musculus
tacaaaagctgagtttacttctccg

SEQ ID NO: 49794 - DNA, 25 bp, Mus musculus
tacaaaagtaaacacaggagtcgcc

SEQ ID NO: 49795 - DNA, 25 bp, Mus musculus
tacaaaatacccagttctcaggaag

SEQ ID NO: 49796 - DNA, 25 bp, Mus musculus
tacaaaatggcaaatggtggcgatc

SEQ ID NO: 49797 - DNA, 25 bp, Mus musculus
tacaaacaacccttcgctgacctga

SEQ ID NO: 49798 - DNA, 25 bp, Mus musculus
tacaaaccctccttgttactgcaga

SEQ ID NO: 49799 - DNA, 25 bp, Mus musculus
tacaaaccttgacctgatgagggac

SEQ ID NO: 49800 - DNA, 25 bp, Mus musculus
tacaaaccttgagctgatgagggac

SEQ ID NO: 49801 - DNA, 25 bp, Mus musculus
tacaaacgacagaatgaagcaattc

SEQ ID NO: 49802 - DNA, 25 bp, Mus musculus
tacaaactacctgggcatcgagtgg

SEQ ID NO: 49803 - DNA, 25 bp, Mus musculus
tacaaactagtgatgctgggtgccg

SEQ ID NO: 49804 - DNA, 25 bp, Mus musculus
tacaaactgatggtcaacaaacctc

SEQ ID NO: 49805 - DNA, 25 bp, Mus musculus
tacaaactgccactgagatttctgc

SEQ ID NO: 49806 - DNA, 25 bp, Mus musculus
tacaaactggatccggacacgattt

SEQ ID NO: 49807 - DNA, 25 bp, Mus musculus
tacaaactggcccttactgaccgtg

SEQ ID NO: 49808 - DNA, 25 bp, Mus musculus
tacaaactgtttacataccaagaga

SEQ ID NO: 49809 - DNA, 25 bp, Mus musculus
tacaaactgtttgagaattacggac

SEQ ID NO: 49810 - DNA, 25 bp, Mus musculus
tacaaactttctagcgcatgagaag

SEQ ID NO: 49811 - DNA, 25 bp, Mus musculus
tacaaagaagttaaatagctatccc

SEQ ID NO: 49812 - DNA, 25 bp, Mus musculus
tacaaagacagcctgtacatcccaa

SEQ ID NO: 49813 - DNA, 25 bp, Mus musculus
tacaaagacagtgaagtaagaggac

SEQ ID NO: 49814 - DNA, 25 bp, Mus musculus
tacaaagatccattcctcagtttgg

SEQ ID NO: 49815 - DNA, 25 bp, Mus musculus
tacaaagcttaataatcaagcccgt

SEQ ID NO: 49816 - DNA, 25 bp, Mus musculus
tacaaaggacgacgaacagtgagcc

SEQ ID NO: 49817 - DNA, 25 bp, Mus musculus
tacaaaggacgaggaacagtgagcc

SEQ ID NO: 49818 - DNA, 25 bp, Mus musculus
tacaaaggctccaccctgaagatac

SEQ ID NO: 49819 - DNA, 25 bp, Mus musculus
tacaaaggtgccaccaaagaccaaa

SEQ ID NO: 49820 - DNA, 25 bp, Mus musculus
tacaaaggtgcctccaaagaccaaa

SEQ ID NO: 49821 - DNA, 25 bp, Mus musculus
tacaaagtcagcagttgccgggact

SEQ ID NO: 49822 - DNA, 25 bp, Mus musculus
tacaaagtccaagcgctctctaagc

SEQ ID NO: 49823 - DNA, 25 bp, Mus musculus
tacaaagttcgagttggtgctgagg

SEQ ID NO: 49824 - DNA, 25 bp, Mus musculus
tacaaagttggctaccgtaagcagc

SEQ ID NO: 49825 - DNA, 25 bp, Mus musculus
tacaaataccacctggtctcccagg

SEQ ID NO: 49826 - DNA, 25 bp, Mus musculus
tacaaatcaggttctcttcaaatgc

SEQ ID NO: 49827 - DNA, 25 bp, Mus musculus
tacaaatcgagaagaacaaacagaa

SEQ ID NO: 49828 - DNA, 25 bp, Mus musculus
tacaaatgatgtagagacagctcgt

SEQ ID NO: 49829 - DNA, 25 bp, Mus musculus
tacaaatggctgcaagttgggaaga

SEQ ID NO: 49830 - DNA, 25 bp, Mus musculus
tacaaattggagcaaatcaatgcct

SEQ ID NO: 49831 - DNA, 25 bp, Mus musculus
tacaacaaaccactgcaaagaagca

SEQ ID NO: 49832 - DNA, 25 bp, Mus musculus
tacaacaactactatggatatggtg

SEQ ID NO: 49833 - DNA, 25 bp, Mus musculus
tacaacaagaaggactgccaggcag

SEQ ID NO: 49834 - DNA, 25 bp, Mus musculus
tacaacaagtggttctactgcggtc

SEQ ID NO: 49835 - DNA, 25 bp, Mus musculus
tacaacaccgacgaggtaaggccct

SEQ ID NO: 49836 - DNA, 25 bp, Mus musculus
tacaacagaccttgggcttcaaaga

SEQ ID NO: 49837 - DNA, 25 bp, Mus musculus
tacaacagacgatctctggacccgt

SEQ ID NO: 49838 - DNA, 25 bp, Mus musculus
tacaacagatctcagatattcaagc

SEQ ID NO: 49839 - DNA, 25 bp, Mus musculus
tacaacagtgccctacattgaagta

SEQ ID NO: 49840 - DNA, 25 bp, Mus musculus
tacaacataataactggagatactt

SEQ ID NO: 49841 - DNA, 25 bp, Mus musculus
tacaacattccagggtgctacagca

SEQ ID NO: 49842 - DNA, 25 bp, Mus musculus
tacaaccacacaatggaagtggaaa

SEQ ID NO: 49843 - DNA, 25 bp, Mus musculus
tacaaccacacattggaagtggaaa

SEQ ID NO: 49844 - DNA, 25 bp, Mus musculus
tacaaccaccttcttgcagtttctg

SEQ ID NO: 49845 - DNA, 25 bp, Mus musculus
tacaaccagagaccccattgttctg

SEQ ID NO: 49846 - DNA, 25 bp, Mus musculus
tacaaccagagccagtacagcagct

SEQ ID NO: 49847 - DNA, 25 bp, Mus musculus
tacaaccagagtggcctggtagccg

SEQ ID NO: 49848 - DNA, 25 bp, Mus musculus
tacaaccagataaacctgcaagtcc

SEQ ID NO: 49849 - DNA, 25 bp, Mus musculus
tacaaccccttcgaggacgaggacg

SEQ ID NO: 49850 - DNA, 25 bp, Mus musculus
tacaaccgggaagactttgccaaag

SEQ ID NO: 49851 - DNA, 25 bp, Mus musculus
tacaacctgagaataatgaacagtg

SEQ ID NO: 49852 - DNA, 25 bp, Mus musculus
tacaacctgtggatcacttgggccc

SEQ ID NO: 49853 - DNA, 25 bp, Mus musculus
tacaacgaccaagtgtgaattctct

SEQ ID NO: 49854 - DNA, 25 bp, Mus musculus
tacaacgaccgttctgttctggaga

SEQ ID NO: 49855 - DNA, 25 bp, Mus musculus
tacaacgccactcaccattctggga

SEQ ID NO: 49856 - DNA, 25 bp, Mus musculus
tacaacgccactgaccattctggga

SEQ ID NO: 49857 - DNA, 25 bp, Mus musculus
tacaacgtgctgagctgcgagggct

SEQ ID NO: 49858 - DNA, 25 bp, Mus musculus
tacaactcaaaaggacagcagctgc

SEQ ID NO: 49859 - DNA, 25 bp, Mus musculus
tacaactcacgctatagaccaggct

SEQ ID NO: 49860 - DNA, 25 bp, Mus musculus
tacaactcagcgcatgactacatca

SEQ ID NO: 49861 - DNA, 25 bp, Mus musculus
tacaactcagcggatgactacatca

SEQ ID NO: 49862 - DNA, 25 bp, Mus musculus
tacaactcgagaaataaaggccaca

SEQ ID NO: 49863 - DNA, 25 bp, Mus musculus
tacaactgcgactccaacgcatgat

SEQ ID NO: 49864 - DNA, 25 bp, Mus musculus
tacaactggagacaggtttctgccc

SEQ ID NO: 49865 - DNA, 25 bp, Mus musculus
tacaactggctcctcggtgactcta

SEQ ID NO: 49866 - DNA, 25 bp, Mus musculus
tacaacttaggccacaccagtgaga

SEQ ID NO: 49867 - DNA, 25 bp, Mus musculus
tacaacttaggcgacaccagtgaga

SEQ ID NO: 49868 - DNA, 25 bp, Mus musculus
tacaacttctattccaatctccatg

SEQ ID NO: 49869 - DNA, 25 bp, Mus musculus
tacaagaacactcagcccatcatgg

SEQ ID NO: 49870 - DNA, 25 bp, Mus musculus
tacaagaacctcacactgaaattcc

SEQ ID NO: 49871 - DNA, 25 bp, Mus musculus
tacaagaactaaatagcgatgtctc

SEQ ID NO: 49872 - DNA, 25 bp, Mus musculus
tacaagaaggtagggctggctcagc

SEQ ID NO: 49873 - DNA, 25 bp, Mus musculus
tacaagaattccttggagacggtgg

SEQ ID NO: 49874 - DNA, 25 bp, Mus musculus
tacaagacagaaaactcaggagcct

SEQ ID NO: 49875 - DNA, 25 bp, Mus musculus
tacaagacggtcagatttccgagtt

SEQ ID NO: 49876 - DNA, 25 bp, Mus musculus
tacaagagaatgagacgagcatgtt

SEQ ID NO: 49877 - DNA, 25 bp, Mus musculus
tacaagagcgacaaatgcttggtct

SEQ ID NO: 49878 - DNA, 25 bp, Mus musculus
tacaagaggaatttgaaggctgttt

SEQ ID NO: 49879 - DNA, 25 bp, Mus musculus
tacaagaggacagtattttatgtct

SEQ ID NO: 49880 - DNA, 25 bp, Mus musculus
tacaagaggagatggcgctgattct

SEQ ID NO: 49881 - DNA, 25 bp, Mus musculus
tacaagagttttcggccaggtgaca

SEQ ID NO: 49882 - DNA, 25 bp, Mus musculus
tacaagatcaaacgtttggccaagg

SEQ ID NO: 49883 - DNA, 25 bp, Mus musculus
tacaagatcaaaggtttggccaagg

SEQ ID NO: 49884 - DNA, 25 bp, Mus musculus
tacaagatccgaagtcaagccgtcc

SEQ ID NO: 49885 - DNA, 25 bp, Mus musculus
tacaagatgtcactttcctggcaag

SEQ ID NO: 49886 - DNA, 25 bp, Mus musculus
tacaagcaagctgtttcccctaagg

SEQ ID NO: 49887 - DNA, 25 bp, Mus musculus
tacaagcacactcgaaggaaggact

SEQ ID NO: 49888 - DNA, 25 bp, Mus musculus
tacaagcacttttcctactccattg

SEQ ID NO: 49889 - DNA, 25 bp, Mus musculus
tacaagccagcaaatttttcaagcc

SEQ ID NO: 49890 - DNA, 25 bp, Mus musculus
tacaagcccagcctggacctgctgg

SEQ ID NO: 49891 - DNA, 25 bp, Mus musculus
tacaagcccttggaagcacctgaga

SEQ ID NO: 49892 - DNA, 25 bp, Mus musculus
tacaagcctggctacccaggaagta

SEQ ID NO: 49893 - DNA, 25 bp, Mus musculus
tacaagctaatgatcagcaggactt

SEQ ID NO: 49894 - DNA, 25 bp, Mus musculus
tacaagctgaagcacaagcatggcc

SEQ ID NO: 49895 - DNA, 25 bp, Mus musculus
tacaaggaccttcgacagattgaac

SEQ ID NO: 49896 - DNA, 25 bp, Mus musculus
tacaaggagacctctggcctgatgc

SEQ ID NO: 49897 - DNA, 25 bp, Mus musculus
tacaaggaggcaattcagaagtggg

SEQ ID NO: 49898 - DNA, 25 bp, Mus musculus
tacaaggccaacaaggatgtgatgg

SEQ ID NO: 49899 - DNA, 25 bp, Mus musculus
tacaaggccacagattttgtggtag

SEQ ID NO: 49900 - DNA, 25 bp, Mus musculus
tacaaggccgacagagcgaagtatg

SEQ ID NO: 49901 - DNA, 25 bp, Mus musculus
tacaaggctgacatcaatgcagtga

SEQ ID NO: 49902 - DNA, 25 bp, Mus musculus
tacaaggggactccattcagccatg

SEQ ID NO: 49903 - DNA, 25 bp, Mus musculus
tacaagggtctgtatgctgagcagc

SEQ ID NO: 49904 - DNA, 25 bp, Mus musculus
tacaaggtcataaagtccagcagtg

SEQ ID NO: 49905 - DNA, 25 bp, Mus musculus
tacaaggtcttgatacagccttcca

SEQ ID NO: 49906 - DNA, 25 bp, Mus musculus
tacaagtatgtgatgaagcccacct

SEQ ID NO: 49907 - DNA, 25 bp, Mus musculus
tacaagtatgtgttgaagcccacct

SEQ ID NO: 49908 - DNA, 25 bp, Mus musculus
tacaagtctcgggagcgaaccacca

SEQ ID NO: 49909 - DNA, 25 bp, Mus musculus
tacaagtgaaggtggctcaacctgt

SEQ ID NO: 49910 - DNA, 25 bp, Mus musculus
tacaagtggtttatgtaccatccca

SEQ ID NO: 49911 - DNA, 25 bp, Mus musculus
tacaataatacagccttgtgtttgg

SEQ ID NO: 49912 - DNA, 25 bp, Mus musculus
tacaatcatgagagtcgccgtgctg

SEQ ID NO: 49913 - DNA, 25 bp, Mus musculus
tacaatccctacaagtactccgacg

SEQ ID NO: 49914 - DNA, 25 bp, Mus musculus
tacaatccctactagtactccgacg

SEQ ID NO: 49915 - DNA, 25 bp, Mus musculus
tacaatcgagtaaacacaggcttcc

SEQ ID NO: 49916 - DNA, 25 bp, Mus musculus
tacaatcgagtatacacaggcttcc

SEQ ID NO: 49917 - DNA, 25 bp, Mus musculus
tacaatctgcaacatgtcacagtgg

SEQ ID NO: 49918 - DNA, 25 bp, Mus musculus
tacaatgagctgttgctgaaatcag

SEQ ID NO: 49919 - DNA, 25 bp, Mus musculus
tacaatgcggaagtggtggccgcct

SEQ ID NO: 49920 - DNA, 25 bp, Mus musculus
tacaatgcttctgactccgttcagg

SEQ ID NO: 49921 - DNA, 25 bp, Mus musculus
tacaatggattgaagcagtcaaatt

SEQ ID NO: 49922 - DNA, 25 bp, Mus musculus
tacaatggcacacttctggacggca

SEQ ID NO: 49923 - DNA, 25 bp, Mus musculus
tacaatggcgtgatggtaaaaacaa

SEQ ID NO: 49924 - DNA, 25 bp, Mus musculus
tacaatggcgtgttggtaaaaacaa

SEQ ID NO: 49925 - DNA, 25 bp, Mus musculus
tacaatggctctgagtgtagaattc

SEQ ID NO: 49926 - DNA, 25 bp, Mus musculus
tacaatgggcttcgtaacactcacc

SEQ ID NO: 49927 - DNA, 25 bp, Mus musculus
tacaatgggcttggtaacactcacc

SEQ ID NO: 49928 - DNA, 25 bp, Mus musculus
tacaatgggtcctatccttcctggt

SEQ ID NO: 49929 - DNA, 25 bp, Mus musculus
tacaatggtgtgaggctggaagatc

SEQ ID NO: 49930 - DNA, 25 bp, Mus musculus
tacaatgtgcaccacctgcacagag

SEQ ID NO: 49931 - DNA, 25 bp, Mus musculus
tacaatgtggtagcgttctcggaga

SEQ ID NO: 49932 - DNA, 25 bp, Mus musculus
tacaattatcacacagcttgactac

SEQ ID NO: 49933 - DNA, 25 bp, Mus musculus
tacaattatcactcagcttgactac

SEQ ID NO: 49934 - DNA, 25 bp, Mus musculus
tacaattgaaccaagcactcgtgtc

SEQ ID NO: 49935 - DNA, 25 bp, Mus musculus
tacaattgctgatgaaggaacatgg

SEQ ID NO: 49936 - DNA, 25 bp, Mus musculus
tacaatttgggtccttttcgtactg

SEQ ID NO: 49937 - DNA, 25 bp, Mus musculus
tacacaaaattgactgatcctgcca

SEQ ID NO: 49938 - DNA, 25 bp, Mus musculus
tacacaaaattgtctgatcctgcca

SEQ ID NO: 49939 - DNA, 25 bp, Mus musculus
tacacaacagagttttgggacgcct

SEQ ID NO: 49940 - DNA, 25 bp, Mus musculus
tacacaaccgccaagactgatgcgg

SEQ ID NO: 49941 - DNA, 25 bp, Mus musculus
tacacaacgaggctctacttcctgg

SEQ ID NO: 49942 - DNA, 25 bp, Mus musculus
tacacaagccctacctcattagtgg

SEQ ID NO: 49943 - DNA, 25 bp, Mus musculus
tacacaagtctggaaaccatatccc

SEQ ID NO: 49944 - DNA, 25 bp, Mus musculus
tacacaataaagtagatgatcatga

SEQ ID NO: 49945 - DNA, 25 bp, Mus musculus
tacacaatagcaaccagatttggtg

SEQ ID NO: 49946 - DNA, 25 bp, Mus musculus
tacacaatagcatccagatttggtg

SEQ ID NO: 49947 - DNA, 25 bp, Mus musculus
tacacacagaaggatcgagtaggcg

SEQ ID NO: 49948 - DNA, 25 bp, Mus musculus
tacacaccaaaaccacccagattgg

SEQ ID NO: 49949 - DNA, 25 bp, Mus musculus
tacacaccctcagaggcaggcaatg

SEQ ID NO: 49950 - DNA, 25 bp, Mus musculus
tacacacgcaagactggttctcatc

SEQ ID NO: 49951 - DNA, 25 bp, Mus musculus
tacacacgtggatagcctggatctg

SEQ ID NO: 49952 - DNA, 25 bp, Mus musculus
tacacactagtcaccctcagagaca

SEQ ID NO: 49953 - DNA, 25 bp, Mus musculus
tacacactagtctccctcagagaca

SEQ ID NO: 49954 - DNA, 25 bp, Mus musculus
tacacactgctacaggactacgagc

SEQ ID NO: 49955 - DNA, 25 bp, Mus musculus
tacacactggacactcaaagccaga

SEQ ID NO: 49956 - DNA, 25 bp, Mus musculus
tacacacttaccttcgctccaagat

SEQ ID NO: 49957 - DNA, 25 bp, Mus musculus
tacacactttgacccatcatgcctg

SEQ ID NO: 49958 - DNA, 25 bp, Mus musculus
tacacagacgctctaactcttgcag

SEQ ID NO: 49959 - DNA, 25 bp, Mus musculus
tacacagactacagtgactcggtgg

SEQ ID NO: 49960 - DNA, 25 bp, Mus musculus
tacacagaggcctgggacaaagaca

SEQ ID NO: 49961 - DNA, 25 bp, Mus musculus
tacacagcctctcggaaacatatct

SEQ ID NO: 49962 - DNA, 25 bp, Mus musculus
tacacagctccatttcacatgagag

SEQ ID NO: 49963 - DNA, 25 bp, Mus musculus
tacacaggagtgatttctgacgtcc

SEQ ID NO: 49964 - DNA, 25 bp, Mus musculus
tacacaggcaaatactttgacaaag

SEQ ID NO: 49965 - DNA, 25 bp, Mus musculus
tacacaggtttctgttacaagctgt

SEQ ID NO: 49966 - DNA, 25 bp, Mus musculus
tacacagtagtgaccctcccaatat

SEQ ID NO: 49967 - DNA, 25 bp, Mus musculus
tacacagttattcattagtccaagt

SEQ ID NO: 49968 - DNA, 25 bp, Mus musculus
tacacagttattgattagtccaagt

SEQ ID NO: 49969 - DNA, 25 bp, Mus musculus
tacacatattccatggtagctgtcc

SEQ ID NO: 49970 - DNA, 25 bp, Mus musculus
tacacatcgcatctttggctgggca

SEQ ID NO: 49971 - DNA, 25 bp, Mus musculus
tacacatggttcaacctgcaggccc

SEQ ID NO: 49972 - DNA, 25 bp, Mus musculus
tacacatgtgtatccttttccggaa

SEQ ID NO: 49973 - DNA, 25 bp, Mus musculus
tacacattgggcatgcgaaagctgc

SEQ ID NO: 49974 - DNA, 25 bp, Mus musculus
tacacattggtgcacctgcctaggg

SEQ ID NO: 49975 - DNA, 25 bp, Mus musculus
tacaccacaaatgcatccacaaaag

SEQ ID NO: 49976 - DNA, 25 bp, Mus musculus
tacaccactgctgggcagcttttaa

SEQ ID NO: 49977 - DNA, 25 bp, Mus musculus
tacaccaggccctataagccaatga

SEQ ID NO: 49978 - DNA, 25 bp, Mus musculus
tacaccagtgagatgcggagtgagc

SEQ ID NO: 49979 - DNA, 25 bp, Mus musculus
tacaccatacgtggacataccaagc

SEQ ID NO: 49980 - DNA, 25 bp, Mus musculus
tacaccatcaccatgtatgacacca

SEQ ID NO: 49981 - DNA, 25 bp, Mus musculus
tacaccatcttgactgtgcagctct

SEQ ID NO: 49982 - DNA, 25 bp, Mus musculus
tacaccattcctccttctgaaacaa

SEQ ID NO: 49983 - DNA, 25 bp, Mus musculus
tacaccattcctgcttctgaaacaa

SEQ ID NO: 49984 - DNA, 25 bp, Mus musculus
tacaccccaaggtccagatggcggc

SEQ ID NO: 49985 - DNA, 25 bp, Mus musculus
tacacccgccgcagcgaataattcg

SEQ ID NO: 49986 - DNA, 25 bp, Mus musculus
tacaccgtgaaggataaagctactg

SEQ ID NO: 49987 - DNA, 25 bp, Mus musculus
tacaccgtgcactgaaaatgaggat

SEQ ID NO: 49988 - DNA, 25 bp, Mus musculus
tacacctagagcattagtatccctg

SEQ ID NO: 49989 - DNA, 25 bp, Mus musculus
tacacctatgaggaacgcagagtct

SEQ ID NO: 49990 - DNA, 25 bp, Mus musculus
tacacctctaagttactgtcttgca

SEQ ID NO: 49991 - DNA, 25 bp, Mus musculus
tacacctgagctaatctgcacaagg

SEQ ID NO: 49992 - DNA, 25 bp, Mus musculus
tacacctgagcttatctgcacaagg

SEQ ID NO: 49993 - DNA, 25 bp, Mus musculus
tacacctgccgtgtggatcacaggg

SEQ ID NO: 49994 - DNA, 25 bp, Mus musculus
tacacctgcgtggttcagcacagcg

SEQ ID NO: 49995 - DNA, 25 bp, Mus musculus
tacacctgtctctgttcacgaagag

SEQ ID NO: 49996 - DNA, 25 bp, Mus musculus
tacaccttgaacagaagctcctacg

SEQ ID NO: 49997 - DNA, 25 bp, Mus musculus
tacacctttgaaaatttccagtatg

SEQ ID NO: 49998 - DNA, 25 bp, Mus musculus
tacacctttgcgatgtatcctccat

SEQ ID NO: 49999 - DNA, 25 bp, Mus musculus
tacacgagttccatgctgatctacg

SEQ ID NO: 50000 - DNA, 25 bp, Mus musculus
tacacgcagctctgtgactggtgga

SEQ ID NO: 50001 - DNA, 25 bp, Mus musculus
tacacgccaggtcgtggtacgttca

SEQ ID NO: 50002 - DNA, 25 bp, Mus musculus
tacacgctgtgtggtatctcacaac

SEQ ID NO: 50003 - DNA, 25 bp, Mus musculus
tacacgggtgatgtaacaattctac

SEQ ID NO: 50004 - DNA, 25 bp, Mus musculus
tacacggtgctggagtgccagccac

SEQ ID NO: 50005 - DNA, 25 bp, Mus musculus
tacacggtttcccattacgccattg

SEQ ID NO: 50006 - DNA, 25 bp, Mus musculus
tacacgtgcaacatccaaacttggc

SEQ ID NO: 50007 - DNA, 25 bp, Mus musculus
tacacgttgcctcgaagcgaggaaa

SEQ ID NO: 50008 - DNA, 25 bp, Mus musculus
tacactaaagaaaattgacattccg

SEQ ID NO: 50009 - DNA, 25 bp, Mus musculus
tacactaccactgacgggcaaacag

SEQ ID NO: 50010 - DNA, 25 bp, Mus musculus
tacactacgtaattctcatcaagat

SEQ ID NO: 50011 - DNA, 25 bp, Mus musculus
tacactacttgtggatgttgaacct

SEQ ID NO: 50012 - DNA, 25 bp, Mus musculus
tacactaggcgctgctagccgaatc

SEQ ID NO: 50013 - DNA, 25 bp, Mus musculus
tacactatttccgtgtacccaggga

SEQ ID NO: 50014 - DNA, 25 bp, Mus musculus
tacactcatttctatggtggcagga

SEQ ID NO: 50015 - DNA, 25 bp, Mus musculus
tacactcctttgatggaagcagctg

SEQ ID NO: 50016 - DNA, 25 bp, Mus musculus
tacactctagtggttgcacggctgc

SEQ ID NO: 50017 - DNA, 25 bp, Mus musculus
tacactcttccacacctggatggta

SEQ ID NO: 50018 - DNA, 25 bp, Mus musculus
tacactcttccagacctggatggta

SEQ ID NO: 50019 - DNA, 25 bp, Mus musculus
tacactgactacctctggaccatca

SEQ ID NO: 50020 - DNA, 25 bp, Mus musculus
tacactgaggccattaaaaacatgg

SEQ ID NO: 50021 - DNA, 25 bp, Mus musculus
tacactgaggctttattgtctccag

SEQ ID NO: 50022 - DNA, 25 bp, Mus musculus
tacactggatatttttgcgacttgg

SEQ ID NO: 50023 - DNA, 25 bp, Mus musculus
tacactgggccaaaaagaaggttgt

SEQ ID NO: 50024 - DNA, 25 bp, Mus musculus
tacactgggccataaagaaggttgt

SEQ ID NO: 50025 - DNA, 25 bp, Mus musculus
tacactggtgtctgcccagatgtct

SEQ ID NO: 50026 - DNA, 25 bp, Mus musculus
tacacttcagttcagccacgtttgc

SEQ ID NO: 50027 - DNA, 25 bp, Mus musculus
tacacttcctaaactcaacagtggg

SEQ ID NO: 50028 - DNA, 25 bp, Mus musculus
tacacttgtggaatctgctctcacg

SEQ ID NO: 50029 - DNA, 25 bp, Mus musculus
tacactttcttgtacaaagtgggat

SEQ ID NO: 50030 - DNA, 25 bp, Mus musculus
tacagaaactacactggaacccgga

SEQ ID NO: 50031 - DNA, 25 bp, Mus musculus
tacagaaagctggagggaatgtcag

SEQ ID NO: 50032 - DNA, 25 bp, Mus musculus
tacagaacaggctatacgtaccgcc

SEQ ID NO: 50033 - DNA, 25 bp, Mus musculus
tacagaaccgtcaggatggcagcgt

SEQ ID NO: 50034 - DNA, 25 bp, Mus musculus
tacagaagcaagaccaaagataagg

SEQ ID NO: 50035 - DNA, 25 bp, Mus musculus
tacagaagcagctccgacaccactt

SEQ ID NO: 50036 - DNA, 25 bp, Mus musculus
tacagaaggaaacattcgaagcggg

SEQ ID NO: 50037 - DNA, 25 bp, Mus musculus
tacagaaggcgtttgcttcaagagt

SEQ ID NO: 50038 - DNA, 25 bp, Mus musculus
tacagaatgacgaggtggcagcttt

SEQ ID NO: 50039 - DNA, 25 bp, Mus musculus
tacagaatgaggataaaggcatcaa

SEQ ID NO: 50040 - DNA, 25 bp, Mus musculus
tacagaattaagaggagaaatagca

SEQ ID NO: 50041 - DNA, 25 bp, Mus musculus
tacagaattctgcactgaggcaagc

SEQ ID NO: 50042 - DNA, 25 bp, Mus musculus
tacagacactatctcactcagtcct

SEQ ID NO: 50043 - DNA, 25 bp, Mus musculus
tacagacagccctcattacagtgat

SEQ ID NO: 50044 - DNA, 25 bp, Mus musculus
tacagacagtttcatcatcttatca

SEQ ID NO: 50045 - DNA, 25 bp, Mus musculus
tacagacatttgtggctgcctcgtg

SEQ ID NO: 50046 - DNA, 25 bp, Mus musculus
tacagaccacgtgcgctgtgcatgg

SEQ ID NO: 50047 - DNA, 25 bp, Mus musculus
tacagactctctatccccaagtcaa

SEQ ID NO: 50048 - DNA, 25 bp, Mus musculus
tacagactctctttccccaagtcaa

SEQ ID NO: 50049 - DNA, 25 bp, Mus musculus
tacagactgggaggccacaaatgag

SEQ ID NO: 50050 - DNA, 25 bp, Mus musculus
tacagacttctgaaaatatctatcg

SEQ ID NO: 50051 - DNA, 25 bp, Mus musculus
tacagacttttgctcaaccagcagg

SEQ ID NO: 50052 - DNA, 25 bp, Mus musculus
tacagagaatggctggtcccctcct

SEQ ID NO: 50053 - DNA, 25 bp, Mus musculus
tacagagaccattccatgtccgtga

SEQ ID NO: 50054 - DNA, 25 bp, Mus musculus
tacagagagatcagtggactgacag

SEQ ID NO: 50055 - DNA, 25 bp, Mus musculus
tacagagatgaaacggactctccaa

SEQ ID NO: 50056 - DNA, 25 bp, Mus musculus
tacagagatgatataatgtccgtga

SEQ ID NO: 50057 - DNA, 25 bp, Mus musculus
tacagagatggtcacgtacaaggac

SEQ ID NO: 50058 - DNA, 25 bp, Mus musculus
tacagagcccgtgaggcatcttcaa

SEQ ID NO: 50059 - DNA, 25 bp, Mus musculus
tacagagcggtgatgagagaaacca

SEQ ID NO: 50060 - DNA, 25 bp, Mus musculus
tacagaggaagccattctacccagc

SEQ ID NO: 50061 - DNA, 25 bp, Mus musculus
tacagagtcccagatcctaattata

SEQ ID NO: 50062 - DNA, 25 bp, Mus musculus
tacagagtctgaagattggattgat

SEQ ID NO: 50063 - DNA, 25 bp, Mus musculus
tacagatccatcagttcttcagctt

SEQ ID NO: 50064 - DNA, 25 bp, Mus musculus
tacagatctgcgacaagtacctccc

SEQ ID NO: 50065 - DNA, 25 bp, Mus musculus
tacagatcttatagcagtcggttta

SEQ ID NO: 50066 - DNA, 25 bp, Mus musculus
tacagatgaacccaatctaccaact

SEQ ID NO: 50067 - DNA, 25 bp, Mus musculus
tacagatgagcagatgagaggcttg

SEQ ID NO: 50068 - DNA, 25 bp, Mus musculus
tacagatgaggaacgtgtgttgagc

SEQ ID NO: 50069 - DNA, 25 bp, Mus musculus
tacagatgaggatcgtgtgttgagc

SEQ ID NO: 50070 - DNA, 25 bp, Mus musculus
tacagatggatcagtactaaaaccc

SEQ ID NO: 50071 - DNA, 25 bp, Mus musculus
tacagatggccctcccaactcattt

SEQ ID NO: 50072 - DNA, 25 bp, Mus musculus
tacagatgtacaacctggaaactac

SEQ ID NO: 50073 - DNA, 25 bp, Mus musculus
tacagatgtacatcctggaaactac

SEQ ID NO: 50074 - DNA, 25 bp, Mus musculus
tacagcaaacatgtcaagtccgagc

SEQ ID NO: 50075 - DNA, 25 bp, Mus musculus
tacagcaagcggacccgttttttat

SEQ ID NO: 50076 - DNA, 25 bp, Mus musculus
tacagcaagctcaatgtgcagaaga

SEQ ID NO: 50077 - DNA, 25 bp, Mus musculus
tacagcaagggagaactggaaattc

SEQ ID NO: 50078 - DNA, 25 bp, Mus musculus
tacagcaatgaattggtggcctagc

SEQ ID NO: 50079 - DNA, 25 bp, Mus musculus
tacagcaatgactggagcctcagtg

SEQ ID NO: 50080 - DNA, 25 bp, Mus musculus
tacagcaccacaactgacttcatca

SEQ ID NO: 50081 - DNA, 25 bp, Mus musculus
tacagcacgtgggagcccgaagaaa

SEQ ID NO: 50082 - DNA, 25 bp, Mus musculus
tacagcactcgagagcacactgctt

SEQ ID NO: 50083 - DNA, 25 bp, Mus musculus
tacagcactgtcatggcagctgcct

SEQ ID NO: 50084 - DNA, 25 bp, Mus musculus
tacagcactgtcttggcagctgcct

SEQ ID NO: 50085 - DNA, 25 bp, Mus musculus
tacagcagaggacaccttgagggcc

SEQ ID NO: 50086 - DNA, 25 bp, Mus musculus
tacagcagtgctacccagtggaact

SEQ ID NO: 50087 - DNA, 25 bp, Mus musculus
tacagccaatgaagggtgacccagt

SEQ ID NO: 50088 - DNA, 25 bp, Mus musculus
tacagccacatactggaatccgagt

SEQ ID NO: 50089 - DNA, 25 bp, Mus musculus
tacagccagcagtgtgacatttgga

SEQ ID NO: 50090 - DNA, 25 bp, Mus musculus
tacagccatcactgctgcacaagtt

SEQ ID NO: 50091 - DNA, 25 bp, Mus musculus
tacagccatgatgattaaagcggtg

SEQ ID NO: 50092 - DNA, 25 bp, Mus musculus
tacagccatgccagtgaagatggca

SEQ ID NO: 50093 - DNA, 25 bp, Mus musculus
tacagcctgacttagcccctgaaga

SEQ ID NO: 50094 - DNA, 25 bp, Mus musculus
tacagcctgtcagaagactcgtgtc

SEQ ID NO: 50095 - DNA, 25 bp, Mus musculus
tacagccttaatgagggttatgcca

SEQ ID NO: 50096 - DNA, 25 bp, Mus musculus
tacagcctttgataaaagtccggcc

SEQ ID NO: 50097 - DNA, 25 bp, Mus musculus
tacagcgaatcagcacttatggact

SEQ ID NO: 50098 - DNA, 25 bp, Mus musculus
tacagcgactatgaaagcattaagc

SEQ ID NO: 50099 - DNA, 25 bp, Mus musculus
tacagcgcagcagctggtgcagttg

SEQ ID NO: 50100 - DNA, 25 bp, Mus musculus
tacagcgccattgaagacgttcagc

SEQ ID NO: 50101 - DNA, 25 bp, Mus musculus
tacagcgcgaattagcaaaaagagc

SEQ ID NO: 50102 - DNA, 25 bp, Mus musculus
tacagcgtcactcggccaggagctg

SEQ ID NO: 50103 - DNA, 25 bp, Mus musculus
tacagcgtcactgggccaggagctg

SEQ ID NO: 50104 - DNA, 25 bp, Mus musculus
tacagcgtgtcctgtccaaggccaa

SEQ ID NO: 50105 - DNA, 25 bp, Mus musculus
tacagctaaccccaggtgatgccac

SEQ ID NO: 50106 - DNA, 25 bp, Mus musculus
tacagctaaggagactgccacacag

SEQ ID NO: 50107 - DNA, 25 bp, Mus musculus
tacagctacctgaataagcttccgg

SEQ ID NO: 50108 - DNA, 25 bp, Mus musculus
tacagctataagtgtgacaacgggt

SEQ ID NO: 50109 - DNA, 25 bp, Mus musculus
tacagctatgcaagagaatacagcg

SEQ ID NO: 50110 - DNA, 25 bp, Mus musculus
tacagctccaaagcaagcacgatgc

SEQ ID NO: 50111 - DNA, 25 bp, Mus musculus
tacagctccagtatgaccactgcaa

SEQ ID NO: 50112 - DNA, 25 bp, Mus musculus
tacagctcggcctctttggcacagc

SEQ ID NO: 50113 - DNA, 25 bp, Mus musculus
tacagctctcaaacggaagtgccgc

SEQ ID NO: 50114 - DNA, 25 bp, Mus musculus
tacagctggttggtattcttctaga

SEQ ID NO: 50115 - DNA, 25 bp, Mus musculus
tacagcttcgctgtcggcttcgcga

SEQ ID NO: 50116 - DNA, 25 bp, Mus musculus
tacagcttgcccaaacctcatgaga

SEQ ID NO: 50117 - DNA, 25 bp, Mus musculus
tacagctttgactatgattactacc

SEQ ID NO: 50118 - DNA, 25 bp, Mus musculus
tacaggaagccaacaatgtggagac

SEQ ID NO: 50119 - DNA, 25 bp, Mus musculus
tacaggaagtcacagccaacaaatg

SEQ ID NO: 50120 - DNA, 25 bp, Mus musculus
tacaggaattcaaagagaagggctc

SEQ ID NO: 50121 - DNA, 25 bp, Mus musculus
tacaggacctaaaacccggagactg

SEQ ID NO: 50122 - DNA, 25 bp, Mus musculus
tacaggacctaatacccggagactg

SEQ ID NO: 50123 - DNA, 25 bp, Mus musculus
tacaggagaggaaccctactacttt

SEQ ID NO: 50124 - DNA, 25 bp, Mus musculus
tacaggatcgactgccactggtcgg

SEQ ID NO: 50125 - DNA, 25 bp, Mus musculus
tacaggatgatgcagactgtgcgcc

SEQ ID NO: 50126 - DNA, 25 bp, Mus musculus
tacaggattgcgaacatctgatccc

SEQ ID NO: 50127 - DNA, 25 bp, Mus musculus
tacaggcactggaatgcagatggga

SEQ ID NO: 50128 - DNA, 25 bp, Mus musculus
tacaggcatgggacctgctggcaaa

SEQ ID NO: 50129 - DNA, 25 bp, Mus musculus
tacaggcatgttgatgggaatttgt

SEQ ID NO: 50130 - DNA, 25 bp, Mus musculus
tacaggcctgctgtgaagtccgagg

SEQ ID NO: 50131 - DNA, 25 bp, Mus musculus
tacaggcgctttgagaaggagcagc

SEQ ID NO: 50132 - DNA, 25 bp, Mus musculus
tacaggcgggaagctgaaatcagtg

SEQ ID NO: 50133 - DNA, 25 bp, Mus musculus
tacaggctatgtttgcccgaggaat

SEQ ID NO: 50134 - DNA, 25 bp, Mus musculus
tacaggctcatcttgtagctcaaac

SEQ ID NO: 50135 - DNA, 25 bp, Mus musculus
tacaggctggaagaggatgtccttc

SEQ ID NO: 50136 - DNA, 25 bp, Mus musculus
tacagggaagtttcaggaagaagcc

SEQ ID NO: 50137 - DNA, 25 bp, Mus musculus
tacagggatagcagtgtcttgcaat

SEQ ID NO: 50138 - DNA, 25 bp, Mus musculus
tacagggattctaacaggagaggcc

SEQ ID NO: 50139 - DNA, 25 bp, Mus musculus
tacagggcacagtgtatccagagca

SEQ ID NO: 50140 - DNA, 25 bp, Mus musculus
tacaggggccctgccaatggattta

SEQ ID NO: 50141 - DNA, 25 bp, Mus musculus
tacagggtacccagtcagaaactga

SEQ ID NO: 50142 - DNA, 25 bp, Mus musculus
tacaggtccagggagttattcagac

SEQ ID NO: 50143 - DNA, 25 bp, Mus musculus
tacaggtcccagaatgacagctgcc

SEQ ID NO: 50144 - DNA, 25 bp, Mus musculus
tacaggtgatcacgtatgtccttcg

SEQ ID NO: 50145 - DNA, 25 bp, Mus musculus
tacaggtgatccagtgccagggcct

SEQ ID NO: 50146 - DNA, 25 bp, Mus musculus
tacaggtggttgtgcactatatcca

SEQ ID NO: 50147 - DNA, 25 bp, Mus musculus
tacaggtgttcttcactctgatttg

SEQ ID NO: 50148 - DNA, 25 bp, Mus musculus
tacaggttgggagatgcagcctccc

SEQ ID NO: 50149 - DNA, 25 bp, Mus musculus
tacagtaaacggaaagaatcttgga

SEQ ID NO: 50150 - DNA, 25 bp, Mus musculus
tacagtaccatgtcactcaggagaa

SEQ ID NO: 50151 - DNA, 25 bp, Mus musculus
tacagtattgcgactttctgggctc

SEQ ID NO: 50152 - DNA, 25 bp, Mus musculus
tacagtattgcttccatcctgacct

SEQ ID NO: 50153 - DNA, 25 bp, Mus musculus
tacagtcagaccgaaagagctgtgc

SEQ ID NO: 50154 - DNA, 25 bp, Mus musculus
tacagtcaggagagatgcaagtggc

SEQ ID NO: 50155 - DNA, 25 bp, Mus musculus
tacagtcatcatcaacgaggccagc

SEQ ID NO: 50156 - DNA, 25 bp, Mus musculus
tacagtcatcccttagctgtggagg

SEQ ID NO: 50157 - DNA, 25 bp, Mus musculus
tacagtcattcagttggtaggaatg

SEQ ID NO: 50158 - DNA, 25 bp, Mus musculus
tacagtccagataaagtccaggtgg

SEQ ID NO: 50159 - DNA, 25 bp, Mus musculus
tacagtcgggcttttgttgccctga

SEQ ID NO: 50160 - DNA, 25 bp, Mus musculus
tacagtctcaagagtctttcacaag

SEQ ID NO: 50161 - DNA, 25 bp, Mus musculus
tacagtctcgttacccgctcttggg

SEQ ID NO: 50162 - DNA, 25 bp, Mus musculus
tacagtctgagaagacagctgttaa

SEQ ID NO: 50163 - DNA, 25 bp, Mus musculus
tacagtctgcttgcaatacttcttg

SEQ ID NO: 50164 - DNA, 25 bp, Mus musculus
tacagtgaaagcctctcatgccagg

SEQ ID NO: 50165 - DNA, 25 bp, Mus musculus
tacagtgaaagcgtctcatgccagg

SEQ ID NO: 50166 - DNA, 25 bp, Mus musculus
tacagtgcaccagacacagatggga

SEQ ID NO: 50167 - DNA, 25 bp, Mus musculus
tacagtgcctcgactccttaacagg

SEQ ID NO: 50168 - DNA, 25 bp, Mus musculus
tacagtgctttttgtccttgttggc

SEQ ID NO: 50169 - DNA, 25 bp, Mus musculus
tacagtggatacagtttgctgtggc

SEQ ID NO: 50170 - DNA, 25 bp, Mus musculus
tacagtgggattatgaatgcgagcc

SEQ ID NO: 50171 - DNA, 25 bp, Mus musculus
tacagtggttgctactggaagtatg

SEQ ID NO: 50172 - DNA, 25 bp, Mus musculus
tacagtgtcctcaatacccatccat

SEQ ID NO: 50173 - DNA, 25 bp, Mus musculus
tacagtgtcgtatagactagaagac

SEQ ID NO: 50174 - DNA, 25 bp, Mus musculus
tacagtgttttagcttgtgagagtc

SEQ ID NO: 50175 - DNA, 25 bp, Mus musculus
tacagttaggcagtgcaccagcaag

SEQ ID NO: 50176 - DNA, 25 bp, Mus musculus
tacagttcaagatcaagaggcacac

SEQ ID NO: 50177 - DNA, 25 bp, Mus musculus
tacagttccagataccaagacagtg

SEQ ID NO: 50178 - DNA, 25 bp, Mus musculus
tacagttcctccaagcatgaccgag

SEQ ID NO: 50179 - DNA, 25 bp, Mus musculus
tacagttcctcctagcatgaccgag

SEQ ID NO: 50180 - DNA, 25 bp, Mus musculus
tacagttggccatattgaagatcac

SEQ ID NO: 50181 - DNA, 25 bp, Mus musculus
tacagttggctgacgattccacaga

SEQ ID NO: 50182 - DNA, 25 bp, Mus musculus
tacagttgtagctgcccattaaaga

SEQ ID NO: 50183 - DNA, 25 bp, Mus musculus
tacagttgttcaacatacattccag

SEQ ID NO: 50184 - DNA, 25 bp, Mus musculus
tacataattggcaaggaccgctgac

SEQ ID NO: 50185 - DNA, 25 bp, Mus musculus
tacataattggtactcatggcggtg

SEQ ID NO: 50186 - DNA, 25 bp, Mus musculus
tacatagacttcctctaccaggttc

SEQ ID NO: 50187 - DNA, 25 bp, Mus musculus
tacatagacttcgtctaccaggttc

SEQ ID NO: 50188 - DNA, 25 bp, Mus musculus
tacatagcccatctagaaagtgaac

SEQ ID NO: 50189 - DNA, 25 bp, Mus musculus
tacatagcccatgtagaaagtgaac

SEQ ID NO: 50190 - DNA, 25 bp, Mus musculus
tacataggccattgcctgtgggcag

SEQ ID NO: 50191 - DNA, 25 bp, Mus musculus
tacataggtgccgtacctcacagtg

SEQ ID NO: 50192 - DNA, 25 bp, Mus musculus
tacatagtgggcttcaacaagcaag

SEQ ID NO: 50193 - DNA, 25 bp, Mus musculus
tacatataccatttgcgtggttttg

SEQ ID NO: 50194 - DNA, 25 bp, Mus musculus
tacatatccttcagtggcatagagt

SEQ ID NO: 50195 - DNA, 25 bp, Mus musculus
tacatatgtcctttcaatggcccca

SEQ ID NO: 50196 - DNA, 25 bp, Mus musculus
tacatattggctggagtcagttttc

SEQ ID NO: 50197 - DNA, 25 bp, Mus musculus
tacatcaaaggctactaccgccggg

SEQ ID NO: 50198 - DNA, 25 bp, Mus musculus
tacatcaaatgggtctttggagggc

SEQ ID NO: 50199 - DNA, 25 bp, Mus musculus
tacatcagcaacttcgagaagagct

SEQ ID NO: 50200 - DNA, 25 bp, Mus musculus
tacatcaggatgtccaagccctgtg

SEQ ID NO: 50201 - DNA, 25 bp, Mus musculus
tacatcatggaaggtgtaaaggcca

SEQ ID NO: 50202 - DNA, 25 bp, Mus musculus
tacatcatggaattgacattcaatc

SEQ ID NO: 50203 - DNA, 25 bp, Mus musculus
tacatcatggcgtctgagctgcggt

SEQ ID NO: 50204 - DNA, 25 bp, Mus musculus
tacatcattatcatcttcatcccag

SEQ ID NO: 50205 - DNA, 25 bp, Mus musculus
tacatccagcctgataattgagccg

SEQ ID NO: 50206 - DNA, 25 bp, Mus musculus
tacatcccagggacttgggcagggt

SEQ ID NO: 50207 - DNA, 25 bp, Mus musculus
tacatccccaccttggctgtactgg

SEQ ID NO: 50208 - DNA, 25 bp, Mus musculus
tacatcctcaaaggcggctacaagg

SEQ ID NO: 50209 - DNA, 25 bp, Mus musculus
tacatcctgctggtcaccagtgacg

SEQ ID NO: 50210 - DNA, 25 bp, Mus musculus
tacatccttgccacttctatgtgcg

SEQ ID NO: 50211 - DNA, 25 bp, Mus musculus
tacatccttgtggaggaagccaagc

SEQ ID NO: 50212 - DNA, 25 bp, Mus musculus
tacatcgcgttccagagcccacaga

SEQ ID NO: 50213 - DNA, 25 bp, Mus musculus
tacatcgtccactaccatcacaggg

SEQ ID NO: 50214 - DNA, 25 bp, Mus musculus
tacatcgtgttgtggaacagttaca

SEQ ID NO: 50215 - DNA, 25 bp, Mus musculus
tacatctaccactgcaatgcacaga

SEQ ID NO: 50216 - DNA, 25 bp, Mus musculus
tacatctatagtgggaacagcctcc

SEQ ID NO: 50217 - DNA, 25 bp, Mus musculus
tacatctccatctgcaaccgcgaga

SEQ ID NO: 50218 - DNA, 25 bp, Mus musculus
tacatctcggaaatcgcctacccag

SEQ ID NO: 50219 - DNA, 25 bp, Mus musculus
tacatctcggcgaataggatgtccg

SEQ ID NO: 50220 - DNA, 25 bp, Mus musculus
tacatctgatataaggctaatatcc

SEQ ID NO: 50221 - DNA, 25 bp, Mus musculus
tacatctgatattaggctaatatcc

SEQ ID NO: 50222 - DNA, 25 bp, Mus musculus
tacatctgctttgccagcaaggagg

SEQ ID NO: 50223 - DNA, 25 bp, Mus musculus
tacatctggtgtctgtactcggagc

SEQ ID NO: 50224 - DNA, 25 bp, Mus musculus
tacatcttcacctctggcactactg

SEQ ID NO: 50225 - DNA, 25 bp, Mus musculus
tacatctttggcgacctctgtggta

SEQ ID NO: 50226 - DNA, 25 bp, Mus musculus
tacatcttttcttctggataccacc

SEQ ID NO: 50227 - DNA, 25 bp, Mus musculus
tacatgaaagtaagagctggagtcc

SEQ ID NO: 50228 - DNA, 25 bp, Mus musculus
tacatgaaagttcacattgtgtcac

SEQ ID NO: 50229 - DNA, 25 bp, Mus musculus
tacatgaagagcttcatggcccagg

SEQ ID NO: 50230 - DNA, 25 bp, Mus musculus
tacatgaatcagaagtgccatagcg

SEQ ID NO: 50231 - DNA, 25 bp, Mus musculus
tacatgaccagaagcgctacataag

SEQ ID NO: 50232 - DNA, 25 bp, Mus musculus
tacatgagaccttgggagaacaaag

SEQ ID NO: 50233 - DNA, 25 bp, Mus musculus
tacatgaggatccagcagtttcgga

SEQ ID NO: 50234 - DNA, 25 bp, Mus musculus
tacatgaggtgagggcggaactaac

SEQ ID NO: 50235 - DNA, 25 bp, Mus musculus
tacatgataatcagctgacatctct

SEQ ID NO: 50236 - DNA, 25 bp, Mus musculus
tacatgatgctagtgatgagaagat

SEQ ID NO: 50237 - DNA, 25 bp, Mus musculus
tacatgcacggcattgtgtttggaa

SEQ ID NO: 50238 - DNA, 25 bp, Mus musculus
tacatgcagggactgaaagagatga

SEQ ID NO: 50239 - DNA, 25 bp, Mus musculus
tacatgcatccagctcaatgcacat

SEQ ID NO: 50240 - DNA, 25 bp, Mus musculus
tacatgcatggaacaaaactcaaaa

SEQ ID NO: 50241 - DNA, 25 bp, Mus musculus
tacatgcccaggtcttcgttagaga

SEQ ID NO: 50242 - DNA, 25 bp, Mus musculus
tacatgcgatgcaatagctacacca

SEQ ID NO: 50243 - DNA, 25 bp, Mus musculus
tacatgcgatgctatagctacacca

SEQ ID NO: 50244 - DNA, 25 bp, Mus musculus
tacatggaaatgcatcttcaaaatg

SEQ ID NO: 50245 - DNA, 25 bp, Mus musculus
tacatggaacggatagacaagcggg

SEQ ID NO: 50246 - DNA, 25 bp, Mus musculus
tacatggacctgcttatggactgga

SEQ ID NO: 50247 - DNA, 25 bp, Mus musculus
tacatggagccctacgaagcccaga

SEQ ID NO: 50248 - DNA, 25 bp, Mus musculus
tacatggaggatgcagtgtgccagc

SEQ ID NO: 50249 - DNA, 25 bp, Mus musculus
tacatggattctccacaatcaatag

SEQ ID NO: 50250 - DNA, 25 bp, Mus musculus
tacatggcccaggtggagggtttca

SEQ ID NO: 50251 - DNA, 25 bp, Mus musculus
tacatggcccttcacctcgtgggaa

SEQ ID NO: 50252 - DNA, 25 bp, Mus musculus
tacatggcctatgcagactatcatg

SEQ ID NO: 50253 - DNA, 25 bp, Mus musculus
tacatgggcggcagctcccgccgaa

SEQ ID NO: 50254 - DNA, 25 bp, Mus musculus
tacatgggctacgagccagggcatc

SEQ ID NO: 50255 - DNA, 25 bp, Mus musculus
tacatgtacctgagagtaatatgaa

SEQ ID NO: 50256 - DNA, 25 bp, Mus musculus
tacatgtatatcaggtactgctgtg

SEQ ID NO: 50257 - DNA, 25 bp, Mus musculus
tacatgtatgcaggccaaacattaa

SEQ ID NO: 50258 - DNA, 25 bp, Mus musculus
tacatgtcagatcaagaggaggaga

SEQ ID NO: 50259 - DNA, 25 bp, Mus musculus
tacatgtcagccaacgctcatgaaa

SEQ ID NO: 50260 - DNA, 25 bp, Mus musculus
tacatgtccttctggaacagctgtg

SEQ ID NO: 50261 - DNA, 25 bp, Mus musculus
tacatgtgagttttcccaacaagcc

SEQ ID NO: 50262 - DNA, 25 bp, Mus musculus
tacatgtggctgagattgctggcaa

SEQ ID NO: 50263 - DNA, 25 bp, Mus musculus
tacatgtgtacgtatatgcctggtc

SEQ ID NO: 50264 - DNA, 25 bp, Mus musculus
tacatgtgtatagagcctggctggt

SEQ ID NO: 50265 - DNA, 25 bp, Mus musculus
tacatgtgtgaaaaccaggcgacta

SEQ ID NO: 50266 - DNA, 25 bp, Mus musculus
tacatgtgtgctttcagagcagtag

SEQ ID NO: 50267 - DNA, 25 bp, Mus musculus
tacatgttcggtgtcgtaggcatcc

SEQ ID NO: 50268 - DNA, 25 bp, Mus musculus
tacattaagcaagggactgagatcg

SEQ ID NO: 50269 - DNA, 25 bp, Mus musculus
tacattaccttttgccggatgggac

SEQ ID NO: 50270 - DNA, 25 bp, Mus musculus
tacattaggcatggatctaagccca

SEQ ID NO: 50271 - DNA, 25 bp, Mus musculus
tacattatggtgatggtggccaaca

SEQ ID NO: 50272 - DNA, 25 bp, Mus musculus
tacattattccttattcagcagtca

SEQ ID NO: 50273 - DNA, 25 bp, Mus musculus
tacattcaggcttctaaagccaggg

SEQ ID NO: 50274 - DNA, 25 bp, Mus musculus
tacattcatccttaaaacacgtggg

SEQ ID NO: 50275 - DNA, 25 bp, Mus musculus
tacattccgaaaagcaaatgggaga

SEQ ID NO: 50276 - DNA, 25 bp, Mus musculus
tacattccgtgttatagctaaaagg

SEQ ID NO: 50277 - DNA, 25 bp, Mus musculus
tacattcgagactccactgtggcag

SEQ ID NO: 50278 - DNA, 25 bp, Mus musculus
tacattcgatacattcagcagggac

SEQ ID NO: 50279 - DNA, 25 bp, Mus musculus
tacattctggaaagattgtgtaccg

SEQ ID NO: 50280 - DNA, 25 bp, Mus musculus
tacattcttggaagttgtggttccc

SEQ ID NO: 50281 - DNA, 25 bp, Mus musculus
tacattcttggatgttgtggttccc

SEQ ID NO: 50282 - DNA, 25 bp, Mus musculus
tacattgaccgagtagatgaacccg

SEQ ID NO: 50283 - DNA, 25 bp, Mus musculus
tacattgagcttcgtggtcacactg

SEQ ID NO: 50284 - DNA, 25 bp, Mus musculus
tacattgatatttgaaggagacaca

SEQ ID NO: 50285 - DNA, 25 bp, Mus musculus
tacattgcatatgcccatagtacca

SEQ ID NO: 50286 - DNA, 25 bp, Mus musculus
tacattgccagcacgagtttgctga

SEQ ID NO: 50287 - DNA, 25 bp, Mus musculus
tacattgccccagagaagattgaaa

SEQ ID NO: 50288 - DNA, 25 bp, Mus musculus
tacattgcccctgctttgtgcgagt

SEQ ID NO: 50289 - DNA, 25 bp, Mus musculus
tacattgccttctccctgctctggg

SEQ ID NO: 50290 - DNA, 25 bp, Mus musculus
tacattgctccctcaggcgtgcaaa

SEQ ID NO: 50291 - DNA, 25 bp, Mus musculus
tacattgtctcttcggagccttggc

SEQ ID NO: 50292 - DNA, 25 bp, Mus musculus
tacatttggagtatgccaagcgggc

SEQ ID NO: 50293 - DNA, 25 bp, Mus musculus
tacattttgcatctgtcagaacttc

SEQ ID NO: 50294 - DNA, 25 bp, Mus musculus
tacattttgtgtggaatatgaagac

SEQ ID NO: 50295 - DNA, 25 bp, Mus musculus
tacatttttcctgactttcgctggt

SEQ ID NO: 50296 - DNA, 25 bp, Mus musculus
taccaaaaccatcagtaccacggct

SEQ ID NO: 50297 - DNA, 25 bp, Mus musculus
taccaaaacctaggcgaatcctgcg

SEQ ID NO: 50298 - DNA, 25 bp, Mus musculus
taccaaaactttgatgtcttcatgg

SEQ ID NO: 50299 - DNA, 25 bp, Mus musculus
taccaaacctgacactgctggcaca

SEQ ID NO: 50300 - DNA, 25 bp, Mus musculus
taccaaacctgagactgctggcaca

SEQ ID NO: 50301 - DNA, 25 bp, Mus musculus
taccaaagattgagacggaccactg

SEQ ID NO: 50302 - DNA, 25 bp, Mus musculus
taccaaagcccaagactagtcgagt

SEQ ID NO: 50303 - DNA, 25 bp, Mus musculus
taccaaagcctttcgcagagggacc

SEQ ID NO: 50304 - DNA, 25 bp, Mus musculus
taccaaaggacgtatctgaggatac

SEQ ID NO: 50305 - DNA, 25 bp, Mus musculus
taccaaaggctctataacatgtact

SEQ ID NO: 50306 - DNA, 25 bp, Mus musculus
taccaaagggctgttcacactggag

SEQ ID NO: 50307 - DNA, 25 bp, Mus musculus
taccaaatatgaatgtagccagact

SEQ ID NO: 50308 - DNA, 25 bp, Mus musculus
taccaaattccagtccatcgggatt

SEQ ID NO: 50309 - DNA, 25 bp, Mus musculus
taccaacaacttgaaatccctggaa

SEQ ID NO: 50310 - DNA, 25 bp, Mus musculus
taccaacacagtaatagcaaagaag

SEQ ID NO: 50311 - DNA, 25 bp, Mus musculus
taccaacacagttatagcaaagaag

SEQ ID NO: 50312 - DNA, 25 bp, Mus musculus
taccaacagaatgtgccatcaaggt

SEQ ID NO: 50313 - DNA, 25 bp, Mus musculus
taccaacattttttgagctctgctc

SEQ ID NO: 50314 - DNA, 25 bp, Mus musculus
taccaaccctattgccagcatcttt

SEQ ID NO: 50315 - DNA, 25 bp, Mus musculus
taccaacctctaaccgcagaactgg

SEQ ID NO: 50316 - DNA, 25 bp, Mus musculus
taccaactgcttcctaagaaagtgc

SEQ ID NO: 50317 - DNA, 25 bp, Mus musculus
taccaagaactgacccagttgaagg

SEQ ID NO: 50318 - DNA, 25 bp, Mus musculus
taccaagagagtggtcaacattgcc

SEQ ID NO: 50319 - DNA, 25 bp, Mus musculus
taccaagcagtatgaaaagtctgaa

SEQ ID NO: 50320 - DNA, 25 bp, Mus musculus
taccaagctaatgagcgtgtgaagg

SEQ ID NO: 50321 - DNA, 25 bp, Mus musculus
taccaaggacttacaaaaattccag

SEQ ID NO: 50322 - DNA, 25 bp, Mus musculus
taccaaggagataacagatctgttt

SEQ ID NO: 50323 - DNA, 25 bp, Mus musculus
taccaaggagtagccaggaaaataa

SEQ ID NO: 50324 - DNA, 25 bp, Mus musculus
taccaagggtcccaagtcggagcca

SEQ ID NO: 50325 - DNA, 25 bp, Mus musculus
taccaagtgacaaggtgtttctaaa

SEQ ID NO: 50326 - DNA, 25 bp, Mus musculus
taccaagtgagccaggaagagcact

SEQ ID NO: 50327 - DNA, 25 bp, Mus musculus
taccaagtgctgtagtggatccctg

SEQ ID NO: 50328 - DNA, 25 bp, Mus musculus
taccaagttggaaaggtctggaggc

SEQ ID NO: 50329 - DNA, 25 bp, Mus musculus
taccaataatggtcaccgtctgcag

SEQ ID NO: 50330 - DNA, 25 bp, Mus musculus
taccaatacaacgacacagatgata

SEQ ID NO: 50331 - DNA, 25 bp, Mus musculus
taccaatacgaacaggaggataaga

SEQ ID NO: 50332 - DNA, 25 bp, Mus musculus
taccaatagttctcgggttgtggga

SEQ ID NO: 50333 - DNA, 25 bp, Mus musculus
taccaatatagtaatactgagcctg

SEQ ID NO: 50334 - DNA, 25 bp, Mus musculus
taccaatgcctcagtcaccagggct

SEQ ID NO: 50335 - DNA, 25 bp, Mus musculus
taccaatgcctctgtcaccagggct

SEQ ID NO: 50336 - DNA, 25 bp, Mus musculus
taccaatggctagaagcagatcgtc

SEQ ID NO: 50337 - DNA, 25 bp, Mus musculus
taccaatttgtggagcgcctgctcc

SEQ ID NO: 50338 - DNA, 25 bp, Mus musculus
taccacaaacatttagaagatctgg

SEQ ID NO: 50339 - DNA, 25 bp, Mus musculus
taccacaacgtggaagggttcaccg

SEQ ID NO: 50340 - DNA, 25 bp, Mus musculus
taccacaagaagaagggctatgcag

SEQ ID NO: 50341 - DNA, 25 bp, Mus musculus
taccacaatgagagcgaggtgggaa

SEQ ID NO: 50342 - DNA, 25 bp, Mus musculus
taccacaatggcctaaagacagagg

SEQ ID NO: 50343 - DNA, 25 bp, Mus musculus
taccacacccaatgaacttgttcag

SEQ ID NO: 50344 - DNA, 25 bp, Mus musculus
taccacacttgcttttttccagtct

SEQ ID NO: 50345 - DNA, 25 bp, Mus musculus
taccacagcgacgaacaaaagctga

SEQ ID NO: 50346 - DNA, 25 bp, Mus musculus
taccacagcgtgctctgagaggtca

SEQ ID NO: 50347 - DNA, 25 bp, Mus musculus
taccacaggcgcattgcgtgcactg

SEQ ID NO: 50348 - DNA, 25 bp, Mus musculus
taccacaggcgctttgcgtgcactg

SEQ ID NO: 50349 - DNA, 25 bp, Mus musculus
taccacagtgaaactcaaagttaca

SEQ ID NO: 50350 - DNA, 25 bp, Mus musculus
taccacatcaacaaactgaccctga

SEQ ID NO: 50351 - DNA, 25 bp, Mus musculus
taccacatccctatatctgaagaag

SEQ ID NO: 50352 - DNA, 25 bp, Mus musculus
taccacattacagatgaccgtacca

SEQ ID NO: 50353 - DNA, 25 bp, Mus musculus
taccacattataagagaagcacgtt

SEQ ID NO: 50354 - DNA, 25 bp, Mus musculus
taccaccaacctttcagttctcaag

SEQ ID NO: 50355 - DNA, 25 bp, Mus musculus
taccaccaacttgataaacgacaca

SEQ ID NO: 50356 - DNA, 25 bp, Mus musculus
taccaccagaagctggtggaccagg

SEQ ID NO: 50357 - DNA, 25 bp, Mus musculus
taccacctatgatgggactacacct

SEQ ID NO: 50358 - DNA, 25 bp, Mus musculus
taccacctgcggcacctagtcattg

SEQ ID NO: 50359 - DNA, 25 bp, Mus musculus
taccacctggactggaagtaggact

SEQ ID NO: 50360 - DNA, 25 bp, Mus musculus
taccacctgtgggaccatgtttgac

SEQ ID NO: 50361 - DNA, 25 bp, Mus musculus
taccacctgtggtggacaccacaca

SEQ ID NO: 50362 - DNA, 25 bp, Mus musculus
taccacgacggcagaggccgttgtg

SEQ ID NO: 50363 - DNA, 25 bp, Mus musculus
taccacgagctgatgaagcatgcgg

SEQ ID NO: 50364 - DNA, 25 bp, Mus musculus
taccacggcataaggaagactctcc

SEQ ID NO: 50365 - DNA, 25 bp, Mus musculus
taccacggcatatggaagactctcc

SEQ ID NO: 50366 - DNA, 25 bp, Mus musculus
taccacgtgggacagacctttgacc

SEQ ID NO: 50367 - DNA, 25 bp, Mus musculus
taccactaaatagtacagctacgtc

SEQ ID NO: 50368 - DNA, 25 bp, Mus musculus
taccactacaatggattgaagcagt

SEQ ID NO: 50369 - DNA, 25 bp, Mus musculus
taccactatgctgtctattacaggg

SEQ ID NO: 50370 - DNA, 25 bp, Mus musculus
taccactcggcacaaattttacaaa

SEQ ID NO: 50371 - DNA, 25 bp, Mus musculus
taccactgcaggaacggcctgtgca

SEQ ID NO: 50372 - DNA, 25 bp, Mus musculus
taccactggcgacagttatctgctc

SEQ ID NO: 50373 - DNA, 25 bp, Mus musculus
taccagaaacatatccatttaaccc

SEQ ID NO: 50374 - DNA, 25 bp, Mus musculus
taccagaaagcatgcaagtgtgatt

SEQ ID NO: 50375 - DNA, 25 bp, Mus musculus
taccagaatatgaaccattatcatc

SEQ ID NO: 50376 - DNA, 25 bp, Mus musculus
taccagaccttccagcgcatcgtgg

SEQ ID NO: 50377 - DNA, 25 bp, Mus musculus
taccagagagaaattaaagccccag

SEQ ID NO: 50378 - DNA, 25 bp, Mus musculus
taccagagcgatgggcagagctatc

SEQ ID NO: 50379 - DNA, 25 bp, Mus musculus
taccagaggaaaggttggaagacct

SEQ ID NO: 50380 - DNA, 25 bp, Mus musculus
taccagaggcgaattgttccactgt

SEQ ID NO: 50381 - DNA, 25 bp, Mus musculus
taccagagggtcagccttcttacct

SEQ ID NO: 50382 - DNA, 25 bp, Mus musculus
taccagagtccttccgtgggtcaaa

SEQ ID NO: 50383 - DNA, 25 bp, Mus musculus
taccagagttcacgacagagaagca

SEQ ID NO: 50384 - DNA, 25 bp, Mus musculus
taccagattcatcagtatgggagaa

SEQ ID NO: 50385 - DNA, 25 bp, Mus musculus
taccagcaaggaataaggccgagtg

SEQ ID NO: 50386 - DNA, 25 bp, Mus musculus
taccagcaagtcttcagccacattg

SEQ ID NO: 50387 - DNA, 25 bp, Mus musculus
taccagcaccatgacatggactctt

SEQ ID NO: 50388 - DNA, 25 bp, Mus musculus
taccagcagctaatagaagacatcg

SEQ ID NO: 50389 - DNA, 25 bp, Mus musculus
taccagcagtgcctatgagtttgtc

SEQ ID NO: 50390 - DNA, 25 bp, Mus musculus
taccagcattcacacagacaagagc

SEQ ID NO: 50391 - DNA, 25 bp, Mus musculus
taccagccctactaaaggaggacgc

SEQ ID NO: 50392 - DNA, 25 bp, Mus musculus
taccagccctatggagtatccatct

SEQ ID NO: 50393 - DNA, 25 bp, Mus musculus
taccagcgaaaaagttagtaaatct

SEQ ID NO: 50394 - DNA, 25 bp, Mus musculus
taccagcgggcaaccatggaggaga

SEQ ID NO: 50395 - DNA, 25 bp, Mus musculus
taccagcgtgatggccccatgtgca

SEQ ID NO: 50396 - DNA, 25 bp, Mus musculus
taccagctgcccagcacagtgtata

SEQ ID NO: 50397 - DNA, 25 bp, Mus musculus
taccagctggaggatgagtctgccc

SEQ ID NO: 50398 - DNA, 25 bp, Mus musculus
taccagctttagtggcagtttccag

SEQ ID NO: 50399 - DNA, 25 bp, Mus musculus
taccaggaacacaagactgcagctc

SEQ ID NO: 50400 - DNA, 25 bp, Mus musculus
taccaggaagtgcacactgagcagg

SEQ ID NO: 50401 - DNA, 25 bp, Mus musculus
taccaggagacgtcggagatgcgct

SEQ ID NO: 50402 - DNA, 25 bp, Mus musculus
taccaggaggacatctttccatgtt

SEQ ID NO: 50403 - DNA, 25 bp, Mus musculus
taccaggaggtgatgaactccaagc

SEQ ID NO: 50404 - DNA, 25 bp, Mus musculus
taccaggatctgagagatatatgag

SEQ ID NO: 50405 - DNA, 25 bp, Mus musculus
taccaggatctgtgagatatatgag

SEQ ID NO: 50406 - DNA, 25 bp, Mus musculus
taccaggatttccacaggaggtgga

SEQ ID NO: 50407 - DNA, 25 bp, Mus musculus
taccaggcctcccagcatgacatgt

SEQ ID NO: 50408 - DNA, 25 bp, Mus musculus
taccaggtggctcgagatgtgcccc

SEQ ID NO: 50409 - DNA, 25 bp, Mus musculus
taccaggttctccagagcgacgaga

SEQ ID NO: 50410 - DNA, 25 bp, Mus musculus
taccaggttctcgagagcgacgaga

SEQ ID NO: 50411 - DNA, 25 bp, Mus musculus
taccagtatgacctgggctacggaa

SEQ ID NO: 50412 - DNA, 25 bp, Mus musculus
taccagtcctccttcaactgggacg

SEQ ID NO: 50413 - DNA, 25 bp, Mus musculus
taccagtgaacctcttccccaagat

SEQ ID NO: 50414 - DNA, 25 bp, Mus musculus
taccagtttcaatggtcataaaccc

SEQ ID NO: 50415 - DNA, 25 bp, Mus musculus
taccataacccagatgcaagaacat

SEQ ID NO: 50416 - DNA, 25 bp, Mus musculus
taccataactattgaaaacgaaagc

SEQ ID NO: 50417 - DNA, 25 bp, Mus musculus
taccatagaaaagcattagcagtct

SEQ ID NO: 50418 - DNA, 25 bp, Mus musculus
taccatagagcagaagatgacctga

SEQ ID NO: 50419 - DNA, 25 bp, Mus musculus
taccatatccaaaataaaaggacac

SEQ ID NO: 50420 - DNA, 25 bp, Mus musculus
taccatatggaaggtgaatcgctcc

SEQ ID NO: 50421 - DNA, 25 bp, Mus musculus
taccatatttgcagatgattctctg

SEQ ID NO: 50422 - DNA, 25 bp, Mus musculus
taccatcaagagatcagggtctttg

SEQ ID NO: 50423 - DNA, 25 bp, Mus musculus
taccatcacctgctgctttatgaag

SEQ ID NO: 50424 - DNA, 25 bp, Mus musculus
taccatcagcgatggctgcaccgag

SEQ ID NO: 50425 - DNA, 25 bp, Mus musculus
taccatcatagataggaccgtgtgg

SEQ ID NO: 50426 - DNA, 25 bp, Mus musculus
taccatcatttccctgctgacgcag

SEQ ID NO: 50427 - DNA, 25 bp, Mus musculus
taccatccagacactgtttagtaaa

SEQ ID NO: 50428 - DNA, 25 bp, Mus musculus
taccatcccagaactcaaggaccat

SEQ ID NO: 50429 - DNA, 25 bp, Mus musculus
taccatcctactttgccaaaagtgc

SEQ ID NO: 50430 - DNA, 25 bp, Mus musculus
taccatcgtgagcttggcatcaaga

SEQ ID NO: 50431 - DNA, 25 bp, Mus musculus
taccatctacgtccatgagaagtgg

SEQ ID NO: 50432 - DNA, 25 bp, Mus musculus
taccatgaagaacgcagcaacggtt

SEQ ID NO: 50433 - DNA, 25 bp, Mus musculus
taccatgcactaggagtgctctatc

SEQ ID NO: 50434 - DNA, 25 bp, Mus musculus
taccatggacaagagttcatccgtg

SEQ ID NO: 50435 - DNA, 25 bp, Mus musculus
taccatggcttcatgaaggctgtcc

SEQ ID NO: 50436 - DNA, 25 bp, Mus musculus
taccatggtgatgatcctaaggaga

SEQ ID NO: 50437 - DNA, 25 bp, Mus musculus
taccatggtgatggccagtgtcatg

SEQ ID NO: 50438 - DNA, 25 bp, Mus musculus
taccatgtgcgactccgggagtgaa

SEQ ID NO: 50439 - DNA, 25 bp, Mus musculus
taccatgttctctaggagtccccag

SEQ ID NO: 50440 - DNA, 25 bp, Mus musculus
taccattctctttctttacactagc

SEQ ID NO: 50441 - DNA, 25 bp, Mus musculus
taccattggatcacgggaccttgct

SEQ ID NO: 50442 - DNA, 25 bp, Mus musculus
taccattggcacaaactgcacagcc

SEQ ID NO: 50443 - DNA, 25 bp, Mus musculus
taccattgtggccaccctgacggct

SEQ ID NO: 50444 - DNA, 25 bp, Mus musculus
taccattgtgtgtgctgtgatagcc

SEQ ID NO: 50445 - DNA, 25 bp, Mus musculus
taccattgttgctggaggtcttatt

SEQ ID NO: 50446 - DNA, 25 bp, Mus musculus
tacccaaaagattcaccctgtagag

SEQ ID NO: 50447 - DNA, 25 bp, Mus musculus
tacccaaacctctggatctggagcc

SEQ ID NO: 50448 - DNA, 25 bp, Mus musculus
tacccaaagacaataaaggcaaagt

SEQ ID NO: 50449 - DNA, 25 bp, Mus musculus
tacccaaagacgagcggctggatgg

SEQ ID NO: 50450 - DNA, 25 bp, Mus musculus
tacccaaccaagaacggctgtggga

SEQ ID NO: 50451 - DNA, 25 bp, Mus musculus
tacccaactcttaagatctttagag

SEQ ID NO: 50452 - DNA, 25 bp, Mus musculus
tacccaaggagacctctcgggtcgc

SEQ ID NO: 50453 - DNA, 25 bp, Mus musculus
tacccaatctttttcaccatgactg

SEQ ID NO: 50454 - DNA, 25 bp, Mus musculus
tacccacaacataagcagtatggag

SEQ ID NO: 50455 - DNA, 25 bp, Mus musculus
tacccacacagaagcgatggtttag

SEQ ID NO: 50456 - DNA, 25 bp, Mus musculus
tacccacagacggaaggcttgctgg

SEQ ID NO: 50457 - DNA, 25 bp, Mus musculus
tacccacaggccagtgaacgttgtg

SEQ ID NO: 50458 - DNA, 25 bp, Mus musculus
tacccacattccagatgttcaagta

SEQ ID NO: 50459 - DNA, 25 bp, Mus musculus
tacccaccatgagaagggccagaag

SEQ ID NO: 50460 - DNA, 25 bp, Mus musculus
tacccacgctgaacgaaagggacac

SEQ ID NO: 50461 - DNA, 25 bp, Mus musculus
tacccactttccagccggatgctga

SEQ ID NO: 50462 - DNA, 25 bp, Mus musculus
tacccagaaggcctaggagaagtgc

SEQ ID NO: 50463 - DNA, 25 bp, Mus musculus
tacccagaattttttgaactgaaat

SEQ ID NO: 50464 - DNA, 25 bp, Mus musculus
tacccagcatctggactggcataga

SEQ ID NO: 50465 - DNA, 25 bp, Mus musculus
tacccagctcttatcagctacatga

SEQ ID NO: 50466 - DNA, 25 bp, Mus musculus
tacccagtcagacgaagagaagtct

SEQ ID NO: 50467 - DNA, 25 bp, Mus musculus
tacccagtgaggaaaatcttgcccc

SEQ ID NO: 50468 - DNA, 25 bp, Mus musculus
tacccataatgatacttccctgagt

SEQ ID NO: 50469 - DNA, 25 bp, Mus musculus
tacccatgatgcacagcgctacgtc

SEQ ID NO: 50470 - DNA, 25 bp, Mus musculus
tacccatgggtcctggctctcagag

SEQ ID NO: 50471 - DNA, 25 bp, Mus musculus
tacccatgggtcgtggctctcagag

SEQ ID NO: 50472 - DNA, 25 bp, Mus musculus
tacccatgtctaaatggaggtacta

SEQ ID NO: 50473 - DNA, 25 bp, Mus musculus
tacccattggtctaagcttgatcca

SEQ ID NO: 50474 - DNA, 25 bp, Mus musculus
taccccaactatgttgcagaatgtg

SEQ ID NO: 50475 - DNA, 25 bp, Mus musculus
taccccaagctttgtgatggacggt

SEQ ID NO: 50476 - DNA, 25 bp, Mus musculus
taccccaatgccagaagaatttgag

SEQ ID NO: 50477 - DNA, 25 bp, Mus musculus
taccccacttatgaggtggaggatg

SEQ ID NO: 50478 - DNA, 25 bp, Mus musculus
taccccagtagtgaataagcaacga

SEQ ID NO: 50479 - DNA, 25 bp, Mus musculus
taccccagtgaagagaccaaagaag

SEQ ID NO: 50480 - DNA, 25 bp, Mus musculus
taccccatgttggatggcccctgaa

SEQ ID NO: 50481 - DNA, 25 bp, Mus musculus
taccccgagggtgtccaagagcttc

SEQ ID NO: 50482 - DNA, 25 bp, Mus musculus
taccccgcttctactgggaggaccg

SEQ ID NO: 50483 - DNA, 25 bp, Mus musculus
tacccctatgagtatgaaggcgggc

SEQ ID NO: 50484 - DNA, 25 bp, Mus musculus
tacccctatggagagaagcaagatg

SEQ ID NO: 50485 - DNA, 25 bp, Mus musculus
tacccctcaatggatcagttggctg

SEQ ID NO: 50486 - DNA, 25 bp, Mus musculus
tacccctctatgaccagtgggaaga

SEQ ID NO: 50487 - DNA, 25 bp, Mus musculus
tacccctgggccactagtcgtgtta

SEQ ID NO: 50488 - DNA, 25 bp, Mus musculus
tacccctgggcctctagtcgtgtta

SEQ ID NO: 50489 - DNA, 25 bp, Mus musculus
tacccgaataggagacaaggaccac

SEQ ID NO: 50490 - DNA, 25 bp, Mus musculus
tacccgagaggcttcacctgtgcct

SEQ ID NO: 50491 - DNA, 25 bp, Mus musculus
tacccgcattgcttactccatggtg

SEQ ID NO: 50492 - DNA, 25 bp, Mus musculus
tacccggaatttcagagacggccat

SEQ ID NO: 50493 - DNA, 25 bp, Mus musculus
tacccggagatatgtacgcaagttt

SEQ ID NO: 50494 - DNA, 25 bp, Mus musculus
tacccggcagcctcagagctgtgga

SEQ ID NO: 50495 - DNA, 25 bp, Mus musculus
tacccggccctcatggactgcatga

SEQ ID NO: 50496 - DNA, 25 bp, Mus musculus
tacccgggatatggtccgtgttctc

SEQ ID NO: 50497 - DNA, 25 bp, Mus musculus
tacccgtcagtcaggctgtgcttag

SEQ ID NO: 50498 - DNA, 25 bp, Mus musculus
tacccgttacatatccttcagtggc

SEQ ID NO: 50499 - DNA, 25 bp, Mus musculus
taccctaatctaggaaatcccacag

SEQ ID NO: 50500 - DNA, 25 bp, Mus musculus
taccctacgggactcgctgatgaga

SEQ ID NO: 50501 - DNA, 25 bp, Mus musculus
taccctacgggagtcgctgatgaga

SEQ ID NO: 50502 - DNA, 25 bp, Mus musculus
taccctagaggaagagatgaccaag

SEQ ID NO: 50503 - DNA, 25 bp, Mus musculus
taccctagatgctgggaaattccag

SEQ ID NO: 50504 - DNA, 25 bp, Mus musculus
taccctcaaaggcttccgaaggtca

SEQ ID NO: 50505 - DNA, 25 bp, Mus musculus
taccctcaatgacaagctgtttgcc

SEQ ID NO: 50506 - DNA, 25 bp, Mus musculus
taccctcccacagcttggaagagtg

SEQ ID NO: 50507 - DNA, 25 bp, Mus musculus
taccctcggaagtctggaggagagc

SEQ ID NO: 50508 - DNA, 25 bp, Mus musculus
taccctctccgcagcatgcaagtag

SEQ ID NO: 50509 - DNA, 25 bp, Mus musculus
taccctcttataccagttggcaaac

SEQ ID NO: 50510 - DNA, 25 bp, Mus musculus
taccctgactgtaattgaagaagcc

SEQ ID NO: 50511 - DNA, 25 bp, Mus musculus
taccctgagaccagtgtcctttttc

SEQ ID NO: 50512 - DNA, 25 bp, Mus musculus
taccctgaggcaccggcgaccaagg

SEQ ID NO: 50513 - DNA, 25 bp, Mus musculus
taccctgatctttgtgtactgttgg

SEQ ID NO: 50514 - DNA, 25 bp, Mus musculus
taccctgatgctggctgtcgtcaca

SEQ ID NO: 50515 - DNA, 25 bp, Mus musculus
taccctgcagtttgtgaatttttac

SEQ ID NO: 50516 - DNA, 25 bp, Mus musculus
taccctgcctctgaatgggagtgcc

SEQ ID NO: 50517 - DNA, 25 bp, Mus musculus
taccctggaagcatttcggtcgtag

SEQ ID NO: 50518 - DNA, 25 bp, Mus musculus
taccctggagcgatatgtggagaca

SEQ ID NO: 50519 - DNA, 25 bp, Mus musculus
taccctggcagttttggagacagtg

SEQ ID NO: 50520 - DNA, 25 bp, Mus musculus
taccctggcatacagtttgaaatca

SEQ ID NO: 50521 - DNA, 25 bp, Mus musculus
taccctggcgagcagcaaaagagac

SEQ ID NO: 50522 - DNA, 25 bp, Mus musculus
taccctggctaaagcagagccggag

SEQ ID NO: 50523 - DNA, 25 bp, Mus musculus
taccctgtgacagcagactggtgta

SEQ ID NO: 50524 - DNA, 25 bp, Mus musculus
taccctgtggacttggagatcagca

SEQ ID NO: 50525 - DNA, 25 bp, Mus musculus
taccctgtgtggaggtgcagacact

SEQ ID NO: 50526 - DNA, 25 bp, Mus musculus
tacccttacaaggaagacaccatac

SEQ ID NO: 50527 - DNA, 25 bp, Mus musculus
tacccttcagcagacgccggagaga

SEQ ID NO: 50528 - DNA, 25 bp, Mus musculus
tacccttgagggttcagaatcgtgc

SEQ ID NO: 50529 - DNA, 25 bp, Mus musculus
tacccttggctttcctagacactgc

SEQ ID NO: 50530 - DNA, 25 bp, Mus musculus
taccgaaagaggattggcttgaagc

SEQ ID NO: 50531 - DNA, 25 bp, Mus musculus
taccgaaagaggtttggcttgaagc

SEQ ID NO: 50532 - DNA, 25 bp, Mus musculus
taccgaaagatgctaggcaacccca

SEQ ID NO: 50533 - DNA, 25 bp, Mus musculus
taccgaagctgccatttatcaacct

SEQ ID NO: 50534 - DNA, 25 bp, Mus musculus
taccgaaggatgagcacgaaggaca

SEQ ID NO: 50535 - DNA, 25 bp, Mus musculus
taccgaaggatgtgcacgaaggaca

SEQ ID NO: 50536 - DNA, 25 bp, Mus musculus
taccgaatgtataggaagaaccaag

SEQ ID NO: 50537 - DNA, 25 bp, Mus musculus
taccgaatttgtgctatccctagag

SEQ ID NO: 50538 - DNA, 25 bp, Mus musculus
taccgacacccttggttctgcagag

SEQ ID NO: 50539 - DNA, 25 bp, Mus musculus
taccgacatgacaagaggatcaagc

SEQ ID NO: 50540 - DNA, 25 bp, Mus musculus
taccgagaagagactctgagcatca

SEQ ID NO: 50541 - DNA, 25 bp, Mus musculus
taccgagagcagatgttcagactgc

SEQ ID NO: 50542 - DNA, 25 bp, Mus musculus
taccgagcagctctgcgctcctgta

SEQ ID NO: 50543 - DNA, 25 bp, Mus musculus
taccgaggaccatccccagtaaata

SEQ ID NO: 50544 - DNA, 25 bp, Mus musculus
taccgattgccctacctgctggtgg

SEQ ID NO: 50545 - DNA, 25 bp, Mus musculus
taccgcaagtcactgaagtggaccc

SEQ ID NO: 50546 - DNA, 25 bp, Mus musculus
taccgcacagggatcgtcaatgcct

SEQ ID NO: 50547 - DNA, 25 bp, Mus musculus
taccgccacattgattgtgcttctg

SEQ ID NO: 50548 - DNA, 25 bp, Mus musculus
taccgccagctcagcaagccagtaa

SEQ ID NO: 50549 - DNA, 25 bp, Mus musculus
taccgccctcagcacattttctttg

SEQ ID NO: 50550 - DNA, 25 bp, Mus musculus
taccgccgcaaccacaaaggtggtg

SEQ ID NO: 50551 - DNA, 25 bp, Mus musculus
taccgccttaaggaatacctagcag

SEQ ID NO: 50552 - DNA, 25 bp, Mus musculus
taccgcgtagtccaggtgactgatg

SEQ ID NO: 50553 - DNA, 25 bp, Mus musculus
taccgcgtgacgtcggacggcatgc

SEQ ID NO: 50554 - DNA, 25 bp, Mus musculus
taccgctactaccaggtggctcgag

SEQ ID NO: 50555 - DNA, 25 bp, Mus musculus
taccgctgcagggatcaaaggcccg

SEQ ID NO: 50556 - DNA, 25 bp, Mus musculus
taccgctgccgtccgttagtcctgg

SEQ ID NO: 50557 - DNA, 25 bp, Mus musculus
taccgcttcaccaaatatcaatgtg

SEQ ID NO: 50558 - DNA, 25 bp, Mus musculus
taccgcttgacaactgtacttggaa

SEQ ID NO: 50559 - DNA, 25 bp, Mus musculus
taccgcttgacatctgtacttggaa

SEQ ID NO: 50560 - DNA, 25 bp, Mus musculus
taccggaaagcctgtgcctctgctg

SEQ ID NO: 50561 - DNA, 25 bp, Mus musculus
taccggacaagcttagaacaaaact

SEQ ID NO: 50562 - DNA, 25 bp, Mus musculus
taccggagcacgtgcaacttctctg

SEQ ID NO: 50563 - DNA, 25 bp, Mus musculus
taccggatgttgctacaacaggatc

SEQ ID NO: 50564 - DNA, 25 bp, Mus musculus
taccggcgtgtgtacaagtccctct

SEQ ID NO: 50565 - DNA, 25 bp, Mus musculus
taccgggaaggagatcagctgaatt

SEQ ID NO: 50566 - DNA, 25 bp, Mus musculus
taccgggacacaggaatgctgccaa

SEQ ID NO: 50567 - DNA, 25 bp, Mus musculus
taccgggacctacagaggaagccat

SEQ ID NO: 50568 - DNA, 25 bp, Mus musculus
taccgggtatgggagttttcgattg

SEQ ID NO: 50569 - DNA, 25 bp, Mus musculus
taccggtggattccaaacgctatag

SEQ ID NO: 50570 - DNA, 25 bp, Mus musculus
taccgtaatggctccagtgccaata

SEQ ID NO: 50571 - DNA, 25 bp, Mus musculus
taccgtagcatcagtgacgacccga

SEQ ID NO: 50572 - DNA, 25 bp, Mus musculus
taccgtagttacttcatggagtgcc

SEQ ID NO: 50573 - DNA, 25 bp, Mus musculus
taccgtgcactccagggagcactga

SEQ ID NO: 50574 - DNA, 25 bp, Mus musculus
taccgtgctagccatcaagaacggg

SEQ ID NO: 50575 - DNA, 25 bp, Mus musculus
taccgtggacccagatgcaggtggt

SEQ ID NO: 50576 - DNA, 25 bp, Mus musculus
taccgtggttgactctccagacctc

SEQ ID NO: 50577 - DNA, 25 bp, Mus musculus
taccgtgtacatgtggctcagcaac

SEQ ID NO: 50578 - DNA, 25 bp, Mus musculus
taccgtgttaggtattctaatgaca

SEQ ID NO: 50579 - DNA, 25 bp, Mus musculus
taccgttcctgtgtccacgttacaa

SEQ ID NO: 50580 - DNA, 25 bp, Mus musculus
taccgttgtcagcacacagcgttca

SEQ ID NO: 50581 - DNA, 25 bp, Mus musculus
taccgtttacttacatgttagagaa

SEQ ID NO: 50582 - DNA, 25 bp, Mus musculus
taccgttttgcagagattcgctacc

SEQ ID NO: 50583 - DNA, 25 bp, Mus musculus
tacctaaagttctatgagcctcaag

SEQ ID NO: 50584 - DNA, 25 bp, Mus musculus
tacctaaattaggatcagttgacaa

SEQ ID NO: 50585 - DNA, 25 bp, Mus musculus
tacctaacaggagtttgagggacag

SEQ ID NO: 50586 - DNA, 25 bp, Mus musculus
tacctaagaacaggcccctggtggg

SEQ ID NO: 50587 - DNA, 25 bp, Mus musculus
tacctacaggagagctatcgaactg

SEQ ID NO: 50588 - DNA, 25 bp, Mus musculus
tacctacgcatgctttcatgtcagt

SEQ ID NO: 50589 - DNA, 25 bp, Mus musculus
tacctacggctcaaaaaactctttg

SEQ ID NO: 50590 - DNA, 25 bp, Mus musculus
tacctactgggaaacttcacggagg

SEQ ID NO: 50591 - DNA, 25 bp, Mus musculus
tacctagacgcttgcaagacagctg

SEQ ID NO: 50592 - DNA, 25 bp, Mus musculus
tacctagattcctgagaaaacgcgg

SEQ ID NO: 50593 - DNA, 25 bp, Mus musculus
tacctagcaggtgatgtcatgtcag

SEQ ID NO: 50594 - DNA, 25 bp, Mus musculus
tacctaggccagttccctgatatca

SEQ ID NO: 50595 - DNA, 25 bp, Mus musculus
tacctaggtcgcactggccaacatg

SEQ ID NO: 50596 - DNA, 25 bp, Mus musculus
tacctaggtcgctctggccaacatg

SEQ ID NO: 50597 - DNA, 25 bp, Mus musculus
tacctagtgcaaagccaaggatgga

SEQ ID NO: 50598 - DNA, 25 bp, Mus musculus
tacctataaaaagggccttgatagg

SEQ ID NO: 50599 - DNA, 25 bp, Mus musculus
tacctatgcagaaaatcaggatggc

SEQ ID NO: 50600 - DNA, 25 bp, Mus musculus
tacctatggttttacatgctgcggg

SEQ ID NO: 50601 - DNA, 25 bp, Mus musculus
tacctatgtcaatgaggacttccgg

SEQ ID NO: 50602 - DNA, 25 bp, Mus musculus
tacctcaaatggtgaccaaacgcag

SEQ ID NO: 50603 - DNA, 25 bp, Mus musculus
tacctcaagtgcctgacccagcagg

SEQ ID NO: 50604 - DNA, 25 bp, Mus musculus
tacctcaccttttttagaactacag

SEQ ID NO: 50605 - DNA, 25 bp, Mus musculus
tacctcacttgggaatcagtaaacc

SEQ ID NO: 50606 - DNA, 25 bp, Mus musculus
tacctcagagagcacttgtcaaccg

SEQ ID NO: 50607 - DNA, 25 bp, Mus musculus
tacctcagagaggacttgtcaaccg

SEQ ID NO: 50608 - DNA, 25 bp, Mus musculus
tacctcagaggatcctccaacagga

SEQ ID NO: 50609 - DNA, 25 bp, Mus musculus
tacctcagctacctcggtactggga

SEQ ID NO: 50610 - DNA, 25 bp, Mus musculus
tacctcagggatgacacttggaggc

SEQ ID NO: 50611 - DNA, 25 bp, Mus musculus
tacctcagtggcatgcctgccaaga

SEQ ID NO: 50612 - DNA, 25 bp, Mus musculus
tacctcagtgtcaagcctgcaggag

SEQ ID NO: 50613 - DNA, 25 bp, Mus musculus
tacctcattagtggcagcaaatttg

SEQ ID NO: 50614 - DNA, 25 bp, Mus musculus
tacctccaggtggatcgctttaacc

SEQ ID NO: 50615 - DNA, 25 bp, Mus musculus
tacctcccaggagctggaacgttgc

SEQ ID NO: 50616 - DNA, 25 bp, Mus musculus
tacctcccaggttactacagtgcag

SEQ ID NO: 50617 - DNA, 25 bp, Mus musculus
tacctccctagctccttaaagactt

SEQ ID NO: 50618 - DNA, 25 bp, Mus musculus
tacctcctggactaaatgaaagtga

SEQ ID NO: 50619 - DNA, 25 bp, Mus musculus
tacctcctgggaagatgcactctct

SEQ ID NO: 50620 - DNA, 25 bp, Mus musculus
tacctcgagctaggataacacggag

SEQ ID NO: 50621 - DNA, 25 bp, Mus musculus
tacctcggcaagtttctgaacacag

SEQ ID NO: 50622 - DNA, 25 bp, Mus musculus
tacctctacaagcagggctttgcca

SEQ ID NO: 50623 - DNA, 25 bp, Mus musculus
tacctctctatgacacaccctatga

SEQ ID NO: 50624 - DNA, 25 bp, Mus musculus
tacctctgaaagctctgcgctttcc

SEQ ID NO: 50625 - DNA, 25 bp, Mus musculus
tacctctgaggctacagagagctgt

SEQ ID NO: 50626 - DNA, 25 bp, Mus musculus
tacctctgcctgcatgtagtcaagg

SEQ ID NO: 50627 - DNA, 25 bp, Mus musculus
tacctctgcctggatgtagtcaagg

SEQ ID NO: 50628 - DNA, 25 bp, Mus musculus
tacctctttccttagcggcagagcc

SEQ ID NO: 50629 - DNA, 25 bp, Mus musculus
tacctctttgtctgctccctggatg

SEQ ID NO: 50630 - DNA, 25 bp, Mus musculus
tacctcttttcggatggactcgtcc

SEQ ID NO: 50631 - DNA, 25 bp, Mus musculus
tacctgaacccttccagtaggacgg

SEQ ID NO: 50632 - DNA, 25 bp, Mus musculus
tacctgaagcccatgttgcagcggg

SEQ ID NO: 50633 - DNA, 25 bp, Mus musculus
tacctgaagtggattttctgtcaga

SEQ ID NO: 50634 - DNA, 25 bp, Mus musculus
tacctgaataagcttccggtgaaga

SEQ ID NO: 50635 - DNA, 25 bp, Mus musculus
tacctgaatgttgcctgaccttagg

SEQ ID NO: 50636 - DNA, 25 bp, Mus musculus
tacctgacaatgatgagcagtttgt

SEQ ID NO: 50637 - DNA, 25 bp, Mus musculus
tacctgagagtaatatgaatgaaga

SEQ ID NO: 50638 - DNA, 25 bp, Mus musculus
tacctgagctcttaagagtcaccaa

SEQ ID NO: 50639 - DNA, 25 bp, Mus musculus
tacctgaggttatttggaattgctg

SEQ ID NO: 50640 - DNA, 25 bp, Mus musculus
tacctgatcgagaagctgctgacaa

SEQ ID NO: 50641 - DNA, 25 bp, Mus musculus
tacctgcaagtcaaaaaagacgtgc

SEQ ID NO: 50642 - DNA, 25 bp, Mus musculus
tacctgcaggtctgatatatgcatc

SEQ ID NO: 50643 - DNA, 25 bp, Mus musculus
tacctgcatctacagaacccagggc

SEQ ID NO: 50644 - DNA, 25 bp, Mus musculus
tacctgccgcgcctctgatggattc

SEQ ID NO: 50645 - DNA, 25 bp, Mus musculus
tacctgcctgagagggatgtgtacg

SEQ ID NO: 50646 - DNA, 25 bp, Mus musculus
tacctgcctgtccagaccgtgctgg

SEQ ID NO: 50647 - DNA, 25 bp, Mus musculus
tacctgcggtctggtgtggtgacct

SEQ ID NO: 50648 - DNA, 25 bp, Mus musculus
tacctgcgtcaaggaaatcggctga

SEQ ID NO: 50649 - DNA, 25 bp, Mus musculus
tacctgctgagtgtcaggccctctt

SEQ ID NO: 50650 - DNA, 25 bp, Mus musculus
tacctgctgccagaagagtacacca

SEQ ID NO: 50651 - DNA, 25 bp, Mus musculus
tacctgctgcgggacagcaatgagc

SEQ ID NO: 50652 - DNA, 25 bp, Mus musculus
tacctggaactgctcctgtgttggg

SEQ ID NO: 50653 - DNA, 25 bp, Mus musculus
tacctggaactggtcctgtgttggg

SEQ ID NO: 50654 - DNA, 25 bp, Mus musculus
tacctggaagcagtgagacagtcaa

SEQ ID NO: 50655 - DNA, 25 bp, Mus musculus
tacctggaatattacaatcttaaag

SEQ ID NO: 50656 - DNA, 25 bp, Mus musculus
tacctggaatcccagagccttagca

SEQ ID NO: 50657 - DNA, 25 bp, Mus musculus
tacctggaatgtcttcattatctgc

SEQ ID NO: 50658 - DNA, 25 bp, Mus musculus
tacctggacattgtgcggcaacacc

SEQ ID NO: 50659 - DNA, 25 bp, Mus musculus
tacctggactatgccagagtaccca

SEQ ID NO: 50660 - DNA, 25 bp, Mus musculus
tacctggagcagtagaccttaacct

SEQ ID NO: 50661 - DNA, 25 bp, Mus musculus
tacctggagccggagcacaccaaat

SEQ ID NO: 50662 - DNA, 25 bp, Mus musculus
tacctggaggaggtagcaacgtgcc

SEQ ID NO: 50663 - DNA, 25 bp, Mus musculus
tacctggagttgctcatggcaccgt

SEQ ID NO: 50664 - DNA, 25 bp, Mus musculus
tacctggagtttgccatcggtcaga

SEQ ID NO: 50665 - DNA, 25 bp, Mus musculus
tacctggatgttagataactggagt

SEQ ID NO: 50666 - DNA, 25 bp, Mus musculus
tacctggattctttatgaccttcct

SEQ ID NO: 50667 - DNA, 25 bp, Mus musculus
tacctggccactttccatcagcggg

SEQ ID NO: 50668 - DNA, 25 bp, Mus musculus
tacctgggcaacctctggaagaacc

SEQ ID NO: 50669 - DNA, 25 bp, Mus musculus
tacctggtgactcaggcccagcagt

SEQ ID NO: 50670 - DNA, 25 bp, Mus musculus
tacctggtgatgaaccccttcgacc

SEQ ID NO: 50671 - DNA, 25 bp, Mus musculus
tacctggtgcctcaatcagactaca

SEQ ID NO: 50672 - DNA, 25 bp, Mus musculus
tacctggtgcctgaatcagactaca

SEQ ID NO: 50673 - DNA, 25 bp, Mus musculus
tacctggtggaaaactgcaactgcc

SEQ ID NO: 50674 - DNA, 25 bp, Mus musculus
tacctggttaatactgacagagggc

SEQ ID NO: 50675 - DNA, 25 bp, Mus musculus
tacctgtagaagagtctgaggcagc

SEQ ID NO: 50676 - DNA, 25 bp, Mus musculus
tacctgtatttgctggctttaaaga

SEQ ID NO: 50677 - DNA, 25 bp, Mus musculus
tacctgtccgtgctctcgctttttt

SEQ ID NO: 50678 - DNA, 25 bp, Mus musculus
tacctgtgaccaagccctccaaagt

SEQ ID NO: 50679 - DNA, 25 bp, Mus musculus
tacctgtgcttcagcccagcataca

SEQ ID NO: 50680 - DNA, 25 bp, Mus musculus
tacctgtggccgttctggcttttca

SEQ ID NO: 50681 - DNA, 25 bp, Mus musculus
tacctgtgtattccagcggcagaca

SEQ ID NO: 50682 - DNA, 25 bp, Mus musculus
tacctgttaccaagacaacagtacg

SEQ ID NO: 50683 - DNA, 25 bp, Mus musculus
tacctgttcagcttcagtgagcaca

SEQ ID NO: 50684 - DNA, 25 bp, Mus musculus
tacctgttgttctgggagctggact

SEQ ID NO: 50685 - DNA, 25 bp, Mus musculus
taccttatcccaggactgttctgtg

SEQ ID NO: 50686 - DNA, 25 bp, Mus musculus
taccttatgagcctcccaggagatc

SEQ ID NO: 50687 - DNA, 25 bp, Mus musculus
taccttcaacactttctgaaagcca

SEQ ID NO: 50688 - DNA, 25 bp, Mus musculus
taccttcaaggaacttcagtacggc

SEQ ID NO: 50689 - DNA, 25 bp, Mus musculus
taccttcacaactgcaggatagcac

SEQ ID NO: 50690 - DNA, 25 bp, Mus musculus
taccttcacaccatgggctcactga

SEQ ID NO: 50691 - DNA, 25 bp, Mus musculus
taccttcatctgtgatcacccacag

SEQ ID NO: 50692 - DNA, 25 bp, Mus musculus
taccttccaggaaagacttaccaga

SEQ ID NO: 50693 - DNA, 25 bp, Mus musculus
taccttccatgagtgctacgtagca

SEQ ID NO: 50694 - DNA, 25 bp, Mus musculus
taccttcgtcaagggcaagatacac

SEQ ID NO: 50695 - DNA, 25 bp, Mus musculus
taccttctatgtcgtgatcggtgac

SEQ ID NO: 50696 - DNA, 25 bp, Mus musculus
taccttctggactcttgttttaaca

SEQ ID NO: 50697 - DNA, 25 bp, Mus musculus
taccttcttgcgctgttgcagtgag

SEQ ID NO: 50698 - DNA, 25 bp, Mus musculus
taccttgacgatgtcccatttaaga

SEQ ID NO: 50699 - DNA, 25 bp, Mus musculus
taccttggaccggagcagttgccag

SEQ ID NO: 50700 - DNA, 25 bp, Mus musculus
taccttggtaatagctgagcatgca

SEQ ID NO: 50701 - DNA, 25 bp, Mus musculus
taccttgtaggaggtgggacttccg

SEQ ID NO: 50702 - DNA, 25 bp, Mus musculus
taccttgtcaccagctcgtctgatc

SEQ ID NO: 50703 - DNA, 25 bp, Mus musculus
taccttgttcctggcgctgacatcg

SEQ ID NO: 50704 - DNA, 25 bp, Mus musculus
tacctttaatgggatttgtggccag

SEQ ID NO: 50705 - DNA, 25 bp, Mus musculus
tacctttcagagtcatgagccagag

SEQ ID NO: 50706 - DNA, 25 bp, Mus musculus
tacctttgaggaagaatgtgggact

SEQ ID NO: 50707 - DNA, 25 bp, Mus musculus
tacctttgaggaccagggaacaact

SEQ ID NO: 50708 - DNA, 25 bp, Mus musculus
tacctttgaggagcagggaacaact

SEQ ID NO: 50709 - DNA, 25 bp, Mus musculus
tacctttgaggatgaatgtgggact

SEQ ID NO: 50710 - DNA, 25 bp, Mus musculus
tacctttgatcacccagaacttgtg

SEQ ID NO: 50711 - DNA, 25 bp, Mus musculus
tacctttgatccagaacttgcagca

SEQ ID NO: 50712 - DNA, 25 bp, Mus musculus
tacctttggacatttggcaggaggg

SEQ ID NO: 50713 - DNA, 25 bp, Mus musculus
taccttttattcagcaggaagatgg

SEQ ID NO: 50714 - DNA, 25 bp, Mus musculus
taccttttccgccagaatcgcttct

SEQ ID NO: 50715 - DNA, 25 bp, Mus musculus
tacgaaaagtcctgtatttgtccct

SEQ ID NO: 50716 - DNA, 25 bp, Mus musculus
tacgaaccatgtgtgcggtcctggg

SEQ ID NO: 50717 - DNA, 25 bp, Mus musculus
tacgaacctgtgatttctcatcaag

SEQ ID NO: 50718 - DNA, 25 bp, Mus musculus
tacgaacgagggaactgcagtggaa

SEQ ID NO: 50719 - DNA, 25 bp, Mus musculus
tacgaacggagcgaatgtcaacgca

SEQ ID NO: 50720 - DNA, 25 bp, Mus musculus
tacgaactatagagttagatgggaa

SEQ ID NO: 50721 - DNA, 25 bp, Mus musculus
tacgaactcgctctgacagccgagg

SEQ ID NO: 50722 - DNA, 25 bp, Mus musculus
tacgaagaggccaccgagagaacaa

SEQ ID NO: 50723 - DNA, 25 bp, Mus musculus
tacgaagcccagaggatcatgacag

SEQ ID NO: 50724 - DNA, 25 bp, Mus musculus
tacgaagcccatctgttctggaagt

SEQ ID NO: 50725 - DNA, 25 bp, Mus musculus
tacgaaggtttcctctggatgctgc

SEQ ID NO: 50726 - DNA, 25 bp, Mus musculus
tacgaatatgaagtagacaaggatt

SEQ ID NO: 50727 - DNA, 25 bp, Mus musculus
tacgaatgcttgatgcctcgggaga

SEQ ID NO: 50728 - DNA, 25 bp, Mus musculus
tacgacaagttccagcgtgccacat

SEQ ID NO: 50729 - DNA, 25 bp, Mus musculus
tacgacaagttcgagcgtgccacat

SEQ ID NO: 50730 - DNA, 25 bp, Mus musculus
tacgacaccacctgcgttggcctgg

SEQ ID NO: 50731 - DNA, 25 bp, Mus musculus
tacgacattagcagtgagcgctcct

SEQ ID NO: 50732 - DNA, 25 bp, Mus musculus
tacgaccaactgaccctagtgagat

SEQ ID NO: 50733 - DNA, 25 bp, Mus musculus
tacgacccatcgctctgaatctgtg

SEQ ID NO: 50734 - DNA, 25 bp, Mus musculus
tacgacgcttttggtgaagattcca

SEQ ID NO: 50735 - DNA, 25 bp, Mus musculus
tacgactcgagctacaagactggaa

SEQ ID NO: 50736 - DNA, 25 bp, Mus musculus
tacgactggacgctggtgcccatgc

SEQ ID NO: 50737 - DNA, 25 bp, Mus musculus
tacgactggataagtatcccattgg

SEQ ID NO: 50738 - DNA, 25 bp, Mus musculus
tacgagaagatgttcaactggatgg

SEQ ID NO: 50739 - DNA, 25 bp, Mus musculus
tacgagacagccaccctgtcagaca

SEQ ID NO: 50740 - DNA, 25 bp, Mus musculus
tacgagatgagaacagaagcacggc

SEQ ID NO: 50741 - DNA, 25 bp, Mus musculus
tacgagattctagacgtaccgcgga

SEQ ID NO: 50742 - DNA, 25 bp, Mus musculus
tacgagcaaggcctaatagacctgg

SEQ ID NO: 50743 - DNA, 25 bp, Mus musculus
tacgaggaaccctatgcagcatggc

SEQ ID NO: 50744 - DNA, 25 bp, Mus musculus
tacgaggaagtaaaccatgccacat

SEQ ID NO: 50745 - DNA, 25 bp, Mus musculus
tacgaggagttttcagcaacaaatt

SEQ ID NO: 50746 - DNA, 25 bp, Mus musculus
tacgagtccatgctcaacaccgtgc

SEQ ID NO: 50747 - DNA, 25 bp, Mus musculus
tacgagtgctatggagtgccaattg

SEQ ID NO: 50748 - DNA, 25 bp, Mus musculus
tacgagtggatgaacataccattgg

SEQ ID NO: 50749 - DNA, 25 bp, Mus musculus
tacgagtgtgctgcagtggttctgc

SEQ ID NO: 50750 - DNA, 25 bp, Mus musculus
tacgataatcagaaagtggcccttc

SEQ ID NO: 50751 - DNA, 25 bp, Mus musculus
tacgatagcctgcaggacctgagga

SEQ ID NO: 50752 - DNA, 25 bp, Mus musculus
tacgatatgccacatcagccgcatt

SEQ ID NO: 50753 - DNA, 25 bp, Mus musculus
tacgatcagagctgagagccctgag

SEQ ID NO: 50754 - DNA, 25 bp, Mus musculus
tacgatctgttaatcccaacaaacc

SEQ ID NO: 50755 - DNA, 25 bp, Mus musculus
tacgatgaggagtatggctgtccca

SEQ ID NO: 50756 - DNA, 25 bp, Mus musculus
tacgatgggccggactgtgatagta

SEQ ID NO: 50757 - DNA, 25 bp, Mus musculus
tacgattttctctgcccctaattac

SEQ ID NO: 50758 - DNA, 25 bp, Mus musculus
tacgcaaagaattacaactaggcca

SEQ ID NO: 50759 - DNA, 25 bp, Mus musculus
tacgcaacgaggagctggcgaagct

SEQ ID NO: 50760 - DNA, 25 bp, Mus musculus
tacgcaacgaggtgctggcgaagct

SEQ ID NO: 50761 - DNA, 25 bp, Mus musculus
tacgcaatcgggtgcgccatgtcag

SEQ ID NO: 50762 - DNA, 25 bp, Mus musculus
tacgcaccatgcagaatacaaatga

SEQ ID NO: 50763 - DNA, 25 bp, Mus musculus
tacgcacctttaaaaccagatctag

SEQ ID NO: 50764 - DNA, 25 bp, Mus musculus
tacgcagaagatcactagtttggct

SEQ ID NO: 50765 - DNA, 25 bp, Mus musculus
tacgcagaagtctgggatctccagg

SEQ ID NO: 50766 - DNA, 25 bp, Mus musculus
tacgcagaatccatgcggaatctct

SEQ ID NO: 50767 - DNA, 25 bp, Mus musculus
tacgcagagaaggacctggtacagt

SEQ ID NO: 50768 - DNA, 25 bp, Mus musculus
tacgcagtaaacagtgcagaccccg

SEQ ID NO: 50769 - DNA, 25 bp, Mus musculus
tacgccaaggtctgcctctatctca

SEQ ID NO: 50770 - DNA, 25 bp, Mus musculus
tacgccaagtatattcaaggagatc

SEQ ID NO: 50771 - DNA, 25 bp, Mus musculus
tacgccaagtattttcaaggagatc

SEQ ID NO: 50772 - DNA, 25 bp, Mus musculus
tacgccagaagctaaaagacatcag

SEQ ID NO: 50773 - DNA, 25 bp, Mus musculus
tacgccagcttggaggaagatgatg

SEQ ID NO: 50774 - DNA, 25 bp, Mus musculus
tacgccatcacgacactgcataatc

SEQ ID NO: 50775 - DNA, 25 bp, Mus musculus
tacgccatccccagtgaaatgtcag

SEQ ID NO: 50776 - DNA, 25 bp, Mus musculus
tacgccatgggcttcaatcgaccgt

SEQ ID NO: 50777 - DNA, 25 bp, Mus musculus
tacgccattacagcattcggatttc

SEQ ID NO: 50778 - DNA, 25 bp, Mus musculus
tacgcccaactcatccatgagtgca

SEQ ID NO: 50779 - DNA, 25 bp, Mus musculus
tacgcccagacggagatgggccacg

SEQ ID NO: 50780 - DNA, 25 bp, Mus musculus
tacgcccaggagtttctggaatgca

SEQ ID NO: 50781 - DNA, 25 bp, Mus musculus
tacgccggtacatcaagtggcctct

SEQ ID NO: 50782 - DNA, 25 bp, Mus musculus
tacgccttctacgaatccatttgtt

SEQ ID NO: 50783 - DNA, 25 bp, Mus musculus
tacgcggaggtggataccatctacg

SEQ ID NO: 50784 - DNA, 25 bp, Mus musculus
tacgctactatgagtctccctgtcc

SEQ ID NO: 50785 - DNA, 25 bp, Mus musculus
tacgctattggcaccactatctgca

SEQ ID NO: 50786 - DNA, 25 bp, Mus musculus
tacgctattggctccactatctgca

SEQ ID NO: 50787 - DNA, 25 bp, Mus musculus
tacgctcacggttcctggatgccag

SEQ ID NO: 50788 - DNA, 25 bp, Mus musculus
tacgctcattattacaccattgggc

SEQ ID NO: 50789 - DNA, 25 bp, Mus musculus
tacgctctgcaaagactgctcagac

SEQ ID NO: 50790 - DNA, 25 bp, Mus musculus
tacgctcttactatgagaccagcaa

SEQ ID NO: 50791 - DNA, 25 bp, Mus musculus
tacgctgactgctctcaggaatggc

SEQ ID NO: 50792 - DNA, 25 bp, Mus musculus
tacgctgactggagcctttggcatc

SEQ ID NO: 50793 - DNA, 25 bp, Mus musculus
tacgctgacttttggctcagtgact

SEQ ID NO: 50794 - DNA, 25 bp, Mus musculus
tacgctgagcagctctcgggatcag

SEQ ID NO: 50795 - DNA, 25 bp, Mus musculus
tacgctggatttgagccaaaagtag

SEQ ID NO: 50796 - DNA, 25 bp, Mus musculus
tacgcttcggtcatcgctctcttgg

SEQ ID NO: 50797 - DNA, 25 bp, Mus musculus
tacgctttgtcttggctactgccaa

SEQ ID NO: 50798 - DNA, 25 bp, Mus musculus
tacgcttttcgagctcaagcccaga

SEQ ID NO: 50799 - DNA, 25 bp, Mus musculus
tacggaaactatcgaagggctcgca

SEQ ID NO: 50800 - DNA, 25 bp, Mus musculus
tacggaaagccaaggagaccattca

SEQ ID NO: 50801 - DNA, 25 bp, Mus musculus
tacggaaagcttgaagtcgcaagtc

SEQ ID NO: 50802 - DNA, 25 bp, Mus musculus
tacggaacatcaaaatcccaatgaa

SEQ ID NO: 50803 - DNA, 25 bp, Mus musculus
tacggaaccactagtgtgcagaatg

SEQ ID NO: 50804 - DNA, 25 bp, Mus musculus
tacggaagagagactccaatcaaca

SEQ ID NO: 50805 - DNA, 25 bp, Mus musculus
tacggaaggaatggcttgtaggaat

SEQ ID NO: 50806 - DNA, 25 bp, Mus musculus
tacggaatactttggagacatgctt

SEQ ID NO: 50807 - DNA, 25 bp, Mus musculus
tacggaatatcaatcccagcacagc

SEQ ID NO: 50808 - DNA, 25 bp, Mus musculus
tacggaatgtctcctttgaggatgc

SEQ ID NO: 50809 - DNA, 25 bp, Mus musculus
tacggacactagaggagctcctgaa

SEQ ID NO: 50810 - DNA, 25 bp, Mus musculus
tacggaccaagtgatgctcaaagcc

SEQ ID NO: 50811 - DNA, 25 bp, Mus musculus
tacggactcgagacatgggaggcta

SEQ ID NO: 50812 - DNA, 25 bp, Mus musculus
tacggagccagctggtctgctgtga

SEQ ID NO: 50813 - DNA, 25 bp, Mus musculus
tacggaggcaaaaacaaagatctgc

SEQ ID NO: 50814 - DNA, 25 bp, Mus musculus
tacggaggcaccatgacagatcctg

SEQ ID NO: 50815 - DNA, 25 bp, Mus musculus
tacggattccacagagtcagatact

SEQ ID NO: 50816 - DNA, 25 bp, Mus musculus
tacggatttacctcttttcggatgg

SEQ ID NO: 50817 - DNA, 25 bp, Mus musculus
tacggcaagcactggtgtggaactt

SEQ ID NO: 50818 - DNA, 25 bp, Mus musculus
tacggcaagtccttcagaaagttac

SEQ ID NO: 50819 - DNA, 25 bp, Mus musculus
tacggcaccaaactcgtgggaggaa

SEQ ID NO: 50820 - DNA, 25 bp, Mus musculus
tacggcatggggaggcatccctgcc

SEQ ID NO: 50821 - DNA, 25 bp, Mus musculus
tacggcattatggagattgccatca

SEQ ID NO: 50822 - DNA, 25 bp, Mus musculus
tacggcccagtcatcgaatgtgaca

SEQ ID NO: 50823 - DNA, 25 bp, Mus musculus
tacggcccatatctcggaacttgcg

SEQ ID NO: 50824 - DNA, 25 bp, Mus musculus
tacggcccgcccattgacctttggg

SEQ ID NO: 50825 - DNA, 25 bp, Mus musculus
tacggcctctactctgccttcatgg

SEQ ID NO: 50826 - DNA, 25 bp, Mus musculus
tacggcctgccaagtcggtgccgtc

SEQ ID NO: 50827 - DNA, 25 bp, Mus musculus
tacggcgagctcctcatgctagcgg

SEQ ID NO: 50828 - DNA, 25 bp, Mus musculus
tacggctcacccaaaggttgcgctt

SEQ ID NO: 50829 - DNA, 25 bp, Mus musculus
tacggctcagcacagtcgacatgac

SEQ ID NO: 50830 - DNA, 25 bp, Mus musculus
tacggctctgttggctcacgaagta

SEQ ID NO: 50831 - DNA, 25 bp, Mus musculus
tacggctggtaccttaccttagtgc

SEQ ID NO: 50832 - DNA, 25 bp, Mus musculus
tacgggaaccgagtccgcatcagag

SEQ ID NO: 50833 - DNA, 25 bp, Mus musculus
tacgggactcgcagatgagacgaca

SEQ ID NO: 50834 - DNA, 25 bp, Mus musculus
tacgggactcgctgatgagacgaca

SEQ ID NO: 50835 - DNA, 25 bp, Mus musculus
tacgggagaaaactcacggccttgt

SEQ ID NO: 50836 - DNA, 25 bp, Mus musculus
tacgggtacaacctctccgtggtga

SEQ ID NO: 50837 - DNA, 25 bp, Mus musculus
tacgggtggttctcaaatacaggca

SEQ ID NO: 50838 - DNA, 25 bp, Mus musculus
tacggtcacgatggcacaaagacag

SEQ ID NO: 50839 - DNA, 25 bp, Mus musculus
tacggtctctgcagtctatagcacg

SEQ ID NO: 50840 - DNA, 25 bp, Mus musculus
tacggtctcttaaccacagatgcag

SEQ ID NO: 50841 - DNA, 25 bp, Mus musculus
tacggtgaaggaaaagtcctgagcg

SEQ ID NO: 50842 - DNA, 25 bp, Mus musculus
tacggtgaaggctctggtgctgact

SEQ ID NO: 50843 - DNA, 25 bp, Mus musculus
tacggtgacatccatgctttagagt

SEQ ID NO: 50844 - DNA, 25 bp, Mus musculus
tacggtgacatcgatgctttagagt

SEQ ID NO: 50845 - DNA, 25 bp, Mus musculus
tacggtggtgtgtttggaaataagc

SEQ ID NO: 50846 - DNA, 25 bp, Mus musculus
tacggtgtggctatgaacaagctga

SEQ ID NO: 50847 - DNA, 25 bp, Mus musculus
tacggttagaacacctgcaggagaa

SEQ ID NO: 50848 - DNA, 25 bp, Mus musculus
tacgtaattctcatcaagatatggg

SEQ ID NO: 50849 - DNA, 25 bp, Mus musculus
tacgtacaaattccccgagcttcca

SEQ ID NO: 50850 - DNA, 25 bp, Mus musculus
tacgtagaccattccaagactctgc

SEQ ID NO: 50851 - DNA, 25 bp, Mus musculus
tacgtagactctaccttatcccagg

SEQ ID NO: 50852 - DNA, 25 bp, Mus musculus
tacgtatacggaaagctacatcagc

SEQ ID NO: 50853 - DNA, 25 bp, Mus musculus
tacgtatgttaccacatgcacctgg

SEQ ID NO: 50854 - DNA, 25 bp, Mus musculus
tacgtcaatatggagaggcacccag

SEQ ID NO: 50855 - DNA, 25 bp, Mus musculus
tacgtcacagggaagaaatccaaca

SEQ ID NO: 50856 - DNA, 25 bp, Mus musculus
tacgtcaccaagtgagaagccatgc

SEQ ID NO: 50857 - DNA, 25 bp, Mus musculus
tacgtcagcttcactgatgccacca

SEQ ID NO: 50858 - DNA, 25 bp, Mus musculus
tacgtcaggtcagctgtctcaattt

SEQ ID NO: 50859 - DNA, 25 bp, Mus musculus
tacgtccagaagatgtctatgtaca

SEQ ID NO: 50860 - DNA, 25 bp, Mus musculus
tacgtccagaagttgtctatgtaca

SEQ ID NO: 50861 - DNA, 25 bp, Mus musculus
tacgtccctcgttagtgtggctgtc

SEQ ID NO: 50862 - DNA, 25 bp, Mus musculus
tacgtcctctttacaagtattgtgg

SEQ ID NO: 50863 - DNA, 25 bp, Mus musculus
tacgtcctcttttcaagtattgtgg

SEQ ID NO: 50864 - DNA, 25 bp, Mus musculus
tacgtccttcctgggcagacaagtt

SEQ ID NO: 50865 - DNA, 25 bp, Mus musculus
tacgtcgagccgtgaattctacccg

SEQ ID NO: 50866 - DNA, 25 bp, Mus musculus
tacgtcgaggccttctcccagcatg

SEQ ID NO: 50867 - DNA, 25 bp, Mus musculus
tacgtcgtgatttgtgacagctttg

SEQ ID NO: 50868 - DNA, 25 bp, Mus musculus
tacgtctacattaaccagcaaggca

SEQ ID NO: 50869 - DNA, 25 bp, Mus musculus
tacgtctacgccaaaggtcaaggca

SEQ ID NO: 50870 - DNA, 25 bp, Mus musculus
tacgtctacgcctaaggtcaaggca

SEQ ID NO: 50871 - DNA, 25 bp, Mus musculus
tacgtcttaaggcagagactagcaa

SEQ ID NO: 50872 - DNA, 25 bp, Mus musculus
tacgtctttcagattgtcagactcc

SEQ ID NO: 50873 - DNA, 25 bp, Mus musculus
tacgtgaccagacaggaggtgtcct

SEQ ID NO: 50874 - DNA, 25 bp, Mus musculus
tacgtgcaaaggaggccctaaggac

SEQ ID NO: 50875 - DNA, 25 bp, Mus musculus
tacgtgccatcacaagcagacgtgg

SEQ ID NO: 50876 - DNA, 25 bp, Mus musculus
tacgtgcccagctcaggcagcctga

SEQ ID NO: 50877 - DNA, 25 bp, Mus musculus
tacgtgcgctggtcccctaagggta

SEQ ID NO: 50878 - DNA, 25 bp, Mus musculus
tacgtggaaatgaaatgggagttca

SEQ ID NO: 50879 - DNA, 25 bp, Mus musculus
tacgtggagtccctgaaagagctgc

SEQ ID NO: 50880 - DNA, 25 bp, Mus musculus
tacgtggctcaccagcgtctcagct

SEQ ID NO: 50881 - DNA, 25 bp, Mus musculus
tacgtggctcacgagcgtctcagct

SEQ ID NO: 50882 - DNA, 25 bp, Mus musculus
tacgtggctgtatgttaattgaatt

SEQ ID NO: 50883 - DNA, 25 bp, Mus musculus
tacgtgggaacggaagcatttggaa

SEQ ID NO: 50884 - DNA, 25 bp, Mus musculus
tacgtggtgaccaagacaagagcga

SEQ ID NO: 50885 - DNA, 25 bp, Mus musculus
tacgtgtggcgtttctgcattggcc

SEQ ID NO: 50886 - DNA, 25 bp, Mus musculus
tacgtgttacagacccagacatggg

SEQ ID NO: 50887 - DNA, 25 bp, Mus musculus
tacgttaataatacaagccacagac

SEQ ID NO: 50888 - DNA, 25 bp, Mus musculus
tacgttaataattcaagccacagac

SEQ ID NO: 50889 - DNA, 25 bp, Mus musculus
tacgttcctgatcctgaatatgtct

SEQ ID NO: 50890 - DNA, 25 bp, Mus musculus
tacgttgaaagtggtttgaagacca

SEQ ID NO: 50891 - DNA, 25 bp, Mus musculus
tacgttgacttaggtaccctgtgac

SEQ ID NO: 50892 - DNA, 25 bp, Mus musculus
tacgttgtcggtcagcaatgaggac

SEQ ID NO: 50893 - DNA, 25 bp, Mus musculus
tactaaaaggtgctacccatgtcta

SEQ ID NO: 50894 - DNA, 25 bp, Mus musculus
tactaaacgaaccaccagatctgct

SEQ ID NO: 50895 - DNA, 25 bp, Mus musculus
tactaaatgggaaaccgtatgagcc

SEQ ID NO: 50896 - DNA, 25 bp, Mus musculus
tactaacagacgactttaaaggtgt

SEQ ID NO: 50897 - DNA, 25 bp, Mus musculus
tactaactggtatcatggagaatgt

SEQ ID NO: 50898 - DNA, 25 bp, Mus musculus
tactaactttcagaatatcagaagt

SEQ ID NO: 50899 - DNA, 25 bp, Mus musculus
tactaagagatgctgtagcagactg

SEQ ID NO: 50900 - DNA, 25 bp, Mus musculus
tactaagcatcgtctttcagctact

SEQ ID NO: 50901 - DNA, 25 bp, Mus musculus
tactaaggcagtgttgccctgggac

SEQ ID NO: 50902 - DNA, 25 bp, Mus musculus
tactaagtcgttacttggagtgcag

SEQ ID NO: 50903 - DNA, 25 bp, Mus musculus
tactaagtgacatgcaaaatgtccc

SEQ ID NO: 50904 - DNA, 25 bp, Mus musculus
tactacaacctggatggagaataca

SEQ ID NO: 50905 - DNA, 25 bp, Mus musculus
tactacaagcacactcgaaggaagg

SEQ ID NO: 50906 - DNA, 25 bp, Mus musculus
tactacagccttctatgacccaaga

SEQ ID NO: 50907 - DNA, 25 bp, Mus musculus
tactacagcttttttgacctggatc

SEQ ID NO: 50908 - DNA, 25 bp, Mus musculus
tactacatgacccagacagaggagc

SEQ ID NO: 50909 - DNA, 25 bp, Mus musculus
tactacattcctgccatgggaccat

SEQ ID NO: 50910 - DNA, 25 bp, Mus musculus
tactacattgataaccttggaagaa

SEQ ID NO: 50911 - DNA, 25 bp, Mus musculus
tactacccactgcacaaagaacctt

SEQ ID NO: 50912 - DNA, 25 bp, Mus musculus
tactacccggagatgtacatcctca

SEQ ID NO: 50913 - DNA, 25 bp, Mus musculus
tactacctgagatatccctgggccg

SEQ ID NO: 50914 - DNA, 25 bp, Mus musculus
tactacctgatggatgctgcctcct

SEQ ID NO: 50915 - DNA, 25 bp, Mus musculus
tactacctggcagttagtgacctca

SEQ ID NO: 50916 - DNA, 25 bp, Mus musculus
tactacgcagagttgtgtgctcccc

SEQ ID NO: 50917 - DNA, 25 bp, Mus musculus
tactacgctactatgagtctccctg

SEQ ID NO: 50918 - DNA, 25 bp, Mus musculus
tactacgtggctgctgtgtacgagc

SEQ ID NO: 50919 - DNA, 25 bp, Mus musculus
tactactaggacacctactcatgag

SEQ ID NO: 50920 - DNA, 25 bp, Mus musculus
tactacttaatcatcggccaaaacg

SEQ ID NO: 50921 - DNA, 25 bp, Mus musculus
tactacttccaaattcagctacaag

SEQ ID NO: 50922 - DNA, 25 bp, Mus musculus
tactagagagtagtacaacaaaact

SEQ ID NO: 50923 - DNA, 25 bp, Mus musculus
tactagagttgtaactgaaaattgc

SEQ ID NO: 50924 - DNA, 25 bp, Mus musculus
tactagatggtacaacccacgcagc

SEQ ID NO: 50925 - DNA, 25 bp, Mus musculus
tactagctactgatacctgcttgag

SEQ ID NO: 50926 - DNA, 25 bp, Mus musculus
tactaggtcttacgcagacacaaag

SEQ ID NO: 50927 - DNA, 25 bp, Mus musculus
tactaggtcttaggcagacacaaag

SEQ ID NO: 50928 - DNA, 25 bp, Mus musculus
tactagtcagtgcttcgcaagatgg

SEQ ID NO: 50929 - DNA, 25 bp, Mus musculus
tactagtctctaccacaagatccat

SEQ ID NO: 50930 - DNA, 25 bp, Mus musculus
tactagtgctcctatatctccagct

SEQ ID NO: 50931 - DNA, 25 bp, Mus musculus
tactagtggcccctgtcaagagaaa

SEQ ID NO: 50932 - DNA, 25 bp, Mus musculus
tactagttggctatggctttacagg

SEQ ID NO: 50933 - DNA, 25 bp, Mus musculus
tactatacgtgtggcaagcaccagc

SEQ ID NO: 50934 - DNA, 25 bp, Mus musculus
tactatatgaagcagccactcacca

SEQ ID NO: 50935 - DNA, 25 bp, Mus musculus
tactatcgacgaaaacagcaatgac

SEQ ID NO: 50936 - DNA, 25 bp, Mus musculus
tactatcgcggagctatgggtttcc

SEQ ID NO: 50937 - DNA, 25 bp, Mus musculus
tactatctggctgctttggtttctg

SEQ ID NO: 50938 - DNA, 25 bp, Mus musculus
tactatgaacacttttacaatgagc

SEQ ID NO: 50939 - DNA, 25 bp, Mus musculus
tactatgaattaattaggaagccag

SEQ ID NO: 50940 - DNA, 25 bp, Mus musculus
tactatgacagatattcactcaagc

SEQ ID NO: 50941 - DNA, 25 bp, Mus musculus
tactatgactcccacaacgtcaaca

SEQ ID NO: 50942 - DNA, 25 bp, Mus musculus
tactatgagaccagcaagatgaaag

SEQ ID NO: 50943 - DNA, 25 bp, Mus musculus
tactatgagtctccctgtcctgcaa

SEQ ID NO: 50944 - DNA, 25 bp, Mus musculus
tactatgcccagaaggctgttctgc

SEQ ID NO: 50945 - DNA, 25 bp, Mus musculus
tactatggtagaaaagcgaatgctt

SEQ ID NO: 50946 - DNA, 25 bp, Mus musculus
tactatgtggccgagagtttcaatg

SEQ ID NO: 50947 - DNA, 25 bp, Mus musculus
tactcaaacatatcagccctgacca

SEQ ID NO: 50948 - DNA, 25 bp, Mus musculus
tactcaacaatgatcggcagaacgc

SEQ ID NO: 50949 - DNA, 25 bp, Mus musculus
tactcaacccaagtgggctttgcag

SEQ ID NO: 50950 - DNA, 25 bp, Mus musculus
tactcaagaccaactcagctgtccg

SEQ ID NO: 50951 - DNA, 25 bp, Mus musculus
tactcacaaagattcacctctctgc

SEQ ID NO: 50952 - DNA, 25 bp, Mus musculus
tactcacagattattaaagaaggcc

SEQ ID NO: 50953 - DNA, 25 bp, Mus musculus
tactcacagcaaagcagccatcctg

SEQ ID NO: 50954 - DNA, 25 bp, Mus musculus
tactcacaggatgctatcatggacg

SEQ ID NO: 50955 - DNA, 25 bp, Mus musculus
tactcacaggcttcctggacaaaag

SEQ ID NO: 50956 - DNA, 25 bp, Mus musculus
tactcaccaggactcacagggtctg

SEQ ID NO: 50957 - DNA, 25 bp, Mus musculus
tactcaccaggagtcacagggtctg

SEQ ID NO: 50958 - DNA, 25 bp, Mus musculus
tactcacctatgtgctggcagccct

SEQ ID NO: 50959 - DNA, 25 bp, Mus musculus
tactcacggttgtagctatggatcg

SEQ ID NO: 50960 - DNA, 25 bp, Mus musculus
tactcactgatgttctggtcccata

SEQ ID NO: 50961 - DNA, 25 bp, Mus musculus
tactcactggagctcagctttgatt

SEQ ID NO: 50962 - DNA, 25 bp, Mus musculus
tactcagaagatcgccttgaggtgg

SEQ ID NO: 50963 - DNA, 25 bp, Mus musculus
tactcagcagagaccctgagggaga

SEQ ID NO: 50964 - DNA, 25 bp, Mus musculus
tactcagccgtctgataaagagagg

SEQ ID NO: 50965 - DNA, 25 bp, Mus musculus
tactcagcgaggaactggctgggca

SEQ ID NO: 50966 - DNA, 25 bp, Mus musculus
tactcaggtggaaagattatcttca

SEQ ID NO: 50967 - DNA, 25 bp, Mus musculus
tactcagtgatacctcagccaggaa

SEQ ID NO: 50968 - DNA, 25 bp, Mus musculus
tactcagtggagcaaatatcatgtg

SEQ ID NO: 50969 - DNA, 25 bp, Mus musculus
tactcagtgtatccccgtgtcctgg

SEQ ID NO: 50970 - DNA, 25 bp, Mus musculus
tactcatcagtctcaagtactgttg

SEQ ID NO: 50971 - DNA, 25 bp, Mus musculus
tactcatcgtaaaaagctgacttct

SEQ ID NO: 50972 - DNA, 25 bp, Mus musculus
tactcatggcggtgagacttcctgg

SEQ ID NO: 50973 - DNA, 25 bp, Mus musculus
tactcattagctcacggaaagggaa

SEQ ID NO: 50974 - DNA, 25 bp, Mus musculus
tactcattatgtagctccagctagc

SEQ ID NO: 50975 - DNA, 25 bp, Mus musculus
tactcattggctctgatagtaagcc

SEQ ID NO: 50976 - DNA, 25 bp, Mus musculus
tactcatttgtaaggatacatctcg

SEQ ID NO: 50977 - DNA, 25 bp, Mus musculus
tactccatatggctgacttcgcttt

SEQ ID NO: 50978 - DNA, 25 bp, Mus musculus
tactccatcatacacaaacttggga

SEQ ID NO: 50979 - DNA, 25 bp, Mus musculus
tactccatcatagacaaacttggga

SEQ ID NO: 50980 - DNA, 25 bp, Mus musculus
tactccatgaagaaagcataagaag

SEQ ID NO: 50981 - DNA, 25 bp, Mus musculus
tactccatggtgaaacagttcggga

SEQ ID NO: 50982 - DNA, 25 bp, Mus musculus
tactccattctcattgcttctctgt

SEQ ID NO: 50983 - DNA, 25 bp, Mus musculus
tactccattgcttcatgtacaccag

SEQ ID NO: 50984 - DNA, 25 bp, Mus musculus
tactcccatgaattcacctttgatt

SEQ ID NO: 50985 - DNA, 25 bp, Mus musculus
tactccccaaggtggaagtggccct

SEQ ID NO: 50986 - DNA, 25 bp, Mus musculus
tactcccgcaaagtggactttctga

SEQ ID NO: 50987 - DNA, 25 bp, Mus musculus
tactcccgttcaaaattgaggcctg

SEQ ID NO: 50988 - DNA, 25 bp, Mus musculus
tactccctccctactggtgtcagga

SEQ ID NO: 50989 - DNA, 25 bp, Mus musculus
tactccggaccgaagcatgattgct

SEQ ID NO: 50990 - DNA, 25 bp, Mus musculus
tactccggcatgctggactgtgcca

SEQ ID NO: 50991 - DNA, 25 bp, Mus musculus
tactccggctgctccatgggagagt

SEQ ID NO: 50992 - DNA, 25 bp, Mus musculus
tactccgtatttggcctaatcgagc

SEQ ID NO: 50993 - DNA, 25 bp, Mus musculus
tactcctgacatacttcgaccctga

SEQ ID NO: 50994 - DNA, 25 bp, Mus musculus
tactcctggacagcagtagcattct

SEQ ID NO: 50995 - DNA, 25 bp, Mus musculus
tactcctgggagaggcacagctgtc

SEQ ID NO: 50996 - DNA, 25 bp, Mus musculus
tactcctgggagtggcacagctgtc

SEQ ID NO: 50997 - DNA, 25 bp, Mus musculus
tactcctgtaacttctggaagggcc

SEQ ID NO: 50998 - DNA, 25 bp, Mus musculus
tactccttaaacttttgcctgatga

SEQ ID NO: 50999 - DNA, 25 bp, Mus musculus
tactccttctacgagggctttgagg

SEQ ID NO: 51000 - DNA, 25 bp, Mus musculus
tactccttttcggtgctggagccag

SEQ ID NO: 51001 - DNA, 25 bp, Mus musculus
tactcgaaacacagaaaaggccaaa

SEQ ID NO: 51002 - DNA, 25 bp, Mus musculus
tactcgacagtacgtggatcagata

SEQ ID NO: 51003 - DNA, 25 bp, Mus musculus
tactcgacagtaggtggatcagata

SEQ ID NO: 51004 - DNA, 25 bp, Mus musculus
tactcgagccctgaggatggaatcc

SEQ ID NO: 51005 - DNA, 25 bp, Mus musculus
tactcgcacagcgtacggaccaaat

SEQ ID NO: 51006 - DNA, 25 bp, Mus musculus
tactcgctgttcatctatatcccca

SEQ ID NO: 51007 - DNA, 25 bp, Mus musculus
tactcggaaaagaatcttgtgtcct

SEQ ID NO: 51008 - DNA, 25 bp, Mus musculus
tactcggataccatctgtaaaaatc

SEQ ID NO: 51009 - DNA, 25 bp, Mus musculus
tactcggataccttctgtaaaaatc

SEQ ID NO: 51010 - DNA, 25 bp, Mus musculus
tactcggctgccctgaatgctgact

SEQ ID NO: 51011 - DNA, 25 bp, Mus musculus
tactcgggtttcatactttgctgtg

SEQ ID NO: 51012 - DNA, 25 bp, Mus musculus
tactcggtggagatcacggtcgaga

SEQ ID NO: 51013 - DNA, 25 bp, Mus musculus
tactcgtagggcttaccagcagatc

SEQ ID NO: 51014 - DNA, 25 bp, Mus musculus
tactcgtgccatccagattaatcct

SEQ ID NO: 51015 - DNA, 25 bp, Mus musculus
tactcgttatatgtgacaggaagtg

SEQ ID NO: 51016 - DNA, 25 bp, Mus musculus
tactctacactagttggtgttttcc

SEQ ID NO: 51017 - DNA, 25 bp, Mus musculus
tactctaccattacatgcatccagc

SEQ ID NO: 51018 - DNA, 25 bp, Mus musculus
tactctagcctggtggtcatctagc

SEQ ID NO: 51019 - DNA, 25 bp, Mus musculus
tactctaggagtctgtgttacaaaa

SEQ ID NO: 51020 - DNA, 25 bp, Mus musculus
tactctatatttgggcaggaagccc

SEQ ID NO: 51021 - DNA, 25 bp, Mus musculus
tactctatccagaagaaatggccgc

SEQ ID NO: 51022 - DNA, 25 bp, Mus musculus
tactctatgtcacgttatgggacag

SEQ ID NO: 51023 - DNA, 25 bp, Mus musculus
tactctatgtcaggttatgggacag

SEQ ID NO: 51024 - DNA, 25 bp, Mus musculus
tactctcacctaatgctctgttcct

SEQ ID NO: 51025 - DNA, 25 bp, Mus musculus
tactctcacctattgctctgttcct

SEQ ID NO: 51026 - DNA, 25 bp, Mus musculus
tactctccttgagatcttctccagg

SEQ ID NO: 51027 - DNA, 25 bp, Mus musculus
tactctcgtagattccggagaaaca

SEQ ID NO: 51028 - DNA, 25 bp, Mus musculus
tactctctgatagacgattcaaccg

SEQ ID NO: 51029 - DNA, 25 bp, Mus musculus
tactctctgtatgaggacaaaggag

SEQ ID NO: 51030 - DNA, 25 bp, Mus musculus
tactctgaacaaagagccatccgag

SEQ ID NO: 51031 - DNA, 25 bp, Mus musculus
tactctgacttatgaagcagttcac

SEQ ID NO: 51032 - DNA, 25 bp, Mus musculus
tactctgatgggtctgatgacacct

SEQ ID NO: 51033 - DNA, 25 bp, Mus musculus
tactctgcagataatgatagcgacc

SEQ ID NO: 51034 - DNA, 25 bp, Mus musculus
tactctgcatacacgttccctgatg

SEQ ID NO: 51035 - DNA, 25 bp, Mus musculus
tactctgccgtggttaaatacttta

SEQ ID NO: 51036 - DNA, 25 bp, Mus musculus
tactctggactgcaggactactttg

SEQ ID NO: 51037 - DNA, 25 bp, Mus musculus
tactctggatcttgggactctactg

SEQ ID NO: 51038 - DNA, 25 bp, Mus musculus
tactctggatgcctttgacctggtg

SEQ ID NO: 51039 - DNA, 25 bp, Mus musculus
tactctggatggactaccaccagaa

SEQ ID NO: 51040 - DNA, 25 bp, Mus musculus
tactctggattctgccagcagtgca

SEQ ID NO: 51041 - DNA, 25 bp, Mus musculus
tactctgggtgtctgcaagtacacg

SEQ ID NO: 51042 - DNA, 25 bp, Mus musculus
tactctgggtttctggactgtgcaa

SEQ ID NO: 51043 - DNA, 25 bp, Mus musculus
tactctgtaatctgaagcctgcaaa

SEQ ID NO: 51044 - DNA, 25 bp, Mus musculus
tactctgtatgttgggaagtattcc

SEQ ID NO: 51045 - DNA, 25 bp, Mus musculus
tactctgtcaaagggtgaaacaaag

SEQ ID NO: 51046 - DNA, 25 bp, Mus musculus
tactctgtgtgatgtgtcagggctt

SEQ ID NO: 51047 - DNA, 25 bp, Mus musculus
tactcttctcatgcgagggtcccaa

SEQ ID NO: 51048 - DNA, 25 bp, Mus musculus
tactcttctccaggctatgtgctct

SEQ ID NO: 51049 - DNA, 25 bp, Mus musculus
tactcttgactcattagactttgca

SEQ ID NO: 51050 - DNA, 25 bp, Mus musculus
tactcttgagtttctaggacaccgc

SEQ ID NO: 51051 - DNA, 25 bp, Mus musculus
tactcttgggtgtgaaaacacccct

SEQ ID NO: 51052 - DNA, 25 bp, Mus musculus
tactctttgaagcagatacatctgc

SEQ ID NO: 51053 - DNA, 25 bp, Mus musculus
tactctttgatgatcttccgcctgc

SEQ ID NO: 51054 - DNA, 25 bp, Mus musculus
tactgaaaagaactctgcctctgag

SEQ ID NO: 51055 - DNA, 25 bp, Mus musculus
tactgaaaagaagtctgcctctgag

SEQ ID NO: 51056 - DNA, 25 bp, Mus musculus
tactgaaaagagttcacccgagtcc

SEQ ID NO: 51057 - DNA, 25 bp, Mus musculus
tactgaaagcctccaaccaactgtt

SEQ ID NO: 51058 - DNA, 25 bp, Mus musculus
tactgaaatgaaaaattcagtggcc

SEQ ID NO: 51059 - DNA, 25 bp, Mus musculus
tactgaaatgggtacaacttaagga

SEQ ID NO: 51060 - DNA, 25 bp, Mus musculus
tactgaactgaacgatggagacaca

SEQ ID NO: 51061 - DNA, 25 bp, Mus musculus
tactgaactgtacgcatcaagatgt

SEQ ID NO: 51062 - DNA, 25 bp, Mus musculus
tactgaacttcgcaggctgcgcagt

SEQ ID NO: 51063 - DNA, 25 bp, Mus musculus
tactgaagaactgcgcacactctgc

SEQ ID NO: 51064 - DNA, 25 bp, Mus musculus
tactgaagacaactgccccttctgc

SEQ ID NO: 51065 - DNA, 25 bp, Mus musculus
tactgaaggatccttagggcctaca

SEQ ID NO: 51066 - DNA, 25 bp, Mus musculus
tactgaattggtgaggctttctaaa

SEQ ID NO: 51067 - DNA, 25 bp, Mus musculus
tactgacaactgtgaagtaacccat

SEQ ID NO: 51068 - DNA, 25 bp, Mus musculus
tactgacaccatctggaacgagctg

SEQ ID NO: 51069 - DNA, 25 bp, Mus musculus
tactgacagaggagatcgactgcac

SEQ ID NO: 51070 - DNA, 25 bp, Mus musculus
tactgacagccattgttcaggtgct

SEQ ID NO: 51071 - DNA, 25 bp, Mus musculus
tactgaccagaacaatgagattcgg

SEQ ID NO: 51072 - DNA, 25 bp, Mus musculus
tactgaccgcctctttagttacacg

SEQ ID NO: 51073 - DNA, 25 bp, Mus musculus
tactgaccgcctgtttagttacacg

SEQ ID NO: 51074 - DNA, 25 bp, Mus musculus
tactgaccgtgtccaaagggttctt

SEQ ID NO: 51075 - DNA, 25 bp, Mus musculus
tactgacctgaagaaacactttgac

SEQ ID NO: 51076 - DNA, 25 bp, Mus musculus
tactgacgcaaatggaagcgtgagc

SEQ ID NO: 51077 - DNA, 25 bp, Mus musculus
tactgactgctgtgcccctggtcct

SEQ ID NO: 51078 - DNA, 25 bp, Mus musculus
tactgagataggagccattggttgg

SEQ ID NO: 51079 - DNA, 25 bp, Mus musculus
tactgagcctgtaaatgaggtttgc

SEQ ID NO: 51080 - DNA, 25 bp, Mus musculus
tactgagcctgttaatgaggtttgc

SEQ ID NO: 51081 - DNA, 25 bp, Mus musculus
tactgagctggccatcgtgtccgtg

SEQ ID NO: 51082 - DNA, 25 bp, Mus musculus
tactgagctgtttgggcggacttcc

SEQ ID NO: 51083 - DNA, 25 bp, Mus musculus
tactgaggacagcatgaatgatcat

SEQ ID NO: 51084 - DNA, 25 bp, Mus musculus
tactgaggagcccttctagggacag

SEQ ID NO: 51085 - DNA, 25 bp, Mus musculus
tactgagtacggaaaacacatttcc

SEQ ID NO: 51086 - DNA, 25 bp, Mus musculus
tactgagtctcattgaagtttgatc

SEQ ID NO: 51087 - DNA, 25 bp, Mus musculus
tactgagtggctttgcagggtgaca

SEQ ID NO: 51088 - DNA, 25 bp, Mus musculus
tactgatactaactcacccatcgtg

SEQ ID NO: 51089 - DNA, 25 bp, Mus musculus
tactgatcctcaaatatcaggcccc

SEQ ID NO: 51090 - DNA, 25 bp, Mus musculus
tactgatccttcctcagatcatggc

SEQ ID NO: 51091 - DNA, 25 bp, Mus musculus
tactgatccttcgtcagatcatggc

SEQ ID NO: 51092 - DNA, 25 bp, Mus musculus
tactgatgaaccgtgtgtcgcaaat

SEQ ID NO: 51093 - DNA, 25 bp, Mus musculus
tactgatgcaacttggtgtgcacta

SEQ ID NO: 51094 - DNA, 25 bp, Mus musculus
tactgatgctatccaggagtgggtt

SEQ ID NO: 51095 - DNA, 25 bp, Mus musculus
tactgatgctggagaatgggctact

SEQ ID NO: 51096 - DNA, 25 bp, Mus musculus
tactgatggagcaggagctcactgc

SEQ ID NO: 51097 - DNA, 25 bp, Mus musculus
tactgcaaagttagaagaaactgcc

SEQ ID NO: 51098 - DNA, 25 bp, Mus musculus
tactgcaaggctggtacggtcctcg

SEQ ID NO: 51099 - DNA, 25 bp, Mus musculus
tactgcacagccaaatacaatgttg

SEQ ID NO: 51100 - DNA, 25 bp, Mus musculus
tactgcagacgacatggagctagga

SEQ ID NO: 51101 - DNA, 25 bp, Mus musculus
tactgcagattgacaatgccaggct

SEQ ID NO: 51102 - DNA, 25 bp, Mus musculus
tactgcagctccaacagctgctgca

SEQ ID NO: 51103 - DNA, 25 bp, Mus musculus
tactgcagtggacactgatgagatc

SEQ ID NO: 51104 - DNA, 25 bp, Mus musculus
tactgcatcatgatcatagcaggag

SEQ ID NO: 51105 - DNA, 25 bp, Mus musculus
tactgcatcgtgtacgacagcaaca

SEQ ID NO: 51106 - DNA, 25 bp, Mus musculus
tactgcatggccctttatcctatgc

SEQ ID NO: 51107 - DNA, 25 bp, Mus musculus
tactgcattaaaaaacttcgacgga

SEQ ID NO: 51108 - DNA, 25 bp, Mus musculus
tactgccagcccacagtggatgtca

SEQ ID NO: 51109 - DNA, 25 bp, Mus musculus
tactgccattcaagtctcacgaacc

SEQ ID NO: 51110 - DNA, 25 bp, Mus musculus
tactgccctgaatgtgattgtcgag

SEQ ID NO: 51111 - DNA, 25 bp, Mus musculus
tactgccctttcataaaggcatcgg

SEQ ID NO: 51112 - DNA, 25 bp, Mus musculus
tactgccgaggagtcaatgcaattg

SEQ ID NO: 51113 - DNA, 25 bp, Mus musculus
tactgcggcaagcttttcaacgggc

SEQ ID NO: 51114 - DNA, 25 bp, Mus musculus
tactgcggcaaggttttcaacgggc

SEQ ID NO: 51115 - DNA, 25 bp, Mus musculus
tactgcggcattgctgaaactggcc

SEQ ID NO: 51116 - DNA, 25 bp, Mus musculus
tactgcggctccagcgtagatggcc

SEQ ID NO: 51117 - DNA, 25 bp, Mus musculus
tactgcggctcctgcgtagatggcc

SEQ ID NO: 51118 - DNA, 25 bp, Mus musculus
tactgctaagccagccaatactgct

SEQ ID NO: 51119 - DNA, 25 bp, Mus musculus
tactgctactattacagagtactgc

SEQ ID NO: 51120 - DNA, 25 bp, Mus musculus
tactgctagagtctccagctcaggc

SEQ ID NO: 51121 - DNA, 25 bp, Mus musculus
tactgctccggaaattgcagtccct

SEQ ID NO: 51122 - DNA, 25 bp, Mus musculus
tactgctgaaacagccgccgctaaa

SEQ ID NO: 51123 - DNA, 25 bp, Mus musculus
tactgctgaggcagtctccactggg

SEQ ID NO: 51124 - DNA, 25 bp, Mus musculus
tactgctgctggtatacgtaacttg

SEQ ID NO: 51125 - DNA, 25 bp, Mus musculus
tactgctggcactgtttccgaggtc

SEQ ID NO: 51126 - DNA, 25 bp, Mus musculus
tactgctggccaacctgctgtcgct

SEQ ID NO: 51127 - DNA, 25 bp, Mus musculus
tactgctggccatcctgctgtcgct

SEQ ID NO: 51128 - DNA, 25 bp, Mus musculus
tactgctggcttaaacactacacac

SEQ ID NO: 51129 - DNA, 25 bp, Mus musculus
tactgctgtctttcctgacaggctg

SEQ ID NO: 51130 - DNA, 25 bp, Mus musculus
tactgcttctccataggcatcacgt

SEQ ID NO: 51131 - DNA, 25 bp, Mus musculus
tactgcttctggacaagcttcggaa

SEQ ID NO: 51132 - DNA, 25 bp, Mus musculus
tactgcttctggtcaagcttcggaa

SEQ ID NO: 51133 - DNA, 25 bp, Mus musculus
tactgctttcctaagtgttccggat

SEQ ID NO: 51134 - DNA, 25 bp, Mus musculus
tactggaactatgatgacctgcctt

SEQ ID NO: 51135 - DNA, 25 bp, Mus musculus
tactggaagattacccttatgagga

SEQ ID NO: 51136 - DNA, 25 bp, Mus musculus
tactggaagtatggatactacagcc

SEQ ID NO: 51137 - DNA, 25 bp, Mus musculus
tactggacatctgtgagcatgctgt

SEQ ID NO: 51138 - DNA, 25 bp, Mus musculus
tactggaccaacaccgagaagatgg

SEQ ID NO: 51139 - DNA, 25 bp, Mus musculus
tactggactcagctcaacatgttcc

SEQ ID NO: 51140 - DNA, 25 bp, Mus musculus
tactggagaaaaaaggcaacatgga

SEQ ID NO: 51141 - DNA, 25 bp, Mus musculus
tactggagctgaactctcgggtgga

SEQ ID NO: 51142 - DNA, 25 bp, Mus musculus
tactggaggagaaatgggcctgaac

SEQ ID NO: 51143 - DNA, 25 bp, Mus musculus
tactggatacttctttgttaacagg

SEQ ID NO: 51144 - DNA, 25 bp, Mus musculus
tactggatcagtacttgtcaatgac

SEQ ID NO: 51145 - DNA, 25 bp, Mus musculus
tactggcactgatcagagaaagcaa

SEQ ID NO: 51146 - DNA, 25 bp, Mus musculus
tactggcagcacaagcaagtgtgtg

SEQ ID NO: 51147 - DNA, 25 bp, Mus musculus
tactggcagcactagcaagtgtgtg

SEQ ID NO: 51148 - DNA, 25 bp, Mus musculus
tactggccatagtggagaatctgtt

SEQ ID NO: 51149 - DNA, 25 bp, Mus musculus
tactggcccagcacctacttctggt

SEQ ID NO: 51150 - DNA, 25 bp, Mus musculus
tactggctgctgacaggtgaagagt

SEQ ID NO: 51151 - DNA, 25 bp, Mus musculus
tactggcttcctagaacagctgctg

SEQ ID NO: 51152 - DNA, 25 bp, Mus musculus
tactggcttccttgaacagctgctg

SEQ ID NO: 51153 - DNA, 25 bp, Mus musculus
tactggctttgcaggcaagcctgag

SEQ ID NO: 51154 - DNA, 25 bp, Mus musculus
tactgggaaacttcacggaggccac

SEQ ID NO: 51155 - DNA, 25 bp, Mus musculus
tactgggaattccaccactgtttgc

SEQ ID NO: 51156 - DNA, 25 bp, Mus musculus
tactgggacaacattacagactctg

SEQ ID NO: 51157 - DNA, 25 bp, Mus musculus
tactgggacctcctgctgctcattc

SEQ ID NO: 51158 - DNA, 25 bp, Mus musculus
tactgggactgtaggagaggctcct

SEQ ID NO: 51159 - DNA, 25 bp, Mus musculus
tactgggcataaacaacaaccggat

SEQ ID NO: 51160 - DNA, 25 bp, Mus musculus
tactgggccaatttcgcaagaaatg

SEQ ID NO: 51161 - DNA, 25 bp, Mus musculus
tactgggtgaaccaagatggcactg

SEQ ID NO: 51162 - DNA, 25 bp, Mus musculus
tactgggtgaacgaagatggcactg

SEQ ID NO: 51163 - DNA, 25 bp, Mus musculus
tactggtaacagagtgatttggtat

SEQ ID NO: 51164 - DNA, 25 bp, Mus musculus
tactggtactgagaggaagctcggg

SEQ ID NO: 51165 - DNA, 25 bp, Mus musculus
tactggtccttctgcggcatcgtct

SEQ ID NO: 51166 - DNA, 25 bp, Mus musculus
tactggtcgctgcttgcaccagcgg

SEQ ID NO: 51167 - DNA, 25 bp, Mus musculus
tactggtgggagtctgatattgaaa

SEQ ID NO: 51168 - DNA, 25 bp, Mus musculus
tactggtgtacacaatagcatccag

SEQ ID NO: 51169 - DNA, 25 bp, Mus musculus
tactggtgtacagaatagcatccag

SEQ ID NO: 51170 - DNA, 25 bp, Mus musculus
tactggttcgtgctgacagctgagt

SEQ ID NO: 51171 - DNA, 25 bp, Mus musculus
tactggttctggaagggccaaaatg

SEQ ID NO: 51172 - DNA, 25 bp, Mus musculus
tactggtttgtcctcactgcagaaa

SEQ ID NO: 51173 - DNA, 25 bp, Mus musculus
tactggtttgtctcccgggacaagg

SEQ ID NO: 51174 - DNA, 25 bp, Mus musculus
tactgtaaactccagtggaagctag

SEQ ID NO: 51175 - DNA, 25 bp, Mus musculus
tactgtaatacgaatcccagccaaa

SEQ ID NO: 51176 - DNA, 25 bp, Mus musculus
tactgtaatacgtatcccagccaaa

SEQ ID NO: 51177 - DNA, 25 bp, Mus musculus
tactgtaggctccttctcctgcaag

SEQ ID NO: 51178 - DNA, 25 bp, Mus musculus
tactgtaggctcgttctcctgcaag

SEQ ID NO: 51179 - DNA, 25 bp, Mus musculus
tactgtatactcacacctattgctc

SEQ ID NO: 51180 - DNA, 25 bp, Mus musculus
tactgtatactctcacctattgctc

SEQ ID NO: 51181 - DNA, 25 bp, Mus musculus
tactgtatccgaggagcctcctgca

SEQ ID NO: 51182 - DNA, 25 bp, Mus musculus
tactgtcactacctggagtaacaaa

SEQ ID NO: 51183 - DNA, 25 bp, Mus musculus
tactgtcactgtgtcttcagaaaga

SEQ ID NO: 51184 - DNA, 25 bp, Mus musculus
tactgtcagaagcacttctttctgc

SEQ ID NO: 51185 - DNA, 25 bp, Mus musculus
tactgtcagaaggacttctttctgc

SEQ ID NO: 51186 - DNA, 25 bp, Mus musculus
tactgtcgcagcttgtgaattgctc

SEQ ID NO: 51187 - DNA, 25 bp, Mus musculus
tactgtcgtctcgagatttcttggg

SEQ ID NO: 51188 - DNA, 25 bp, Mus musculus
tactgtctaccactacaatggattg

SEQ ID NO: 51189 - DNA, 25 bp, Mus musculus
tactgtctgatttgccttgactcag

SEQ ID NO: 51190 - DNA, 25 bp, Mus musculus
tactgtctgtgccagacgatctgga

SEQ ID NO: 51191 - DNA, 25 bp, Mus musculus
tactgtgaatgatctaacagttcac

SEQ ID NO: 51192 - DNA, 25 bp, Mus musculus
tactgtgactaagagtattgtggag

SEQ ID NO: 51193 - DNA, 25 bp, Mus musculus
tactgtgactatggagttgtgatct

SEQ ID NO: 51194 - DNA, 25 bp, Mus musculus
tactgtgaggctggttggcatggcg

SEQ ID NO: 51195 - DNA, 25 bp, Mus musculus
tactgtgatgccattaagctgtaca

SEQ ID NO: 51196 - DNA, 25 bp, Mus musculus
tactgtgctttgtggccctttgaag

SEQ ID NO: 51197 - DNA, 25 bp, Mus musculus
tactgtgggctatgaagaaggactt

SEQ ID NO: 51198 - DNA, 25 bp, Mus musculus
tactgtgtactgtggaggaattgct

SEQ ID NO: 51199 - DNA, 25 bp, Mus musculus
tactgtgtagcctgcagctgaaaaa

SEQ ID NO: 51200 - DNA, 25 bp, Mus musculus
tactgtgtcaccaaggatgaccctg

SEQ ID NO: 51201 - DNA, 25 bp, Mus musculus
tactgtgtgcagtgagtggtctcgt

SEQ ID NO: 51202 - DNA, 25 bp, Mus musculus
tactgtgttgctacaaggagatgaa

SEQ ID NO: 51203 - DNA, 25 bp, Mus musculus
tactgttaacgaatccttaccaaag

SEQ ID NO: 51204 - DNA, 25 bp, Mus musculus
tactgttacataaaagtctcacttc

SEQ ID NO: 51205 - DNA, 25 bp, Mus musculus
tactgttagaagaagatacagtgac

SEQ ID NO: 51206 - DNA, 25 bp, Mus musculus
tactgttatctgttgagccgtttgt

SEQ ID NO: 51207 - DNA, 25 bp, Mus musculus
tactgttcagccatgttgctgttga

SEQ ID NO: 51208 - DNA, 25 bp, Mus musculus
tactgttgccgggagacaccactgt

SEQ ID NO: 51209 - DNA, 25 bp, Mus musculus
tactgttgctttacgtggcagctgg

SEQ ID NO: 51210 - DNA, 25 bp, Mus musculus
tactgttggacccagactgagtggc

SEQ ID NO: 51211 - DNA, 25 bp, Mus musculus
tactgttggtgtaatcatttggagg

SEQ ID NO: 51212 - DNA, 25 bp, Mus musculus
tactgttggtgttatcatttggagg

SEQ ID NO: 51213 - DNA, 25 bp, Mus musculus
tactgtttacagctcacgatccccg

SEQ ID NO: 51214 - DNA, 25 bp, Mus musculus
tactgtttactccttgaacttgctg

SEQ ID NO: 51215 - DNA, 25 bp, Mus musculus
tactgtttataaccagttagctggc

SEQ ID NO: 51216 - DNA, 25 bp, Mus musculus
tactgtttatcagacaagccaaagc

SEQ ID NO: 51217 - DNA, 25 bp, Mus musculus
tactgtttgacatgacggcaaaaaa

SEQ ID NO: 51218 - DNA, 25 bp, Mus musculus
tactgtttgggtaccaccctgagct

SEQ ID NO: 51219 - DNA, 25 bp, Mus musculus
tacttaaacagcaagaattcttcac

SEQ ID NO: 51220 - DNA, 25 bp, Mus musculus
tacttaagagcagctcgggcagggc

SEQ ID NO: 51221 - DNA, 25 bp, Mus musculus
tacttaatgcccttttgtccagaaa

SEQ ID NO: 51222 - DNA, 25 bp, Mus musculus
tacttacacacgtggatagcctgga

SEQ ID NO: 51223 - DNA, 25 bp, Mus musculus
tacttacacattgggcatgcgaaag

SEQ ID NO: 51224 - DNA, 25 bp, Mus musculus
tacttaccacattacagatgaccgt

SEQ ID NO: 51225 - DNA, 25 bp, Mus musculus
tacttacctctgagagcagccggta

SEQ ID NO: 51226 - DNA, 25 bp, Mus musculus
tacttacgtcacttgtccttcaaca

SEQ ID NO: 51227 - DNA, 25 bp, Mus musculus
tacttactccaagaagcccttgggc

SEQ ID NO: 51228 - DNA, 25 bp, Mus musculus
tacttagcctttccgatcattcgtg

SEQ ID NO: 51229 - DNA, 25 bp, Mus musculus
tacttataaacacggccttcccttg

SEQ ID NO: 51230 - DNA, 25 bp, Mus musculus
tacttataccacaatgagagcgagg

SEQ ID NO: 51231 - DNA, 25 bp, Mus musculus
tacttcaatgaggagatggcaccca

SEQ ID NO: 51232 - DNA, 25 bp, Mus musculus
tacttcaatgtcatcaacacctggg

SEQ ID NO: 51233 - DNA, 25 bp, Mus musculus
tacttcaccagttctaccagggctt

SEQ ID NO: 51234 - DNA, 25 bp, Mus musculus
tacttcacccttgtgcttgttcagc

SEQ ID NO: 51235 - DNA, 25 bp, Mus musculus
tacttcaccgcatcgatgccttact

SEQ ID NO: 51236 - DNA, 25 bp, Mus musculus
tacttcacctggctggcatttgact

SEQ ID NO: 51237 - DNA, 25 bp, Mus musculus
tacttcactagtgggaccagtggcc

SEQ ID NO: 51238 - DNA, 25 bp, Mus musculus
tacttcagacattatctgacgaatc

SEQ ID NO: 51239 - DNA, 25 bp, Mus musculus
tacttcaggatatctggaaggtgcc

SEQ ID NO: 51240 - DNA, 25 bp, Mus musculus
tacttcaggctgaagtggccgctct

SEQ ID NO: 51241 - DNA, 25 bp, Mus musculus
tacttcagtatatcccgaagctacg

SEQ ID NO: 51242 - DNA, 25 bp, Mus musculus
tacttcatgagagagacggtcaata

SEQ ID NO: 51243 - DNA, 25 bp, Mus musculus
tacttcatgtacgtcctctgggctc

SEQ ID NO: 51244 - DNA, 25 bp, Mus musculus
tacttccaaagaatgaccacaacct

SEQ ID NO: 51245 - DNA, 25 bp, Mus musculus
tacttccaactgaagataatggact

SEQ ID NO: 51246 - DNA, 25 bp, Mus musculus
tacttccaagatgaaccatgccttc

SEQ ID NO: 51247 - DNA, 25 bp, Mus musculus
tacttccatcgtggtgccaagtgga

SEQ ID NO: 51248 - DNA, 25 bp, Mus musculus
tacttcctagctacactcctgatga

SEQ ID NO: 51249 - DNA, 25 bp, Mus musculus
tacttcctgccagtgattgggttgg

SEQ ID NO: 51250 - DNA, 25 bp, Mus musculus
tacttcctgccttgtgaccacacag

SEQ ID NO: 51251 - DNA, 25 bp, Mus musculus
tacttcctggactctaccttggaaa

SEQ ID NO: 51252 - DNA, 25 bp, Mus musculus
tacttcgagctgtgcctggcagtgc

SEQ ID NO: 51253 - DNA, 25 bp, Mus musculus
tacttcgatccaagcagataaaacg

SEQ ID NO: 51254 - DNA, 25 bp, Mus musculus
tacttcggcaaaaccagagggccct

SEQ ID NO: 51255 - DNA, 25 bp, Mus musculus
tacttctacaaagaggagtggcccc

SEQ ID NO: 51256 - DNA, 25 bp, Mus musculus
tacttctactacgaagagaaggatg

SEQ ID NO: 51257 - DNA, 25 bp, Mus musculus
tacttctaggaaggaatgatcacgt

SEQ ID NO: 51258 - DNA, 25 bp, Mus musculus
tacttctccagaccttcttggtgtg

SEQ ID NO: 51259 - DNA, 25 bp, Mus musculus
tacttctgaagcttcgattatgatc

SEQ ID NO: 51260 - DNA, 25 bp, Mus musculus
tacttctgacactgagagctctatc

SEQ ID NO: 51261 - DNA, 25 bp, Mus musculus
tacttctgctccaaacacttcgagg

SEQ ID NO: 51262 - DNA, 25 bp, Mus musculus
tacttctgcttctgccgtggatgta

SEQ ID NO: 51263 - DNA, 25 bp, Mus musculus
tacttctggacgaagcaacatcagc

SEQ ID NO: 51264 - DNA, 25 bp, Mus musculus
tacttctggtacaggaaaacactca

SEQ ID NO: 51265 - DNA, 25 bp, Mus musculus
tacttctggtgactcacgaccgcct

SEQ ID NO: 51266 - DNA, 25 bp, Mus musculus
tacttcttcagagaatattcccgat

SEQ ID NO: 51267 - DNA, 25 bp, Mus musculus
tacttcttcgattgagctctgcttc

SEQ ID NO: 51268 - DNA, 25 bp, Mus musculus
tacttcttgagcagcggtgacaaga

SEQ ID NO: 51269 - DNA, 25 bp, Mus musculus
tacttgaaaacgaagaagctattct

SEQ ID NO: 51270 - DNA, 25 bp, Mus musculus
tacttgaaacgaactggaaacttcg

SEQ ID NO: 51271 - DNA, 25 bp, Mus musculus
tacttgaaagaatgtttgagtgaac

SEQ ID NO: 51272 - DNA, 25 bp, Mus musculus
tacttgaaatcccaccattggaaga

SEQ ID NO: 51273 - DNA, 25 bp, Mus musculus
tacttgaacctccactattcctcaa

SEQ ID NO: 51274 - DNA, 25 bp, Mus musculus
tacttgaagccccttagaggctctg

SEQ ID NO: 51275 - DNA, 25 bp, Mus musculus
tacttgaagcccgttagaggctctg

SEQ ID NO: 51276 - DNA, 25 bp, Mus musculus
tacttgaagttcagtgaaatggaca

SEQ ID NO: 51277 - DNA, 25 bp, Mus musculus
tacttgagaaagacagccaacagac

SEQ ID NO: 51278 - DNA, 25 bp, Mus musculus
tacttgagaaagtcagccaacagac

SEQ ID NO: 51279 - DNA, 25 bp, Mus musculus
tacttgagcatagtttctgtggcaa

SEQ ID NO: 51280 - DNA, 25 bp, Mus musculus
tacttgagtgaccacgaaatgctag

SEQ ID NO: 51281 - DNA, 25 bp, Mus musculus
tacttgagtgcaccatggaaacgct

SEQ ID NO: 51282 - DNA, 25 bp, Mus musculus
tacttgatagctcagggtctacatt

SEQ ID NO: 51283 - DNA, 25 bp, Mus musculus
tacttgatagctgagggtctacatt

SEQ ID NO: 51284 - DNA, 25 bp, Mus musculus
tacttgatagttatccttgttagct

SEQ ID NO: 51285 - DNA, 25 bp, Mus musculus
tacttgccctgcatttaccggaaca

SEQ ID NO: 51286 - DNA, 25 bp, Mus musculus
tacttgccggtcagaagcgaagctc

SEQ ID NO: 51287 - DNA, 25 bp, Mus musculus
tacttggaatacaaaggaggaggca

SEQ ID NO: 51288 - DNA, 25 bp, Mus musculus
tacttggaccttgtgtgggacccct

SEQ ID NO: 51289 - DNA, 25 bp, Mus musculus
tacttggagtgcagatgatgctgtg

SEQ ID NO: 51290 - DNA, 25 bp, Mus musculus
tacttggcccccgagattatcctga

SEQ ID NO: 51291 - DNA, 25 bp, Mus musculus
tacttggccctacgctttgtcttgg

SEQ ID NO: 51292 - DNA, 25 bp, Mus musculus
tacttggcggaggtatcagtggatt

SEQ ID NO: 51293 - DNA, 25 bp, Mus musculus
tacttggctccttggttcttgaaaa

SEQ ID NO: 51294 - DNA, 25 bp, Mus musculus
tacttgggagatgtggacgccacta

SEQ ID NO: 51295 - DNA, 25 bp, Mus musculus
tacttggtacttggagacgggagac

SEQ ID NO: 51296 - DNA, 25 bp, Mus musculus
tacttggtcgtggtggattatattt

SEQ ID NO: 51297 - DNA, 25 bp, Mus musculus
tacttggtgagtacagctctcaaac

SEQ ID NO: 51298 - DNA, 25 bp, Mus musculus
tacttggtggaggagattaaaaagc

SEQ ID NO: 51299 - DNA, 25 bp, Mus musculus
tacttgtgatgatttcagctgtagt

SEQ ID NO: 51300 - DNA, 25 bp, Mus musculus
tacttgtgcaaaggttactccacct

SEQ ID NO: 51301 - DNA, 25 bp, Mus musculus
tacttgtgccgggagcggaacatat

SEQ ID NO: 51302 - DNA, 25 bp, Mus musculus
tacttgtggatgttgaacctaaggt

SEQ ID NO: 51303 - DNA, 25 bp, Mus musculus
tacttgtggcctcaatggcactgcc

SEQ ID NO: 51304 - DNA, 25 bp, Mus musculus
tacttgtgtgactacaaggtagcaa

SEQ ID NO: 51305 - DNA, 25 bp, Mus musculus
tacttgtttgctcggagctttgaag

SEQ ID NO: 51306 - DNA, 25 bp, Mus musculus
tacttgtttgctgggagctttgaag

SEQ ID NO: 51307 - DNA, 25 bp, Mus musculus
tactttagagacaacggcaagcacg

SEQ ID NO: 51308 - DNA, 25 bp, Mus musculus
tactttatcgtgagtaacatccagc

SEQ ID NO: 51309 - DNA, 25 bp, Mus musculus
tactttcatctatacacttccagtg

SEQ ID NO: 51310 - DNA, 25 bp, Mus musculus
tactttccagctggaatacatggac

SEQ ID NO: 51311 - DNA, 25 bp, Mus musculus
tactttgaacggttgttagaggaag

SEQ ID NO: 51312 - DNA, 25 bp, Mus musculus
tactttgaataacttgggagcaaca

SEQ ID NO: 51313 - DNA, 25 bp, Mus musculus
tactttgacaatgttggaggtgaca

SEQ ID NO: 51314 - DNA, 25 bp, Mus musculus
tactttgactttgtgcgtctccgaa

SEQ ID NO: 51315 - DNA, 25 bp, Mus musculus
tactttgagagctacctggcagttg

SEQ ID NO: 51316 - DNA, 25 bp, Mus musculus
tactttgagtaatccttaaatgaag

SEQ ID NO: 51317 - DNA, 25 bp, Mus musculus
tactttgataactgtcctctcttaa

SEQ ID NO: 51318 - DNA, 25 bp, Mus musculus
tactttgatttcttggatctccggc

SEQ ID NO: 51319 - DNA, 25 bp, Mus musculus
tactttgcaaatcaaactagaaatg

SEQ ID NO: 51320 - DNA, 25 bp, Mus musculus
tactttgcagctcttctgagcatga

SEQ ID NO: 51321 - DNA, 25 bp, Mus musculus
tactttgcagctgttctgagcatga

SEQ ID NO: 51322 - DNA, 25 bp, Mus musculus
tactttgccagaggattccagatgc

SEQ ID NO: 51323 - DNA, 25 bp, Mus musculus
tactttgccagcattgcagccatag

SEQ ID NO: 51324 - DNA, 25 bp, Mus musculus
tactttgggatcctcaaggagtcca

SEQ ID NO: 51325 - DNA, 25 bp, Mus musculus
tactttgtcggctatctgggagaga

SEQ ID NO: 51326 - DNA, 25 bp, Mus musculus
tacttttactgaagaaacagtagca

SEQ ID NO: 51327 - DNA, 25 bp, Mus musculus
tacttttcagtaaacaacgaaggcg

SEQ ID NO: 51328 - DNA, 25 bp, Mus musculus
tacttttcatgtatgtgccttggtg

SEQ ID NO: 51329 - DNA, 25 bp, Mus musculus
tacttttgttggaaatgaccttcac

SEQ ID NO: 51330 - DNA, 25 bp, Mus musculus
tactttttcagctatcaagaattcc

SEQ ID NO: 51331 - DNA, 25 bp, Mus musculus
tactttttggaaatgatctctctgt

SEQ ID NO: 51332 - DNA, 25 bp, Mus musculus
tagaaaaacattaggagggtatatc

SEQ ID NO: 51333 - DNA, 25 bp, Mus musculus
tagaaaaacatttggagggtatatc

SEQ ID NO: 51334 - DNA, 25 bp, Mus musculus
tagaaaacactgctgctgcctcaac

SEQ ID NO: 51335 - DNA, 25 bp, Mus musculus
tagaaaacttacaagcaactctggg

SEQ ID NO: 51336 - DNA, 25 bp, Mus musculus
tagaaaaggcagatactccctgaca

SEQ ID NO: 51337 - DNA, 25 bp, Mus musculus
tagaaaaggcccttcccgaaatgcg

SEQ ID NO: 51338 - DNA, 25 bp, Mus musculus
tagaaaagtcaaacactaagctgat

SEQ ID NO: 51339 - DNA, 25 bp, Mus musculus
tagaaaagtggagctgtctgagtct

SEQ ID NO: 51340 - DNA, 25 bp, Mus musculus
tagaaaatgcgtatcacatggaagc

SEQ ID NO: 51341 - DNA, 25 bp, Mus musculus
tagaaaatgttcacctggagcaggt

SEQ ID NO: 51342 - DNA, 25 bp, Mus musculus
tagaaaatttacaccatgaagcagc

SEQ ID NO: 51343 - DNA, 25 bp, Mus musculus
tagaaacaggagctatactacctaa

SEQ ID NO: 51344 - DNA, 25 bp, Mus musculus
tagaaacaggaggtatactacctaa

SEQ ID NO: 51345 - DNA, 25 bp, Mus musculus
tagaaacatatcttcgaaagcacag

SEQ ID NO: 51346 - DNA, 25 bp, Mus musculus
tagaaactgctgaaactgccacagg

SEQ ID NO: 51347 - DNA, 25 bp, Mus musculus
tagaaagaagcccagttcccagtgg

SEQ ID NO: 51348 - DNA, 25 bp, Mus musculus
tagaaagaagccgagttcccagtgg

SEQ ID NO: 51349 - DNA, 25 bp, Mus musculus
tagaaagagtggtagagcagagccc

SEQ ID NO: 51350 - DNA, 25 bp, Mus musculus
tagaaagcgaaatcagaggagatgt

SEQ ID NO: 51351 - DNA, 25 bp, Mus musculus
tagaaaggagaaataggacaagttc

SEQ ID NO: 51352 - DNA, 25 bp, Mus musculus
tagaaagtcgagctctcagttccaa

SEQ ID NO: 51353 - DNA, 25 bp, Mus musculus
tagaaagtgaggaagacactaatca

SEQ ID NO: 51354 - DNA, 25 bp, Mus musculus
tagaaagtggtaaatcttcatttcc

SEQ ID NO: 51355 - DNA, 25 bp, Mus musculus
tagaaagtggtatatcttcatttcc

SEQ ID NO: 51356 - DNA, 25 bp, Mus musculus
tagaaagttcttgcaccaccagggt

SEQ ID NO: 51357 - DNA, 25 bp, Mus musculus
tagaaatatacaggcctgcaaggag

SEQ ID NO: 51358 - DNA, 25 bp, Mus musculus
tagaaatcaataagactgaagcgtc

SEQ ID NO: 51359 - DNA, 25 bp, Mus musculus
tagaaatccagagtgtgaacagcct

SEQ ID NO: 51360 - DNA, 25 bp, Mus musculus
tagaaatccttttgcccctgacagg

SEQ ID NO: 51361 - DNA, 25 bp, Mus musculus
tagaaatggccagagtttttgacag

SEQ ID NO: 51362 - DNA, 25 bp, Mus musculus
tagaaattggcgctttcgagctgaa

SEQ ID NO: 51363 - DNA, 25 bp, Mus musculus
tagaacaacagttacaccctgcagc

SEQ ID NO: 51364 - DNA, 25 bp, Mus musculus
tagaacaagtaatcacggcaacagc

SEQ ID NO: 51365 - DNA, 25 bp, Mus musculus
tagaacacggctttgagggcgacag

SEQ ID NO: 51366 - DNA, 25 bp, Mus musculus
tagaacagatcacaagtgctcctgg

SEQ ID NO: 51367 - DNA, 25 bp, Mus musculus
tagaacagcttgagtgcctaaagca

SEQ ID NO: 51368 - DNA, 25 bp, Mus musculus
tagaacaggttatcttcaagttcca

SEQ ID NO: 51369 - DNA, 25 bp, Mus musculus
tagaacatcattcagtgacaaactc

SEQ ID NO: 51370 - DNA, 25 bp, Mus musculus
tagaaccctctgagggcttgtcccg

SEQ ID NO: 51371 - DNA, 25 bp, Mus musculus
tagaaccggtctacaggcagagtcc

SEQ ID NO: 51372 - DNA, 25 bp, Mus musculus
tagaacctgccatctcagcccaaga

SEQ ID NO: 51373 - DNA, 25 bp, Mus musculus
tagaacctgtccctgcaattagccc

SEQ ID NO: 51374 - DNA, 25 bp, Mus musculus
tagaacgagtagtccagaaattgtt

SEQ ID NO: 51375 - DNA, 25 bp, Mus musculus
tagaacgatatcctggatcgcccgg

SEQ ID NO: 51376 - DNA, 25 bp, Mus musculus
tagaacggagggttaaggagctctc

SEQ ID NO: 51377 - DNA, 25 bp, Mus musculus
tagaactcaagatgtctgccagggc

SEQ ID NO: 51378 - DNA, 25 bp, Mus musculus
tagaactcagaacagcttgcccatg

SEQ ID NO: 51379 - DNA, 25 bp, Mus musculus
tagaactctatgcagctgaccaggg

SEQ ID NO: 51380 - DNA, 25 bp, Mus musculus
tagaagaaacccctcaggatacagc

SEQ ID NO: 51381 - DNA, 25 bp, Mus musculus
tagaagaacaaataaggcagaccag

SEQ ID NO: 51382 - DNA, 25 bp, Mus musculus
tagaagaaggttatcgtttgccggc

SEQ ID NO: 51383 - DNA, 25 bp, Mus musculus
tagaagaatcttggatccagaaatg

SEQ ID NO: 51384 - DNA, 25 bp, Mus musculus
tagaagacgctgaaccccagaatgc

SEQ ID NO: 51385 - DNA, 25 bp, Mus musculus
tagaagactatatgaacttcacaca

SEQ ID NO: 51386 - DNA, 25 bp, Mus musculus
tagaagacttgaatcggaaggacag

SEQ ID NO: 51387 - DNA, 25 bp, Mus musculus
tagaagagcaatatggacaaacagg

SEQ ID NO: 51388 - DNA, 25 bp, Mus musculus
tagaagaggatgctttatacgctgc

SEQ ID NO: 51389 - DNA, 25 bp, Mus musculus
tagaagagtagaaaatgcgtatcac

SEQ ID NO: 51390 - DNA, 25 bp, Mus musculus
tagaagagttgaaagaaccagagaa

SEQ ID NO: 51391 - DNA, 25 bp, Mus musculus
tagaagagtttctcatggagcagga

SEQ ID NO: 51392 - DNA, 25 bp, Mus musculus
tagaagcacccatggcatggcgctc

SEQ ID NO: 51393 - DNA, 25 bp, Mus musculus
tagaagcagaagtcaagttctgcaa

SEQ ID NO: 51394 - DNA, 25 bp, Mus musculus
tagaagcagatcgtcatggcaagag

SEQ ID NO: 51395 - DNA, 25 bp, Mus musculus
tagaagcagcatttgaccaggaggc

SEQ ID NO: 51396 - DNA, 25 bp, Mus musculus
tagaagcagtcacatgcacagcaaa

SEQ ID NO: 51397 - DNA, 25 bp, Mus musculus
tagaagccacaaaccaacaaacttg

SEQ ID NO: 51398 - DNA, 25 bp, Mus musculus
tagaagccaggaatgtattgccctg

SEQ ID NO: 51399 - DNA, 25 bp, Mus musculus
tagaagccagtccatctggaactcc

SEQ ID NO: 51400 - DNA, 25 bp, Mus musculus
tagaagctctccacgtcctggatgc

SEQ ID NO: 51401 - DNA, 25 bp, Mus musculus
tagaaggagacactaaccagaagct

SEQ ID NO: 51402 - DNA, 25 bp, Mus musculus
tagaaggaggaaaaaccaaatgcct

SEQ ID NO: 51403 - DNA, 25 bp, Mus musculus
tagaaggcaaatacatgcagggact

SEQ ID NO: 51404 - DNA, 25 bp, Mus musculus
tagaaggcacgggtcctgagtgtaa

SEQ ID NO: 51405 - DNA, 25 bp, Mus musculus
tagaaggcattaatcctggagcaaa

SEQ ID NO: 51406 - DNA, 25 bp, Mus musculus
tagaaggcattattcctggagcaaa

SEQ ID NO: 51407 - DNA, 25 bp, Mus musculus
tagaaggtggtgcttcagaccctcc

SEQ ID NO: 51408 - DNA, 25 bp, Mus musculus
tagaaggttcaactctctttttgag

SEQ ID NO: 51409 - DNA, 25 bp, Mus musculus
tagaagtatgttcccgtgattttgc

SEQ ID NO: 51410 - DNA, 25 bp, Mus musculus
tagaagtgtgcatcccagcctttct

SEQ ID NO: 51411 - DNA, 25 bp, Mus musculus
tagaataaaagtgtccctctccatg

SEQ ID NO: 51412 - DNA, 25 bp, Mus musculus
tagaatatcagtttcaacagaaggc

SEQ ID NO: 51413 - DNA, 25 bp, Mus musculus
tagaatcaaagcaccgaagcctggt

SEQ ID NO: 51414 - DNA, 25 bp, Mus musculus
tagaatctggcgaaataggacagtc

SEQ ID NO: 51415 - DNA, 25 bp, Mus musculus
tagaattatgagaaatggcactatt

SEQ ID NO: 51416 - DNA, 25 bp, Mus musculus
tagaattgcctcttacaaatccaga

SEQ ID NO: 51417 - DNA, 25 bp, Mus musculus
tagaattggaggtgagcaacagacc

SEQ ID NO: 51418 - DNA, 25 bp, Mus musculus
tagaattgtttgttaaccggcttga

SEQ ID NO: 51419 - DNA, 25 bp, Mus musculus
tagaatttatgtccaccagtgctgt

SEQ ID NO: 51420 - DNA, 25 bp, Mus musculus
tagacaaagagaagggcctttttat

SEQ ID NO: 51421 - DNA, 25 bp, Mus musculus
tagacaagagtcaagaagagatcaa

SEQ ID NO: 51422 - DNA, 25 bp, Mus musculus
tagacaaggccatgaactggcaaag

SEQ ID NO: 51423 - DNA, 25 bp, Mus musculus
tagacaaggcttgtgagcccggagt

SEQ ID NO: 51424 - DNA, 25 bp, Mus musculus
tagacaagtacaaggtcgaccctgg

SEQ ID NO: 51425 - DNA, 25 bp, Mus musculus
tagacaatagaaaactgggagagct

SEQ ID NO: 51426 - DNA, 25 bp, Mus musculus
tagacactggttcaggatggacgcc

SEQ ID NO: 51427 - DNA, 25 bp, Mus musculus
tagacactgtgaagcacctgtgtgg

SEQ ID NO: 51428 - DNA, 25 bp, Mus musculus
tagacagacggaaggctttcacggg

SEQ ID NO: 51429 - DNA, 25 bp, Mus musculus
tagacagacggatggctttcacggg

SEQ ID NO: 51430 - DNA, 25 bp, Mus musculus
tagacagcctcacagacatcttgac

SEQ ID NO: 51431 - DNA, 25 bp, Mus musculus
tagacagcctcatcgacttcaaacg

SEQ ID NO: 51432 - DNA, 25 bp, Mus musculus
tagacagtcactgcgagtgtaacga

SEQ ID NO: 51433 - DNA, 25 bp, Mus musculus
tagacagtgatagataacagagtcc

SEQ ID NO: 51434 - DNA, 25 bp, Mus musculus
tagacagtggtgctcctcacgctgt

SEQ ID NO: 51435 - DNA, 25 bp, Mus musculus
tagacagtggtggtcctcacgctgt

SEQ ID NO: 51436 - DNA, 25 bp, Mus musculus
tagacagtgttgaagtcttcgtggc

SEQ ID NO: 51437 - DNA, 25 bp, Mus musculus
tagacagttcagaccgctaacttac

SEQ ID NO: 51438 - DNA, 25 bp, Mus musculus
tagacataaagtactaggcactttc

SEQ ID NO: 51439 - DNA, 25 bp, Mus musculus
tagacataaagttctaggcactttc

SEQ ID NO: 51440 - DNA, 25 bp, Mus musculus
tagacatcagcaaggatgatcccga

SEQ ID NO: 51441 - DNA, 25 bp, Mus musculus
tagacatctgttgccgccttcagga

SEQ ID NO: 51442 - DNA, 25 bp, Mus musculus
tagacatgaaacagcccctgatcct

SEQ ID NO: 51443 - DNA, 25 bp, Mus musculus
tagacatgctgatagaacctgatgg

SEQ ID NO: 51444 - DNA, 25 bp, Mus musculus
tagacatggaaggtgcaccaggaac

SEQ ID NO: 51445 - DNA, 25 bp, Mus musculus
tagacattattctaaatggcaactg

SEQ ID NO: 51446 - DNA, 25 bp, Mus musculus
tagacattggctcatttgccccaga

SEQ ID NO: 51447 - DNA, 25 bp, Mus musculus
tagacatttctagcaatcgcttgct

SEQ ID NO: 51448 - DNA, 25 bp, Mus musculus
tagacattttcattggcaccgagga

SEQ ID NO: 51449 - DNA, 25 bp, Mus musculus
tagaccaaggcagcaaggatgcccg

SEQ ID NO: 51450 - DNA, 25 bp, Mus musculus
tagaccagccattgactataatcgg

SEQ ID NO: 51451 - DNA, 25 bp, Mus musculus
tagaccattccaagactctgcagaa

SEQ ID NO: 51452 - DNA, 25 bp, Mus musculus
tagacccagaacaaaaggacggaat

SEQ ID NO: 51453 - DNA, 25 bp, Mus musculus
tagacccatgggaatcaaagccagc

SEQ ID NO: 51454 - DNA, 25 bp, Mus musculus
tagaccccgtgaatgggcagatcac

SEQ ID NO: 51455 - DNA, 25 bp, Mus musculus
tagaccccgtgattgggcagatcac

SEQ ID NO: 51456 - DNA, 25 bp, Mus musculus
tagaccctaagtctccccagtatag

SEQ ID NO: 51457 - DNA, 25 bp, Mus musculus
tagaccctacttaccacattacaga

SEQ ID NO: 51458 - DNA, 25 bp, Mus musculus
tagaccctcaagtcaagtcagcgga

SEQ ID NO: 51459 - DNA, 25 bp, Mus musculus
tagaccctctgtggttaaagactgc

SEQ ID NO: 51460 - DNA, 25 bp, Mus musculus
tagaccctgtgtacgggcatggcag

SEQ ID NO: 51461 - DNA, 25 bp, Mus musculus
tagaccgggctcatcttgtactcac

SEQ ID NO: 51462 - DNA, 25 bp, Mus musculus
tagacctcgtaaactttataaacat

SEQ ID NO: 51463 - DNA, 25 bp, Mus musculus
tagacctcttccgtaatgcgggatg

SEQ ID NO: 51464 - DNA, 25 bp, Mus musculus
tagacctggccattgatacctacag

SEQ ID NO: 51465 - DNA, 25 bp, Mus musculus
tagaccttgcttcacttggaactcg

SEQ ID NO: 51466 - DNA, 25 bp, Mus musculus
tagaccttggccacatttatggaga

SEQ ID NO: 51467 - DNA, 25 bp, Mus musculus
tagaccttggcctcatttatggaga

SEQ ID NO: 51468 - DNA, 25 bp, Mus musculus
tagacctttcccagggtgcagccca

SEQ ID NO: 51469 - DNA, 25 bp, Mus musculus
tagacctttgtcgaccgtttgctgc

SEQ ID NO: 51470 - DNA, 25 bp, Mus musculus
tagacgagaggcctatccatgctga

SEQ ID NO: 51471 - DNA, 25 bp, Mus musculus
tagacgagaggcgtatccatgctga

SEQ ID NO: 51472 - DNA, 25 bp, Mus musculus
tagacgattcaaccggtgacttaag

SEQ ID NO: 51473 - DNA, 25 bp, Mus musculus
tagacggaagcctgggctttgccgc

SEQ ID NO: 51474 - DNA, 25 bp, Mus musculus
tagacggctggtgtcccacgctgga

SEQ ID NO: 51475 - DNA, 25 bp, Mus musculus
tagacgtgtcaaagaagacttccaa

SEQ ID NO: 51476 - DNA, 25 bp, Mus musculus
tagactcacccttacggaagctgcc

SEQ ID NO: 51477 - DNA, 25 bp, Mus musculus
tagactcagctgtgggatctggttc

SEQ ID NO: 51478 - DNA, 25 bp, Mus musculus
tagactcagttgagttgacaacctt

SEQ ID NO: 51479 - DNA, 25 bp, Mus musculus
tagactcataagcatcatagagaac

SEQ ID NO: 51480 - DNA, 25 bp, Mus musculus
tagactccacagattcaggagaccg

SEQ ID NO: 51481 - DNA, 25 bp, Mus musculus
tagactccttggagggaaaacaaga

SEQ ID NO: 51482 - DNA, 25 bp, Mus musculus
tagactccttgggtcgtcgcagtag

SEQ ID NO: 51483 - DNA, 25 bp, Mus musculus
tagactccttggtgggaaaacaaga

SEQ ID NO: 51484 - DNA, 25 bp, Mus musculus
tagactctaccttatcccaggactg

SEQ ID NO: 51485 - DNA, 25 bp, Mus musculus
tagactggatcgtctctaaggcgcc

SEQ ID NO: 51486 - DNA, 25 bp, Mus musculus
tagacttcgtaaagatcaacttaaa

SEQ ID NO: 51487 - DNA, 25 bp, Mus musculus
tagacttttcgccattggtatcaca

SEQ ID NO: 51488 - DNA, 25 bp, Mus musculus
tagagaaaaagaggacatcgaaagt

SEQ ID NO: 51489 - DNA, 25 bp, Mus musculus
tagagaaactccgagacctgcaggg

SEQ ID NO: 51490 - DNA, 25 bp, Mus musculus
tagagaaagcatcgtacctttggag

SEQ ID NO: 51491 - DNA, 25 bp, Mus musculus
tagagaaagtgggtggattattccc

SEQ ID NO: 51492 - DNA, 25 bp, Mus musculus
tagagaagatttgggcccgagagat

SEQ ID NO: 51493 - DNA, 25 bp, Mus musculus
tagagaatcctggtgctgcacacag

SEQ ID NO: 51494 - DNA, 25 bp, Mus musculus
tagagacaacggcaagcacgctttg

SEQ ID NO: 51495 - DNA, 25 bp, Mus musculus
tagagacacaggatattcaagcctt

SEQ ID NO: 51496 - DNA, 25 bp, Mus musculus
tagagacagcagtagtcactggcag

SEQ ID NO: 51497 - DNA, 25 bp, Mus musculus
tagagacagccaagtccttcagcat

SEQ ID NO: 51498 - DNA, 25 bp, Mus musculus
tagagacaggtctcaccgggaggaa

SEQ ID NO: 51499 - DNA, 25 bp, Mus musculus
tagagaccatatctaaacacactgc

SEQ ID NO: 51500 - DNA, 25 bp, Mus musculus
tagagacgccttcaaggactccatg

SEQ ID NO: 51501 - DNA, 25 bp, Mus musculus
tagagagactgagtgagctggccct

SEQ ID NO: 51502 - DNA, 25 bp, Mus musculus
tagagagagctatccagattggtgt

SEQ ID NO: 51503 - DNA, 25 bp, Mus musculus
tagagagctacaaaaactcccatct

SEQ ID NO: 51504 - DNA, 25 bp, Mus musculus
tagagataatgaccaagcaatcaag

SEQ ID NO: 51505 - DNA, 25 bp, Mus musculus
tagagatcataagcccagccttgtt

SEQ ID NO: 51506 - DNA, 25 bp, Mus musculus
tagagatcggagcaagatgaagatc

SEQ ID NO: 51507 - DNA, 25 bp, Mus musculus
tagagatgacccctgaggtgttcag

SEQ ID NO: 51508 - DNA, 25 bp, Mus musculus
tagagatgttgcttgacagatccgc

SEQ ID NO: 51509 - DNA, 25 bp, Mus musculus
tagagcacctgcaggcttcaagtgt

SEQ ID NO: 51510 - DNA, 25 bp, Mus musculus
tagagcatctcgagcaactaaagca

SEQ ID NO: 51511 - DNA, 25 bp, Mus musculus
tagagccacagcacagatacagcca

SEQ ID NO: 51512 - DNA, 25 bp, Mus musculus
tagagccaccgacagctgcatatct

SEQ ID NO: 51513 - DNA, 25 bp, Mus musculus
tagagccagaggaaatcaatgtcgt

SEQ ID NO: 51514 - DNA, 25 bp, Mus musculus
tagagcccctgacagaggatcatgg

SEQ ID NO: 51515 - DNA, 25 bp, Mus musculus
tagagccctccgatgaggaaggtag

SEQ ID NO: 51516 - DNA, 25 bp, Mus musculus
tagagcctcacctttcctgcttcag

SEQ ID NO: 51517 - DNA, 25 bp, Mus musculus
tagagcctgaggtgcaatctctgga

SEQ ID NO: 51518 - DNA, 25 bp, Mus musculus
tagagcctgcaagcagccacaagct

SEQ ID NO: 51519 - DNA, 25 bp, Mus musculus
tagagcctgcagtgatggtgacctg

SEQ ID NO: 51520 - DNA, 25 bp, Mus musculus
tagagcctggctggttccgactcgt

SEQ ID NO: 51521 - DNA, 25 bp, Mus musculus
tagagcgtccctttgtcctgagtag

SEQ ID NO: 51522 - DNA, 25 bp, Mus musculus
tagagcgtttggatggatttggaca

SEQ ID NO: 51523 - DNA, 25 bp, Mus musculus
tagagctacagtccctcttagccat

SEQ ID NO: 51524 - DNA, 25 bp, Mus musculus
tagagctccacagaaggttaatgac

SEQ ID NO: 51525 - DNA, 25 bp, Mus musculus
tagagctcggatttctataagtgtg

SEQ ID NO: 51526 - DNA, 25 bp, Mus musculus
tagagctctcctgaaacatctggaa

SEQ ID NO: 51527 - DNA, 25 bp, Mus musculus
tagagctgacctcgctgtccgatga

SEQ ID NO: 51528 - DNA, 25 bp, Mus musculus
tagagctgacctggctgtccgatga

SEQ ID NO: 51529 - DNA, 25 bp, Mus musculus
tagagctggtgagtttgccctgttc

SEQ ID NO: 51530 - DNA, 25 bp, Mus musculus
tagagcttcgggagtctcaaacaat

SEQ ID NO: 51531 - DNA, 25 bp, Mus musculus
tagaggaagaacacaatggctaccc

SEQ ID NO: 51532 - DNA, 25 bp, Mus musculus
tagaggaagcatgcgagatctatgc

SEQ ID NO: 51533 - DNA, 25 bp, Mus musculus
tagaggaagccaaacagttatttgg

SEQ ID NO: 51534 - DNA, 25 bp, Mus musculus
tagaggacaacctgcaagagtcttc

SEQ ID NO: 51535 - DNA, 25 bp, Mus musculus
tagaggacacactggttaaaaatta

SEQ ID NO: 51536 - DNA, 25 bp, Mus musculus
tagaggacgggaacaccagtgataa

SEQ ID NO: 51537 - DNA, 25 bp, Mus musculus
tagaggagactcacttccgtaagga

SEQ ID NO: 51538 - DNA, 25 bp, Mus musculus
tagaggaggagccttttagcctcat

SEQ ID NO: 51539 - DNA, 25 bp, Mus musculus
tagaggatgccgctatggagacctt

SEQ ID NO: 51540 - DNA, 25 bp, Mus musculus
tagaggcacacaagcatcttcgagg

SEQ ID NO: 51541 - DNA, 25 bp, Mus musculus
tagaggccactgacgtcttgggaaa

SEQ ID NO: 51542 - DNA, 25 bp, Mus musculus
tagaggccactgtcgtcttgggaaa

SEQ ID NO: 51543 - DNA, 25 bp, Mus musculus
tagaggcccccgaagaaccaagaag

SEQ ID NO: 51544 - DNA, 25 bp, Mus musculus
tagaggccgattcctgactgccacc

SEQ ID NO: 51545 - DNA, 25 bp, Mus musculus
tagaggccgtcaagcataaatctga

SEQ ID NO: 51546 - DNA, 25 bp, Mus musculus
tagaggcctcataactggcattggc

SEQ ID NO: 51547 - DNA, 25 bp, Mus musculus
tagaggctatctgggtaagtggacc

SEQ ID NO: 51548 - DNA, 25 bp, Mus musculus
tagaggctctcacgcttttcaaaag

SEQ ID NO: 51549 - DNA, 25 bp, Mus musculus
tagaggctgcaacacatacaagaag

SEQ ID NO: 51550 - DNA, 25 bp, Mus musculus
tagaggctgggtaccagatagcagt

SEQ ID NO: 51551 - DNA, 25 bp, Mus musculus
tagagggcaaattggtgacgtcatc

SEQ ID NO: 51552 - DNA, 25 bp, Mus musculus
tagaggtcaggcatcgcctaacaca

SEQ ID NO: 51553 - DNA, 25 bp, Mus musculus
tagaggtgccatcacaaatgcttga

SEQ ID NO: 51554 - DNA, 25 bp, Mus musculus
tagagtaatcagaaagaagacttcc

SEQ ID NO: 51555 - DNA, 25 bp, Mus musculus
tagagtactttactaagcgaaggag

SEQ ID NO: 51556 - DNA, 25 bp, Mus musculus
tagagtcagggcatgacactgcccc

SEQ ID NO: 51557 - DNA, 25 bp, Mus musculus
tagagtccttcaacttatgccacta

SEQ ID NO: 51558 - DNA, 25 bp, Mus musculus
tagagtctaaagctgacaaagaggc

SEQ ID NO: 51559 - DNA, 25 bp, Mus musculus
tagagtctagacagaatgtggtcac

SEQ ID NO: 51560 - DNA, 25 bp, Mus musculus
tagagtctagactgaatgtggtcac

SEQ ID NO: 51561 - DNA, 25 bp, Mus musculus
tagagtctgtgaagcctcagtgctc

SEQ ID NO: 51562 - DNA, 25 bp, Mus musculus
tagagtctgtgtcagaggatcccac

SEQ ID NO: 51563 - DNA, 25 bp, Mus musculus
tagagtgcatctaggtattttaaag

SEQ ID NO: 51564 - DNA, 25 bp, Mus musculus
tagagtgctgcttgcgaaaaccctg

SEQ ID NO: 51565 - DNA, 25 bp, Mus musculus
tagagtgcttcaccctaccctgaga

SEQ ID NO: 51566 - DNA, 25 bp, Mus musculus
tagagtgtgtgcatgcaagcaggca

SEQ ID NO: 51567 - DNA, 25 bp, Mus musculus
tagagttaaactgaccttcttggag

SEQ ID NO: 51568 - DNA, 25 bp, Mus musculus
tagagttgtaactgaaaattgcaac

SEQ ID NO: 51569 - DNA, 25 bp, Mus musculus
tagagtttcgtcgtcgcagtcaaga

SEQ ID NO: 51570 - DNA, 25 bp, Mus musculus
tagagtttgagaagccagtcacctg

SEQ ID NO: 51571 - DNA, 25 bp, Mus musculus
tagagtttgatgaaagttgtctcag

SEQ ID NO: 51572 - DNA, 25 bp, Mus musculus
tagataaatccacgcagactgaact

SEQ ID NO: 51573 - DNA, 25 bp, Mus musculus
tagataacgagctagagtatgagaa

SEQ ID NO: 51574 - DNA, 25 bp, Mus musculus
tagataattctggaggatacaaaca

SEQ ID NO: 51575 - DNA, 25 bp, Mus musculus
tagatacatctccaagtacgagatg

SEQ ID NO: 51576 - DNA, 25 bp, Mus musculus
tagatacgcttgaaggtcttgccct

SEQ ID NO: 51577 - DNA, 25 bp, Mus musculus
tagatatagtactgcactttgctgc

SEQ ID NO: 51578 - DNA, 25 bp, Mus musculus
tagatcaagctcgagtttttctggc

SEQ ID NO: 51579 - DNA, 25 bp, Mus musculus
tagatcaagtgtagctgtgcaagca

SEQ ID NO: 51580 - DNA, 25 bp, Mus musculus
tagatcacatcatagttacctccag

SEQ ID NO: 51581 - DNA, 25 bp, Mus musculus
tagatcacatcttggcaggttcttt

SEQ ID NO: 51582 - DNA, 25 bp, Mus musculus
tagatcaccactttctaccacgtga

SEQ ID NO: 51583 - DNA, 25 bp, Mus musculus
tagatcagaatctaagagggatgga

SEQ ID NO: 51584 - DNA, 25 bp, Mus musculus
tagatcagagtggacatgtcacaag

SEQ ID NO: 51585 - DNA, 25 bp, Mus musculus
tagatcagctacaagaggagatggc

SEQ ID NO: 51586 - DNA, 25 bp, Mus musculus
tagatccattgaagcctttaaggac

SEQ ID NO: 51587 - DNA, 25 bp, Mus musculus
tagatccattgatgcctttaaggac

SEQ ID NO: 51588 - DNA, 25 bp, Mus musculus
tagatcctgctcacagaatcacagc

SEQ ID NO: 51589 - DNA, 25 bp, Mus musculus
tagatcgacttctgcagtatgagaa

SEQ ID NO: 51590 - DNA, 25 bp, Mus musculus
tagatctagaatattttgaagaagg

SEQ ID NO: 51591 - DNA, 25 bp, Mus musculus
tagatctgagcttcaaccccttgaa

SEQ ID NO: 51592 - DNA, 25 bp, Mus musculus
tagatctgaggagctgtgatatctc

SEQ ID NO: 51593 - DNA, 25 bp, Mus musculus
tagatctgcaggagagcctagcctg

SEQ ID NO: 51594 - DNA, 25 bp, Mus musculus
tagatctgtaaatatatccttcgaa

SEQ ID NO: 51595 - DNA, 25 bp, Mus musculus
tagatcttccccaactgctggagga

SEQ ID NO: 51596 - DNA, 25 bp, Mus musculus
tagatcttgagcactgggatccaca

SEQ ID NO: 51597 - DNA, 25 bp, Mus musculus
tagatctttcagaaatggagctggc

SEQ ID NO: 51598 - DNA, 25 bp, Mus musculus
tagatgaaattgatgtggaccagga

SEQ ID NO: 51599 - DNA, 25 bp, Mus musculus
tagatgaacccgtctcctgctccta

SEQ ID NO: 51600 - DNA, 25 bp, Mus musculus
tagatgaaggacacaacagacagct

SEQ ID NO: 51601 - DNA, 25 bp, Mus musculus
tagatgactctcagacacagcggca

SEQ ID NO: 51602 - DNA, 25 bp, Mus musculus
tagatgactgttggatggctcccga

SEQ ID NO: 51603 - DNA, 25 bp, Mus musculus
tagatgcacaggtgcgccttgaaga

SEQ ID NO: 51604 - DNA, 25 bp, Mus musculus
tagatgcagggaactcaacctagga

SEQ ID NO: 51605 - DNA, 25 bp, Mus musculus
tagatgcagtcgtttttggaggaga

SEQ ID NO: 51606 - DNA, 25 bp, Mus musculus
tagatgcccttgtaattgtctactc

SEQ ID NO: 51607 - DNA, 25 bp, Mus musculus
tagatgcctagatcatgaaaatgga

SEQ ID NO: 51608 - DNA, 25 bp, Mus musculus
tagatgcgactgacctttttgatcg

SEQ ID NO: 51609 - DNA, 25 bp, Mus musculus
tagatgctcaaatccctgggaatgt

SEQ ID NO: 51610 - DNA, 25 bp, Mus musculus
tagatgctcctgagagccgggctat

SEQ ID NO: 51611 - DNA, 25 bp, Mus musculus
tagatgctcctgtgagccgggctat

SEQ ID NO: 51612 - DNA, 25 bp, Mus musculus
tagatgctgctctggtgcagacaga

SEQ ID NO: 51613 - DNA, 25 bp, Mus musculus
tagatgcttccggatcttccgtgtg

SEQ ID NO: 51614 - DNA, 25 bp, Mus musculus
tagatggaaaaccagtgaatctggg

SEQ ID NO: 51615 - DNA, 25 bp, Mus musculus
tagatggactaagctgattttatca

SEQ ID NO: 51616 - DNA, 25 bp, Mus musculus
tagatggccgagatggaataccagg

SEQ ID NO: 51617 - DNA, 25 bp, Mus musculus
tagatggcgcctactgtgcaaacat

SEQ ID NO: 51618 - DNA, 25 bp, Mus musculus
tagatggctggattgcagtggcata

SEQ ID NO: 51619 - DNA, 25 bp, Mus musculus
tagatggtacaacccacgcagctct

SEQ ID NO: 51620 - DNA, 25 bp, Mus musculus
tagatggtcggcaaggagactccct

SEQ ID NO: 51621 - DNA, 25 bp, Mus musculus
tagatggttctggaaagtccatgct

SEQ ID NO: 51622 - DNA, 25 bp, Mus musculus
tagatgtatctaagaaaatggctcc

SEQ ID NO: 51623 - DNA, 25 bp, Mus musculus
tagatgttgtagacactggttcagg

SEQ ID NO: 51624 - DNA, 25 bp, Mus musculus
tagatgtttcccacttgaagctaaa

SEQ ID NO: 51625 - DNA, 25 bp, Mus musculus
tagattcagatttgtcagatggacc

SEQ ID NO: 51626 - DNA, 25 bp, Mus musculus
tagattccagcaggagcttgatgac

SEQ ID NO: 51627 - DNA, 25 bp, Mus musculus
tagattcctgagaaaacgcggccac

SEQ ID NO: 51628 - DNA, 25 bp, Mus musculus
tagattcgctcaccagcatgttggc

SEQ ID NO: 51629 - DNA, 25 bp, Mus musculus
tagattgcttggagccagagttcca

SEQ ID NO: 51630 - DNA, 25 bp, Mus musculus
tagattggcaaaatataggacacta

SEQ ID NO: 51631 - DNA, 25 bp, Mus musculus
tagatttagaagaggctggaaaaga

SEQ ID NO: 51632 - DNA, 25 bp, Mus musculus
tagatttccaatcagatgtgctgga

SEQ ID NO: 51633 - DNA, 25 bp, Mus musculus
tagatttccaatgagatgtgctgga

SEQ ID NO: 51634 - DNA, 25 bp, Mus musculus
tagatttccagtggccccattgatc

SEQ ID NO: 51635 - DNA, 25 bp, Mus musculus
tagattttatgactgagtgcaccac

SEQ ID NO: 51636 - DNA, 25 bp, Mus musculus
tagattttcagcaggaccgggaagc

SEQ ID NO: 51637 - DNA, 25 bp, Mus musculus
tagcaaacaacttactatggtagaa

SEQ ID NO: 51638 - DNA, 25 bp, Mus musculus
tagcaaacagtctatttcggcgaat

SEQ ID NO: 51639 - DNA, 25 bp, Mus musculus
tagcaaacatgaatgacgtttcgca

SEQ ID NO: 51640 - DNA, 25 bp, Mus musculus
tagcaaatgatgtcatccaaaacag

SEQ ID NO: 51641 - DNA, 25 bp, Mus musculus
tagcaacaggtgctgtagatctctc

SEQ ID NO: 51642 - DNA, 25 bp, Mus musculus
tagcaaccagctggtcacagactgc

SEQ ID NO: 51643 - DNA, 25 bp, Mus musculus
tagcaacgtgccaaggccaggagtc

SEQ ID NO: 51644 - DNA, 25 bp, Mus musculus
tagcaactgtctaactggacttaag

SEQ ID NO: 51645 - DNA, 25 bp, Mus musculus
tagcaagatttgactggagaggaca

SEQ ID NO: 51646 - DNA, 25 bp, Mus musculus
tagcaagccatctacacgtgcaaca

SEQ ID NO: 51647 - DNA, 25 bp, Mus musculus
tagcaagctgtctgtgatccacaga

SEQ ID NO: 51648 - DNA, 25 bp, Mus musculus
tagcaagcttccctgtttcaggtga

SEQ ID NO: 51649 - DNA, 25 bp, Mus musculus
tagcaaggacaaaacaattcaacat

SEQ ID NO: 51650 - DNA, 25 bp, Mus musculus
tagcaaggataaggtgccagctcaa

SEQ ID NO: 51651 - DNA, 25 bp, Mus musculus
tagcaagtcttgtacagcgaatcag

SEQ ID NO: 51652 - DNA, 25 bp, Mus musculus
tagcaatgccatcaaagagcaactg

SEQ ID NO: 51653 - DNA, 25 bp, Mus musculus
tagcaatgcctgtccgtgaaaccaa

SEQ ID NO: 51654 - DNA, 25 bp, Mus musculus
tagcacacatgtttgagcgcatggt

SEQ ID NO: 51655 - DNA, 25 bp, Mus musculus
tagcacaggacagtttaatgacagc

SEQ ID NO: 51656 - DNA, 25 bp, Mus musculus
tagcacctgtgatggtccaagtctg

SEQ ID NO: 51657 - DNA, 25 bp, Mus musculus
tagcacgagctatgcccaacagaag

SEQ ID NO: 51658 - DNA, 25 bp, Mus musculus
tagcacggacctcacggacgtgatg

SEQ ID NO: 51659 - DNA, 25 bp, Mus musculus
tagcactaactgcatatggtactcc

SEQ ID NO: 51660 - DNA, 25 bp, Mus musculus
tagcactacaccctgtgaagggacc

SEQ ID NO: 51661 - DNA, 25 bp, Mus musculus
tagcactagtattcgaagcaccaag

SEQ ID NO: 51662 - DNA, 25 bp, Mus musculus
tagcactggcacactgattgaggac

SEQ ID NO: 51663 - DNA, 25 bp, Mus musculus
tagcagaacgcttgatgcacctgac

SEQ ID NO: 51664 - DNA, 25 bp, Mus musculus
tagcagaagcccatgctaaagtaag

SEQ ID NO: 51665 - DNA, 25 bp, Mus musculus
tagcagaagcctattcgaatttggg

SEQ ID NO: 51666 - DNA, 25 bp, Mus musculus
tagcagaagggtttgatttcgcgaa

SEQ ID NO: 51667 - DNA, 25 bp, Mus musculus
tagcagacaccatagcacagcactt

SEQ ID NO: 51668 - DNA, 25 bp, Mus musculus
tagcagaccgtgaacatcctctgac

SEQ ID NO: 51669 - DNA, 25 bp, Mus musculus
tagcagagatagacctttcccaggg

SEQ ID NO: 51670 - DNA, 25 bp, Mus musculus
tagcagcaaccactcatcagcttgg

SEQ ID NO: 51671 - DNA, 25 bp, Mus musculus
tagcagcactaacaattctgtttcg

SEQ ID NO: 51672 - DNA, 25 bp, Mus musculus
tagcagcatctatgttatcctttgg

SEQ ID NO: 51673 - DNA, 25 bp, Mus musculus
tagcagccactcactgtattctcag

SEQ ID NO: 51674 - DNA, 25 bp, Mus musculus
tagcagccctggacacactgcgcag

SEQ ID NO: 51675 - DNA, 25 bp, Mus musculus
tagcagcgcattacgataatcagaa

SEQ ID NO: 51676 - DNA, 25 bp, Mus musculus
tagcagctccaccatctaggcgctg

SEQ ID NO: 51677 - DNA, 25 bp, Mus musculus
tagcagctcctctggcatgacgtcc

SEQ ID NO: 51678 - DNA, 25 bp, Mus musculus
tagcagctgaattgttagaacactg

SEQ ID NO: 51679 - DNA, 25 bp, Mus musculus
tagcaggacaaatagcatgagcagt

SEQ ID NO: 51680 - DNA, 25 bp, Mus musculus
tagcaggacttgatgccgttctcca

SEQ ID NO: 51681 - DNA, 25 bp, Mus musculus
tagcagggactgaagaacacctctg

SEQ ID NO: 51682 - DNA, 25 bp, Mus musculus
tagcagtcactgcagttgccttaca

SEQ ID NO: 51683 - DNA, 25 bp, Mus musculus
tagcagtcctgcttcaacttccaaa

SEQ ID NO: 51684 - DNA, 25 bp, Mus musculus
tagcagtcgccactatgttgacagg

SEQ ID NO: 51685 - DNA, 25 bp, Mus musculus
tagcagtcttagaaaaggcccttcc

SEQ ID NO: 51686 - DNA, 25 bp, Mus musculus
tagcagtcttggcattatggacctg

SEQ ID NO: 51687 - DNA, 25 bp, Mus musculus
tagcagtgaagatatcgaaaaaagc

SEQ ID NO: 51688 - DNA, 25 bp, Mus musculus
tagcagtggccaaaatcgatggagc

SEQ ID NO: 51689 - DNA, 25 bp, Mus musculus
tagcagtgtcttgcaatggctcttc

SEQ ID NO: 51690 - DNA, 25 bp, Mus musculus
tagcagttccaaatttacattccac

SEQ ID NO: 51691 - DNA, 25 bp, Mus musculus
tagcagttcgtggtgatcagccttc

SEQ ID NO: 51692 - DNA, 25 bp, Mus musculus
tagcatagacttacttgactattta

SEQ ID NO: 51693 - DNA, 25 bp, Mus musculus
tagcatagactttcttgactattta

SEQ ID NO: 51694 - DNA, 25 bp, Mus musculus
tagcatagccctgaaatttgatacc

SEQ ID NO: 51695 - DNA, 25 bp, Mus musculus
tagcatagcttgtgtgggacactgg

SEQ ID NO: 51696 - DNA, 25 bp, Mus musculus
tagcatattattaccagaggaaagg

SEQ ID NO: 51697 - DNA, 25 bp, Mus musculus
tagcatctcagatgataacggaagg

SEQ ID NO: 51698 - DNA, 25 bp, Mus musculus
tagcatctcctctcggagtggctct

SEQ ID NO: 51699 - DNA, 25 bp, Mus musculus
tagcatcttagcagtgtattccaaa

SEQ ID NO: 51700 - DNA, 25 bp, Mus musculus
tagcatgaccgacatctgatcagcc

SEQ ID NO: 51701 - DNA, 25 bp, Mus musculus
tagcatgaccgagatctgatcagcc

SEQ ID NO: 51702 - DNA, 25 bp, Mus musculus
tagcatgctgtaccctctttcccat

SEQ ID NO: 51703 - DNA, 25 bp, Mus musculus
tagcatggaaattggaggctgaaag

SEQ ID NO: 51704 - DNA, 25 bp, Mus musculus
tagcatgtgacctgctgccctgcaa

SEQ ID NO: 51705 - DNA, 25 bp, Mus musculus
tagcatgtgccaatgtcctcagtga

SEQ ID NO: 51706 - DNA, 25 bp, Mus musculus
tagcattagctctggaatccagccg

SEQ ID NO: 51707 - DNA, 25 bp, Mus musculus
tagcattagtgaactcaagcgcaat

SEQ ID NO: 51708 - DNA, 25 bp, Mus musculus
tagcattcctttcgaacaccacggc

SEQ ID NO: 51709 - DNA, 25 bp, Mus musculus
tagcatttatacgagggcagcttga

SEQ ID NO: 51710 - DNA, 25 bp, Mus musculus
tagccaacatgcagttacagcagca

SEQ ID NO: 51711 - DNA, 25 bp, Mus musculus
tagccaacgaccaggagaaatagag

SEQ ID NO: 51712 - DNA, 25 bp, Mus musculus
tagccaagactgaggaagaaatgca

SEQ ID NO: 51713 - DNA, 25 bp, Mus musculus
tagccaagaggcatctagagacggt

SEQ ID NO: 51714 - DNA, 25 bp, Mus musculus
tagccaagatgtcttcagcacctga

SEQ ID NO: 51715 - DNA, 25 bp, Mus musculus
tagccaaggatccattaacctgctt

SEQ ID NO: 51716 - DNA, 25 bp, Mus musculus
tagccaagggtcttctgctcaaggg

SEQ ID NO: 51717 - DNA, 25 bp, Mus musculus
tagccaagtacccaagaggaaccac

SEQ ID NO: 51718 - DNA, 25 bp, Mus musculus
tagccaatacatgcactgtgtcaac

SEQ ID NO: 51719 - DNA, 25 bp, Mus musculus
tagccacaatgcttaactgcatgct

SEQ ID NO: 51720 - DNA, 25 bp, Mus musculus
tagccacagggggtgatgttacacg

SEQ ID NO: 51721 - DNA, 25 bp, Mus musculus
tagccacagtgctgaaggctccagc

SEQ ID NO: 51722 - DNA, 25 bp, Mus musculus
tagccactgctgatacagatgagga

SEQ ID NO: 51723 - DNA, 25 bp, Mus musculus
tagccactgctgttacagatgagga

SEQ ID NO: 51724 - DNA, 25 bp, Mus musculus
tagccagaagagaaacccacagact

SEQ ID NO: 51725 - DNA, 25 bp, Mus musculus
tagccagagccccttatatgccagt

SEQ ID NO: 51726 - DNA, 25 bp, Mus musculus
tagccagagcccgttatatgccagt

SEQ ID NO: 51727 - DNA, 25 bp, Mus musculus
tagccagatggctgtgcacaagctg

SEQ ID NO: 51728 - DNA, 25 bp, Mus musculus
tagccagcaggaaaaatagcctcac

SEQ ID NO: 51729 - DNA, 25 bp, Mus musculus
tagccagcctgtgcatagtagccct

SEQ ID NO: 51730 - DNA, 25 bp, Mus musculus
tagccaggagtaacaggcttaatat

SEQ ID NO: 51731 - DNA, 25 bp, Mus musculus
tagccaggagtatcaggcttaatat

SEQ ID NO: 51732 - DNA, 25 bp, Mus musculus
tagccaggcagtttggtcacatgaa

SEQ ID NO: 51733 - DNA, 25 bp, Mus musculus
tagccaggtcctgaattctctgggt

SEQ ID NO: 51734 - DNA, 25 bp, Mus musculus
tagccagtcttctcatggcgcacct

SEQ ID NO: 51735 - DNA, 25 bp, Mus musculus
tagccagtgcgtccaggttggtcct

SEQ ID NO: 51736 - DNA, 25 bp, Mus musculus
tagccataagacatgttacaaattc

SEQ ID NO: 51737 - DNA, 25 bp, Mus musculus
tagccatcaacgtcaaggcgctcta

SEQ ID NO: 51738 - DNA, 25 bp, Mus musculus
tagccatcaagaacggggacgtggt

SEQ ID NO: 51739 - DNA, 25 bp, Mus musculus
tagccatccggtggcgcaggtgtct

SEQ ID NO: 51740 - DNA, 25 bp, Mus musculus
tagccatcgctcagaaaaaagtgag

SEQ ID NO: 51741 - DNA, 25 bp, Mus musculus
tagccatcttccaggggcggctggt

SEQ ID NO: 51742 - DNA, 25 bp, Mus musculus
tagccatgggctaccttacgatatg

SEQ ID NO: 51743 - DNA, 25 bp, Mus musculus
tagcccaaagtacagattctgggaa

SEQ ID NO: 51744 - DNA, 25 bp, Mus musculus
tagcccaagcttttctgtgtacaat

SEQ ID NO: 51745 - DNA, 25 bp, Mus musculus
tagcccacactatccttcaaactat

SEQ ID NO: 51746 - DNA, 25 bp, Mus musculus
tagcccagaagaactgaaacaagca

SEQ ID NO: 51747 - DNA, 25 bp, Mus musculus
tagcccagctttgattaaagatggc

SEQ ID NO: 51748 - DNA, 25 bp, Mus musculus
tagcccagtataaacgggagtgccc

SEQ ID NO: 51749 - DNA, 25 bp, Mus musculus
tagcccatggtctcagaagaagtgt

SEQ ID NO: 51750 - DNA, 25 bp, Mus musculus
tagcccattgagaccagttgctcag

SEQ ID NO: 51751 - DNA, 25 bp, Mus musculus
tagcccctatgaacttagagcttag

SEQ ID NO: 51752 - DNA, 25 bp, Mus musculus
tagcccctatgatcttagagcttag

SEQ ID NO: 51753 - DNA, 25 bp, Mus musculus
tagcccgaattctggcctggatcta

SEQ ID NO: 51754 - DNA, 25 bp, Mus musculus
tagcccgtcttcaaagtggtcacca

SEQ ID NO: 51755 - DNA, 25 bp, Mus musculus
tagcccgtcttctaagtggtcacca

SEQ ID NO: 51756 - DNA, 25 bp, Mus musculus
tagccctgaaatttgataccacacc

SEQ ID NO: 51757 - DNA, 25 bp, Mus musculus
tagccctgcaactgcaacagaaaga

SEQ ID NO: 51758 - DNA, 25 bp, Mus musculus
tagccctgctcatagagccacggtg

SEQ ID NO: 51759 - DNA, 25 bp, Mus musculus
tagccctgggattagccagtggatc

SEQ ID NO: 51760 - DNA, 25 bp, Mus musculus
tagcccttcttcaacgtccatgact

SEQ ID NO: 51761 - DNA, 25 bp, Mus musculus
tagccgaatcatccagacatcacag

SEQ ID NO: 51762 - DNA, 25 bp, Mus musculus
tagccgcaatgcaggtttctccagg

SEQ ID NO: 51763 - DNA, 25 bp, Mus musculus
tagccggcctgctgatagtggtaag

SEQ ID NO: 51764 - DNA, 25 bp, Mus musculus
tagccggctcagatacacctgcatg

SEQ ID NO: 51765 - DNA, 25 bp, Mus musculus
tagccggtgcaagcaaaaaccagga

SEQ ID NO: 51766 - DNA, 25 bp, Mus musculus
tagcctaccacgaggctgggcatgc

SEQ ID NO: 51767 - DNA, 25 bp, Mus musculus
tagcctagaataccagctgtgagca

SEQ ID NO: 51768 - DNA, 25 bp, Mus musculus
tagcctcacggcactgagcttattc

SEQ ID NO: 51769 - DNA, 25 bp, Mus musculus
tagcctcacggctctgagcttattc

SEQ ID NO: 51770 - DNA, 25 bp, Mus musculus
tagcctcagctctgttcaaatctgg

SEQ ID NO: 51771 - DNA, 25 bp, Mus musculus
tagcctcattcccagttacatccgt

SEQ ID NO: 51772 - DNA, 25 bp, Mus musculus
tagcctcctatgatatgcagctgag

SEQ ID NO: 51773 - DNA, 25 bp, Mus musculus
tagcctcctcatgctgttggctggc

SEQ ID NO: 51774 - DNA, 25 bp, Mus musculus
tagcctcctgagtggcatatcacca

SEQ ID NO: 51775 - DNA, 25 bp, Mus musculus
tagcctgctattccctgggcatctg

SEQ ID NO: 51776 - DNA, 25 bp, Mus musculus
tagcctggacaagagaatcatcctc

SEQ ID NO: 51777 - DNA, 25 bp, Mus musculus
tagcctggacggcatcccatttact

SEQ ID NO: 51778 - DNA, 25 bp, Mus musculus
tagcctggagtaatctcggctgtgt

SEQ ID NO: 51779 - DNA, 25 bp, Mus musculus
tagcctgggagcatgatcgtggaca

SEQ ID NO: 51780 - DNA, 25 bp, Mus musculus
tagcctggtggtcatctagccccag

SEQ ID NO: 51781 - DNA, 25 bp, Mus musculus
tagcctgtcgcgtttacgaagccca

SEQ ID NO: 51782 - DNA, 25 bp, Mus musculus
tagcctgtctcccaggaccaggtga

SEQ ID NO: 51783 - DNA, 25 bp, Mus musculus
tagcctgtctggattggagtccgaa

SEQ ID NO: 51784 - DNA, 25 bp, Mus musculus
tagcctgttacacatattccatggt

SEQ ID NO: 51785 - DNA, 25 bp, Mus musculus
tagcctgtttgaggagtgggaccct

SEQ ID NO: 51786 - DNA, 25 bp, Mus musculus
tagccttcgttggtattaccttctt

SEQ ID NO: 51787 - DNA, 25 bp, Mus musculus
tagccttgggctctggtaaagctgt

SEQ ID NO: 51788 - DNA, 25 bp, Mus musculus
tagcctttgcagagtctgaactaga

SEQ ID NO: 51789 - DNA, 25 bp, Mus musculus
tagcgaacactttcatcgtgctgtc

SEQ ID NO: 51790 - DNA, 25 bp, Mus musculus
tagcgaatgcctcagtcagggagca

SEQ ID NO: 51791 - DNA, 25 bp, Mus musculus
tagcgagagtgaatgtttaaaatcc

SEQ ID NO: 51792 - DNA, 25 bp, Mus musculus
tagcgatgcaactaagttaaggcca

SEQ ID NO: 51793 - DNA, 25 bp, Mus musculus
tagcgatgtctctggaagttttgtg

SEQ ID NO: 51794 - DNA, 25 bp, Mus musculus
tagcggaggccctcctggagcagtg

SEQ ID NO: 51795 - DNA, 25 bp, Mus musculus
tagcggcagtggtagcagctacagt

SEQ ID NO: 51796 - DNA, 25 bp, Mus musculus
tagcggctgaagctgagaattctca

SEQ ID NO: 51797 - DNA, 25 bp, Mus musculus
tagcgggagagaaagccgagtcaca

SEQ ID NO: 51798 - DNA, 25 bp, Mus musculus
tagcgggagtaacaccaatgtgacc

SEQ ID NO: 51799 - DNA, 25 bp, Mus musculus
tagcggtgtcatcctttgaacatgc

SEQ ID NO: 51800 - DNA, 25 bp, Mus musculus
tagcgtgcaacgcttatgataagaa

SEQ ID NO: 51801 - DNA, 25 bp, Mus musculus
tagcgtgcctcccacagaagggatg

SEQ ID NO: 51802 - DNA, 25 bp, Mus musculus
tagcgttgctgtttctccatgtata

SEQ ID NO: 51803 - DNA, 25 bp, Mus musculus
tagctaaagaaatgatacatcaaag

SEQ ID NO: 51804 - DNA, 25 bp, Mus musculus
tagctaaaggcaatcagcacccacc

SEQ ID NO: 51805 - DNA, 25 bp, Mus musculus
tagctaaaggcattcagcacccacc

SEQ ID NO: 51806 - DNA, 25 bp, Mus musculus
tagctaacagaactattgtggaagg

SEQ ID NO: 51807 - DNA, 25 bp, Mus musculus
tagctaaccagttcctggctcctgg

SEQ ID NO: 51808 - DNA, 25 bp, Mus musculus
tagctaaccctccctttcttcagaa

SEQ ID NO: 51809 - DNA, 25 bp, Mus musculus
tagctaagagctgcctggtgctgaa

SEQ ID NO: 51810 - DNA, 25 bp, Mus musculus
tagctacattcgagactccactgtg

SEQ ID NO: 51811 - DNA, 25 bp, Mus musculus
tagctactctttcccagtgtaatga

SEQ ID NO: 51812 - DNA, 25 bp, Mus musculus
tagctactggtgtcagaacatggag

SEQ ID NO: 51813 - DNA, 25 bp, Mus musculus
tagctagaagaatgctggaaatgat

SEQ ID NO: 51814 - DNA, 25 bp, Mus musculus
tagctagtactttgtatgaagatgg

SEQ ID NO: 51815 - DNA, 25 bp, Mus musculus
tagctatcctgaaacatctgttggc

SEQ ID NO: 51816 - DNA, 25 bp, Mus musculus
tagctattgatgcaagaatgcttgt

SEQ ID NO: 51817 - DNA, 25 bp, Mus musculus
tagctcaaactaacctgctccgaaa

SEQ ID NO: 51818 - DNA, 25 bp, Mus musculus
tagctcaccgctaggagagatgtcc

SEQ ID NO: 51819 - DNA, 25 bp, Mus musculus
tagctccgaagacgttgtcagtgag

SEQ ID NO: 51820 - DNA, 25 bp, Mus musculus
tagctcgtcatgcagacatccttgc

SEQ ID NO: 51821 - DNA, 25 bp, Mus musculus
tagctctacgtcaccttctttcata

SEQ ID NO: 51822 - DNA, 25 bp, Mus musculus
tagctctattttccatgacagatag

SEQ ID NO: 51823 - DNA, 25 bp, Mus musculus
tagctctgaaaacgctgtcttctag

SEQ ID NO: 51824 - DNA, 25 bp, Mus musculus
tagctctgacggatgactctttgcc

SEQ ID NO: 51825 - DNA, 25 bp, Mus musculus
tagctgaaactataaaggcttcaag

SEQ ID NO: 51826 - DNA, 25 bp, Mus musculus
tagctgaagactttgtttgggctca

SEQ ID NO: 51827 - DNA, 25 bp, Mus musculus
tagctgaattgctggctcacaagat

SEQ ID NO: 51828 - DNA, 25 bp, Mus musculus
tagctgactagaggtgtttctggcc

SEQ ID NO: 51829 - DNA, 25 bp, Mus musculus
tagctgacttgctggcttttgctgg

SEQ ID NO: 51830 - DNA, 25 bp, Mus musculus
tagctgagatcaagtctctgttgga

SEQ ID NO: 51831 - DNA, 25 bp, Mus musculus
tagctgagcatgcaaatgattccct

SEQ ID NO: 51832 - DNA, 25 bp, Mus musculus
tagctgagctcccttgccttttggt

SEQ ID NO: 51833 - DNA, 25 bp, Mus musculus
tagctgaggctgacggaaggaccta

SEQ ID NO: 51834 - DNA, 25 bp, Mus musculus
tagctgatgggcaggtgtctcagat

SEQ ID NO: 51835 - DNA, 25 bp, Mus musculus
tagctgcccactatgggaacatcaa

SEQ ID NO: 51836 - DNA, 25 bp, Mus musculus
tagctgcctgtggtgtactgataaa

SEQ ID NO: 51837 - DNA, 25 bp, Mus musculus
tagctgcgttcctcctggatcatgg

SEQ ID NO: 51838 - DNA, 25 bp, Mus musculus
tagctggccacattcaacagtctgt

SEQ ID NO: 51839 - DNA, 25 bp, Mus musculus
tagctggcctttaaccacgacctgg

SEQ ID NO: 51840 - DNA, 25 bp, Mus musculus
tagctggcgtgtcaaaagcagaaac

SEQ ID NO: 51841 - DNA, 25 bp, Mus musculus
tagctgggacaagtttacaggctgc

SEQ ID NO: 51842 - DNA, 25 bp, Mus musculus
tagctgggatcaccgtctttcaaca

SEQ ID NO: 51843 - DNA, 25 bp, Mus musculus
tagctggtgaatgaaggatgacagc

SEQ ID NO: 51844 - DNA, 25 bp, Mus musculus
tagctgtaaaccagagccgggagcc

SEQ ID NO: 51845 - DNA, 25 bp, Mus musculus
tagctgtaaacctgagccgggagcc

SEQ ID NO: 51846 - DNA, 25 bp, Mus musculus
tagctgtaggactaggtgttgcagc

SEQ ID NO: 51847 - DNA, 25 bp, Mus musculus
tagctgtcttcttgccccggtcagt

SEQ ID NO: 51848 - DNA, 25 bp, Mus musculus
tagctgtgaatatggatctggcaga

SEQ ID NO: 51849 - DNA, 25 bp, Mus musculus
tagctgtgagcaaggatgcagtgaa

SEQ ID NO: 51850 - DNA, 25 bp, Mus musculus
tagctgtggccactggaagactctc

SEQ ID NO: 51851 - DNA, 25 bp, Mus musculus
tagctgtgtcagctgtcctcactag

SEQ ID NO: 51852 - DNA, 25 bp, Mus musculus
tagctgtgtggtactcatggtactt

SEQ ID NO: 51853 - DNA, 25 bp, Mus musculus
tagctgtgtggttctcatggtactt

SEQ ID NO: 51854 - DNA, 25 bp, Mus musculus
tagctgtgttccagttttgttcaaa

SEQ ID NO: 51855 - DNA, 25 bp, Mus musculus
tagctgttggtagtaagtccgggta

SEQ ID NO: 51856 - DNA, 25 bp, Mus musculus
tagctgtttcacaccctggaatggg

SEQ ID NO: 51857 - DNA, 25 bp, Mus musculus
tagctgtttcactccctggaatggg

SEQ ID NO: 51858 - DNA, 25 bp, Mus musculus
tagctgtttcctctgggactataac

SEQ ID NO: 51859 - DNA, 25 bp, Mus musculus
tagcttaataactgcaggactgcgc

SEQ ID NO: 51860 - DNA, 25 bp, Mus musculus
tagcttacagcctgggtgcctcagc

SEQ ID NO: 51861 - DNA, 25 bp, Mus musculus
tagcttcgccatgtacatggccctt

SEQ ID NO: 51862 - DNA, 25 bp, Mus musculus
tagcttctcttcagataccccatgg

SEQ ID NO: 51863 - DNA, 25 bp, Mus musculus
tagcttctgtgctggatttgagaat

SEQ ID NO: 51864 - DNA, 25 bp, Mus musculus
tagcttcttcagtagctgagagtaa

SEQ ID NO: 51865 - DNA, 25 bp, Mus musculus
tagcttgcgatgaagagttttcaga

SEQ ID NO: 51866 - DNA, 25 bp, Mus musculus
tagcttggagacttctgagccgccg

SEQ ID NO: 51867 - DNA, 25 bp, Mus musculus
tagcttggtggtctcgtttttggcc

SEQ ID NO: 51868 - DNA, 25 bp, Mus musculus
tagctttgagaggaaggttacagtt

SEQ ID NO: 51869 - DNA, 25 bp, Mus musculus
tagctttgccttcttaccatcaggc

SEQ ID NO: 51870 - DNA, 25 bp, Mus musculus
taggaaaaatacatgcatggaacaa

SEQ ID NO: 51871 - DNA, 25 bp, Mus musculus
taggaaaacatggagaaaatggagc

SEQ ID NO: 51872 - DNA, 25 bp, Mus musculus
taggaaacgccagtcttctcagcac

SEQ ID NO: 51873 - DNA, 25 bp, Mus musculus
taggaaataagtacagctataagtg

SEQ ID NO: 51874 - DNA, 25 bp, Mus musculus
taggaaatgacctcgggtcctctgc

SEQ ID NO: 51875 - DNA, 25 bp, Mus musculus
taggaaatgtcttgaaagaggcacg

SEQ ID NO: 51876 - DNA, 25 bp, Mus musculus
taggaaatgttgcagattcccaagg

SEQ ID NO: 51877 - DNA, 25 bp, Mus musculus
taggaacagacattcagcccagact

SEQ ID NO: 51878 - DNA, 25 bp, Mus musculus
taggaaccaacgcagacatggccat

SEQ ID NO: 51879 - DNA, 25 bp, Mus musculus
taggaacttattttgtagtccttgc

SEQ ID NO: 51880 - DNA, 25 bp, Mus musculus
taggaacttgttgcctaaggacgtc

SEQ ID NO: 51881 - DNA, 25 bp, Mus musculus
taggaagaaaatgtggccgtattct

SEQ ID NO: 51882 - DNA, 25 bp, Mus musculus
taggaagataaggttttcaacactg

SEQ ID NO: 51883 - DNA, 25 bp, Mus musculus
taggaagataataccagagaagaat

SEQ ID NO: 51884 - DNA, 25 bp, Mus musculus
taggaagtgtcctgtattttactaa

SEQ ID NO: 51885 - DNA, 25 bp, Mus musculus
taggaataagcacgctattgcagtt

SEQ ID NO: 51886 - DNA, 25 bp, Mus musculus
taggaataatacctccaaaaggctg

SEQ ID NO: 51887 - DNA, 25 bp, Mus musculus
taggaatacgaggagttttcagcaa

SEQ ID NO: 51888 - DNA, 25 bp, Mus musculus
taggaatgacgtcctttccgactgt

SEQ ID NO: 51889 - DNA, 25 bp, Mus musculus
taggaatgacgtgctttccgactgt

SEQ ID NO: 51890 - DNA, 25 bp, Mus musculus
taggaatgaggcagcaaaaggtcgc

SEQ ID NO: 51891 - DNA, 25 bp, Mus musculus
taggaatgctgggagcagaatctac

SEQ ID NO: 51892 - DNA, 25 bp, Mus musculus
taggaattctaatgtctagtctgca

SEQ ID NO: 51893 - DNA, 25 bp, Mus musculus
taggacactgcatttactcaaaccc

SEQ ID NO: 51894 - DNA, 25 bp, Mus musculus
taggacagaaacatctggtgatggg

SEQ ID NO: 51895 - DNA, 25 bp, Mus musculus
taggacatggtttaagctcaatgac

SEQ ID NO: 51896 - DNA, 25 bp, Mus musculus
taggaccagggcacatgtggacttc

SEQ ID NO: 51897 - DNA, 25 bp, Mus musculus
taggaccccgcggacagagctactg

SEQ ID NO: 51898 - DNA, 25 bp, Mus musculus
taggacccctcatgagggactgatc

SEQ ID NO: 51899 - DNA, 25 bp, Mus musculus
taggaccgaaaatcctctgcaagaa

SEQ ID NO: 51900 - DNA, 25 bp, Mus musculus
taggacctattaagttctgggactc

SEQ ID NO: 51901 - DNA, 25 bp, Mus musculus
taggacctcctcgaaataaccctgg

SEQ ID NO: 51902 - DNA, 25 bp, Mus musculus
taggacgtggaatcataagcgaaac

SEQ ID NO: 51903 - DNA, 25 bp, Mus musculus
taggactacaagcatttcttcagaa

SEQ ID NO: 51904 - DNA, 25 bp, Mus musculus
taggactccactccaaggttgactt

SEQ ID NO: 51905 - DNA, 25 bp, Mus musculus
taggactccatcagttacagacact

SEQ ID NO: 51906 - DNA, 25 bp, Mus musculus
taggactccatctgttacagacact

SEQ ID NO: 51907 - DNA, 25 bp, Mus musculus
taggacttcagagctcacaaccaga

SEQ ID NO: 51908 - DNA, 25 bp, Mus musculus
taggacttgaatgtgacagagtaca

SEQ ID NO: 51909 - DNA, 25 bp, Mus musculus
taggagagatttatgggaagttgac

SEQ ID NO: 51910 - DNA, 25 bp, Mus musculus
taggagagcatgtcttgtaccttcc

SEQ ID NO: 51911 - DNA, 25 bp, Mus musculus
taggagaggctccttttggcattcc

SEQ ID NO: 51912 - DNA, 25 bp, Mus musculus
taggagatgagatcattgcagtaaa

SEQ ID NO: 51913 - DNA, 25 bp, Mus musculus
taggagatgccacccaagtttatat

SEQ ID NO: 51914 - DNA, 25 bp, Mus musculus
taggagatgccgaaacagatgatga

SEQ ID NO: 51915 - DNA, 25 bp, Mus musculus
taggagattcagcatcacgcgctcc

SEQ ID NO: 51916 - DNA, 25 bp, Mus musculus
taggagcacccatatggttccgagt

SEQ ID NO: 51917 - DNA, 25 bp, Mus musculus
taggagcacgtgtgcgcagaagcat

SEQ ID NO: 51918 - DNA, 25 bp, Mus musculus
taggagcagccatgagatctgaggc

SEQ ID NO: 51919 - DNA, 25 bp, Mus musculus
taggagcgtttctggaaccttgggt

SEQ ID NO: 51920 - DNA, 25 bp, Mus musculus
taggaggaaggaaacaaaggattat

SEQ ID NO: 51921 - DNA, 25 bp, Mus musculus
taggaggcatgaacactgaggagtt

SEQ ID NO: 51922 - DNA, 25 bp, Mus musculus
taggaggcgcttcattcagtcctgt

SEQ ID NO: 51923 - DNA, 25 bp, Mus musculus
taggagggaaaagcaatattcggcc

SEQ ID NO: 51924 - DNA, 25 bp, Mus musculus
taggaggtgataagaggacaagcaa

SEQ ID NO: 51925 - DNA, 25 bp, Mus musculus
taggagtaaatgacgtgccactgca

SEQ ID NO: 51926 - DNA, 25 bp, Mus musculus
taggagtaacgcagcagctgtcatc

SEQ ID NO: 51927 - DNA, 25 bp, Mus musculus
taggagtccaggtgccatcacagct

SEQ ID NO: 51928 - DNA, 25 bp, Mus musculus
taggagtccctatcttctccatcga

SEQ ID NO: 51929 - DNA, 25 bp, Mus musculus
taggagtctaccagacagagtcacc

SEQ ID NO: 51930 - DNA, 25 bp, Mus musculus
taggagtgctctatcaccttaggaa

SEQ ID NO: 51931 - DNA, 25 bp, Mus musculus
taggagtttgctaagaggccaaaaa

SEQ ID NO: 51932 - DNA, 25 bp, Mus musculus
taggatatggccgaatatttcttcc

SEQ ID NO: 51933 - DNA, 25 bp, Mus musculus
taggatcagttgacaattgctggcc

SEQ ID NO: 51934 - DNA, 25 bp, Mus musculus
taggatgaaatcagatctactaaga

SEQ ID NO: 51935 - DNA, 25 bp, Mus musculus
taggatgcggccttggcagcacctg

SEQ ID NO: 51936 - DNA, 25 bp, Mus musculus
taggatgtttagcaaccctgataat

SEQ ID NO: 51937 - DNA, 25 bp, Mus musculus
taggattccagggattcccacatca

SEQ ID NO: 51938 - DNA, 25 bp, Mus musculus
taggattggacgagccatgaagtgc

SEQ ID NO: 51939 - DNA, 25 bp, Mus musculus
taggatttgcttttttccagaagag

SEQ ID NO: 51940 - DNA, 25 bp, Mus musculus
taggcaaagaacttgcatcaagatc

SEQ ID NO: 51941 - DNA, 25 bp, Mus musculus
taggcaacgccctggtttgtacctg

SEQ ID NO: 51942 - DNA, 25 bp, Mus musculus
taggcaaggacaaggacaaagcact

SEQ ID NO: 51943 - DNA, 25 bp, Mus musculus
taggcaagtctaactctattaaaat

SEQ ID NO: 51944 - DNA, 25 bp, Mus musculus
taggcaagtctgtgatagcagctgc

SEQ ID NO: 51945 - DNA, 25 bp, Mus musculus
taggcaatgaagtcccatctgagga

SEQ ID NO: 51946 - DNA, 25 bp, Mus musculus
taggcaatgcagactatgtcttcac

SEQ ID NO: 51947 - DNA, 25 bp, Mus musculus
taggcaatgccatgtttattgaaaa

SEQ ID NO: 51948 - DNA, 25 bp, Mus musculus
taggcacaggctaagtgctttttgc

SEQ ID NO: 51949 - DNA, 25 bp, Mus musculus
taggcaccatcttgtagccctggaa

SEQ ID NO: 51950 - DNA, 25 bp, Mus musculus
taggcacggtcactggctctgtcgc

SEQ ID NO: 51951 - DNA, 25 bp, Mus musculus
taggcagagtgtcttttggcgcttt

SEQ ID NO: 51952 - DNA, 25 bp, Mus musculus
taggcagataattactccgagtgaa

SEQ ID NO: 51953 - DNA, 25 bp, Mus musculus
taggcatacctgaccacatttgtgc

SEQ ID NO: 51954 - DNA, 25 bp, Mus musculus
taggcatccccgtgaccgaaatcgc

SEQ ID NO: 51955 - DNA, 25 bp, Mus musculus
taggcatcttgctccagactacaga

SEQ ID NO: 51956 - DNA, 25 bp, Mus musculus
taggccaaggtcacccttaacacag

SEQ ID NO: 51957 - DNA, 25 bp, Mus musculus
taggccacctacttattctgtgggc

SEQ ID NO: 51958 - DNA, 25 bp, Mus musculus
taggccagactcctgcccatggagg

SEQ ID NO: 51959 - DNA, 25 bp, Mus musculus
taggccaggaaatgaaactggaaga

SEQ ID NO: 51960 - DNA, 25 bp, Mus musculus
taggccatcttttgccagaagagca

SEQ ID NO: 51961 - DNA, 25 bp, Mus musculus
taggccctcaccaggcaagtaacag

SEQ ID NO: 51962 - DNA, 25 bp, Mus musculus
taggcccttctggtgttgggtacca

SEQ ID NO: 51963 - DNA, 25 bp, Mus musculus
taggccgaagtgctaaaactgtccg

SEQ ID NO: 51964 - DNA, 25 bp, Mus musculus
taggccgctttttcctgtaccacat

SEQ ID NO: 51965 - DNA, 25 bp, Mus musculus
taggcctaccccaaggcaaccttgg

SEQ ID NO: 51966 - DNA, 25 bp, Mus musculus
taggcctgaagccacggccggcatc

SEQ ID NO: 51967 - DNA, 25 bp, Mus musculus
taggcctgagccaacactctggtaa

SEQ ID NO: 51968 - DNA, 25 bp, Mus musculus
taggcctggttcctaagcatactga

SEQ ID NO: 51969 - DNA, 25 bp, Mus musculus
taggcctggttcgtaagcatactga

SEQ ID NO: 51970 - DNA, 25 bp, Mus musculus
taggcctttctgtccagcgctctgt

SEQ ID NO: 51971 - DNA, 25 bp, Mus musculus
taggcgaatcctgcgctcagcctgg

SEQ ID NO: 51972 - DNA, 25 bp, Mus musculus
taggcgagttcaatttggctcacag

SEQ ID NO: 51973 - DNA, 25 bp, Mus musculus
taggcgagttcattttggctcacag

SEQ ID NO: 51974 - DNA, 25 bp, Mus musculus
taggcgcctgctctatgtctgcgga

SEQ ID NO: 51975 - DNA, 25 bp, Mus musculus
taggcgcctgtgaacagccagcgta

SEQ ID NO: 51976 - DNA, 25 bp, Mus musculus
taggcggaccaagcacctttcagga

SEQ ID NO: 51977 - DNA, 25 bp, Mus musculus
taggcggtcaaatgagagtctttga

SEQ ID NO: 51978 - DNA, 25 bp, Mus musculus
taggcggtttggaggccctgtacac

SEQ ID NO: 51979 - DNA, 25 bp, Mus musculus
taggcgtgtgtaggcggagccaggg

SEQ ID NO: 51980 - DNA, 25 bp, Mus musculus
taggcgttgttctctacactggcag

SEQ ID NO: 51981 - DNA, 25 bp, Mus musculus
taggctcagcgtttgacatgtcaac

SEQ ID NO: 51982 - DNA, 25 bp, Mus musculus
taggctcagtcgacacagaacagga

SEQ ID NO: 51983 - DNA, 25 bp, Mus musculus
taggctcgagcctaccatggactgg

SEQ ID NO: 51984 - DNA, 25 bp, Mus musculus
taggctctacttcttaaaggttctg

SEQ ID NO: 51985 - DNA, 25 bp, Mus musculus
taggctctgctttgccgacccagag

SEQ ID NO: 51986 - DNA, 25 bp, Mus musculus
taggctgcatctctccttggcatag

SEQ ID NO: 51987 - DNA, 25 bp, Mus musculus
taggctgcgaaccagtttgggctcc

SEQ ID NO: 51988 - DNA, 25 bp, Mus musculus
taggctgcgaacgagtttgggctcc

SEQ ID NO: 51989 - DNA, 25 bp, Mus musculus
taggctgcgccaacctggtagagag

SEQ ID NO: 51990 - DNA, 25 bp, Mus musculus
taggctgctgcatgaagaacctcat

SEQ ID NO: 51991 - DNA, 25 bp, Mus musculus
taggcttaaatattctacccaccac

SEQ ID NO: 51992 - DNA, 25 bp, Mus musculus
taggcttcaggctcagaacatacag

SEQ ID NO: 51993 - DNA, 25 bp, Mus musculus
tagggaagaagtgagcctcagcaat

SEQ ID NO: 51994 - DNA, 25 bp, Mus musculus
tagggaatgagtcctgccctatgaa

SEQ ID NO: 51995 - DNA, 25 bp, Mus musculus
tagggactatggacaagatgatctc

SEQ ID NO: 51996 - DNA, 25 bp, Mus musculus
tagggactatggtcaagatgatctc

SEQ ID NO: 51997 - DNA, 25 bp, Mus musculus
tagggagatacgaaccagctagcag

SEQ ID NO: 51998 - DNA, 25 bp, Mus musculus
tagggagatacgtaccagctagcag

SEQ ID NO: 51999 - DNA, 25 bp, Mus musculus
tagggaggacgctccatgtcctgga

SEQ ID NO: 52000 - DNA, 25 bp, Mus musculus
tagggataaaaagaactgtaaggtg

SEQ ID NO: 52001 - DNA, 25 bp, Mus musculus
tagggatcaatcaaaaacgtgttca

SEQ ID NO: 52002 - DNA, 25 bp, Mus musculus
tagggcaagcgaaatgccccaggct

SEQ ID NO: 52003 - DNA, 25 bp, Mus musculus
tagggcaccaaggacagagcaaagt

SEQ ID NO: 52004 - DNA, 25 bp, Mus musculus
tagggcacgttacaccagtgagatg

SEQ ID NO: 52005 - DNA, 25 bp, Mus musculus
tagggccagaaggaatggaaaaatt

SEQ ID NO: 52006 - DNA, 25 bp, Mus musculus
tagggccagctctgcaagggccagt

SEQ ID NO: 52007 - DNA, 25 bp, Mus musculus
tagggccagtgttgagtgaaacaaa

SEQ ID NO: 52008 - DNA, 25 bp, Mus musculus
tagggctggtttgccttgccaggac

SEQ ID NO: 52009 - DNA, 25 bp, Mus musculus
tagggctttcttctcaggctcccag

SEQ ID NO: 52010 - DNA, 25 bp, Mus musculus
tagggtatttcaaaactgccaaggg

SEQ ID NO: 52011 - DNA, 25 bp, Mus musculus
tagggtatttcataactgccaaggg

SEQ ID NO: 52012 - DNA, 25 bp, Mus musculus
tagggtctaattaaggcctacctat

SEQ ID NO: 52013 - DNA, 25 bp, Mus musculus
tagggtctctccacattgtccagac

SEQ ID NO: 52014 - DNA, 25 bp, Mus musculus
taggtacgccagtgaacaagaagac

SEQ ID NO: 52015 - DNA, 25 bp, Mus musculus
taggtagaggctaggacacggacta

SEQ ID NO: 52016 - DNA, 25 bp, Mus musculus
taggtataccgacaattaatttaag

SEQ ID NO: 52017 - DNA, 25 bp, Mus musculus
taggtatttggtcccttggagctgt

SEQ ID NO: 52018 - DNA, 25 bp, Mus musculus
taggtattttaaagaaactgctctg

SEQ ID NO: 52019 - DNA, 25 bp, Mus musculus
taggtcacagcagagtgagtgtccc

SEQ ID NO: 52020 - DNA, 25 bp, Mus musculus
taggtcagagaccatactgattcac

SEQ ID NO: 52021 - DNA, 25 bp, Mus musculus
taggtcagttaacatccattcccgg

SEQ ID NO: 52022 - DNA, 25 bp, Mus musculus
taggtccctctgcagtcttagctgg

SEQ ID NO: 52023 - DNA, 25 bp, Mus musculus
taggtcgcgaccacgagctcggtgc

SEQ ID NO: 52024 - DNA, 25 bp, Mus musculus
taggtctcaatgaaattcctggcac

SEQ ID NO: 52025 - DNA, 25 bp, Mus musculus
taggtctgcagggtatagcacagcc

SEQ ID NO: 52026 - DNA, 25 bp, Mus musculus
taggtcttggcttattgtggttgga

SEQ ID NO: 52027 - DNA, 25 bp, Mus musculus
taggtctttactactatgacccaaa

SEQ ID NO: 52028 - DNA, 25 bp, Mus musculus
taggtgaagtgctaaaacagttaac

SEQ ID NO: 52029 - DNA, 25 bp, Mus musculus
taggtgacaaacaagatgccctgga

SEQ ID NO: 52030 - DNA, 25 bp, Mus musculus
taggtgacgcaactaagccaagtca

SEQ ID NO: 52031 - DNA, 25 bp, Mus musculus
taggtgaggactccatcaagggccc

SEQ ID NO: 52032 - DNA, 25 bp, Mus musculus
taggtgctttggacgctgctttgct

SEQ ID NO: 52033 - DNA, 25 bp, Mus musculus
taggtggattcacacagatgattcg

SEQ ID NO: 52034 - DNA, 25 bp, Mus musculus
taggtgtacatgactgcacatgcct

SEQ ID NO: 52035 - DNA, 25 bp, Mus musculus
taggtgttcatgatcgtgttttcga

SEQ ID NO: 52036 - DNA, 25 bp, Mus musculus
taggtttccgatccagaccctggag

SEQ ID NO: 52037 - DNA, 25 bp, Mus musculus
taggttttggatgcaaggtcacaac

SEQ ID NO: 52038 - DNA, 25 bp, Mus musculus
tagtaaaactcctgagtgtcgtaaa

SEQ ID NO: 52039 - DNA, 25 bp, Mus musculus
tagtaaaatgtctaccctctcctgt

SEQ ID NO: 52040 - DNA, 25 bp, Mus musculus
tagtaaacataatgaggacctacac

SEQ ID NO: 52041 - DNA, 25 bp, Mus musculus
tagtaaagacttcaacggagatttc

SEQ ID NO: 52042 - DNA, 25 bp, Mus musculus
tagtaaagatgatgaaccagctgta

SEQ ID NO: 52043 - DNA, 25 bp, Mus musculus
tagtaaatgggcatagcctcgagct

SEQ ID NO: 52044 - DNA, 25 bp, Mus musculus
tagtaaccattcaataccgcctggg

SEQ ID NO: 52045 - DNA, 25 bp, Mus musculus
tagtaaccgagaaggctacaagcaa

SEQ ID NO: 52046 - DNA, 25 bp, Mus musculus
tagtaattgtcgtcactgtggcctt

SEQ ID NO: 52047 - DNA, 25 bp, Mus musculus
tagtacaactcgagaaataaaggcc

SEQ ID NO: 52048 - DNA, 25 bp, Mus musculus
tagtacagaaactacactggaaccc

SEQ ID NO: 52049 - DNA, 25 bp, Mus musculus
tagtacagttaccttcaggccaaac

SEQ ID NO: 52050 - DNA, 25 bp, Mus musculus
tagtaccgttgtcagcacacagcgt

SEQ ID NO: 52051 - DNA, 25 bp, Mus musculus
tagtactactgccatattttccagt

SEQ ID NO: 52052 - DNA, 25 bp, Mus musculus
tagtactgagtcaccacagaagaca

SEQ ID NO: 52053 - DNA, 25 bp, Mus musculus
tagtagaactcccagccctcagctg

SEQ ID NO: 52054 - DNA, 25 bp, Mus musculus
tagtagacttctggaccatcatggg

SEQ ID NO: 52055 - DNA, 25 bp, Mus musculus
tagtagcatcttggccagcccatca

SEQ ID NO: 52056 - DNA, 25 bp, Mus musculus
tagtagccagacacgagtatacatt

SEQ ID NO: 52057 - DNA, 25 bp, Mus musculus
tagtagccagtggagcgtcatctac

SEQ ID NO: 52058 - DNA, 25 bp, Mus musculus
tagtagcccttcttaccgccaaatg

SEQ ID NO: 52059 - DNA, 25 bp, Mus musculus
tagtagctctgaaagacttgcttaa

SEQ ID NO: 52060 - DNA, 25 bp, Mus musculus
tagtagctggaaccaagtgtgacaa

SEQ ID NO: 52061 - DNA, 25 bp, Mus musculus
tagtaggaaatgttgcagattccca

SEQ ID NO: 52062 - DNA, 25 bp, Mus musculus
tagtaggactataagcacctgcccc

SEQ ID NO: 52063 - DNA, 25 bp, Mus musculus
tagtaggacttgaggacaaatcgtg

SEQ ID NO: 52064 - DNA, 25 bp, Mus musculus
tagtaggagcgcagctgatccacgc

SEQ ID NO: 52065 - DNA, 25 bp, Mus musculus
tagtaggctcaaatgttcaggaagc

SEQ ID NO: 52066 - DNA, 25 bp, Mus musculus
tagtaggttctaagccacgtgtgga

SEQ ID NO: 52067 - DNA, 25 bp, Mus musculus
tagtagtgctgttaggagtcccagc

SEQ ID NO: 52068 - DNA, 25 bp, Mus musculus
tagtatgagaaactggagtcaaaga

SEQ ID NO: 52069 - DNA, 25 bp, Mus musculus
tagtatgtgacaaaggctgtccctg

SEQ ID NO: 52070 - DNA, 25 bp, Mus musculus
tagtatgtgcacagaactgagtatc

SEQ ID NO: 52071 - DNA, 25 bp, Mus musculus
tagtatttcttggtagccctggaac

SEQ ID NO: 52072 - DNA, 25 bp, Mus musculus
tagtattttcctcaagtcccatgac

SEQ ID NO: 52073 - DNA, 25 bp, Mus musculus
tagtcaagccgatgttgtcgacagt

SEQ ID NO: 52074 - DNA, 25 bp, Mus musculus
tagtcacagctacaatacgacgaag

SEQ ID NO: 52075 - DNA, 25 bp, Mus musculus
tagtcacagctagaatacgacgaag

SEQ ID NO: 52076 - DNA, 25 bp, Mus musculus
tagtcacagtgggaagacccagcat

SEQ ID NO: 52077 - DNA, 25 bp, Mus musculus
tagtcacattaccatgcctaggtgc

SEQ ID NO: 52078 - DNA, 25 bp, Mus musculus
tagtcacctttgtagctgcttgcaa

SEQ ID NO: 52079 - DNA, 25 bp, Mus musculus
tagtcacgtatcagctcctgggcac

SEQ ID NO: 52080 - DNA, 25 bp, Mus musculus
tagtcactgggagggatgtgcttct

SEQ ID NO: 52081 - DNA, 25 bp, Mus musculus
tagtcagagcctgatgaccactccg

SEQ ID NO: 52082 - DNA, 25 bp, Mus musculus
tagtcaggatgactgtaagttacgg

SEQ ID NO: 52083 - DNA, 25 bp, Mus musculus
tagtcagtgcttcgcaagatggaaa

SEQ ID NO: 52084 - DNA, 25 bp, Mus musculus
tagtcatatacaggtcttagcaaga

SEQ ID NO: 52085 - DNA, 25 bp, Mus musculus
tagtccaagatcctccactgttggc

SEQ ID NO: 52086 - DNA, 25 bp, Mus musculus
tagtccacagaaaagcattacactg

SEQ ID NO: 52087 - DNA, 25 bp, Mus musculus
tagtccaggtgactgatggtcagct

SEQ ID NO: 52088 - DNA, 25 bp, Mus musculus
tagtccatctaactgtcttctaaca

SEQ ID NO: 52089 - DNA, 25 bp, Mus musculus
tagtccatctaagtgtcttctaaca

SEQ ID NO: 52090 - DNA, 25 bp, Mus musculus
tagtccccaaggtgaattattgctt

SEQ ID NO: 52091 - DNA, 25 bp, Mus musculus
tagtccccatgcagtgatgtatgcc

SEQ ID NO: 52092 - DNA, 25 bp, Mus musculus
tagtcccgggccacaaatgttcttg

SEQ ID NO: 52093 - DNA, 25 bp, Mus musculus
tagtcctgcagaggaaatggttgtt

SEQ ID NO: 52094 - DNA, 25 bp, Mus musculus
tagtcctgctactggtggctctgca

SEQ ID NO: 52095 - DNA, 25 bp, Mus musculus
tagtccttgccctcaaaagagcaca

SEQ ID NO: 52096 - DNA, 25 bp, Mus musculus
tagtcgaaccgatcacaagtgctgc

SEQ ID NO: 52097 - DNA, 25 bp, Mus musculus
tagtcgacgctatgttgatgaatac

SEQ ID NO: 52098 - DNA, 25 bp, Mus musculus
tagtctaaagagagagacttttccc

SEQ ID NO: 52099 - DNA, 25 bp, Mus musculus
tagtctaaagagtgagacttttccc

SEQ ID NO: 52100 - DNA, 25 bp, Mus musculus
tagtctaagactactagactttccc

SEQ ID NO: 52101 - DNA, 25 bp, Mus musculus
tagtctacgacattagcagtgagcg

SEQ ID NO: 52102 - DNA, 25 bp, Mus musculus
tagtctcaagactagactccttctt

SEQ ID NO: 52103 - DNA, 25 bp, Mus musculus
tagtctcctgagacaagatctagga

SEQ ID NO: 52104 - DNA, 25 bp, Mus musculus
tagtctgaagactctgtgcaagctg

SEQ ID NO: 52105 - DNA, 25 bp, Mus musculus
tagtctgctccgagacagctacggg

SEQ ID NO: 52106 - DNA, 25 bp, Mus musculus
tagtctggaagccagtaacccggcg

SEQ ID NO: 52107 - DNA, 25 bp, Mus musculus
tagtctgggacaaggtcaccggaga

SEQ ID NO: 52108 - DNA, 25 bp, Mus musculus
tagtctgggtcggtgtcattcgcta

SEQ ID NO: 52109 - DNA, 25 bp, Mus musculus
tagtcttccgtgtgtcatcagccaa

SEQ ID NO: 52110 - DNA, 25 bp, Mus musculus
tagtctttgactacgagggcagcgg

SEQ ID NO: 52111 - DNA, 25 bp, Mus musculus
tagtctttgacttcgagggcagcgg

SEQ ID NO: 52112 - DNA, 25 bp, Mus musculus
tagtgaaagaagaatcgaaaggctg

SEQ ID NO: 52113 - DNA, 25 bp, Mus musculus
tagtgaacaccatgaaggcaagtgg

SEQ ID NO: 52114 - DNA, 25 bp, Mus musculus
tagtgaacgctcttcaagctcacaa

SEQ ID NO: 52115 - DNA, 25 bp, Mus musculus
tagtgaagaagtcctcctctcctct

SEQ ID NO: 52116 - DNA, 25 bp, Mus musculus
tagtgaagctaagaaactactggga

SEQ ID NO: 52117 - DNA, 25 bp, Mus musculus
tagtgaatgctttccagagtggaag

SEQ ID NO: 52118 - DNA, 25 bp, Mus musculus
tagtgacaatgccagagcagatgca

SEQ ID NO: 52119 - DNA, 25 bp, Mus musculus
tagtgacaatgcgagagcagatgca

SEQ ID NO: 52120 - DNA, 25 bp, Mus musculus
tagtgacactgaaggcgagaaacct

SEQ ID NO: 52121 - DNA, 25 bp, Mus musculus
tagtgacagcgaagacagagtcggt

SEQ ID NO: 52122 - DNA, 25 bp, Mus musculus
tagtgaccaccgtggactgatcgga

SEQ ID NO: 52123 - DNA, 25 bp, Mus musculus
tagtgacccagctgaagtactcatc

SEQ ID NO: 52124 - DNA, 25 bp, Mus musculus
tagtgaccctcccaatatcacgctg

SEQ ID NO: 52125 - DNA, 25 bp, Mus musculus
tagtgacctcacactgctgatgcag

SEQ ID NO: 52126 - DNA, 25 bp, Mus musculus
tagtgacctcactctccggaatgcc

SEQ ID NO: 52127 - DNA, 25 bp, Mus musculus
tagtgagagtgtggttgaactgccc

SEQ ID NO: 52128 - DNA, 25 bp, Mus musculus
tagtgaggccatcccaatcctgagg

SEQ ID NO: 52129 - DNA, 25 bp, Mus musculus
tagtgagggcctccgttcaaaggcc

SEQ ID NO: 52130 - DNA, 25 bp, Mus musculus
tagtgaggtggagcatgacaccatg

SEQ ID NO: 52131 - DNA, 25 bp, Mus musculus
tagtgagtgcttctccaagccccac

SEQ ID NO: 52132 - DNA, 25 bp, Mus musculus
tagtgagttgaatactgctgaggac

SEQ ID NO: 52133 - DNA, 25 bp, Mus musculus
tagtgataaagatgcctcagtggtg

SEQ ID NO: 52134 - DNA, 25 bp, Mus musculus
tagtgattcaagttcatccacagaa

SEQ ID NO: 52135 - DNA, 25 bp, Mus musculus
tagtgattcctaaagttccctcagc

SEQ ID NO: 52136 - DNA, 25 bp, Mus musculus
tagtgattccttaagcagcaagtgg

SEQ ID NO: 52137 - DNA, 25 bp, Mus musculus
tagtgattcctttagcagcaagtgg

SEQ ID NO: 52138 - DNA, 25 bp, Mus musculus
tagtgcacagagatctaaagctgga

SEQ ID NO: 52139 - DNA, 25 bp, Mus musculus
tagtgcaccgagtcctgaagatcca

SEQ ID NO: 52140 - DNA, 25 bp, Mus musculus
tagtgcactacctaaccaggccctt

SEQ ID NO: 52141 - DNA, 25 bp, Mus musculus
tagtgcactgactagaagtgtgggt

SEQ ID NO: 52142 - DNA, 25 bp, Mus musculus
tagtgcagcttctgggttccgatga

SEQ ID NO: 52143 - DNA, 25 bp, Mus musculus
tagtgcaggagccacactgactgtg

SEQ ID NO: 52144 - DNA, 25 bp, Mus musculus
tagtgccaatcttagtgctgaccag

SEQ ID NO: 52145 - DNA, 25 bp, Mus musculus
tagtgccacaaggagagagtctcta

SEQ ID NO: 52146 - DNA, 25 bp, Mus musculus
tagtgcccagcaaccaagttgttgt

SEQ ID NO: 52147 - DNA, 25 bp, Mus musculus
tagtgcccatcaacctcataaagga

SEQ ID NO: 52148 - DNA, 25 bp, Mus musculus
tagtgccccactggtcaaaaagctg

SEQ ID NO: 52149 - DNA, 25 bp, Mus musculus
tagtgccgctcccttcatttggtga

SEQ ID NO: 52150 - DNA, 25 bp, Mus musculus
tagtgcctccaccactgaaagacaa

SEQ ID NO: 52151 - DNA, 25 bp, Mus musculus
tagtgcctggctacatttgcctgtg

SEQ ID NO: 52152 - DNA, 25 bp, Mus musculus
tagtgcctggcttcatttgcctgtg

SEQ ID NO: 52153 - DNA, 25 bp, Mus musculus
tagtgcgcaacgaacaggtggagat

SEQ ID NO: 52154 - DNA, 25 bp, Mus musculus
tagtgctagccgtagagtggaagaa

SEQ ID NO: 52155 - DNA, 25 bp, Mus musculus
tagtgctcctatatctccagctgcc

SEQ ID NO: 52156 - DNA, 25 bp, Mus musculus
tagtgctgacagcaactggtgcagt

SEQ ID NO: 52157 - DNA, 25 bp, Mus musculus
tagtgctgccctaatcccactggca

SEQ ID NO: 52158 - DNA, 25 bp, Mus musculus
tagtgctggcctccttcctgcttct

SEQ ID NO: 52159 - DNA, 25 bp, Mus musculus
tagtgctggcctctactacacaggg

SEQ ID NO: 52160 - DNA, 25 bp, Mus musculus
tagtgctgtctctgtcgtatttaag

SEQ ID NO: 52161 - DNA, 25 bp, Mus musculus
tagtggaacagaagttgtctggatc

SEQ ID NO: 52162 - DNA, 25 bp, Mus musculus
tagtggaacattaacaagccggtgg

SEQ ID NO: 52163 - DNA, 25 bp, Mus musculus
tagtggaacatttacaagccggtgg

SEQ ID NO: 52164 - DNA, 25 bp, Mus musculus
tagtggacctgcagtttcttcatga

SEQ ID NO: 52165 - DNA, 25 bp, Mus musculus
tagtggacgtgttccgaaagctgcc

SEQ ID NO: 52166 - DNA, 25 bp, Mus musculus
tagtggagaatctgttgactgagaa

SEQ ID NO: 52167 - DNA, 25 bp, Mus musculus
tagtggatgagagagctcccgacaa

SEQ ID NO: 52168 - DNA, 25 bp, Mus musculus
tagtggcatccaggctgcatgaatg

SEQ ID NO: 52169 - DNA, 25 bp, Mus musculus
tagtggcgatgaaggattctttccc

SEQ ID NO: 52170 - DNA, 25 bp, Mus musculus
tagtgggcagggaccttcttcccag

SEQ ID NO: 52171 - DNA, 25 bp, Mus musculus
tagtgggccgtataaatttccattc

SEQ ID NO: 52172 - DNA, 25 bp, Mus musculus
tagtgggcttcaacaagcaagagtt

SEQ ID NO: 52173 - DNA, 25 bp, Mus musculus
tagtgggcttcggtgccctgatgac

SEQ ID NO: 52174 - DNA, 25 bp, Mus musculus
tagtgggctttactgtggtttccct

SEQ ID NO: 52175 - DNA, 25 bp, Mus musculus
tagtgggtgctttcctactcctggc

SEQ ID NO: 52176 - DNA, 25 bp, Mus musculus
tagtggtcttgcaatctgaagcccc

SEQ ID NO: 52177 - DNA, 25 bp, Mus musculus
tagtggtgcactgttcatggattac

SEQ ID NO: 52178 - DNA, 25 bp, Mus musculus
tagtgtagacagaggacctgaggcc

SEQ ID NO: 52179 - DNA, 25 bp, Mus musculus
tagtgtcatggcaccctacttcctg

SEQ ID NO: 52180 - DNA, 25 bp, Mus musculus
tagtgtccgaaatttcattaccaga

SEQ ID NO: 52181 - DNA, 25 bp, Mus musculus
tagtgtctgaaaatcaacaactgca

SEQ ID NO: 52182 - DNA, 25 bp, Mus musculus
tagtgtgatcccttcccagagaaag

SEQ ID NO: 52183 - DNA, 25 bp, Mus musculus
tagtgtgggcacttgtcctccttgc

SEQ ID NO: 52184 - DNA, 25 bp, Mus musculus
tagtgtgggttcattctcaggctgg

SEQ ID NO: 52185 - DNA, 25 bp, Mus musculus
tagtgtgtgtagaaagcgaaatcag

SEQ ID NO: 52186 - DNA, 25 bp, Mus musculus
tagtgttccaagcaccacatcaaca

SEQ ID NO: 52187 - DNA, 25 bp, Mus musculus
tagtgttgccttggaccttgtggag

SEQ ID NO: 52188 - DNA, 25 bp, Mus musculus
tagtgttggagtgcacagtacagtt

SEQ ID NO: 52189 - DNA, 25 bp, Mus musculus
tagtgttgtcatcagcgtctgcaag

SEQ ID NO: 52190 - DNA, 25 bp, Mus musculus
tagttacacgtactccactgctcca

SEQ ID NO: 52191 - DNA, 25 bp, Mus musculus
tagttacacgtagtccactgctcca

SEQ ID NO: 52192 - DNA, 25 bp, Mus musculus
tagttactcctccaacaccagtcat

SEQ ID NO: 52193 - DNA, 25 bp, Mus musculus
tagttatgagtgctaccctagatgc

SEQ ID NO: 52194 - DNA, 25 bp, Mus musculus
tagttatgtctttcattggccatga

SEQ ID NO: 52195 - DNA, 25 bp, Mus musculus
tagttcagccattttgttcagaacg

SEQ ID NO: 52196 - DNA, 25 bp, Mus musculus
tagttccctagaagacctttgccca

SEQ ID NO: 52197 - DNA, 25 bp, Mus musculus
tagttcctaagacttctgcaggcac

SEQ ID NO: 52198 - DNA, 25 bp, Mus musculus
tagttcctatgaatgctggtgccaa

SEQ ID NO: 52199 - DNA, 25 bp, Mus musculus
tagttctacctctgaaagctctgcg

SEQ ID NO: 52200 - DNA, 25 bp, Mus musculus
tagttctagatggtcgagaaagctc

SEQ ID NO: 52201 - DNA, 25 bp, Mus musculus
tagttctatccaagcggtggagccc

SEQ ID NO: 52202 - DNA, 25 bp, Mus musculus
tagttctatccatgcggtggagccc

SEQ ID NO: 52203 - DNA, 25 bp, Mus musculus
tagttctcaccgacctttcagtgcg

SEQ ID NO: 52204 - DNA, 25 bp, Mus musculus
tagttctgaggtgaagacagatcat

SEQ ID NO: 52205 - DNA, 25 bp, Mus musculus
tagttctgctgccagaaacggcctc

SEQ ID NO: 52206 - DNA, 25 bp, Mus musculus
tagttcttgctaacgccatttctga

SEQ ID NO: 52207 - DNA, 25 bp, Mus musculus
tagttgaagtattggtaacaccaag

SEQ ID NO: 52208 - DNA, 25 bp, Mus musculus
tagttgcccaaaagttacctggaga

SEQ ID NO: 52209 - DNA, 25 bp, Mus musculus
tagttgctacgggttcttcaggcgt

SEQ ID NO: 52210 - DNA, 25 bp, Mus musculus
tagttgctcagatgggtccttacag

SEQ ID NO: 52211 - DNA, 25 bp, Mus musculus
tagttggagtggcaagatcccacct

SEQ ID NO: 52212 - DNA, 25 bp, Mus musculus
tagttggccgcaggcgttttcctcg

SEQ ID NO: 52213 - DNA, 25 bp, Mus musculus
tagttgggccaactgaaagccctgc

SEQ ID NO: 52214 - DNA, 25 bp, Mus musculus
tagttgggccaagtgaaagccctgc

SEQ ID NO: 52215 - DNA, 25 bp, Mus musculus
tagttgggctggttggaaatgccac

SEQ ID NO: 52216 - DNA, 25 bp, Mus musculus
tagttgtgacaacactcacaggtat

SEQ ID NO: 52217 - DNA, 25 bp, Mus musculus
tagttgtgaccctgacgctgagaag

SEQ ID NO: 52218 - DNA, 25 bp, Mus musculus
tagttgtgttgatcaggctgctctg

SEQ ID NO: 52219 - DNA, 25 bp, Mus musculus
tagtttactagtccagtatggagtg

SEQ ID NO: 52220 - DNA, 25 bp, Mus musculus
tagtttcacttgatactctccagga

SEQ ID NO: 52221 - DNA, 25 bp, Mus musculus
tagtttccgcaaaacaacgcaacac

SEQ ID NO: 52222 - DNA, 25 bp, Mus musculus
tagtttccgcaatacaacgcaacac

SEQ ID NO: 52223 - DNA, 25 bp, Mus musculus
tagtttggccaaggagcagcgactc

SEQ ID NO: 52224 - DNA, 25 bp, Mus musculus
tagtttggcttacgaaattcacgac

SEQ ID NO: 52225 - DNA, 25 bp, Mus musculus
tagttttagcatggaaattggaggc

SEQ ID NO: 52226 - DNA, 25 bp, Mus musculus
tagttttccgaagatacactgactt

SEQ ID NO: 52227 - DNA, 25 bp, Mus musculus
tagttttggaggaacaactcaacct

SEQ ID NO: 52228 - DNA, 25 bp, Mus musculus
tataaaaaccgaatgtcccaacact

SEQ ID NO: 52229 - DNA, 25 bp, Mus musculus
tataaaaactgaagtgacaaaattg

SEQ ID NO: 52230 - DNA, 25 bp, Mus musculus
tataaaaagatagacgaggagtttg

SEQ ID NO: 52231 - DNA, 25 bp, Mus musculus
tataaaagaatcaccgaagaggcca

SEQ ID NO: 52232 - DNA, 25 bp, Mus musculus
tataaaagaatctccgaagaggcca

SEQ ID NO: 52233 - DNA, 25 bp, Mus musculus
tataaacaagacagggacatcgcac

SEQ ID NO: 52234 - DNA, 25 bp, Mus musculus
tataaacaaggacaacactggctgg

SEQ ID NO: 52235 - DNA, 25 bp, Mus musculus
tataaacagcgcaagccatcaagtg

SEQ ID NO: 52236 - DNA, 25 bp, Mus musculus
tataaagaatctcatggaagacttc

SEQ ID NO: 52237 - DNA, 25 bp, Mus musculus
tataaagacaccagcacagtggacc

SEQ ID NO: 52238 - DNA, 25 bp, Mus musculus
tataaagacacctgcacagtggacc

SEQ ID NO: 52239 - DNA, 25 bp, Mus musculus
tataaagcaccattcattgcagaga

SEQ ID NO: 52240 - DNA, 25 bp, Mus musculus
tataaaggcatatggtgctgggctc

SEQ ID NO: 52241 - DNA, 25 bp, Mus musculus
tataaaggcttcaagcaacgaatcc

SEQ ID NO: 52242 - DNA, 25 bp, Mus musculus
tataaatcggctcacaagggattca

SEQ ID NO: 52243 - DNA, 25 bp, Mus musculus
tataaattcagcattggctcagaga

SEQ ID NO: 52244 - DNA, 25 bp, Mus musculus
tataaccactgtcctgaaattccct

SEQ ID NO: 52245 - DNA, 25 bp, Mus musculus
tataaccagtttgattcccaagagt

SEQ ID NO: 52246 - DNA, 25 bp, Mus musculus
tataacccaagagatcttcctgacc

SEQ ID NO: 52247 - DNA, 25 bp, Mus musculus
tataacccagatctagactccgacc

SEQ ID NO: 52248 - DNA, 25 bp, Mus musculus
tataaccttagctggcctacaactc

SEQ ID NO: 52249 - DNA, 25 bp, Mus musculus
tataacctttatagagtcagatgac

SEQ ID NO: 52250 - DNA, 25 bp, Mus musculus
tataacctttattgagtcagatgac

SEQ ID NO: 52251 - DNA, 25 bp, Mus musculus
tataactaagaatactaggacatgg

SEQ ID NO: 52252 - DNA, 25 bp, Mus musculus
tataactactgtgcccagtttggcg

SEQ ID NO: 52253 - DNA, 25 bp, Mus musculus
tataactctggttgcacgaaatgag

SEQ ID NO: 52254 - DNA, 25 bp, Mus musculus
tataactgtgcccagctaaccttgt

SEQ ID NO: 52255 - DNA, 25 bp, Mus musculus
tataactttgagaaacctgtggtca

SEQ ID NO: 52256 - DNA, 25 bp, Mus musculus
tataagaaagcccacaagaatgccc

SEQ ID NO: 52257 - DNA, 25 bp, Mus musculus
tataagaaccccaagattgccctct

SEQ ID NO: 52258 - DNA, 25 bp, Mus musculus
tataagaatcgtgaacctgtcagac

SEQ ID NO: 52259 - DNA, 25 bp, Mus musculus
tataagagagctagacaatcttcag

SEQ ID NO: 52260 - DNA, 25 bp, Mus musculus
tataagagatcacggattagtcaac

SEQ ID NO: 52261 - DNA, 25 bp, Mus musculus
tataagagccaagatgaagcaccgg

SEQ ID NO: 52262 - DNA, 25 bp, Mus musculus
tataagatcctggaacatggaggag

SEQ ID NO: 52263 - DNA, 25 bp, Mus musculus
tataagcaaaaagggagtgaggcca

SEQ ID NO: 52264 - DNA, 25 bp, Mus musculus
tataagcaactgttcctacagacat

SEQ ID NO: 52265 - DNA, 25 bp, Mus musculus
tataagcagctaaagcacagacctc

SEQ ID NO: 52266 - DNA, 25 bp, Mus musculus
tataagcggaaagtttatgagtgcg

SEQ ID NO: 52267 - DNA, 25 bp, Mus musculus
tataagctggagacttacctgaaga

SEQ ID NO: 52268 - DNA, 25 bp, Mus musculus
tataagcttctgaatgaaagcgggc

SEQ ID NO: 52269 - DNA, 25 bp, Mus musculus
tataaggacatcttcacgcggcacg

SEQ ID NO: 52270 - DNA, 25 bp, Mus musculus
tataagggtgaactagcctcctatg

SEQ ID NO: 52271 - DNA, 25 bp, Mus musculus
tataagtacaatcctccagaccacg

SEQ ID NO: 52272 - DNA, 25 bp, Mus musculus
tataataatccaaaaggactctctc

SEQ ID NO: 52273 - DNA, 25 bp, Mus musculus
tataatatcaagattgcacccctgt

SEQ ID NO: 52274 - DNA, 25 bp, Mus musculus
tataatcaatgtcgctaacaaggga

SEQ ID NO: 52275 - DNA, 25 bp, Mus musculus
tataatcactgcctatctccaactg

SEQ ID NO: 52276 - DNA, 25 bp, Mus musculus
tataatcctgatgaccgttctaatg

SEQ ID NO: 52277 - DNA, 25 bp, Mus musculus
tataatcgggttctggatttaggac

SEQ ID NO: 52278 - DNA, 25 bp, Mus musculus
tataatcttcaagttatggtgggaa

SEQ ID NO: 52279 - DNA, 25 bp, Mus musculus
tataatgaggaaagtcagaagcacg

SEQ ID NO: 52280 - DNA, 25 bp, Mus musculus
tataatgagttcagatcttggaagg

SEQ ID NO: 52281 - DNA, 25 bp, Mus musculus
tataatgctaccatccttgcttctg

SEQ ID NO: 52282 - DNA, 25 bp, Mus musculus
tataatgctaccttccttgcttctg

SEQ ID NO: 52283 - DNA, 25 bp, Mus musculus
tataatggactagctctctctgccc

SEQ ID NO: 52284 - DNA, 25 bp, Mus musculus
tataatgtgacatactggcccctct

SEQ ID NO: 52285 - DNA, 25 bp, Mus musculus
tataatgtgtctgagcaagcctcgc

SEQ ID NO: 52286 - DNA, 25 bp, Mus musculus
tataattcacagtatctcactgctg

SEQ ID NO: 52287 - DNA, 25 bp, Mus musculus
tataattcttctttccaccatggta

SEQ ID NO: 52288 - DNA, 25 bp, Mus musculus
tataattgctcccaagaacccaact

SEQ ID NO: 52289 - DNA, 25 bp, Mus musculus
tatacaaggagctcccattatggtg

SEQ ID NO: 52290 - DNA, 25 bp, Mus musculus
tatacaaggcactgacactgctgga

SEQ ID NO: 52291 - DNA, 25 bp, Mus musculus
tatacaaggcttcagccccaaacca

SEQ ID NO: 52292 - DNA, 25 bp, Mus musculus
tatacaattgcatatgtacgagtgg

SEQ ID NO: 52293 - DNA, 25 bp, Mus musculus
tatacacagagaatgggcatcccac

SEQ ID NO: 52294 - DNA, 25 bp, Mus musculus
tatacacagggagactgggccgcat

SEQ ID NO: 52295 - DNA, 25 bp, Mus musculus
tatacacgaccatgagaatggaact

SEQ ID NO: 52296 - DNA, 25 bp, Mus musculus
tatacactacgtaattctcatcaag

SEQ ID NO: 52297 - DNA, 25 bp, Mus musculus
tatacagcaaaatgaaagagcccgg

SEQ ID NO: 52298 - DNA, 25 bp, Mus musculus
tatacagcggatgaataccaggcca

SEQ ID NO: 52299 - DNA, 25 bp, Mus musculus
tatacagcgttaccactggcgacag

SEQ ID NO: 52300 - DNA, 25 bp, Mus musculus
tatacagctggttgttaccatggtg

SEQ ID NO: 52301 - DNA, 25 bp, Mus musculus
tatacaggcctctgctatgggggtg

SEQ ID NO: 52302 - DNA, 25 bp, Mus musculus
tatacagggatgtgacattggagaa

SEQ ID NO: 52303 - DNA, 25 bp, Mus musculus
tatacatgctgtactcaagagatgg

SEQ ID NO: 52304 - DNA, 25 bp, Mus musculus
tatacatgctgttctcaagagatgg

SEQ ID NO: 52305 - DNA, 25 bp, Mus musculus
tataccaaaacctaggcgaatcctg

SEQ ID NO: 52306 - DNA, 25 bp, Mus musculus
tataccaaagcttctttcaaagcca

SEQ ID NO: 52307 - DNA, 25 bp, Mus musculus
tataccaactgcttcctaagaaagt

SEQ ID NO: 52308 - DNA, 25 bp, Mus musculus
tataccacttgcagagcaagaacgg

SEQ ID NO: 52309 - DNA, 25 bp, Mus musculus
tataccacttgctgagcaagaacgg

SEQ ID NO: 52310 - DNA, 25 bp, Mus musculus
tataccagattcatcagtatgggag

SEQ ID NO: 52311 - DNA, 25 bp, Mus musculus
tataccagcgttataagatcaagat

SEQ ID NO: 52312 - DNA, 25 bp, Mus musculus
tataccaggatttccacaggaggtg

SEQ ID NO: 52313 - DNA, 25 bp, Mus musculus
tataccagggatggaaaaggcctta

SEQ ID NO: 52314 - DNA, 25 bp, Mus musculus
tataccagttggcaaactggtttta

SEQ ID NO: 52315 - DNA, 25 bp, Mus musculus
tataccatctacaggcctgacgagg

SEQ ID NO: 52316 - DNA, 25 bp, Mus musculus
tataccatttgcgtggttttgaaac

SEQ ID NO: 52317 - DNA, 25 bp, Mus musculus
tatacccagcatctggactggcata

SEQ ID NO: 52318 - DNA, 25 bp, Mus musculus
tatacccagtgtcggctggaactgc

SEQ ID NO: 52319 - DNA, 25 bp, Mus musculus
tatacccagtgtgggctggaactgc

SEQ ID NO: 52320 - DNA, 25 bp, Mus musculus
tataccccaatggagtataagggtg

SEQ ID NO: 52321 - DNA, 25 bp, Mus musculus
tataccctgactgtaattgaagaag

SEQ ID NO: 52322 - DNA, 25 bp, Mus musculus
tataccggtgaaggagacaccgtgc

SEQ ID NO: 52323 - DNA, 25 bp, Mus musculus
tataccgtagcaccaacaagtctgg

SEQ ID NO: 52324 - DNA, 25 bp, Mus musculus
tataccgtatgctttttccaagtac

SEQ ID NO: 52325 - DNA, 25 bp, Mus musculus
tatacctactgattctttggtggac

SEQ ID NO: 52326 - DNA, 25 bp, Mus musculus
tatacctaggtgatgtgtcagagag

SEQ ID NO: 52327 - DNA, 25 bp, Mus musculus
tatacctcaacatcgatgactgctg

SEQ ID NO: 52328 - DNA, 25 bp, Mus musculus
tatacctgctcggactctgaggaag

SEQ ID NO: 52329 - DNA, 25 bp, Mus musculus
tatacctggaggatgacgatcccgt

SEQ ID NO: 52330 - DNA, 25 bp, Mus musculus
tatacgcactacatttcttcagccc

SEQ ID NO: 52331 - DNA, 25 bp, Mus musculus
tatacgctgcccagcgtgaagcagc

SEQ ID NO: 52332 - DNA, 25 bp, Mus musculus
tatacgtgggtacaaatgaagcaaa

SEQ ID NO: 52333 - DNA, 25 bp, Mus musculus
tatactcagaacaaagatcttgcca

SEQ ID NO: 52334 - DNA, 25 bp, Mus musculus
tatactcgcattctgccctctgtac

SEQ ID NO: 52335 - DNA, 25 bp, Mus musculus
tatactcgcattgtgccctctgtac

SEQ ID NO: 52336 - DNA, 25 bp, Mus musculus
tatactctatatttgggcaggaagc

SEQ ID NO: 52337 - DNA, 25 bp, Mus musculus
tatactctgagctggagctctcggc

SEQ ID NO: 52338 - DNA, 25 bp, Mus musculus
tatactgaagaacttcaaccccaca

SEQ ID NO: 52339 - DNA, 25 bp, Mus musculus
tatactgatgcaacttggtgtgcac

SEQ ID NO: 52340 - DNA, 25 bp, Mus musculus
tatactgggacaccatttagtctga

SEQ ID NO: 52341 - DNA, 25 bp, Mus musculus
tatactgggacagcatttagtctga

SEQ ID NO: 52342 - DNA, 25 bp, Mus musculus
tatactgtcacagagttccagcctc

SEQ ID NO: 52343 - DNA, 25 bp, Mus musculus
tatacttagaaacaacactttatgc

SEQ ID NO: 52344 - DNA, 25 bp, Mus musculus
tatacttagcaaatgatgtcatcca

SEQ ID NO: 52345 - DNA, 25 bp, Mus musculus
tatacttcccagaccatgatcttcc

SEQ ID NO: 52346 - DNA, 25 bp, Mus musculus
tatacttgaaggctcccatgattct

SEQ ID NO: 52347 - DNA, 25 bp, Mus musculus
tatacttggaatacaaaggaggagg

SEQ ID NO: 52348 - DNA, 25 bp, Mus musculus
tatacttggtatgagagctcgggac

SEQ ID NO: 52349 - DNA, 25 bp, Mus musculus
tatagaaaacggagacgtggttaag

SEQ ID NO: 52350 - DNA, 25 bp, Mus musculus
tatagaaaatcaggacagcatccac

SEQ ID NO: 52351 - DNA, 25 bp, Mus musculus
tatagaaatatacaggcctgcaagg

SEQ ID NO: 52352 - DNA, 25 bp, Mus musculus
tatagaacaccgatgctctctactg

SEQ ID NO: 52353 - DNA, 25 bp, Mus musculus
tatagaacatcattcagtgacaaac

SEQ ID NO: 52354 - DNA, 25 bp, Mus musculus
tatagaaccatccaagcattcctgg

SEQ ID NO: 52355 - DNA, 25 bp, Mus musculus
tatagaattgtttgttaaccggctt

SEQ ID NO: 52356 - DNA, 25 bp, Mus musculus
tatagacaccattttgcccggcagg

SEQ ID NO: 52357 - DNA, 25 bp, Mus musculus
tatagacagaatcagcaccagtgct

SEQ ID NO: 52358 - DNA, 25 bp, Mus musculus
tatagacagcctcacagacatcttg

SEQ ID NO: 52359 - DNA, 25 bp, Mus musculus
tatagacagtcttccattcttacat

SEQ ID NO: 52360 - DNA, 25 bp, Mus musculus
tatagaccagaagcttgagaaaaga

SEQ ID NO: 52361 - DNA, 25 bp, Mus musculus
tatagacctgggtgtgaattccacc

SEQ ID NO: 52362 - DNA, 25 bp, Mus musculus
tatagagaagatttgggcccgagag

SEQ ID NO: 52363 - DNA, 25 bp, Mus musculus
tatagagacggacaccctatcacag

SEQ ID NO: 52364 - DNA, 25 bp, Mus musculus
tatagagatcacatatcgagcgaag

SEQ ID NO: 52365 - DNA, 25 bp, Mus musculus
tatagagcacccgaagacttcgttg

SEQ ID NO: 52366 - DNA, 25 bp, Mus musculus
tatagaggaaagaactaagagcacc

SEQ ID NO: 52367 - DNA, 25 bp, Mus musculus
tatagaggcctcaagagtttccgga

SEQ ID NO: 52368 - DNA, 25 bp, Mus musculus
tatagatgagtgcagcgagtcttct

SEQ ID NO: 52369 - DNA, 25 bp, Mus musculus
tatagatgcctaccataacccagat

SEQ ID NO: 52370 - DNA, 25 bp, Mus musculus
tatagatggtgcagtaatttcagag

SEQ ID NO: 52371 - DNA, 25 bp, Mus musculus
tatagcaaacatgaatgacgtttcg

SEQ ID NO: 52372 - DNA, 25 bp, Mus musculus
tatagcaactgtcatgaagaaagct

SEQ ID NO: 52373 - DNA, 25 bp, Mus musculus
tatagcagaagctaaactcctgcgg

SEQ ID NO: 52374 - DNA, 25 bp, Mus musculus
tatagcccagctttgattaaagatg

SEQ ID NO: 52375 - DNA, 25 bp, Mus musculus
tatagccctgcctatttatctcctc

SEQ ID NO: 52376 - DNA, 25 bp, Mus musculus
tatagcctggaccagtcctgtctgc

SEQ ID NO: 52377 - DNA, 25 bp, Mus musculus
tatagctctcatatggcccagcgaa

SEQ ID NO: 52378 - DNA, 25 bp, Mus musculus
tatagctgctattggacctgagagc

SEQ ID NO: 52379 - DNA, 25 bp, Mus musculus
tatagctgggccatcaggcagtgct

SEQ ID NO: 52380 - DNA, 25 bp, Mus musculus
tatagctgggccttcaggcagtgct

SEQ ID NO: 52381 - DNA, 25 bp, Mus musculus
tataggaattggcagcaggtatcca

SEQ ID NO: 52382 - DNA, 25 bp, Mus musculus
tataggacagagaaaatcaaagtcg

SEQ ID NO: 52383 - DNA, 25 bp, Mus musculus
tataggacagataggtggaaatgtg

SEQ ID NO: 52384 - DNA, 25 bp, Mus musculus
tataggacagattggtggaaatgtg

SEQ ID NO: 52385 - DNA, 25 bp, Mus musculus
tataggactgccaatgaagcctggc

SEQ ID NO: 52386 - DNA, 25 bp, Mus musculus
tataggagatgccacccaagtttat

SEQ ID NO: 52387 - DNA, 25 bp, Mus musculus
tataggcagagtgtcttttggcgct

SEQ ID NO: 52388 - DNA, 25 bp, Mus musculus
tataggccaggcttgtgtcaaactc

SEQ ID NO: 52389 - DNA, 25 bp, Mus musculus
tatagggcaggccaaccagtctgcc

SEQ ID NO: 52390 - DNA, 25 bp, Mus musculus
tataggtgttcatgatcgtgttttc

SEQ ID NO: 52391 - DNA, 25 bp, Mus musculus
tatagtaaaagcagccaagagaccg

SEQ ID NO: 52392 - DNA, 25 bp, Mus musculus
tatagtactgcactttgctgcacag

SEQ ID NO: 52393 - DNA, 25 bp, Mus musculus
tatagtaggaaatgttgcagattcc

SEQ ID NO: 52394 - DNA, 25 bp, Mus musculus
tatagtcattcaaattctggattcc

SEQ ID NO: 52395 - DNA, 25 bp, Mus musculus
tatagtcccgctaagcttcatcttc

SEQ ID NO: 52396 - DNA, 25 bp, Mus musculus
tatagtcgctcttcctccatgtctt

SEQ ID NO: 52397 - DNA, 25 bp, Mus musculus
tatagtgcacagagatctaaagctg

SEQ ID NO: 52398 - DNA, 25 bp, Mus musculus
tatagtgtgtctgtggcccagaagg

SEQ ID NO: 52399 - DNA, 25 bp, Mus musculus
tatagttcaacttttccaagtggtt

SEQ ID NO: 52400 - DNA, 25 bp, Mus musculus
tatagtttggccaaggagcagcgac

SEQ ID NO: 52401 - DNA, 25 bp, Mus musculus
tatataaacaagacagggacatcgc

SEQ ID NO: 52402 - DNA, 25 bp, Mus musculus
tatataaaggatccaaagaaggctc

SEQ ID NO: 52403 - DNA, 25 bp, Mus musculus
tatataacaggcaatctctctgctc

SEQ ID NO: 52404 - DNA, 25 bp, Mus musculus
tatataaccttagctggcctacaac

SEQ ID NO: 52405 - DNA, 25 bp, Mus musculus
tatatactgatgaaccgtgtgtcgc

SEQ ID NO: 52406 - DNA, 25 bp, Mus musculus
tatatagaaccatccaagcattcct

SEQ ID NO: 52407 - DNA, 25 bp, Mus musculus
tatatagcattcttggtttacctgg

SEQ ID NO: 52408 - DNA, 25 bp, Mus musculus
tatatagccccagattcaattcgtg

SEQ ID NO: 52409 - DNA, 25 bp, Mus musculus
tatatagctgaattgctggctcaca

SEQ ID NO: 52410 - DNA, 25 bp, Mus musculus
tatatatgtcaccagctttgggccc

SEQ ID NO: 52411 - DNA, 25 bp, Mus musculus
tatatattatgagccaaactgcagt

SEQ ID NO: 52412 - DNA, 25 bp, Mus musculus
tatatcaatactctgttcccaacag

SEQ ID NO: 52413 - DNA, 25 bp, Mus musculus
tatatcactgggactgtggcctggc

SEQ ID NO: 52414 - DNA, 25 bp, Mus musculus
tatatcaggtactgctgtgatgatc

SEQ ID NO: 52415 - DNA, 25 bp, Mus musculus
tatatccagagcctgatggatttgg

SEQ ID NO: 52416 - DNA, 25 bp, Mus musculus
tatatccagagcgtgatggatttgg

SEQ ID NO: 52417 - DNA, 25 bp, Mus musculus
tatatcccaagtaattacgtcacag

SEQ ID NO: 52418 - DNA, 25 bp, Mus musculus
tatatccggctcactcagtacatcg

SEQ ID NO: 52419 - DNA, 25 bp, Mus musculus
tatatcctgcccagaaagctacatc

SEQ ID NO: 52420 - DNA, 25 bp, Mus musculus
tatatccttgcccacaaagatgcca

SEQ ID NO: 52421 - DNA, 25 bp, Mus musculus
tatatcgatgatgaatggtctgggt

SEQ ID NO: 52422 - DNA, 25 bp, Mus musculus
tatatctaaagctccatcagacgct

SEQ ID NO: 52423 - DNA, 25 bp, Mus musculus
tatatctacatacagttctgggccc

SEQ ID NO: 52424 - DNA, 25 bp, Mus musculus
tatatctcagaagagggacactact

SEQ ID NO: 52425 - DNA, 25 bp, Mus musculus
tatatctgctggatctaatcagaca

SEQ ID NO: 52426 - DNA, 25 bp, Mus musculus
tatatctggtgctgaacggactgcc

SEQ ID NO: 52427 - DNA, 25 bp, Mus musculus
tatatcttcaagatgccacaggagc

SEQ ID NO: 52428 - DNA, 25 bp, Mus musculus
tatatcttcaggatgatctacctag

SEQ ID NO: 52429 - DNA, 25 bp, Mus musculus
tatatgaactctcttctgattggag

SEQ ID NO: 52430 - DNA, 25 bp, Mus musculus
tatatgaactgagtctgtctgcatg

SEQ ID NO: 52431 - DNA, 25 bp, Mus musculus
tatatgagccaatcccacagcaagc

SEQ ID NO: 52432 - DNA, 25 bp, Mus musculus
tatatgaggatattggctcctccag

SEQ ID NO: 52433 - DNA, 25 bp, Mus musculus
tatatgatatgaacatcctttatgc

SEQ ID NO: 52434 - DNA, 25 bp, Mus musculus
tatatgatatgatcatcctttatgc

SEQ ID NO: 52435 - DNA, 25 bp, Mus musculus
tatatgcagatgaccctaagaagta

SEQ ID NO: 52436 - DNA, 25 bp, Mus musculus
tatatgccagtgatattcctaagtc

SEQ ID NO: 52437 - DNA, 25 bp, Mus musculus
tatatgccagtgttattcctaagtc

SEQ ID NO: 52438 - DNA, 25 bp, Mus musculus
tatatgccctggatcctactctacc

SEQ ID NO: 52439 - DNA, 25 bp, Mus musculus
tatatgcctcggagaaccatcagga

SEQ ID NO: 52440 - DNA, 25 bp, Mus musculus
tatatgcctttaatcacacccctca

SEQ ID NO: 52441 - DNA, 25 bp, Mus musculus
tatatgctagtgaagcaataccttc

SEQ ID NO: 52442 - DNA, 25 bp, Mus musculus
tatatgctctaaatagagaaacatc

SEQ ID NO: 52443 - DNA, 25 bp, Mus musculus
tatatggagaatgggaaacagaaga

SEQ ID NO: 52444 - DNA, 25 bp, Mus musculus
tatatggcagaagcttttggtgtgg

SEQ ID NO: 52445 - DNA, 25 bp, Mus musculus
tatatggccgccagctggaaaggaa

SEQ ID NO: 52446 - DNA, 25 bp, Mus musculus
tatatggctgacatgattgccagaa

SEQ ID NO: 52447 - DNA, 25 bp, Mus musculus
tatatgggcatagccaatcagatgc

SEQ ID NO: 52448 - DNA, 25 bp, Mus musculus
tatatggtatttgtcctctgggttc

SEQ ID NO: 52449 - DNA, 25 bp, Mus musculus
tatatggtgcagaagctcggaagga

SEQ ID NO: 52450 - DNA, 25 bp, Mus musculus
tatatgtcaccagctttgggcccgt

SEQ ID NO: 52451 - DNA, 25 bp, Mus musculus
tatatgtccggtacctgtggatgcc

SEQ ID NO: 52452 - DNA, 25 bp, Mus musculus
tatatgtggacaggctcctgggcac

SEQ ID NO: 52453 - DNA, 25 bp, Mus musculus
tatattactacaggactgacatcac

SEQ ID NO: 52454 - DNA, 25 bp, Mus musculus
tatattagcttgacctatgcagatc

SEQ ID NO: 52455 - DNA, 25 bp, Mus musculus
tatattatgtctcccagcgtgggta

SEQ ID NO: 52456 - DNA, 25 bp, Mus musculus
tatattcacaaacctggttcccggg

SEQ ID NO: 52457 - DNA, 25 bp, Mus musculus
tatattcccttcaccatatcaatgg

SEQ ID NO: 52458 - DNA, 25 bp, Mus musculus
tatattctaaatggtatctacacac

SEQ ID NO: 52459 - DNA, 25 bp, Mus musculus
tatattctcgaaatctatgaacgaa

SEQ ID NO: 52460 - DNA, 25 bp, Mus musculus
tatattgttggacggctcctggcct

SEQ ID NO: 52461 - DNA, 25 bp, Mus musculus
tatattgttggagggctcctggcct

SEQ ID NO: 52462 - DNA, 25 bp, Mus musculus
tatatttctagagctgagtctcaga

SEQ ID NO: 52463 - DNA, 25 bp, Mus musculus
tatatttgcttcagagcagaattcc

SEQ ID NO: 52464 - DNA, 25 bp, Mus musculus
tatatttgcttctgagcagaattcc

SEQ ID NO: 52465 - DNA, 25 bp, Mus musculus
tatatttgggcaggaagcccactgt

SEQ ID NO: 52466 - DNA, 25 bp, Mus musculus
tatattttgcacagacagccctgaa

SEQ ID NO: 52467 - DNA, 25 bp, Mus musculus
tatcaaaaaactgctaccacctggc

SEQ ID NO: 52468 - DNA, 25 bp, Mus musculus
tatcaaaaacaccatgtaggaacca

SEQ ID NO: 52469 - DNA, 25 bp, Mus musculus
tatcaaacacgtcccgggtggaggc

SEQ ID NO: 52470 - DNA, 25 bp, Mus musculus
tatcaaactgaatagaaaggaggga

SEQ ID NO: 52471 - DNA, 25 bp, Mus musculus
tatcaaagactacttccatcgtggt

SEQ ID NO: 52472 - DNA, 25 bp, Mus musculus
tatcaaagtgctctgttttgggcag

SEQ ID NO: 52473 - DNA, 25 bp, Mus musculus
tatcaaatgatggtgctcgtagaca

SEQ ID NO: 52474 - DNA, 25 bp, Mus musculus
tatcaacacggtatcttccagtcaa

SEQ ID NO: 52475 - DNA, 25 bp, Mus musculus
tatcaaccaagacatgaaggaggcc

SEQ ID NO: 52476 - DNA, 25 bp, Mus musculus
tatcaaccagcataccgaaacacag

SEQ ID NO: 52477 - DNA, 25 bp, Mus musculus
tatcaactagagataaaaataccag

SEQ ID NO: 52478 - DNA, 25 bp, Mus musculus
tatcaagaatttagcgctgcaccct

SEQ ID NO: 52479 - DNA, 25 bp, Mus musculus
tatcaagaattttgcgctgcaccct

SEQ ID NO: 52480 - DNA, 25 bp, Mus musculus
tatcaagagccagtgtatggcaata

SEQ ID NO: 52481 - DNA, 25 bp, Mus musculus
tatcaagagttaatgaaagtggcta

SEQ ID NO: 52482 - DNA, 25 bp, Mus musculus
tatcaagatacatggatgaagtacg

SEQ ID NO: 52483 - DNA, 25 bp, Mus musculus
tatcaagcccaccatgtcagcagga

SEQ ID NO: 52484 - DNA, 25 bp, Mus musculus
tatcaagcgtggtccgaaatgggaa

SEQ ID NO: 52485 - DNA, 25 bp, Mus musculus
tatcaagctaataggagggaaaagc

SEQ ID NO: 52486 - DNA, 25 bp, Mus musculus
tatcaaggacaccatgtcaggctca

SEQ ID NO: 52487 - DNA, 25 bp, Mus musculus
tatcaagtgagtcccatgcagggcc

SEQ ID NO: 52488 - DNA, 25 bp, Mus musculus
tatcaagtttttaaccaaaggagat

SEQ ID NO: 52489 - DNA, 25 bp, Mus musculus
tatcaataatcagagcccatgaagc

SEQ ID NO: 52490 - DNA, 25 bp, Mus musculus
tatcaatcggatgaggagcctgctt

SEQ ID NO: 52491 - DNA, 25 bp, Mus musculus
tatcaatgacaatgcgccaaaattc

SEQ ID NO: 52492 - DNA, 25 bp, Mus musculus
tatcaatggacaatggccgctcctt

SEQ ID NO: 52493 - DNA, 25 bp, Mus musculus
tatcacaaggcactcagttaccgag

SEQ ID NO: 52494 - DNA, 25 bp, Mus musculus
tatcacaatacgacctcttttcaag

SEQ ID NO: 52495 - DNA, 25 bp, Mus musculus
tatcacaatacgtcctcttttcaag

SEQ ID NO: 52496 - DNA, 25 bp, Mus musculus
tatcacactttagtaggacttgagg

SEQ ID NO: 52497 - DNA, 25 bp, Mus musculus
tatcacagtgtctggaattcagctg

SEQ ID NO: 52498 - DNA, 25 bp, Mus musculus
tatcacatcaatagaaacccaacga

SEQ ID NO: 52499 - DNA, 25 bp, Mus musculus
tatcacatccaacaagaagttcttc

SEQ ID NO: 52500 - DNA, 25 bp, Mus musculus
tatcaccagtattatcagaggccca

SEQ ID NO: 52501 - DNA, 25 bp, Mus musculus
tatcacctgcggctcttcaaggatg

SEQ ID NO: 52502 - DNA, 25 bp, Mus musculus
tatcacctgcgggtcttcaaggatg

SEQ ID NO: 52503 - DNA, 25 bp, Mus musculus
tatcacctttgaagaacttggagct

SEQ ID NO: 52504 - DNA, 25 bp, Mus musculus
tatcacgagcattctcagcaacgta

SEQ ID NO: 52505 - DNA, 25 bp, Mus musculus
tatcacgctaagtgtctgagactga

SEQ ID NO: 52506 - DNA, 25 bp, Mus musculus
tatcacgctcatcagtatgtggcca

SEQ ID NO: 52507 - DNA, 25 bp, Mus musculus
tatcacggagtatcagagcattctg

SEQ ID NO: 52508 - DNA, 25 bp, Mus musculus
tatcacgtatggactaaaggccatg

SEQ ID NO: 52509 - DNA, 25 bp, Mus musculus
tatcacgtatggtctaaaggccatg

SEQ ID NO: 52510 - DNA, 25 bp, Mus musculus
tatcactaaataacatcaagagggt

SEQ ID NO: 52511 - DNA, 25 bp, Mus musculus
tatcactcaggagtgtaatcctcca

SEQ ID NO: 52512 - DNA, 25 bp, Mus musculus
tatcactcagttgcgtgatgcaaag

SEQ ID NO: 52513 - DNA, 25 bp, Mus musculus
tatcactgggactgtggcctggcct

SEQ ID NO: 52514 - DNA, 25 bp, Mus musculus
tatcactgggttgtcaacttctgca

SEQ ID NO: 52515 - DNA, 25 bp, Mus musculus
tatcacttatgccttcatggtgctg

SEQ ID NO: 52516 - DNA, 25 bp, Mus musculus
tatcacttccgtctatgttagcccc

SEQ ID NO: 52517 - DNA, 25 bp, Mus musculus
tatcacttccgtgtatgttagcccc

SEQ ID NO: 52518 - DNA, 25 bp, Mus musculus
tatcacttgagcctggatgtctgcg

SEQ ID NO: 52519 - DNA, 25 bp, Mus musculus
tatcacttgcacagtggaacacgac

SEQ ID NO: 52520 - DNA, 25 bp, Mus musculus
tatcacttgggagtatgagggacca

SEQ ID NO: 52521 - DNA, 25 bp, Mus musculus
tatcacttgtgctgagtacactcat

SEQ ID NO: 52522 - DNA, 25 bp, Mus musculus
tatcagaacatgaacagagccttcc

SEQ ID NO: 52523 - DNA, 25 bp, Mus musculus
tatcagaatctgcattatgcctgca

SEQ ID NO: 52524 - DNA, 25 bp, Mus musculus
tatcagaatgccctatacctaggtg

SEQ ID NO: 52525 - DNA, 25 bp, Mus musculus
tatcagaatgtgctcaggaacactg

SEQ ID NO: 52526 - DNA, 25 bp, Mus musculus
tatcagacaagaaaagccacctccg

SEQ ID NO: 52527 - DNA, 25 bp, Mus musculus
tatcagacaagccaaagctcctgcc

SEQ ID NO: 52528 - DNA, 25 bp, Mus musculus
tatcagagcctcgagtacatagaag

SEQ ID NO: 52529 - DNA, 25 bp, Mus musculus
tatcagatgccacaatgctggcgag

SEQ ID NO: 52530 - DNA, 25 bp, Mus musculus
tatcagatgccagaatgctggcgag

SEQ ID NO: 52531 - DNA, 25 bp, Mus musculus
tatcagcagcatggccgggccctgg

SEQ ID NO: 52532 - DNA, 25 bp, Mus musculus
tatcagcaggaaactggctgctggg

SEQ ID NO: 52533 - DNA, 25 bp, Mus musculus
tatcagcatggctgccccctacatt

SEQ ID NO: 52534 - DNA, 25 bp, Mus musculus
tatcagccaggctgagcccatccag

SEQ ID NO: 52535 - DNA, 25 bp, Mus musculus
tatcagcgcacatgggtagctgtgg

SEQ ID NO: 52536 - DNA, 25 bp, Mus musculus
tatcagcggctggtggagttcatga

SEQ ID NO: 52537 - DNA, 25 bp, Mus musculus
tatcagctgagaacataccctgcca

SEQ ID NO: 52538 - DNA, 25 bp, Mus musculus
tatcagcttgatgaagggtggctcc

SEQ ID NO: 52539 - DNA, 25 bp, Mus musculus
tatcaggaaagcataccgtcttctc

SEQ ID NO: 52540 - DNA, 25 bp, Mus musculus
tatcaggagaacagatcagtggagg

SEQ ID NO: 52541 - DNA, 25 bp, Mus musculus
tatcaggagattacactgactggaa

SEQ ID NO: 52542 - DNA, 25 bp, Mus musculus
tatcaggaggaaggcctatgctccg

SEQ ID NO: 52543 - DNA, 25 bp, Mus musculus
tatcaggcacccagaggagctgtct

SEQ ID NO: 52544 - DNA, 25 bp, Mus musculus
tatcaggccgttcatgatgctggta

SEQ ID NO: 52545 - DNA, 25 bp, Mus musculus
tatcagggccgtggataccgaggaa

SEQ ID NO: 52546 - DNA, 25 bp, Mus musculus
tatcagggctgcagaaaagcagggc

SEQ ID NO: 52547 - DNA, 25 bp, Mus musculus
tatcaggtatgggatacaatctgcc

SEQ ID NO: 52548 - DNA, 25 bp, Mus musculus
tatcagtactttttgcaaattaagc

SEQ ID NO: 52549 - DNA, 25 bp, Mus musculus
tatcagtattacctgcaagtcaaaa

SEQ ID NO: 52550 - DNA, 25 bp, Mus musculus
tatcagtccttaaaagcctcatttc

SEQ ID NO: 52551 - DNA, 25 bp, Mus musculus
tatcagtgacccctgaggagtgtca

SEQ ID NO: 52552 - DNA, 25 bp, Mus musculus
tatcagtgcttcgtgagcttctttg

SEQ ID NO: 52553 - DNA, 25 bp, Mus musculus
tatcagtgggatgttagccgtaatc

SEQ ID NO: 52554 - DNA, 25 bp, Mus musculus
tatcagttccgcaatctggcagaat

SEQ ID NO: 52555 - DNA, 25 bp, Mus musculus
tatcagttctcatttcacacactgg

SEQ ID NO: 52556 - DNA, 25 bp, Mus musculus
tatcagtttcaacagaaggcgcaaa

SEQ ID NO: 52557 - DNA, 25 bp, Mus musculus
tatcatactgcttgtcacggtcggc

SEQ ID NO: 52558 - DNA, 25 bp, Mus musculus
tatcatagcctcttatgtgcatatg

SEQ ID NO: 52559 - DNA, 25 bp, Mus musculus
tatcatcacagtacagtagcccgtc

SEQ ID NO: 52560 - DNA, 25 bp, Mus musculus
tatcatcacagttcagtagcccgtc

SEQ ID NO: 52561 - DNA, 25 bp, Mus musculus
tatcatcagttgactatcagtgcca

SEQ ID NO: 52562 - DNA, 25 bp, Mus musculus
tatcatcatcacttcatcacaagaa

SEQ ID NO: 52563 - DNA, 25 bp, Mus musculus
tatcatccagcagctatatcactgg

SEQ ID NO: 52564 - DNA, 25 bp, Mus musculus
tatcatcggccgcttccgctgcaat

SEQ ID NO: 52565 - DNA, 25 bp, Mus musculus
tatcatcggcttagccgtgacagtg

SEQ ID NO: 52566 - DNA, 25 bp, Mus musculus
tatcatctcagagttacaggatgac

SEQ ID NO: 52567 - DNA, 25 bp, Mus musculus
tatcatctctccctacctgtagtgg

SEQ ID NO: 52568 - DNA, 25 bp, Mus musculus
tatcatctggattacgtggctgtat

SEQ ID NO: 52569 - DNA, 25 bp, Mus musculus
tatcatgagaagtttctccctcctg

SEQ ID NO: 52570 - DNA, 25 bp, Mus musculus
tatcatgccattggatacaaactgg

SEQ ID NO: 52571 - DNA, 25 bp, Mus musculus
tatcatggaaggcaacaggtgtcac

SEQ ID NO: 52572 - DNA, 25 bp, Mus musculus
tatcatgggtaatgccaaagtgaag

SEQ ID NO: 52573 - DNA, 25 bp, Mus musculus
tatcatgtttgtacaggaagaggcc

SEQ ID NO: 52574 - DNA, 25 bp, Mus musculus
tatcattaagatcgtccgctccacc

SEQ ID NO: 52575 - DNA, 25 bp, Mus musculus
tatcattccaggttaaaagagaggc

SEQ ID NO: 52576 - DNA, 25 bp, Mus musculus
tatcattcgaagagccttttattct

SEQ ID NO: 52577 - DNA, 25 bp, Mus musculus
tatcattgacgaattcttacacatc

SEQ ID NO: 52578 - DNA, 25 bp, Mus musculus
tatcattgccgtgactcgaaatccc

SEQ ID NO: 52579 - DNA, 25 bp, Mus musculus
tatcattggaaatgaagcggcagaa

SEQ ID NO: 52580 - DNA, 25 bp, Mus musculus
tatcattgtccttcttaataatggg

SEQ ID NO: 52581 - DNA, 25 bp, Mus musculus
tatcattttgtcagcgctcctaaag

SEQ ID NO: 52582 - DNA, 25 bp, Mus musculus
tatccaaacaaacgcacttactgtc

SEQ ID NO: 52583 - DNA, 25 bp, Mus musculus
tatccaaacaaaggcacttactgtc

SEQ ID NO: 52584 - DNA, 25 bp, Mus musculus
tatccaaacctgaggctggtacccg

SEQ ID NO: 52585 - DNA, 25 bp, Mus musculus
tatccaaacctgtggctggtacccg

SEQ ID NO: 52586 - DNA, 25 bp, Mus musculus
tatccaacatgagagaaatgcgacc

SEQ ID NO: 52587 - DNA, 25 bp, Mus musculus
tatccaaccagtacaacaatgagcc

SEQ ID NO: 52588 - DNA, 25 bp, Mus musculus
tatccaagcaggtcaaaggatgtct

SEQ ID NO: 52589 - DNA, 25 bp, Mus musculus
tatccaagtggagcttcagggatct

SEQ ID NO: 52590 - DNA, 25 bp, Mus musculus
tatccacaggctccttgacctggga

SEQ ID NO: 52591 - DNA, 25 bp, Mus musculus
tatccacagttcaaaaagatgtctg

SEQ ID NO: 52592 - DNA, 25 bp, Mus musculus
tatccacatttcatacctcagcaag

SEQ ID NO: 52593 - DNA, 25 bp, Mus musculus
tatccagaagaaatggccgctctac

SEQ ID NO: 52594 - DNA, 25 bp, Mus musculus
tatccagaataacgaaaaaggttag

SEQ ID NO: 52595 - DNA, 25 bp, Mus musculus
tatccagaataaggaaaaaggttag

SEQ ID NO: 52596 - DNA, 25 bp, Mus musculus
tatccagagatacgtgcagctcaag

SEQ ID NO: 52597 - DNA, 25 bp, Mus musculus
tatccagagtggaaactgttggctc

SEQ ID NO: 52598 - DNA, 25 bp, Mus musculus
tatccagcaccctttgccatgatga

SEQ ID NO: 52599 - DNA, 25 bp, Mus musculus
tatccagcgtccacagtacagatcc

SEQ ID NO: 52600 - DNA, 25 bp, Mus musculus
tatccagctctgtgggcttatccgg

SEQ ID NO: 52601 - DNA, 25 bp, Mus musculus
tatccagctgagctctaagcacacg

SEQ ID NO: 52602 - DNA, 25 bp, Mus musculus
tatccaggcgaggtggacatcaaaa

SEQ ID NO: 52603 - DNA, 25 bp, Mus musculus
tatccaggctaaccccgctctggag

SEQ ID NO: 52604 - DNA, 25 bp, Mus musculus
tatccaggtgattgtgaaagccaga

SEQ ID NO: 52605 - DNA, 25 bp, Mus musculus
tatccagtcaacaaagaataccgca

SEQ ID NO: 52606 - DNA, 25 bp, Mus musculus
tatccagtccttcagtgccatggcg

SEQ ID NO: 52607 - DNA, 25 bp, Mus musculus
tatccataacccagtggacgggatt

SEQ ID NO: 52608 - DNA, 25 bp, Mus musculus
tatccatagccagaagagaaaccca

SEQ ID NO: 52609 - DNA, 25 bp, Mus musculus
tatccatatccgataccgggagcca

SEQ ID NO: 52610 - DNA, 25 bp, Mus musculus
tatccatcccatttggcatggctgc

SEQ ID NO: 52611 - DNA, 25 bp, Mus musculus
tatccatcgagatttggctgccaga

SEQ ID NO: 52612 - DNA, 25 bp, Mus musculus
tatccatcgctgaggcgagcaacac

SEQ ID NO: 52613 - DNA, 25 bp, Mus musculus
tatccatcgctgtggcgagcaacac

SEQ ID NO: 52614 - DNA, 25 bp, Mus musculus
tatccatctagcatgagcgggcaca

SEQ ID NO: 52615 - DNA, 25 bp, Mus musculus
tatccatgacccaagatgactacaa

SEQ ID NO: 52616 - DNA, 25 bp, Mus musculus
tatccatgaggtaaaccccagctct

SEQ ID NO: 52617 - DNA, 25 bp, Mus musculus
tatccatggaatgtgattactttac

SEQ ID NO: 52618 - DNA, 25 bp, Mus musculus
tatccatggctggaatgatatatac

SEQ ID NO: 52619 - DNA, 25 bp, Mus musculus
tatccattgaatacctgttatacac

SEQ ID NO: 52620 - DNA, 25 bp, Mus musculus
tatcccaaactcattctgcagaaca

SEQ ID NO: 52621 - DNA, 25 bp, Mus musculus
tatcccaaagccagctggccttgca

SEQ ID NO: 52622 - DNA, 25 bp, Mus musculus
tatcccaacaaccaatgtgtttgcc

SEQ ID NO: 52623 - DNA, 25 bp, Mus musculus
tatcccaagtaattacgtcacaggg

SEQ ID NO: 52624 - DNA, 25 bp, Mus musculus
tatcccaagtcaaggcctagagtca

SEQ ID NO: 52625 - DNA, 25 bp, Mus musculus
tatcccaagtgtttctccaggtgga

SEQ ID NO: 52626 - DNA, 25 bp, Mus musculus
tatcccaatgaggagaagcagcacg

SEQ ID NO: 52627 - DNA, 25 bp, Mus musculus
tatcccacagccactggagaaaaag

SEQ ID NO: 52628 - DNA, 25 bp, Mus musculus
tatcccactactgctccggaaattg

SEQ ID NO: 52629 - DNA, 25 bp, Mus musculus
tatcccagaatcacctaccaacttt

SEQ ID NO: 52630 - DNA, 25 bp, Mus musculus
tatcccagcatggaccagtcaataa

SEQ ID NO: 52631 - DNA, 25 bp, Mus musculus
tatcccatcaataccctggtgggtg

SEQ ID NO: 52632 - DNA, 25 bp, Mus musculus
tatcccatctgatccccaaaacggt

SEQ ID NO: 52633 - DNA, 25 bp, Mus musculus
tatcccatttttcctctctgcggtg

SEQ ID NO: 52634 - DNA, 25 bp, Mus musculus
tatccccagaccgtttgtagctcag

SEQ ID NO: 52635 - DNA, 25 bp, Mus musculus
tatccccagtacatgtgttggacct

SEQ ID NO: 52636 - DNA, 25 bp, Mus musculus
tatccccgaaaatttgagactgctc

SEQ ID NO: 52637 - DNA, 25 bp, Mus musculus
tatccccgtgtcctggagatgcgat

SEQ ID NO: 52638 - DNA, 25 bp, Mus musculus
tatcccgaaagcctatcagcatagt

SEQ ID NO: 52639 - DNA, 25 bp, Mus musculus
tatcccgccccacttacaatgggag

SEQ ID NO: 52640 - DNA, 25 bp, Mus musculus
tatcccgggacttcagtaccagggc

SEQ ID NO: 52641 - DNA, 25 bp, Mus musculus
tatccctccaagtggatcgcaagac

SEQ ID NO: 52642 - DNA, 25 bp, Mus musculus
tatccctccactgtgatgtactgtc

SEQ ID NO: 52643 - DNA, 25 bp, Mus musculus
tatccctctggacagaatgcaggtc

SEQ ID NO: 52644 - DNA, 25 bp, Mus musculus
tatccctctgtaagtgctgtttggg

SEQ ID NO: 52645 - DNA, 25 bp, Mus musculus
tatccctgagtcaaaacgcatgcgt

SEQ ID NO: 52646 - DNA, 25 bp, Mus musculus
tatccctgcagtcaacccaagaaag

SEQ ID NO: 52647 - DNA, 25 bp, Mus musculus
tatccctgcctctccatttatgcag

SEQ ID NO: 52648 - DNA, 25 bp, Mus musculus
tatccctggcagtcgatgggctggt

SEQ ID NO: 52649 - DNA, 25 bp, Mus musculus
tatcccttgcgtgtgtgtgatcaca

SEQ ID NO: 52650 - DNA, 25 bp, Mus musculus
tatcccttgggatcatatccgtctg

SEQ ID NO: 52651 - DNA, 25 bp, Mus musculus
tatccgaagcagagactccaaagct

SEQ ID NO: 52652 - DNA, 25 bp, Mus musculus
tatccgacaacaacaagacacccag

SEQ ID NO: 52653 - DNA, 25 bp, Mus musculus
tatccgagatactcgctttgggaag

SEQ ID NO: 52654 - DNA, 25 bp, Mus musculus
tatccgagcaactgaaaaagacaag

SEQ ID NO: 52655 - DNA, 25 bp, Mus musculus
tatccgaggagcctcctgcatgtcc

SEQ ID NO: 52656 - DNA, 25 bp, Mus musculus
tatccgagtctgaaagcttcgtctg

SEQ ID NO: 52657 - DNA, 25 bp, Mus musculus
tatccgatttgggaagctggatgct

SEQ ID NO: 52658 - DNA, 25 bp, Mus musculus
tatccgctccattcagcattcgatt

SEQ ID NO: 52659 - DNA, 25 bp, Mus musculus
tatccgctcttttgaagtgctgtga

SEQ ID NO: 52660 - DNA, 25 bp, Mus musculus
tatccgctggaggtgaccaaactta

SEQ ID NO: 52661 - DNA, 25 bp, Mus musculus
tatccgggtattctgactcctggga

SEQ ID NO: 52662 - DNA, 25 bp, Mus musculus
tatccgggtgacctgcatgggttcc

SEQ ID NO: 52663 - DNA, 25 bp, Mus musculus
tatccgtcggactatgacggaggtg

SEQ ID NO: 52664 - DNA, 25 bp, Mus musculus
tatccgtgcattccggagtacgaag

SEQ ID NO: 52665 - DNA, 25 bp, Mus musculus
tatccgtgccagaaccagggtgtct

SEQ ID NO: 52666 - DNA, 25 bp, Mus musculus
tatccgtgccagtaccagggtgtct

SEQ ID NO: 52667 - DNA, 25 bp, Mus musculus
tatcctaacaatgccagatgttcct

SEQ ID NO: 52668 - DNA, 25 bp, Mus musculus
tatcctatcttgtggatgatcccct

SEQ ID NO: 52669 - DNA, 25 bp, Mus musculus
tatcctcaacgaacaggagagcctt

SEQ ID NO: 52670 - DNA, 25 bp, Mus musculus
tatcctcatcaactcagcattccta

SEQ ID NO: 52671 - DNA, 25 bp, Mus musculus
tatcctcccaaggagtttattctaa

SEQ ID NO: 52672 - DNA, 25 bp, Mus musculus
tatcctcttgtttactgttgccggg

SEQ ID NO: 52673 - DNA, 25 bp, Mus musculus
tatcctgaacaaggctacgataggc

SEQ ID NO: 52674 - DNA, 25 bp, Mus musculus
tatcctgacactctatgagctgagc

SEQ ID NO: 52675 - DNA, 25 bp, Mus musculus
tatcctgaggacgtactggtgccga

SEQ ID NO: 52676 - DNA, 25 bp, Mus musculus
tatcctgcccagaaagctacatcag

SEQ ID NO: 52677 - DNA, 25 bp, Mus musculus
tatcctgcccagatactggcagagc

SEQ ID NO: 52678 - DNA, 25 bp, Mus musculus
tatcctgctcggagagccaggtacc

SEQ ID NO: 52679 - DNA, 25 bp, Mus musculus
tatcctgctgaacgccaactgggtt

SEQ ID NO: 52680 - DNA, 25 bp, Mus musculus
tatcctgctgcagtagatactattg

SEQ ID NO: 52681 - DNA, 25 bp, Mus musculus
tatcctgctgttatggttctccttc

SEQ ID NO: 52682 - DNA, 25 bp, Mus musculus
tatcctggaaccagctctataggcc

SEQ ID NO: 52683 - DNA, 25 bp, Mus musculus
tatcctggaactcagcgagatcacc

SEQ ID NO: 52684 - DNA, 25 bp, Mus musculus
tatcctggagattgttgtgtctgtg

SEQ ID NO: 52685 - DNA, 25 bp, Mus musculus
tatcctggccaacggttccctgagg

SEQ ID NO: 52686 - DNA, 25 bp, Mus musculus
tatcctggctggaaacaaatgtgac

SEQ ID NO: 52687 - DNA, 25 bp, Mus musculus
tatcctgtagatatccctggctgtc

SEQ ID NO: 52688 - DNA, 25 bp, Mus musculus
tatcctgtcaatcttctgcgaaacg

SEQ ID NO: 52689 - DNA, 25 bp, Mus musculus
tatcctgtcaatgttctgcgaaacg

SEQ ID NO: 52690 - DNA, 25 bp, Mus musculus
tatcctgtgcgtaggcacggctgcc

SEQ ID NO: 52691 - DNA, 25 bp, Mus musculus
tatcctgtgcgtcctgcttcaatga

SEQ ID NO: 52692 - DNA, 25 bp, Mus musculus
tatcctgtggaaaggtattactcag

SEQ ID NO: 52693 - DNA, 25 bp, Mus musculus
tatcctgtggaatggtattactcag

SEQ ID NO: 52694 - DNA, 25 bp, Mus musculus
tatcctgtttctcaacaagaaggac

SEQ ID NO: 52695 - DNA, 25 bp, Mus musculus
tatccttcaagaacaaacactgagc

SEQ ID NO: 52696 - DNA, 25 bp, Mus musculus
tatccttcaagatcaaacactgagc

SEQ ID NO: 52697 - DNA, 25 bp, Mus musculus
tatccttccccgaggcacaagaggg

SEQ ID NO: 52698 - DNA, 25 bp, Mus musculus
tatccttcgaaatacgatcttgtcc

SEQ ID NO: 52699 - DNA, 25 bp, Mus musculus
tatccttctgtgaatcatcatcctg

SEQ ID NO: 52700 - DNA, 25 bp, Mus musculus
tatccttctgtgtatcatcatcctg

SEQ ID NO: 52701 - DNA, 25 bp, Mus musculus
tatccttgctcatttctggttcccg

SEQ ID NO: 52702 - DNA, 25 bp, Mus musculus
tatcctttggttctttctcttgcca

SEQ ID NO: 52703 - DNA, 25 bp, Mus musculus
tatcctttggttgctgcttggctcc

SEQ ID NO: 52704 - DNA, 25 bp, Mus musculus
tatccttttccggaatggacggaag

SEQ ID NO: 52705 - DNA, 25 bp, Mus musculus
tatcgaaaccgcatcgccatggaat

SEQ ID NO: 52706 - DNA, 25 bp, Mus musculus
tatcgaaaccgcttcgccatggaat

SEQ ID NO: 52707 - DNA, 25 bp, Mus musculus
tatcgaagggtttgtgatccaggag

SEQ ID NO: 52708 - DNA, 25 bp, Mus musculus
tatcgacatgccttgcggctgaagc

SEQ ID NO: 52709 - DNA, 25 bp, Mus musculus
tatcgactatgagatctgcattcac

SEQ ID NO: 52710 - DNA, 25 bp, Mus musculus
tatcgacttgataaacatcgagagc

SEQ ID NO: 52711 - DNA, 25 bp, Mus musculus
tatcgagaggcacatcacggttttc

SEQ ID NO: 52712 - DNA, 25 bp, Mus musculus
tatcgagaggcagatcacggttttc

SEQ ID NO: 52713 - DNA, 25 bp, Mus musculus
tatcgagcataagattgtcatagct

SEQ ID NO: 52714 - DNA, 25 bp, Mus musculus
tatcgagccaaaaaactctccaggt

SEQ ID NO: 52715 - DNA, 25 bp, Mus musculus
tatcgagcttgtcgctgagcattgc

SEQ ID NO: 52716 - DNA, 25 bp, Mus musculus
tatcgagcttgtggctgagcattgc

SEQ ID NO: 52717 - DNA, 25 bp, Mus musculus
tatcgaggaaaagtttcccctgtga

SEQ ID NO: 52718 - DNA, 25 bp, Mus musculus
tatcgagggcagaactgcatgagaa

SEQ ID NO: 52719 - DNA, 25 bp, Mus musculus
tatcgagggcctggagtacaacatg

SEQ ID NO: 52720 - DNA, 25 bp, Mus musculus
tatcgattcctgaactgcgagaagc

SEQ ID NO: 52721 - DNA, 25 bp, Mus musculus
tatcgcagcgactgtcatctatgcc

SEQ ID NO: 52722 - DNA, 25 bp, Mus musculus
tatcgccaaccttggagatagtcgg

SEQ ID NO: 52723 - DNA, 25 bp, Mus musculus
tatcgccaacgctgagccgaaacca

SEQ ID NO: 52724 - DNA, 25 bp, Mus musculus
tatcgccacattgctcagctagctg

SEQ ID NO: 52725 - DNA, 25 bp, Mus musculus
tatcgccagcctccaaacaagttta

SEQ ID NO: 52726 - DNA, 25 bp, Mus musculus
tatcgcccaagcttcgtgtctgaca

SEQ ID NO: 52727 - DNA, 25 bp, Mus musculus
tatcgccggaatcccttctgctttc

SEQ ID NO: 52728 - DNA, 25 bp, Mus musculus
tatcgccggaatgaactcttcctag

SEQ ID NO: 52729 - DNA, 25 bp, Mus musculus
tatcgccttcttatataaccggagt

SEQ ID NO: 52730 - DNA, 25 bp, Mus musculus
tatcgccttcttttataaccggagt

SEQ ID NO: 52731 - DNA, 25 bp, Mus musculus
tatcgccttgggatctttggcttcc

SEQ ID NO: 52732 - DNA, 25 bp, Mus musculus
tatcgcggagctatgggtttcctgc

SEQ ID NO: 52733 - DNA, 25 bp, Mus musculus
tatcgcgttccattggagatgggca

SEQ ID NO: 52734 - DNA, 25 bp, Mus musculus
tatcgcttcacgaccatgatggctc

SEQ ID NO: 52735 - DNA, 25 bp, Mus musculus
tatcgcttgggcctcgaatcatggc

SEQ ID NO: 52736 - DNA, 25 bp, Mus musculus
tatcggaacgtgttggaggctctct

SEQ ID NO: 52737 - DNA, 25 bp, Mus musculus
tatcggaagcagcagaccaagtgga

SEQ ID NO: 52738 - DNA, 25 bp, Mus musculus
tatcggagttgcagtattatctcac

SEQ ID NO: 52739 - DNA, 25 bp, Mus musculus
tatcggatttggatgaaggccctcc

SEQ ID NO: 52740 - DNA, 25 bp, Mus musculus
tatcggcattcttttgacacttaag

SEQ ID NO: 52741 - DNA, 25 bp, Mus musculus
tatcggccttagtccaggcaggttg

SEQ ID NO: 52742 - DNA, 25 bp, Mus musculus
tatcggctgggctgaccatggccct

SEQ ID NO: 52743 - DNA, 25 bp, Mus musculus
tatcggctgtcctgctaatccagcg

SEQ ID NO: 52744 - DNA, 25 bp, Mus musculus
tatcgggaccaggactatcggaccg

SEQ ID NO: 52745 - DNA, 25 bp, Mus musculus
tatcgggatatcctttcactctgca

SEQ ID NO: 52746 - DNA, 25 bp, Mus musculus
tatcgggatattatactcgcactta

SEQ ID NO: 52747 - DNA, 25 bp, Mus musculus
tatcgggcaccagaggtcatcttga

SEQ ID NO: 52748 - DNA, 25 bp, Mus musculus
tatcgggtctgctatagtccttggg

SEQ ID NO: 52749 - DNA, 25 bp, Mus musculus
tatcggtaccgaatggcgtaaagca

SEQ ID NO: 52750 - DNA, 25 bp, Mus musculus
tatcggtgccactgatacccaggct

SEQ ID NO: 52751 - DNA, 25 bp, Mus musculus
tatcggtgctgactctggatgtcct

SEQ ID NO: 52752 - DNA, 25 bp, Mus musculus
tatcggtttaagagctgaaatcagc

SEQ ID NO: 52753 - DNA, 25 bp, Mus musculus
tatcgtctgacaaaggctttgctgc

SEQ ID NO: 52754 - DNA, 25 bp, Mus musculus
tatcgtgaggagaccgagcttggcc

SEQ ID NO: 52755 - DNA, 25 bp, Mus musculus
tatcgtgtgaggtaaaggaccagca

SEQ ID NO: 52756 - DNA, 25 bp, Mus musculus
tatcgttccggatccaggatacctg

SEQ ID NO: 52757 - DNA, 25 bp, Mus musculus
tatcgttcgtccagcatcattacag

SEQ ID NO: 52758 - DNA, 25 bp, Mus musculus
tatcgtttgtctcccagtatggcca

SEQ ID NO: 52759 - DNA, 25 bp, Mus musculus
tatctaaaaccatcactagccttac

SEQ ID NO: 52760 - DNA, 25 bp, Mus musculus
tatctaaagctccatcagacgcttc

SEQ ID NO: 52761 - DNA, 25 bp, Mus musculus
tatctaatgattgccctgaccgtgg

SEQ ID NO: 52762 - DNA, 25 bp, Mus musculus
tatctacaaccccattatctatgtc

SEQ ID NO: 52763 - DNA, 25 bp, Mus musculus
tatctacagcaagcggacccgtttt

SEQ ID NO: 52764 - DNA, 25 bp, Mus musculus
tatctacgggcccacgtcccaggga

SEQ ID NO: 52765 - DNA, 25 bp, Mus musculus
tatctactgctcacggaccgtgcca

SEQ ID NO: 52766 - DNA, 25 bp, Mus musculus
tatctactggactcagctcaacatg

SEQ ID NO: 52767 - DNA, 25 bp, Mus musculus
tatctacttgaacaagagcggcagc

SEQ ID NO: 52768 - DNA, 25 bp, Mus musculus
tatctacttggtccgtggccttaca

SEQ ID NO: 52769 - DNA, 25 bp, Mus musculus
tatctagccacagtgctgaaggctc

SEQ ID NO: 52770 - DNA, 25 bp, Mus musculus
tatctagcctcatcaaactctccaa

SEQ ID NO: 52771 - DNA, 25 bp, Mus musculus
tatctatagaccaaaatttagccac

SEQ ID NO: 52772 - DNA, 25 bp, Mus musculus
tatctatgcgaaaaccaagagaaga

SEQ ID NO: 52773 - DNA, 25 bp, Mus musculus
tatctatgtctttatgaaccggcag

SEQ ID NO: 52774 - DNA, 25 bp, Mus musculus
tatctcaagtctcaactgaactgcc

SEQ ID NO: 52775 - DNA, 25 bp, Mus musculus
tatctcacagacaagttttcgccgc

SEQ ID NO: 52776 - DNA, 25 bp, Mus musculus
tatctcaccaggctcattgctgctg

SEQ ID NO: 52777 - DNA, 25 bp, Mus musculus
tatctcactgctgaaagctgaagaa

SEQ ID NO: 52778 - DNA, 25 bp, Mus musculus
tatctcagaaacttcaaagtgccag

SEQ ID NO: 52779 - DNA, 25 bp, Mus musculus
tatctcagaagagggacactactgg

SEQ ID NO: 52780 - DNA, 25 bp, Mus musculus
tatctcattaacaggatgccaagcc

SEQ ID NO: 52781 - DNA, 25 bp, Mus musculus
tatctccagcaaactgcagacttgc

SEQ ID NO: 52782 - DNA, 25 bp, Mus musculus
tatctccagtacttgtggccagctg

SEQ ID NO: 52783 - DNA, 25 bp, Mus musculus
tatctccagtccattgcacgggtgg

SEQ ID NO: 52784 - DNA, 25 bp, Mus musculus
tatctccagtcctttgcacgggtgg

SEQ ID NO: 52785 - DNA, 25 bp, Mus musculus
tatctccctgtcaaagtaatcccat

SEQ ID NO: 52786 - DNA, 25 bp, Mus musculus
tatctccggaacagggcagttcagg

SEQ ID NO: 52787 - DNA, 25 bp, Mus musculus
tatctcctcaaagctgataggagca

SEQ ID NO: 52788 - DNA, 25 bp, Mus musculus
tatctcctgacaaaataaacctcag

SEQ ID NO: 52789 - DNA, 25 bp, Mus musculus
tatctcctgagattgagctcacatg

SEQ ID NO: 52790 - DNA, 25 bp, Mus musculus
tatctcgtgaaatggaagggctggt

SEQ ID NO: 52791 - DNA, 25 bp, Mus musculus
tatctcgtgatggagctttgtgagg

SEQ ID NO: 52792 - DNA, 25 bp, Mus musculus
tatctctctactctgataatagcca

SEQ ID NO: 52793 - DNA, 25 bp, Mus musculus
tatctctgagcaagtaaaactttcg

SEQ ID NO: 52794 - DNA, 25 bp, Mus musculus
tatctcttcctgctctatttctcta

SEQ ID NO: 52795 - DNA, 25 bp, Mus musculus
tatctcttgggttgttcggacatcg

SEQ ID NO: 52796 - DNA, 25 bp, Mus musculus
tatctcttggtttctctactgcatg

SEQ ID NO: 52797 - DNA, 25 bp, Mus musculus
tatctcttgtcaaggcatttgcacc

SEQ ID NO: 52798 - DNA, 25 bp, Mus musculus
tatctgaagaagtgcactgtgggcc

SEQ ID NO: 52799 - DNA, 25 bp, Mus musculus
tatctgaagacccacgtgggacctg

SEQ ID NO: 52800 - DNA, 25 bp, Mus musculus
tatctgaatcccaaggtgggcagct

SEQ ID NO: 52801 - DNA, 25 bp, Mus musculus
tatctgagcaggctggacctctgtg

SEQ ID NO: 52802 - DNA, 25 bp, Mus musculus
tatctgaggcgggaagctctgtctg

SEQ ID NO: 52803 - DNA, 25 bp, Mus musculus
tatctgaggtcactaaataagcttc

SEQ ID NO: 52804 - DNA, 25 bp, Mus musculus
tatctgagtccatgcacatttgacc

SEQ ID NO: 52805 - DNA, 25 bp, Mus musculus
tatctgagtttgtggttccagaggg

SEQ ID NO: 52806 - DNA, 25 bp, Mus musculus
tatctgatcctgtccaactgtgaga

SEQ ID NO: 52807 - DNA, 25 bp, Mus musculus
tatctgatggtagatcctgcctcca

SEQ ID NO: 52808 - DNA, 25 bp, Mus musculus
tatctgatgtcagaacactgcccaa

SEQ ID NO: 52809 - DNA, 25 bp, Mus musculus
tatctgatgtttccaagtgggagga

SEQ ID NO: 52810 - DNA, 25 bp, Mus musculus
tatctgattgccaccctcaatgagt

SEQ ID NO: 52811 - DNA, 25 bp, Mus musculus
tatctgcaaagagaaagatgtggtt

SEQ ID NO: 52812 - DNA, 25 bp, Mus musculus
tatctgcacaagcactgtggcttcc

SEQ ID NO: 52813 - DNA, 25 bp, Mus musculus
tatctgcacaaggactgtggcttcc

SEQ ID NO: 52814 - DNA, 25 bp, Mus musculus
tatctgcacacttccagagaaggag

SEQ ID NO: 52815 - DNA, 25 bp, Mus musculus
tatctgcaccccatgttgaggcggc

SEQ ID NO: 52816 - DNA, 25 bp, Mus musculus
tatctgcaccccttgttgaggcggc

SEQ ID NO: 52817 - DNA, 25 bp, Mus musculus
tatctgcagaattcaccttcatccc

SEQ ID NO: 52818 - DNA, 25 bp, Mus musculus
tatctgcccagttcatcggaataca

SEQ ID NO: 52819 - DNA, 25 bp, Mus musculus
tatctgcccggctctgatctataag

SEQ ID NO: 52820 - DNA, 25 bp, Mus musculus
tatctgcctgtgagaaaaaccccac

SEQ ID NO: 52821 - DNA, 25 bp, Mus musculus
tatctgctgtagtccttccatgaaa

SEQ ID NO: 52822 - DNA, 25 bp, Mus musculus
tatctggaatcctcgccattctgag

SEQ ID NO: 52823 - DNA, 25 bp, Mus musculus
tatctggactagaacagaaaactta

SEQ ID NO: 52824 - DNA, 25 bp, Mus musculus
tatctggagatagctatttactgca

SEQ ID NO: 52825 - DNA, 25 bp, Mus musculus
tatctggatgactggacagtgctct

SEQ ID NO: 52826 - DNA, 25 bp, Mus musculus
tatctggctcagataaaggctgctc

SEQ ID NO: 52827 - DNA, 25 bp, Mus musculus
tatctggtcgtgtgcagtgcctgca

SEQ ID NO: 52828 - DNA, 25 bp, Mus musculus
tatctggtgtggagtaagtgcactt

SEQ ID NO: 52829 - DNA, 25 bp, Mus musculus
tatctgtcaaaacaacaactcatca

SEQ ID NO: 52830 - DNA, 25 bp, Mus musculus
tatctgtcaaaagaacaactcatca

SEQ ID NO: 52831 - DNA, 25 bp, Mus musculus
tatctgtcagctaaagggccctctt

SEQ ID NO: 52832 - DNA, 25 bp, Mus musculus
tatctgtcatgaactcttgggacat

SEQ ID NO: 52833 - DNA, 25 bp, Mus musculus
tatctgtctaaccaggccagtgccc

SEQ ID NO: 52834 - DNA, 25 bp, Mus musculus
tatctgtctcggacactgggcctag

SEQ ID NO: 52835 - DNA, 25 bp, Mus musculus
tatctgtgcaaccattctctgagga

SEQ ID NO: 52836 - DNA, 25 bp, Mus musculus
tatctgtgcatcctgagaggcaccg

SEQ ID NO: 52837 - DNA, 25 bp, Mus musculus
tatcttaatgctacagccactggcc

SEQ ID NO: 52838 - DNA, 25 bp, Mus musculus
tatcttaatgcttcagccactggcc

SEQ ID NO: 52839 - DNA, 25 bp, Mus musculus
tatcttcaagttccatcccaaagaa

SEQ ID NO: 52840 - DNA, 25 bp, Mus musculus
tatcttcggtaactctgctggaggc

SEQ ID NO: 52841 - DNA, 25 bp, Mus musculus
tatcttctacctgagtgactacatc

SEQ ID NO: 52842 - DNA, 25 bp, Mus musculus
tatcttctcgaaaaaatagatgcag

SEQ ID NO: 52843 - DNA, 25 bp, Mus musculus
tatcttctcgaataaatagatgcag

SEQ ID NO: 52844 - DNA, 25 bp, Mus musculus
tatcttctggcctgggagtgaccag

SEQ ID NO: 52845 - DNA, 25 bp, Mus musculus
tatcttgaagcagcaattcggacag

SEQ ID NO: 52846 - DNA, 25 bp, Mus musculus
tatcttgacaaactcggaaaaatct

SEQ ID NO: 52847 - DNA, 25 bp, Mus musculus
tatcttgacgaatcaaattacgacc

SEQ ID NO: 52848 - DNA, 25 bp, Mus musculus
tatcttgcgccaagacaattcaggg

SEQ ID NO: 52849 - DNA, 25 bp, Mus musculus
tatcttggaaatctctggaaaaacc

SEQ ID NO: 52850 - DNA, 25 bp, Mus musculus
tatcttggaaatgtctggaaaaacc

SEQ ID NO: 52851 - DNA, 25 bp, Mus musculus
tatcttggctaaggcggacacactg

SEQ ID NO: 52852 - DNA, 25 bp, Mus musculus
tatcttgggaaacaaaattgacagg

SEQ ID NO: 52853 - DNA, 25 bp, Mus musculus
tatctttatgaatggaacaatgtcc

SEQ ID NO: 52854 - DNA, 25 bp, Mus musculus
tatctttctacaatgcccgcaccaa

SEQ ID NO: 52855 - DNA, 25 bp, Mus musculus
tatctttctgtgtacctccatagcc

SEQ ID NO: 52856 - DNA, 25 bp, Mus musculus
tatctttgagttaatggagccagct

SEQ ID NO: 52857 - DNA, 25 bp, Mus musculus
tatctttgagtttatggagccagct

SEQ ID NO: 52858 - DNA, 25 bp, Mus musculus
tatctttgggacttaagtgtgactg

SEQ ID NO: 52859 - DNA, 25 bp, Mus musculus
tatgaaaaacagttacaaggaattc

SEQ ID NO: 52860 - DNA, 25 bp, Mus musculus
tatgaaaagatcctgaaggcgctca

SEQ ID NO: 52861 - DNA, 25 bp, Mus musculus
tatgaaaatatcaaccatgttgtgg

SEQ ID NO: 52862 - DNA, 25 bp, Mus musculus
tatgaaactgtgcaagacattttga

SEQ ID NO: 52863 - DNA, 25 bp, Mus musculus
tatgaaactttgttgacaagagagg

SEQ ID NO: 52864 - DNA, 25 bp, Mus musculus
tatgaaagactgctcagcaccatgc

SEQ ID NO: 52865 - DNA, 25 bp, Mus musculus
tatgaaagtgccagtgtgtctagca

SEQ ID NO: 52866 - DNA, 25 bp, Mus musculus
tatgaaatagtcaagcagcctcgcc

SEQ ID NO: 52867 - DNA, 25 bp, Mus musculus
tatgaaatcatccacgtgctggcag

SEQ ID NO: 52868 - DNA, 25 bp, Mus musculus
tatgaaatcttacgccctctctggt

SEQ ID NO: 52869 - DNA, 25 bp, Mus musculus
tatgaaatttcagtcgatgacggcc

SEQ ID NO: 52870 - DNA, 25 bp, Mus musculus
tatgaaatttcttacattttgtgtg

SEQ ID NO: 52871 - DNA, 25 bp, Mus musculus
tatgaacaagctgacgctacccatc

SEQ ID NO: 52872 - DNA, 25 bp, Mus musculus
tatgaacacagatacaacgcctatc

SEQ ID NO: 52873 - DNA, 25 bp, Mus musculus
tatgaacagacaggtttgtccctcc

SEQ ID NO: 52874 - DNA, 25 bp, Mus musculus
tatgaaccagtttggcccttcagcg

SEQ ID NO: 52875 - DNA, 25 bp, Mus musculus
tatgaacccaactgtagcagcaaga

SEQ ID NO: 52876 - DNA, 25 bp, Mus musculus
tatgaaccccagctccttgcagatg

SEQ ID NO: 52877 - DNA, 25 bp, Mus musculus
tatgaacccttcctctgcatctata

SEQ ID NO: 52878 - DNA, 25 bp, Mus musculus
tatgaacccttcgtctgcatctata

SEQ ID NO: 52879 - DNA, 25 bp, Mus musculus
tatgaacgcacttgaagacacaggc

SEQ ID NO: 52880 - DNA, 25 bp, Mus musculus
tatgaagactgaaaattgtgtggcc

SEQ ID NO: 52881 - DNA, 25 bp, Mus musculus
tatgaagagaaggacaaagccttca

SEQ ID NO: 52882 - DNA, 25 bp, Mus musculus
tatgaagagacagaatgtagtgacg

SEQ ID NO: 52883 - DNA, 25 bp, Mus musculus
tatgaagagagcctgagacccaact

SEQ ID NO: 52884 - DNA, 25 bp, Mus musculus
tatgaagagcgcatgaggatacaga

SEQ ID NO: 52885 - DNA, 25 bp, Mus musculus
tatgaagatggtaccttggatgatg

SEQ ID NO: 52886 - DNA, 25 bp, Mus musculus
tatgaagcagcacaagaagctgacc

SEQ ID NO: 52887 - DNA, 25 bp, Mus musculus
tatgaagcagttcaccaaacaaccc

SEQ ID NO: 52888 - DNA, 25 bp, Mus musculus
tatgaagccaagacacacaaaggtg

SEQ ID NO: 52889 - DNA, 25 bp, Mus musculus
tatgaagccttgtgtaaatccctcg

SEQ ID NO: 52890 - DNA, 25 bp, Mus musculus
tatgaagctgcagcaaccagattaa

SEQ ID NO: 52891 - DNA, 25 bp, Mus musculus
tatgaaggtggtgtagacttgaaca

SEQ ID NO: 52892 - DNA, 25 bp, Mus musculus
tatgaagtcatcaagctcaaaggct

SEQ ID NO: 52893 - DNA, 25 bp, Mus musculus
tatgaagtgactagaaaggactgcg

SEQ ID NO: 52894 - DNA, 25 bp, Mus musculus
tatgaagtgtgttaatcacaaaaat

SEQ ID NO: 52895 - DNA, 25 bp, Mus musculus
tatgaagttgcttcctacctcaaga

SEQ ID NO: 52896 - DNA, 25 bp, Mus musculus
tatgaataagatgaagctgctgaag

SEQ ID NO: 52897 - DNA, 25 bp, Mus musculus
tatgaatacttatggaggtcagccg

SEQ ID NO: 52898 - DNA, 25 bp, Mus musculus
tatgaatcaagccaaggtgtctgtg

SEQ ID NO: 52899 - DNA, 25 bp, Mus musculus
tatgaatccacagaagtgaccctgg

SEQ ID NO: 52900 - DNA, 25 bp, Mus musculus
tatgaatgattgatacagaactgaa

SEQ ID NO: 52901 - DNA, 25 bp, Mus musculus
tatgaatgcaggaatgagaaaatac

SEQ ID NO: 52902 - DNA, 25 bp, Mus musculus
tatgaatgctgctgtcagggctgtg

SEQ ID NO: 52903 - DNA, 25 bp, Mus musculus
tatgaatgtagccagactggtatca

SEQ ID NO: 52904 - DNA, 25 bp, Mus musculus
tatgacaaatacatccggcctgaaa

SEQ ID NO: 52905 - DNA, 25 bp, Mus musculus
tatgacaagtttgtggctcagttgc

SEQ ID NO: 52906 - DNA, 25 bp, Mus musculus
tatgacaatccatccttcaatctgc

SEQ ID NO: 52907 - DNA, 25 bp, Mus musculus
tatgacaatgcaccggggtatggac

SEQ ID NO: 52908 - DNA, 25 bp, Mus musculus
tatgacacaccctatgagccagaag

SEQ ID NO: 52909 - DNA, 25 bp, Mus musculus
tatgacacagtgagcagaattcgct

SEQ ID NO: 52910 - DNA, 25 bp, Mus musculus
tatgacaccagtcagaaacagcagg

SEQ ID NO: 52911 - DNA, 25 bp, Mus musculus
tatgacacctatccggcagacatag

SEQ ID NO: 52912 - DNA, 25 bp, Mus musculus
tatgacacctatgcggcagacatag

SEQ ID NO: 52913 - DNA, 25 bp, Mus musculus
tatgacagctataacaacggaggag

SEQ ID NO: 52914 - DNA, 25 bp, Mus musculus
tatgacagtaaaagagtcaatcact

SEQ ID NO: 52915 - DNA, 25 bp, Mus musculus
tatgacagtagcaccagtgccaacg

SEQ ID NO: 52916 - DNA, 25 bp, Mus musculus
tatgacatccatcggctggagaaga

SEQ ID NO: 52917 - DNA, 25 bp, Mus musculus
tatgacatcgccaaccaggagtcct

SEQ ID NO: 52918 - DNA, 25 bp, Mus musculus
tatgacatggaaagcacagacagtg

SEQ ID NO: 52919 - DNA, 25 bp, Mus musculus
tatgaccaatcctttctaccgagag

SEQ ID NO: 52920 - DNA, 25 bp, Mus musculus
tatgaccacacggtgcgcttttggc

SEQ ID NO: 52921 - DNA, 25 bp, Mus musculus
tatgaccacaggctactgctacgat

SEQ ID NO: 52922 - DNA, 25 bp, Mus musculus
tatgaccacagggtactgctacgat

SEQ ID NO: 52923 - DNA, 25 bp, Mus musculus
tatgaccatcctgtgtcgctgtgag

SEQ ID NO: 52924 - DNA, 25 bp, Mus musculus
tatgacccggtaagaaaggactctg

SEQ ID NO: 52925 - DNA, 25 bp, Mus musculus
tatgacccggtatgaaaggactctg

SEQ ID NO: 52926 - DNA, 25 bp, Mus musculus
tatgaccctgacgaacgaattgcgg

SEQ ID NO: 52927 - DNA, 25 bp, Mus musculus
tatgaccgcggcttctgtaagcatg

SEQ ID NO: 52928 - DNA, 25 bp, Mus musculus
tatgaccggtataaaatggtggtgc

SEQ ID NO: 52929 - DNA, 25 bp, Mus musculus
tatgacctcattgggcagactgtat

SEQ ID NO: 52930 - DNA, 25 bp, Mus musculus
tatgacctgaaggaccagattcatg

SEQ ID NO: 52931 - DNA, 25 bp, Mus musculus
tatgacctgccatattcagtaagaa

SEQ ID NO: 52932 - DNA, 25 bp, Mus musculus
tatgacctgcgtgtcgatgctatcc

SEQ ID NO: 52933 - DNA, 25 bp, Mus musculus
tatgacctggacctgtcttcagatc

SEQ ID NO: 52934 - DNA, 25 bp, Mus musculus
tatgacctggacgactcttgggaga

SEQ ID NO: 52935 - DNA, 25 bp, Mus musculus
tatgaccttcatgaagtatgtggat

SEQ ID NO: 52936 - DNA, 25 bp, Mus musculus
tatgacgcccatgttttcagccagc

SEQ ID NO: 52937 - DNA, 25 bp, Mus musculus
tatgacggagactattgtggatccc

SEQ ID NO: 52938 - DNA, 25 bp, Mus musculus
tatgacggccagtattatggatatc

SEQ ID NO: 52939 - DNA, 25 bp, Mus musculus
tatgacgggcgtttcaaggacatct

SEQ ID NO: 52940 - DNA, 25 bp, Mus musculus
tatgacggtgccagcctcaccatgc

SEQ ID NO: 52941 - DNA, 25 bp, Mus musculus
tatgacggtttacttccacctcaga

SEQ ID NO: 52942 - DNA, 25 bp, Mus musculus
tatgacgtgttcactcttgccctct

SEQ ID NO: 52943 - DNA, 25 bp, Mus musculus
tatgacgtgtttgtgaatctggcag

SEQ ID NO: 52944 - DNA, 25 bp, Mus musculus
tatgacgtttacgaccaggtggagt

SEQ ID NO: 52945 - DNA, 25 bp, Mus musculus
tatgactaagccaaggaaaaggatg

SEQ ID NO: 52946 - DNA, 25 bp, Mus musculus
tatgactacacacagctgcagggtg

SEQ ID NO: 52947 - DNA, 25 bp, Mus musculus
tatgactacactggttacaacaact

SEQ ID NO: 52948 - DNA, 25 bp, Mus musculus
tatgactacagatacacaaatggcc

SEQ ID NO: 52949 - DNA, 25 bp, Mus musculus
tatgactacctcacctccctgagga

SEQ ID NO: 52950 - DNA, 25 bp, Mus musculus
tatgactatctctgcatagatgact

SEQ ID NO: 52951 - DNA, 25 bp, Mus musculus
tatgactccaggaccacaatatttt

SEQ ID NO: 52952 - DNA, 25 bp, Mus musculus
tatgactccctgcatgtctcctctg

SEQ ID NO: 52953 - DNA, 25 bp, Mus musculus
tatgactgacgtccctgttgaccca

SEQ ID NO: 52954 - DNA, 25 bp, Mus musculus
tatgactgcacttacggtggtggag

SEQ ID NO: 52955 - DNA, 25 bp, Mus musculus
tatgactgcattcaacaagctagtg

SEQ ID NO: 52956 - DNA, 25 bp, Mus musculus
tatgactgccctccacggtagattc

SEQ ID NO: 52957 - DNA, 25 bp, Mus musculus
tatgactgtgaaggactcggcctca

SEQ ID NO: 52958 - DNA, 25 bp, Mus musculus
tatgacttggccatcagtgttgcca

SEQ ID NO: 52959 - DNA, 25 bp, Mus musculus
tatgagaacccagcccgctggagtg

SEQ ID NO: 52960 - DNA, 25 bp, Mus musculus
tatgagaacgtggatgaagactcct

SEQ ID NO: 52961 - DNA, 25 bp, Mus musculus
tatgagaagaaatagagaccggtat

SEQ ID NO: 52962 - DNA, 25 bp, Mus musculus
tatgagaagatcttgaagcttactg

SEQ ID NO: 52963 - DNA, 25 bp, Mus musculus
tatgagaagctcatgcgtgaggaag

SEQ ID NO: 52964 - DNA, 25 bp, Mus musculus
tatgagaatatttagcgtgcctccc

SEQ ID NO: 52965 - DNA, 25 bp, Mus musculus
tatgagacaagaagatgttagtgag

SEQ ID NO: 52966 - DNA, 25 bp, Mus musculus
tatgagaccaacgtggcgaggaacc

SEQ ID NO: 52967 - DNA, 25 bp, Mus musculus
tatgagaccaactgatgtaccagat

SEQ ID NO: 52968 - DNA, 25 bp, Mus musculus
tatgagaccccgacttagagcgttt

SEQ ID NO: 52969 - DNA, 25 bp, Mus musculus
tatgagaccgtgcttggaagaaatg

SEQ ID NO: 52970 - DNA, 25 bp, Mus musculus
tatgagactattctgggcaagacag

SEQ ID NO: 52971 - DNA, 25 bp, Mus musculus
tatgagactattgtgggcaagacag

SEQ ID NO: 52972 - DNA, 25 bp, Mus musculus
tatgagactgataggtagaggctag

SEQ ID NO: 52973 - DNA, 25 bp, Mus musculus
tatgagactgtggaacttgccccgg

SEQ ID NO: 52974 - DNA, 25 bp, Mus musculus
tatgagatagcagtggaggccatct

SEQ ID NO: 52975 - DNA, 25 bp, Mus musculus
tatgagatgcttgctaatcgaactg

SEQ ID NO: 52976 - DNA, 25 bp, Mus musculus
tatgagattcttttcccgggctgtg

SEQ ID NO: 52977 - DNA, 25 bp, Mus musculus
tatgagcacatctacctggtgagga

SEQ ID NO: 52978 - DNA, 25 bp, Mus musculus
tatgagcagcagctgagcgcacaca

SEQ ID NO: 52979 - DNA, 25 bp, Mus musculus
tatgagcagcaggtgttgtttgaca

SEQ ID NO: 52980 - DNA, 25 bp, Mus musculus
tatgagcagctgctgaatgtcaagg

SEQ ID NO: 52981 - DNA, 25 bp, Mus musculus
tatgagccaaactgcagtagctctg

SEQ ID NO: 52982 - DNA, 25 bp, Mus musculus
tatgagcccttgctattggagatcc

SEQ ID NO: 52983 - DNA, 25 bp, Mus musculus
tatgagccgaggagactacaaggcc

SEQ ID NO: 52984 - DNA, 25 bp, Mus musculus
tatgagcctcaagacagagatgatc

SEQ ID NO: 52985 - DNA, 25 bp, Mus musculus
tatgagcctcccaggagatcagcct

SEQ ID NO: 52986 - DNA, 25 bp, Mus musculus
tatgagctgacaagcaaggctgggc

SEQ ID NO: 52987 - DNA, 25 bp, Mus musculus
tatgagctggcattacaaactggaa

SEQ ID NO: 52988 - DNA, 25 bp, Mus musculus
tatgagctggctgctgggttacatg

SEQ ID NO: 52989 - DNA, 25 bp, Mus musculus
tatgagctgtggaacgagacctcag

SEQ ID NO: 52990 - DNA, 25 bp, Mus musculus
tatgaggaaattccccagaaggaat

SEQ ID NO: 52991 - DNA, 25 bp, Mus musculus
tatgaggaaattgcccagaaggaat

SEQ ID NO: 52992 - DNA, 25 bp, Mus musculus
tatgaggagacaatcgtcaccaaga

SEQ ID NO: 52993 - DNA, 25 bp, Mus musculus
tatgaggagagagcacggtacctgc

SEQ ID NO: 52994 - DNA, 25 bp, Mus musculus
tatgaggagctcctggacaaccgaa

SEQ ID NO: 52995 - DNA, 25 bp, Mus musculus
tatgaggccaaagccaaatgcaccc

SEQ ID NO: 52996 - DNA, 25 bp, Mus musculus
tatgagggtgtccttcagtgcagca

SEQ ID NO: 52997 - DNA, 25 bp, Mus musculus
tatgaggtagacgacattgatgaag

SEQ ID NO: 52998 - DNA, 25 bp, Mus musculus
tatgagtatgaaggcgggcatatca

SEQ ID NO: 52999 - DNA, 25 bp, Mus musculus
tatgagtatgttttagaagactgca

SEQ ID NO: 53000 - DNA, 25 bp, Mus musculus
tatgagtcagaatcagaggaaatgg

SEQ ID NO: 53001 - DNA, 25 bp, Mus musculus
tatgagtcgccagaacagttgagtg

SEQ ID NO: 53002 - DNA, 25 bp, Mus musculus
tatgagtctccctgtcctgcaagtc

SEQ ID NO: 53003 - DNA, 25 bp, Mus musculus
tatgagtctcttcaaaccgccaaaa

SEQ ID NO: 53004 - DNA, 25 bp, Mus musculus
tatgagtctgatggctccgtcatgg

SEQ ID NO: 53005 - DNA, 25 bp, Mus musculus
tatgagtgatgacaaaccctttcta

SEQ ID NO: 53006 - DNA, 25 bp, Mus musculus
tatgagtgcgaggtcgtccctgtcg

SEQ ID NO: 53007 - DNA, 25 bp, Mus musculus
tatgagttgaagtctaaagctcggc

SEQ ID NO: 53008 - DNA, 25 bp, Mus musculus
tatgagttgctaaaagtgagcctga

SEQ ID NO: 53009 - DNA, 25 bp, Mus musculus
tatgagtttatcagctctggtctct

SEQ ID NO: 53010 - DNA, 25 bp, Mus musculus
tatgagtttcggtatcgcccaagct

SEQ ID NO: 53011 - DNA, 25 bp, Mus musculus
tatgagtttctgaaagttggtggga

SEQ ID NO: 53012 - DNA, 25 bp, Mus musculus
tatgataaaacagagaaaacacgtc

SEQ ID NO: 53013 - DNA, 25 bp, Mus musculus
tatgatcacctgaagaagacacgcg

SEQ ID NO: 53014 - DNA, 25 bp, Mus musculus
tatgatcattaccattgggcaagcc

SEQ ID NO: 53015 - DNA, 25 bp, Mus musculus
tatgatccagcccattctctattct

SEQ ID NO: 53016 - DNA, 25 bp, Mus musculus
tatgatccatctctgtgagaagact

SEQ ID NO: 53017 - DNA, 25 bp, Mus musculus
tatgatcctctacggatttacctct

SEQ ID NO: 53018 - DNA, 25 bp, Mus musculus
tatgatcgccttagaaaggccggac

SEQ ID NO: 53019 - DNA, 25 bp, Mus musculus
tatgatgaaccactcccaggttggt

SEQ ID NO: 53020 - DNA, 25 bp, Mus musculus
tatgatgacattccacatctctcag

SEQ ID NO: 53021 - DNA, 25 bp, Mus musculus
tatgatgagccagcccaagatggag

SEQ ID NO: 53022 - DNA, 25 bp, Mus musculus
tatgatgagtttggtttccgtgtgg

SEQ ID NO: 53023 - DNA, 25 bp, Mus musculus
tatgatgcacagtgtacagcgggct

SEQ ID NO: 53024 - DNA, 25 bp, Mus musculus
tatgatgccaagaagaaagcagctc

SEQ ID NO: 53025 - DNA, 25 bp, Mus musculus
tatgatgcgtctcacatgggacatg

SEQ ID NO: 53026 - DNA, 25 bp, Mus musculus
tatgatggactaaaacgtcaaagac

SEQ ID NO: 53027 - DNA, 25 bp, Mus musculus
tatgatgggaaatacaattgaacca

SEQ ID NO: 53028 - DNA, 25 bp, Mus musculus
tatgatggtcaccaaagtttggacc

SEQ ID NO: 53029 - DNA, 25 bp, Mus musculus
tatgatgtactgcaagtcagttggc

SEQ ID NO: 53030 - DNA, 25 bp, Mus musculus
tatgatgtagctaccctgcaggatg

SEQ ID NO: 53031 - DNA, 25 bp, Mus musculus
tatgatgtccagcacttgcagactg

SEQ ID NO: 53032 - DNA, 25 bp, Mus musculus
tatgatgtggcagtggtggacctca

SEQ ID NO: 53033 - DNA, 25 bp, Mus musculus
tatgatgtgtttctggatgtctacc

SEQ ID NO: 53034 - DNA, 25 bp, Mus musculus
tatgatgttgattctaagagtccca

SEQ ID NO: 53035 - DNA, 25 bp, Mus musculus
tatgattactaccaagactacttct

SEQ ID NO: 53036 - DNA, 25 bp, Mus musculus
tatgattactccaagcccatccagg

SEQ ID NO: 53037 - DNA, 25 bp, Mus musculus
tatgattagggccttcaccattacc

SEQ ID NO: 53038 - DNA, 25 bp, Mus musculus
tatgattagggcgttcaccattacc

SEQ ID NO: 53039 - DNA, 25 bp, Mus musculus
tatgattcagacgtatatcccatgc

SEQ ID NO: 53040 - DNA, 25 bp, Mus musculus
tatgattccgtctaatgactgtgaa

SEQ ID NO: 53041 - DNA, 25 bp, Mus musculus
tatgattccttcagataccaaggac

SEQ ID NO: 53042 - DNA, 25 bp, Mus musculus
tatgattctaccatctccagagttc

SEQ ID NO: 53043 - DNA, 25 bp, Mus musculus
tatgattgaacatgcacagaaagag

SEQ ID NO: 53044 - DNA, 25 bp, Mus musculus
tatgattgtttcaggccaaattggg

SEQ ID NO: 53045 - DNA, 25 bp, Mus musculus
tatgatttgccacatctgaggaaca

SEQ ID NO: 53046 - DNA, 25 bp, Mus musculus
tatgcaaacatctgagtctggaatc

SEQ ID NO: 53047 - DNA, 25 bp, Mus musculus
tatgcaaacccaggcaagaacgcgt

SEQ ID NO: 53048 - DNA, 25 bp, Mus musculus
tatgcaaagtaaacagggtgccttg

SEQ ID NO: 53049 - DNA, 25 bp, Mus musculus
tatgcaaccgaggatggacttgtac

SEQ ID NO: 53050 - DNA, 25 bp, Mus musculus
tatgcaagccactgcagcgttagaa

SEQ ID NO: 53051 - DNA, 25 bp, Mus musculus
tatgcaatcacgcatcaaagatgca

SEQ ID NO: 53052 - DNA, 25 bp, Mus musculus
tatgcaatgactagggctcagaggg

SEQ ID NO: 53053 - DNA, 25 bp, Mus musculus
tatgcacacatcctctcagttcctg

SEQ ID NO: 53054 - DNA, 25 bp, Mus musculus
tatgcacacctgtcttcagcctttg

SEQ ID NO: 53055 - DNA, 25 bp, Mus musculus
tatgcacagaattcttgctgcctgc

SEQ ID NO: 53056 - DNA, 25 bp, Mus musculus
tatgcaccagcagcgatgtagggag

SEQ ID NO: 53057 - DNA, 25 bp, Mus musculus
tatgcaccagtgtgtccaggaatgc

SEQ ID NO: 53058 - DNA, 25 bp, Mus musculus
tatgcacctatttggccattatcca

SEQ ID NO: 53059 - DNA, 25 bp, Mus musculus
tatgcacctgaggatataatcgagt

SEQ ID NO: 53060 - DNA, 25 bp, Mus musculus
tatgcacggtctctgggcgcttctt

SEQ ID NO: 53061 - DNA, 25 bp, Mus musculus
tatgcactctgcacattcgctctca

SEQ ID NO: 53062 - DNA, 25 bp, Mus musculus
tatgcactgaccacagaaagtcgag

SEQ ID NO: 53063 - DNA, 25 bp, Mus musculus
tatgcactgacctcagaaagtcgag

SEQ ID NO: 53064 - DNA, 25 bp, Mus musculus
tatgcactgcctcctggaacaacag

SEQ ID NO: 53065 - DNA, 25 bp, Mus musculus
tatgcactggcaggctcttcaaacg

SEQ ID NO: 53066 - DNA, 25 bp, Mus musculus
tatgcacttcatggtggacacacta

SEQ ID NO: 53067 - DNA, 25 bp, Mus musculus
tatgcacttgatgttccaaacacag

SEQ ID NO: 53068 - DNA, 25 bp, Mus musculus
tatgcagaacgcagaaataatcaga

SEQ ID NO: 53069 - DNA, 25 bp, Mus musculus
tatgcagaagtaccagctggtggcc

SEQ ID NO: 53070 - DNA, 25 bp, Mus musculus
tatgcagaatgggacttaagagaca

SEQ ID NO: 53071 - DNA, 25 bp, Mus musculus
tatgcagacacacaagagattaatt

SEQ ID NO: 53072 - DNA, 25 bp, Mus musculus
tatgcagactatcatgacctcatgg

SEQ ID NO: 53073 - DNA, 25 bp, Mus musculus
tatgcagagcctgttcactcaatac

SEQ ID NO: 53074 - DNA, 25 bp, Mus musculus
tatgcagatcgcctggtctcgggaa

SEQ ID NO: 53075 - DNA, 25 bp, Mus musculus
tatgcagatgttgggaataaaacct

SEQ ID NO: 53076 - DNA, 25 bp, Mus musculus
tatgcagattcctcaggaaacactc

SEQ ID NO: 53077 - DNA, 25 bp, Mus musculus
tatgcagctgaccagggaaaacagc

SEQ ID NO: 53078 - DNA, 25 bp, Mus musculus
tatgcaggacaggtgggctttctga

SEQ ID NO: 53079 - DNA, 25 bp, Mus musculus
tatgcaggactgaatatcttctttg

SEQ ID NO: 53080 - DNA, 25 bp, Mus musculus
tatgcaggctccacagatgagaaca

SEQ ID NO: 53081 - DNA, 25 bp, Mus musculus
tatgcagtctgggctgaagctggct

SEQ ID NO: 53082 - DNA, 25 bp, Mus musculus
tatgcagtgatgtccacccagctga

SEQ ID NO: 53083 - DNA, 25 bp, Mus musculus
tatgcagtgtatagtcaagccagcg

SEQ ID NO: 53084 - DNA, 25 bp, Mus musculus
tatgcatctaatcagccagagtgca

SEQ ID NO: 53085 - DNA, 25 bp, Mus musculus
tatgcatgagattatgtacaaactg

SEQ ID NO: 53086 - DNA, 25 bp, Mus musculus
tatgcattgtgtgatgtgagcctca

SEQ ID NO: 53087 - DNA, 25 bp, Mus musculus
tatgccaaagacacgcgctatagca

SEQ ID NO: 53088 - DNA, 25 bp, Mus musculus
tatgccaaagctgccgcaaaactga

SEQ ID NO: 53089 - DNA, 25 bp, Mus musculus
tatgccaaggactttgaccctgcca

SEQ ID NO: 53090 - DNA, 25 bp, Mus musculus
tatgccacaaaaggatccatgccag

SEQ ID NO: 53091 - DNA, 25 bp, Mus musculus
tatgccagacacagggctgcgagtc

SEQ ID NO: 53092 - DNA, 25 bp, Mus musculus
tatgccatgtgctcaggctctggtg

SEQ ID NO: 53093 - DNA, 25 bp, Mus musculus
tatgccattgctaggctcagacacc

SEQ ID NO: 53094 - DNA, 25 bp, Mus musculus
tatgccattgcttggctcagacacc

SEQ ID NO: 53095 - DNA, 25 bp, Mus musculus
tatgcccagaagcaacttatgatgg

SEQ ID NO: 53096 - DNA, 25 bp, Mus musculus
tatgcccatcgctccctggtgcagg

SEQ ID NO: 53097 - DNA, 25 bp, Mus musculus
tatgcccggaaacagaaccgatggg

SEQ ID NO: 53098 - DNA, 25 bp, Mus musculus
tatgcccggcagaaggttgttgtca

SEQ ID NO: 53099 - DNA, 25 bp, Mus musculus
tatgccctcagtgtactgaagctgt

SEQ ID NO: 53100 - DNA, 25 bp, Mus musculus
tatgccctccatcggaacagtgctg

SEQ ID NO: 53101 - DNA, 25 bp, Mus musculus
tatgccctggccctgatgaacaaac

SEQ ID NO: 53102 - DNA, 25 bp, Mus musculus
tatgccgagtggctacaggaattca

SEQ ID NO: 53103 - DNA, 25 bp, Mus musculus
tatgccgccaatggcaggctgtgtc

SEQ ID NO: 53104 - DNA, 25 bp, Mus musculus
tatgccgccttcactaggatattgt

SEQ ID NO: 53105 - DNA, 25 bp, Mus musculus
tatgcctaagcctggtgtgtttaac

SEQ ID NO: 53106 - DNA, 25 bp, Mus musculus
tatgcctacgactggataagtatcc

SEQ ID NO: 53107 - DNA, 25 bp, Mus musculus
tatgcctctcaatgggacggacagc

SEQ ID NO: 53108 - DNA, 25 bp, Mus musculus
tatgcctctctaatgaaaagcgagc

SEQ ID NO: 53109 - DNA, 25 bp, Mus musculus
tatgcctgattccaaaaccaccagc

SEQ ID NO: 53110 - DNA, 25 bp, Mus musculus
tatgcctgccgctttgagtacgatg

SEQ ID NO: 53111 - DNA, 25 bp, Mus musculus
tatgcctgctcaggtggaccaggga

SEQ ID NO: 53112 - DNA, 25 bp, Mus musculus
tatgcctggatttccccacgcaaga

SEQ ID NO: 53113 - DNA, 25 bp, Mus musculus
tatgcctgggtgtggatccattccc

SEQ ID NO: 53114 - DNA, 25 bp, Mus musculus
tatgcctggtactgaaaacctatcc

SEQ ID NO: 53115 - DNA, 25 bp, Mus musculus
tatgcctgtgctcccttgggacact

SEQ ID NO: 53116 - DNA, 25 bp, Mus musculus
tatgcctgtggtatcaaggctgaag

SEQ ID NO: 53117 - DNA, 25 bp, Mus musculus
tatgccttgcagagctcaagttggg

SEQ ID NO: 53118 - DNA, 25 bp, Mus musculus
tatgcctttaatcacacccctcagg

SEQ ID NO: 53119 - DNA, 25 bp, Mus musculus
tatgcctttactgcccggccttggg

SEQ ID NO: 53120 - DNA, 25 bp, Mus musculus
tatgcctttggtagagtgttcctct

SEQ ID NO: 53121 - DNA, 25 bp, Mus musculus
tatgccttttcggtttgggacccag

SEQ ID NO: 53122 - DNA, 25 bp, Mus musculus
tatgcctttttgagcccttctcctg

SEQ ID NO: 53123 - DNA, 25 bp, Mus musculus
tatgcgaccctgaagcaagactgca

SEQ ID NO: 53124 - DNA, 25 bp, Mus musculus
tatgcgcgtgtccttgattacagaa

SEQ ID NO: 53125 - DNA, 25 bp, Mus musculus
tatgcggagttcactcagtttttgt

SEQ ID NO: 53126 - DNA, 25 bp, Mus musculus
tatgcggattttggaccactcaatc

SEQ ID NO: 53127 - DNA, 25 bp, Mus musculus
tatgcggcaacattaagctgtgtga

SEQ ID NO: 53128 - DNA, 25 bp, Mus musculus
tatgcgggagcatgaacgcaaagag

SEQ ID NO: 53129 - DNA, 25 bp, Mus musculus
tatgcgggcgacaacatcatcacag

SEQ ID NO: 53130 - DNA, 25 bp, Mus musculus
tatgcgtggctatgtcatgtgctga

SEQ ID NO: 53131 - DNA, 25 bp, Mus musculus
tatgcgtggtggaccgataagtact

SEQ ID NO: 53132 - DNA, 25 bp, Mus musculus
tatgcgtttgatggttctcagcctc

SEQ ID NO: 53133 - DNA, 25 bp, Mus musculus
tatgctaaaagatactgcaatgcac

SEQ ID NO: 53134 - DNA, 25 bp, Mus musculus
tatgctaaccggtgccactatgttc

SEQ ID NO: 53135 - DNA, 25 bp, Mus musculus
tatgctaatgagtctgaagagtctc

SEQ ID NO: 53136 - DNA, 25 bp, Mus musculus
tatgctacacccctatgctacatgc

SEQ ID NO: 53137 - DNA, 25 bp, Mus musculus
tatgctaccgcgagcacgccagctg

SEQ ID NO: 53138 - DNA, 25 bp, Mus musculus
tatgctaggatctgcaagtaaccag

SEQ ID NO: 53139 - DNA, 25 bp, Mus musculus
tatgctatgcaaactggaatgaaga

SEQ ID NO: 53140 - DNA, 25 bp, Mus musculus
tatgctcactattaccagcagcagg

SEQ ID NO: 53141 - DNA, 25 bp, Mus musculus
tatgctccgagcaggaacggttgag

SEQ ID NO: 53142 - DNA, 25 bp, Mus musculus
tatgctcctctgtcaagaatcggct

SEQ ID NO: 53143 - DNA, 25 bp, Mus musculus
tatgctctacattacgagcgccaca

SEQ ID NO: 53144 - DNA, 25 bp, Mus musculus
tatgctcttggttcccatggactcg

SEQ ID NO: 53145 - DNA, 25 bp, Mus musculus
tatgctgaaccccaattctacaaca

SEQ ID NO: 53146 - DNA, 25 bp, Mus musculus
tatgctgacaacatcctcaagggct

SEQ ID NO: 53147 - DNA, 25 bp, Mus musculus
tatgctgaccatgtccgccaggatt

SEQ ID NO: 53148 - DNA, 25 bp, Mus musculus
tatgctgagcagcaatgactcctgg

SEQ ID NO: 53149 - DNA, 25 bp, Mus musculus
tatgctgagtctgttaggttacctg

SEQ ID NO: 53150 - DNA, 25 bp, Mus musculus
tatgctgatcacaaacagatccctg

SEQ ID NO: 53151 - DNA, 25 bp, Mus musculus
tatgctgattcgaattgctagtcgc

SEQ ID NO: 53152 - DNA, 25 bp, Mus musculus
tatgctgcacctaccttggcgctgt

SEQ ID NO: 53153 - DNA, 25 bp, Mus musculus
tatgctgcagtgcaagtgcccattg

SEQ ID NO: 53154 - DNA, 25 bp, Mus musculus
tatgctgcttgggactccttgcatg

SEQ ID NO: 53155 - DNA, 25 bp, Mus musculus
tatgctggcatcgacctagctgtct

SEQ ID NO: 53156 - DNA, 25 bp, Mus musculus
tatgctgggtttgaaatgcagccca

SEQ ID NO: 53157 - DNA, 25 bp, Mus musculus
tatgctgtacatctctttgtgctgg

SEQ ID NO: 53158 - DNA, 25 bp, Mus musculus
tatgctgtcaaggtcctttaattcc

SEQ ID NO: 53159 - DNA, 25 bp, Mus musculus
tatgctgtcgggtgcaacagcagcc

SEQ ID NO: 53160 - DNA, 25 bp, Mus musculus
tatgctgtctattacagggtgtgtc

SEQ ID NO: 53161 - DNA, 25 bp, Mus musculus
tatgctgtgcagacgctgaaggact

SEQ ID NO: 53162 - DNA, 25 bp, Mus musculus
tatgctgtgctgcttgccttcctgt

SEQ ID NO: 53163 - DNA, 25 bp, Mus musculus
tatgctgtgtctacaaaatggaaga

SEQ ID NO: 53164 - DNA, 25 bp, Mus musculus
tatgctttccttccaagggttagct

SEQ ID NO: 53165 - DNA, 25 bp, Mus musculus
tatggaaaaggacttaagtagattt

SEQ ID NO: 53166 - DNA, 25 bp, Mus musculus
tatggaaaaggagttaagtagattt

SEQ ID NO: 53167 - DNA, 25 bp, Mus musculus
tatggaaacccacaacagtatggac

SEQ ID NO: 53168 - DNA, 25 bp, Mus musculus
tatggaaccattacagaattctgca

SEQ ID NO: 53169 - DNA, 25 bp, Mus musculus
tatggaactgcagcagcccacaagg

SEQ ID NO: 53170 - DNA, 25 bp, Mus musculus
tatggaagatggactttggagccca

SEQ ID NO: 53171 - DNA, 25 bp, Mus musculus
tatggaagttacaccaggtgcagag

SEQ ID NO: 53172 - DNA, 25 bp, Mus musculus
tatggaatactctgggtgtctgcaa

SEQ ID NO: 53173 - DNA, 25 bp, Mus musculus
tatggaatcggtacccgaaccacgg

SEQ ID NO: 53174 - DNA, 25 bp, Mus musculus
tatggacaagtagaatccgtacgat

SEQ ID NO: 53175 - DNA, 25 bp, Mus musculus
tatggacagcaagatacagcccaca

SEQ ID NO: 53176 - DNA, 25 bp, Mus musculus
tatggacattacacatgagggacct

SEQ ID NO: 53177 - DNA, 25 bp, Mus musculus
tatggacattactcatgagggacct

SEQ ID NO: 53178 - DNA, 25 bp, Mus musculus
tatggaccagcccagtagaagacta

SEQ ID NO: 53179 - DNA, 25 bp, Mus musculus
tatggaccatgggatcatccagcat

SEQ ID NO: 53180 - DNA, 25 bp, Mus musculus
tatggacctttccagggaacagcca

SEQ ID NO: 53181 - DNA, 25 bp, Mus musculus
tatggacgtcatatccagcagtacc

SEQ ID NO: 53182 - DNA, 25 bp, Mus musculus
tatggactacagactgatgtgggag

SEQ ID NO: 53183 - DNA, 25 bp, Mus musculus
tatggactacccagtgaggaaaatc

SEQ ID NO: 53184 - DNA, 25 bp, Mus musculus
tatggactattcacggatcattgag

SEQ ID NO: 53185 - DNA, 25 bp, Mus musculus
tatggactctttaccacagcccgct

SEQ ID NO: 53186 - DNA, 25 bp, Mus musculus
tatggactggcatcaggagtagcaa

SEQ ID NO: 53187 - DNA, 25 bp, Mus musculus
tatggacttcattagctgagctccc

SEQ ID NO: 53188 - DNA, 25 bp, Mus musculus
tatggagaaattggtgccacttcca

SEQ ID NO: 53189 - DNA, 25 bp, Mus musculus
tatggagaccaaaggctgaagccca

SEQ ID NO: 53190 - DNA, 25 bp, Mus musculus
tatggagacctaaagcatctaaaga

SEQ ID NO: 53191 - DNA, 25 bp, Mus musculus
tatggagactcagctgttggaagac

SEQ ID NO: 53192 - DNA, 25 bp, Mus musculus
tatggagaggcacccagcccacgtc

SEQ ID NO: 53193 - DNA, 25 bp, Mus musculus
tatggagatccacaaggccacagca

SEQ ID NO: 53194 - DNA, 25 bp, Mus musculus
tatggagcaaaactgattgcacaga

SEQ ID NO: 53195 - DNA, 25 bp, Mus musculus
tatggagcagaacaaagagacctgg

SEQ ID NO: 53196 - DNA, 25 bp, Mus musculus
tatggagcagccgtagctcagaacc

SEQ ID NO: 53197 - DNA, 25 bp, Mus musculus
tatggagccagcactgagctagacg

SEQ ID NO: 53198 - DNA, 25 bp, Mus musculus
tatggagccgaactggatgcagacc

SEQ ID NO: 53199 - DNA, 25 bp, Mus musculus
tatggagggatctttttataccccg

SEQ ID NO: 53200 - DNA, 25 bp, Mus musculus
tatggagtctccaaccaaggaaatt

SEQ ID NO: 53201 - DNA, 25 bp, Mus musculus
tatggatacactcctttgatggaag

SEQ ID NO: 53202 - DNA, 25 bp, Mus musculus
tatggatacctgtgagcgctgtgac

SEQ ID NO: 53203 - DNA, 25 bp, Mus musculus
tatggatactacagccaaattatgg

SEQ ID NO: 53204 - DNA, 25 bp, Mus musculus
tatggatactgacgtcaactgtgtc

SEQ ID NO: 53205 - DNA, 25 bp, Mus musculus
tatggatactgaggtcaactgtgtc

SEQ ID NO: 53206 - DNA, 25 bp, Mus musculus
tatggatcacacaccttcaagttgg

SEQ ID NO: 53207 - DNA, 25 bp, Mus musculus
tatggatcagaacccatactatgga

SEQ ID NO: 53208 - DNA, 25 bp, Mus musculus
tatggatccacggaggctctctgct

SEQ ID NO: 53209 - DNA, 25 bp, Mus musculus
tatggatgaaattgatgagaagacc

SEQ ID NO: 53210 - DNA, 25 bp, Mus musculus
tatggatgaccgcaatctgtaccgt

SEQ ID NO: 53211 - DNA, 25 bp, Mus musculus
tatggatgaccggaatctgtaccgt

SEQ ID NO: 53212 - DNA, 25 bp, Mus musculus
tatggatgagcgtggaggaacaaca

SEQ ID NO: 53213 - DNA, 25 bp, Mus musculus
tatggattgagaacaagttgctttt

SEQ ID NO: 53214 - DNA, 25 bp, Mus musculus
tatggcaacaagacttctgtgcagt

SEQ ID NO: 53215 - DNA, 25 bp, Mus musculus
tatggcaactatggatataacagcc

SEQ ID NO: 53216 - DNA, 25 bp, Mus musculus
tatggcaagctaagcagtgacgagg

SEQ ID NO: 53217 - DNA, 25 bp, Mus musculus
tatggcaaggatgccactaacgtgg

SEQ ID NO: 53218 - DNA, 25 bp, Mus musculus
tatggcacatctcctcatcacctgg

SEQ ID NO: 53219 - DNA, 25 bp, Mus musculus
tatggcaccaaagaacttgaaacag

SEQ ID NO: 53220 - DNA, 25 bp, Mus musculus
tatggcagccaagaagggtttgcct

SEQ ID NO: 53221 - DNA, 25 bp, Mus musculus
tatggcagccactttcaagggaacc

SEQ ID NO: 53222 - DNA, 25 bp, Mus musculus
tatggcaggccaaaggctcctcttc

SEQ ID NO: 53223 - DNA, 25 bp, Mus musculus
tatggcatctggatctgcctggaat

SEQ ID NO: 53224 - DNA, 25 bp, Mus musculus
tatggcatggacaatcacagtggtg

SEQ ID NO: 53225 - DNA, 25 bp, Mus musculus
tatggccaaaattagagatcggagc

SEQ ID NO: 53226 - DNA, 25 bp, Mus musculus
tatggccaagataacaggagcggac

SEQ ID NO: 53227 - DNA, 25 bp, Mus musculus
tatggccagcccacagtggctttca

SEQ ID NO: 53228 - DNA, 25 bp, Mus musculus
tatggcccagcgaatggcaaatgat

SEQ ID NO: 53229 - DNA, 25 bp, Mus musculus
tatggcccatcaactgattcaagga

SEQ ID NO: 53230 - DNA, 25 bp, Mus musculus
tatggccccggcactgttctagtgg

SEQ ID NO: 53231 - DNA, 25 bp, Mus musculus
tatggccgaatatttcttcccttga

SEQ ID NO: 53232 - DNA, 25 bp, Mus musculus
tatggccgagggatagcctatggaa

SEQ ID NO: 53233 - DNA, 25 bp, Mus musculus
tatggccgcatagccctggtatcag

SEQ ID NO: 53234 - DNA, 25 bp, Mus musculus
tatggccgcataggctacatctttg

SEQ ID NO: 53235 - DNA, 25 bp, Mus musculus
tatggcctcttcaggaaacggagag

SEQ ID NO: 53236 - DNA, 25 bp, Mus musculus
tatggcctgatgaagctggttctga

SEQ ID NO: 53237 - DNA, 25 bp, Mus musculus
tatggcctgatgtagctggttctga

SEQ ID NO: 53238 - DNA, 25 bp, Mus musculus
tatggcgaactatgtgagaagctcc

SEQ ID NO: 53239 - DNA, 25 bp, Mus musculus
tatggcgagttctcggagctccagc

SEQ ID NO: 53240 - DNA, 25 bp, Mus musculus
tatggcggctcggtccggacaagca

SEQ ID NO: 53241 - DNA, 25 bp, Mus musculus
tatggcggttctcaggtggctaccc

SEQ ID NO: 53242 - DNA, 25 bp, Mus musculus
tatggctaacgaccccttggaaggc

SEQ ID NO: 53243 - DNA, 25 bp, Mus musculus
tatggctatgcactgggcgacgcca

SEQ ID NO: 53244 - DNA, 25 bp, Mus musculus
tatggctcacagatgtgcccaggga

SEQ ID NO: 53245 - DNA, 25 bp, Mus musculus
tatggctcccatgtacccaatcttt

SEQ ID NO: 53246 - DNA, 25 bp, Mus musculus
tatggctcctgtctttgagcagaag

SEQ ID NO: 53247 - DNA, 25 bp, Mus musculus
tatggctcttcggtttctcctgggc

SEQ ID NO: 53248 - DNA, 25 bp, Mus musculus
tatggctgacatgattgccagaaat

SEQ ID NO: 53249 - DNA, 25 bp, Mus musculus
tatggctgcagcttctattgccaac

SEQ ID NO: 53250 - DNA, 25 bp, Mus musculus
tatggctgtcccattctagatgagg

SEQ ID NO: 53251 - DNA, 25 bp, Mus musculus
tatggctttcccttaccagtaccca

SEQ ID NO: 53252 - DNA, 25 bp, Mus musculus
tatgggaaaagtcaatcgaacagac

SEQ ID NO: 53253 - DNA, 25 bp, Mus musculus
tatgggaaaagtctgttgaacaaag

SEQ ID NO: 53254 - DNA, 25 bp, Mus musculus
tatgggaaatacttcgagctgtgcc

SEQ ID NO: 53255 - DNA, 25 bp, Mus musculus
tatgggaagagctatgcccagcgcc

SEQ ID NO: 53256 - DNA, 25 bp, Mus musculus
tatgggaatggcaaagactatcggg

SEQ ID NO: 53257 - DNA, 25 bp, Mus musculus
tatgggacaaaacccttccctatga

SEQ ID NO: 53258 - DNA, 25 bp, Mus musculus
tatgggacacaatggtgggcaccgt

SEQ ID NO: 53259 - DNA, 25 bp, Mus musculus
tatgggaccatggttttcgtaaggt

SEQ ID NO: 53260 - DNA, 25 bp, Mus musculus
tatgggacggatatctacagcaagc

SEQ ID NO: 53261 - DNA, 25 bp, Mus musculus
tatgggactctggtacaggaaggag

SEQ ID NO: 53262 - DNA, 25 bp, Mus musculus
tatgggagaatcaagattctacaca

SEQ ID NO: 53263 - DNA, 25 bp, Mus musculus
tatgggagactcgtgtgcactgact

SEQ ID NO: 53264 - DNA, 25 bp, Mus musculus
tatgggagccaagctatggattatg

SEQ ID NO: 53265 - DNA, 25 bp, Mus musculus
tatgggatacaatctgccacagtcc

SEQ ID NO: 53266 - DNA, 25 bp, Mus musculus
tatgggatacgttcacagggacctt

SEQ ID NO: 53267 - DNA, 25 bp, Mus musculus
tatgggatcaactatttcgagatca

SEQ ID NO: 53268 - DNA, 25 bp, Mus musculus
tatgggatggccagctcctacggct

SEQ ID NO: 53269 - DNA, 25 bp, Mus musculus
tatgggcagatctcacccactgagc

SEQ ID NO: 53270 - DNA, 25 bp, Mus musculus
tatgggcatagccaatcagatgctc

SEQ ID NO: 53271 - DNA, 25 bp, Mus musculus
tatgggcatctgtccgaggctctac

SEQ ID NO: 53272 - DNA, 25 bp, Mus musculus
tatgggctgctcatagttcttgcta

SEQ ID NO: 53273 - DNA, 25 bp, Mus musculus
tatgggtaccacaggcgctttgcgt

SEQ ID NO: 53274 - DNA, 25 bp, Mus musculus
tatgggtaccactggcgctttgcgt

SEQ ID NO: 53275 - DNA, 25 bp, Mus musculus
tatgggtacccttacatgcccagcg

SEQ ID NO: 53276 - DNA, 25 bp, Mus musculus
tatgggtcatcgctggcttcctgac

SEQ ID NO: 53277 - DNA, 25 bp, Mus musculus
tatgggtccagtacgtatggcacac

SEQ ID NO: 53278 - DNA, 25 bp, Mus musculus
tatgggtgacctagtaagtgtgcct

SEQ ID NO: 53279 - DNA, 25 bp, Mus musculus
tatgggtgaccttgtaagtgtgcct

SEQ ID NO: 53280 - DNA, 25 bp, Mus musculus
tatgggtgcatggatcactcctgta

SEQ ID NO: 53281 - DNA, 25 bp, Mus musculus
tatgggtgctacatgtgtgctttca

SEQ ID NO: 53282 - DNA, 25 bp, Mus musculus
tatgggtttcagtccctcagaatgc

SEQ ID NO: 53283 - DNA, 25 bp, Mus musculus
tatgggtttcatgggcttgcagcgc

SEQ ID NO: 53284 - DNA, 25 bp, Mus musculus
tatggtaaacaaactgcattatctg

SEQ ID NO: 53285 - DNA, 25 bp, Mus musculus
tatggtaaataccagaaccggtcct

SEQ ID NO: 53286 - DNA, 25 bp, Mus musculus
tatggtaaccgagctctctgttttc

SEQ ID NO: 53287 - DNA, 25 bp, Mus musculus
tatggtacactgattctcaaacctg

SEQ ID NO: 53288 - DNA, 25 bp, Mus musculus
tatggtagatggaaaaccagtgaat

SEQ ID NO: 53289 - DNA, 25 bp, Mus musculus
tatggtatttcttagaacttcagag

SEQ ID NO: 53290 - DNA, 25 bp, Mus musculus
tatggtatttgtcctctgggttctt

SEQ ID NO: 53291 - DNA, 25 bp, Mus musculus
tatggtcccagaccaaacatgaata

SEQ ID NO: 53292 - DNA, 25 bp, Mus musculus
tatggtccctcaccattgggccgac

SEQ ID NO: 53293 - DNA, 25 bp, Mus musculus
tatggtctgaaccaagcttccagtg

SEQ ID NO: 53294 - DNA, 25 bp, Mus musculus
tatggtctgaacgaagcttccagtg

SEQ ID NO: 53295 - DNA, 25 bp, Mus musculus
tatggtgacagactatggagctttt

SEQ ID NO: 53296 - DNA, 25 bp, Mus musculus
tatggtgaggactgatggacataca

SEQ ID NO: 53297 - DNA, 25 bp, Mus musculus
tatggtgccgtcaatctcttcagcc

SEQ ID NO: 53298 - DNA, 25 bp, Mus musculus
tatggtgcctggtccccgagtgttg

SEQ ID NO: 53299 - DNA, 25 bp, Mus musculus
tatggtggacctgggcacttagaca

SEQ ID NO: 53300 - DNA, 25 bp, Mus musculus
tatggtggcatcagacactagtgac

SEQ ID NO: 53301 - DNA, 25 bp, Mus musculus
tatggtggcatctgacactagtgac

SEQ ID NO: 53302 - DNA, 25 bp, Mus musculus
tatggtggccactctttggaagagg

SEQ ID NO: 53303 - DNA, 25 bp, Mus musculus
tatggtggccctgatcactgtctgc

SEQ ID NO: 53304 - DNA, 25 bp, Mus musculus
tatggtggcgttccagctgtttgac

SEQ ID NO: 53305 - DNA, 25 bp, Mus musculus
tatggtggtgatcagaactatagtg

SEQ ID NO: 53306 - DNA, 25 bp, Mus musculus
tatggtgtccgaaactggagactcc

SEQ ID NO: 53307 - DNA, 25 bp, Mus musculus
tatggtgtggaagaccaccttagga

SEQ ID NO: 53308 - DNA, 25 bp, Mus musculus
tatggtgttcacaatcctgttatga

SEQ ID NO: 53309 - DNA, 25 bp, Mus musculus
tatggttagcatatacgcactacat

SEQ ID NO: 53310 - DNA, 25 bp, Mus musculus
tatggttctccttcttattgaaaca

SEQ ID NO: 53311 - DNA, 25 bp, Mus musculus
tatggttgctccaacaaaactggaa

SEQ ID NO: 53312 - DNA, 25 bp, Mus musculus
tatggttttacatgctgcgggccgc

SEQ ID NO: 53313 - DNA, 25 bp, Mus musculus
tatgtacaacctcagatgcgctgcg

SEQ ID NO: 53314 - DNA, 25 bp, Mus musculus
tatgtacaacctgagatgcgctgcg

SEQ ID NO: 53315 - DNA, 25 bp, Mus musculus
tatgtacaatgtcacgcacctacca

SEQ ID NO: 53316 - DNA, 25 bp, Mus musculus
tatgtacagatcgactggaagagag

SEQ ID NO: 53317 - DNA, 25 bp, Mus musculus
tatgtacaggtgttcttcactctga

SEQ ID NO: 53318 - DNA, 25 bp, Mus musculus
tatgtacccatgcaaggtgcatcaa

SEQ ID NO: 53319 - DNA, 25 bp, Mus musculus
tatgtacccatggaaggtgcatcaa

SEQ ID NO: 53320 - DNA, 25 bp, Mus musculus
tatgtaccctcaaaggcttccgaag

SEQ ID NO: 53321 - DNA, 25 bp, Mus musculus
tatgtacttaagcatctctctggag

SEQ ID NO: 53322 - DNA, 25 bp, Mus musculus
tatgtataaaatggtcaactctgga

SEQ ID NO: 53323 - DNA, 25 bp, Mus musculus
tatgtatacacttctagacagctgt

SEQ ID NO: 53324 - DNA, 25 bp, Mus musculus
tatgtatggacacaaagaatgatag

SEQ ID NO: 53325 - DNA, 25 bp, Mus musculus
tatgtatggccggagctcccaggcc

SEQ ID NO: 53326 - DNA, 25 bp, Mus musculus
tatgtatgggctctatgagtacctc

SEQ ID NO: 53327 - DNA, 25 bp, Mus musculus
tatgtatgggctgtatgagtacctc

SEQ ID NO: 53328 - DNA, 25 bp, Mus musculus
tatgtcaacaatgagtacccagacc

SEQ ID NO: 53329 - DNA, 25 bp, Mus musculus
tatgtcaatgggactgatcaggaag

SEQ ID NO: 53330 - DNA, 25 bp, Mus musculus
tatgtcacaatcaggaagaaacacc

SEQ ID NO: 53331 - DNA, 25 bp, Mus musculus
tatgtcaccagctttgggcccgttt

SEQ ID NO: 53332 - DNA, 25 bp, Mus musculus
tatgtcactggctggggtcgcctct

SEQ ID NO: 53333 - DNA, 25 bp, Mus musculus
tatgtcagggctggtggcattcttc

SEQ ID NO: 53334 - DNA, 25 bp, Mus musculus
tatgtccatcctggacatctccatg

SEQ ID NO: 53335 - DNA, 25 bp, Mus musculus
tatgtcccatggcatcctggaagga

SEQ ID NO: 53336 - DNA, 25 bp, Mus musculus
tatgtcccatgggatcctggaagga

SEQ ID NO: 53337 - DNA, 25 bp, Mus musculus
tatgtccccaaagagtttaaagctg

SEQ ID NO: 53338 - DNA, 25 bp, Mus musculus
tatgtccccagaattgtgtttgtag

SEQ ID NO: 53339 - DNA, 25 bp, Mus musculus
tatgtcccctcctactttgactttg

SEQ ID NO: 53340 - DNA, 25 bp, Mus musculus
tatgtccctcctccttttgctgctg

SEQ ID NO: 53341 - DNA, 25 bp, Mus musculus
tatgtccggtacctgtggatgccag

SEQ ID NO: 53342 - DNA, 25 bp, Mus musculus
tatgtcctccagaatgcaaagcaga

SEQ ID NO: 53343 - DNA, 25 bp, Mus musculus
tatgtcctccgtttcctggagaagc

SEQ ID NO: 53344 - DNA, 25 bp, Mus musculus
tatgtcctctacatcaatggcggcc

SEQ ID NO: 53345 - DNA, 25 bp, Mus musculus
tatgtccttcgatccggagtgaacc

SEQ ID NO: 53346 - DNA, 25 bp, Mus musculus
tatgtcctttgtgcccacctgggat

SEQ ID NO: 53347 - DNA, 25 bp, Mus musculus
tatgtcgacgacttctatcaagtgc

SEQ ID NO: 53348 - DNA, 25 bp, Mus musculus
tatgtcggagacctttgagacgctg

SEQ ID NO: 53349 - DNA, 25 bp, Mus musculus
tatgtcggctatttgcacaaacgga

SEQ ID NO: 53350 - DNA, 25 bp, Mus musculus
tatgtctacccgctgcttactgtga

SEQ ID NO: 53351 - DNA, 25 bp, Mus musculus
tatgtctcctggtggccctaagttt

SEQ ID NO: 53352 - DNA, 25 bp, Mus musculus
tatgtctctagtgttgagagttccc

SEQ ID NO: 53353 - DNA, 25 bp, Mus musculus
tatgtctctcaacatcatcaccgtc

SEQ ID NO: 53354 - DNA, 25 bp, Mus musculus
tatgtctgaactgtctgggaatgtc

SEQ ID NO: 53355 - DNA, 25 bp, Mus musculus
tatgtctgcctgtgcgatacacgca

SEQ ID NO: 53356 - DNA, 25 bp, Mus musculus
tatgtctggaggagactgtgtgata

SEQ ID NO: 53357 - DNA, 25 bp, Mus musculus
tatgtctggatttggaatgaacagg

SEQ ID NO: 53358 - DNA, 25 bp, Mus musculus
tatgtcttcgtggagttctttgtca

SEQ ID NO: 53359 - DNA, 25 bp, Mus musculus
tatgtgaaaacgtctgagaaacttg

SEQ ID NO: 53360 - DNA, 25 bp, Mus musculus
tatgtgacacagctgatatttggag

SEQ ID NO: 53361 - DNA, 25 bp, Mus musculus
tatgtgacagacatccagaatgaca

SEQ ID NO: 53362 - DNA, 25 bp, Mus musculus
tatgtgacatttcagcagacacggg

SEQ ID NO: 53363 - DNA, 25 bp, Mus musculus
tatgtgatagaatatgcagcatgtg

SEQ ID NO: 53364 - DNA, 25 bp, Mus musculus
tatgtgatctggcaaaaagcaaacc

SEQ ID NO: 53365 - DNA, 25 bp, Mus musculus
tatgtgatctgggaaaaagcaaacc

SEQ ID NO: 53366 - DNA, 25 bp, Mus musculus
tatgtgattttggacgtggtaccgg

SEQ ID NO: 53367 - DNA, 25 bp, Mus musculus
tatgtgcacagaactgagtatccca

SEQ ID NO: 53368 - DNA, 25 bp, Mus musculus
tatgtgcaccgcctcataaagggag

SEQ ID NO: 53369 - DNA, 25 bp, Mus musculus
tatgtgcagaaaacctactctgaag

SEQ ID NO: 53370 - DNA, 25 bp, Mus musculus
tatgtgcaggaagattcgtgtcagc

SEQ ID NO: 53371 - DNA, 25 bp, Mus musculus
tatgtgcaggagtttgtgagaccag

SEQ ID NO: 53372 - DNA, 25 bp, Mus musculus
tatgtgcaggcagtcatgcagcggg

SEQ ID NO: 53373 - DNA, 25 bp, Mus musculus
tatgtgccatggaacctccatgagc

SEQ ID NO: 53374 - DNA, 25 bp, Mus musculus
tatgtgcctgctgatgacctgactg

SEQ ID NO: 53375 - DNA, 25 bp, Mus musculus
tatgtgccttggtgtgttgtgatca

SEQ ID NO: 53376 - DNA, 25 bp, Mus musculus
tatgtgctcttatttggaatcaaca

SEQ ID NO: 53377 - DNA, 25 bp, Mus musculus
tatgtgctcttttacctcgttagga

SEQ ID NO: 53378 - DNA, 25 bp, Mus musculus
tatgtggaaagaaaaaacagtgctc

SEQ ID NO: 53379 - DNA, 25 bp, Mus musculus
tatgtggacaatgcagtgggaactg

SEQ ID NO: 53380 - DNA, 25 bp, Mus musculus
tatgtggaccgtgatggcaaggacc

SEQ ID NO: 53381 - DNA, 25 bp, Mus musculus
tatgtggagacacaagccaaagaga

SEQ ID NO: 53382 - DNA, 25 bp, Mus musculus
tatgtggagccccacgaattaagag

SEQ ID NO: 53383 - DNA, 25 bp, Mus musculus
tatgtggagttttggaataactgcc

SEQ ID NO: 53384 - DNA, 25 bp, Mus musculus
tatgtggatgcggtcaaagacagcg

SEQ ID NO: 53385 - DNA, 25 bp, Mus musculus
tatgtggattccaacctctgttgct

SEQ ID NO: 53386 - DNA, 25 bp, Mus musculus
tatgtggccatatttgctgagtcca

SEQ ID NO: 53387 - DNA, 25 bp, Mus musculus
tatgtggctggaattggtgaaacct

SEQ ID NO: 53388 - DNA, 25 bp, Mus musculus
tatgtgggcaaagagcaggtcgccc

SEQ ID NO: 53389 - DNA, 25 bp, Mus musculus
tatgtgggcatttataaacagcgca

SEQ ID NO: 53390 - DNA, 25 bp, Mus musculus
tatgtggtagtcctctctcaggcac

SEQ ID NO: 53391 - DNA, 25 bp, Mus musculus
tatgtggtcaacacctacttccgcc

SEQ ID NO: 53392 - DNA, 25 bp, Mus musculus
tatgtggtttgtaatgcaccaacca

SEQ ID NO: 53393 - DNA, 25 bp, Mus musculus
tatgtgtacaacctggtccccagag

SEQ ID NO: 53394 - DNA, 25 bp, Mus musculus
tatgtgtacactgctgagctcttcc

SEQ ID NO: 53395 - DNA, 25 bp, Mus musculus
tatgtgtacgctgaagagcccaaca

SEQ ID NO: 53396 - DNA, 25 bp, Mus musculus
tatgtgtcacggctcagggatgtct

SEQ ID NO: 53397 - DNA, 25 bp, Mus musculus
tatgtgtcagtgttgctgctcccag

SEQ ID NO: 53398 - DNA, 25 bp, Mus musculus
tatgtgtccagcttctaccatgcct

SEQ ID NO: 53399 - DNA, 25 bp, Mus musculus
tatgtgtccttcctagcaggctgcg

SEQ ID NO: 53400 - DNA, 25 bp, Mus musculus
tatgtgtgctttccgttggactgct

SEQ ID NO: 53401 - DNA, 25 bp, Mus musculus
tatgtgtgtgaaggtttccagtgca

SEQ ID NO: 53402 - DNA, 25 bp, Mus musculus
tatgtgttcaaaggagatgaagtca

SEQ ID NO: 53403 - DNA, 25 bp, Mus musculus
tatgttaagtgtaagactcagaggc

SEQ ID NO: 53404 - DNA, 25 bp, Mus musculus
tatgttaccacatgcacctggtgtt

SEQ ID NO: 53405 - DNA, 25 bp, Mus musculus
tatgttagccccaatgaacttagag

SEQ ID NO: 53406 - DNA, 25 bp, Mus musculus
tatgttagcccctatgaacttagag

SEQ ID NO: 53407 - DNA, 25 bp, Mus musculus
tatgttatcgacctcctgactggcg

SEQ ID NO: 53408 - DNA, 25 bp, Mus musculus
tatgttatgtatatgtccggtacct

SEQ ID NO: 53409 - DNA, 25 bp, Mus musculus
tatgttattgagttcatagccagag

SEQ ID NO: 53410 - DNA, 25 bp, Mus musculus
tatgttcaagcagttctgccaggag

SEQ ID NO: 53411 - DNA, 25 bp, Mus musculus
tatgttcatcacacccatgctaaga

SEQ ID NO: 53412 - DNA, 25 bp, Mus musculus
tatgttcatcactccaagcacaatg

SEQ ID NO: 53413 - DNA, 25 bp, Mus musculus
tatgttcccaagacatcacagaggg

SEQ ID NO: 53414 - DNA, 25 bp, Mus musculus
tatgttcccgtgattttgcaacgga

SEQ ID NO: 53415 - DNA, 25 bp, Mus musculus
tatgttcgtgaacacatatggccac

SEQ ID NO: 53416 - DNA, 25 bp, Mus musculus
tatgttcgtgaagacatatggccac

SEQ ID NO: 53417 - DNA, 25 bp, Mus musculus
tatgttctactttctgacagatata

SEQ ID NO: 53418 - DNA, 25 bp, Mus musculus
tatgttctccaactgctataagtac

SEQ ID NO: 53419 - DNA, 25 bp, Mus musculus
tatgttgaatatggtgtagcaggca

SEQ ID NO: 53420 - DNA, 25 bp, Mus musculus
tatgttgacaggctatttgaccctg

SEQ ID NO: 53421 - DNA, 25 bp, Mus musculus
tatgttggatgtttgaacaccatca

SEQ ID NO: 53422 - DNA, 25 bp, Mus musculus
tatgttgggaagtattccaccagcc

SEQ ID NO: 53423 - DNA, 25 bp, Mus musculus
tatgttgtctactataccacgcaag

SEQ ID NO: 53424 - DNA, 25 bp, Mus musculus
tatgttgtgcccagcttcatctcca

SEQ ID NO: 53425 - DNA, 25 bp, Mus musculus
tatgttgttggaacgggcaggccaa

SEQ ID NO: 53426 - DNA, 25 bp, Mus musculus
tatgtttccatacggagccacccca

SEQ ID NO: 53427 - DNA, 25 bp, Mus musculus
tatgtttcctgtaaccccagggcag

SEQ ID NO: 53428 - DNA, 25 bp, Mus musculus
tatgtttctgcgacaagagttgcct

SEQ ID NO: 53429 - DNA, 25 bp, Mus musculus
tatgtttgaggatgtcacccgggcc

SEQ ID NO: 53430 - DNA, 25 bp, Mus musculus
tatgtttgcccgaggaattgctgcc

SEQ ID NO: 53431 - DNA, 25 bp, Mus musculus
tatgtttgcggttggatagcattga

SEQ ID NO: 53432 - DNA, 25 bp, Mus musculus
tatgttttgtgccagttgatggaag

SEQ ID NO: 53433 - DNA, 25 bp, Mus musculus
tattaaatagctctacagaagcagg

SEQ ID NO: 53434 - DNA, 25 bp, Mus musculus
tattaaatagctgtacagaagcagg

SEQ ID NO: 53435 - DNA, 25 bp, Mus musculus
tattaacaatgcagcctctgtccat

SEQ ID NO: 53436 - DNA, 25 bp, Mus musculus
tattaacagggttgcagcgcaggct

SEQ ID NO: 53437 - DNA, 25 bp, Mus musculus
tattaacatggccagtccattccct

SEQ ID NO: 53438 - DNA, 25 bp, Mus musculus
tattaaccagacgatatgtttgcgg

SEQ ID NO: 53439 - DNA, 25 bp, Mus musculus
tattaaccttgcaagaactcttcag

SEQ ID NO: 53440 - DNA, 25 bp, Mus musculus
tattaactggaaacaacatttgcag

SEQ ID NO: 53441 - DNA, 25 bp, Mus musculus
tattaagataatggaagtccctgtt

SEQ ID NO: 53442 - DNA, 25 bp, Mus musculus
tattaattatgctgccattagggca

SEQ ID NO: 53443 - DNA, 25 bp, Mus musculus
tattaattgaagcagatacttgtga

SEQ ID NO: 53444 - DNA, 25 bp, Mus musculus
tattacaacaacacgtacggagcgc

SEQ ID NO: 53445 - DNA, 25 bp, Mus musculus
tattacaaggagacctctggcctga

SEQ ID NO: 53446 - DNA, 25 bp, Mus musculus
tattacacaaggaccatttaccaat

SEQ ID NO: 53447 - DNA, 25 bp, Mus musculus
tattacacagtatgcgatttttgag

SEQ ID NO: 53448 - DNA, 25 bp, Mus musculus
tattacaccagagccattgaatata

SEQ ID NO: 53449 - DNA, 25 bp, Mus musculus
tattacaccattgggcccggcatgt

SEQ ID NO: 53450 - DNA, 25 bp, Mus musculus
tattacaccgatgcaaaaaaccggg

SEQ ID NO: 53451 - DNA, 25 bp, Mus musculus
tattacacggaaagcctgaactggt

SEQ ID NO: 53452 - DNA, 25 bp, Mus musculus
tattacactttcatgtcctctagac

SEQ ID NO: 53453 - DNA, 25 bp, Mus musculus
tattacagatgagcagatgagaggc

SEQ ID NO: 53454 - DNA, 25 bp, Mus musculus
tattacagtcatgttgattgccgag

SEQ ID NO: 53455 - DNA, 25 bp, Mus musculus
tattaccatggaggagtacttcatg

SEQ ID NO: 53456 - DNA, 25 bp, Mus musculus
tattaccggacaaagcttcgaggcc

SEQ ID NO: 53457 - DNA, 25 bp, Mus musculus
tattacctctagatgaaattgggca

SEQ ID NO: 53458 - DNA, 25 bp, Mus musculus
tattacgagactggctccatcagac

SEQ ID NO: 53459 - DNA, 25 bp, Mus musculus
tattacggagacagtggttggctaa

SEQ ID NO: 53460 - DNA, 25 bp, Mus musculus
tattactaccctttgcttccagatg

SEQ ID NO: 53461 - DNA, 25 bp, Mus musculus
tattactatgaagtgagcatggcct

SEQ ID NO: 53462 - DNA, 25 bp, Mus musculus
tattactcctggagcgagtccggcg

SEQ ID NO: 53463 - DNA, 25 bp, Mus musculus
tattactcctggtgcgagtccggcg

SEQ ID NO: 53464 - DNA, 25 bp, Mus musculus
tattactgatgctatccaggagtgg

SEQ ID NO: 53465 - DNA, 25 bp, Mus musculus
tattactgcacctgtaaacgaggct

SEQ ID NO: 53466 - DNA, 25 bp, Mus musculus
tattagaaagaaccccagttcccag

SEQ ID NO: 53467 - DNA, 25 bp, Mus musculus
tattagaaagaagcccagttcccag

SEQ ID NO: 53468 - DNA, 25 bp, Mus musculus
tattagaacactgacagatgatatg

SEQ ID NO: 53469 - DNA, 25 bp, Mus musculus
tattagaacagatcacaagtgctcc

SEQ ID NO: 53470 - DNA, 25 bp, Mus musculus
tattagaagcccaagcagattacca

SEQ ID NO: 53471 - DNA, 25 bp, Mus musculus
tattagcaaatcacccattggattg

SEQ ID NO: 53472 - DNA, 25 bp, Mus musculus
tattagcactggcacactgattgag

SEQ ID NO: 53473 - DNA, 25 bp, Mus musculus
tattagccagtatggcattgcccgg

SEQ ID NO: 53474 - DNA, 25 bp, Mus musculus
tattagctactgtacaaccttcggg

SEQ ID NO: 53475 - DNA, 25 bp, Mus musculus
tattagctattgatgcaagaatgct

SEQ ID NO: 53476 - DNA, 25 bp, Mus musculus
tattagttcctatgaatgctggtgc

SEQ ID NO: 53477 - DNA, 25 bp, Mus musculus
tattataatgtgacatactggcccc

SEQ ID NO: 53478 - DNA, 25 bp, Mus musculus
tattataccttcagccctggacttc

SEQ ID NO: 53479 - DNA, 25 bp, Mus musculus
tattatactcgcacttaaaaatgcc

SEQ ID NO: 53480 - DNA, 25 bp, Mus musculus
tattatcaggagaacagatcagtgg

SEQ ID NO: 53481 - DNA, 25 bp, Mus musculus
tattatcctgatgccacacactcta

SEQ ID NO: 53482 - DNA, 25 bp, Mus musculus
tattatcttgatgctgtctctggac

SEQ ID NO: 53483 - DNA, 25 bp, Mus musculus
tattatctttaactcctgcccggat

SEQ ID NO: 53484 - DNA, 25 bp, Mus musculus
tattatgagaagaaatagagaccgg

SEQ ID NO: 53485 - DNA, 25 bp, Mus musculus
tattatgagccaaactgcagtagct

SEQ ID NO: 53486 - DNA, 25 bp, Mus musculus
tattatgagggaagctgaggaattc

SEQ ID NO: 53487 - DNA, 25 bp, Mus musculus
tattatgagggatgctgaggaattc

SEQ ID NO: 53488 - DNA, 25 bp, Mus musculus
tattatgcatgcacttaaaaatgcc

SEQ ID NO: 53489 - DNA, 25 bp, Mus musculus
tattatgcctgtgctcccttgggac

SEQ ID NO: 53490 - DNA, 25 bp, Mus musculus
tattatggatatctttggagtgaag

SEQ ID NO: 53491 - DNA, 25 bp, Mus musculus
tattatggatggtctgatacaccct

SEQ ID NO: 53492 - DNA, 25 bp, Mus musculus
tattatgggctggatacaaaatggg

SEQ ID NO: 53493 - DNA, 25 bp, Mus musculus
tattatggtttacggaaggaatggc

SEQ ID NO: 53494 - DNA, 25 bp, Mus musculus
tattatgtctcccagcgtgggtacc

SEQ ID NO: 53495 - DNA, 25 bp, Mus musculus
tattatgtgaaggaggcccatggca

SEQ ID NO: 53496 - DNA, 25 bp, Mus musculus
tattattaccagaggaaaggttgga

SEQ ID NO: 53497 - DNA, 25 bp, Mus musculus
tattattcgtgaagcaaatgaggac

SEQ ID NO: 53498 - DNA, 25 bp, Mus musculus
tattattctgtgaggaggctgcctg

SEQ ID NO: 53499 - DNA, 25 bp, Mus musculus
tattattgagtgaacatcgtctcct

SEQ ID NO: 53500 - DNA, 25 bp, Mus musculus
tattcaaattgccaaaggcaaaggt

SEQ ID NO: 53501 - DNA, 25 bp, Mus musculus
tattcaacaacgatggatgtcgcac

SEQ ID NO: 53502 - DNA, 25 bp, Mus musculus
tattcaacgaaattcactgacggtt

SEQ ID NO: 53503 - DNA, 25 bp, Mus musculus
tattcaagccttacgattccataga

SEQ ID NO: 53504 - DNA, 25 bp, Mus musculus
tattcaatagagttcggacaattca

SEQ ID NO: 53505 - DNA, 25 bp, Mus musculus
tattcaatcatcagcctgctcttga

SEQ ID NO: 53506 - DNA, 25 bp, Mus musculus
tattcaatgactatgcggccaccct

SEQ ID NO: 53507 - DNA, 25 bp, Mus musculus
tattcacaaacctggttcccgggag

SEQ ID NO: 53508 - DNA, 25 bp, Mus musculus
tattcacagagcaattactgagcct

SEQ ID NO: 53509 - DNA, 25 bp, Mus musculus
tattcacagagctattactgagcct

SEQ ID NO: 53510 - DNA, 25 bp, Mus musculus
tattcacggaaccacacctttgaca

SEQ ID NO: 53511 - DNA, 25 bp, Mus musculus
tattcacggatcattgagcgtctct

SEQ ID NO: 53512 - DNA, 25 bp, Mus musculus
tattcacttgcacaagaggttcttc

SEQ ID NO: 53513 - DNA, 25 bp, Mus musculus
tattcagaggagctcagctatctag

SEQ ID NO: 53514 - DNA, 25 bp, Mus musculus
tattcagagtgaacttcatcgggac

SEQ ID NO: 53515 - DNA, 25 bp, Mus musculus
tattcagagtgatcttcatcgggac

SEQ ID NO: 53516 - DNA, 25 bp, Mus musculus
tattcagcagtcatggatctgctct

SEQ ID NO: 53517 - DNA, 25 bp, Mus musculus
tattcagccatctggagcgcctgga

SEQ ID NO: 53518 - DNA, 25 bp, Mus musculus
tattcaggagtagcttggtggatca

SEQ ID NO: 53519 - DNA, 25 bp, Mus musculus
tattcagtgcccgttgtctgcccag

SEQ ID NO: 53520 - DNA, 25 bp, Mus musculus
tattcagtgggttcatctccgaccg

SEQ ID NO: 53521 - DNA, 25 bp, Mus musculus
tattcatcaactggagtatactcag

SEQ ID NO: 53522 - DNA, 25 bp, Mus musculus
tattcatcgtaatgctgtggatggc

SEQ ID NO: 53523 - DNA, 25 bp, Mus musculus
tattcatgcagacttctgtgttaca

SEQ ID NO: 53524 - DNA, 25 bp, Mus musculus
tattcatggaaaacgtcacccagct

SEQ ID NO: 53525 - DNA, 25 bp, Mus musculus
tattccaactgctctaactctgtgg

SEQ ID NO: 53526 - DNA, 25 bp, Mus musculus
tattccaaggccaaactaagcaggg

SEQ ID NO: 53527 - DNA, 25 bp, Mus musculus
tattccaatctccatgacatcatgt

SEQ ID NO: 53528 - DNA, 25 bp, Mus musculus
tattccacgttggtgaatagcagtg

SEQ ID NO: 53529 - DNA, 25 bp, Mus musculus
tattccagaaggttggaaaacttgc

SEQ ID NO: 53530 - DNA, 25 bp, Mus musculus
tattccagactgcaaaaaatgcggg

SEQ ID NO: 53531 - DNA, 25 bp, Mus musculus
tattccagcggcagacacaccatct

SEQ ID NO: 53532 - DNA, 25 bp, Mus musculus
tattccaggagcagaccagtattgc

SEQ ID NO: 53533 - DNA, 25 bp, Mus musculus
tattccatagcatttggaagacgcc

SEQ ID NO: 53534 - DNA, 25 bp, Mus musculus
tattccatctgtttcttcgggatca

SEQ ID NO: 53535 - DNA, 25 bp, Mus musculus
tattccatgaaaggcgctggcacgg

SEQ ID NO: 53536 - DNA, 25 bp, Mus musculus
tattcccagagtatggcctcagaac

SEQ ID NO: 53537 - DNA, 25 bp, Mus musculus
tattcccagcatggtctagatggga

SEQ ID NO: 53538 - DNA, 25 bp, Mus musculus
tattcccaggcttcaggagcgatcc

SEQ ID NO: 53539 - DNA, 25 bp, Mus musculus
tattcccaggttgattacagctgac

SEQ ID NO: 53540 - DNA, 25 bp, Mus musculus
tattcccatcgagagaaccttcagt

SEQ ID NO: 53541 - DNA, 25 bp, Mus musculus
tattcccgatcaactatcgagggcc

SEQ ID NO: 53542 - DNA, 25 bp, Mus musculus
tattcccgggaaaagcgcgagtaga

SEQ ID NO: 53543 - DNA, 25 bp, Mus musculus
tattcccgtgatcaactgtcgtgtg

SEQ ID NO: 53544 - DNA, 25 bp, Mus musculus
tattccctcaaagttgccccgaagg

SEQ ID NO: 53545 - DNA, 25 bp, Mus musculus
tattccctgcccaaaaaattcctgg

SEQ ID NO: 53546 - DNA, 25 bp, Mus musculus
tattccctgggcatctgcatcctgc

SEQ ID NO: 53547 - DNA, 25 bp, Mus musculus
tattccgaatgtctgaggacaagcc

SEQ ID NO: 53548 - DNA, 25 bp, Mus musculus
tattccgagatgagattaacctgca

SEQ ID NO: 53549 - DNA, 25 bp, Mus musculus
tattccgcagcaggatatggtgcgg

SEQ ID NO: 53550 - DNA, 25 bp, Mus musculus
tattccgcgtagtgttccacgacag

SEQ ID NO: 53551 - DNA, 25 bp, Mus musculus
tattcctcaagatagtagaactttt

SEQ ID NO: 53552 - DNA, 25 bp, Mus musculus
tattcctgagcctgacggttgtaag

SEQ ID NO: 53553 - DNA, 25 bp, Mus musculus
tattccttctacacattcagtctcc

SEQ ID NO: 53554 - DNA, 25 bp, Mus musculus
tattcgcaagggaatcctgctgatg

SEQ ID NO: 53555 - DNA, 25 bp, Mus musculus
tattcgccattatctggcagaggtt

SEQ ID NO: 53556 - DNA, 25 bp, Mus musculus
tattcggcaccaacgtgatggtgac

SEQ ID NO: 53557 - DNA, 25 bp, Mus musculus
tattcggcctgcgagagttgtgtct

SEQ ID NO: 53558 - DNA, 25 bp, Mus musculus
tattcgtccccgagaatggcaaggg

SEQ ID NO: 53559 - DNA, 25 bp, Mus musculus
tattcgtgaagcaaatgaggaccag

SEQ ID NO: 53560 - DNA, 25 bp, Mus musculus
tattcgtggagtggagagcctctct

SEQ ID NO: 53561 - DNA, 25 bp, Mus musculus
tattctaaaaaccaagccgtcgcac

SEQ ID NO: 53562 - DNA, 25 bp, Mus musculus
tattctaaacatttcaccctacgcc

SEQ ID NO: 53563 - DNA, 25 bp, Mus musculus
tattctaactccttggctcagtggt

SEQ ID NO: 53564 - DNA, 25 bp, Mus musculus
tattctaactcgtagcagtcctgct

SEQ ID NO: 53565 - DNA, 25 bp, Mus musculus
tattctaagaagtgataggcgtggg

SEQ ID NO: 53566 - DNA, 25 bp, Mus musculus
tattctactgagtacggaaaacaca

SEQ ID NO: 53567 - DNA, 25 bp, Mus musculus
tattctagaagtggacgtatatccc

SEQ ID NO: 53568 - DNA, 25 bp, Mus musculus
tattctagactcagttgagttgaca

SEQ ID NO: 53569 - DNA, 25 bp, Mus musculus
tattctcaagtcatgtggactccga

SEQ ID NO: 53570 - DNA, 25 bp, Mus musculus
tattctcatactagactccctgaaa

SEQ ID NO: 53571 - DNA, 25 bp, Mus musculus
tattctccagatgaaatgcctcaac

SEQ ID NO: 53572 - DNA, 25 bp, Mus musculus
tattctcctgttcaatccctggtgc

SEQ ID NO: 53573 - DNA, 25 bp, Mus musculus
tattctctaaagcatgtattccaaa

SEQ ID NO: 53574 - DNA, 25 bp, Mus musculus
tattctctaaaggatgtattccaaa

SEQ ID NO: 53575 - DNA, 25 bp, Mus musculus
tattctctcgagcagtcgtgactgg

SEQ ID NO: 53576 - DNA, 25 bp, Mus musculus
tattctctgtgcatcaaggtcttca

SEQ ID NO: 53577 - DNA, 25 bp, Mus musculus
tattctcttggactgaccccgacag

SEQ ID NO: 53578 - DNA, 25 bp, Mus musculus
tattctcttgggtacctccactctg

SEQ ID NO: 53579 - DNA, 25 bp, Mus musculus
tattctgaaaagtccattgtgtacc

SEQ ID NO: 53580 - DNA, 25 bp, Mus musculus
tattctgaaactcactacgtaggcc

SEQ ID NO: 53581 - DNA, 25 bp, Mus musculus
tattctgctgcaatcctctactgtc

SEQ ID NO: 53582 - DNA, 25 bp, Mus musculus
tattctgctgcttcataggaccatc

SEQ ID NO: 53583 - DNA, 25 bp, Mus musculus
tattctggacaaagactatctgagg

SEQ ID NO: 53584 - DNA, 25 bp, Mus musculus
tattctggatagcaggttttgtgaa

SEQ ID NO: 53585 - DNA, 25 bp, Mus musculus
tattctgggcaacacagatccgcaa

SEQ ID NO: 53586 - DNA, 25 bp, Mus musculus
tattctgggcaagacagatccgcaa

SEQ ID NO: 53587 - DNA, 25 bp, Mus musculus
tattctgtgctgaacgccgtagatc

SEQ ID NO: 53588 - DNA, 25 bp, Mus musculus
tattctgtggagacgccctatggct

SEQ ID NO: 53589 - DNA, 25 bp, Mus musculus
tattcttcccaccactgagatagac

SEQ ID NO: 53590 - DNA, 25 bp, Mus musculus
tattcttgctaactcttcattacag

SEQ ID NO: 53591 - DNA, 25 bp, Mus musculus
tattcttgctaagtcttcattacag

SEQ ID NO: 53592 - DNA, 25 bp, Mus musculus
tattcttgttcctaggtggacacac

SEQ ID NO: 53593 - DNA, 25 bp, Mus musculus
tattctttgctcttgaagcaagacg

SEQ ID NO: 53594 - DNA, 25 bp, Mus musculus
tattgaaagttaccacttcattgtg

SEQ ID NO: 53595 - DNA, 25 bp, Mus musculus
tattgaaattgatcaggcatggaaa

SEQ ID NO: 53596 - DNA, 25 bp, Mus musculus
tattgaacaagaagtcagatggcgg

SEQ ID NO: 53597 - DNA, 25 bp, Mus musculus
tattgaacactcagattacagagcc

SEQ ID NO: 53598 - DNA, 25 bp, Mus musculus
tattgaagttctcactctcaagaaa

SEQ ID NO: 53599 - DNA, 25 bp, Mus musculus
tattgacagaaccatcaagatgaga

SEQ ID NO: 53600 - DNA, 25 bp, Mus musculus
tattgaccaatcagaagaccaggtg

SEQ ID NO: 53601 - DNA, 25 bp, Mus musculus
tattgaccagacagaagaacccgag

SEQ ID NO: 53602 - DNA, 25 bp, Mus musculus
tattgaccctgcctgggaatctcca

SEQ ID NO: 53603 - DNA, 25 bp, Mus musculus
tattgaccgggagggttccacccag

SEQ ID NO: 53604 - DNA, 25 bp, Mus musculus
tattgacctggagattgactctctg

SEQ ID NO: 53605 - DNA, 25 bp, Mus musculus
tattgactagactggcccttggata

SEQ ID NO: 53606 - DNA, 25 bp, Mus musculus
tattgactctcatgaagcccttgga

SEQ ID NO: 53607 - DNA, 25 bp, Mus musculus
tattgagaaataccagaggcgaatt

SEQ ID NO: 53608 - DNA, 25 bp, Mus musculus
tattgagaccatgaaggccagagca

SEQ ID NO: 53609 - DNA, 25 bp, Mus musculus
tattgagaccctacatggctccctg

SEQ ID NO: 53610 - DNA, 25 bp, Mus musculus
tattgagagagtatccatgacacgc

SEQ ID NO: 53611 - DNA, 25 bp, Mus musculus
tattgagagagtttccatgacacgc

SEQ ID NO: 53612 - DNA, 25 bp, Mus musculus
tattgagaggcaaatggaggcacca

SEQ ID NO: 53613 - DNA, 25 bp, Mus musculus
tattgagcaagtgaacagtctgcga

SEQ ID NO: 53614 - DNA, 25 bp, Mus musculus
tattgagcatgctccagtgtgcacc

SEQ ID NO: 53615 - DNA, 25 bp, Mus musculus
tattgagcggtttcatatccagatc

SEQ ID NO: 53616 - DNA, 25 bp, Mus musculus
tattgagctcctgttacatgcacgg

SEQ ID NO: 53617 - DNA, 25 bp, Mus musculus
tattgaggagttcagcacttcacgg

SEQ ID NO: 53618 - DNA, 25 bp, Mus musculus
tattgagtgaacatcgtctcctgaa

SEQ ID NO: 53619 - DNA, 25 bp, Mus musculus
tattgagtgctacaaacaaggagca

SEQ ID NO: 53620 - DNA, 25 bp, Mus musculus
tattgagttgacatgtgaccagcga

SEQ ID NO: 53621 - DNA, 25 bp, Mus musculus
tattgagttgacttgtgaccagcga

SEQ ID NO: 53622 - DNA, 25 bp, Mus musculus
tattgagttgcagccagtcttagtc

SEQ ID NO: 53623 - DNA, 25 bp, Mus musculus
tattgatctaggatatgccaaggag

SEQ ID NO: 53624 - DNA, 25 bp, Mus musculus
tattgatcttcgtatcttgaaactg

SEQ ID NO: 53625 - DNA, 25 bp, Mus musculus
tattgatgagtgagaggaccgtgaa

SEQ ID NO: 53626 - DNA, 25 bp, Mus musculus
tattgatgagtgtgaggaccgtgaa

SEQ ID NO: 53627 - DNA, 25 bp, Mus musculus
tattgatggcactcagatcgcggga

SEQ ID NO: 53628 - DNA, 25 bp, Mus musculus
tattgattacacagtccatgaagcc

SEQ ID NO: 53629 - DNA, 25 bp, Mus musculus
tattgcacgtcaacacaaagtggct

SEQ ID NO: 53630 - DNA, 25 bp, Mus musculus
tattgcagaattagagtctcgagtc

SEQ ID NO: 53631 - DNA, 25 bp, Mus musculus
tattgcagacttaccaggaggacag

SEQ ID NO: 53632 - DNA, 25 bp, Mus musculus
tattgcatgatgctgaagagtcttg

SEQ ID NO: 53633 - DNA, 25 bp, Mus musculus
tattgcatgtgcctctgcggcagca

SEQ ID NO: 53634 - DNA, 25 bp, Mus musculus
tattgcatgttggtatcactccagg

SEQ ID NO: 53635 - DNA, 25 bp, Mus musculus
tattgccacaaggttcaaacagaga

SEQ ID NO: 53636 - DNA, 25 bp, Mus musculus
tattgccaccaatgaagacgcgaag

SEQ ID NO: 53637 - DNA, 25 bp, Mus musculus
tattgcccaacatcacaagagatta

SEQ ID NO: 53638 - DNA, 25 bp, Mus musculus
tattgccccgcagatgtttacctac

SEQ ID NO: 53639 - DNA, 25 bp, Mus musculus
tattgccctgcttgtcgaggctcag

SEQ ID NO: 53640 - DNA, 25 bp, Mus musculus
tattgccctgggtcctggtaattcc

SEQ ID NO: 53641 - DNA, 25 bp, Mus musculus
tattgccgctgggatgcgatacttg

SEQ ID NO: 53642 - DNA, 25 bp, Mus musculus
tattgccggctggaagggacttgtc

SEQ ID NO: 53643 - DNA, 25 bp, Mus musculus
tattgccgttttcgacagagaatcg

SEQ ID NO: 53644 - DNA, 25 bp, Mus musculus
tattgccgttttggacagagaatcg

SEQ ID NO: 53645 - DNA, 25 bp, Mus musculus
tattgcctgttcagcttgctttggc

SEQ ID NO: 53646 - DNA, 25 bp, Mus musculus
tattgcctgttctgcttgctttggc

SEQ ID NO: 53647 - DNA, 25 bp, Mus musculus
tattgccttcgaatattgcacgtca

SEQ ID NO: 53648 - DNA, 25 bp, Mus musculus
tattgctaccctggctccctgaggg

SEQ ID NO: 53649 - DNA, 25 bp, Mus musculus
tattgctcagatttccaacggccag

SEQ ID NO: 53650 - DNA, 25 bp, Mus musculus
tattgctcgaaactgggccaaccaa

SEQ ID NO: 53651 - DNA, 25 bp, Mus musculus
tattgctctcaagcagcggacctgg

SEQ ID NO: 53652 - DNA, 25 bp, Mus musculus
tattgctgagcacatcctggctaca

SEQ ID NO: 53653 - DNA, 25 bp, Mus musculus
tattgctgagcagatcctggctaca

SEQ ID NO: 53654 - DNA, 25 bp, Mus musculus
tattgctgagttgggcatctatcca

SEQ ID NO: 53655 - DNA, 25 bp, Mus musculus
tattgctggcgaaattactgtgact

SEQ ID NO: 53656 - DNA, 25 bp, Mus musculus
tattgcttaacagaaatggttccca

SEQ ID NO: 53657 - DNA, 25 bp, Mus musculus
tattgcttctgtggctggatcgttc

SEQ ID NO: 53658 - DNA, 25 bp, Mus musculus
tattggaaacatcctgtgaagaagg

SEQ ID NO: 53659 - DNA, 25 bp, Mus musculus
tattggaaaccacccagcaagattt

SEQ ID NO: 53660 - DNA, 25 bp, Mus musculus
tattggaaaggcaagcacctagttt

SEQ ID NO: 53661 - DNA, 25 bp, Mus musculus
tattggaaaggccataatatttctg

SEQ ID NO: 53662 - DNA, 25 bp, Mus musculus
tattggaaccactacctcagctgtg

SEQ ID NO: 53663 - DNA, 25 bp, Mus musculus
tattggaatgagtggaagtaatgca

SEQ ID NO: 53664 - DNA, 25 bp, Mus musculus
tattggacctaagtcatgtgacctg

SEQ ID NO: 53665 - DNA, 25 bp, Mus musculus
tattggacctacaaattggagcaaa

SEQ ID NO: 53666 - DNA, 25 bp, Mus musculus
tattggacctatcacggctccttca

SEQ ID NO: 53667 - DNA, 25 bp, Mus musculus
tattggagaatattctggcacagct

SEQ ID NO: 53668 - DNA, 25 bp, Mus musculus
tattggagatcctcgtggaagtgat

SEQ ID NO: 53669 - DNA, 25 bp, Mus musculus
tattggagcatgattacggatgacg

SEQ ID NO: 53670 - DNA, 25 bp, Mus musculus
tattggagcatgtttacggatgacg

SEQ ID NO: 53671 - DNA, 25 bp, Mus musculus
tattggagctatgactacgtggagg

SEQ ID NO: 53672 - DNA, 25 bp, Mus musculus
tattggaggagccacctatgaagag

SEQ ID NO: 53673 - DNA, 25 bp, Mus musculus
tattggcacgccttggactcaggcg

SEQ ID NO: 53674 - DNA, 25 bp, Mus musculus
tattggcaggttctcgatacatagc

SEQ ID NO: 53675 - DNA, 25 bp, Mus musculus
tattggcagtcacctattcgcccgc

SEQ ID NO: 53676 - DNA, 25 bp, Mus musculus
tattggcctcggtcatagcgctggc

SEQ ID NO: 53677 - DNA, 25 bp, Mus musculus
tattggctatgcgtggtggaccgat

SEQ ID NO: 53678 - DNA, 25 bp, Mus musculus
tattggctcctgactctctctacca

SEQ ID NO: 53679 - DNA, 25 bp, Mus musculus
tattgggaagccctaaactcggagc

SEQ ID NO: 53680 - DNA, 25 bp, Mus musculus
tattgggagcatgcatatttgtcca

SEQ ID NO: 53681 - DNA, 25 bp, Mus musculus
tattgggattcctcttctggccagc

SEQ ID NO: 53682 - DNA, 25 bp, Mus musculus
tattgggtaccgcttgacaactgta

SEQ ID NO: 53683 - DNA, 25 bp, Mus musculus
tattgggtaccggttgacaactgta

SEQ ID NO: 53684 - DNA, 25 bp, Mus musculus
tattgggttcacacgctttcctagg

SEQ ID NO: 53685 - DNA, 25 bp, Mus musculus
tattgggttcactcgctttcctagg

SEQ ID NO: 53686 - DNA, 25 bp, Mus musculus
tattggtaacaccaaggaactgtca

SEQ ID NO: 53687 - DNA, 25 bp, Mus musculus
tattggtattgctgccgctggagag

SEQ ID NO: 53688 - DNA, 25 bp, Mus musculus
tattggtccccggtggcgatctttg

SEQ ID NO: 53689 - DNA, 25 bp, Mus musculus
tattggtgaagctaaccagtctgcg

SEQ ID NO: 53690 - DNA, 25 bp, Mus musculus
tattggtgccttgttgattggtgaa

SEQ ID NO: 53691 - DNA, 25 bp, Mus musculus
tattggtgtaggtataccgacaatt

SEQ ID NO: 53692 - DNA, 25 bp, Mus musculus
tattggttgtgtgcatgccatatcg

SEQ ID NO: 53693 - DNA, 25 bp, Mus musculus
tattgtaacagctgaagtctcttca

SEQ ID NO: 53694 - DNA, 25 bp, Mus musculus
tattgtaagagcaaaaccccttgtc

SEQ ID NO: 53695 - DNA, 25 bp, Mus musculus
tattgtaagagctaaaccccttgtc

SEQ ID NO: 53696 - DNA, 25 bp, Mus musculus
tattgtacgagaaagtggacacatt

SEQ ID NO: 53697 - DNA, 25 bp, Mus musculus
tattgtacgtgcaactcaggacttg

SEQ ID NO: 53698 - DNA, 25 bp, Mus musculus
tattgtataaacgacttgaaacaag

SEQ ID NO: 53699 - DNA, 25 bp, Mus musculus
tattgtattgaaagcagagcaagca

SEQ ID NO: 53700 - DNA, 25 bp, Mus musculus
tattgtcaattgctcctgataatgg

SEQ ID NO: 53701 - DNA, 25 bp, Mus musculus
tattgtccgcatcatgaaagcacga

SEQ ID NO: 53702 - DNA, 25 bp, Mus musculus
tattgtcctttttgcccacaatgac

SEQ ID NO: 53703 - DNA, 25 bp, Mus musculus
tattgtctctggaactcgatacaag

SEQ ID NO: 53704 - DNA, 25 bp, Mus musculus
tattgtcttcgccattcagtacagt

SEQ ID NO: 53705 - DNA, 25 bp, Mus musculus
tattgtgatgtcaacacttgttcca

SEQ ID NO: 53706 - DNA, 25 bp, Mus musculus
tattgtgatgtgtgccccgaggaca

SEQ ID NO: 53707 - DNA, 25 bp, Mus musculus
tattgtgcctgttcttggacccctg

SEQ ID NO: 53708 - DNA, 25 bp, Mus musculus
tattgtggaatgtgggaagaattac

SEQ ID NO: 53709 - DNA, 25 bp, Mus musculus
tattgtggtctgctacaactgcttc

SEQ ID NO: 53710 - DNA, 25 bp, Mus musculus
tattgtggtctggtacaactgcttc

SEQ ID NO: 53711 - DNA, 25 bp, Mus musculus
tattgttacagaagtagctgtttac

SEQ ID NO: 53712 - DNA, 25 bp, Mus musculus
tattgttagaactcagagggtagct

SEQ ID NO: 53713 - DNA, 25 bp, Mus musculus
tatttaaccgtgtacctgagatttc

SEQ ID NO: 53714 - DNA, 25 bp, Mus musculus
tatttaatcggcacgctgcttctcc

SEQ ID NO: 53715 - DNA, 25 bp, Mus musculus
tatttacagccaatgaagggtgacc

SEQ ID NO: 53716 - DNA, 25 bp, Mus musculus
tatttacaggatcgactgccactgg

SEQ ID NO: 53717 - DNA, 25 bp, Mus musculus
tatttacataatcatccagtggaac

SEQ ID NO: 53718 - DNA, 25 bp, Mus musculus
tatttacctggattctttatgacct

SEQ ID NO: 53719 - DNA, 25 bp, Mus musculus
tatttagagagaacagatgaagtgg

SEQ ID NO: 53720 - DNA, 25 bp, Mus musculus
tatttagcgtgcctcccacagaagg

SEQ ID NO: 53721 - DNA, 25 bp, Mus musculus
tatttataagaatcgtgaacctgtc

SEQ ID NO: 53722 - DNA, 25 bp, Mus musculus
tatttatatagaaaacggagacgtg

SEQ ID NO: 53723 - DNA, 25 bp, Mus musculus
tatttatcttcatcgatagcgacca

SEQ ID NO: 53724 - DNA, 25 bp, Mus musculus
tatttatgcttgtgcccttgaccaa

SEQ ID NO: 53725 - DNA, 25 bp, Mus musculus
tatttattacaccagagccattgaa

SEQ ID NO: 53726 - DNA, 25 bp, Mus musculus
tatttcaatgaatctgccgcccacg

SEQ ID NO: 53727 - DNA, 25 bp, Mus musculus
tatttcacatgcctgacttgtggcg

SEQ ID NO: 53728 - DNA, 25 bp, Mus musculus
tatttcagacaccatatacccgagg

SEQ ID NO: 53729 - DNA, 25 bp, Mus musculus
tatttcagcatagataacgagctag

SEQ ID NO: 53730 - DNA, 25 bp, Mus musculus
tatttcatcctcataaactgtggag

SEQ ID NO: 53731 - DNA, 25 bp, Mus musculus
tatttcatttagaagtatgttcccg

SEQ ID NO: 53732 - DNA, 25 bp, Mus musculus
tatttccactccatgcaccacagta

SEQ ID NO: 53733 - DNA, 25 bp, Mus musculus
tatttccagaataaatagtgctgcc

SEQ ID NO: 53734 - DNA, 25 bp, Mus musculus
tatttccctctattcagttgtctcc

SEQ ID NO: 53735 - DNA, 25 bp, Mus musculus
tatttccgaagctcctgttcatgga

SEQ ID NO: 53736 - DNA, 25 bp, Mus musculus
tatttcctacctcagctacctcggt

SEQ ID NO: 53737 - DNA, 25 bp, Mus musculus
tatttcctgagtcaacatggccgtt

SEQ ID NO: 53738 - DNA, 25 bp, Mus musculus
tatttcctgcagcagtggctttggg

SEQ ID NO: 53739 - DNA, 25 bp, Mus musculus
tatttcctgcagctcaagtttgacc

SEQ ID NO: 53740 - DNA, 25 bp, Mus musculus
tatttcctgcaggtcaagtttgacc

SEQ ID NO: 53741 - DNA, 25 bp, Mus musculus
tatttcggcgaatcttgaacgtgac

SEQ ID NO: 53742 - DNA, 25 bp, Mus musculus
tatttcgttcatccaacattccgtt

SEQ ID NO: 53743 - DNA, 25 bp, Mus musculus
tatttctacccctacacatgtagtg

SEQ ID NO: 53744 - DNA, 25 bp, Mus musculus
tatttctacgactatgactgcggag

SEQ ID NO: 53745 - DNA, 25 bp, Mus musculus
tatttctagagacagctgctgctga

SEQ ID NO: 53746 - DNA, 25 bp, Mus musculus
tatttctagagctgagtctcagagc

SEQ ID NO: 53747 - DNA, 25 bp, Mus musculus
tatttctgaagaagggtttcactac

SEQ ID NO: 53748 - DNA, 25 bp, Mus musculus
tatttctgcaccgatacaggaaagg

SEQ ID NO: 53749 - DNA, 25 bp, Mus musculus
tatttctgccagactgggcactgcc

SEQ ID NO: 53750 - DNA, 25 bp, Mus musculus
tatttctggcgataccttgtatggc

SEQ ID NO: 53751 - DNA, 25 bp, Mus musculus
tatttctgtccagctgctccaatga

SEQ ID NO: 53752 - DNA, 25 bp, Mus musculus
tatttcttaaggaggagaattcctt

SEQ ID NO: 53753 - DNA, 25 bp, Mus musculus
tatttcttagaacttcagagaaagc

SEQ ID NO: 53754 - DNA, 25 bp, Mus musculus
tatttgaaactctggcagctgagca

SEQ ID NO: 53755 - DNA, 25 bp, Mus musculus
tatttgaaagcaattgagacgcaac

SEQ ID NO: 53756 - DNA, 25 bp, Mus musculus
tatttgaaggagacacattggttct

SEQ ID NO: 53757 - DNA, 25 bp, Mus musculus
tatttgacatactaaatgggaaacc

SEQ ID NO: 53758 - DNA, 25 bp, Mus musculus
tatttgaccagtgagaaccgagatg

SEQ ID NO: 53759 - DNA, 25 bp, Mus musculus
tatttgagtctttctccaagttgcg

SEQ ID NO: 53760 - DNA, 25 bp, Mus musculus
tatttgatggtttccgagattttca

SEQ ID NO: 53761 - DNA, 25 bp, Mus musculus
tatttgcacaaacggagtggtgcga

SEQ ID NO: 53762 - DNA, 25 bp, Mus musculus
tatttgcagatgattctctgttgcc

SEQ ID NO: 53763 - DNA, 25 bp, Mus musculus
tatttgcagtgtagttggccaacaa

SEQ ID NO: 53764 - DNA, 25 bp, Mus musculus
tatttgccaaaaggaaacagacttc

SEQ ID NO: 53765 - DNA, 25 bp, Mus musculus
tatttgcccggcagctgatgcaggt

SEQ ID NO: 53766 - DNA, 25 bp, Mus musculus
tatttgccttcactctcagccacag

SEQ ID NO: 53767 - DNA, 25 bp, Mus musculus
tatttgctaggtcggtttggtagac

SEQ ID NO: 53768 - DNA, 25 bp, Mus musculus
tatttgctaggtgggtttggtagac

SEQ ID NO: 53769 - DNA, 25 bp, Mus musculus
tatttgctctgggactagggcttct

SEQ ID NO: 53770 - DNA, 25 bp, Mus musculus
tatttgctgagtccacacgggtgat

SEQ ID NO: 53771 - DNA, 25 bp, Mus musculus
tatttgctggccacattgccaattc

SEQ ID NO: 53772 - DNA, 25 bp, Mus musculus
tatttgctggcctcattgccaattc

SEQ ID NO: 53773 - DNA, 25 bp, Mus musculus
tatttggagcccaaggctgtcccga

SEQ ID NO: 53774 - DNA, 25 bp, Mus musculus
tatttggagccctaggctgtcccga

SEQ ID NO: 53775 - DNA, 25 bp, Mus musculus
tatttggcatgcgaaacagtgcagc

SEQ ID NO: 53776 - DNA, 25 bp, Mus musculus
tatttggcctaatcgagctacagct

SEQ ID NO: 53777 - DNA, 25 bp, Mus musculus
tatttgggcaggaagcccactgtgg

SEQ ID NO: 53778 - DNA, 25 bp, Mus musculus
tatttgggcttactggcttggatcg

SEQ ID NO: 53779 - DNA, 25 bp, Mus musculus
tatttgggtatccacaaacaaaggg

SEQ ID NO: 53780 - DNA, 25 bp, Mus musculus
tatttgggtatcgacaaacaaaggg

SEQ ID NO: 53781 - DNA, 25 bp, Mus musculus
tatttggtctcaagctgttccgtaa

SEQ ID NO: 53782 - DNA, 25 bp, Mus musculus
tatttggtggaccactatcacacct

SEQ ID NO: 53783 - DNA, 25 bp, Mus musculus
tatttggttagtgccaccataccat

SEQ ID NO: 53784 - DNA, 25 bp, Mus musculus
tatttgtccctaaaggaattcaaga

SEQ ID NO: 53785 - DNA, 25 bp, Mus musculus
tatttgtcctctgggttcttatagg

SEQ ID NO: 53786 - DNA, 25 bp, Mus musculus
tatttgtgcccctgttggtgggtac

SEQ ID NO: 53787 - DNA, 25 bp, Mus musculus
tatttgtgttgcaaaagctgttgaa

SEQ ID NO: 53788 - DNA, 25 bp, Mus musculus
tattttacatggaatgggcttaagg

SEQ ID NO: 53789 - DNA, 25 bp, Mus musculus
tattttaccaaggagaacagctcag

SEQ ID NO: 53790 - DNA, 25 bp, Mus musculus
tattttagctgccttattgggagag

SEQ ID NO: 53791 - DNA, 25 bp, Mus musculus
tattttagctgcgttattgggagag

SEQ ID NO: 53792 - DNA, 25 bp, Mus musculus
tattttagtagcctgttggtccgca

SEQ ID NO: 53793 - DNA, 25 bp, Mus musculus
tattttatgtctacccgctgcttac

SEQ ID NO: 53794 - DNA, 25 bp, Mus musculus
tattttcaatagatccattgatgcc

SEQ ID NO: 53795 - DNA, 25 bp, Mus musculus
tattttcaatagttccattgatgcc

SEQ ID NO: 53796 - DNA, 25 bp, Mus musculus
tattttccatatatcctggttctgc

SEQ ID NO: 53797 - DNA, 25 bp, Mus musculus
tattttccatgacagatagtgacga

SEQ ID NO: 53798 - DNA, 25 bp, Mus musculus
tattttccttcacggattgggagat

SEQ ID NO: 53799 - DNA, 25 bp, Mus musculus
tattttcgcaagatccaaaccctta

SEQ ID NO: 53800 - DNA, 25 bp, Mus musculus
tattttcggaggaaacacctgtagt

SEQ ID NO: 53801 - DNA, 25 bp, Mus musculus
tattttctcaaagtcacagctagta

SEQ ID NO: 53802 - DNA, 25 bp, Mus musculus
tattttctggtagtgtcctgctcac

SEQ ID NO: 53803 - DNA, 25 bp, Mus musculus
tattttcttcaaagccagagatgat

SEQ ID NO: 53804 - DNA, 25 bp, Mus musculus
tattttcttcaatgccagagatgat

SEQ ID NO: 53805 - DNA, 25 bp, Mus musculus
tattttgacaggaggccagggaaac

SEQ ID NO: 53806 - DNA, 25 bp, Mus musculus
tattttgacaggtggccagggaaac

SEQ ID NO: 53807 - DNA, 25 bp, Mus musculus
tattttgactatgcagcctcactgc

SEQ ID NO: 53808 - DNA, 25 bp, Mus musculus
tattttgatagggatggtgaagtcg

SEQ ID NO: 53809 - DNA, 25 bp, Mus musculus
tattttggaccagacttcaaactgc

SEQ ID NO: 53810 - DNA, 25 bp, Mus musculus
tattttggatgctaccaacccaaga

SEQ ID NO: 53811 - DNA, 25 bp, Mus musculus
tattttggcaagagttggatcaacc

SEQ ID NO: 53812 - DNA, 25 bp, Mus musculus
tatttttagtctacgacattagcag

SEQ ID NO: 53813 - DNA, 25 bp, Mus musculus
tatttttcttactcattggctctga

SEQ ID NO: 53814 - DNA, 25 bp, Mus musculus
tatttttgcccgagaaccatttgtg

SEQ ID NO: 53815 - DNA, 25 bp, Mus musculus
tatttttgctcgagacaaaattccc

SEQ ID NO: 53816 - DNA, 25 bp, Mus musculus
tattttttgtgtgtgatacccacag

SEQ ID NO: 53817 - DNA, 25 bp, Mus musculus
tcaaaaagatgtctgggactgtctc

SEQ ID NO: 53818 - DNA, 25 bp, Mus musculus
tcaaaaagccgaccaagaaccagat

SEQ ID NO: 53819 - DNA, 25 bp, Mus musculus
tcaaaaaggagagtccgagttgcca

SEQ ID NO: 53820 - DNA, 25 bp, Mus musculus
tcaaaaaggtcgagttcacggactc

SEQ ID NO: 53821 - DNA, 25 bp, Mus musculus
tcaaaaatgtctgccatagcctgtg

SEQ ID NO: 53822 - DNA, 25 bp, Mus musculus
tcaaaaccaataaacaggaagcagc

SEQ ID NO: 53823 - DNA, 25 bp, Mus musculus
tcaaaagagtactgtgctgcctcag

SEQ ID NO: 53824 - DNA, 25 bp, Mus musculus
tcaaaagcagaaacgcaggagatgg

SEQ ID NO: 53825 - DNA, 25 bp, Mus musculus
tcaaaaggatgagcaagtccgtgcc

SEQ ID NO: 53826 - DNA, 25 bp, Mus musculus
tcaaaaggtgactctgacaacagct

SEQ ID NO: 53827 - DNA, 25 bp, Mus musculus
tcaaaagtaacctaagcgatctgct

SEQ ID NO: 53828 - DNA, 25 bp, Mus musculus
tcaaaatattggacaagtgactgtt

SEQ ID NO: 53829 - DNA, 25 bp, Mus musculus
tcaaaatggcatcctctaaaaaggt

SEQ ID NO: 53830 - DNA, 25 bp, Mus musculus
tcaaaatgtcttagaggactcgctg

SEQ ID NO: 53831 - DNA, 25 bp, Mus musculus
tcaaaatgttcccaagaagataaaa

SEQ ID NO: 53832 - DNA, 25 bp, Mus musculus
tcaaaatgttgagattaatgtcatg

SEQ ID NO: 53833 - DNA, 25 bp, Mus musculus
tcaaaattcgaaggctgcaaaaagc

SEQ ID NO: 53834 - DNA, 25 bp, Mus musculus
tcaaaattgcccctgagtcggccat

SEQ ID NO: 53835 - DNA, 25 bp, Mus musculus
tcaaacaaaactcagctgtgaactc

SEQ ID NO: 53836 - DNA, 25 bp, Mus musculus
tcaaacagaggggaagaccatgccg

SEQ ID NO: 53837 - DNA, 25 bp, Mus musculus
tcaaacaggtgttggcccggaccag

SEQ ID NO: 53838 - DNA, 25 bp, Mus musculus
tcaaaccgaaattggccaaaccgtg

SEQ ID NO: 53839 - DNA, 25 bp, Mus musculus
tcaaaccgaggcaaagttgtaactt

SEQ ID NO: 53840 - DNA, 25 bp, Mus musculus
tcaaaccgccaaaaagaaggatgaa

SEQ ID NO: 53841 - DNA, 25 bp, Mus musculus
tcaaaccgtacaagaaaaagtcgtg

SEQ ID NO: 53842 - DNA, 25 bp, Mus musculus
tcaaaccgtgcttcaggctctgaga

SEQ ID NO: 53843 - DNA, 25 bp, Mus musculus
tcaaacctgggtgtgctggtggtgc

SEQ ID NO: 53844 - DNA, 25 bp, Mus musculus
tcaaacctttgtgggccaggaatgt

SEQ ID NO: 53845 - DNA, 25 bp, Mus musculus
tcaaacggcagctgtcaatgacact

SEQ ID NO: 53846 - DNA, 25 bp, Mus musculus
tcaaacgggaaaggcaaggaaatgt

SEQ ID NO: 53847 - DNA, 25 bp, Mus musculus
tcaaactaacctgctccgaaatcag

SEQ ID NO: 53848 - DNA, 25 bp, Mus musculus
tcaaactcaatcgaaataacaggcc

SEQ ID NO: 53849 - DNA, 25 bp, Mus musculus
tcaaactcagtcaccgcagagtgtc

SEQ ID NO: 53850 - DNA, 25 bp, Mus musculus
tcaaactccgagagctaaatgagaa

SEQ ID NO: 53851 - DNA, 25 bp, Mus musculus
tcaaactgaaggagggaactcaagt

SEQ ID NO: 53852 - DNA, 25 bp, Mus musculus
tcaaactgtttgcacgattccgtca

SEQ ID NO: 53853 - DNA, 25 bp, Mus musculus
tcaaacttcaactcaggcgccaact

SEQ ID NO: 53854 - DNA, 25 bp, Mus musculus
tcaaacttcctattgaggatggcct

SEQ ID NO: 53855 - DNA, 25 bp, Mus musculus
tcaaagaaaacaaaatagatggttc

SEQ ID NO: 53856 - DNA, 25 bp, Mus musculus
tcaaagaaacaacctaagaaccagt

SEQ ID NO: 53857 - DNA, 25 bp, Mus musculus
tcaaagaaaggtcgaaagtcaactc

SEQ ID NO: 53858 - DNA, 25 bp, Mus musculus
tcaaagaattgggagtcacacagca

SEQ ID NO: 53859 - DNA, 25 bp, Mus musculus
tcaaagagatctttgcccgagccag

SEQ ID NO: 53860 - DNA, 25 bp, Mus musculus
tcaaagagattgctgcaaagcacaa

SEQ ID NO: 53861 - DNA, 25 bp, Mus musculus
tcaaagagccgagtttgaagtgtgt

SEQ ID NO: 53862 - DNA, 25 bp, Mus musculus
tcaaagaggacatctgtgtttattc

SEQ ID NO: 53863 - DNA, 25 bp, Mus musculus
tcaaagatgagctgtggctggtcat

SEQ ID NO: 53864 - DNA, 25 bp, Mus musculus
tcaaagcaaagaggtactacgcctg

SEQ ID NO: 53865 - DNA, 25 bp, Mus musculus
tcaaagccctgggtcgcttggaaga

SEQ ID NO: 53866 - DNA, 25 bp, Mus musculus
tcaaagcgaggtcaccggctccagc

SEQ ID NO: 53867 - DNA, 25 bp, Mus musculus
tcaaagcgagtgtcatcctcagaaa

SEQ ID NO: 53868 - DNA, 25 bp, Mus musculus
tcaaagcgggcacattcagcctgtc

SEQ ID NO: 53869 - DNA, 25 bp, Mus musculus
tcaaagcgggcagattcagcctgtc

SEQ ID NO: 53870 - DNA, 25 bp, Mus musculus
tcaaagcgtcagagctgtggaagga

SEQ ID NO: 53871 - DNA, 25 bp, Mus musculus
tcaaagctgatttggacggcccgct

SEQ ID NO: 53872 - DNA, 25 bp, Mus musculus
tcaaagctgtgaccctctttctcca

SEQ ID NO: 53873 - DNA, 25 bp, Mus musculus
tcaaagcttgccacagaagtgctct

SEQ ID NO: 53874 - DNA, 25 bp, Mus musculus
tcaaaggatcccaagcactgtcagg

SEQ ID NO: 53875 - DNA, 25 bp, Mus musculus
tcaaaggcagatcagtaagcaaggc

SEQ ID NO: 53876 - DNA, 25 bp, Mus musculus
tcaaaggccttgtcactggagaagg

SEQ ID NO: 53877 - DNA, 25 bp, Mus musculus
tcaaaggcgatttaccagtgacttc

SEQ ID NO: 53878 - DNA, 25 bp, Mus musculus
tcaaaggtcactatgaggcaaagca

SEQ ID NO: 53879 - DNA, 25 bp, Mus musculus
tcaaaggtgacgtcctctatcttgg

SEQ ID NO: 53880 - DNA, 25 bp, Mus musculus
tcaaaggttcagaagtagacacctg

SEQ ID NO: 53881 - DNA, 25 bp, Mus musculus
tcaaagtaatctcccggaaccgtgt

SEQ ID NO: 53882 - DNA, 25 bp, Mus musculus
tcaaagtagcttcccgagagctgaa

SEQ ID NO: 53883 - DNA, 25 bp, Mus musculus
tcaaagtcacagctagtaaatggag

SEQ ID NO: 53884 - DNA, 25 bp, Mus musculus
tcaaagtcggtgaagtcagggacaa

SEQ ID NO: 53885 - DNA, 25 bp, Mus musculus
tcaaagtcttatgtgtggacatcag

SEQ ID NO: 53886 - DNA, 25 bp, Mus musculus
tcaaagtgcagtcatggctgtgtcc

SEQ ID NO: 53887 - DNA, 25 bp, Mus musculus
tcaaagtgctctgttttgggcagac

SEQ ID NO: 53888 - DNA, 25 bp, Mus musculus
tcaaagtggtcaccagctccctctg

SEQ ID NO: 53889 - DNA, 25 bp, Mus musculus
tcaaagtggtcagcagctccctctg

SEQ ID NO: 53890 - DNA, 25 bp, Mus musculus
tcaaagttacagacattctggccca

SEQ ID NO: 53891 - DNA, 25 bp, Mus musculus
tcaaagttggagaagagtttgagga

SEQ ID NO: 53892 - DNA, 25 bp, Mus musculus
tcaaatacgtggaggaaatcgagcg

SEQ ID NO: 53893 - DNA, 25 bp, Mus musculus
tcaaatagtgcactacctaaccagg

SEQ ID NO: 53894 - DNA, 25 bp, Mus musculus
tcaaatataacaaagatggcagtgt

SEQ ID NO: 53895 - DNA, 25 bp, Mus musculus
tcaaatatactttgggagcattgta

SEQ ID NO: 53896 - DNA, 25 bp, Mus musculus
tcaaatatgccatcattggtatggc

SEQ ID NO: 53897 - DNA, 25 bp, Mus musculus
tcaaatcaaatgttagtcggtatgc

SEQ ID NO: 53898 - DNA, 25 bp, Mus musculus
tcaaatcactgaagcgacccctcga

SEQ ID NO: 53899 - DNA, 25 bp, Mus musculus
tcaaatcagaaaattaatgcccgtt

SEQ ID NO: 53900 - DNA, 25 bp, Mus musculus
tcaaatcagacagacgccggactgg

SEQ ID NO: 53901 - DNA, 25 bp, Mus musculus
tcaaatcccaaatcttcagctaagg

SEQ ID NO: 53902 - DNA, 25 bp, Mus musculus
tcaaatccgatagagcatggttgct

SEQ ID NO: 53903 - DNA, 25 bp, Mus musculus
tcaaatcgtttgtgggctgaggata

SEQ ID NO: 53904 - DNA, 25 bp, Mus musculus
tcaaatgacaaggaagctatcaaat

SEQ ID NO: 53905 - DNA, 25 bp, Mus musculus
tcaaatgcagggtcaacagtgcagc

SEQ ID NO: 53906 - DNA, 25 bp, Mus musculus
tcaaatgccatcgatccaacggtac

SEQ ID NO: 53907 - DNA, 25 bp, Mus musculus
tcaaatgccccgtggagtacactct

SEQ ID NO: 53908 - DNA, 25 bp, Mus musculus
tcaaatgcgagaactgcgggaagaa

SEQ ID NO: 53909 - DNA, 25 bp, Mus musculus
tcaaatgcgggcagcccatccgtct

SEQ ID NO: 53910 - DNA, 25 bp, Mus musculus
tcaaatggcgtttttccgagtggac

SEQ ID NO: 53911 - DNA, 25 bp, Mus musculus
tcaaatgttagtcggtatgcagagt

SEQ ID NO: 53912 - DNA, 25 bp, Mus musculus
tcaaatgttggaatcagagacctag

SEQ ID NO: 53913 - DNA, 25 bp, Mus musculus
tcaaattaaggcaccagagtttttc

SEQ ID NO: 53914 - DNA, 25 bp, Mus musculus
tcaaattatgtctttgcacactgaa

SEQ ID NO: 53915 - DNA, 25 bp, Mus musculus
tcaaattgcaactaggaggccggcc

SEQ ID NO: 53916 - DNA, 25 bp, Mus musculus
tcaacaaaactgtggccatccatac

SEQ ID NO: 53917 - DNA, 25 bp, Mus musculus
tcaacaaaatggacttggcagatct

SEQ ID NO: 53918 - DNA, 25 bp, Mus musculus
tcaacaaagagaggcgcggtgatta

SEQ ID NO: 53919 - DNA, 25 bp, Mus musculus
tcaacaaagctcttcttgccaagag

SEQ ID NO: 53920 - DNA, 25 bp, Mus musculus
tcaacaaatgacagaaatgagcatt

SEQ ID NO: 53921 - DNA, 25 bp, Mus musculus
tcaacaaatgacagttcaagcccag

SEQ ID NO: 53922 - DNA, 25 bp, Mus musculus
tcaacaagcaagagtttggctggat

SEQ ID NO: 53923 - DNA, 25 bp, Mus musculus
tcaacaatcagatcgaggaactgcc

SEQ ID NO: 53924 - DNA, 25 bp, Mus musculus
tcaacacaaagtggctaggcttaaa

SEQ ID NO: 53925 - DNA, 25 bp, Mus musculus
tcaacacaacagacattctacgaac

SEQ ID NO: 53926 - DNA, 25 bp, Mus musculus
tcaacacagtgcaagatgggcggct

SEQ ID NO: 53927 - DNA, 25 bp, Mus musculus
tcaacacagttctataatatcaaga

SEQ ID NO: 53928 - DNA, 25 bp, Mus musculus
tcaacaccgtggagatacagaccag

SEQ ID NO: 53929 - DNA, 25 bp, Mus musculus
tcaacactctgggatcctacagctg

SEQ ID NO: 53930 - DNA, 25 bp, Mus musculus
tcaacacttctcttttcaagcagac

SEQ ID NO: 53931 - DNA, 25 bp, Mus musculus
tcaacacttgttccagaaaaatgca

SEQ ID NO: 53932 - DNA, 25 bp, Mus musculus
tcaacagaatgtttggagttcagct

SEQ ID NO: 53933 - DNA, 25 bp, Mus musculus
tcaacagcaaatgatgagatagtag

SEQ ID NO: 53934 - DNA, 25 bp, Mus musculus
tcaacagcaagctaggaactgtcag

SEQ ID NO: 53935 - DNA, 25 bp, Mus musculus
tcaacagcaaggaggaccccagcca

SEQ ID NO: 53936 - DNA, 25 bp, Mus musculus
tcaacagcacacagcctggaggaca

SEQ ID NO: 53937 - DNA, 25 bp, Mus musculus
tcaacagcacgtttccctcttgcag

SEQ ID NO: 53938 - DNA, 25 bp, Mus musculus
tcaacagcactttccgttcagtcag

SEQ ID NO: 53939 - DNA, 25 bp, Mus musculus
tcaacagcgatgctgtgctccccag

SEQ ID NO: 53940 - DNA, 25 bp, Mus musculus
tcaacagcggacaccccgatgctag

SEQ ID NO: 53941 - DNA, 25 bp, Mus musculus
tcaacagctccctgtcactggctga

SEQ ID NO: 53942 - DNA, 25 bp, Mus musculus
tcaacagctgagagaccagcagaaa

SEQ ID NO: 53943 - DNA, 25 bp, Mus musculus
tcaacaggacgaataaatttacagc

SEQ ID NO: 53944 - DNA, 25 bp, Mus musculus
tcaacaggagaacctgcccaaacgt

SEQ ID NO: 53945 - DNA, 25 bp, Mus musculus
tcaacataaccaagttggcctctgc

SEQ ID NO: 53946 - DNA, 25 bp, Mus musculus
tcaacataaggaaagtgcagcccct

SEQ ID NO: 53947 - DNA, 25 bp, Mus musculus
tcaacatatcaatggagcaagtcac

SEQ ID NO: 53948 - DNA, 25 bp, Mus musculus
tcaacatccccagctggaactggaa

SEQ ID NO: 53949 - DNA, 25 bp, Mus musculus
tcaacatcgggcttggagctcaaag

SEQ ID NO: 53950 - DNA, 25 bp, Mus musculus
tcaacatgattctcgccacaaggag

SEQ ID NO: 53951 - DNA, 25 bp, Mus musculus
tcaacatgctgagacacatgcaccg

SEQ ID NO: 53952 - DNA, 25 bp, Mus musculus
tcaacatggattcactgagtgcccg

SEQ ID NO: 53953 - DNA, 25 bp, Mus musculus
tcaacattgagtgtctgcgagactt

SEQ ID NO: 53954 - DNA, 25 bp, Mus musculus
tcaaccaaatcccagttcaactcag

SEQ ID NO: 53955 - DNA, 25 bp, Mus musculus
tcaaccaaatccgagttcaactcag

SEQ ID NO: 53956 - DNA, 25 bp, Mus musculus
tcaaccaagaacatagatctgagct

SEQ ID NO: 53957 - DNA, 25 bp, Mus musculus
tcaaccacacagtgctgtgtgcaga

SEQ ID NO: 53958 - DNA, 25 bp, Mus musculus
tcaaccacaccatggtttatgacgg

SEQ ID NO: 53959 - DNA, 25 bp, Mus musculus
tcaaccagatgtggactgcctagaa

SEQ ID NO: 53960 - DNA, 25 bp, Mus musculus
tcaaccagcagagcggcacgattcg

SEQ ID NO: 53961 - DNA, 25 bp, Mus musculus
tcaaccagcataccgaaacacagat

SEQ ID NO: 53962 - DNA, 25 bp, Mus musculus
tcaaccagctgctgattcacgcggc

SEQ ID NO: 53963 - DNA, 25 bp, Mus musculus
tcaaccaggctttgtcttgaatggc

SEQ ID NO: 53964 - DNA, 25 bp, Mus musculus
tcaaccccttgaagatcttaaaaag

SEQ ID NO: 53965 - DNA, 25 bp, Mus musculus
tcaacccgactctggaggcacagta

SEQ ID NO: 53966 - DNA, 25 bp, Mus musculus
tcaaccctatccagacagtgagcgt

SEQ ID NO: 53967 - DNA, 25 bp, Mus musculus
tcaaccctggggaggacgaggtctc

SEQ ID NO: 53968 - DNA, 25 bp, Mus musculus
tcaaccgagagaggccagcgcttag

SEQ ID NO: 53969 - DNA, 25 bp, Mus musculus
tcaaccgccttgaggatctgtctgc

SEQ ID NO: 53970 - DNA, 25 bp, Mus musculus
tcaaccggtgacttaagaagccaaa

SEQ ID NO: 53971 - DNA, 25 bp, Mus musculus
tcaacctcggatgatcgggtaaaag

SEQ ID NO: 53972 - DNA, 25 bp, Mus musculus
tcaacctctactttccccgggatgg

SEQ ID NO: 53973 - DNA, 25 bp, Mus musculus
tcaacctgaattctcctaacaaagg

SEQ ID NO: 53974 - DNA, 25 bp, Mus musculus
tcaacctgacacacattgaatccag

SEQ ID NO: 53975 - DNA, 25 bp, Mus musculus
tcaacctgagaaacgtcttgtggca

SEQ ID NO: 53976 - DNA, 25 bp, Mus musculus
tcaacctggatggtaaacttcacca

SEQ ID NO: 53977 - DNA, 25 bp, Mus musculus
tcaacctggctggagagaatatcct

SEQ ID NO: 53978 - DNA, 25 bp, Mus musculus
tcaacctggcttacttgtacggcgc

SEQ ID NO: 53979 - DNA, 25 bp, Mus musculus
tcaacctgtcgggaggtgaattcag

SEQ ID NO: 53980 - DNA, 25 bp, Mus musculus
tcaaccttttctgagtctacccaaa

SEQ ID NO: 53981 - DNA, 25 bp, Mus musculus
tcaacgaaattcactgacggttaac

SEQ ID NO: 53982 - DNA, 25 bp, Mus musculus
tcaacgactgcgagtgcgatgggct

SEQ ID NO: 53983 - DNA, 25 bp, Mus musculus
tcaacgactgcgtgtgcgatgggct

SEQ ID NO: 53984 - DNA, 25 bp, Mus musculus
tcaacgagaccaccttataccagcg

SEQ ID NO: 53985 - DNA, 25 bp, Mus musculus
tcaacgagaggcagtccatcatcaa

SEQ ID NO: 53986 - DNA, 25 bp, Mus musculus
tcaacgagccataaacccccaagga

SEQ ID NO: 53987 - DNA, 25 bp, Mus musculus
tcaacgaggagatgcagcgcatgct

SEQ ID NO: 53988 - DNA, 25 bp, Mus musculus
tcaacgatgggaccgacgagaagaa

SEQ ID NO: 53989 - DNA, 25 bp, Mus musculus
tcaacgggcaagtccctactggaga

SEQ ID NO: 53990 - DNA, 25 bp, Mus musculus
tcaacgggcctgctaaatgcaaaga

SEQ ID NO: 53991 - DNA, 25 bp, Mus musculus
tcaacgtagaccatgaagcagtact

SEQ ID NO: 53992 - DNA, 25 bp, Mus musculus
tcaacgtccagaacttccatatcag

SEQ ID NO: 53993 - DNA, 25 bp, Mus musculus
tcaacgtccatgactcttgagggat

SEQ ID NO: 53994 - DNA, 25 bp, Mus musculus
tcaacgtcctggcttttccgtgcaa

SEQ ID NO: 53995 - DNA, 25 bp, Mus musculus
tcaacgtcggccttttcgaccagta

SEQ ID NO: 53996 - DNA, 25 bp, Mus musculus
tcaacgtgcctgtcattggcggcca

SEQ ID NO: 53997 - DNA, 25 bp, Mus musculus
tcaacgtgggctacctagaggcact

SEQ ID NO: 53998 - DNA, 25 bp, Mus musculus
tcaacgtgggcttcctagaggcact

SEQ ID NO: 53999 - DNA, 25 bp, Mus musculus
tcaacgtggtcaccgccttctatgt

SEQ ID NO: 54000 - DNA, 25 bp, Mus musculus
tcaacgttgaaacaaggaccattgc

SEQ ID NO: 54001 - DNA, 25 bp, Mus musculus
tcaacgttgttgacctaaagaagaa

SEQ ID NO: 54002 - DNA, 25 bp, Mus musculus
tcaactacaagcagaagtcaaggag

SEQ ID NO: 54003 - DNA, 25 bp, Mus musculus
tcaactactagagagtagtacaaca

SEQ ID NO: 54004 - DNA, 25 bp, Mus musculus
tcaactagagataaaaataccagaa

SEQ ID NO: 54005 - DNA, 25 bp, Mus musculus
tcaactagcaatatccaagacgcgc

SEQ ID NO: 54006 - DNA, 25 bp, Mus musculus
tcaactcaaacttgctgctaaagct

SEQ ID NO: 54007 - DNA, 25 bp, Mus musculus
tcaactcaacgccaagactacatag

SEQ ID NO: 54008 - DNA, 25 bp, Mus musculus
tcaactcacaaaacgtctatcagaa

SEQ ID NO: 54009 - DNA, 25 bp, Mus musculus
tcaactctccagctagcttcagtgg

SEQ ID NO: 54010 - DNA, 25 bp, Mus musculus
tcaactctcttaccgggagatggag

SEQ ID NO: 54011 - DNA, 25 bp, Mus musculus
tcaactctgaggacatgcaggagat

SEQ ID NO: 54012 - DNA, 25 bp, Mus musculus
tcaactcttctcagtcaagctaaga

SEQ ID NO: 54013 - DNA, 25 bp, Mus musculus
tcaactgcatgagagaagaatgaag

SEQ ID NO: 54014 - DNA, 25 bp, Mus musculus
tcaactgcctttcccagcctggtgt

SEQ ID NO: 54015 - DNA, 25 bp, Mus musculus
tcaactgctgctactcagccttgct

SEQ ID NO: 54016 - DNA, 25 bp, Mus musculus
tcaactggactgctccagaaggagc

SEQ ID NO: 54017 - DNA, 25 bp, Mus musculus
tcaactggatggtgacacgcatcaa

SEQ ID NO: 54018 - DNA, 25 bp, Mus musculus
tcaactggcatgttgggccgtatca

SEQ ID NO: 54019 - DNA, 25 bp, Mus musculus
tcaactggctgaagaaacgcacggg

SEQ ID NO: 54020 - DNA, 25 bp, Mus musculus
tcaactgggcatgctcacatagacg

SEQ ID NO: 54021 - DNA, 25 bp, Mus musculus
tcaactgtaagaagaagggaaagct

SEQ ID NO: 54022 - DNA, 25 bp, Mus musculus
tcaactgtcgcttcattgagcagcg

SEQ ID NO: 54023 - DNA, 25 bp, Mus musculus
tcaacttccaggaacaggcggctac

SEQ ID NO: 54024 - DNA, 25 bp, Mus musculus
tcaacttcgagaacatgagcaacga

SEQ ID NO: 54025 - DNA, 25 bp, Mus musculus
tcaacttctgtcatgagaaataagc

SEQ ID NO: 54026 - DNA, 25 bp, Mus musculus
tcaacttggacaactaccacctctg

SEQ ID NO: 54027 - DNA, 25 bp, Mus musculus
tcaacttgtagctgttctagaccca

SEQ ID NO: 54028 - DNA, 25 bp, Mus musculus
tcaactttgcgaggtgaggtgtcaa

SEQ ID NO: 54029 - DNA, 25 bp, Mus musculus
tcaacttttttatccagtgttcagg

SEQ ID NO: 54030 - DNA, 25 bp, Mus musculus
tcaagaaaaagtaaccacagccaag

SEQ ID NO: 54031 - DNA, 25 bp, Mus musculus
tcaagaaaatcaaagtcgtcttcac

SEQ ID NO: 54032 - DNA, 25 bp, Mus musculus
tcaagaaaatcatagtcgtcttcac

SEQ ID NO: 54033 - DNA, 25 bp, Mus musculus
tcaagaaagcaggatggaccatagt

SEQ ID NO: 54034 - DNA, 25 bp, Mus musculus
tcaagaaatgctggtttgctacagt

SEQ ID NO: 54035 - DNA, 25 bp, Mus musculus
tcaagaacaagcctctcctgtctgc

SEQ ID NO: 54036 - DNA, 25 bp, Mus musculus
tcaagaaccctgataccgtcctctg

SEQ ID NO: 54037 - DNA, 25 bp, Mus musculus
tcaagaagaaaagtcagcccacctg

SEQ ID NO: 54038 - DNA, 25 bp, Mus musculus
tcaagaagaccgagtgaatgtggcc

SEQ ID NO: 54039 - DNA, 25 bp, Mus musculus
tcaagaagcacggtgtgtacaaccc

SEQ ID NO: 54040 - DNA, 25 bp, Mus musculus
tcaagaaggtgaagatgacaccttt

SEQ ID NO: 54041 - DNA, 25 bp, Mus musculus
tcaagaagtgaagaatggcattcct

SEQ ID NO: 54042 - DNA, 25 bp, Mus musculus
tcaagaatggagacgtgacctgcgt

SEQ ID NO: 54043 - DNA, 25 bp, Mus musculus
tcaagaatgtccactgtgcttaagc

SEQ ID NO: 54044 - DNA, 25 bp, Mus musculus
tcaagaatgtgctgggacagcctcc

SEQ ID NO: 54045 - DNA, 25 bp, Mus musculus
tcaagacatccaccagtctgaagga

SEQ ID NO: 54046 - DNA, 25 bp, Mus musculus
tcaagacatggagtgtgtgccctgc

SEQ ID NO: 54047 - DNA, 25 bp, Mus musculus
tcaagaccaactcagctgtccggac

SEQ ID NO: 54048 - DNA, 25 bp, Mus musculus
tcaagaccagagtgagtgcacaagc

SEQ ID NO: 54049 - DNA, 25 bp, Mus musculus
tcaagactaggtttccaacctggac

SEQ ID NO: 54050 - DNA, 25 bp, Mus musculus
tcaagactcaaaagagtactgtgct

SEQ ID NO: 54051 - DNA, 25 bp, Mus musculus
tcaagactgaaactgctcaaaagag

SEQ ID NO: 54052 - DNA, 25 bp, Mus musculus
tcaagactgttccacacgaccaggt

SEQ ID NO: 54053 - DNA, 25 bp, Mus musculus
tcaagacttctacaagctggagctg

SEQ ID NO: 54054 - DNA, 25 bp, Mus musculus
tcaagactttggtggacaaatggcc

SEQ ID NO: 54055 - DNA, 25 bp, Mus musculus
tcaagagaacggttgtgaggaatac

SEQ ID NO: 54056 - DNA, 25 bp, Mus musculus
tcaagagagtcgtggatagagagat

SEQ ID NO: 54057 - DNA, 25 bp, Mus musculus
tcaagagatgttgtgtctcgatcca

SEQ ID NO: 54058 - DNA, 25 bp, Mus musculus
tcaagagcacgaagaggaagcacgc

SEQ ID NO: 54059 - DNA, 25 bp, Mus musculus
tcaagagcagaaggtggacagatcc

SEQ ID NO: 54060 - DNA, 25 bp, Mus musculus
tcaagagccagtgtatggcaataaa

SEQ ID NO: 54061 - DNA, 25 bp, Mus musculus
tcaagaggaagcacgttgccttgtg

SEQ ID NO: 54062 - DNA, 25 bp, Mus musculus
tcaagaggaggagatgtgctttgaa

SEQ ID NO: 54063 - DNA, 25 bp, Mus musculus
tcaagaggagtccacctcacctcat

SEQ ID NO: 54064 - DNA, 25 bp, Mus musculus
tcaagaggcacaccccactgagcaa

SEQ ID NO: 54065 - DNA, 25 bp, Mus musculus
tcaagaggctccaagaatataggac

SEQ ID NO: 54066 - DNA, 25 bp, Mus musculus
tcaagaggctcgatcaagtgggcgc

SEQ ID NO: 54067 - DNA, 25 bp, Mus musculus
tcaagagggagttcattcaggaacc

SEQ ID NO: 54068 - DNA, 25 bp, Mus musculus
tcaagaggtctgtgcctacctgtgc

SEQ ID NO: 54069 - DNA, 25 bp, Mus musculus
tcaagaggtgtcttccagtgtggct

SEQ ID NO: 54070 - DNA, 25 bp, Mus musculus
tcaagagtgacattagcatcccgtg

SEQ ID NO: 54071 - DNA, 25 bp, Mus musculus
tcaagagtggcagacccttcaacca

SEQ ID NO: 54072 - DNA, 25 bp, Mus musculus
tcaagatcaacagaaggttcccttc

SEQ ID NO: 54073 - DNA, 25 bp, Mus musculus
tcaagatgctagagggcctaagtcc

SEQ ID NO: 54074 - DNA, 25 bp, Mus musculus
tcaagattcgggagatgattctgaa

SEQ ID NO: 54075 - DNA, 25 bp, Mus musculus
tcaagattctacacaaacaaatgga

SEQ ID NO: 54076 - DNA, 25 bp, Mus musculus
tcaagattctgagctccccatggtt

SEQ ID NO: 54077 - DNA, 25 bp, Mus musculus
tcaagcaagaggacccaaagaaaga

SEQ ID NO: 54078 - DNA, 25 bp, Mus musculus
tcaagcaagccactgcagagaagca

SEQ ID NO: 54079 - DNA, 25 bp, Mus musculus
tcaagcaagtggacgtgcctacgct

SEQ ID NO: 54080 - DNA, 25 bp, Mus musculus
tcaagcaattttcccaggagtcttc

SEQ ID NO: 54081 - DNA, 25 bp, Mus musculus
tcaagcactgcacctagcagaaatt

SEQ ID NO: 54082 - DNA, 25 bp, Mus musculus
tcaagcacttcctggaggacagcag

SEQ ID NO: 54083 - DNA, 25 bp, Mus musculus
tcaagcagaactggagtcatgctgc

SEQ ID NO: 54084 - DNA, 25 bp, Mus musculus
tcaagcagcaaagtttgatccttct

SEQ ID NO: 54085 - DNA, 25 bp, Mus musculus
tcaagccagactatcaaccctgtgg

SEQ ID NO: 54086 - DNA, 25 bp, Mus musculus
tcaagccagggaagctaagacctaa

SEQ ID NO: 54087 - DNA, 25 bp, Mus musculus
tcaagccagggatgctaagacctaa

SEQ ID NO: 54088 - DNA, 25 bp, Mus musculus
tcaagccatgactcactggagggag

SEQ ID NO: 54089 - DNA, 25 bp, Mus musculus
tcaagcccgggctcaagaatctgaa

SEQ ID NO: 54090 - DNA, 25 bp, Mus musculus
tcaagcccgtggcaatcagacggct

SEQ ID NO: 54091 - DNA, 25 bp, Mus musculus
tcaagcccgtgggaatcagacggct

SEQ ID NO: 54092 - DNA, 25 bp, Mus musculus
tcaagccctacatgctctgagccag

SEQ ID NO: 54093 - DNA, 25 bp, Mus musculus
tcaagcgactcctgtatgtttcctg

SEQ ID NO: 54094 - DNA, 25 bp, Mus musculus
tcaagcgagggcctggatctcacag

SEQ ID NO: 54095 - DNA, 25 bp, Mus musculus
tcaagcggctgcacctgggtacggt

SEQ ID NO: 54096 - DNA, 25 bp, Mus musculus
tcaagcgtctggctgagaactcagc

SEQ ID NO: 54097 - DNA, 25 bp, Mus musculus
tcaagcgttcccctgtcaaaagcct

SEQ ID NO: 54098 - DNA, 25 bp, Mus musculus
tcaagctcaagaacttcaagacagc

SEQ ID NO: 54099 - DNA, 25 bp, Mus musculus
tcaagctcacaaactctgacccaat

SEQ ID NO: 54100 - DNA, 25 bp, Mus musculus
tcaagctcttgcattagaatctcgg

SEQ ID NO: 54101 - DNA, 25 bp, Mus musculus
tcaagctgccatggaattcttacaa

SEQ ID NO: 54102 - DNA, 25 bp, Mus musculus
tcaagctgctattgtccgcatcatg

SEQ ID NO: 54103 - DNA, 25 bp, Mus musculus
tcaagctggcaaaatggtagggctg

SEQ ID NO: 54104 - DNA, 25 bp, Mus musculus
tcaagctgtctaaaattggcaagac

SEQ ID NO: 54105 - DNA, 25 bp, Mus musculus
tcaagcttctatttctggaggcctg

SEQ ID NO: 54106 - DNA, 25 bp, Mus musculus
tcaagcttgaccagaaacagcagtc

SEQ ID NO: 54107 - DNA, 25 bp, Mus musculus
tcaaggaaccagagcctggaactcc

SEQ ID NO: 54108 - DNA, 25 bp, Mus musculus
tcaaggacagcgaggccctccagga

SEQ ID NO: 54109 - DNA, 25 bp, Mus musculus
tcaaggaccatctccggatcttccg

SEQ ID NO: 54110 - DNA, 25 bp, Mus musculus
tcaaggacctccctgcaatggtaca

SEQ ID NO: 54111 - DNA, 25 bp, Mus musculus
tcaaggacttcagttacaaccggga

SEQ ID NO: 54112 - DNA, 25 bp, Mus musculus
tcaaggagatgttcctggactacag

SEQ ID NO: 54113 - DNA, 25 bp, Mus musculus
tcaaggagctgtttggtcacctgag

SEQ ID NO: 54114 - DNA, 25 bp, Mus musculus
tcaaggaggccatgcatatcttaag

SEQ ID NO: 54115 - DNA, 25 bp, Mus musculus
tcaaggaggctatggaacaacagaa

SEQ ID NO: 54116 - DNA, 25 bp, Mus musculus
tcaaggagtcaaaaagacaggaact

SEQ ID NO: 54117 - DNA, 25 bp, Mus musculus
tcaaggagtccagagtgaccacatt

SEQ ID NO: 54118 - DNA, 25 bp, Mus musculus
tcaaggagtcttgtgattcatcacc

SEQ ID NO: 54119 - DNA, 25 bp, Mus musculus
tcaaggagttcctgagacagtaccg

SEQ ID NO: 54120 - DNA, 25 bp, Mus musculus
tcaaggatctaattcagcagcatgt

SEQ ID NO: 54121 - DNA, 25 bp, Mus musculus
tcaaggatgatcataagcaaacatg

SEQ ID NO: 54122 - DNA, 25 bp, Mus musculus
tcaaggattccagctgaacggatgc

SEQ ID NO: 54123 - DNA, 25 bp, Mus musculus
tcaaggcaatcagggctgtaacgga

SEQ ID NO: 54124 - DNA, 25 bp, Mus musculus
tcaaggcaccttgcaagtcgtccgt

SEQ ID NO: 54125 - DNA, 25 bp, Mus musculus
tcaaggcacggtcctctaggttctc

SEQ ID NO: 54126 - DNA, 25 bp, Mus musculus
tcaaggcagaatcttcaaaaactgt

SEQ ID NO: 54127 - DNA, 25 bp, Mus musculus
tcaaggccaaggacagcacttacca

SEQ ID NO: 54128 - DNA, 25 bp, Mus musculus
tcaaggccaccttcaactatgaaaa

SEQ ID NO: 54129 - DNA, 25 bp, Mus musculus
tcaaggccctcacgaccattgtcta

SEQ ID NO: 54130 - DNA, 25 bp, Mus musculus
tcaaggccctcaggaccattgtcta

SEQ ID NO: 54131 - DNA, 25 bp, Mus musculus
tcaaggccgacaccccttatagagt

SEQ ID NO: 54132 - DNA, 25 bp, Mus musculus
tcaaggcgctgcaagagacaaaggc

SEQ ID NO: 54133 - DNA, 25 bp, Mus musculus
tcaaggctgatatgtggagttttgg

SEQ ID NO: 54134 - DNA, 25 bp, Mus musculus
tcaaggctggctttgcaggagacca

SEQ ID NO: 54135 - DNA, 25 bp, Mus musculus
tcaaggctgtgatgcgccgctggct

SEQ ID NO: 54136 - DNA, 25 bp, Mus musculus
tcaaggctgtggatagcctggtgcc

SEQ ID NO: 54137 - DNA, 25 bp, Mus musculus
tcaagggaagagaaatcaaaccaaa

SEQ ID NO: 54138 - DNA, 25 bp, Mus musculus
tcaagggagcaacggtggctttcct

SEQ ID NO: 54139 - DNA, 25 bp, Mus musculus
tcaagggaggagtcgtttgaagacc

SEQ ID NO: 54140 - DNA, 25 bp, Mus musculus
tcaagggcctccaagggaatcccat

SEQ ID NO: 54141 - DNA, 25 bp, Mus musculus
tcaagggcctcctagggaatcccat

SEQ ID NO: 54142 - DNA, 25 bp, Mus musculus
tcaagggcctctgccgcatcatggg

SEQ ID NO: 54143 - DNA, 25 bp, Mus musculus
tcaagggttccttctgcaaccaggg

SEQ ID NO: 54144 - DNA, 25 bp, Mus musculus
tcaaggtaaaaaggcagagggagcc

SEQ ID NO: 54145 - DNA, 25 bp, Mus musculus
tcaaggtcaagacggtctaccgaca

SEQ ID NO: 54146 - DNA, 25 bp, Mus musculus
tcaaggtcaccaaaatcaagagaag

SEQ ID NO: 54147 - DNA, 25 bp, Mus musculus
tcaaggtcagagatcaaaaacaatc

SEQ ID NO: 54148 - DNA, 25 bp, Mus musculus
tcaaggtcttggttacgaacggagc

SEQ ID NO: 54149 - DNA, 25 bp, Mus musculus
tcaaggtctttaccccagaagaagc

SEQ ID NO: 54150 - DNA, 25 bp, Mus musculus
tcaaggtggccttcatggacaaaaa

SEQ ID NO: 54151 - DNA, 25 bp, Mus musculus
tcaaggtggtatcctgctactgctc

SEQ ID NO: 54152 - DNA, 25 bp, Mus musculus
tcaaggtggtgatggatatccccta

SEQ ID NO: 54153 - DNA, 25 bp, Mus musculus
tcaaggtgtttgttctggacgaggc

SEQ ID NO: 54154 - DNA, 25 bp, Mus musculus
tcaaggttacatcccagtggaagga

SEQ ID NO: 54155 - DNA, 25 bp, Mus musculus
tcaaggttacatgccagtggaagga

SEQ ID NO: 54156 - DNA, 25 bp, Mus musculus
tcaaggttccgaccgggtgctgata

SEQ ID NO: 54157 - DNA, 25 bp, Mus musculus
tcaagtaacactttcagggaagatt

SEQ ID NO: 54158 - DNA, 25 bp, Mus musculus
tcaagtaacgctaacgaagagaagg

SEQ ID NO: 54159 - DNA, 25 bp, Mus musculus
tcaagtacattgaaaacagagatgt

SEQ ID NO: 54160 - DNA, 25 bp, Mus musculus
tcaagtactacaggatgatgcagac

SEQ ID NO: 54161 - DNA, 25 bp, Mus musculus
tcaagtactacgcagagttgtgtgc

SEQ ID NO: 54162 - DNA, 25 bp, Mus musculus
tcaagtactgtaatcacccaggcac

SEQ ID NO: 54163 - DNA, 25 bp, Mus musculus
tcaagtagacatgaaacagcccctg

SEQ ID NO: 54164 - DNA, 25 bp, Mus musculus
tcaagtagctgtgaaaaccagcgcc

SEQ ID NO: 54165 - DNA, 25 bp, Mus musculus
tcaagtatcggctcgtgggctccca

SEQ ID NO: 54166 - DNA, 25 bp, Mus musculus
tcaagtatgagctgatgcgcccatc

SEQ ID NO: 54167 - DNA, 25 bp, Mus musculus
tcaagtatgccaaagacacgcgcta

SEQ ID NO: 54168 - DNA, 25 bp, Mus musculus
tcaagtattggaaaggcaagcacct

SEQ ID NO: 54169 - DNA, 25 bp, Mus musculus
tcaagtcacagccacggatgaggac

SEQ ID NO: 54170 - DNA, 25 bp, Mus musculus
tcaagtcagaggaggacaagatccc

SEQ ID NO: 54171 - DNA, 25 bp, Mus musculus
tcaagtcagttgaggacgtcgtggt

SEQ ID NO: 54172 - DNA, 25 bp, Mus musculus
tcaagtcatgtgcagttttgcaaac

SEQ ID NO: 54173 - DNA, 25 bp, Mus musculus
tcaagtcatgtggagttttgcaaac

SEQ ID NO: 54174 - DNA, 25 bp, Mus musculus
tcaagtcgagaagacaacgtgaccc

SEQ ID NO: 54175 - DNA, 25 bp, Mus musculus
tcaagtcgctgatcgcctcagagga

SEQ ID NO: 54176 - DNA, 25 bp, Mus musculus
tcaagtcgtatgaaaaagaaaaggc

SEQ ID NO: 54177 - DNA, 25 bp, Mus musculus
tcaagtctacccctgcagccattgt

SEQ ID NO: 54178 - DNA, 25 bp, Mus musculus
tcaagtctcaactgaactgccttct

SEQ ID NO: 54179 - DNA, 25 bp, Mus musculus
tcaagtctctaagcttgtggtccac

SEQ ID NO: 54180 - DNA, 25 bp, Mus musculus
tcaagtctcttgaggctcaggcgga

SEQ ID NO: 54181 - DNA, 25 bp, Mus musculus
tcaagtctgctctacaagccatagg

SEQ ID NO: 54182 - DNA, 25 bp, Mus musculus
tcaagtctgtcatcggccacctgca

SEQ ID NO: 54183 - DNA, 25 bp, Mus musculus
tcaagtgcagaaacgccctgaagct

SEQ ID NO: 54184 - DNA, 25 bp, Mus musculus
tcaagtgcccacaggttgtcatatc

SEQ ID NO: 54185 - DNA, 25 bp, Mus musculus
tcaagtgctaggagtccaggtgcca

SEQ ID NO: 54186 - DNA, 25 bp, Mus musculus
tcaagtgctcgaaaatggtgcctgt

SEQ ID NO: 54187 - DNA, 25 bp, Mus musculus
tcaagtggagaagtacaatagggaa

SEQ ID NO: 54188 - DNA, 25 bp, Mus musculus
tcaagtgggcaaaagagcatgatgc

SEQ ID NO: 54189 - DNA, 25 bp, Mus musculus
tcaagtgggctgttgctgccaggat

SEQ ID NO: 54190 - DNA, 25 bp, Mus musculus
tcaagtggttgcaaaaaagtcttcc

SEQ ID NO: 54191 - DNA, 25 bp, Mus musculus
tcaagtgttgcaggagaaacttcag

SEQ ID NO: 54192 - DNA, 25 bp, Mus musculus
tcaagttaagagctcagacatacaa

SEQ ID NO: 54193 - DNA, 25 bp, Mus musculus
tcaagttatcatcaacctgggaggg

SEQ ID NO: 54194 - DNA, 25 bp, Mus musculus
tcaagttatggtgggaaaagattca

SEQ ID NO: 54195 - DNA, 25 bp, Mus musculus
tcaagttcaaactgcagactctgct

SEQ ID NO: 54196 - DNA, 25 bp, Mus musculus
tcaagttcccctacaagtctcggga

SEQ ID NO: 54197 - DNA, 25 bp, Mus musculus
tcaagttcgcaccagcaaacatagg

SEQ ID NO: 54198 - DNA, 25 bp, Mus musculus
tcaagttcgtttaggtcgtctctac

SEQ ID NO: 54199 - DNA, 25 bp, Mus musculus
tcaagttctaattctcaaagggcag

SEQ ID NO: 54200 - DNA, 25 bp, Mus musculus
tcaagttcttccacgagaatgagct

SEQ ID NO: 54201 - DNA, 25 bp, Mus musculus
tcaagttgaactaccaccatttgtt

SEQ ID NO: 54202 - DNA, 25 bp, Mus musculus
tcaagttgaacttccaccatttgtt

SEQ ID NO: 54203 - DNA, 25 bp, Mus musculus
tcaagttgcatgtgaattctgccag

SEQ ID NO: 54204 - DNA, 25 bp, Mus musculus
tcaagttggcacaaggagaatacat

SEQ ID NO: 54205 - DNA, 25 bp, Mus musculus
tcaagtttgcctcccgataatgaga

SEQ ID NO: 54206 - DNA, 25 bp, Mus musculus
tcaagtttgcctccttggagttttc

SEQ ID NO: 54207 - DNA, 25 bp, Mus musculus
tcaagttttgggagatcaccgcagg

SEQ ID NO: 54208 - DNA, 25 bp, Mus musculus
tcaataagactgaagcgtcgactga

SEQ ID NO: 54209 - DNA, 25 bp, Mus musculus
tcaataatcagagcccatgaagccc

SEQ ID NO: 54210 - DNA, 25 bp, Mus musculus
tcaatacacaattcaggcattagtt

SEQ ID NO: 54211 - DNA, 25 bp, Mus musculus
tcaataccaaccagttttttgcctc

SEQ ID NO: 54212 - DNA, 25 bp, Mus musculus
tcaataccaacgaaaagcagcggtt

SEQ ID NO: 54213 - DNA, 25 bp, Mus musculus
tcaatagagacatggcgggagacca

SEQ ID NO: 54214 - DNA, 25 bp, Mus musculus
tcaataggacccttaacgtttgtct

SEQ ID NO: 54215 - DNA, 25 bp, Mus musculus
tcaatatagaccttctgatttgctg

SEQ ID NO: 54216 - DNA, 25 bp, Mus musculus
tcaatatccgacaacaacaagacac

SEQ ID NO: 54217 - DNA, 25 bp, Mus musculus
tcaatatggagaggcacccagccca

SEQ ID NO: 54218 - DNA, 25 bp, Mus musculus
tcaatattaacagggttgcagcgca

SEQ ID NO: 54219 - DNA, 25 bp, Mus musculus
tcaatatttgatggtttccgagatt

SEQ ID NO: 54220 - DNA, 25 bp, Mus musculus
tcaatcaaaatttgccactgctttg

SEQ ID NO: 54221 - DNA, 25 bp, Mus musculus
tcaatcaactgaaagctttgttgcg

SEQ ID NO: 54222 - DNA, 25 bp, Mus musculus
tcaatcaatatgctaagtggtggat

SEQ ID NO: 54223 - DNA, 25 bp, Mus musculus
tcaatcacgtggctgtagcagtgcc

SEQ ID NO: 54224 - DNA, 25 bp, Mus musculus
tcaatcagaacaacggaaatatcag

SEQ ID NO: 54225 - DNA, 25 bp, Mus musculus
tcaatcagaacctcaatgatgtcct

SEQ ID NO: 54226 - DNA, 25 bp, Mus musculus
tcaatccatagaagtcttggacagg

SEQ ID NO: 54227 - DNA, 25 bp, Mus musculus
tcaatccgaggatcagatggtgcga

SEQ ID NO: 54228 - DNA, 25 bp, Mus musculus
tcaatccgtccttggcttccagcag

SEQ ID NO: 54229 - DNA, 25 bp, Mus musculus
tcaatcctcagtgggtcagcgtgac

SEQ ID NO: 54230 - DNA, 25 bp, Mus musculus
tcaatcggatgaggagcctgcttcc

SEQ ID NO: 54231 - DNA, 25 bp, Mus musculus
tcaatcggcccaccaaaaagaatgc

SEQ ID NO: 54232 - DNA, 25 bp, Mus musculus
tcaatcgggatgtcttggatgaaga

SEQ ID NO: 54233 - DNA, 25 bp, Mus musculus
tcaatctcatcccactgaggacagc

SEQ ID NO: 54234 - DNA, 25 bp, Mus musculus
tcaatctccctgtaggaggcctaag

SEQ ID NO: 54235 - DNA, 25 bp, Mus musculus
tcaatgaaagcaggcagaaggacca

SEQ ID NO: 54236 - DNA, 25 bp, Mus musculus
tcaatgaaagtgagcaagcacctgc

SEQ ID NO: 54237 - DNA, 25 bp, Mus musculus
tcaatgaagaaagtagcagggatgg

SEQ ID NO: 54238 - DNA, 25 bp, Mus musculus
tcaatgaagacacccaggatgagct

SEQ ID NO: 54239 - DNA, 25 bp, Mus musculus
tcaatgacaagcgtaaaaagaacct

SEQ ID NO: 54240 - DNA, 25 bp, Mus musculus
tcaatgacatttcattctggctgcc

SEQ ID NO: 54241 - DNA, 25 bp, Mus musculus
tcaatgactgctagcacctattatg

SEQ ID NO: 54242 - DNA, 25 bp, Mus musculus
tcaatgaggtggaaaaccagatcct

SEQ ID NO: 54243 - DNA, 25 bp, Mus musculus
tcaatgagtccttccggccagacta

SEQ ID NO: 54244 - DNA, 25 bp, Mus musculus
tcaatgcactagacaactcggaaaa

SEQ ID NO: 54245 - DNA, 25 bp, Mus musculus
tcaatgcagaagctgtcaagaacaa

SEQ ID NO: 54246 - DNA, 25 bp, Mus musculus
tcaatgcagccacgcagatcttctt

SEQ ID NO: 54247 - DNA, 25 bp, Mus musculus
tcaatgccattaacaattctgaaat

SEQ ID NO: 54248 - DNA, 25 bp, Mus musculus
tcaatgccctggagatcgagctgca

SEQ ID NO: 54249 - DNA, 25 bp, Mus musculus
tcaatgcttaagtacccagatagtc

SEQ ID NO: 54250 - DNA, 25 bp, Mus musculus
tcaatggaaagaactcgagaggctc

SEQ ID NO: 54251 - DNA, 25 bp, Mus musculus
tcaatggacagacagagaaaagagg

SEQ ID NO: 54252 - DNA, 25 bp, Mus musculus
tcaatggagcaagtcacagtcgtcg

SEQ ID NO: 54253 - DNA, 25 bp, Mus musculus
tcaatggccccattaagggaagagt

SEQ ID NO: 54254 - DNA, 25 bp, Mus musculus
tcaatgggcaccaagatgtcttgtg

SEQ ID NO: 54255 - DNA, 25 bp, Mus musculus
tcaatgggtcacaggtgacgcccaa

SEQ ID NO: 54256 - DNA, 25 bp, Mus musculus
tcaatgtcacggagacaccagggac

SEQ ID NO: 54257 - DNA, 25 bp, Mus musculus
tcaatgtcatcaacacctgggctct

SEQ ID NO: 54258 - DNA, 25 bp, Mus musculus
tcaatgtcgctaacaagggactact

SEQ ID NO: 54259 - DNA, 25 bp, Mus musculus
tcaatgtgctcaaggacttcaccct

SEQ ID NO: 54260 - DNA, 25 bp, Mus musculus
tcaatgtggtggagaacctcgcgct

SEQ ID NO: 54261 - DNA, 25 bp, Mus musculus
tcaatgtgttccatgcccattcggg

SEQ ID NO: 54262 - DNA, 25 bp, Mus musculus
tcaatgtgtttgtgggaaaaggcca

SEQ ID NO: 54263 - DNA, 25 bp, Mus musculus
tcaatgttggctctggcttggcgct

SEQ ID NO: 54264 - DNA, 25 bp, Mus musculus
tcaattaaggcaaatgctggagaag

SEQ ID NO: 54265 - DNA, 25 bp, Mus musculus
tcaattcccgccctcggatggagag

SEQ ID NO: 54266 - DNA, 25 bp, Mus musculus
tcaattctgtggctgcatagtgggc

SEQ ID NO: 54267 - DNA, 25 bp, Mus musculus
tcaattctgtgggtgcatagtgggc

SEQ ID NO: 54268 - DNA, 25 bp, Mus musculus
tcaattcttggagaacacaaagaag

SEQ ID NO: 54269 - DNA, 25 bp, Mus musculus
tcaattggaagagaacccgggagcc

SEQ ID NO: 54270 - DNA, 25 bp, Mus musculus
tcacaaaacttgcaagaactccaag

SEQ ID NO: 54271 - DNA, 25 bp, Mus musculus
tcacaaacagagagtggctgaagtg

SEQ ID NO: 54272 - DNA, 25 bp, Mus musculus
tcacaaacagatccctgaaagagga

SEQ ID NO: 54273 - DNA, 25 bp, Mus musculus
tcacaaagttcaccctgggaaagga

SEQ ID NO: 54274 - DNA, 25 bp, Mus musculus
tcacaaatcttcgaaggactcctcg

SEQ ID NO: 54275 - DNA, 25 bp, Mus musculus
tcacaaatggagtcagctccccaag

SEQ ID NO: 54276 - DNA, 25 bp, Mus musculus
tcacaacaatagcaatcccctttgg

SEQ ID NO: 54277 - DNA, 25 bp, Mus musculus
tcacaacagtgcaaagagaacatgt

SEQ ID NO: 54278 - DNA, 25 bp, Mus musculus
tcacaacatcaaggctaaggaggag

SEQ ID NO: 54279 - DNA, 25 bp, Mus musculus
tcacaaccatttggcgctgagctat

SEQ ID NO: 54280 - DNA, 25 bp, Mus musculus
tcacaaccgaagacatcaaagcagc

SEQ ID NO: 54281 - DNA, 25 bp, Mus musculus
tcacaacgtgtctgtgttcctggct

SEQ ID NO: 54282 - DNA, 25 bp, Mus musculus
tcacaactacctcgtctacgtcgag

SEQ ID NO: 54283 - DNA, 25 bp, Mus musculus
tcacaagaattgaagtgggagacgt

SEQ ID NO: 54284 - DNA, 25 bp, Mus musculus
tcacaagagaatttgagtctgtgct

SEQ ID NO: 54285 - DNA, 25 bp, Mus musculus
tcacaagagtacagctacgagcagt

SEQ ID NO: 54286 - DNA, 25 bp, Mus musculus
tcacaagagtactgctacgagcagt

SEQ ID NO: 54287 - DNA, 25 bp, Mus musculus
tcacaagcagacgtggcagtatttg

SEQ ID NO: 54288 - DNA, 25 bp, Mus musculus
tcacaaggacccttgggttaagagc

SEQ ID NO: 54289 - DNA, 25 bp, Mus musculus
tcacaaggacctttggctgcagatg

SEQ ID NO: 54290 - DNA, 25 bp, Mus musculus
tcacaaggctgagatccatactcag

SEQ ID NO: 54291 - DNA, 25 bp, Mus musculus
tcacaaggctttgcagagaaaagac

SEQ ID NO: 54292 - DNA, 25 bp, Mus musculus
tcacaagtggcccataacagtaggg

SEQ ID NO: 54293 - DNA, 25 bp, Mus musculus
tcacaagtgtccagaggagtgaagg

SEQ ID NO: 54294 - DNA, 25 bp, Mus musculus
tcacaagttgcatgttgactttagg

SEQ ID NO: 54295 - DNA, 25 bp, Mus musculus
tcacaatcagattcagaaggctcag

SEQ ID NO: 54296 - DNA, 25 bp, Mus musculus
tcacaatgacagagggaaagctgtt

SEQ ID NO: 54297 - DNA, 25 bp, Mus musculus
tcacaatgtagactctgatgacctg

SEQ ID NO: 54298 - DNA, 25 bp, Mus musculus
tcacaatttgaaaagataagccaag

SEQ ID NO: 54299 - DNA, 25 bp, Mus musculus
tcacacaaaaatccagcagaaattg

SEQ ID NO: 54300 - DNA, 25 bp, Mus musculus
tcacacaacgaactagaaaagcaca

SEQ ID NO: 54301 - DNA, 25 bp, Mus musculus
tcacacaagagtctgtcctcaggca

SEQ ID NO: 54302 - DNA, 25 bp, Mus musculus
tcacacagagacattgtacatagct

SEQ ID NO: 54303 - DNA, 25 bp, Mus musculus
tcacaccactcgttccagtcagagg

SEQ ID NO: 54304 - DNA, 25 bp, Mus musculus
tcacaccaggcctgaagacgatcat

SEQ ID NO: 54305 - DNA, 25 bp, Mus musculus
tcacaccagtgttctatcctgttga

SEQ ID NO: 54306 - DNA, 25 bp, Mus musculus
tcacacccttatgtacagctactgg

SEQ ID NO: 54307 - DNA, 25 bp, Mus musculus
tcacaccgtggataaggaacaaggg

SEQ ID NO: 54308 - DNA, 25 bp, Mus musculus
tcacacctaagggagattgctcttc

SEQ ID NO: 54309 - DNA, 25 bp, Mus musculus
tcacacctggcttccattatgatgt

SEQ ID NO: 54310 - DNA, 25 bp, Mus musculus
tcacaccttatgcagtctattccag

SEQ ID NO: 54311 - DNA, 25 bp, Mus musculus
tcacaccttgtgtgatattgtagag

SEQ ID NO: 54312 - DNA, 25 bp, Mus musculus
tcacacggtctggaagcaacccggg

SEQ ID NO: 54313 - DNA, 25 bp, Mus musculus
tcacactcaactggaccacagatga

SEQ ID NO: 54314 - DNA, 25 bp, Mus musculus
tcacactgaggacacaacaaggatc

SEQ ID NO: 54315 - DNA, 25 bp, Mus musculus
tcacacttgcagattacgtagacca

SEQ ID NO: 54316 - DNA, 25 bp, Mus musculus
tcacagaaaaggaggctaagaaaat

SEQ ID NO: 54317 - DNA, 25 bp, Mus musculus
tcacagaagctggaagttctgatgt

SEQ ID NO: 54318 - DNA, 25 bp, Mus musculus
tcacagacaagaggacaatcaagga

SEQ ID NO: 54319 - DNA, 25 bp, Mus musculus
tcacagacaagttttcgccgcttac

SEQ ID NO: 54320 - DNA, 25 bp, Mus musculus
tcacagacatcttgactagagtcat

SEQ ID NO: 54321 - DNA, 25 bp, Mus musculus
tcacagacgagggagaaggcgtgag

SEQ ID NO: 54322 - DNA, 25 bp, Mus musculus
tcacagagacaaggtaatcctgctt

SEQ ID NO: 54323 - DNA, 25 bp, Mus musculus
tcacagagctatgagacaaagagcc

SEQ ID NO: 54324 - DNA, 25 bp, Mus musculus
tcacagagctgtaccctttattcag

SEQ ID NO: 54325 - DNA, 25 bp, Mus musculus
tcacagaggagctgcagtgctgcga

SEQ ID NO: 54326 - DNA, 25 bp, Mus musculus
tcacagaggcgccataagagtcaga

SEQ ID NO: 54327 - DNA, 25 bp, Mus musculus
tcacagagggtctcggatagtggct

SEQ ID NO: 54328 - DNA, 25 bp, Mus musculus
tcacagatagcatctaagagccaag

SEQ ID NO: 54329 - DNA, 25 bp, Mus musculus
tcacagcaacctgagctggctgagt

SEQ ID NO: 54330 - DNA, 25 bp, Mus musculus
tcacagcaactcaaagctaaattgg

SEQ ID NO: 54331 - DNA, 25 bp, Mus musculus
tcacagcagcgggttacaactcact

SEQ ID NO: 54332 - DNA, 25 bp, Mus musculus
tcacagcaggatcgaagtgtaacac

SEQ ID NO: 54333 - DNA, 25 bp, Mus musculus
tcacagcataaattgtcttgattcc

SEQ ID NO: 54334 - DNA, 25 bp, Mus musculus
tcacagcggagtgaatcagcttggt

SEQ ID NO: 54335 - DNA, 25 bp, Mus musculus
tcacagctaatgcatcatggagcct

SEQ ID NO: 54336 - DNA, 25 bp, Mus musculus
tcacaggaagatctgggtatctcag

SEQ ID NO: 54337 - DNA, 25 bp, Mus musculus
tcacaggagcattgtttaacccagc

SEQ ID NO: 54338 - DNA, 25 bp, Mus musculus
tcacaggagctaagatgttcatttt

SEQ ID NO: 54339 - DNA, 25 bp, Mus musculus
tcacaggagttattaagtgttctgc

SEQ ID NO: 54340 - DNA, 25 bp, Mus musculus
tcacaggcgttgaaaagactcatgc

SEQ ID NO: 54341 - DNA, 25 bp, Mus musculus
tcacaggctccttccccatgaggaa

SEQ ID NO: 54342 - DNA, 25 bp, Mus musculus
tcacaggctggacagaaaacatcag

SEQ ID NO: 54343 - DNA, 25 bp, Mus musculus
tcacagggaaatgggagaaaccctt

SEQ ID NO: 54344 - DNA, 25 bp, Mus musculus
tcacagggaagacagtgcaaaattg

SEQ ID NO: 54345 - DNA, 25 bp, Mus musculus
tcacagggatcgattgcctctgatt

SEQ ID NO: 54346 - DNA, 25 bp, Mus musculus
tcacagggccagagggcccatcatc

SEQ ID NO: 54347 - DNA, 25 bp, Mus musculus
tcacagggccttaacttacacccaa

SEQ ID NO: 54348 - DNA, 25 bp, Mus musculus
tcacagggtcctttgaccacacagt

SEQ ID NO: 54349 - DNA, 25 bp, Mus musculus
tcacaggtctcaatggcaggtgtct

SEQ ID NO: 54350 - DNA, 25 bp, Mus musculus
tcacaggtggaagtctccaagacag

SEQ ID NO: 54351 - DNA, 25 bp, Mus musculus
tcacagtaatgaaaggcagtaatag

SEQ ID NO: 54352 - DNA, 25 bp, Mus musculus
tcacagtaggaaaaatcccacacat

SEQ ID NO: 54353 - DNA, 25 bp, Mus musculus
tcacagtcagcaggctttggagtac

SEQ ID NO: 54354 - DNA, 25 bp, Mus musculus
tcacagtgaaacatctagaagacat

SEQ ID NO: 54355 - DNA, 25 bp, Mus musculus
tcacagtgctcaatgggcctatcct

SEQ ID NO: 54356 - DNA, 25 bp, Mus musculus
tcacagtgctcatagcctttactaa

SEQ ID NO: 54357 - DNA, 25 bp, Mus musculus
tcacagtggctcctgcttgtcttcc

SEQ ID NO: 54358 - DNA, 25 bp, Mus musculus
tcacagttcacacctaatgatggct

SEQ ID NO: 54359 - DNA, 25 bp, Mus musculus
tcacagttgaacctttgcacacatg

SEQ ID NO: 54360 - DNA, 25 bp, Mus musculus
tcacagtttcctggagaagactgcg

SEQ ID NO: 54361 - DNA, 25 bp, Mus musculus
tcacataaacctcgtggagatagat

SEQ ID NO: 54362 - DNA, 25 bp, Mus musculus
tcacataaggcacttcacagatagc

SEQ ID NO: 54363 - DNA, 25 bp, Mus musculus
tcacatactggtgtgtgcctggtgc

SEQ ID NO: 54364 - DNA, 25 bp, Mus musculus
tcacatatgtgaacctgctggcccc

SEQ ID NO: 54365 - DNA, 25 bp, Mus musculus
tcacatcagtgacagccatgctggt

SEQ ID NO: 54366 - DNA, 25 bp, Mus musculus
tcacatcatggaattggatgcacag

SEQ ID NO: 54367 - DNA, 25 bp, Mus musculus
tcacatcatggatttggatgcacag

SEQ ID NO: 54368 - DNA, 25 bp, Mus musculus
tcacatcctgctggtgctggctgag

SEQ ID NO: 54369 - DNA, 25 bp, Mus musculus
tcacatctagcatcctgtctgtggc

SEQ ID NO: 54370 - DNA, 25 bp, Mus musculus
tcacatctcgggtcttttgcacagc

SEQ ID NO: 54371 - DNA, 25 bp, Mus musculus
tcacatctgatgatatactaccaca

SEQ ID NO: 54372 - DNA, 25 bp, Mus musculus
tcacatctgtgcctgatatcagacg

SEQ ID NO: 54373 - DNA, 25 bp, Mus musculus
tcacatcttcagcatttacacccag

SEQ ID NO: 54374 - DNA, 25 bp, Mus musculus
tcacatgaacgaccagaaccgagag

SEQ ID NO: 54375 - DNA, 25 bp, Mus musculus
tcacatgaagcaaccttgtctcaag

SEQ ID NO: 54376 - DNA, 25 bp, Mus musculus
tcacatgagaacacggcacgtgatc

SEQ ID NO: 54377 - DNA, 25 bp, Mus musculus
tcacatgagactctgaatgtagtgg

SEQ ID NO: 54378 - DNA, 25 bp, Mus musculus
tcacatgccagtgcttgggctttgg

SEQ ID NO: 54379 - DNA, 25 bp, Mus musculus
tcacatgctctttgactgctcggct

SEQ ID NO: 54380 - DNA, 25 bp, Mus musculus
tcacatggagactctgtgggacctg

SEQ ID NO: 54381 - DNA, 25 bp, Mus musculus
tcacatggatgaagaatgggcagct

SEQ ID NO: 54382 - DNA, 25 bp, Mus musculus
tcacatggcagtagagatgcagaga

SEQ ID NO: 54383 - DNA, 25 bp, Mus musculus
tcacatggctggtagctctctctcc

SEQ ID NO: 54384 - DNA, 25 bp, Mus musculus
tcacatgggctctcggttagtcacc

SEQ ID NO: 54385 - DNA, 25 bp, Mus musculus
tcacatggtccgagagcccatcttc

SEQ ID NO: 54386 - DNA, 25 bp, Mus musculus
tcacatggtgcagaaagggacaggc

SEQ ID NO: 54387 - DNA, 25 bp, Mus musculus
tcacatggtgtttgaactgttcaag

SEQ ID NO: 54388 - DNA, 25 bp, Mus musculus
tcacatgtttgagagagtgatccag

SEQ ID NO: 54389 - DNA, 25 bp, Mus musculus
tcacattcacggattttctggcttt

SEQ ID NO: 54390 - DNA, 25 bp, Mus musculus
tcacattcccatgctcattaggagg

SEQ ID NO: 54391 - DNA, 25 bp, Mus musculus
tcacattctgtaccacaggctgtcg

SEQ ID NO: 54392 - DNA, 25 bp, Mus musculus
tcacatttgacaataaagcgcacag

SEQ ID NO: 54393 - DNA, 25 bp, Mus musculus
tcacatttgtgaaattacatgggaa

SEQ ID NO: 54394 - DNA, 25 bp, Mus musculus
tcaccaaacagttttggagtaacag

SEQ ID NO: 54395 - DNA, 25 bp, Mus musculus
tcaccaaattggcaacagacctgac

SEQ ID NO: 54396 - DNA, 25 bp, Mus musculus
tcaccaacaacctcaagtctcttga

SEQ ID NO: 54397 - DNA, 25 bp, Mus musculus
tcaccaacaaggcagcatcatattg

SEQ ID NO: 54398 - DNA, 25 bp, Mus musculus
tcaccaacagagactgtgactccct

SEQ ID NO: 54399 - DNA, 25 bp, Mus musculus
tcaccaacctcacagtagacatgct

SEQ ID NO: 54400 - DNA, 25 bp, Mus musculus
tcaccaaccttctccgggaacagag

SEQ ID NO: 54401 - DNA, 25 bp, Mus musculus
tcaccaagaaggacctgcgtgtcca

SEQ ID NO: 54402 - DNA, 25 bp, Mus musculus
tcaccaaggctcatgcatctgacac

SEQ ID NO: 54403 - DNA, 25 bp, Mus musculus
tcaccaatcatgagcattttggcac

SEQ ID NO: 54404 - DNA, 25 bp, Mus musculus
tcaccacacacagctcccatcatgg

SEQ ID NO: 54405 - DNA, 25 bp, Mus musculus
tcaccacacagcagaaactggctgg

SEQ ID NO: 54406 - DNA, 25 bp, Mus musculus
tcaccacagatgaatgcgaaagagg

SEQ ID NO: 54407 - DNA, 25 bp, Mus musculus
tcaccacccgctctggaaaggtctt

SEQ ID NO: 54408 - DNA, 25 bp, Mus musculus
tcaccacctccttgtttttcgtggg

SEQ ID NO: 54409 - DNA, 25 bp, Mus musculus
tcaccacctgggagattctggcagt

SEQ ID NO: 54410 - DNA, 25 bp, Mus musculus
tcaccacgccatgactatatcttgg

SEQ ID NO: 54411 - DNA, 25 bp, Mus musculus
tcaccacgggattcacccgcatgag

SEQ ID NO: 54412 - DNA, 25 bp, Mus musculus
tcaccactagaagacgatggagtct

SEQ ID NO: 54413 - DNA, 25 bp, Mus musculus
tcaccactgaagacgtgaagctctt

SEQ ID NO: 54414 - DNA, 25 bp, Mus musculus
tcaccactgggaagatatatcagca

SEQ ID NO: 54415 - DNA, 25 bp, Mus musculus
tcaccagaacatgaagtaaagaaca

SEQ ID NO: 54416 - DNA, 25 bp, Mus musculus
tcaccagcacaacgaaaactacaag

SEQ ID NO: 54417 - DNA, 25 bp, Mus musculus
tcaccagcatccagttcacctgtga

SEQ ID NO: 54418 - DNA, 25 bp, Mus musculus
tcaccaggaattactacgtccgggc

SEQ ID NO: 54419 - DNA, 25 bp, Mus musculus
tcaccaggacagacaatacaagtgg

SEQ ID NO: 54420 - DNA, 25 bp, Mus musculus
tcaccagtgtttttggatcataaca

SEQ ID NO: 54421 - DNA, 25 bp, Mus musculus
tcaccatacataaaaagccgccaag

SEQ ID NO: 54422 - DNA, 25 bp, Mus musculus
tcaccatacatataaagccgccaag

SEQ ID NO: 54423 - DNA, 25 bp, Mus musculus
tcaccatagagaaggagtcgggctg

SEQ ID NO: 54424 - DNA, 25 bp, Mus musculus
tcaccatcaggctacttatgcatgg

SEQ ID NO: 54425 - DNA, 25 bp, Mus musculus
tcaccatctcctatgtgtacactgc

SEQ ID NO: 54426 - DNA, 25 bp, Mus musculus
tcaccatctgctttcctgaatacac

SEQ ID NO: 54427 - DNA, 25 bp, Mus musculus
tcaccatgctctatgccctgggagg

SEQ ID NO: 54428 - DNA, 25 bp, Mus musculus
tcaccatggaggctgggaactactg

SEQ ID NO: 54429 - DNA, 25 bp, Mus musculus
tcaccatggcctcctctgggcttta

SEQ ID NO: 54430 - DNA, 25 bp, Mus musculus
tcaccatggtgcaaaagtcagacgg

SEQ ID NO: 54431 - DNA, 25 bp, Mus musculus
tcaccatgtcggaagaacagaggca

SEQ ID NO: 54432 - DNA, 25 bp, Mus musculus
tcaccattctgctgattgatcacag

SEQ ID NO: 54433 - DNA, 25 bp, Mus musculus
tcaccattgtccaaactcagaggct

SEQ ID NO: 54434 - DNA, 25 bp, Mus musculus
tcacccaaaggttgcgcttccacaa

SEQ ID NO: 54435 - DNA, 25 bp, Mus musculus
tcacccaagagcagagagacacagt

SEQ ID NO: 54436 - DNA, 25 bp, Mus musculus
tcacccaagcgcaagatgaggagac

SEQ ID NO: 54437 - DNA, 25 bp, Mus musculus
tcacccaatggttctctcagcagca

SEQ ID NO: 54438 - DNA, 25 bp, Mus musculus
tcacccacagtgtctatcgcagcga

SEQ ID NO: 54439 - DNA, 25 bp, Mus musculus
tcacccagaggacatttaagctcga

SEQ ID NO: 54440 - DNA, 25 bp, Mus musculus
tcacccaggcaatatgggacggata

SEQ ID NO: 54441 - DNA, 25 bp, Mus musculus
tcacccagggaggacaaatgccttc

SEQ ID NO: 54442 - DNA, 25 bp, Mus musculus
tcacccagggcgagaactgcataaa

SEQ ID NO: 54443 - DNA, 25 bp, Mus musculus
tcacccatctttggaagaagaacct

SEQ ID NO: 54444 - DNA, 25 bp, Mus musculus
tcaccccaccatttaaaacctggag

SEQ ID NO: 54445 - DNA, 25 bp, Mus musculus
tcaccccatgggaaagcaagcgaag

SEQ ID NO: 54446 - DNA, 25 bp, Mus musculus
tcaccccgtgtctaccatggtgaag

SEQ ID NO: 54447 - DNA, 25 bp, Mus musculus
tcacccctctgactgacagcaaggt

SEQ ID NO: 54448 - DNA, 25 bp, Mus musculus
tcacccgagcatgcgaatcttgtca

SEQ ID NO: 54449 - DNA, 25 bp, Mus musculus
tcacccggagcgcttctttctttgc

SEQ ID NO: 54450 - DNA, 25 bp, Mus musculus
tcaccctcagggtaccctcttcctg

SEQ ID NO: 54451 - DNA, 25 bp, Mus musculus
tcaccctctgcacgagaacgaagtt

SEQ ID NO: 54452 - DNA, 25 bp, Mus musculus
tcaccctgatagaaaggactggagg

SEQ ID NO: 54453 - DNA, 25 bp, Mus musculus
tcaccctgctgagaaatgaagtggc

SEQ ID NO: 54454 - DNA, 25 bp, Mus musculus
tcaccctggacaaccgtgcagaata

SEQ ID NO: 54455 - DNA, 25 bp, Mus musculus
tcaccctggatttgctgggaaaacc

SEQ ID NO: 54456 - DNA, 25 bp, Mus musculus
tcaccctgtagaggtacttgtgccg

SEQ ID NO: 54457 - DNA, 25 bp, Mus musculus
tcacccttatctgagaagctgtggg

SEQ ID NO: 54458 - DNA, 25 bp, Mus musculus
tcacccttctgggactatttgatgc

SEQ ID NO: 54459 - DNA, 25 bp, Mus musculus
tcacccttgacccaaattttctgga

SEQ ID NO: 54460 - DNA, 25 bp, Mus musculus
tcacccttggagctcatgatgtgag

SEQ ID NO: 54461 - DNA, 25 bp, Mus musculus
tcaccgaaatgaagcgaacgctcca

SEQ ID NO: 54462 - DNA, 25 bp, Mus musculus
tcaccgaagaagtattcctcagaag

SEQ ID NO: 54463 - DNA, 25 bp, Mus musculus
tcaccgcactcatagttggtcttgg

SEQ ID NO: 54464 - DNA, 25 bp, Mus musculus
tcaccgcactctggtatatggaggg

SEQ ID NO: 54465 - DNA, 25 bp, Mus musculus
tcaccgcagagtgtccctgagagat

SEQ ID NO: 54466 - DNA, 25 bp, Mus musculus
tcaccgcaggaaaaaagtgtcccaa

SEQ ID NO: 54467 - DNA, 25 bp, Mus musculus
tcaccgcagttttggtccacccttt

SEQ ID NO: 54468 - DNA, 25 bp, Mus musculus
tcaccgcctggatattgtattctat

SEQ ID NO: 54469 - DNA, 25 bp, Mus musculus
tcaccgctagaagagattgttgaca

SEQ ID NO: 54470 - DNA, 25 bp, Mus musculus
tcaccgctctacctggagatcatta

SEQ ID NO: 54471 - DNA, 25 bp, Mus musculus
tcaccgcttggctgtggttgacccg

SEQ ID NO: 54472 - DNA, 25 bp, Mus musculus
tcaccggccgaggtcttgccgtgag

SEQ ID NO: 54473 - DNA, 25 bp, Mus musculus
tcaccgggcaactcctgaagatcta

SEQ ID NO: 54474 - DNA, 25 bp, Mus musculus
tcaccgggtcttcctggatcaagca

SEQ ID NO: 54475 - DNA, 25 bp, Mus musculus
tcaccgtacagattgagaataccgt

SEQ ID NO: 54476 - DNA, 25 bp, Mus musculus
tcaccgtcgccattgccagaaagag

SEQ ID NO: 54477 - DNA, 25 bp, Mus musculus
tcaccgtgtagatgcagggaactca

SEQ ID NO: 54478 - DNA, 25 bp, Mus musculus
tcaccgttacactgtgcgggccaag

SEQ ID NO: 54479 - DNA, 25 bp, Mus musculus
tcacctaaaagtcggaaagcaaata

SEQ ID NO: 54480 - DNA, 25 bp, Mus musculus
tcacctaaatggcatagttcacagg

SEQ ID NO: 54481 - DNA, 25 bp, Mus musculus
tcacctactgtgtcctgctcagacg

SEQ ID NO: 54482 - DNA, 25 bp, Mus musculus
tcacctagcccattgagaccagttg

SEQ ID NO: 54483 - DNA, 25 bp, Mus musculus
tcacctatctccctgtcaaagtaat

SEQ ID NO: 54484 - DNA, 25 bp, Mus musculus
tcacctatggagcagaacaaagaga

SEQ ID NO: 54485 - DNA, 25 bp, Mus musculus
tcacctatgtcaaactgaaaatggc

SEQ ID NO: 54486 - DNA, 25 bp, Mus musculus
tcacctattgtctgatagccctggg

SEQ ID NO: 54487 - DNA, 25 bp, Mus musculus
tcacctcagaatagtgctgcctaag

SEQ ID NO: 54488 - DNA, 25 bp, Mus musculus
tcacctcatcaaggagataatcctg

SEQ ID NO: 54489 - DNA, 25 bp, Mus musculus
tcacctcgggcatgcgggtggcctt

SEQ ID NO: 54490 - DNA, 25 bp, Mus musculus
tcacctcgtatctgtggtaacggct

SEQ ID NO: 54491 - DNA, 25 bp, Mus musculus
tcacctcttgccagatctcttacag

SEQ ID NO: 54492 - DNA, 25 bp, Mus musculus
tcacctgaagaagacacgcgaggag

SEQ ID NO: 54493 - DNA, 25 bp, Mus musculus
tcacctgaagcagaagctgtgctgc

SEQ ID NO: 54494 - DNA, 25 bp, Mus musculus
tcacctgaatcctgagggaatccag

SEQ ID NO: 54495 - DNA, 25 bp, Mus musculus
tcacctgaattgttgccagcatatc

SEQ ID NO: 54496 - DNA, 25 bp, Mus musculus
tcacctgacttgaataaaatgcttc

SEQ ID NO: 54497 - DNA, 25 bp, Mus musculus
tcacctgagggacacttggctggtt

SEQ ID NO: 54498 - DNA, 25 bp, Mus musculus
tcacctgcacctaccatggacaaga

SEQ ID NO: 54499 - DNA, 25 bp, Mus musculus
tcacctgcagtaccagccaaaaagg

SEQ ID NO: 54500 - DNA, 25 bp, Mus musculus
tcacctgcattctctggcggctgac

SEQ ID NO: 54501 - DNA, 25 bp, Mus musculus
tcacctgctgctttatgaagaggat

SEQ ID NO: 54502 - DNA, 25 bp, Mus musculus
tcacctggccgagggagttctctct

SEQ ID NO: 54503 - DNA, 25 bp, Mus musculus
tcacctggctcaacagatctaaggt

SEQ ID NO: 54504 - DNA, 25 bp, Mus musculus
tcacctgtgagccaggctatgtcct

SEQ ID NO: 54505 - DNA, 25 bp, Mus musculus
tcacctgtgagtcagccgcagagtc

SEQ ID NO: 54506 - DNA, 25 bp, Mus musculus
tcacctgtgcaagccatatatgtcc

SEQ ID NO: 54507 - DNA, 25 bp, Mus musculus
tcacctgtgcgctgggctacgtgac

SEQ ID NO: 54508 - DNA, 25 bp, Mus musculus
tcacctgtggaattatgactaagcc

SEQ ID NO: 54509 - DNA, 25 bp, Mus musculus
tcaccttaggaagaatgatcggctt

SEQ ID NO: 54510 - DNA, 25 bp, Mus musculus
tcaccttagtgacacaaccattggg

SEQ ID NO: 54511 - DNA, 25 bp, Mus musculus
tcaccttcagtgacttcaatgcaga

SEQ ID NO: 54512 - DNA, 25 bp, Mus musculus
tcaccttccaaaatgtcaccttcag

SEQ ID NO: 54513 - DNA, 25 bp, Mus musculus
tcaccttccacatctattgcttcta

SEQ ID NO: 54514 - DNA, 25 bp, Mus musculus
tcaccttggagaagatccagcctcg

SEQ ID NO: 54515 - DNA, 25 bp, Mus musculus
tcacctttctaaaagacatgaagaa

SEQ ID NO: 54516 - DNA, 25 bp, Mus musculus
tcacctttctccgaaggcggacgtg

SEQ ID NO: 54517 - DNA, 25 bp, Mus musculus
tcacctttgccactgacgagtcggg

SEQ ID NO: 54518 - DNA, 25 bp, Mus musculus
tcacctttggatgggaaagtgtcaa

SEQ ID NO: 54519 - DNA, 25 bp, Mus musculus
tcacctttgtatgcacacctgtctt

SEQ ID NO: 54520 - DNA, 25 bp, Mus musculus
tcacgaaacaatgaatcagaaaagc

SEQ ID NO: 54521 - DNA, 25 bp, Mus musculus
tcacgaacagctagttcagctactt

SEQ ID NO: 54522 - DNA, 25 bp, Mus musculus
tcacgaagacctctcttgagaaggc

SEQ ID NO: 54523 - DNA, 25 bp, Mus musculus
tcacgaagcgcaggaaagaggagct

SEQ ID NO: 54524 - DNA, 25 bp, Mus musculus
tcacgaagtatttggtggaccacta

SEQ ID NO: 54525 - DNA, 25 bp, Mus musculus
tcacgaggacatttgctccctcctg

SEQ ID NO: 54526 - DNA, 25 bp, Mus musculus
tcacgaggatcctggaaatgtatct

SEQ ID NO: 54527 - DNA, 25 bp, Mus musculus
tcacgaggcaaacactacggcatca

SEQ ID NO: 54528 - DNA, 25 bp, Mus musculus
tcacgaggccctgagaaccttctgg

SEQ ID NO: 54529 - DNA, 25 bp, Mus musculus
tcacgatgtagctgcatctgatggc

SEQ ID NO: 54530 - DNA, 25 bp, Mus musculus
tcacgattgtagctggaaacagttc

SEQ ID NO: 54531 - DNA, 25 bp, Mus musculus
tcacgatttcacctttggatgggaa

SEQ ID NO: 54532 - DNA, 25 bp, Mus musculus
tcacgcagccagtgcttgcaccagt

SEQ ID NO: 54533 - DNA, 25 bp, Mus musculus
tcacgcagctcacacagaagctgct

SEQ ID NO: 54534 - DNA, 25 bp, Mus musculus
tcacgccagagggaatgctgactgc

SEQ ID NO: 54535 - DNA, 25 bp, Mus musculus
tcacgcctcatgagaagacacaagc

SEQ ID NO: 54536 - DNA, 25 bp, Mus musculus
tcacgcgagctcctcaagtattggg

SEQ ID NO: 54537 - DNA, 25 bp, Mus musculus
tcacgcgagtgctgctcacagtgct

SEQ ID NO: 54538 - DNA, 25 bp, Mus musculus
tcacgcggctgggtcatatcttcac

SEQ ID NO: 54539 - DNA, 25 bp, Mus musculus
tcacgctcatcagtatgtggccaga

SEQ ID NO: 54540 - DNA, 25 bp, Mus musculus
tcacgctctcgaatgctgccgtttg

SEQ ID NO: 54541 - DNA, 25 bp, Mus musculus
tcacgctggagttcagggcacagcg

SEQ ID NO: 54542 - DNA, 25 bp, Mus musculus
tcacggaacagcagcagcgccggat

SEQ ID NO: 54543 - DNA, 25 bp, Mus musculus
tcacggaattaaagttctaccagag

SEQ ID NO: 54544 - DNA, 25 bp, Mus musculus
tcacggagaagcacaaaatgaatgt

SEQ ID NO: 54545 - DNA, 25 bp, Mus musculus
tcacggagtatcagagcattctggc

SEQ ID NO: 54546 - DNA, 25 bp, Mus musculus
tcacggagtgtgacaatatgctgat

SEQ ID NO: 54547 - DNA, 25 bp, Mus musculus
tcacggatgattgacatccagacca

SEQ ID NO: 54548 - DNA, 25 bp, Mus musculus
tcacggatgtgtcattatcagcatg

SEQ ID NO: 54549 - DNA, 25 bp, Mus musculus
tcacggattagtcaaccttaggaag

SEQ ID NO: 54550 - DNA, 25 bp, Mus musculus
tcacggcctctcgaatcgatatctg

SEQ ID NO: 54551 - DNA, 25 bp, Mus musculus
tcacggccttgtggttgagaaccag

SEQ ID NO: 54552 - DNA, 25 bp, Mus musculus
tcacggctgatgacttcagactcaa

SEQ ID NO: 54553 - DNA, 25 bp, Mus musculus
tcacgggaatagcagtagagctctc

SEQ ID NO: 54554 - DNA, 25 bp, Mus musculus
tcacgggacctttgcagagaaacgc

SEQ ID NO: 54555 - DNA, 25 bp, Mus musculus
tcacgggactggatgcaactttaaa

SEQ ID NO: 54556 - DNA, 25 bp, Mus musculus
tcacgggctccttgagtgccgagtg

SEQ ID NO: 54557 - DNA, 25 bp, Mus musculus
tcacgggtcacagtgaaacatctag

SEQ ID NO: 54558 - DNA, 25 bp, Mus musculus
tcacggtctttgacaacgggcagaa

SEQ ID NO: 54559 - DNA, 25 bp, Mus musculus
tcacggtgaaacaaggacgggataa

SEQ ID NO: 54560 - DNA, 25 bp, Mus musculus
tcacgtaattgaccgcgctattcag

SEQ ID NO: 54561 - DNA, 25 bp, Mus musculus
tcacgtatcacgacatcggcatgaa

SEQ ID NO: 54562 - DNA, 25 bp, Mus musculus
tcacgtcaaaagagcaccagcagct

SEQ ID NO: 54563 - DNA, 25 bp, Mus musculus
tcacgtccaccatcagaaagtgtag

SEQ ID NO: 54564 - DNA, 25 bp, Mus musculus
tcacgtcttggctgatgacgaccaa

SEQ ID NO: 54565 - DNA, 25 bp, Mus musculus
tcacgtgacaagagtgatgccctcc

SEQ ID NO: 54566 - DNA, 25 bp, Mus musculus
tcacgtgagggtcaacttcttcggc

SEQ ID NO: 54567 - DNA, 25 bp, Mus musculus
tcacgtgccagatgacaaatatgga

SEQ ID NO: 54568 - DNA, 25 bp, Mus musculus
tcacgtgccccggacgttggtgagc

SEQ ID NO: 54569 - DNA, 25 bp, Mus musculus
tcacgtggatgagaacactcctgtc

SEQ ID NO: 54570 - DNA, 25 bp, Mus musculus
tcacgttctccgagcagtgctacta

SEQ ID NO: 54571 - DNA, 25 bp, Mus musculus
tcacgttgagcgacaagacccagtc

SEQ ID NO: 54572 - DNA, 25 bp, Mus musculus
tcacgttgagcgtcaagacccagtc

SEQ ID NO: 54573 - DNA, 25 bp, Mus musculus
tcacgttggaggtgcgaaggaaatt

SEQ ID NO: 54574 - DNA, 25 bp, Mus musculus
tcacgtttggaagaaccatcaacaa

SEQ ID NO: 54575 - DNA, 25 bp, Mus musculus
tcactaaggtgctgaagaacaagtt

SEQ ID NO: 54576 - DNA, 25 bp, Mus musculus
tcactaatccagctggcttgttttg

SEQ ID NO: 54577 - DNA, 25 bp, Mus musculus
tcactaatccaggtggcttgttttg

SEQ ID NO: 54578 - DNA, 25 bp, Mus musculus
tcactaccatcccagaactcaagga

SEQ ID NO: 54579 - DNA, 25 bp, Mus musculus
tcactaccgtggttgactctccaga

SEQ ID NO: 54580 - DNA, 25 bp, Mus musculus
tcactacctggagtaacaaaactcc

SEQ ID NO: 54581 - DNA, 25 bp, Mus musculus
tcactagccttacagacatctggat

SEQ ID NO: 54582 - DNA, 25 bp, Mus musculus
tcactatcagtgacccctgaggagt

SEQ ID NO: 54583 - DNA, 25 bp, Mus musculus
tcactatcgtctgacaaaggctttg

SEQ ID NO: 54584 - DNA, 25 bp, Mus musculus
tcactatcgttgttcacatggccag

SEQ ID NO: 54585 - DNA, 25 bp, Mus musculus
tcactatgaggcaaagcaaggtgga

SEQ ID NO: 54586 - DNA, 25 bp, Mus musculus
tcactatggagccttgattggcctc

SEQ ID NO: 54587 - DNA, 25 bp, Mus musculus
tcactattaccagcagcaggcacaa

SEQ ID NO: 54588 - DNA, 25 bp, Mus musculus
tcactcaacttctgtcatgagaaat

SEQ ID NO: 54589 - DNA, 25 bp, Mus musculus
tcactcaaggaaagcttcaagcagt

SEQ ID NO: 54590 - DNA, 25 bp, Mus musculus
tcactcacctttggattcatctcgg

SEQ ID NO: 54591 - DNA, 25 bp, Mus musculus
tcactcactctttggagatgtgaag

SEQ ID NO: 54592 - DNA, 25 bp, Mus musculus
tcactcagactgaaccacaagacag

SEQ ID NO: 54593 - DNA, 25 bp, Mus musculus
tcactcaggagaaaggaactgaaag

SEQ ID NO: 54594 - DNA, 25 bp, Mus musculus
tcactcaggtatgtggtccgaagca

SEQ ID NO: 54595 - DNA, 25 bp, Mus musculus
tcactcagtacatcgacgggcaggg

SEQ ID NO: 54596 - DNA, 25 bp, Mus musculus
tcactccagatgaactgctaaaagt

SEQ ID NO: 54597 - DNA, 25 bp, Mus musculus
tcactccctggatgaaaatgggctg

SEQ ID NO: 54598 - DNA, 25 bp, Mus musculus
tcactcctgagtcctgccgtttgga

SEQ ID NO: 54599 - DNA, 25 bp, Mus musculus
tcactcctggatgggactctgctgg

SEQ ID NO: 54600 - DNA, 25 bp, Mus musculus
tcactcgctttcctaggcgcggaca

SEQ ID NO: 54601 - DNA, 25 bp, Mus musculus
tcactcgctttcgtaggcgcggaca

SEQ ID NO: 54602 - DNA, 25 bp, Mus musculus
tcactcggcggctgagagatcctga

SEQ ID NO: 54603 - DNA, 25 bp, Mus musculus
tcactctgacagaactagaaaccca

SEQ ID NO: 54604 - DNA, 25 bp, Mus musculus
tcactctgacagtactagaaaccca

SEQ ID NO: 54605 - DNA, 25 bp, Mus musculus
tcactctgactgtagccaagtgctg

SEQ ID NO: 54606 - DNA, 25 bp, Mus musculus
tcactctgccatccagaaaagagcg

SEQ ID NO: 54607 - DNA, 25 bp, Mus musculus
tcactcttaccacctgtggtggaca

SEQ ID NO: 54608 - DNA, 25 bp, Mus musculus
tcactcttcaccagtgaccaaagac

SEQ ID NO: 54609 - DNA, 25 bp, Mus musculus
tcactcttcagtgtgatcacagttg

SEQ ID NO: 54610 - DNA, 25 bp, Mus musculus
tcactcttcagtttccatcatctag

SEQ ID NO: 54611 - DNA, 25 bp, Mus musculus
tcactgaagcgacccctcgaggcaa

SEQ ID NO: 54612 - DNA, 25 bp, Mus musculus
tcactgacgagtgtggcatcagcct

SEQ ID NO: 54613 - DNA, 25 bp, Mus musculus
tcactgacgctgcttccagccaaag

SEQ ID NO: 54614 - DNA, 25 bp, Mus musculus
tcactgagaccatttgcaagaggct

SEQ ID NO: 54615 - DNA, 25 bp, Mus musculus
tcactgagattctgatgaacagacc

SEQ ID NO: 54616 - DNA, 25 bp, Mus musculus
tcactgagttgtttctatgctgtaa

SEQ ID NO: 54617 - DNA, 25 bp, Mus musculus
tcactgatcaccacatctgtgagat

SEQ ID NO: 54618 - DNA, 25 bp, Mus musculus
tcactgatcctggttgtttatcctc

SEQ ID NO: 54619 - DNA, 25 bp, Mus musculus
tcactgcaagtgtatccaatattca

SEQ ID NO: 54620 - DNA, 25 bp, Mus musculus
tcactgccaggaacaggaaatcact

SEQ ID NO: 54621 - DNA, 25 bp, Mus musculus
tcactgccggaagacgacgtggact

SEQ ID NO: 54622 - DNA, 25 bp, Mus musculus
tcactgccttactttgtgctcatca

SEQ ID NO: 54623 - DNA, 25 bp, Mus musculus
tcactgctgatgaagatatttcacg

SEQ ID NO: 54624 - DNA, 25 bp, Mus musculus
tcactgctggctgggttacaaccca

SEQ ID NO: 54625 - DNA, 25 bp, Mus musculus
tcactggaccgtgccaagcataggg

SEQ ID NO: 54626 - DNA, 25 bp, Mus musculus
tcactggactcagggaagggtattg

SEQ ID NO: 54627 - DNA, 25 bp, Mus musculus
tcactggcaggtacgtgccatcaca

SEQ ID NO: 54628 - DNA, 25 bp, Mus musculus
tcactggcatagttggagacaaagg

SEQ ID NO: 54629 - DNA, 25 bp, Mus musculus
tcactggccagagtaagccctgcag

SEQ ID NO: 54630 - DNA, 25 bp, Mus musculus
tcactggctgccctaaggccaagac

SEQ ID NO: 54631 - DNA, 25 bp, Mus musculus
tcactgggctgaatggtaacctatc

SEQ ID NO: 54632 - DNA, 25 bp, Mus musculus
tcactggtgaggcaggagctctacc

SEQ ID NO: 54633 - DNA, 25 bp, Mus musculus
tcactgtacttcattggctatcagg

SEQ ID NO: 54634 - DNA, 25 bp, Mus musculus
tcactgtagagacgagtactccaga

SEQ ID NO: 54635 - DNA, 25 bp, Mus musculus
tcactgtgaacattatggatacctg

SEQ ID NO: 54636 - DNA, 25 bp, Mus musculus
tcactgtgacagtgtagtatccttg

SEQ ID NO: 54637 - DNA, 25 bp, Mus musculus
tcactgtgctggacatggctgtgac

SEQ ID NO: 54638 - DNA, 25 bp, Mus musculus
tcactgtgggagcaacagatatcaa

SEQ ID NO: 54639 - DNA, 25 bp, Mus musculus
tcactgtgtcaaacatcaggaagca

SEQ ID NO: 54640 - DNA, 25 bp, Mus musculus
tcacttaacccccagaagtctggcg

SEQ ID NO: 54641 - DNA, 25 bp, Mus musculus
tcacttacgttattggatccttact

SEQ ID NO: 54642 - DNA, 25 bp, Mus musculus
tcacttatcactcactgccacagag

SEQ ID NO: 54643 - DNA, 25 bp, Mus musculus
tcacttatcccctagctgccaggag

SEQ ID NO: 54644 - DNA, 25 bp, Mus musculus
tcacttatgtctgcctgtgcgatac

SEQ ID NO: 54645 - DNA, 25 bp, Mus musculus
tcacttctgaatgccaccttcttga

SEQ ID NO: 54646 - DNA, 25 bp, Mus musculus
tcacttggagaacggctgccatcca

SEQ ID NO: 54647 - DNA, 25 bp, Mus musculus
tcacttggagaagggctgccatcca

SEQ ID NO: 54648 - DNA, 25 bp, Mus musculus
tcacttggccagtgcagactggatt

SEQ ID NO: 54649 - DNA, 25 bp, Mus musculus
tcacttggccttggtgagtgtggca

SEQ ID NO: 54650 - DNA, 25 bp, Mus musculus
tcacttgttcaaagcccagcagcag

SEQ ID NO: 54651 - DNA, 25 bp, Mus musculus
tcactttcatcacatggatcctcat

SEQ ID NO: 54652 - DNA, 25 bp, Mus musculus
tcactttctgcttcggacgtcaagg

SEQ ID NO: 54653 - DNA, 25 bp, Mus musculus
tcactttgacaagtctcctggaagg

SEQ ID NO: 54654 - DNA, 25 bp, Mus musculus
tcagaaaaactaagtacaaaatggc

SEQ ID NO: 54655 - DNA, 25 bp, Mus musculus
tcagaaaactaaagaatgattgggt

SEQ ID NO: 54656 - DNA, 25 bp, Mus musculus
tcagaaaactcgagtacaggcaggc

SEQ ID NO: 54657 - DNA, 25 bp, Mus musculus
tcagaaaactctcacaagtcaagcg

SEQ ID NO: 54658 - DNA, 25 bp, Mus musculus
tcagaaaacttaacttggctccagt

SEQ ID NO: 54659 - DNA, 25 bp, Mus musculus
tcagaaaagcagctgcacctggctg

SEQ ID NO: 54660 - DNA, 25 bp, Mus musculus
tcagaaaattaatgcccgttggacc

SEQ ID NO: 54661 - DNA, 25 bp, Mus musculus
tcagaaacacaaccgctgccgagga

SEQ ID NO: 54662 - DNA, 25 bp, Mus musculus
tcagaaacacctggtgagagactgc

SEQ ID NO: 54663 - DNA, 25 bp, Mus musculus
tcagaaacagaatcatttggaaatg

SEQ ID NO: 54664 - DNA, 25 bp, Mus musculus
tcagaaaccaaatttgactctggtt

SEQ ID NO: 54665 - DNA, 25 bp, Mus musculus
tcagaaacccacaacagaaagtgtt

SEQ ID NO: 54666 - DNA, 25 bp, Mus musculus
tcagaaacctcaggacacttcaggg

SEQ ID NO: 54667 - DNA, 25 bp, Mus musculus
tcagaaaccttccacagttaaagtt

SEQ ID NO: 54668 - DNA, 25 bp, Mus musculus
tcagaaacctttcagatgcagcgac

SEQ ID NO: 54669 - DNA, 25 bp, Mus musculus
tcagaaactagaacgagaggcccgg

SEQ ID NO: 54670 - DNA, 25 bp, Mus musculus
tcagaaacttcaaagtgccagggcg

SEQ ID NO: 54671 - DNA, 25 bp, Mus musculus
tcagaaagacatcagactggaagct

SEQ ID NO: 54672 - DNA, 25 bp, Mus musculus
tcagaaagttactgtcactgtgtct

SEQ ID NO: 54673 - DNA, 25 bp, Mus musculus
tcagaaatgcgtcttcataaggaag

SEQ ID NO: 54674 - DNA, 25 bp, Mus musculus
tcagaaatggagctggcttctatac

SEQ ID NO: 54675 - DNA, 25 bp, Mus musculus
tcagaaattgcagccctacgatcag

SEQ ID NO: 54676 - DNA, 25 bp, Mus musculus
tcagaaattttgaagaatctaagcc

SEQ ID NO: 54677 - DNA, 25 bp, Mus musculus
tcagaaattttgtcaaagcagacag

SEQ ID NO: 54678 - DNA, 25 bp, Mus musculus
tcagaaccaattgggccacacgtaa

SEQ ID NO: 54679 - DNA, 25 bp, Mus musculus
tcagaaccacagaaaacggagggaa

SEQ ID NO: 54680 - DNA, 25 bp, Mus musculus
tcagaacccactcatgatcaaaatc

SEQ ID NO: 54681 - DNA, 25 bp, Mus musculus
tcagaacctgtgacccacatcggca

SEQ ID NO: 54682 - DNA, 25 bp, Mus musculus
tcagaacgaatccacaaatgaacag

SEQ ID NO: 54683 - DNA, 25 bp, Mus musculus
tcagaacgcacgtgctaacagcagc

SEQ ID NO: 54684 - DNA, 25 bp, Mus musculus
tcagaactatagtggctatggcggc

SEQ ID NO: 54685 - DNA, 25 bp, Mus musculus
tcagaactccaaaccgaggctctca

SEQ ID NO: 54686 - DNA, 25 bp, Mus musculus
tcagaactccaatccgaggctctca

SEQ ID NO: 54687 - DNA, 25 bp, Mus musculus
tcagaactctgtctgggcatcatgg

SEQ ID NO: 54688 - DNA, 25 bp, Mus musculus
tcagaagacagcacttacacgtatg

SEQ ID NO: 54689 - DNA, 25 bp, Mus musculus
tcagaagacgacgaggagaaagacc

SEQ ID NO: 54690 - DNA, 25 bp, Mus musculus
tcagaagactcctcggcagaagaca

SEQ ID NO: 54691 - DNA, 25 bp, Mus musculus
tcagaagagagagttgtacgaaaag

SEQ ID NO: 54692 - DNA, 25 bp, Mus musculus
tcagaagagtcatggattgaacagc

SEQ ID NO: 54693 - DNA, 25 bp, Mus musculus
tcagaagatcacgacgttggctttc

SEQ ID NO: 54694 - DNA, 25 bp, Mus musculus
tcagaagatcatctggatgccccag

SEQ ID NO: 54695 - DNA, 25 bp, Mus musculus
tcagaagatgaagacaatgtcctca

SEQ ID NO: 54696 - DNA, 25 bp, Mus musculus
tcagaagcactcagctacctcaaac

SEQ ID NO: 54697 - DNA, 25 bp, Mus musculus
tcagaagcagcaaggtcagagggcc

SEQ ID NO: 54698 - DNA, 25 bp, Mus musculus
tcagaagccacttgctagtagctac

SEQ ID NO: 54699 - DNA, 25 bp, Mus musculus
tcagaagcctgtagacagtggtgct

SEQ ID NO: 54700 - DNA, 25 bp, Mus musculus
tcagaagcctgttgacagtggtgct

SEQ ID NO: 54701 - DNA, 25 bp, Mus musculus
tcagaagctccaacgatgtcaatgt

SEQ ID NO: 54702 - DNA, 25 bp, Mus musculus
tcagaaggacaactggagcttgcag

SEQ ID NO: 54703 - DNA, 25 bp, Mus musculus
tcagaaggaggacttttggcactct

SEQ ID NO: 54704 - DNA, 25 bp, Mus musculus
tcagaagtactggagtgggccagca

SEQ ID NO: 54705 - DNA, 25 bp, Mus musculus
tcagaagtagacacctgactgcttc

SEQ ID NO: 54706 - DNA, 25 bp, Mus musculus
tcagaagtgatcagcgagtactccc

SEQ ID NO: 54707 - DNA, 25 bp, Mus musculus
tcagaagttctccagtacatccagg

SEQ ID NO: 54708 - DNA, 25 bp, Mus musculus
tcagaagttgggagctgcccttcag

SEQ ID NO: 54709 - DNA, 25 bp, Mus musculus
tcagaatagtgctgcctaaggacct

SEQ ID NO: 54710 - DNA, 25 bp, Mus musculus
tcagaatatggcagccacctcaact

SEQ ID NO: 54711 - DNA, 25 bp, Mus musculus
tcagaatcacggctgtactcttggg

SEQ ID NO: 54712 - DNA, 25 bp, Mus musculus
tcagaatcagctggcttcctctagc

SEQ ID NO: 54713 - DNA, 25 bp, Mus musculus
tcagaatccagaatattcaacaacg

SEQ ID NO: 54714 - DNA, 25 bp, Mus musculus
tcagaatctaagagggatggaggct

SEQ ID NO: 54715 - DNA, 25 bp, Mus musculus
tcagaatctgcattatgcctgcata

SEQ ID NO: 54716 - DNA, 25 bp, Mus musculus
tcagaatgaacttccgtcggaggcg

SEQ ID NO: 54717 - DNA, 25 bp, Mus musculus
tcagaatgctcagcgctcggaagga

SEQ ID NO: 54718 - DNA, 25 bp, Mus musculus
tcagaatgctgttatgtacaatagc

SEQ ID NO: 54719 - DNA, 25 bp, Mus musculus
tcagaatggcgtttggtgctacgtt

SEQ ID NO: 54720 - DNA, 25 bp, Mus musculus
tcagaatgtgacgatggcagcatgc

SEQ ID NO: 54721 - DNA, 25 bp, Mus musculus
tcagaatgtgggaggataccagaga

SEQ ID NO: 54722 - DNA, 25 bp, Mus musculus
tcagaattatgccaaggaggtggca

SEQ ID NO: 54723 - DNA, 25 bp, Mus musculus
tcagaatttgtggaaaggcccaatc

SEQ ID NO: 54724 - DNA, 25 bp, Mus musculus
tcagacaaacggatagcttgcgatg

SEQ ID NO: 54725 - DNA, 25 bp, Mus musculus
tcagacaacctgactgccactgggt

SEQ ID NO: 54726 - DNA, 25 bp, Mus musculus
tcagacaagactggacagagaagtt

SEQ ID NO: 54727 - DNA, 25 bp, Mus musculus
tcagacacagacttagaggtggtac

SEQ ID NO: 54728 - DNA, 25 bp, Mus musculus
tcagacactgaagcagatctttagt

SEQ ID NO: 54729 - DNA, 25 bp, Mus musculus
tcagacagataagcgcagaggcctg

SEQ ID NO: 54730 - DNA, 25 bp, Mus musculus
tcagacagcaccaaacgcagccggt

SEQ ID NO: 54731 - DNA, 25 bp, Mus musculus
tcagacatacaagttggagacctca

SEQ ID NO: 54732 - DNA, 25 bp, Mus musculus
tcagacatgaccttcaaggccaagc

SEQ ID NO: 54733 - DNA, 25 bp, Mus musculus
tcagacattaaacaagttgaacaca

SEQ ID NO: 54734 - DNA, 25 bp, Mus musculus
tcagacccaagtttacaaggaacca

SEQ ID NO: 54735 - DNA, 25 bp, Mus musculus
tcagacccagcaagttttccttaac

SEQ ID NO: 54736 - DNA, 25 bp, Mus musculus
tcagacctaccgagtgctgctgggc

SEQ ID NO: 54737 - DNA, 25 bp, Mus musculus
tcagacctatttcaagcctcccagt

SEQ ID NO: 54738 - DNA, 25 bp, Mus musculus
tcagacctcaatggcctgcgcagga

SEQ ID NO: 54739 - DNA, 25 bp, Mus musculus
tcagacctccctccaaagtgtcatg

SEQ ID NO: 54740 - DNA, 25 bp, Mus musculus
tcagaccttatcatccagagcaacg

SEQ ID NO: 54741 - DNA, 25 bp, Mus musculus
tcagaccttatcttccagagcaacg

SEQ ID NO: 54742 - DNA, 25 bp, Mus musculus
tcagacgaagaacctgttgatgaag

SEQ ID NO: 54743 - DNA, 25 bp, Mus musculus
tcagacgaagagaagtctcccagcc

SEQ ID NO: 54744 - DNA, 25 bp, Mus musculus
tcagacgccacagggcttgatgcca

SEQ ID NO: 54745 - DNA, 25 bp, Mus musculus
tcagacgctgcgtaacatccacggg

SEQ ID NO: 54746 - DNA, 25 bp, Mus musculus
tcagacggtgaaataaaagtggcca

SEQ ID NO: 54747 - DNA, 25 bp, Mus musculus
tcagacgttccaaattacgggcagt

SEQ ID NO: 54748 - DNA, 25 bp, Mus musculus
tcagactactcgcacagcgtacgga

SEQ ID NO: 54749 - DNA, 25 bp, Mus musculus
tcagactagtctgaagggaatcccc

SEQ ID NO: 54750 - DNA, 25 bp, Mus musculus
tcagactctcgctctcgcacaggat

SEQ ID NO: 54751 - DNA, 25 bp, Mus musculus
tcagactgctcatggccagcaagaa

SEQ ID NO: 54752 - DNA, 25 bp, Mus musculus
tcagactggaagacagagaggtgca

SEQ ID NO: 54753 - DNA, 25 bp, Mus musculus
tcagacttaagatcaatgaagagac

SEQ ID NO: 54754 - DNA, 25 bp, Mus musculus
tcagacttggtctatacactggctt

SEQ ID NO: 54755 - DNA, 25 bp, Mus musculus
tcagactttgacagagtaggaggca

SEQ ID NO: 54756 - DNA, 25 bp, Mus musculus
tcagagaaagcaagcgaatgccgcc

SEQ ID NO: 54757 - DNA, 25 bp, Mus musculus
tcagagaaattattttgttcagcct

SEQ ID NO: 54758 - DNA, 25 bp, Mus musculus
tcagagacagtttaagtacaaccaa

SEQ ID NO: 54759 - DNA, 25 bp, Mus musculus
tcagagaccgagaactcttgcagtc

SEQ ID NO: 54760 - DNA, 25 bp, Mus musculus
tcagagacctagctgtacagttcag

SEQ ID NO: 54761 - DNA, 25 bp, Mus musculus
tcagagagaggctcattttccctgt

SEQ ID NO: 54762 - DNA, 25 bp, Mus musculus
tcagagagagtacggatcctgaaga

SEQ ID NO: 54763 - DNA, 25 bp, Mus musculus
tcagagaggtcacatggcttgctcg

SEQ ID NO: 54764 - DNA, 25 bp, Mus musculus
tcagagaggtgacagaacttattaa

SEQ ID NO: 54765 - DNA, 25 bp, Mus musculus
tcagagaggttaagctattttctca

SEQ ID NO: 54766 - DNA, 25 bp, Mus musculus
tcagagagttgcaaagttcgataaa

SEQ ID NO: 54767 - DNA, 25 bp, Mus musculus
tcagagatcattctgcccagcacag

SEQ ID NO: 54768 - DNA, 25 bp, Mus musculus
tcagagatggacaaacagagaccct

SEQ ID NO: 54769 - DNA, 25 bp, Mus musculus
tcagagcagacaaagaaacctccca

SEQ ID NO: 54770 - DNA, 25 bp, Mus musculus
tcagagccagcagagtctctgaact

SEQ ID NO: 54771 - DNA, 25 bp, Mus musculus
tcagagccctatgcactggtgagaa

SEQ ID NO: 54772 - DNA, 25 bp, Mus musculus
tcagagccctcgtgctccaaggaga

SEQ ID NO: 54773 - DNA, 25 bp, Mus musculus
tcagagccgcttcgccaaggaagtg

SEQ ID NO: 54774 - DNA, 25 bp, Mus musculus
tcagagccttaagccaaagcaagga

SEQ ID NO: 54775 - DNA, 25 bp, Mus musculus
tcagagcgtttgtcaccagttaagc

SEQ ID NO: 54776 - DNA, 25 bp, Mus musculus
tcagagctaagacatggtccgtttt

SEQ ID NO: 54777 - DNA, 25 bp, Mus musculus
tcagagctagaagacttatgctctt

SEQ ID NO: 54778 - DNA, 25 bp, Mus musculus
tcagagctctgactctaagtcggag

SEQ ID NO: 54779 - DNA, 25 bp, Mus musculus
tcagagctctttggccttaaaatga

SEQ ID NO: 54780 - DNA, 25 bp, Mus musculus
tcagagctgagagccctgagaaact

SEQ ID NO: 54781 - DNA, 25 bp, Mus musculus
tcagagctgcgaatctcttctcggg

SEQ ID NO: 54782 - DNA, 25 bp, Mus musculus
tcagagctgtggacatcccaggcct

SEQ ID NO: 54783 - DNA, 25 bp, Mus musculus
tcagagctgttctactatgcccaga

SEQ ID NO: 54784 - DNA, 25 bp, Mus musculus
tcagaggagagaacagaaacaagag

SEQ ID NO: 54785 - DNA, 25 bp, Mus musculus
tcagaggagcagttgtgcagccaag

SEQ ID NO: 54786 - DNA, 25 bp, Mus musculus
tcagaggatatctgggcggcatgct

SEQ ID NO: 54787 - DNA, 25 bp, Mus musculus
tcagaggatgtgtttgagacaggac

SEQ ID NO: 54788 - DNA, 25 bp, Mus musculus
tcagaggcaaggagaatgcgctgtt

SEQ ID NO: 54789 - DNA, 25 bp, Mus musculus
tcagaggcagttcaagttgaatcat

SEQ ID NO: 54790 - DNA, 25 bp, Mus musculus
tcagaggccaaaatggtgttgttct

SEQ ID NO: 54791 - DNA, 25 bp, Mus musculus
tcagaggctccttaaagatatgttc

SEQ ID NO: 54792 - DNA, 25 bp, Mus musculus
tcagagggaacttcgactgggccac

SEQ ID NO: 54793 - DNA, 25 bp, Mus musculus
tcagagggccgatttccagggaaag

SEQ ID NO: 54794 - DNA, 25 bp, Mus musculus
tcagaggtcaaggatggactgcaga

SEQ ID NO: 54795 - DNA, 25 bp, Mus musculus
tcagaggtcagtctgttcaacaagt

SEQ ID NO: 54796 - DNA, 25 bp, Mus musculus
tcagagtacctatctcagcaaagag

SEQ ID NO: 54797 - DNA, 25 bp, Mus musculus
tcagagtagagggagaagcaagcct

SEQ ID NO: 54798 - DNA, 25 bp, Mus musculus
tcagagtcattaaccccggagagca

SEQ ID NO: 54799 - DNA, 25 bp, Mus musculus
tcagagtctggtcgcacttgtttgc

SEQ ID NO: 54800 - DNA, 25 bp, Mus musculus
tcagagtgaactacatcgggacagg

SEQ ID NO: 54801 - DNA, 25 bp, Mus musculus
tcagagtgaacttcatcgggacagg

SEQ ID NO: 54802 - DNA, 25 bp, Mus musculus
tcagagtgataaaaatgaagagcct

SEQ ID NO: 54803 - DNA, 25 bp, Mus musculus
tcagagtgtgaagaccagccagggt

SEQ ID NO: 54804 - DNA, 25 bp, Mus musculus
tcagagttcaatcagaacaacggaa

SEQ ID NO: 54805 - DNA, 25 bp, Mus musculus
tcagagttgaaaggaaacaagttcc

SEQ ID NO: 54806 - DNA, 25 bp, Mus musculus
tcagagtttataccagctcaaactc

SEQ ID NO: 54807 - DNA, 25 bp, Mus musculus
tcagagtttcttccgggctctggcc

SEQ ID NO: 54808 - DNA, 25 bp, Mus musculus
tcagatacaaaggagaccagggaag

SEQ ID NO: 54809 - DNA, 25 bp, Mus musculus
tcagataccatctcggccagcacgg

SEQ ID NO: 54810 - DNA, 25 bp, Mus musculus
tcagataccccatggagcaactgta

SEQ ID NO: 54811 - DNA, 25 bp, Mus musculus
tcagatagaagctttgcccagtttt

SEQ ID NO: 54812 - DNA, 25 bp, Mus musculus
tcagatattcaagctgaaatctacc

SEQ ID NO: 54813 - DNA, 25 bp, Mus musculus
tcagatcacagcttatttcctcaag

SEQ ID NO: 54814 - DNA, 25 bp, Mus musculus
tcagatcagtagttatagtaaaagc

SEQ ID NO: 54815 - DNA, 25 bp, Mus musculus
tcagatccaggctcagatcagcgcc

SEQ ID NO: 54816 - DNA, 25 bp, Mus musculus
tcagatccccatctttgcatatcag

SEQ ID NO: 54817 - DNA, 25 bp, Mus musculus
tcagatccgatttctaaaggccaag

SEQ ID NO: 54818 - DNA, 25 bp, Mus musculus
tcagatccgtcttttctccaaggca

SEQ ID NO: 54819 - DNA, 25 bp, Mus musculus
tcagatcctgaagtccgtggagagg

SEQ ID NO: 54820 - DNA, 25 bp, Mus musculus
tcagatccttcagcattgccagaat

SEQ ID NO: 54821 - DNA, 25 bp, Mus musculus
tcagatcgaaaacatagctcagcgg

SEQ ID NO: 54822 - DNA, 25 bp, Mus musculus
tcagatcgaaaagatagctcagcgg

SEQ ID NO: 54823 - DNA, 25 bp, Mus musculus
tcagatctcaccaaatcgaccgaca

SEQ ID NO: 54824 - DNA, 25 bp, Mus musculus
tcagatctcagcttcctcaatagcc

SEQ ID NO: 54825 - DNA, 25 bp, Mus musculus
tcagatctccaaagccctggtggat

SEQ ID NO: 54826 - DNA, 25 bp, Mus musculus
tcagatctccagtggatgagaggca

SEQ ID NO: 54827 - DNA, 25 bp, Mus musculus
tcagatctgacgtggaccttccctg

SEQ ID NO: 54828 - DNA, 25 bp, Mus musculus
tcagatctggaaacctctagaacaa

SEQ ID NO: 54829 - DNA, 25 bp, Mus musculus
tcagatgaagcctggcggcccagct

SEQ ID NO: 54830 - DNA, 25 bp, Mus musculus
tcagatgcacgaccgttgttatggg

SEQ ID NO: 54831 - DNA, 25 bp, Mus musculus
tcagatgcacggctccagtatggcc

SEQ ID NO: 54832 - DNA, 25 bp, Mus musculus
tcagatgcagacctccgggctgaag

SEQ ID NO: 54833 - DNA, 25 bp, Mus musculus
tcagatgcagagtgagcattcggtg

SEQ ID NO: 54834 - DNA, 25 bp, Mus musculus
tcagatgcatgctatcgccttcagt

SEQ ID NO: 54835 - DNA, 25 bp, Mus musculus
tcagatgccactccagacggtttcc

SEQ ID NO: 54836 - DNA, 25 bp, Mus musculus
tcagatgctcaagtattggaaaggc

SEQ ID NO: 54837 - DNA, 25 bp, Mus musculus
tcagatggaccagtcactgtgcagg

SEQ ID NO: 54838 - DNA, 25 bp, Mus musculus
tcagatggactctccaaggtgtcag

SEQ ID NO: 54839 - DNA, 25 bp, Mus musculus
tcagatggcaaagatgatccaatcg

SEQ ID NO: 54840 - DNA, 25 bp, Mus musculus
tcagatggctgcagatcattacaga

SEQ ID NO: 54841 - DNA, 25 bp, Mus musculus
tcagatggtcggaaatgcccacacc

SEQ ID NO: 54842 - DNA, 25 bp, Mus musculus
tcagatggtcggtaatgcccacacc

SEQ ID NO: 54843 - DNA, 25 bp, Mus musculus
tcagatggttgtctccgaccccgag

SEQ ID NO: 54844 - DNA, 25 bp, Mus musculus
tcagatgtcacaaaacttgcaagaa

SEQ ID NO: 54845 - DNA, 25 bp, Mus musculus
tcagatgtccaaacagaatgtgtcc

SEQ ID NO: 54846 - DNA, 25 bp, Mus musculus
tcagattgcagatatactgtcaaca

SEQ ID NO: 54847 - DNA, 25 bp, Mus musculus
tcagattgctgtacttgtgttccag

SEQ ID NO: 54848 - DNA, 25 bp, Mus musculus
tcagatttccgagttcttgtttcag

SEQ ID NO: 54849 - DNA, 25 bp, Mus musculus
tcagattttctctttcgttggtacc

SEQ ID NO: 54850 - DNA, 25 bp, Mus musculus
tcagcaaaaactgaacctctctcag

SEQ ID NO: 54851 - DNA, 25 bp, Mus musculus
tcagcaaagaaaaaagccttggcct

SEQ ID NO: 54852 - DNA, 25 bp, Mus musculus
tcagcaaagagagcttgcagtgacc

SEQ ID NO: 54853 - DNA, 25 bp, Mus musculus
tcagcaacaaatttttagcgatgtc

SEQ ID NO: 54854 - DNA, 25 bp, Mus musculus
tcagcaactcttaggcacccagagg

SEQ ID NO: 54855 - DNA, 25 bp, Mus musculus
tcagcaacttcgagaagagctggcc

SEQ ID NO: 54856 - DNA, 25 bp, Mus musculus
tcagcaacttgactgggtatacacc

SEQ ID NO: 54857 - DNA, 25 bp, Mus musculus
tcagcaagctatgagaaggaaaagg

SEQ ID NO: 54858 - DNA, 25 bp, Mus musculus
tcagcaaggccttatgtttatgacc

SEQ ID NO: 54859 - DNA, 25 bp, Mus musculus
tcagcaaggtgaatatagtgaggcc

SEQ ID NO: 54860 - DNA, 25 bp, Mus musculus
tcagcaagtaccagaagaccttcac

SEQ ID NO: 54861 - DNA, 25 bp, Mus musculus
tcagcaagtcaagtagcaggggttc

SEQ ID NO: 54862 - DNA, 25 bp, Mus musculus
tcagcaatatcctccagcactgtgg

SEQ ID NO: 54863 - DNA, 25 bp, Mus musculus
tcagcaatggagaaacatggaaaca

SEQ ID NO: 54864 - DNA, 25 bp, Mus musculus
tcagcaatgggctcgtggtttccgg

SEQ ID NO: 54865 - DNA, 25 bp, Mus musculus
tcagcaatgtcttgccgactgtggg

SEQ ID NO: 54866 - DNA, 25 bp, Mus musculus
tcagcaatttgctatcggaagcagc

SEQ ID NO: 54867 - DNA, 25 bp, Mus musculus
tcagcacagccagaagtcatgaatt

SEQ ID NO: 54868 - DNA, 25 bp, Mus musculus
tcagcacagctcagtccactgtgtt

SEQ ID NO: 54869 - DNA, 25 bp, Mus musculus
tcagcacagttcgtgaggtggcctt

SEQ ID NO: 54870 - DNA, 25 bp, Mus musculus
tcagcaccagtgctcatggagaaaa

SEQ ID NO: 54871 - DNA, 25 bp, Mus musculus
tcagcaccgaaaaggagatcctgcc

SEQ ID NO: 54872 - DNA, 25 bp, Mus musculus
tcagcaccggcttcagcaggatgag

SEQ ID NO: 54873 - DNA, 25 bp, Mus musculus
tcagcacctcttatgatgcacagtg

SEQ ID NO: 54874 - DNA, 25 bp, Mus musculus
tcagcacctgcttttaggacatcac

SEQ ID NO: 54875 - DNA, 25 bp, Mus musculus
tcagcacgcgtagctatatccaggg

SEQ ID NO: 54876 - DNA, 25 bp, Mus musculus
tcagcacgcgtcaggtccttcagtg

SEQ ID NO: 54877 - DNA, 25 bp, Mus musculus
tcagcacttaggagccgacctccat

SEQ ID NO: 54878 - DNA, 25 bp, Mus musculus
tcagcagaaaaccaggcacagaata

SEQ ID NO: 54879 - DNA, 25 bp, Mus musculus
tcagcagaaatggtgtcaacctgtc

SEQ ID NO: 54880 - DNA, 25 bp, Mus musculus
tcagcagacagccttttctcaacag

SEQ ID NO: 54881 - DNA, 25 bp, Mus musculus
tcagcagagaaaggttgggatgaca

SEQ ID NO: 54882 - DNA, 25 bp, Mus musculus
tcagcagagtggaaccagcagacag

SEQ ID NO: 54883 - DNA, 25 bp, Mus musculus
tcagcagagtggttatgggaaagta

SEQ ID NO: 54884 - DNA, 25 bp, Mus musculus
tcagcagatcacatgggctctcggt

SEQ ID NO: 54885 - DNA, 25 bp, Mus musculus
tcagcagcacttaatttggaataac

SEQ ID NO: 54886 - DNA, 25 bp, Mus musculus
tcagcagcagacgtgtccggtagac

SEQ ID NO: 54887 - DNA, 25 bp, Mus musculus
tcagcagcagctcctctgtgtccag

SEQ ID NO: 54888 - DNA, 25 bp, Mus musculus
tcagcagcatcacagactccactat

SEQ ID NO: 54889 - DNA, 25 bp, Mus musculus
tcagcagcctgcgtgagatcacact

SEQ ID NO: 54890 - DNA, 25 bp, Mus musculus
tcagcagctggtgagtgccacgctg

SEQ ID NO: 54891 - DNA, 25 bp, Mus musculus
tcagcaggacagaggtgttagctgc

SEQ ID NO: 54892 - DNA, 25 bp, Mus musculus
tcagcaggatgagtgagcggcaact

SEQ ID NO: 54893 - DNA, 25 bp, Mus musculus
tcagcaggcaccattctccgagctg

SEQ ID NO: 54894 - DNA, 25 bp, Mus musculus
tcagcaggctttggagtacggcacc

SEQ ID NO: 54895 - DNA, 25 bp, Mus musculus
tcagcagggactcgtgaaacagcag

SEQ ID NO: 54896 - DNA, 25 bp, Mus musculus
tcagcagggtggatactggacacat

SEQ ID NO: 54897 - DNA, 25 bp, Mus musculus
tcagcagggtggttactggacacat

SEQ ID NO: 54898 - DNA, 25 bp, Mus musculus
tcagcaggtagcctggtttccagct

SEQ ID NO: 54899 - DNA, 25 bp, Mus musculus
tcagcaggttaagctggcactggcc

SEQ ID NO: 54900 - DNA, 25 bp, Mus musculus
tcagcaggttgataaaggagccatc

SEQ ID NO: 54901 - DNA, 25 bp, Mus musculus
tcagcagtaagagccggagttctct

SEQ ID NO: 54902 - DNA, 25 bp, Mus musculus
tcagcagtacgggttgggcagcttc

SEQ ID NO: 54903 - DNA, 25 bp, Mus musculus
tcagcagtatagcagttcagccctg

SEQ ID NO: 54904 - DNA, 25 bp, Mus musculus
tcagcagtgccagtatgaagtgggt

SEQ ID NO: 54905 - DNA, 25 bp, Mus musculus
tcagcagtgcccatcggagttcgag

SEQ ID NO: 54906 - DNA, 25 bp, Mus musculus
tcagcagtgcccttcggagttcgag

SEQ ID NO: 54907 - DNA, 25 bp, Mus musculus
tcagcagttaacatgggctctgtgc

SEQ ID NO: 54908 - DNA, 25 bp, Mus musculus
tcagcatagagaacactctgtgggc

SEQ ID NO: 54909 - DNA, 25 bp, Mus musculus
tcagcatagataacgagctagagta

SEQ ID NO: 54910 - DNA, 25 bp, Mus musculus
tcagcatagtctccattcagagagc

SEQ ID NO: 54911 - DNA, 25 bp, Mus musculus
tcagcatatcatgaagtgggtcagt

SEQ ID NO: 54912 - DNA, 25 bp, Mus musculus
tcagcatatgcatctaatcagccag

SEQ ID NO: 54913 - DNA, 25 bp, Mus musculus
tcagcatcaacgaggagatgcagcg

SEQ ID NO: 54914 - DNA, 25 bp, Mus musculus
tcagcatcctgctcaagagcagaaa

SEQ ID NO: 54915 - DNA, 25 bp, Mus musculus
tcagcatcgcagacaagaagcgcag

SEQ ID NO: 54916 - DNA, 25 bp, Mus musculus
tcagcatcgctgtggtctggcaagc

SEQ ID NO: 54917 - DNA, 25 bp, Mus musculus
tcagcatgatcctgggcgcctggat

SEQ ID NO: 54918 - DNA, 25 bp, Mus musculus
tcagcatggacagttggcaaatttt

SEQ ID NO: 54919 - DNA, 25 bp, Mus musculus
tcagcatggccaatagaagaggagg

SEQ ID NO: 54920 - DNA, 25 bp, Mus musculus
tcagcatggcccagtcttcatttgt

SEQ ID NO: 54921 - DNA, 25 bp, Mus musculus
tcagcatggcggctcctcgacttca

SEQ ID NO: 54922 - DNA, 25 bp, Mus musculus
tcagcattcgattagcatgcctgct

SEQ ID NO: 54923 - DNA, 25 bp, Mus musculus
tcagcatttagaccgggttgtctcc

SEQ ID NO: 54924 - DNA, 25 bp, Mus musculus
tcagcatttggatctatgggcctgc

SEQ ID NO: 54925 - DNA, 25 bp, Mus musculus
tcagcatttgtgaaggcctcggcgt

SEQ ID NO: 54926 - DNA, 25 bp, Mus musculus
tcagccaaaaatgcagaaggagttt

SEQ ID NO: 54927 - DNA, 25 bp, Mus musculus
tcagccaaagaagatgagagcatcc

SEQ ID NO: 54928 - DNA, 25 bp, Mus musculus
tcagccaatggtccccattccaggg

SEQ ID NO: 54929 - DNA, 25 bp, Mus musculus
tcagccacatcaagtgcagaaacgc

SEQ ID NO: 54930 - DNA, 25 bp, Mus musculus
tcagccaccagcgtggtgatcacat

SEQ ID NO: 54931 - DNA, 25 bp, Mus musculus
tcagccacgtttgcatagcgtaagc

SEQ ID NO: 54932 - DNA, 25 bp, Mus musculus
tcagccagcaagttgcccatcgagg

SEQ ID NO: 54933 - DNA, 25 bp, Mus musculus
tcagccagcccttgagttgaagcag

SEQ ID NO: 54934 - DNA, 25 bp, Mus musculus
tcagccagctagctgtggatccgga

SEQ ID NO: 54935 - DNA, 25 bp, Mus musculus
tcagccaggaacgaacttacagaga

SEQ ID NO: 54936 - DNA, 25 bp, Mus musculus
tcagccaggaatgatgggtaaccaa

SEQ ID NO: 54937 - DNA, 25 bp, Mus musculus
tcagccagttctgctcacctgtgaa

SEQ ID NO: 54938 - DNA, 25 bp, Mus musculus
tcagccatcaatcactagcacatga

SEQ ID NO: 54939 - DNA, 25 bp, Mus musculus
tcagccatcaatgactagcacatga

SEQ ID NO: 54940 - DNA, 25 bp, Mus musculus
tcagccatggcgttcaaggcacggt

SEQ ID NO: 54941 - DNA, 25 bp, Mus musculus
tcagccatgttgctgttgacggcag

SEQ ID NO: 54942 - DNA, 25 bp, Mus musculus
tcagcccagcataaacgatagtctg

SEQ ID NO: 54943 - DNA, 25 bp, Mus musculus
tcagccccagcaagaggaaattcag

SEQ ID NO: 54944 - DNA, 25 bp, Mus musculus
tcagccccgagacaacgaagctctt

SEQ ID NO: 54945 - DNA, 25 bp, Mus musculus
tcagcccgtgcagctggaagacggc

SEQ ID NO: 54946 - DNA, 25 bp, Mus musculus
tcagccctaccttcatctgtgatca

SEQ ID NO: 54947 - DNA, 25 bp, Mus musculus
tcagccctcttgtgcaggaccatgg

SEQ ID NO: 54948 - DNA, 25 bp, Mus musculus
tcagccctggaatcctgcaggtacc

SEQ ID NO: 54949 - DNA, 25 bp, Mus musculus
tcagccctggagcacagcgtccagt

SEQ ID NO: 54950 - DNA, 25 bp, Mus musculus
tcagccgaaagtccagaaatgagtg

SEQ ID NO: 54951 - DNA, 25 bp, Mus musculus
tcagccgaatagaccagaggcatcg

SEQ ID NO: 54952 - DNA, 25 bp, Mus musculus
tcagccgcagaggttgaaagctcta

SEQ ID NO: 54953 - DNA, 25 bp, Mus musculus
tcagccgcaggacagacatgccttt

SEQ ID NO: 54954 - DNA, 25 bp, Mus musculus
tcagccggagttgtaccacccaatg

SEQ ID NO: 54955 - DNA, 25 bp, Mus musculus
tcagccggcagatgggaatggtttt

SEQ ID NO: 54956 - DNA, 25 bp, Mus musculus
tcagccgggtactaccattctacag

SEQ ID NO: 54957 - DNA, 25 bp, Mus musculus
tcagccgtgctggtgttcgacatcc

SEQ ID NO: 54958 - DNA, 25 bp, Mus musculus
tcagcctccccagggatcttgagtg

SEQ ID NO: 54959 - DNA, 25 bp, Mus musculus
tcagcctcctaaggcagctggagct

SEQ ID NO: 54960 - DNA, 25 bp, Mus musculus
tcagcctcttgtagaagagcctaag

SEQ ID NO: 54961 - DNA, 25 bp, Mus musculus
tcagcctgcgttatgatgggaccca

SEQ ID NO: 54962 - DNA, 25 bp, Mus musculus
tcagcctgctgtgtctcatggtggg

SEQ ID NO: 54963 - DNA, 25 bp, Mus musculus
tcagcctggatccacagtccatgtt

SEQ ID NO: 54964 - DNA, 25 bp, Mus musculus
tcagcctgggcgctctgaagatgca

SEQ ID NO: 54965 - DNA, 25 bp, Mus musculus
tcagcctgggcggtctgaagatgca

SEQ ID NO: 54966 - DNA, 25 bp, Mus musculus
tcagcctgtatctatattttcgacc

SEQ ID NO: 54967 - DNA, 25 bp, Mus musculus
tcagcctgtcggaggccgacagtca

SEQ ID NO: 54968 - DNA, 25 bp, Mus musculus
tcagcctgttgactcctgggtctag

SEQ ID NO: 54969 - DNA, 25 bp, Mus musculus
tcagccttacaaacctgggcctggt

SEQ ID NO: 54970 - DNA, 25 bp, Mus musculus
tcagccttattacaacagtcgtggg

SEQ ID NO: 54971 - DNA, 25 bp, Mus musculus
tcagccttcacttgtccacggaaca

SEQ ID NO: 54972 - DNA, 25 bp, Mus musculus
tcagccttcctatttccccaagagg

SEQ ID NO: 54973 - DNA, 25 bp, Mus musculus
tcagcctttaccagacatgttccag

SEQ ID NO: 54974 - DNA, 25 bp, Mus musculus
tcagcctttcttgacccctgggtgt

SEQ ID NO: 54975 - DNA, 25 bp, Mus musculus
tcagcctttggatgcacgatttcgc

SEQ ID NO: 54976 - DNA, 25 bp, Mus musculus
tcagcctttggtgatcctccaggac

SEQ ID NO: 54977 - DNA, 25 bp, Mus musculus
tcagcgaaaccaatggtgtttgcag

SEQ ID NO: 54978 - DNA, 25 bp, Mus musculus
tcagcgaccgtaccgctgcagggat

SEQ ID NO: 54979 - DNA, 25 bp, Mus musculus
tcagcgactctgcaacaattggcca

SEQ ID NO: 54980 - DNA, 25 bp, Mus musculus
tcagcgaggagaacatcaagaacaa

SEQ ID NO: 54981 - DNA, 25 bp, Mus musculus
tcagcgcctgggacttcgaacaaaa

SEQ ID NO: 54982 - DNA, 25 bp, Mus musculus
tcagcgctctggtcccgagcagtct

SEQ ID NO: 54983 - DNA, 25 bp, Mus musculus
tcagcgctgtaaggagacaattggg

SEQ ID NO: 54984 - DNA, 25 bp, Mus musculus
tcagcggaaccacgagggtcatgaa

SEQ ID NO: 54985 - DNA, 25 bp, Mus musculus
tcagcggacagtacctttagatgcc

SEQ ID NO: 54986 - DNA, 25 bp, Mus musculus
tcagcggacagttcctttagatgcc

SEQ ID NO: 54987 - DNA, 25 bp, Mus musculus
tcagcggctggtggagttcatgaca

SEQ ID NO: 54988 - DNA, 25 bp, Mus musculus
tcagcgggtcaacattgtgcctatc

SEQ ID NO: 54989 - DNA, 25 bp, Mus musculus
tcagcggtgctgttttccttatcat

SEQ ID NO: 54990 - DNA, 25 bp, Mus musculus
tcagcgtcatgctgccgggaccagg

SEQ ID NO: 54991 - DNA, 25 bp, Mus musculus
tcagcgtccccatatgtgatacaag

SEQ ID NO: 54992 - DNA, 25 bp, Mus musculus
tcagcgtgactgtggaagaattctg

SEQ ID NO: 54993 - DNA, 25 bp, Mus musculus
tcagcgtggatggacacacgtgtat

SEQ ID NO: 54994 - DNA, 25 bp, Mus musculus
tcagctaaacctcctaagacctctt

SEQ ID NO: 54995 - DNA, 25 bp, Mus musculus
tcagctaagaaatttcatgtgtcat

SEQ ID NO: 54996 - DNA, 25 bp, Mus musculus
tcagctacaagaggagatggcgctg

SEQ ID NO: 54997 - DNA, 25 bp, Mus musculus
tcagctacctcggtactgggagtac

SEQ ID NO: 54998 - DNA, 25 bp, Mus musculus
tcagctaccttttattcagcaggaa

SEQ ID NO: 54999 - DNA, 25 bp, Mus musculus
tcagctactagaaggaggaaaaacc

SEQ ID NO: 55000 - DNA, 25 bp, Mus musculus
tcagctagtaagagccgcctgcaga

SEQ ID NO: 55001 - DNA, 25 bp, Mus musculus
tcagctataagagagctagacaatc

SEQ ID NO: 55002 - DNA, 25 bp, Mus musculus
tcagctcaactgctgacccaaaggc

SEQ ID NO: 55003 - DNA, 25 bp, Mus musculus
tcagctcaactggtgacccaaaggc

SEQ ID NO: 55004 - DNA, 25 bp, Mus musculus
tcagctcaccctggcagtggttaac

SEQ ID NO: 55005 - DNA, 25 bp, Mus musculus
tcagctcagatctccaaagccctgg

SEQ ID NO: 55006 - DNA, 25 bp, Mus musculus
tcagctccagccaggagcagcagtt

SEQ ID NO: 55007 - DNA, 25 bp, Mus musculus
tcagctccccacaaaaacagaagca

SEQ ID NO: 55008 - DNA, 25 bp, Mus musculus
tcagctccccactaaaacagaagca

SEQ ID NO: 55009 - DNA, 25 bp, Mus musculus
tcagctccgaattacgtatagaaaa

SEQ ID NO: 55010 - DNA, 25 bp, Mus musculus
tcagctccgtttttcatcccaacag

SEQ ID NO: 55011 - DNA, 25 bp, Mus musculus
tcagctcggtgccaaggttccaaag

SEQ ID NO: 55012 - DNA, 25 bp, Mus musculus
tcagctctatgtccaagaacgcccg

SEQ ID NO: 55013 - DNA, 25 bp, Mus musculus
tcagctctctgactctgcaggatgg

SEQ ID NO: 55014 - DNA, 25 bp, Mus musculus
tcagctctgacttggacgggcatcc

SEQ ID NO: 55015 - DNA, 25 bp, Mus musculus
tcagctctggatacagaaagtgaaa

SEQ ID NO: 55016 - DNA, 25 bp, Mus musculus
tcagctctgttcaaatctggctcag

SEQ ID NO: 55017 - DNA, 25 bp, Mus musculus
tcagctgaagcgtcacatgattacc

SEQ ID NO: 55018 - DNA, 25 bp, Mus musculus
tcagctgaaggccactatggaggct

SEQ ID NO: 55019 - DNA, 25 bp, Mus musculus
tcagctgagtggaagcatgttctcg

SEQ ID NO: 55020 - DNA, 25 bp, Mus musculus
tcagctgatgacaacaaacgtgtgg

SEQ ID NO: 55021 - DNA, 25 bp, Mus musculus
tcagctgcagatagcatgggggccc

SEQ ID NO: 55022 - DNA, 25 bp, Mus musculus
tcagctgctctgctctggctagcca

SEQ ID NO: 55023 - DNA, 25 bp, Mus musculus
tcagctggagactggagactaggaa

SEQ ID NO: 55024 - DNA, 25 bp, Mus musculus
tcagctggatatgttttaccggcac

SEQ ID NO: 55025 - DNA, 25 bp, Mus musculus
tcagctggccgctggaacctgtgag

SEQ ID NO: 55026 - DNA, 25 bp, Mus musculus
tcagctggctctagagaccatgaat

SEQ ID NO: 55027 - DNA, 25 bp, Mus musculus
tcagctgggaatagagttcgacgag

SEQ ID NO: 55028 - DNA, 25 bp, Mus musculus
tcagctgggaatgtgcaatagagaa

SEQ ID NO: 55029 - DNA, 25 bp, Mus musculus
tcagctgggctctgccagtcacgtg

SEQ ID NO: 55030 - DNA, 25 bp, Mus musculus
tcagctggtgaagagactgacggat

SEQ ID NO: 55031 - DNA, 25 bp, Mus musculus
tcagctgtacatctgcccataccag

SEQ ID NO: 55032 - DNA, 25 bp, Mus musculus
tcagctgtagttataaagcaaagca

SEQ ID NO: 55033 - DNA, 25 bp, Mus musculus
tcagctgtcaccgtctacggatgag

SEQ ID NO: 55034 - DNA, 25 bp, Mus musculus
tcagctgtctccacttgacttgcat

SEQ ID NO: 55035 - DNA, 25 bp, Mus musculus
tcagctgtggcggataagcacgaat

SEQ ID NO: 55036 - DNA, 25 bp, Mus musculus
tcagctgtgggtaccccacttatga

SEQ ID NO: 55037 - DNA, 25 bp, Mus musculus
tcagctgtggtgtgctgcaagacca

SEQ ID NO: 55038 - DNA, 25 bp, Mus musculus
tcagctgttcgtgaagacttcaagg

SEQ ID NO: 55039 - DNA, 25 bp, Mus musculus
tcagctgtttctatgggaatacggg

SEQ ID NO: 55040 - DNA, 25 bp, Mus musculus
tcagcttacggaaggatgggaaata

SEQ ID NO: 55041 - DNA, 25 bp, Mus musculus
tcagcttcagctcattctctacata

SEQ ID NO: 55042 - DNA, 25 bp, Mus musculus
tcagcttcagtgagcacaacacggc

SEQ ID NO: 55043 - DNA, 25 bp, Mus musculus
tcagcttcggcttcgcgctcggcta

SEQ ID NO: 55044 - DNA, 25 bp, Mus musculus
tcagcttctccaaggagtctacgcc

SEQ ID NO: 55045 - DNA, 25 bp, Mus musculus
tcagcttctgctatatcatcagatt

SEQ ID NO: 55046 - DNA, 25 bp, Mus musculus
tcagcttgactactcttctggacaa

SEQ ID NO: 55047 - DNA, 25 bp, Mus musculus
tcagcttgactagtcttctggacaa

SEQ ID NO: 55048 - DNA, 25 bp, Mus musculus
tcagcttgacttggagagatatagt

SEQ ID NO: 55049 - DNA, 25 bp, Mus musculus
tcagcttggaacctgggcagcgcct

SEQ ID NO: 55050 - DNA, 25 bp, Mus musculus
tcagcttggattccggatctgggac

SEQ ID NO: 55051 - DNA, 25 bp, Mus musculus
tcagctttcaagttctaccgagaga

SEQ ID NO: 55052 - DNA, 25 bp, Mus musculus
tcagctttcccgtggacaaccttag

SEQ ID NO: 55053 - DNA, 25 bp, Mus musculus
tcagctttgaagtgggagcccagtt

SEQ ID NO: 55054 - DNA, 25 bp, Mus musculus
tcagctttgacatagttcgagatca

SEQ ID NO: 55055 - DNA, 25 bp, Mus musculus
tcagctttgccttaggtggactcct

SEQ ID NO: 55056 - DNA, 25 bp, Mus musculus
tcaggaaaattggaaccaaagtatg

SEQ ID NO: 55057 - DNA, 25 bp, Mus musculus
tcaggaaagctggacttctgcagcg

SEQ ID NO: 55058 - DNA, 25 bp, Mus musculus
tcaggaacaggcaacgacagagggc

SEQ ID NO: 55059 - DNA, 25 bp, Mus musculus
tcaggaactaccttgtaaaattcaa

SEQ ID NO: 55060 - DNA, 25 bp, Mus musculus
tcaggaagagatagcttgatttttc

SEQ ID NO: 55061 - DNA, 25 bp, Mus musculus
tcaggaagccctcaacgagaggcag

SEQ ID NO: 55062 - DNA, 25 bp, Mus musculus
tcaggaagcgcaggattggaaccct

SEQ ID NO: 55063 - DNA, 25 bp, Mus musculus
tcaggaagggacagaggcccatgaa

SEQ ID NO: 55064 - DNA, 25 bp, Mus musculus
tcaggaagtggagaaccacaaaaag

SEQ ID NO: 55065 - DNA, 25 bp, Mus musculus
tcaggaagttttgctgttcgagtca

SEQ ID NO: 55066 - DNA, 25 bp, Mus musculus
tcaggaatgaaagccatcatgatgg

SEQ ID NO: 55067 - DNA, 25 bp, Mus musculus
tcaggacaaagttgtgttgcgcccc

SEQ ID NO: 55068 - DNA, 25 bp, Mus musculus
tcaggacacttcagggatactctca

SEQ ID NO: 55069 - DNA, 25 bp, Mus musculus
tcaggaccccatccgtacagctggt

SEQ ID NO: 55070 - DNA, 25 bp, Mus musculus
tcaggaccccgaacgatatatgcaa

SEQ ID NO: 55071 - DNA, 25 bp, Mus musculus
tcaggaccccgatcgatatatgcaa

SEQ ID NO: 55072 - DNA, 25 bp, Mus musculus
tcaggaccccttaggcatccaggga

SEQ ID NO: 55073 - DNA, 25 bp, Mus musculus
tcaggacccttctgggaaggccttg

SEQ ID NO: 55074 - DNA, 25 bp, Mus musculus
tcaggaccttccaacacagtgcaga

SEQ ID NO: 55075 - DNA, 25 bp, Mus musculus
tcaggacgatgaggtaccgcagaag

SEQ ID NO: 55076 - DNA, 25 bp, Mus musculus
tcaggacggtcataagcatccacac

SEQ ID NO: 55077 - DNA, 25 bp, Mus musculus
tcaggactggcctggatgacttgga

SEQ ID NO: 55078 - DNA, 25 bp, Mus musculus
tcaggactgtatttaaaaccatgta

SEQ ID NO: 55079 - DNA, 25 bp, Mus musculus
tcaggacttactagatgctgagaga

SEQ ID NO: 55080 - DNA, 25 bp, Mus musculus
tcaggacttacttgatgctgagaga

SEQ ID NO: 55081 - DNA, 25 bp, Mus musculus
tcaggactttgatgtggctaatgac

SEQ ID NO: 55082 - DNA, 25 bp, Mus musculus
tcaggagaacagatcagtggaggac

SEQ ID NO: 55083 - DNA, 25 bp, Mus musculus
tcaggagaatccaggaccgggtgtt

SEQ ID NO: 55084 - DNA, 25 bp, Mus musculus
tcaggagacaagagtgtggaaacag

SEQ ID NO: 55085 - DNA, 25 bp, Mus musculus
tcaggagatgctgctgagtgtatcg

SEQ ID NO: 55086 - DNA, 25 bp, Mus musculus
tcaggagattacactgactggaatt

SEQ ID NO: 55087 - DNA, 25 bp, Mus musculus
tcaggagcagaagtctgggcgcaca

SEQ ID NO: 55088 - DNA, 25 bp, Mus musculus
tcaggagccctcaatggtggtgtct

SEQ ID NO: 55089 - DNA, 25 bp, Mus musculus
tcaggagccctggaagaccgtgtcc

SEQ ID NO: 55090 - DNA, 25 bp, Mus musculus
tcaggagccgcattgaccaagccca

SEQ ID NO: 55091 - DNA, 25 bp, Mus musculus
tcaggagcctccttaatttacacgg

SEQ ID NO: 55092 - DNA, 25 bp, Mus musculus
tcaggagcgaccctacttcatgtcg

SEQ ID NO: 55093 - DNA, 25 bp, Mus musculus
tcaggagcggagacacctggacttc

SEQ ID NO: 55094 - DNA, 25 bp, Mus musculus
tcaggaggaaacttccatggtgaat

SEQ ID NO: 55095 - DNA, 25 bp, Mus musculus
tcaggaggagcgtctttgggttttc

SEQ ID NO: 55096 - DNA, 25 bp, Mus musculus
tcaggaggatgaagtagcacatact

SEQ ID NO: 55097 - DNA, 25 bp, Mus musculus
tcaggaggatgtagcactaactgca

SEQ ID NO: 55098 - DNA, 25 bp, Mus musculus
tcaggaggcatgaaacttgtgaact

SEQ ID NO: 55099 - DNA, 25 bp, Mus musculus
tcaggaggctccaggcttggccttt

SEQ ID NO: 55100 - DNA, 25 bp, Mus musculus
tcaggagtcagtgaggtacattgca

SEQ ID NO: 55101 - DNA, 25 bp, Mus musculus
tcaggagtcctgatctagctgtggc

SEQ ID NO: 55102 - DNA, 25 bp, Mus musculus
tcaggagtcgactcaggctgagaat

SEQ ID NO: 55103 - DNA, 25 bp, Mus musculus
tcaggagtctgctgtccatttgaaa

SEQ ID NO: 55104 - DNA, 25 bp, Mus musculus
tcaggagtggcaggaaaggacgccg

SEQ ID NO: 55105 - DNA, 25 bp, Mus musculus
tcaggatagactgtcacagagctct

SEQ ID NO: 55106 - DNA, 25 bp, Mus musculus
tcaggatatcactgaagagagcttc

SEQ ID NO: 55107 - DNA, 25 bp, Mus musculus
tcaggatatcctctgggaagaggtc

SEQ ID NO: 55108 - DNA, 25 bp, Mus musculus
tcaggatccaaatgttgctgccttc

SEQ ID NO: 55109 - DNA, 25 bp, Mus musculus
tcaggatccaggcatgccttacctg

SEQ ID NO: 55110 - DNA, 25 bp, Mus musculus
tcaggatctagctcgaagtttcaac

SEQ ID NO: 55111 - DNA, 25 bp, Mus musculus
tcaggatctgcgatctgcgagcgcc

SEQ ID NO: 55112 - DNA, 25 bp, Mus musculus
tcaggatctggtgacaaacgtactc

SEQ ID NO: 55113 - DNA, 25 bp, Mus musculus
tcaggatgaggcatatgaccggcgt

SEQ ID NO: 55114 - DNA, 25 bp, Mus musculus
tcaggatgtccaagccctgtggtac

SEQ ID NO: 55115 - DNA, 25 bp, Mus musculus
tcaggattgtggtcactcgaagtga

SEQ ID NO: 55116 - DNA, 25 bp, Mus musculus
tcaggcaacccaaacttacggacta

SEQ ID NO: 55117 - DNA, 25 bp, Mus musculus
tcaggcaacgtcttctaccatgggt

SEQ ID NO: 55118 - DNA, 25 bp, Mus musculus
tcaggcaataaaggatccgggccca

SEQ ID NO: 55119 - DNA, 25 bp, Mus musculus
tcaggcacatatggaagatctcgaa

SEQ ID NO: 55120 - DNA, 25 bp, Mus musculus
tcaggcacattatagtcaaacccat

SEQ ID NO: 55121 - DNA, 25 bp, Mus musculus
tcaggcacccagaggagctgtctct

SEQ ID NO: 55122 - DNA, 25 bp, Mus musculus
tcaggcactgtggtaaagacaggag

SEQ ID NO: 55123 - DNA, 25 bp, Mus musculus
tcaggcagcagttgagtgacatgag

SEQ ID NO: 55124 - DNA, 25 bp, Mus musculus
tcaggcagcctgactgtggttgtac

SEQ ID NO: 55125 - DNA, 25 bp, Mus musculus
tcaggcaggagattttgaggcagct

SEQ ID NO: 55126 - DNA, 25 bp, Mus musculus
tcaggcagtgctatgtcaaattttc

SEQ ID NO: 55127 - DNA, 25 bp, Mus musculus
tcaggcagtgctttgtcaaattttc

SEQ ID NO: 55128 - DNA, 25 bp, Mus musculus
tcaggcatccagtgggacttgcgga

SEQ ID NO: 55129 - DNA, 25 bp, Mus musculus
tcaggcatcctgtcggccgtggtgc

SEQ ID NO: 55130 - DNA, 25 bp, Mus musculus
tcaggcatcgcctaacacatggtga

SEQ ID NO: 55131 - DNA, 25 bp, Mus musculus
tcaggcatcttctaccggccagagc

SEQ ID NO: 55132 - DNA, 25 bp, Mus musculus
tcaggcatggaaaattctagggaat

SEQ ID NO: 55133 - DNA, 25 bp, Mus musculus
tcaggcattacccaaacctgcaagc

SEQ ID NO: 55134 - DNA, 25 bp, Mus musculus
tcaggcattagtttctcagttaaaa

SEQ ID NO: 55135 - DNA, 25 bp, Mus musculus
tcaggccaaactgtacaggtccagg

SEQ ID NO: 55136 - DNA, 25 bp, Mus musculus
tcaggccaccatttctgaaatcaag

SEQ ID NO: 55137 - DNA, 25 bp, Mus musculus
tcaggccagaaagcggaggccgaaa

SEQ ID NO: 55138 - DNA, 25 bp, Mus musculus
tcaggccagcaaacggaggaaggaa

SEQ ID NO: 55139 - DNA, 25 bp, Mus musculus
tcaggccagcaagaggaagcatgtg

SEQ ID NO: 55140 - DNA, 25 bp, Mus musculus
tcaggccattgaacgaaatgcattc

SEQ ID NO: 55141 - DNA, 25 bp, Mus musculus
tcaggcccttggactgggcactaca

SEQ ID NO: 55142 - DNA, 25 bp, Mus musculus
tcaggcctacgagggcagtcgctct

SEQ ID NO: 55143 - DNA, 25 bp, Mus musculus
tcaggcggatcacagtcgctctggc

SEQ ID NO: 55144 - DNA, 25 bp, Mus musculus
tcaggcggcagatgtggctacgact

SEQ ID NO: 55145 - DNA, 25 bp, Mus musculus
tcaggcgtgcaaaaggaacgcattc

SEQ ID NO: 55146 - DNA, 25 bp, Mus musculus
tcaggctagcattagtgaactcaag

SEQ ID NO: 55147 - DNA, 25 bp, Mus musculus
tcaggctcaagaggactccttgtct

SEQ ID NO: 55148 - DNA, 25 bp, Mus musculus
tcaggctcagaaaattttggaaaga

SEQ ID NO: 55149 - DNA, 25 bp, Mus musculus
tcaggctccttatgtacccagtacc

SEQ ID NO: 55150 - DNA, 25 bp, Mus musculus
tcaggctgacgctccagagtgaact

SEQ ID NO: 55151 - DNA, 25 bp, Mus musculus
tcaggctggaaaggaaactctgagt

SEQ ID NO: 55152 - DNA, 25 bp, Mus musculus
tcaggctggtggcaattgaattgac

SEQ ID NO: 55153 - DNA, 25 bp, Mus musculus
tcaggctgtaaacttcctggctgtt

SEQ ID NO: 55154 - DNA, 25 bp, Mus musculus
tcaggctgtgcttagtaagcatgtg

SEQ ID NO: 55155 - DNA, 25 bp, Mus musculus
tcaggcttagagacagcagtagtca

SEQ ID NO: 55156 - DNA, 25 bp, Mus musculus
tcaggcttggattctagtcacaggt

SEQ ID NO: 55157 - DNA, 25 bp, Mus musculus
tcagggaaacccatagtggcaccca

SEQ ID NO: 55158 - DNA, 25 bp, Mus musculus
tcagggaaacccattcaagctcaag

SEQ ID NO: 55159 - DNA, 25 bp, Mus musculus
tcagggaaacccttagtggcaccca

SEQ ID NO: 55160 - DNA, 25 bp, Mus musculus
tcagggaaggatcgcatttcatgtg

SEQ ID NO: 55161 - DNA, 25 bp, Mus musculus
tcagggacaaacagggccccaacca

SEQ ID NO: 55162 - DNA, 25 bp, Mus musculus
tcagggacaagaagttgttgcaagt

SEQ ID NO: 55163 - DNA, 25 bp, Mus musculus
tcagggacccaagagtctgcagttc

SEQ ID NO: 55164 - DNA, 25 bp, Mus musculus
tcagggacctctagccggctggagc

SEQ ID NO: 55165 - DNA, 25 bp, Mus musculus
tcagggacgtgcctacctcttcaac

SEQ ID NO: 55166 - DNA, 25 bp, Mus musculus
tcagggactatttttggaagccaga

SEQ ID NO: 55167 - DNA, 25 bp, Mus musculus
tcagggactgtcacaacgtgtctgt

SEQ ID NO: 55168 - DNA, 25 bp, Mus musculus
tcagggagcattgcattccagtgac

SEQ ID NO: 55169 - DNA, 25 bp, Mus musculus
tcagggagcccattactgtcagcag

SEQ ID NO: 55170 - DNA, 25 bp, Mus musculus
tcagggatgaacatttgagactctc

SEQ ID NO: 55171 - DNA, 25 bp, Mus musculus
tcagggatgacacttggaggcacac

SEQ ID NO: 55172 - DNA, 25 bp, Mus musculus
tcagggatggccatagaacagatgt

SEQ ID NO: 55173 - DNA, 25 bp, Mus musculus
tcagggatgtgttaatgatgttgct

SEQ ID NO: 55174 - DNA, 25 bp, Mus musculus
tcagggcacaaagcaagagggtgtc

SEQ ID NO: 55175 - DNA, 25 bp, Mus musculus
tcagggcaccaaggcggctctagca

SEQ ID NO: 55176 - DNA, 25 bp, Mus musculus
tcagggcagtctgtgcacgtcattt

SEQ ID NO: 55177 - DNA, 25 bp, Mus musculus
tcagggcagtgactttcacagcagg

SEQ ID NO: 55178 - DNA, 25 bp, Mus musculus
tcagggcagtgagtttcacagcagg

SEQ ID NO: 55179 - DNA, 25 bp, Mus musculus
tcagggcattcagaatttggtggtt

SEQ ID NO: 55180 - DNA, 25 bp, Mus musculus
tcagggccgtccaggacagttcgtc

SEQ ID NO: 55181 - DNA, 25 bp, Mus musculus
tcagggccgtcctggacagttcgtc

SEQ ID NO: 55182 - DNA, 25 bp, Mus musculus
tcagggcgacagctcagtgaagtct

SEQ ID NO: 55183 - DNA, 25 bp, Mus musculus
tcagggcggtgtccatgtacacaag

SEQ ID NO: 55184 - DNA, 25 bp, Mus musculus
tcagggcgtgaaagtctacgaggac

SEQ ID NO: 55185 - DNA, 25 bp, Mus musculus
tcagggcttcacaggagtgaataag

SEQ ID NO: 55186 - DNA, 25 bp, Mus musculus
tcagggcttcactgggatgcgtgct

SEQ ID NO: 55187 - DNA, 25 bp, Mus musculus
tcaggggaccgggatgaatttcaga

SEQ ID NO: 55188 - DNA, 25 bp, Mus musculus
tcagggtaaagcttccttggagtgc

SEQ ID NO: 55189 - DNA, 25 bp, Mus musculus
tcagggtcagctctctaaagcaggg

SEQ ID NO: 55190 - DNA, 25 bp, Mus musculus
tcagggtcagctgtctaaagcaggg

SEQ ID NO: 55191 - DNA, 25 bp, Mus musculus
tcagggtccttatttccaaccacgt

SEQ ID NO: 55192 - DNA, 25 bp, Mus musculus
tcagggtctcaagatctacagtggg

SEQ ID NO: 55193 - DNA, 25 bp, Mus musculus
tcagggtctgagaggcatcactggc

SEQ ID NO: 55194 - DNA, 25 bp, Mus musculus
tcagggtcttcttccatcttagctc

SEQ ID NO: 55195 - DNA, 25 bp, Mus musculus
tcaggtaaacgttgaagctcgctgt

SEQ ID NO: 55196 - DNA, 25 bp, Mus musculus
tcaggtacctgacaatgatgagcag

SEQ ID NO: 55197 - DNA, 25 bp, Mus musculus
tcaggtcacctggagagcacttcag

SEQ ID NO: 55198 - DNA, 25 bp, Mus musculus
tcaggtcacgtttggaagaaccatc

SEQ ID NO: 55199 - DNA, 25 bp, Mus musculus
tcaggtcagagtttcttccgggctc

SEQ ID NO: 55200 - DNA, 25 bp, Mus musculus
tcaggtcatcgcctccttcaaggtc

SEQ ID NO: 55201 - DNA, 25 bp, Mus musculus
tcaggtccaagaaatattttgccaa

SEQ ID NO: 55202 - DNA, 25 bp, Mus musculus
tcaggtctgatacagataaaaacct

SEQ ID NO: 55203 - DNA, 25 bp, Mus musculus
tcaggtctgatagagataaaaacct

SEQ ID NO: 55204 - DNA, 25 bp, Mus musculus
tcaggtctgcaaaagcaccctgcgg

SEQ ID NO: 55205 - DNA, 25 bp, Mus musculus
tcaggtgacaggaagcagagtacaa

SEQ ID NO: 55206 - DNA, 25 bp, Mus musculus
tcaggtgacttgaacataaattgcg

SEQ ID NO: 55207 - DNA, 25 bp, Mus musculus
tcaggtgcacttagtcacagaggtc

SEQ ID NO: 55208 - DNA, 25 bp, Mus musculus
tcaggtgggatcaggatctacagcc

SEQ ID NO: 55209 - DNA, 25 bp, Mus musculus
tcaggtggttcacaatcacttataa

SEQ ID NO: 55210 - DNA, 25 bp, Mus musculus
tcaggtgtacgaccctctcatggaa

SEQ ID NO: 55211 - DNA, 25 bp, Mus musculus
tcaggtgtagaatggaaaaactgtt

SEQ ID NO: 55212 - DNA, 25 bp, Mus musculus
tcaggtgtgaaacgacaaagagcag

SEQ ID NO: 55213 - DNA, 25 bp, Mus musculus
tcaggtgtgatgacgcagggtgcca

SEQ ID NO: 55214 - DNA, 25 bp, Mus musculus
tcaggttagtcctagcaagcctaga

SEQ ID NO: 55215 - DNA, 25 bp, Mus musculus
tcaggttatgggacagacgctatca

SEQ ID NO: 55216 - DNA, 25 bp, Mus musculus
tcaggttatgggtcagacgctatca

SEQ ID NO: 55217 - DNA, 25 bp, Mus musculus
tcaggttcaaaaagagcccagaaga

SEQ ID NO: 55218 - DNA, 25 bp, Mus musculus
tcaggttcctgtgcttcgagagaaa

SEQ ID NO: 55219 - DNA, 25 bp, Mus musculus
tcaggtttaagaagccgcagagaag

SEQ ID NO: 55220 - DNA, 25 bp, Mus musculus
tcagtaaactggacttgcacactat

SEQ ID NO: 55221 - DNA, 25 bp, Mus musculus
tcagtaaactggtcttgcacactat

SEQ ID NO: 55222 - DNA, 25 bp, Mus musculus
tcagtaatggaatcctacgccttct

SEQ ID NO: 55223 - DNA, 25 bp, Mus musculus
tcagtaatgtgaggctcgaggaccg

SEQ ID NO: 55224 - DNA, 25 bp, Mus musculus
tcagtacactgacaagggtcttcgg

SEQ ID NO: 55225 - DNA, 25 bp, Mus musculus
tcagtacagctgtgaagagactttc

SEQ ID NO: 55226 - DNA, 25 bp, Mus musculus
tcagtacagtgccttgtagtggaca

SEQ ID NO: 55227 - DNA, 25 bp, Mus musculus
tcagtacctcatcccggagtccgta

SEQ ID NO: 55228 - DNA, 25 bp, Mus musculus
tcagtactaaaacccgattctgatc

SEQ ID NO: 55229 - DNA, 25 bp, Mus musculus
tcagtactacaatgggtcctatcct

SEQ ID NO: 55230 - DNA, 25 bp, Mus musculus
tcagtactactgtggtgttctctac

SEQ ID NO: 55231 - DNA, 25 bp, Mus musculus
tcagtactggctgctgacaggtgaa

SEQ ID NO: 55232 - DNA, 25 bp, Mus musculus
tcagtagttcacatgatgacacaat

SEQ ID NO: 55233 - DNA, 25 bp, Mus musculus
tcagtatagcctggaccagtcctgt

SEQ ID NO: 55234 - DNA, 25 bp, Mus musculus
tcagtatatcccgaagctacgcaaa

SEQ ID NO: 55235 - DNA, 25 bp, Mus musculus
tcagtatcaagaacaaactaacagt

SEQ ID NO: 55236 - DNA, 25 bp, Mus musculus
tcagtatccatcatagccatgggcc

SEQ ID NO: 55237 - DNA, 25 bp, Mus musculus
tcagtatccatcttagccatgggcc

SEQ ID NO: 55238 - DNA, 25 bp, Mus musculus
tcagtatgatttgctgggccagtca

SEQ ID NO: 55239 - DNA, 25 bp, Mus musculus
tcagtattgaggattcacgagtcta

SEQ ID NO: 55240 - DNA, 25 bp, Mus musculus
tcagtcaaatcccaaatcttcagct

SEQ ID NO: 55241 - DNA, 25 bp, Mus musculus
tcagtcaaatgcttcaggtaaacgt

SEQ ID NO: 55242 - DNA, 25 bp, Mus musculus
tcagtcaagtaatgaacatggccgc

SEQ ID NO: 55243 - DNA, 25 bp, Mus musculus
tcagtcaagtacagtgtcgtataga

SEQ ID NO: 55244 - DNA, 25 bp, Mus musculus
tcagtcacaacaaatgggacaggag

SEQ ID NO: 55245 - DNA, 25 bp, Mus musculus
tcagtcaccgcagagtgtccctgag

SEQ ID NO: 55246 - DNA, 25 bp, Mus musculus
tcagtcactggctttagccctcgat

SEQ ID NO: 55247 - DNA, 25 bp, Mus musculus
tcagtcagccccaaagttctgccag

SEQ ID NO: 55248 - DNA, 25 bp, Mus musculus
tcagtcaggctgtgcttagtaagca

SEQ ID NO: 55249 - DNA, 25 bp, Mus musculus
tcagtcccagcaggtaagctgaggt

SEQ ID NO: 55250 - DNA, 25 bp, Mus musculus
tcagtcccctgtttctcaccaaagg

SEQ ID NO: 55251 - DNA, 25 bp, Mus musculus
tcagtccctgctctcaagggagaaa

SEQ ID NO: 55252 - DNA, 25 bp, Mus musculus
tcagtcctcgcccttatctgatggt

SEQ ID NO: 55253 - DNA, 25 bp, Mus musculus
tcagtcctcggatgagtcctttgag

SEQ ID NO: 55254 - DNA, 25 bp, Mus musculus
tcagtcctgatttcttacagctcgt

SEQ ID NO: 55255 - DNA, 25 bp, Mus musculus
tcagtcctggatatagttgccaaag

SEQ ID NO: 55256 - DNA, 25 bp, Mus musculus
tcagtcgagctgaccagttccctct

SEQ ID NO: 55257 - DNA, 25 bp, Mus musculus
tcagtcgttgtctacacggatggct

SEQ ID NO: 55258 - DNA, 25 bp, Mus musculus
tcagtctcaaaacatatgaaaagga

SEQ ID NO: 55259 - DNA, 25 bp, Mus musculus
tcagtctcgctgtgaaaatctttca

SEQ ID NO: 55260 - DNA, 25 bp, Mus musculus
tcagtctcgtgggtgcacaaagaaa

SEQ ID NO: 55261 - DNA, 25 bp, Mus musculus
tcagtctggaacacagccaagatac

SEQ ID NO: 55262 - DNA, 25 bp, Mus musculus
tcagtctgggctgctatgtcgcctc

SEQ ID NO: 55263 - DNA, 25 bp, Mus musculus
tcagtctgttcaacaagtgggaccc

SEQ ID NO: 55264 - DNA, 25 bp, Mus musculus
tcagtgaaaagaactccgcagaaac

SEQ ID NO: 55265 - DNA, 25 bp, Mus musculus
tcagtgaaatggacacagaacaaaa

SEQ ID NO: 55266 - DNA, 25 bp, Mus musculus
tcagtgaaatggtcacagaacaaaa

SEQ ID NO: 55267 - DNA, 25 bp, Mus musculus
tcagtgaacactgggatgacacctg

SEQ ID NO: 55268 - DNA, 25 bp, Mus musculus
tcagtgaagaaaaactccgtgaaat

SEQ ID NO: 55269 - DNA, 25 bp, Mus musculus
tcagtgaagaccatgagctccatct

SEQ ID NO: 55270 - DNA, 25 bp, Mus musculus
tcagtgaagaggaggtacccgaata

SEQ ID NO: 55271 - DNA, 25 bp, Mus musculus
tcagtgacagccatgctggtttgct

SEQ ID NO: 55272 - DNA, 25 bp, Mus musculus
tcagtgacagttggcacaatagacg

SEQ ID NO: 55273 - DNA, 25 bp, Mus musculus
tcagtgacccctgaggagtgtcagc

SEQ ID NO: 55274 - DNA, 25 bp, Mus musculus
tcagtgacccgtcgttggagagtca

SEQ ID NO: 55275 - DNA, 25 bp, Mus musculus
tcagtgacctgtacgaagacctccg

SEQ ID NO: 55276 - DNA, 25 bp, Mus musculus
tcagtgactcaaagacgggaaaccc

SEQ ID NO: 55277 - DNA, 25 bp, Mus musculus
tcagtgactcaatgacgggaaaccc

SEQ ID NO: 55278 - DNA, 25 bp, Mus musculus
tcagtgacttcaacacctgcctgtt

SEQ ID NO: 55279 - DNA, 25 bp, Mus musculus
tcagtgagatcgagcgaagggatcc

SEQ ID NO: 55280 - DNA, 25 bp, Mus musculus
tcagtgagcacaacacggctaaacc

SEQ ID NO: 55281 - DNA, 25 bp, Mus musculus
tcagtgagctccaaagaatgaagat

SEQ ID NO: 55282 - DNA, 25 bp, Mus musculus
tcagtgatacagtgcaacgcctccg

SEQ ID NO: 55283 - DNA, 25 bp, Mus musculus
tcagtgatgggacaacagcctacgt

SEQ ID NO: 55284 - DNA, 25 bp, Mus musculus
tcagtgccagccgtactattcacaa

SEQ ID NO: 55285 - DNA, 25 bp, Mus musculus
tcagtgccaggttgctgtatgagga

SEQ ID NO: 55286 - DNA, 25 bp, Mus musculus
tcagtgccagtggagtctgaaccca

SEQ ID NO: 55287 - DNA, 25 bp, Mus musculus
tcagtgcctctgacgatgttcacag

SEQ ID NO: 55288 - DNA, 25 bp, Mus musculus
tcagtgctaaaacccagcagaaatg

SEQ ID NO: 55289 - DNA, 25 bp, Mus musculus
tcagtgctcactggtgaaagagctg

SEQ ID NO: 55290 - DNA, 25 bp, Mus musculus
tcagtgctcgatacagaccttatca

SEQ ID NO: 55291 - DNA, 25 bp, Mus musculus
tcagtgctcgattcagaccttatca

SEQ ID NO: 55292 - DNA, 25 bp, Mus musculus
tcagtgctgccatggaaaggtgttc

SEQ ID NO: 55293 - DNA, 25 bp, Mus musculus
tcagtgctggaaagcctagtgggca

SEQ ID NO: 55294 - DNA, 25 bp, Mus musculus
tcagtgcttcgtgagcttctttgat

SEQ ID NO: 55295 - DNA, 25 bp, Mus musculus
tcagtggaagagcttaaaaacttgt

SEQ ID NO: 55296 - DNA, 25 bp, Mus musculus
tcagtggcaacagaacggttgaacc

SEQ ID NO: 55297 - DNA, 25 bp, Mus musculus
tcagtggcagatgagctcctatgcg

SEQ ID NO: 55298 - DNA, 25 bp, Mus musculus
tcagtggcatccgttgctagctaag

SEQ ID NO: 55299 - DNA, 25 bp, Mus musculus
tcagtggcatgcctgccaagagacg

SEQ ID NO: 55300 - DNA, 25 bp, Mus musculus
tcagtggccaagcttcaagatgaaa

SEQ ID NO: 55301 - DNA, 25 bp, Mus musculus
tcagtggcccataacatgacaatgc

SEQ ID NO: 55302 - DNA, 25 bp, Mus musculus
tcagtggcctgcaagttattccaaa

SEQ ID NO: 55303 - DNA, 25 bp, Mus musculus
tcagtggccttctcatgctcctgct

SEQ ID NO: 55304 - DNA, 25 bp, Mus musculus
tcagtggcgatgatgaacatggctc

SEQ ID NO: 55305 - DNA, 25 bp, Mus musculus
tcagtggctgatcgcctgtgttcca

SEQ ID NO: 55306 - DNA, 25 bp, Mus musculus
tcagtgggaactacaagaaaggaga

SEQ ID NO: 55307 - DNA, 25 bp, Mus musculus
tcagtgggaacttcaagaaaggaga

SEQ ID NO: 55308 - DNA, 25 bp, Mus musculus
tcagtggtggatctgaagtgcaaaa

SEQ ID NO: 55309 - DNA, 25 bp, Mus musculus
tcagtggtgtcaactcagcccatgt

SEQ ID NO: 55310 - DNA, 25 bp, Mus musculus
tcagtggtgttctaccagaccccgg

SEQ ID NO: 55311 - DNA, 25 bp, Mus musculus
tcagtgtagcgtcagcacagtctcg

SEQ ID NO: 55312 - DNA, 25 bp, Mus musculus
tcagtgtcaagcctgcaggagcaca

SEQ ID NO: 55313 - DNA, 25 bp, Mus musculus
tcagtgtcacaaccgttgacctgaa

SEQ ID NO: 55314 - DNA, 25 bp, Mus musculus
tcagtgtgaacgatgaagatctcct

SEQ ID NO: 55315 - DNA, 25 bp, Mus musculus
tcagtgtgatccctgtataccaggc

SEQ ID NO: 55316 - DNA, 25 bp, Mus musculus
tcagtgtgatgtagcggacccgaat

SEQ ID NO: 55317 - DNA, 25 bp, Mus musculus
tcagtgtgcctcttcttgttgtgga

SEQ ID NO: 55318 - DNA, 25 bp, Mus musculus
tcagtgtggacagctgtatgcctac

SEQ ID NO: 55319 - DNA, 25 bp, Mus musculus
tcagtgtgtaatccagactggcctt

SEQ ID NO: 55320 - DNA, 25 bp, Mus musculus
tcagtgtgtgctacagcgctgctgt

SEQ ID NO: 55321 - DNA, 25 bp, Mus musculus
tcagttaaggaggatacactttcca

SEQ ID NO: 55322 - DNA, 25 bp, Mus musculus
tcagttacaaatcagagggcaggct

SEQ ID NO: 55323 - DNA, 25 bp, Mus musculus
tcagttaccttgacgatgtcccatt

SEQ ID NO: 55324 - DNA, 25 bp, Mus musculus
tcagttatcaaccacagcatgtatt

SEQ ID NO: 55325 - DNA, 25 bp, Mus musculus
tcagttcaaggcgagccccaggagt

SEQ ID NO: 55326 - DNA, 25 bp, Mus musculus
tcagttcactgtcggagtcaagccc

SEQ ID NO: 55327 - DNA, 25 bp, Mus musculus
tcagttcactgtgggagtcaagccc

SEQ ID NO: 55328 - DNA, 25 bp, Mus musculus
tcagttcagagaagttaagtacaga

SEQ ID NO: 55329 - DNA, 25 bp, Mus musculus
tcagttcagcaggaacaggagtcga

SEQ ID NO: 55330 - DNA, 25 bp, Mus musculus
tcagttcagccacgtttgcatagcg

SEQ ID NO: 55331 - DNA, 25 bp, Mus musculus
tcagttccggatattggtgtgtggt

SEQ ID NO: 55332 - DNA, 25 bp, Mus musculus
tcagttcctctcaggactgaggaag

SEQ ID NO: 55333 - DNA, 25 bp, Mus musculus
tcagttctatcttgtgggaaaagaa

SEQ ID NO: 55334 - DNA, 25 bp, Mus musculus
tcagttctcagtacaactttgtgaa

SEQ ID NO: 55335 - DNA, 25 bp, Mus musculus
tcagttctctcgatgttatgacaaa

SEQ ID NO: 55336 - DNA, 25 bp, Mus musculus
tcagttctgctgaggacaacggtca

SEQ ID NO: 55337 - DNA, 25 bp, Mus musculus
tcagttcttcagcttcactcagatt

SEQ ID NO: 55338 - DNA, 25 bp, Mus musculus
tcagttcttggtggcattagagacg

SEQ ID NO: 55339 - DNA, 25 bp, Mus musculus
tcagttgaacacctggaattttcca

SEQ ID NO: 55340 - DNA, 25 bp, Mus musculus
tcagttgaacccatttttatggtac

SEQ ID NO: 55341 - DNA, 25 bp, Mus musculus
tcagttgacaattgctggcccatgc

SEQ ID NO: 55342 - DNA, 25 bp, Mus musculus
tcagttgactatcagtgccagaagt

SEQ ID NO: 55343 - DNA, 25 bp, Mus musculus
tcagttgcaatgagttacaaaggct

SEQ ID NO: 55344 - DNA, 25 bp, Mus musculus
tcagttggattcaatggacggtcac

SEQ ID NO: 55345 - DNA, 25 bp, Mus musculus
tcagttggctgaaatgcttcctgga

SEQ ID NO: 55346 - DNA, 25 bp, Mus musculus
tcagttgtgtggaatgctccaacca

SEQ ID NO: 55347 - DNA, 25 bp, Mus musculus
tcagtttacatcgtggaccccaagg

SEQ ID NO: 55348 - DNA, 25 bp, Mus musculus
tcagtttccatcatctagagatgga

SEQ ID NO: 55349 - DNA, 25 bp, Mus musculus
tcagttttcaccatctgtgccacac

SEQ ID NO: 55350 - DNA, 25 bp, Mus musculus
tcagttttgacagtgtgtgtggagt

SEQ ID NO: 55351 - DNA, 25 bp, Mus musculus
tcagttttgccaagaagttctccct

SEQ ID NO: 55352 - DNA, 25 bp, Mus musculus
tcagttttgttccatgaaacgttcc

SEQ ID NO: 55353 - DNA, 25 bp, Mus musculus
tcagtttttctcagctcagatgaag

SEQ ID NO: 55354 - DNA, 25 bp, Mus musculus
tcagtttttctctgctcagatgaag

SEQ ID NO: 55355 - DNA, 25 bp, Mus musculus
tcataaacaagattttgcctcagta

SEQ ID NO: 55356 - DNA, 25 bp, Mus musculus
tcataaactcattatcagtggattc

SEQ ID NO: 55357 - DNA, 25 bp, Mus musculus
tcataaaggcatcggacagtgggcc

SEQ ID NO: 55358 - DNA, 25 bp, Mus musculus
tcataagcatgtgcctgactgggtt

SEQ ID NO: 55359 - DNA, 25 bp, Mus musculus
tcataagggacaaccaggtggtggt

SEQ ID NO: 55360 - DNA, 25 bp, Mus musculus
tcataagtcgccaaaaacaaatggg

SEQ ID NO: 55361 - DNA, 25 bp, Mus musculus
tcataagttcttcttgggataacaa

SEQ ID NO: 55362 - DNA, 25 bp, Mus musculus
tcatacagaacaagaactttgacat

SEQ ID NO: 55363 - DNA, 25 bp, Mus musculus
tcatacagactgtttgaagacatgg

SEQ ID NO: 55364 - DNA, 25 bp, Mus musculus
tcataccataggagtggaatttggc

SEQ ID NO: 55365 - DNA, 25 bp, Mus musculus
tcataccataggtgtggaatttggc

SEQ ID NO: 55366 - DNA, 25 bp, Mus musculus
tcataccgcattaaaggttttagaa

SEQ ID NO: 55367 - DNA, 25 bp, Mus musculus
tcatactagaccaagacggagacat

SEQ ID NO: 55368 - DNA, 25 bp, Mus musculus
tcatactgcatgatggtctccgccg

SEQ ID NO: 55369 - DNA, 25 bp, Mus musculus
tcatactgggctgcacagggggcat

SEQ ID NO: 55370 - DNA, 25 bp, Mus musculus
tcatacttgctactgcctgagcggc

SEQ ID NO: 55371 - DNA, 25 bp, Mus musculus
tcatagacttgagaggaccaggacc

SEQ ID NO: 55372 - DNA, 25 bp, Mus musculus
tcatagagaacttagctggccacat

SEQ ID NO: 55373 - DNA, 25 bp, Mus musculus
tcatagagaaggttctagaagagtt

SEQ ID NO: 55374 - DNA, 25 bp, Mus musculus
tcatagatgccaatcactgccctgg

SEQ ID NO: 55375 - DNA, 25 bp, Mus musculus
tcatagcaggagtcgacgtcgacgt

SEQ ID NO: 55376 - DNA, 25 bp, Mus musculus
tcatagcaggagtggagagcatgca

SEQ ID NO: 55377 - DNA, 25 bp, Mus musculus
tcatagcatctcctctcggagtggc

SEQ ID NO: 55378 - DNA, 25 bp, Mus musculus
tcatagccggtgcaagcaaaaacca

SEQ ID NO: 55379 - DNA, 25 bp, Mus musculus
tcataggagtaaatgacgtgccact

SEQ ID NO: 55380 - DNA, 25 bp, Mus musculus
tcatagggctgagccctatgcctgg

SEQ ID NO: 55381 - DNA, 25 bp, Mus musculus
tcatataccctcagactgaccttgg

SEQ ID NO: 55382 - DNA, 25 bp, Mus musculus
tcatataggtcattaaccctcggct

SEQ ID NO: 55383 - DNA, 25 bp, Mus musculus
tcatatagtgtttgtgttgagaaca

SEQ ID NO: 55384 - DNA, 25 bp, Mus musculus
tcatatgtttgagaggcttgtccag

SEQ ID NO: 55385 - DNA, 25 bp, Mus musculus
tcatcaaagtcgttaatggctgtcg

SEQ ID NO: 55386 - DNA, 25 bp, Mus musculus
tcatcaacaatgagatccctgattg

SEQ ID NO: 55387 - DNA, 25 bp, Mus musculus
tcatcaacgtgctgcaagagagtca

SEQ ID NO: 55388 - DNA, 25 bp, Mus musculus
tcatcaactacctctgctacggagt

SEQ ID NO: 55389 - DNA, 25 bp, Mus musculus
tcatcaagaagacctgaattctgtc

SEQ ID NO: 55390 - DNA, 25 bp, Mus musculus
tcatcaagcatgtcaggccatcaca

SEQ ID NO: 55391 - DNA, 25 bp, Mus musculus
tcatcaagccatgactcactggagg

SEQ ID NO: 55392 - DNA, 25 bp, Mus musculus
tcatcaagcccctgcctaatgaaaa

SEQ ID NO: 55393 - DNA, 25 bp, Mus musculus
tcatcaaggagataatcctggtgga

SEQ ID NO: 55394 - DNA, 25 bp, Mus musculus
tcatcaagggagcacgctatgtctg

SEQ ID NO: 55395 - DNA, 25 bp, Mus musculus
tcatcaagttatcatcaacctggga

SEQ ID NO: 55396 - DNA, 25 bp, Mus musculus
tcatcaagttcaaggatatccaaga

SEQ ID NO: 55397 - DNA, 25 bp, Mus musculus
tcatcaatggcatcctcttcattcc

SEQ ID NO: 55398 - DNA, 25 bp, Mus musculus
tcatcacacttgcagacattgtaaa

SEQ ID NO: 55399 - DNA, 25 bp, Mus musculus
tcatcacagaagtgaagcgggcaca

SEQ ID NO: 55400 - DNA, 25 bp, Mus musculus
tcatcacagtacagtagcccgtctt

SEQ ID NO: 55401 - DNA, 25 bp, Mus musculus
tcatcacagtactgtagcccgtctt

SEQ ID NO: 55402 - DNA, 25 bp, Mus musculus
tcatcaccaacgagactgggcagcc

SEQ ID NO: 55403 - DNA, 25 bp, Mus musculus
tcatcaccaataaggtctctgccca

SEQ ID NO: 55404 - DNA, 25 bp, Mus musculus
tcatcaccgggattggcagaacccg

SEQ ID NO: 55405 - DNA, 25 bp, Mus musculus
tcatcaccgtgccaatagttctgct

SEQ ID NO: 55406 - DNA, 25 bp, Mus musculus
tcatcactcactctttggagatgtg

SEQ ID NO: 55407 - DNA, 25 bp, Mus musculus
tcatcacttcatcacaagaagaaga

SEQ ID NO: 55408 - DNA, 25 bp, Mus musculus
tcatcagcttggaacctgggcagcg

SEQ ID NO: 55409 - DNA, 25 bp, Mus musculus
tcatcagcttggtcctggtcgtcct

SEQ ID NO: 55410 - DNA, 25 bp, Mus musculus
tcatcaggagggacggcatccagat

SEQ ID NO: 55411 - DNA, 25 bp, Mus musculus
tcatcaggagtcgactcaggctgag

SEQ ID NO: 55412 - DNA, 25 bp, Mus musculus
tcatcaggatatcactgaagagagc

SEQ ID NO: 55413 - DNA, 25 bp, Mus musculus
tcatcaggttctggcgtagagccct

SEQ ID NO: 55414 - DNA, 25 bp, Mus musculus
tcatcagtgatggtgtcaagaagac

SEQ ID NO: 55415 - DNA, 25 bp, Mus musculus
tcatcagtgctgaagcagaggccga

SEQ ID NO: 55416 - DNA, 25 bp, Mus musculus
tcatcataccaggttattaattggc

SEQ ID NO: 55417 - DNA, 25 bp, Mus musculus
tcatcatagcaaggctcctgagcca

SEQ ID NO: 55418 - DNA, 25 bp, Mus musculus
tcatcatagccagcgaagatgctgt

SEQ ID NO: 55419 - DNA, 25 bp, Mus musculus
tcatcatcacgcaggaaatcctcac

SEQ ID NO: 55420 - DNA, 25 bp, Mus musculus
tcatcatcacttcatcacaagaaga

SEQ ID NO: 55421 - DNA, 25 bp, Mus musculus
tcatcatcctccctcttgggagaat

SEQ ID NO: 55422 - DNA, 25 bp, Mus musculus
tcatcatcctccgtcttgggagaat

SEQ ID NO: 55423 - DNA, 25 bp, Mus musculus
tcatcatcctgaccctggtgaatgc

SEQ ID NO: 55424 - DNA, 25 bp, Mus musculus
tcatcatcgagagcgacctggaacg

SEQ ID NO: 55425 - DNA, 25 bp, Mus musculus
tcatcatcttgtcaggaaaacagat

SEQ ID NO: 55426 - DNA, 25 bp, Mus musculus
tcatcatgagaatagtgggctttac

SEQ ID NO: 55427 - DNA, 25 bp, Mus musculus
tcatcatgagggaattccgatcagg

SEQ ID NO: 55428 - DNA, 25 bp, Mus musculus
tcatcatgctcgtgggtgacacata

SEQ ID NO: 55429 - DNA, 25 bp, Mus musculus
tcatcatggatcacccgagcatgcg

SEQ ID NO: 55430 - DNA, 25 bp, Mus musculus
tcatcatgtagtagccagacacgag

SEQ ID NO: 55431 - DNA, 25 bp, Mus musculus
tcatcatgtggcactaacacccgtt

SEQ ID NO: 55432 - DNA, 25 bp, Mus musculus
tcatcattcattgagcgcaggacct

SEQ ID NO: 55433 - DNA, 25 bp, Mus musculus
tcatcattccacagaggaaccgaag

SEQ ID NO: 55434 - DNA, 25 bp, Mus musculus
tcatcattggcatcaccataaccgt

SEQ ID NO: 55435 - DNA, 25 bp, Mus musculus
tcatcatttcttccaagccctaagg

SEQ ID NO: 55436 - DNA, 25 bp, Mus musculus
tcatccaaaatagaggaagcatgcg

SEQ ID NO: 55437 - DNA, 25 bp, Mus musculus
tcatccacgccttgggcggcatggc

SEQ ID NO: 55438 - DNA, 25 bp, Mus musculus
tcatccagaagtgactcaacacaga

SEQ ID NO: 55439 - DNA, 25 bp, Mus musculus
tcatccagataaacaaagtgcagat

SEQ ID NO: 55440 - DNA, 25 bp, Mus musculus
tcatccagcagctatatcactggga

SEQ ID NO: 55441 - DNA, 25 bp, Mus musculus
tcatccagcagtcgagcccgtattt

SEQ ID NO: 55442 - DNA, 25 bp, Mus musculus
tcatccagcttggtgtcaagtgggc

SEQ ID NO: 55443 - DNA, 25 bp, Mus musculus
tcatccaggagagaatctcgaggcc

SEQ ID NO: 55444 - DNA, 25 bp, Mus musculus
tcatccatcgagacctgaagccaga

SEQ ID NO: 55445 - DNA, 25 bp, Mus musculus
tcatccattagaccggtaatcaaga

SEQ ID NO: 55446 - DNA, 25 bp, Mus musculus
tcatccattagagcggtaatcaaga

SEQ ID NO: 55447 - DNA, 25 bp, Mus musculus
tcatcccaaccatgatcaatgttgg

SEQ ID NO: 55448 - DNA, 25 bp, Mus musculus
tcatcccactaatgtccagcgcttg

SEQ ID NO: 55449 - DNA, 25 bp, Mus musculus
tcatcccactgaggacagccttgtg

SEQ ID NO: 55450 - DNA, 25 bp, Mus musculus
tcatcccctgacctatgaaggtggt

SEQ ID NO: 55451 - DNA, 25 bp, Mus musculus
tcatccctggcgtcacatgagaaca

SEQ ID NO: 55452 - DNA, 25 bp, Mus musculus
tcatccctgggcacatggcatgttc

SEQ ID NO: 55453 - DNA, 25 bp, Mus musculus
tcatccctgtggcaaaagccattcc

SEQ ID NO: 55454 - DNA, 25 bp, Mus musculus
tcatcccttaccaaagagacaagca

SEQ ID NO: 55455 - DNA, 25 bp, Mus musculus
tcatcccttagctgtggagggacag

SEQ ID NO: 55456 - DNA, 25 bp, Mus musculus
tcatccgccataccgtcaacaagat

SEQ ID NO: 55457 - DNA, 25 bp, Mus musculus
tcatccgctacaagagcgccaagca

SEQ ID NO: 55458 - DNA, 25 bp, Mus musculus
tcatccggcctctgtcagtgtttgg

SEQ ID NO: 55459 - DNA, 25 bp, Mus musculus
tcatccgggacggagtccgagcctg

SEQ ID NO: 55460 - DNA, 25 bp, Mus musculus
tcatcctaaattcacaaagggccag

SEQ ID NO: 55461 - DNA, 25 bp, Mus musculus
tcatcctaaattgacaaagggccag

SEQ ID NO: 55462 - DNA, 25 bp, Mus musculus
tcatcctatgctgtctctgcagcta

SEQ ID NO: 55463 - DNA, 25 bp, Mus musculus
tcatcctcacgtatcacgacatcgg

SEQ ID NO: 55464 - DNA, 25 bp, Mus musculus
tcatcctcattttccactgtgaatt

SEQ ID NO: 55465 - DNA, 25 bp, Mus musculus
tcatcctgaccctggtgaatgcacc

SEQ ID NO: 55466 - DNA, 25 bp, Mus musculus
tcatcctgatgccaggaaccaagaa

SEQ ID NO: 55467 - DNA, 25 bp, Mus musculus
tcatcctggccagatacggactgga

SEQ ID NO: 55468 - DNA, 25 bp, Mus musculus
tcatcctggtctttctcatcttcac

SEQ ID NO: 55469 - DNA, 25 bp, Mus musculus
tcatcctggtgcctgtacgactggg

SEQ ID NO: 55470 - DNA, 25 bp, Mus musculus
tcatcctgtgggtctttggtcttgc

SEQ ID NO: 55471 - DNA, 25 bp, Mus musculus
tcatccttaaaacacgtgggaaatt

SEQ ID NO: 55472 - DNA, 25 bp, Mus musculus
tcatccttcctagatgaggatgagg

SEQ ID NO: 55473 - DNA, 25 bp, Mus musculus
tcatccttcggaagccagctcggga

SEQ ID NO: 55474 - DNA, 25 bp, Mus musculus
tcatcgacgacatggtggcccaggt

SEQ ID NO: 55475 - DNA, 25 bp, Mus musculus
tcatcgacttctctccgtgtgaaag

SEQ ID NO: 55476 - DNA, 25 bp, Mus musculus
tcatcgagagcgacctggaacgtgc

SEQ ID NO: 55477 - DNA, 25 bp, Mus musculus
tcatcgagatccagagtgcgtgggc

SEQ ID NO: 55478 - DNA, 25 bp, Mus musculus
tcatcgagctgagacgcacagtcaa

SEQ ID NO: 55479 - DNA, 25 bp, Mus musculus
tcatcgcagaagagaacaagaacct

SEQ ID NO: 55480 - DNA, 25 bp, Mus musculus
tcatcgccacagtgttcgtgtttgc

SEQ ID NO: 55481 - DNA, 25 bp, Mus musculus
tcatcgctatgacgaaattccccag

SEQ ID NO: 55482 - DNA, 25 bp, Mus musculus
tcatcgctatgaggaaattccccag

SEQ ID NO: 55483 - DNA, 25 bp, Mus musculus
tcatcgctctcttgggcatcaccat

SEQ ID NO: 55484 - DNA, 25 bp, Mus musculus
tcatcggataccagtatgggcacaa

SEQ ID NO: 55485 - DNA, 25 bp, Mus musculus
tcatcggcatctatctcttggaaat

SEQ ID NO: 55486 - DNA, 25 bp, Mus musculus
tcatcggccctctggatgccaaagg

SEQ ID NO: 55487 - DNA, 25 bp, Mus musculus
tcatcgggtaattaatctggccaat

SEQ ID NO: 55488 - DNA, 25 bp, Mus musculus
tcatcgtagcctagccggaggaggt

SEQ ID NO: 55489 - DNA, 25 bp, Mus musculus
tcatcgtcacaccacagaacaagtc

SEQ ID NO: 55490 - DNA, 25 bp, Mus musculus
tcatcgtcagcacgcagaggaaggc

SEQ ID NO: 55491 - DNA, 25 bp, Mus musculus
tcatcgtctggcacgtgcggagtaa

SEQ ID NO: 55492 - DNA, 25 bp, Mus musculus
tcatcgttaaagcaacaaatggacc

SEQ ID NO: 55493 - DNA, 25 bp, Mus musculus
tcatctaccatctgccccaggagtt

SEQ ID NO: 55494 - DNA, 25 bp, Mus musculus
tcatctactcttggcatctactttg

SEQ ID NO: 55495 - DNA, 25 bp, Mus musculus
tcatctactgacagctatagctcag

SEQ ID NO: 55496 - DNA, 25 bp, Mus musculus
tcatctcaaagaaggacccagagga

SEQ ID NO: 55497 - DNA, 25 bp, Mus musculus
tcatctcaacaacctgtacttcctg

SEQ ID NO: 55498 - DNA, 25 bp, Mus musculus
tcatctcaggcattggtaaagggat

SEQ ID NO: 55499 - DNA, 25 bp, Mus musculus
tcatctcatcaaaggaaggcttaag

SEQ ID NO: 55500 - DNA, 25 bp, Mus musculus
tcatctccggctctgtctgccagga

SEQ ID NO: 55501 - DNA, 25 bp, Mus musculus
tcatctcctgccctgtcattaaagg

SEQ ID NO: 55502 - DNA, 25 bp, Mus musculus
tcatctcgatttgactgcaactcca

SEQ ID NO: 55503 - DNA, 25 bp, Mus musculus
tcatctctgactttattcgcagtgg

SEQ ID NO: 55504 - DNA, 25 bp, Mus musculus
tcatctgaagaaggctgttgctgag

SEQ ID NO: 55505 - DNA, 25 bp, Mus musculus
tcatctgatgtatcattttgcaaga

SEQ ID NO: 55506 - DNA, 25 bp, Mus musculus
tcatctgccagtcaaacaagcgctg

SEQ ID NO: 55507 - DNA, 25 bp, Mus musculus
tcatctggaggaaagagtgaagcag

SEQ ID NO: 55508 - DNA, 25 bp, Mus musculus
tcatctggctccgtttttaaactcc

SEQ ID NO: 55509 - DNA, 25 bp, Mus musculus
tcatctggcttgagcctgggcaagg

SEQ ID NO: 55510 - DNA, 25 bp, Mus musculus
tcatctgggccaactagttgaaaag

SEQ ID NO: 55511 - DNA, 25 bp, Mus musculus
tcatctgggtgaagatttaaagggc

SEQ ID NO: 55512 - DNA, 25 bp, Mus musculus
tcatctgtattgagtccttgtgtca

SEQ ID NO: 55513 - DNA, 25 bp, Mus musculus
tcatctgtccgtcagagaatgaagt

SEQ ID NO: 55514 - DNA, 25 bp, Mus musculus
tcatctgtcggctcttcgcccttta

SEQ ID NO: 55515 - DNA, 25 bp, Mus musculus
tcatctgtctgctggagtatccccg

SEQ ID NO: 55516 - DNA, 25 bp, Mus musculus
tcatctgtgcccaaaagtcgcctga

SEQ ID NO: 55517 - DNA, 25 bp, Mus musculus
tcatctgtggatactgccgtaccag

SEQ ID NO: 55518 - DNA, 25 bp, Mus musculus
tcatctgtttcaccagtggaactac

SEQ ID NO: 55519 - DNA, 25 bp, Mus musculus
tcatcttcacgatccagaccaggga

SEQ ID NO: 55520 - DNA, 25 bp, Mus musculus
tcatcttcagcttatgcactgcctc

SEQ ID NO: 55521 - DNA, 25 bp, Mus musculus
tcatcttcgtttctgacagagcaaa

SEQ ID NO: 55522 - DNA, 25 bp, Mus musculus
tcatcttgggaactgcatgcagaaa

SEQ ID NO: 55523 - DNA, 25 bp, Mus musculus
tcatcttgtagctcaaactaacctg

SEQ ID NO: 55524 - DNA, 25 bp, Mus musculus
tcatgaaagtagatcctgctcacag

SEQ ID NO: 55525 - DNA, 25 bp, Mus musculus
tcatgaacacttgcacagcataggc

SEQ ID NO: 55526 - DNA, 25 bp, Mus musculus
tcatgaacgcatgctcccgatggca

SEQ ID NO: 55527 - DNA, 25 bp, Mus musculus
tcatgaactcttgggacatgtgccc

SEQ ID NO: 55528 - DNA, 25 bp, Mus musculus
tcatgaagaagaaagatggtattcc

SEQ ID NO: 55529 - DNA, 25 bp, Mus musculus
tcatgaagcaggtaaatggctctgt

SEQ ID NO: 55530 - DNA, 25 bp, Mus musculus
tcatgaaggacactgtgccccgatt

SEQ ID NO: 55531 - DNA, 25 bp, Mus musculus
tcatgaaggccctgcatcagcgggt

SEQ ID NO: 55532 - DNA, 25 bp, Mus musculus
tcatgaaggtgcaagagcagaggaa

SEQ ID NO: 55533 - DNA, 25 bp, Mus musculus
tcatgaagtgcacctttggcaaagg

SEQ ID NO: 55534 - DNA, 25 bp, Mus musculus
tcatgaatcggttcagcccctctca

SEQ ID NO: 55535 - DNA, 25 bp, Mus musculus
tcatgacaacctcatccagaagtga

SEQ ID NO: 55536 - DNA, 25 bp, Mus musculus
tcatgacaccatccatataaacggt

SEQ ID NO: 55537 - DNA, 25 bp, Mus musculus
tcatgacagaagtggaaactaaaac

SEQ ID NO: 55538 - DNA, 25 bp, Mus musculus
tcatgaccaacactgggaaggcacg

SEQ ID NO: 55539 - DNA, 25 bp, Mus musculus
tcatgaccactacagatgaacccaa

SEQ ID NO: 55540 - DNA, 25 bp, Mus musculus
tcatgaccccagagcccaagtgttt

SEQ ID NO: 55541 - DNA, 25 bp, Mus musculus
tcatgaccccagtgcccaagtgttt

SEQ ID NO: 55542 - DNA, 25 bp, Mus musculus
tcatgaccgtgaggcctttgcttca

SEQ ID NO: 55543 - DNA, 25 bp, Mus musculus
tcatgacgttgacgctgttccccat

SEQ ID NO: 55544 - DNA, 25 bp, Mus musculus
tcatgagaaccttctaattaatgaa

SEQ ID NO: 55545 - DNA, 25 bp, Mus musculus
tcatgagaagacacaagcggcggcg

SEQ ID NO: 55546 - DNA, 25 bp, Mus musculus
tcatgagagccgagtgaatggaaat

SEQ ID NO: 55547 - DNA, 25 bp, Mus musculus
tcatgagagtctccgctgtgacagg

SEQ ID NO: 55548 - DNA, 25 bp, Mus musculus
tcatgagcatgatctggaagcggct

SEQ ID NO: 55549 - DNA, 25 bp, Mus musculus
tcatgagcatggtttggaagcgact

SEQ ID NO: 55550 - DNA, 25 bp, Mus musculus
tcatgagcatgtgacctacaggctg

SEQ ID NO: 55551 - DNA, 25 bp, Mus musculus
tcatgagccggcagaacgtgggcta

SEQ ID NO: 55552 - DNA, 25 bp, Mus musculus
tcatgagccggctgaacgtgggcta

SEQ ID NO: 55553 - DNA, 25 bp, Mus musculus
tcatgaggcagtgaaatccatgttt

SEQ ID NO: 55554 - DNA, 25 bp, Mus musculus
tcatgagggactgatctgccccggg

SEQ ID NO: 55555 - DNA, 25 bp, Mus musculus
tcatgagggccgattacatccccag

SEQ ID NO: 55556 - DNA, 25 bp, Mus musculus
tcatgatcctcttgccttcgttcca

SEQ ID NO: 55557 - DNA, 25 bp, Mus musculus
tcatgattggcgatgacatcgtggg

SEQ ID NO: 55558 - DNA, 25 bp, Mus musculus
tcatgattgtgaggagggccatcaa

SEQ ID NO: 55559 - DNA, 25 bp, Mus musculus
tcatgatttgccgtgaaccctggca

SEQ ID NO: 55560 - DNA, 25 bp, Mus musculus
tcatgattttaagttggcttcccat

SEQ ID NO: 55561 - DNA, 25 bp, Mus musculus
tcatgcacagggatgtgaaacctca

SEQ ID NO: 55562 - DNA, 25 bp, Mus musculus
tcatgcaccagctgcgatgcaatgg

SEQ ID NO: 55563 - DNA, 25 bp, Mus musculus
tcatgcacgcactgaggtaaattca

SEQ ID NO: 55564 - DNA, 25 bp, Mus musculus
tcatgcactacagaggagagaccgt

SEQ ID NO: 55565 - DNA, 25 bp, Mus musculus
tcatgcagcccatggatagccatcc

SEQ ID NO: 55566 - DNA, 25 bp, Mus musculus
tcatgcagctcttccaggaccatgg

SEQ ID NO: 55567 - DNA, 25 bp, Mus musculus
tcatgcaggagagatctgctcgaca

SEQ ID NO: 55568 - DNA, 25 bp, Mus musculus
tcatgcccatggtggcagctggatt

SEQ ID NO: 55569 - DNA, 25 bp, Mus musculus
tcatgcctaagaaagaccctgtgaa

SEQ ID NO: 55570 - DNA, 25 bp, Mus musculus
tcatgcctatgcctcaggctgcaca

SEQ ID NO: 55571 - DNA, 25 bp, Mus musculus
tcatgcctatgcgtcaggctgcaca

SEQ ID NO: 55572 - DNA, 25 bp, Mus musculus
tcatgcctggccacattcacaagaa

SEQ ID NO: 55573 - DNA, 25 bp, Mus musculus
tcatgcgagggtcccaacccggagc

SEQ ID NO: 55574 - DNA, 25 bp, Mus musculus
tcatgcgcacaaggtggtcttggca

SEQ ID NO: 55575 - DNA, 25 bp, Mus musculus
tcatgcgctcccctcagatggtgtc

SEQ ID NO: 55576 - DNA, 25 bp, Mus musculus
tcatgcgttcctgggagaccaacat

SEQ ID NO: 55577 - DNA, 25 bp, Mus musculus
tcatgcgtttctgctgctgtgtggc

SEQ ID NO: 55578 - DNA, 25 bp, Mus musculus
tcatgctacagtggctacagtgagc

SEQ ID NO: 55579 - DNA, 25 bp, Mus musculus
tcatgctagaccctcaggatgaggc

SEQ ID NO: 55580 - DNA, 25 bp, Mus musculus
tcatgctagcggctggcacaggcct

SEQ ID NO: 55581 - DNA, 25 bp, Mus musculus
tcatgctgtttctataggtccaacg

SEQ ID NO: 55582 - DNA, 25 bp, Mus musculus
tcatgcttctggagacgtcacggag

SEQ ID NO: 55583 - DNA, 25 bp, Mus musculus
tcatgcttggctcaagactgcatca

SEQ ID NO: 55584 - DNA, 25 bp, Mus musculus
tcatgctttggagatcggatacagg

SEQ ID NO: 55585 - DNA, 25 bp, Mus musculus
tcatggaacccctgtaaggttgaga

SEQ ID NO: 55586 - DNA, 25 bp, Mus musculus
tcatggaacttccttggaactcacc

SEQ ID NO: 55587 - DNA, 25 bp, Mus musculus
tcatggaattgccaatgaagacatt

SEQ ID NO: 55588 - DNA, 25 bp, Mus musculus
tcatggaattgcgaatgaagacatt

SEQ ID NO: 55589 - DNA, 25 bp, Mus musculus
tcatggacggaagctgctggcgtca

SEQ ID NO: 55590 - DNA, 25 bp, Mus musculus
tcatggacgggaagggccaaagccc

SEQ ID NO: 55591 - DNA, 25 bp, Mus musculus
tcatggactctaaacctctgcagct

SEQ ID NO: 55592 - DNA, 25 bp, Mus musculus
tcatggacttcctcgaggagccctt

SEQ ID NO: 55593 - DNA, 25 bp, Mus musculus
tcatggagaaaattggaccccggaa

SEQ ID NO: 55594 - DNA, 25 bp, Mus musculus
tcatggagcacaggcacagagcaga

SEQ ID NO: 55595 - DNA, 25 bp, Mus musculus
tcatggatacacttcagttcagcca

SEQ ID NO: 55596 - DNA, 25 bp, Mus musculus
tcatggatgcctgccctcgtaagca

SEQ ID NO: 55597 - DNA, 25 bp, Mus musculus
tcatggcacactatgggcggctggc

SEQ ID NO: 55598 - DNA, 25 bp, Mus musculus
tcatggcagcagctgacgaactggc

SEQ ID NO: 55599 - DNA, 25 bp, Mus musculus
tcatggcattgctggcctctacaag

SEQ ID NO: 55600 - DNA, 25 bp, Mus musculus
tcatggccaagttggtggtcctcgc

SEQ ID NO: 55601 - DNA, 25 bp, Mus musculus
tcatgggacatgtaaatatcgtgtc

SEQ ID NO: 55602 - DNA, 25 bp, Mus musculus
tcatgggagagagcacctgcagatc

SEQ ID NO: 55603 - DNA, 25 bp, Mus musculus
tcatgggataactgagtcgcgcccg

SEQ ID NO: 55604 - DNA, 25 bp, Mus musculus
tcatgggcaatatctttgggaacct

SEQ ID NO: 55605 - DNA, 25 bp, Mus musculus
tcatgggcagctggtgcgtgaccta

SEQ ID NO: 55606 - DNA, 25 bp, Mus musculus
tcatgggcctcatcaaaggtcacta

SEQ ID NO: 55607 - DNA, 25 bp, Mus musculus
tcatggggtgggatcagtacctacc

SEQ ID NO: 55608 - DNA, 25 bp, Mus musculus
tcatgggtcgcacgctgttcttcag

SEQ ID NO: 55609 - DNA, 25 bp, Mus musculus
tcatggtagcaagcgcccagagtgg

SEQ ID NO: 55610 - DNA, 25 bp, Mus musculus
tcatggtagggctcagtaaatctcc

SEQ ID NO: 55611 - DNA, 25 bp, Mus musculus
tcatggtatggatccacggaggctc

SEQ ID NO: 55612 - DNA, 25 bp, Mus musculus
tcatggtcacgagcaattccagcgc

SEQ ID NO: 55613 - DNA, 25 bp, Mus musculus
tcatggtccaccaggaacacaactt

SEQ ID NO: 55614 - DNA, 25 bp, Mus musculus
tcatggtggaaccaggaaccactgt

SEQ ID NO: 55615 - DNA, 25 bp, Mus musculus
tcatggtggacacactaagatccac

SEQ ID NO: 55616 - DNA, 25 bp, Mus musculus
tcatggtggcaaactacgtcaaccg

SEQ ID NO: 55617 - DNA, 25 bp, Mus musculus
tcatggtggcaatctacgtcaaccg

SEQ ID NO: 55618 - DNA, 25 bp, Mus musculus
tcatggtggccctgactatcaggac

SEQ ID NO: 55619 - DNA, 25 bp, Mus musculus
tcatggttcataaaagcaaaagcag

SEQ ID NO: 55620 - DNA, 25 bp, Mus musculus
tcatggtttcagagtctgaagatgc

SEQ ID NO: 55621 - DNA, 25 bp, Mus musculus
tcatggtttcctattgtgcctctct

SEQ ID NO: 55622 - DNA, 25 bp, Mus musculus
tcatgtaatgcctgatacaccggag

SEQ ID NO: 55623 - DNA, 25 bp, Mus musculus
tcatgtacaccagaaagggaagaaa

SEQ ID NO: 55624 - DNA, 25 bp, Mus musculus
tcatgtagccatgggcactggttcc

SEQ ID NO: 55625 - DNA, 25 bp, Mus musculus
tcatgtataaaagtggatcaattcc

SEQ ID NO: 55626 - DNA, 25 bp, Mus musculus
tcatgtatgggagtcactactcttc

SEQ ID NO: 55627 - DNA, 25 bp, Mus musculus
tcatgtattgccacaaggttcaaac

SEQ ID NO: 55628 - DNA, 25 bp, Mus musculus
tcatgtcaagggagaccacagacac

SEQ ID NO: 55629 - DNA, 25 bp, Mus musculus
tcatgtcagaagagcagaaccaccc

SEQ ID NO: 55630 - DNA, 25 bp, Mus musculus
tcatgtcagtgttgggcttcgccgg

SEQ ID NO: 55631 - DNA, 25 bp, Mus musculus
tcatgtccacggacctgcgtaccat

SEQ ID NO: 55632 - DNA, 25 bp, Mus musculus
tcatgtcctctagacttaactctgt

SEQ ID NO: 55633 - DNA, 25 bp, Mus musculus
tcatgtccttcctggtggcttccca

SEQ ID NO: 55634 - DNA, 25 bp, Mus musculus
tcatgtcgcctgagctgagaggcat

SEQ ID NO: 55635 - DNA, 25 bp, Mus musculus
tcatgtctttggactgactatcttt

SEQ ID NO: 55636 - DNA, 25 bp, Mus musculus
tcatgtgaggaactactcacttcat

SEQ ID NO: 55637 - DNA, 25 bp, Mus musculus
tcatgtgaggaagtactcacttcat

SEQ ID NO: 55638 - DNA, 25 bp, Mus musculus
tcatgtgcagcaacgggcggtgcat

SEQ ID NO: 55639 - DNA, 25 bp, Mus musculus
tcatgtggcattcagagtaaagtct

SEQ ID NO: 55640 - DNA, 25 bp, Mus musculus
tcatgtggcattgagagtaaagtct

SEQ ID NO: 55641 - DNA, 25 bp, Mus musculus
tcatgtgtcattcaatgcttggacc

SEQ ID NO: 55642 - DNA, 25 bp, Mus musculus
tcatgtgtccgatggaagaggtgat

SEQ ID NO: 55643 - DNA, 25 bp, Mus musculus
tcatgttaagccacctgtttgctga

SEQ ID NO: 55644 - DNA, 25 bp, Mus musculus
tcatgttcaacaacgagctgatggc

SEQ ID NO: 55645 - DNA, 25 bp, Mus musculus
tcatgttccatcatatcagccaatc

SEQ ID NO: 55646 - DNA, 25 bp, Mus musculus
tcatgttcgcccctcaagaatggca

SEQ ID NO: 55647 - DNA, 25 bp, Mus musculus
tcatgttggaatggattagaaaggg

SEQ ID NO: 55648 - DNA, 25 bp, Mus musculus
tcatgttgggactccagtggcttgc

SEQ ID NO: 55649 - DNA, 25 bp, Mus musculus
tcatgtttctcttcggtggtgttct

SEQ ID NO: 55650 - DNA, 25 bp, Mus musculus
tcatgtttgtacaggaagaggccct

SEQ ID NO: 55651 - DNA, 25 bp, Mus musculus
tcattaaaggcttcacctccgctgc

SEQ ID NO: 55652 - DNA, 25 bp, Mus musculus
tcattaagcccatcgacaagaaggc

SEQ ID NO: 55653 - DNA, 25 bp, Mus musculus
tcattaatcaccacgagtgtggatc

SEQ ID NO: 55654 - DNA, 25 bp, Mus musculus
tcattacaccactattggacatggg

SEQ ID NO: 55655 - DNA, 25 bp, Mus musculus
tcattacagaggcagcctctcccga

SEQ ID NO: 55656 - DNA, 25 bp, Mus musculus
tcattacaggttcccaatgtgctgc

SEQ ID NO: 55657 - DNA, 25 bp, Mus musculus
tcattaccgggctcctggatctcct

SEQ ID NO: 55658 - DNA, 25 bp, Mus musculus
tcattactcaggaagctcacctcgg

SEQ ID NO: 55659 - DNA, 25 bp, Mus musculus
tcattactctcctgttctctgtgct

SEQ ID NO: 55660 - DNA, 25 bp, Mus musculus
tcattaggattggacgagccatgaa

SEQ ID NO: 55661 - DNA, 25 bp, Mus musculus
tcattataatccttccatggccaca

SEQ ID NO: 55662 - DNA, 25 bp, Mus musculus
tcattatgcaggctaggctgaccct

SEQ ID NO: 55663 - DNA, 25 bp, Mus musculus
tcattcaagactgtctgcagctgat

SEQ ID NO: 55664 - DNA, 25 bp, Mus musculus
tcattcaatgacaagcgtaaaaaga

SEQ ID NO: 55665 - DNA, 25 bp, Mus musculus
tcattcacaaatggagtcagctccc

SEQ ID NO: 55666 - DNA, 25 bp, Mus musculus
tcattcacatttatgggatgaaacg

SEQ ID NO: 55667 - DNA, 25 bp, Mus musculus
tcattcagaaacacgcccaagcaaa

SEQ ID NO: 55668 - DNA, 25 bp, Mus musculus
tcattcagcctgaagtggatacccc

SEQ ID NO: 55669 - DNA, 25 bp, Mus musculus
tcattcaggcctaaggatttccttc

SEQ ID NO: 55670 - DNA, 25 bp, Mus musculus
tcattcatgccaaggagagctacat

SEQ ID NO: 55671 - DNA, 25 bp, Mus musculus
tcattccaaaagcagcgatttcccg

SEQ ID NO: 55672 - DNA, 25 bp, Mus musculus
tcattccacagaggaaccgaagcca

SEQ ID NO: 55673 - DNA, 25 bp, Mus musculus
tcattccagaaacttgcatctgaag

SEQ ID NO: 55674 - DNA, 25 bp, Mus musculus
tcattccagctctgcccaagctttg

SEQ ID NO: 55675 - DNA, 25 bp, Mus musculus
tcattccaggttaaaagagaggcaa

SEQ ID NO: 55676 - DNA, 25 bp, Mus musculus
tcattcccaacgagcgaaaggctcc

SEQ ID NO: 55677 - DNA, 25 bp, Mus musculus
tcattcccaatgtgctcttcttcat

SEQ ID NO: 55678 - DNA, 25 bp, Mus musculus
tcattccctgaggttgggacaaccc

SEQ ID NO: 55679 - DNA, 25 bp, Mus musculus
tcattcgccaagaggaaggcctcca

SEQ ID NO: 55680 - DNA, 25 bp, Mus musculus
tcattcgccaagtggaaggcctcca

SEQ ID NO: 55681 - DNA, 25 bp, Mus musculus
tcattcgtcctctgcccagagtgaa

SEQ ID NO: 55682 - DNA, 25 bp, Mus musculus
tcattctaacctgcaagagagactg

SEQ ID NO: 55683 - DNA, 25 bp, Mus musculus
tcattctcagataagtatgagcttg

SEQ ID NO: 55684 - DNA, 25 bp, Mus musculus
tcattctctttcctctgagactagg

SEQ ID NO: 55685 - DNA, 25 bp, Mus musculus
tcattctgacttacacatcttggac

SEQ ID NO: 55686 - DNA, 25 bp, Mus musculus
tcattctgcctcagatctctgtcaa

SEQ ID NO: 55687 - DNA, 25 bp, Mus musculus
tcattcttaggcctgaagccacggc

SEQ ID NO: 55688 - DNA, 25 bp, Mus musculus
tcattgaaacggaaaaaactctcta

SEQ ID NO: 55689 - DNA, 25 bp, Mus musculus
tcattgaagccagtgaaatccaagc

SEQ ID NO: 55690 - DNA, 25 bp, Mus musculus
tcattgaatatgacggcgagttttc

SEQ ID NO: 55691 - DNA, 25 bp, Mus musculus
tcattgacactggtgagccatcagt

SEQ ID NO: 55692 - DNA, 25 bp, Mus musculus
tcattgacagccagcatgtcatcca

SEQ ID NO: 55693 - DNA, 25 bp, Mus musculus
tcattgaccccaaagagctggagcc

SEQ ID NO: 55694 - DNA, 25 bp, Mus musculus
tcattgagcgctgcagcgctgaggt

SEQ ID NO: 55695 - DNA, 25 bp, Mus musculus
tcattgaggagtatgtgcagcactt

SEQ ID NO: 55696 - DNA, 25 bp, Mus musculus
tcattgaggagtttgtgcagcactt

SEQ ID NO: 55697 - DNA, 25 bp, Mus musculus
tcattgatcagagtgaaccgctttg

SEQ ID NO: 55698 - DNA, 25 bp, Mus musculus
tcattgatggtacatggagccaggc

SEQ ID NO: 55699 - DNA, 25 bp, Mus musculus
tcattgattacaacggcgagcggac

SEQ ID NO: 55700 - DNA, 25 bp, Mus musculus
tcattgcaacgatgtcttcaagaag

SEQ ID NO: 55701 - DNA, 25 bp, Mus musculus
tcattgcaggactgtcttgagactc

SEQ ID NO: 55702 - DNA, 25 bp, Mus musculus
tcattgcaggccgtgtgtcaccctg

SEQ ID NO: 55703 - DNA, 25 bp, Mus musculus
tcattgccctgcaggagttaacctt

SEQ ID NO: 55704 - DNA, 25 bp, Mus musculus
tcattgccgtgactcgaaatcccca

SEQ ID NO: 55705 - DNA, 25 bp, Mus musculus
tcattgcggtacactacctggacca

SEQ ID NO: 55706 - DNA, 25 bp, Mus musculus
tcattgctcatgctggcagcctcac

SEQ ID NO: 55707 - DNA, 25 bp, Mus musculus
tcattgctccgttttcagagtacct

SEQ ID NO: 55708 - DNA, 25 bp, Mus musculus
tcattgctgtcttccctcagatact

SEQ ID NO: 55709 - DNA, 25 bp, Mus musculus
tcattgcttatgtctcctggtggcc

SEQ ID NO: 55710 - DNA, 25 bp, Mus musculus
tcattgcttattcccgggaaaagcg

SEQ ID NO: 55711 - DNA, 25 bp, Mus musculus
tcattggcacgaagactatcctggc

SEQ ID NO: 55712 - DNA, 25 bp, Mus musculus
tcattggccatgatcaagttccagc

SEQ ID NO: 55713 - DNA, 25 bp, Mus musculus
tcattggcctgagcgtagttgtgac

SEQ ID NO: 55714 - DNA, 25 bp, Mus musculus
tcattggcggccacgccgggaagac

SEQ ID NO: 55715 - DNA, 25 bp, Mus musculus
tcattgggctacaggactgcagacg

SEQ ID NO: 55716 - DNA, 25 bp, Mus musculus
tcattgggtagctcaccacagtctg

SEQ ID NO: 55717 - DNA, 25 bp, Mus musculus
tcattggtgaacttgactgcagcaa

SEQ ID NO: 55718 - DNA, 25 bp, Mus musculus
tcattggtggtggagtcttccaggc

SEQ ID NO: 55719 - DNA, 25 bp, Mus musculus
tcattgtacgaacgagggaactgca

SEQ ID NO: 55720 - DNA, 25 bp, Mus musculus
tcattgtactaccaaagtgaggagc

SEQ ID NO: 55721 - DNA, 25 bp, Mus musculus
tcattgtactgtgtccaacttactc

SEQ ID NO: 55722 - DNA, 25 bp, Mus musculus
tcattgtcagcatggtctcctccgg

SEQ ID NO: 55723 - DNA, 25 bp, Mus musculus
tcattgtccccttgaagatcggcca

SEQ ID NO: 55724 - DNA, 25 bp, Mus musculus
tcattgtcctggagaaccagggtct

SEQ ID NO: 55725 - DNA, 25 bp, Mus musculus
tcattgtcgactgggatgtccacca

SEQ ID NO: 55726 - DNA, 25 bp, Mus musculus
tcattgtgacagaaaagacgaacat

SEQ ID NO: 55727 - DNA, 25 bp, Mus musculus
tcattgtgggcaccatcatcggctc

SEQ ID NO: 55728 - DNA, 25 bp, Mus musculus
tcattgtgtttatcgcggcatccct

SEQ ID NO: 55729 - DNA, 25 bp, Mus musculus
tcatttagaagtatgttcccgtgat

SEQ ID NO: 55730 - DNA, 25 bp, Mus musculus
tcatttcaaacctttgtgggccagg

SEQ ID NO: 55731 - DNA, 25 bp, Mus musculus
tcatttcaggacagctctcagacag

SEQ ID NO: 55732 - DNA, 25 bp, Mus musculus
tcatttcgcttgaaattggctttgc

SEQ ID NO: 55733 - DNA, 25 bp, Mus musculus
tcatttcgcttgtaattggctttgc

SEQ ID NO: 55734 - DNA, 25 bp, Mus musculus
tcatttctagtcttcctcagctgct

SEQ ID NO: 55735 - DNA, 25 bp, Mus musculus
tcatttctggttcccgctggtccca

SEQ ID NO: 55736 - DNA, 25 bp, Mus musculus
tcatttgccccagaagatatccaca

SEQ ID NO: 55737 - DNA, 25 bp, Mus musculus
tcatttgctcgacacccaaccaatg

SEQ ID NO: 55738 - DNA, 25 bp, Mus musculus
tcatttggcaacattctggatgtcc

SEQ ID NO: 55739 - DNA, 25 bp, Mus musculus
tcatttggcccggagtcatttggct

SEQ ID NO: 55740 - DNA, 25 bp, Mus musculus
tcatttggctgagcacatgatacgt

SEQ ID NO: 55741 - DNA, 25 bp, Mus musculus
tcatttgggaacaagtaacagaaac

SEQ ID NO: 55742 - DNA, 25 bp, Mus musculus
tcatttgggaactagtaacagaaac

SEQ ID NO: 55743 - DNA, 25 bp, Mus musculus
tcatttgttcaagttgtgctcaact

SEQ ID NO: 55744 - DNA, 25 bp, Mus musculus
tcatttgttggcagtacatattggc

SEQ ID NO: 55745 - DNA, 25 bp, Mus musculus
tcattttgccataattagtcacagc

SEQ ID NO: 55746 - DNA, 25 bp, Mus musculus
tcattttgccattattagtcacagc

SEQ ID NO: 55747 - DNA, 25 bp, Mus musculus
tcattttgctggcttgcgacgggct

SEQ ID NO: 55748 - DNA, 25 bp, Mus musculus
tcatttttagcagggactgaagaac

SEQ ID NO: 55749 - DNA, 25 bp, Mus musculus
tcatttttccgacgcttatacgatg

SEQ ID NO: 55750 - DNA, 25 bp, Mus musculus
tccaaaaagaggttcttacgagccg

SEQ ID NO: 55751 - DNA, 25 bp, Mus musculus
tccaaaaccaaagtggtggtcacca

SEQ ID NO: 55752 - DNA, 25 bp, Mus musculus
tccaaaagaagaaccaaaagatgaa

SEQ ID NO: 55753 - DNA, 25 bp, Mus musculus
tccaaaatgctacaaagaagtatat

SEQ ID NO: 55754 - DNA, 25 bp, Mus musculus
tccaaaatggtctggtcggcaagcc

SEQ ID NO: 55755 - DNA, 25 bp, Mus musculus
tccaaaattactccttctacgaggg

SEQ ID NO: 55756 - DNA, 25 bp, Mus musculus
tccaaacaagatctttgaaagaact

SEQ ID NO: 55757 - DNA, 25 bp, Mus musculus
tccaaacccactcggatgtgaagag

SEQ ID NO: 55758 - DNA, 25 bp, Mus musculus
tccaaacccactgggatgtgaagag

SEQ ID NO: 55759 - DNA, 25 bp, Mus musculus
tccaaaccccgctgtttctcagaag

SEQ ID NO: 55760 - DNA, 25 bp, Mus musculus
tccaaacccgataactataattcgg

SEQ ID NO: 55761 - DNA, 25 bp, Mus musculus
tccaaacgctttgtgcagtggcagt

SEQ ID NO: 55762 - DNA, 25 bp, Mus musculus
tccaaacggattcttcggacagaga

SEQ ID NO: 55763 - DNA, 25 bp, Mus musculus
tccaaactcagttgagaacagagac

SEQ ID NO: 55764 - DNA, 25 bp, Mus musculus
tccaaactgacacctactcaggagc

SEQ ID NO: 55765 - DNA, 25 bp, Mus musculus
tccaaactgatgttactgagtctca

SEQ ID NO: 55766 - DNA, 25 bp, Mus musculus
tccaaactggcagcattcgatgaac

SEQ ID NO: 55767 - DNA, 25 bp, Mus musculus
tccaaacttggcatcccagaaacaa

SEQ ID NO: 55768 - DNA, 25 bp, Mus musculus
tccaaagaagctatatcagcagaat

SEQ ID NO: 55769 - DNA, 25 bp, Mus musculus
tccaaagaaggctcttcaaggcttc

SEQ ID NO: 55770 - DNA, 25 bp, Mus musculus
tccaaagaaggtatcgagacaactg

SEQ ID NO: 55771 - DNA, 25 bp, Mus musculus
tccaaagacatcctggtaacttctg

SEQ ID NO: 55772 - DNA, 25 bp, Mus musculus
tccaaagactccgaaatcaaaaagg

SEQ ID NO: 55773 - DNA, 25 bp, Mus musculus
tccaaagcattgaggcatggcgaac

SEQ ID NO: 55774 - DNA, 25 bp, Mus musculus
tccaaagccttgagccgaagtgaca

SEQ ID NO: 55775 - DNA, 25 bp, Mus musculus
tccaaagctctctggagtcagaatc

SEQ ID NO: 55776 - DNA, 25 bp, Mus musculus
tccaaaggcctcttagaagagaaat

SEQ ID NO: 55777 - DNA, 25 bp, Mus musculus
tccaaaggcttcctcaacgtgaatg

SEQ ID NO: 55778 - DNA, 25 bp, Mus musculus
tccaaagggttctttgaaggctcca

SEQ ID NO: 55779 - DNA, 25 bp, Mus musculus
tccaaagtacttgtcaagactgcag

SEQ ID NO: 55780 - DNA, 25 bp, Mus musculus
tccaaagtgccctggagacaactat

SEQ ID NO: 55781 - DNA, 25 bp, Mus musculus
tccaaagtgctaagctaaaactgag

SEQ ID NO: 55782 - DNA, 25 bp, Mus musculus
tccaaagtttaataggatatggccg

SEQ ID NO: 55783 - DNA, 25 bp, Mus musculus
tccaaataccagaattacatcatgg

SEQ ID NO: 55784 - DNA, 25 bp, Mus musculus
tccaaatacggacgcggtggcttcc

SEQ ID NO: 55785 - DNA, 25 bp, Mus musculus
tccaaatccaggagaccaaccaact

SEQ ID NO: 55786 - DNA, 25 bp, Mus musculus
tccaaatctcggtctcggacccgat

SEQ ID NO: 55787 - DNA, 25 bp, Mus musculus
tccaaatggatactctggacagccc

SEQ ID NO: 55788 - DNA, 25 bp, Mus musculus
tccaaatggctttccatgaacgtct

SEQ ID NO: 55789 - DNA, 25 bp, Mus musculus
tccaaatgggaaagagaacttctca

SEQ ID NO: 55790 - DNA, 25 bp, Mus musculus
tccaaatgtctaccaaggagtagcc

SEQ ID NO: 55791 - DNA, 25 bp, Mus musculus
tccaaattcagctacaagatagact

SEQ ID NO: 55792 - DNA, 25 bp, Mus musculus
tccaaatttccaacagaagagccag

SEQ ID NO: 55793 - DNA, 25 bp, Mus musculus
tccaacaaagcaccgctcttggtgt

SEQ ID NO: 55794 - DNA, 25 bp, Mus musculus
tccaacaagcccatccgtgtgatag

SEQ ID NO: 55795 - DNA, 25 bp, Mus musculus
tccaacaggaatgggctcttctggg

SEQ ID NO: 55796 - DNA, 25 bp, Mus musculus
tccaacatctggctggccgcagtca

SEQ ID NO: 55797 - DNA, 25 bp, Mus musculus
tccaacccatcaattgatgaaagcc

SEQ ID NO: 55798 - DNA, 25 bp, Mus musculus
tccaacccctgtcataatggaggtg

SEQ ID NO: 55799 - DNA, 25 bp, Mus musculus
tccaacccggtgacagagatgatcc

SEQ ID NO: 55800 - DNA, 25 bp, Mus musculus
tccaaccctgtctgagattgttccc

SEQ ID NO: 55801 - DNA, 25 bp, Mus musculus
tccaaccggaagaagcaccgcggga

SEQ ID NO: 55802 - DNA, 25 bp, Mus musculus
tccaacctggacctgaaatcccagg

SEQ ID NO: 55803 - DNA, 25 bp, Mus musculus
tccaacggaacacggttatagcagc

SEQ ID NO: 55804 - DNA, 25 bp, Mus musculus
tccaacgggcatcttcattatcaac

SEQ ID NO: 55805 - DNA, 25 bp, Mus musculus
tccaacgggcatgttcattatcaac

SEQ ID NO: 55806 - DNA, 25 bp, Mus musculus
tccaacggttgtgtgagtaaaattc

SEQ ID NO: 55807 - DNA, 25 bp, Mus musculus
tccaactgaatatgagaggaacggg

SEQ ID NO: 55808 - DNA, 25 bp, Mus musculus
tccaactgcccatgcgccaatgatg

SEQ ID NO: 55809 - DNA, 25 bp, Mus musculus
tccaactgttagcaatgacgccgac

SEQ ID NO: 55810 - DNA, 25 bp, Mus musculus
tccaactttcactgtgaaggacaga

SEQ ID NO: 55811 - DNA, 25 bp, Mus musculus
tccaactttgttggagggtccacta

SEQ ID NO: 55812 - DNA, 25 bp, Mus musculus
tccaagaaaggaggtaaaatgcgcc

SEQ ID NO: 55813 - DNA, 25 bp, Mus musculus
tccaagaaaggttaccaagtgacaa

SEQ ID NO: 55814 - DNA, 25 bp, Mus musculus
tccaagaacttaatgaagtagcaag

SEQ ID NO: 55815 - DNA, 25 bp, Mus musculus
tccaagaagacaggtggcagctcta

SEQ ID NO: 55816 - DNA, 25 bp, Mus musculus
tccaagaagcagagaatcgaaacca

SEQ ID NO: 55817 - DNA, 25 bp, Mus musculus
tccaagaccaggcatctatattgga

SEQ ID NO: 55818 - DNA, 25 bp, Mus musculus
tccaagaccgagagctcacatgctg

SEQ ID NO: 55819 - DNA, 25 bp, Mus musculus
tccaagacctacaccatggaggagg

SEQ ID NO: 55820 - DNA, 25 bp, Mus musculus
tccaagacctactccatggaggagg

SEQ ID NO: 55821 - DNA, 25 bp, Mus musculus
tccaagagaagatcaaagagaatgc

SEQ ID NO: 55822 - DNA, 25 bp, Mus musculus
tccaagagagcaaggcccagaagga

SEQ ID NO: 55823 - DNA, 25 bp, Mus musculus
tccaagagttacaaccagagtggcc

SEQ ID NO: 55824 - DNA, 25 bp, Mus musculus
tccaagagtttgtagcctttgagtc

SEQ ID NO: 55825 - DNA, 25 bp, Mus musculus
tccaagatacacagaagctttgtcc

SEQ ID NO: 55826 - DNA, 25 bp, Mus musculus
tccaagatacactgaagctttgtcc

SEQ ID NO: 55827 - DNA, 25 bp, Mus musculus
tccaagatcacattcctcttacaag

SEQ ID NO: 55828 - DNA, 25 bp, Mus musculus
tccaagatgaaccatgccttcttac

SEQ ID NO: 55829 - DNA, 25 bp, Mus musculus
tccaagatggcagattcaatctttt

SEQ ID NO: 55830 - DNA, 25 bp, Mus musculus
tccaagcaaccgcagagaaaactac

SEQ ID NO: 55831 - DNA, 25 bp, Mus musculus
tccaagcagcatcggctgaaacgct

SEQ ID NO: 55832 - DNA, 25 bp, Mus musculus
tccaagcaggaaaaggatgggactg

SEQ ID NO: 55833 - DNA, 25 bp, Mus musculus
tccaagcagtgcagttcgggaacag

SEQ ID NO: 55834 - DNA, 25 bp, Mus musculus
tccaagccactgagactgcttctag

SEQ ID NO: 55835 - DNA, 25 bp, Mus musculus
tccaagccgatgtgtccgaggtgct

SEQ ID NO: 55836 - DNA, 25 bp, Mus musculus
tccaagcgctctctaagcgaagcag

SEQ ID NO: 55837 - DNA, 25 bp, Mus musculus
tccaagctgaacacggaggtggcct

SEQ ID NO: 55838 - DNA, 25 bp, Mus musculus
tccaagctggaatgggcgcagacgt

SEQ ID NO: 55839 - DNA, 25 bp, Mus musculus
tccaagctgtgtccctcaagataca

SEQ ID NO: 55840 - DNA, 25 bp, Mus musculus
tccaaggagatatccggttgctacc

SEQ ID NO: 55841 - DNA, 25 bp, Mus musculus
tccaaggagtctacgccatgggctt

SEQ ID NO: 55842 - DNA, 25 bp, Mus musculus
tccaaggagtgtcctcagaatggcg

SEQ ID NO: 55843 - DNA, 25 bp, Mus musculus
tccaaggatttcaaagtgctttgca

SEQ ID NO: 55844 - DNA, 25 bp, Mus musculus
tccaagggcagttgactacgtgaag

SEQ ID NO: 55845 - DNA, 25 bp, Mus musculus
tccaagggctctccaacatcgcttt

SEQ ID NO: 55846 - DNA, 25 bp, Mus musculus
tccaaggtcacaaagttcattgaag

SEQ ID NO: 55847 - DNA, 25 bp, Mus musculus
tccaagtaccaggtggcagaccact

SEQ ID NO: 55848 - DNA, 25 bp, Mus musculus
tccaagtacgagatgaacaaagcct

SEQ ID NO: 55849 - DNA, 25 bp, Mus musculus
tccaagtagagaggctgcaacacac

SEQ ID NO: 55850 - DNA, 25 bp, Mus musculus
tccaagtcctgcaagtgaacaagcc

SEQ ID NO: 55851 - DNA, 25 bp, Mus musculus
tccaagtctatcattgacgaattct

SEQ ID NO: 55852 - DNA, 25 bp, Mus musculus
tccaagtgcagagtgtcttaagggc

SEQ ID NO: 55853 - DNA, 25 bp, Mus musculus
tccaagtgtggctggccatccgagc

SEQ ID NO: 55854 - DNA, 25 bp, Mus musculus
tccaagtgtggtgctggttcctctc

SEQ ID NO: 55855 - DNA, 25 bp, Mus musculus
tccaagtgtggttccaaggacaata

SEQ ID NO: 55856 - DNA, 25 bp, Mus musculus
tccaagttgccaggaagcttctggg

SEQ ID NO: 55857 - DNA, 25 bp, Mus musculus
tccaatcaaaagaaaagcacccagc

SEQ ID NO: 55858 - DNA, 25 bp, Mus musculus
tccaatcctggcatttgttgcgtct

SEQ ID NO: 55859 - DNA, 25 bp, Mus musculus
tccaatcttgcccacaggatggata

SEQ ID NO: 55860 - DNA, 25 bp, Mus musculus
tccaatgaagtaagagggccaagct

SEQ ID NO: 55861 - DNA, 25 bp, Mus musculus
tccaatgacagagatacctgcacct

SEQ ID NO: 55862 - DNA, 25 bp, Mus musculus
tccaatggacgtgatggtagctacc

SEQ ID NO: 55863 - DNA, 25 bp, Mus musculus
tccaatggcgatggactggtggtaa

SEQ ID NO: 55864 - DNA, 25 bp, Mus musculus
tccaatggtgtgacggaccaggctg

SEQ ID NO: 55865 - DNA, 25 bp, Mus musculus
tccaatgtacctgccgtggtggtgg

SEQ ID NO: 55866 - DNA, 25 bp, Mus musculus
tccaatgtattgttctcaagaagca

SEQ ID NO: 55867 - DNA, 25 bp, Mus musculus
tccaatgtccgaagtctgtatccat

SEQ ID NO: 55868 - DNA, 25 bp, Mus musculus
tccaatgtccgatgtctgtatccat

SEQ ID NO: 55869 - DNA, 25 bp, Mus musculus
tccaatgtctgctgggctcttccac

SEQ ID NO: 55870 - DNA, 25 bp, Mus musculus
tccaatgttgtttactacagtccag

SEQ ID NO: 55871 - DNA, 25 bp, Mus musculus
tccaattatatagggcaggccaacc

SEQ ID NO: 55872 - DNA, 25 bp, Mus musculus
tccaattatattggtgaagctaacc

SEQ ID NO: 55873 - DNA, 25 bp, Mus musculus
tccaattcaaaagatgtttgagaag

SEQ ID NO: 55874 - DNA, 25 bp, Mus musculus
tccaattcaaagacggggccttcct

SEQ ID NO: 55875 - DNA, 25 bp, Mus musculus
tccacaaaggagtccagtttgctct

SEQ ID NO: 55876 - DNA, 25 bp, Mus musculus
tccacaactgatgattagtaaagtc

SEQ ID NO: 55877 - DNA, 25 bp, Mus musculus
tccacaagaccaagtttcacatcca

SEQ ID NO: 55878 - DNA, 25 bp, Mus musculus
tccacaagagagagaacattctggt

SEQ ID NO: 55879 - DNA, 25 bp, Mus musculus
tccacaagaggacaaaatgaaacac

SEQ ID NO: 55880 - DNA, 25 bp, Mus musculus
tccacaaggacagagtcagattaca

SEQ ID NO: 55881 - DNA, 25 bp, Mus musculus
tccacaaggaggttctgcgacagag

SEQ ID NO: 55882 - DNA, 25 bp, Mus musculus
tccacaagggacacggtgacatgag

SEQ ID NO: 55883 - DNA, 25 bp, Mus musculus
tccacaagggactcggtgacatgag

SEQ ID NO: 55884 - DNA, 25 bp, Mus musculus
tccacaagggagtcaaggcgttctc

SEQ ID NO: 55885 - DNA, 25 bp, Mus musculus
tccacaatattgctgaaagaaaaag

SEQ ID NO: 55886 - DNA, 25 bp, Mus musculus
tccacaccgaagagccaagtcattg

SEQ ID NO: 55887 - DNA, 25 bp, Mus musculus
tccacaccgtgtggtggcacatctg

SEQ ID NO: 55888 - DNA, 25 bp, Mus musculus
tccacacctgatagtaggcaggaaa

SEQ ID NO: 55889 - DNA, 25 bp, Mus musculus
tccacacgatgcctttaatgatgaa

SEQ ID NO: 55890 - DNA, 25 bp, Mus musculus
tccacacttgtgctgtgaagtcctc

SEQ ID NO: 55891 - DNA, 25 bp, Mus musculus
tccacagagaaaatgatgtaaagcc

SEQ ID NO: 55892 - DNA, 25 bp, Mus musculus
tccacagagcacagagacttgccgg

SEQ ID NO: 55893 - DNA, 25 bp, Mus musculus
tccacagagcgtgagacgcatcatc

SEQ ID NO: 55894 - DNA, 25 bp, Mus musculus
tccacagagggtgtgacaaccatcc

SEQ ID NO: 55895 - DNA, 25 bp, Mus musculus
tccacagctagtgcgcatgtttctc

SEQ ID NO: 55896 - DNA, 25 bp, Mus musculus
tccacagtaacttccccatatgcag

SEQ ID NO: 55897 - DNA, 25 bp, Mus musculus
tccacagtgacatggcggccatcgt

SEQ ID NO: 55898 - DNA, 25 bp, Mus musculus
tccacatagcaagctgcacaaggga

SEQ ID NO: 55899 - DNA, 25 bp, Mus musculus
tccacatagctgtgatgagcaatag

SEQ ID NO: 55900 - DNA, 25 bp, Mus musculus
tccacatcaatcagggaaacccatt

SEQ ID NO: 55901 - DNA, 25 bp, Mus musculus
tccacatcatagccagcttccagag

SEQ ID NO: 55902 - DNA, 25 bp, Mus musculus
tccacatcataggcagcttccagag

SEQ ID NO: 55903 - DNA, 25 bp, Mus musculus
tccacatcgacgtgggcggccacat

SEQ ID NO: 55904 - DNA, 25 bp, Mus musculus
tccacatctctcagccaagatcaag

SEQ ID NO: 55905 - DNA, 25 bp, Mus musculus
tccacatcttttcgacgcaacttca

SEQ ID NO: 55906 - DNA, 25 bp, Mus musculus
tccaccagagcgtagaggctgacgt

SEQ ID NO: 55907 - DNA, 25 bp, Mus musculus
tccaccagaggtggaactcccaaaa

SEQ ID NO: 55908 - DNA, 25 bp, Mus musculus
tccaccagtgctgtggcttccaggt

SEQ ID NO: 55909 - DNA, 25 bp, Mus musculus
tccaccatagaaaaggactctaatg

SEQ ID NO: 55910 - DNA, 25 bp, Mus musculus
tccaccatgattgacgggagtggtg

SEQ ID NO: 55911 - DNA, 25 bp, Mus musculus
tccaccatggacagtttgctcctgg

SEQ ID NO: 55912 - DNA, 25 bp, Mus musculus
tccacccagctggatatcagaatgt

SEQ ID NO: 55913 - DNA, 25 bp, Mus musculus
tccaccccagacaactgttgtgaga

SEQ ID NO: 55914 - DNA, 25 bp, Mus musculus
tccaccccaggaaagagggcacttt

SEQ ID NO: 55915 - DNA, 25 bp, Mus musculus
tccacccggcagaagatcgtagagc

SEQ ID NO: 55916 - DNA, 25 bp, Mus musculus
tccaccctgaagagtgaggacataa

SEQ ID NO: 55917 - DNA, 25 bp, Mus musculus
tccaccgaacactggtaaacctgca

SEQ ID NO: 55918 - DNA, 25 bp, Mus musculus
tccaccgagtgctctttgaggtgca

SEQ ID NO: 55919 - DNA, 25 bp, Mus musculus
tccaccgcgaagacgaaagttgtcc

SEQ ID NO: 55920 - DNA, 25 bp, Mus musculus
tccacctagcctttgcagagtctga

SEQ ID NO: 55921 - DNA, 25 bp, Mus musculus
tccacctgaagtcacactgtgtgct

SEQ ID NO: 55922 - DNA, 25 bp, Mus musculus
tccacctgcggtggacagagggcat

SEQ ID NO: 55923 - DNA, 25 bp, Mus musculus
tccacctggaagagacaattgagca

SEQ ID NO: 55924 - DNA, 25 bp, Mus musculus
tccacctgggtgaccattctttgca

SEQ ID NO: 55925 - DNA, 25 bp, Mus musculus
tccacctgtcaaatcgacagcacgg

SEQ ID NO: 55926 - DNA, 25 bp, Mus musculus
tccacgaagagatcctcaaagatgt

SEQ ID NO: 55927 - DNA, 25 bp, Mus musculus
tccacgactacttggacaacagcac

SEQ ID NO: 55928 - DNA, 25 bp, Mus musculus
tccacgagaatgagctatggtttag

SEQ ID NO: 55929 - DNA, 25 bp, Mus musculus
tccacgatttgttcctgagcttcga

SEQ ID NO: 55930 - DNA, 25 bp, Mus musculus
tccacgcagttacagtccagctaca

SEQ ID NO: 55931 - DNA, 25 bp, Mus musculus
tccacgcagttattggacctaagtc

SEQ ID NO: 55932 - DNA, 25 bp, Mus musculus
tccacggagattgttgaatggctcc

SEQ ID NO: 55933 - DNA, 25 bp, Mus musculus
tccacggatgcctcggaagatgcat

SEQ ID NO: 55934 - DNA, 25 bp, Mus musculus
tccacggccgacaggccaagcagaa

SEQ ID NO: 55935 - DNA, 25 bp, Mus musculus
tccacggtagattctccagatcaca

SEQ ID NO: 55936 - DNA, 25 bp, Mus musculus
tccacggtcattagtgttcccagag

SEQ ID NO: 55937 - DNA, 25 bp, Mus musculus
tccacggtggcttctgtcccaagga

SEQ ID NO: 55938 - DNA, 25 bp, Mus musculus
tccacgtacgtccagaagatgtcta

SEQ ID NO: 55939 - DNA, 25 bp, Mus musculus
tccacgtacgtcgagaagatgtcta

SEQ ID NO: 55940 - DNA, 25 bp, Mus musculus
tccacgtgtacgagcagcacgagaa

SEQ ID NO: 55941 - DNA, 25 bp, Mus musculus
tccacgtgtcggaagatgtgattct

SEQ ID NO: 55942 - DNA, 25 bp, Mus musculus
tccacgttctcgctgcctgaggagg

SEQ ID NO: 55943 - DNA, 25 bp, Mus musculus
tccactaaagtttgcagctcaatgg

SEQ ID NO: 55944 - DNA, 25 bp, Mus musculus
tccactaccaacacagttatagcaa

SEQ ID NO: 55945 - DNA, 25 bp, Mus musculus
tccactaccaactcagttatagcaa

SEQ ID NO: 55946 - DNA, 25 bp, Mus musculus
tccactatcgtatgtccgggcccat

SEQ ID NO: 55947 - DNA, 25 bp, Mus musculus
tccactatggaattctcactacaga

SEQ ID NO: 55948 - DNA, 25 bp, Mus musculus
tccactcaaggaggagtatgctcgg

SEQ ID NO: 55949 - DNA, 25 bp, Mus musculus
tccactcagccacaatgctgggcaa

SEQ ID NO: 55950 - DNA, 25 bp, Mus musculus
tccactcccgaattctggacatcag

SEQ ID NO: 55951 - DNA, 25 bp, Mus musculus
tccactctatggtaagatgcttcca

SEQ ID NO: 55952 - DNA, 25 bp, Mus musculus
tccactgaggtgacagtcggaccag

SEQ ID NO: 55953 - DNA, 25 bp, Mus musculus
tccactgcaagtgcaaagccacaag

SEQ ID NO: 55954 - DNA, 25 bp, Mus musculus
tccactgcagtttcatgacttcaag

SEQ ID NO: 55955 - DNA, 25 bp, Mus musculus
tccactgccacgtgtgtcctggctg

SEQ ID NO: 55956 - DNA, 25 bp, Mus musculus
tccactgccagaagcatttctcagg

SEQ ID NO: 55957 - DNA, 25 bp, Mus musculus
tccactgggagcgaatcaaagttct

SEQ ID NO: 55958 - DNA, 25 bp, Mus musculus
tccactggtggagtacttcctgtcc

SEQ ID NO: 55959 - DNA, 25 bp, Mus musculus
tccactgtgaattctcgtctgagcg

SEQ ID NO: 55960 - DNA, 25 bp, Mus musculus
tccactgtggcagggctgaggatct

SEQ ID NO: 55961 - DNA, 25 bp, Mus musculus
tccactgttacttgtcagtctgagt

SEQ ID NO: 55962 - DNA, 25 bp, Mus musculus
tccacttcgaagctctgcagcacgt

SEQ ID NO: 55963 - DNA, 25 bp, Mus musculus
tccacttcgggcttcgttttcacag

SEQ ID NO: 55964 - DNA, 25 bp, Mus musculus
tccacttgcacgaaagcttccctag

SEQ ID NO: 55965 - DNA, 25 bp, Mus musculus
tccacttgtgccgactgccgtgtta

SEQ ID NO: 55966 - DNA, 25 bp, Mus musculus
tccagaaaagccagttcaagcgttg

SEQ ID NO: 55967 - DNA, 25 bp, Mus musculus
tccagaaacgctgaacgattctcaa

SEQ ID NO: 55968 - DNA, 25 bp, Mus musculus
tccagaaacttgcatctgaagatac

SEQ ID NO: 55969 - DNA, 25 bp, Mus musculus
tccagaaagcctatgatgcctacgg

SEQ ID NO: 55970 - DNA, 25 bp, Mus musculus
tccagaaagcgcttcacgctgcagg

SEQ ID NO: 55971 - DNA, 25 bp, Mus musculus
tccagaaagtcctcaaagtagcagc

SEQ ID NO: 55972 - DNA, 25 bp, Mus musculus
tccagaaatcacaaccgaagacatc

SEQ ID NO: 55973 - DNA, 25 bp, Mus musculus
tccagaaatgagtggcaagtgtgtg

SEQ ID NO: 55974 - DNA, 25 bp, Mus musculus
tccagaaattacaacagaagatatc

SEQ ID NO: 55975 - DNA, 25 bp, Mus musculus
tccagaacctcacagtcccaggagg

SEQ ID NO: 55976 - DNA, 25 bp, Mus musculus
tccagaactcaacggcaagctggtg

SEQ ID NO: 55977 - DNA, 25 bp, Mus musculus
tccagaactcatctgaaaaactgcc

SEQ ID NO: 55978 - DNA, 25 bp, Mus musculus
tccagaactccctccagctttaatg

SEQ ID NO: 55979 - DNA, 25 bp, Mus musculus
tccagaagacatgccattcttgaag

SEQ ID NO: 55980 - DNA, 25 bp, Mus musculus
tccagaagcacatggacggactccg

SEQ ID NO: 55981 - DNA, 25 bp, Mus musculus
tccagaagcagagctatggaatccc

SEQ ID NO: 55982 - DNA, 25 bp, Mus musculus
tccagaagctgagcagccatgacat

SEQ ID NO: 55983 - DNA, 25 bp, Mus musculus
tccagaaggaaaacggaccacctag

SEQ ID NO: 55984 - DNA, 25 bp, Mus musculus
tccagaaggagtacccattgagggt

SEQ ID NO: 55985 - DNA, 25 bp, Mus musculus
tccagaaggctgtcacacacgtggg

SEQ ID NO: 55986 - DNA, 25 bp, Mus musculus
tccagaaggcttcgcaggtccgaac

SEQ ID NO: 55987 - DNA, 25 bp, Mus musculus
tccagaagtgactcaacacagaccc

SEQ ID NO: 55988 - DNA, 25 bp, Mus musculus
tccagaagtgccacaatggtggcag

SEQ ID NO: 55989 - DNA, 25 bp, Mus musculus
tccagaagtggttgctccaaaatca

SEQ ID NO: 55990 - DNA, 25 bp, Mus musculus
tccagaatgaagagagcgtggtgct

SEQ ID NO: 55991 - DNA, 25 bp, Mus musculus
tccagaatgccaagcaggcactccg

SEQ ID NO: 55992 - DNA, 25 bp, Mus musculus
tccagaatgtgtttgtggataccca

SEQ ID NO: 55993 - DNA, 25 bp, Mus musculus
tccagacacaaaggacctggaactg

SEQ ID NO: 55994 - DNA, 25 bp, Mus musculus
tccagacagtcatctctatcagaaa

SEQ ID NO: 55995 - DNA, 25 bp, Mus musculus
tccagacatctgaatttcagccttc

SEQ ID NO: 55996 - DNA, 25 bp, Mus musculus
tccagaccagtatccctgagtcaaa

SEQ ID NO: 55997 - DNA, 25 bp, Mus musculus
tccagacctcattcatgccaaggag

SEQ ID NO: 55998 - DNA, 25 bp, Mus musculus
tccagacctggaaggtacctgcagt

SEQ ID NO: 55999 - DNA, 25 bp, Mus musculus
tccagacctggatggtacctgcagt

SEQ ID NO: 56000 - DNA, 25 bp, Mus musculus
tccagacctggctgcaggaccttct

SEQ ID NO: 56001 - DNA, 25 bp, Mus musculus
tccagacgtttgtgtcttgccagga

SEQ ID NO: 56002 - DNA, 25 bp, Mus musculus
tccagactacagagtacatatcatc

SEQ ID NO: 56003 - DNA, 25 bp, Mus musculus
tccagactagcagcaagaaaatatg

SEQ ID NO: 56004 - DNA, 25 bp, Mus musculus
tccagactataatcctgatgaccgt

SEQ ID NO: 56005 - DNA, 25 bp, Mus musculus
tccagactccaaactatcatgtcac

SEQ ID NO: 56006 - DNA, 25 bp, Mus musculus
tccagactctgaactcgaaagtggc

SEQ ID NO: 56007 - DNA, 25 bp, Mus musculus
tccagagacagtccagaactggatt

SEQ ID NO: 56008 - DNA, 25 bp, Mus musculus
tccagagactgggaacagaggagca

SEQ ID NO: 56009 - DNA, 25 bp, Mus musculus
tccagagattgagagagtcaaacgc

SEQ ID NO: 56010 - DNA, 25 bp, Mus musculus
tccagagcaatgaggaaggcatgca

SEQ ID NO: 56011 - DNA, 25 bp, Mus musculus
tccagagcactgtgaaggcgcagca

SEQ ID NO: 56012 - DNA, 25 bp, Mus musculus
tccagagcaggatcctagatacgcc

SEQ ID NO: 56013 - DNA, 25 bp, Mus musculus
tccagagcatgacccggctagtagt

SEQ ID NO: 56014 - DNA, 25 bp, Mus musculus
tccagagccatgaatgagctgcaac

SEQ ID NO: 56015 - DNA, 25 bp, Mus musculus
tccagagcctgaaggatttggtgga

SEQ ID NO: 56016 - DNA, 25 bp, Mus musculus
tccagagcctgatggatttggtgga

SEQ ID NO: 56017 - DNA, 25 bp, Mus musculus
tccagagcctgtgggttgagaatca

SEQ ID NO: 56018 - DNA, 25 bp, Mus musculus
tccagagctcagaagtccaagatac

SEQ ID NO: 56019 - DNA, 25 bp, Mus musculus
tccagagctcagtagtccaagatac

SEQ ID NO: 56020 - DNA, 25 bp, Mus musculus
tccagagctcgaagcagcatgggta

SEQ ID NO: 56021 - DNA, 25 bp, Mus musculus
tccagaggaagtaggtgagtacaga

SEQ ID NO: 56022 - DNA, 25 bp, Mus musculus
tccagaggacccattcctcaagagc

SEQ ID NO: 56023 - DNA, 25 bp, Mus musculus
tccagaggaccctgagggcaccaag

SEQ ID NO: 56024 - DNA, 25 bp, Mus musculus
tccagaggaccctttcctcaagagc

SEQ ID NO: 56025 - DNA, 25 bp, Mus musculus
tccagagggacactcctgtttgcct

SEQ ID NO: 56026 - DNA, 25 bp, Mus musculus
tccagagggagttagaagacactag

SEQ ID NO: 56027 - DNA, 25 bp, Mus musculus
tccagaggtatttgagcagcgagct

SEQ ID NO: 56028 - DNA, 25 bp, Mus musculus
tccagagtaatcaattggcccagaa

SEQ ID NO: 56029 - DNA, 25 bp, Mus musculus
tccagagtacccctggccgacaagg

SEQ ID NO: 56030 - DNA, 25 bp, Mus musculus
tccagagtactttagtcctgaggac

SEQ ID NO: 56031 - DNA, 25 bp, Mus musculus
tccagagtcacattctccactgttc

SEQ ID NO: 56032 - DNA, 25 bp, Mus musculus
tccagagtctcagaaggtgcatgct

SEQ ID NO: 56033 - DNA, 25 bp, Mus musculus
tccagagtgaactgacaggagatga

SEQ ID NO: 56034 - DNA, 25 bp, Mus musculus
tccagagtgccaggaatcagcaaag

SEQ ID NO: 56035 - DNA, 25 bp, Mus musculus
tccagagtgctaaagtccagagtac

SEQ ID NO: 56036 - DNA, 25 bp, Mus musculus
tccagagtggaagttccattcaggg

SEQ ID NO: 56037 - DNA, 25 bp, Mus musculus
tccagataaccagggccttcctgat

SEQ ID NO: 56038 - DNA, 25 bp, Mus musculus
tccagatcaagggttgggaatacag

SEQ ID NO: 56039 - DNA, 25 bp, Mus musculus
tccagatcgcccagtacaagtgcct

SEQ ID NO: 56040 - DNA, 25 bp, Mus musculus
tccagatcgccttcgggacattgct

SEQ ID NO: 56041 - DNA, 25 bp, Mus musculus
tccagatctccatctcctaaaagaa

SEQ ID NO: 56042 - DNA, 25 bp, Mus musculus
tccagatctggctcctgtacaggcc

SEQ ID NO: 56043 - DNA, 25 bp, Mus musculus
tccagatgaactgctaaaagtatgg

SEQ ID NO: 56044 - DNA, 25 bp, Mus musculus
tccagatgagatcattcaggaagtc

SEQ ID NO: 56045 - DNA, 25 bp, Mus musculus
tccagatgagcttcccagccgtgga

SEQ ID NO: 56046 - DNA, 25 bp, Mus musculus
tccagatggcaaagtctgtagcaac

SEQ ID NO: 56047 - DNA, 25 bp, Mus musculus
tccagatgtgggaaaaatagtcccc

SEQ ID NO: 56048 - DNA, 25 bp, Mus musculus
tccagattacaacagatctcagata

SEQ ID NO: 56049 - DNA, 25 bp, Mus musculus
tccagattatgtcccttccatagtg

SEQ ID NO: 56050 - DNA, 25 bp, Mus musculus
tccagattgatgatgaatggcagca

SEQ ID NO: 56051 - DNA, 25 bp, Mus musculus
tccagcaaaagcacgggctccttgg

SEQ ID NO: 56052 - DNA, 25 bp, Mus musculus
tccagcaactggaggccctgctgct

SEQ ID NO: 56053 - DNA, 25 bp, Mus musculus
tccagcaagactagaagagcaggaa

SEQ ID NO: 56054 - DNA, 25 bp, Mus musculus
tccagcaagtttgttcaagattggc

SEQ ID NO: 56055 - DNA, 25 bp, Mus musculus
tccagcacaacgtgcccgtggacga

SEQ ID NO: 56056 - DNA, 25 bp, Mus musculus
tccagcagaatcagggacaatgccc

SEQ ID NO: 56057 - DNA, 25 bp, Mus musculus
tccagcagaccataagggacaacct

SEQ ID NO: 56058 - DNA, 25 bp, Mus musculus
tccagcagctatatcactgggactg

SEQ ID NO: 56059 - DNA, 25 bp, Mus musculus
tccagcaggctctggtctactggct

SEQ ID NO: 56060 - DNA, 25 bp, Mus musculus
tccagcaggctggttctgagaccac

SEQ ID NO: 56061 - DNA, 25 bp, Mus musculus
tccagcaggttaaccaggaaaagca

SEQ ID NO: 56062 - DNA, 25 bp, Mus musculus
tccagcatctgctgcagtggctgat

SEQ ID NO: 56063 - DNA, 25 bp, Mus musculus
tccagcatgagaaggagggttacac

SEQ ID NO: 56064 - DNA, 25 bp, Mus musculus
tccagcatgtctacatttcttgaaa

SEQ ID NO: 56065 - DNA, 25 bp, Mus musculus
tccagccatgtctgcaggtgccgtc

SEQ ID NO: 56066 - DNA, 25 bp, Mus musculus
tccagcccagaatcacgattcgtca

SEQ ID NO: 56067 - DNA, 25 bp, Mus musculus
tccagccgagcaggaccctatgaag

SEQ ID NO: 56068 - DNA, 25 bp, Mus musculus
tccagcctcaccaagtcttatctga

SEQ ID NO: 56069 - DNA, 25 bp, Mus musculus
tccagcctgatgagcgaagaagcaa

SEQ ID NO: 56070 - DNA, 25 bp, Mus musculus
tccagcctggatgctcacgaagaga

SEQ ID NO: 56071 - DNA, 25 bp, Mus musculus
tccagcctgtacctccttggagttc

SEQ ID NO: 56072 - DNA, 25 bp, Mus musculus
tccagcctgtgcctgaacggtggca

SEQ ID NO: 56073 - DNA, 25 bp, Mus musculus
tccagccttccttttggaggagtgg

SEQ ID NO: 56074 - DNA, 25 bp, Mus musculus
tccagccttttgtctacccagtctg

SEQ ID NO: 56075 - DNA, 25 bp, Mus musculus
tccagcgatgagtcattcgccatga

SEQ ID NO: 56076 - DNA, 25 bp, Mus musculus
tccagcggagcctctgatcctggcg

SEQ ID NO: 56077 - DNA, 25 bp, Mus musculus
tccagcgggcttgcatgatcagaag

SEQ ID NO: 56078 - DNA, 25 bp, Mus musculus
tccagcggtggctctttctgtggtc

SEQ ID NO: 56079 - DNA, 25 bp, Mus musculus
tccagcgtgtaggaataatacctcc

SEQ ID NO: 56080 - DNA, 25 bp, Mus musculus
tccagctccagagaacgtgcagagg

SEQ ID NO: 56081 - DNA, 25 bp, Mus musculus
tccagctccagatgaaccagggtag

SEQ ID NO: 56082 - DNA, 25 bp, Mus musculus
tccagctgaaagaggccaagcacat

SEQ ID NO: 56083 - DNA, 25 bp, Mus musculus
tccagctgaacggatgctaacatct

SEQ ID NO: 56084 - DNA, 25 bp, Mus musculus
tccagctgcaacctatttcaggaca

SEQ ID NO: 56085 - DNA, 25 bp, Mus musculus
tccagctggaggaattcagccacat

SEQ ID NO: 56086 - DNA, 25 bp, Mus musculus
tccagctggctgcagaattcgggct

SEQ ID NO: 56087 - DNA, 25 bp, Mus musculus
tccagctggtcaatggcaccatgtg

SEQ ID NO: 56088 - DNA, 25 bp, Mus musculus
tccagctggtcattggcaccatgtg

SEQ ID NO: 56089 - DNA, 25 bp, Mus musculus
tccagctgtttggtagctgcactag

SEQ ID NO: 56090 - DNA, 25 bp, Mus musculus
tccagcttcaagagacgtaagtcct

SEQ ID NO: 56091 - DNA, 25 bp, Mus musculus
tccagcttctctgtggatacacaag

SEQ ID NO: 56092 - DNA, 25 bp, Mus musculus
tccagcttgaccatgccaataccaa

SEQ ID NO: 56093 - DNA, 25 bp, Mus musculus
tccagcttgaccttgccaataccaa

SEQ ID NO: 56094 - DNA, 25 bp, Mus musculus
tccagcttttgctccggagagttgt

SEQ ID NO: 56095 - DNA, 25 bp, Mus musculus
tccaggaatctgaaagagatgatgt

SEQ ID NO: 56096 - DNA, 25 bp, Mus musculus
tccaggaatgcatgacatcctctgc

SEQ ID NO: 56097 - DNA, 25 bp, Mus musculus
tccaggacagtgctaaagtgactca

SEQ ID NO: 56098 - DNA, 25 bp, Mus musculus
tccaggacatgaaaccctttggtgt

SEQ ID NO: 56099 - DNA, 25 bp, Mus musculus
tccaggacatgactcaacggtgcac

SEQ ID NO: 56100 - DNA, 25 bp, Mus musculus
tccaggaccagtatggcgagttctc

SEQ ID NO: 56101 - DNA, 25 bp, Mus musculus
tccaggaccgggtgttaagccctag

SEQ ID NO: 56102 - DNA, 25 bp, Mus musculus
tccaggactctggatactgtctgcc

SEQ ID NO: 56103 - DNA, 25 bp, Mus musculus
tccaggactgggatttccctccacg

SEQ ID NO: 56104 - DNA, 25 bp, Mus musculus
tccaggactgggttttccctccacg

SEQ ID NO: 56105 - DNA, 25 bp, Mus musculus
tccaggacttacaaagacagcctgt

SEQ ID NO: 56106 - DNA, 25 bp, Mus musculus
tccaggagagaatctcgaggccgcg

SEQ ID NO: 56107 - DNA, 25 bp, Mus musculus
tccaggagcatgtatgaaaaccgac

SEQ ID NO: 56108 - DNA, 25 bp, Mus musculus
tccaggagctgactgcctatcatcc

SEQ ID NO: 56109 - DNA, 25 bp, Mus musculus
tccaggaggatgtgagccacctaag

SEQ ID NO: 56110 - DNA, 25 bp, Mus musculus
tccaggagtgaaggcatgatgcaga

SEQ ID NO: 56111 - DNA, 25 bp, Mus musculus
tccaggagtgggttatgaatcaagc

SEQ ID NO: 56112 - DNA, 25 bp, Mus musculus
tccaggatagaaaaacaagggctac

SEQ ID NO: 56113 - DNA, 25 bp, Mus musculus
tccaggatatcttggctaatggctg

SEQ ID NO: 56114 - DNA, 25 bp, Mus musculus
tccaggatccacacagttactactg

SEQ ID NO: 56115 - DNA, 25 bp, Mus musculus
tccaggatgaaagcggtggagacaa

SEQ ID NO: 56116 - DNA, 25 bp, Mus musculus
tccaggatgcctggtccatgggcac

SEQ ID NO: 56117 - DNA, 25 bp, Mus musculus
tccaggcaagaagagccttggactt

SEQ ID NO: 56118 - DNA, 25 bp, Mus musculus
tccaggcatggagcagatagttctg

SEQ ID NO: 56119 - DNA, 25 bp, Mus musculus
tccaggccaaccaatccacattgtg

SEQ ID NO: 56120 - DNA, 25 bp, Mus musculus
tccaggccaacctatccacattgtg

SEQ ID NO: 56121 - DNA, 25 bp, Mus musculus
tccaggccacagacatggatggaga

SEQ ID NO: 56122 - DNA, 25 bp, Mus musculus
tccaggccctgttcctagaggccgt

SEQ ID NO: 56123 - DNA, 25 bp, Mus musculus
tccaggccgctctgaaaaagctgaa

SEQ ID NO: 56124 - DNA, 25 bp, Mus musculus
tccaggctgagtaacgtgtcccagt

SEQ ID NO: 56125 - DNA, 25 bp, Mus musculus
tccaggctggacactctgtgcccag

SEQ ID NO: 56126 - DNA, 25 bp, Mus musculus
tccaggctgtggtcgaagtctgccg

SEQ ID NO: 56127 - DNA, 25 bp, Mus musculus
tccaggcttactgagaagagtctcg

SEQ ID NO: 56128 - DNA, 25 bp, Mus musculus
tccaggcttgcattgactgtgctta

SEQ ID NO: 56129 - DNA, 25 bp, Mus musculus
tccaggctttcgattagcacttcct

SEQ ID NO: 56130 - DNA, 25 bp, Mus musculus
tccagggaaatgaaggacctattga

SEQ ID NO: 56131 - DNA, 25 bp, Mus musculus
tccagggagcactgatgatatattt

SEQ ID NO: 56132 - DNA, 25 bp, Mus musculus
tccagggatcaagtccagaggctcc

SEQ ID NO: 56133 - DNA, 25 bp, Mus musculus
tccagggattcccacatcaaagaaa

SEQ ID NO: 56134 - DNA, 25 bp, Mus musculus
tccagggctatgttcgaatctcagg

SEQ ID NO: 56135 - DNA, 25 bp, Mus musculus
tccagggtcaacaagcagctgcatc

SEQ ID NO: 56136 - DNA, 25 bp, Mus musculus
tccagggtcacgatgtagctgcatc

SEQ ID NO: 56137 - DNA, 25 bp, Mus musculus
tccagggtccagtggaggtgacatc

SEQ ID NO: 56138 - DNA, 25 bp, Mus musculus
tccagggtcttcgtcgaaaggtcca

SEQ ID NO: 56139 - DNA, 25 bp, Mus musculus
tccagggtgttggaagtaaaaggct

SEQ ID NO: 56140 - DNA, 25 bp, Mus musculus
tccagggttcaagatatcaagtatg

SEQ ID NO: 56141 - DNA, 25 bp, Mus musculus
tccaggtaaaggaaagccgcatccg

SEQ ID NO: 56142 - DNA, 25 bp, Mus musculus
tccaggtccccatggtggcaggttc

SEQ ID NO: 56143 - DNA, 25 bp, Mus musculus
tccaggtgattgtgaaagccagaag

SEQ ID NO: 56144 - DNA, 25 bp, Mus musculus
tccaggtggtaatgagcccgctgct

SEQ ID NO: 56145 - DNA, 25 bp, Mus musculus
tccaggtggtccatgaaagacacaa

SEQ ID NO: 56146 - DNA, 25 bp, Mus musculus
tccaggttaaaagagaggcaaagaa

SEQ ID NO: 56147 - DNA, 25 bp, Mus musculus
tccaggttggactggtggttcatca

SEQ ID NO: 56148 - DNA, 25 bp, Mus musculus
tccaggtttattgctgctggaagac

SEQ ID NO: 56149 - DNA, 25 bp, Mus musculus
tccaggtttcataatgcagggcaat

SEQ ID NO: 56150 - DNA, 25 bp, Mus musculus
tccagtaaacaaacagttggaagga

SEQ ID NO: 56151 - DNA, 25 bp, Mus musculus
tccagtaaggtggactgcaccggaa

SEQ ID NO: 56152 - DNA, 25 bp, Mus musculus
tccagtacctcctgtacctatggca

SEQ ID NO: 56153 - DNA, 25 bp, Mus musculus
tccagtaccttgattcagagagaag

SEQ ID NO: 56154 - DNA, 25 bp, Mus musculus
tccagtactatgacagggactacag

SEQ ID NO: 56155 - DNA, 25 bp, Mus musculus
tccagtactatgtcagggactacag

SEQ ID NO: 56156 - DNA, 25 bp, Mus musculus
tccagtagaacgatagctccctccg

SEQ ID NO: 56157 - DNA, 25 bp, Mus musculus
tccagtagatcacatcttggcaggt

SEQ ID NO: 56158 - DNA, 25 bp, Mus musculus
tccagtatatcttcaacgatgaccc

SEQ ID NO: 56159 - DNA, 25 bp, Mus musculus
tccagtatgaatctagagcacaaat

SEQ ID NO: 56160 - DNA, 25 bp, Mus musculus
tccagtatttcctttggatactcag

SEQ ID NO: 56161 - DNA, 25 bp, Mus musculus
tccagtcaaagcatgaagcttcccc

SEQ ID NO: 56162 - DNA, 25 bp, Mus musculus
tccagtcaagtggatggctcctgaa

SEQ ID NO: 56163 - DNA, 25 bp, Mus musculus
tccagtcagccgcaaagaaccatag

SEQ ID NO: 56164 - DNA, 25 bp, Mus musculus
tccagtcagctaccctcttagcaga

SEQ ID NO: 56165 - DNA, 25 bp, Mus musculus
tccagtcagggacccaagagtctgc

SEQ ID NO: 56166 - DNA, 25 bp, Mus musculus
tccagtcatccacagagcaatgcag

SEQ ID NO: 56167 - DNA, 25 bp, Mus musculus
tccagtcatccggacattggtcgtg

SEQ ID NO: 56168 - DNA, 25 bp, Mus musculus
tccagtcattgtcctggagaaccag

SEQ ID NO: 56169 - DNA, 25 bp, Mus musculus
tccagtccctgctatcaatggagca

SEQ ID NO: 56170 - DNA, 25 bp, Mus musculus
tccagtccttcgacccgtgacgttt

SEQ ID NO: 56171 - DNA, 25 bp, Mus musculus
tccagtcggatgtggtcgtgcctgt

SEQ ID NO: 56172 - DNA, 25 bp, Mus musculus
tccagtcggcttgtgttgtcatgtg

SEQ ID NO: 56173 - DNA, 25 bp, Mus musculus
tccagtctcgacaacagcgcatttc

SEQ ID NO: 56174 - DNA, 25 bp, Mus musculus
tccagtcttctggtatctctccagt

SEQ ID NO: 56175 - DNA, 25 bp, Mus musculus
tccagtcttgacattcttcagggct

SEQ ID NO: 56176 - DNA, 25 bp, Mus musculus
tccagtgaaggaaacaatcaagtgg

SEQ ID NO: 56177 - DNA, 25 bp, Mus musculus
tccagtgagcggcaaactgatgcac

SEQ ID NO: 56178 - DNA, 25 bp, Mus musculus
tccagtgagggcatcctggatgacc

SEQ ID NO: 56179 - DNA, 25 bp, Mus musculus
tccagtgatggcaatcagagacaag

SEQ ID NO: 56180 - DNA, 25 bp, Mus musculus
tccagtgcaagtaggatgtttagca

SEQ ID NO: 56181 - DNA, 25 bp, Mus musculus
tccagtgcagccaagcatagtgtcg

SEQ ID NO: 56182 - DNA, 25 bp, Mus musculus
tccagtgcctattctacagccaaat

SEQ ID NO: 56183 - DNA, 25 bp, Mus musculus
tccagtgcctcaaggaagcagcagt

SEQ ID NO: 56184 - DNA, 25 bp, Mus musculus
tccagtgcgctgtagatgtgaaacg

SEQ ID NO: 56185 - DNA, 25 bp, Mus musculus
tccagtgcttcagccgctgtcatag

SEQ ID NO: 56186 - DNA, 25 bp, Mus musculus
tccagtggaacccttgcctgggttt

SEQ ID NO: 56187 - DNA, 25 bp, Mus musculus
tccagtggcctggaggaatggacta

SEQ ID NO: 56188 - DNA, 25 bp, Mus musculus
tccagtggcggattcgaaatctccc

SEQ ID NO: 56189 - DNA, 25 bp, Mus musculus
tccagtggctgatccctgacagtgc

SEQ ID NO: 56190 - DNA, 25 bp, Mus musculus
tccagtggtttgtgcttagagacaa

SEQ ID NO: 56191 - DNA, 25 bp, Mus musculus
tccagtgtgatgcatgtaaagcctt

SEQ ID NO: 56192 - DNA, 25 bp, Mus musculus
tccagtgtgtgaacctcaagctcct

SEQ ID NO: 56193 - DNA, 25 bp, Mus musculus
tccagtgtgtgatcaatgctatgtt

SEQ ID NO: 56194 - DNA, 25 bp, Mus musculus
tccagttagactgtagtcaggtggc

SEQ ID NO: 56195 - DNA, 25 bp, Mus musculus
tccagttccaaaaccaaagtggtgg

SEQ ID NO: 56196 - DNA, 25 bp, Mus musculus
tccagttccactcccgaattctgga

SEQ ID NO: 56197 - DNA, 25 bp, Mus musculus
tccagttgcctctaacttcagcaag

SEQ ID NO: 56198 - DNA, 25 bp, Mus musculus
tccagttgtagaaggcctgacagag

SEQ ID NO: 56199 - DNA, 25 bp, Mus musculus
tccagtttcccttgtgggaatcctt

SEQ ID NO: 56200 - DNA, 25 bp, Mus musculus
tccagttttctggtggtctccagcg

SEQ ID NO: 56201 - DNA, 25 bp, Mus musculus
tccataaagttcagtgtagcgtcag

SEQ ID NO: 56202 - DNA, 25 bp, Mus musculus
tccataacccagtggacgggattaa

SEQ ID NO: 56203 - DNA, 25 bp, Mus musculus
tccataactggagtgaaagacgcca

SEQ ID NO: 56204 - DNA, 25 bp, Mus musculus
tccataagacagcatctggcatcta

SEQ ID NO: 56205 - DNA, 25 bp, Mus musculus
tccataagcagattgctgtcatgag

SEQ ID NO: 56206 - DNA, 25 bp, Mus musculus
tccataaggccagatgaacttgagt

SEQ ID NO: 56207 - DNA, 25 bp, Mus musculus
tccatacacgaaagagcaaccggcg

SEQ ID NO: 56208 - DNA, 25 bp, Mus musculus
tccatacacgaatgagcaaccggcg

SEQ ID NO: 56209 - DNA, 25 bp, Mus musculus
tccataccggcagcggcgtttcccg

SEQ ID NO: 56210 - DNA, 25 bp, Mus musculus
tccatagccaagagccgaaggagcc

SEQ ID NO: 56211 - DNA, 25 bp, Mus musculus
tccatagggaggacgctccatgtcc

SEQ ID NO: 56212 - DNA, 25 bp, Mus musculus
tccatagtacctatgaggatgaatg

SEQ ID NO: 56213 - DNA, 25 bp, Mus musculus
tccatagtacctttgaggatgaatg

SEQ ID NO: 56214 - DNA, 25 bp, Mus musculus
tccatagtgatagcctccaagagtt

SEQ ID NO: 56215 - DNA, 25 bp, Mus musculus
tccatatatcctggttctgcctcag

SEQ ID NO: 56216 - DNA, 25 bp, Mus musculus
tccatatgcctctcaatgggacgga

SEQ ID NO: 56217 - DNA, 25 bp, Mus musculus
tccatatttgccagcattgtcacct

SEQ ID NO: 56218 - DNA, 25 bp, Mus musculus
tccatcaagccgtacagagtatact

SEQ ID NO: 56219 - DNA, 25 bp, Mus musculus
tccatcaagctctgcttcacacggg

SEQ ID NO: 56220 - DNA, 25 bp, Mus musculus
tccatcaccacctgggagattctgg

SEQ ID NO: 56221 - DNA, 25 bp, Mus musculus
tccatcaccgtttttgaaaaatcgt

SEQ ID NO: 56222 - DNA, 25 bp, Mus musculus
tccatcacctaccagcacgacttgg

SEQ ID NO: 56223 - DNA, 25 bp, Mus musculus
tccatcagacccagggcaatcggag

SEQ ID NO: 56224 - DNA, 25 bp, Mus musculus
tccatcagacgcttcatatatgtga

SEQ ID NO: 56225 - DNA, 25 bp, Mus musculus
tccatcaggaaggagctaaaatggc

SEQ ID NO: 56226 - DNA, 25 bp, Mus musculus
tccatcaggtgcaaaggataactcg

SEQ ID NO: 56227 - DNA, 25 bp, Mus musculus
tccatcagtgagctccaaagaatga

SEQ ID NO: 56228 - DNA, 25 bp, Mus musculus
tccatcataagcgagtatgaagagg

SEQ ID NO: 56229 - DNA, 25 bp, Mus musculus
tccatccactcccagagtcatgagt

SEQ ID NO: 56230 - DNA, 25 bp, Mus musculus
tccatccactccgagagtcatgagt

SEQ ID NO: 56231 - DNA, 25 bp, Mus musculus
tccatccagtgttcggttccaagtg

SEQ ID NO: 56232 - DNA, 25 bp, Mus musculus
tccatccggataggtagcactgggc

SEQ ID NO: 56233 - DNA, 25 bp, Mus musculus
tccatcctggaaacttgataatcaa

SEQ ID NO: 56234 - DNA, 25 bp, Mus musculus
tccatcctggaagaacagtttccca

SEQ ID NO: 56235 - DNA, 25 bp, Mus musculus
tccatcctggacatctccatgatga

SEQ ID NO: 56236 - DNA, 25 bp, Mus musculus
tccatcctttatccatagccagaag

SEQ ID NO: 56237 - DNA, 25 bp, Mus musculus
tccatcgccagccagcatcatgatg

SEQ ID NO: 56238 - DNA, 25 bp, Mus musculus
tccatcggaacagtgctgtgtggcc

SEQ ID NO: 56239 - DNA, 25 bp, Mus musculus
tccatctggactggagccaacaagc

SEQ ID NO: 56240 - DNA, 25 bp, Mus musculus
tccatctgggagagaagacatacca

SEQ ID NO: 56241 - DNA, 25 bp, Mus musculus
tccatcttcgacaacgaggaggaca

SEQ ID NO: 56242 - DNA, 25 bp, Mus musculus
tccatgaaacgttcccggtgctttc

SEQ ID NO: 56243 - DNA, 25 bp, Mus musculus
tccatgaaagacacaagaagtaccg

SEQ ID NO: 56244 - DNA, 25 bp, Mus musculus
tccatgaacagcagaccctgaaggg

SEQ ID NO: 56245 - DNA, 25 bp, Mus musculus
tccatgaatttgatgaacaagtagc

SEQ ID NO: 56246 - DNA, 25 bp, Mus musculus
tccatgacagcttactaccagccaa

SEQ ID NO: 56247 - DNA, 25 bp, Mus musculus
tccatgacagtatttctgaagaagg

SEQ ID NO: 56248 - DNA, 25 bp, Mus musculus
tccatgacccaagatgactacaaac

SEQ ID NO: 56249 - DNA, 25 bp, Mus musculus
tccatgagccagaaagaggcaaatt

SEQ ID NO: 56250 - DNA, 25 bp, Mus musculus
tccatgagctttcccgagacaagga

SEQ ID NO: 56251 - DNA, 25 bp, Mus musculus
tccatgatcaggtgggagtaatcca

SEQ ID NO: 56252 - DNA, 25 bp, Mus musculus
tccatgatgggtggcaaagacttcg

SEQ ID NO: 56253 - DNA, 25 bp, Mus musculus
tccatgattcccatcatgacagaag

SEQ ID NO: 56254 - DNA, 25 bp, Mus musculus
tccatgcacatttgaccaagagcag

SEQ ID NO: 56255 - DNA, 25 bp, Mus musculus
tccatgcagcagaagctagctggcc

SEQ ID NO: 56256 - DNA, 25 bp, Mus musculus
tccatgcatgaccagtgaagaaatg

SEQ ID NO: 56257 - DNA, 25 bp, Mus musculus
tccatgccagaaacaagcctgtgaa

SEQ ID NO: 56258 - DNA, 25 bp, Mus musculus
tccatgccagctgtcaacattcagt

SEQ ID NO: 56259 - DNA, 25 bp, Mus musculus
tccatgcgatcgtgcctggagcact

SEQ ID NO: 56260 - DNA, 25 bp, Mus musculus
tccatgcggaatctctgctcctcga

SEQ ID NO: 56261 - DNA, 25 bp, Mus musculus
tccatgcgggatgagaagctgtgcc

SEQ ID NO: 56262 - DNA, 25 bp, Mus musculus
tccatgcggtctaacctctatcggg

SEQ ID NO: 56263 - DNA, 25 bp, Mus musculus
tccatgctgagacactctccactga

SEQ ID NO: 56264 - DNA, 25 bp, Mus musculus
tccatgctggatgagagcagcctct

SEQ ID NO: 56265 - DNA, 25 bp, Mus musculus
tccatggacaaaactgaaaacacag

SEQ ID NO: 56266 - DNA, 25 bp, Mus musculus
tccatggacatgtttcacagctgtt

SEQ ID NO: 56267 - DNA, 25 bp, Mus musculus
tccatggacgaagtgcagagtcaca

SEQ ID NO: 56268 - DNA, 25 bp, Mus musculus
tccatggcctatgccaagctgatgc

SEQ ID NO: 56269 - DNA, 25 bp, Mus musculus
tccatggcgtgtggtgggagagcgt

SEQ ID NO: 56270 - DNA, 25 bp, Mus musculus
tccatggctggaatgatatatactg

SEQ ID NO: 56271 - DNA, 25 bp, Mus musculus
tccatggctttgcaccttgcacgac

SEQ ID NO: 56272 - DNA, 25 bp, Mus musculus
tccatggtttctgagtgtctgttct

SEQ ID NO: 56273 - DNA, 25 bp, Mus musculus
tccatgtaagtctgaccagtcaaag

SEQ ID NO: 56274 - DNA, 25 bp, Mus musculus
tccatgtactacaatgtcatcaatg

SEQ ID NO: 56275 - DNA, 25 bp, Mus musculus
tccatgtatctgtcagctaaagggc

SEQ ID NO: 56276 - DNA, 25 bp, Mus musculus
tccatgtctcaactgaagaatgtgg

SEQ ID NO: 56277 - DNA, 25 bp, Mus musculus
tccatgtctcctctaggtcagcgag

SEQ ID NO: 56278 - DNA, 25 bp, Mus musculus
tccatgtgctggagacctcagaccg

SEQ ID NO: 56279 - DNA, 25 bp, Mus musculus
tccatgtgggctgtcactatggaaa

SEQ ID NO: 56280 - DNA, 25 bp, Mus musculus
tccatgtgtaaatatccctgcctct

SEQ ID NO: 56281 - DNA, 25 bp, Mus musculus
tccatgttcgcgattggcttttgtt

SEQ ID NO: 56282 - DNA, 25 bp, Mus musculus
tccatgttgctgtcttcatgggaca

SEQ ID NO: 56283 - DNA, 25 bp, Mus musculus
tccatgttgtggtactgcaaggctg

SEQ ID NO: 56284 - DNA, 25 bp, Mus musculus
tccattactaatgccaagaagaggg

SEQ ID NO: 56285 - DNA, 25 bp, Mus musculus
tccattagagcgctaatcaagagat

SEQ ID NO: 56286 - DNA, 25 bp, Mus musculus
tccattagagcggtaatcaagagat

SEQ ID NO: 56287 - DNA, 25 bp, Mus musculus
tccattagaggacacactggttaaa

SEQ ID NO: 56288 - DNA, 25 bp, Mus musculus
tccattatgatgtgctgaagcccta

SEQ ID NO: 56289 - DNA, 25 bp, Mus musculus
tccattatggacctttccagggaac

SEQ ID NO: 56290 - DNA, 25 bp, Mus musculus
tccattatggtagcctatgacgccc

SEQ ID NO: 56291 - DNA, 25 bp, Mus musculus
tccattcaagagtggactcgttaga

SEQ ID NO: 56292 - DNA, 25 bp, Mus musculus
tccattcactccttattttcggagg

SEQ ID NO: 56293 - DNA, 25 bp, Mus musculus
tccattcagcattcgattagcatgc

SEQ ID NO: 56294 - DNA, 25 bp, Mus musculus
tccattccggatccacagtcaaagg

SEQ ID NO: 56295 - DNA, 25 bp, Mus musculus
tccattccgtggaagacagacacaa

SEQ ID NO: 56296 - DNA, 25 bp, Mus musculus
tccattctaaaggtgccaggaacaa

SEQ ID NO: 56297 - DNA, 25 bp, Mus musculus
tccattctggaaaaagccaaggact

SEQ ID NO: 56298 - DNA, 25 bp, Mus musculus
tccattcttggaccgggcgattctg

SEQ ID NO: 56299 - DNA, 25 bp, Mus musculus
tccattgacaatttgccagcacagc

SEQ ID NO: 56300 - DNA, 25 bp, Mus musculus
tccattgacggtggcccagaaaaaa

SEQ ID NO: 56301 - DNA, 25 bp, Mus musculus
tccattgatgaatcggaaaatgccg

SEQ ID NO: 56302 - DNA, 25 bp, Mus musculus
tccattgcaaagacctgcgggtgct

SEQ ID NO: 56303 - DNA, 25 bp, Mus musculus
tccattggagatgggcagtacaagc

SEQ ID NO: 56304 - DNA, 25 bp, Mus musculus
tccattgtctccgttacagtcagtt

SEQ ID NO: 56305 - DNA, 25 bp, Mus musculus
tccatttcgggcttcgcgcacagct

SEQ ID NO: 56306 - DNA, 25 bp, Mus musculus
tccatttgcaacttatccccaacag

SEQ ID NO: 56307 - DNA, 25 bp, Mus musculus
tccatttgctcccaagacggactct

SEQ ID NO: 56308 - DNA, 25 bp, Mus musculus
tccattttgacagtgccagcagaag

SEQ ID NO: 56309 - DNA, 25 bp, Mus musculus
tcccaaaagaggctacacagagatg

SEQ ID NO: 56310 - DNA, 25 bp, Mus musculus
tcccaaaagtgctccgatgtgtctg

SEQ ID NO: 56311 - DNA, 25 bp, Mus musculus
tcccaaagaagagaggacggaagcc

SEQ ID NO: 56312 - DNA, 25 bp, Mus musculus
tcccaaagatcatctgaagaaggct

SEQ ID NO: 56313 - DNA, 25 bp, Mus musculus
tcccaaagtatgtggagttctccaa

SEQ ID NO: 56314 - DNA, 25 bp, Mus musculus
tcccaaataatctgctcttgccatg

SEQ ID NO: 56315 - DNA, 25 bp, Mus musculus
tcccaaatcttcagctaaggaacca

SEQ ID NO: 56316 - DNA, 25 bp, Mus musculus
tcccaacatttgacacacaaaggca

SEQ ID NO: 56317 - DNA, 25 bp, Mus musculus
tcccaaccagaacaaaaacatggct

SEQ ID NO: 56318 - DNA, 25 bp, Mus musculus
tcccaactactacaaaggaaagtgt

SEQ ID NO: 56319 - DNA, 25 bp, Mus musculus
tcccaactactagaaaggaaagtgt

SEQ ID NO: 56320 - DNA, 25 bp, Mus musculus
tcccaactcggctgttccttttgat

SEQ ID NO: 56321 - DNA, 25 bp, Mus musculus
tcccaactgggccaagagttgcttg

SEQ ID NO: 56322 - DNA, 25 bp, Mus musculus
tcccaactgtcaatatcctacgaca

SEQ ID NO: 56323 - DNA, 25 bp, Mus musculus
tcccaacttccttctaggagtggaa

SEQ ID NO: 56324 - DNA, 25 bp, Mus musculus
tcccaagaaatgttttgaaggtgaa

SEQ ID NO: 56325 - DNA, 25 bp, Mus musculus
tcccaagacagaattatggtacttc

SEQ ID NO: 56326 - DNA, 25 bp, Mus musculus
tcccaagacatcacagagggaagct

SEQ ID NO: 56327 - DNA, 25 bp, Mus musculus
tcccaagagatgagccaaggatgtg

SEQ ID NO: 56328 - DNA, 25 bp, Mus musculus
tcccaagagccggaaagagtcggcc

SEQ ID NO: 56329 - DNA, 25 bp, Mus musculus
tcccaagagttcctccgagagtatg

SEQ ID NO: 56330 - DNA, 25 bp, Mus musculus
tcccaagagttcctgtttctcctgt

SEQ ID NO: 56331 - DNA, 25 bp, Mus musculus
tcccaagcactgtcaggaattcctt

SEQ ID NO: 56332 - DNA, 25 bp, Mus musculus
tcccaagcagtattgaagatatatt

SEQ ID NO: 56333 - DNA, 25 bp, Mus musculus
tcccaagctggaccgcagtgatggc

SEQ ID NO: 56334 - DNA, 25 bp, Mus musculus
tcccaaggagcaatacatggaagca

SEQ ID NO: 56335 - DNA, 25 bp, Mus musculus
tcccaaggatgttgagaaggagctg

SEQ ID NO: 56336 - DNA, 25 bp, Mus musculus
tcccaaggcttgattgcatctttat

SEQ ID NO: 56337 - DNA, 25 bp, Mus musculus
tcccaagtcggagccaatgtgcagt

SEQ ID NO: 56338 - DNA, 25 bp, Mus musculus
tcccaagtgtccttcgagataccac

SEQ ID NO: 56339 - DNA, 25 bp, Mus musculus
tcccaatgaggagaagcagcacgag

SEQ ID NO: 56340 - DNA, 25 bp, Mus musculus
tcccacacataagaatggacgatgg

SEQ ID NO: 56341 - DNA, 25 bp, Mus musculus
tcccacacttctgctgatgacaaga

SEQ ID NO: 56342 - DNA, 25 bp, Mus musculus
tcccacagagaaaatcccaggctca

SEQ ID NO: 56343 - DNA, 25 bp, Mus musculus
tcccacagagctggttgtggaccat

SEQ ID NO: 56344 - DNA, 25 bp, Mus musculus
tcccacagcaagctaaacaagaagg

SEQ ID NO: 56345 - DNA, 25 bp, Mus musculus
tcccacaggcaagatgacaacaaca

SEQ ID NO: 56346 - DNA, 25 bp, Mus musculus
tcccacattgaaaccgattcccaag

SEQ ID NO: 56347 - DNA, 25 bp, Mus musculus
tcccacattgagaattggcattcaa

SEQ ID NO: 56348 - DNA, 25 bp, Mus musculus
tcccaccgtggacctgaaccgagtg

SEQ ID NO: 56349 - DNA, 25 bp, Mus musculus
tcccaccgtggaggtggatctctat

SEQ ID NO: 56350 - DNA, 25 bp, Mus musculus
tcccaccttcaacaggacgaataaa

SEQ ID NO: 56351 - DNA, 25 bp, Mus musculus
tcccacggaagaactcaatgaggtt

SEQ ID NO: 56352 - DNA, 25 bp, Mus musculus
tcccacggaagatctcaatgaggtt

SEQ ID NO: 56353 - DNA, 25 bp, Mus musculus
tcccacggacacaagtagaaaaaag

SEQ ID NO: 56354 - DNA, 25 bp, Mus musculus
tcccacgtcggaagggccttgcact

SEQ ID NO: 56355 - DNA, 25 bp, Mus musculus
tcccacgtgatctgagcgacactct

SEQ ID NO: 56356 - DNA, 25 bp, Mus musculus
tcccactcctgaggtttggctctgg

SEQ ID NO: 56357 - DNA, 25 bp, Mus musculus
tcccactgacattggaccgggatgg

SEQ ID NO: 56358 - DNA, 25 bp, Mus musculus
tcccactgccccagtggaaagctaa

SEQ ID NO: 56359 - DNA, 25 bp, Mus musculus
tcccagaaaactaagaacaagccag

SEQ ID NO: 56360 - DNA, 25 bp, Mus musculus
tcccagaaaagtgaatcctgaaggt

SEQ ID NO: 56361 - DNA, 25 bp, Mus musculus
tcccagaaacgatgaatgaagtcct

SEQ ID NO: 56362 - DNA, 25 bp, Mus musculus
tcccagaaggctacatccctgaaca

SEQ ID NO: 56363 - DNA, 25 bp, Mus musculus
tcccagaaggtagcagccgaaggtt

SEQ ID NO: 56364 - DNA, 25 bp, Mus musculus
tcccagaatgacagctgcctacatc

SEQ ID NO: 56365 - DNA, 25 bp, Mus musculus
tcccagacctaaaaccacagcaagt

SEQ ID NO: 56366 - DNA, 25 bp, Mus musculus
tcccagacctaaaagcgatgacgag

SEQ ID NO: 56367 - DNA, 25 bp, Mus musculus
tcccagagaaagtgaggcctaaacc

SEQ ID NO: 56368 - DNA, 25 bp, Mus musculus
tcccagagatgtccagtcatccgga

SEQ ID NO: 56369 - DNA, 25 bp, Mus musculus
tcccagaggtacaaggagtgatcct

SEQ ID NO: 56370 - DNA, 25 bp, Mus musculus
tcccagatcatacaacagacttact

SEQ ID NO: 56371 - DNA, 25 bp, Mus musculus
tcccagatctgccagagtccttgga

SEQ ID NO: 56372 - DNA, 25 bp, Mus musculus
tcccagatgaagatggcaatcacag

SEQ ID NO: 56373 - DNA, 25 bp, Mus musculus
tcccagatgctaagattagagctac

SEQ ID NO: 56374 - DNA, 25 bp, Mus musculus
tcccagattggctgttggaatgctt

SEQ ID NO: 56375 - DNA, 25 bp, Mus musculus
tcccagcaagtgaaggaacacagga

SEQ ID NO: 56376 - DNA, 25 bp, Mus musculus
tcccagcattgcttcagggattgtt

SEQ ID NO: 56377 - DNA, 25 bp, Mus musculus
tcccagcatttatgaacatgaagat

SEQ ID NO: 56378 - DNA, 25 bp, Mus musculus
tcccagccaagccagctgaagaagc

SEQ ID NO: 56379 - DNA, 25 bp, Mus musculus
tcccagccatcatgtctatagagaa

SEQ ID NO: 56380 - DNA, 25 bp, Mus musculus
tcccagccgtgatgatgaatgcagg

SEQ ID NO: 56381 - DNA, 25 bp, Mus musculus
tcccagccgtggactgctgtctctg

SEQ ID NO: 56382 - DNA, 25 bp, Mus musculus
tcccagcgagaaagactgatcacag

SEQ ID NO: 56383 - DNA, 25 bp, Mus musculus
tcccagcgagaaggatggaaaggaa

SEQ ID NO: 56384 - DNA, 25 bp, Mus musculus
tcccagcgctggtgaaaatgcttgg

SEQ ID NO: 56385 - DNA, 25 bp, Mus musculus
tcccagctctggaattccgagggta

SEQ ID NO: 56386 - DNA, 25 bp, Mus musculus
tcccagctgcctgaatggcttctga

SEQ ID NO: 56387 - DNA, 25 bp, Mus musculus
tcccagctgctacagtatgtgtaca

SEQ ID NO: 56388 - DNA, 25 bp, Mus musculus
tcccaggaaaccctgatcacaggga

SEQ ID NO: 56389 - DNA, 25 bp, Mus musculus
tcccaggaatgcaccaagtacaaag

SEQ ID NO: 56390 - DNA, 25 bp, Mus musculus
tcccaggagaacaatatgcaagccg

SEQ ID NO: 56391 - DNA, 25 bp, Mus musculus
tcccaggaggagtggatgttcctga

SEQ ID NO: 56392 - DNA, 25 bp, Mus musculus
tcccaggagggattagacccaggct

SEQ ID NO: 56393 - DNA, 25 bp, Mus musculus
tcccaggatttatgtcatcaggctt

SEQ ID NO: 56394 - DNA, 25 bp, Mus musculus
tcccaggccggtccaagatcacatt

SEQ ID NO: 56395 - DNA, 25 bp, Mus musculus
tcccaggctgggtaatggtgagccc

SEQ ID NO: 56396 - DNA, 25 bp, Mus musculus
tcccaggcttttccagaagtacccg

SEQ ID NO: 56397 - DNA, 25 bp, Mus musculus
tcccagggacctcgcaaagctttgt

SEQ ID NO: 56398 - DNA, 25 bp, Mus musculus
tcccagggacctggcaaagctttgt

SEQ ID NO: 56399 - DNA, 25 bp, Mus musculus
tcccagggagaacgtatgcagattc

SEQ ID NO: 56400 - DNA, 25 bp, Mus musculus
tcccagggatgctggttcccatgcc

SEQ ID NO: 56401 - DNA, 25 bp, Mus musculus
tcccagggtctcctctgagaatcat

SEQ ID NO: 56402 - DNA, 25 bp, Mus musculus
tcccaggtctttatgtatggacaca

SEQ ID NO: 56403 - DNA, 25 bp, Mus musculus
tcccaggtgatgtggacttacctgc

SEQ ID NO: 56404 - DNA, 25 bp, Mus musculus
tcccaggttactacagtgcagggct

SEQ ID NO: 56405 - DNA, 25 bp, Mus musculus
tcccagtatgggatggccagctcct

SEQ ID NO: 56406 - DNA, 25 bp, Mus musculus
tcccagtatgtagtgcaggcagact

SEQ ID NO: 56407 - DNA, 25 bp, Mus musculus
tcccagtcaaccgaggacattgttc

SEQ ID NO: 56408 - DNA, 25 bp, Mus musculus
tcccagtccctaagtagaagatctg

SEQ ID NO: 56409 - DNA, 25 bp, Mus musculus
tcccagtgaccatcaacaaattctt

SEQ ID NO: 56410 - DNA, 25 bp, Mus musculus
tcccagtgcctgtgtattctggccc

SEQ ID NO: 56411 - DNA, 25 bp, Mus musculus
tcccagtggcacaggctgatggcag

SEQ ID NO: 56412 - DNA, 25 bp, Mus musculus
tcccagttgtgctctgcttgctcct

SEQ ID NO: 56413 - DNA, 25 bp, Mus musculus
tcccagtttttgataaagctactaa

SEQ ID NO: 56414 - DNA, 25 bp, Mus musculus
tcccataacaactgctttcaagctc

SEQ ID NO: 56415 - DNA, 25 bp, Mus musculus
tcccatagctgaaactataaaggct

SEQ ID NO: 56416 - DNA, 25 bp, Mus musculus
tcccataggaaccaacgcagacatg

SEQ ID NO: 56417 - DNA, 25 bp, Mus musculus
tcccatcacgggtggattcaggcaa

SEQ ID NO: 56418 - DNA, 25 bp, Mus musculus
tcccatcagtatgagctcttgaagc

SEQ ID NO: 56419 - DNA, 25 bp, Mus musculus
tcccatctcaccataggagcactgg

SEQ ID NO: 56420 - DNA, 25 bp, Mus musculus
tcccatctctagagtcctttgtatc

SEQ ID NO: 56421 - DNA, 25 bp, Mus musculus
tcccatctctagtgtcctttgtatc

SEQ ID NO: 56422 - DNA, 25 bp, Mus musculus
tcccatctgtcagcagcacttaatt

SEQ ID NO: 56423 - DNA, 25 bp, Mus musculus
tcccatgaaggtgaaggcttaccag

SEQ ID NO: 56424 - DNA, 25 bp, Mus musculus
tcccatggactctgacactgttgcc

SEQ ID NO: 56425 - DNA, 25 bp, Mus musculus
tcccatggcctctagagtggtaaca

SEQ ID NO: 56426 - DNA, 25 bp, Mus musculus
tcccatgtctgtttgtctttacctg

SEQ ID NO: 56427 - DNA, 25 bp, Mus musculus
tcccattatggtggttctctgccca

SEQ ID NO: 56428 - DNA, 25 bp, Mus musculus
tcccattcagaggagatactctcct

SEQ ID NO: 56429 - DNA, 25 bp, Mus musculus
tcccattcctggaggctgcaatttg

SEQ ID NO: 56430 - DNA, 25 bp, Mus musculus
tcccattctcagtacctgaagttcc

SEQ ID NO: 56431 - DNA, 25 bp, Mus musculus
tcccattgtcttccgacctctagaa

SEQ ID NO: 56432 - DNA, 25 bp, Mus musculus
tcccatttactgtggatgcttgcgg

SEQ ID NO: 56433 - DNA, 25 bp, Mus musculus
tcccatttccaaacccgataactat

SEQ ID NO: 56434 - DNA, 25 bp, Mus musculus
tcccatttctctggctggagacaca

SEQ ID NO: 56435 - DNA, 25 bp, Mus musculus
tcccatttttcctctctgcggtgtc

SEQ ID NO: 56436 - DNA, 25 bp, Mus musculus
tccccaaaacggtatccactgtgtt

SEQ ID NO: 56437 - DNA, 25 bp, Mus musculus
tccccaaagaaaagtgctctttggc

SEQ ID NO: 56438 - DNA, 25 bp, Mus musculus
tccccaacaaggacattcgtggttc

SEQ ID NO: 56439 - DNA, 25 bp, Mus musculus
tccccaaggatccagtttacacttt

SEQ ID NO: 56440 - DNA, 25 bp, Mus musculus
tccccaaggccttgaccaagcatag

SEQ ID NO: 56441 - DNA, 25 bp, Mus musculus
tccccacagcattctgcattgagct

SEQ ID NO: 56442 - DNA, 25 bp, Mus musculus
tccccactagccctagtgactggag

SEQ ID NO: 56443 - DNA, 25 bp, Mus musculus
tccccactgatgaggacgagtctgg

SEQ ID NO: 56444 - DNA, 25 bp, Mus musculus
tccccagacaccatctatgaggact

SEQ ID NO: 56445 - DNA, 25 bp, Mus musculus
tccccagagacatcatgatagaaga

SEQ ID NO: 56446 - DNA, 25 bp, Mus musculus
tccccagatgggtcgtcagcaatga

SEQ ID NO: 56447 - DNA, 25 bp, Mus musculus
tccccagctgagctggtccagtgtt

SEQ ID NO: 56448 - DNA, 25 bp, Mus musculus
tccccaggaacagactctggaagct

SEQ ID NO: 56449 - DNA, 25 bp, Mus musculus
tccccaggaagagaatcagcagcaa

SEQ ID NO: 56450 - DNA, 25 bp, Mus musculus
tccccaggagaagtgactgatgcag

SEQ ID NO: 56451 - DNA, 25 bp, Mus musculus
tccccaggagctagctctgaaagct

SEQ ID NO: 56452 - DNA, 25 bp, Mus musculus
tccccaggattggaattacctgtga

SEQ ID NO: 56453 - DNA, 25 bp, Mus musculus
tccccaggcactgtgttagctcttg

SEQ ID NO: 56454 - DNA, 25 bp, Mus musculus
tccccaggcaggagtgctgagcaga

SEQ ID NO: 56455 - DNA, 25 bp, Mus musculus
tccccaggcctatttggaactgcag

SEQ ID NO: 56456 - DNA, 25 bp, Mus musculus
tccccatatggaagagcttgatgaa

SEQ ID NO: 56457 - DNA, 25 bp, Mus musculus
tccccatatggatgagcttgatgaa

SEQ ID NO: 56458 - DNA, 25 bp, Mus musculus
tccccatcaaagttgagtccagacg

SEQ ID NO: 56459 - DNA, 25 bp, Mus musculus
tccccatcgatgtgacctttaaaag

SEQ ID NO: 56460 - DNA, 25 bp, Mus musculus
tccccatgcagtttggaatcatcca

SEQ ID NO: 56461 - DNA, 25 bp, Mus musculus
tccccattcgccacataggcgagtt

SEQ ID NO: 56462 - DNA, 25 bp, Mus musculus
tccccattcgcctcataggcgagtt

SEQ ID NO: 56463 - DNA, 25 bp, Mus musculus
tccccattgttcaaactgagaccaa

SEQ ID NO: 56464 - DNA, 25 bp, Mus musculus
tccccccttacatgttcacgtggat

SEQ ID NO: 56465 - DNA, 25 bp, Mus musculus
tccccgaaaatttgagactgctcct

SEQ ID NO: 56466 - DNA, 25 bp, Mus musculus
tccccgaacgctggtttcatatagt

SEQ ID NO: 56467 - DNA, 25 bp, Mus musculus
tccccgaggagccttacatgcctgt

SEQ ID NO: 56468 - DNA, 25 bp, Mus musculus
tccccgagtgatggtagtaggtcct

SEQ ID NO: 56469 - DNA, 25 bp, Mus musculus
tccccgatggctacagcactgtggt

SEQ ID NO: 56470 - DNA, 25 bp, Mus musculus
tccccgggagttttggatcctatga

SEQ ID NO: 56471 - DNA, 25 bp, Mus musculus
tccccgggtttatcacgctaagtgt

SEQ ID NO: 56472 - DNA, 25 bp, Mus musculus
tccccgtaagcatccacatcaatat

SEQ ID NO: 56473 - DNA, 25 bp, Mus musculus
tccccgtgtgcatccgcgaggcggt

SEQ ID NO: 56474 - DNA, 25 bp, Mus musculus
tccccgtgtggtcattcaagatcaa

SEQ ID NO: 56475 - DNA, 25 bp, Mus musculus
tcccctacatagtgggcttcaacaa

SEQ ID NO: 56476 - DNA, 25 bp, Mus musculus
tcccctaggtaccagaacttctaca

SEQ ID NO: 56477 - DNA, 25 bp, Mus musculus
tcccctatttgctggaaatcctcag

SEQ ID NO: 56478 - DNA, 25 bp, Mus musculus
tcccctcagactatgatctcttcat

SEQ ID NO: 56479 - DNA, 25 bp, Mus musculus
tcccctcagcaattgtgagcttcgc

SEQ ID NO: 56480 - DNA, 25 bp, Mus musculus
tcccctccaggtagagagtacagcc

SEQ ID NO: 56481 - DNA, 25 bp, Mus musculus
tcccctcctactttgactttgtgcg

SEQ ID NO: 56482 - DNA, 25 bp, Mus musculus
tcccctgacatcctgctggaggagg

SEQ ID NO: 56483 - DNA, 25 bp, Mus musculus
tcccctgacctatgaaggtggtgta

SEQ ID NO: 56484 - DNA, 25 bp, Mus musculus
tcccctgagtcagggttggaggtcc

SEQ ID NO: 56485 - DNA, 25 bp, Mus musculus
tcccctgctaatggtcatagcagca

SEQ ID NO: 56486 - DNA, 25 bp, Mus musculus
tcccctgcttcgagaatggctgcca

SEQ ID NO: 56487 - DNA, 25 bp, Mus musculus
tcccctgggcttcagtgctgcgtgt

SEQ ID NO: 56488 - DNA, 25 bp, Mus musculus
tcccctgtaacaaggagaaaggcat

SEQ ID NO: 56489 - DNA, 25 bp, Mus musculus
tcccctgtatcgcttaattgagaag

SEQ ID NO: 56490 - DNA, 25 bp, Mus musculus
tcccctgtcagtgctctgagaatga

SEQ ID NO: 56491 - DNA, 25 bp, Mus musculus
tcccctgtcatctcaaatatgcctg

SEQ ID NO: 56492 - DNA, 25 bp, Mus musculus
tcccctgtgaagctataagggcaca

SEQ ID NO: 56493 - DNA, 25 bp, Mus musculus
tcccctgtggctatcactgtccaag

SEQ ID NO: 56494 - DNA, 25 bp, Mus musculus
tcccctgtttctcaccaaaggaatt

SEQ ID NO: 56495 - DNA, 25 bp, Mus musculus
tccccttacaacacctcagtgtatg

SEQ ID NO: 56496 - DNA, 25 bp, Mus musculus
tcccctttgaggctgacattagcaa

SEQ ID NO: 56497 - DNA, 25 bp, Mus musculus
tcccctttgtggagactgcaatggg

SEQ ID NO: 56498 - DNA, 25 bp, Mus musculus
tccccttttgggacatcattcttct

SEQ ID NO: 56499 - DNA, 25 bp, Mus musculus
tcccgaattctggacatcagcaatg

SEQ ID NO: 56500 - DNA, 25 bp, Mus musculus
tcccgacatacaatggctctgagtg

SEQ ID NO: 56501 - DNA, 25 bp, Mus musculus
tcccgacatctgcactagtgagagt

SEQ ID NO: 56502 - DNA, 25 bp, Mus musculus
tcccgaccaaagaaaacaacacagg

SEQ ID NO: 56503 - DNA, 25 bp, Mus musculus
tcccgacgggtctgatgaagacttc

SEQ ID NO: 56504 - DNA, 25 bp, Mus musculus
tcccgacgtggaggaaattcctcca

SEQ ID NO: 56505 - DNA, 25 bp, Mus musculus
tcccgactgtgaaatgccaagcatt

SEQ ID NO: 56506 - DNA, 25 bp, Mus musculus
tcccgagacaaggaaaagaacacag

SEQ ID NO: 56507 - DNA, 25 bp, Mus musculus
tcccgagagatctgagcatgagcac

SEQ ID NO: 56508 - DNA, 25 bp, Mus musculus
tcccgagcagtcttggacgcagact

SEQ ID NO: 56509 - DNA, 25 bp, Mus musculus
tcccgaggaattcctggatccccag

SEQ ID NO: 56510 - DNA, 25 bp, Mus musculus
tcccgagggagcaaaagagcagctt

SEQ ID NO: 56511 - DNA, 25 bp, Mus musculus
tcccgagggagctaaagagcagctt

SEQ ID NO: 56512 - DNA, 25 bp, Mus musculus
tcccgagtgctgcatgctgtaccat

SEQ ID NO: 56513 - DNA, 25 bp, Mus musculus
tcccgagtgtatgaagaagatgccg

SEQ ID NO: 56514 - DNA, 25 bp, Mus musculus
tcccgatagatgtttcccacttgaa

SEQ ID NO: 56515 - DNA, 25 bp, Mus musculus
tcccgatcacatagcaagaatccca

SEQ ID NO: 56516 - DNA, 25 bp, Mus musculus
tcccgatggcaggtctgcgagccag

SEQ ID NO: 56517 - DNA, 25 bp, Mus musculus
tcccgcaaacaacttatcagtagtg

SEQ ID NO: 56518 - DNA, 25 bp, Mus musculus
tcccgcagcaacaacatgtgcatcg

SEQ ID NO: 56519 - DNA, 25 bp, Mus musculus
tcccgccatcctatgaacaagtgat

SEQ ID NO: 56520 - DNA, 25 bp, Mus musculus
tcccgccatcctttgaacaagtgat

SEQ ID NO: 56521 - DNA, 25 bp, Mus musculus
tcccgcctgaaacgcagatggctgt

SEQ ID NO: 56522 - DNA, 25 bp, Mus musculus
tcccgcctgaaaggcagatggctgt

SEQ ID NO: 56523 - DNA, 25 bp, Mus musculus
tcccgcggcacacatttggactggt

SEQ ID NO: 56524 - DNA, 25 bp, Mus musculus
tcccggaaccgtgtgctaggctggt

SEQ ID NO: 56525 - DNA, 25 bp, Mus musculus
tcccggagacctcggttttgcacaa

SEQ ID NO: 56526 - DNA, 25 bp, Mus musculus
tcccggagacctgggttttgcacaa

SEQ ID NO: 56527 - DNA, 25 bp, Mus musculus
tcccggagaggagagtatgtactca

SEQ ID NO: 56528 - DNA, 25 bp, Mus musculus
tcccggagagtgaactttccatccg

SEQ ID NO: 56529 - DNA, 25 bp, Mus musculus
tcccggataagcagagcaagcgtaa

SEQ ID NO: 56530 - DNA, 25 bp, Mus musculus
tcccggatcactagaagaacctcta

SEQ ID NO: 56531 - DNA, 25 bp, Mus musculus
tcccggcgtgccagtgataaacctg

SEQ ID NO: 56532 - DNA, 25 bp, Mus musculus
tcccgggaatacaaactagtgatgc

SEQ ID NO: 56533 - DNA, 25 bp, Mus musculus
tcccgggatcggaatgtcaacctgt

SEQ ID NO: 56534 - DNA, 25 bp, Mus musculus
tcccgggcagcagagtgacagttct

SEQ ID NO: 56535 - DNA, 25 bp, Mus musculus
tcccgggtggaacagggattatcct

SEQ ID NO: 56536 - DNA, 25 bp, Mus musculus
tcccggtgctttctgaagaatctct

SEQ ID NO: 56537 - DNA, 25 bp, Mus musculus
tcccgtaggcgggaacctcctggtg

SEQ ID NO: 56538 - DNA, 25 bp, Mus musculus
tcccgtgaagacagtgaaaagccct

SEQ ID NO: 56539 - DNA, 25 bp, Mus musculus
tcccgtgagtcttcatcatgaccag

SEQ ID NO: 56540 - DNA, 25 bp, Mus musculus
tcccgtgcgtccttctttgcacaaa

SEQ ID NO: 56541 - DNA, 25 bp, Mus musculus
tcccgttacttccattggaaactga

SEQ ID NO: 56542 - DNA, 25 bp, Mus musculus
tcccgtttaaacaaagatgagtatg

SEQ ID NO: 56543 - DNA, 25 bp, Mus musculus
tcccgtttccccatatgagagcgag

SEQ ID NO: 56544 - DNA, 25 bp, Mus musculus
tccctaaagataccagatcgaaggc

SEQ ID NO: 56545 - DNA, 25 bp, Mus musculus
tccctaatgagaccccgggagttgg

SEQ ID NO: 56546 - DNA, 25 bp, Mus musculus
tccctaatgagagcccgggagttgg

SEQ ID NO: 56547 - DNA, 25 bp, Mus musculus
tccctacaccagtaaacttgtgaaa

SEQ ID NO: 56548 - DNA, 25 bp, Mus musculus
tccctacagagatgatataatgtcc

SEQ ID NO: 56549 - DNA, 25 bp, Mus musculus
tccctacctgaaactgatgaaaagt

SEQ ID NO: 56550 - DNA, 25 bp, Mus musculus
tccctactggtgtcaggaggcttgg

SEQ ID NO: 56551 - DNA, 25 bp, Mus musculus
tccctagacccatgggaatcaaagc

SEQ ID NO: 56552 - DNA, 25 bp, Mus musculus
tccctagcaggagaacaagaagatt

SEQ ID NO: 56553 - DNA, 25 bp, Mus musculus
tccctagctgggaagacatcgcgct

SEQ ID NO: 56554 - DNA, 25 bp, Mus musculus
tccctagctgggtagacatcgcgct

SEQ ID NO: 56555 - DNA, 25 bp, Mus musculus
tccctagctgttggtagtaagtccg

SEQ ID NO: 56556 - DNA, 25 bp, Mus musculus
tccctaggcggtcaaatgagagtct

SEQ ID NO: 56557 - DNA, 25 bp, Mus musculus
tccctagtagagcaggtgcgtgtcc

SEQ ID NO: 56558 - DNA, 25 bp, Mus musculus
tccctatcgggtgagttagcacacc

SEQ ID NO: 56559 - DNA, 25 bp, Mus musculus
tccctatgacggagatactttccag

SEQ ID NO: 56560 - DNA, 25 bp, Mus musculus
tccctcaaggttgacgtccgggtgg

SEQ ID NO: 56561 - DNA, 25 bp, Mus musculus
tccctcacaggaatagattctaaaa

SEQ ID NO: 56562 - DNA, 25 bp, Mus musculus
tccctcagcactggaggctcagaag

SEQ ID NO: 56563 - DNA, 25 bp, Mus musculus
tccctcaggactctagagaagatgg

SEQ ID NO: 56564 - DNA, 25 bp, Mus musculus
tccctcaggcgtgcaaaaggaacgc

SEQ ID NO: 56565 - DNA, 25 bp, Mus musculus
tccctcagggcgtgaaagtctacga

SEQ ID NO: 56566 - DNA, 25 bp, Mus musculus
tccctcagggtgttcgtgaatgccg

SEQ ID NO: 56567 - DNA, 25 bp, Mus musculus
tccctcagttgtaaagatccccatg

SEQ ID NO: 56568 - DNA, 25 bp, Mus musculus
tccctcatcggatcttacaacagca

SEQ ID NO: 56569 - DNA, 25 bp, Mus musculus
tccctcatctgagaaggcagagttc

SEQ ID NO: 56570 - DNA, 25 bp, Mus musculus
tccctccaaccctgtctgagattgt

SEQ ID NO: 56571 - DNA, 25 bp, Mus musculus
tccctccatgaagaactggaaactg

SEQ ID NO: 56572 - DNA, 25 bp, Mus musculus
tccctcccagtatgtgggtgccctg

SEQ ID NO: 56573 - DNA, 25 bp, Mus musculus
tccctccgagggatgatatcatcaa

SEQ ID NO: 56574 - DNA, 25 bp, Mus musculus
tccctcctaaaatcgctgcatgtat

SEQ ID NO: 56575 - DNA, 25 bp, Mus musculus
tccctcctgaaaagttgtcagactc

SEQ ID NO: 56576 - DNA, 25 bp, Mus musculus
tccctcctgatgcaggtgcttctgt

SEQ ID NO: 56577 - DNA, 25 bp, Mus musculus
tccctctagctgagatggaggctct

SEQ ID NO: 56578 - DNA, 25 bp, Mus musculus
tccctctggacagaatgcaggtcca

SEQ ID NO: 56579 - DNA, 25 bp, Mus musculus
tccctctggtgtgcagtactcggct

SEQ ID NO: 56580 - DNA, 25 bp, Mus musculus
tccctcttgagatgctggaggccca

SEQ ID NO: 56581 - DNA, 25 bp, Mus musculus
tccctctttggcacacttggaaact

SEQ ID NO: 56582 - DNA, 25 bp, Mus musculus
tccctgaaaactatggtggaaattt

SEQ ID NO: 56583 - DNA, 25 bp, Mus musculus
tccctgaacactgggagtattacaa

SEQ ID NO: 56584 - DNA, 25 bp, Mus musculus
tccctgaaccaatctcttccggagt

SEQ ID NO: 56585 - DNA, 25 bp, Mus musculus
tccctgaacttggaacccgacaatg

SEQ ID NO: 56586 - DNA, 25 bp, Mus musculus
tccctgaagaccacagcccaggttt

SEQ ID NO: 56587 - DNA, 25 bp, Mus musculus
tccctgaagaccatgagcactagtg

SEQ ID NO: 56588 - DNA, 25 bp, Mus musculus
tccctgaagccttacggaggttctc

SEQ ID NO: 56589 - DNA, 25 bp, Mus musculus
tccctgaattcttggtctattttcc

SEQ ID NO: 56590 - DNA, 25 bp, Mus musculus
tccctgacaacaggacgctgtagtt

SEQ ID NO: 56591 - DNA, 25 bp, Mus musculus
tccctgaccagttactaggagatgc

SEQ ID NO: 56592 - DNA, 25 bp, Mus musculus
tccctgaccatgacatccacatgga

SEQ ID NO: 56593 - DNA, 25 bp, Mus musculus
tccctgaccatgtcatccacatgga

SEQ ID NO: 56594 - DNA, 25 bp, Mus musculus
tccctgacgacatgggatcaaaagg

SEQ ID NO: 56595 - DNA, 25 bp, Mus musculus
tccctgagaacacggtggacgtcat

SEQ ID NO: 56596 - DNA, 25 bp, Mus musculus
tccctgagaacagggtggacgtcat

SEQ ID NO: 56597 - DNA, 25 bp, Mus musculus
tccctgagacagagccgctgcagtc

SEQ ID NO: 56598 - DNA, 25 bp, Mus musculus
tccctgagctggacgggaagacagc

SEQ ID NO: 56599 - DNA, 25 bp, Mus musculus
tccctgaggagtaagctgattgccc

SEQ ID NO: 56600 - DNA, 25 bp, Mus musculus
tccctgaggagtgtcccatatggct

SEQ ID NO: 56601 - DNA, 25 bp, Mus musculus
tccctgagtcagtcatcagaaatat

SEQ ID NO: 56602 - DNA, 25 bp, Mus musculus
tccctgatctgtggttgagtggccc

SEQ ID NO: 56603 - DNA, 25 bp, Mus musculus
tccctgattctgatgatattaaggc

SEQ ID NO: 56604 - DNA, 25 bp, Mus musculus
tccctgatttgtctccagggtacct

SEQ ID NO: 56605 - DNA, 25 bp, Mus musculus
tccctgcagatgagctctatggaat

SEQ ID NO: 56606 - DNA, 25 bp, Mus musculus
tccctgcagcccgaggtgaatggct

SEQ ID NO: 56607 - DNA, 25 bp, Mus musculus
tccctgccgccaacactgtgaagtt

SEQ ID NO: 56608 - DNA, 25 bp, Mus musculus
tccctgccggtgctacagagtgagt

SEQ ID NO: 56609 - DNA, 25 bp, Mus musculus
tccctgctactgcttttggcctggg

SEQ ID NO: 56610 - DNA, 25 bp, Mus musculus
tccctgctccagtaggaggagctga

SEQ ID NO: 56611 - DNA, 25 bp, Mus musculus
tccctgctgagagtactgtcgtcct

SEQ ID NO: 56612 - DNA, 25 bp, Mus musculus
tccctgcttaatggcgtgtgtctca

SEQ ID NO: 56613 - DNA, 25 bp, Mus musculus
tccctggaaaggatagaagctaatg

SEQ ID NO: 56614 - DNA, 25 bp, Mus musculus
tccctggaagctttgctggcaagca

SEQ ID NO: 56615 - DNA, 25 bp, Mus musculus
tccctggaatggacaaagggctgct

SEQ ID NO: 56616 - DNA, 25 bp, Mus musculus
tccctggacagcacagtagatctgg

SEQ ID NO: 56617 - DNA, 25 bp, Mus musculus
tccctggacgtcaattggcgctaac

SEQ ID NO: 56618 - DNA, 25 bp, Mus musculus
tccctggataaacgtagaaggagta

SEQ ID NO: 56619 - DNA, 25 bp, Mus musculus
tccctggcagtcgatgggctggtct

SEQ ID NO: 56620 - DNA, 25 bp, Mus musculus
tccctggcatatgggtgtccagtcc

SEQ ID NO: 56621 - DNA, 25 bp, Mus musculus
tccctggcgtcacatgagaacacgg

SEQ ID NO: 56622 - DNA, 25 bp, Mus musculus
tccctgggactaagtctccgaagta

SEQ ID NO: 56623 - DNA, 25 bp, Mus musculus
tccctgggctgcactgtggagctgc

SEQ ID NO: 56624 - DNA, 25 bp, Mus musculus
tccctggtacagagaaactcaatga

SEQ ID NO: 56625 - DNA, 25 bp, Mus musculus
tccctggtacaggtgagtttttctt

SEQ ID NO: 56626 - DNA, 25 bp, Mus musculus
tccctggtgcactgtgactcctgca

SEQ ID NO: 56627 - DNA, 25 bp, Mus musculus
tccctggtggccaacaactgggttc

SEQ ID NO: 56628 - DNA, 25 bp, Mus musculus
tccctggtttgtggtggagcagata

SEQ ID NO: 56629 - DNA, 25 bp, Mus musculus
tccctgtacagcagagactctggac

SEQ ID NO: 56630 - DNA, 25 bp, Mus musculus
tccctgtacgacaagcagcagagag

SEQ ID NO: 56631 - DNA, 25 bp, Mus musculus
tccctgtcaaagtaatcccatcaca

SEQ ID NO: 56632 - DNA, 25 bp, Mus musculus
tccctgtcaagcaggaggccatgga

SEQ ID NO: 56633 - DNA, 25 bp, Mus musculus
tccctgtcggagagtgatgggcccc

SEQ ID NO: 56634 - DNA, 25 bp, Mus musculus
tccctgtctgttgggtcctcaggga

SEQ ID NO: 56635 - DNA, 25 bp, Mus musculus
tccctgtgaagaaagacaaacggca

SEQ ID NO: 56636 - DNA, 25 bp, Mus musculus
tccctgtggttacatatttattagc

SEQ ID NO: 56637 - DNA, 25 bp, Mus musculus
tcccttaagcagcagaggagcacca

SEQ ID NO: 56638 - DNA, 25 bp, Mus musculus
tcccttacacgttgcctcgaagcga

SEQ ID NO: 56639 - DNA, 25 bp, Mus musculus
tcccttacagactcggagatcaaag

SEQ ID NO: 56640 - DNA, 25 bp, Mus musculus
tcccttacagccctgctggtgtggc

SEQ ID NO: 56641 - DNA, 25 bp, Mus musculus
tcccttagaagatttgcggagtttt

SEQ ID NO: 56642 - DNA, 25 bp, Mus musculus
tcccttcaacttcaccgcgattgga

SEQ ID NO: 56643 - DNA, 25 bp, Mus musculus
tcccttcagaaaccagtgaggaccc

SEQ ID NO: 56644 - DNA, 25 bp, Mus musculus
tcccttcatggcagaacatttagag

SEQ ID NO: 56645 - DNA, 25 bp, Mus musculus
tcccttcccaaaggacatgaagcta

SEQ ID NO: 56646 - DNA, 25 bp, Mus musculus
tcccttctatatcttggacggacag

SEQ ID NO: 56647 - DNA, 25 bp, Mus musculus
tcccttctcaggatgatcctggcct

SEQ ID NO: 56648 - DNA, 25 bp, Mus musculus
tcccttctcaggatgccatttctgc

SEQ ID NO: 56649 - DNA, 25 bp, Mus musculus
tcccttgcaaggcataggcagcagg

SEQ ID NO: 56650 - DNA, 25 bp, Mus musculus
tcccttgccaagacgattagcagga

SEQ ID NO: 56651 - DNA, 25 bp, Mus musculus
tcccttgggacactttggaacttgc

SEQ ID NO: 56652 - DNA, 25 bp, Mus musculus
tcccttgggtgaaagagcagagaga

SEQ ID NO: 56653 - DNA, 25 bp, Mus musculus
tcccttgtatcctcgtctgacctta

SEQ ID NO: 56654 - DNA, 25 bp, Mus musculus
tcccttgtgagtcaggattatgtca

SEQ ID NO: 56655 - DNA, 25 bp, Mus musculus
tccctttgaactggaaaaggccttg

SEQ ID NO: 56656 - DNA, 25 bp, Mus musculus
tccctttgtcctgagtagggctttc

SEQ ID NO: 56657 - DNA, 25 bp, Mus musculus
tcccttttcaaagctgggatgtggc

SEQ ID NO: 56658 - DNA, 25 bp, Mus musculus
tcccttttgctagcattgcatctga

SEQ ID NO: 56659 - DNA, 25 bp, Mus musculus
tcccttttggatatgtgccacgttg

SEQ ID NO: 56660 - DNA, 25 bp, Mus musculus
tccctttttggagacacttctgata

SEQ ID NO: 56661 - DNA, 25 bp, Mus musculus
tccgaaaatcttggcctgagcctga

SEQ ID NO: 56662 - DNA, 25 bp, Mus musculus
tccgaaactctcagctggcccagtt

SEQ ID NO: 56663 - DNA, 25 bp, Mus musculus
tccgaaagtcacagaatttgatgca

SEQ ID NO: 56664 - DNA, 25 bp, Mus musculus
tccgaaatgtatctcatccagcctg

SEQ ID NO: 56665 - DNA, 25 bp, Mus musculus
tccgaacaagctcagaatgaaaatg

SEQ ID NO: 56666 - DNA, 25 bp, Mus musculus
tccgaacagatccagcagatggctg

SEQ ID NO: 56667 - DNA, 25 bp, Mus musculus
tccgaagaatgaaatgagcagatgg

SEQ ID NO: 56668 - DNA, 25 bp, Mus musculus
tccgaagaggccagaaactagatcc

SEQ ID NO: 56669 - DNA, 25 bp, Mus musculus
tccgaagaggcctgaaactagatcc

SEQ ID NO: 56670 - DNA, 25 bp, Mus musculus
tccgaagatacactgacttctccag

SEQ ID NO: 56671 - DNA, 25 bp, Mus musculus
tccgaagatgatgggctcagcaaag

SEQ ID NO: 56672 - DNA, 25 bp, Mus musculus
tccgaagccagaggatctgagcgtc

SEQ ID NO: 56673 - DNA, 25 bp, Mus musculus
tccgaagctcctgttcatggagagt

SEQ ID NO: 56674 - DNA, 25 bp, Mus musculus
tccgaaggccagaaagtcattcttg

SEQ ID NO: 56675 - DNA, 25 bp, Mus musculus
tccgaagggaaatcaagaggctcca

SEQ ID NO: 56676 - DNA, 25 bp, Mus musculus
tccgaagtagctgggatcaccgtct

SEQ ID NO: 56677 - DNA, 25 bp, Mus musculus
tccgaatctccccttttgggacatc

SEQ ID NO: 56678 - DNA, 25 bp, Mus musculus
tccgaatgctagacaatagaaaact

SEQ ID NO: 56679 - DNA, 25 bp, Mus musculus
tccgaattcattaagtgcatcttcg

SEQ ID NO: 56680 - DNA, 25 bp, Mus musculus
tccgaattcggagcccagaggagag

SEQ ID NO: 56681 - DNA, 25 bp, Mus musculus
tccgacaaagggataactcacacca

SEQ ID NO: 56682 - DNA, 25 bp, Mus musculus
tccgacggacgatggaaaggagcca

SEQ ID NO: 56683 - DNA, 25 bp, Mus musculus
tccgacgtgtcacctctgcaaaggg

SEQ ID NO: 56684 - DNA, 25 bp, Mus musculus
tccgactataaatcggctcacaagg

SEQ ID NO: 56685 - DNA, 25 bp, Mus musculus
tccgactgtcttagatggcctgatc

SEQ ID NO: 56686 - DNA, 25 bp, Mus musculus
tccgactgtctttgatggcctgatc

SEQ ID NO: 56687 - DNA, 25 bp, Mus musculus
tccgacttttgagatcacaggccca

SEQ ID NO: 56688 - DNA, 25 bp, Mus musculus
tccgagaaatctatggccagacaga

SEQ ID NO: 56689 - DNA, 25 bp, Mus musculus
tccgagaagtacacatgcgcctggt

SEQ ID NO: 56690 - DNA, 25 bp, Mus musculus
tccgagaagtactcatgcgcctggt

SEQ ID NO: 56691 - DNA, 25 bp, Mus musculus
tccgagaagtcgtcctggcgggatt

SEQ ID NO: 56692 - DNA, 25 bp, Mus musculus
tccgagacagattattatccgaggg

SEQ ID NO: 56693 - DNA, 25 bp, Mus musculus
tccgagacagctacgggcgcgcgct

SEQ ID NO: 56694 - DNA, 25 bp, Mus musculus
tccgagacaggacgatgtgctcatc

SEQ ID NO: 56695 - DNA, 25 bp, Mus musculus
tccgagagcaggtgaaggagctctt

SEQ ID NO: 56696 - DNA, 25 bp, Mus musculus
tccgagagcccatcttcaagattta

SEQ ID NO: 56697 - DNA, 25 bp, Mus musculus
tccgagatcagtcttctcacaccag

SEQ ID NO: 56698 - DNA, 25 bp, Mus musculus
tccgagatcagtgttctcacaccag

SEQ ID NO: 56699 - DNA, 25 bp, Mus musculus
tccgagcagtaccacacactgggag

SEQ ID NO: 56700 - DNA, 25 bp, Mus musculus
tccgagccaacctaacaaaggctgc

SEQ ID NO: 56701 - DNA, 25 bp, Mus musculus
tccgagcgattcctctgtgagtcgg

SEQ ID NO: 56702 - DNA, 25 bp, Mus musculus
tccgagctgtggagctcgagcggca

SEQ ID NO: 56703 - DNA, 25 bp, Mus musculus
tccgaggagatctcccaccagcaat

SEQ ID NO: 56704 - DNA, 25 bp, Mus musculus
tccgaggatcagatggtgcgatctt

SEQ ID NO: 56705 - DNA, 25 bp, Mus musculus
tccgaggatgggacacacggagcat

SEQ ID NO: 56706 - DNA, 25 bp, Mus musculus
tccgaggcatgcagcaagcagaggc

SEQ ID NO: 56707 - DNA, 25 bp, Mus musculus
tccgaggcatgctgcaagcagaggc

SEQ ID NO: 56708 - DNA, 25 bp, Mus musculus
tccgaggccagcaggcgggatttcc

SEQ ID NO: 56709 - DNA, 25 bp, Mus musculus
tccgaggctgacttagagctggtcc

SEQ ID NO: 56710 - DNA, 25 bp, Mus musculus
tccgagggaagcacgtctgtgatgc

SEQ ID NO: 56711 - DNA, 25 bp, Mus musculus
tccgaggtgacttttcgacagtgcg

SEQ ID NO: 56712 - DNA, 25 bp, Mus musculus
tccgagtacaccgagaattatccga

SEQ ID NO: 56713 - DNA, 25 bp, Mus musculus
tccgagtctgctcaggagctagcag

SEQ ID NO: 56714 - DNA, 25 bp, Mus musculus
tccgagtctggttcaactttactgt

SEQ ID NO: 56715 - DNA, 25 bp, Mus musculus
tccgagtgaacaacaaccagcagaa

SEQ ID NO: 56716 - DNA, 25 bp, Mus musculus
tccgagtgggcttcgtgatgtctgt

SEQ ID NO: 56717 - DNA, 25 bp, Mus musculus
tccgagtgtaagaggcaaagtttgg

SEQ ID NO: 56718 - DNA, 25 bp, Mus musculus
tccgataacgtctctgtcactgtgc

SEQ ID NO: 56719 - DNA, 25 bp, Mus musculus
tccgatccccaggattggaattacc

SEQ ID NO: 56720 - DNA, 25 bp, Mus musculus
tccgatccctttgatgccaagagcg

SEQ ID NO: 56721 - DNA, 25 bp, Mus musculus
tccgatccgtgagtgcctatggcac

SEQ ID NO: 56722 - DNA, 25 bp, Mus musculus
tccgatgctaagagcactccaactg

SEQ ID NO: 56723 - DNA, 25 bp, Mus musculus
tccgattcagcatcactattgttgc

SEQ ID NO: 56724 - DNA, 25 bp, Mus musculus
tccgattcttctttgaaaaaggcgt

SEQ ID NO: 56725 - DNA, 25 bp, Mus musculus
tccgatttctaaaggccaagctcca

SEQ ID NO: 56726 - DNA, 25 bp, Mus musculus
tccgatttgaatacctgtggccgtt

SEQ ID NO: 56727 - DNA, 25 bp, Mus musculus
tccgcaaagagagacaaaaccagat

SEQ ID NO: 56728 - DNA, 25 bp, Mus musculus
tccgcaaagcccataccagagtgga

SEQ ID NO: 56729 - DNA, 25 bp, Mus musculus
tccgcaaagcgctggataagatagc

SEQ ID NO: 56730 - DNA, 25 bp, Mus musculus
tccgcaagcattgcgtggagggcaa

SEQ ID NO: 56731 - DNA, 25 bp, Mus musculus
tccgcaaggaacagattttggcagt

SEQ ID NO: 56732 - DNA, 25 bp, Mus musculus
tccgcaatagacctgttcccgtcta

SEQ ID NO: 56733 - DNA, 25 bp, Mus musculus
tccgcaccggaaagatgttgatgaa

SEQ ID NO: 56734 - DNA, 25 bp, Mus musculus
tccgcagagtgccttgtgattggcc

SEQ ID NO: 56735 - DNA, 25 bp, Mus musculus
tccgcagatgcacttttggtggcaa

SEQ ID NO: 56736 - DNA, 25 bp, Mus musculus
tccgcagggattccaaaatccccgg

SEQ ID NO: 56737 - DNA, 25 bp, Mus musculus
tccgcatccgctacatgggcgaaag

SEQ ID NO: 56738 - DNA, 25 bp, Mus musculus
tccgccactcgataagtatgcctgt

SEQ ID NO: 56739 - DNA, 25 bp, Mus musculus
tccgccagagtgaatgacatgcacg

SEQ ID NO: 56740 - DNA, 25 bp, Mus musculus
tccgccagcagctctatgtgggagg

SEQ ID NO: 56741 - DNA, 25 bp, Mus musculus
tccgccagcgcatgatgcaaatgta

SEQ ID NO: 56742 - DNA, 25 bp, Mus musculus
tccgccaggagctgattcacatcga

SEQ ID NO: 56743 - DNA, 25 bp, Mus musculus
tccgccatccatgcgtggggagtga

SEQ ID NO: 56744 - DNA, 25 bp, Mus musculus
tccgccattccataagtatgcctgc

SEQ ID NO: 56745 - DNA, 25 bp, Mus musculus
tccgccctgccattaatgtgggttt

SEQ ID NO: 56746 - DNA, 25 bp, Mus musculus
tccgccctggcagtctggatgctga

SEQ ID NO: 56747 - DNA, 25 bp, Mus musculus
tccgcctaagaatattaaagacctc

SEQ ID NO: 56748 - DNA, 25 bp, Mus musculus
tccgcctcactaactgttgtgaaat

SEQ ID NO: 56749 - DNA, 25 bp, Mus musculus
tccgcctccatgagccggatagcgg

SEQ ID NO: 56750 - DNA, 25 bp, Mus musculus
tccgcctccatgtgccggatagcgg

SEQ ID NO: 56751 - DNA, 25 bp, Mus musculus
tccgcctcgtctgtgtatatgggtt

SEQ ID NO: 56752 - DNA, 25 bp, Mus musculus
tccgcctgatccgagagactggaga

SEQ ID NO: 56753 - DNA, 25 bp, Mus musculus
tccgcctggaggacggcttcagtgt

SEQ ID NO: 56754 - DNA, 25 bp, Mus musculus
tccgcctggcaaatctatctgcaga

SEQ ID NO: 56755 - DNA, 25 bp, Mus musculus
tccgcgacaattcagtgagcagctt

SEQ ID NO: 56756 - DNA, 25 bp, Mus musculus
tccgcgccgtttgctggagaaagag

SEQ ID NO: 56757 - DNA, 25 bp, Mus musculus
tccgcgtaccctggaagcatttcgg

SEQ ID NO: 56758 - DNA, 25 bp, Mus musculus
tccgcgttaccccaactatgttgca

SEQ ID NO: 56759 - DNA, 25 bp, Mus musculus
tccgctcaatccgaggatcagatgg

SEQ ID NO: 56760 - DNA, 25 bp, Mus musculus
tccgctcaatcctggaggacctgag

SEQ ID NO: 56761 - DNA, 25 bp, Mus musculus
tccgctcagaatttgatgacatcga

SEQ ID NO: 56762 - DNA, 25 bp, Mus musculus
tccgctccattcagcattcgattag

SEQ ID NO: 56763 - DNA, 25 bp, Mus musculus
tccgctcgctgtccatggtttctga

SEQ ID NO: 56764 - DNA, 25 bp, Mus musculus
tccgctcttttgaagtgctgtgatg

SEQ ID NO: 56765 - DNA, 25 bp, Mus musculus
tccgctgagacgctctgcatctctg

SEQ ID NO: 56766 - DNA, 25 bp, Mus musculus
tccgctgcagttgacttgctggtga

SEQ ID NO: 56767 - DNA, 25 bp, Mus musculus
tccgctgccagcatcacaattggct

SEQ ID NO: 56768 - DNA, 25 bp, Mus musculus
tccgctgtcctgatggcatatcgat

SEQ ID NO: 56769 - DNA, 25 bp, Mus musculus
tccgctgtgacaggaagccagaagg

SEQ ID NO: 56770 - DNA, 25 bp, Mus musculus
tccgcttcagatgggaagagtcata

SEQ ID NO: 56771 - DNA, 25 bp, Mus musculus
tccgcttcgagctcctgggctgtga

SEQ ID NO: 56772 - DNA, 25 bp, Mus musculus
tccgcttcgtgaaggcttccgctgt

SEQ ID NO: 56773 - DNA, 25 bp, Mus musculus
tccggaaaatgtaatgcagagtaaa

SEQ ID NO: 56774 - DNA, 25 bp, Mus musculus
tccggaaagctgagaacatcaagcg

SEQ ID NO: 56775 - DNA, 25 bp, Mus musculus
tccggaaattgcagtccctgagctg

SEQ ID NO: 56776 - DNA, 25 bp, Mus musculus
tccggaataacaatgatgtcaaacc

SEQ ID NO: 56777 - DNA, 25 bp, Mus musculus
tccggaatacaaggacaacaaactt

SEQ ID NO: 56778 - DNA, 25 bp, Mus musculus
tccggaatgttcatactgcccagaa

SEQ ID NO: 56779 - DNA, 25 bp, Mus musculus
tccggaccaggcaagaagaataact

SEQ ID NO: 56780 - DNA, 25 bp, Mus musculus
tccggaccgaagcatgattgctgct

SEQ ID NO: 56781 - DNA, 25 bp, Mus musculus
tccggactgagtaagcgacagctgg

SEQ ID NO: 56782 - DNA, 25 bp, Mus musculus
tccggagaacgaagcggctacagca

SEQ ID NO: 56783 - DNA, 25 bp, Mus musculus
tccggagacacggagcttcttggga

SEQ ID NO: 56784 - DNA, 25 bp, Mus musculus
tccggagaccgcgagcaggatcctg

SEQ ID NO: 56785 - DNA, 25 bp, Mus musculus
tccggaggaattttcagccccgctg

SEQ ID NO: 56786 - DNA, 25 bp, Mus musculus
tccggagtacgaagggaaggatcac

SEQ ID NO: 56787 - DNA, 25 bp, Mus musculus
tccggagtgaacctggagactccag

SEQ ID NO: 56788 - DNA, 25 bp, Mus musculus
tccggagtgtcacagtacaagaaac

SEQ ID NO: 56789 - DNA, 25 bp, Mus musculus
tccggagttgagctgctcacacacc

SEQ ID NO: 56790 - DNA, 25 bp, Mus musculus
tccggatacactggctgctggatct

SEQ ID NO: 56791 - DNA, 25 bp, Mus musculus
tccggataggtagcactgggcttct

SEQ ID NO: 56792 - DNA, 25 bp, Mus musculus
tccggatgacatccgtagggccttt

SEQ ID NO: 56793 - DNA, 25 bp, Mus musculus
tccggattctagaaaggactccagg

SEQ ID NO: 56794 - DNA, 25 bp, Mus musculus
tccggatttaacactcacagaccag

SEQ ID NO: 56795 - DNA, 25 bp, Mus musculus
tccggcagcacgtcatggtagaaat

SEQ ID NO: 56796 - DNA, 25 bp, Mus musculus
tccggcaggtcatccgagaagacct

SEQ ID NO: 56797 - DNA, 25 bp, Mus musculus
tccggccaagtccacatagcaagct

SEQ ID NO: 56798 - DNA, 25 bp, Mus musculus
tccggccagtgagcaggacatatct

SEQ ID NO: 56799 - DNA, 25 bp, Mus musculus
tccggcccgctgagacggaagacat

SEQ ID NO: 56800 - DNA, 25 bp, Mus musculus
tccggcctctgtcagtgtttggttt

SEQ ID NO: 56801 - DNA, 25 bp, Mus musculus
tccggcctgagctaagtcagctgga

SEQ ID NO: 56802 - DNA, 25 bp, Mus musculus
tccggcctgtggaaagacaacaagt

SEQ ID NO: 56803 - DNA, 25 bp, Mus musculus
tccggcgcagtttattatctcttgg

SEQ ID NO: 56804 - DNA, 25 bp, Mus musculus
tccggcggtttcatggacatgtttg

SEQ ID NO: 56805 - DNA, 25 bp, Mus musculus
tccggctccgcttcactatggtggc

SEQ ID NO: 56806 - DNA, 25 bp, Mus musculus
tccggctctgtctgccaggacctgt

SEQ ID NO: 56807 - DNA, 25 bp, Mus musculus
tccggctggaggtagacacacagag

SEQ ID NO: 56808 - DNA, 25 bp, Mus musculus
tccgggaaaagaactggaaggccat

SEQ ID NO: 56809 - DNA, 25 bp, Mus musculus
tccgggaacaagtgaattccatggt

SEQ ID NO: 56810 - DNA, 25 bp, Mus musculus
tccgggaagatctagcccagcgcat

SEQ ID NO: 56811 - DNA, 25 bp, Mus musculus
tccgggaccccaggattcagaagga

SEQ ID NO: 56812 - DNA, 25 bp, Mus musculus
tccgggacgtggaaaagggcttcat

SEQ ID NO: 56813 - DNA, 25 bp, Mus musculus
tccgggactcagacagtggtctaga

SEQ ID NO: 56814 - DNA, 25 bp, Mus musculus
tccgggacttgcagcaagcatctct

SEQ ID NO: 56815 - DNA, 25 bp, Mus musculus
tccgggagaagcacctggatcccat

SEQ ID NO: 56816 - DNA, 25 bp, Mus musculus
tccgggagacgatggtgtgcgctgg

SEQ ID NO: 56817 - DNA, 25 bp, Mus musculus
tccgggcccatctcttcaaactgtg

SEQ ID NO: 56818 - DNA, 25 bp, Mus musculus
tccgggcggaataagacctttctct

SEQ ID NO: 56819 - DNA, 25 bp, Mus musculus
tccgggctgaagtggacacattcat

SEQ ID NO: 56820 - DNA, 25 bp, Mus musculus
tccgggctgccctgcgtgactacga

SEQ ID NO: 56821 - DNA, 25 bp, Mus musculus
tccgggctgcctcaagtgcccagtg

SEQ ID NO: 56822 - DNA, 25 bp, Mus musculus
tccgggctgcctgaagtgcccagtg

SEQ ID NO: 56823 - DNA, 25 bp, Mus musculus
tccgggcttctatccgaaggaagaa

SEQ ID NO: 56824 - DNA, 25 bp, Mus musculus
tccgggtgacctgcatgggttcctg

SEQ ID NO: 56825 - DNA, 25 bp, Mus musculus
tccggtaactgtttcttcaaacgtg

SEQ ID NO: 56826 - DNA, 25 bp, Mus musculus
tccggtacaaagaggcatttctgag

SEQ ID NO: 56827 - DNA, 25 bp, Mus musculus
tccggtacctgtggatgccagattc

SEQ ID NO: 56828 - DNA, 25 bp, Mus musculus
tccggtactctgacttatgaagcag

SEQ ID NO: 56829 - DNA, 25 bp, Mus musculus
tccggtactgggacctcctgctgct

SEQ ID NO: 56830 - DNA, 25 bp, Mus musculus
tccggtagaccgtagcgttgtcacg

SEQ ID NO: 56831 - DNA, 25 bp, Mus musculus
tccggtctgtgctcctacgtgaaac

SEQ ID NO: 56832 - DNA, 25 bp, Mus musculus
tccggtgaagaatgaatacccctct

SEQ ID NO: 56833 - DNA, 25 bp, Mus musculus
tccggtgagggaacacatagtactg

SEQ ID NO: 56834 - DNA, 25 bp, Mus musculus
tccggtgagggatcacatagtactg

SEQ ID NO: 56835 - DNA, 25 bp, Mus musculus
tccggtgcaggaaagatgttcactt

SEQ ID NO: 56836 - DNA, 25 bp, Mus musculus
tccggtgcattagcgttcagcagat

SEQ ID NO: 56837 - DNA, 25 bp, Mus musculus
tccggtgccagcgttttcatctttt

SEQ ID NO: 56838 - DNA, 25 bp, Mus musculus
tccggtgcctactgagctgatatca

SEQ ID NO: 56839 - DNA, 25 bp, Mus musculus
tccgtaaagaatatctgctacccag

SEQ ID NO: 56840 - DNA, 25 bp, Mus musculus
tccgtaattgagcaggtctcatggg

SEQ ID NO: 56841 - DNA, 25 bp, Mus musculus
tccgtacgcaaggaagacattcacg

SEQ ID NO: 56842 - DNA, 25 bp, Mus musculus
tccgtactgccctttcataaaggca

SEQ ID NO: 56843 - DNA, 25 bp, Mus musculus
tccgtactttcgtcatgcttacaca

SEQ ID NO: 56844 - DNA, 25 bp, Mus musculus
tccgtagatttccagtggccccatt

SEQ ID NO: 56845 - DNA, 25 bp, Mus musculus
tccgtagcggtgtcatcctttgaac

SEQ ID NO: 56846 - DNA, 25 bp, Mus musculus
tccgtagctattgtagacgtgtgtc

SEQ ID NO: 56847 - DNA, 25 bp, Mus musculus
tccgtaggctggaacggcttgacca

SEQ ID NO: 56848 - DNA, 25 bp, Mus musculus
tccgtagtgccattcggagcgacgc

SEQ ID NO: 56849 - DNA, 25 bp, Mus musculus
tccgtagtgtgtttacctgaatgtt

SEQ ID NO: 56850 - DNA, 25 bp, Mus musculus
tccgtatcggagcatgttagccctg

SEQ ID NO: 56851 - DNA, 25 bp, Mus musculus
tccgtatgcaggagccgggttccct

SEQ ID NO: 56852 - DNA, 25 bp, Mus musculus
tccgtcaggccatgtctgcaggtcc

SEQ ID NO: 56853 - DNA, 25 bp, Mus musculus
tccgtcatctctgcagagcttcaga

SEQ ID NO: 56854 - DNA, 25 bp, Mus musculus
tccgtcatggtttattggcacgcct

SEQ ID NO: 56855 - DNA, 25 bp, Mus musculus
tccgtcattagaaacaacaggaaaa

SEQ ID NO: 56856 - DNA, 25 bp, Mus musculus
tccgtcctgttgctggcttactgtc

SEQ ID NO: 56857 - DNA, 25 bp, Mus musculus
tccgtcgtcgttcctgttgtgatcg

SEQ ID NO: 56858 - DNA, 25 bp, Mus musculus
tccgtctatgttagcccctatgaac

SEQ ID NO: 56859 - DNA, 25 bp, Mus musculus
tccgtctatgtttgcccctatgaac

SEQ ID NO: 56860 - DNA, 25 bp, Mus musculus
tccgtctgcacaaggtgcacgtgtg

SEQ ID NO: 56861 - DNA, 25 bp, Mus musculus
tccgtctggacacaacattgggtct

SEQ ID NO: 56862 - DNA, 25 bp, Mus musculus
tccgtcttatcaggcatcaagcacg

SEQ ID NO: 56863 - DNA, 25 bp, Mus musculus
tccgtgacagaacgcggttcggcct

SEQ ID NO: 56864 - DNA, 25 bp, Mus musculus
tccgtgacctcgtgaggctggcatg

SEQ ID NO: 56865 - DNA, 25 bp, Mus musculus
tccgtgaggccaagaatgacagcga

SEQ ID NO: 56866 - DNA, 25 bp, Mus musculus
tccgtgatccttccgcttcagatgg

SEQ ID NO: 56867 - DNA, 25 bp, Mus musculus
tccgtgatgaggagctatcgtgctc

SEQ ID NO: 56868 - DNA, 25 bp, Mus musculus
tccgtgatgtaggtgattttgatga

SEQ ID NO: 56869 - DNA, 25 bp, Mus musculus
tccgtgattacttcacctctgcgtg

SEQ ID NO: 56870 - DNA, 25 bp, Mus musculus
tccgtgcacataccagcaaaggcgc

SEQ ID NO: 56871 - DNA, 25 bp, Mus musculus
tccgtgcagtaaaccccaggatcag

SEQ ID NO: 56872 - DNA, 25 bp, Mus musculus
tccgtgccagaaccagggtgtctgt

SEQ ID NO: 56873 - DNA, 25 bp, Mus musculus
tccgtgccagaagcagggtgtctgt

SEQ ID NO: 56874 - DNA, 25 bp, Mus musculus
tccgtgctttcaatgtgacagcccc

SEQ ID NO: 56875 - DNA, 25 bp, Mus musculus
tccgtggacgatcgccttaagcagc

SEQ ID NO: 56876 - DNA, 25 bp, Mus musculus
tccgtggactgctgactgcgcgaga

SEQ ID NO: 56877 - DNA, 25 bp, Mus musculus
tccgtgggtcaaagtaagggatact

SEQ ID NO: 56878 - DNA, 25 bp, Mus musculus
tccgtggtgattgccgtcaagatgc

SEQ ID NO: 56879 - DNA, 25 bp, Mus musculus
tccgtggtgctctcccatcaaggtg

SEQ ID NO: 56880 - DNA, 25 bp, Mus musculus
tccgtggttgcacagtttggctgac

SEQ ID NO: 56881 - DNA, 25 bp, Mus musculus
tccgtgtgacctcagttctgggagt

SEQ ID NO: 56882 - DNA, 25 bp, Mus musculus
tccgtgtgggctactatgtcaacaa

SEQ ID NO: 56883 - DNA, 25 bp, Mus musculus
tccgtgtgtcatcagccaaactcga

SEQ ID NO: 56884 - DNA, 25 bp, Mus musculus
tccgttaactttgcactccgacgtg

SEQ ID NO: 56885 - DNA, 25 bp, Mus musculus
tccgttaagtggactctccaccaag

SEQ ID NO: 56886 - DNA, 25 bp, Mus musculus
tccgttacagtcagtttcagaggag

SEQ ID NO: 56887 - DNA, 25 bp, Mus musculus
tccgttcagtgagctcctatgggaa

SEQ ID NO: 56888 - DNA, 25 bp, Mus musculus
tccgttccatcccagtaatgtgaag

SEQ ID NO: 56889 - DNA, 25 bp, Mus musculus
tccgttccatcgctgtctactatga

SEQ ID NO: 56890 - DNA, 25 bp, Mus musculus
tccgttttactctaggagtctgtgt

SEQ ID NO: 56891 - DNA, 25 bp, Mus musculus
tcctaaagaggtgctaggatggaag

SEQ ID NO: 56892 - DNA, 25 bp, Mus musculus
tcctaaagttagctgatgttttcag

SEQ ID NO: 56893 - DNA, 25 bp, Mus musculus
tcctaaattgacaaagggccagcca

SEQ ID NO: 56894 - DNA, 25 bp, Mus musculus
tcctaaattgactaagggccagcca

SEQ ID NO: 56895 - DNA, 25 bp, Mus musculus
tcctaacaatgccagatgttcctgg

SEQ ID NO: 56896 - DNA, 25 bp, Mus musculus
tcctaacccatgaggctggaatcac

SEQ ID NO: 56897 - DNA, 25 bp, Mus musculus
tcctaactgatagcagctctacaac

SEQ ID NO: 56898 - DNA, 25 bp, Mus musculus
tcctaagaaagtgctgagatagagt

SEQ ID NO: 56899 - DNA, 25 bp, Mus musculus
tcctaatggcccatgcgctgaagcg

SEQ ID NO: 56900 - DNA, 25 bp, Mus musculus
tcctaatgtacagcggacacgccgt

SEQ ID NO: 56901 - DNA, 25 bp, Mus musculus
tcctaattttgggtacaggtcagtt

SEQ ID NO: 56902 - DNA, 25 bp, Mus musculus
tcctacaaacgacagaatgaagcaa

SEQ ID NO: 56903 - DNA, 25 bp, Mus musculus
tcctacaatttgaggcaggagccaa

SEQ ID NO: 56904 - DNA, 25 bp, Mus musculus
tcctacaatttgtggcaggagccaa

SEQ ID NO: 56905 - DNA, 25 bp, Mus musculus
tcctacacagttattcattagtcca

SEQ ID NO: 56906 - DNA, 25 bp, Mus musculus
tcctacacagtttttcattagtcca

SEQ ID NO: 56907 - DNA, 25 bp, Mus musculus
tcctacagacatatgcccgaggccg

SEQ ID NO: 56908 - DNA, 25 bp, Mus musculus
tcctacagcggagtggaaatctgtg

SEQ ID NO: 56909 - DNA, 25 bp, Mus musculus
tcctacagctcagcagggaggacca

SEQ ID NO: 56910 - DNA, 25 bp, Mus musculus
tcctacaggaacaccagggaagcca

SEQ ID NO: 56911 - DNA, 25 bp, Mus musculus
tcctacaggctgacggtggtggcca

SEQ ID NO: 56912 - DNA, 25 bp, Mus musculus
tcctaccaaggccttggaacagcgc

SEQ ID NO: 56913 - DNA, 25 bp, Mus musculus
tcctaccagggtgtcaaggccagag

SEQ ID NO: 56914 - DNA, 25 bp, Mus musculus
tcctaccagtaagagcagccaaatg

SEQ ID NO: 56915 - DNA, 25 bp, Mus musculus
tcctacccacaacataagcagtatg

SEQ ID NO: 56916 - DNA, 25 bp, Mus musculus
tcctacccagctaaacacagtggag

SEQ ID NO: 56917 - DNA, 25 bp, Mus musculus
tcctaccgccttcacgagggcttct

SEQ ID NO: 56918 - DNA, 25 bp, Mus musculus
tcctaccgggatattagccacctca

SEQ ID NO: 56919 - DNA, 25 bp, Mus musculus
tcctacctgagttgttctaccctgt

SEQ ID NO: 56920 - DNA, 25 bp, Mus musculus
tcctaccttcccttggctcatatgt

SEQ ID NO: 56921 - DNA, 25 bp, Mus musculus
tcctacgacggcacagcagcagact

SEQ ID NO: 56922 - DNA, 25 bp, Mus musculus
tcctacgcaagggacagcatgatga

SEQ ID NO: 56923 - DNA, 25 bp, Mus musculus
tcctacgcttaccagccctatggag

SEQ ID NO: 56924 - DNA, 25 bp, Mus musculus
tcctacgtgaaacctgagcaacatt

SEQ ID NO: 56925 - DNA, 25 bp, Mus musculus
tcctactacaaaactgagggcgagg

SEQ ID NO: 56926 - DNA, 25 bp, Mus musculus
tcctactatggactctttaccacag

SEQ ID NO: 56927 - DNA, 25 bp, Mus musculus
tcctactctgatactgggctgctgg

SEQ ID NO: 56928 - DNA, 25 bp, Mus musculus
tcctactctggcacatcaagtttct

SEQ ID NO: 56929 - DNA, 25 bp, Mus musculus
tcctactctggctcatcaagtttct

SEQ ID NO: 56930 - DNA, 25 bp, Mus musculus
tcctactgaaacaggcattgacaat

SEQ ID NO: 56931 - DNA, 25 bp, Mus musculus
tcctactgagtggaagccctatgcc

SEQ ID NO: 56932 - DNA, 25 bp, Mus musculus
tcctactgtgtgaatggaggcgtgt

SEQ ID NO: 56933 - DNA, 25 bp, Mus musculus
tcctacttgcctttagcacacatgt

SEQ ID NO: 56934 - DNA, 25 bp, Mus musculus
tcctagacacaaaccggtatcttta

SEQ ID NO: 56935 - DNA, 25 bp, Mus musculus
tcctagacacttggcagtcctggtg

SEQ ID NO: 56936 - DNA, 25 bp, Mus musculus
tcctagacccaaacaactattctgc

SEQ ID NO: 56937 - DNA, 25 bp, Mus musculus
tcctagatgacaatgacaactggcc

SEQ ID NO: 56938 - DNA, 25 bp, Mus musculus
tcctagcctcagctctgttcaaatc

SEQ ID NO: 56939 - DNA, 25 bp, Mus musculus
tcctagctacactcctgatgattgt

SEQ ID NO: 56940 - DNA, 25 bp, Mus musculus
tcctagctacattcgagactccact

SEQ ID NO: 56941 - DNA, 25 bp, Mus musculus
tcctaggaattctatcaaaaatcag

SEQ ID NO: 56942 - DNA, 25 bp, Mus musculus
tcctaggcgtgctctgccccttgtg

SEQ ID NO: 56943 - DNA, 25 bp, Mus musculus
tcctagtaaagaaaagcccagaaga

SEQ ID NO: 56944 - DNA, 25 bp, Mus musculus
tcctagtaccccatggaacccaagt

SEQ ID NO: 56945 - DNA, 25 bp, Mus musculus
tcctagtgatgacaagacgacattg

SEQ ID NO: 56946 - DNA, 25 bp, Mus musculus
tcctagtgccagaagtcaatttgct

SEQ ID NO: 56947 - DNA, 25 bp, Mus musculus
tcctagtggacaagtggaaactgac

SEQ ID NO: 56948 - DNA, 25 bp, Mus musculus
tcctagttaaaggtttgagcaacgc

SEQ ID NO: 56949 - DNA, 25 bp, Mus musculus
tcctataatgaacactggaaccatc

SEQ ID NO: 56950 - DNA, 25 bp, Mus musculus
tcctataatgaagactggaaccatc

SEQ ID NO: 56951 - DNA, 25 bp, Mus musculus
tcctataggatgaggacagaccctc

SEQ ID NO: 56952 - DNA, 25 bp, Mus musculus
tcctatcacgctcatcagtatgtgg

SEQ ID NO: 56953 - DNA, 25 bp, Mus musculus
tcctatcagcatatcatgaagtggg

SEQ ID NO: 56954 - DNA, 25 bp, Mus musculus
tcctatcattaacgaccagtctcaa

SEQ ID NO: 56955 - DNA, 25 bp, Mus musculus
tcctatcccagagagttttgtcaag

SEQ ID NO: 56956 - DNA, 25 bp, Mus musculus
tcctatcgaaaaccgggatgtactg

SEQ ID NO: 56957 - DNA, 25 bp, Mus musculus
tcctatcggagttgcagtattatct

SEQ ID NO: 56958 - DNA, 25 bp, Mus musculus
tcctatctcctgagattgagctcac

SEQ ID NO: 56959 - DNA, 25 bp, Mus musculus
tcctatctgatcctggagaccctgc

SEQ ID NO: 56960 - DNA, 25 bp, Mus musculus
tcctatcttcaagctgaaggaatct

SEQ ID NO: 56961 - DNA, 25 bp, Mus musculus
tcctatcttgtggatgatcccctgt

SEQ ID NO: 56962 - DNA, 25 bp, Mus musculus
tcctatgaagagatgctgcgattct

SEQ ID NO: 56963 - DNA, 25 bp, Mus musculus
tcctatggatggtcatgcctgccct

SEQ ID NO: 56964 - DNA, 25 bp, Mus musculus
tcctatggcatggacaatcacagtg

SEQ ID NO: 56965 - DNA, 25 bp, Mus musculus
tcctatgggaacatccgagccgtca

SEQ ID NO: 56966 - DNA, 25 bp, Mus musculus
tcctatgggcgtgccctgcaggcat

SEQ ID NO: 56967 - DNA, 25 bp, Mus musculus
tcctatgtgtacactgctgagctct

SEQ ID NO: 56968 - DNA, 25 bp, Mus musculus
tcctattccactggagacaacagag

SEQ ID NO: 56969 - DNA, 25 bp, Mus musculus
tcctattccatctgtttcttcggga

SEQ ID NO: 56970 - DNA, 25 bp, Mus musculus
tcctattgggcctgtacatctcatc

SEQ ID NO: 56971 - DNA, 25 bp, Mus musculus
tcctattgtatagagatgtgtgaca

SEQ ID NO: 56972 - DNA, 25 bp, Mus musculus
tcctatttgactaccaacccgaggc

SEQ ID NO: 56973 - DNA, 25 bp, Mus musculus
tcctatttggaccaagtaccactaa

SEQ ID NO: 56974 - DNA, 25 bp, Mus musculus
tcctcaaatggtcaccgacccaatt

SEQ ID NO: 56975 - DNA, 25 bp, Mus musculus
tcctcaacgatgtagccatgttcct

SEQ ID NO: 56976 - DNA, 25 bp, Mus musculus
tcctcaacgcacataggaagtgtgt

SEQ ID NO: 56977 - DNA, 25 bp, Mus musculus
tcctcaagcgatgacagctgggaaa

SEQ ID NO: 56978 - DNA, 25 bp, Mus musculus
tcctcaaggattcaaccagggcctg

SEQ ID NO: 56979 - DNA, 25 bp, Mus musculus
tcctcaatgactagaacccacagag

SEQ ID NO: 56980 - DNA, 25 bp, Mus musculus
tcctcacaacattactacgaaggag

SEQ ID NO: 56981 - DNA, 25 bp, Mus musculus
tcctcacactggcttggttcctggc

SEQ ID NO: 56982 - DNA, 25 bp, Mus musculus
tcctcaccatgtttgaagaaaatta

SEQ ID NO: 56983 - DNA, 25 bp, Mus musculus
tcctcacctttatgggaatggcagt

SEQ ID NO: 56984 - DNA, 25 bp, Mus musculus
tcctcacgcggtagagatcagccgg

SEQ ID NO: 56985 - DNA, 25 bp, Mus musculus
tcctcacggtgatatgggagctgcc

SEQ ID NO: 56986 - DNA, 25 bp, Mus musculus
tcctcacgtatcacgacatcggcat

SEQ ID NO: 56987 - DNA, 25 bp, Mus musculus
tcctcactgacatgtatgatgctca

SEQ ID NO: 56988 - DNA, 25 bp, Mus musculus
tcctcacttttacggttgggccagc

SEQ ID NO: 56989 - DNA, 25 bp, Mus musculus
tcctcacttttagggttgggccagc

SEQ ID NO: 56990 - DNA, 25 bp, Mus musculus
tcctcagagagaatctgaagttgag

SEQ ID NO: 56991 - DNA, 25 bp, Mus musculus
tcctcagcactttgtggaacctgtt

SEQ ID NO: 56992 - DNA, 25 bp, Mus musculus
tcctcagcagaaaaccaggcacaga

SEQ ID NO: 56993 - DNA, 25 bp, Mus musculus
tcctcagcccagatggatggcccag

SEQ ID NO: 56994 - DNA, 25 bp, Mus musculus
tcctcagcctgatcatcagccaggg

SEQ ID NO: 56995 - DNA, 25 bp, Mus musculus
tcctcagggcccagtgagtacatgg

SEQ ID NO: 56996 - DNA, 25 bp, Mus musculus
tcctcagtctgggagtggtgaaaga

SEQ ID NO: 56997 - DNA, 25 bp, Mus musculus
tcctcagtgacctttatgcaatggg

SEQ ID NO: 56998 - DNA, 25 bp, Mus musculus
tcctcagtgattggagaaagctata

SEQ ID NO: 56999 - DNA, 25 bp, Mus musculus
tcctcagttccggatattggtgtgt

SEQ ID NO: 57000 - DNA, 25 bp, Mus musculus
tcctcataggtggtatattctttgc

SEQ ID NO: 57001 - DNA, 25 bp, Mus musculus
tcctcatcagagatcctgagataca

SEQ ID NO: 57002 - DNA, 25 bp, Mus musculus
tcctcatcatagtgggcatctgcct

SEQ ID NO: 57003 - DNA, 25 bp, Mus musculus
tcctcatcatggatcacccgagcat

SEQ ID NO: 57004 - DNA, 25 bp, Mus musculus
tcctcatcgcactgcaggaagccag

SEQ ID NO: 57005 - DNA, 25 bp, Mus musculus
tcctcatcgcctccatagtgatagc

SEQ ID NO: 57006 - DNA, 25 bp, Mus musculus
tcctcatgacactggcatgttcaca

SEQ ID NO: 57007 - DNA, 25 bp, Mus musculus
tcctcatgactttgtcactcggtat

SEQ ID NO: 57008 - DNA, 25 bp, Mus musculus
tcctcatgctgttggctggcccaga

SEQ ID NO: 57009 - DNA, 25 bp, Mus musculus
tcctcattgcagttccctgaagaga

SEQ ID NO: 57010 - DNA, 25 bp, Mus musculus
tcctccaaaacgctggtttaaagat

SEQ ID NO: 57011 - DNA, 25 bp, Mus musculus
tcctccaaaagaagaaccaaaagat

SEQ ID NO: 57012 - DNA, 25 bp, Mus musculus
tcctccagagttaactgccatgact

SEQ ID NO: 57013 - DNA, 25 bp, Mus musculus
tcctccagagtttactgccatgact

SEQ ID NO: 57014 - DNA, 25 bp, Mus musculus
tcctccagcatctgatgcttgtgct

SEQ ID NO: 57015 - DNA, 25 bp, Mus musculus
tcctcccacacaaggagctgcggtt

SEQ ID NO: 57016 - DNA, 25 bp, Mus musculus
tcctcccattcagaggagatactct

SEQ ID NO: 57017 - DNA, 25 bp, Mus musculus
tcctccccacagagtatgctctgga

SEQ ID NO: 57018 - DNA, 25 bp, Mus musculus
tcctccccaggttctgcgagatgtg

SEQ ID NO: 57019 - DNA, 25 bp, Mus musculus
tcctcccggataagcagagcaagcg

SEQ ID NO: 57020 - DNA, 25 bp, Mus musculus
tcctccctaggacgttaggattgca

SEQ ID NO: 57021 - DNA, 25 bp, Mus musculus
tcctccctcatctgagaaggcagag

SEQ ID NO: 57022 - DNA, 25 bp, Mus musculus
tcctccctgacgtcctcaagaaggt

SEQ ID NO: 57023 - DNA, 25 bp, Mus musculus
tcctcccttcaatttgcctttgcag

SEQ ID NO: 57024 - DNA, 25 bp, Mus musculus
tcctccgagaagtcgtcctggcggg

SEQ ID NO: 57025 - DNA, 25 bp, Mus musculus
tcctccgaggcacacagtcggctgt

SEQ ID NO: 57026 - DNA, 25 bp, Mus musculus
tcctccgcggctctgattgcttacg

SEQ ID NO: 57027 - DNA, 25 bp, Mus musculus
tcctccggaagggtgtgcagctgct

SEQ ID NO: 57028 - DNA, 25 bp, Mus musculus
tcctccggaaggtggcgccacaact

SEQ ID NO: 57029 - DNA, 25 bp, Mus musculus
tcctccgttccatcccagtaatgtg

SEQ ID NO: 57030 - DNA, 25 bp, Mus musculus
tcctcctaggtgctttggacgctgc

SEQ ID NO: 57031 - DNA, 25 bp, Mus musculus
tcctcctcattgtcttggccggctt

SEQ ID NO: 57032 - DNA, 25 bp, Mus musculus
tcctcctccggaagggtgtgcagct

SEQ ID NO: 57033 - DNA, 25 bp, Mus musculus
tcctcctcggaggagaaagagacgg

SEQ ID NO: 57034 - DNA, 25 bp, Mus musculus
tcctcctgcacactggacagaagat

SEQ ID NO: 57035 - DNA, 25 bp, Mus musculus
tcctcctgcagaccgtggatggcaa

SEQ ID NO: 57036 - DNA, 25 bp, Mus musculus
tcctcctgcctgcatgtacactaag

SEQ ID NO: 57037 - DNA, 25 bp, Mus musculus
tcctcctggatcatggagcatcttt

SEQ ID NO: 57038 - DNA, 25 bp, Mus musculus
tcctccttcaactgggacgacgaaa

SEQ ID NO: 57039 - DNA, 25 bp, Mus musculus
tcctccttcacacttgcagattacg

SEQ ID NO: 57040 - DNA, 25 bp, Mus musculus
tcctccttcatgtcacgagagcgtg

SEQ ID NO: 57041 - DNA, 25 bp, Mus musculus
tcctccttgcaggtgggaatcctag

SEQ ID NO: 57042 - DNA, 25 bp, Mus musculus
tcctccttgccgactttgtcctgga

SEQ ID NO: 57043 - DNA, 25 bp, Mus musculus
tcctccttggcatctggctcatttg

SEQ ID NO: 57044 - DNA, 25 bp, Mus musculus
tcctccttgggaggcacaggattct

SEQ ID NO: 57045 - DNA, 25 bp, Mus musculus
tcctcctttggcagcatcccttgtg

SEQ ID NO: 57046 - DNA, 25 bp, Mus musculus
tcctcctttggctgcatcccttgtg

SEQ ID NO: 57047 - DNA, 25 bp, Mus musculus
tcctcgaaggatcacccccaagttt

SEQ ID NO: 57048 - DNA, 25 bp, Mus musculus
tcctcgacgagtcctggccataaag

SEQ ID NO: 57049 - DNA, 25 bp, Mus musculus
tcctcgatctacagactacacttgg

SEQ ID NO: 57050 - DNA, 25 bp, Mus musculus
tcctcgccttcctggtgtgattcgc

SEQ ID NO: 57051 - DNA, 25 bp, Mus musculus
tcctcgctcaatgacgaacctgagg

SEQ ID NO: 57052 - DNA, 25 bp, Mus musculus
tcctcggaggagaaagagacggaca

SEQ ID NO: 57053 - DNA, 25 bp, Mus musculus
tcctcggatggctttttgtgccagt

SEQ ID NO: 57054 - DNA, 25 bp, Mus musculus
tcctcgtaagtgatcagagccgctt

SEQ ID NO: 57055 - DNA, 25 bp, Mus musculus
tcctcgtctttcagcagcatcacag

SEQ ID NO: 57056 - DNA, 25 bp, Mus musculus
tcctcgtggaagtgatggatcctgg

SEQ ID NO: 57057 - DNA, 25 bp, Mus musculus
tcctcgtggaggaccacccactgtg

SEQ ID NO: 57058 - DNA, 25 bp, Mus musculus
tcctcgtgggactgaggtcagcttc

SEQ ID NO: 57059 - DNA, 25 bp, Mus musculus
tcctcgtgggagacactggagaaga

SEQ ID NO: 57060 - DNA, 25 bp, Mus musculus
tcctctaacctgtgcctgtgagcca

SEQ ID NO: 57061 - DNA, 25 bp, Mus musculus
tcctctacacataccagaaactggg

SEQ ID NO: 57062 - DNA, 25 bp, Mus musculus
tcctctacagtgtctgtcccttgca

SEQ ID NO: 57063 - DNA, 25 bp, Mus musculus
tcctctaccatctgggagataaaat

SEQ ID NO: 57064 - DNA, 25 bp, Mus musculus
tcctctacctaaaatagatcttgat

SEQ ID NO: 57065 - DNA, 25 bp, Mus musculus
tcctctagaagatagcagcactatt

SEQ ID NO: 57066 - DNA, 25 bp, Mus musculus
tcctctagcgaacatgttaaagcct

SEQ ID NO: 57067 - DNA, 25 bp, Mus musculus
tcctctatcataagtcgccaaaaac

SEQ ID NO: 57068 - DNA, 25 bp, Mus musculus
tcctctattcagagggacaggagga

SEQ ID NO: 57069 - DNA, 25 bp, Mus musculus
tcctctcaaccaccggaaggttgtt

SEQ ID NO: 57070 - DNA, 25 bp, Mus musculus
tcctctcaagcttgaccagaaacag

SEQ ID NO: 57071 - DNA, 25 bp, Mus musculus
tcctctcaaggatgatttggccaac

SEQ ID NO: 57072 - DNA, 25 bp, Mus musculus
tcctctcaggagacgcatgacagtc

SEQ ID NO: 57073 - DNA, 25 bp, Mus musculus
tcctctcgctctccggagactggag

SEQ ID NO: 57074 - DNA, 25 bp, Mus musculus
tcctctcgctctgcggagactggag

SEQ ID NO: 57075 - DNA, 25 bp, Mus musculus
tcctctcggagtgaaaccgacctgg

SEQ ID NO: 57076 - DNA, 25 bp, Mus musculus
tcctctctaagctgcgatcgccgtg

SEQ ID NO: 57077 - DNA, 25 bp, Mus musculus
tcctctctacatgaatcagaagtgc

SEQ ID NO: 57078 - DNA, 25 bp, Mus musculus
tcctctgataaaatgcctaatgacc

SEQ ID NO: 57079 - DNA, 25 bp, Mus musculus
tcctctgatgaggaagggattccaa

SEQ ID NO: 57080 - DNA, 25 bp, Mus musculus
tcctctgcccagagtgaaaagactg

SEQ ID NO: 57081 - DNA, 25 bp, Mus musculus
tcctctgctgtcagatgtctttctg

SEQ ID NO: 57082 - DNA, 25 bp, Mus musculus
tcctctgctgtgtcaggtgccggca

SEQ ID NO: 57083 - DNA, 25 bp, Mus musculus
tcctctggaaacattctgtatctca

SEQ ID NO: 57084 - DNA, 25 bp, Mus musculus
tcctctggaactggcaatgttgttg

SEQ ID NO: 57085 - DNA, 25 bp, Mus musculus
tcctctggatcctcggctcacaaaa

SEQ ID NO: 57086 - DNA, 25 bp, Mus musculus
tcctctggcatgacgtccttgtcct

SEQ ID NO: 57087 - DNA, 25 bp, Mus musculus
tcctctggcctcagatctggatctt

SEQ ID NO: 57088 - DNA, 25 bp, Mus musculus
tcctctgggacatcaagtggtggcc

SEQ ID NO: 57089 - DNA, 25 bp, Mus musculus
tcctctgggctttaccagtgcacag

SEQ ID NO: 57090 - DNA, 25 bp, Mus musculus
tcctctgtgaagctgcgactgctgt

SEQ ID NO: 57091 - DNA, 25 bp, Mus musculus
tcctctgtgagtcggtgtttagcta

SEQ ID NO: 57092 - DNA, 25 bp, Mus musculus
tcctctgtgtggtgaagatgaaaga

SEQ ID NO: 57093 - DNA, 25 bp, Mus musculus
tcctctgttgtgcatccgttgctgc

SEQ ID NO: 57094 - DNA, 25 bp, Mus musculus
tcctcttaagcactcatccttctat

SEQ ID NO: 57095 - DNA, 25 bp, Mus musculus
tcctcttaagcagtcatccttctat

SEQ ID NO: 57096 - DNA, 25 bp, Mus musculus
tcctcttagtctcctgtttgctctg

SEQ ID NO: 57097 - DNA, 25 bp, Mus musculus
tcctcttccttgaggcttctgatgg

SEQ ID NO: 57098 - DNA, 25 bp, Mus musculus
tcctcttgaccaaggcagtgaacag

SEQ ID NO: 57099 - DNA, 25 bp, Mus musculus
tcctcttgccttcgttccaaattgc

SEQ ID NO: 57100 - DNA, 25 bp, Mus musculus
tcctcttgggtctattaaatcatca

SEQ ID NO: 57101 - DNA, 25 bp, Mus musculus
tcctctttaaaaggctttgtgaaag

SEQ ID NO: 57102 - DNA, 25 bp, Mus musculus
tcctgaaacacagcgagcagatctt

SEQ ID NO: 57103 - DNA, 25 bp, Mus musculus
tcctgaaacactgaagcgtctgttt

SEQ ID NO: 57104 - DNA, 25 bp, Mus musculus
tcctgaaatggaggcgccagcttgt

SEQ ID NO: 57105 - DNA, 25 bp, Mus musculus
tcctgaaattccctgatgatcaggc

SEQ ID NO: 57106 - DNA, 25 bp, Mus musculus
tcctgaaattcgtgcggcagattgg

SEQ ID NO: 57107 - DNA, 25 bp, Mus musculus
tcctgaacaaggctgagaatctggt

SEQ ID NO: 57108 - DNA, 25 bp, Mus musculus
tcctgaacaagggtgagaatctggt

SEQ ID NO: 57109 - DNA, 25 bp, Mus musculus
tcctgaacctgttgggctcgctggg

SEQ ID NO: 57110 - DNA, 25 bp, Mus musculus
tcctgaacttgagcgggaaggtgct

SEQ ID NO: 57111 - DNA, 25 bp, Mus musculus
tcctgaactttaagaggctacagtc

SEQ ID NO: 57112 - DNA, 25 bp, Mus musculus
tcctgaactttgtccgttttactct

SEQ ID NO: 57113 - DNA, 25 bp, Mus musculus
tcctgaagaaaggataaagttcaag

SEQ ID NO: 57114 - DNA, 25 bp, Mus musculus
tcctgaagaagatgctccatcctcg

SEQ ID NO: 57115 - DNA, 25 bp, Mus musculus
tcctgaagcaacaggataccctgtg

SEQ ID NO: 57116 - DNA, 25 bp, Mus musculus
tcctgaagctaggtcgcgaccacga

SEQ ID NO: 57117 - DNA, 25 bp, Mus musculus
tcctgaagctggcagattttgggct

SEQ ID NO: 57118 - DNA, 25 bp, Mus musculus
tcctgaaggcctataccatctacag

SEQ ID NO: 57119 - DNA, 25 bp, Mus musculus
tcctgaaggtgcctctgatgctggc

SEQ ID NO: 57120 - DNA, 25 bp, Mus musculus
tcctgaatctctttatccacacact

SEQ ID NO: 57121 - DNA, 25 bp, Mus musculus
tcctgacaaaaaagctaagcggcac

SEQ ID NO: 57122 - DNA, 25 bp, Mus musculus
tcctgacagaggtgacagatgttta

SEQ ID NO: 57123 - DNA, 25 bp, Mus musculus
tcctgacataaacccttgcttgtcg

SEQ ID NO: 57124 - DNA, 25 bp, Mus musculus
tcctgacatacttcgaccctgactt

SEQ ID NO: 57125 - DNA, 25 bp, Mus musculus
tcctgacatatttgcacccactgga

SEQ ID NO: 57126 - DNA, 25 bp, Mus musculus
tcctgacatcactggccataaacga

SEQ ID NO: 57127 - DNA, 25 bp, Mus musculus
tcctgaccacgcctaggaatgaagt

SEQ ID NO: 57128 - DNA, 25 bp, Mus musculus
tcctgaccacttgactagactgcgt

SEQ ID NO: 57129 - DNA, 25 bp, Mus musculus
tcctgaccctggtgaatgcaccata

SEQ ID NO: 57130 - DNA, 25 bp, Mus musculus
tcctgaccgagctgctcatggtggc

SEQ ID NO: 57131 - DNA, 25 bp, Mus musculus
tcctgaccttcctggcgttggagaa

SEQ ID NO: 57132 - DNA, 25 bp, Mus musculus
tcctgacgatttctctagggctctg

SEQ ID NO: 57133 - DNA, 25 bp, Mus musculus
tcctgacgccgccactgttgtcggt

SEQ ID NO: 57134 - DNA, 25 bp, Mus musculus
tcctgactaactgtgcatctccgag

SEQ ID NO: 57135 - DNA, 25 bp, Mus musculus
tcctgactatcgagggcagaactgc

SEQ ID NO: 57136 - DNA, 25 bp, Mus musculus
tcctgactgcagatatcagtgcgat

SEQ ID NO: 57137 - DNA, 25 bp, Mus musculus
tcctgactggaatctgctgtgtggg

SEQ ID NO: 57138 - DNA, 25 bp, Mus musculus
tcctgactggcgagaagcagcagac

SEQ ID NO: 57139 - DNA, 25 bp, Mus musculus
tcctgactttgaagattctacgtgc

SEQ ID NO: 57140 - DNA, 25 bp, Mus musculus
tcctgagaaaattagagagagacca

SEQ ID NO: 57141 - DNA, 25 bp, Mus musculus
tcctgagaaagataacagagaccag

SEQ ID NO: 57142 - DNA, 25 bp, Mus musculus
tcctgagacagtaccgagtgggcac

SEQ ID NO: 57143 - DNA, 25 bp, Mus musculus
tcctgagaccttgggcagaatcatg

SEQ ID NO: 57144 - DNA, 25 bp, Mus musculus
tcctgagacgtatgtctgggtgccc

SEQ ID NO: 57145 - DNA, 25 bp, Mus musculus
tcctgagccagcagctaaaaagccg

SEQ ID NO: 57146 - DNA, 25 bp, Mus musculus
tcctgagcctagagagagagttcag

SEQ ID NO: 57147 - DNA, 25 bp, Mus musculus
tcctgagcctgacggttgtaagagt

SEQ ID NO: 57148 - DNA, 25 bp, Mus musculus
tcctgagcctgccaaacctggagat

SEQ ID NO: 57149 - DNA, 25 bp, Mus musculus
tcctgagcgaagatgagagtgataa

SEQ ID NO: 57150 - DNA, 25 bp, Mus musculus
tcctgagctctacgtggacaagtct

SEQ ID NO: 57151 - DNA, 25 bp, Mus musculus
tcctgagctgttgtctctaaggccg

SEQ ID NO: 57152 - DNA, 25 bp, Mus musculus
tcctgaggacataggccctcccatt

SEQ ID NO: 57153 - DNA, 25 bp, Mus musculus
tcctgaggacgtactggtgccgaag

SEQ ID NO: 57154 - DNA, 25 bp, Mus musculus
tcctgaggagagagcccagaagatc

SEQ ID NO: 57155 - DNA, 25 bp, Mus musculus
tcctgaggcagatgtatgaaatctt

SEQ ID NO: 57156 - DNA, 25 bp, Mus musculus
tcctgaggcttatcttaaaatgacc

SEQ ID NO: 57157 - DNA, 25 bp, Mus musculus
tcctgaggttcacagatgatacctt

SEQ ID NO: 57158 - DNA, 25 bp, Mus musculus
tcctgagtcccctaggtaccagaac

SEQ ID NO: 57159 - DNA, 25 bp, Mus musculus
tcctgagtcgtgctctgttggtata

SEQ ID NO: 57160 - DNA, 25 bp, Mus musculus
tcctgagtgaaaatggagcattcct

SEQ ID NO: 57161 - DNA, 25 bp, Mus musculus
tcctgagtgtaaagggaccttcggc

SEQ ID NO: 57162 - DNA, 25 bp, Mus musculus
tcctgataatggctcctccctgcat

SEQ ID NO: 57163 - DNA, 25 bp, Mus musculus
tcctgataccttctttcacaatggg

SEQ ID NO: 57164 - DNA, 25 bp, Mus musculus
tcctgatagttcctctccaatcttg

SEQ ID NO: 57165 - DNA, 25 bp, Mus musculus
tcctgatattacgaaagatgaactc

SEQ ID NO: 57166 - DNA, 25 bp, Mus musculus
tcctgatcctgaatatgtctctagt

SEQ ID NO: 57167 - DNA, 25 bp, Mus musculus
tcctgatctcctgcatgttgggctc

SEQ ID NO: 57168 - DNA, 25 bp, Mus musculus
tcctgatctggaagctgagtacttg

SEQ ID NO: 57169 - DNA, 25 bp, Mus musculus
tcctgatgaagttgtagggccagaa

SEQ ID NO: 57170 - DNA, 25 bp, Mus musculus
tcctgatggtgaatgagggcacagc

SEQ ID NO: 57171 - DNA, 25 bp, Mus musculus
tcctgattacagatggatcagtact

SEQ ID NO: 57172 - DNA, 25 bp, Mus musculus
tcctgattatgtccatggaggtgca

SEQ ID NO: 57173 - DNA, 25 bp, Mus musculus
tcctgattctacacttccggcgagc

SEQ ID NO: 57174 - DNA, 25 bp, Mus musculus
tcctgattgactttggagttttcca

SEQ ID NO: 57175 - DNA, 25 bp, Mus musculus
tcctgcaaacagcaagattgtcgct

SEQ ID NO: 57176 - DNA, 25 bp, Mus musculus
tcctgcaaccttccgagatcttagt

SEQ ID NO: 57177 - DNA, 25 bp, Mus musculus
tcctgcaagtgaacaagccggtgct

SEQ ID NO: 57178 - DNA, 25 bp, Mus musculus
tcctgcaatacagtggatacagttt

SEQ ID NO: 57179 - DNA, 25 bp, Mus musculus
tcctgcacaccttcaaggccaagtt

SEQ ID NO: 57180 - DNA, 25 bp, Mus musculus
tcctgcacactggacagaagatgcc

SEQ ID NO: 57181 - DNA, 25 bp, Mus musculus
tcctgcacccagagggtgaatgggt

SEQ ID NO: 57182 - DNA, 25 bp, Mus musculus
tcctgcacctggagcggagggacct

SEQ ID NO: 57183 - DNA, 25 bp, Mus musculus
tcctgcacgttggagggacttccac

SEQ ID NO: 57184 - DNA, 25 bp, Mus musculus
tcctgcactacgagtttgagccttc

SEQ ID NO: 57185 - DNA, 25 bp, Mus musculus
tcctgcactacgtgtttgagccttc

SEQ ID NO: 57186 - DNA, 25 bp, Mus musculus
tcctgcagaccgtggatggcaaaca

SEQ ID NO: 57187 - DNA, 25 bp, Mus musculus
tcctgcagagggtggaccggctcat

SEQ ID NO: 57188 - DNA, 25 bp, Mus musculus
tcctgcagctgaagataactacggt

SEQ ID NO: 57189 - DNA, 25 bp, Mus musculus
tcctgcaggttcagtgcttgggaga

SEQ ID NO: 57190 - DNA, 25 bp, Mus musculus
tcctgcagtaaaatgggagacagag

SEQ ID NO: 57191 - DNA, 25 bp, Mus musculus
tcctgcagtgcaggaaccactgaag

SEQ ID NO: 57192 - DNA, 25 bp, Mus musculus
tcctgcatgccaacacaatggccag

SEQ ID NO: 57193 - DNA, 25 bp, Mus musculus
tcctgcatggctgaagatgatgctg

SEQ ID NO: 57194 - DNA, 25 bp, Mus musculus
tcctgcatgtcacagtgtcctccat

SEQ ID NO: 57195 - DNA, 25 bp, Mus musculus
tcctgccaactcttccacaaggagg

SEQ ID NO: 57196 - DNA, 25 bp, Mus musculus
tcctgccaattacgtcaaagtcatt

SEQ ID NO: 57197 - DNA, 25 bp, Mus musculus
tcctgccaattaggtcaaagtcatt

SEQ ID NO: 57198 - DNA, 25 bp, Mus musculus
tcctgccatcaaagtgctaagaaaa

SEQ ID NO: 57199 - DNA, 25 bp, Mus musculus
tcctgcccagaaagctacatcaggg

SEQ ID NO: 57200 - DNA, 25 bp, Mus musculus
tcctgcccagactcagataatagct

SEQ ID NO: 57201 - DNA, 25 bp, Mus musculus
tcctgcccaggcaacgtatcaaagt

SEQ ID NO: 57202 - DNA, 25 bp, Mus musculus
tcctgcccatggaggctttgccaac

SEQ ID NO: 57203 - DNA, 25 bp, Mus musculus
tcctgccccataaacattgaggaat

SEQ ID NO: 57204 - DNA, 25 bp, Mus musculus
tcctgcccggatggtctttggagaa

SEQ ID NO: 57205 - DNA, 25 bp, Mus musculus
tcctgccctatgaatacttatggag

SEQ ID NO: 57206 - DNA, 25 bp, Mus musculus
tcctgccctgtcattaaaggcttca

SEQ ID NO: 57207 - DNA, 25 bp, Mus musculus
tcctgccgaaaacccagttgggaat

SEQ ID NO: 57208 - DNA, 25 bp, Mus musculus
tcctgccgaaaagccagttgggaat

SEQ ID NO: 57209 - DNA, 25 bp, Mus musculus
tcctgccggctgaagctgaactgat

SEQ ID NO: 57210 - DNA, 25 bp, Mus musculus
tcctgcctctggctcacatgtttga

SEQ ID NO: 57211 - DNA, 25 bp, Mus musculus
tcctgcctgccttatgggcctgttg

SEQ ID NO: 57212 - DNA, 25 bp, Mus musculus
tcctgcctgcgaacaatgccaagaa

SEQ ID NO: 57213 - DNA, 25 bp, Mus musculus
tcctgccttgataaacttggtgacc

SEQ ID NO: 57214 - DNA, 25 bp, Mus musculus
tcctgcgagctgtgtgttcagtcaa

SEQ ID NO: 57215 - DNA, 25 bp, Mus musculus
tcctgcgcattgcattttactccag

SEQ ID NO: 57216 - DNA, 25 bp, Mus musculus
tcctgcgcgccacaatgagctccag

SEQ ID NO: 57217 - DNA, 25 bp, Mus musculus
tcctgcgcgccagaatgagctccag

SEQ ID NO: 57218 - DNA, 25 bp, Mus musculus
tcctgcgcttcctacaacttttctt

SEQ ID NO: 57219 - DNA, 25 bp, Mus musculus
tcctgcggcatgtgcctctgagcag

SEQ ID NO: 57220 - DNA, 25 bp, Mus musculus
tcctgcgtaccatcttccattaaag

SEQ ID NO: 57221 - DNA, 25 bp, Mus musculus
tcctgcgtgaggctccagaactcat

SEQ ID NO: 57222 - DNA, 25 bp, Mus musculus
tcctgcgttctatgagcgccggtct

SEQ ID NO: 57223 - DNA, 25 bp, Mus musculus
tcctgctaatggtgcgtgacggccg

SEQ ID NO: 57224 - DNA, 25 bp, Mus musculus
tcctgctactgcaggcctgcgggct

SEQ ID NO: 57225 - DNA, 25 bp, Mus musculus
tcctgctagactcatcagtggagag

SEQ ID NO: 57226 - DNA, 25 bp, Mus musculus
tcctgctagctggtgttgaccttgg

SEQ ID NO: 57227 - DNA, 25 bp, Mus musculus
tcctgctcaagctgagccttagcct

SEQ ID NO: 57228 - DNA, 25 bp, Mus musculus
tcctgctcccgccttggaaagggtg

SEQ ID NO: 57229 - DNA, 25 bp, Mus musculus
tcctgctgcatctgagcctgtgata

SEQ ID NO: 57230 - DNA, 25 bp, Mus musculus
tcctgctgcgactgactgcgatctc

SEQ ID NO: 57231 - DNA, 25 bp, Mus musculus
tcctgctgctcattcccaatgtgct

SEQ ID NO: 57232 - DNA, 25 bp, Mus musculus
tcctgctgcttagctggtgaatgaa

SEQ ID NO: 57233 - DNA, 25 bp, Mus musculus
tcctgctggaaaaccctgatgaggc

SEQ ID NO: 57234 - DNA, 25 bp, Mus musculus
tcctgctgggctcaagatgaatcgg

SEQ ID NO: 57235 - DNA, 25 bp, Mus musculus
tcctgctgggttactctgatgggtc

SEQ ID NO: 57236 - DNA, 25 bp, Mus musculus
tcctgctgtcgcaggtcctctttct

SEQ ID NO: 57237 - DNA, 25 bp, Mus musculus
tcctgctgtcgctggtcctctttct

SEQ ID NO: 57238 - DNA, 25 bp, Mus musculus
tcctgctgtgcgcacacctttagct

SEQ ID NO: 57239 - DNA, 25 bp, Mus musculus
tcctgctgtgcgtggcactgctgct

SEQ ID NO: 57240 - DNA, 25 bp, Mus musculus
tcctgcttcgaattttggaaggagg

SEQ ID NO: 57241 - DNA, 25 bp, Mus musculus
tcctgcttcgcagaatccgggctga

SEQ ID NO: 57242 - DNA, 25 bp, Mus musculus
tcctgcttttcctatcggagttgca

SEQ ID NO: 57243 - DNA, 25 bp, Mus musculus
tcctgctttttctcatcctcatcgg

SEQ ID NO: 57244 - DNA, 25 bp, Mus musculus
tcctggaaaattgactagtattaag

SEQ ID NO: 57245 - DNA, 25 bp, Mus musculus
tcctggaaacatacgttgttgctaa

SEQ ID NO: 57246 - DNA, 25 bp, Mus musculus
tcctggaaagaactttgtgaggctg

SEQ ID NO: 57247 - DNA, 25 bp, Mus musculus
tcctggaacaacaaaacgggcaagt

SEQ ID NO: 57248 - DNA, 25 bp, Mus musculus
tcctggaacaacaggtacaccgcct

SEQ ID NO: 57249 - DNA, 25 bp, Mus musculus
tcctggaagaaccaaccagcccaaa

SEQ ID NO: 57250 - DNA, 25 bp, Mus musculus
tcctggaagatgataggcatgcact

SEQ ID NO: 57251 - DNA, 25 bp, Mus musculus
tcctggaagatgttaggcatgcact

SEQ ID NO: 57252 - DNA, 25 bp, Mus musculus
tcctggaaggaggaaatccacgtcg

SEQ ID NO: 57253 - DNA, 25 bp, Mus musculus
tcctggaagggaagctcagagaccg

SEQ ID NO: 57254 - DNA, 25 bp, Mus musculus
tcctggaagtgatctggagacccca

SEQ ID NO: 57255 - DNA, 25 bp, Mus musculus
tcctggaccaggacttggaagttga

SEQ ID NO: 57256 - DNA, 25 bp, Mus musculus
tcctggaccggatgcgctcctttgg

SEQ ID NO: 57257 - DNA, 25 bp, Mus musculus
tcctggacgagcagaacacaactgg

SEQ ID NO: 57258 - DNA, 25 bp, Mus musculus
tcctggacgagctgaacacaactgg

SEQ ID NO: 57259 - DNA, 25 bp, Mus musculus
tcctggacgcctactgaagagtctg

SEQ ID NO: 57260 - DNA, 25 bp, Mus musculus
tcctggactctaccttggaaacttc

SEQ ID NO: 57261 - DNA, 25 bp, Mus musculus
tcctggactgtgaccgagatcactc

SEQ ID NO: 57262 - DNA, 25 bp, Mus musculus
tcctggacttggatgacttcaaggg

SEQ ID NO: 57263 - DNA, 25 bp, Mus musculus
tcctggagaatgctgcaaagctctt

SEQ ID NO: 57264 - DNA, 25 bp, Mus musculus
tcctggagaatggagaagaggcccc

SEQ ID NO: 57265 - DNA, 25 bp, Mus musculus
tcctggagaatggtgcaaagctctt

SEQ ID NO: 57266 - DNA, 25 bp, Mus musculus
tcctggagagaaacaacaaaggctg

SEQ ID NO: 57267 - DNA, 25 bp, Mus musculus
tcctggagagcattgccgtggccaa

SEQ ID NO: 57268 - DNA, 25 bp, Mus musculus
tcctggagcagatcctcttcatctt

SEQ ID NO: 57269 - DNA, 25 bp, Mus musculus
tcctggagctactcagtgtgtaaac

SEQ ID NO: 57270 - DNA, 25 bp, Mus musculus
tcctggaggcaaatccgtagctctg

SEQ ID NO: 57271 - DNA, 25 bp, Mus musculus
tcctggaggccccaatcgggacctg

SEQ ID NO: 57272 - DNA, 25 bp, Mus musculus
tcctggaggctgtgctacactgcca

SEQ ID NO: 57273 - DNA, 25 bp, Mus musculus
tcctggagtataaagacacctgcac

SEQ ID NO: 57274 - DNA, 25 bp, Mus musculus
tcctggagtatatagacacctgcac

SEQ ID NO: 57275 - DNA, 25 bp, Mus musculus
tcctggagtgtcctttttggtgcag

SEQ ID NO: 57276 - DNA, 25 bp, Mus musculus
tcctggagtttgaactacggaaagc

SEQ ID NO: 57277 - DNA, 25 bp, Mus musculus
tcctggatcctcgatgcaaactctg

SEQ ID NO: 57278 - DNA, 25 bp, Mus musculus
tcctggatgcagctactggatactt

SEQ ID NO: 57279 - DNA, 25 bp, Mus musculus
tcctggatgtaagcacaggattgag

SEQ ID NO: 57280 - DNA, 25 bp, Mus musculus
tcctggatgttaagacacctatgcg

SEQ ID NO: 57281 - DNA, 25 bp, Mus musculus
tcctggatgttatgacacctatgcg

SEQ ID NO: 57282 - DNA, 25 bp, Mus musculus
tcctggattcttcatattagctctg

SEQ ID NO: 57283 - DNA, 25 bp, Mus musculus
tcctggcagacattgcccggtcacg

SEQ ID NO: 57284 - DNA, 25 bp, Mus musculus
tcctggcagtccctcttgagatgct

SEQ ID NO: 57285 - DNA, 25 bp, Mus musculus
tcctggccagatacggactggatgg

SEQ ID NO: 57286 - DNA, 25 bp, Mus musculus
tcctggccgaacacatcctgttgag

SEQ ID NO: 57287 - DNA, 25 bp, Mus musculus
tcctggccttgtcgaggttttcatg

SEQ ID NO: 57288 - DNA, 25 bp, Mus musculus
tcctggccttgtggaggttttcatg

SEQ ID NO: 57289 - DNA, 25 bp, Mus musculus
tcctggcgctgacatcggctttgct

SEQ ID NO: 57290 - DNA, 25 bp, Mus musculus
tcctggcgtctgaatgagcgtcact

SEQ ID NO: 57291 - DNA, 25 bp, Mus musculus
tcctggcgttggagaagatgttcct

SEQ ID NO: 57292 - DNA, 25 bp, Mus musculus
tcctggctaaaggatgggaagctcg

SEQ ID NO: 57293 - DNA, 25 bp, Mus musculus
tcctggctattccagagcttgctct

SEQ ID NO: 57294 - DNA, 25 bp, Mus musculus
tcctggctcagctggagaagatcaa

SEQ ID NO: 57295 - DNA, 25 bp, Mus musculus
tcctggctcttggtctgcagcatgg

SEQ ID NO: 57296 - DNA, 25 bp, Mus musculus
tcctggctgcgcactttgggttgct

SEQ ID NO: 57297 - DNA, 25 bp, Mus musculus
tcctggctgggctgtccttcaggaa

SEQ ID NO: 57298 - DNA, 25 bp, Mus musculus
tcctggctgggtagtgaatatggca

SEQ ID NO: 57299 - DNA, 25 bp, Mus musculus
tcctggctgtgtgaaaattaaaaaa

SEQ ID NO: 57300 - DNA, 25 bp, Mus musculus
tcctggcttgcagtgagtactggct

SEQ ID NO: 57301 - DNA, 25 bp, Mus musculus
tcctggcttgcattgccacagctgc

SEQ ID NO: 57302 - DNA, 25 bp, Mus musculus
tcctggcttgtctcgaggatctgtg

SEQ ID NO: 57303 - DNA, 25 bp, Mus musculus
tcctgggaaatattggtccccaaca

SEQ ID NO: 57304 - DNA, 25 bp, Mus musculus
tcctgggaacacatcaaggccgttc

SEQ ID NO: 57305 - DNA, 25 bp, Mus musculus
tcctgggaagatgcactctctcgtg

SEQ ID NO: 57306 - DNA, 25 bp, Mus musculus
tcctgggacgttccaatccactggc

SEQ ID NO: 57307 - DNA, 25 bp, Mus musculus
tcctgggacttgaattaaggttgat

SEQ ID NO: 57308 - DNA, 25 bp, Mus musculus
tcctgggagaagtagaagtgcccct

SEQ ID NO: 57309 - DNA, 25 bp, Mus musculus
tcctgggagcctgactctggctgtt

SEQ ID NO: 57310 - DNA, 25 bp, Mus musculus
tcctgggagcttcagcttctttctt

SEQ ID NO: 57311 - DNA, 25 bp, Mus musculus
tcctgggcaagctgcactatgtgga

SEQ ID NO: 57312 - DNA, 25 bp, Mus musculus
tcctgggcactgtgacgtttctggc

SEQ ID NO: 57313 - DNA, 25 bp, Mus musculus
tcctgggcagtaaactcttggcctc

SEQ ID NO: 57314 - DNA, 25 bp, Mus musculus
tcctgggcataactaaccccgaagg

SEQ ID NO: 57315 - DNA, 25 bp, Mus musculus
tcctgggcatctgctggtgccagtg

SEQ ID NO: 57316 - DNA, 25 bp, Mus musculus
tcctgggcctgcttgtgctgcgctg

SEQ ID NO: 57317 - DNA, 25 bp, Mus musculus
tcctgggccttggatcggctgacct

SEQ ID NO: 57318 - DNA, 25 bp, Mus musculus
tcctgggccttgtacgggtcccact

SEQ ID NO: 57319 - DNA, 25 bp, Mus musculus
tcctgggctaatcggccctccaggg

SEQ ID NO: 57320 - DNA, 25 bp, Mus musculus
tcctgggctcacttgggaaaacgtg

SEQ ID NO: 57321 - DNA, 25 bp, Mus musculus
tcctgggtctggaaacctgtggttg

SEQ ID NO: 57322 - DNA, 25 bp, Mus musculus
tcctgggtgactcatagaagctctc

SEQ ID NO: 57323 - DNA, 25 bp, Mus musculus
tcctgggtgctgtgatcctgggctt

SEQ ID NO: 57324 - DNA, 25 bp, Mus musculus
tcctgggttaccagtgggcacccat

SEQ ID NO: 57325 - DNA, 25 bp, Mus musculus
tcctggtactcattatgtagctcca

SEQ ID NO: 57326 - DNA, 25 bp, Mus musculus
tcctggtcaccacgccatgactata

SEQ ID NO: 57327 - DNA, 25 bp, Mus musculus
tcctggtcagcctagagaagcagca

SEQ ID NO: 57328 - DNA, 25 bp, Mus musculus
tcctggtctccaatgctgctgtcaa

SEQ ID NO: 57329 - DNA, 25 bp, Mus musculus
tcctggtgaacaatgccgctgtggt

SEQ ID NO: 57330 - DNA, 25 bp, Mus musculus
tcctggtgatgtgttgcttagtaac

SEQ ID NO: 57331 - DNA, 25 bp, Mus musculus
tcctggtgcctgtggatcagcatgt

SEQ ID NO: 57332 - DNA, 25 bp, Mus musculus
tcctggtgcggaaatctaacactcg

SEQ ID NO: 57333 - DNA, 25 bp, Mus musculus
tcctggtggaagatacctgtctgtg

SEQ ID NO: 57334 - DNA, 25 bp, Mus musculus
tcctggtggatcttcatgtattgcc

SEQ ID NO: 57335 - DNA, 25 bp, Mus musculus
tcctggtggcgagttcgaaattcca

SEQ ID NO: 57336 - DNA, 25 bp, Mus musculus
tcctggtggctaacttcctgcttgt

SEQ ID NO: 57337 - DNA, 25 bp, Mus musculus
tcctggttcgagacaaattcgtgct

SEQ ID NO: 57338 - DNA, 25 bp, Mus musculus
tcctggttctgcctcagctaccata

SEQ ID NO: 57339 - DNA, 25 bp, Mus musculus
tcctggttgtggagttgtccctgag

SEQ ID NO: 57340 - DNA, 25 bp, Mus musculus
tcctgtaataaagagggatccgaac

SEQ ID NO: 57341 - DNA, 25 bp, Mus musculus
tcctgtaatcctaaacttctgactc

SEQ ID NO: 57342 - DNA, 25 bp, Mus musculus
tcctgtaccaggcacccacaaggaa

SEQ ID NO: 57343 - DNA, 25 bp, Mus musculus
tcctgtaccgggaaagagacgtcac

SEQ ID NO: 57344 - DNA, 25 bp, Mus musculus
tcctgtacctcatggaatgatgcca

SEQ ID NO: 57345 - DNA, 25 bp, Mus musculus
tcctgtacgacacagaaggtcccgc

SEQ ID NO: 57346 - DNA, 25 bp, Mus musculus
tcctgtagccaggtgctggagcacc

SEQ ID NO: 57347 - DNA, 25 bp, Mus musculus
tcctgtaggaagtgccccttggata

SEQ ID NO: 57348 - DNA, 25 bp, Mus musculus
tcctgtaggcagtgctgccgtgtcc

SEQ ID NO: 57349 - DNA, 25 bp, Mus musculus
tcctgtatacgtgggtacaaatgaa

SEQ ID NO: 57350 - DNA, 25 bp, Mus musculus
tcctgtatgagcagcagctgagcgc

SEQ ID NO: 57351 - DNA, 25 bp, Mus musculus
tcctgtatgtgggatccacaccact

SEQ ID NO: 57352 - DNA, 25 bp, Mus musculus
tcctgtattcatcgtaatgctgtgg

SEQ ID NO: 57353 - DNA, 25 bp, Mus musculus
tcctgtcactgacttccgagagtcc

SEQ ID NO: 57354 - DNA, 25 bp, Mus musculus
tcctgtcaggctcctgtcctaaact

SEQ ID NO: 57355 - DNA, 25 bp, Mus musculus
tcctgtcaggctgctgtcctaaact

SEQ ID NO: 57356 - DNA, 25 bp, Mus musculus
tcctgtccaacaagaagccggagct

SEQ ID NO: 57357 - DNA, 25 bp, Mus musculus
tcctgtccagcaatggacaaaccaa

SEQ ID NO: 57358 - DNA, 25 bp, Mus musculus
tcctgtcccggatcactagaagaac

SEQ ID NO: 57359 - DNA, 25 bp, Mus musculus
tcctgtccgctgaaaatgatgaatt

SEQ ID NO: 57360 - DNA, 25 bp, Mus musculus
tcctgtccgtggtgattgccgtcaa

SEQ ID NO: 57361 - DNA, 25 bp, Mus musculus
tcctgtcgagtggataagccttctg

SEQ ID NO: 57362 - DNA, 25 bp, Mus musculus
tcctgtctcggtggcgagtatttgc

SEQ ID NO: 57363 - DNA, 25 bp, Mus musculus
tcctgtctgcggctgtgatcacagc

SEQ ID NO: 57364 - DNA, 25 bp, Mus musculus
tcctgtgaaggccagaagtaggtat

SEQ ID NO: 57365 - DNA, 25 bp, Mus musculus
tcctgtgacttctaccgctgttggg

SEQ ID NO: 57366 - DNA, 25 bp, Mus musculus
tcctgtgagccagctcctgagattc

SEQ ID NO: 57367 - DNA, 25 bp, Mus musculus
tcctgtgaggaagatcctgtcgtct

SEQ ID NO: 57368 - DNA, 25 bp, Mus musculus
tcctgtgagtgtccagaaggcttcg

SEQ ID NO: 57369 - DNA, 25 bp, Mus musculus
tcctgtgcagagatctgtgggccgc

SEQ ID NO: 57370 - DNA, 25 bp, Mus musculus
tcctgtggaggcaaaattgggttct

SEQ ID NO: 57371 - DNA, 25 bp, Mus musculus
tcctgtggatcattccccagagggt

SEQ ID NO: 57372 - DNA, 25 bp, Mus musculus
tcctgtggcctataacctcatcaag

SEQ ID NO: 57373 - DNA, 25 bp, Mus musculus
tcctgtggccttcagcactgataag

SEQ ID NO: 57374 - DNA, 25 bp, Mus musculus
tcctgtggctgcattgttcaaccat

SEQ ID NO: 57375 - DNA, 25 bp, Mus musculus
tcctgtggtcatcagtggtgttcta

SEQ ID NO: 57376 - DNA, 25 bp, Mus musculus
tcctgtggtggccttctacgtctgg

SEQ ID NO: 57377 - DNA, 25 bp, Mus musculus
tcctgtgtacctatagaagcagtca

SEQ ID NO: 57378 - DNA, 25 bp, Mus musculus
tcctgtgtaggcagctgtggcccac

SEQ ID NO: 57379 - DNA, 25 bp, Mus musculus
tcctgtgtgacgagggtgcgggcat

SEQ ID NO: 57380 - DNA, 25 bp, Mus musculus
tcctgtgtgcagctgatggttgtca

SEQ ID NO: 57381 - DNA, 25 bp, Mus musculus
tcctgtgtgtatctggacaatgagt

SEQ ID NO: 57382 - DNA, 25 bp, Mus musculus
tcctgtgtgtatgtggacaatgagt

SEQ ID NO: 57383 - DNA, 25 bp, Mus musculus
tcctgtgttttcagaaagttgcagc

SEQ ID NO: 57384 - DNA, 25 bp, Mus musculus
tcctgttaacacagagtgccctggg

SEQ ID NO: 57385 - DNA, 25 bp, Mus musculus
tcctgttacatgcacggcattgtgt

SEQ ID NO: 57386 - DNA, 25 bp, Mus musculus
tcctgttacccaaggagacctctcg

SEQ ID NO: 57387 - DNA, 25 bp, Mus musculus
tcctgttcagtgaaatggacacaga

SEQ ID NO: 57388 - DNA, 25 bp, Mus musculus
tcctgttcagtgtaatggacacaga

SEQ ID NO: 57389 - DNA, 25 bp, Mus musculus
tcctgttcatggagagttcgaattg

SEQ ID NO: 57390 - DNA, 25 bp, Mus musculus
tcctgttccgctatgccgatgactc

SEQ ID NO: 57391 - DNA, 25 bp, Mus musculus
tcctgttcgtaaagctggccaaccc

SEQ ID NO: 57392 - DNA, 25 bp, Mus musculus
tcctgttcttcacttcccgggagcg

SEQ ID NO: 57393 - DNA, 25 bp, Mus musculus
tcctgttctttttaatgacaccgaa

SEQ ID NO: 57394 - DNA, 25 bp, Mus musculus
tcctgttggcacaagctcgggacaa

SEQ ID NO: 57395 - DNA, 25 bp, Mus musculus
tcctgttggccctgacaatcactgc

SEQ ID NO: 57396 - DNA, 25 bp, Mus musculus
tcctgttgtgatcgcctgtaatggc

SEQ ID NO: 57397 - DNA, 25 bp, Mus musculus
tccttaaaagcctcatttccccaag

SEQ ID NO: 57398 - DNA, 25 bp, Mus musculus
tccttaaacttttgcctgatgatta

SEQ ID NO: 57399 - DNA, 25 bp, Mus musculus
tccttaaatttagagcattcgcagc

SEQ ID NO: 57400 - DNA, 25 bp, Mus musculus
tccttaacaggtccattcacacagc

SEQ ID NO: 57401 - DNA, 25 bp, Mus musculus
tccttaaggcacatacctgaagtgg

SEQ ID NO: 57402 - DNA, 25 bp, Mus musculus
tccttacaggacgtgagctggtgtg

SEQ ID NO: 57403 - DNA, 25 bp, Mus musculus
tccttacagtaaatggagaattact

SEQ ID NO: 57404 - DNA, 25 bp, Mus musculus
tccttaccaaaggacgtatctgagg

SEQ ID NO: 57405 - DNA, 25 bp, Mus musculus
tccttaccaaccagttctcagaagc

SEQ ID NO: 57406 - DNA, 25 bp, Mus musculus
tccttactgcttctcaacttggagg

SEQ ID NO: 57407 - DNA, 25 bp, Mus musculus
tccttactggccatagtggagaatc

SEQ ID NO: 57408 - DNA, 25 bp, Mus musculus
tccttatcccaaactcattctgcag

SEQ ID NO: 57409 - DNA, 25 bp, Mus musculus
tccttatcctctccgggaacaagaa

SEQ ID NO: 57410 - DNA, 25 bp, Mus musculus
tccttatcctctgcgggaacaagaa

SEQ ID NO: 57411 - DNA, 25 bp, Mus musculus
tccttatgtctggaggagactgtgt

SEQ ID NO: 57412 - DNA, 25 bp, Mus musculus
tccttattcagcagtcatggatctg

SEQ ID NO: 57413 - DNA, 25 bp, Mus musculus
tccttattttcggaggaaacacctg

SEQ ID NO: 57414 - DNA, 25 bp, Mus musculus
tccttcaacagcccggctcagagat

SEQ ID NO: 57415 - DNA, 25 bp, Mus musculus
tccttcaactgggacgacgaaacag

SEQ ID NO: 57416 - DNA, 25 bp, Mus musculus
tccttcacggattgggagatacagg

SEQ ID NO: 57417 - DNA, 25 bp, Mus musculus
tccttcagagactgggcaaggctgc

SEQ ID NO: 57418 - DNA, 25 bp, Mus musculus
tccttcagtgccagccagctgcatg

SEQ ID NO: 57419 - DNA, 25 bp, Mus musculus
tccttcagtggtgttggtagtaaaa

SEQ ID NO: 57420 - DNA, 25 bp, Mus musculus
tccttcagttcggataggtcctaca

SEQ ID NO: 57421 - DNA, 25 bp, Mus musculus
tccttcatcaatagaggacatatca

SEQ ID NO: 57422 - DNA, 25 bp, Mus musculus
tccttcatcaattgaggacatatca

SEQ ID NO: 57423 - DNA, 25 bp, Mus musculus
tccttcattgctggggaccatcagg

SEQ ID NO: 57424 - DNA, 25 bp, Mus musculus
tccttccaagggttagctgagttgg

SEQ ID NO: 57425 - DNA, 25 bp, Mus musculus
tccttcccaaataatctgctcttgc

SEQ ID NO: 57426 - DNA, 25 bp, Mus musculus
tccttcccactggacacagttgagg

SEQ ID NO: 57427 - DNA, 25 bp, Mus musculus
tccttcccagcacgtcaggaacagg

SEQ ID NO: 57428 - DNA, 25 bp, Mus musculus
tccttcccatgaggaacaaggccag

SEQ ID NO: 57429 - DNA, 25 bp, Mus musculus
tccttccctggcagtgacatccatg

SEQ ID NO: 57430 - DNA, 25 bp, Mus musculus
tccttccgcaacacgggcgagatca

SEQ ID NO: 57431 - DNA, 25 bp, Mus musculus
tccttccgctgcctgtgtgaccagg

SEQ ID NO: 57432 - DNA, 25 bp, Mus musculus
tccttccgctgcgtgtgtgaccagg

SEQ ID NO: 57433 - DNA, 25 bp, Mus musculus
tccttcctagcaggctgcgtggctg

SEQ ID NO: 57434 - DNA, 25 bp, Mus musculus
tccttcgaaggccttcaggctgagg

SEQ ID NO: 57435 - DNA, 25 bp, Mus musculus
tccttcgaaggcgttcaggctgagg

SEQ ID NO: 57436 - DNA, 25 bp, Mus musculus
tccttcgagataccactgcagccat

SEQ ID NO: 57437 - DNA, 25 bp, Mus musculus
tccttcgcaagccttatgaaaactg

SEQ ID NO: 57438 - DNA, 25 bp, Mus musculus
tccttcgcagtgtggctgtcttcgc

SEQ ID NO: 57439 - DNA, 25 bp, Mus musculus
tccttcggacagtttacagtgttct

SEQ ID NO: 57440 - DNA, 25 bp, Mus musculus
tccttcgggagattgtgcacaagcc

SEQ ID NO: 57441 - DNA, 25 bp, Mus musculus
tccttcggtgtgacaatgtgggaga

SEQ ID NO: 57442 - DNA, 25 bp, Mus musculus
tccttctccagcatgtgaaagggtc

SEQ ID NO: 57443 - DNA, 25 bp, Mus musculus
tccttctcccttcgacagagtgtgt

SEQ ID NO: 57444 - DNA, 25 bp, Mus musculus
tccttctctgctcggtgagatcaag

SEQ ID NO: 57445 - DNA, 25 bp, Mus musculus
tccttctggcgtagagcagctctcg

SEQ ID NO: 57446 - DNA, 25 bp, Mus musculus
tccttctggcgttgagcagctctcg

SEQ ID NO: 57447 - DNA, 25 bp, Mus musculus
tccttctgggatccttgctgcacaa

SEQ ID NO: 57448 - DNA, 25 bp, Mus musculus
tccttctgttcggatcaaggtgaaa

SEQ ID NO: 57449 - DNA, 25 bp, Mus musculus
tccttctgttttggtccgtatcaca

SEQ ID NO: 57450 - DNA, 25 bp, Mus musculus
tccttctttagctcaagacttctac

SEQ ID NO: 57451 - DNA, 25 bp, Mus musculus
tccttgagatcttctccaggatgcc

SEQ ID NO: 57452 - DNA, 25 bp, Mus musculus
tccttgagcaagttccagttaaaaa

SEQ ID NO: 57453 - DNA, 25 bp, Mus musculus
tccttgaggatggagtggagaccat

SEQ ID NO: 57454 - DNA, 25 bp, Mus musculus
tccttgatgcaactatcagccaggc

SEQ ID NO: 57455 - DNA, 25 bp, Mus musculus
tccttgatggatgcaaagaacttag

SEQ ID NO: 57456 - DNA, 25 bp, Mus musculus
tccttgattggcatgtggcaaacac

SEQ ID NO: 57457 - DNA, 25 bp, Mus musculus
tccttgcactgcacgaagtagtttt

SEQ ID NO: 57458 - DNA, 25 bp, Mus musculus
tccttgcagatgatgataccagact

SEQ ID NO: 57459 - DNA, 25 bp, Mus musculus
tccttgccaagaccatggtgggaca

SEQ ID NO: 57460 - DNA, 25 bp, Mus musculus
tccttgcctgactgcttacaggttg

SEQ ID NO: 57461 - DNA, 25 bp, Mus musculus
tccttgctctgttgcagcccctggg

SEQ ID NO: 57462 - DNA, 25 bp, Mus musculus
tccttgctgagcattctctatgtga

SEQ ID NO: 57463 - DNA, 25 bp, Mus musculus
tccttgctgctggagtcctcttagt

SEQ ID NO: 57464 - DNA, 25 bp, Mus musculus
tccttggaactcaccagatactcta

SEQ ID NO: 57465 - DNA, 25 bp, Mus musculus
tccttggcccgaatcttcacttctg

SEQ ID NO: 57466 - DNA, 25 bp, Mus musculus
tccttggcctttatacccttggctt

SEQ ID NO: 57467 - DNA, 25 bp, Mus musculus
tccttggctcagtggtttgacatcc

SEQ ID NO: 57468 - DNA, 25 bp, Mus musculus
tccttggctgaaccgtgtttcatgc

SEQ ID NO: 57469 - DNA, 25 bp, Mus musculus
tccttgggatggatgacctggatcc

SEQ ID NO: 57470 - DNA, 25 bp, Mus musculus
tccttggggccaggaattttccatt

SEQ ID NO: 57471 - DNA, 25 bp, Mus musculus
tccttgggtgccgacatcaactcta

SEQ ID NO: 57472 - DNA, 25 bp, Mus musculus
tccttggtccagtttcccttgtggg

SEQ ID NO: 57473 - DNA, 25 bp, Mus musculus
tccttggttcagctaatgcaccaat

SEQ ID NO: 57474 - DNA, 25 bp, Mus musculus
tccttgtaatggaaaagcagccgac

SEQ ID NO: 57475 - DNA, 25 bp, Mus musculus
tccttgtcatgattgccctgggcgt

SEQ ID NO: 57476 - DNA, 25 bp, Mus musculus
tccttgtcgtttgacacctcaggag

SEQ ID NO: 57477 - DNA, 25 bp, Mus musculus
tccttgtggaggaagccaagctcgc

SEQ ID NO: 57478 - DNA, 25 bp, Mus musculus
tccttgtggcctcggcagagtgtcc

SEQ ID NO: 57479 - DNA, 25 bp, Mus musculus
tccttgtggcgttagctgattattc

SEQ ID NO: 57480 - DNA, 25 bp, Mus musculus
tccttgttactgcagacagaggcag

SEQ ID NO: 57481 - DNA, 25 bp, Mus musculus
tccttgtttgcactggaagctgtgc

SEQ ID NO: 57482 - DNA, 25 bp, Mus musculus
tcctttatcacacttagcctaagaa

SEQ ID NO: 57483 - DNA, 25 bp, Mus musculus
tcctttatgagtggacgctgcagca

SEQ ID NO: 57484 - DNA, 25 bp, Mus musculus
tcctttcaataaccatgagtatcag

SEQ ID NO: 57485 - DNA, 25 bp, Mus musculus
tcctttcacaagtttgtggctcctg

SEQ ID NO: 57486 - DNA, 25 bp, Mus musculus
tcctttcatacttctgctaatctgc

SEQ ID NO: 57487 - DNA, 25 bp, Mus musculus
tcctttcatgatgggagcgctcatg

SEQ ID NO: 57488 - DNA, 25 bp, Mus musculus
tcctttcccacgagaagagtgcaga

SEQ ID NO: 57489 - DNA, 25 bp, Mus musculus
tcctttccggcctggggacagcgag

SEQ ID NO: 57490 - DNA, 25 bp, Mus musculus
tcctttcctacagagaagggtgggt

SEQ ID NO: 57491 - DNA, 25 bp, Mus musculus
tcctttcctggacaaaatctaccag

SEQ ID NO: 57492 - DNA, 25 bp, Mus musculus
tcctttccttgagcaagttccagtt

SEQ ID NO: 57493 - DNA, 25 bp, Mus musculus
tcctttcgaacaccacggcaagtag

SEQ ID NO: 57494 - DNA, 25 bp, Mus musculus
tcctttgagccttacccagaaaaga

SEQ ID NO: 57495 - DNA, 25 bp, Mus musculus
tcctttgatggaagcagctgcctct

SEQ ID NO: 57496 - DNA, 25 bp, Mus musculus
tcctttgccaactgcagaggtccaa

SEQ ID NO: 57497 - DNA, 25 bp, Mus musculus
tcctttgccaagtcatccttctgca

SEQ ID NO: 57498 - DNA, 25 bp, Mus musculus
tcctttgctctggtgttgggctggt

SEQ ID NO: 57499 - DNA, 25 bp, Mus musculus
tcctttgctgtgagctctgtccccg

SEQ ID NO: 57500 - DNA, 25 bp, Mus musculus
tcctttggaagatctaggagattca

SEQ ID NO: 57501 - DNA, 25 bp, Mus musculus
tcctttggctgcatcccttgtggtc

SEQ ID NO: 57502 - DNA, 25 bp, Mus musculus
tcctttggctgcttcccttgtggtc

SEQ ID NO: 57503 - DNA, 25 bp, Mus musculus
tcctttgggtactgcatttgggccc

SEQ ID NO: 57504 - DNA, 25 bp, Mus musculus
tccttttaggatgcggccttggcag

SEQ ID NO: 57505 - DNA, 25 bp, Mus musculus
tccttttccggaatggacggaagct

SEQ ID NO: 57506 - DNA, 25 bp, Mus musculus
tccttttcgaggagctggtggccac

SEQ ID NO: 57507 - DNA, 25 bp, Mus musculus
tccttttctgtgttacagtgccctg

SEQ ID NO: 57508 - DNA, 25 bp, Mus musculus
tccttttggagaggtcaagccacag

SEQ ID NO: 57509 - DNA, 25 bp, Mus musculus
tcctttttgcccacaatgaccttgt

SEQ ID NO: 57510 - DNA, 25 bp, Mus musculus
tccttttttcccaaagtatgtggag

SEQ ID NO: 57511 - DNA, 25 bp, Mus musculus
tcgaaaaaatagatgcagagtggta

SEQ ID NO: 57512 - DNA, 25 bp, Mus musculus
tcgaaaaaatagttgcagagtggta

SEQ ID NO: 57513 - DNA, 25 bp, Mus musculus
tcgaaaaccgggatgtactgggtga

SEQ ID NO: 57514 - DNA, 25 bp, Mus musculus
tcgaaaacttagtttgaacctgaag

SEQ ID NO: 57515 - DNA, 25 bp, Mus musculus
tcgaaactgggccaaccaaaaatca

SEQ ID NO: 57516 - DNA, 25 bp, Mus musculus
tcgaaactgtcctcatttcaagagc

SEQ ID NO: 57517 - DNA, 25 bp, Mus musculus
tcgaaagccggaaagacatcaacag

SEQ ID NO: 57518 - DNA, 25 bp, Mus musculus
tcgaaaggcctactggcaggtgcac

SEQ ID NO: 57519 - DNA, 25 bp, Mus musculus
tcgaaagtcatagccggtgcaagca

SEQ ID NO: 57520 - DNA, 25 bp, Mus musculus
tcgaaatgtgacttcaccaacaagg

SEQ ID NO: 57521 - DNA, 25 bp, Mus musculus
tcgaacagtcagcaagggagcaaga

SEQ ID NO: 57522 - DNA, 25 bp, Mus musculus
tcgaacagtgcagcatcaggactct

SEQ ID NO: 57523 - DNA, 25 bp, Mus musculus
tcgaactacacaagcgtgcacaggc

SEQ ID NO: 57524 - DNA, 25 bp, Mus musculus
tcgaactcaggaatctgctcaactg

SEQ ID NO: 57525 - DNA, 25 bp, Mus musculus
tcgaactgtggtcctcctgtctcag

SEQ ID NO: 57526 - DNA, 25 bp, Mus musculus
tcgaagaaagcctgaggtggtctct

SEQ ID NO: 57527 - DNA, 25 bp, Mus musculus
tcgaagaggcttacatgcagtgtgc

SEQ ID NO: 57528 - DNA, 25 bp, Mus musculus
tcgaagaggctttcatgcagtgtgc

SEQ ID NO: 57529 - DNA, 25 bp, Mus musculus
tcgaagatatgactccaggaccaca

SEQ ID NO: 57530 - DNA, 25 bp, Mus musculus
tcgaagatgacagttccttgcaggg

SEQ ID NO: 57531 - DNA, 25 bp, Mus musculus
tcgaagcagcatgggtaccgagaag

SEQ ID NO: 57532 - DNA, 25 bp, Mus musculus
tcgaagcatcgaaaccctaaggcta

SEQ ID NO: 57533 - DNA, 25 bp, Mus musculus
tcgaagcctccaataggctgagcaa

SEQ ID NO: 57534 - DNA, 25 bp, Mus musculus
tcgaagcttcctgtccaaattagag

SEQ ID NO: 57535 - DNA, 25 bp, Mus musculus
tcgaaggacatgtggtgaaatgcta

SEQ ID NO: 57536 - DNA, 25 bp, Mus musculus
tcgaaggactcctcgaagcgagggc

SEQ ID NO: 57537 - DNA, 25 bp, Mus musculus
tcgaaggctggaagggatcgatcac

SEQ ID NO: 57538 - DNA, 25 bp, Mus musculus
tcgaagggctcgcagagcagacctt

SEQ ID NO: 57539 - DNA, 25 bp, Mus musculus
tcgaagtaaacaattggaacaggtc

SEQ ID NO: 57540 - DNA, 25 bp, Mus musculus
tcgaagtacagagtaagggcggcca

SEQ ID NO: 57541 - DNA, 25 bp, Mus musculus
tcgaagtctgccgtgcagaacaaag

SEQ ID NO: 57542 - DNA, 25 bp, Mus musculus
tcgaagtgaactagaaagagagagc

SEQ ID NO: 57543 - DNA, 25 bp, Mus musculus
tcgaagtgttcaagaggtatctgtc

SEQ ID NO: 57544 - DNA, 25 bp, Mus musculus
tcgaagtttcaaccaaaagtatggg

SEQ ID NO: 57545 - DNA, 25 bp, Mus musculus
tcgaatcctggaccggatgcgctcc

SEQ ID NO: 57546 - DNA, 25 bp, Mus musculus
tcgaatcgtgggagggcatgctgcc

SEQ ID NO: 57547 - DNA, 25 bp, Mus musculus
tcgaatggcccctgtctgacaacat

SEQ ID NO: 57548 - DNA, 25 bp, Mus musculus
tcgaattcaaagcattgtaaggaaa

SEQ ID NO: 57549 - DNA, 25 bp, Mus musculus
tcgaatttgctctaggaatctaaag

SEQ ID NO: 57550 - DNA, 25 bp, Mus musculus
tcgacaacgaggaggacatcactac

SEQ ID NO: 57551 - DNA, 25 bp, Mus musculus
tcgacactcgtccagcaaaatgctg

SEQ ID NO: 57552 - DNA, 25 bp, Mus musculus
tcgacactctcgtgctgctgtggcc

SEQ ID NO: 57553 - DNA, 25 bp, Mus musculus
tcgacaggacttggagtgtgacaaa

SEQ ID NO: 57554 - DNA, 25 bp, Mus musculus
tcgacatcagtcagcagaacagtaa

SEQ ID NO: 57555 - DNA, 25 bp, Mus musculus
tcgacatcgccaacacgcttaggga

SEQ ID NO: 57556 - DNA, 25 bp, Mus musculus
tcgacatgagaaccggaagaacacg

SEQ ID NO: 57557 - DNA, 25 bp, Mus musculus
tcgacatgctacaggcagaggtgac

SEQ ID NO: 57558 - DNA, 25 bp, Mus musculus
tcgacccaaactctgatgtggtagc

SEQ ID NO: 57559 - DNA, 25 bp, Mus musculus
tcgacccaaactgtgatgtggtagc

SEQ ID NO: 57560 - DNA, 25 bp, Mus musculus
tcgaccccaagaaagtggacaaggc

SEQ ID NO: 57561 - DNA, 25 bp, Mus musculus
tcgacccctggaccttgcagatgat

SEQ ID NO: 57562 - DNA, 25 bp, Mus musculus
tcgacccgactgatctcgacgtgga

SEQ ID NO: 57563 - DNA, 25 bp, Mus musculus
tcgaccgtccaagatccaggagaat

SEQ ID NO: 57564 - DNA, 25 bp, Mus musculus
tcgacctcaacgagtggctggccag

SEQ ID NO: 57565 - DNA, 25 bp, Mus musculus
tcgacgaaaacagcaatgacattgc

SEQ ID NO: 57566 - DNA, 25 bp, Mus musculus
tcgacgagtcctggccataaagggc

SEQ ID NO: 57567 - DNA, 25 bp, Mus musculus
tcgacgttttcagcgagacaaggaa

SEQ ID NO: 57568 - DNA, 25 bp, Mus musculus
tcgactagcaaaggtggatgccaca

SEQ ID NO: 57569 - DNA, 25 bp, Mus musculus
tcgactcacagcactttaccttttt

SEQ ID NO: 57570 - DNA, 25 bp, Mus musculus
tcgactcccttttattcgccacagg

SEQ ID NO: 57571 - DNA, 25 bp, Mus musculus
tcgactctgaagtagtgggagctgt

SEQ ID NO: 57572 - DNA, 25 bp, Mus musculus
tcgactgctttgaaagcaccgagga

SEQ ID NO: 57573 - DNA, 25 bp, Mus musculus
tcgactgtgtacacaagctggtgca

SEQ ID NO: 57574 - DNA, 25 bp, Mus musculus
tcgactgtgtactcaagctggtgca

SEQ ID NO: 57575 - DNA, 25 bp, Mus musculus
tcgacttaacaatttaatggccagc

SEQ ID NO: 57576 - DNA, 25 bp, Mus musculus
tcgacttcactttcatccactaaag

SEQ ID NO: 57577 - DNA, 25 bp, Mus musculus
tcgacttcggcaatttccaaggcaa

SEQ ID NO: 57578 - DNA, 25 bp, Mus musculus
tcgactttctcggagtctggaatgc

SEQ ID NO: 57579 - DNA, 25 bp, Mus musculus
tcgagaaattcaagccgccattaag

SEQ ID NO: 57580 - DNA, 25 bp, Mus musculus
tcgagaacatgagcaacgatgacgc

SEQ ID NO: 57581 - DNA, 25 bp, Mus musculus
tcgagaaccattgggagtgctggcc

SEQ ID NO: 57582 - DNA, 25 bp, Mus musculus
tcgagaagctggacatcaagctgga

SEQ ID NO: 57583 - DNA, 25 bp, Mus musculus
tcgagaaggaatacactcagaagct

SEQ ID NO: 57584 - DNA, 25 bp, Mus musculus
tcgagacatgattgccgaggccagc

SEQ ID NO: 57585 - DNA, 25 bp, Mus musculus
tcgagacctggaagctatggccaag

SEQ ID NO: 57586 - DNA, 25 bp, Mus musculus
tcgagactgatgtcctgaactgaag

SEQ ID NO: 57587 - DNA, 25 bp, Mus musculus
tcgagactttgttaggagccacctg

SEQ ID NO: 57588 - DNA, 25 bp, Mus musculus
tcgagagattgatgaagatgacctt

SEQ ID NO: 57589 - DNA, 25 bp, Mus musculus
tcgagagcgacctggaacgtgcaga

SEQ ID NO: 57590 - DNA, 25 bp, Mus musculus
tcgagagctgatagcccggtttcac

SEQ ID NO: 57591 - DNA, 25 bp, Mus musculus
tcgagagctgattgcccggtttcac

SEQ ID NO: 57592 - DNA, 25 bp, Mus musculus
tcgagagcttctccagtcgtgtggt

SEQ ID NO: 57593 - DNA, 25 bp, Mus musculus
tcgagaggctgcaccacatgcacat

SEQ ID NO: 57594 - DNA, 25 bp, Mus musculus
tcgagagtaccggaaagagcaccag

SEQ ID NO: 57595 - DNA, 25 bp, Mus musculus
tcgagataccactgcagccatgaag

SEQ ID NO: 57596 - DNA, 25 bp, Mus musculus
tcgagatcacttgggcgacaaccgg

SEQ ID NO: 57597 - DNA, 25 bp, Mus musculus
tcgagatcccattccttcagtgacc

SEQ ID NO: 57598 - DNA, 25 bp, Mus musculus
tcgagatttcttgggtggcctggcc

SEQ ID NO: 57599 - DNA, 25 bp, Mus musculus
tcgagcaaaagacgtgataatacca

SEQ ID NO: 57600 - DNA, 25 bp, Mus musculus
tcgagcaactaaagcagcacgtgga

SEQ ID NO: 57601 - DNA, 25 bp, Mus musculus
tcgagcaagagtagcaaacagttgt

SEQ ID NO: 57602 - DNA, 25 bp, Mus musculus
tcgagcataagattgtcatagctga

SEQ ID NO: 57603 - DNA, 25 bp, Mus musculus
tcgagcatgcggacagcaaccgctt

SEQ ID NO: 57604 - DNA, 25 bp, Mus musculus
tcgagcccagccctgacaaaatgct

SEQ ID NO: 57605 - DNA, 25 bp, Mus musculus
tcgagccgtgaattctacccgggaa

SEQ ID NO: 57606 - DNA, 25 bp, Mus musculus
tcgagcctgtttggaagaaaatgtg

SEQ ID NO: 57607 - DNA, 25 bp, Mus musculus
tcgagcgcactctcgtggaggctca

SEQ ID NO: 57608 - DNA, 25 bp, Mus musculus
tcgagcggcagatcgagagcataga

SEQ ID NO: 57609 - DNA, 25 bp, Mus musculus
tcgagctagaggagccccttccaag

SEQ ID NO: 57610 - DNA, 25 bp, Mus musculus
tcgagctcatggagcgccactgcct

SEQ ID NO: 57611 - DNA, 25 bp, Mus musculus
tcgagctggagatggcgaaaatcca

SEQ ID NO: 57612 - DNA, 25 bp, Mus musculus
tcgagctggcacgttcaagttggtc

SEQ ID NO: 57613 - DNA, 25 bp, Mus musculus
tcgagctgggagcattagtactctt

SEQ ID NO: 57614 - DNA, 25 bp, Mus musculus
tcgaggaactgcctacccagatcag

SEQ ID NO: 57615 - DNA, 25 bp, Mus musculus
tcgaggactggtgcttgaaaatgag

SEQ ID NO: 57616 - DNA, 25 bp, Mus musculus
tcgaggagcccttccctgacgtggg

SEQ ID NO: 57617 - DNA, 25 bp, Mus musculus
tcgaggagctttccggagcttccca

SEQ ID NO: 57618 - DNA, 25 bp, Mus musculus
tcgaggaggacatcgcagcgaaaga

SEQ ID NO: 57619 - DNA, 25 bp, Mus musculus
tcgaggccgaataccgacttggccc

SEQ ID NO: 57620 - DNA, 25 bp, Mus musculus
tcgaggctcaggacaggaagaaaca

SEQ ID NO: 57621 - DNA, 25 bp, Mus musculus
tcgaggctccgtggactgctgactg

SEQ ID NO: 57622 - DNA, 25 bp, Mus musculus
tcgaggggcacagacagctgctgct

SEQ ID NO: 57623 - DNA, 25 bp, Mus musculus
tcgagtacaggcaggcaattcaaac

SEQ ID NO: 57624 - DNA, 25 bp, Mus musculus
tcgagtcaaccgcagaccccgaaaa

SEQ ID NO: 57625 - DNA, 25 bp, Mus musculus
tcgagtcaacgtgcctgtcattggc

SEQ ID NO: 57626 - DNA, 25 bp, Mus musculus
tcgagtccggcctttttatgctgtc

SEQ ID NO: 57627 - DNA, 25 bp, Mus musculus
tcgagtgacggtgtttccctcaaag

SEQ ID NO: 57628 - DNA, 25 bp, Mus musculus
tcgagtggccaactaccagcgtgat

SEQ ID NO: 57629 - DNA, 25 bp, Mus musculus
tcgagtgtttgagtttggtggacca

SEQ ID NO: 57630 - DNA, 25 bp, Mus musculus
tcgagttcacggactctcccaagag

SEQ ID NO: 57631 - DNA, 25 bp, Mus musculus
tcgagtttttctggctgatcagcca

SEQ ID NO: 57632 - DNA, 25 bp, Mus musculus
tcgatacagtgctgtgaggcgccag

SEQ ID NO: 57633 - DNA, 25 bp, Mus musculus
tcgatacattcagcagggactcgtg

SEQ ID NO: 57634 - DNA, 25 bp, Mus musculus
tcgatacccttttgactctcctcag

SEQ ID NO: 57635 - DNA, 25 bp, Mus musculus
tcgatatctgcctccggaagcggca

SEQ ID NO: 57636 - DNA, 25 bp, Mus musculus
tcgatatgtgtctcaactggctgct

SEQ ID NO: 57637 - DNA, 25 bp, Mus musculus
tcgatccaacggtaccaacacttcg

SEQ ID NO: 57638 - DNA, 25 bp, Mus musculus
tcgatccagttttctggtggtctcc

SEQ ID NO: 57639 - DNA, 25 bp, Mus musculus
tcgatcccaacaacgttgtcattga

SEQ ID NO: 57640 - DNA, 25 bp, Mus musculus
tcgatccccttctgctgtgtcagct

SEQ ID NO: 57641 - DNA, 25 bp, Mus musculus
tcgatccggagtgaacctggagact

SEQ ID NO: 57642 - DNA, 25 bp, Mus musculus
tcgatctacgatgcctaccggaaag

SEQ ID NO: 57643 - DNA, 25 bp, Mus musculus
tcgatgagttagagcatcagatgca

SEQ ID NO: 57644 - DNA, 25 bp, Mus musculus
tcgatgctttagagttctacccggg

SEQ ID NO: 57645 - DNA, 25 bp, Mus musculus
tcgatgctttagtgttctacccggg

SEQ ID NO: 57646 - DNA, 25 bp, Mus musculus
tcgatgtagatgtaagagcaaagtc

SEQ ID NO: 57647 - DNA, 25 bp, Mus musculus
tcgatgtccatcgtaaggagaatac

SEQ ID NO: 57648 - DNA, 25 bp, Mus musculus
tcgatgtcccggagaccacgggaga

SEQ ID NO: 57649 - DNA, 25 bp, Mus musculus
tcgatgtcctttatccgccagagcg

SEQ ID NO: 57650 - DNA, 25 bp, Mus musculus
tcgatgtgacctttaaaagtaccaa

SEQ ID NO: 57651 - DNA, 25 bp, Mus musculus
tcgatgtgatccttcaggctctggc

SEQ ID NO: 57652 - DNA, 25 bp, Mus musculus
tcgatgttaacgacaaagtagaaaa

SEQ ID NO: 57653 - DNA, 25 bp, Mus musculus
tcgattccatcactggatgccaaca

SEQ ID NO: 57654 - DNA, 25 bp, Mus musculus
tcgattccatcagtggatgccaaca

SEQ ID NO: 57655 - DNA, 25 bp, Mus musculus
tcgattgagctctgcttcctcgacc

SEQ ID NO: 57656 - DNA, 25 bp, Mus musculus
tcgattgtaaatcccgaacgttgtg

SEQ ID NO: 57657 - DNA, 25 bp, Mus musculus
tcgattgtgggtcctaagtcgaaag

SEQ ID NO: 57658 - DNA, 25 bp, Mus musculus
tcgatttcctgagtgcttatggtgc

SEQ ID NO: 57659 - DNA, 25 bp, Mus musculus
tcgcaaactagaacggagggttaag

SEQ ID NO: 57660 - DNA, 25 bp, Mus musculus
tcgcaaagaattggtggaagcccag

SEQ ID NO: 57661 - DNA, 25 bp, Mus musculus
tcgcaaaggtctgaattaagaagct

SEQ ID NO: 57662 - DNA, 25 bp, Mus musculus
tcgcaacgagcgacataagccagag

SEQ ID NO: 57663 - DNA, 25 bp, Mus musculus
tcgcaacgagcgtcataagccagag

SEQ ID NO: 57664 - DNA, 25 bp, Mus musculus
tcgcaactgcagaggcgattcaagg

SEQ ID NO: 57665 - DNA, 25 bp, Mus musculus
tcgcaagcaggactggtctgaccat

SEQ ID NO: 57666 - DNA, 25 bp, Mus musculus
tcgcaatggagacagatgggcctca

SEQ ID NO: 57667 - DNA, 25 bp, Mus musculus
tcgcaatgtgtgacccactgcagct

SEQ ID NO: 57668 - DNA, 25 bp, Mus musculus
tcgcacctttgttgtcagcaggaca

SEQ ID NO: 57669 - DNA, 25 bp, Mus musculus
tcgcacgtccacaccggtgcggagt

SEQ ID NO: 57670 - DNA, 25 bp, Mus musculus
tcgcagaaagctgacggcagaagca

SEQ ID NO: 57671 - DNA, 25 bp, Mus musculus
tcgcagaatgcatcgcctaagcaaa

SEQ ID NO: 57672 - DNA, 25 bp, Mus musculus
tcgcagacgccctctgccggaggag

SEQ ID NO: 57673 - DNA, 25 bp, Mus musculus
tcgcagagatgggagttaaaaggct

SEQ ID NO: 57674 - DNA, 25 bp, Mus musculus
tcgcagagcagccaattaagaagtg

SEQ ID NO: 57675 - DNA, 25 bp, Mus musculus
tcgcagccagtcagatgtacagtcc

SEQ ID NO: 57676 - DNA, 25 bp, Mus musculus
tcgcagcgaaagagaagctgctgcg

SEQ ID NO: 57677 - DNA, 25 bp, Mus musculus
tcgcagctgttggacttggatggtt

SEQ ID NO: 57678 - DNA, 25 bp, Mus musculus
tcgcagcttgtgaattgctctttaa

SEQ ID NO: 57679 - DNA, 25 bp, Mus musculus
tcgcaggagaaactggtccacgatg

SEQ ID NO: 57680 - DNA, 25 bp, Mus musculus
tcgcagggcatgtccccaaggccat

SEQ ID NO: 57681 - DNA, 25 bp, Mus musculus
tcgcagtagtagaccagccattgac

SEQ ID NO: 57682 - DNA, 25 bp, Mus musculus
tcgcagtcaagaacaaatggacagc

SEQ ID NO: 57683 - DNA, 25 bp, Mus musculus
tcgcagtgactgagaaatgctctga

SEQ ID NO: 57684 - DNA, 25 bp, Mus musculus
tcgcagtggtccttcagcaccatca

SEQ ID NO: 57685 - DNA, 25 bp, Mus musculus
tcgcagtgtggctgtcttcgccgtg

SEQ ID NO: 57686 - DNA, 25 bp, Mus musculus
tcgccaaagcaaggtatccatctgt

SEQ ID NO: 57687 - DNA, 25 bp, Mus musculus
tcgccaacacgcttagggaacaagt

SEQ ID NO: 57688 - DNA, 25 bp, Mus musculus
tcgccaacgctgagccgaaaccatg

SEQ ID NO: 57689 - DNA, 25 bp, Mus musculus
tcgccacaaacggatatgtcagagg

SEQ ID NO: 57690 - DNA, 25 bp, Mus musculus
tcgccagaattaaacctcacacaag

SEQ ID NO: 57691 - DNA, 25 bp, Mus musculus
tcgccagaattatacctcacacaag

SEQ ID NO: 57692 - DNA, 25 bp, Mus musculus
tcgccagaccccacttctagaaggt

SEQ ID NO: 57693 - DNA, 25 bp, Mus musculus
tcgccagagacactcaggtctgagc

SEQ ID NO: 57694 - DNA, 25 bp, Mus musculus
tcgccagctgtggagatgactgcaa

SEQ ID NO: 57695 - DNA, 25 bp, Mus musculus
tcgccaggaatcacagtcatccggc

SEQ ID NO: 57696 - DNA, 25 bp, Mus musculus
tcgccaggactttcagctgagaaat

SEQ ID NO: 57697 - DNA, 25 bp, Mus musculus
tcgccaggttacctggcagagccag

SEQ ID NO: 57698 - DNA, 25 bp, Mus musculus
tcgccaggttacgtggcagagccag

SEQ ID NO: 57699 - DNA, 25 bp, Mus musculus
tcgccatcatcaagttggctgagcc

SEQ ID NO: 57700 - DNA, 25 bp, Mus musculus
tcgccatctacgtcaggtcagctgt

SEQ ID NO: 57701 - DNA, 25 bp, Mus musculus
tcgccattatctggcagaggttcag

SEQ ID NO: 57702 - DNA, 25 bp, Mus musculus
tcgcccagcagcagtttcaacgagg

SEQ ID NO: 57703 - DNA, 25 bp, Mus musculus
tcgcccaggtccattgcctgattcg

SEQ ID NO: 57704 - DNA, 25 bp, Mus musculus
tcgcccaggtcctttgcctgattcg

SEQ ID NO: 57705 - DNA, 25 bp, Mus musculus
tcgcccagttctcgagaagaaaaag

SEQ ID NO: 57706 - DNA, 25 bp, Mus musculus
tcgcccgaggagtgcagaaaatcct

SEQ ID NO: 57707 - DNA, 25 bp, Mus musculus
tcgcccgccaatgaagtatatcctg

SEQ ID NO: 57708 - DNA, 25 bp, Mus musculus
tcgcccgcggcgcttagttaggact

SEQ ID NO: 57709 - DNA, 25 bp, Mus musculus
tcgccctgtggtccctggtggtcct

SEQ ID NO: 57710 - DNA, 25 bp, Mus musculus
tcgccctgtgttggacattcttcgg

SEQ ID NO: 57711 - DNA, 25 bp, Mus musculus
tcgcccttatctgatggtagatcct

SEQ ID NO: 57712 - DNA, 25 bp, Mus musculus
tcgccgtgggacatggacgcagcct

SEQ ID NO: 57713 - DNA, 25 bp, Mus musculus
tcgcctcacaaaagttacatgaaga

SEQ ID NO: 57714 - DNA, 25 bp, Mus musculus
tcgcctcctgcgtcatcaacttagg

SEQ ID NO: 57715 - DNA, 25 bp, Mus musculus
tcgcctctcaggtgacactggaggg

SEQ ID NO: 57716 - DNA, 25 bp, Mus musculus
tcgcctctcgcctggccagggatga

SEQ ID NO: 57717 - DNA, 25 bp, Mus musculus
tcgcctgcatcaggattgagcaagg

SEQ ID NO: 57718 - DNA, 25 bp, Mus musculus
tcgcctggaactggaaattctgagc

SEQ ID NO: 57719 - DNA, 25 bp, Mus musculus
tcgcctggtggtattaccagtatca

SEQ ID NO: 57720 - DNA, 25 bp, Mus musculus
tcgcctgtatcgcaaagcattagaa

SEQ ID NO: 57721 - DNA, 25 bp, Mus musculus
tcgcctgttcagagtaaagtgtgcc

SEQ ID NO: 57722 - DNA, 25 bp, Mus musculus
tcgccttcctggtgtgattcgcaga

SEQ ID NO: 57723 - DNA, 25 bp, Mus musculus
tcgccttgaggtggcgaggatgcag

SEQ ID NO: 57724 - DNA, 25 bp, Mus musculus
tcgccttgttccaagggctctccaa

SEQ ID NO: 57725 - DNA, 25 bp, Mus musculus
tcgcctttgttttgccattctctac

SEQ ID NO: 57726 - DNA, 25 bp, Mus musculus
tcgcgagcggagatgactaccgacc

SEQ ID NO: 57727 - DNA, 25 bp, Mus musculus
tcgcgagcggagttgactaccgacc

SEQ ID NO: 57728 - DNA, 25 bp, Mus musculus
tcgcgcctgccagaggatgacgaga

SEQ ID NO: 57729 - DNA, 25 bp, Mus musculus
tcgcgcgggtttatgagagcaaagc

SEQ ID NO: 57730 - DNA, 25 bp, Mus musculus
tcgcggagagaaaaatgcctctttc

SEQ ID NO: 57731 - DNA, 25 bp, Mus musculus
tcgcggagcccgcttggttgcacat

SEQ ID NO: 57732 - DNA, 25 bp, Mus musculus
tcgcggcatccctcggttacatgct

SEQ ID NO: 57733 - DNA, 25 bp, Mus musculus
tcgcggcccagctcagaatggtgga

SEQ ID NO: 57734 - DNA, 25 bp, Mus musculus
tcgcggctggagtgtcagtgctccc

SEQ ID NO: 57735 - DNA, 25 bp, Mus musculus
tcgcggcttggatttcaaactggag

SEQ ID NO: 57736 - DNA, 25 bp, Mus musculus
tcgcgggacacccaaggatggcact

SEQ ID NO: 57737 - DNA, 25 bp, Mus musculus
tcgcgggtctggaggaaaacttcca

SEQ ID NO: 57738 - DNA, 25 bp, Mus musculus
tcgcgtcgcctgatcctgttcaagt

SEQ ID NO: 57739 - DNA, 25 bp, Mus musculus
tcgcgtgcaaggctctgaccgacca

SEQ ID NO: 57740 - DNA, 25 bp, Mus musculus
tcgcgtgtcggtgcttcctacaaac

SEQ ID NO: 57741 - DNA, 25 bp, Mus musculus
tcgctaacaagggactactgcactc

SEQ ID NO: 57742 - DNA, 25 bp, Mus musculus
tcgctacctgacatttttccacaag

SEQ ID NO: 57743 - DNA, 25 bp, Mus musculus
tcgctatgacgcaagagtacacact

SEQ ID NO: 57744 - DNA, 25 bp, Mus musculus
tcgctatgaggaaattccccagaag

SEQ ID NO: 57745 - DNA, 25 bp, Mus musculus
tcgctatgaggatattccccagaag

SEQ ID NO: 57746 - DNA, 25 bp, Mus musculus
tcgctatgttccaggaacttcagga

SEQ ID NO: 57747 - DNA, 25 bp, Mus musculus
tcgctcaaagtgcactacagcccat

SEQ ID NO: 57748 - DNA, 25 bp, Mus musculus
tcgctcaaggctaagcagttgcaag

SEQ ID NO: 57749 - DNA, 25 bp, Mus musculus
tcgctcaaggcttagcagttgcaag

SEQ ID NO: 57750 - DNA, 25 bp, Mus musculus
tcgctcaatgacgaacctgaggcct

SEQ ID NO: 57751 - DNA, 25 bp, Mus musculus
tcgctccatctcagaaagtgccttc

SEQ ID NO: 57752 - DNA, 25 bp, Mus musculus
tcgctccatctctgaaagtgccttc

SEQ ID NO: 57753 - DNA, 25 bp, Mus musculus
tcgctctcgtgaacgcaaggtgcct

SEQ ID NO: 57754 - DNA, 25 bp, Mus musculus
tcgctctggatatccaggcctacca

SEQ ID NO: 57755 - DNA, 25 bp, Mus musculus
tcgctcttcagtcttaatgccttgt

SEQ ID NO: 57756 - DNA, 25 bp, Mus musculus
tcgctgaaagttggcatgatccctg

SEQ ID NO: 57757 - DNA, 25 bp, Mus musculus
tcgctgaagctgctggcagctcact

SEQ ID NO: 57758 - DNA, 25 bp, Mus musculus
tcgctgaatcagacttaaaccagtg

SEQ ID NO: 57759 - DNA, 25 bp, Mus musculus
tcgctgcagcacagagattttctct

SEQ ID NO: 57760 - DNA, 25 bp, Mus musculus
tcgctgcccacctttcgagagttca

SEQ ID NO: 57761 - DNA, 25 bp, Mus musculus
tcgctgcccagcagaaggcagcttt

SEQ ID NO: 57762 - DNA, 25 bp, Mus musculus
tcgctgctagcacatatgtatgggt

SEQ ID NO: 57763 - DNA, 25 bp, Mus musculus
tcgctggtcctcattctgctcttca

SEQ ID NO: 57764 - DNA, 25 bp, Mus musculus
tcgctggtcctctttctgctcttca

SEQ ID NO: 57765 - DNA, 25 bp, Mus musculus
tcgctgtgagaatattgagacgtcg

SEQ ID NO: 57766 - DNA, 25 bp, Mus musculus
tcgctgtgcggtaggacagatcccg

SEQ ID NO: 57767 - DNA, 25 bp, Mus musculus
tcgcttagcaaactacctggatagc

SEQ ID NO: 57768 - DNA, 25 bp, Mus musculus
tcgcttcagtaaactaaatccacgt

SEQ ID NO: 57769 - DNA, 25 bp, Mus musculus
tcgcttcccgtttccccatatgaga

SEQ ID NO: 57770 - DNA, 25 bp, Mus musculus
tcgcttcgcacaccactgaggagaa

SEQ ID NO: 57771 - DNA, 25 bp, Mus musculus
tcgcttgtcagaggccgaggaactg

SEQ ID NO: 57772 - DNA, 25 bp, Mus musculus
tcgcttgtggcagattcagcatcat

SEQ ID NO: 57773 - DNA, 25 bp, Mus musculus
tcggaaaagttcattgttgagggct

SEQ ID NO: 57774 - DNA, 25 bp, Mus musculus
tcggaaagccccacacaaacaaggg

SEQ ID NO: 57775 - DNA, 25 bp, Mus musculus
tcggaaatgcggcaactggcaaatc

SEQ ID NO: 57776 - DNA, 25 bp, Mus musculus
tcggaaatgcgggaactggcaaatc

SEQ ID NO: 57777 - DNA, 25 bp, Mus musculus
tcggaacagtccaagctcctcattt

SEQ ID NO: 57778 - DNA, 25 bp, Mus musculus
tcggaactacaacgccaagacggag

SEQ ID NO: 57779 - DNA, 25 bp, Mus musculus
tcggaagaaagtaacgtgaaagact

SEQ ID NO: 57780 - DNA, 25 bp, Mus musculus
tcggaagaatgatggctcctttggg

SEQ ID NO: 57781 - DNA, 25 bp, Mus musculus
tcggaagatgcatcacctccataaa

SEQ ID NO: 57782 - DNA, 25 bp, Mus musculus
tcggaagcccttccaacttcgaggc

SEQ ID NO: 57783 - DNA, 25 bp, Mus musculus
tcggaagctggagttcaacaaggcg

SEQ ID NO: 57784 - DNA, 25 bp, Mus musculus
tcggaagctggatcatatatgtgca

SEQ ID NO: 57785 - DNA, 25 bp, Mus musculus
tcggaagggccttgcactggaccca

SEQ ID NO: 57786 - DNA, 25 bp, Mus musculus
tcggaagtctatgtctaagctgctc

SEQ ID NO: 57787 - DNA, 25 bp, Mus musculus
tcggaatgtaacttttgaggatgct

SEQ ID NO: 57788 - DNA, 25 bp, Mus musculus
tcggacaagccccatcttccagtgg

SEQ ID NO: 57789 - DNA, 25 bp, Mus musculus
tcggacaattcagaagaaaagtgga

SEQ ID NO: 57790 - DNA, 25 bp, Mus musculus
tcggacagagatgtttggagaaact

SEQ ID NO: 57791 - DNA, 25 bp, Mus musculus
tcggacagcgcccagactgaggctt

SEQ ID NO: 57792 - DNA, 25 bp, Mus musculus
tcggacagtgatccaaatacatatg

SEQ ID NO: 57793 - DNA, 25 bp, Mus musculus
tcggacatcaaataagaatccaatt

SEQ ID NO: 57794 - DNA, 25 bp, Mus musculus
tcggacatcttcaggctcgcttcaa

SEQ ID NO: 57795 - DNA, 25 bp, Mus musculus
tcggacccagtcctatgactacaga

SEQ ID NO: 57796 - DNA, 25 bp, Mus musculus
tcggacctgtatacagagtgaactt

SEQ ID NO: 57797 - DNA, 25 bp, Mus musculus
tcggacctgtattcagagtgaactt

SEQ ID NO: 57798 - DNA, 25 bp, Mus musculus
tcggacgagcaagactaaaacacaa

SEQ ID NO: 57799 - DNA, 25 bp, Mus musculus
tcggagaatctctgagacctcggtg

SEQ ID NO: 57800 - DNA, 25 bp, Mus musculus
tcggagaccatttctgtgccacagg

SEQ ID NO: 57801 - DNA, 25 bp, Mus musculus
tcggagacctccgatgctaagagca

SEQ ID NO: 57802 - DNA, 25 bp, Mus musculus
tcggagaggagatgtagatgaattc

SEQ ID NO: 57803 - DNA, 25 bp, Mus musculus
tcggagatcactgacgagtgtggca

SEQ ID NO: 57804 - DNA, 25 bp, Mus musculus
tcggagatgcgctctgccccaggcg

SEQ ID NO: 57805 - DNA, 25 bp, Mus musculus
tcggagcatgttagccctgtgttgg

SEQ ID NO: 57806 - DNA, 25 bp, Mus musculus
tcggagcctacctgagctcggtgac

SEQ ID NO: 57807 - DNA, 25 bp, Mus musculus
tcggagctaatcagcacggttagac

SEQ ID NO: 57808 - DNA, 25 bp, Mus musculus
tcggaggaaacacctgtagttttgc

SEQ ID NO: 57809 - DNA, 25 bp, Mus musculus
tcggaggaatgaaagctatttcagg

SEQ ID NO: 57810 - DNA, 25 bp, Mus musculus
tcggaggacactaagcagatgatga

SEQ ID NO: 57811 - DNA, 25 bp, Mus musculus
tcggaggagaaagagacggacaaca

SEQ ID NO: 57812 - DNA, 25 bp, Mus musculus
tcggaggcagctggagacactgaac

SEQ ID NO: 57813 - DNA, 25 bp, Mus musculus
tcggaggccattgggtaacaacaga

SEQ ID NO: 57814 - DNA, 25 bp, Mus musculus
tcggaggtggagataacgagaaaca

SEQ ID NO: 57815 - DNA, 25 bp, Mus musculus
tcggaggtggagttaacgagaaaca

SEQ ID NO: 57816 - DNA, 25 bp, Mus musculus
tcggagtctactctggacccaggct

SEQ ID NO: 57817 - DNA, 25 bp, Mus musculus
tcggagtgcctcacatcaagacgag

SEQ ID NO: 57818 - DNA, 25 bp, Mus musculus
tcggagtggctctctccttgtgcag

SEQ ID NO: 57819 - DNA, 25 bp, Mus musculus
tcggataagctgaatgtccctgtgc

SEQ ID NO: 57820 - DNA, 25 bp, Mus musculus
tcggataccatcagtaaaaatcccc

SEQ ID NO: 57821 - DNA, 25 bp, Mus musculus
tcggataccatctgtaaaaatcccc

SEQ ID NO: 57822 - DNA, 25 bp, Mus musculus
tcggatacctctgcctgtatcaaat

SEQ ID NO: 57823 - DNA, 25 bp, Mus musculus
tcggatcaccaaccagatatgctgc

SEQ ID NO: 57824 - DNA, 25 bp, Mus musculus
tcggatcaccaagcagatatgctgc

SEQ ID NO: 57825 - DNA, 25 bp, Mus musculus
tcggatccatgaggtgccactgctg

SEQ ID NO: 57826 - DNA, 25 bp, Mus musculus
tcggatccgggctgtggccacacag

SEQ ID NO: 57827 - DNA, 25 bp, Mus musculus
tcggatgagcagttaaggcgacgtc

SEQ ID NO: 57828 - DNA, 25 bp, Mus musculus
tcggatgagtcctttgagccttacc

SEQ ID NO: 57829 - DNA, 25 bp, Mus musculus
tcggatgatcgggtaaaagacgagt

SEQ ID NO: 57830 - DNA, 25 bp, Mus musculus
tcggatgtctgtccatcttccctga

SEQ ID NO: 57831 - DNA, 25 bp, Mus musculus
tcggatttcactttacaaaaggatg

SEQ ID NO: 57832 - DNA, 25 bp, Mus musculus
tcggcaaaaccagagggccctgaac

SEQ ID NO: 57833 - DNA, 25 bp, Mus musculus
tcggcaaaaggctcagctaagaaat

SEQ ID NO: 57834 - DNA, 25 bp, Mus musculus
tcggcaacacggaagctgattataa

SEQ ID NO: 57835 - DNA, 25 bp, Mus musculus
tcggcaagaaggagatgcgcatcct

SEQ ID NO: 57836 - DNA, 25 bp, Mus musculus
tcggcaagagctagatgaagctaac

SEQ ID NO: 57837 - DNA, 25 bp, Mus musculus
tcggcaagcctttgtctttgtctgc

SEQ ID NO: 57838 - DNA, 25 bp, Mus musculus
tcggcaatttccaaggcaaaatgag

SEQ ID NO: 57839 - DNA, 25 bp, Mus musculus
tcggcaccaacgtgatggtgacagt

SEQ ID NO: 57840 - DNA, 25 bp, Mus musculus
tcggcagaaactagatgatcagacc

SEQ ID NO: 57841 - DNA, 25 bp, Mus musculus
tcggcagcagcggtatttccagctg

SEQ ID NO: 57842 - DNA, 25 bp, Mus musculus
tcggcagcagctctaggcaaactat

SEQ ID NO: 57843 - DNA, 25 bp, Mus musculus
tcggcagcggctatggtggtaactc

SEQ ID NO: 57844 - DNA, 25 bp, Mus musculus
tcggcatcatgcctggccacattca

SEQ ID NO: 57845 - DNA, 25 bp, Mus musculus
tcggcatgcaaatccctcgattctg

SEQ ID NO: 57846 - DNA, 25 bp, Mus musculus
tcggcattcccccttctgaaagaag

SEQ ID NO: 57847 - DNA, 25 bp, Mus musculus
tcggccaacaagaggtggaggtcaa

SEQ ID NO: 57848 - DNA, 25 bp, Mus musculus
tcggccaacgatcccatttttcttc

SEQ ID NO: 57849 - DNA, 25 bp, Mus musculus
tcggccacgtttgagttttccaagt

SEQ ID NO: 57850 - DNA, 25 bp, Mus musculus
tcggcccctgcctagtttgtaaaca

SEQ ID NO: 57851 - DNA, 25 bp, Mus musculus
tcggccctcccatgaataatcctgt

SEQ ID NO: 57852 - DNA, 25 bp, Mus musculus
tcggccctgagattgagcagttcag

SEQ ID NO: 57853 - DNA, 25 bp, Mus musculus
tcggccctgcggtggtcatgaatcg

SEQ ID NO: 57854 - DNA, 25 bp, Mus musculus
tcggccgggttgagcaagtctctga

SEQ ID NO: 57855 - DNA, 25 bp, Mus musculus
tcggcctatgcactctgcacattcg

SEQ ID NO: 57856 - DNA, 25 bp, Mus musculus
tcggcctccaacgtgtaagtaaagc

SEQ ID NO: 57857 - DNA, 25 bp, Mus musculus
tcggccttttcgaccagtacttccg

SEQ ID NO: 57858 - DNA, 25 bp, Mus musculus
tcggcgaataggatgtccgagaccc

SEQ ID NO: 57859 - DNA, 25 bp, Mus musculus
tcggcgagaagcgtatcatcacagt

SEQ ID NO: 57860 - DNA, 25 bp, Mus musculus
tcggcgagccactgctgtggccctg

SEQ ID NO: 57861 - DNA, 25 bp, Mus musculus
tcggcggatcagaatggcactacat

SEQ ID NO: 57862 - DNA, 25 bp, Mus musculus
tcggcggctgagagatcctgacata

SEQ ID NO: 57863 - DNA, 25 bp, Mus musculus
tcggctacaacacccatgctgactt

SEQ ID NO: 57864 - DNA, 25 bp, Mus musculus
tcggctatttgcacaaacggagtgg

SEQ ID NO: 57865 - DNA, 25 bp, Mus musculus
tcggctcgactgtttcactcattgc

SEQ ID NO: 57866 - DNA, 25 bp, Mus musculus
tcggctgaatcacaaccatttggcg

SEQ ID NO: 57867 - DNA, 25 bp, Mus musculus
tcggctgccgagtgaccatgatgct

SEQ ID NO: 57868 - DNA, 25 bp, Mus musculus
tcggctggcccgaaaaagaagtcag

SEQ ID NO: 57869 - DNA, 25 bp, Mus musculus
tcggcttagccgtgacagtgacagc

SEQ ID NO: 57870 - DNA, 25 bp, Mus musculus
tcggcttcccttggagtgagatcag

SEQ ID NO: 57871 - DNA, 25 bp, Mus musculus
tcggcttgccaaagggtcagaatgt

SEQ ID NO: 57872 - DNA, 25 bp, Mus musculus
tcggcttggctacctgcctgtccag

SEQ ID NO: 57873 - DNA, 25 bp, Mus musculus
tcgggaaaaacagcagattacgcct

SEQ ID NO: 57874 - DNA, 25 bp, Mus musculus
tcgggaactctgcaccaggcaccag

SEQ ID NO: 57875 - DNA, 25 bp, Mus musculus
tcgggaagcatgacgaccgagacct

SEQ ID NO: 57876 - DNA, 25 bp, Mus musculus
tcgggaagctcctgcaggctcatga

SEQ ID NO: 57877 - DNA, 25 bp, Mus musculus
tcgggacaagcgagacagtgactcg

SEQ ID NO: 57878 - DNA, 25 bp, Mus musculus
tcgggaggatgtggcgcaatatatt

SEQ ID NO: 57879 - DNA, 25 bp, Mus musculus
tcgggatacgttgaaagtggtttga

SEQ ID NO: 57880 - DNA, 25 bp, Mus musculus
tcgggatatcctttcactctgcatg

SEQ ID NO: 57881 - DNA, 25 bp, Mus musculus
tcgggatgacaagcctgccttcaga

SEQ ID NO: 57882 - DNA, 25 bp, Mus musculus
tcgggcaagtagtcatggctgaagc

SEQ ID NO: 57883 - DNA, 25 bp, Mus musculus
tcgggcaagtcaccaagtccatcac

SEQ ID NO: 57884 - DNA, 25 bp, Mus musculus
tcgggccaaacaagtgcaaatgtca

SEQ ID NO: 57885 - DNA, 25 bp, Mus musculus
tcgggccacaggaccttaaggagct

SEQ ID NO: 57886 - DNA, 25 bp, Mus musculus
tcgggcccaatgtgctcatggttca

SEQ ID NO: 57887 - DNA, 25 bp, Mus musculus
tcgggcccctgggattcggcttctt

SEQ ID NO: 57888 - DNA, 25 bp, Mus musculus
tcgggcctacaaaggacagccatgg

SEQ ID NO: 57889 - DNA, 25 bp, Mus musculus
tcgggcctacaatggacagccatgg

SEQ ID NO: 57890 - DNA, 25 bp, Mus musculus
tcgggcctatagagatcacatatcg

SEQ ID NO: 57891 - DNA, 25 bp, Mus musculus
tcgggccttatgaccagaccctaag

SEQ ID NO: 57892 - DNA, 25 bp, Mus musculus
tcgggcctttgctcatagaaacaca

SEQ ID NO: 57893 - DNA, 25 bp, Mus musculus
tcgggcggctgcatttggtcctgac

SEQ ID NO: 57894 - DNA, 25 bp, Mus musculus
tcgggctgctgcatctgtgcctgaa

SEQ ID NO: 57895 - DNA, 25 bp, Mus musculus
tcgggctggctgttgttgcatatgc

SEQ ID NO: 57896 - DNA, 25 bp, Mus musculus
tcgggtaaaagacgagttcagtgac

SEQ ID NO: 57897 - DNA, 25 bp, Mus musculus
tcgggtacagagtctgaagattgga

SEQ ID NO: 57898 - DNA, 25 bp, Mus musculus
tcgggtaccttcctaggcctaggca

SEQ ID NO: 57899 - DNA, 25 bp, Mus musculus
tcgggtagaaacaagtatttgctct

SEQ ID NO: 57900 - DNA, 25 bp, Mus musculus
tcgggtcatttcctttgaagagcag

SEQ ID NO: 57901 - DNA, 25 bp, Mus musculus
tcgggtcctaacctggatcccagcg

SEQ ID NO: 57902 - DNA, 25 bp, Mus musculus
tcgggtcctccagcacagttggatc

SEQ ID NO: 57903 - DNA, 25 bp, Mus musculus
tcgggtcctttcaggacaccttatg

SEQ ID NO: 57904 - DNA, 25 bp, Mus musculus
tcgggtctcttggagctaagaacca

SEQ ID NO: 57905 - DNA, 25 bp, Mus musculus
tcgggtcttttgcacagcctgttcc

SEQ ID NO: 57906 - DNA, 25 bp, Mus musculus
tcgggtggcctaggccaaggtcacc

SEQ ID NO: 57907 - DNA, 25 bp, Mus musculus
tcgggtggcttacaagacagtgaca

SEQ ID NO: 57908 - DNA, 25 bp, Mus musculus
tcgggttgtagatgggatatttgct

SEQ ID NO: 57909 - DNA, 25 bp, Mus musculus
tcgggtttgccctaaggtcaggtgt

SEQ ID NO: 57910 - DNA, 25 bp, Mus musculus
tcgggtttgtgatggttccaatggc

SEQ ID NO: 57911 - DNA, 25 bp, Mus musculus
tcggtaatcattgaaggcctacccc

SEQ ID NO: 57912 - DNA, 25 bp, Mus musculus
tcggtaccttgaggatccagacaac

SEQ ID NO: 57913 - DNA, 25 bp, Mus musculus
tcggtcctatgtgtacgctgaagag

SEQ ID NO: 57914 - DNA, 25 bp, Mus musculus
tcggtcctgaagcatggcagccatc

SEQ ID NO: 57915 - DNA, 25 bp, Mus musculus
tcggtctcgtggagaaccagagcga

SEQ ID NO: 57916 - DNA, 25 bp, Mus musculus
tcggtctgacgctgatcactctggc

SEQ ID NO: 57917 - DNA, 25 bp, Mus musculus
tcggtgaagtcagggacaatttaag

SEQ ID NO: 57918 - DNA, 25 bp, Mus musculus
tcggtgactcgggaatcctgaagac

SEQ ID NO: 57919 - DNA, 25 bp, Mus musculus
tcggtgagatcaagactgaaactgc

SEQ ID NO: 57920 - DNA, 25 bp, Mus musculus
tcggtgatctttggtctgaaaggct

SEQ ID NO: 57921 - DNA, 25 bp, Mus musculus
tcggtgccagcaagaactgtgtttg

SEQ ID NO: 57922 - DNA, 25 bp, Mus musculus
tcggtgccccaccaggaccaagttt

SEQ ID NO: 57923 - DNA, 25 bp, Mus musculus
tcggtgccctgatgactcagctgtt

SEQ ID NO: 57924 - DNA, 25 bp, Mus musculus
tcggtgctggaatcggtggtacttc

SEQ ID NO: 57925 - DNA, 25 bp, Mus musculus
tcggtggaaagggtcttggaaatca

SEQ ID NO: 57926 - DNA, 25 bp, Mus musculus
tcggtggccatcttcactgtcttcg

SEQ ID NO: 57927 - DNA, 25 bp, Mus musculus
tcggtggttgacacactgaaggtcg

SEQ ID NO: 57928 - DNA, 25 bp, Mus musculus
tcggttaagcatatcttactgtcgg

SEQ ID NO: 57929 - DNA, 25 bp, Mus musculus
tcggttacagagcacagagttcaat

SEQ ID NO: 57930 - DNA, 25 bp, Mus musculus
tcggttacatgctcctcacctgcat

SEQ ID NO: 57931 - DNA, 25 bp, Mus musculus
tcggttatggagtacagtgtcgcct

SEQ ID NO: 57932 - DNA, 25 bp, Mus musculus
tcggttcagccccagcctttacaag

SEQ ID NO: 57933 - DNA, 25 bp, Mus musculus
tcggttgtgatactgccctgaatgt

SEQ ID NO: 57934 - DNA, 25 bp, Mus musculus
tcggttgtttaccactcggcacaaa

SEQ ID NO: 57935 - DNA, 25 bp, Mus musculus
tcggtttaagagctgaaatcagcag

SEQ ID NO: 57936 - DNA, 25 bp, Mus musculus
tcggtttccagcactgaccagtgga

SEQ ID NO: 57937 - DNA, 25 bp, Mus musculus
tcggttttgcacaagccggcctcga

SEQ ID NO: 57938 - DNA, 25 bp, Mus musculus
tcggttttgcactagccggcctcga

SEQ ID NO: 57939 - DNA, 25 bp, Mus musculus
tcgtaactttcgaaaatagtgcgga

SEQ ID NO: 57940 - DNA, 25 bp, Mus musculus
tcgtaaggtccttcctcgtgggaag

SEQ ID NO: 57941 - DNA, 25 bp, Mus musculus
tcgtaatcgcggtcctgctactcgc

SEQ ID NO: 57942 - DNA, 25 bp, Mus musculus
tcgtaatgttgcatgatgcgatcgg

SEQ ID NO: 57943 - DNA, 25 bp, Mus musculus
tcgtaccactgccagtgtgatcggg

SEQ ID NO: 57944 - DNA, 25 bp, Mus musculus
tcgtaccactgcgagtgtgatcggg

SEQ ID NO: 57945 - DNA, 25 bp, Mus musculus
tcgtacctgctgaggatggccggag

SEQ ID NO: 57946 - DNA, 25 bp, Mus musculus
tcgtagaagaagagcatcgcaggcc

SEQ ID NO: 57947 - DNA, 25 bp, Mus musculus
tcgtagaagacatgacagaagaaca

SEQ ID NO: 57948 - DNA, 25 bp, Mus musculus
tcgtagacatggaaggtgcaccagg

SEQ ID NO: 57949 - DNA, 25 bp, Mus musculus
tcgtagactgctataaaccaacaga

SEQ ID NO: 57950 - DNA, 25 bp, Mus musculus
tcgtagattccggagaaacacgtcg

SEQ ID NO: 57951 - DNA, 25 bp, Mus musculus
tcgtagtgcttacagatgatgatgt

SEQ ID NO: 57952 - DNA, 25 bp, Mus musculus
tcgtatagactagaagacttatctt

SEQ ID NO: 57953 - DNA, 25 bp, Mus musculus
tcgtatcataaaattcaaacccgga

SEQ ID NO: 57954 - DNA, 25 bp, Mus musculus
tcgtcaacctcggatgatcgggtaa

SEQ ID NO: 57955 - DNA, 25 bp, Mus musculus
tcgtcaagatggacaacagccggga

SEQ ID NO: 57956 - DNA, 25 bp, Mus musculus
tcgtcaaggctggaaacctgttcct

SEQ ID NO: 57957 - DNA, 25 bp, Mus musculus
tcgtcaattgggaatgctgcccttc

SEQ ID NO: 57958 - DNA, 25 bp, Mus musculus
tcgtcacacaaattagtctccacct

SEQ ID NO: 57959 - DNA, 25 bp, Mus musculus
tcgtcaccaagaatgggcagaagcg

SEQ ID NO: 57960 - DNA, 25 bp, Mus musculus
tcgtcagacagcctcacattttact

SEQ ID NO: 57961 - DNA, 25 bp, Mus musculus
tcgtcagccgcagaggttgaaagct

SEQ ID NO: 57962 - DNA, 25 bp, Mus musculus
tcgtcagcgacctgtatgagaagct

SEQ ID NO: 57963 - DNA, 25 bp, Mus musculus
tcgtcaggttattctggacaatggc

SEQ ID NO: 57964 - DNA, 25 bp, Mus musculus
tcgtcagtggcataatccatcatac

SEQ ID NO: 57965 - DNA, 25 bp, Mus musculus
tcgtcagtggccttctcatgctcct

SEQ ID NO: 57966 - DNA, 25 bp, Mus musculus
tcgtcatcgccatgtccttgcagat

SEQ ID NO: 57967 - DNA, 25 bp, Mus musculus
tcgtcatgaacaaaactgacattgg

SEQ ID NO: 57968 - DNA, 25 bp, Mus musculus
tcgtcatggcaagagccaagatact

SEQ ID NO: 57969 - DNA, 25 bp, Mus musculus
tcgtccacagcgaagaacctgagga

SEQ ID NO: 57970 - DNA, 25 bp, Mus musculus
tcgtccacagcgtagaacctgagga

SEQ ID NO: 57971 - DNA, 25 bp, Mus musculus
tcgtccactaccatcacagggaaga

SEQ ID NO: 57972 - DNA, 25 bp, Mus musculus
tcgtccctcaactgcatgagagaag

SEQ ID NO: 57973 - DNA, 25 bp, Mus musculus
tcgtccgaagttccggagcagccac

SEQ ID NO: 57974 - DNA, 25 bp, Mus musculus
tcgtccgaagttgcggagcagccac

SEQ ID NO: 57975 - DNA, 25 bp, Mus musculus
tcgtcctaatgtgtcaggccatggc

SEQ ID NO: 57976 - DNA, 25 bp, Mus musculus
tcgtcctcatcgcactgcaggaagc

SEQ ID NO: 57977 - DNA, 25 bp, Mus musculus
tcgtcctccaaagaacagatgctgg

SEQ ID NO: 57978 - DNA, 25 bp, Mus musculus
tcgtcctctgcccagagtgaaaaga

SEQ ID NO: 57979 - DNA, 25 bp, Mus musculus
tcgtcctggtcagcttcaagcagtg

SEQ ID NO: 57980 - DNA, 25 bp, Mus musculus
tcgtcctgtcgagtggataagcctt

SEQ ID NO: 57981 - DNA, 25 bp, Mus musculus
tcgtcgagaacgtgatgatggcgaa

SEQ ID NO: 57982 - DNA, 25 bp, Mus musculus
tcgtcgcggcttggatttcaaactg

SEQ ID NO: 57983 - DNA, 25 bp, Mus musculus
tcgtcgtacagaatgccacggtcct

SEQ ID NO: 57984 - DNA, 25 bp, Mus musculus
tcgtcgtcgcagtcaagaacaaatg

SEQ ID NO: 57985 - DNA, 25 bp, Mus musculus
tcgtcgtggatatgctgatcaaagc

SEQ ID NO: 57986 - DNA, 25 bp, Mus musculus
tcgtctacaagactgacacctccat

SEQ ID NO: 57987 - DNA, 25 bp, Mus musculus
tcgtctagcgcaacaggaaaagcaa

SEQ ID NO: 57988 - DNA, 25 bp, Mus musculus
tcgtctaggaaaaatacaaaacctg

SEQ ID NO: 57989 - DNA, 25 bp, Mus musculus
tcgtctctcagggagaggtgtccgt

SEQ ID NO: 57990 - DNA, 25 bp, Mus musculus
tcgtctgacaaaggctttgctgcag

SEQ ID NO: 57991 - DNA, 25 bp, Mus musculus
tcgtctggacctgggcctaagtgtg

SEQ ID NO: 57992 - DNA, 25 bp, Mus musculus
tcgtctggcacgtgcggagtaaatg

SEQ ID NO: 57993 - DNA, 25 bp, Mus musculus
tcgtctgtatccatacacagctgac

SEQ ID NO: 57994 - DNA, 25 bp, Mus musculus
tcgtctgtatccttacacagctgac

SEQ ID NO: 57995 - DNA, 25 bp, Mus musculus
tcgtctgtgccgcatacaatgccag

SEQ ID NO: 57996 - DNA, 25 bp, Mus musculus
tcgtctgtgccggatacaatgccag

SEQ ID NO: 57997 - DNA, 25 bp, Mus musculus
tcgtcttagtgacataaacatcgcg

SEQ ID NO: 57998 - DNA, 25 bp, Mus musculus
tcgtctttcagcagcatcacagact

SEQ ID NO: 57999 - DNA, 25 bp, Mus musculus
tcgtgaacataaccgcgtgtgcgac

SEQ ID NO: 58000 - DNA, 25 bp, Mus musculus
tcgtgaacataagcgcgtgtgcgac

SEQ ID NO: 58001 - DNA, 25 bp, Mus musculus
tcgtgaaccccgaccgtctttgtct

SEQ ID NO: 58002 - DNA, 25 bp, Mus musculus
tcgtgaacctgtcagacaaatgaaa

SEQ ID NO: 58003 - DNA, 25 bp, Mus musculus
tcgtgaagcaaatgaggaccagagc

SEQ ID NO: 58004 - DNA, 25 bp, Mus musculus
tcgtgaaggatatcaagcccgggct

SEQ ID NO: 58005 - DNA, 25 bp, Mus musculus
tcgtgacggagagccggtccctgca

SEQ ID NO: 58006 - DNA, 25 bp, Mus musculus
tcgtgacggaggaaattatgaccac

SEQ ID NO: 58007 - DNA, 25 bp, Mus musculus
tcgtgacttcttctcccatcaggag

SEQ ID NO: 58008 - DNA, 25 bp, Mus musculus
tcgtgagacatgacctaaaagaact

SEQ ID NO: 58009 - DNA, 25 bp, Mus musculus
tcgtgatttgtgacagctttgcggt

SEQ ID NO: 58010 - DNA, 25 bp, Mus musculus
tcgtgcacaccgtgcagagtcagga

SEQ ID NO: 58011 - DNA, 25 bp, Mus musculus
tcgtgcaccgattctctcacggaac

SEQ ID NO: 58012 - DNA, 25 bp, Mus musculus
tcgtgcaggcgcattaccaggccgt

SEQ ID NO: 58013 - DNA, 25 bp, Mus musculus
tcgtgccagaaatagcccacactta

SEQ ID NO: 58014 - DNA, 25 bp, Mus musculus
tcgtgcccctgctggaaggtgtagc

SEQ ID NO: 58015 - DNA, 25 bp, Mus musculus
tcgtgccgatgcctggcatactgca

SEQ ID NO: 58016 - DNA, 25 bp, Mus musculus
tcgtgcctgtagacaccctgggtga

SEQ ID NO: 58017 - DNA, 25 bp, Mus musculus
tcgtgctcaggagcgtctggccaca

SEQ ID NO: 58018 - DNA, 25 bp, Mus musculus
tcgtgctcgtcacatctgctacttc

SEQ ID NO: 58019 - DNA, 25 bp, Mus musculus
tcgtgctgacagctgagtcattgtc

SEQ ID NO: 58020 - DNA, 25 bp, Mus musculus
tcgtgctgagccagagttcgcagga

SEQ ID NO: 58021 - DNA, 25 bp, Mus musculus
tcgtgctgctgtggccgatcccata

SEQ ID NO: 58022 - DNA, 25 bp, Mus musculus
tcgtggagatagcaccaaagtggac

SEQ ID NO: 58023 - DNA, 25 bp, Mus musculus
tcgtggaggtgtctttgactccatt

SEQ ID NO: 58024 - DNA, 25 bp, Mus musculus
tcgtggagtccttcgatgtggagac

SEQ ID NO: 58025 - DNA, 25 bp, Mus musculus
tcgtggatagagagatggtacattc

SEQ ID NO: 58026 - DNA, 25 bp, Mus musculus
tcgtggatatccctcagcaagagaa

SEQ ID NO: 58027 - DNA, 25 bp, Mus musculus
tcgtggatatgctgatcaaagcaaa

SEQ ID NO: 58028 - DNA, 25 bp, Mus musculus
tcgtggcaaaggcagagattgctcc

SEQ ID NO: 58029 - DNA, 25 bp, Mus musculus
tcgtggcagcagagccactgaggcc

SEQ ID NO: 58030 - DNA, 25 bp, Mus musculus
tcgtggcagcagtgccactgaggcc

SEQ ID NO: 58031 - DNA, 25 bp, Mus musculus
tcgtggcagctctcgtgggagcctt

SEQ ID NO: 58032 - DNA, 25 bp, Mus musculus
tcgtggccaacgctgctcaggacgt

SEQ ID NO: 58033 - DNA, 25 bp, Mus musculus
tcgtggccaacggtgctcaggacgt

SEQ ID NO: 58034 - DNA, 25 bp, Mus musculus
tcgtggccgatgcttgtgtacatgt

SEQ ID NO: 58035 - DNA, 25 bp, Mus musculus
tcgtggcgaccctgcctttgccaat

SEQ ID NO: 58036 - DNA, 25 bp, Mus musculus
tcgtggctacccatgactactatcg

SEQ ID NO: 58037 - DNA, 25 bp, Mus musculus
tcgtggctctcacagatgaccaagg

SEQ ID NO: 58038 - DNA, 25 bp, Mus musculus
tcgtggctctcagagatgaccaagg

SEQ ID NO: 58039 - DNA, 25 bp, Mus musculus
tcgtggctgccactcttccctagaa

SEQ ID NO: 58040 - DNA, 25 bp, Mus musculus
tcgtggcttctgaaatagctaaaga

SEQ ID NO: 58041 - DNA, 25 bp, Mus musculus
tcgtgggactgaggtcagcttcaga

SEQ ID NO: 58042 - DNA, 25 bp, Mus musculus
tcgtgggagccttcgggtcctcctt

SEQ ID NO: 58043 - DNA, 25 bp, Mus musculus
tcgtgggatctgagtcccggtcttc

SEQ ID NO: 58044 - DNA, 25 bp, Mus musculus
tcgtgggatctgtgtcccggtcttc

SEQ ID NO: 58045 - DNA, 25 bp, Mus musculus
tcgtgggattgtgctgctgaccttg

SEQ ID NO: 58046 - DNA, 25 bp, Mus musculus
tcgtgggcatcctcaactttgctgc

SEQ ID NO: 58047 - DNA, 25 bp, Mus musculus
tcgtggtctgcctggcaagcctcct

SEQ ID NO: 58048 - DNA, 25 bp, Mus musculus
tcgtggtgcaaagacaacagctatg

SEQ ID NO: 58049 - DNA, 25 bp, Mus musculus
tcgtggtgccactcagcaaattctg

SEQ ID NO: 58050 - DNA, 25 bp, Mus musculus
tcgtggtgctgctcctcggatggct

SEQ ID NO: 58051 - DNA, 25 bp, Mus musculus
tcgtggtttataagatcctggaaca

SEQ ID NO: 58052 - DNA, 25 bp, Mus musculus
tcgtgtatcccacgtgggcagccct

SEQ ID NO: 58053 - DNA, 25 bp, Mus musculus
tcgtgtatgatcaggcaatgaagag

SEQ ID NO: 58054 - DNA, 25 bp, Mus musculus
tcgtgtcacagctaatgcatcatgg

SEQ ID NO: 58055 - DNA, 25 bp, Mus musculus
tcgtgtcagacagaaggcgaggcat

SEQ ID NO: 58056 - DNA, 25 bp, Mus musculus
tcgtgtccaggtccggtactctgac

SEQ ID NO: 58057 - DNA, 25 bp, Mus musculus
tcgtgtccggatgcgatcctactat

SEQ ID NO: 58058 - DNA, 25 bp, Mus musculus
tcgtgtcctgagctgaagatgttcc

SEQ ID NO: 58059 - DNA, 25 bp, Mus musculus
tcgtgtctggagaaggaaaccagtg

SEQ ID NO: 58060 - DNA, 25 bp, Mus musculus
tcgtgtgatctcactctcaggagag

SEQ ID NO: 58061 - DNA, 25 bp, Mus musculus
tcgtgtgcaaggaatggtaccgcgt

SEQ ID NO: 58062 - DNA, 25 bp, Mus musculus
tcgtgtgggcgctccctgttgtgat

SEQ ID NO: 58063 - DNA, 25 bp, Mus musculus
tcgtgtgtatcattccaagtgtttg

SEQ ID NO: 58064 - DNA, 25 bp, Mus musculus
tcgtgttatgaacaaagatcagtgg

SEQ ID NO: 58065 - DNA, 25 bp, Mus musculus
tcgttaaagcaacaaatggaccaag

SEQ ID NO: 58066 - DNA, 25 bp, Mus musculus
tcgttaactttcagcagagtgaaaa

SEQ ID NO: 58067 - DNA, 25 bp, Mus musculus
tcgttaaggtagaaggttgttgact

SEQ ID NO: 58068 - DNA, 25 bp, Mus musculus
tcgttacgaggagaagtactgactc

SEQ ID NO: 58069 - DNA, 25 bp, Mus musculus
tcgttagaaaagtcaaacactaagc

SEQ ID NO: 58070 - DNA, 25 bp, Mus musculus
tcgttagccgccaggaggccctgga

SEQ ID NO: 58071 - DNA, 25 bp, Mus musculus
tcgttataggcatttccgtgggact

SEQ ID NO: 58072 - DNA, 25 bp, Mus musculus
tcgttatgggccctcttcacctcta

SEQ ID NO: 58073 - DNA, 25 bp, Mus musculus
tcgttattgaagacagttacctttc

SEQ ID NO: 58074 - DNA, 25 bp, Mus musculus
tcgttcaattggagcagcagctaag

SEQ ID NO: 58075 - DNA, 25 bp, Mus musculus
tcgttcacccgacaaacactgactt

SEQ ID NO: 58076 - DNA, 25 bp, Mus musculus
tcgttcatccaacattccgttcaaa

SEQ ID NO: 58077 - DNA, 25 bp, Mus musculus
tcgttccagcacaattcctgagcag

SEQ ID NO: 58078 - DNA, 25 bp, Mus musculus
tcgttccagtcagaggtgcttagcc

SEQ ID NO: 58079 - DNA, 25 bp, Mus musculus
tcgttcctgttgtgatcgcctgtaa

SEQ ID NO: 58080 - DNA, 25 bp, Mus musculus
tcgttcgaagaggattaagaaggac

SEQ ID NO: 58081 - DNA, 25 bp, Mus musculus
tcgttcgaagcaggcatcaaagtgc

SEQ ID NO: 58082 - DNA, 25 bp, Mus musculus
tcgttcgaagtcatattggatacag

SEQ ID NO: 58083 - DNA, 25 bp, Mus musculus
tcgttgtatttctgcctcggccggc

SEQ ID NO: 58084 - DNA, 25 bp, Mus musculus
tcgttgtctacacggatggctgttg

SEQ ID NO: 58085 - DNA, 25 bp, Mus musculus
tcgttgtctgcctactgaaccacta

SEQ ID NO: 58086 - DNA, 25 bp, Mus musculus
tcgtttgctgtcacgtgcctgtggt

SEQ ID NO: 58087 - DNA, 25 bp, Mus musculus
tcgtttttggcctctgtgtacttca

SEQ ID NO: 58088 - DNA, 25 bp, Mus musculus
tctaaaaaacgatgaaggcactgta

SEQ ID NO: 58089 - DNA, 25 bp, Mus musculus
tctaaaaaccaagccgtcgcacaga

SEQ ID NO: 58090 - DNA, 25 bp, Mus musculus
tctaaaaatgttggaaccggattgg

SEQ ID NO: 58091 - DNA, 25 bp, Mus musculus
tctaaaacaaatgggcgaagaccaa

SEQ ID NO: 58092 - DNA, 25 bp, Mus musculus
tctaaaacctacagatgagaatctt

SEQ ID NO: 58093 - DNA, 25 bp, Mus musculus
tctaaaacgtgagcctgcattccca

SEQ ID NO: 58094 - DNA, 25 bp, Mus musculus
tctaaaagccttgaggtccatgtgc

SEQ ID NO: 58095 - DNA, 25 bp, Mus musculus
tctaaaatgaggaagaccatggttt

SEQ ID NO: 58096 - DNA, 25 bp, Mus musculus
tctaaacatggcagaggagggagct

SEQ ID NO: 58097 - DNA, 25 bp, Mus musculus
tctaaacatggctgaggagggagct

SEQ ID NO: 58098 - DNA, 25 bp, Mus musculus
tctaaactaaacagagagaagaagc

SEQ ID NO: 58099 - DNA, 25 bp, Mus musculus
tctaaactcatctgcgaggccacga

SEQ ID NO: 58100 - DNA, 25 bp, Mus musculus
tctaaagaagtagaacttctgcagc

SEQ ID NO: 58101 - DNA, 25 bp, Mus musculus
tctaaagcatgtattccaaaaacac

SEQ ID NO: 58102 - DNA, 25 bp, Mus musculus
tctaaagcatgttttccaaaaacac

SEQ ID NO: 58103 - DNA, 25 bp, Mus musculus
tctaaagccagggatggtgccagcc

SEQ ID NO: 58104 - DNA, 25 bp, Mus musculus
tctaaagctccatcagacgcttcat

SEQ ID NO: 58105 - DNA, 25 bp, Mus musculus
tctaaagctgacaaagaggccgtgg

SEQ ID NO: 58106 - DNA, 25 bp, Mus musculus
tctaaaggagctgtcagacggtgaa

SEQ ID NO: 58107 - DNA, 25 bp, Mus musculus
tctaaaggatatgaagagtgtccag

SEQ ID NO: 58108 - DNA, 25 bp, Mus musculus
tctaaaggtgccaggaacaacccca

SEQ ID NO: 58109 - DNA, 25 bp, Mus musculus
tctaaagttctatctcagatctcag

SEQ ID NO: 58110 - DNA, 25 bp, Mus musculus
tctaaatcctggtggcgagttcgaa

SEQ ID NO: 58111 - DNA, 25 bp, Mus musculus
tctaaatgccatccacatagctgtg

SEQ ID NO: 58112 - DNA, 25 bp, Mus musculus
tctaaatgccatgtggtatgcagag

SEQ ID NO: 58113 - DNA, 25 bp, Mus musculus
tctaaatgggaccaaagactcgatg

SEQ ID NO: 58114 - DNA, 25 bp, Mus musculus
tctaaatgtggatgagtttgtgaag

SEQ ID NO: 58115 - DNA, 25 bp, Mus musculus
tctaaattatgagcaggagcagcgt

SEQ ID NO: 58116 - DNA, 25 bp, Mus musculus
tctaaatttgggtccacacccaagt

SEQ ID NO: 58117 - DNA, 25 bp, Mus musculus
tctaacaaacatgatggccacatcc

SEQ ID NO: 58118 - DNA, 25 bp, Mus musculus
tctaacagccaaaggaaaaggccga

SEQ ID NO: 58119 - DNA, 25 bp, Mus musculus
tctaacaggactgcagagggacagg

SEQ ID NO: 58120 - DNA, 25 bp, Mus musculus
tctaacagttcaccgggcaactcct

SEQ ID NO: 58121 - DNA, 25 bp, Mus musculus
tctaaccaagactcccaagctggac

SEQ ID NO: 58122 - DNA, 25 bp, Mus musculus
tctaaccagtgtaagaaataaacct

SEQ ID NO: 58123 - DNA, 25 bp, Mus musculus
tctaaccgcagaactgggatgtggg

SEQ ID NO: 58124 - DNA, 25 bp, Mus musculus
tctaactcagaattgtcggatgagc

SEQ ID NO: 58125 - DNA, 25 bp, Mus musculus
tctaactgacaaactcatgatggat

SEQ ID NO: 58126 - DNA, 25 bp, Mus musculus
tctaactgagcgtgctctgcaaggc

SEQ ID NO: 58127 - DNA, 25 bp, Mus musculus
tctaactgccgtttgggttcttgga

SEQ ID NO: 58128 - DNA, 25 bp, Mus musculus
tctaacttcagcaagcgccttggtc

SEQ ID NO: 58129 - DNA, 25 bp, Mus musculus
tctaacttgaaggtctgctgccctc

SEQ ID NO: 58130 - DNA, 25 bp, Mus musculus
tctaagaaggttcgagacttgtggt

SEQ ID NO: 58131 - DNA, 25 bp, Mus musculus
tctaagagagttcggatacctctgc

SEQ ID NO: 58132 - DNA, 25 bp, Mus musculus
tctaagagggatggaggctttaaaa

SEQ ID NO: 58133 - DNA, 25 bp, Mus musculus
tctaagagtcccaacttgtccaaac

SEQ ID NO: 58134 - DNA, 25 bp, Mus musculus
tctaagcacaaaaaagccatctggg

SEQ ID NO: 58135 - DNA, 25 bp, Mus musculus
tctaagccgactcgcttatgctggc

SEQ ID NO: 58136 - DNA, 25 bp, Mus musculus
tctaagcttgtggtccaccagaggt

SEQ ID NO: 58137 - DNA, 25 bp, Mus musculus
tctaaggaaaaccacggaggagcag

SEQ ID NO: 58138 - DNA, 25 bp, Mus musculus
tctaaggaatccaaaatgctacaaa

SEQ ID NO: 58139 - DNA, 25 bp, Mus musculus
tctaaggactacaacagtctcaaag

SEQ ID NO: 58140 - DNA, 25 bp, Mus musculus
tctaaggccgccatttctctgggtc

SEQ ID NO: 58141 - DNA, 25 bp, Mus musculus
tctaaggctggattttgaaaagcac

SEQ ID NO: 58142 - DNA, 25 bp, Mus musculus
tctaagggacacatgttggcagatg

SEQ ID NO: 58143 - DNA, 25 bp, Mus musculus
tctaagggacagttggcagctggaa

SEQ ID NO: 58144 - DNA, 25 bp, Mus musculus
tctaagggtgaagtttgcaacggcg

SEQ ID NO: 58145 - DNA, 25 bp, Mus musculus
tctaagggtgttcacatgggagctc

SEQ ID NO: 58146 - DNA, 25 bp, Mus musculus
tctaagggttgtccccaagactgtg

SEQ ID NO: 58147 - DNA, 25 bp, Mus musculus
tctaagggttgtgcccaagactgtg

SEQ ID NO: 58148 - DNA, 25 bp, Mus musculus
tctaaggtccaacatcaacgaggtg

SEQ ID NO: 58149 - DNA, 25 bp, Mus musculus
tctaaggtggaaaaacagctgcagg

SEQ ID NO: 58150 - DNA, 25 bp, Mus musculus
tctaagtatggtgacctggccaact

SEQ ID NO: 58151 - DNA, 25 bp, Mus musculus
tctaagtggtatggccgtcggagcc

SEQ ID NO: 58152 - DNA, 25 bp, Mus musculus
tctaagttactgtcttgcaaggtga

SEQ ID NO: 58153 - DNA, 25 bp, Mus musculus
tctaagttccttaaaacatccgtca

SEQ ID NO: 58154 - DNA, 25 bp, Mus musculus
tctaatagcatttaccactatggct

SEQ ID NO: 58155 - DNA, 25 bp, Mus musculus
tctaatcaaatcaaatgttagtcgg

SEQ ID NO: 58156 - DNA, 25 bp, Mus musculus
tctaatccagacatcaagggcggtg

SEQ ID NO: 58157 - DNA, 25 bp, Mus musculus
tctaatcctcatcatgacaacgtca

SEQ ID NO: 58158 - DNA, 25 bp, Mus musculus
tctaatctcaaagcgaggtcaccgg

SEQ ID NO: 58159 - DNA, 25 bp, Mus musculus
tctaatctccctccatgaagaactg

SEQ ID NO: 58160 - DNA, 25 bp, Mus musculus
tctaatctccttattggaacatggg

SEQ ID NO: 58161 - DNA, 25 bp, Mus musculus
tctaatgagagagctcttggtgtgc

SEQ ID NO: 58162 - DNA, 25 bp, Mus musculus
tctaatgatgagcatgatggacctc

SEQ ID NO: 58163 - DNA, 25 bp, Mus musculus
tctaatgatgaggatgatggacctc

SEQ ID NO: 58164 - DNA, 25 bp, Mus musculus
tctaatgcgctctcgggtccggggt

SEQ ID NO: 58165 - DNA, 25 bp, Mus musculus
tctaatgtggttggccagtttttct

SEQ ID NO: 58166 - DNA, 25 bp, Mus musculus
tctaattaaggcctacctatctgga

SEQ ID NO: 58167 - DNA, 25 bp, Mus musculus
tctaattgctggagtggatgcagac

SEQ ID NO: 58168 - DNA, 25 bp, Mus musculus
tctacaaacccatttcagaccaatg

SEQ ID NO: 58169 - DNA, 25 bp, Mus musculus
tctacaacaagtggttctactgcgg

SEQ ID NO: 58170 - DNA, 25 bp, Mus musculus
tctacaacgtagaggccacatccta

SEQ ID NO: 58171 - DNA, 25 bp, Mus musculus
tctacaagctgagatgagtttgtcc

SEQ ID NO: 58172 - DNA, 25 bp, Mus musculus
tctacaagtacctaacccatcttgg

SEQ ID NO: 58173 - DNA, 25 bp, Mus musculus
tctacaagtcagctgaaggtgacgc

SEQ ID NO: 58174 - DNA, 25 bp, Mus musculus
tctacaagtcaggtgaaggtgacgc

SEQ ID NO: 58175 - DNA, 25 bp, Mus musculus
tctacaagttcatgaaggagcgaca

SEQ ID NO: 58176 - DNA, 25 bp, Mus musculus
tctacaatatctacctggaagccac

SEQ ID NO: 58177 - DNA, 25 bp, Mus musculus
tctacaatgccacaaagcttcttct

SEQ ID NO: 58178 - DNA, 25 bp, Mus musculus
tctacaatggtgcagtaaatagcaa

SEQ ID NO: 58179 - DNA, 25 bp, Mus musculus
tctacaattgctgatgaaggaacat

SEQ ID NO: 58180 - DNA, 25 bp, Mus musculus
tctacaatttctcactggtgatact

SEQ ID NO: 58181 - DNA, 25 bp, Mus musculus
tctacacaagctgacaagagaggga

SEQ ID NO: 58182 - DNA, 25 bp, Mus musculus
tctacaccatcctcactcaggtatg

SEQ ID NO: 58183 - DNA, 25 bp, Mus musculus
tctacaccgcgcagcagtcactggg

SEQ ID NO: 58184 - DNA, 25 bp, Mus musculus
tctacaccgtcagctacatctggtg

SEQ ID NO: 58185 - DNA, 25 bp, Mus musculus
tctacacctcggaagtctggaagtc

SEQ ID NO: 58186 - DNA, 25 bp, Mus musculus
tctacagacaaaggagagcctaaca

SEQ ID NO: 58187 - DNA, 25 bp, Mus musculus
tctacagaggaaataatgccatcag

SEQ ID NO: 58188 - DNA, 25 bp, Mus musculus
tctacagatgaaagaaatcgctcag

SEQ ID NO: 58189 - DNA, 25 bp, Mus musculus
tctacagcagaccaaagagtgcaac

SEQ ID NO: 58190 - DNA, 25 bp, Mus musculus
tctacagcgacagcttcggtggcga

SEQ ID NO: 58191 - DNA, 25 bp, Mus musculus
tctacaggcagagtcctagaagcct

SEQ ID NO: 58192 - DNA, 25 bp, Mus musculus
tctacaggcattatggctcttcggt

SEQ ID NO: 58193 - DNA, 25 bp, Mus musculus
tctacaggcctgacgagggctactg

SEQ ID NO: 58194 - DNA, 25 bp, Mus musculus
tctacaggcctgctgtgaagtccga

SEQ ID NO: 58195 - DNA, 25 bp, Mus musculus
tctacaggcttatgcgtggctatgt

SEQ ID NO: 58196 - DNA, 25 bp, Mus musculus
tctacagtctgagaagacagctgtt

SEQ ID NO: 58197 - DNA, 25 bp, Mus musculus
tctacagtgacaagcgcatggtcca

SEQ ID NO: 58198 - DNA, 25 bp, Mus musculus
tctacagtgggtacccacgtggcct

SEQ ID NO: 58199 - DNA, 25 bp, Mus musculus
tctacagtgtgtacggagttcttca

SEQ ID NO: 58200 - DNA, 25 bp, Mus musculus
tctacagtgtgttcggagttcttca

SEQ ID NO: 58201 - DNA, 25 bp, Mus musculus
tctacataacaaccgcatccagcat

SEQ ID NO: 58202 - DNA, 25 bp, Mus musculus
tctacatacagttctgggccctggg

SEQ ID NO: 58203 - DNA, 25 bp, Mus musculus
tctacatgaacgtgggaggcttcct

SEQ ID NO: 58204 - DNA, 25 bp, Mus musculus
tctacatggcctatgcagactatca

SEQ ID NO: 58205 - DNA, 25 bp, Mus musculus
tctacatggtgctgagcctcttcat

SEQ ID NO: 58206 - DNA, 25 bp, Mus musculus
tctacattcggcctgcagtgcctgc

SEQ ID NO: 58207 - DNA, 25 bp, Mus musculus
tctacatttgtagtacaagaccctg

SEQ ID NO: 58208 - DNA, 25 bp, Mus musculus
tctaccaacatcaaggaacgcctcg

SEQ ID NO: 58209 - DNA, 25 bp, Mus musculus
tctaccacgtgagtgacgcgagctg

SEQ ID NO: 58210 - DNA, 25 bp, Mus musculus
tctaccagagggatagagaagaaga

SEQ ID NO: 58211 - DNA, 25 bp, Mus musculus
tctaccagcagatgcgtaggaaggg

SEQ ID NO: 58212 - DNA, 25 bp, Mus musculus
tctaccatctccagagttctgtgga

SEQ ID NO: 58213 - DNA, 25 bp, Mus musculus
tctaccatctgggagataaaattgt

SEQ ID NO: 58214 - DNA, 25 bp, Mus musculus
tctaccatgccttttcaggagcgca

SEQ ID NO: 58215 - DNA, 25 bp, Mus musculus
tctaccatgggtccagtccatagct

SEQ ID NO: 58216 - DNA, 25 bp, Mus musculus
tctacccaaagaatgggtttgtatt

SEQ ID NO: 58217 - DNA, 25 bp, Mus musculus
tctacccacctgtaccccaagtgta

SEQ ID NO: 58218 - DNA, 25 bp, Mus musculus
tctacccagaggagcgctacatgga

SEQ ID NO: 58219 - DNA, 25 bp, Mus musculus
tctacccagaggatggtctgggcca

SEQ ID NO: 58220 - DNA, 25 bp, Mus musculus
tctacccgttacatatccttcagtg

SEQ ID NO: 58221 - DNA, 25 bp, Mus musculus
tctaccctgtgtcttttcaagaggc

SEQ ID NO: 58222 - DNA, 25 bp, Mus musculus
tctaccctgtgtgttttcaagaggc

SEQ ID NO: 58223 - DNA, 25 bp, Mus musculus
tctacccttcagatcacatttgaca

SEQ ID NO: 58224 - DNA, 25 bp, Mus musculus
tctacccttcagcagacgccggaga

SEQ ID NO: 58225 - DNA, 25 bp, Mus musculus
tctaccgctgtctggtccagaaggg

SEQ ID NO: 58226 - DNA, 25 bp, Mus musculus
tctaccgctgttgggcctgttggaa

SEQ ID NO: 58227 - DNA, 25 bp, Mus musculus
tctacctaaactctgatttgaaagg

SEQ ID NO: 58228 - DNA, 25 bp, Mus musculus
tctacctatgcttctgctgataccg

SEQ ID NO: 58229 - DNA, 25 bp, Mus musculus
tctacctcatttctggggaagtgac

SEQ ID NO: 58230 - DNA, 25 bp, Mus musculus
tctacctgaaacttgaagaaggatt

SEQ ID NO: 58231 - DNA, 25 bp, Mus musculus
tctacctgaagatcagcaaaagaca

SEQ ID NO: 58232 - DNA, 25 bp, Mus musculus
tctacctgggctattgcttctgtgg

SEQ ID NO: 58233 - DNA, 25 bp, Mus musculus
tctacgaactagtggactggttcct

SEQ ID NO: 58234 - DNA, 25 bp, Mus musculus
tctacgaagcttcgccctatgagcc

SEQ ID NO: 58235 - DNA, 25 bp, Mus musculus
tctacgaatccatttgttgctgcta

SEQ ID NO: 58236 - DNA, 25 bp, Mus musculus
tctacgaatgttgctgtagattctg

SEQ ID NO: 58237 - DNA, 25 bp, Mus musculus
tctacgacaccccagagaacatcgt

SEQ ID NO: 58238 - DNA, 25 bp, Mus musculus
tctacgacattagcagtgagcgctc

SEQ ID NO: 58239 - DNA, 25 bp, Mus musculus
tctacgagggctttgaggaacctta

SEQ ID NO: 58240 - DNA, 25 bp, Mus musculus
tctacgcaaccgactcgggcagtac

SEQ ID NO: 58241 - DNA, 25 bp, Mus musculus
tctacgcccaactcatccatgagtg

SEQ ID NO: 58242 - DNA, 25 bp, Mus musculus
tctacgggaatcctcaggacacaag

SEQ ID NO: 58243 - DNA, 25 bp, Mus musculus
tctacgggctggtgatgagaaggcg

SEQ ID NO: 58244 - DNA, 25 bp, Mus musculus
tctacgggtacaacctctccgtggt

SEQ ID NO: 58245 - DNA, 25 bp, Mus musculus
tctacgggtccatggagctacaggt

SEQ ID NO: 58246 - DNA, 25 bp, Mus musculus
tctacgtcaggtcagctgtctcaat

SEQ ID NO: 58247 - DNA, 25 bp, Mus musculus
tctacgtccatgagaagtggaaccg

SEQ ID NO: 58248 - DNA, 25 bp, Mus musculus
tctacgtcttaaggcagagactagc

SEQ ID NO: 58249 - DNA, 25 bp, Mus musculus
tctacgtgcctcaaggaacccaaca

SEQ ID NO: 58250 - DNA, 25 bp, Mus musculus
tctacgtggaaatgaaatgggagtt

SEQ ID NO: 58251 - DNA, 25 bp, Mus musculus
tctacgtgggagtctgtgcatttgt

SEQ ID NO: 58252 - DNA, 25 bp, Mus musculus
tctactaaaagggtatcctgtgtac

SEQ ID NO: 58253 - DNA, 25 bp, Mus musculus
tctactacatcagtgctttccggga

SEQ ID NO: 58254 - DNA, 25 bp, Mus musculus
tctactagtgctcctatatctccag

SEQ ID NO: 58255 - DNA, 25 bp, Mus musculus
tctactatcgttgaacttgggtgtt

SEQ ID NO: 58256 - DNA, 25 bp, Mus musculus
tctactatgcccagaaggctgttct

SEQ ID NO: 58257 - DNA, 25 bp, Mus musculus
tctactattccatgaaaggcgctgg

SEQ ID NO: 58258 - DNA, 25 bp, Mus musculus
tctactcaacatgtcccttcagaaa

SEQ ID NO: 58259 - DNA, 25 bp, Mus musculus
tctactcatgaatttgagaagaagg

SEQ ID NO: 58260 - DNA, 25 bp, Mus musculus
tctactccaggtttctctcgaagat

SEQ ID NO: 58261 - DNA, 25 bp, Mus musculus
tctactccatcgtgggactcagcag

SEQ ID NO: 58262 - DNA, 25 bp, Mus musculus
tctactcccatgaattcacctttga

SEQ ID NO: 58263 - DNA, 25 bp, Mus musculus
tctactcctatttccgaagctcctg

SEQ ID NO: 58264 - DNA, 25 bp, Mus musculus
tctactctctcatgggtgaagaaca

SEQ ID NO: 58265 - DNA, 25 bp, Mus musculus
tctactcttggcatctactttgaag

SEQ ID NO: 58266 - DNA, 25 bp, Mus musculus
tctactgaactgaaagcccacaaag

SEQ ID NO: 58267 - DNA, 25 bp, Mus musculus
tctactgaactgtaagcccacaaag

SEQ ID NO: 58268 - DNA, 25 bp, Mus musculus
tctactgcgtgaggcttgccagagt

SEQ ID NO: 58269 - DNA, 25 bp, Mus musculus
tctactgggaggaccggctgctgaa

SEQ ID NO: 58270 - DNA, 25 bp, Mus musculus
tctactgggctgtctgaaggggctt

SEQ ID NO: 58271 - DNA, 25 bp, Mus musculus
tctactgtggagatgactccatccg

SEQ ID NO: 58272 - DNA, 25 bp, Mus musculus
tctacttaatcatggaatatgcaag

SEQ ID NO: 58273 - DNA, 25 bp, Mus musculus
tctacttacatcctggtaaagccag

SEQ ID NO: 58274 - DNA, 25 bp, Mus musculus
tctacttcatattacgggcgggatc

SEQ ID NO: 58275 - DNA, 25 bp, Mus musculus
tctacttcgccattgcagaagagga

SEQ ID NO: 58276 - DNA, 25 bp, Mus musculus
tctacttctccaactccatttcaga

SEQ ID NO: 58277 - DNA, 25 bp, Mus musculus
tctagaaacccagtggaccgaccaa

SEQ ID NO: 58278 - DNA, 25 bp, Mus musculus
tctagaaaggactccagggagggaa

SEQ ID NO: 58279 - DNA, 25 bp, Mus musculus
tctagaaagtgaactgaaactattt

SEQ ID NO: 58280 - DNA, 25 bp, Mus musculus
tctagaaagtgatctgaaactattt

SEQ ID NO: 58281 - DNA, 25 bp, Mus musculus
tctagaactgagatagacaccagat

SEQ ID NO: 58282 - DNA, 25 bp, Mus musculus
tctagaagggcaagagatgcaagtg

SEQ ID NO: 58283 - DNA, 25 bp, Mus musculus
tctagaagtggacgtatatcccagt

SEQ ID NO: 58284 - DNA, 25 bp, Mus musculus
tctagactcagttgagttgacaacc

SEQ ID NO: 58285 - DNA, 25 bp, Mus musculus
tctagactgaatctggtcacagcct

SEQ ID NO: 58286 - DNA, 25 bp, Mus musculus
tctagactgaatgtggtcacagcct

SEQ ID NO: 58287 - DNA, 25 bp, Mus musculus
tctagactgacctttaacttgtggg

SEQ ID NO: 58288 - DNA, 25 bp, Mus musculus
tctagagaaagcatcgtacctttgg

SEQ ID NO: 58289 - DNA, 25 bp, Mus musculus
tctagagacggtagacagaggcaag

SEQ ID NO: 58290 - DNA, 25 bp, Mus musculus
tctagagagcctgaatgcacgggtc

SEQ ID NO: 58291 - DNA, 25 bp, Mus musculus
tctagagatcccacaggttaacatc

SEQ ID NO: 58292 - DNA, 25 bp, Mus musculus
tctagagcagatgtccattgggcat

SEQ ID NO: 58293 - DNA, 25 bp, Mus musculus
tctagaggaatacggaatcatggtt

SEQ ID NO: 58294 - DNA, 25 bp, Mus musculus
tctagagtctgtgaagcctcagtgc

SEQ ID NO: 58295 - DNA, 25 bp, Mus musculus
tctagagtggtaacagtacttgagc

SEQ ID NO: 58296 - DNA, 25 bp, Mus musculus
tctagataaaactcaagatgagctg

SEQ ID NO: 58297 - DNA, 25 bp, Mus musculus
tctagataaaccacagttacaaggg

SEQ ID NO: 58298 - DNA, 25 bp, Mus musculus
tctagatacactacttgtggatgtt

SEQ ID NO: 58299 - DNA, 25 bp, Mus musculus
tctagatcgacttctgcagtatgag

SEQ ID NO: 58300 - DNA, 25 bp, Mus musculus
tctagatcttgagcactgggatcca

SEQ ID NO: 58301 - DNA, 25 bp, Mus musculus
tctagatgagttggtagagctccac

SEQ ID NO: 58302 - DNA, 25 bp, Mus musculus
tctagatgcaagagaaatcagagtg

SEQ ID NO: 58303 - DNA, 25 bp, Mus musculus
tctagatgggaatggccttgaaaag

SEQ ID NO: 58304 - DNA, 25 bp, Mus musculus
tctagcacacgtagcaatgcctgtc

SEQ ID NO: 58305 - DNA, 25 bp, Mus musculus
tctagccacagaatggaacacagtg

SEQ ID NO: 58306 - DNA, 25 bp, Mus musculus
tctagccacagattggaacacagtg

SEQ ID NO: 58307 - DNA, 25 bp, Mus musculus
tctagccgcagacaggagctctcca

SEQ ID NO: 58308 - DNA, 25 bp, Mus musculus
tctagccgccggtgtgccagcaggt

SEQ ID NO: 58309 - DNA, 25 bp, Mus musculus
tctagcgcatgagaagatctggttt

SEQ ID NO: 58310 - DNA, 25 bp, Mus musculus
tctagctccgactgtggcagctcct

SEQ ID NO: 58311 - DNA, 25 bp, Mus musculus
tctagctcgaagtttcaaccaaaag

SEQ ID NO: 58312 - DNA, 25 bp, Mus musculus
tctagctgacagaattctgctgatg

SEQ ID NO: 58313 - DNA, 25 bp, Mus musculus
tctagctgccctaagtacttgtgcc

SEQ ID NO: 58314 - DNA, 25 bp, Mus musculus
tctagctgtggccactggaagactc

SEQ ID NO: 58315 - DNA, 25 bp, Mus musculus
tctagcttagttcaatatgacctca

SEQ ID NO: 58316 - DNA, 25 bp, Mus musculus
tctagcttcgccatgtacatggccc

SEQ ID NO: 58317 - DNA, 25 bp, Mus musculus
tctaggaaatcccacagagccagga

SEQ ID NO: 58318 - DNA, 25 bp, Mus musculus
tctaggaagataaggttttcaacac

SEQ ID NO: 58319 - DNA, 25 bp, Mus musculus
tctaggacctcctcgaaataaccct

SEQ ID NO: 58320 - DNA, 25 bp, Mus musculus
tctaggactccaactgttacagaca

SEQ ID NO: 58321 - DNA, 25 bp, Mus musculus
tctaggactccatctgttacagaca

SEQ ID NO: 58322 - DNA, 25 bp, Mus musculus
tctaggagattcagcatcacgcgct

SEQ ID NO: 58323 - DNA, 25 bp, Mus musculus
tctaggagttccagagcctgtgggt

SEQ ID NO: 58324 - DNA, 25 bp, Mus musculus
tctaggccagccatggatgcatagt

SEQ ID NO: 58325 - DNA, 25 bp, Mus musculus
tctaggccagccttggatgcatagt

SEQ ID NO: 58326 - DNA, 25 bp, Mus musculus
tctaggcctcatcatgagaatagtg

SEQ ID NO: 58327 - DNA, 25 bp, Mus musculus
tctaggctctgctttgccgacccag

SEQ ID NO: 58328 - DNA, 25 bp, Mus musculus
tctagggaacaacacaattcgattc

SEQ ID NO: 58329 - DNA, 25 bp, Mus musculus
tctagggaaggatcccagccgagtt

SEQ ID NO: 58330 - DNA, 25 bp, Mus musculus
tctagggccagctctgcaagggcca

SEQ ID NO: 58331 - DNA, 25 bp, Mus musculus
tctagggcccaagaacaatgacagc

SEQ ID NO: 58332 - DNA, 25 bp, Mus musculus
tctaggtgctatcaaaggcagcagt

SEQ ID NO: 58333 - DNA, 25 bp, Mus musculus
tctaggtggctgtgctgtagactct

SEQ ID NO: 58334 - DNA, 25 bp, Mus musculus
tctaggttctccgtgaaaatggttg

SEQ ID NO: 58335 - DNA, 25 bp, Mus musculus
tctagtcattagtggaagaacgagt

SEQ ID NO: 58336 - DNA, 25 bp, Mus musculus
tctagtctatgagggaggctatgtg

SEQ ID NO: 58337 - DNA, 25 bp, Mus musculus
tctagtggaccagagagggctcctt

SEQ ID NO: 58338 - DNA, 25 bp, Mus musculus
tctagtgggcttgaagaagcaaaaa

SEQ ID NO: 58339 - DNA, 25 bp, Mus musculus
tctagtgggttagtgatgaataaca

SEQ ID NO: 58340 - DNA, 25 bp, Mus musculus
tctagtgtattcaaaggatcccaag

SEQ ID NO: 58341 - DNA, 25 bp, Mus musculus
tctagtgttgccttggaccttgtgg

SEQ ID NO: 58342 - DNA, 25 bp, Mus musculus
tctagttggcttttgggagtctgcc

SEQ ID NO: 58343 - DNA, 25 bp, Mus musculus
tctataaagcaccattcattgcaga

SEQ ID NO: 58344 - DNA, 25 bp, Mus musculus
tctataaaggcatatggtgctgggc

SEQ ID NO: 58345 - DNA, 25 bp, Mus musculus
tctataaaggcatccgccctgccat

SEQ ID NO: 58346 - DNA, 25 bp, Mus musculus
tctataaccagctggaggagttcaa

SEQ ID NO: 58347 - DNA, 25 bp, Mus musculus
tctataactaccaaggccccgagga

SEQ ID NO: 58348 - DNA, 25 bp, Mus musculus
tctataactacctaggccccgagga

SEQ ID NO: 58349 - DNA, 25 bp, Mus musculus
tctataagcagctaaagcacagacc

SEQ ID NO: 58350 - DNA, 25 bp, Mus musculus
tctataatcaacaagcggctctcaa

SEQ ID NO: 58351 - DNA, 25 bp, Mus musculus
tctataatgagacagaggctttgct

SEQ ID NO: 58352 - DNA, 25 bp, Mus musculus
tctatacactactaatcagcatcat

SEQ ID NO: 58353 - DNA, 25 bp, Mus musculus
tctatacctttggaagaatattggg

SEQ ID NO: 58354 - DNA, 25 bp, Mus musculus
tctatactggatgtgcctgaaacca

SEQ ID NO: 58355 - DNA, 25 bp, Mus musculus
tctatacttagcaaatgatgtcatc

SEQ ID NO: 58356 - DNA, 25 bp, Mus musculus
tctatagaccagaagcttgagaaaa

SEQ ID NO: 58357 - DNA, 25 bp, Mus musculus
tctatagatcacaagttcctgggaa

SEQ ID NO: 58358 - DNA, 25 bp, Mus musculus
tctatagcagagatttgtgaggagc

SEQ ID NO: 58359 - DNA, 25 bp, Mus musculus
tctatagccagcctgaaacatggtg

SEQ ID NO: 58360 - DNA, 25 bp, Mus musculus
tctatagctgactagaggtgtttct

SEQ ID NO: 58361 - DNA, 25 bp, Mus musculus
tctatagtgggaacagcctccagga

SEQ ID NO: 58362 - DNA, 25 bp, Mus musculus
tctatattacagttgtagctgccca

SEQ ID NO: 58363 - DNA, 25 bp, Mus musculus
tctatattggctgtgatctttgtac

SEQ ID NO: 58364 - DNA, 25 bp, Mus musculus
tctatcaaaaatcagaaatacaatg

SEQ ID NO: 58365 - DNA, 25 bp, Mus musculus
tctatcacagtttcctggagaagac

SEQ ID NO: 58366 - DNA, 25 bp, Mus musculus
tctatcagcggctggtggagttcat

SEQ ID NO: 58367 - DNA, 25 bp, Mus musculus
tctatcaggcctctgatccggcaca

SEQ ID NO: 58368 - DNA, 25 bp, Mus musculus
tctatcatccagagaaggacgatgg

SEQ ID NO: 58369 - DNA, 25 bp, Mus musculus
tctatcattgacgaattcttacaca

SEQ ID NO: 58370 - DNA, 25 bp, Mus musculus
tctatccagcggatgtgaccatcac

SEQ ID NO: 58371 - DNA, 25 bp, Mus musculus
tctatcccatttttcctctctgcgg

SEQ ID NO: 58372 - DNA, 25 bp, Mus musculus
tctatccctctgtaagtgctgtttg

SEQ ID NO: 58373 - DNA, 25 bp, Mus musculus
tctatcgggatatcctttcactctg

SEQ ID NO: 58374 - DNA, 25 bp, Mus musculus
tctatctaggctctgctttgccgac

SEQ ID NO: 58375 - DNA, 25 bp, Mus musculus
tctatgaacgaaaacatgaaaaacc

SEQ ID NO: 58376 - DNA, 25 bp, Mus musculus
tctatgaagccctcagctggcagca

SEQ ID NO: 58377 - DNA, 25 bp, Mus musculus
tctatgaagggctagacatcatcac

SEQ ID NO: 58378 - DNA, 25 bp, Mus musculus
tctatgacaactgcagtcgccttcg

SEQ ID NO: 58379 - DNA, 25 bp, Mus musculus
tctatgacatcgtccgaacagtcgg

SEQ ID NO: 58380 - DNA, 25 bp, Mus musculus
tctatgacatggtaccctgtgtgga

SEQ ID NO: 58381 - DNA, 25 bp, Mus musculus
tctatgaccagcatggtggagaggt

SEQ ID NO: 58382 - DNA, 25 bp, Mus musculus
tctatgaccgctatggccgggaagg

SEQ ID NO: 58383 - DNA, 25 bp, Mus musculus
tctatgacctctaaataggaccctc

SEQ ID NO: 58384 - DNA, 25 bp, Mus musculus
tctatgacctgaaggaccagattca

SEQ ID NO: 58385 - DNA, 25 bp, Mus musculus
tctatgacctggacgactcttggga

SEQ ID NO: 58386 - DNA, 25 bp, Mus musculus
tctatgaccttgagaacgccagcag

SEQ ID NO: 58387 - DNA, 25 bp, Mus musculus
tctatgagaagacaggtggatgcca

SEQ ID NO: 58388 - DNA, 25 bp, Mus musculus
tctatgaggagacaatcgtcaccaa

SEQ ID NO: 58389 - DNA, 25 bp, Mus musculus
tctatgatgcgtctcacatgggaca

SEQ ID NO: 58390 - DNA, 25 bp, Mus musculus
tctatgatggcgagtctgtctcagg

SEQ ID NO: 58391 - DNA, 25 bp, Mus musculus
tctatgattgtttcaggccaaattg

SEQ ID NO: 58392 - DNA, 25 bp, Mus musculus
tctatgcagcccagtccagccaggt

SEQ ID NO: 58393 - DNA, 25 bp, Mus musculus
tctatgccctccatcggaacagtgc

SEQ ID NO: 58394 - DNA, 25 bp, Mus musculus
tctatgccctgggaggctgacctct

SEQ ID NO: 58395 - DNA, 25 bp, Mus musculus
tctatgcgaaaaccaagagaagaac

SEQ ID NO: 58396 - DNA, 25 bp, Mus musculus
tctatgctgcccagctagccgcaat

SEQ ID NO: 58397 - DNA, 25 bp, Mus musculus
tctatggactgatagagcggacccg

SEQ ID NO: 58398 - DNA, 25 bp, Mus musculus
tctatggagtgtttacattacacaa

SEQ ID NO: 58399 - DNA, 25 bp, Mus musculus
tctatggcaacaagacttctgtgca

SEQ ID NO: 58400 - DNA, 25 bp, Mus musculus
tctatggctcacagatgtgcccagg

SEQ ID NO: 58401 - DNA, 25 bp, Mus musculus
tctatgggcgaggacccaggcatag

SEQ ID NO: 58402 - DNA, 25 bp, Mus musculus
tctatggtgacaacagagtccatga

SEQ ID NO: 58403 - DNA, 25 bp, Mus musculus
tctatggtgcaaaaattgtctctgc

SEQ ID NO: 58404 - DNA, 25 bp, Mus musculus
tctatgtcgtgatcggtgacttggg

SEQ ID NO: 58405 - DNA, 25 bp, Mus musculus
tctatgtctgcggatgagctcacag

SEQ ID NO: 58406 - DNA, 25 bp, Mus musculus
tctatgtgaaactggctgtaactgt

SEQ ID NO: 58407 - DNA, 25 bp, Mus musculus
tctatgtgcggaaatattcacaaat

SEQ ID NO: 58408 - DNA, 25 bp, Mus musculus
tctatgtggcgccaaatggagactg

SEQ ID NO: 58409 - DNA, 25 bp, Mus musculus
tctatgtggcgcgaaatggagactg

SEQ ID NO: 58410 - DNA, 25 bp, Mus musculus
tctatgtgggcttcatgctgtgggc

SEQ ID NO: 58411 - DNA, 25 bp, Mus musculus
tctatgtgtttggtggagacaacgg

SEQ ID NO: 58412 - DNA, 25 bp, Mus musculus
tctatgttactagttggctatggct

SEQ ID NO: 58413 - DNA, 25 bp, Mus musculus
tctattacagggtgtgtccccagga

SEQ ID NO: 58414 - DNA, 25 bp, Mus musculus
tctattacgtgcattgacttgggat

SEQ ID NO: 58415 - DNA, 25 bp, Mus musculus
tctattactcttccggtaccgtgtt

SEQ ID NO: 58416 - DNA, 25 bp, Mus musculus
tctattagaaggttcctgtatcagg

SEQ ID NO: 58417 - DNA, 25 bp, Mus musculus
tctattatgccgagttgcaatcaac

SEQ ID NO: 58418 - DNA, 25 bp, Mus musculus
tctattcccagtgtggccgtggctg

SEQ ID NO: 58419 - DNA, 25 bp, Mus musculus
tctattctcaggctatcacaggcag

SEQ ID NO: 58420 - DNA, 25 bp, Mus musculus
tctattctggatagcaggttttgtg

SEQ ID NO: 58421 - DNA, 25 bp, Mus musculus
tctattggactgactcagttgtggg

SEQ ID NO: 58422 - DNA, 25 bp, Mus musculus
tctattgtctcattgtttcctcagc

SEQ ID NO: 58423 - DNA, 25 bp, Mus musculus
tctattgtggatgcaggccttgttt

SEQ ID NO: 58424 - DNA, 25 bp, Mus musculus
tctatttcggcgaatcttgaacgtg

SEQ ID NO: 58425 - DNA, 25 bp, Mus musculus
tctatttggttagtgccaccatacc

SEQ ID NO: 58426 - DNA, 25 bp, Mus musculus
tctattttcacgtctccttgggctg

SEQ ID NO: 58427 - DNA, 25 bp, Mus musculus
tctatttttatatcgccacgtacct

SEQ ID NO: 58428 - DNA, 25 bp, Mus musculus
tctcaaaaacattcaggctggtggc

SEQ ID NO: 58429 - DNA, 25 bp, Mus musculus
tctcaaaaccaaagagcgcatggct

SEQ ID NO: 58430 - DNA, 25 bp, Mus musculus
tctcaaaacctctgttttgggctgg

SEQ ID NO: 58431 - DNA, 25 bp, Mus musculus
tctcaaaatccgtttcctatcgaaa

SEQ ID NO: 58432 - DNA, 25 bp, Mus musculus
tctcaaacagtgatgaggctgtaat

SEQ ID NO: 58433 - DNA, 25 bp, Mus musculus
tctcaaacggaagtgccgcctacag

SEQ ID NO: 58434 - DNA, 25 bp, Mus musculus
tctcaaagaaggacccagaggatat

SEQ ID NO: 58435 - DNA, 25 bp, Mus musculus
tctcaaagagaagagaacaatgacc

SEQ ID NO: 58436 - DNA, 25 bp, Mus musculus
tctcaaagcacgtgacagtggtcgg

SEQ ID NO: 58437 - DNA, 25 bp, Mus musculus
tctcaaagctggtaaagaagcgtgc

SEQ ID NO: 58438 - DNA, 25 bp, Mus musculus
tctcaaagtcacagctagtaaatgg

SEQ ID NO: 58439 - DNA, 25 bp, Mus musculus
tctcaacttggaggagtactacttt

SEQ ID NO: 58440 - DNA, 25 bp, Mus musculus
tctcaagaacttgtcagcctccggg

SEQ ID NO: 58441 - DNA, 25 bp, Mus musculus
tctcaagaaggatcctgctttaaat

SEQ ID NO: 58442 - DNA, 25 bp, Mus musculus
tctcaagacgatggatcacaaccga

SEQ ID NO: 58443 - DNA, 25 bp, Mus musculus
tctcaagactcaaaagagtactgtg

SEQ ID NO: 58444 - DNA, 25 bp, Mus musculus
tctcaagagatcctctgaagtttct

SEQ ID NO: 58445 - DNA, 25 bp, Mus musculus
tctcaagagatcgtctgaagtttct

SEQ ID NO: 58446 - DNA, 25 bp, Mus musculus
tctcaagccattccagatgcctggc

SEQ ID NO: 58447 - DNA, 25 bp, Mus musculus
tctcaagctgttccgtaatctcacc

SEQ ID NO: 58448 - DNA, 25 bp, Mus musculus
tctcaagctttgttcccctgaagag

SEQ ID NO: 58449 - DNA, 25 bp, Mus musculus
tctcaaggatgatttggccaacacc

SEQ ID NO: 58450 - DNA, 25 bp, Mus musculus
tctcaaggcaaagttaccataacgg

SEQ ID NO: 58451 - DNA, 25 bp, Mus musculus
tctcaagggccatgataggacacac

SEQ ID NO: 58452 - DNA, 25 bp, Mus musculus
tctcaagggtcaagtggaagttact

SEQ ID NO: 58453 - DNA, 25 bp, Mus musculus
tctcaagtaggactgatgacagagg

SEQ ID NO: 58454 - DNA, 25 bp, Mus musculus
tctcaagtcacaacaagtgtatcat

SEQ ID NO: 58455 - DNA, 25 bp, Mus musculus
tctcaagtcacatcaagtgtatcat

SEQ ID NO: 58456 - DNA, 25 bp, Mus musculus
tctcaagtgacttggcagagccagg

SEQ ID NO: 58457 - DNA, 25 bp, Mus musculus
tctcaatatggacgtggtcaagtac

SEQ ID NO: 58458 - DNA, 25 bp, Mus musculus
tctcaatccatagaagtcttggaca

SEQ ID NO: 58459 - DNA, 25 bp, Mus musculus
tctcacaagtcaagcgataaagcag

SEQ ID NO: 58460 - DNA, 25 bp, Mus musculus
tctcacagacaagttttcgccgctt

SEQ ID NO: 58461 - DNA, 25 bp, Mus musculus
tctcacatggctggtagctctctct

SEQ ID NO: 58462 - DNA, 25 bp, Mus musculus
tctcaccagccgcttggtttcattg

SEQ ID NO: 58463 - DNA, 25 bp, Mus musculus
tctcacccatccatgggaagtcctg

SEQ ID NO: 58464 - DNA, 25 bp, Mus musculus
tctcacccgtcaatgacagctatgg

SEQ ID NO: 58465 - DNA, 25 bp, Mus musculus
tctcacctatctccctgtcaaagta

SEQ ID NO: 58466 - DNA, 25 bp, Mus musculus
tctcacctattgctctgttcctctg

SEQ ID NO: 58467 - DNA, 25 bp, Mus musculus
tctcacctattggtctgttcctctg

SEQ ID NO: 58468 - DNA, 25 bp, Mus musculus
tctcacgcagtaagactggcaccag

SEQ ID NO: 58469 - DNA, 25 bp, Mus musculus
tctcacgcccggatgtccggattgg

SEQ ID NO: 58470 - DNA, 25 bp, Mus musculus
tctcacgcccggttgtccggattgg

SEQ ID NO: 58471 - DNA, 25 bp, Mus musculus
tctcacgcgagtccttcatcaagac

SEQ ID NO: 58472 - DNA, 25 bp, Mus musculus
tctcacggagcgctttgagctgttt

SEQ ID NO: 58473 - DNA, 25 bp, Mus musculus
tctcacgttcatcagtaaaaacgag

SEQ ID NO: 58474 - DNA, 25 bp, Mus musculus
tctcactatggcagctctagggatc

SEQ ID NO: 58475 - DNA, 25 bp, Mus musculus
tctcactctcaagaaattcagaggg

SEQ ID NO: 58476 - DNA, 25 bp, Mus musculus
tctcactgcatggagccagaggtgg

SEQ ID NO: 58477 - DNA, 25 bp, Mus musculus
tctcactgcctgagaggcctctctt

SEQ ID NO: 58478 - DNA, 25 bp, Mus musculus
tctcactgcctgtgaggcctctctt

SEQ ID NO: 58479 - DNA, 25 bp, Mus musculus
tctcacttcagtaagacgtatggtc

SEQ ID NO: 58480 - DNA, 25 bp, Mus musculus
tctcacttgccgctgatcgtagcta

SEQ ID NO: 58481 - DNA, 25 bp, Mus musculus
tctcagaaacttcaaagtgccaggg

SEQ ID NO: 58482 - DNA, 25 bp, Mus musculus
tctcagaagaagaggtgactgcccc

SEQ ID NO: 58483 - DNA, 25 bp, Mus musculus
tctcagaaggactggacccggagct

SEQ ID NO: 58484 - DNA, 25 bp, Mus musculus
tctcagacagccctgcttggccttt

SEQ ID NO: 58485 - DNA, 25 bp, Mus musculus
tctcagacagtcaagggaagcagcc

SEQ ID NO: 58486 - DNA, 25 bp, Mus musculus
tctcagagaacgagacaaggctgat

SEQ ID NO: 58487 - DNA, 25 bp, Mus musculus
tctcagagacccatgatagcagcag

SEQ ID NO: 58488 - DNA, 25 bp, Mus musculus
tctcagaggagcagttgtgcagcca

SEQ ID NO: 58489 - DNA, 25 bp, Mus musculus
tctcagagtgattccctggaaagga

SEQ ID NO: 58490 - DNA, 25 bp, Mus musculus
tctcagatgataacggaaggacgca

SEQ ID NO: 58491 - DNA, 25 bp, Mus musculus
tctcagatgtggctctccagcacct

SEQ ID NO: 58492 - DNA, 25 bp, Mus musculus
tctcagcaggttcctactcaggtga

SEQ ID NO: 58493 - DNA, 25 bp, Mus musculus
tctcagcatagagaacactctgtgg

SEQ ID NO: 58494 - DNA, 25 bp, Mus musculus
tctcagcatagagcatttggaggag

SEQ ID NO: 58495 - DNA, 25 bp, Mus musculus
tctcagccaagatcaagcccaaaca

SEQ ID NO: 58496 - DNA, 25 bp, Mus musculus
tctcagcccgcaaaatcgctcaagg

SEQ ID NO: 58497 - DNA, 25 bp, Mus musculus
tctcagcctgccttggactgactgt

SEQ ID NO: 58498 - DNA, 25 bp, Mus musculus
tctcagcctgtatctatattttcga

SEQ ID NO: 58499 - DNA, 25 bp, Mus musculus
tctcagccttggaggatgacctggc

SEQ ID NO: 58500 - DNA, 25 bp, Mus musculus
tctcagcctttttgatgacgcattt

SEQ ID NO: 58501 - DNA, 25 bp, Mus musculus
tctcagcgccctggaagtggtggtc

SEQ ID NO: 58502 - DNA, 25 bp, Mus musculus
tctcagcgtgactgtggaagaattc

SEQ ID NO: 58503 - DNA, 25 bp, Mus musculus
tctcagctcaaatggaatactgccg

SEQ ID NO: 58504 - DNA, 25 bp, Mus musculus
tctcagctctcggacaaaaagaggc

SEQ ID NO: 58505 - DNA, 25 bp, Mus musculus
tctcagctgatgaggcgctaggaag

SEQ ID NO: 58506 - DNA, 25 bp, Mus musculus
tctcagctgcagaatgaggaagagc

SEQ ID NO: 58507 - DNA, 25 bp, Mus musculus
tctcagctgctacccatggcttaga

SEQ ID NO: 58508 - DNA, 25 bp, Mus musculus
tctcaggaaagacttcagctttgga

SEQ ID NO: 58509 - DNA, 25 bp, Mus musculus
tctcaggatggatcagcactggccg

SEQ ID NO: 58510 - DNA, 25 bp, Mus musculus
tctcaggcaagccaagatggagtgc

SEQ ID NO: 58511 - DNA, 25 bp, Mus musculus
tctcaggcggaagctcgatgtctct

SEQ ID NO: 58512 - DNA, 25 bp, Mus musculus
tctcaggcggatcacagtcgctctg

SEQ ID NO: 58513 - DNA, 25 bp, Mus musculus
tctcagggcagttccccacgcatgg

SEQ ID NO: 58514 - DNA, 25 bp, Mus musculus
tctcagggtgaagatgaactcacac

SEQ ID NO: 58515 - DNA, 25 bp, Mus musculus
tctcagtacagaggttaaaggatga

SEQ ID NO: 58516 - DNA, 25 bp, Mus musculus
tctcagtaccctcttcttatgtgga

SEQ ID NO: 58517 - DNA, 25 bp, Mus musculus
tctcagtcaccaaacagttttggag

SEQ ID NO: 58518 - DNA, 25 bp, Mus musculus
tctcagtgaccagggacaataagac

SEQ ID NO: 58519 - DNA, 25 bp, Mus musculus
tctcagtgctcagccgggagcagtc

SEQ ID NO: 58520 - DNA, 25 bp, Mus musculus
tctcagtggagatcttcatagtgca

SEQ ID NO: 58521 - DNA, 25 bp, Mus musculus
tctcagtgtgtcagattactagagt

SEQ ID NO: 58522 - DNA, 25 bp, Mus musculus
tctcagttccaaaggactaaaatcg

SEQ ID NO: 58523 - DNA, 25 bp, Mus musculus
tctcagttcctgttcggaaaccact

SEQ ID NO: 58524 - DNA, 25 bp, Mus musculus
tctcatacagtgaccagctagccat

SEQ ID NO: 58525 - DNA, 25 bp, Mus musculus
tctcatatggcccagcgaatggcaa

SEQ ID NO: 58526 - DNA, 25 bp, Mus musculus
tctcatcaaaggtgggaagattgtg

SEQ ID NO: 58527 - DNA, 25 bp, Mus musculus
tctcatcaagttatcatcaacctgg

SEQ ID NO: 58528 - DNA, 25 bp, Mus musculus
tctcatcagccgaaagtccagaaat

SEQ ID NO: 58529 - DNA, 25 bp, Mus musculus
tctcatcagttaagtacaagagcga

SEQ ID NO: 58530 - DNA, 25 bp, Mus musculus
tctcatccacgccttgggcggcatg

SEQ ID NO: 58531 - DNA, 25 bp, Mus musculus
tctcatccctggcttcctgtatggg

SEQ ID NO: 58532 - DNA, 25 bp, Mus musculus
tctcatcccttatggagaccaaagg

SEQ ID NO: 58533 - DNA, 25 bp, Mus musculus
tctcatccggacactacggcaggaa

SEQ ID NO: 58534 - DNA, 25 bp, Mus musculus
tctcatccgtgaactaaatgccttt

SEQ ID NO: 58535 - DNA, 25 bp, Mus musculus
tctcatcgaaatgtggaatccctta

SEQ ID NO: 58536 - DNA, 25 bp, Mus musculus
tctcatgaaatacccagaaattgaa

SEQ ID NO: 58537 - DNA, 25 bp, Mus musculus
tctcatgaccctgaatgaagagaga

SEQ ID NO: 58538 - DNA, 25 bp, Mus musculus
tctcatgagggagcagagcgagtcc

SEQ ID NO: 58539 - DNA, 25 bp, Mus musculus
tctcatgggataactgagtcgcgcc

SEQ ID NO: 58540 - DNA, 25 bp, Mus musculus
tctcatggtgtctgccactgcaatg

SEQ ID NO: 58541 - DNA, 25 bp, Mus musculus
tctcatggtttatgatccatctctg

SEQ ID NO: 58542 - DNA, 25 bp, Mus musculus
tctcatgtggcaactctacccagag

SEQ ID NO: 58543 - DNA, 25 bp, Mus musculus
tctcattaacaggatgccaagccat

SEQ ID NO: 58544 - DNA, 25 bp, Mus musculus
tctcattatgcaggctaggctgacc

SEQ ID NO: 58545 - DNA, 25 bp, Mus musculus
tctcattggccctgatgaattatta

SEQ ID NO: 58546 - DNA, 25 bp, Mus musculus
tctcattgtcttcatttctggaaaa

SEQ ID NO: 58547 - DNA, 25 bp, Mus musculus
tctcatttcagacgaactgagaaaa

SEQ ID NO: 58548 - DNA, 25 bp, Mus musculus
tctccaaagccctggtggatgctgg

SEQ ID NO: 58549 - DNA, 25 bp, Mus musculus
tctccaaaggaaatctactatcgtt

SEQ ID NO: 58550 - DNA, 25 bp, Mus musculus
tctccaacatctcggcgctgacaga

SEQ ID NO: 58551 - DNA, 25 bp, Mus musculus
tctccaacgacagtggcatctacgt

SEQ ID NO: 58552 - DNA, 25 bp, Mus musculus
tctccaactgcatctgatgctgtga

SEQ ID NO: 58553 - DNA, 25 bp, Mus musculus
tctccaagacagtaaagatgcactg

SEQ ID NO: 58554 - DNA, 25 bp, Mus musculus
tctccaagatgagccgcatcttcag

SEQ ID NO: 58555 - DNA, 25 bp, Mus musculus
tctccaagtccaataggcatgcctc

SEQ ID NO: 58556 - DNA, 25 bp, Mus musculus
tctccaagttgcgtcgaacagccaa

SEQ ID NO: 58557 - DNA, 25 bp, Mus musculus
tctccaatgctgctgtcaacccttt

SEQ ID NO: 58558 - DNA, 25 bp, Mus musculus
tctccaatggcatcaaaaagcacag

SEQ ID NO: 58559 - DNA, 25 bp, Mus musculus
tctccaatgtgacctactatactcg

SEQ ID NO: 58560 - DNA, 25 bp, Mus musculus
tctccaatgtgagctactatactcg

SEQ ID NO: 58561 - DNA, 25 bp, Mus musculus
tctccaatgtgatgctggagttgaa

SEQ ID NO: 58562 - DNA, 25 bp, Mus musculus
tctccaatttttcagaacttcagtg

SEQ ID NO: 58563 - DNA, 25 bp, Mus musculus
tctccacagactttggcagctggca

SEQ ID NO: 58564 - DNA, 25 bp, Mus musculus
tctccaccaaggaagtccccattgt

SEQ ID NO: 58565 - DNA, 25 bp, Mus musculus
tctccaccaagtcaggaaatgatgc

SEQ ID NO: 58566 - DNA, 25 bp, Mus musculus
tctccaccgcgaagacgaaagttgt

SEQ ID NO: 58567 - DNA, 25 bp, Mus musculus
tctccaccggcacaatgtcttcaag

SEQ ID NO: 58568 - DNA, 25 bp, Mus musculus
tctccactgagccttgagcgcatca

SEQ ID NO: 58569 - DNA, 25 bp, Mus musculus
tctccagaaattgccttgaaccgaa

SEQ ID NO: 58570 - DNA, 25 bp, Mus musculus
tctccagaagagaaggctatgacag

SEQ ID NO: 58571 - DNA, 25 bp, Mus musculus
tctccagagccagttcctgagctgt

SEQ ID NO: 58572 - DNA, 25 bp, Mus musculus
tctccagaggaaaaagttccctccg

SEQ ID NO: 58573 - DNA, 25 bp, Mus musculus
tctccagaggaggacagattgctct

SEQ ID NO: 58574 - DNA, 25 bp, Mus musculus
tctccagattctcttaacacaagac

SEQ ID NO: 58575 - DNA, 25 bp, Mus musculus
tctccagccactagaaggacgtggt

SEQ ID NO: 58576 - DNA, 25 bp, Mus musculus
tctccagccagctaccgaatttgtg

SEQ ID NO: 58577 - DNA, 25 bp, Mus musculus
tctccagcgatgagtcattcgccat

SEQ ID NO: 58578 - DNA, 25 bp, Mus musculus
tctccagctacaagatgtcactttc

SEQ ID NO: 58579 - DNA, 25 bp, Mus musculus
tctccagctgccagtcttggcatct

SEQ ID NO: 58580 - DNA, 25 bp, Mus musculus
tctccaggaaaactaaccaaaatag

SEQ ID NO: 58581 - DNA, 25 bp, Mus musculus
tctccaggaagaacctccggtaaag

SEQ ID NO: 58582 - DNA, 25 bp, Mus musculus
tctccaggatatcttggctaatggc

SEQ ID NO: 58583 - DNA, 25 bp, Mus musculus
tctccaggatgcctggtccatgggc

SEQ ID NO: 58584 - DNA, 25 bp, Mus musculus
tctccaggctatgtgctcttttacc

SEQ ID NO: 58585 - DNA, 25 bp, Mus musculus
tctccagggctacaaatctgcctct

SEQ ID NO: 58586 - DNA, 25 bp, Mus musculus
tctccagtcaggcagtccctctgaa

SEQ ID NO: 58587 - DNA, 25 bp, Mus musculus
tctccagtctaacgctgaatagaag

SEQ ID NO: 58588 - DNA, 25 bp, Mus musculus
tctccagtgcaagtaggatgtttag

SEQ ID NO: 58589 - DNA, 25 bp, Mus musculus
tctccagtgggcacctgaagtgggt

SEQ ID NO: 58590 - DNA, 25 bp, Mus musculus
tctccagtggttcctgcttttaatc

SEQ ID NO: 58591 - DNA, 25 bp, Mus musculus
tctccagttttttccggccagctgg

SEQ ID NO: 58592 - DNA, 25 bp, Mus musculus
tctccatatcgcctgcaaaaagaac

SEQ ID NO: 58593 - DNA, 25 bp, Mus musculus
tctccatcaatgcagggagcttgat

SEQ ID NO: 58594 - DNA, 25 bp, Mus musculus
tctccatcagtgaagagcctccgtt

SEQ ID NO: 58595 - DNA, 25 bp, Mus musculus
tctccatccatgagcttgcagtgat

SEQ ID NO: 58596 - DNA, 25 bp, Mus musculus
tctccatgatcagatatcttctagg

SEQ ID NO: 58597 - DNA, 25 bp, Mus musculus
tctccatggccgtggccgtgtgtcg

SEQ ID NO: 58598 - DNA, 25 bp, Mus musculus
tctccatggctggaaaccatcttgc

SEQ ID NO: 58599 - DNA, 25 bp, Mus musculus
tctccatgggagctcgagcatccac

SEQ ID NO: 58600 - DNA, 25 bp, Mus musculus
tctccatgtatagaacgatgcttag

SEQ ID NO: 58601 - DNA, 25 bp, Mus musculus
tctccattgagatgaacgggactct

SEQ ID NO: 58602 - DNA, 25 bp, Mus musculus
tctccatttatgcagaagcttggct

SEQ ID NO: 58603 - DNA, 25 bp, Mus musculus
tctccatttcaactcaaacttgctg

SEQ ID NO: 58604 - DNA, 25 bp, Mus musculus
tctcccaatttcagagaccgaagcc

SEQ ID NO: 58605 - DNA, 25 bp, Mus musculus
tctcccactctttcttcaaatacgg

SEQ ID NO: 58606 - DNA, 25 bp, Mus musculus
tctcccagacccctatgtgtcagtg

SEQ ID NO: 58607 - DNA, 25 bp, Mus musculus
tctcccagctggacgaatttctcgc

SEQ ID NO: 58608 - DNA, 25 bp, Mus musculus
tctcccagctggtcgaatttctcgc

SEQ ID NO: 58609 - DNA, 25 bp, Mus musculus
tctcccaggacaacaccaaacattg

SEQ ID NO: 58610 - DNA, 25 bp, Mus musculus
tctcccaggagggattagacccagg

SEQ ID NO: 58611 - DNA, 25 bp, Mus musculus
tctcccaggctctagctacagaggc

SEQ ID NO: 58612 - DNA, 25 bp, Mus musculus
tctcccaggttcagctcttagccag

SEQ ID NO: 58613 - DNA, 25 bp, Mus musculus
tctccccaaaagaaccgacaatcag

SEQ ID NO: 58614 - DNA, 25 bp, Mus musculus
tctccccaagatatgtcaccagaag

SEQ ID NO: 58615 - DNA, 25 bp, Mus musculus
tctccccagggaggaagcacaaggc

SEQ ID NO: 58616 - DNA, 25 bp, Mus musculus
tctcccgaggagctgtatacttctc

SEQ ID NO: 58617 - DNA, 25 bp, Mus musculus
tctcccgctggtggttacaagtaac

SEQ ID NO: 58618 - DNA, 25 bp, Mus musculus
tctcccggaaccgtgtgctaggctg

SEQ ID NO: 58619 - DNA, 25 bp, Mus musculus
tctcccggctgtttgcctatatgag

SEQ ID NO: 58620 - DNA, 25 bp, Mus musculus
tctcccgggacaaggaggagacctt

SEQ ID NO: 58621 - DNA, 25 bp, Mus musculus
tctccctcatggctggcttgctggt

SEQ ID NO: 58622 - DNA, 25 bp, Mus musculus
tctccctgctggaagtcctctcagg

SEQ ID NO: 58623 - DNA, 25 bp, Mus musculus
tctccctgtcaaagtaatcccatca

SEQ ID NO: 58624 - DNA, 25 bp, Mus musculus
tctcccttcccaaaggacatgaagc

SEQ ID NO: 58625 - DNA, 25 bp, Mus musculus
tctccctttagtggctcgtgggttt

SEQ ID NO: 58626 - DNA, 25 bp, Mus musculus
tctccctttcagcttccaggatgag

SEQ ID NO: 58627 - DNA, 25 bp, Mus musculus
tctccgaagcatgaaagcaagtcag

SEQ ID NO: 58628 - DNA, 25 bp, Mus musculus
tctccgaattcattaagtgcatctt

SEQ ID NO: 58629 - DNA, 25 bp, Mus musculus
tctccgaggagctggcgggcatttt

SEQ ID NO: 58630 - DNA, 25 bp, Mus musculus
tctccgaggtgacttttcgacagtg

SEQ ID NO: 58631 - DNA, 25 bp, Mus musculus
tctccgatgtacagagatatcttgt

SEQ ID NO: 58632 - DNA, 25 bp, Mus musculus
tctccgcagcatgcaagtagccatt

SEQ ID NO: 58633 - DNA, 25 bp, Mus musculus
tctccgccatcattgttcaagactg

SEQ ID NO: 58634 - DNA, 25 bp, Mus musculus
tctccgcgtcttccaaggatcagtg

SEQ ID NO: 58635 - DNA, 25 bp, Mus musculus
tctccggcttggagcagcatacaag

SEQ ID NO: 58636 - DNA, 25 bp, Mus musculus
tctccggtgcaggaaagatgttcac

SEQ ID NO: 58637 - DNA, 25 bp, Mus musculus
tctccgtatgcaggagccgggttcc

SEQ ID NO: 58638 - DNA, 25 bp, Mus musculus
tctccgttacagtcagtttcagagg

SEQ ID NO: 58639 - DNA, 25 bp, Mus musculus
tctccgttctccattgcttcatgaa

SEQ ID NO: 58640 - DNA, 25 bp, Mus musculus
tctccgtttctctacacagaacaag

SEQ ID NO: 58641 - DNA, 25 bp, Mus musculus
tctcctaattttgggtacaggtcag

SEQ ID NO: 58642 - DNA, 25 bp, Mus musculus
tctcctactactgggcctgattggg

SEQ ID NO: 58643 - DNA, 25 bp, Mus musculus
tctcctagaaatcgccaaaagttag

SEQ ID NO: 58644 - DNA, 25 bp, Mus musculus
tctcctagaagaaacccctcaggat

SEQ ID NO: 58645 - DNA, 25 bp, Mus musculus
tctcctagacaaggccatgaactgg

SEQ ID NO: 58646 - DNA, 25 bp, Mus musculus
tctcctagtttttgagacagattct

SEQ ID NO: 58647 - DNA, 25 bp, Mus musculus
tctcctatactgtgggctatgaaga

SEQ ID NO: 58648 - DNA, 25 bp, Mus musculus
tctcctcacatggtgcaggtgcggg

SEQ ID NO: 58649 - DNA, 25 bp, Mus musculus
tctcctcaggtgatacccattgaag

SEQ ID NO: 58650 - DNA, 25 bp, Mus musculus
tctcctcatctatacagtgtcactg

SEQ ID NO: 58651 - DNA, 25 bp, Mus musculus
tctcctccacaactgatgattagta

SEQ ID NO: 58652 - DNA, 25 bp, Mus musculus
tctcctcccgcatctacgtggtgga

SEQ ID NO: 58653 - DNA, 25 bp, Mus musculus
tctcctccctaggacgttaggattg

SEQ ID NO: 58654 - DNA, 25 bp, Mus musculus
tctcctccctcatctgagaaggcag

SEQ ID NO: 58655 - DNA, 25 bp, Mus musculus
tctcctcctgtgctagaacgtgtca

SEQ ID NO: 58656 - DNA, 25 bp, Mus musculus
tctcctcctgtggtagaacgtgtca

SEQ ID NO: 58657 - DNA, 25 bp, Mus musculus
tctcctcctttaagtccagcatgtc

SEQ ID NO: 58658 - DNA, 25 bp, Mus musculus
tctcctcgagatctccggtccttga

SEQ ID NO: 58659 - DNA, 25 bp, Mus musculus
tctcctctctggactctagcattga

SEQ ID NO: 58660 - DNA, 25 bp, Mus musculus
tctcctgaaaacttccaagtctgag

SEQ ID NO: 58661 - DNA, 25 bp, Mus musculus
tctcctgaatgggaatcactgcatc

SEQ ID NO: 58662 - DNA, 25 bp, Mus musculus
tctcctgactacctcaaggtcattg

SEQ ID NO: 58663 - DNA, 25 bp, Mus musculus
tctcctgagaatatgacaggacggc

SEQ ID NO: 58664 - DNA, 25 bp, Mus musculus
tctcctgagacacgacgaagtgcga

SEQ ID NO: 58665 - DNA, 25 bp, Mus musculus
tctcctgagtaaatccacattcttg

SEQ ID NO: 58666 - DNA, 25 bp, Mus musculus
tctcctgcatggttgagggacttca

SEQ ID NO: 58667 - DNA, 25 bp, Mus musculus
tctcctgctgtagccggctcagata

SEQ ID NO: 58668 - DNA, 25 bp, Mus musculus
tctcctggaaggaacagccagcggg

SEQ ID NO: 58669 - DNA, 25 bp, Mus musculus
tctcctggaagggtataacaagact

SEQ ID NO: 58670 - DNA, 25 bp, Mus musculus
tctcctggagcgacagaacctgtct

SEQ ID NO: 58671 - DNA, 25 bp, Mus musculus
tctcctggattctgggttgtctgtt

SEQ ID NO: 58672 - DNA, 25 bp, Mus musculus
tctcctgggtggactaccagggaca

SEQ ID NO: 58673 - DNA, 25 bp, Mus musculus
tctcctgtgccctctttgggccaga

SEQ ID NO: 58674 - DNA, 25 bp, Mus musculus
tctccttaaagaatcaacctctgca

SEQ ID NO: 58675 - DNA, 25 bp, Mus musculus
tctccttacagacagtttcatcatc

SEQ ID NO: 58676 - DNA, 25 bp, Mus musculus
tctccttatgtctggaggagactgt

SEQ ID NO: 58677 - DNA, 25 bp, Mus musculus
tctccttattggaacatgggaagga

SEQ ID NO: 58678 - DNA, 25 bp, Mus musculus
tctccttcctcaccgagtctggaaa

SEQ ID NO: 58679 - DNA, 25 bp, Mus musculus
tctccttcttacgattatgacgact

SEQ ID NO: 58680 - DNA, 25 bp, Mus musculus
tctccttgagatcttctccaggatg

SEQ ID NO: 58681 - DNA, 25 bp, Mus musculus
tctccttggcataggatagtaacta

SEQ ID NO: 58682 - DNA, 25 bp, Mus musculus
tctccttgtcctacaaagatttcac

SEQ ID NO: 58683 - DNA, 25 bp, Mus musculus
tctcctttcccacgagaagagtgca

SEQ ID NO: 58684 - DNA, 25 bp, Mus musculus
tctcctttggctacctacagacaac

SEQ ID NO: 58685 - DNA, 25 bp, Mus musculus
tctcgaaatctatgaacgaaaacat

SEQ ID NO: 58686 - DNA, 25 bp, Mus musculus
tctcgaagatatgactccaggacca

SEQ ID NO: 58687 - DNA, 25 bp, Mus musculus
tctcgaagcttctttgggttaaagg

SEQ ID NO: 58688 - DNA, 25 bp, Mus musculus
tctcgacctatggagcagccgtagc

SEQ ID NO: 58689 - DNA, 25 bp, Mus musculus
tctcgactgcaatgctaacgtgtac

SEQ ID NO: 58690 - DNA, 25 bp, Mus musculus
tctcgactggagaaggtagatctag

SEQ ID NO: 58691 - DNA, 25 bp, Mus musculus
tctcgagagcccctgaagcggcgat

SEQ ID NO: 58692 - DNA, 25 bp, Mus musculus
tctcgagcaactaaagcagcacgtg

SEQ ID NO: 58693 - DNA, 25 bp, Mus musculus
tctcgagcacagacagttgacactg

SEQ ID NO: 58694 - DNA, 25 bp, Mus musculus
tctcgagcccttccaatgcagtcat

SEQ ID NO: 58695 - DNA, 25 bp, Mus musculus
tctcgagcgcactctcgtggaggct

SEQ ID NO: 58696 - DNA, 25 bp, Mus musculus
tctcgagctggagaggacacaggct

SEQ ID NO: 58697 - DNA, 25 bp, Mus musculus
tctcgaggccgcgaggaatagctgt

SEQ ID NO: 58698 - DNA, 25 bp, Mus musculus
tctcgatagaccagactgggactac

SEQ ID NO: 58699 - DNA, 25 bp, Mus musculus
tctcgatagcctacccgatgtgaag

SEQ ID NO: 58700 - DNA, 25 bp, Mus musculus
tctcgatttgactgcaactccatct

SEQ ID NO: 58701 - DNA, 25 bp, Mus musculus
tctcgcaaaaggtctccagtcggct

SEQ ID NO: 58702 - DNA, 25 bp, Mus musculus
tctcgccacctgcagagtgtatgtg

SEQ ID NO: 58703 - DNA, 25 bp, Mus musculus
tctcgccagagacactcaggtctga

SEQ ID NO: 58704 - DNA, 25 bp, Mus musculus
tctcgcccatatgtttgagaccgtt

SEQ ID NO: 58705 - DNA, 25 bp, Mus musculus
tctcgctcgtcgtggcagctctcgt

SEQ ID NO: 58706 - DNA, 25 bp, Mus musculus
tctcgctctgcgcagactggaggac

SEQ ID NO: 58707 - DNA, 25 bp, Mus musculus
tctcgctctgcggagactggaggac

SEQ ID NO: 58708 - DNA, 25 bp, Mus musculus
tctcgctcttcgtggctcagaagat

SEQ ID NO: 58709 - DNA, 25 bp, Mus musculus
tctcgctgttgtcactgtcacacct

SEQ ID NO: 58710 - DNA, 25 bp, Mus musculus
tctcggaagctattattgtacgtgc

SEQ ID NO: 58711 - DNA, 25 bp, Mus musculus
tctcggacacacaggcatctcctgg

SEQ ID NO: 58712 - DNA, 25 bp, Mus musculus
tctcggacctgtattcagagtgaac

SEQ ID NO: 58713 - DNA, 25 bp, Mus musculus
tctcggacctgttttcagagtgaac

SEQ ID NO: 58714 - DNA, 25 bp, Mus musculus
tctcggacgtgctgggctatgtaaa

SEQ ID NO: 58715 - DNA, 25 bp, Mus musculus
tctcggactccccagaacaaaaagg

SEQ ID NO: 58716 - DNA, 25 bp, Mus musculus
tctcggagcactcggcaccatgggt

SEQ ID NO: 58717 - DNA, 25 bp, Mus musculus
tctcggagtgaaaccgacctggact

SEQ ID NO: 58718 - DNA, 25 bp, Mus musculus
tctcggagtgcctcacatcaagacg

SEQ ID NO: 58719 - DNA, 25 bp, Mus musculus
tctcggatagtacctccaatctctg

SEQ ID NO: 58720 - DNA, 25 bp, Mus musculus
tctcggcagacaatgaagctgattt

SEQ ID NO: 58721 - DNA, 25 bp, Mus musculus
tctcggcagcatgccaccaatgttg

SEQ ID NO: 58722 - DNA, 25 bp, Mus musculus
tctcggcatagtactggacccagga

SEQ ID NO: 58723 - DNA, 25 bp, Mus musculus
tctcggcatagttctggacccagga

SEQ ID NO: 58724 - DNA, 25 bp, Mus musculus
tctcggcccattcctatttgctgtt

SEQ ID NO: 58725 - DNA, 25 bp, Mus musculus
tctcggcccattgctatttgctgtt

SEQ ID NO: 58726 - DNA, 25 bp, Mus musculus
tctcggctgctgatggtaccaatgt

SEQ ID NO: 58727 - DNA, 25 bp, Mus musculus
tctcgggagcgaaccaccagcaggg

SEQ ID NO: 58728 - DNA, 25 bp, Mus musculus
tctcgggctcctgggacggaacgct

SEQ ID NO: 58729 - DNA, 25 bp, Mus musculus
tctcgggtccggcagagcccacttg

SEQ ID NO: 58730 - DNA, 25 bp, Mus musculus
tctcggtcacgatccaaatctcggt

SEQ ID NO: 58731 - DNA, 25 bp, Mus musculus
tctcggtccacagagcatgggctac

SEQ ID NO: 58732 - DNA, 25 bp, Mus musculus
tctcggtctcggacccgatctcgat

SEQ ID NO: 58733 - DNA, 25 bp, Mus musculus
tctcggtgcctcatgcagcaaggta

SEQ ID NO: 58734 - DNA, 25 bp, Mus musculus
tctcggtgggcgttttgaccaaatc

SEQ ID NO: 58735 - DNA, 25 bp, Mus musculus
tctcggtgtgattatcatcggctta

SEQ ID NO: 58736 - DNA, 25 bp, Mus musculus
tctcggttcttacctcagcgtgtga

SEQ ID NO: 58737 - DNA, 25 bp, Mus musculus
tctcggttgtttaccactcggcaca

SEQ ID NO: 58738 - DNA, 25 bp, Mus musculus
tctcgtaaacggaaagaagaattag

SEQ ID NO: 58739 - DNA, 25 bp, Mus musculus
tctcgtagactgctataaaccaaca

SEQ ID NO: 58740 - DNA, 25 bp, Mus musculus
tctcgtctgagcgtggaccacgaat

SEQ ID NO: 58741 - DNA, 25 bp, Mus musculus
tctcgtgaacgcaaggtgcctgcct

SEQ ID NO: 58742 - DNA, 25 bp, Mus musculus
tctcgtgctggaacgcccttctttc

SEQ ID NO: 58743 - DNA, 25 bp, Mus musculus
tctcgtggcgctctccttcagtggg

SEQ ID NO: 58744 - DNA, 25 bp, Mus musculus
tctcgtgggtgcacaaagaaatgca

SEQ ID NO: 58745 - DNA, 25 bp, Mus musculus
tctcgtggtgccagaggcttgatga

SEQ ID NO: 58746 - DNA, 25 bp, Mus musculus
tctcgtgtcctgtctgatgttaggg

SEQ ID NO: 58747 - DNA, 25 bp, Mus musculus
tctcgttcctatagtcccgctaagc

SEQ ID NO: 58748 - DNA, 25 bp, Mus musculus
tctcgttcgatccagttttctggtg

SEQ ID NO: 58749 - DNA, 25 bp, Mus musculus
tctctaaagatgtctcgccagctgg

SEQ ID NO: 58750 - DNA, 25 bp, Mus musculus
tctctaaagcatctattccaaaaac

SEQ ID NO: 58751 - DNA, 25 bp, Mus musculus
tctctaaagcatgtattccaaaaac

SEQ ID NO: 58752 - DNA, 25 bp, Mus musculus
tctctaaatgccatgtggtatgcag

SEQ ID NO: 58753 - DNA, 25 bp, Mus musculus
tctctaacaccgaggtgaccatcgg

SEQ ID NO: 58754 - DNA, 25 bp, Mus musculus
tctctaacagccaaaggaaaaggcc

SEQ ID NO: 58755 - DNA, 25 bp, Mus musculus
tctctaagatggagaagatctgagc

SEQ ID NO: 58756 - DNA, 25 bp, Mus musculus
tctctaagcgaagcagactggcaga

SEQ ID NO: 58757 - DNA, 25 bp, Mus musculus
tctctacaaactgccactgagattt

SEQ ID NO: 58758 - DNA, 25 bp, Mus musculus
tctctacacatctgacagtccagag

SEQ ID NO: 58759 - DNA, 25 bp, Mus musculus
tctctacctctgaggctacagagag

SEQ ID NO: 58760 - DNA, 25 bp, Mus musculus
tctctactacaggatcaagtagaca

SEQ ID NO: 58761 - DNA, 25 bp, Mus musculus
tctctagaagatgcgcaggacaaca

SEQ ID NO: 58762 - DNA, 25 bp, Mus musculus
tctctagacgcctttgtagcaggtg

SEQ ID NO: 58763 - DNA, 25 bp, Mus musculus
tctctagagagacaacaagcagcca

SEQ ID NO: 58764 - DNA, 25 bp, Mus musculus
tctctagcttgtattctgaatctgt

SEQ ID NO: 58765 - DNA, 25 bp, Mus musculus
tctctaggaagataaggttttcaac

SEQ ID NO: 58766 - DNA, 25 bp, Mus musculus
tctctatcacatggtgtttgaactg

SEQ ID NO: 58767 - DNA, 25 bp, Mus musculus
tctctatcaccctgcgcaatgtgac

SEQ ID NO: 58768 - DNA, 25 bp, Mus musculus
tctctatggctcacagatgtgccca

SEQ ID NO: 58769 - DNA, 25 bp, Mus musculus
tctctattcagcacaacggacattg

SEQ ID NO: 58770 - DNA, 25 bp, Mus musculus
tctctattcttactccttccacgga

SEQ ID NO: 58771 - DNA, 25 bp, Mus musculus
tctctcaaaagagatgcaacagcca

SEQ ID NO: 58772 - DNA, 25 bp, Mus musculus
tctctcaactggaaggacattttga

SEQ ID NO: 58773 - DNA, 25 bp, Mus musculus
tctctcaagcagcaaagtttgatcc

SEQ ID NO: 58774 - DNA, 25 bp, Mus musculus
tctctcacacggcagccatgacagg

SEQ ID NO: 58775 - DNA, 25 bp, Mus musculus
tctctcacagagtataaagcagctg

SEQ ID NO: 58776 - DNA, 25 bp, Mus musculus
tctctcaccagcctgaataccaagg

SEQ ID NO: 58777 - DNA, 25 bp, Mus musculus
tctctcagagtgattccctggaaag

SEQ ID NO: 58778 - DNA, 25 bp, Mus musculus
tctctcatggaacttccttggaact

SEQ ID NO: 58779 - DNA, 25 bp, Mus musculus
tctctccacggtgctaagttgacat

SEQ ID NO: 58780 - DNA, 25 bp, Mus musculus
tctctccagctacaagatgtcactt

SEQ ID NO: 58781 - DNA, 25 bp, Mus musculus
tctctccatggaccgtgcccagtga

SEQ ID NO: 58782 - DNA, 25 bp, Mus musculus
tctctcccaagcaccgtttgcaatg

SEQ ID NO: 58783 - DNA, 25 bp, Mus musculus
tctctcccaagctccgtttgcaatg

SEQ ID NO: 58784 - DNA, 25 bp, Mus musculus
tctctccctacctgtagtggccatt

SEQ ID NO: 58785 - DNA, 25 bp, Mus musculus
tctctccctctcatttaagaaagcc

SEQ ID NO: 58786 - DNA, 25 bp, Mus musculus
tctctccctttagtggctcgtgggt

SEQ ID NO: 58787 - DNA, 25 bp, Mus musculus
tctctccgtggagcttgaagctggg

SEQ ID NO: 58788 - DNA, 25 bp, Mus musculus
tctctcctggaaagtctgtgctgat

SEQ ID NO: 58789 - DNA, 25 bp, Mus musculus
tctctcctttcccacgagaagagtg

SEQ ID NO: 58790 - DNA, 25 bp, Mus musculus
tctctcgatgttatgacaaaccctg

SEQ ID NO: 58791 - DNA, 25 bp, Mus musculus
tctctcggattatgaacagccctga

SEQ ID NO: 58792 - DNA, 25 bp, Mus musculus
tctctcggattgacccagatggaac

SEQ ID NO: 58793 - DNA, 25 bp, Mus musculus
tctctcggcccggtgacaagagtgc

SEQ ID NO: 58794 - DNA, 25 bp, Mus musculus
tctctcgggagcctgtggcctacat

SEQ ID NO: 58795 - DNA, 25 bp, Mus musculus
tctctcggtagggattcacagggtc

SEQ ID NO: 58796 - DNA, 25 bp, Mus musculus
tctctctaggcgcatatttgaacgc

SEQ ID NO: 58797 - DNA, 25 bp, Mus musculus
tctctctatagctgactagaggtgt

SEQ ID NO: 58798 - DNA, 25 bp, Mus musculus
tctctctatgaatgccgttattcag

SEQ ID NO: 58799 - DNA, 25 bp, Mus musculus
tctctctgcccatgagaacgtggtg

SEQ ID NO: 58800 - DNA, 25 bp, Mus musculus
tctctctgtaatttccaaacgctga

SEQ ID NO: 58801 - DNA, 25 bp, Mus musculus
tctctctgtatccattcagactgct

SEQ ID NO: 58802 - DNA, 25 bp, Mus musculus
tctctctgtggctgacaagatcaag

SEQ ID NO: 58803 - DNA, 25 bp, Mus musculus
tctctgaaacttggaggcccgtgtc

SEQ ID NO: 58804 - DNA, 25 bp, Mus musculus
tctctgaacagacgcatccagctgg

SEQ ID NO: 58805 - DNA, 25 bp, Mus musculus
tctctgaaggacaactgagagcctt

SEQ ID NO: 58806 - DNA, 25 bp, Mus musculus
tctctgaaggactactgagagcctt

SEQ ID NO: 58807 - DNA, 25 bp, Mus musculus
tctctgaaggtgaccaatgagccca

SEQ ID NO: 58808 - DNA, 25 bp, Mus musculus
tctctgacaaggaaagggattgttc

SEQ ID NO: 58809 - DNA, 25 bp, Mus musculus
tctctgacatcccagaagattctcc

SEQ ID NO: 58810 - DNA, 25 bp, Mus musculus
tctctgaccttgattgggatgctgg

SEQ ID NO: 58811 - DNA, 25 bp, Mus musculus
tctctgagagccacggccgagaatg

SEQ ID NO: 58812 - DNA, 25 bp, Mus musculus
tctctgagatctccatgagtgttgg

SEQ ID NO: 58813 - DNA, 25 bp, Mus musculus
tctctgagcagggtttcgctttctc

SEQ ID NO: 58814 - DNA, 25 bp, Mus musculus
tctctgaggtgcagaaagagagaag

SEQ ID NO: 58815 - DNA, 25 bp, Mus musculus
tctctgagtgagtggcttcttgtaa

SEQ ID NO: 58816 - DNA, 25 bp, Mus musculus
tctctgagtggaggaaggataagac

SEQ ID NO: 58817 - DNA, 25 bp, Mus musculus
tctctgatacaaagcgaggccttca

SEQ ID NO: 58818 - DNA, 25 bp, Mus musculus
tctctgatggtagaggaagaaccca

SEQ ID NO: 58819 - DNA, 25 bp, Mus musculus
tctctgcacaaatgtgacatctcaa

SEQ ID NO: 58820 - DNA, 25 bp, Mus musculus
tctctgcagttgttggctccaacac

SEQ ID NO: 58821 - DNA, 25 bp, Mus musculus
tctctgccagaaaggccgatgcctc

SEQ ID NO: 58822 - DNA, 25 bp, Mus musculus
tctctgccagaatggccgatgcctc

SEQ ID NO: 58823 - DNA, 25 bp, Mus musculus
tctctgcccctaattacctagatgt

SEQ ID NO: 58824 - DNA, 25 bp, Mus musculus
tctctgcctggtggcagctggacag

SEQ ID NO: 58825 - DNA, 25 bp, Mus musculus
tctctgcgatatgacaccagttatt

SEQ ID NO: 58826 - DNA, 25 bp, Mus musculus
tctctgcgcatcttagcagatctgg

SEQ ID NO: 58827 - DNA, 25 bp, Mus musculus
tctctgcgccactagtaaataaacg

SEQ ID NO: 58828 - DNA, 25 bp, Mus musculus
tctctgctccttggtgtgcaaatgg

SEQ ID NO: 58829 - DNA, 25 bp, Mus musculus
tctctgctcggtgagatcaagactg

SEQ ID NO: 58830 - DNA, 25 bp, Mus musculus
tctctgctctggatcaagagggtca

SEQ ID NO: 58831 - DNA, 25 bp, Mus musculus
tctctggaaaaaccaccgtccatgg

SEQ ID NO: 58832 - DNA, 25 bp, Mus musculus
tctctggaaaaagcaccgtccatgg

SEQ ID NO: 58833 - DNA, 25 bp, Mus musculus
tctctggacaagaacggtgtggacc

SEQ ID NO: 58834 - DNA, 25 bp, Mus musculus
tctctggacccgttttgttttctct

SEQ ID NO: 58835 - DNA, 25 bp, Mus musculus
tctctggagacttcaccctgctgta

SEQ ID NO: 58836 - DNA, 25 bp, Mus musculus
tctctggagatcactgtaaacttac

SEQ ID NO: 58837 - DNA, 25 bp, Mus musculus
tctctggagtcagaatcagctggct

SEQ ID NO: 58838 - DNA, 25 bp, Mus musculus
tctctggagtgctccctgacggaga

SEQ ID NO: 58839 - DNA, 25 bp, Mus musculus
tctctggatgggttctacaacggcc

SEQ ID NO: 58840 - DNA, 25 bp, Mus musculus
tctctggccaggattgaaaccgaca

SEQ ID NO: 58841 - DNA, 25 bp, Mus musculus
tctctggctcaaagttgtgcattgg

SEQ ID NO: 58842 - DNA, 25 bp, Mus musculus
tctctggcttgttatgggacctcag

SEQ ID NO: 58843 - DNA, 25 bp, Mus musculus
tctctgggctgctatacagaaatag

SEQ ID NO: 58844 - DNA, 25 bp, Mus musculus
tctctggggccaggaatcagctgcg

SEQ ID NO: 58845 - DNA, 25 bp, Mus musculus
tctctgggtcccgagacaagaccat

SEQ ID NO: 58846 - DNA, 25 bp, Mus musculus
tctctggtccactcaaggaggagta

SEQ ID NO: 58847 - DNA, 25 bp, Mus musculus
tctctgtatccattcagactgctct

SEQ ID NO: 58848 - DNA, 25 bp, Mus musculus
tctctgtcaactcaacgccaagact

SEQ ID NO: 58849 - DNA, 25 bp, Mus musculus
tctctgtctcctactgtgtccagca

SEQ ID NO: 58850 - DNA, 25 bp, Mus musculus
tctctgtgaaatgttctagaacacg

SEQ ID NO: 58851 - DNA, 25 bp, Mus musculus
tctctgtgaaggatagtaaaatgtc

SEQ ID NO: 58852 - DNA, 25 bp, Mus musculus
tctctgtgagcgagaccccaagtcc

SEQ ID NO: 58853 - DNA, 25 bp, Mus musculus
tctctgtgatggtgtcaacttggct

SEQ ID NO: 58854 - DNA, 25 bp, Mus musculus
tctctgtgcatcaaggtcttcatct

SEQ ID NO: 58855 - DNA, 25 bp, Mus musculus
tctctgtgctcaaatggatcaggaa

SEQ ID NO: 58856 - DNA, 25 bp, Mus musculus
tctctgtggatacacaagttgcata

SEQ ID NO: 58857 - DNA, 25 bp, Mus musculus
tctctgtgggtgaggacagcatccc

SEQ ID NO: 58858 - DNA, 25 bp, Mus musculus
tctctgtggtaggaaggccctgtgc

SEQ ID NO: 58859 - DNA, 25 bp, Mus musculus
tctctgtgtattggcaggttctcga

SEQ ID NO: 58860 - DNA, 25 bp, Mus musculus
tctctgtgtctgcagccaccctggg

SEQ ID NO: 58861 - DNA, 25 bp, Mus musculus
tctctgttgccagcgccagcaggag

SEQ ID NO: 58862 - DNA, 25 bp, Mus musculus
tctcttagtgtgaaagcctccttcc

SEQ ID NO: 58863 - DNA, 25 bp, Mus musculus
tctcttcaatgaaagtcactggatt

SEQ ID NO: 58864 - DNA, 25 bp, Mus musculus
tctcttcaatgatagtcactggatt

SEQ ID NO: 58865 - DNA, 25 bp, Mus musculus
tctcttcagtacctcagggatgaca

SEQ ID NO: 58866 - DNA, 25 bp, Mus musculus
tctcttccatatgcctctcaatggg

SEQ ID NO: 58867 - DNA, 25 bp, Mus musculus
tctcttccctgatttgtctccaggg

SEQ ID NO: 58868 - DNA, 25 bp, Mus musculus
tctcttcggtggtgttcttatgact

SEQ ID NO: 58869 - DNA, 25 bp, Mus musculus
tctcttcgttatgagctggctgctg

SEQ ID NO: 58870 - DNA, 25 bp, Mus musculus
tctcttctatgatggcgagtctgtc

SEQ ID NO: 58871 - DNA, 25 bp, Mus musculus
tctcttctctatgaggtcattcata

SEQ ID NO: 58872 - DNA, 25 bp, Mus musculus
tctcttctgattggagagctggctc

SEQ ID NO: 58873 - DNA, 25 bp, Mus musculus
tctcttctttagaagaggaaggcaa

SEQ ID NO: 58874 - DNA, 25 bp, Mus musculus
tctcttgaactcatggagggtagtc

SEQ ID NO: 58875 - DNA, 25 bp, Mus musculus
tctcttgaccgcatgctcagcagca

SEQ ID NO: 58876 - DNA, 25 bp, Mus musculus
tctcttgatggaaacaagaggctgg

SEQ ID NO: 58877 - DNA, 25 bp, Mus musculus
tctcttgccacatcaggttcccagg

SEQ ID NO: 58878 - DNA, 25 bp, Mus musculus
tctcttgcctgcgtgtggtttgcct

SEQ ID NO: 58879 - DNA, 25 bp, Mus musculus
tctcttgctcgatggctactctgta

SEQ ID NO: 58880 - DNA, 25 bp, Mus musculus
tctcttggaattgggctgctaacaa

SEQ ID NO: 58881 - DNA, 25 bp, Mus musculus
tctcttggtcaatgcctgcctctgt

SEQ ID NO: 58882 - DNA, 25 bp, Mus musculus
tctcttgtcacaaatcagctctgga

SEQ ID NO: 58883 - DNA, 25 bp, Mus musculus
tctctttccccagcaataaactggt

SEQ ID NO: 58884 - DNA, 25 bp, Mus musculus
tctctttgaaggatactttggaaca

SEQ ID NO: 58885 - DNA, 25 bp, Mus musculus
tctctttgagatgctggttgggcag

SEQ ID NO: 58886 - DNA, 25 bp, Mus musculus
tctctttgcctatgcctgtgatttt

SEQ ID NO: 58887 - DNA, 25 bp, Mus musculus
tctctttgtacccttagcggtcctg

SEQ ID NO: 58888 - DNA, 25 bp, Mus musculus
tctctttgtgctggtgttgatgtgt

SEQ ID NO: 58889 - DNA, 25 bp, Mus musculus
tctcttttcactggatacgaactgg

SEQ ID NO: 58890 - DNA, 25 bp, Mus musculus
tctgaaaaaatctcaaccaaaccct

SEQ ID NO: 58891 - DNA, 25 bp, Mus musculus
tctgaaaaatgtcagaagttaccat

SEQ ID NO: 58892 - DNA, 25 bp, Mus musculus
tctgaaaacacgcaacagcagcagg

SEQ ID NO: 58893 - DNA, 25 bp, Mus musculus
tctgaaaagtccattgtgtaccttg

SEQ ID NO: 58894 - DNA, 25 bp, Mus musculus
tctgaaaatcaagttgctggtgtct

SEQ ID NO: 58895 - DNA, 25 bp, Mus musculus
tctgaaacagtattcccagcatggt

SEQ ID NO: 58896 - DNA, 25 bp, Mus musculus
tctgaaacatcaggctagcattagt

SEQ ID NO: 58897 - DNA, 25 bp, Mus musculus
tctgaaaccaagaaggagctcctgg

SEQ ID NO: 58898 - DNA, 25 bp, Mus musculus
tctgaaactcactacgtaggccagg

SEQ ID NO: 58899 - DNA, 25 bp, Mus musculus
tctgaaactgatggtgttgatgaaa

SEQ ID NO: 58900 - DNA, 25 bp, Mus musculus
tctgaaacttgagagtctgaggcag

SEQ ID NO: 58901 - DNA, 25 bp, Mus musculus
tctgaaataagacagtacacacttg

SEQ ID NO: 58902 - DNA, 25 bp, Mus musculus
tctgaaatcaggctcagcggctgca

SEQ ID NO: 58903 - DNA, 25 bp, Mus musculus
tctgaaatcgactggctgaacctga

SEQ ID NO: 58904 - DNA, 25 bp, Mus musculus
tctgaaatgataaagaccatgaaaa

SEQ ID NO: 58905 - DNA, 25 bp, Mus musculus
tctgaaatgtgtggagcaactggtg

SEQ ID NO: 58906 - DNA, 25 bp, Mus musculus
tctgaacaaagagccatccgagtga

SEQ ID NO: 58907 - DNA, 25 bp, Mus musculus
tctgaacaagccgagaccgggccat

SEQ ID NO: 58908 - DNA, 25 bp, Mus musculus
tctgaacaccggaaagcgtgaaagt

SEQ ID NO: 58909 - DNA, 25 bp, Mus musculus
tctgaacagacgcatccagctggtt

SEQ ID NO: 58910 - DNA, 25 bp, Mus musculus
tctgaacagccagctactggatgcc

SEQ ID NO: 58911 - DNA, 25 bp, Mus musculus
tctgaacagtcttctggtgcctctt

SEQ ID NO: 58912 - DNA, 25 bp, Mus musculus
tctgaaccaggcagagagccgaaac

SEQ ID NO: 58913 - DNA, 25 bp, Mus musculus
tctgaacccagcatcgttaggaaca

SEQ ID NO: 58914 - DNA, 25 bp, Mus musculus
tctgaacctcttggaagagacttgc

SEQ ID NO: 58915 - DNA, 25 bp, Mus musculus
tctgaactggcttataatatctggc

SEQ ID NO: 58916 - DNA, 25 bp, Mus musculus
tctgaacttgatgtgaatgacttgg

SEQ ID NO: 58917 - DNA, 25 bp, Mus musculus
tctgaacttggcttggagtctgaag

SEQ ID NO: 58918 - DNA, 25 bp, Mus musculus
tctgaagaaaatctcctcagagtct

SEQ ID NO: 58919 - DNA, 25 bp, Mus musculus
tctgaagaaagaggacaccaccttt

SEQ ID NO: 58920 - DNA, 25 bp, Mus musculus
tctgaagaagagtttattacctctc

SEQ ID NO: 58921 - DNA, 25 bp, Mus musculus
tctgaagaagggtttcactacctcg

SEQ ID NO: 58922 - DNA, 25 bp, Mus musculus
tctgaagacaaaaaggcctgcgaag

SEQ ID NO: 58923 - DNA, 25 bp, Mus musculus
tctgaagacccacgtgggacctgaa

SEQ ID NO: 58924 - DNA, 25 bp, Mus musculus
tctgaagacccgaatggccctgcgg

SEQ ID NO: 58925 - DNA, 25 bp, Mus musculus
tctgaagatgcaaagggaaatgtct

SEQ ID NO: 58926 - DNA, 25 bp, Mus musculus
tctgaagcagcctgatggcatcgct

SEQ ID NO: 58927 - DNA, 25 bp, Mus musculus
tctgaagcccaagaagccggcaagg

SEQ ID NO: 58928 - DNA, 25 bp, Mus musculus
tctgaagcttcgattatgatctgga

SEQ ID NO: 58929 - DNA, 25 bp, Mus musculus
tctgaaggaggacctctccggctca

SEQ ID NO: 58930 - DNA, 25 bp, Mus musculus
tctgaaggcatgacggtttgagctc

SEQ ID NO: 58931 - DNA, 25 bp, Mus musculus
tctgaaggctgcactggctgtctcc

SEQ ID NO: 58932 - DNA, 25 bp, Mus musculus
tctgaaggtcacttatgtctgcctg

SEQ ID NO: 58933 - DNA, 25 bp, Mus musculus
tctgaagtcactttagctggagtct

SEQ ID NO: 58934 - DNA, 25 bp, Mus musculus
tctgaagtcggtggattgtgttatc

SEQ ID NO: 58935 - DNA, 25 bp, Mus musculus
tctgaagtgaaaggaggagtctgca

SEQ ID NO: 58936 - DNA, 25 bp, Mus musculus
tctgaagtggctgtggtatggaaac

SEQ ID NO: 58937 - DNA, 25 bp, Mus musculus
tctgaagtgtccaggattcccaaca

SEQ ID NO: 58938 - DNA, 25 bp, Mus musculus
tctgaagtgtcctggattcccaaca

SEQ ID NO: 58939 - DNA, 25 bp, Mus musculus
tctgaagttcttcgagagtaccgga

SEQ ID NO: 58940 - DNA, 25 bp, Mus musculus
tctgaatcctaatactacaggagtc

SEQ ID NO: 58941 - DNA, 25 bp, Mus musculus
tctgaatgagcgtcactatggagcc

SEQ ID NO: 58942 - DNA, 25 bp, Mus musculus
tctgaatggaggaccacagtaggcc

SEQ ID NO: 58943 - DNA, 25 bp, Mus musculus
tctgaatggcatcgatctcaaagca

SEQ ID NO: 58944 - DNA, 25 bp, Mus musculus
tctgaatggtgaatatcgagccaaa

SEQ ID NO: 58945 - DNA, 25 bp, Mus musculus
tctgaattgcccagcctgtatgacg

SEQ ID NO: 58946 - DNA, 25 bp, Mus musculus
tctgacaaaggctttgctgcagttc

SEQ ID NO: 58947 - DNA, 25 bp, Mus musculus
tctgacaattgggatctgccctaag

SEQ ID NO: 58948 - DNA, 25 bp, Mus musculus
tctgacacacagtcgcagggaagcc

SEQ ID NO: 58949 - DNA, 25 bp, Mus musculus
tctgacaccaccattcccatggatg

SEQ ID NO: 58950 - DNA, 25 bp, Mus musculus
tctgacactagtcactgtgtgctct

SEQ ID NO: 58951 - DNA, 25 bp, Mus musculus
tctgacactagtgactgtgtgctct

SEQ ID NO: 58952 - DNA, 25 bp, Mus musculus
tctgacactgagagctctatcatca

SEQ ID NO: 58953 - DNA, 25 bp, Mus musculus
tctgacagtcagcaacctggaggag

SEQ ID NO: 58954 - DNA, 25 bp, Mus musculus
tctgacagtggatttacacacggac

SEQ ID NO: 58955 - DNA, 25 bp, Mus musculus
tctgacatctagcatcaaagagatc

SEQ ID NO: 58956 - DNA, 25 bp, Mus musculus
tctgacatggatcttcagaagaagc

SEQ ID NO: 58957 - DNA, 25 bp, Mus musculus
tctgacatggatgttcagaagaagc

SEQ ID NO: 58958 - DNA, 25 bp, Mus musculus
tctgacattgctgcgagggcctatg

SEQ ID NO: 58959 - DNA, 25 bp, Mus musculus
tctgaccaaacggttcatctgggag

SEQ ID NO: 58960 - DNA, 25 bp, Mus musculus
tctgaccaaggacatgactggaaag

SEQ ID NO: 58961 - DNA, 25 bp, Mus musculus
tctgaccaagtagcgcagagtgatg

SEQ ID NO: 58962 - DNA, 25 bp, Mus musculus
tctgaccacacagcagtgctgctga

SEQ ID NO: 58963 - DNA, 25 bp, Mus musculus
tctgaccatgaagaaagacgagctt

SEQ ID NO: 58964 - DNA, 25 bp, Mus musculus
tctgacccagtgaaagcgtggaaag

SEQ ID NO: 58965 - DNA, 25 bp, Mus musculus
tctgaccccaacactgtgcttggaa

SEQ ID NO: 58966 - DNA, 25 bp, Mus musculus
tctgaccctcccagatgatgcagct

SEQ ID NO: 58967 - DNA, 25 bp, Mus musculus
tctgaccgaggacgcggtgttcctc

SEQ ID NO: 58968 - DNA, 25 bp, Mus musculus
tctgaccgaggaggcggtgttcctc

SEQ ID NO: 58969 - DNA, 25 bp, Mus musculus
tctgaccgagttgctaaagcaagga

SEQ ID NO: 58970 - DNA, 25 bp, Mus musculus
tctgaccgctggtgtgatcacaatg

SEQ ID NO: 58971 - DNA, 25 bp, Mus musculus
tctgacctatgggagcagggtatct

SEQ ID NO: 58972 - DNA, 25 bp, Mus musculus
tctgacctccatgggtaactgcaca

SEQ ID NO: 58973 - DNA, 25 bp, Mus musculus
tctgacctggctcagcagtatggtg

SEQ ID NO: 58974 - DNA, 25 bp, Mus musculus
tctgacctgtttgagggttcaggac

SEQ ID NO: 58975 - DNA, 25 bp, Mus musculus
tctgaccttgattgggatgctggcg

SEQ ID NO: 58976 - DNA, 25 bp, Mus musculus
tctgacgaagacgagcgcttgtccg

SEQ ID NO: 58977 - DNA, 25 bp, Mus musculus
tctgacgctgagttgccatggcatc

SEQ ID NO: 58978 - DNA, 25 bp, Mus musculus
tctgacgtggaccttccctggagag

SEQ ID NO: 58979 - DNA, 25 bp, Mus musculus
tctgactcattatccgccagacctt

SEQ ID NO: 58980 - DNA, 25 bp, Mus musculus
tctgactcccgcatcaatggtgtct

SEQ ID NO: 58981 - DNA, 25 bp, Mus musculus
tctgactccgactatgagcactatg

SEQ ID NO: 58982 - DNA, 25 bp, Mus musculus
tctgactcctgggaccttctgtgtc

SEQ ID NO: 58983 - DNA, 25 bp, Mus musculus
tctgactgtacggaaactatcgaag

SEQ ID NO: 58984 - DNA, 25 bp, Mus musculus
tctgactgtagtaattactgcaagg

SEQ ID NO: 58985 - DNA, 25 bp, Mus musculus
tctgactgtagttattactgcaagg

SEQ ID NO: 58986 - DNA, 25 bp, Mus musculus
tctgacttacacatcttggacttca

SEQ ID NO: 58987 - DNA, 25 bp, Mus musculus
tctgacttatgaagcagttcaccaa

SEQ ID NO: 58988 - DNA, 25 bp, Mus musculus
tctgacttccctagcatggaggact

SEQ ID NO: 58989 - DNA, 25 bp, Mus musculus
tctgactttatgactgacgtccctg

SEQ ID NO: 58990 - DNA, 25 bp, Mus musculus
tctgactttattcgcagtggcatgg

SEQ ID NO: 58991 - DNA, 25 bp, Mus musculus
tctgactttgggtttcctggaagaa

SEQ ID NO: 58992 - DNA, 25 bp, Mus musculus
tctgacttttgccaagatgacctgg

SEQ ID NO: 58993 - DNA, 25 bp, Mus musculus
tctgagaaagtagagaagggctcca

SEQ ID NO: 58994 - DNA, 25 bp, Mus musculus
tctgagaaatagagccctaagggac

SEQ ID NO: 58995 - DNA, 25 bp, Mus musculus
tctgagaaatagtgccctaagggac

SEQ ID NO: 58996 - DNA, 25 bp, Mus musculus
tctgagaactacacggagaatgatt

SEQ ID NO: 58997 - DNA, 25 bp, Mus musculus
tctgagaactgatgcttggaccacc

SEQ ID NO: 58998 - DNA, 25 bp, Mus musculus
tctgagaagacagctgttaacaact

SEQ ID NO: 58999 - DNA, 25 bp, Mus musculus
tctgagaagagtctaaaatggagtc

SEQ ID NO: 59000 - DNA, 25 bp, Mus musculus
tctgagaagctctttgccccggcac

SEQ ID NO: 59001 - DNA, 25 bp, Mus musculus
tctgagaatcatcagaagatcccga

SEQ ID NO: 59002 - DNA, 25 bp, Mus musculus
tctgagacagtcattacatctgtag

SEQ ID NO: 59003 - DNA, 25 bp, Mus musculus
tctgagaccactgcaatcattcagg

SEQ ID NO: 59004 - DNA, 25 bp, Mus musculus
tctgagaccagaattatcctgcaag

SEQ ID NO: 59005 - DNA, 25 bp, Mus musculus
tctgagagatatatgagtaaaggat

SEQ ID NO: 59006 - DNA, 25 bp, Mus musculus
tctgagagatatttgagtaaaggat

SEQ ID NO: 59007 - DNA, 25 bp, Mus musculus
tctgagagatgagataaatcctccc

SEQ ID NO: 59008 - DNA, 25 bp, Mus musculus
tctgagagatgggaattactatgcg

SEQ ID NO: 59009 - DNA, 25 bp, Mus musculus
tctgagagcagagaggtgatctgaa

SEQ ID NO: 59010 - DNA, 25 bp, Mus musculus
tctgagaggagtcttaagagagact

SEQ ID NO: 59011 - DNA, 25 bp, Mus musculus
tctgagaggatgtccaagttctgtg

SEQ ID NO: 59012 - DNA, 25 bp, Mus musculus
tctgagaggtcaaccttttctgagt

SEQ ID NO: 59013 - DNA, 25 bp, Mus musculus
tctgagagtggtaggaagaaccctg

SEQ ID NO: 59014 - DNA, 25 bp, Mus musculus
tctgagatagtagatgttggagaca

SEQ ID NO: 59015 - DNA, 25 bp, Mus musculus
tctgagatcccaagtaaacaacccg

SEQ ID NO: 59016 - DNA, 25 bp, Mus musculus
tctgagatggtctttgaattggaag

SEQ ID NO: 59017 - DNA, 25 bp, Mus musculus
tctgagatgtgacacaagtacatgt

SEQ ID NO: 59018 - DNA, 25 bp, Mus musculus
tctgagattgttcccgagcactgtt

SEQ ID NO: 59019 - DNA, 25 bp, Mus musculus
tctgagcaagaattagagtttcgtc

SEQ ID NO: 59020 - DNA, 25 bp, Mus musculus
tctgagcaccattctatcatggaag

SEQ ID NO: 59021 - DNA, 25 bp, Mus musculus
tctgagcaggctggacctctgtgag

SEQ ID NO: 59022 - DNA, 25 bp, Mus musculus
tctgagcctgtgataccctcctctg

SEQ ID NO: 59023 - DNA, 25 bp, Mus musculus
tctgagcctgttggtccttctagca

SEQ ID NO: 59024 - DNA, 25 bp, Mus musculus
tctgagctaagtgagggttccattg

SEQ ID NO: 59025 - DNA, 25 bp, Mus musculus
tctgagctcctgcacctggagcgga

SEQ ID NO: 59026 - DNA, 25 bp, Mus musculus
tctgagctgcgagtacaggtgatcc

SEQ ID NO: 59027 - DNA, 25 bp, Mus musculus
tctgagctgggcaacacccagcaac

SEQ ID NO: 59028 - DNA, 25 bp, Mus musculus
tctgaggacatgcaggagatcacac

SEQ ID NO: 59029 - DNA, 25 bp, Mus musculus
tctgaggaccgcacacgtttctatg

SEQ ID NO: 59030 - DNA, 25 bp, Mus musculus
tctgaggagaacatggccacccatt

SEQ ID NO: 59031 - DNA, 25 bp, Mus musculus
tctgaggatgaagacagcatggaca

SEQ ID NO: 59032 - DNA, 25 bp, Mus musculus
tctgaggccagatgagaaggccatc

SEQ ID NO: 59033 - DNA, 25 bp, Mus musculus
tctgaggctcactgcaagccggtgg

SEQ ID NO: 59034 - DNA, 25 bp, Mus musculus
tctgagggagctcgaaagcagcctc

SEQ ID NO: 59035 - DNA, 25 bp, Mus musculus
tctgagggagctggaaagcagcctc

SEQ ID NO: 59036 - DNA, 25 bp, Mus musculus
tctgaggtacacaaaggaggaggaa

SEQ ID NO: 59037 - DNA, 25 bp, Mus musculus
tctgaggtgatggtacatctcaatg

SEQ ID NO: 59038 - DNA, 25 bp, Mus musculus
tctgaggtggagactaatccattag

SEQ ID NO: 59039 - DNA, 25 bp, Mus musculus
tctgagtccctctgcctcagacggg

SEQ ID NO: 59040 - DNA, 25 bp, Mus musculus
tctgagtctccaagcactcggtgtc

SEQ ID NO: 59041 - DNA, 25 bp, Mus musculus
tctgagtcttctgtaaacaagatgg

SEQ ID NO: 59042 - DNA, 25 bp, Mus musculus
tctgagtgcgacaccattctgtgct

SEQ ID NO: 59043 - DNA, 25 bp, Mus musculus
tctgagtgcgatgaagatcgcgcac

SEQ ID NO: 59044 - DNA, 25 bp, Mus musculus
tctgagttaattggccctgctgaag

SEQ ID NO: 59045 - DNA, 25 bp, Mus musculus
tctgagttccttgtggcgttagctg

SEQ ID NO: 59046 - DNA, 25 bp, Mus musculus
tctgataaaaattaccccaaaaatg

SEQ ID NO: 59047 - DNA, 25 bp, Mus musculus
tctgataaacatctaccctaagtgc

SEQ ID NO: 59048 - DNA, 25 bp, Mus musculus
tctgatacaacttccaccggccttg

SEQ ID NO: 59049 - DNA, 25 bp, Mus musculus
tctgatactggcagagccttggcca

SEQ ID NO: 59050 - DNA, 25 bp, Mus musculus
tctgatagacgattcaaccggtgac

SEQ ID NO: 59051 - DNA, 25 bp, Mus musculus
tctgatcacagggaatgtctgcctt

SEQ ID NO: 59052 - DNA, 25 bp, Mus musculus
tctgatcactcgatcccctgcatcg

SEQ ID NO: 59053 - DNA, 25 bp, Mus musculus
tctgatcccaggttgaaagagtgta

SEQ ID NO: 59054 - DNA, 25 bp, Mus musculus
tctgatccgaaaacatgaggccttt

SEQ ID NO: 59055 - DNA, 25 bp, Mus musculus
tctgatcctgctctgctttggcctc

SEQ ID NO: 59056 - DNA, 25 bp, Mus musculus
tctgatcgcctcagtgatttagggc

SEQ ID NO: 59057 - DNA, 25 bp, Mus musculus
tctgatctataagaaagcccacaag

SEQ ID NO: 59058 - DNA, 25 bp, Mus musculus
tctgatgaacagacctaatgcccgc

SEQ ID NO: 59059 - DNA, 25 bp, Mus musculus
tctgatgaagacttctgtcaaaact

SEQ ID NO: 59060 - DNA, 25 bp, Mus musculus
tctgatgacaccttccattacacca

SEQ ID NO: 59061 - DNA, 25 bp, Mus musculus
tctgatgagctatccgtgccctcag

SEQ ID NO: 59062 - DNA, 25 bp, Mus musculus
tctgatgaggaagggattccaatgc

SEQ ID NO: 59063 - DNA, 25 bp, Mus musculus
tctgatgatgtgaccatatcctacc

SEQ ID NO: 59064 - DNA, 25 bp, Mus musculus
tctgatgcaagccaggtcatcctgc

SEQ ID NO: 59065 - DNA, 25 bp, Mus musculus
tctgatgccatggtagatgacccca

SEQ ID NO: 59066 - DNA, 25 bp, Mus musculus
tctgatgctatcatgaatatgcagg

SEQ ID NO: 59067 - DNA, 25 bp, Mus musculus
tctgatgctatcttgaatatgcagg

SEQ ID NO: 59068 - DNA, 25 bp, Mus musculus
tctgatggattctgcattgctcaaa

SEQ ID NO: 59069 - DNA, 25 bp, Mus musculus
tctgatggcgtttctcagacaaatg

SEQ ID NO: 59070 - DNA, 25 bp, Mus musculus
tctgatggctataaagtacaagaga

SEQ ID NO: 59071 - DNA, 25 bp, Mus musculus
tctgatgggcattaaaactgacttc

SEQ ID NO: 59072 - DNA, 25 bp, Mus musculus
tctgatggtagatcctgcctccaag

SEQ ID NO: 59073 - DNA, 25 bp, Mus musculus
tctgatgtctccctctgtcagtctc

SEQ ID NO: 59074 - DNA, 25 bp, Mus musculus
tctgattaaagtcatccacttgctg

SEQ ID NO: 59075 - DNA, 25 bp, Mus musculus
tctgattatcagtgggatgttagcc

SEQ ID NO: 59076 - DNA, 25 bp, Mus musculus
tctgattcctatccaacatgagaga

SEQ ID NO: 59077 - DNA, 25 bp, Mus musculus
tctgattgtgactcccaatggcagg

SEQ ID NO: 59078 - DNA, 25 bp, Mus musculus
tctgatttgaaaggaccactaactt

SEQ ID NO: 59079 - DNA, 25 bp, Mus musculus
tctgcaaaagttaatgccaagacga

SEQ ID NO: 59080 - DNA, 25 bp, Mus musculus
tctgcaaacatggtggctactatac

SEQ ID NO: 59081 - DNA, 25 bp, Mus musculus
tctgcaaaccagagttcaccttctt

SEQ ID NO: 59082 - DNA, 25 bp, Mus musculus
tctgcaaacgggaaggaggagaccc

SEQ ID NO: 59083 - DNA, 25 bp, Mus musculus
tctgcaaagcactattctgttctga

SEQ ID NO: 59084 - DNA, 25 bp, Mus musculus
tctgcaactagtgagtgcgtgggac

SEQ ID NO: 59085 - DNA, 25 bp, Mus musculus
tctgcaactgcgagcacagtggaaa

SEQ ID NO: 59086 - DNA, 25 bp, Mus musculus
tctgcaagaagaaagtgttatccaa

SEQ ID NO: 59087 - DNA, 25 bp, Mus musculus
tctgcaagcggcagaaaaagaccaa

SEQ ID NO: 59088 - DNA, 25 bp, Mus musculus
tctgcaaggtgctggctgtgaacca

SEQ ID NO: 59089 - DNA, 25 bp, Mus musculus
tctgcaatagcaacaaacgggtttg

SEQ ID NO: 59090 - DNA, 25 bp, Mus musculus
tctgcaatcttcacatcatgattgg

SEQ ID NO: 59091 - DNA, 25 bp, Mus musculus
tctgcaatgacatcacagcttatct

SEQ ID NO: 59092 - DNA, 25 bp, Mus musculus
tctgcacagctggacgatgagaatg

SEQ ID NO: 59093 - DNA, 25 bp, Mus musculus
tctgcacatggtgatgatattatgc

SEQ ID NO: 59094 - DNA, 25 bp, Mus musculus
tctgcacattcgctctcagcactgg

SEQ ID NO: 59095 - DNA, 25 bp, Mus musculus
tctgcaccaatactgtaggctcctt

SEQ ID NO: 59096 - DNA, 25 bp, Mus musculus
tctgcaccaatagtgtaggctcctt

SEQ ID NO: 59097 - DNA, 25 bp, Mus musculus
tctgcaccaggtatggaatgggtct

SEQ ID NO: 59098 - DNA, 25 bp, Mus musculus
tctgcaccaggtttggaatgggtct

SEQ ID NO: 59099 - DNA, 25 bp, Mus musculus
tctgcacccaactctgattcttttt

SEQ ID NO: 59100 - DNA, 25 bp, Mus musculus
tctgcacccagtccgatgggaggaa

SEQ ID NO: 59101 - DNA, 25 bp, Mus musculus
tctgcaccgagaaaagactcaaagt

SEQ ID NO: 59102 - DNA, 25 bp, Mus musculus
tctgcacgaaggaggaccattcatg

SEQ ID NO: 59103 - DNA, 25 bp, Mus musculus
tctgcacgagaacgaagttcttcgt

SEQ ID NO: 59104 - DNA, 25 bp, Mus musculus
tctgcacgtggcagccaaatacgga

SEQ ID NO: 59105 - DNA, 25 bp, Mus musculus
tctgcactactcaggcctacgaggg

SEQ ID NO: 59106 - DNA, 25 bp, Mus musculus
tctgcactgaggcaagctgcccagt

SEQ ID NO: 59107 - DNA, 25 bp, Mus musculus
tctgcactgcccactttgtcgggaa

SEQ ID NO: 59108 - DNA, 25 bp, Mus musculus
tctgcactgggattctggtggcccc

SEQ ID NO: 59109 - DNA, 25 bp, Mus musculus
tctgcactggtgcttggtcttttgc

SEQ ID NO: 59110 - DNA, 25 bp, Mus musculus
tctgcacttccacctcattgctgat

SEQ ID NO: 59111 - DNA, 25 bp, Mus musculus
tctgcacttccagctcattgctgat

SEQ ID NO: 59112 - DNA, 25 bp, Mus musculus
tctgcactttccgtgctttgacgaa

SEQ ID NO: 59113 - DNA, 25 bp, Mus musculus
tctgcagacactctggtggagtttc

SEQ ID NO: 59114 - DNA, 25 bp, Mus musculus
tctgcagacagagaatagaattccc

SEQ ID NO: 59115 - DNA, 25 bp, Mus musculus
tctgcagagacacctgttaatccac

SEQ ID NO: 59116 - DNA, 25 bp, Mus musculus
tctgcagataatgatagcgaccatt

SEQ ID NO: 59117 - DNA, 25 bp, Mus musculus
tctgcagatgaagtcctcatcaccg

SEQ ID NO: 59118 - DNA, 25 bp, Mus musculus
tctgcagcaacaactcctgcaacaa

SEQ ID NO: 59119 - DNA, 25 bp, Mus musculus
tctgcagcacgtgccagtgctggtg

SEQ ID NO: 59120 - DNA, 25 bp, Mus musculus
tctgcagcaggtgatacactttcgg

SEQ ID NO: 59121 - DNA, 25 bp, Mus musculus
tctgcagcagttctttccccaggct

SEQ ID NO: 59122 - DNA, 25 bp, Mus musculus
tctgcagcgtatctccactggtgga

SEQ ID NO: 59123 - DNA, 25 bp, Mus musculus
tctgcagctaaccatgtaaaagcta

SEQ ID NO: 59124 - DNA, 25 bp, Mus musculus
tctgcaggacagcttcgaatacatt

SEQ ID NO: 59125 - DNA, 25 bp, Mus musculus
tctgcaggccaagggacatacttcc

SEQ ID NO: 59126 - DNA, 25 bp, Mus musculus
tctgcagtccaaactctgagtgagg

SEQ ID NO: 59127 - DNA, 25 bp, Mus musculus
tctgcagtcttagctggaagcacca

SEQ ID NO: 59128 - DNA, 25 bp, Mus musculus
tctgcagtggcacccagacaagaac

SEQ ID NO: 59129 - DNA, 25 bp, Mus musculus
tctgcagttcgttggggtcctcaac

SEQ ID NO: 59130 - DNA, 25 bp, Mus musculus
tctgcatcaaaggtaacaatgtgtt

SEQ ID NO: 59131 - DNA, 25 bp, Mus musculus
tctgcatcaactacttaggaggcta

SEQ ID NO: 59132 - DNA, 25 bp, Mus musculus
tctgcatcactgagataaagtctac

SEQ ID NO: 59133 - DNA, 25 bp, Mus musculus
tctgcatcagaggaagaagggctgc

SEQ ID NO: 59134 - DNA, 25 bp, Mus musculus
tctgcatcagccgacgacaacgatg

SEQ ID NO: 59135 - DNA, 25 bp, Mus musculus
tctgcatcctagacaggcgtcttcc

SEQ ID NO: 59136 - DNA, 25 bp, Mus musculus
tctgcatcctctgggctgtaacgac

SEQ ID NO: 59137 - DNA, 25 bp, Mus musculus
tctgcatgactaagagaagaaacca

SEQ ID NO: 59138 - DNA, 25 bp, Mus musculus
tctgcatgagaaacacctcaaggtt

SEQ ID NO: 59139 - DNA, 25 bp, Mus musculus
tctgcatgatgcagctctgatttct

SEQ ID NO: 59140 - DNA, 25 bp, Mus musculus
tctgcatggaaatcattccaaccag

SEQ ID NO: 59141 - DNA, 25 bp, Mus musculus
tctgcatggttgaccgttctggaag

SEQ ID NO: 59142 - DNA, 25 bp, Mus musculus
tctgcattacaaagagaagatccag

SEQ ID NO: 59143 - DNA, 25 bp, Mus musculus
tctgcattctccttaaggaccaacc

SEQ ID NO: 59144 - DNA, 25 bp, Mus musculus
tctgcattctgtcccagagctggac

SEQ ID NO: 59145 - DNA, 25 bp, Mus musculus
tctgcattgagctactcacttgaca

SEQ ID NO: 59146 - DNA, 25 bp, Mus musculus
tctgcattgagtgctgcgccctgga

SEQ ID NO: 59147 - DNA, 25 bp, Mus musculus
tctgcatttggacagattcttcgaa

SEQ ID NO: 59148 - DNA, 25 bp, Mus musculus
tctgcattttccagggtattaaaga

SEQ ID NO: 59149 - DNA, 25 bp, Mus musculus
tctgcattttcctgggtattaaaga

SEQ ID NO: 59150 - DNA, 25 bp, Mus musculus
tctgccaaagacttgcctcctgatg

SEQ ID NO: 59151 - DNA, 25 bp, Mus musculus
tctgccaacctgtgcgcctgggtac

SEQ ID NO: 59152 - DNA, 25 bp, Mus musculus
tctgccaagagttgattagacaatc

SEQ ID NO: 59153 - DNA, 25 bp, Mus musculus
tctgccacctcagatatttaatggg

SEQ ID NO: 59154 - DNA, 25 bp, Mus musculus
tctgccacgatgacatagacactgt

SEQ ID NO: 59155 - DNA, 25 bp, Mus musculus
tctgccactcctatgactctgcggg

SEQ ID NO: 59156 - DNA, 25 bp, Mus musculus
tctgccactgcaaccaaatatggat

SEQ ID NO: 59157 - DNA, 25 bp, Mus musculus
tctgccactggaaacttaacaaaca

SEQ ID NO: 59158 - DNA, 25 bp, Mus musculus
tctgccagaacctgggtgctgcagc

SEQ ID NO: 59159 - DNA, 25 bp, Mus musculus
tctgccaggatcctatgctgcagtg

SEQ ID NO: 59160 - DNA, 25 bp, Mus musculus
tctgccatcttccagttttctgcca

SEQ ID NO: 59161 - DNA, 25 bp, Mus musculus
tctgccattgggaaagtcctgcttg

SEQ ID NO: 59162 - DNA, 25 bp, Mus musculus
tctgccatttaaagttgtgatcttg

SEQ ID NO: 59163 - DNA, 25 bp, Mus musculus
tctgcccactgaatagtaatcacac

SEQ ID NO: 59164 - DNA, 25 bp, Mus musculus
tctgcccactggaaggagatccttc

SEQ ID NO: 59165 - DNA, 25 bp, Mus musculus
tctgcccagaacattttcaccccag

SEQ ID NO: 59166 - DNA, 25 bp, Mus musculus
tctgcccagaactttttcaccccag

SEQ ID NO: 59167 - DNA, 25 bp, Mus musculus
tctgcccagatgtctgtgagacaaa

SEQ ID NO: 59168 - DNA, 25 bp, Mus musculus
tctgcccatgagaacgtggtggtag

SEQ ID NO: 59169 - DNA, 25 bp, Mus musculus
tctgcccatggaaagagcatctaag

SEQ ID NO: 59170 - DNA, 25 bp, Mus musculus
tctgccccggcacttaggacttaga

SEQ ID NO: 59171 - DNA, 25 bp, Mus musculus
tctgccccggggagtttagcactag

SEQ ID NO: 59172 - DNA, 25 bp, Mus musculus
tctgccccgtttctggaaaccctgg

SEQ ID NO: 59173 - DNA, 25 bp, Mus musculus
tctgcccgcggtattggaatgagtg

SEQ ID NO: 59174 - DNA, 25 bp, Mus musculus
tctgcccggacaaaatagaacagct

SEQ ID NO: 59175 - DNA, 25 bp, Mus musculus
tctgcccggcatgtgggatgcaagt

SEQ ID NO: 59176 - DNA, 25 bp, Mus musculus
tctgcccgggtgacttgaaagttgc

SEQ ID NO: 59177 - DNA, 25 bp, Mus musculus
tctgcccgtggcattttgtcgctta

SEQ ID NO: 59178 - DNA, 25 bp, Mus musculus
tctgccctctgagggctggaatgaa

SEQ ID NO: 59179 - DNA, 25 bp, Mus musculus
tctgccctgcgcaactgtttgtctc

SEQ ID NO: 59180 - DNA, 25 bp, Mus musculus
tctgcccttcggatgtctgtccatc

SEQ ID NO: 59181 - DNA, 25 bp, Mus musculus
tctgcccttctaagtaaacggcgga

SEQ ID NO: 59182 - DNA, 25 bp, Mus musculus
tctgccgcatcatgggcaatggctt

SEQ ID NO: 59183 - DNA, 25 bp, Mus musculus
tctgccggaggagctgacactcaga

SEQ ID NO: 59184 - DNA, 25 bp, Mus musculus
tctgccggcaggacagcttccggtg

SEQ ID NO: 59185 - DNA, 25 bp, Mus musculus
tctgccggctggagagcacaacttc

SEQ ID NO: 59186 - DNA, 25 bp, Mus musculus
tctgccgggactgtaaggaagcata

SEQ ID NO: 59187 - DNA, 25 bp, Mus musculus
tctgccgggatcacaagttgcatgt

SEQ ID NO: 59188 - DNA, 25 bp, Mus musculus
tctgccgtgcagaacaaagtggtgg

SEQ ID NO: 59189 - DNA, 25 bp, Mus musculus
tctgcctaaggcacaccgtaggacc

SEQ ID NO: 59190 - DNA, 25 bp, Mus musculus
tctgcctactggatcgcttcgcaca

SEQ ID NO: 59191 - DNA, 25 bp, Mus musculus
tctgcctcaacacggagggctcctt

SEQ ID NO: 59192 - DNA, 25 bp, Mus musculus
tctgcctcaacagggagggctcctt

SEQ ID NO: 59193 - DNA, 25 bp, Mus musculus
tctgcctcacgtgttgctaagggag

SEQ ID NO: 59194 - DNA, 25 bp, Mus musculus
tctgcctccggaagcggcagagtca

SEQ ID NO: 59195 - DNA, 25 bp, Mus musculus
tctgcctctggaaaggatcagtgct

SEQ ID NO: 59196 - DNA, 25 bp, Mus musculus
tctgcctgcagtagctgagtaccgt

SEQ ID NO: 59197 - DNA, 25 bp, Mus musculus
tctgcctgccaacctggagagagtc

SEQ ID NO: 59198 - DNA, 25 bp, Mus musculus
tctgcctgccaagctggagagagtc

SEQ ID NO: 59199 - DNA, 25 bp, Mus musculus
tctgcctgccgctgcttcataggca

SEQ ID NO: 59200 - DNA, 25 bp, Mus musculus
tctgcctggaccactggtttgcact

SEQ ID NO: 59201 - DNA, 25 bp, Mus musculus
tctgcctggatttgagcatgctgtc

SEQ ID NO: 59202 - DNA, 25 bp, Mus musculus
tctgcctggctgatggccactttgc

SEQ ID NO: 59203 - DNA, 25 bp, Mus musculus
tctgcctgggcttatgaagacaaag

SEQ ID NO: 59204 - DNA, 25 bp, Mus musculus
tctgcctgtcagctctacccaaagg

SEQ ID NO: 59205 - DNA, 25 bp, Mus musculus
tctgccttagctacatggccctgct

SEQ ID NO: 59206 - DNA, 25 bp, Mus musculus
tctgccttgcaaatgctcggattca

SEQ ID NO: 59207 - DNA, 25 bp, Mus musculus
tctgcgacaagagttgcctgttaga

SEQ ID NO: 59208 - DNA, 25 bp, Mus musculus
tctgcgacaagtacctcccaggtta

SEQ ID NO: 59209 - DNA, 25 bp, Mus musculus
tctgcgaccagtattatctaacatc

SEQ ID NO: 59210 - DNA, 25 bp, Mus musculus
tctgcgaccagttttatctaacatc

SEQ ID NO: 59211 - DNA, 25 bp, Mus musculus
tctgcgacttgccaggaaaggctca

SEQ ID NO: 59212 - DNA, 25 bp, Mus musculus
tctgcgagaagggtagactttaaat

SEQ ID NO: 59213 - DNA, 25 bp, Mus musculus
tctgcgagagatccaagcactgagg

SEQ ID NO: 59214 - DNA, 25 bp, Mus musculus
tctgcgagagttagggaatcgatct

SEQ ID NO: 59215 - DNA, 25 bp, Mus musculus
tctgcgagagtttgggaatcgatct

SEQ ID NO: 59216 - DNA, 25 bp, Mus musculus
tctgcgagtatacgcagaagtctgg

SEQ ID NO: 59217 - DNA, 25 bp, Mus musculus
tctgcgatgttgtcatcaacctggc

SEQ ID NO: 59218 - DNA, 25 bp, Mus musculus
tctgcgcaggacctcagggacccag

SEQ ID NO: 59219 - DNA, 25 bp, Mus musculus
tctgcgccaccacaaactaggtttg

SEQ ID NO: 59220 - DNA, 25 bp, Mus musculus
tctgcgccactagtaaataaacgaa

SEQ ID NO: 59221 - DNA, 25 bp, Mus musculus
tctgcgccagcgagtggattcttgt

SEQ ID NO: 59222 - DNA, 25 bp, Mus musculus
tctgcgccaggtgctggcagccaaa

SEQ ID NO: 59223 - DNA, 25 bp, Mus musculus
tctgcgcggaaacccacagagttca

SEQ ID NO: 59224 - DNA, 25 bp, Mus musculus
tctgcgctctgctgcttctcgttgg

SEQ ID NO: 59225 - DNA, 25 bp, Mus musculus
tctgcgcttgcgttgggcgtcagct

SEQ ID NO: 59226 - DNA, 25 bp, Mus musculus
tctgcggataaagagagacttgcca

SEQ ID NO: 59227 - DNA, 25 bp, Mus musculus
tctgcggatgagctcacagagttgc

SEQ ID NO: 59228 - DNA, 25 bp, Mus musculus
tctgcggcttcagatctgcatggaa

SEQ ID NO: 59229 - DNA, 25 bp, Mus musculus
tctgcggtagcatcagggctcacga

SEQ ID NO: 59230 - DNA, 25 bp, Mus musculus
tctgcggttcaaattgcaactagga

SEQ ID NO: 59231 - DNA, 25 bp, Mus musculus
tctgcgtaagacttggcgggcgccc

SEQ ID NO: 59232 - DNA, 25 bp, Mus musculus
tctgcgtgacagagctcggcgcttt

SEQ ID NO: 59233 - DNA, 25 bp, Mus musculus
tctgctaaggcagcggatgaccctg

SEQ ID NO: 59234 - DNA, 25 bp, Mus musculus
tctgctaagtgatgttagtgatggg

SEQ ID NO: 59235 - DNA, 25 bp, Mus musculus
tctgctaatcagctgaagcgtcaca

SEQ ID NO: 59236 - DNA, 25 bp, Mus musculus
tctgctacagagatggtcacgtaca

SEQ ID NO: 59237 - DNA, 25 bp, Mus musculus
tctgctacggagtcactatcctggg

SEQ ID NO: 59238 - DNA, 25 bp, Mus musculus
tctgctactctagatgctgttgagg

SEQ ID NO: 59239 - DNA, 25 bp, Mus musculus
tctgctagaaaagctcaagtgggca

SEQ ID NO: 59240 - DNA, 25 bp, Mus musculus
tctgctagccaggtcctgaattctc

SEQ ID NO: 59241 - DNA, 25 bp, Mus musculus
tctgctataacctacagaccgtggg

SEQ ID NO: 59242 - DNA, 25 bp, Mus musculus
tctgctatcgccacaaacggatatg

SEQ ID NO: 59243 - DNA, 25 bp, Mus musculus
tctgctatgccttgagcccggatga

SEQ ID NO: 59244 - DNA, 25 bp, Mus musculus
tctgctcaatttgggagagtacaaa

SEQ ID NO: 59245 - DNA, 25 bp, Mus musculus
tctgctcacctgtgaatgagaacta

SEQ ID NO: 59246 - DNA, 25 bp, Mus musculus
tctgctcacttatggtgaaattatc

SEQ ID NO: 59247 - DNA, 25 bp, Mus musculus
tctgctcatcagcttggtcctggtc

SEQ ID NO: 59248 - DNA, 25 bp, Mus musculus
tctgctccaagatgtccctttagga

SEQ ID NO: 59249 - DNA, 25 bp, Mus musculus
tctgctccaggctggtcactgaaca

SEQ ID NO: 59250 - DNA, 25 bp, Mus musculus
tctgctccggaaacatcgacatcaa

SEQ ID NO: 59251 - DNA, 25 bp, Mus musculus
tctgctcctcaatggacaaactaga

SEQ ID NO: 59252 - DNA, 25 bp, Mus musculus
tctgctcctggatgacacaccagtc

SEQ ID NO: 59253 - DNA, 25 bp, Mus musculus
tctgctcctggattcttcatattag

SEQ ID NO: 59254 - DNA, 25 bp, Mus musculus
tctgctcctgtgtcgtcaattggga

SEQ ID NO: 59255 - DNA, 25 bp, Mus musculus
tctgctcgacaggacttggagtgtg

SEQ ID NO: 59256 - DNA, 25 bp, Mus musculus
tctgctcgaggcattggcattcagg

SEQ ID NO: 59257 - DNA, 25 bp, Mus musculus
tctgctcgggatctcatgaaggtgc

SEQ ID NO: 59258 - DNA, 25 bp, Mus musculus
tctgctcggtctgacgctgatcact

SEQ ID NO: 59259 - DNA, 25 bp, Mus musculus
tctgctctatgcaagcttccactta

SEQ ID NO: 59260 - DNA, 25 bp, Mus musculus
tctgctctgcaaaccagagttcacc

SEQ ID NO: 59261 - DNA, 25 bp, Mus musculus
tctgctcttctggacaatgtggatc

SEQ ID NO: 59262 - DNA, 25 bp, Mus musculus
tctgctcttgaacccacgggcactg

SEQ ID NO: 59263 - DNA, 25 bp, Mus musculus
tctgctgaagtcagggaagaattga

SEQ ID NO: 59264 - DNA, 25 bp, Mus musculus
tctgctgaagtctgggaagaattga

SEQ ID NO: 59265 - DNA, 25 bp, Mus musculus
tctgctgacagacaggacccttgaa

SEQ ID NO: 59266 - DNA, 25 bp, Mus musculus
tctgctgaccttggatagctcaata

SEQ ID NO: 59267 - DNA, 25 bp, Mus musculus
tctgctgacgcaagagacttgtggt

SEQ ID NO: 59268 - DNA, 25 bp, Mus musculus
tctgctgaggacaacggtcagagaa

SEQ ID NO: 59269 - DNA, 25 bp, Mus musculus
tctgctgaggtgaactttagtacca

SEQ ID NO: 59270 - DNA, 25 bp, Mus musculus
tctgctgatgacaagaatcggcgta

SEQ ID NO: 59271 - DNA, 25 bp, Mus musculus
tctgctgcaggtgtgcagcggcaaa

SEQ ID NO: 59272 - DNA, 25 bp, Mus musculus
tctgctgcccaaactaactccatgg

SEQ ID NO: 59273 - DNA, 25 bp, Mus musculus
tctgctgcctttgaggcccttatga

SEQ ID NO: 59274 - DNA, 25 bp, Mus musculus
tctgctgcgacaagcccaaattcgg

SEQ ID NO: 59275 - DNA, 25 bp, Mus musculus
tctgctgcgccctctgctttgtcat

SEQ ID NO: 59276 - DNA, 25 bp, Mus musculus
tctgctgcgcctgcaggaaagcaaa

SEQ ID NO: 59277 - DNA, 25 bp, Mus musculus
tctgctgcgtgctccagagaagaag

SEQ ID NO: 59278 - DNA, 25 bp, Mus musculus
tctgctgctggtagggatttaaagt

SEQ ID NO: 59279 - DNA, 25 bp, Mus musculus
tctgctgcttcataggaccatcggg

SEQ ID NO: 59280 - DNA, 25 bp, Mus musculus
tctgctggaatgtgtgacctggatc

SEQ ID NO: 59281 - DNA, 25 bp, Mus musculus
tctgctggacaagctggccaaggag

SEQ ID NO: 59282 - DNA, 25 bp, Mus musculus
tctgctggagaagggccttgaagca

SEQ ID NO: 59283 - DNA, 25 bp, Mus musculus
tctgctggagccaacttgaggcgtt

SEQ ID NO: 59284 - DNA, 25 bp, Mus musculus
tctgctggagctgttctttgtttaa

SEQ ID NO: 59285 - DNA, 25 bp, Mus musculus
tctgctggggcctcctcctgttggg

SEQ ID NO: 59286 - DNA, 25 bp, Mus musculus
tctgctggtaggacatcatgttcat

SEQ ID NO: 59287 - DNA, 25 bp, Mus musculus
tctgctgtaacagtacaagctgggc

SEQ ID NO: 59288 - DNA, 25 bp, Mus musculus
tctgctgtctgctagccaggtcctg

SEQ ID NO: 59289 - DNA, 25 bp, Mus musculus
tctgctgtgcctgccagaagactag

SEQ ID NO: 59290 - DNA, 25 bp, Mus musculus
tctgctgtgtcagcttcacatgaag

SEQ ID NO: 59291 - DNA, 25 bp, Mus musculus
tctgctgttaaaataattcccgtga

SEQ ID NO: 59292 - DNA, 25 bp, Mus musculus
tctgctgttctttcaagccaagtcg

SEQ ID NO: 59293 - DNA, 25 bp, Mus musculus
tctgctgtttacgtagactctacct

SEQ ID NO: 59294 - DNA, 25 bp, Mus musculus
tctgctgtttcttcagaatatcacc

SEQ ID NO: 59295 - DNA, 25 bp, Mus musculus
tctgcttaccctcgacagctagagt

SEQ ID NO: 59296 - DNA, 25 bp, Mus musculus
tctgcttatgtcagagacttgaggc

SEQ ID NO: 59297 - DNA, 25 bp, Mus musculus
tctgcttcaagtccttgacaacgca

SEQ ID NO: 59298 - DNA, 25 bp, Mus musculus
tctgcttcaagtgcttgacaacgca

SEQ ID NO: 59299 - DNA, 25 bp, Mus musculus
tctgcttctggtgtgttgaggtgat

SEQ ID NO: 59300 - DNA, 25 bp, Mus musculus
tctgcttgactgaactacacctgtg

SEQ ID NO: 59301 - DNA, 25 bp, Mus musculus
tctgcttgaggatgaaactgtccac

SEQ ID NO: 59302 - DNA, 25 bp, Mus musculus
tctgctttgaaaggtctggtgacat

SEQ ID NO: 59303 - DNA, 25 bp, Mus musculus
tctgctttgccgacccagaggatca

SEQ ID NO: 59304 - DNA, 25 bp, Mus musculus
tctgctttgggaaaatagtaccaca

SEQ ID NO: 59305 - DNA, 25 bp, Mus musculus
tctgctttgggtagtcaagtctacc

SEQ ID NO: 59306 - DNA, 25 bp, Mus musculus
tctgcttttgactctgatgtcctta

SEQ ID NO: 59307 - DNA, 25 bp, Mus musculus
tctggaaaaacttcctcgtgacttc

SEQ ID NO: 59308 - DNA, 25 bp, Mus musculus
tctggaaaacagctccttcagtctg

SEQ ID NO: 59309 - DNA, 25 bp, Mus musculus
tctggaaaacaggatactgggcatc

SEQ ID NO: 59310 - DNA, 25 bp, Mus musculus
tctggaaacctgtggttggagttcc

SEQ ID NO: 59311 - DNA, 25 bp, Mus musculus
tctggaaagattgtgtaccgtgatc

SEQ ID NO: 59312 - DNA, 25 bp, Mus musculus
tctggaaagcagatccataaatgag

SEQ ID NO: 59313 - DNA, 25 bp, Mus musculus
tctggaaaggtcttccccactagcc

SEQ ID NO: 59314 - DNA, 25 bp, Mus musculus
tctggaacaagtgtgagcctggagc

SEQ ID NO: 59315 - DNA, 25 bp, Mus musculus
tctggaaccccgtcttgtaaaggtg

SEQ ID NO: 59316 - DNA, 25 bp, Mus musculus
tctggaacgacactatcacctgcgg

SEQ ID NO: 59317 - DNA, 25 bp, Mus musculus
tctggaacgacagtatcacctgcgg

SEQ ID NO: 59318 - DNA, 25 bp, Mus musculus
tctggaactgaagttctaggcgcct

SEQ ID NO: 59319 - DNA, 25 bp, Mus musculus
tctggaactggcaatgttgttgtga

SEQ ID NO: 59320 - DNA, 25 bp, Mus musculus
tctggaagacttgaatgcatggtct

SEQ ID NO: 59321 - DNA, 25 bp, Mus musculus
tctggaagatgagatgcaaaacgag

SEQ ID NO: 59322 - DNA, 25 bp, Mus musculus
tctggaagccaacaagatagagttc

SEQ ID NO: 59323 - DNA, 25 bp, Mus musculus
tctggaagcttctccccaggcactt

SEQ ID NO: 59324 - DNA, 25 bp, Mus musculus
tctggaaggcccagtcactctgaca

SEQ ID NO: 59325 - DNA, 25 bp, Mus musculus
tctggaaggccctgtcactctgaca

SEQ ID NO: 59326 - DNA, 25 bp, Mus musculus
tctggaagttagagagaagggctac

SEQ ID NO: 59327 - DNA, 25 bp, Mus musculus
tctggaatatcctggataagatgga

SEQ ID NO: 59328 - DNA, 25 bp, Mus musculus
tctggaatgaccacaggatctgact

SEQ ID NO: 59329 - DNA, 25 bp, Mus musculus
tctggaatggcaagacaactaaggt

SEQ ID NO: 59330 - DNA, 25 bp, Mus musculus
tctggaatgtgcagctgtcagacca

SEQ ID NO: 59331 - DNA, 25 bp, Mus musculus
tctggaatgtgctgctgtcagacca

SEQ ID NO: 59332 - DNA, 25 bp, Mus musculus
tctggaattcagctgagtggaagca

SEQ ID NO: 59333 - DNA, 25 bp, Mus musculus
tctggaattccaccccatgttaaag

SEQ ID NO: 59334 - DNA, 25 bp, Mus musculus
tctggaattccgagggtagccttca

SEQ ID NO: 59335 - DNA, 25 bp, Mus musculus
tctggaattctgaagaccaggttca

SEQ ID NO: 59336 - DNA, 25 bp, Mus musculus
tctggaatttcgacggcatgaggca

SEQ ID NO: 59337 - DNA, 25 bp, Mus musculus
tctggacaaagactatctgaggtca

SEQ ID NO: 59338 - DNA, 25 bp, Mus musculus
tctggacaagaacacagctttgtaa

SEQ ID NO: 59339 - DNA, 25 bp, Mus musculus
tctggacaagaacggtgtggacctc

SEQ ID NO: 59340 - DNA, 25 bp, Mus musculus
tctggacactcttgagacgaacagg

SEQ ID NO: 59341 - DNA, 25 bp, Mus musculus
tctggacagcccaagaaaggacatc

SEQ ID NO: 59342 - DNA, 25 bp, Mus musculus
tctggacagcttgggattttctgcc

SEQ ID NO: 59343 - DNA, 25 bp, Mus musculus
tctggacatctttcctttggcctgc

SEQ ID NO: 59344 - DNA, 25 bp, Mus musculus
tctggacatgttgaccaagatgatg

SEQ ID NO: 59345 - DNA, 25 bp, Mus musculus
tctggaccatcacctgtgtcctgga

SEQ ID NO: 59346 - DNA, 25 bp, Mus musculus
tctggacctggtacctgcttggctc

SEQ ID NO: 59347 - DNA, 25 bp, Mus musculus
tctggacctggttcctgcttggctc

SEQ ID NO: 59348 - DNA, 25 bp, Mus musculus
tctggacgaccatcaccatcttcat

SEQ ID NO: 59349 - DNA, 25 bp, Mus musculus
tctggacgaggctgatgtgatgata

SEQ ID NO: 59350 - DNA, 25 bp, Mus musculus
tctggacgcacttgctacccttctg

SEQ ID NO: 59351 - DNA, 25 bp, Mus musculus
tctggacgtacgtagggatgtctcc

SEQ ID NO: 59352 - DNA, 25 bp, Mus musculus
tctggactcctatggttgcaactta

SEQ ID NO: 59353 - DNA, 25 bp, Mus musculus
tctggactcggaggagtcttacccc

SEQ ID NO: 59354 - DNA, 25 bp, Mus musculus
tctggactctagcattgaaaccctg

SEQ ID NO: 59355 - DNA, 25 bp, Mus musculus
tctggactctgttgcatgactgtac

SEQ ID NO: 59356 - DNA, 25 bp, Mus musculus
tctggactctgttggcctccgtgga

SEQ ID NO: 59357 - DNA, 25 bp, Mus musculus
tctggactgcaggactactttgcag

SEQ ID NO: 59358 - DNA, 25 bp, Mus musculus
tctggactggcatagaaaagaggag

SEQ ID NO: 59359 - DNA, 25 bp, Mus musculus
tctggactgtcttcacgctaggcgg

SEQ ID NO: 59360 - DNA, 25 bp, Mus musculus
tctggagaaggaaaccagtgagctc

SEQ ID NO: 59361 - DNA, 25 bp, Mus musculus
tctggagaattactagccacaggag

SEQ ID NO: 59362 - DNA, 25 bp, Mus musculus
tctggagacaagtgcggttcaatca

SEQ ID NO: 59363 - DNA, 25 bp, Mus musculus
tctggagacgtcacggaggtacaac

SEQ ID NO: 59364 - DNA, 25 bp, Mus musculus
tctggagacgtgaaggccacggtcg

SEQ ID NO: 59365 - DNA, 25 bp, Mus musculus
tctggagactcaccactagaagacg

SEQ ID NO: 59366 - DNA, 25 bp, Mus musculus
tctggagagacttcttccctactgg

SEQ ID NO: 59367 - DNA, 25 bp, Mus musculus
tctggagaggacgatccctttgcct

SEQ ID NO: 59368 - DNA, 25 bp, Mus musculus
tctggagatcactgtaaacttacag

SEQ ID NO: 59369 - DNA, 25 bp, Mus musculus
tctggagatcgtgtgtgtctacggc

SEQ ID NO: 59370 - DNA, 25 bp, Mus musculus
tctggagatttgttcatgagcgtgc

SEQ ID NO: 59371 - DNA, 25 bp, Mus musculus
tctggagcacaaggcacgctcatgg

SEQ ID NO: 59372 - DNA, 25 bp, Mus musculus
tctggagccagttgctgagccagaa

SEQ ID NO: 59373 - DNA, 25 bp, Mus musculus
tctggagcccctgaatctgtcatcg

SEQ ID NO: 59374 - DNA, 25 bp, Mus musculus
tctggagcccttgctacagttatag

SEQ ID NO: 59375 - DNA, 25 bp, Mus musculus
tctggagcgcctggagattttgtca

SEQ ID NO: 59376 - DNA, 25 bp, Mus musculus
tctggagctgtagttgcagatggtt

SEQ ID NO: 59377 - DNA, 25 bp, Mus musculus
tctggaggagagtcagccagctagc

SEQ ID NO: 59378 - DNA, 25 bp, Mus musculus
tctggaggcattgtagacatttgta

SEQ ID NO: 59379 - DNA, 25 bp, Mus musculus
tctggaggcgagagagcccagctat

SEQ ID NO: 59380 - DNA, 25 bp, Mus musculus
tctggaggctactggttggagatct

SEQ ID NO: 59381 - DNA, 25 bp, Mus musculus
tctggagtcagaatcagctggcttc

SEQ ID NO: 59382 - DNA, 25 bp, Mus musculus
tctggagtcagttcaaggcgagccc

SEQ ID NO: 59383 - DNA, 25 bp, Mus musculus
tctggagtctggacgatcagcagtc

SEQ ID NO: 59384 - DNA, 25 bp, Mus musculus
tctggagtgcactaataccgctcct

SEQ ID NO: 59385 - DNA, 25 bp, Mus musculus
tctggagtggctagaagccttgctt

SEQ ID NO: 59386 - DNA, 25 bp, Mus musculus
tctggatacgagatgaagggcccac

SEQ ID NO: 59387 - DNA, 25 bp, Mus musculus
tctggatattatgcatgcacttaaa

SEQ ID NO: 59388 - DNA, 25 bp, Mus musculus
tctggatcaagagggtcacctgaat

SEQ ID NO: 59389 - DNA, 25 bp, Mus musculus
tctggatcagcagttaacatgggct

SEQ ID NO: 59390 - DNA, 25 bp, Mus musculus
tctggatcccgtttgtgtacttcta

SEQ ID NO: 59391 - DNA, 25 bp, Mus musculus
tctggatcctcgatgggctggccta

SEQ ID NO: 59392 - DNA, 25 bp, Mus musculus
tctggatcctcgttgggctggccta

SEQ ID NO: 59393 - DNA, 25 bp, Mus musculus
tctggatcttctgtagttttggagg

SEQ ID NO: 59394 - DNA, 25 bp, Mus musculus
tctggatcttttcctgccctgggag

SEQ ID NO: 59395 - DNA, 25 bp, Mus musculus
tctggatgaagctgaacgatctctg

SEQ ID NO: 59396 - DNA, 25 bp, Mus musculus
tctggatgatccaccaggtccattt

SEQ ID NO: 59397 - DNA, 25 bp, Mus musculus
tctggatgcctttgacctggtggac

SEQ ID NO: 59398 - DNA, 25 bp, Mus musculus
tctggatgctgagatagattcgctc

SEQ ID NO: 59399 - DNA, 25 bp, Mus musculus
tctggatgcttatatcaatttagga

SEQ ID NO: 59400 - DNA, 25 bp, Mus musculus
tctggatgcttgatgatggatatca

SEQ ID NO: 59401 - DNA, 25 bp, Mus musculus
tctggatggcagaagtggcatttct

SEQ ID NO: 59402 - DNA, 25 bp, Mus musculus
tctggatggcctttgttcctcctcc

SEQ ID NO: 59403 - DNA, 25 bp, Mus musculus
tctggatggcttcttcagagtttgc

SEQ ID NO: 59404 - DNA, 25 bp, Mus musculus
tctggatgggttctacaacggccgt

SEQ ID NO: 59405 - DNA, 25 bp, Mus musculus
tctggatgtcatccaaatggctttc

SEQ ID NO: 59406 - DNA, 25 bp, Mus musculus
tctggatgtccctgagatcgtcata

SEQ ID NO: 59407 - DNA, 25 bp, Mus musculus
tctggatgtctaccagcgctggcag

SEQ ID NO: 59408 - DNA, 25 bp, Mus musculus
tctggatgtggatagtgaagctaag

SEQ ID NO: 59409 - DNA, 25 bp, Mus musculus
tctggattattgtccccggatgggc

SEQ ID NO: 59410 - DNA, 25 bp, Mus musculus
tctggattccatgggcacttgcatc

SEQ ID NO: 59411 - DNA, 25 bp, Mus musculus
tctggattggctaaagatgcttggg

SEQ ID NO: 59412 - DNA, 25 bp, Mus musculus
tctggattggtcgtgtcgccgatag

SEQ ID NO: 59413 - DNA, 25 bp, Mus musculus
tctggcacagctggagattccctgt

SEQ ID NO: 59414 - DNA, 25 bp, Mus musculus
tctggcaccacagaaggcaccttgg

SEQ ID NO: 59415 - DNA, 25 bp, Mus musculus
tctggcacggaaccctgttatgaca

SEQ ID NO: 59416 - DNA, 25 bp, Mus musculus
tctggcagcgataccacctacttct

SEQ ID NO: 59417 - DNA, 25 bp, Mus musculus
tctggcaggaaagctggatgccctg

SEQ ID NO: 59418 - DNA, 25 bp, Mus musculus
tctggcaggatcaaagcctttctca

SEQ ID NO: 59419 - DNA, 25 bp, Mus musculus
tctggcagtgagcttgtcagacaag

SEQ ID NO: 59420 - DNA, 25 bp, Mus musculus
tctggcagtgcaggcattactaaac

SEQ ID NO: 59421 - DNA, 25 bp, Mus musculus
tctggcatccgctgcctgcactttg

SEQ ID NO: 59422 - DNA, 25 bp, Mus musculus
tctggcatgtaccacttcttccgga

SEQ ID NO: 59423 - DNA, 25 bp, Mus musculus
tctggccaaccagagtctcctgctg

SEQ ID NO: 59424 - DNA, 25 bp, Mus musculus
tctggccaatgacgacaatgaagaa

SEQ ID NO: 59425 - DNA, 25 bp, Mus musculus
tctggccaatgaggacaatgaagaa

SEQ ID NO: 59426 - DNA, 25 bp, Mus musculus
tctggccagcatgccaccaggaagt

SEQ ID NO: 59427 - DNA, 25 bp, Mus musculus
tctggccatcagcacaagcagaggc

SEQ ID NO: 59428 - DNA, 25 bp, Mus musculus
tctggccatggtttacagatattgt

SEQ ID NO: 59429 - DNA, 25 bp, Mus musculus
tctggccgggaacataatttcacac

SEQ ID NO: 59430 - DNA, 25 bp, Mus musculus
tctggcctcagatctggatcttttc

SEQ ID NO: 59431 - DNA, 25 bp, Mus musculus
tctggcctcccattgcatcccaggg

SEQ ID NO: 59432 - DNA, 25 bp, Mus musculus
tctggcctgggacagtgacaatgac

SEQ ID NO: 59433 - DNA, 25 bp, Mus musculus
tctggcctgtgttccctgcaatgtg

SEQ ID NO: 59434 - DNA, 25 bp, Mus musculus
tctggccttccggaggggtacatgt

SEQ ID NO: 59435 - DNA, 25 bp, Mus musculus
tctggccttgaaaatcgctgggcga

SEQ ID NO: 59436 - DNA, 25 bp, Mus musculus
tctggcctttaatcttcgtagaaag

SEQ ID NO: 59437 - DNA, 25 bp, Mus musculus
tctggcctttctgctctagatcaca

SEQ ID NO: 59438 - DNA, 25 bp, Mus musculus
tctggcgaaataggacagtcgacat

SEQ ID NO: 59439 - DNA, 25 bp, Mus musculus
tctggcgcaatgaccgagggaagac

SEQ ID NO: 59440 - DNA, 25 bp, Mus musculus
tctggcgcaatgtccgagggaagac

SEQ ID NO: 59441 - DNA, 25 bp, Mus musculus
tctggcgccagctctggagggtcat

SEQ ID NO: 59442 - DNA, 25 bp, Mus musculus
tctggcgcccatatgcaaaggcctt

SEQ ID NO: 59443 - DNA, 25 bp, Mus musculus
tctggcgcccatttgcaaaggcctt

SEQ ID NO: 59444 - DNA, 25 bp, Mus musculus
tctggcggcgactagccactgtgga

SEQ ID NO: 59445 - DNA, 25 bp, Mus musculus
tctggcggtggtacatcctcatgca

SEQ ID NO: 59446 - DNA, 25 bp, Mus musculus
tctggcgtcacgctacgagtgtgct

SEQ ID NO: 59447 - DNA, 25 bp, Mus musculus
tctggcgtgcaggtgtacaagcaca

SEQ ID NO: 59448 - DNA, 25 bp, Mus musculus
tctggctaagagaaaatggccagca

SEQ ID NO: 59449 - DNA, 25 bp, Mus musculus
tctggctagccaatacatgcactgt

SEQ ID NO: 59450 - DNA, 25 bp, Mus musculus
tctggctcagaggttgctggatgtc

SEQ ID NO: 59451 - DNA, 25 bp, Mus musculus
tctggctgaacagagaatcggtgcc

SEQ ID NO: 59452 - DNA, 25 bp, Mus musculus
tctggctgctttggtttctgatcta

SEQ ID NO: 59453 - DNA, 25 bp, Mus musculus
tctggctggcatcatgtacatcatt

SEQ ID NO: 59454 - DNA, 25 bp, Mus musculus
tctggctggctatgaggatggatca

SEQ ID NO: 59455 - DNA, 25 bp, Mus musculus
tctggctgttgcgtgccttcttcca

SEQ ID NO: 59456 - DNA, 25 bp, Mus musculus
tctggcttcctggatgtaagcacag

SEQ ID NO: 59457 - DNA, 25 bp, Mus musculus
tctggcttttcatcagaagcgtcta

SEQ ID NO: 59458 - DNA, 25 bp, Mus musculus
tctgggaaaaacaagctcgcaaagg

SEQ ID NO: 59459 - DNA, 25 bp, Mus musculus
tctgggaaaagacctcctgcaacaa

SEQ ID NO: 59460 - DNA, 25 bp, Mus musculus
tctgggaaactctcgaaggacattc

SEQ ID NO: 59461 - DNA, 25 bp, Mus musculus
tctgggaaagagtctgctccttgaa

SEQ ID NO: 59462 - DNA, 25 bp, Mus musculus
tctgggaaagctatacgtacaatgg

SEQ ID NO: 59463 - DNA, 25 bp, Mus musculus
tctgggaacatgaagagatggaatc

SEQ ID NO: 59464 - DNA, 25 bp, Mus musculus
tctgggaacatgtagagatggaatc

SEQ ID NO: 59465 - DNA, 25 bp, Mus musculus
tctgggaagagcagtcgaaatggtc

SEQ ID NO: 59466 - DNA, 25 bp, Mus musculus
tctgggaaggcctgactgttgatga

SEQ ID NO: 59467 - DNA, 25 bp, Mus musculus
tctgggaaggttgtgatctggaata

SEQ ID NO: 59468 - DNA, 25 bp, Mus musculus
tctgggaagtgatggaatctttctc

SEQ ID NO: 59469 - DNA, 25 bp, Mus musculus
tctgggaatgtcagcacctcaacag

SEQ ID NO: 59470 - DNA, 25 bp, Mus musculus
tctgggaattttcccttctccgcct

SEQ ID NO: 59471 - DNA, 25 bp, Mus musculus
tctgggacagtatgtgtaccctggt

SEQ ID NO: 59472 - DNA, 25 bp, Mus musculus
tctgggacatcaaggtggcggctat

SEQ ID NO: 59473 - DNA, 25 bp, Mus musculus
tctgggacccaactttatgttgtgg

SEQ ID NO: 59474 - DNA, 25 bp, Mus musculus
tctgggacctagaatgggatttgca

SEQ ID NO: 59475 - DNA, 25 bp, Mus musculus
tctgggacctctcaaagacctgcca

SEQ ID NO: 59476 - DNA, 25 bp, Mus musculus
tctgggactcctcgaactgacagca

SEQ ID NO: 59477 - DNA, 25 bp, Mus musculus
tctgggactctgttccagtcctgac

SEQ ID NO: 59478 - DNA, 25 bp, Mus musculus
tctgggactcttcgcttttggatta

SEQ ID NO: 59479 - DNA, 25 bp, Mus musculus
tctgggactgtctcaaagcacgtga

SEQ ID NO: 59480 - DNA, 25 bp, Mus musculus
tctgggagaagtagacctagttggc

SEQ ID NO: 59481 - DNA, 25 bp, Mus musculus
tctgggagataaaattgttaccaaa

SEQ ID NO: 59482 - DNA, 25 bp, Mus musculus
tctgggaggtcttgtatggcagcca

SEQ ID NO: 59483 - DNA, 25 bp, Mus musculus
tctgggagtcctgcacagtctagtt

SEQ ID NO: 59484 - DNA, 25 bp, Mus musculus
tctgggatcctacagctgctcatgc

SEQ ID NO: 59485 - DNA, 25 bp, Mus musculus
tctgggatgacctgaacaagtcctc

SEQ ID NO: 59486 - DNA, 25 bp, Mus musculus
tctgggatgcacagctccggtgtca

SEQ ID NO: 59487 - DNA, 25 bp, Mus musculus
tctgggatgtgaacaccgggaaact

SEQ ID NO: 59488 - DNA, 25 bp, Mus musculus
tctgggatgtttaggtccctaagct

SEQ ID NO: 59489 - DNA, 25 bp, Mus musculus
tctgggattcccttaaacatatgga

SEQ ID NO: 59490 - DNA, 25 bp, Mus musculus
tctgggatttccttctttgcctgtc

SEQ ID NO: 59491 - DNA, 25 bp, Mus musculus
tctgggatttcgtggacatgtcacc

SEQ ID NO: 59492 - DNA, 25 bp, Mus musculus
tctgggcaagacagatccgcaacca

SEQ ID NO: 59493 - DNA, 25 bp, Mus musculus
tctgggcaagactgatccgcaacca

SEQ ID NO: 59494 - DNA, 25 bp, Mus musculus
tctgggcaaggacctcttccacaga

SEQ ID NO: 59495 - DNA, 25 bp, Mus musculus
tctgggcacatgtctgtccgcagct

SEQ ID NO: 59496 - DNA, 25 bp, Mus musculus
tctgggcagaatgtcacgatggatg

SEQ ID NO: 59497 - DNA, 25 bp, Mus musculus
tctgggcatcatgggcggcaagccc

SEQ ID NO: 59498 - DNA, 25 bp, Mus musculus
tctgggccaaaaacaggcacttgaa

SEQ ID NO: 59499 - DNA, 25 bp, Mus musculus
tctgggccaactttgctcgaaatgg

SEQ ID NO: 59500 - DNA, 25 bp, Mus musculus
tctgggccatttacaacctggtgac

SEQ ID NO: 59501 - DNA, 25 bp, Mus musculus
tctgggccattttcaacctggtgac

SEQ ID NO: 59502 - DNA, 25 bp, Mus musculus
tctgggccccaaagaagccaagaag

SEQ ID NO: 59503 - DNA, 25 bp, Mus musculus
tctgggccttaaacttcccggtgag

SEQ ID NO: 59504 - DNA, 25 bp, Mus musculus
tctgggcctttctggacatctttcc

SEQ ID NO: 59505 - DNA, 25 bp, Mus musculus
tctgggcgcttcttcctactatgga

SEQ ID NO: 59506 - DNA, 25 bp, Mus musculus
tctgggctcagatagaattttatca

SEQ ID NO: 59507 - DNA, 25 bp, Mus musculus
tctgggctgagtccttctgttctga

SEQ ID NO: 59508 - DNA, 25 bp, Mus musculus
tctgggctgagtggagattatatct

SEQ ID NO: 59509 - DNA, 25 bp, Mus musculus
tctgggtaagaccaccctgacagcg

SEQ ID NO: 59510 - DNA, 25 bp, Mus musculus
tctgggtacctgagccaggacactg

SEQ ID NO: 59511 - DNA, 25 bp, Mus musculus
tctgggtagcccagtggccaaggcc

SEQ ID NO: 59512 - DNA, 25 bp, Mus musculus
tctgggtccgggaccccaggattca

SEQ ID NO: 59513 - DNA, 25 bp, Mus musculus
tctgggtcgcaacatcttcctggga

SEQ ID NO: 59514 - DNA, 25 bp, Mus musculus
tctgggtctccctcttatttctgcc

SEQ ID NO: 59515 - DNA, 25 bp, Mus musculus
tctgggtctggtgcgctgcctgcgc

SEQ ID NO: 59516 - DNA, 25 bp, Mus musculus
tctgggtcttgaaaggagtgtactc

SEQ ID NO: 59517 - DNA, 25 bp, Mus musculus
tctgggtctttctaaaaactgcttt

SEQ ID NO: 59518 - DNA, 25 bp, Mus musculus
tctgggtgaagatttaaagggcatt

SEQ ID NO: 59519 - DNA, 25 bp, Mus musculus
tctgggtgaatgagaaagcatctta

SEQ ID NO: 59520 - DNA, 25 bp, Mus musculus
tctgggtgcccattgagcagtgcct

SEQ ID NO: 59521 - DNA, 25 bp, Mus musculus
tctgggtgtccgtgctctgcaagaa

SEQ ID NO: 59522 - DNA, 25 bp, Mus musculus
tctgggttcaccaagaaggagtcta

SEQ ID NO: 59523 - DNA, 25 bp, Mus musculus
tctgggttccccagttccgagccga

SEQ ID NO: 59524 - DNA, 25 bp, Mus musculus
tctgggtttccttgggctctgcatc

SEQ ID NO: 59525 - DNA, 25 bp, Mus musculus
tctggtaaatgagttagcccgtttc

SEQ ID NO: 59526 - DNA, 25 bp, Mus musculus
tctggtaccccaagtttaatttcag

SEQ ID NO: 59527 - DNA, 25 bp, Mus musculus
tctggtacgacatcatcggccctct

SEQ ID NO: 59528 - DNA, 25 bp, Mus musculus
tctggtacgtgcgtttcctgtggga

SEQ ID NO: 59529 - DNA, 25 bp, Mus musculus
tctggtagcccagggtcgggcgagg

SEQ ID NO: 59530 - DNA, 25 bp, Mus musculus
tctggtagtgctgaagatgggttct

SEQ ID NO: 59531 - DNA, 25 bp, Mus musculus
tctggtcaaatctaccttagctaag

SEQ ID NO: 59532 - DNA, 25 bp, Mus musculus
tctggtcacctttgaggaccccaaa

SEQ ID NO: 59533 - DNA, 25 bp, Mus musculus
tctggtccaaacaaggcctgaaggg

SEQ ID NO: 59534 - DNA, 25 bp, Mus musculus
tctggtccactcaaggaggagtatg

SEQ ID NO: 59535 - DNA, 25 bp, Mus musculus
tctggtccatcattggcctttcagg

SEQ ID NO: 59536 - DNA, 25 bp, Mus musculus
tctggtcctcagaaaagccaaggga

SEQ ID NO: 59537 - DNA, 25 bp, Mus musculus
tctggtcgcacttgtttgctggtgc

SEQ ID NO: 59538 - DNA, 25 bp, Mus musculus
tctggtctcctggactgtgaccgag

SEQ ID NO: 59539 - DNA, 25 bp, Mus musculus
tctggtctgcatagtgtcacttatc

SEQ ID NO: 59540 - DNA, 25 bp, Mus musculus
tctggtcttgagattggcgttttag

SEQ ID NO: 59541 - DNA, 25 bp, Mus musculus
tctggtgagcactggagccatcatg

SEQ ID NO: 59542 - DNA, 25 bp, Mus musculus
tctggtgaggtgacactggaagaca

SEQ ID NO: 59543 - DNA, 25 bp, Mus musculus
tctggtgcaataactcccagcttcc

SEQ ID NO: 59544 - DNA, 25 bp, Mus musculus
tctggtgccaacagagactgttacc

SEQ ID NO: 59545 - DNA, 25 bp, Mus musculus
tctggtggaaatgggtaatctccga

SEQ ID NO: 59546 - DNA, 25 bp, Mus musculus
tctggtggaacttatatgctagtga

SEQ ID NO: 59547 - DNA, 25 bp, Mus musculus
tctggtggagtttgtaatagctgcc

SEQ ID NO: 59548 - DNA, 25 bp, Mus musculus
tctggtggccctccagacaggaaca

SEQ ID NO: 59549 - DNA, 25 bp, Mus musculus
tctggtggttgaaaaggacactcgc

SEQ ID NO: 59550 - DNA, 25 bp, Mus musculus
tctggtgtatcaccttccctgcttc

SEQ ID NO: 59551 - DNA, 25 bp, Mus musculus
tctggtgtatcagcttccctgcttc

SEQ ID NO: 59552 - DNA, 25 bp, Mus musculus
tctggtgtcattaacggaccttcta

SEQ ID NO: 59553 - DNA, 25 bp, Mus musculus
tctggtgtccactgttttgtttggg

SEQ ID NO: 59554 - DNA, 25 bp, Mus musculus
tctggtgtctgtactcggagctgag

SEQ ID NO: 59555 - DNA, 25 bp, Mus musculus
tctggtgtgcagtactcggctgccc

SEQ ID NO: 59556 - DNA, 25 bp, Mus musculus
tctggttaaggcagtgtcactgtgc

SEQ ID NO: 59557 - DNA, 25 bp, Mus musculus
tctggttcaaaccaagacaattaaa

SEQ ID NO: 59558 - DNA, 25 bp, Mus musculus
tctggttcagaatctacttacatcc

SEQ ID NO: 59559 - DNA, 25 bp, Mus musculus
tctggttcagatggcaaagatgatc

SEQ ID NO: 59560 - DNA, 25 bp, Mus musculus
tctggttcaggtccctccaggactc

SEQ ID NO: 59561 - DNA, 25 bp, Mus musculus
tctggttgacccaagattccagcct

SEQ ID NO: 59562 - DNA, 25 bp, Mus musculus
tctggttgatgcctccagggctatg

SEQ ID NO: 59563 - DNA, 25 bp, Mus musculus
tctggttgcagcaagatgacaagca

SEQ ID NO: 59564 - DNA, 25 bp, Mus musculus
tctggttgcggtagtaaatggccca

SEQ ID NO: 59565 - DNA, 25 bp, Mus musculus
tctggtttaaagcaagcgtttgcag

SEQ ID NO: 59566 - DNA, 25 bp, Mus musculus
tctggtttaaccatgagcactgttg

SEQ ID NO: 59567 - DNA, 25 bp, Mus musculus
tctggtttcagacggagtgttgaac

SEQ ID NO: 59568 - DNA, 25 bp, Mus musculus
tctggtttccaggtgacagacacga

SEQ ID NO: 59569 - DNA, 25 bp, Mus musculus
tctggtttcttgacatgattatgga

SEQ ID NO: 59570 - DNA, 25 bp, Mus musculus
tctggtttgatctctgatgacatca

SEQ ID NO: 59571 - DNA, 25 bp, Mus musculus
tctgtaaaaatgaccctgagggaat

SEQ ID NO: 59572 - DNA, 25 bp, Mus musculus
tctgtaatctgaagcctgcaaagat

SEQ ID NO: 59573 - DNA, 25 bp, Mus musculus
tctgtaatttccaaacgctgaacca

SEQ ID NO: 59574 - DNA, 25 bp, Mus musculus
tctgtacaagagatacccctcactc

SEQ ID NO: 59575 - DNA, 25 bp, Mus musculus
tctgtaccgttgaggtgaccagccc

SEQ ID NO: 59576 - DNA, 25 bp, Mus musculus
tctgtaccgttgtggtgaccagccc

SEQ ID NO: 59577 - DNA, 25 bp, Mus musculus
tctgtactgcccagttcggtgatgg

SEQ ID NO: 59578 - DNA, 25 bp, Mus musculus
tctgtacttggagaccactgtgagg

SEQ ID NO: 59579 - DNA, 25 bp, Mus musculus
tctgtagcaggcttcactcggttcc

SEQ ID NO: 59580 - DNA, 25 bp, Mus musculus
tctgtagctgagagcacatcgctaa

SEQ ID NO: 59581 - DNA, 25 bp, Mus musculus
tctgtagctggatcaggcactggaa

SEQ ID NO: 59582 - DNA, 25 bp, Mus musculus
tctgtaggcctttctgtccagcgct

SEQ ID NO: 59583 - DNA, 25 bp, Mus musculus
tctgtagttggagtggcaagatccc

SEQ ID NO: 59584 - DNA, 25 bp, Mus musculus
tctgtagttttggaggaacaactca

SEQ ID NO: 59585 - DNA, 25 bp, Mus musculus
tctgtataaatggacacaccaccta

SEQ ID NO: 59586 - DNA, 25 bp, Mus musculus
tctgtatactctgtgtgagcctggc

SEQ ID NO: 59587 - DNA, 25 bp, Mus musculus
tctgtatcctggagattgttgtgtc

SEQ ID NO: 59588 - DNA, 25 bp, Mus musculus
tctgtatctcaaatgccccgtggag

SEQ ID NO: 59589 - DNA, 25 bp, Mus musculus
tctgtatctcagaaacttcaaagtg

SEQ ID NO: 59590 - DNA, 25 bp, Mus musculus
tctgtatgaagcagcacaagaagct

SEQ ID NO: 59591 - DNA, 25 bp, Mus musculus
tctgtatgcacggtctctgggcgct

SEQ ID NO: 59592 - DNA, 25 bp, Mus musculus
tctgtatggagaaaagcggctgtag

SEQ ID NO: 59593 - DNA, 25 bp, Mus musculus
tctgtatgttcagcaaagagagctt

SEQ ID NO: 59594 - DNA, 25 bp, Mus musculus
tctgtatgttgggaagtattccacc

SEQ ID NO: 59595 - DNA, 25 bp, Mus musculus
tctgtattgaaaagaatgccccagg

SEQ ID NO: 59596 - DNA, 25 bp, Mus musculus
tctgtcaaactacttgaaagaatgt

SEQ ID NO: 59597 - DNA, 25 bp, Mus musculus
tctgtcaaagggtgaaacaaagttc

SEQ ID NO: 59598 - DNA, 25 bp, Mus musculus
tctgtcaacgtcaaccgcagcgtgt

SEQ ID NO: 59599 - DNA, 25 bp, Mus musculus
tctgtcaaggaacaccttaaacagg

SEQ ID NO: 59600 - DNA, 25 bp, Mus musculus
tctgtcactgaagccagtcaatcag

SEQ ID NO: 59601 - DNA, 25 bp, Mus musculus
tctgtcagaaacgatggcagccctg

SEQ ID NO: 59602 - DNA, 25 bp, Mus musculus
tctgtcagcagcacttaatttggaa

SEQ ID NO: 59603 - DNA, 25 bp, Mus musculus
tctgtcaggatacaaatcaggttct

SEQ ID NO: 59604 - DNA, 25 bp, Mus musculus
tctgtcaggcatcacaagcatggcc

SEQ ID NO: 59605 - DNA, 25 bp, Mus musculus
tctgtcatgagaaataagctgaaac

SEQ ID NO: 59606 - DNA, 25 bp, Mus musculus
tctgtcattcagcacaattctttag

SEQ ID NO: 59607 - DNA, 25 bp, Mus musculus
tctgtccaagaccaacacgatgggc

SEQ ID NO: 59608 - DNA, 25 bp, Mus musculus
tctgtccacctcatcatagcaaggc

SEQ ID NO: 59609 - DNA, 25 bp, Mus musculus
tctgtccactcacagaagctctctt

SEQ ID NO: 59610 - DNA, 25 bp, Mus musculus
tctgtccagattgcagagaaggtct

SEQ ID NO: 59611 - DNA, 25 bp, Mus musculus
tctgtccagcttcatcaagcatgtc

SEQ ID NO: 59612 - DNA, 25 bp, Mus musculus
tctgtccccaggattatacatgctg

SEQ ID NO: 59613 - DNA, 25 bp, Mus musculus
tctgtccccaggtttatacatgctg

SEQ ID NO: 59614 - DNA, 25 bp, Mus musculus
tctgtccccgggtttatcacgctaa

SEQ ID NO: 59615 - DNA, 25 bp, Mus musculus
tctgtcccgatagatgtttcccact

SEQ ID NO: 59616 - DNA, 25 bp, Mus musculus
tctgtccgaatctccccttttggga

SEQ ID NO: 59617 - DNA, 25 bp, Mus musculus
tctgtccgctgcagggtcttgaaaa

SEQ ID NO: 59618 - DNA, 25 bp, Mus musculus
tctgtccgtagcctgctgaggcatt

SEQ ID NO: 59619 - DNA, 25 bp, Mus musculus
tctgtcctctccagcggtggctctt

SEQ ID NO: 59620 - DNA, 25 bp, Mus musculus
tctgtcctctggcattcctctttgc

SEQ ID NO: 59621 - DNA, 25 bp, Mus musculus
tctgtcctctgggattcctctttgc

SEQ ID NO: 59622 - DNA, 25 bp, Mus musculus
tctgtcctgactggaatctgctgtg

SEQ ID NO: 59623 - DNA, 25 bp, Mus musculus
tctgtcctgccccacatttgaagtc

SEQ ID NO: 59624 - DNA, 25 bp, Mus musculus
tctgtcgagggttttgaaatggtta

SEQ ID NO: 59625 - DNA, 25 bp, Mus musculus
tctgtcgccatctacatagctttct

SEQ ID NO: 59626 - DNA, 25 bp, Mus musculus
tctgtcgggtgctgaggtctctcaa

SEQ ID NO: 59627 - DNA, 25 bp, Mus musculus
tctgtctaaacaccaggtgttggct

SEQ ID NO: 59628 - DNA, 25 bp, Mus musculus
tctgtctacctccagcccaggaata

SEQ ID NO: 59629 - DNA, 25 bp, Mus musculus
tctgtctcggacactgggcctagat

SEQ ID NO: 59630 - DNA, 25 bp, Mus musculus
tctgtctctacacatcattctctgt

SEQ ID NO: 59631 - DNA, 25 bp, Mus musculus
tctgtctctctaggcgcatatttga

SEQ ID NO: 59632 - DNA, 25 bp, Mus musculus
tctgtctctgtgtattggcaggttc

SEQ ID NO: 59633 - DNA, 25 bp, Mus musculus
tctgtctctgttaatgattgctcca

SEQ ID NO: 59634 - DNA, 25 bp, Mus musculus
tctgtctgaggaagcagagccacga

SEQ ID NO: 59635 - DNA, 25 bp, Mus musculus
tctgtctgaggtacacaaaggagga

SEQ ID NO: 59636 - DNA, 25 bp, Mus musculus
tctgtctgatgagagtagcctggag

SEQ ID NO: 59637 - DNA, 25 bp, Mus musculus
tctgtctgcggtgatcatgctgtgt

SEQ ID NO: 59638 - DNA, 25 bp, Mus musculus
tctgtctggcaagagaacccttctg

SEQ ID NO: 59639 - DNA, 25 bp, Mus musculus
tctgtctgggcatcatgggcggcaa

SEQ ID NO: 59640 - DNA, 25 bp, Mus musculus
tctgtctggtgagctagagtcagcg

SEQ ID NO: 59641 - DNA, 25 bp, Mus musculus
tctgtctgtcccatgtggtcacagc

SEQ ID NO: 59642 - DNA, 25 bp, Mus musculus
tctgtcttccctgaggagcgtgagg

SEQ ID NO: 59643 - DNA, 25 bp, Mus musculus
tctgtcttctggtgtcattaacgga

SEQ ID NO: 59644 - DNA, 25 bp, Mus musculus
tctgtctttcagagtctggtcgcac

SEQ ID NO: 59645 - DNA, 25 bp, Mus musculus
tctgtgaactcgtctgctctcaggc

SEQ ID NO: 59646 - DNA, 25 bp, Mus musculus
tctgtgaacttgctcaggacaagga

SEQ ID NO: 59647 - DNA, 25 bp, Mus musculus
tctgtgaagctcgttaactttcagc

SEQ ID NO: 59648 - DNA, 25 bp, Mus musculus
tctgtgaagtcaaactcctccttca

SEQ ID NO: 59649 - DNA, 25 bp, Mus musculus
tctgtgacaacacggacggctcctt

SEQ ID NO: 59650 - DNA, 25 bp, Mus musculus
tctgtgacaacagggacggctcctt

SEQ ID NO: 59651 - DNA, 25 bp, Mus musculus
tctgtgagaagaacaatggcggctg

SEQ ID NO: 59652 - DNA, 25 bp, Mus musculus
tctgtgagaggatttttcatcaaac

SEQ ID NO: 59653 - DNA, 25 bp, Mus musculus
tctgtgaggattttagtacaagtca

SEQ ID NO: 59654 - DNA, 25 bp, Mus musculus
tctgtgaggccgagaacatccttgg

SEQ ID NO: 59655 - DNA, 25 bp, Mus musculus
tctgtgaggtgccaagagcttgccc

SEQ ID NO: 59656 - DNA, 25 bp, Mus musculus
tctgtgatacattactaagagatgc

SEQ ID NO: 59657 - DNA, 25 bp, Mus musculus
tctgtgatagccaagtacccacaca

SEQ ID NO: 59658 - DNA, 25 bp, Mus musculus
tctgtgatattcaaaagggtacttc

SEQ ID NO: 59659 - DNA, 25 bp, Mus musculus
tctgtgatcactctcttcagaaaat

SEQ ID NO: 59660 - DNA, 25 bp, Mus musculus
tctgtgatgacattgaatggatgac

SEQ ID NO: 59661 - DNA, 25 bp, Mus musculus
tctgtgatggacacgctgctggcca

SEQ ID NO: 59662 - DNA, 25 bp, Mus musculus
tctgtgatggtgtcaacttggctgg

SEQ ID NO: 59663 - DNA, 25 bp, Mus musculus
tctgtgatgtcaagctccgagggca

SEQ ID NO: 59664 - DNA, 25 bp, Mus musculus
tctgtgcaaccattctctgaggatg

SEQ ID NO: 59665 - DNA, 25 bp, Mus musculus
tctgtgcactgtgtaggcctgttgc

SEQ ID NO: 59666 - DNA, 25 bp, Mus musculus
tctgtgcagcagagaagacaatacc

SEQ ID NO: 59667 - DNA, 25 bp, Mus musculus
tctgtgcagggacactacgttcaac

SEQ ID NO: 59668 - DNA, 25 bp, Mus musculus
tctgtgccaaccacgtgctgaaggg

SEQ ID NO: 59669 - DNA, 25 bp, Mus musculus
tctgtgccacaggaaatcaaagcgt

SEQ ID NO: 59670 - DNA, 25 bp, Mus musculus
tctgtgccggatacaatgccagcag

SEQ ID NO: 59671 - DNA, 25 bp, Mus musculus
tctgtgccggattcaatgccagcag

SEQ ID NO: 59672 - DNA, 25 bp, Mus musculus
tctgtgcctatcatcatgggcgtca

SEQ ID NO: 59673 - DNA, 25 bp, Mus musculus
tctgtgcctgaactgcaccgtggag

SEQ ID NO: 59674 - DNA, 25 bp, Mus musculus
tctgtgcctgatatcagacgctgcc

SEQ ID NO: 59675 - DNA, 25 bp, Mus musculus
tctgtgcgacgcagtgtgctaccac

SEQ ID NO: 59676 - DNA, 25 bp, Mus musculus
tctgtgcgacgctgtgtgctaccac

SEQ ID NO: 59677 - DNA, 25 bp, Mus musculus
tctgtgcgagaagtatttgcccggc

SEQ ID NO: 59678 - DNA, 25 bp, Mus musculus
tctgtgcggcagatcattttctcct

SEQ ID NO: 59679 - DNA, 25 bp, Mus musculus
tctgtgctcatgttgaatcgcagcc

SEQ ID NO: 59680 - DNA, 25 bp, Mus musculus
tctgtgctcctacgtgaaacctgag

SEQ ID NO: 59681 - DNA, 25 bp, Mus musculus
tctgtgctctcctgcggctctctgg

SEQ ID NO: 59682 - DNA, 25 bp, Mus musculus
tctgtgctggatttgagaattgaga

SEQ ID NO: 59683 - DNA, 25 bp, Mus musculus
tctgtgctggctattagcaattcct

SEQ ID NO: 59684 - DNA, 25 bp, Mus musculus
tctgtgctggcttttagcaattcct

SEQ ID NO: 59685 - DNA, 25 bp, Mus musculus
tctgtgctggtctgccctgatggga

SEQ ID NO: 59686 - DNA, 25 bp, Mus musculus
tctgtgctgtctaaagttctatctc

SEQ ID NO: 59687 - DNA, 25 bp, Mus musculus
tctgtgcttcatcgaattgccaatg

SEQ ID NO: 59688 - DNA, 25 bp, Mus musculus
tctgtgcttcatggaattgccaatg

SEQ ID NO: 59689 - DNA, 25 bp, Mus musculus
tctgtgcttggaggctgttgcttgt

SEQ ID NO: 59690 - DNA, 25 bp, Mus musculus
tctgtgcttggcaccgtcggtcggt

SEQ ID NO: 59691 - DNA, 25 bp, Mus musculus
tctgtgcttggctccgtcggtcggt

SEQ ID NO: 59692 - DNA, 25 bp, Mus musculus
tctgtggaactaaaaatccaactcc

SEQ ID NO: 59693 - DNA, 25 bp, Mus musculus
tctgtggacaaagaaagtcacctac

SEQ ID NO: 59694 - DNA, 25 bp, Mus musculus
tctgtggacacactacagtattgct

SEQ ID NO: 59695 - DNA, 25 bp, Mus musculus
tctgtggagccctattgtgccgaca

SEQ ID NO: 59696 - DNA, 25 bp, Mus musculus
tctgtggagctcacgaacccaattt

SEQ ID NO: 59697 - DNA, 25 bp, Mus musculus
tctgtggataagctggaacagatct

SEQ ID NO: 59698 - DNA, 25 bp, Mus musculus
tctgtggatggcaataaggaagatc

SEQ ID NO: 59699 - DNA, 25 bp, Mus musculus
tctgtggcaagaataccaaagggct

SEQ ID NO: 59700 - DNA, 25 bp, Mus musculus
tctgtggcacaccagagtacctggc

SEQ ID NO: 59701 - DNA, 25 bp, Mus musculus
tctgtggccagtgaagctggctttg

SEQ ID NO: 59702 - DNA, 25 bp, Mus musculus
tctgtggcctggatccctcatctac

SEQ ID NO: 59703 - DNA, 25 bp, Mus musculus
tctgtggcgcaaatggagtttagga

SEQ ID NO: 59704 - DNA, 25 bp, Mus musculus
tctgtggcttatgaagtctgtctac

SEQ ID NO: 59705 - DNA, 25 bp, Mus musculus
tctgtggcttccctgggactaagtc

SEQ ID NO: 59706 - DNA, 25 bp, Mus musculus
tctgtggcttccgatgagatggaaa

SEQ ID NO: 59707 - DNA, 25 bp, Mus musculus
tctgtgggaagctacagctgtacct

SEQ ID NO: 59708 - DNA, 25 bp, Mus musculus
tctgtgggagcccagatatcccact

SEQ ID NO: 59709 - DNA, 25 bp, Mus musculus
tctgtgggcaagcactattgttgca

SEQ ID NO: 59710 - DNA, 25 bp, Mus musculus
tctgtgggcccagtccctggagctg

SEQ ID NO: 59711 - DNA, 25 bp, Mus musculus
tctgtggtctgctggagctacctcc

SEQ ID NO: 59712 - DNA, 25 bp, Mus musculus
tctgtggtctggttcatcttggtcc

SEQ ID NO: 59713 - DNA, 25 bp, Mus musculus
tctgtggtggacctggagacccttc

SEQ ID NO: 59714 - DNA, 25 bp, Mus musculus
tctgtggttctctggtcagcaagtt

SEQ ID NO: 59715 - DNA, 25 bp, Mus musculus
tctgtgtaagaactgtcatcatgta

SEQ ID NO: 59716 - DNA, 25 bp, Mus musculus
tctgtgtaccgaggagtgcatgcac

SEQ ID NO: 59717 - DNA, 25 bp, Mus musculus
tctgtgtacgagctggactacggca

SEQ ID NO: 59718 - DNA, 25 bp, Mus musculus
tctgtgtatgccttgcgtgcctgag

SEQ ID NO: 59719 - DNA, 25 bp, Mus musculus
tctgtgtattgctttctgactgtgt

SEQ ID NO: 59720 - DNA, 25 bp, Mus musculus
tctgtgtattggcaggttctcgata

SEQ ID NO: 59721 - DNA, 25 bp, Mus musculus
tctgtgtccacatggaggactcatg

SEQ ID NO: 59722 - DNA, 25 bp, Mus musculus
tctgtgtccccaagaactgtctctc

SEQ ID NO: 59723 - DNA, 25 bp, Mus musculus
tctgtgtccccatgaactgtctctc

SEQ ID NO: 59724 - DNA, 25 bp, Mus musculus
tctgtgtcccgtgtcggatctgctg

SEQ ID NO: 59725 - DNA, 25 bp, Mus musculus
tctgtgtctccaggaagaacctccg

SEQ ID NO: 59726 - DNA, 25 bp, Mus musculus
tctgtgtcttacatgataagcatca

SEQ ID NO: 59727 - DNA, 25 bp, Mus musculus
tctgtgtcttacttgataagcatca

SEQ ID NO: 59728 - DNA, 25 bp, Mus musculus
tctgtgtcttctgtagtattaccag

SEQ ID NO: 59729 - DNA, 25 bp, Mus musculus
tctgtgtgaagaggactaaggatta

SEQ ID NO: 59730 - DNA, 25 bp, Mus musculus
tctgtgtgctcatcccgaagtgacc

SEQ ID NO: 59731 - DNA, 25 bp, Mus musculus
tctgtgtgctctagagcccgggccc

SEQ ID NO: 59732 - DNA, 25 bp, Mus musculus
tctgtgttacaaaacaactactgct

SEQ ID NO: 59733 - DNA, 25 bp, Mus musculus
tctgtgttagcgttcctcagctcct

SEQ ID NO: 59734 - DNA, 25 bp, Mus musculus
tctgtgttctaccacctgggtgtca

SEQ ID NO: 59735 - DNA, 25 bp, Mus musculus
tctgtgttggcttcttcagatggcg

SEQ ID NO: 59736 - DNA, 25 bp, Mus musculus
tctgtgtttcacgttcaagcctgtg

SEQ ID NO: 59737 - DNA, 25 bp, Mus musculus
tctgtgtttggaaataaatctacga

SEQ ID NO: 59738 - DNA, 25 bp, Mus musculus
tctgttaacaacgtgcttccggtct

SEQ ID NO: 59739 - DNA, 25 bp, Mus musculus
tctgttacaagctgtgaatcagaaa

SEQ ID NO: 59740 - DNA, 25 bp, Mus musculus
tctgttacgaatgtgttggtgagcc

SEQ ID NO: 59741 - DNA, 25 bp, Mus musculus
tctgttagagtctgcgcggaaaccc

SEQ ID NO: 59742 - DNA, 25 bp, Mus musculus
tctgttatagcaggggccccgtgca

SEQ ID NO: 59743 - DNA, 25 bp, Mus musculus
tctgttatggacgtcatatccagca

SEQ ID NO: 59744 - DNA, 25 bp, Mus musculus
tctgttcaacaagtgggaccccagg

SEQ ID NO: 59745 - DNA, 25 bp, Mus musculus
tctgttcaagttgcaaaccacaagc

SEQ ID NO: 59746 - DNA, 25 bp, Mus musculus
tctgttcggatcaaggtgaaaggga

SEQ ID NO: 59747 - DNA, 25 bp, Mus musculus
tctgttctcctacgccgctgctgtg

SEQ ID NO: 59748 - DNA, 25 bp, Mus musculus
tctgttctgagaggtcaaccttttc

SEQ ID NO: 59749 - DNA, 25 bp, Mus musculus
tctgttgagccgtttgtgagataaa

SEQ ID NO: 59750 - DNA, 25 bp, Mus musculus
tctgttgatgccatttagagtggaa

SEQ ID NO: 59751 - DNA, 25 bp, Mus musculus
tctgttgatggacttctcagttggc

SEQ ID NO: 59752 - DNA, 25 bp, Mus musculus
tctgttgcagggaatggaacaatta

SEQ ID NO: 59753 - DNA, 25 bp, Mus musculus
tctgttgcccctcttgtcatagatc

SEQ ID NO: 59754 - DNA, 25 bp, Mus musculus
tctgttggaacagaggatgacaact

SEQ ID NO: 59755 - DNA, 25 bp, Mus musculus
tctgttgggaaaactgcaattttgg

SEQ ID NO: 59756 - DNA, 25 bp, Mus musculus
tctgttgggagttttcactttcaga

SEQ ID NO: 59757 - DNA, 25 bp, Mus musculus
tctgttggtatagaggagtaagctg

SEQ ID NO: 59758 - DNA, 25 bp, Mus musculus
tctgttgtgcatccgttgctgcagc

SEQ ID NO: 59759 - DNA, 25 bp, Mus musculus
tctgtttaccagagggtcagccttc

SEQ ID NO: 59760 - DNA, 25 bp, Mus musculus
tctgtttatcggcattcttttgaca

SEQ ID NO: 59761 - DNA, 25 bp, Mus musculus
tctgtttcacaaattcagtctcaaa

SEQ ID NO: 59762 - DNA, 25 bp, Mus musculus
tctgtttcatttgctggccaccagg

SEQ ID NO: 59763 - DNA, 25 bp, Mus musculus
tctgtttccggatttaacactcaca

SEQ ID NO: 59764 - DNA, 25 bp, Mus musculus
tctgtttgatgtggtggttatcctc

SEQ ID NO: 59765 - DNA, 25 bp, Mus musculus
tctgttttaatgacacctgtatcag

SEQ ID NO: 59766 - DNA, 25 bp, Mus musculus
tctgttttctactgcagtggacact

SEQ ID NO: 59767 - DNA, 25 bp, Mus musculus
tctgttttggccatgaccatgagtg

SEQ ID NO: 59768 - DNA, 25 bp, Mus musculus
tctgttttgtaatgtcagccaacgc

SEQ ID NO: 59769 - DNA, 25 bp, Mus musculus
tctgtttttatggagtgcctggagg

SEQ ID NO: 59770 - DNA, 25 bp, Mus musculus
tcttaaaaacattgattcagggaca

SEQ ID NO: 59771 - DNA, 25 bp, Mus musculus
tcttaaaacataatgggtgaagacg

SEQ ID NO: 59772 - DNA, 25 bp, Mus musculus
tcttaaagacctcggatgttaggat

SEQ ID NO: 59773 - DNA, 25 bp, Mus musculus
tcttaaagccaggtctccttccatg

SEQ ID NO: 59774 - DNA, 25 bp, Mus musculus
tcttaaagtgcccacgttctcctgt

SEQ ID NO: 59775 - DNA, 25 bp, Mus musculus
tcttaacacaagactcttgagatgg

SEQ ID NO: 59776 - DNA, 25 bp, Mus musculus
tcttaaccagcaataacttacagag

SEQ ID NO: 59777 - DNA, 25 bp, Mus musculus
tcttaacccagctccaggagcttgg

SEQ ID NO: 59778 - DNA, 25 bp, Mus musculus
tcttaactagatcagagccactggc

SEQ ID NO: 59779 - DNA, 25 bp, Mus musculus
tcttaactagcctgctacacttctc

SEQ ID NO: 59780 - DNA, 25 bp, Mus musculus
tcttaacttcttccaaggttaccag

SEQ ID NO: 59781 - DNA, 25 bp, Mus musculus
tcttaagaagttcaggagaatctca

SEQ ID NO: 59782 - DNA, 25 bp, Mus musculus
tcttaagcatcgtggcgctggttgg

SEQ ID NO: 59783 - DNA, 25 bp, Mus musculus
tcttaagctcactcatgtggttctg

SEQ ID NO: 59784 - DNA, 25 bp, Mus musculus
tcttaaggagacgaaagagagagtg

SEQ ID NO: 59785 - DNA, 25 bp, Mus musculus
tcttaaggcacaaacaaagaccctc

SEQ ID NO: 59786 - DNA, 25 bp, Mus musculus
tcttaagggcattatctactacaag

SEQ ID NO: 59787 - DNA, 25 bp, Mus musculus
tcttaataatgggtttccaacagcc

SEQ ID NO: 59788 - DNA, 25 bp, Mus musculus
tcttaatcactcaacttctgtcatg

SEQ ID NO: 59789 - DNA, 25 bp, Mus musculus
tcttaatcagcctttggatgcacga

SEQ ID NO: 59790 - DNA, 25 bp, Mus musculus
tcttaatgctagatgagaagcgcgt

SEQ ID NO: 59791 - DNA, 25 bp, Mus musculus
tcttacatatggcagggatcgtagg

SEQ ID NO: 59792 - DNA, 25 bp, Mus musculus
tcttaccaagggtcccaagtcggag

SEQ ID NO: 59793 - DNA, 25 bp, Mus musculus
tcttaccacctgtggtggacaccac

SEQ ID NO: 59794 - DNA, 25 bp, Mus musculus
tcttacccatggaatcttctctggg

SEQ ID NO: 59795 - DNA, 25 bp, Mus musculus
tcttaccgcccctcctatgaagaga

SEQ ID NO: 59796 - DNA, 25 bp, Mus musculus
tcttaccgggagatggagcatttga

SEQ ID NO: 59797 - DNA, 25 bp, Mus musculus
tcttacctgtgcttcagcccagcat

SEQ ID NO: 59798 - DNA, 25 bp, Mus musculus
tcttacgaccgcagtctctccgggc

SEQ ID NO: 59799 - DNA, 25 bp, Mus musculus
tcttacgaccgctgtctctccgggc

SEQ ID NO: 59800 - DNA, 25 bp, Mus musculus
tcttacgagccgcttggatactacc

SEQ ID NO: 59801 - DNA, 25 bp, Mus musculus
tcttacggcctatcatagcctctta

SEQ ID NO: 59802 - DNA, 25 bp, Mus musculus
tcttactcagatccccatctttgca

SEQ ID NO: 59803 - DNA, 25 bp, Mus musculus
tcttactgaacttcgcaggctgcgc

SEQ ID NO: 59804 - DNA, 25 bp, Mus musculus
tcttactgcacttgtgtgaacaaag

SEQ ID NO: 59805 - DNA, 25 bp, Mus musculus
tcttactgtcggagcagcggtcctg

SEQ ID NO: 59806 - DNA, 25 bp, Mus musculus
tcttactgtgtatctctggttgacc

SEQ ID NO: 59807 - DNA, 25 bp, Mus musculus
tcttactgttgaaagactaaaagca

SEQ ID NO: 59808 - DNA, 25 bp, Mus musculus
tcttagaaagtgagctcgatgaaaa

SEQ ID NO: 59809 - DNA, 25 bp, Mus musculus
tcttagaacctttggtgctcagagg

SEQ ID NO: 59810 - DNA, 25 bp, Mus musculus
tcttagaactcacacagaaatcagg

SEQ ID NO: 59811 - DNA, 25 bp, Mus musculus
tcttagaagaggatgcagctgggaa

SEQ ID NO: 59812 - DNA, 25 bp, Mus musculus
tcttagacggaagcctgggctttgc

SEQ ID NO: 59813 - DNA, 25 bp, Mus musculus
tcttagagaaaacagacatggcagg

SEQ ID NO: 59814 - DNA, 25 bp, Mus musculus
tcttagagaaaagagacatggcagg

SEQ ID NO: 59815 - DNA, 25 bp, Mus musculus
tcttagataccttcacgaaaacaga

SEQ ID NO: 59816 - DNA, 25 bp, Mus musculus
tcttagcagctcctctggcatgacg

SEQ ID NO: 59817 - DNA, 25 bp, Mus musculus
tcttagccaacagttctgatccaga

SEQ ID NO: 59818 - DNA, 25 bp, Mus musculus
tcttagccgtttgtggaaagctcgg

SEQ ID NO: 59819 - DNA, 25 bp, Mus musculus
tcttagcctggctgtataatgaaag

SEQ ID NO: 59820 - DNA, 25 bp, Mus musculus
tcttagcgcccgactctgtgaacat

SEQ ID NO: 59821 - DNA, 25 bp, Mus musculus
tcttagctgaatggaagaaaaaggc

SEQ ID NO: 59822 - DNA, 25 bp, Mus musculus
tcttagctgcaaagccatcccgagg

SEQ ID NO: 59823 - DNA, 25 bp, Mus musculus
tcttagctgcaatgccatcccgagg

SEQ ID NO: 59824 - DNA, 25 bp, Mus musculus
tcttagctgctggatatttcatttg

SEQ ID NO: 59825 - DNA, 25 bp, Mus musculus
tcttagctggaagcaccaggccggg

SEQ ID NO: 59826 - DNA, 25 bp, Mus musculus
tcttagggatcaatcaaaaacgtgt

SEQ ID NO: 59827 - DNA, 25 bp, Mus musculus
tcttagtgacataaacatcgcgtcc

SEQ ID NO: 59828 - DNA, 25 bp, Mus musculus
tcttagttccagaactgagtcttcc

SEQ ID NO: 59829 - DNA, 25 bp, Mus musculus
tcttataccccaagtacccgagagg

SEQ ID NO: 59830 - DNA, 25 bp, Mus musculus
tcttatagacaagtttgaacatcca

SEQ ID NO: 59831 - DNA, 25 bp, Mus musculus
tcttatatcgactatgagatctgca

SEQ ID NO: 59832 - DNA, 25 bp, Mus musculus
tcttatcctgtagatatccctggct

SEQ ID NO: 59833 - DNA, 25 bp, Mus musculus
tcttatctcctctgggcaaggacct

SEQ ID NO: 59834 - DNA, 25 bp, Mus musculus
tcttatcttcattgtactggagaca

SEQ ID NO: 59835 - DNA, 25 bp, Mus musculus
tcttatggaagagtctgttgggagt

SEQ ID NO: 59836 - DNA, 25 bp, Mus musculus
tcttatgttttggagtcacacaagc

SEQ ID NO: 59837 - DNA, 25 bp, Mus musculus
tcttattagcaaatcacccattgga

SEQ ID NO: 59838 - DNA, 25 bp, Mus musculus
tcttattatctacttggtccgtggc

SEQ ID NO: 59839 - DNA, 25 bp, Mus musculus
tcttattgcccaacatcacaagaga

SEQ ID NO: 59840 - DNA, 25 bp, Mus musculus
tcttatttcttaaggaggagaattc

SEQ ID NO: 59841 - DNA, 25 bp, Mus musculus
tcttcaaaaaccaaggcataatttc

SEQ ID NO: 59842 - DNA, 25 bp, Mus musculus
tcttcaaaccgccaaaaagaaggat

SEQ ID NO: 59843 - DNA, 25 bp, Mus musculus
tcttcaaacggcgacctgtacatct

SEQ ID NO: 59844 - DNA, 25 bp, Mus musculus
tcttcaaactctacctgatcatgtc

SEQ ID NO: 59845 - DNA, 25 bp, Mus musculus
tcttcaaacttcaactcaggcgcca

SEQ ID NO: 59846 - DNA, 25 bp, Mus musculus
tcttcaaagatgaaggcaaaacttg

SEQ ID NO: 59847 - DNA, 25 bp, Mus musculus
tcttcaaagccacagatgattttac

SEQ ID NO: 59848 - DNA, 25 bp, Mus musculus
tcttcaaagccagagatgattttac

SEQ ID NO: 59849 - DNA, 25 bp, Mus musculus
tcttcaaagtggacaccagctccct

SEQ ID NO: 59850 - DNA, 25 bp, Mus musculus
tcttcaaagtggtcaccagctccct

SEQ ID NO: 59851 - DNA, 25 bp, Mus musculus
tcttcaaatgctgccagggatctga

SEQ ID NO: 59852 - DNA, 25 bp, Mus musculus
tcttcaacattacgtcccgagaaag

SEQ ID NO: 59853 - DNA, 25 bp, Mus musculus
tcttcaacattaggtcccgagaaag

SEQ ID NO: 59854 - DNA, 25 bp, Mus musculus
tcttcaaccaccaagggaatttgtg

SEQ ID NO: 59855 - DNA, 25 bp, Mus musculus
tcttcaactctgaggacatgcagga

SEQ ID NO: 59856 - DNA, 25 bp, Mus musculus
tcttcaagaacaacctcagagctct

SEQ ID NO: 59857 - DNA, 25 bp, Mus musculus
tcttcaagaatggagacacagcctc

SEQ ID NO: 59858 - DNA, 25 bp, Mus musculus
tcttcaagaccatatttacccgagc

SEQ ID NO: 59859 - DNA, 25 bp, Mus musculus
tcttcaaggtctgccggcaggacag

SEQ ID NO: 59860 - DNA, 25 bp, Mus musculus
tcttcaagtctgctctacaagccat

SEQ ID NO: 59861 - DNA, 25 bp, Mus musculus
tcttcaatcagatcaacatgttgta

SEQ ID NO: 59862 - DNA, 25 bp, Mus musculus
tcttcacaatgacagagggaaagct

SEQ ID NO: 59863 - DNA, 25 bp, Mus musculus
tcttcacacaacgaactagaaaagc

SEQ ID NO: 59864 - DNA, 25 bp, Mus musculus
tcttcacacctgacctcgcttttga

SEQ ID NO: 59865 - DNA, 25 bp, Mus musculus
tcttcacactgttgatcggccatgg

SEQ ID NO: 59866 - DNA, 25 bp, Mus musculus
tcttcacagccatccagcttgcctg

SEQ ID NO: 59867 - DNA, 25 bp, Mus musculus
tcttcacatgtcacttcaatgaaag

SEQ ID NO: 59868 - DNA, 25 bp, Mus musculus
tcttcacatgtctcttcaatgaaag

SEQ ID NO: 59869 - DNA, 25 bp, Mus musculus
tcttcaccaaaaatcaacagctgag

SEQ ID NO: 59870 - DNA, 25 bp, Mus musculus
tcttcaccacaacccaaacttggtg

SEQ ID NO: 59871 - DNA, 25 bp, Mus musculus
tcttcaccacactgaagccgttagg

SEQ ID NO: 59872 - DNA, 25 bp, Mus musculus
tcttcacctaccagtatgacctggg

SEQ ID NO: 59873 - DNA, 25 bp, Mus musculus
tcttcacctgctttgttaaggtctg

SEQ ID NO: 59874 - DNA, 25 bp, Mus musculus
tcttcacgccggatttggcgttcga

SEQ ID NO: 59875 - DNA, 25 bp, Mus musculus
tcttcactaactacgagagccggaa

SEQ ID NO: 59876 - DNA, 25 bp, Mus musculus
tcttcagacaacgtcagatggtgtc

SEQ ID NO: 59877 - DNA, 25 bp, Mus musculus
tcttcagacgaagaacctgttgatg

SEQ ID NO: 59878 - DNA, 25 bp, Mus musculus
tcttcagactgcaataacagtggct

SEQ ID NO: 59879 - DNA, 25 bp, Mus musculus
tcttcagagaccacatatcatccag

SEQ ID NO: 59880 - DNA, 25 bp, Mus musculus
tcttcagagacccatgcctggtgca

SEQ ID NO: 59881 - DNA, 25 bp, Mus musculus
tcttcagagagccaatcatctgcaa

SEQ ID NO: 59882 - DNA, 25 bp, Mus musculus
tcttcagagtttgctacttctcctg

SEQ ID NO: 59883 - DNA, 25 bp, Mus musculus
tcttcagcaatatcctccagcactg

SEQ ID NO: 59884 - DNA, 25 bp, Mus musculus
tcttcagcatgacagagacaaggaa

SEQ ID NO: 59885 - DNA, 25 bp, Mus musculus
tcttcagcatgagagagacaaggaa

SEQ ID NO: 59886 - DNA, 25 bp, Mus musculus
tcttcagcctattatcaaaacggaa

SEQ ID NO: 59887 - DNA, 25 bp, Mus musculus
tcttcagcctcctgggcgtgtgcca

SEQ ID NO: 59888 - DNA, 25 bp, Mus musculus
tcttcagctaaggaaccagttcata

SEQ ID NO: 59889 - DNA, 25 bp, Mus musculus
tcttcagctggcaagaaggagcgga

SEQ ID NO: 59890 - DNA, 25 bp, Mus musculus
tcttcagctggccttaatgttgact

SEQ ID NO: 59891 - DNA, 25 bp, Mus musculus
tcttcaggattgtacagcaagcaca

SEQ ID NO: 59892 - DNA, 25 bp, Mus musculus
tcttcaggcacatatggaagatctc

SEQ ID NO: 59893 - DNA, 25 bp, Mus musculus
tcttcaggcgtaacctaacatggga

SEQ ID NO: 59894 - DNA, 25 bp, Mus musculus
tcttcaggtccagccctgtggtgga

SEQ ID NO: 59895 - DNA, 25 bp, Mus musculus
tcttcaggtgtgaaacgacaaagag

SEQ ID NO: 59896 - DNA, 25 bp, Mus musculus
tcttcaggttcaacgcaaagttcgc

SEQ ID NO: 59897 - DNA, 25 bp, Mus musculus
tcttcagtagccaagatgtcttcag

SEQ ID NO: 59898 - DNA, 25 bp, Mus musculus
tcttcagtgtgatcacagttgttgg

SEQ ID NO: 59899 - DNA, 25 bp, Mus musculus
tcttcagtttccatcatctagagat

SEQ ID NO: 59900 - DNA, 25 bp, Mus musculus
tcttcatatggatcagaacccatac

SEQ ID NO: 59901 - DNA, 25 bp, Mus musculus
tcttcatattagctctgaggacatc

SEQ ID NO: 59902 - DNA, 25 bp, Mus musculus
tcttcatcatccaccctcttgggag

SEQ ID NO: 59903 - DNA, 25 bp, Mus musculus
tcttcatcatcctccctcttgggag

SEQ ID NO: 59904 - DNA, 25 bp, Mus musculus
tcttcatccgctacaagagcgccaa

SEQ ID NO: 59905 - DNA, 25 bp, Mus musculus
tcttcatcggatgggcaggagcttc

SEQ ID NO: 59906 - DNA, 25 bp, Mus musculus
tcttcatcgggtctccctgcggact

SEQ ID NO: 59907 - DNA, 25 bp, Mus musculus
tcttcatctcttcagcaagttgcag

SEQ ID NO: 59908 - DNA, 25 bp, Mus musculus
tcttcatgaatgtagtcccagcgag

SEQ ID NO: 59909 - DNA, 25 bp, Mus musculus
tcttcatgagacagaggatagacaa

SEQ ID NO: 59910 - DNA, 25 bp, Mus musculus
tcttcatgaggaggaagaaactctt

SEQ ID NO: 59911 - DNA, 25 bp, Mus musculus
tcttcatggcctgcagagacattga

SEQ ID NO: 59912 - DNA, 25 bp, Mus musculus
tcttcattacagaagggtattgatg

SEQ ID NO: 59913 - DNA, 25 bp, Mus musculus
tcttcattacagtagggtattgatg

SEQ ID NO: 59914 - DNA, 25 bp, Mus musculus
tcttcattcccatacaatggctttt

SEQ ID NO: 59915 - DNA, 25 bp, Mus musculus
tcttcattgtctcttctgctccagg

SEQ ID NO: 59916 - DNA, 25 bp, Mus musculus
tcttccaaacggtggctgccatctg

SEQ ID NO: 59917 - DNA, 25 bp, Mus musculus
tcttccaattgcaaatgtggctagg

SEQ ID NO: 59918 - DNA, 25 bp, Mus musculus
tcttccacaccataaagcatgtagc

SEQ ID NO: 59919 - DNA, 25 bp, Mus musculus
tcttccacccgcgtttcaagaggga

SEQ ID NO: 59920 - DNA, 25 bp, Mus musculus
tcttccaccgagtgctctttgaggt

SEQ ID NO: 59921 - DNA, 25 bp, Mus musculus
tcttccacctcagaagatgagcggc

SEQ ID NO: 59922 - DNA, 25 bp, Mus musculus
tcttccacgagaatgagctatggtt

SEQ ID NO: 59923 - DNA, 25 bp, Mus musculus
tcttccactgggaaagactggattc

SEQ ID NO: 59924 - DNA, 25 bp, Mus musculus
tcttccagaagaaccctctgctaaa

SEQ ID NO: 59925 - DNA, 25 bp, Mus musculus
tcttccagacctgtgtatgacatcc

SEQ ID NO: 59926 - DNA, 25 bp, Mus musculus
tcttccagcagttcggcagtatctg

SEQ ID NO: 59927 - DNA, 25 bp, Mus musculus
tcttccagccgcctgttcaggtgtt

SEQ ID NO: 59928 - DNA, 25 bp, Mus musculus
tcttccagcttaactctgggtgtga

SEQ ID NO: 59929 - DNA, 25 bp, Mus musculus
tcttccagcttatctctgggtgtga

SEQ ID NO: 59930 - DNA, 25 bp, Mus musculus
tcttccagtcaattggcttcaagga

SEQ ID NO: 59931 - DNA, 25 bp, Mus musculus
tcttccagttttctgccagcctgca

SEQ ID NO: 59932 - DNA, 25 bp, Mus musculus
tcttccattgatctagtcagtgcct

SEQ ID NO: 59933 - DNA, 25 bp, Mus musculus
tcttcccaaaagaggctacacagag

SEQ ID NO: 59934 - DNA, 25 bp, Mus musculus
tcttcccagatttggtccaagccat

SEQ ID NO: 59935 - DNA, 25 bp, Mus musculus
tcttcccagtggctgttggcttcac

SEQ ID NO: 59936 - DNA, 25 bp, Mus musculus
tcttcccatggactctgacactgtt

SEQ ID NO: 59937 - DNA, 25 bp, Mus musculus
tcttccccatgagggaagcccagga

SEQ ID NO: 59938 - DNA, 25 bp, Mus musculus
tcttccccgagagcatccgtgtgga

SEQ ID NO: 59939 - DNA, 25 bp, Mus musculus
tcttcccggagagtgaactttccat

SEQ ID NO: 59940 - DNA, 25 bp, Mus musculus
tcttcccggagccaaaattagcttg

SEQ ID NO: 59941 - DNA, 25 bp, Mus musculus
tcttccctacaccagtaaacttgtg

SEQ ID NO: 59942 - DNA, 25 bp, Mus musculus
tcttccctgacatttaaaggcacag

SEQ ID NO: 59943 - DNA, 25 bp, Mus musculus
tcttccctgacctggaagctgtgat

SEQ ID NO: 59944 - DNA, 25 bp, Mus musculus
tcttccctgaggagcgtgaggtgct

SEQ ID NO: 59945 - DNA, 25 bp, Mus musculus
tcttccctgatttgtctccagggta

SEQ ID NO: 59946 - DNA, 25 bp, Mus musculus
tcttccgactggtactgaacataca

SEQ ID NO: 59947 - DNA, 25 bp, Mus musculus
tcttccgcaggattgcgaagttctc

SEQ ID NO: 59948 - DNA, 25 bp, Mus musculus
tcttccgccgcagtgtcatcaaggg

SEQ ID NO: 59949 - DNA, 25 bp, Mus musculus
tcttccggactcagaagatcatctg

SEQ ID NO: 59950 - DNA, 25 bp, Mus musculus
tcttccggtggctttgtgtgggctt

SEQ ID NO: 59951 - DNA, 25 bp, Mus musculus
tcttccgtgtcctatattcccaggc

SEQ ID NO: 59952 - DNA, 25 bp, Mus musculus
tcttcctagtgctttgggcctcagt

SEQ ID NO: 59953 - DNA, 25 bp, Mus musculus
tcttcctatcttcaagctgaaggaa

SEQ ID NO: 59954 - DNA, 25 bp, Mus musculus
tcttcctcctaagaaactgattgga

SEQ ID NO: 59955 - DNA, 25 bp, Mus musculus
tcttcctgagcccaggcataacgct

SEQ ID NO: 59956 - DNA, 25 bp, Mus musculus
tcttcctgaggacgtcagagaaaaa

SEQ ID NO: 59957 - DNA, 25 bp, Mus musculus
tcttcctgcccaaggcctgagtggc

SEQ ID NO: 59958 - DNA, 25 bp, Mus musculus
tcttcctgccgaaaagccagttggg

SEQ ID NO: 59959 - DNA, 25 bp, Mus musculus
tcttcctgccgataagccagttggg

SEQ ID NO: 59960 - DNA, 25 bp, Mus musculus
tcttcctggcatgcacatgctctgg

SEQ ID NO: 59961 - DNA, 25 bp, Mus musculus
tcttcctggcgcaggtttcccggat

SEQ ID NO: 59962 - DNA, 25 bp, Mus musculus
tcttcctggcgctggtttcccggat

SEQ ID NO: 59963 - DNA, 25 bp, Mus musculus
tcttcctgtgggacggggatgaaat

SEQ ID NO: 59964 - DNA, 25 bp, Mus musculus
tcttccttcttcaaaaaccaaggca

SEQ ID NO: 59965 - DNA, 25 bp, Mus musculus
tcttccttgactcctgtcgaaaggg

SEQ ID NO: 59966 - DNA, 25 bp, Mus musculus
tcttcctttagtagaagagatggag

SEQ ID NO: 59967 - DNA, 25 bp, Mus musculus
tcttcgaacgccagctcagaagctg

SEQ ID NO: 59968 - DNA, 25 bp, Mus musculus
tcttcgaaggactcctcgaagcgag

SEQ ID NO: 59969 - DNA, 25 bp, Mus musculus
tcttcgacaacaagcacaccaacta

SEQ ID NO: 59970 - DNA, 25 bp, Mus musculus
tcttcgagactttgttaggagccac

SEQ ID NO: 59971 - DNA, 25 bp, Mus musculus
tcttcgagcagtacgggaaggtgct

SEQ ID NO: 59972 - DNA, 25 bp, Mus musculus
tcttcgaggacgagtttgtccatgt

SEQ ID NO: 59973 - DNA, 25 bp, Mus musculus
tcttcgcgcggagaatgaggtgtct

SEQ ID NO: 59974 - DNA, 25 bp, Mus musculus
tcttcgcgggacaccgcgtcacgga

SEQ ID NO: 59975 - DNA, 25 bp, Mus musculus
tcttcgctatggaacctgatgggca

SEQ ID NO: 59976 - DNA, 25 bp, Mus musculus
tcttcgctggtgtggatgtcactaa

SEQ ID NO: 59977 - DNA, 25 bp, Mus musculus
tcttcgcttcccttgggtggccttc

SEQ ID NO: 59978 - DNA, 25 bp, Mus musculus
tcttcggagcctcatccagggttcg

SEQ ID NO: 59979 - DNA, 25 bp, Mus musculus
tcttcggcagcagcggtatttccag

SEQ ID NO: 59980 - DNA, 25 bp, Mus musculus
tcttcggctgtcgagaatcttaaag

SEQ ID NO: 59981 - DNA, 25 bp, Mus musculus
tcttcggcttactcaacttccaggc

SEQ ID NO: 59982 - DNA, 25 bp, Mus musculus
tcttcgggcccctgggattcggctt

SEQ ID NO: 59983 - DNA, 25 bp, Mus musculus
tcttcgtagaaagtctgagttcctt

SEQ ID NO: 59984 - DNA, 25 bp, Mus musculus
tcttcgtcgcggcttggatttcaaa

SEQ ID NO: 59985 - DNA, 25 bp, Mus musculus
tcttcgtgccttaagtttgagccca

SEQ ID NO: 59986 - DNA, 25 bp, Mus musculus
tcttcgtggaatgaggttgatccgt

SEQ ID NO: 59987 - DNA, 25 bp, Mus musculus
tcttcgtggctcagaagatgtacag

SEQ ID NO: 59988 - DNA, 25 bp, Mus musculus
tcttcgtttctgacagagcaaacag

SEQ ID NO: 59989 - DNA, 25 bp, Mus musculus
tcttctagaggaatacggaatcatg

SEQ ID NO: 59990 - DNA, 25 bp, Mus musculus
tcttctaggctctacttcttaaagg

SEQ ID NO: 59991 - DNA, 25 bp, Mus musculus
tcttctagggccagctctgcaaggg

SEQ ID NO: 59992 - DNA, 25 bp, Mus musculus
tcttctataattgctcccaagaacc

SEQ ID NO: 59993 - DNA, 25 bp, Mus musculus
tcttctatgaccagcatggtggaga

SEQ ID NO: 59994 - DNA, 25 bp, Mus musculus
tcttctccagcgatgagtcattcgc

SEQ ID NO: 59995 - DNA, 25 bp, Mus musculus
tcttctccggaccacaagatcacaa

SEQ ID NO: 59996 - DNA, 25 bp, Mus musculus
tcttctccgtgcttggcttttttga

SEQ ID NO: 59997 - DNA, 25 bp, Mus musculus
tcttctcgccagagacactcaggtc

SEQ ID NO: 59998 - DNA, 25 bp, Mus musculus
tcttctcggagatgaccgcttggcc

SEQ ID NO: 59999 - DNA, 25 bp, Mus musculus
tcttctcgggccttatgaccagacc

SEQ ID NO: 60000 - DNA, 25 bp, Mus musculus
tcttctcgtcgtgggcttcctgttt

SEQ ID NO: 60001 - DNA, 25 bp, Mus musculus
tcttctgaacagagagcgatacatc

SEQ ID NO: 60002 - DNA, 25 bp, Mus musculus
tcttctgaaccagcactaccaggtt

SEQ ID NO: 60003 - DNA, 25 bp, Mus musculus
tcttctgcatcctgtggtccctgct

SEQ ID NO: 60004 - DNA, 25 bp, Mus musculus
tcttctgcccaatctcttcctgaga

SEQ ID NO: 60005 - DNA, 25 bp, Mus musculus
tcttctgcctcaaagtgacccctta

SEQ ID NO: 60006 - DNA, 25 bp, Mus musculus
tcttctgctctgcaaacgctgctgg

SEQ ID NO: 60007 - DNA, 25 bp, Mus musculus
tcttctgcttctgagggtcctgtgt

SEQ ID NO: 60008 - DNA, 25 bp, Mus musculus
tcttctggccagcaacttcatcagt

SEQ ID NO: 60009 - DNA, 25 bp, Mus musculus
tcttctggctcataaagattgccct

SEQ ID NO: 60010 - DNA, 25 bp, Mus musculus
tcttctgggtccgactactgttggt

SEQ ID NO: 60011 - DNA, 25 bp, Mus musculus
tcttctgggtgtccgtgctctgcaa

SEQ ID NO: 60012 - DNA, 25 bp, Mus musculus
tcttctgtagttttggaggaacaac

SEQ ID NO: 60013 - DNA, 25 bp, Mus musculus
tcttctgtctaaacaccaggtgttg

SEQ ID NO: 60014 - DNA, 25 bp, Mus musculus
tcttctgtggagactctgttgacca

SEQ ID NO: 60015 - DNA, 25 bp, Mus musculus
tcttctgtggataagctggaacaga

SEQ ID NO: 60016 - DNA, 25 bp, Mus musculus
tcttctgtgtattctctgtgcatca

SEQ ID NO: 60017 - DNA, 25 bp, Mus musculus
tcttctgttcaagttgcaaaccaca

SEQ ID NO: 60018 - DNA, 25 bp, Mus musculus
tcttcttcccacattgaaaccgatt

SEQ ID NO: 60019 - DNA, 25 bp, Mus musculus
tcttcttcggcagcagcggtatttc

SEQ ID NO: 60020 - DNA, 25 bp, Mus musculus
tcttcttctatgaccagcatggtgg

SEQ ID NO: 60021 - DNA, 25 bp, Mus musculus
tcttcttgatgccaacagcgaggag

SEQ ID NO: 60022 - DNA, 25 bp, Mus musculus
tcttcttgcaaaatgaaactctttc

SEQ ID NO: 60023 - DNA, 25 bp, Mus musculus
tcttcttggaaacagaattgttcta

SEQ ID NO: 60024 - DNA, 25 bp, Mus musculus
tcttcttggtcactgggttctccca

SEQ ID NO: 60025 - DNA, 25 bp, Mus musculus
tcttcttgtctcagagagcagtaga

SEQ ID NO: 60026 - DNA, 25 bp, Mus musculus
tcttctttccaccatggtaacctct

SEQ ID NO: 60027 - DNA, 25 bp, Mus musculus
tcttctttggcctggctgtgaactt

SEQ ID NO: 60028 - DNA, 25 bp, Mus musculus
tcttctttgggagctgctgaccggg

SEQ ID NO: 60029 - DNA, 25 bp, Mus musculus
tcttgaaaatatcaggaggtgaaag

SEQ ID NO: 60030 - DNA, 25 bp, Mus musculus
tcttgaaactgaattcacgtaccag

SEQ ID NO: 60031 - DNA, 25 bp, Mus musculus
tcttgaaaggagtgtactcaaccca

SEQ ID NO: 60032 - DNA, 25 bp, Mus musculus
tcttgaaaggcctggaagaagaatt

SEQ ID NO: 60033 - DNA, 25 bp, Mus musculus
tcttgaaatgcatccagtttagggc

SEQ ID NO: 60034 - DNA, 25 bp, Mus musculus
tcttgaacaggctccatcaggtgca

SEQ ID NO: 60035 - DNA, 25 bp, Mus musculus
tcttgaacatcatcccattgagaac

SEQ ID NO: 60036 - DNA, 25 bp, Mus musculus
tcttgaacgggccttctgcaacacc

SEQ ID NO: 60037 - DNA, 25 bp, Mus musculus
tcttgaagcatgcagaggcgactct

SEQ ID NO: 60038 - DNA, 25 bp, Mus musculus
tcttgaagcttactgctgatgccaa

SEQ ID NO: 60039 - DNA, 25 bp, Mus musculus
tcttgaaggataaagtccgggaaag

SEQ ID NO: 60040 - DNA, 25 bp, Mus musculus
tcttgaattggatgcgctacacgca

SEQ ID NO: 60041 - DNA, 25 bp, Mus musculus
tcttgaatttaggacagtcctcctc

SEQ ID NO: 60042 - DNA, 25 bp, Mus musculus
tcttgacaagttgagatttgccgat

SEQ ID NO: 60043 - DNA, 25 bp, Mus musculus
tcttgacaatgttcacaaacagaga

SEQ ID NO: 60044 - DNA, 25 bp, Mus musculus
tcttgacagccttcgcctattggaa

SEQ ID NO: 60045 - DNA, 25 bp, Mus musculus
tcttgacattcttcagggctgcaat

SEQ ID NO: 60046 - DNA, 25 bp, Mus musculus
tcttgaccaaggcagtgaacagcct

SEQ ID NO: 60047 - DNA, 25 bp, Mus musculus
tcttgacccaggatataaatgagct

SEQ ID NO: 60048 - DNA, 25 bp, Mus musculus
tcttgacttcctcaagcctttcagg

SEQ ID NO: 60049 - DNA, 25 bp, Mus musculus
tcttgagaaaatgtaatgctctgtg

SEQ ID NO: 60050 - DNA, 25 bp, Mus musculus
tcttgagaacatgaagctgagcctt

SEQ ID NO: 60051 - DNA, 25 bp, Mus musculus
tcttgagaaggctgccgaagtgtca

SEQ ID NO: 60052 - DNA, 25 bp, Mus musculus
tcttgagctttctgcactaattgaa

SEQ ID NO: 60053 - DNA, 25 bp, Mus musculus
tcttgagtgcaccaagccagcagcc

SEQ ID NO: 60054 - DNA, 25 bp, Mus musculus
tcttgagttatggtggctgaaacat

SEQ ID NO: 60055 - DNA, 25 bp, Mus musculus
tcttgatagacaaggtcatggacgg

SEQ ID NO: 60056 - DNA, 25 bp, Mus musculus
tcttgatgaagctctaaagcatgtt

SEQ ID NO: 60057 - DNA, 25 bp, Mus musculus
tcttgatgcacagcgaagctgacgc

SEQ ID NO: 60058 - DNA, 25 bp, Mus musculus
tcttgatgccaacagcgaggaggaa

SEQ ID NO: 60059 - DNA, 25 bp, Mus musculus
tcttgatgccctggacaaaattaag

SEQ ID NO: 60060 - DNA, 25 bp, Mus musculus
tcttgatggttcataagcgaagcca

SEQ ID NO: 60061 - DNA, 25 bp, Mus musculus
tcttgattcctgttgccggcctggc

SEQ ID NO: 60062 - DNA, 25 bp, Mus musculus
tcttgattgccacgttgcgagtggc

SEQ ID NO: 60063 - DNA, 25 bp, Mus musculus
tcttgcacaccgagaaagtatgcgc

SEQ ID NO: 60064 - DNA, 25 bp, Mus musculus
tcttgcactaccagcaggctctgac

SEQ ID NO: 60065 - DNA, 25 bp, Mus musculus
tcttgcactatccataatgaggccc

SEQ ID NO: 60066 - DNA, 25 bp, Mus musculus
tcttgcagacaagaacagcttcatt

SEQ ID NO: 60067 - DNA, 25 bp, Mus musculus
tcttgcagatacagcgctaggaaaa

SEQ ID NO: 60068 - DNA, 25 bp, Mus musculus
tcttgcaggatgagaagcagctcga

SEQ ID NO: 60069 - DNA, 25 bp, Mus musculus
tcttgcagtttctgcaaagaccttc

SEQ ID NO: 60070 - DNA, 25 bp, Mus musculus
tcttgcatatccgaagagtatatgg

SEQ ID NO: 60071 - DNA, 25 bp, Mus musculus
tcttgcatttcgagaaggaactgtg

SEQ ID NO: 60072 - DNA, 25 bp, Mus musculus
tcttgcatttggaagaccttcagaa

SEQ ID NO: 60073 - DNA, 25 bp, Mus musculus
tcttgccaaccgaagacgatgtgac

SEQ ID NO: 60074 - DNA, 25 bp, Mus musculus
tcttgccacatcaggttcccaggtg

SEQ ID NO: 60075 - DNA, 25 bp, Mus musculus
tcttgccagaacactggtagtaagc

SEQ ID NO: 60076 - DNA, 25 bp, Mus musculus
tcttgccagaactctggtagtaagc

SEQ ID NO: 60077 - DNA, 25 bp, Mus musculus
tcttgccagagcaactttgatcacc

SEQ ID NO: 60078 - DNA, 25 bp, Mus musculus
tcttgcccacaatggtggaaaccag

SEQ ID NO: 60079 - DNA, 25 bp, Mus musculus
tcttgccccacgacggagtatttgg

SEQ ID NO: 60080 - DNA, 25 bp, Mus musculus
tcttgcccctcgcaggatagcgagg

SEQ ID NO: 60081 - DNA, 25 bp, Mus musculus
tcttgccctggagccattgatcaca

SEQ ID NO: 60082 - DNA, 25 bp, Mus musculus
tcttgccgggattctgatgctggct

SEQ ID NO: 60083 - DNA, 25 bp, Mus musculus
tcttgccgtcccaacgatgaggcct

SEQ ID NO: 60084 - DNA, 25 bp, Mus musculus
tcttgcctatgccagacacagggct

SEQ ID NO: 60085 - DNA, 25 bp, Mus musculus
tcttgcctcaaagctgtgcgacgtc

SEQ ID NO: 60086 - DNA, 25 bp, Mus musculus
tcttgcctcccatgcatgtccagtg

SEQ ID NO: 60087 - DNA, 25 bp, Mus musculus
tcttgccttcgttccaaattgccag

SEQ ID NO: 60088 - DNA, 25 bp, Mus musculus
tcttgcctttaaggagcagggcagg

SEQ ID NO: 60089 - DNA, 25 bp, Mus musculus
tcttgcgcacggatcagctggatgg

SEQ ID NO: 60090 - DNA, 25 bp, Mus musculus
tcttgctaggtagttcaaattggcc

SEQ ID NO: 60091 - DNA, 25 bp, Mus musculus
tcttgctcagactgtaaaagatcct

SEQ ID NO: 60092 - DNA, 25 bp, Mus musculus
tcttgctctacaaatcgacttcgca

SEQ ID NO: 60093 - DNA, 25 bp, Mus musculus
tcttgctctccctcatggctggctt

SEQ ID NO: 60094 - DNA, 25 bp, Mus musculus
tcttgctgcataggcaaagctggcc

SEQ ID NO: 60095 - DNA, 25 bp, Mus musculus
tcttgctggcagcagaggctattga

SEQ ID NO: 60096 - DNA, 25 bp, Mus musculus
tcttgctgtcctggattgtgctgaa

SEQ ID NO: 60097 - DNA, 25 bp, Mus musculus
tcttgcttggccttctcgtgtcctg

SEQ ID NO: 60098 - DNA, 25 bp, Mus musculus
tcttgctttgagtggacatgataaa

SEQ ID NO: 60099 - DNA, 25 bp, Mus musculus
tcttgctttgttggtgattgtatcg

SEQ ID NO: 60100 - DNA, 25 bp, Mus musculus
tcttggaaaaagtgaaactatgctg

SEQ ID NO: 60101 - DNA, 25 bp, Mus musculus
tcttggaaacaatgattgggctcta

SEQ ID NO: 60102 - DNA, 25 bp, Mus musculus
tcttggaaagaattagccgattagc

SEQ ID NO: 60103 - DNA, 25 bp, Mus musculus
tcttggaaggatgagcccacgatgg

SEQ ID NO: 60104 - DNA, 25 bp, Mus musculus
tcttggaagtgtctcggcaaccgct

SEQ ID NO: 60105 - DNA, 25 bp, Mus musculus
tcttggaagtgtgtcggcaaccgct

SEQ ID NO: 60106 - DNA, 25 bp, Mus musculus
tcttggaattaaaagtaaagctgga

SEQ ID NO: 60107 - DNA, 25 bp, Mus musculus
tcttggacaaatccgagcagtacca

SEQ ID NO: 60108 - DNA, 25 bp, Mus musculus
tcttggaccgagagctgtgcatcac

SEQ ID NO: 60109 - DNA, 25 bp, Mus musculus
tcttggactacttcatggcatttgg

SEQ ID NO: 60110 - DNA, 25 bp, Mus musculus
tcttggagaaaacttgcagccttgg

SEQ ID NO: 60111 - DNA, 25 bp, Mus musculus
tcttggagaacacaaagaagtgtgg

SEQ ID NO: 60112 - DNA, 25 bp, Mus musculus
tcttggagaccagccgacgactgga

SEQ ID NO: 60113 - DNA, 25 bp, Mus musculus
tcttggagaggatcctcgatgagcc

SEQ ID NO: 60114 - DNA, 25 bp, Mus musculus
tcttggagagtcatgcaaaacctga

SEQ ID NO: 60115 - DNA, 25 bp, Mus musculus
tcttggagatttcagggaaactggt

SEQ ID NO: 60116 - DNA, 25 bp, Mus musculus
tcttggagcaagagaaacaccggcc

SEQ ID NO: 60117 - DNA, 25 bp, Mus musculus
tcttggagctaagaaccatacctgc

SEQ ID NO: 60118 - DNA, 25 bp, Mus musculus
tcttggagggctcatggcctttcag

SEQ ID NO: 60119 - DNA, 25 bp, Mus musculus
tcttggaggtcgaatccgggacacc

SEQ ID NO: 60120 - DNA, 25 bp, Mus musculus
tcttggatcagggatgcagtaccac

SEQ ID NO: 60121 - DNA, 25 bp, Mus musculus
tcttggatgcaataccagttgtact

SEQ ID NO: 60122 - DNA, 25 bp, Mus musculus
tcttggatggcagcgccagttacaa

SEQ ID NO: 60123 - DNA, 25 bp, Mus musculus
tcttggcaatggaagatgctttaaa

SEQ ID NO: 60124 - DNA, 25 bp, Mus musculus
tcttggcagacagaactggcactgc

SEQ ID NO: 60125 - DNA, 25 bp, Mus musculus
tcttggcagaggaggccaggttttc

SEQ ID NO: 60126 - DNA, 25 bp, Mus musculus
tcttggcagaggtggccaggttttc

SEQ ID NO: 60127 - DNA, 25 bp, Mus musculus
tcttggcagtcagcagtctgcggag

SEQ ID NO: 60128 - DNA, 25 bp, Mus musculus
tcttggcagtctatgtagacttcga

SEQ ID NO: 60129 - DNA, 25 bp, Mus musculus
tcttggcagtctttgtagacttcga

SEQ ID NO: 60130 - DNA, 25 bp, Mus musculus
tcttggcagtttaagaaaagcccgg

SEQ ID NO: 60131 - DNA, 25 bp, Mus musculus
tcttggcatagcagtgaggcgtccc

SEQ ID NO: 60132 - DNA, 25 bp, Mus musculus
tcttggcatctactttgaagttgtc

SEQ ID NO: 60133 - DNA, 25 bp, Mus musculus
tcttggcatcttcgaagtaaggaga

SEQ ID NO: 60134 - DNA, 25 bp, Mus musculus
tcttggcattatggacctggacatt

SEQ ID NO: 60135 - DNA, 25 bp, Mus musculus
tcttggccctgtggtactactgtct

SEQ ID NO: 60136 - DNA, 25 bp, Mus musculus
tcttggccggcttgggagccttttg

SEQ ID NO: 60137 - DNA, 25 bp, Mus musculus
tcttggcctcaagacaaggtcttcc

SEQ ID NO: 60138 - DNA, 25 bp, Mus musculus
tcttggctaaagagggtgtagctgc

SEQ ID NO: 60139 - DNA, 25 bp, Mus musculus
tcttggctaagaagagaaataggaa

SEQ ID NO: 60140 - DNA, 25 bp, Mus musculus
tcttggctattacaacagactgcct

SEQ ID NO: 60141 - DNA, 25 bp, Mus musculus
tcttggctgggcttctgctgatcat

SEQ ID NO: 60142 - DNA, 25 bp, Mus musculus
tcttggctgtcatcattggcatcac

SEQ ID NO: 60143 - DNA, 25 bp, Mus musculus
tcttggcttctagccctgagcaggg

SEQ ID NO: 60144 - DNA, 25 bp, Mus musculus
tcttggcttgagtaaactggcagct

SEQ ID NO: 60145 - DNA, 25 bp, Mus musculus
tcttgggaagcaaaatcaagcacca

SEQ ID NO: 60146 - DNA, 25 bp, Mus musculus
tcttgggaagcataatcaagcacca

SEQ ID NO: 60147 - DNA, 25 bp, Mus musculus
tcttgggacccaccttatgggacaa

SEQ ID NO: 60148 - DNA, 25 bp, Mus musculus
tcttgggacgtaactgaagtgggcc

SEQ ID NO: 60149 - DNA, 25 bp, Mus musculus
tcttgggagaataaatggagcaatg

SEQ ID NO: 60150 - DNA, 25 bp, Mus musculus
tcttgggagaattaatggagcaatg

SEQ ID NO: 60151 - DNA, 25 bp, Mus musculus
tcttgggagtcaccaaccatgagtt

SEQ ID NO: 60152 - DNA, 25 bp, Mus musculus
tcttgggcatgttgtcaggagacct

SEQ ID NO: 60153 - DNA, 25 bp, Mus musculus
tcttgggtatggatgaactttctga

SEQ ID NO: 60154 - DNA, 25 bp, Mus musculus
tcttgggtggaccatccgtcttcat

SEQ ID NO: 60155 - DNA, 25 bp, Mus musculus
tcttgggttgttcggacatcggctt

SEQ ID NO: 60156 - DNA, 25 bp, Mus musculus
tcttggtaaagaacaacatctggta

SEQ ID NO: 60157 - DNA, 25 bp, Mus musculus
tcttggtaagcgaaacagactcaga

SEQ ID NO: 60158 - DNA, 25 bp, Mus musculus
tcttggtcatcgcaaatgcgggaac

SEQ ID NO: 60159 - DNA, 25 bp, Mus musculus
tcttggtcatcggaaatgcgggaac

SEQ ID NO: 60160 - DNA, 25 bp, Mus musculus
tcttggtccatgtgacagaccgatc

SEQ ID NO: 60161 - DNA, 25 bp, Mus musculus
tcttggtctccaaaaacgagagatt

SEQ ID NO: 60162 - DNA, 25 bp, Mus musculus
tcttggtctgcagcatggagacact

SEQ ID NO: 60163 - DNA, 25 bp, Mus musculus
tcttggtgacacaagacagagcaac

SEQ ID NO: 60164 - DNA, 25 bp, Mus musculus
tcttggtgacactagacagagcaac

SEQ ID NO: 60165 - DNA, 25 bp, Mus musculus
tcttggtggcacgatgtgaagtgat

SEQ ID NO: 60166 - DNA, 25 bp, Mus musculus
tcttggtggcattagagacgctgaa

SEQ ID NO: 60167 - DNA, 25 bp, Mus musculus
tcttggtggctgacaagtctggaga

SEQ ID NO: 60168 - DNA, 25 bp, Mus musculus
tcttggtgtctacagaagtcacaac

SEQ ID NO: 60169 - DNA, 25 bp, Mus musculus
tcttggtgtgtgtgacccgggaacc

SEQ ID NO: 60170 - DNA, 25 bp, Mus musculus
tcttggttaggccagccgaagttag

SEQ ID NO: 60171 - DNA, 25 bp, Mus musculus
tcttggttggacgtgaagaatagct

SEQ ID NO: 60172 - DNA, 25 bp, Mus musculus
tcttggtttctctactgcatggccc

SEQ ID NO: 60173 - DNA, 25 bp, Mus musculus
tcttgtacaaagtgggatttcctac

SEQ ID NO: 60174 - DNA, 25 bp, Mus musculus
tcttgtactcacaaagattcacctc

SEQ ID NO: 60175 - DNA, 25 bp, Mus musculus
tcttgtcctaggaagaaagggagcg

SEQ ID NO: 60176 - DNA, 25 bp, Mus musculus
tcttgtctcagagagcagtagagat

SEQ ID NO: 60177 - DNA, 25 bp, Mus musculus
tcttgtctcctgataaccctctttc

SEQ ID NO: 60178 - DNA, 25 bp, Mus musculus
tcttgtctcctgttaaccctctttc

SEQ ID NO: 60179 - DNA, 25 bp, Mus musculus
tcttgtgagcatagcaaagcctgca

SEQ ID NO: 60180 - DNA, 25 bp, Mus musculus
tcttgtgcaggaccatggagcacag

SEQ ID NO: 60181 - DNA, 25 bp, Mus musculus
tcttgtggaaggtcttgtgagagca

SEQ ID NO: 60182 - DNA, 25 bp, Mus musculus
tcttgtggacgagaccccgaagaga

SEQ ID NO: 60183 - DNA, 25 bp, Mus musculus
tcttgtggatgatcccctgttatct

SEQ ID NO: 60184 - DNA, 25 bp, Mus musculus
tcttgtgggcaaacctttggatgga

SEQ ID NO: 60185 - DNA, 25 bp, Mus musculus
tcttgttccctaaaacagtcatttg

SEQ ID NO: 60186 - DNA, 25 bp, Mus musculus
tcttgttcctaggtggacacaccac

SEQ ID NO: 60187 - DNA, 25 bp, Mus musculus
tcttgttgaacttggctatcatcag

SEQ ID NO: 60188 - DNA, 25 bp, Mus musculus
tcttgttgcagcatctggcagtgac

SEQ ID NO: 60189 - DNA, 25 bp, Mus musculus
tcttgttgggcgtttagcgcatcgg

SEQ ID NO: 60190 - DNA, 25 bp, Mus musculus
tcttgtttactgttgccgggagaca

SEQ ID NO: 60191 - DNA, 25 bp, Mus musculus
tcttgtttgacaacctcccactgtt

SEQ ID NO: 60192 - DNA, 25 bp, Mus musculus
tcttgtttgagaaccagctgctgca

SEQ ID NO: 60193 - DNA, 25 bp, Mus musculus
tcttgttttcagactggactcaggc

SEQ ID NO: 60194 - DNA, 25 bp, Mus musculus
tctttaaaaaccaagatccggtgct

SEQ ID NO: 60195 - DNA, 25 bp, Mus musculus
tctttaaaaacctagatccggtgct

SEQ ID NO: 60196 - DNA, 25 bp, Mus musculus
tctttaaagaggaacagctgctggc

SEQ ID NO: 60197 - DNA, 25 bp, Mus musculus
tctttaacagtcagaggcagcccaa

SEQ ID NO: 60198 - DNA, 25 bp, Mus musculus
tctttaacagtctgaggcagcccaa

SEQ ID NO: 60199 - DNA, 25 bp, Mus musculus
tctttaagggccacagtccctgctt

SEQ ID NO: 60200 - DNA, 25 bp, Mus musculus
tctttaagtggagtggagaaaactc

SEQ ID NO: 60201 - DNA, 25 bp, Mus musculus
tctttacacaagtcctcaactaggg

SEQ ID NO: 60202 - DNA, 25 bp, Mus musculus
tctttacgtctcatctgaaccgggc

SEQ ID NO: 60203 - DNA, 25 bp, Mus musculus
tctttactaagagatgctccgaggc

SEQ ID NO: 60204 - DNA, 25 bp, Mus musculus
tctttactcagaagatcgccttgag

SEQ ID NO: 60205 - DNA, 25 bp, Mus musculus
tctttagcagtcacaatccccagtg

SEQ ID NO: 60206 - DNA, 25 bp, Mus musculus
tctttagctgtgagcaaggatgcag

SEQ ID NO: 60207 - DNA, 25 bp, Mus musculus
tctttagttgccgtggaatagcaat

SEQ ID NO: 60208 - DNA, 25 bp, Mus musculus
tctttatgaaggtggtgatatccca

SEQ ID NO: 60209 - DNA, 25 bp, Mus musculus
tctttatgctggagggagtcagctc

SEQ ID NO: 60210 - DNA, 25 bp, Mus musculus
tctttatgctttcccagaccgccag

SEQ ID NO: 60211 - DNA, 25 bp, Mus musculus
tctttattgccaccaacatctgtga

SEQ ID NO: 60212 - DNA, 25 bp, Mus musculus
tctttattggtgaatcatcagctaa

SEQ ID NO: 60213 - DNA, 25 bp, Mus musculus
tctttcaacacttggcctggctctg

SEQ ID NO: 60214 - DNA, 25 bp, Mus musculus
tctttcaacgacaagaagtttgtca

SEQ ID NO: 60215 - DNA, 25 bp, Mus musculus
tctttcaagccaagtcgctgggact

SEQ ID NO: 60216 - DNA, 25 bp, Mus musculus
tctttcacctcaaccggaaacttca

SEQ ID NO: 60217 - DNA, 25 bp, Mus musculus
tctttcacctgtggaattatgacta

SEQ ID NO: 60218 - DNA, 25 bp, Mus musculus
tctttcagcagcatcacagactcca

SEQ ID NO: 60219 - DNA, 25 bp, Mus musculus
tctttcagccagacgacgaagtggt

SEQ ID NO: 60220 - DNA, 25 bp, Mus musculus
tctttcaggaggatgggcccgtgat

SEQ ID NO: 60221 - DNA, 25 bp, Mus musculus
tctttcatctctgtgatggtgtcaa

SEQ ID NO: 60222 - DNA, 25 bp, Mus musculus
tctttccaagaccaggcatctatat

SEQ ID NO: 60223 - DNA, 25 bp, Mus musculus
tctttccaccatagaaaaggactct

SEQ ID NO: 60224 - DNA, 25 bp, Mus musculus
tctttccacctatcggcacgttgag

SEQ ID NO: 60225 - DNA, 25 bp, Mus musculus
tctttccagatgctagtgattctct

SEQ ID NO: 60226 - DNA, 25 bp, Mus musculus
tctttcccatggcttcaggaaggct

SEQ ID NO: 60227 - DNA, 25 bp, Mus musculus
tctttccccagcaataaactggtct

SEQ ID NO: 60228 - DNA, 25 bp, Mus musculus
tctttccgacgacagaagcaatatc

SEQ ID NO: 60229 - DNA, 25 bp, Mus musculus
tctttccgagacaggacgatgtgct

SEQ ID NO: 60230 - DNA, 25 bp, Mus musculus
tctttcctccatgcagcagttcaag

SEQ ID NO: 60231 - DNA, 25 bp, Mus musculus
tctttcctgccccattctgggaggt

SEQ ID NO: 60232 - DNA, 25 bp, Mus musculus
tctttcggaggtagaaaccagggcg

SEQ ID NO: 60233 - DNA, 25 bp, Mus musculus
tctttcggccctgcggtggtcatga

SEQ ID NO: 60234 - DNA, 25 bp, Mus musculus
tctttctacctcttgtcatctgcca

SEQ ID NO: 60235 - DNA, 25 bp, Mus musculus
tctttctcaactctctcctggaaag

SEQ ID NO: 60236 - DNA, 25 bp, Mus musculus
tctttctcttgccacgctactctgg

SEQ ID NO: 60237 - DNA, 25 bp, Mus musculus
tctttctgaaatcgccaagtctgca

SEQ ID NO: 60238 - DNA, 25 bp, Mus musculus
tctttctgagtagagaagataacga

SEQ ID NO: 60239 - DNA, 25 bp, Mus musculus
tctttctgcaaaatggagcccttcc

SEQ ID NO: 60240 - DNA, 25 bp, Mus musculus
tctttctgcttatgtcagagacttg

SEQ ID NO: 60241 - DNA, 25 bp, Mus musculus
tctttcttctccagcgatgagtcat

SEQ ID NO: 60242 - DNA, 25 bp, Mus musculus
tctttcttgttcagtgaccgaggga

SEQ ID NO: 60243 - DNA, 25 bp, Mus musculus
tctttgaactatgcaagccactgca

SEQ ID NO: 60244 - DNA, 25 bp, Mus musculus
tctttgaactggaagtttctgggaa

SEQ ID NO: 60245 - DNA, 25 bp, Mus musculus
tctttgaagaaagagagaatcttcg

SEQ ID NO: 60246 - DNA, 25 bp, Mus musculus
tctttgaatgcgctgctccctggat

SEQ ID NO: 60247 - DNA, 25 bp, Mus musculus
tctttgagatcaatgaggcctttgc

SEQ ID NO: 60248 - DNA, 25 bp, Mus musculus
tctttgaggatgacaccatctcgga

SEQ ID NO: 60249 - DNA, 25 bp, Mus musculus
tctttgaggtacaacagactatgca

SEQ ID NO: 60250 - DNA, 25 bp, Mus musculus
tctttgaggtactacagactatgca

SEQ ID NO: 60251 - DNA, 25 bp, Mus musculus
tctttgaggtgcactcgctgaagct

SEQ ID NO: 60252 - DNA, 25 bp, Mus musculus
tctttgataccagaacggaggcctg

SEQ ID NO: 60253 - DNA, 25 bp, Mus musculus
tctttgatgaactttacaggcagtg

SEQ ID NO: 60254 - DNA, 25 bp, Mus musculus
tctttgatgactcctgccttgaccc

SEQ ID NO: 60255 - DNA, 25 bp, Mus musculus
tctttgatgatcttccgcctgctgc

SEQ ID NO: 60256 - DNA, 25 bp, Mus musculus
tctttgatgccaaaaagacagggca

SEQ ID NO: 60257 - DNA, 25 bp, Mus musculus
tctttgatgtgctcctggattgggt

SEQ ID NO: 60258 - DNA, 25 bp, Mus musculus
tctttgattatggacaatattctgc

SEQ ID NO: 60259 - DNA, 25 bp, Mus musculus
tctttgcacaaacatctcggatagt

SEQ ID NO: 60260 - DNA, 25 bp, Mus musculus
tctttgcaccagaggccctcctgaa

SEQ ID NO: 60261 - DNA, 25 bp, Mus musculus
tctttgcagaatctgagcttgacgg

SEQ ID NO: 60262 - DNA, 25 bp, Mus musculus
tctttgcagacctgatagtcttgaa

SEQ ID NO: 60263 - DNA, 25 bp, Mus musculus
tctttgcaggaacagagaccaccag

SEQ ID NO: 60264 - DNA, 25 bp, Mus musculus
tctttgcatgctttgctactgccca

SEQ ID NO: 60265 - DNA, 25 bp, Mus musculus
tctttgccagaactccttgaaaaaa

SEQ ID NO: 60266 - DNA, 25 bp, Mus musculus
tctttgccatgaaacagaggacatg

SEQ ID NO: 60267 - DNA, 25 bp, Mus musculus
tctttgccctcatcaccatcctcat

SEQ ID NO: 60268 - DNA, 25 bp, Mus musculus
tctttgcggctttgatgcttaacca

SEQ ID NO: 60269 - DNA, 25 bp, Mus musculus
tctttgcggttgcttcaagtttttc

SEQ ID NO: 60270 - DNA, 25 bp, Mus musculus
tctttgctcacactcgcgattctgc

SEQ ID NO: 60271 - DNA, 25 bp, Mus musculus
tctttggaaatctaatggatgtcac

SEQ ID NO: 60272 - DNA, 25 bp, Mus musculus
tctttggaccccatgactgttccca

SEQ ID NO: 60273 - DNA, 25 bp, Mus musculus
tctttggcaccgaaccgcgagttct

SEQ ID NO: 60274 - DNA, 25 bp, Mus musculus
tctttggcaccgtaccgcgagttct

SEQ ID NO: 60275 - DNA, 25 bp, Mus musculus
tctttggcccagtttgctgcccttg

SEQ ID NO: 60276 - DNA, 25 bp, Mus musculus
tctttggcttttcccactggtcaac

SEQ ID NO: 60277 - DNA, 25 bp, Mus musculus
tctttggcttttgccactggtcaac

SEQ ID NO: 60278 - DNA, 25 bp, Mus musculus
tctttgggagaccaatagacgcccc

SEQ ID NO: 60279 - DNA, 25 bp, Mus musculus
tctttgggccacagcaccgacctgt

SEQ ID NO: 60280 - DNA, 25 bp, Mus musculus
tctttgggttgagcacggatagcct

SEQ ID NO: 60281 - DNA, 25 bp, Mus musculus
tctttggtctgaaaggctatgtggc

SEQ ID NO: 60282 - DNA, 25 bp, Mus musculus
tctttggtcttctaagtcttctgtg

SEQ ID NO: 60283 - DNA, 25 bp, Mus musculus
tctttggtgaaggaactaggcgacc

SEQ ID NO: 60284 - DNA, 25 bp, Mus musculus
tctttgtaaactacaggcgtcggtt

SEQ ID NO: 60285 - DNA, 25 bp, Mus musculus
tctttgtaagcaccagaggagtagt

SEQ ID NO: 60286 - DNA, 25 bp, Mus musculus
tctttgtaagtgaccccaacaagtt

SEQ ID NO: 60287 - DNA, 25 bp, Mus musculus
tctttgtacagcttgggaccagcag

SEQ ID NO: 60288 - DNA, 25 bp, Mus musculus
tctttgtacccttagcggtcctgaa

SEQ ID NO: 60289 - DNA, 25 bp, Mus musculus
tctttgtaccgtgaacctggtccag

SEQ ID NO: 60290 - DNA, 25 bp, Mus musculus
tctttgtcagagtatcgccagagcc

SEQ ID NO: 60291 - DNA, 25 bp, Mus musculus
tctttgtcggaacactgtcaacggc

SEQ ID NO: 60292 - DNA, 25 bp, Mus musculus
tctttgtcggaagactgtcaacggc

SEQ ID NO: 60293 - DNA, 25 bp, Mus musculus
tctttgtcgtattcaggagctctcc

SEQ ID NO: 60294 - DNA, 25 bp, Mus musculus
tctttgtggatgaggcccaggactg

SEQ ID NO: 60295 - DNA, 25 bp, Mus musculus
tctttgtggctaggctgcgccaacc

SEQ ID NO: 60296 - DNA, 25 bp, Mus musculus
tctttgtgtactgttggttggaacg

SEQ ID NO: 60297 - DNA, 25 bp, Mus musculus
tctttgtgtggaaaacgacagcagc

SEQ ID NO: 60298 - DNA, 25 bp, Mus musculus
tctttgttgaagacacttcgggtct

SEQ ID NO: 60299 - DNA, 25 bp, Mus musculus
tctttgttggacttcagattttcca

SEQ ID NO: 60300 - DNA, 25 bp, Mus musculus
tctttgtttaaggactgaggaccca

SEQ ID NO: 60301 - DNA, 25 bp, Mus musculus
tcttttaacatgtcaaactctggag

SEQ ID NO: 60302 - DNA, 25 bp, Mus musculus
tcttttaatcattaaggaccccagg

SEQ ID NO: 60303 - DNA, 25 bp, Mus musculus
tcttttacaataagagactgaagcg

SEQ ID NO: 60304 - DNA, 25 bp, Mus musculus
tcttttacatgtacctgagagtaat

SEQ ID NO: 60305 - DNA, 25 bp, Mus musculus
tcttttacgaacattctcagacgaa

SEQ ID NO: 60306 - DNA, 25 bp, Mus musculus
tcttttacggcggatgtggcggcaa

SEQ ID NO: 60307 - DNA, 25 bp, Mus musculus
tcttttacttcgtggctgccctctg

SEQ ID NO: 60308 - DNA, 25 bp, Mus musculus
tcttttagagatccctgcagctaag

SEQ ID NO: 60309 - DNA, 25 bp, Mus musculus
tcttttaggaagagcaccatatcca

SEQ ID NO: 60310 - DNA, 25 bp, Mus musculus
tcttttcagtggaaggctttaagcc

SEQ ID NO: 60311 - DNA, 25 bp, Mus musculus
tcttttcctaagctcacaatttggc

SEQ ID NO: 60312 - DNA, 25 bp, Mus musculus
tcttttcctggatgtcagctgccct

SEQ ID NO: 60313 - DNA, 25 bp, Mus musculus
tcttttcggaattggagtttgggag

SEQ ID NO: 60314 - DNA, 25 bp, Mus musculus
tcttttctcagtcctcagggcctca

SEQ ID NO: 60315 - DNA, 25 bp, Mus musculus
tcttttctctgcctggtggcagctg

SEQ ID NO: 60316 - DNA, 25 bp, Mus musculus
tcttttctgagatcctgggagctgt

SEQ ID NO: 60317 - DNA, 25 bp, Mus musculus
tcttttctgagggtattttagtgga

SEQ ID NO: 60318 - DNA, 25 bp, Mus musculus
tcttttcttgggttgtggctggaca

SEQ ID NO: 60319 - DNA, 25 bp, Mus musculus
tcttttgcgtggacgagggcggact

SEQ ID NO: 60320 - DNA, 25 bp, Mus musculus
tcttttggagacgtgctagagagtg

SEQ ID NO: 60321 - DNA, 25 bp, Mus musculus
tcttttggcgggtagtgctgtctct

SEQ ID NO: 60322 - DNA, 25 bp, Mus musculus
tcttttggctctggtcagggccctg

SEQ ID NO: 60323 - DNA, 25 bp, Mus musculus
tcttttgggccagttggcttggata

SEQ ID NO: 60324 - DNA, 25 bp, Mus musculus
tcttttggtcctaagaatcgttcaa

SEQ ID NO: 60325 - DNA, 25 bp, Mus musculus
tcttttgtctccagccactatatcg

SEQ ID NO: 60326 - DNA, 25 bp, Mus musculus
tcttttgtcttggagtgtcccactg

SEQ ID NO: 60327 - DNA, 25 bp, Mus musculus
tcttttgtggcatgctgatgaacta

SEQ ID NO: 60328 - DNA, 25 bp, Mus musculus
tctttttaaagcgagaatcattcat

SEQ ID NO: 60329 - DNA, 25 bp, Mus musculus
tctttttagatgaatggcggaaatt

SEQ ID NO: 60330 - DNA, 25 bp, Mus musculus
tctttttctagacactggatgtata

SEQ ID NO: 60331 - DNA, 25 bp, Mus musculus
tctttttgggcccactcccacgatg

SEQ ID NO: 60332 - DNA, 25 bp, Mus musculus
tgaaaaaacataacctcaaattagg

SEQ ID NO: 60333 - DNA, 25 bp, Mus musculus
tgaaaaaaccaacggtgccaccgca

SEQ ID NO: 60334 - DNA, 25 bp, Mus musculus
tgaaaaaatttcaattccagatgcc

SEQ ID NO: 60335 - DNA, 25 bp, Mus musculus
tgaaaaaatttctattccagatgcc

SEQ ID NO: 60336 - DNA, 25 bp, Mus musculus
tgaaaaacagtttgaccacattccc

SEQ ID NO: 60337 - DNA, 25 bp, Mus musculus
tgaaaaactttcatgtagacctttg

SEQ ID NO: 60338 - DNA, 25 bp, Mus musculus
tgaaaaagaagaaatactgaaggca

SEQ ID NO: 60339 - DNA, 25 bp, Mus musculus
tgaaaaagcaggtggtcaagctgaa

SEQ ID NO: 60340 - DNA, 25 bp, Mus musculus
tgaaaaagtagccatgctgacccaa

SEQ ID NO: 60341 - DNA, 25 bp, Mus musculus
tgaaaaagtgacacaagcatcatca

SEQ ID NO: 60342 - DNA, 25 bp, Mus musculus
tgaaaaatttggacccttcgctggg

SEQ ID NO: 60343 - DNA, 25 bp, Mus musculus
tgaaaacacagaaagggcatctctc

SEQ ID NO: 60344 - DNA, 25 bp, Mus musculus
tgaaaacacccctgggaacttgtag

SEQ ID NO: 60345 - DNA, 25 bp, Mus musculus
tgaaaacagaagactaaaatagggc

SEQ ID NO: 60346 - DNA, 25 bp, Mus musculus
tgaaaacatcaatgaaagcaggcag

SEQ ID NO: 60347 - DNA, 25 bp, Mus musculus
tgaaaacatttatatcagacatagc

SEQ ID NO: 60348 - DNA, 25 bp, Mus musculus
tgaaaaccaaggtaccttggatgcc

SEQ ID NO: 60349 - DNA, 25 bp, Mus musculus
tgaaaaccagctttcagatccgtct

SEQ ID NO: 60350 - DNA, 25 bp, Mus musculus
tgaaaaccaggcgactatctccagc

SEQ ID NO: 60351 - DNA, 25 bp, Mus musculus
tgaaaaccattcacatttgggtctt

SEQ ID NO: 60352 - DNA, 25 bp, Mus musculus
tgaaaaccccagagctacaagatgt

SEQ ID NO: 60353 - DNA, 25 bp, Mus musculus
tgaaaaccccagtgctacaagatgt

SEQ ID NO: 60354 - DNA, 25 bp, Mus musculus
tgaaaaccctcagcttacggaagga

SEQ ID NO: 60355 - DNA, 25 bp, Mus musculus
tgaaaaccctgctgattctgaaaaa

SEQ ID NO: 60356 - DNA, 25 bp, Mus musculus
tgaaaaccgtggtcgagtcctgctg

SEQ ID NO: 60357 - DNA, 25 bp, Mus musculus
tgaaaacctatgacacgtacgtggg

SEQ ID NO: 60358 - DNA, 25 bp, Mus musculus
tgaaaacgaaagcttggacatactg

SEQ ID NO: 60359 - DNA, 25 bp, Mus musculus
tgaaaacgggcagtgagacatcact

SEQ ID NO: 60360 - DNA, 25 bp, Mus musculus
tgaaaactatggtggaaatttccct

SEQ ID NO: 60361 - DNA, 25 bp, Mus musculus
tgaaaagactgctgtcagatagcac

SEQ ID NO: 60362 - DNA, 25 bp, Mus musculus
tgaaaagagacagcggccagtactg

SEQ ID NO: 60363 - DNA, 25 bp, Mus musculus
tgaaaagcacattaagcaaatactg

SEQ ID NO: 60364 - DNA, 25 bp, Mus musculus
tgaaaagcccttcaggcctagtact

SEQ ID NO: 60365 - DNA, 25 bp, Mus musculus
tgaaaagcgcttcccttcaaggttc

SEQ ID NO: 60366 - DNA, 25 bp, Mus musculus
tgaaaagctctaccacagcctgagc

SEQ ID NO: 60367 - DNA, 25 bp, Mus musculus
tgaaaaggctctaaagaaacacaag

SEQ ID NO: 60368 - DNA, 25 bp, Mus musculus
tgaaaaggtacattaaccagctgac

SEQ ID NO: 60369 - DNA, 25 bp, Mus musculus
tgaaaagtactgttaacgaatcctt

SEQ ID NO: 60370 - DNA, 25 bp, Mus musculus
tgaaaagtcctgtattaagagccct

SEQ ID NO: 60371 - DNA, 25 bp, Mus musculus
tgaaaagttgtcagactcctgtgct

SEQ ID NO: 60372 - DNA, 25 bp, Mus musculus
tgaaaataaaggtggacagcattct

SEQ ID NO: 60373 - DNA, 25 bp, Mus musculus
tgaaaatatccaactaccgcacaca

SEQ ID NO: 60374 - DNA, 25 bp, Mus musculus
tgaaaatatggactacagactgatg

SEQ ID NO: 60375 - DNA, 25 bp, Mus musculus
tgaaaatctggggagctagagtcct

SEQ ID NO: 60376 - DNA, 25 bp, Mus musculus
tgaaaatgaggaagactgctggaat

SEQ ID NO: 60377 - DNA, 25 bp, Mus musculus
tgaaaatgaggatgactgctggaat

SEQ ID NO: 60378 - DNA, 25 bp, Mus musculus
tgaaaatgaggtgcctgagcctcct

SEQ ID NO: 60379 - DNA, 25 bp, Mus musculus
tgaaaatgatttgaaggcactacaa

SEQ ID NO: 60380 - DNA, 25 bp, Mus musculus
tgaaaatgcagacgctgtgtatgaa

SEQ ID NO: 60381 - DNA, 25 bp, Mus musculus
tgaaaatgccaagtacatttctcgg

SEQ ID NO: 60382 - DNA, 25 bp, Mus musculus
tgaaaatgcctacccagtcagacga

SEQ ID NO: 60383 - DNA, 25 bp, Mus musculus
tgaaaatggcatggccaggtgtgcc

SEQ ID NO: 60384 - DNA, 25 bp, Mus musculus
tgaaaattgacctcactgtgctgct

SEQ ID NO: 60385 - DNA, 25 bp, Mus musculus
tgaaaattgcaacttgctagaagaa

SEQ ID NO: 60386 - DNA, 25 bp, Mus musculus
tgaaaattggctacctctacaccta

SEQ ID NO: 60387 - DNA, 25 bp, Mus musculus
tgaaaattgttgaccggaagaagaa

SEQ ID NO: 60388 - DNA, 25 bp, Mus musculus
tgaaaatttttccttggctacagca

SEQ ID NO: 60389 - DNA, 25 bp, Mus musculus
tgaaacaactcatgaaagtagatcc

SEQ ID NO: 60390 - DNA, 25 bp, Mus musculus
tgaaacaagctaagaagttctggtc

SEQ ID NO: 60391 - DNA, 25 bp, Mus musculus
tgaaacaagctatgaagttctggtc

SEQ ID NO: 60392 - DNA, 25 bp, Mus musculus
tgaaacaagtgaagatgctaactgt

SEQ ID NO: 60393 - DNA, 25 bp, Mus musculus
tgaaacaccggaagctccgggaaca

SEQ ID NO: 60394 - DNA, 25 bp, Mus musculus
tgaaacacctgcaacctgagcagat

SEQ ID NO: 60395 - DNA, 25 bp, Mus musculus
tgaaacactgaagcgtctgtttgtt

SEQ ID NO: 60396 - DNA, 25 bp, Mus musculus
tgaaacagaattcccttaagaaata

SEQ ID NO: 60397 - DNA, 25 bp, Mus musculus
tgaaacagaggacatgataaactgt

SEQ ID NO: 60398 - DNA, 25 bp, Mus musculus
tgaaacagctggatcactgagacct

SEQ ID NO: 60399 - DNA, 25 bp, Mus musculus
tgaaacagcttgacaagaacaaact

SEQ ID NO: 60400 - DNA, 25 bp, Mus musculus
tgaaacagtattcccagcatggtct

SEQ ID NO: 60401 - DNA, 25 bp, Mus musculus
tgaaacagtcagtccagcagttgcg

SEQ ID NO: 60402 - DNA, 25 bp, Mus musculus
tgaaacagtgcggttccaaggaaga

SEQ ID NO: 60403 - DNA, 25 bp, Mus musculus
tgaaacatatgtccccaaagagttt

SEQ ID NO: 60404 - DNA, 25 bp, Mus musculus
tgaaacatctagaagacattgtgga

SEQ ID NO: 60405 - DNA, 25 bp, Mus musculus
tgaaaccaataaagaagaagatgaa

SEQ ID NO: 60406 - DNA, 25 bp, Mus musculus
tgaaaccactctatgctaaccggtg

SEQ ID NO: 60407 - DNA, 25 bp, Mus musculus
tgaaaccatcccatataacgatctg

SEQ ID NO: 60408 - DNA, 25 bp, Mus musculus
tgaaaccggccacgtacctggtgcc

SEQ ID NO: 60409 - DNA, 25 bp, Mus musculus
tgaaacgaactggaaacttcgagcg

SEQ ID NO: 60410 - DNA, 25 bp, Mus musculus
tgaaacgacccatggagacgaggac

SEQ ID NO: 60411 - DNA, 25 bp, Mus musculus
tgaaacgcagacaacagataagaaa

SEQ ID NO: 60412 - DNA, 25 bp, Mus musculus
tgaaacgctaccacagccagaccta

SEQ ID NO: 60413 - DNA, 25 bp, Mus musculus
tgaaacgctgcgctacagactctct

SEQ ID NO: 60414 - DNA, 25 bp, Mus musculus
tgaaacgctgcggtacagactctct

SEQ ID NO: 60415 - DNA, 25 bp, Mus musculus
tgaaacggactctccaaaccctgga

SEQ ID NO: 60416 - DNA, 25 bp, Mus musculus
tgaaacggcttgtcggtagtgatca

SEQ ID NO: 60417 - DNA, 25 bp, Mus musculus
tgaaactattcacttgcacaagagg

SEQ ID NO: 60418 - DNA, 25 bp, Mus musculus
tgaaactcattcaagatggccaagt

SEQ ID NO: 60419 - DNA, 25 bp, Mus musculus
tgaaactccgattcagcatcactat

SEQ ID NO: 60420 - DNA, 25 bp, Mus musculus
tgaaactccgtcttcagatggctgc

SEQ ID NO: 60421 - DNA, 25 bp, Mus musculus
tgaaactgctcaaaagaggaatgat

SEQ ID NO: 60422 - DNA, 25 bp, Mus musculus
tgaaactggcccgaaactggttttg

SEQ ID NO: 60423 - DNA, 25 bp, Mus musculus
tgaaactgttttcccagaatgcttc

SEQ ID NO: 60424 - DNA, 25 bp, Mus musculus
tgaaactgttttgccagaatgcttc

SEQ ID NO: 60425 - DNA, 25 bp, Mus musculus
tgaaacttactctgagtactaggct

SEQ ID NO: 60426 - DNA, 25 bp, Mus musculus
tgaaagaagcggtgaaccactgata

SEQ ID NO: 60427 - DNA, 25 bp, Mus musculus
tgaaagaattctttgatttacggtt

SEQ ID NO: 60428 - DNA, 25 bp, Mus musculus
tgaaagacaattcttccggcacgtt

SEQ ID NO: 60429 - DNA, 25 bp, Mus musculus
tgaaagacgaagctgatgcggatct

SEQ ID NO: 60430 - DNA, 25 bp, Mus musculus
tgaaagactcactgggctggaccca

SEQ ID NO: 60431 - DNA, 25 bp, Mus musculus
tgaaagagacagagaaatcaattcc

SEQ ID NO: 60432 - DNA, 25 bp, Mus musculus
tgaaagaggagagtcaagctatgac

SEQ ID NO: 60433 - DNA, 25 bp, Mus musculus
tgaaagagtagtttacaagagcccc

SEQ ID NO: 60434 - DNA, 25 bp, Mus musculus
tgaaagatagcaggccatggcagca

SEQ ID NO: 60435 - DNA, 25 bp, Mus musculus
tgaaagatctgacgaggcttgtttt

SEQ ID NO: 60436 - DNA, 25 bp, Mus musculus
tgaaagatctgaggaggcttgtttt

SEQ ID NO: 60437 - DNA, 25 bp, Mus musculus
tgaaagatgcctactatcagactct

SEQ ID NO: 60438 - DNA, 25 bp, Mus musculus
tgaaagcactgaacaaaaccactcc

SEQ ID NO: 60439 - DNA, 25 bp, Mus musculus
tgaaagcagaagtcctcagctaccc

SEQ ID NO: 60440 - DNA, 25 bp, Mus musculus
tgaaagcagagcaagcaatagaaat

SEQ ID NO: 60441 - DNA, 25 bp, Mus musculus
tgaaagcagccattaaacatgccct

SEQ ID NO: 60442 - DNA, 25 bp, Mus musculus
tgaaagcagtcctggcttctaaggc

SEQ ID NO: 60443 - DNA, 25 bp, Mus musculus
tgaaagcatggaaagcagaccgggc

SEQ ID NO: 60444 - DNA, 25 bp, Mus musculus
tgaaagccacatctataactactgt

SEQ ID NO: 60445 - DNA, 25 bp, Mus musculus
tgaaagccacattttgatcagcaga

SEQ ID NO: 60446 - DNA, 25 bp, Mus musculus
tgaaagccatcatgatggcctctca

SEQ ID NO: 60447 - DNA, 25 bp, Mus musculus
tgaaagcctatttcccctgtattgg

SEQ ID NO: 60448 - DNA, 25 bp, Mus musculus
tgaaagcctcagaataccttggacc

SEQ ID NO: 60449 - DNA, 25 bp, Mus musculus
tgaaagcctctctttgggccaaacc

SEQ ID NO: 60450 - DNA, 25 bp, Mus musculus
tgaaagcgggcctgctcattcgaag

SEQ ID NO: 60451 - DNA, 25 bp, Mus musculus
tgaaagctactcgtgtaagatggcg

SEQ ID NO: 60452 - DNA, 25 bp, Mus musculus
tgaaagctgctcacctcatggatgt

SEQ ID NO: 60453 - DNA, 25 bp, Mus musculus
tgaaagctttagagaccagatgtct

SEQ ID NO: 60454 - DNA, 25 bp, Mus musculus
tgaaaggaagcgtgcagtttgcact

SEQ ID NO: 60455 - DNA, 25 bp, Mus musculus
tgaaaggagcgctttttgaaggttc

SEQ ID NO: 60456 - DNA, 25 bp, Mus musculus
tgaaaggcctaatgcacaatcaagc

SEQ ID NO: 60457 - DNA, 25 bp, Mus musculus
tgaaaggcggatacttggaccagcg

SEQ ID NO: 60458 - DNA, 25 bp, Mus musculus
tgaaaggctacttcctggctggagg

SEQ ID NO: 60459 - DNA, 25 bp, Mus musculus
tgaaaggctagctctcatttagtca

SEQ ID NO: 60460 - DNA, 25 bp, Mus musculus
tgaaagggccatgcgtgtcagaaaa

SEQ ID NO: 60461 - DNA, 25 bp, Mus musculus
tgaaaggtccacagacagcgtcact

SEQ ID NO: 60462 - DNA, 25 bp, Mus musculus
tgaaagtacgtttggaagcagaagc

SEQ ID NO: 60463 - DNA, 25 bp, Mus musculus
tgaaagtattccaactcaaaaaaga

SEQ ID NO: 60464 - DNA, 25 bp, Mus musculus
tgaaagtattcctactcaaaaaaga

SEQ ID NO: 60465 - DNA, 25 bp, Mus musculus
tgaaagtcacttattggcccctgct

SEQ ID NO: 60466 - DNA, 25 bp, Mus musculus
tgaaagtccaagtgcggtatggacg

SEQ ID NO: 60467 - DNA, 25 bp, Mus musculus
tgaaagtctacgaggacgaaacaaa

SEQ ID NO: 60468 - DNA, 25 bp, Mus musculus
tgaaagtctgtatactctgtgtgag

SEQ ID NO: 60469 - DNA, 25 bp, Mus musculus
tgaaagtgacaagcattacaggaag

SEQ ID NO: 60470 - DNA, 25 bp, Mus musculus
tgaaagtgacctggctgcacaccag

SEQ ID NO: 60471 - DNA, 25 bp, Mus musculus
tgaaagtgaccttcgggccatgact

SEQ ID NO: 60472 - DNA, 25 bp, Mus musculus
tgaaagtgagcaagcacctgctgtg

SEQ ID NO: 60473 - DNA, 25 bp, Mus musculus
tgaaagttggttacacagaaaagca

SEQ ID NO: 60474 - DNA, 25 bp, Mus musculus
tgaaataacaaagattctgagcagc

SEQ ID NO: 60475 - DNA, 25 bp, Mus musculus
tgaaataaccaagataatgagcacc

SEQ ID NO: 60476 - DNA, 25 bp, Mus musculus
tgaaatcacaatggacagtcttgac

SEQ ID NO: 60477 - DNA, 25 bp, Mus musculus
tgaaatccatgttcgcgattggctt

SEQ ID NO: 60478 - DNA, 25 bp, Mus musculus
tgaaatccgaatgctagacaataga

SEQ ID NO: 60479 - DNA, 25 bp, Mus musculus
tgaaatcctgtcatgcagtgtccca

SEQ ID NO: 60480 - DNA, 25 bp, Mus musculus
tgaaatgagacccttgcctagatac

SEQ ID NO: 60481 - DNA, 25 bp, Mus musculus
tgaaatgagtgccaagaaaatccat

SEQ ID NO: 60482 - DNA, 25 bp, Mus musculus
tgaaatgatagagtatgagtcgcca

SEQ ID NO: 60483 - DNA, 25 bp, Mus musculus
tgaaatgcagagaagaattgatgag

SEQ ID NO: 60484 - DNA, 25 bp, Mus musculus
tgaaatgcatccagtttagggcaga

SEQ ID NO: 60485 - DNA, 25 bp, Mus musculus
tgaaatgcctcaactcacaaaacgt

SEQ ID NO: 60486 - DNA, 25 bp, Mus musculus
tgaaatggagacatttggtgcaacg

SEQ ID NO: 60487 - DNA, 25 bp, Mus musculus
tgaaatggcaagaaggcctccaggt

SEQ ID NO: 60488 - DNA, 25 bp, Mus musculus
tgaaatggccaatctggatggctcc

SEQ ID NO: 60489 - DNA, 25 bp, Mus musculus
tgaaatgggcatgaaaaaccatgag

SEQ ID NO: 60490 - DNA, 25 bp, Mus musculus
tgaaattaccccagatccagaagat

SEQ ID NO: 60491 - DNA, 25 bp, Mus musculus
tgaaattatggaaactgacgtcaac

SEQ ID NO: 60492 - DNA, 25 bp, Mus musculus
tgaaattatggatactgacgtcaac

SEQ ID NO: 60493 - DNA, 25 bp, Mus musculus
tgaaattctcaacaggactgagaag

SEQ ID NO: 60494 - DNA, 25 bp, Mus musculus
tgaaattgactttaaagacacgggt

SEQ ID NO: 60495 - DNA, 25 bp, Mus musculus
tgaaatttgataccacacccaatga

SEQ ID NO: 60496 - DNA, 25 bp, Mus musculus
tgaacaaaaaccttcccttgcatgc

SEQ ID NO: 60497 - DNA, 25 bp, Mus musculus
tgaacaaaaccactccattgctaga

SEQ ID NO: 60498 - DNA, 25 bp, Mus musculus
tgaacaaaccgatggaatcaaagct

SEQ ID NO: 60499 - DNA, 25 bp, Mus musculus
tgaacaaagagccatccgagtgaag

SEQ ID NO: 60500 - DNA, 25 bp, Mus musculus
tgaacaaagtggacggacccgatgt

SEQ ID NO: 60501 - DNA, 25 bp, Mus musculus
tgaacaaatacatagtgcttccaaa

SEQ ID NO: 60502 - DNA, 25 bp, Mus musculus
tgaacaaccaatgaatttaatcccc

SEQ ID NO: 60503 - DNA, 25 bp, Mus musculus
tgaacaaccaccaagtcaagggcct

SEQ ID NO: 60504 - DNA, 25 bp, Mus musculus
tgaacaacgccaagatcagcccttg

SEQ ID NO: 60505 - DNA, 25 bp, Mus musculus
tgaacaacgtggaagtacacacagc

SEQ ID NO: 60506 - DNA, 25 bp, Mus musculus
tgaacaagaaagacctctggagcgc

SEQ ID NO: 60507 - DNA, 25 bp, Mus musculus
tgaacaagaagagggccatacccaa

SEQ ID NO: 60508 - DNA, 25 bp, Mus musculus
tgaacaagccggtgctctcctactg

SEQ ID NO: 60509 - DNA, 25 bp, Mus musculus
tgaacaaggacccagaggtgatcgt

SEQ ID NO: 60510 - DNA, 25 bp, Mus musculus
tgaacaaggtcagcactaagaggcc

SEQ ID NO: 60511 - DNA, 25 bp, Mus musculus
tgaacacaagcacaatattcggccc

SEQ ID NO: 60512 - DNA, 25 bp, Mus musculus
tgaacacatagaaatccttacagta

SEQ ID NO: 60513 - DNA, 25 bp, Mus musculus
tgaacacatatctagcctcatcaaa

SEQ ID NO: 60514 - DNA, 25 bp, Mus musculus
tgaacacccggctgattctccagta

SEQ ID NO: 60515 - DNA, 25 bp, Mus musculus
tgaacacccttgctcacacagaggt

SEQ ID NO: 60516 - DNA, 25 bp, Mus musculus
tgaacaccggaaagcgtgaaagtgt

SEQ ID NO: 60517 - DNA, 25 bp, Mus musculus
tgaacacgcagaacttcagggtcgt

SEQ ID NO: 60518 - DNA, 25 bp, Mus musculus
tgaacactcggaaggagctacagtc

SEQ ID NO: 60519 - DNA, 25 bp, Mus musculus
tgaacacttgcacagcataggcacc

SEQ ID NO: 60520 - DNA, 25 bp, Mus musculus
tgaacagaaaaattcaacgccaaga

SEQ ID NO: 60521 - DNA, 25 bp, Mus musculus
tgaacagaatgatccagaggctgac

SEQ ID NO: 60522 - DNA, 25 bp, Mus musculus
tgaacagacctaatgcccgcaatgc

SEQ ID NO: 60523 - DNA, 25 bp, Mus musculus
tgaacagacggatacaggacggagc

SEQ ID NO: 60524 - DNA, 25 bp, Mus musculus
tgaacagcaaccacacaggctacga

SEQ ID NO: 60525 - DNA, 25 bp, Mus musculus
tgaacagcccatggcttgtcgacct

SEQ ID NO: 60526 - DNA, 25 bp, Mus musculus
tgaacagcctgtggccgtcttcctg

SEQ ID NO: 60527 - DNA, 25 bp, Mus musculus
tgaacaggaaacgagtgatgctgac

SEQ ID NO: 60528 - DNA, 25 bp, Mus musculus
tgaacaggaatcaggcatttggaat

SEQ ID NO: 60529 - DNA, 25 bp, Mus musculus
tgaacagtctgcgagagatccaagc

SEQ ID NO: 60530 - DNA, 25 bp, Mus musculus
tgaacagtgtggtcacgtgtccatg

SEQ ID NO: 60531 - DNA, 25 bp, Mus musculus
tgaacatcaggactgtatgtccttt

SEQ ID NO: 60532 - DNA, 25 bp, Mus musculus
tgaacatgcaacctgccacaacact

SEQ ID NO: 60533 - DNA, 25 bp, Mus musculus
tgaacatgcacagaaagagcttcag

SEQ ID NO: 60534 - DNA, 25 bp, Mus musculus
tgaacatgcattcctccgtgcggta

SEQ ID NO: 60535 - DNA, 25 bp, Mus musculus
tgaacatggactgtgtcgtggctga

SEQ ID NO: 60536 - DNA, 25 bp, Mus musculus
tgaacatggatgtgtccttccacct

SEQ ID NO: 60537 - DNA, 25 bp, Mus musculus
tgaacatggctacgcctcatcgttc

SEQ ID NO: 60538 - DNA, 25 bp, Mus musculus
tgaacattgagtccaagacctgcgc

SEQ ID NO: 60539 - DNA, 25 bp, Mus musculus
tgaacattgttcacagcacttctga

SEQ ID NO: 60540 - DNA, 25 bp, Mus musculus
tgaaccaaaatgatcagctcctgag

SEQ ID NO: 60541 - DNA, 25 bp, Mus musculus
tgaaccaacccaaccctttgctggc

SEQ ID NO: 60542 - DNA, 25 bp, Mus musculus
tgaaccaagttaaccctatcggctg

SEQ ID NO: 60543 - DNA, 25 bp, Mus musculus
tgaaccacagaatgagataatccac

SEQ ID NO: 60544 - DNA, 25 bp, Mus musculus
tgaaccactacaaagtctccacacg

SEQ ID NO: 60545 - DNA, 25 bp, Mus musculus
tgaaccagagcagtgtacgttctgt

SEQ ID NO: 60546 - DNA, 25 bp, Mus musculus
tgaaccagctgtaaagttacatctg

SEQ ID NO: 60547 - DNA, 25 bp, Mus musculus
tgaaccatggacaagtatattctgc

SEQ ID NO: 60548 - DNA, 25 bp, Mus musculus
tgaaccattaccttaccctccgaag

SEQ ID NO: 60549 - DNA, 25 bp, Mus musculus
tgaaccccagctccttgcagatgat

SEQ ID NO: 60550 - DNA, 25 bp, Mus musculus
tgaacccgttgatgacacatgctgg

SEQ ID NO: 60551 - DNA, 25 bp, Mus musculus
tgaaccctgaggtgacgcagaggat

SEQ ID NO: 60552 - DNA, 25 bp, Mus musculus
tgaaccctgtctgccagacaatgct

SEQ ID NO: 60553 - DNA, 25 bp, Mus musculus
tgaacccttccagtaggacggaaat

SEQ ID NO: 60554 - DNA, 25 bp, Mus musculus
tgaaccgaaggtgctagaccctgag

SEQ ID NO: 60555 - DNA, 25 bp, Mus musculus
tgaaccgacagaaggcagtaacctg

SEQ ID NO: 60556 - DNA, 25 bp, Mus musculus
tgaaccgactcatcatgaactacct

SEQ ID NO: 60557 - DNA, 25 bp, Mus musculus
tgaaccgcaccactcctggagtgag

SEQ ID NO: 60558 - DNA, 25 bp, Mus musculus
tgaaccgctttcagagggccaactg

SEQ ID NO: 60559 - DNA, 25 bp, Mus musculus
tgaaccgggaaaacccacagctgaa

SEQ ID NO: 60560 - DNA, 25 bp, Mus musculus
tgaaccgggcctaggaggaatgacc

SEQ ID NO: 60561 - DNA, 25 bp, Mus musculus
tgaaccgtgtgtcgcaaattctgca

SEQ ID NO: 60562 - DNA, 25 bp, Mus musculus
tgaaccgtgtttcatgctgatcggg

SEQ ID NO: 60563 - DNA, 25 bp, Mus musculus
tgaacctaacgaggtgacaccctca

SEQ ID NO: 60564 - DNA, 25 bp, Mus musculus
tgaacctcaccgagaaaatcaagaa

SEQ ID NO: 60565 - DNA, 25 bp, Mus musculus
tgaacctcaccgtgaaaatcaagaa

SEQ ID NO: 60566 - DNA, 25 bp, Mus musculus
tgaacctcccagcagtcaacagcat

SEQ ID NO: 60567 - DNA, 25 bp, Mus musculus
tgaacctcgatactgcagatgcctt

SEQ ID NO: 60568 - DNA, 25 bp, Mus musculus
tgaacctgaagtagaggaggaggag

SEQ ID NO: 60569 - DNA, 25 bp, Mus musculus
tgaacctgaatgtgtacacctgccg

SEQ ID NO: 60570 - DNA, 25 bp, Mus musculus
tgaacctgaccttcagctaacctca

SEQ ID NO: 60571 - DNA, 25 bp, Mus musculus
tgaacctgacggatgccccagacat

SEQ ID NO: 60572 - DNA, 25 bp, Mus musculus
tgaacctgagctcaaaacagaccca

SEQ ID NO: 60573 - DNA, 25 bp, Mus musculus
tgaacctgaggaagatcagctctga

SEQ ID NO: 60574 - DNA, 25 bp, Mus musculus
tgaacctgatggcactgtaacgctg

SEQ ID NO: 60575 - DNA, 25 bp, Mus musculus
tgaacctgcttatcaccataatggg

SEQ ID NO: 60576 - DNA, 25 bp, Mus musculus
tgaaccttattcacagtgaaatcag

SEQ ID NO: 60577 - DNA, 25 bp, Mus musculus
tgaaccttctttgtcccggcagcga

SEQ ID NO: 60578 - DNA, 25 bp, Mus musculus
tgaaccttgcaaaaataggaacaga

SEQ ID NO: 60579 - DNA, 25 bp, Mus musculus
tgaaccttggtataaattcttttcg

SEQ ID NO: 60580 - DNA, 25 bp, Mus musculus
tgaacgaaccacctggcgctcgagc

SEQ ID NO: 60581 - DNA, 25 bp, Mus musculus
tgaacgacaactgcaagaagctccg

SEQ ID NO: 60582 - DNA, 25 bp, Mus musculus
tgaacgacatgtggacaattggcct

SEQ ID NO: 60583 - DNA, 25 bp, Mus musculus
tgaacgagaccgtgtgcagaagaaa

SEQ ID NO: 60584 - DNA, 25 bp, Mus musculus
tgaacgaggacactggcactgacta

SEQ ID NO: 60585 - DNA, 25 bp, Mus musculus
tgaacgatgtcatggcagagttagc

SEQ ID NO: 60586 - DNA, 25 bp, Mus musculus
tgaacgcatgctcccgatggcaggt

SEQ ID NO: 60587 - DNA, 25 bp, Mus musculus
tgaacgccatcttgcaatgcctctg

SEQ ID NO: 60588 - DNA, 25 bp, Mus musculus
tgaacgccgtagatcaagctcgagt

SEQ ID NO: 60589 - DNA, 25 bp, Mus musculus
tgaacgcctgctgctgccttgaact

SEQ ID NO: 60590 - DNA, 25 bp, Mus musculus
tgaacgcctttatggtgtgggccaa

SEQ ID NO: 60591 - DNA, 25 bp, Mus musculus
tgaacgcgcaccagtagatgagcag

SEQ ID NO: 60592 - DNA, 25 bp, Mus musculus
tgaacggaaactagaagcattgcca

SEQ ID NO: 60593 - DNA, 25 bp, Mus musculus
tgaacggctctttatggagatggcg

SEQ ID NO: 60594 - DNA, 25 bp, Mus musculus
tgaacgggataaaagagcagaaggt

SEQ ID NO: 60595 - DNA, 25 bp, Mus musculus
tgaacgggggcttcagctgcttctg

SEQ ID NO: 60596 - DNA, 25 bp, Mus musculus
tgaacgtcactcgaaaggcctactg

SEQ ID NO: 60597 - DNA, 25 bp, Mus musculus
tgaacgtcgcagagaactcaggaga

SEQ ID NO: 60598 - DNA, 25 bp, Mus musculus
tgaactaaatggacttgctgtcaaa

SEQ ID NO: 60599 - DNA, 25 bp, Mus musculus
tgaactaatgctggagtggtgccca

SEQ ID NO: 60600 - DNA, 25 bp, Mus musculus
tgaactacagctagtagcatcttgg

SEQ ID NO: 60601 - DNA, 25 bp, Mus musculus
tgaactaccaggaagaaaacccagc

SEQ ID NO: 60602 - DNA, 25 bp, Mus musculus
tgaactatgcaagccactgcagcgt

SEQ ID NO: 60603 - DNA, 25 bp, Mus musculus
tgaactatgttaagtgtaagactca

SEQ ID NO: 60604 - DNA, 25 bp, Mus musculus
tgaactcaaaataccaccaagcttg

SEQ ID NO: 60605 - DNA, 25 bp, Mus musculus
tgaactcaagcgcaatttcatggcg

SEQ ID NO: 60606 - DNA, 25 bp, Mus musculus
tgaactcacgtccaccatcagaaag

SEQ ID NO: 60607 - DNA, 25 bp, Mus musculus
tgaactcagcgagcaaaacctcagg

SEQ ID NO: 60608 - DNA, 25 bp, Mus musculus
tgaactcgtctgctctcaggcagat

SEQ ID NO: 60609 - DNA, 25 bp, Mus musculus
tgaactctccagaatcaagtgtgtg

SEQ ID NO: 60610 - DNA, 25 bp, Mus musculus
tgaactctggtgtgagtcttcaaag

SEQ ID NO: 60611 - DNA, 25 bp, Mus musculus
tgaactgaaggcataacatccggtc

SEQ ID NO: 60612 - DNA, 25 bp, Mus musculus
tgaactgaatcagccagcgacatct

SEQ ID NO: 60613 - DNA, 25 bp, Mus musculus
tgaactgacacatagaagtctgacc

SEQ ID NO: 60614 - DNA, 25 bp, Mus musculus
tgaactgacaggagatgaacttgag

SEQ ID NO: 60615 - DNA, 25 bp, Mus musculus
tgaactgagacaaagcccaggaggc

SEQ ID NO: 60616 - DNA, 25 bp, Mus musculus
tgaactgagccgagtaattgccttg

SEQ ID NO: 60617 - DNA, 25 bp, Mus musculus
tgaactgagtcgctatccagaggac

SEQ ID NO: 60618 - DNA, 25 bp, Mus musculus
tgaactggcagacttggagacatag

SEQ ID NO: 60619 - DNA, 25 bp, Mus musculus
tgaactggcttgtgactcccaggaa

SEQ ID NO: 60620 - DNA, 25 bp, Mus musculus
tgaactgggagataactctggacac

SEQ ID NO: 60621 - DNA, 25 bp, Mus musculus
tgaacttcacacataccattccagt

SEQ ID NO: 60622 - DNA, 25 bp, Mus musculus
tgaacttccgatcctcatcctgcag

SEQ ID NO: 60623 - DNA, 25 bp, Mus musculus
tgaacttctgaaatcatgctgcaag

SEQ ID NO: 60624 - DNA, 25 bp, Mus musculus
tgaacttctgaacatcgtagttgtg

SEQ ID NO: 60625 - DNA, 25 bp, Mus musculus
tgaacttctgaattcatgctgcaag

SEQ ID NO: 60626 - DNA, 25 bp, Mus musculus
tgaacttgagcacatagcccagaag

SEQ ID NO: 60627 - DNA, 25 bp, Mus musculus
tgaacttgggtcctccgtgagagca

SEQ ID NO: 60628 - DNA, 25 bp, Mus musculus
tgaacttgtaccacgagctgatgaa

SEQ ID NO: 60629 - DNA, 25 bp, Mus musculus
tgaactttctagatgcaagagaaat

SEQ ID NO: 60630 - DNA, 25 bp, Mus musculus
tgaactttgtccgttttactctagg

SEQ ID NO: 60631 - DNA, 25 bp, Mus musculus
tgaactttgtggctgagagcacaag

SEQ ID NO: 60632 - DNA, 25 bp, Mus musculus
tgaacttttccagattacaacagat

SEQ ID NO: 60633 - DNA, 25 bp, Mus musculus
tgaagaaaaaactccagaacagatt

SEQ ID NO: 60634 - DNA, 25 bp, Mus musculus
tgaagaaaaccattcctgcctttta

SEQ ID NO: 60635 - DNA, 25 bp, Mus musculus
tgaagaaacaactgaggaaccctca

SEQ ID NO: 60636 - DNA, 25 bp, Mus musculus
tgaagaaacactaaagactggacct

SEQ ID NO: 60637 - DNA, 25 bp, Mus musculus
tgaagaaaccacctaccctagagcc

SEQ ID NO: 60638 - DNA, 25 bp, Mus musculus
tgaagaaacggaatctgaacccgat

SEQ ID NO: 60639 - DNA, 25 bp, Mus musculus
tgaagaaactaggacgaggcccaac

SEQ ID NO: 60640 - DNA, 25 bp, Mus musculus
tgaagaaactgctgtacaaagaagt

SEQ ID NO: 60641 - DNA, 25 bp, Mus musculus
tgaagaaagaggacaccacctttga

SEQ ID NO: 60642 - DNA, 25 bp, Mus musculus
tgaagaaatgaaagatgcctactat

SEQ ID NO: 60643 - DNA, 25 bp, Mus musculus
tgaagaacaatccagactagcagca

SEQ ID NO: 60644 - DNA, 25 bp, Mus musculus
tgaagaacgcagcaacggttatgcg

SEQ ID NO: 60645 - DNA, 25 bp, Mus musculus
tgaagaacgggcatggccgtttctt

SEQ ID NO: 60646 - DNA, 25 bp, Mus musculus
tgaagaactcgctccctgtgctcat

SEQ ID NO: 60647 - DNA, 25 bp, Mus musculus
tgaagaactctctcgagcccagaat

SEQ ID NO: 60648 - DNA, 25 bp, Mus musculus
tgaagaagaaatggaggccaaggct

SEQ ID NO: 60649 - DNA, 25 bp, Mus musculus
tgaagaagaattgaaaacggtgacg

SEQ ID NO: 60650 - DNA, 25 bp, Mus musculus
tgaagaagacctcccagtcggtgtt

SEQ ID NO: 60651 - DNA, 25 bp, Mus musculus
tgaagaagagctttctggaactgac

SEQ ID NO: 60652 - DNA, 25 bp, Mus musculus
tgaagaagatcaaacggcagctgtc

SEQ ID NO: 60653 - DNA, 25 bp, Mus musculus
tgaagaagatggcatttctgctgtt

SEQ ID NO: 60654 - DNA, 25 bp, Mus musculus
tgaagaagattcgagagccgtgtct

SEQ ID NO: 60655 - DNA, 25 bp, Mus musculus
tgaagaagcccttgaggcagctgtg

SEQ ID NO: 60656 - DNA, 25 bp, Mus musculus
tgaagaaggcacctgagttcccaga

SEQ ID NO: 60657 - DNA, 25 bp, Mus musculus
tgaagaaggcacgtgagttcccaga

SEQ ID NO: 60658 - DNA, 25 bp, Mus musculus
tgaagaaggctatccagagatacgt

SEQ ID NO: 60659 - DNA, 25 bp, Mus musculus
tgaagaagggtttcactacctcgtg

SEQ ID NO: 60660 - DNA, 25 bp, Mus musculus
tgaagaagtatcttgacagtggtgg

SEQ ID NO: 60661 - DNA, 25 bp, Mus musculus
tgaagaatctctttcccacatgcag

SEQ ID NO: 60662 - DNA, 25 bp, Mus musculus
tgaagaatgatgacacagccgacag

SEQ ID NO: 60663 - DNA, 25 bp, Mus musculus
tgaagaatggtgtatatgaactgag

SEQ ID NO: 60664 - DNA, 25 bp, Mus musculus
tgaagacaattaacctgcagagcct

SEQ ID NO: 60665 - DNA, 25 bp, Mus musculus
tgaagacacctagcaagaggatgtg

SEQ ID NO: 60666 - DNA, 25 bp, Mus musculus
tgaagacagaatccagtttcttgtg

SEQ ID NO: 60667 - DNA, 25 bp, Mus musculus
tgaagacagatcatgggagagataa

SEQ ID NO: 60668 - DNA, 25 bp, Mus musculus
tgaagacagcatggacagtcccctg

SEQ ID NO: 60669 - DNA, 25 bp, Mus musculus
tgaagacagtgtttcctcacggcct

SEQ ID NO: 60670 - DNA, 25 bp, Mus musculus
tgaagacagttacctttctgagaat

SEQ ID NO: 60671 - DNA, 25 bp, Mus musculus
tgaagacagtttgactaagcagcct

SEQ ID NO: 60672 - DNA, 25 bp, Mus musculus
tgaagacatcctgtggcccagacgt

SEQ ID NO: 60673 - DNA, 25 bp, Mus musculus
tgaagacattggacaactcaatggc

SEQ ID NO: 60674 - DNA, 25 bp, Mus musculus
tgaagacattgtctcccgaaacccc

SEQ ID NO: 60675 - DNA, 25 bp, Mus musculus
tgaagacattgtgtcccgaaacccc

SEQ ID NO: 60676 - DNA, 25 bp, Mus musculus
tgaagaccaactagcaaaacatttg

SEQ ID NO: 60677 - DNA, 25 bp, Mus musculus
tgaagaccaccttaagtaaaatagg

SEQ ID NO: 60678 - DNA, 25 bp, Mus musculus
tgaagaccaggttcacattcagacc

SEQ ID NO: 60679 - DNA, 25 bp, Mus musculus
tgaagaccttcttccaggaacaggc

SEQ ID NO: 60680 - DNA, 25 bp, Mus musculus
tgaagacgctgcagactcagatagc

SEQ ID NO: 60681 - DNA, 25 bp, Mus musculus
tgaagactgtcattggaggtagaag

SEQ ID NO: 60682 - DNA, 25 bp, Mus musculus
tgaagacttcttcgtgatgagtgat

SEQ ID NO: 60683 - DNA, 25 bp, Mus musculus
tgaagactttgcagcacaggttttc

SEQ ID NO: 60684 - DNA, 25 bp, Mus musculus
tgaagagaaccccattgccttagat

SEQ ID NO: 60685 - DNA, 25 bp, Mus musculus
tgaagagacctgtcacttctgagga

SEQ ID NO: 60686 - DNA, 25 bp, Mus musculus
tgaagagacgttcttgcccctacat

SEQ ID NO: 60687 - DNA, 25 bp, Mus musculus
tgaagagactagcagctcgctgctt

SEQ ID NO: 60688 - DNA, 25 bp, Mus musculus
tgaagagactccactgaaaccaagg

SEQ ID NO: 60689 - DNA, 25 bp, Mus musculus
tgaagagactttctacacaatgagc

SEQ ID NO: 60690 - DNA, 25 bp, Mus musculus
tgaagagagcccaacagaaattatc

SEQ ID NO: 60691 - DNA, 25 bp, Mus musculus
tgaagagatgccaacaggcccaagt

SEQ ID NO: 60692 - DNA, 25 bp, Mus musculus
tgaagagatgctgcgattctacagc

SEQ ID NO: 60693 - DNA, 25 bp, Mus musculus
tgaagagattatgagaagaaccagg

SEQ ID NO: 60694 - DNA, 25 bp, Mus musculus
tgaagagattgaagaagacctttcc

SEQ ID NO: 60695 - DNA, 25 bp, Mus musculus
tgaagagcccatctagcaactggtg

SEQ ID NO: 60696 - DNA, 25 bp, Mus musculus
tgaagagcctccgtttgcttgttgc

SEQ ID NO: 60697 - DNA, 25 bp, Mus musculus
tgaagagctagaggtccagagagac

SEQ ID NO: 60698 - DNA, 25 bp, Mus musculus
tgaagagctctttcctgcccacaaa

SEQ ID NO: 60699 - DNA, 25 bp, Mus musculus
tgaagaggacttgctgccactggat

SEQ ID NO: 60700 - DNA, 25 bp, Mus musculus
tgaagaggactttgcctgtccacag

SEQ ID NO: 60701 - DNA, 25 bp, Mus musculus
tgaagaggagctttgatgtccgaga

SEQ ID NO: 60702 - DNA, 25 bp, Mus musculus
tgaagaggatggtggtatatcagac

SEQ ID NO: 60703 - DNA, 25 bp, Mus musculus
tgaagaggcatctagcaggacccct

SEQ ID NO: 60704 - DNA, 25 bp, Mus musculus
tgaagagtgggtaaagtgtgtatac

SEQ ID NO: 60705 - DNA, 25 bp, Mus musculus
tgaagagttaccttcaccacacaaa

SEQ ID NO: 60706 - DNA, 25 bp, Mus musculus
tgaagagttctcaaaggaaaagttt

SEQ ID NO: 60707 - DNA, 25 bp, Mus musculus
tgaagatagaagaaagggctgaaaa

SEQ ID NO: 60708 - DNA, 25 bp, Mus musculus
tgaagatatttttgctcgagacaaa

SEQ ID NO: 60709 - DNA, 25 bp, Mus musculus
tgaagatcagagactgccttgtgtg

SEQ ID NO: 60710 - DNA, 25 bp, Mus musculus
tgaagatcctcatgaaagttggaca

SEQ ID NO: 60711 - DNA, 25 bp, Mus musculus
tgaagatctgataagaatgaggaag

SEQ ID NO: 60712 - DNA, 25 bp, Mus musculus
tgaagatgacacctttctaacagct

SEQ ID NO: 60713 - DNA, 25 bp, Mus musculus
tgaagatgcacaaccgaagccacac

SEQ ID NO: 60714 - DNA, 25 bp, Mus musculus
tgaagatgcacatccgaagccacac

SEQ ID NO: 60715 - DNA, 25 bp, Mus musculus
tgaagatgccatcacaggggacact

SEQ ID NO: 60716 - DNA, 25 bp, Mus musculus
tgaagatgcggtaccgatgcgaaga

SEQ ID NO: 60717 - DNA, 25 bp, Mus musculus
tgaagatgcggttccgatgcgaaga

SEQ ID NO: 60718 - DNA, 25 bp, Mus musculus
tgaagatgctgaccggaagtatgaa

SEQ ID NO: 60719 - DNA, 25 bp, Mus musculus
tgaagatgcttgaaaaactcaacca

SEQ ID NO: 60720 - DNA, 25 bp, Mus musculus
tgaagatgcttgtaaaactcaacca

SEQ ID NO: 60721 - DNA, 25 bp, Mus musculus
tgaagatggatcaggctttgctgct

SEQ ID NO: 60722 - DNA, 25 bp, Mus musculus
tgaagatggtcagcccgtgcagctg

SEQ ID NO: 60723 - DNA, 25 bp, Mus musculus
tgaagatgtcaactaaagaaaggac

SEQ ID NO: 60724 - DNA, 25 bp, Mus musculus
tgaagatgtggatctggcccaggta

SEQ ID NO: 60725 - DNA, 25 bp, Mus musculus
tgaagatgtgtacgccgtagtcacg

SEQ ID NO: 60726 - DNA, 25 bp, Mus musculus
tgaagattccagttctgcaatggga

SEQ ID NO: 60727 - DNA, 25 bp, Mus musculus
tgaagattctacgtgcctcaaggaa

SEQ ID NO: 60728 - DNA, 25 bp, Mus musculus
tgaagattgacgtgtttgagagaga

SEQ ID NO: 60729 - DNA, 25 bp, Mus musculus
tgaagattgcaaggctatacctgga

SEQ ID NO: 60730 - DNA, 25 bp, Mus musculus
tgaagcaaatgaggaccagagcagt

SEQ ID NO: 60731 - DNA, 25 bp, Mus musculus
tgaagcaacccatagaacccgggag

SEQ ID NO: 60732 - DNA, 25 bp, Mus musculus
tgaagcaacgggactacgagacagc

SEQ ID NO: 60733 - DNA, 25 bp, Mus musculus
tgaagcacctgctgtccgggcagga

SEQ ID NO: 60734 - DNA, 25 bp, Mus musculus
tgaagcacctggtctcggataagct

SEQ ID NO: 60735 - DNA, 25 bp, Mus musculus
tgaagcacctgtgtggcgactggtt

SEQ ID NO: 60736 - DNA, 25 bp, Mus musculus
tgaagcactacagctaaccccaggt

SEQ ID NO: 60737 - DNA, 25 bp, Mus musculus
tgaagcactctcctgatctaatgag

SEQ ID NO: 60738 - DNA, 25 bp, Mus musculus
tgaagcagacggaagagctgatacg

SEQ ID NO: 60739 - DNA, 25 bp, Mus musculus
tgaagcagagatcccttctacaagg

SEQ ID NO: 60740 - DNA, 25 bp, Mus musculus
tgaagcagagcatcctaaggtcaag

SEQ ID NO: 60741 - DNA, 25 bp, Mus musculus
tgaagcagatcgagaaggaatacac

SEQ ID NO: 60742 - DNA, 25 bp, Mus musculus
tgaagcagcacaagaagctgaccca

SEQ ID NO: 60743 - DNA, 25 bp, Mus musculus
tgaagcaggccattttgcaagcctg

SEQ ID NO: 60744 - DNA, 25 bp, Mus musculus
tgaagcagtacgagcgcagcatcgt

SEQ ID NO: 60745 - DNA, 25 bp, Mus musculus
tgaagcagtgggaatcgataaagac

SEQ ID NO: 60746 - DNA, 25 bp, Mus musculus
tgaagcagtttgagcacctggaccc

SEQ ID NO: 60747 - DNA, 25 bp, Mus musculus
tgaagcatcctgtgggcccggagtt

SEQ ID NO: 60748 - DNA, 25 bp, Mus musculus
tgaagcatgtagagcctgaggtgct

SEQ ID NO: 60749 - DNA, 25 bp, Mus musculus
tgaagccaagaacatcacgcagatt

SEQ ID NO: 60750 - DNA, 25 bp, Mus musculus
tgaagccactgtgtttggtctttgg

SEQ ID NO: 60751 - DNA, 25 bp, Mus musculus
tgaagccagagtttgagagtgctgc

SEQ ID NO: 60752 - DNA, 25 bp, Mus musculus
tgaagccagcgagccggagctcctg

SEQ ID NO: 60753 - DNA, 25 bp, Mus musculus
tgaagccagtccagcacttagcctg

SEQ ID NO: 60754 - DNA, 25 bp, Mus musculus
tgaagcccaagaagccggcaaggct

SEQ ID NO: 60755 - DNA, 25 bp, Mus musculus
tgaagccctgaaagacgacagctgg

SEQ ID NO: 60756 - DNA, 25 bp, Mus musculus
tgaagcccttggagtgttaaatacc

SEQ ID NO: 60757 - DNA, 25 bp, Mus musculus
tgaagccgatagcatagacagtgat

SEQ ID NO: 60758 - DNA, 25 bp, Mus musculus
tgaagccgattcgtctaaatgggac

SEQ ID NO: 60759 - DNA, 25 bp, Mus musculus
tgaagcctatgagcccgtgtgtaga

SEQ ID NO: 60760 - DNA, 25 bp, Mus musculus
tgaagcctcaggcacagcctgtctg

SEQ ID NO: 60761 - DNA, 25 bp, Mus musculus
tgaagcctggaacgaagccaccaat

SEQ ID NO: 60762 - DNA, 25 bp, Mus musculus
tgaagcctggcatggctcctgcttc

SEQ ID NO: 60763 - DNA, 25 bp, Mus musculus
tgaagcctggtgttcgatacagaga

SEQ ID NO: 60764 - DNA, 25 bp, Mus musculus
tgaagcctgtctgcagttttcacaa

SEQ ID NO: 60765 - DNA, 25 bp, Mus musculus
tgaagcgacccctcgaggcaacctt

SEQ ID NO: 60766 - DNA, 25 bp, Mus musculus
tgaagcgattttggctactgacctg

SEQ ID NO: 60767 - DNA, 25 bp, Mus musculus
tgaagcgctgttcctgacactccag

SEQ ID NO: 60768 - DNA, 25 bp, Mus musculus
tgaagcggcagaaaatacagagaga

SEQ ID NO: 60769 - DNA, 25 bp, Mus musculus
tgaagcggcgatgctaccgttcgcc

SEQ ID NO: 60770 - DNA, 25 bp, Mus musculus
tgaagcgggtccgaatctccctggc

SEQ ID NO: 60771 - DNA, 25 bp, Mus musculus
tgaagcggttccctcagtatgtgtt

SEQ ID NO: 60772 - DNA, 25 bp, Mus musculus
tgaagcgtcacatgattacccactc

SEQ ID NO: 60773 - DNA, 25 bp, Mus musculus
tgaagcgtctctctgccttttacaa

SEQ ID NO: 60774 - DNA, 25 bp, Mus musculus
tgaagctaacggcaccatcaagcag

SEQ ID NO: 60775 - DNA, 25 bp, Mus musculus
tgaagctagaaaaggatacagcaga

SEQ ID NO: 60776 - DNA, 25 bp, Mus musculus
tgaagctcattttaagactcgttgg

SEQ ID NO: 60777 - DNA, 25 bp, Mus musculus
tgaagctcctgtttgaagaccttgg

SEQ ID NO: 60778 - DNA, 25 bp, Mus musculus
tgaagctcgggctggttaaatgact

SEQ ID NO: 60779 - DNA, 25 bp, Mus musculus
tgaagctcgttaactttcagcagag

SEQ ID NO: 60780 - DNA, 25 bp, Mus musculus
tgaagctcttcgacagcatctgcaa

SEQ ID NO: 60781 - DNA, 25 bp, Mus musculus
tgaagctgaattccttcctccatga

SEQ ID NO: 60782 - DNA, 25 bp, Mus musculus
tgaagctgacagtgtggtaccacag

SEQ ID NO: 60783 - DNA, 25 bp, Mus musculus
tgaagctgagtctcatcaaagtcgt

SEQ ID NO: 60784 - DNA, 25 bp, Mus musculus
tgaagctgcgactgctgtgtagcca

SEQ ID NO: 60785 - DNA, 25 bp, Mus musculus
tgaagctggaccactaccgagcagc

SEQ ID NO: 60786 - DNA, 25 bp, Mus musculus
tgaagctggagcagaacacttgttc

SEQ ID NO: 60787 - DNA, 25 bp, Mus musculus
tgaagctggcaagtccgaattcgga

SEQ ID NO: 60788 - DNA, 25 bp, Mus musculus
tgaagctgttccgacattactacgt

SEQ ID NO: 60789 - DNA, 25 bp, Mus musculus
tgaagcttactgctgatgccaagtt

SEQ ID NO: 60790 - DNA, 25 bp, Mus musculus
tgaaggaaaaggagcgcaaggcaac

SEQ ID NO: 60791 - DNA, 25 bp, Mus musculus
tgaaggaaacatctattcctgatgt

SEQ ID NO: 60792 - DNA, 25 bp, Mus musculus
tgaaggaacacaggactgccgtttt

SEQ ID NO: 60793 - DNA, 25 bp, Mus musculus
tgaaggaacagtacaagaaggagcg

SEQ ID NO: 60794 - DNA, 25 bp, Mus musculus
tgaaggaacgccttcaggcactgca

SEQ ID NO: 60795 - DNA, 25 bp, Mus musculus
tgaaggaacggaaactacagaaggc

SEQ ID NO: 60796 - DNA, 25 bp, Mus musculus
tgaaggaagtgtaccttgacctgct

SEQ ID NO: 60797 - DNA, 25 bp, Mus musculus
tgaaggacacaacagacagctgcct

SEQ ID NO: 60798 - DNA, 25 bp, Mus musculus
tgaaggacactgtgccccgattaga

SEQ ID NO: 60799 - DNA, 25 bp, Mus musculus
tgaaggacctattgagaggcaaatg

SEQ ID NO: 60800 - DNA, 25 bp, Mus musculus
tgaaggacttcttaccgcagccaag

SEQ ID NO: 60801 - DNA, 25 bp, Mus musculus
tgaaggagacacattggttctgcac

SEQ ID NO: 60802 - DNA, 25 bp, Mus musculus
tgaaggagaggtactctctgtatga

SEQ ID NO: 60803 - DNA, 25 bp, Mus musculus
tgaaggagatcctcctccggaaggg

SEQ ID NO: 60804 - DNA, 25 bp, Mus musculus
tgaaggagccaaagtccaccaggct

SEQ ID NO: 60805 - DNA, 25 bp, Mus musculus
tgaaggagctcctgcgtgaggctcc

SEQ ID NO: 60806 - DNA, 25 bp, Mus musculus
tgaaggaggacctctccggctcacc

SEQ ID NO: 60807 - DNA, 25 bp, Mus musculus
tgaaggaggacggacacatggtcac

SEQ ID NO: 60808 - DNA, 25 bp, Mus musculus
tgaaggagtacatccttgtggagga

SEQ ID NO: 60809 - DNA, 25 bp, Mus musculus
tgaaggataaccacgacaaaataaa

SEQ ID NO: 60810 - DNA, 25 bp, Mus musculus
tgaaggatattagttttctcaggag

SEQ ID NO: 60811 - DNA, 25 bp, Mus musculus
tgaaggatcctgacatggtctggga

SEQ ID NO: 60812 - DNA, 25 bp, Mus musculus
tgaaggatgacagctacgcaccaaa

SEQ ID NO: 60813 - DNA, 25 bp, Mus musculus
tgaaggatttcccaggaagcgaacc

SEQ ID NO: 60814 - DNA, 25 bp, Mus musculus
tgaaggcaaaatctgctagcatcag

SEQ ID NO: 60815 - DNA, 25 bp, Mus musculus
tgaaggcacctctgcagcttgtaag

SEQ ID NO: 60816 - DNA, 25 bp, Mus musculus
tgaaggcattgcaggtagcccatgg

SEQ ID NO: 60817 - DNA, 25 bp, Mus musculus
tgaaggccactctggtgctcttgcc

SEQ ID NO: 60818 - DNA, 25 bp, Mus musculus
tgaaggccagcactttgcgtcacct

SEQ ID NO: 60819 - DNA, 25 bp, Mus musculus
tgaaggcgactatctggatgactgg

SEQ ID NO: 60820 - DNA, 25 bp, Mus musculus
tgaaggctccagcaattgcagtggc

SEQ ID NO: 60821 - DNA, 25 bp, Mus musculus
tgaaggctcccatgattctgaatgg

SEQ ID NO: 60822 - DNA, 25 bp, Mus musculus
tgaaggctccgggatcctgatgtgt

SEQ ID NO: 60823 - DNA, 25 bp, Mus musculus
tgaaggctctggtgctgactgcaga

SEQ ID NO: 60824 - DNA, 25 bp, Mus musculus
tgaaggctggctgcaacctgaaaat

SEQ ID NO: 60825 - DNA, 25 bp, Mus musculus
tgaaggctttgaaacccacagtgtt

SEQ ID NO: 60826 - DNA, 25 bp, Mus musculus
tgaagggacctgaacagatggaaga

SEQ ID NO: 60827 - DNA, 25 bp, Mus musculus
tgaagggcacgagagcctggtggac

SEQ ID NO: 60828 - DNA, 25 bp, Mus musculus
tgaagggcagagagtgacttttgac

SEQ ID NO: 60829 - DNA, 25 bp, Mus musculus
tgaagggcaggtatgtcccctgtgc

SEQ ID NO: 60830 - DNA, 25 bp, Mus musculus
tgaagggtacacagactagctctcc

SEQ ID NO: 60831 - DNA, 25 bp, Mus musculus
tgaagggtcccatcagtatgagctc

SEQ ID NO: 60832 - DNA, 25 bp, Mus musculus
tgaagggtctcctcacactggcttg

SEQ ID NO: 60833 - DNA, 25 bp, Mus musculus
tgaaggtcccagcttacagcctgac

SEQ ID NO: 60834 - DNA, 25 bp, Mus musculus
tgaaggtgaccaatgagcccatctt

SEQ ID NO: 60835 - DNA, 25 bp, Mus musculus
tgaaggtgcttatctcttttaaagc

SEQ ID NO: 60836 - DNA, 25 bp, Mus musculus
tgaaggttggtttgatgcctggtct

SEQ ID NO: 60837 - DNA, 25 bp, Mus musculus
tgaagtaactcaagatgagcaagct

SEQ ID NO: 60838 - DNA, 25 bp, Mus musculus
tgaagtacagttggccatattgaag

SEQ ID NO: 60839 - DNA, 25 bp, Mus musculus
tgaagtaccagcaaggaataaggcc

SEQ ID NO: 60840 - DNA, 25 bp, Mus musculus
tgaagtacccgtaccatgacagtac

SEQ ID NO: 60841 - DNA, 25 bp, Mus musculus
tgaagtactcatcaaaaatagccag

SEQ ID NO: 60842 - DNA, 25 bp, Mus musculus
tgaagtatgtggattccaacctctg

SEQ ID NO: 60843 - DNA, 25 bp, Mus musculus
tgaagtcacagcaaaaagtattacg

SEQ ID NO: 60844 - DNA, 25 bp, Mus musculus
tgaagtcactcaatatccccatggc

SEQ ID NO: 60845 - DNA, 25 bp, Mus musculus
tgaagtcactgagaccatttgcaag

SEQ ID NO: 60846 - DNA, 25 bp, Mus musculus
tgaagtcagcgtggatggacacacg

SEQ ID NO: 60847 - DNA, 25 bp, Mus musculus
tgaagtccaggctcagaagacagga

SEQ ID NO: 60848 - DNA, 25 bp, Mus musculus
tgaagtcctggtccgtcgagagtca

SEQ ID NO: 60849 - DNA, 25 bp, Mus musculus
tgaagtcggtggattgtgttatcga

SEQ ID NO: 60850 - DNA, 25 bp, Mus musculus
tgaagtctccttctccataattagg

SEQ ID NO: 60851 - DNA, 25 bp, Mus musculus
tgaagtctctcatgaccactacaga

SEQ ID NO: 60852 - DNA, 25 bp, Mus musculus
tgaagtgaaccttgcttcgcctact

SEQ ID NO: 60853 - DNA, 25 bp, Mus musculus
tgaagtgactacctacaaagctgtg

SEQ ID NO: 60854 - DNA, 25 bp, Mus musculus
tgaagtgatgtggaacacatcagag

SEQ ID NO: 60855 - DNA, 25 bp, Mus musculus
tgaagtgcagcatcagagcttatcc

SEQ ID NO: 60856 - DNA, 25 bp, Mus musculus
tgaagtgcatcagtgaaggtcagaa

SEQ ID NO: 60857 - DNA, 25 bp, Mus musculus
tgaagtgctaaaacagttaacagaa

SEQ ID NO: 60858 - DNA, 25 bp, Mus musculus
tgaagtgctgtccaaatcttacagg

SEQ ID NO: 60859 - DNA, 25 bp, Mus musculus
tgaagtggaccgaaagaaatgcaaa

SEQ ID NO: 60860 - DNA, 25 bp, Mus musculus
tgaagtgtaaagaagattcccggcc

SEQ ID NO: 60861 - DNA, 25 bp, Mus musculus
tgaagtgtcctgcttagtagctgga

SEQ ID NO: 60862 - DNA, 25 bp, Mus musculus
tgaagtgtggcctcatgagcatgtg

SEQ ID NO: 60863 - DNA, 25 bp, Mus musculus
tgaagttaaagagatcgccactcct

SEQ ID NO: 60864 - DNA, 25 bp, Mus musculus
tgaagttactgactgcacgccactt

SEQ ID NO: 60865 - DNA, 25 bp, Mus musculus
tgaagttaggatcctccagcctcta

SEQ ID NO: 60866 - DNA, 25 bp, Mus musculus
tgaagttcaagcagaagcagcggga

SEQ ID NO: 60867 - DNA, 25 bp, Mus musculus
tgaagttcagtgaaatggacacact

SEQ ID NO: 60868 - DNA, 25 bp, Mus musculus
tgaagttcccatcattatcacagat

SEQ ID NO: 60869 - DNA, 25 bp, Mus musculus
tgaagttcccatgattatcacagat

SEQ ID NO: 60870 - DNA, 25 bp, Mus musculus
tgaagttcctacagaattctcgggt

SEQ ID NO: 60871 - DNA, 25 bp, Mus musculus
tgaagttcctctggtattccaaggc

SEQ ID NO: 60872 - DNA, 25 bp, Mus musculus
tgaagttgatcatgagtttcctccc

SEQ ID NO: 60873 - DNA, 25 bp, Mus musculus
tgaagttgctgtttgaagtggagaa

SEQ ID NO: 60874 - DNA, 25 bp, Mus musculus
tgaagttgcttgaactgggagctaa

SEQ ID NO: 60875 - DNA, 25 bp, Mus musculus
tgaagttggcagagtcacagcgact

SEQ ID NO: 60876 - DNA, 25 bp, Mus musculus
tgaagttgttcgaagtcattgaaac

SEQ ID NO: 60877 - DNA, 25 bp, Mus musculus
tgaagttgtttttattcctgggcga

SEQ ID NO: 60878 - DNA, 25 bp, Mus musculus
tgaagtttctaccagccagagtgga

SEQ ID NO: 60879 - DNA, 25 bp, Mus musculus
tgaagtttctacgagccagagtgga

SEQ ID NO: 60880 - DNA, 25 bp, Mus musculus
tgaataaacgccacagcctggaggt

SEQ ID NO: 60881 - DNA, 25 bp, Mus musculus
tgaatacagcgacagagatgagaac

SEQ ID NO: 60882 - DNA, 25 bp, Mus musculus
tgaatacattgttatgacggtttac

SEQ ID NO: 60883 - DNA, 25 bp, Mus musculus
tgaataccaccccaggcacagtggg

SEQ ID NO: 60884 - DNA, 25 bp, Mus musculus
tgaatacccagatgagctccagtgt

SEQ ID NO: 60885 - DNA, 25 bp, Mus musculus
tgaatacccttcaccctggcagtac

SEQ ID NO: 60886 - DNA, 25 bp, Mus musculus
tgaatacttatggaggtcagccgaa

SEQ ID NO: 60887 - DNA, 25 bp, Mus musculus
tgaatagtaatcacacaggctacga

SEQ ID NO: 60888 - DNA, 25 bp, Mus musculus
tgaatatcgagccaaaaaactctcc

SEQ ID NO: 60889 - DNA, 25 bp, Mus musculus
tgaatatcgatacaagaagtcttaa

SEQ ID NO: 60890 - DNA, 25 bp, Mus musculus
tgaatatcgatagaagaagtcttaa

SEQ ID NO: 60891 - DNA, 25 bp, Mus musculus
tgaatatcgggcacgaagtcggcta

SEQ ID NO: 60892 - DNA, 25 bp, Mus musculus
tgaatatgactctcgggtgaaggcc

SEQ ID NO: 60893 - DNA, 25 bp, Mus musculus
tgaatatgagaggaacgggagatat

SEQ ID NO: 60894 - DNA, 25 bp, Mus musculus
tgaatcacaaccatttggcgctgag

SEQ ID NO: 60895 - DNA, 25 bp, Mus musculus
tgaatcacacaattacaatgcaaag

SEQ ID NO: 60896 - DNA, 25 bp, Mus musculus
tgaatcacctttcccacgttcttga

SEQ ID NO: 60897 - DNA, 25 bp, Mus musculus
tgaatcagaagtgccatagcgttgc

SEQ ID NO: 60898 - DNA, 25 bp, Mus musculus
tgaatccaaggcctttgagccctgg

SEQ ID NO: 60899 - DNA, 25 bp, Mus musculus
tgaatccaataagggaggagtgacc

SEQ ID NO: 60900 - DNA, 25 bp, Mus musculus
tgaatccagaaagcctatgatgcct

SEQ ID NO: 60901 - DNA, 25 bp, Mus musculus
tgaatcccagagaaacaaaccgcac

SEQ ID NO: 60902 - DNA, 25 bp, Mus musculus
tgaatcccgaacctgcacccggaga

SEQ ID NO: 60903 - DNA, 25 bp, Mus musculus
tgaatcccgggcacaaatggccctg

SEQ ID NO: 60904 - DNA, 25 bp, Mus musculus
tgaatccctctacaaagctttctgg

SEQ ID NO: 60905 - DNA, 25 bp, Mus musculus
tgaatcgcaccgcatacactgtggg

SEQ ID NO: 60906 - DNA, 25 bp, Mus musculus
tgaatcgcaccggatacactgtggg

SEQ ID NO: 60907 - DNA, 25 bp, Mus musculus
tgaatcgggcacacatgctgagagc

SEQ ID NO: 60908 - DNA, 25 bp, Mus musculus
tgaatctacagaaaattgccagcct

SEQ ID NO: 60909 - DNA, 25 bp, Mus musculus
tgaatctgaagaacggaagtggcaa

SEQ ID NO: 60910 - DNA, 25 bp, Mus musculus
tgaatctgacccagtgaaagcgtgg

SEQ ID NO: 60911 - DNA, 25 bp, Mus musculus
tgaatctgaggagcagatccagagc

SEQ ID NO: 60912 - DNA, 25 bp, Mus musculus
tgaatctgtgaaatttgtcactcag

SEQ ID NO: 60913 - DNA, 25 bp, Mus musculus
tgaatctgtgaattttgtcactcag

SEQ ID NO: 60914 - DNA, 25 bp, Mus musculus
tgaatgaaatccgtaggctggaacg

SEQ ID NO: 60915 - DNA, 25 bp, Mus musculus
tgaatgaactcattctcaaacagaa

SEQ ID NO: 60916 - DNA, 25 bp, Mus musculus
tgaatgaaggatgacagctacgcac

SEQ ID NO: 60917 - DNA, 25 bp, Mus musculus
tgaatgaccccgtgcggcagaggca

SEQ ID NO: 60918 - DNA, 25 bp, Mus musculus
tgaatgacgtttcgcaaaaggcaga

SEQ ID NO: 60919 - DNA, 25 bp, Mus musculus
tgaatgacttggatacagacagctt

SEQ ID NO: 60920 - DNA, 25 bp, Mus musculus
tgaatgagcgagtcttgaacaggct

SEQ ID NO: 60921 - DNA, 25 bp, Mus musculus
tgaatgaggaaacggccagtcttct

SEQ ID NO: 60922 - DNA, 25 bp, Mus musculus
tgaatgatctaacagttcaccgggc

SEQ ID NO: 60923 - DNA, 25 bp, Mus musculus
tgaatgatgatgtctttgatgtgct

SEQ ID NO: 60924 - DNA, 25 bp, Mus musculus
tgaatgattgatacagaactgaact

SEQ ID NO: 60925 - DNA, 25 bp, Mus musculus
tgaatgcaacatgaacaaaaacctt

SEQ ID NO: 60926 - DNA, 25 bp, Mus musculus
tgaatgcaatcacacagaccagctc

SEQ ID NO: 60927 - DNA, 25 bp, Mus musculus
tgaatgcagcccaccaaggagaagt

SEQ ID NO: 60928 - DNA, 25 bp, Mus musculus
tgaatgcagctgacgctttcgacat

SEQ ID NO: 60929 - DNA, 25 bp, Mus musculus
tgaatgcagttcagactgaggcaag

SEQ ID NO: 60930 - DNA, 25 bp, Mus musculus
tgaatgccacctacatccgagaagt

SEQ ID NO: 60931 - DNA, 25 bp, Mus musculus
tgaatgccaccttcatccgagaagt

SEQ ID NO: 60932 - DNA, 25 bp, Mus musculus
tgaatgcgaaagaggattagggcaa

SEQ ID NO: 60933 - DNA, 25 bp, Mus musculus
tgaatgcgagccagggatgatcaag

SEQ ID NO: 60934 - DNA, 25 bp, Mus musculus
tgaatgcgattcaaatggaaaccat

SEQ ID NO: 60935 - DNA, 25 bp, Mus musculus
tgaatgctgctgtcagggctgtgac

SEQ ID NO: 60936 - DNA, 25 bp, Mus musculus
tgaatggactcagctggatatgttt

SEQ ID NO: 60937 - DNA, 25 bp, Mus musculus
tgaatggccaggatcagattgtgcc

SEQ ID NO: 60938 - DNA, 25 bp, Mus musculus
tgaatggcgtgcctctcatgaccct

SEQ ID NO: 60939 - DNA, 25 bp, Mus musculus
tgaatggtaaagagatgtcaccggg

SEQ ID NO: 60940 - DNA, 25 bp, Mus musculus
tgaatggtaacctatccccaggccg

SEQ ID NO: 60941 - DNA, 25 bp, Mus musculus
tgaatggtctgtagttaagaatggc

SEQ ID NO: 60942 - DNA, 25 bp, Mus musculus
tgaatgtagccagactggtatcaaa

SEQ ID NO: 60943 - DNA, 25 bp, Mus musculus
tgaatgtgacagagtacatgtgtgg

SEQ ID NO: 60944 - DNA, 25 bp, Mus musculus
tgaatgtgactcagtggacagaact

SEQ ID NO: 60945 - DNA, 25 bp, Mus musculus
tgaatgtgactctgtggacagaact

SEQ ID NO: 60946 - DNA, 25 bp, Mus musculus
tgaatgtggcagacaggctagctga

SEQ ID NO: 60947 - DNA, 25 bp, Mus musculus
tgaatgtggccgaggtccttgtcaa

SEQ ID NO: 60948 - DNA, 25 bp, Mus musculus
tgaatgtggcctccctgctccagta

SEQ ID NO: 60949 - DNA, 25 bp, Mus musculus
tgaattaatatgatccaggagctct

SEQ ID NO: 60950 - DNA, 25 bp, Mus musculus
tgaattaatatgttccaggagctct

SEQ ID NO: 60951 - DNA, 25 bp, Mus musculus
tgaattaattaggaagccagtggat

SEQ ID NO: 60952 - DNA, 25 bp, Mus musculus
tgaattagcctgacattttatcaac

SEQ ID NO: 60953 - DNA, 25 bp, Mus musculus
tgaattatataaacaagacagggac

SEQ ID NO: 60954 - DNA, 25 bp, Mus musculus
tgaattatcaggagattacactgac

SEQ ID NO: 60955 - DNA, 25 bp, Mus musculus
tgaattcacagttatatagcaagct

SEQ ID NO: 60956 - DNA, 25 bp, Mus musculus
tgaattcaggaaggcctgagaccat

SEQ ID NO: 60957 - DNA, 25 bp, Mus musculus
tgaattccaaggctgaagtaaggtt

SEQ ID NO: 60958 - DNA, 25 bp, Mus musculus
tgaattcctctgtgccaaccacgtg

SEQ ID NO: 60959 - DNA, 25 bp, Mus musculus
tgaattctcaccaaataacactgtc

SEQ ID NO: 60960 - DNA, 25 bp, Mus musculus
tgaattctctgaagaagcggcagct

SEQ ID NO: 60961 - DNA, 25 bp, Mus musculus
tgaattgaggctggaaggtgaacct

SEQ ID NO: 60962 - DNA, 25 bp, Mus musculus
tgaattgccaaaccaggcgtgcctg

SEQ ID NO: 60963 - DNA, 25 bp, Mus musculus
tgaattgctcatgcctgtagggagg

SEQ ID NO: 60964 - DNA, 25 bp, Mus musculus
tgaattggctccctctgaccgccat

SEQ ID NO: 60965 - DNA, 25 bp, Mus musculus
tgaattggtggcctagcaacctcca

SEQ ID NO: 60966 - DNA, 25 bp, Mus musculus
tgaatttaacaatcacaatgaggcc

SEQ ID NO: 60967 - DNA, 25 bp, Mus musculus
tgaatttaggacagtcctcctccct

SEQ ID NO: 60968 - DNA, 25 bp, Mus musculus
tgaatttcagaaagggtctcacaaa

SEQ ID NO: 60969 - DNA, 25 bp, Mus musculus
tgaatttcagaatgggtctcacaaa

SEQ ID NO: 60970 - DNA, 25 bp, Mus musculus
tgaatttgcaaatctgagagcagag

SEQ ID NO: 60971 - DNA, 25 bp, Mus musculus
tgaatttggtctggaacttgatgaa

SEQ ID NO: 60972 - DNA, 25 bp, Mus musculus
tgacaaaatctccttggagagacag

SEQ ID NO: 60973 - DNA, 25 bp, Mus musculus
tgacaaacaagatgccctggacttg

SEQ ID NO: 60974 - DNA, 25 bp, Mus musculus
tgacaaacggaagcgcatgctacgt

SEQ ID NO: 60975 - DNA, 25 bp, Mus musculus
tgacaaacgtactccctttggaagt

SEQ ID NO: 60976 - DNA, 25 bp, Mus musculus
tgacaaaggccgcttctatgccttt

SEQ ID NO: 60977 - DNA, 25 bp, Mus musculus
tgacaaatctagtgacaattcaagt

SEQ ID NO: 60978 - DNA, 25 bp, Mus musculus
tgacaacaaacgtgtggctgaagca

SEQ ID NO: 60979 - DNA, 25 bp, Mus musculus
tgacaacagcgtgaagtacccgtac

SEQ ID NO: 60980 - DNA, 25 bp, Mus musculus
tgacaacagctactacctggcagtt

SEQ ID NO: 60981 - DNA, 25 bp, Mus musculus
tgacaacagctcttcccaagtgcca

SEQ ID NO: 60982 - DNA, 25 bp, Mus musculus
tgacaacagtgctacagtttgaagg

SEQ ID NO: 60983 - DNA, 25 bp, Mus musculus
tgacaacattaactcatagaacccg

SEQ ID NO: 60984 - DNA, 25 bp, Mus musculus
tgacaacatttggaccaaaggcctg

SEQ ID NO: 60985 - DNA, 25 bp, Mus musculus
tgacaaccggcagattgtctctggg

SEQ ID NO: 60986 - DNA, 25 bp, Mus musculus
tgacaacctcccactgttctacagg

SEQ ID NO: 60987 - DNA, 25 bp, Mus musculus
tgacaacctgaaaacggatgagcgc

SEQ ID NO: 60988 - DNA, 25 bp, Mus musculus
tgacaacctggccatccagctcact

SEQ ID NO: 60989 - DNA, 25 bp, Mus musculus
tgacaacgagtgaatgaggaacccc

SEQ ID NO: 60990 - DNA, 25 bp, Mus musculus
tgacaacgagtgtatgaggaacccc

SEQ ID NO: 60991 - DNA, 25 bp, Mus musculus
tgacaacgccccacaggtgttacct

SEQ ID NO: 60992 - DNA, 25 bp, Mus musculus
tgacaacgcccctcaggtgttacct

SEQ ID NO: 60993 - DNA, 25 bp, Mus musculus
tgacaagaacaaactacaggcgatt

SEQ ID NO: 60994 - DNA, 25 bp, Mus musculus
tgacaagaaccccagacatagccca

SEQ ID NO: 60995 - DNA, 25 bp, Mus musculus
tgacaagacctgtaaactctggagt

SEQ ID NO: 60996 - DNA, 25 bp, Mus musculus
tgacaagagggctccaggagaccag

SEQ ID NO: 60997 - DNA, 25 bp, Mus musculus
tgacaagataactgttcctgcaaaa

SEQ ID NO: 60998 - DNA, 25 bp, Mus musculus
tgacaagcaatcttaagagggaggc

SEQ ID NO: 60999 - DNA, 25 bp, Mus musculus
tgacaagccagggacctgacacact

SEQ ID NO: 61000 - DNA, 25 bp, Mus musculus
tgacaagcctgccttcagaaaggaa

SEQ ID NO: 61001 - DNA, 25 bp, Mus musculus
tgacaagcgcaagctgaagcgggtc

SEQ ID NO: 61002 - DNA, 25 bp, Mus musculus
tgacaagctcagcaagatccagacg

SEQ ID NO: 61003 - DNA, 25 bp, Mus musculus
tgacaagctcaggaagatccagacg

SEQ ID NO: 61004 - DNA, 25 bp, Mus musculus
tgacaaggctgcatcctggctcacc

SEQ ID NO: 61005 - DNA, 25 bp, Mus musculus
tgacaagtcaacacaaaccccaagt

SEQ ID NO: 61006 - DNA, 25 bp, Mus musculus
tgacaagtctggagacgtctactcc

SEQ ID NO: 61007 - DNA, 25 bp, Mus musculus
tgacaagtggttaaattgatctccc

SEQ ID NO: 61008 - DNA, 25 bp, Mus musculus
tgacaatagcattgagcactcagac

SEQ ID NO: 61009 - DNA, 25 bp, Mus musculus
tgacaatcaccgcaaagactggaac

SEQ ID NO: 61010 - DNA, 25 bp, Mus musculus
tgacaatcctccagagtttactgcc

SEQ ID NO: 61011 - DNA, 25 bp, Mus musculus
tgacaatcctcctgagtttactgcc

SEQ ID NO: 61012 - DNA, 25 bp, Mus musculus
tgacaatctgtttggcaaccagccc

SEQ ID NO: 61013 - DNA, 25 bp, Mus musculus
tgacaatctttttgggcccactccc

SEQ ID NO: 61014 - DNA, 25 bp, Mus musculus
tgacaatgatgagcagtttgttcca

SEQ ID NO: 61015 - DNA, 25 bp, Mus musculus
tgacaatgccaaacaagctgcttcg

SEQ ID NO: 61016 - DNA, 25 bp, Mus musculus
tgacaatgcccctgagaaagggaac

SEQ ID NO: 61017 - DNA, 25 bp, Mus musculus
tgacaatggacctcttttcacggaa

SEQ ID NO: 61018 - DNA, 25 bp, Mus musculus
tgacaatggagacatcacctccttg

SEQ ID NO: 61019 - DNA, 25 bp, Mus musculus
tgacaatgggatgtttgcgccaggc

SEQ ID NO: 61020 - DNA, 25 bp, Mus musculus
tgacaatgtgggagatcgccacccg

SEQ ID NO: 61021 - DNA, 25 bp, Mus musculus
tgacaatgttcacaaacagagagtg

SEQ ID NO: 61022 - DNA, 25 bp, Mus musculus
tgacaattgttggaacactaccgtt

SEQ ID NO: 61023 - DNA, 25 bp, Mus musculus
tgacaatttgcccatcaaacgggaa

SEQ ID NO: 61024 - DNA, 25 bp, Mus musculus
tgacacaatcatcaaccagaaacgt

SEQ ID NO: 61025 - DNA, 25 bp, Mus musculus
tgacacacattgaatccagaccttc

SEQ ID NO: 61026 - DNA, 25 bp, Mus musculus
tgacacagatgacgatgaccctttc

SEQ ID NO: 61027 - DNA, 25 bp, Mus musculus
tgacacagtatgatgccaagaagaa

SEQ ID NO: 61028 - DNA, 25 bp, Mus musculus
tgacacagtggctgcacatcagtct

SEQ ID NO: 61029 - DNA, 25 bp, Mus musculus
tgacacatacattgggcagggctat

SEQ ID NO: 61030 - DNA, 25 bp, Mus musculus
tgacaccagcaacccagacatactg

SEQ ID NO: 61031 - DNA, 25 bp, Mus musculus
tgacaccagcaagccagacatactg

SEQ ID NO: 61032 - DNA, 25 bp, Mus musculus
tgacaccatgcctgctgatctgcct

SEQ ID NO: 61033 - DNA, 25 bp, Mus musculus
tgacacccatagatgcttccggatc

SEQ ID NO: 61034 - DNA, 25 bp, Mus musculus
tgacacccctgaaatcatcacagga

SEQ ID NO: 61035 - DNA, 25 bp, Mus musculus
tgacacccgaaatactacccatggc

SEQ ID NO: 61036 - DNA, 25 bp, Mus musculus
tgacacccgtgtacgagtccaatgg

SEQ ID NO: 61037 - DNA, 25 bp, Mus musculus
tgacacctccatcaagccgtacaga

SEQ ID NO: 61038 - DNA, 25 bp, Mus musculus
tgacaccttcatagtaatggcagag

SEQ ID NO: 61039 - DNA, 25 bp, Mus musculus
tgacacgaccctccgaggatgggac

SEQ ID NO: 61040 - DNA, 25 bp, Mus musculus
tgacacgctattactacctttttcc

SEQ ID NO: 61041 - DNA, 25 bp, Mus musculus
tgacacgctatttctacctttttcc

SEQ ID NO: 61042 - DNA, 25 bp, Mus musculus
tgacacgctgggtacagaagccatc

SEQ ID NO: 61043 - DNA, 25 bp, Mus musculus
tgacacggaagagtactgcatggcg

SEQ ID NO: 61044 - DNA, 25 bp, Mus musculus
tgacacgggcactagaacaagaacg

SEQ ID NO: 61045 - DNA, 25 bp, Mus musculus
tgacactccagaccgttgccatctg

SEQ ID NO: 61046 - DNA, 25 bp, Mus musculus
tgacactcgtcagggccgcagtgag

SEQ ID NO: 61047 - DNA, 25 bp, Mus musculus
tgacactgagagctctatcatcatt

SEQ ID NO: 61048 - DNA, 25 bp, Mus musculus
tgacactgctgagcgtggagatgac

SEQ ID NO: 61049 - DNA, 25 bp, Mus musculus
tgacactggatcagggtagtgtgca

SEQ ID NO: 61050 - DNA, 25 bp, Mus musculus
tgacactgggcaccttttcacagag

SEQ ID NO: 61051 - DNA, 25 bp, Mus musculus
tgacactgtgccgagagtgtttgtg

SEQ ID NO: 61052 - DNA, 25 bp, Mus musculus
tgacacttcccaagtatttgacagt

SEQ ID NO: 61053 - DNA, 25 bp, Mus musculus
tgacacttcccatgtatttgacagt

SEQ ID NO: 61054 - DNA, 25 bp, Mus musculus
tgacacttgctcttaagcacggtgg

SEQ ID NO: 61055 - DNA, 25 bp, Mus musculus
tgacacttgggaggaaagttctttg

SEQ ID NO: 61056 - DNA, 25 bp, Mus musculus
tgacacttttcatggatgcctgccc

SEQ ID NO: 61057 - DNA, 25 bp, Mus musculus
tgacagaaccctccactcagtgagc

SEQ ID NO: 61058 - DNA, 25 bp, Mus musculus
tgacagaaccctgcactcagtgagc

SEQ ID NO: 61059 - DNA, 25 bp, Mus musculus
tgacagaagctatgcactggcaggc

SEQ ID NO: 61060 - DNA, 25 bp, Mus musculus
tgacagaaggagactattgaacaga

SEQ ID NO: 61061 - DNA, 25 bp, Mus musculus
tgacagacccaagtcagcgacttgt

SEQ ID NO: 61062 - DNA, 25 bp, Mus musculus
tgacagaccgatcagatgcacggct

SEQ ID NO: 61063 - DNA, 25 bp, Mus musculus
tgacagacttaaaagaagggatatg

SEQ ID NO: 61064 - DNA, 25 bp, Mus musculus
tgacagacttcggttttgccaagcg

SEQ ID NO: 61065 - DNA, 25 bp, Mus musculus
tgacagagatgatccgagtgggctt

SEQ ID NO: 61066 - DNA, 25 bp, Mus musculus
tgacagagcagaagcttcgagcctg

SEQ ID NO: 61067 - DNA, 25 bp, Mus musculus
tgacagaggatcatggaccaacaag

SEQ ID NO: 61068 - DNA, 25 bp, Mus musculus
tgacagagtggttcatgtgcatctt

SEQ ID NO: 61069 - DNA, 25 bp, Mus musculus
tgacagagttactccactccaggaa

SEQ ID NO: 61070 - DNA, 25 bp, Mus musculus
tgacagatagtgacgacactacgtg

SEQ ID NO: 61071 - DNA, 25 bp, Mus musculus
tgacagcacactcctttgaagagaa

SEQ ID NO: 61072 - DNA, 25 bp, Mus musculus
tgacagccaatttgtccccgcaatg

SEQ ID NO: 61073 - DNA, 25 bp, Mus musculus
tgacagcgatgggatcccgtggtca

SEQ ID NO: 61074 - DNA, 25 bp, Mus musculus
tgacagcggcgacccgttccaaaat

SEQ ID NO: 61075 - DNA, 25 bp, Mus musculus
tgacagctaagtgcccatccaggac

SEQ ID NO: 61076 - DNA, 25 bp, Mus musculus
tgacagctataacaacggaggaggc

SEQ ID NO: 61077 - DNA, 25 bp, Mus musculus
tgacagctatgggaagaaagacctg

SEQ ID NO: 61078 - DNA, 25 bp, Mus musculus
tgacagctcaacttccaggaacagg

SEQ ID NO: 61079 - DNA, 25 bp, Mus musculus
tgacagctgcctacatctgaaacat

SEQ ID NO: 61080 - DNA, 25 bp, Mus musculus
tgacagctttgacttggagcccgtg

SEQ ID NO: 61081 - DNA, 25 bp, Mus musculus
tgacaggacggcatccctttgcctt

SEQ ID NO: 61082 - DNA, 25 bp, Mus musculus
tgacaggctatttgaccctgatccc

SEQ ID NO: 61083 - DNA, 25 bp, Mus musculus
tgacagggaaaaattcccgagttct

SEQ ID NO: 61084 - DNA, 25 bp, Mus musculus
tgacagggaagacatcactgagcct

SEQ ID NO: 61085 - DNA, 25 bp, Mus musculus
tgacagggacagaagcgctgtacca

SEQ ID NO: 61086 - DNA, 25 bp, Mus musculus
tgacagggcagctggacaacatgaa

SEQ ID NO: 61087 - DNA, 25 bp, Mus musculus
tgacagggctgcatggagcaagcca

SEQ ID NO: 61088 - DNA, 25 bp, Mus musculus
tgacaggtccttcgcacaataaaag

SEQ ID NO: 61089 - DNA, 25 bp, Mus musculus
tgacaggtttctggaactatatcct

SEQ ID NO: 61090 - DNA, 25 bp, Mus musculus
tgacaggtttgtgttagcttacacg

SEQ ID NO: 61091 - DNA, 25 bp, Mus musculus
tgacagtacttgagtgaccacgaaa

SEQ ID NO: 61092 - DNA, 25 bp, Mus musculus
tgacagtcctatctttgaagatgat

SEQ ID NO: 61093 - DNA, 25 bp, Mus musculus
tgacagtctctataccagggatgga

SEQ ID NO: 61094 - DNA, 25 bp, Mus musculus
tgacagtgatgattccggagacacc

SEQ ID NO: 61095 - DNA, 25 bp, Mus musculus
tgacagtgccaacgtcaagcaagtg

SEQ ID NO: 61096 - DNA, 25 bp, Mus musculus
tgacagtgctttcaaccttccagcc

SEQ ID NO: 61097 - DNA, 25 bp, Mus musculus
tgacagtgggaagccttccagtaga

SEQ ID NO: 61098 - DNA, 25 bp, Mus musculus
tgacagtgtcgttctgaagcaggac

SEQ ID NO: 61099 - DNA, 25 bp, Mus musculus
tgacagttcagacaaggcccctgtg

SEQ ID NO: 61100 - DNA, 25 bp, Mus musculus
tgacagtttttactgcccacctcct

SEQ ID NO: 61101 - DNA, 25 bp, Mus musculus
tgacataaatttgataccgaggacc

SEQ ID NO: 61102 - DNA, 25 bp, Mus musculus
tgacatacatggttgaaggcggcag

SEQ ID NO: 61103 - DNA, 25 bp, Mus musculus
tgacatacttcgaccctgacttcta

SEQ ID NO: 61104 - DNA, 25 bp, Mus musculus
tgacatagcgttggcttgtgatggc

SEQ ID NO: 61105 - DNA, 25 bp, Mus musculus
tgacatatccgtggagaacaagccc

SEQ ID NO: 61106 - DNA, 25 bp, Mus musculus
tgacatcaacaaagctcttcttgcc

SEQ ID NO: 61107 - DNA, 25 bp, Mus musculus
tgacatcaagttcaactaccaccat

SEQ ID NO: 61108 - DNA, 25 bp, Mus musculus
tgacatcaagttgaactaccaccat

SEQ ID NO: 61109 - DNA, 25 bp, Mus musculus
tgacatcacagcttatctttttgga

SEQ ID NO: 61110 - DNA, 25 bp, Mus musculus
tgacatcacatggtccgagagccca

SEQ ID NO: 61111 - DNA, 25 bp, Mus musculus
tgacatcagatggtccccggtgcat

SEQ ID NO: 61112 - DNA, 25 bp, Mus musculus
tgacatcaggatttctggtctcccc

SEQ ID NO: 61113 - DNA, 25 bp, Mus musculus
tgacatcaggctgtaaacttcctgg

SEQ ID NO: 61114 - DNA, 25 bp, Mus musculus
tgacatcagttaccccagaagctgg

SEQ ID NO: 61115 - DNA, 25 bp, Mus musculus
tgacatcatgttactagacacctgt

SEQ ID NO: 61116 - DNA, 25 bp, Mus musculus
tgacatccacagcacctacaaggag

SEQ ID NO: 61117 - DNA, 25 bp, Mus musculus
tgacatccagacaaagtccgaacag

SEQ ID NO: 61118 - DNA, 25 bp, Mus musculus
tgacatccagaccaagatgactgag

SEQ ID NO: 61119 - DNA, 25 bp, Mus musculus
tgacatcctgctggaggaggtcatt

SEQ ID NO: 61120 - DNA, 25 bp, Mus musculus
tgacatcggctttgctgctggccct

SEQ ID NO: 61121 - DNA, 25 bp, Mus musculus
tgacatctaccggttataccaaagc

SEQ ID NO: 61122 - DNA, 25 bp, Mus musculus
tgacatctcagttgattccaaggag

SEQ ID NO: 61123 - DNA, 25 bp, Mus musculus
tgacatcttcctggatgccccagag

SEQ ID NO: 61124 - DNA, 25 bp, Mus musculus
tgacatgaccatcactgagtgggtt

SEQ ID NO: 61125 - DNA, 25 bp, Mus musculus
tgacatgattgccagaaatggatac

SEQ ID NO: 61126 - DNA, 25 bp, Mus musculus
tgacatggaaggagcagtacaagcc

SEQ ID NO: 61127 - DNA, 25 bp, Mus musculus
tgacatggaattccggaaacattgc

SEQ ID NO: 61128 - DNA, 25 bp, Mus musculus
tgacatggagggttgtgagccctat

SEQ ID NO: 61129 - DNA, 25 bp, Mus musculus
tgacatggcatatgccaggcaacct

SEQ ID NO: 61130 - DNA, 25 bp, Mus musculus
tgacatggtcttcttcctgcaaggc

SEQ ID NO: 61131 - DNA, 25 bp, Mus musculus
tgacatgttgtgtgcaggagatatg

SEQ ID NO: 61132 - DNA, 25 bp, Mus musculus
tgacattaacatctcgggctttcta

SEQ ID NO: 61133 - DNA, 25 bp, Mus musculus
tgacattaaccgtgtccccgaggag

SEQ ID NO: 61134 - DNA, 25 bp, Mus musculus
tgacattcagctctgcaaggacatc

SEQ ID NO: 61135 - DNA, 25 bp, Mus musculus
tgacattcatttttagcagggactg

SEQ ID NO: 61136 - DNA, 25 bp, Mus musculus
tgacattcttcagggctgcaatggg

SEQ ID NO: 61137 - DNA, 25 bp, Mus musculus
tgacattgctggtgagtttgaccca

SEQ ID NO: 61138 - DNA, 25 bp, Mus musculus
tgacatttagtagctgtgtgacctt

SEQ ID NO: 61139 - DNA, 25 bp, Mus musculus
tgacatttccaccacctcttggcag

SEQ ID NO: 61140 - DNA, 25 bp, Mus musculus
tgacatttccacgacctcttggcag

SEQ ID NO: 61141 - DNA, 25 bp, Mus musculus
tgacatttggtcagttgggtgcatc

SEQ ID NO: 61142 - DNA, 25 bp, Mus musculus
tgaccaaagtcaacaaggagtgctg

SEQ ID NO: 61143 - DNA, 25 bp, Mus musculus
tgaccaagaacaaggaacggacatc

SEQ ID NO: 61144 - DNA, 25 bp, Mus musculus
tgaccaagaacgatcccttcaaagc

SEQ ID NO: 61145 - DNA, 25 bp, Mus musculus
tgaccaagacaagagcgattaacgg

SEQ ID NO: 61146 - DNA, 25 bp, Mus musculus
tgaccaagagcagatccttcaccag

SEQ ID NO: 61147 - DNA, 25 bp, Mus musculus
tgaccacattcccatacatctggat

SEQ ID NO: 61148 - DNA, 25 bp, Mus musculus
tgaccacgttttccgtcacataaac

SEQ ID NO: 61149 - DNA, 25 bp, Mus musculus
tgaccactacagatgaacccaatct

SEQ ID NO: 61150 - DNA, 25 bp, Mus musculus
tgaccagaataaacccaaggaagct

SEQ ID NO: 61151 - DNA, 25 bp, Mus musculus
tgaccagaatgaagcccggaaatac

SEQ ID NO: 61152 - DNA, 25 bp, Mus musculus
tgaccagacacagtggcaacagagg

SEQ ID NO: 61153 - DNA, 25 bp, Mus musculus
tgaccagagatgagaccaactatgg

SEQ ID NO: 61154 - DNA, 25 bp, Mus musculus
tgaccagaggatcatctacacggtg

SEQ ID NO: 61155 - DNA, 25 bp, Mus musculus
tgaccagatcgatggaatagttcat

SEQ ID NO: 61156 - DNA, 25 bp, Mus musculus
tgaccagattgattgccagcactac

SEQ ID NO: 61157 - DNA, 25 bp, Mus musculus
tgaccagcaacgcaatacaagtttg

SEQ ID NO: 61158 - DNA, 25 bp, Mus musculus
tgaccagcaagaggatggagcctcg

SEQ ID NO: 61159 - DNA, 25 bp, Mus musculus
tgaccagcctgttgctgcttatgag

SEQ ID NO: 61160 - DNA, 25 bp, Mus musculus
tgaccagcggcagcttggcctgcta

SEQ ID NO: 61161 - DNA, 25 bp, Mus musculus
tgaccagctagccatgacgcagctc

SEQ ID NO: 61162 - DNA, 25 bp, Mus musculus
tgaccaggacaggttcagccatctg

SEQ ID NO: 61163 - DNA, 25 bp, Mus musculus
tgaccagtgggaagacgtcatgaag

SEQ ID NO: 61164 - DNA, 25 bp, Mus musculus
tgaccagtggtctgaatcagatcag

SEQ ID NO: 61165 - DNA, 25 bp, Mus musculus
tgaccagtgtcaacgtgaggctgga

SEQ ID NO: 61166 - DNA, 25 bp, Mus musculus
tgaccagtgttcatctccaccgaac

SEQ ID NO: 61167 - DNA, 25 bp, Mus musculus
tgaccagttactaggagatgcggga

SEQ ID NO: 61168 - DNA, 25 bp, Mus musculus
tgaccagttcctcttcttaattctg

SEQ ID NO: 61169 - DNA, 25 bp, Mus musculus
tgaccatacaggtaggcctttccct

SEQ ID NO: 61170 - DNA, 25 bp, Mus musculus
tgaccatagctgatgactactccga

SEQ ID NO: 61171 - DNA, 25 bp, Mus musculus
tgaccatcaacaaattcttccagcc

SEQ ID NO: 61172 - DNA, 25 bp, Mus musculus
tgaccatcagctcagtggcgatgat

SEQ ID NO: 61173 - DNA, 25 bp, Mus musculus
tgaccatccagcaggtcatcaagtc

SEQ ID NO: 61174 - DNA, 25 bp, Mus musculus
tgaccatcctgtgtcgctgtgagaa

SEQ ID NO: 61175 - DNA, 25 bp, Mus musculus
tgaccatcggctatgctgatgtgca

SEQ ID NO: 61176 - DNA, 25 bp, Mus musculus
tgaccatcttagctgcaaagccatc

SEQ ID NO: 61177 - DNA, 25 bp, Mus musculus
tgaccatcttaggtgcaaagccatc

SEQ ID NO: 61178 - DNA, 25 bp, Mus musculus
tgaccatctttccaccatagaaaag

SEQ ID NO: 61179 - DNA, 25 bp, Mus musculus
tgaccatgaagaaagacgagcttac

SEQ ID NO: 61180 - DNA, 25 bp, Mus musculus
tgaccatgcaatggaaagacctgct

SEQ ID NO: 61181 - DNA, 25 bp, Mus musculus
tgaccatgcatctgccgtaggcggt

SEQ ID NO: 61182 - DNA, 25 bp, Mus musculus
tgaccatgcgatacctgcctgagct

SEQ ID NO: 61183 - DNA, 25 bp, Mus musculus
tgaccatgcgtctgagaattccttt

SEQ ID NO: 61184 - DNA, 25 bp, Mus musculus
tgaccatggcaagaactggcggcat

SEQ ID NO: 61185 - DNA, 25 bp, Mus musculus
tgaccatggtacctggcaaaggacc

SEQ ID NO: 61186 - DNA, 25 bp, Mus musculus
tgaccattcgcacgtcaaggctctg

SEQ ID NO: 61187 - DNA, 25 bp, Mus musculus
tgacccaactcccttgatgacgcag

SEQ ID NO: 61188 - DNA, 25 bp, Mus musculus
tgacccaagacaaagacctgtagct

SEQ ID NO: 61189 - DNA, 25 bp, Mus musculus
tgacccaagatgactacaaaccatc

SEQ ID NO: 61190 - DNA, 25 bp, Mus musculus
tgacccaatgatccctgatgcagag

SEQ ID NO: 61191 - DNA, 25 bp, Mus musculus
tgacccacgagcatctgacaatgac

SEQ ID NO: 61192 - DNA, 25 bp, Mus musculus
tgacccacgcttcatcaggctactg

SEQ ID NO: 61193 - DNA, 25 bp, Mus musculus
tgacccactgattcctgttgccagc

SEQ ID NO: 61194 - DNA, 25 bp, Mus musculus
tgacccagctatgtactaagcttgg

SEQ ID NO: 61195 - DNA, 25 bp, Mus musculus
tgacccagtcagagatcgatacgta

SEQ ID NO: 61196 - DNA, 25 bp, Mus musculus
tgacccatcgtcagtggacatgaag

SEQ ID NO: 61197 - DNA, 25 bp, Mus musculus
tgacccatgaatcagagactactgt

SEQ ID NO: 61198 - DNA, 25 bp, Mus musculus
tgacccattgatcgatgattactct

SEQ ID NO: 61199 - DNA, 25 bp, Mus musculus
tgaccccaaagatcggcttcccttg

SEQ ID NO: 61200 - DNA, 25 bp, Mus musculus
tgaccccaaaggagctatgctaacc

SEQ ID NO: 61201 - DNA, 25 bp, Mus musculus
tgaccccaacaagttacaagaagag

SEQ ID NO: 61202 - DNA, 25 bp, Mus musculus
tgaccccaaggcactcatggccata

SEQ ID NO: 61203 - DNA, 25 bp, Mus musculus
tgaccccagtagaggccactgtcgt

SEQ ID NO: 61204 - DNA, 25 bp, Mus musculus
tgaccccagtagtggccactgtcgt

SEQ ID NO: 61205 - DNA, 25 bp, Mus musculus
tgaccccgacaagagctgctcagtg

SEQ ID NO: 61206 - DNA, 25 bp, Mus musculus
tgacccctaactgagacaagatgct

SEQ ID NO: 61207 - DNA, 25 bp, Mus musculus
tgacccctgaggagtgtcagctacg

SEQ ID NO: 61208 - DNA, 25 bp, Mus musculus
tgacccctgctgagcttcgagacct

SEQ ID NO: 61209 - DNA, 25 bp, Mus musculus
tgacccgaaggacatgcactctccg

SEQ ID NO: 61210 - DNA, 25 bp, Mus musculus
tgacccgcccacttggtgtaaaaga

SEQ ID NO: 61211 - DNA, 25 bp, Mus musculus
tgacccgctgtctggccttacatca

SEQ ID NO: 61212 - DNA, 25 bp, Mus musculus
tgacccggcgctgaagctattccag

SEQ ID NO: 61213 - DNA, 25 bp, Mus musculus
tgaccctcccagatgatgcagctag

SEQ ID NO: 61214 - DNA, 25 bp, Mus musculus
tgaccctccgatcagtgagagtctg

SEQ ID NO: 61215 - DNA, 25 bp, Mus musculus
tgaccctctgcaagtctgatctgga

SEQ ID NO: 61216 - DNA, 25 bp, Mus musculus
tgaccctgaactcaaagcaatcctc

SEQ ID NO: 61217 - DNA, 25 bp, Mus musculus
tgaccctgaagatcaaatgtgtggc

SEQ ID NO: 61218 - DNA, 25 bp, Mus musculus
tgaccctgacgctgagaagtaaagt

SEQ ID NO: 61219 - DNA, 25 bp, Mus musculus
tgaccctgagctagagctggcgcca

SEQ ID NO: 61220 - DNA, 25 bp, Mus musculus
tgaccctgagtaagatttgctgctg

SEQ ID NO: 61221 - DNA, 25 bp, Mus musculus
tgaccctgcacctggacgggattgt

SEQ ID NO: 61222 - DNA, 25 bp, Mus musculus
tgaccctggagaatgatgatgaccc

SEQ ID NO: 61223 - DNA, 25 bp, Mus musculus
tgaccctggatgtgcaaactgtagt

SEQ ID NO: 61224 - DNA, 25 bp, Mus musculus
tgaccctgtgctctacatgacagag

SEQ ID NO: 61225 - DNA, 25 bp, Mus musculus
tgacccttaccctgttcagctgatc

SEQ ID NO: 61226 - DNA, 25 bp, Mus musculus
tgaccgagagacagctgagtcttag

SEQ ID NO: 61227 - DNA, 25 bp, Mus musculus
tgaccgcacggatccggccactgtg

SEQ ID NO: 61228 - DNA, 25 bp, Mus musculus
tgaccgccatttcagtgcttgtaag

SEQ ID NO: 61229 - DNA, 25 bp, Mus musculus
tgaccgcttcaacgtagaccatgaa

SEQ ID NO: 61230 - DNA, 25 bp, Mus musculus
tgaccgggaagaaattccaatgagc

SEQ ID NO: 61231 - DNA, 25 bp, Mus musculus
tgaccgggctcatgcttcccaagtg

SEQ ID NO: 61232 - DNA, 25 bp, Mus musculus
tgaccggtataaaatggtggtgcaa

SEQ ID NO: 61233 - DNA, 25 bp, Mus musculus
tgaccgtcaaccacctgtgcttcta

SEQ ID NO: 61234 - DNA, 25 bp, Mus musculus
tgaccgtgctactgttcctggagga

SEQ ID NO: 61235 - DNA, 25 bp, Mus musculus
tgacctacagttgctgctcccagag

SEQ ID NO: 61236 - DNA, 25 bp, Mus musculus
tgacctacctgaccatgtgcatgaa

SEQ ID NO: 61237 - DNA, 25 bp, Mus musculus
tgacctagatgggatacatgctttg

SEQ ID NO: 61238 - DNA, 25 bp, Mus musculus
tgacctatctaaggatcaaggtcag

SEQ ID NO: 61239 - DNA, 25 bp, Mus musculus
tgacctcagagaaagaatgaagaat

SEQ ID NO: 61240 - DNA, 25 bp, Mus musculus
tgacctcaggcatcctgtcggccgt

SEQ ID NO: 61241 - DNA, 25 bp, Mus musculus
tgacctcagggaacggaaactctgc

SEQ ID NO: 61242 - DNA, 25 bp, Mus musculus
tgacctcatagatcattctgactta

SEQ ID NO: 61243 - DNA, 25 bp, Mus musculus
tgacctcatcagcaagtaccagaag

SEQ ID NO: 61244 - DNA, 25 bp, Mus musculus
tgacctccatgggtaactgcacaaa

SEQ ID NO: 61245 - DNA, 25 bp, Mus musculus
tgacctctcgctcttcgtggctcag

SEQ ID NO: 61246 - DNA, 25 bp, Mus musculus
tgacctctctttccccagcaataaa

SEQ ID NO: 61247 - DNA, 25 bp, Mus musculus
tgacctctgggacctctcaaagacc

SEQ ID NO: 61248 - DNA, 25 bp, Mus musculus
tgacctctggttgggtgttaacctg

SEQ ID NO: 61249 - DNA, 25 bp, Mus musculus
tgacctgactggtaagagctgctct

SEQ ID NO: 61250 - DNA, 25 bp, Mus musculus
tgacctgaggtcatcaactttgatg

SEQ ID NO: 61251 - DNA, 25 bp, Mus musculus
tgacctgatgttactacgcctcagc

SEQ ID NO: 61252 - DNA, 25 bp, Mus musculus
tgacctgcaaaacccaggaacccag

SEQ ID NO: 61253 - DNA, 25 bp, Mus musculus
tgacctgcagtcagtcaacgtcggc

SEQ ID NO: 61254 - DNA, 25 bp, Mus musculus
tgacctgccatattcagtaagaact

SEQ ID NO: 61255 - DNA, 25 bp, Mus musculus
tgacctgcccgatgtccgggaagcc

SEQ ID NO: 61256 - DNA, 25 bp, Mus musculus
tgacctgcttgactgtgagtgcaca

SEQ ID NO: 61257 - DNA, 25 bp, Mus musculus
tgacctggaccagtatctgaggcgg

SEQ ID NO: 61258 - DNA, 25 bp, Mus musculus
tgacctggatcgtgctcagggagcc

SEQ ID NO: 61259 - DNA, 25 bp, Mus musculus
tgacctggcagacgatgacatcatg

SEQ ID NO: 61260 - DNA, 25 bp, Mus musculus
tgacctggccaactggatgatacct

SEQ ID NO: 61261 - DNA, 25 bp, Mus musculus
tgacctggcgcagacgaaagccatt

SEQ ID NO: 61262 - DNA, 25 bp, Mus musculus
tgacctgggccacctggagcctctg

SEQ ID NO: 61263 - DNA, 25 bp, Mus musculus
tgacctgtaggatgtatgcggcaac

SEQ ID NO: 61264 - DNA, 25 bp, Mus musculus
tgacctgtgtcatgccctacgttgg

SEQ ID NO: 61265 - DNA, 25 bp, Mus musculus
tgaccttaaagcaggagctggaagt

SEQ ID NO: 61266 - DNA, 25 bp, Mus musculus
tgaccttataattgacactgatgag

SEQ ID NO: 61267 - DNA, 25 bp, Mus musculus
tgaccttcaagcaggtcacttaccc

SEQ ID NO: 61268 - DNA, 25 bp, Mus musculus
tgaccttcccgacactcgatgattt

SEQ ID NO: 61269 - DNA, 25 bp, Mus musculus
tgaccttcctagacagtcactgcga

SEQ ID NO: 61270 - DNA, 25 bp, Mus musculus
tgaccttcgatgagtgcggtgacct

SEQ ID NO: 61271 - DNA, 25 bp, Mus musculus
tgaccttgaaccactccaaagctct

SEQ ID NO: 61272 - DNA, 25 bp, Mus musculus
tgaccttgaggactacgacgcagaa

SEQ ID NO: 61273 - DNA, 25 bp, Mus musculus
tgaccttgaggagtacgacgcagaa

SEQ ID NO: 61274 - DNA, 25 bp, Mus musculus
tgaccttgccaaaaccaagaaagca

SEQ ID NO: 61275 - DNA, 25 bp, Mus musculus
tgaccttgccaataccaagaaagca

SEQ ID NO: 61276 - DNA, 25 bp, Mus musculus
tgaccttgccccaagtcacatggct

SEQ ID NO: 61277 - DNA, 25 bp, Mus musculus
tgaccttggatagctcaataccatc

SEQ ID NO: 61278 - DNA, 25 bp, Mus musculus
tgacctttgcatggctacgccggta

SEQ ID NO: 61279 - DNA, 25 bp, Mus musculus
tgacgaacgaattgcggctcaccaa

SEQ ID NO: 61280 - DNA, 25 bp, Mus musculus
tgacgaagacgagcgcttgtccgtg

SEQ ID NO: 61281 - DNA, 25 bp, Mus musculus
tgacgaagatggacctgctgagtaa

SEQ ID NO: 61282 - DNA, 25 bp, Mus musculus
tgacgaagcggaggaagacagaggc

SEQ ID NO: 61283 - DNA, 25 bp, Mus musculus
tgacgacatgggatcaaaaggcctg

SEQ ID NO: 61284 - DNA, 25 bp, Mus musculus
tgacgacctgtgttccgacatatac

SEQ ID NO: 61285 - DNA, 25 bp, Mus musculus
tgacgagaagctactacagaggtgc

SEQ ID NO: 61286 - DNA, 25 bp, Mus musculus
tgacgagaagcttctacagaggtgc

SEQ ID NO: 61287 - DNA, 25 bp, Mus musculus
tgacgagaggcctccagaagagtat

SEQ ID NO: 61288 - DNA, 25 bp, Mus musculus
tgacgagctgagaattatgcagaaa

SEQ ID NO: 61289 - DNA, 25 bp, Mus musculus
tgacgatgaccctttcaaccctcag

SEQ ID NO: 61290 - DNA, 25 bp, Mus musculus
tgacgatgaggacattgacccctgt

SEQ ID NO: 61291 - DNA, 25 bp, Mus musculus
tgacgatggtgagatgaacagattt

SEQ ID NO: 61292 - DNA, 25 bp, Mus musculus
tgacgatgttcacagattcagctcc

SEQ ID NO: 61293 - DNA, 25 bp, Mus musculus
tgacgatttctctagggctctgcag

SEQ ID NO: 61294 - DNA, 25 bp, Mus musculus
tgacgcagcaaagtgagaagcacct

SEQ ID NO: 61295 - DNA, 25 bp, Mus musculus
tgacgcatttgtccctgagatcagc

SEQ ID NO: 61296 - DNA, 25 bp, Mus musculus
tgacgcccaactgttgggctaaggg

SEQ ID NO: 61297 - DNA, 25 bp, Mus musculus
tgacgcccagagtttgagtcccagg

SEQ ID NO: 61298 - DNA, 25 bp, Mus musculus
tgacgcctctaaagagtcatggcag

SEQ ID NO: 61299 - DNA, 25 bp, Mus musculus
tgacgcctgtgcatgtggctgccgc

SEQ ID NO: 61300 - DNA, 25 bp, Mus musculus
tgacgcggcaggtagaccacttact

SEQ ID NO: 61301 - DNA, 25 bp, Mus musculus
tgacgctagggcttgggactaccag

SEQ ID NO: 61302 - DNA, 25 bp, Mus musculus
tgacgctgtcagctcagtctctaca

SEQ ID NO: 61303 - DNA, 25 bp, Mus musculus
tgacgcttgtaatgacgtccctgcg

SEQ ID NO: 61304 - DNA, 25 bp, Mus musculus
tgacggactcgcagccagtcagatg

SEQ ID NO: 61305 - DNA, 25 bp, Mus musculus
tgacggagactattgtggatcccag

SEQ ID NO: 61306 - DNA, 25 bp, Mus musculus
tgacggatgccccagacatacccaa

SEQ ID NO: 61307 - DNA, 25 bp, Mus musculus
tgacggcacgtatgtaaaacctctg

SEQ ID NO: 61308 - DNA, 25 bp, Mus musculus
tgacggcccaattgaaatcttgagg

SEQ ID NO: 61309 - DNA, 25 bp, Mus musculus
tgacggccgtggtgaccaccaccag

SEQ ID NO: 61310 - DNA, 25 bp, Mus musculus
tgacggcgagttttctgcagacact

SEQ ID NO: 61311 - DNA, 25 bp, Mus musculus
tgacgggactttatctgcagtaggt

SEQ ID NO: 61312 - DNA, 25 bp, Mus musculus
tgacgggcaaacagtgtgtcaaccg

SEQ ID NO: 61313 - DNA, 25 bp, Mus musculus
tgacgggcacaatgctttgggtcct

SEQ ID NO: 61314 - DNA, 25 bp, Mus musculus
tgacggttcacctttctgtccctgg

SEQ ID NO: 61315 - DNA, 25 bp, Mus musculus
tgacggtttgagctctcgtgcccgc

SEQ ID NO: 61316 - DNA, 25 bp, Mus musculus
tgacgtcaactgagtcccctgtaag

SEQ ID NO: 61317 - DNA, 25 bp, Mus musculus
tgacgtcaactgtgtcccctgtaag

SEQ ID NO: 61318 - DNA, 25 bp, Mus musculus
tgacgtcagggctccactttctcca

SEQ ID NO: 61319 - DNA, 25 bp, Mus musculus
tgacgtcatcagctcaactctcaag

SEQ ID NO: 61320 - DNA, 25 bp, Mus musculus
tgacgtccctagctacattatgtga

SEQ ID NO: 61321 - DNA, 25 bp, Mus musculus
tgacgtcctctatcttggccactac

SEQ ID NO: 61322 - DNA, 25 bp, Mus musculus
tgacgtcttacgaagatctgggact

SEQ ID NO: 61323 - DNA, 25 bp, Mus musculus
tgacgtgccactgcactgtgtggat

SEQ ID NO: 61324 - DNA, 25 bp, Mus musculus
tgacgtgctggtggaagagtttgaa

SEQ ID NO: 61325 - DNA, 25 bp, Mus musculus
tgacgtggaccttccctggagagct

SEQ ID NO: 61326 - DNA, 25 bp, Mus musculus
tgacgtggctgggtctccagctgtc

SEQ ID NO: 61327 - DNA, 25 bp, Mus musculus
tgacgttgacgctgttccccatccg

SEQ ID NO: 61328 - DNA, 25 bp, Mus musculus
tgactaagctgcagagaagggctgc

SEQ ID NO: 61329 - DNA, 25 bp, Mus musculus
tgactacagaaacatcattggacct

SEQ ID NO: 61330 - DNA, 25 bp, Mus musculus
tgactacagccagcagtgtgacatt

SEQ ID NO: 61331 - DNA, 25 bp, Mus musculus
tgactacatgttcaaactgctcttg

SEQ ID NO: 61332 - DNA, 25 bp, Mus musculus
tgactaccgcagtgagaccagcaat

SEQ ID NO: 61333 - DNA, 25 bp, Mus musculus
tgactaccgccgcaaccacaaaggt

SEQ ID NO: 61334 - DNA, 25 bp, Mus musculus
tgactacgatgacacagatgacgat

SEQ ID NO: 61335 - DNA, 25 bp, Mus musculus
tgactacttggcaccgtggcagctg

SEQ ID NO: 61336 - DNA, 25 bp, Mus musculus
tgactactttgggatcctcaaggag

SEQ ID NO: 61337 - DNA, 25 bp, Mus musculus
tgactagaggtgtttctggcccagc

SEQ ID NO: 61338 - DNA, 25 bp, Mus musculus
tgactaggacccctcatgagggact

SEQ ID NO: 61339 - DNA, 25 bp, Mus musculus
tgactatacggaaaatgtgctgaca

SEQ ID NO: 61340 - DNA, 25 bp, Mus musculus
tgactatcaggacgtggcactggct

SEQ ID NO: 61341 - DNA, 25 bp, Mus musculus
tgactatccagggaagcggctgtcc

SEQ ID NO: 61342 - DNA, 25 bp, Mus musculus
tgactatgagatagtgcccatcaac

SEQ ID NO: 61343 - DNA, 25 bp, Mus musculus
tgactatgattactaccaagactac

SEQ ID NO: 61344 - DNA, 25 bp, Mus musculus
tgactatgcggccaccctgtctctg

SEQ ID NO: 61345 - DNA, 25 bp, Mus musculus
tgactatggccatggatcctatggg

SEQ ID NO: 61346 - DNA, 25 bp, Mus musculus
tgactattgtagatgagctgggcaa

SEQ ID NO: 61347 - DNA, 25 bp, Mus musculus
tgactcaaggctcttccacgtggct

SEQ ID NO: 61348 - DNA, 25 bp, Mus musculus
tgactcaagtacaagcagtaggctg

SEQ ID NO: 61349 - DNA, 25 bp, Mus musculus
tgactcacctgtgggtaaccagttc

SEQ ID NO: 61350 - DNA, 25 bp, Mus musculus
tgactcagagagtctgaacctgacc

SEQ ID NO: 61351 - DNA, 25 bp, Mus musculus
tgactccaggaccacaatattttct

SEQ ID NO: 61352 - DNA, 25 bp, Mus musculus
tgactccaggagtggacatcactct

SEQ ID NO: 61353 - DNA, 25 bp, Mus musculus
tgactccaggatgttccatacacag

SEQ ID NO: 61354 - DNA, 25 bp, Mus musculus
tgactcccaggaagatgtggacagc

SEQ ID NO: 61355 - DNA, 25 bp, Mus musculus
tgactcccgcatcaatggtgtctcc

SEQ ID NO: 61356 - DNA, 25 bp, Mus musculus
tgactccctttgaacggaacttgga

SEQ ID NO: 61357 - DNA, 25 bp, Mus musculus
tgactccgttcaggttgctcccgat

SEQ ID NO: 61358 - DNA, 25 bp, Mus musculus
tgactcctcttgactgcatggtact

SEQ ID NO: 61359 - DNA, 25 bp, Mus musculus
tgactcctctttgtccgaggtgcac

SEQ ID NO: 61360 - DNA, 25 bp, Mus musculus
tgactccttccatcaagctctgctt

SEQ ID NO: 61361 - DNA, 25 bp, Mus musculus
tgactcgcacgcagggcacagctgg

SEQ ID NO: 61362 - DNA, 25 bp, Mus musculus
tgactcggacagtgagctgcgtcct

SEQ ID NO: 61363 - DNA, 25 bp, Mus musculus
tgactcgggagttaaagacactgct

SEQ ID NO: 61364 - DNA, 25 bp, Mus musculus
tgactcgggtcatggtggagaggcc

SEQ ID NO: 61365 - DNA, 25 bp, Mus musculus
tgactcgttgtttctggagaagaag

SEQ ID NO: 61366 - DNA, 25 bp, Mus musculus
tgactctaacaagctcgggaagaag

SEQ ID NO: 61367 - DNA, 25 bp, Mus musculus
tgactctacactcgcctgctcttac

SEQ ID NO: 61368 - DNA, 25 bp, Mus musculus
tgactctacactggcctgctcttac

SEQ ID NO: 61369 - DNA, 25 bp, Mus musculus
tgactctaccgccaagtcctagaaa

SEQ ID NO: 61370 - DNA, 25 bp, Mus musculus
tgactctagtacagttaccttcagg

SEQ ID NO: 61371 - DNA, 25 bp, Mus musculus
tgactctagtttgcgagggccctca

SEQ ID NO: 61372 - DNA, 25 bp, Mus musculus
tgactctatccggttgcagttccct

SEQ ID NO: 61373 - DNA, 25 bp, Mus musculus
tgactctccatgaagggcttcccct

SEQ ID NO: 61374 - DNA, 25 bp, Mus musculus
tgactctcgggcagttcaggtgagt

SEQ ID NO: 61375 - DNA, 25 bp, Mus musculus
tgactctcgggctgttcaggtgagt

SEQ ID NO: 61376 - DNA, 25 bp, Mus musculus
tgactctgacaacttatgcactgaa

SEQ ID NO: 61377 - DNA, 25 bp, Mus musculus
tgactctgatagtggataacaccag

SEQ ID NO: 61378 - DNA, 25 bp, Mus musculus
tgactctgattctcatagctgtctg

SEQ ID NO: 61379 - DNA, 25 bp, Mus musculus
tgactctggcctctacgcttgcgtg

SEQ ID NO: 61380 - DNA, 25 bp, Mus musculus
tgactctgggtttaacaaacagaga

SEQ ID NO: 61381 - DNA, 25 bp, Mus musculus
tgactcttaagaagcagaattgttt

SEQ ID NO: 61382 - DNA, 25 bp, Mus musculus
tgactcttaagatgcagaattgttt

SEQ ID NO: 61383 - DNA, 25 bp, Mus musculus
tgactcttggaatgccccagggttg

SEQ ID NO: 61384 - DNA, 25 bp, Mus musculus
tgactgaaaatgaccaagcacccac

SEQ ID NO: 61385 - DNA, 25 bp, Mus musculus
tgactgaactacacctgtggtctct

SEQ ID NO: 61386 - DNA, 25 bp, Mus musculus
tgactgaccttccaggaaccacatc

SEQ ID NO: 61387 - DNA, 25 bp, Mus musculus
tgactgagatccatccttaatggtg

SEQ ID NO: 61388 - DNA, 25 bp, Mus musculus
tgactgatgggctgaagcgagcact

SEQ ID NO: 61389 - DNA, 25 bp, Mus musculus
tgactgcaaggtgaagttctgggac

SEQ ID NO: 61390 - DNA, 25 bp, Mus musculus
tgactgcatggtactccacctcttg

SEQ ID NO: 61391 - DNA, 25 bp, Mus musculus
tgactgccccagacagcaatgatga

SEQ ID NO: 61392 - DNA, 25 bp, Mus musculus
tgactgccggagaactttccagagt

SEQ ID NO: 61393 - DNA, 25 bp, Mus musculus
tgactgccgggtaaagctgtggaat

SEQ ID NO: 61394 - DNA, 25 bp, Mus musculus
tgactgcgagttcctgcgcactgag

SEQ ID NO: 61395 - DNA, 25 bp, Mus musculus
tgactgcgatctccccgagttctgc

SEQ ID NO: 61396 - DNA, 25 bp, Mus musculus
tgactgcgcccctagtggatgagag

SEQ ID NO: 61397 - DNA, 25 bp, Mus musculus
tgactgctgcacattgctttccaga

SEQ ID NO: 61398 - DNA, 25 bp, Mus musculus
tgactgctgtcatggagtactagct

SEQ ID NO: 61399 - DNA, 25 bp, Mus musculus
tgactgcttcaaaaagtactgttgg

SEQ ID NO: 61400 - DNA, 25 bp, Mus musculus
tgactgcttcaataagtactgttgg

SEQ ID NO: 61401 - DNA, 25 bp, Mus musculus
tgactgcttctctgctaaatgtttc

SEQ ID NO: 61402 - DNA, 25 bp, Mus musculus
tgactggaacttggtgttcaagtgg

SEQ ID NO: 61403 - DNA, 25 bp, Mus musculus
tgactggccacgctcatgtgctcct

SEQ ID NO: 61404 - DNA, 25 bp, Mus musculus
tgactgggcactcaaagctcagaat

SEQ ID NO: 61405 - DNA, 25 bp, Mus musculus
tgactgggccctgcaagcaaacata

SEQ ID NO: 61406 - DNA, 25 bp, Mus musculus
tgactggtgatagagtctgcactgg

SEQ ID NO: 61407 - DNA, 25 bp, Mus musculus
tgactgtaacgctcatagatgccaa

SEQ ID NO: 61408 - DNA, 25 bp, Mus musculus
tgactgtcaccggaggtatagctgt

SEQ ID NO: 61409 - DNA, 25 bp, Mus musculus
tgactgtcatcctgaatttctgcca

SEQ ID NO: 61410 - DNA, 25 bp, Mus musculus
tgactgtccgaaggacgaaggaccg

SEQ ID NO: 61411 - DNA, 25 bp, Mus musculus
tgactgtcctagaggccgattcctg

SEQ ID NO: 61412 - DNA, 25 bp, Mus musculus
tgactgtcggtgtagttcctaagac

SEQ ID NO: 61413 - DNA, 25 bp, Mus musculus
tgactgtctcctcatagagatggag

SEQ ID NO: 61414 - DNA, 25 bp, Mus musculus
tgactgtctcgtaatctacttaagg

SEQ ID NO: 61415 - DNA, 25 bp, Mus musculus
tgactgtgaaaacattagagggaaa

SEQ ID NO: 61416 - DNA, 25 bp, Mus musculus
tgactgtgaaggactcggcctcaag

SEQ ID NO: 61417 - DNA, 25 bp, Mus musculus
tgactgtgaatgacatagacatctt

SEQ ID NO: 61418 - DNA, 25 bp, Mus musculus
tgactgtgaatgagtggcctgatca

SEQ ID NO: 61419 - DNA, 25 bp, Mus musculus
tgactgtgagcagtcccaacggacc

SEQ ID NO: 61420 - DNA, 25 bp, Mus musculus
tgactgtggactagtgagcattttt

SEQ ID NO: 61421 - DNA, 25 bp, Mus musculus
tgactgtggagtctatttgttgcag

SEQ ID NO: 61422 - DNA, 25 bp, Mus musculus
tgactgtggcagtggacgtagcacc

SEQ ID NO: 61423 - DNA, 25 bp, Mus musculus
tgactgtgggtgatacctccctgag

SEQ ID NO: 61424 - DNA, 25 bp, Mus musculus
tgactgttcatcttcaaagtgaaaa

SEQ ID NO: 61425 - DNA, 25 bp, Mus musculus
tgactgttccctctactctgcctgg

SEQ ID NO: 61426 - DNA, 25 bp, Mus musculus
tgacttaaagtctggatcctgttct

SEQ ID NO: 61427 - DNA, 25 bp, Mus musculus
tgacttacatctagaccctacttac

SEQ ID NO: 61428 - DNA, 25 bp, Mus musculus
tgacttagagctggtcctcctgcct

SEQ ID NO: 61429 - DNA, 25 bp, Mus musculus
tgacttagggtgtgcatgcagtcag

SEQ ID NO: 61430 - DNA, 25 bp, Mus musculus
tgacttcaaggctgatatgtggagt

SEQ ID NO: 61431 - DNA, 25 bp, Mus musculus
tgacttcaatgcagaagctgtcaag

SEQ ID NO: 61432 - DNA, 25 bp, Mus musculus
tgacttcaccacacagcgagccaag

SEQ ID NO: 61433 - DNA, 25 bp, Mus musculus
tgacttcacgattctcacaggcccg

SEQ ID NO: 61434 - DNA, 25 bp, Mus musculus
tgacttcagcctgactctccatgaa

SEQ ID NO: 61435 - DNA, 25 bp, Mus musculus
tgacttcaggctggatgctatccca

SEQ ID NO: 61436 - DNA, 25 bp, Mus musculus
tgacttcagtctcacgtgggaccgg

SEQ ID NO: 61437 - DNA, 25 bp, Mus musculus
tgacttccagagaagggctcacgcc

SEQ ID NO: 61438 - DNA, 25 bp, Mus musculus
tgacttccagagtagggctcacgcc

SEQ ID NO: 61439 - DNA, 25 bp, Mus musculus
tgacttccgagagtcctgctgccgg

SEQ ID NO: 61440 - DNA, 25 bp, Mus musculus
tgacttcgacaagaataagatctgg

SEQ ID NO: 61441 - DNA, 25 bp, Mus musculus
tgacttcgctttggcagatctgcta

SEQ ID NO: 61442 - DNA, 25 bp, Mus musculus
tgacttctaccgctgttgggcctgt

SEQ ID NO: 61443 - DNA, 25 bp, Mus musculus
tgacttctatcacagtttcctggag

SEQ ID NO: 61444 - DNA, 25 bp, Mus musculus
tgacttctgcgatgtcctcacggga

SEQ ID NO: 61445 - DNA, 25 bp, Mus musculus
tgacttgaagttatgggctggatcc

SEQ ID NO: 61446 - DNA, 25 bp, Mus musculus
tgacttgattgtgaccccgtttgct

SEQ ID NO: 61447 - DNA, 25 bp, Mus musculus
tgacttgcatccatctctaaagatg

SEQ ID NO: 61448 - DNA, 25 bp, Mus musculus
tgacttgctcatcaattttgtacag

SEQ ID NO: 61449 - DNA, 25 bp, Mus musculus
tgacttggacactcaggagagcgtg

SEQ ID NO: 61450 - DNA, 25 bp, Mus musculus
tgacttggttttttcaagtaatcct

SEQ ID NO: 61451 - DNA, 25 bp, Mus musculus
tgacttgtaagttctactgaaacat

SEQ ID NO: 61452 - DNA, 25 bp, Mus musculus
tgacttgtcggaacattaccaggaa

SEQ ID NO: 61453 - DNA, 25 bp, Mus musculus
tgactttaaagacacgggtttctca

SEQ ID NO: 61454 - DNA, 25 bp, Mus musculus
tgactttctctctactgtaggagga

SEQ ID NO: 61455 - DNA, 25 bp, Mus musculus
tgactttgcaactcgtaagattgcc

SEQ ID NO: 61456 - DNA, 25 bp, Mus musculus
tgactttgcagaaatcaccaaattg

SEQ ID NO: 61457 - DNA, 25 bp, Mus musculus
tgactttgccaatatccctgacctg

SEQ ID NO: 61458 - DNA, 25 bp, Mus musculus
tgagaaaaaccccacagatgcctgc

SEQ ID NO: 61459 - DNA, 25 bp, Mus musculus
tgagaaaaagcaataaggagaaggt

SEQ ID NO: 61460 - DNA, 25 bp, Mus musculus
tgagaaaaagcattaaggagaaggt

SEQ ID NO: 61461 - DNA, 25 bp, Mus musculus
tgagaaaaatggcatcgtgttacgg

SEQ ID NO: 61462 - DNA, 25 bp, Mus musculus
tgagaaaaccaaaaccgagagcctt

SEQ ID NO: 61463 - DNA, 25 bp, Mus musculus
tgagaaaagccccaggcttgctctc

SEQ ID NO: 61464 - DNA, 25 bp, Mus musculus
tgagaaaaggtcaaagcgagtgtca

SEQ ID NO: 61465 - DNA, 25 bp, Mus musculus
tgagaaacagtaacttagcccaagt

SEQ ID NO: 61466 - DNA, 25 bp, Mus musculus
tgagaaacagtatcttagcccaagt

SEQ ID NO: 61467 - DNA, 25 bp, Mus musculus
tgagaaagaagacatccaggaagga

SEQ ID NO: 61468 - DNA, 25 bp, Mus musculus
tgagaaagcttatcatagtcgacgc

SEQ ID NO: 61469 - DNA, 25 bp, Mus musculus
tgagaaagggaacaagagcccgtca

SEQ ID NO: 61470 - DNA, 25 bp, Mus musculus
tgagaaaggtactgctctgaggtct

SEQ ID NO: 61471 - DNA, 25 bp, Mus musculus
tgagaaataagctgaaacaaactgt

SEQ ID NO: 61472 - DNA, 25 bp, Mus musculus
tgagaacaatctccaggaagatctc

SEQ ID NO: 61473 - DNA, 25 bp, Mus musculus
tgagaacacggcacgtgatctgagt

SEQ ID NO: 61474 - DNA, 25 bp, Mus musculus
tgagaacagaagcacggcgaaaaaa

SEQ ID NO: 61475 - DNA, 25 bp, Mus musculus
tgagaacagagccaaattagaggcc

SEQ ID NO: 61476 - DNA, 25 bp, Mus musculus
tgagaacagaggaaataaagatgct

SEQ ID NO: 61477 - DNA, 25 bp, Mus musculus
tgagaacagtttgcttccagcctcc

SEQ ID NO: 61478 - DNA, 25 bp, Mus musculus
tgagaacatgtactacagccagtct

SEQ ID NO: 61479 - DNA, 25 bp, Mus musculus
tgagaaccccaaaccaggaggcaaa

SEQ ID NO: 61480 - DNA, 25 bp, Mus musculus
tgagaacccgactaatggcagtagc

SEQ ID NO: 61481 - DNA, 25 bp, Mus musculus
tgagaaccgctgttttagagacaag

SEQ ID NO: 61482 - DNA, 25 bp, Mus musculus
tgagaacgccagcagacagccccat

SEQ ID NO: 61483 - DNA, 25 bp, Mus musculus
tgagaacgtggatgaagactcctct

SEQ ID NO: 61484 - DNA, 25 bp, Mus musculus
tgagaactaagagccctgggtgatg

SEQ ID NO: 61485 - DNA, 25 bp, Mus musculus
tgagaactgctgcaccactgaaaca

SEQ ID NO: 61486 - DNA, 25 bp, Mus musculus
tgagaacttatctgaaagagatgtc

SEQ ID NO: 61487 - DNA, 25 bp, Mus musculus
tgagaacttatggtacgacaggaac

SEQ ID NO: 61488 - DNA, 25 bp, Mus musculus
tgagaacttggctaccctggagcga

SEQ ID NO: 61489 - DNA, 25 bp, Mus musculus
tgagaagaaatagagaccggtatgt

SEQ ID NO: 61490 - DNA, 25 bp, Mus musculus
tgagaagaagcctgcgcagggcaac

SEQ ID NO: 61491 - DNA, 25 bp, Mus musculus
tgagaagaagtttgcctccaggctt

SEQ ID NO: 61492 - DNA, 25 bp, Mus musculus
tgagaagaccccagtgagtgagcat

SEQ ID NO: 61493 - DNA, 25 bp, Mus musculus
tgagaagacccgtttctatctaggc

SEQ ID NO: 61494 - DNA, 25 bp, Mus musculus
tgagaagagagtgactaacacacaa

SEQ ID NO: 61495 - DNA, 25 bp, Mus musculus
tgagaagagtttcaacactgtcccc

SEQ ID NO: 61496 - DNA, 25 bp, Mus musculus
tgagaagcagctcgaagaactggca

SEQ ID NO: 61497 - DNA, 25 bp, Mus musculus
tgagaagctctttgccccggcacct

SEQ ID NO: 61498 - DNA, 25 bp, Mus musculus
tgagaagctgtatgatgcctatgtc

SEQ ID NO: 61499 - DNA, 25 bp, Mus musculus
tgagaaggactacccacctggctat

SEQ ID NO: 61500 - DNA, 25 bp, Mus musculus
tgagaaggagcagaaaaagcttcag

SEQ ID NO: 61501 - DNA, 25 bp, Mus musculus
tgagaaggcaaaaatgagggtagca

SEQ ID NO: 61502 - DNA, 25 bp, Mus musculus
tgagaaggccatcatgacttacgtg

SEQ ID NO: 61503 - DNA, 25 bp, Mus musculus
tgagaaggcctcctaagattagacc

SEQ ID NO: 61504 - DNA, 25 bp, Mus musculus
tgagaaggcggctggaactcccgct

SEQ ID NO: 61505 - DNA, 25 bp, Mus musculus
tgagaaggcttcgtcgacacagtac

SEQ ID NO: 61506 - DNA, 25 bp, Mus musculus
tgagaagggagtacattcctgcccc

SEQ ID NO: 61507 - DNA, 25 bp, Mus musculus
tgagaagggagttcattcctgcccc

SEQ ID NO: 61508 - DNA, 25 bp, Mus musculus
tgagaagggctttggctacaaaggc

SEQ ID NO: 61509 - DNA, 25 bp, Mus musculus
tgagaagggtgacaccaccaccttg

SEQ ID NO: 61510 - DNA, 25 bp, Mus musculus
tgagaagggtgagaccaccaccttg

SEQ ID NO: 61511 - DNA, 25 bp, Mus musculus
tgagaaggtatttctgtccagctgc

SEQ ID NO: 61512 - DNA, 25 bp, Mus musculus
tgagaaggttcgcaccacagagacc

SEQ ID NO: 61513 - DNA, 25 bp, Mus musculus
tgagaagtaaagtctccaggagctg

SEQ ID NO: 61514 - DNA, 25 bp, Mus musculus
tgagaagtacttagcttctatggca

SEQ ID NO: 61515 - DNA, 25 bp, Mus musculus
tgagaagtctcccaagtgcagtgac

SEQ ID NO: 61516 - DNA, 25 bp, Mus musculus
tgagaagtctggtttcagcagcccc

SEQ ID NO: 61517 - DNA, 25 bp, Mus musculus
tgagaagtctgtccccgtctcctga

SEQ ID NO: 61518 - DNA, 25 bp, Mus musculus
tgagaataacgatgtcagcgaggag

SEQ ID NO: 61519 - DNA, 25 bp, Mus musculus
tgagaataaggtggttcctgagaac

SEQ ID NO: 61520 - DNA, 25 bp, Mus musculus
tgagaatacatgttccggtgtacag

SEQ ID NO: 61521 - DNA, 25 bp, Mus musculus
tgagaataccgttctgtatggctac

SEQ ID NO: 61522 - DNA, 25 bp, Mus musculus
tgagaatagcatagactttcttgac

SEQ ID NO: 61523 - DNA, 25 bp, Mus musculus
tgagaatagcattgactttcttgac

SEQ ID NO: 61524 - DNA, 25 bp, Mus musculus
tgagaatatgacaggacggcatccc

SEQ ID NO: 61525 - DNA, 25 bp, Mus musculus
tgagaatcaacaaaactgtggccat

SEQ ID NO: 61526 - DNA, 25 bp, Mus musculus
tgagaatcatcagaagatcccgatg

SEQ ID NO: 61527 - DNA, 25 bp, Mus musculus
tgagaatgaccctgagctgcagagt

SEQ ID NO: 61528 - DNA, 25 bp, Mus musculus
tgagaatgatatatggccgccagct

SEQ ID NO: 61529 - DNA, 25 bp, Mus musculus
tgagaatgggtcagggtaccacggg

SEQ ID NO: 61530 - DNA, 25 bp, Mus musculus
tgagaatgggtctgggtaccacggg

SEQ ID NO: 61531 - DNA, 25 bp, Mus musculus
tgagaattacggacttgaagtctgg

SEQ ID NO: 61532 - DNA, 25 bp, Mus musculus
tgagaattacttaaacagcaagaat

SEQ ID NO: 61533 - DNA, 25 bp, Mus musculus
tgagacaacagctcccaactttcct

SEQ ID NO: 61534 - DNA, 25 bp, Mus musculus
tgagacaactgttgcaagcctcaag

SEQ ID NO: 61535 - DNA, 25 bp, Mus musculus
tgagacacaatctgcatcctactct

SEQ ID NO: 61536 - DNA, 25 bp, Mus musculus
tgagacaggaaagtgttaccatact

SEQ ID NO: 61537 - DNA, 25 bp, Mus musculus
tgagacagtcaaaagccatgtgcta

SEQ ID NO: 61538 - DNA, 25 bp, Mus musculus
tgagacagtcattacatctgtaggg

SEQ ID NO: 61539 - DNA, 25 bp, Mus musculus
tgagacatcgttcgaagcaggcatc

SEQ ID NO: 61540 - DNA, 25 bp, Mus musculus
tgagacatctcggttgcaaaagcaa

SEQ ID NO: 61541 - DNA, 25 bp, Mus musculus
tgagaccaactgatgtaccagatca

SEQ ID NO: 61542 - DNA, 25 bp, Mus musculus
tgagaccaagacactccccagtgtg

SEQ ID NO: 61543 - DNA, 25 bp, Mus musculus
tgagaccattgctgatagaacgata

SEQ ID NO: 61544 - DNA, 25 bp, Mus musculus
tgagacccctctccctcgggaaatg

SEQ ID NO: 61545 - DNA, 25 bp, Mus musculus
tgagacccgctcttcagcatgtggt

SEQ ID NO: 61546 - DNA, 25 bp, Mus musculus
tgagacccttgcctagatacctggc

SEQ ID NO: 61547 - DNA, 25 bp, Mus musculus
tgagaccgctgccaaccggatctgc

SEQ ID NO: 61548 - DNA, 25 bp, Mus musculus
tgagacctcggtgtctactccgggc

SEQ ID NO: 61549 - DNA, 25 bp, Mus musculus
tgagacgagactcccctgagtatga

SEQ ID NO: 61550 - DNA, 25 bp, Mus musculus
tgagacgagactgccctgagtatga

SEQ ID NO: 61551 - DNA, 25 bp, Mus musculus
tgagacggaagacattgccataaag

SEQ ID NO: 61552 - DNA, 25 bp, Mus musculus
tgagacggcacctttgggtcccaaa

SEQ ID NO: 61553 - DNA, 25 bp, Mus musculus
tgagacggtttaagcggaagcatct

SEQ ID NO: 61554 - DNA, 25 bp, Mus musculus
tgagacgtttcaggcctcagcgtcc

SEQ ID NO: 61555 - DNA, 25 bp, Mus musculus
tgagactacaggagcagatgaaccc

SEQ ID NO: 61556 - DNA, 25 bp, Mus musculus
tgagactcataggtcagctaccctg

SEQ ID NO: 61557 - DNA, 25 bp, Mus musculus
tgagactgagcctgcgacgatggcc

SEQ ID NO: 61558 - DNA, 25 bp, Mus musculus
tgagactgatgtcaacaatgaaaat

SEQ ID NO: 61559 - DNA, 25 bp, Mus musculus
tgagactgatgtgaacaatgaaaat

SEQ ID NO: 61560 - DNA, 25 bp, Mus musculus
tgagactgctcctggtatgatacat

SEQ ID NO: 61561 - DNA, 25 bp, Mus musculus
tgagactggtggattttcctatgga

SEQ ID NO: 61562 - DNA, 25 bp, Mus musculus
tgagactgtgaatgataatatcccc

SEQ ID NO: 61563 - DNA, 25 bp, Mus musculus
tgagactttcccatcgagagcaggc

SEQ ID NO: 61564 - DNA, 25 bp, Mus musculus
tgagagaaacccagaaggaggtcac

SEQ ID NO: 61565 - DNA, 25 bp, Mus musculus
tgagagaagccaaaacaccgtcacc

SEQ ID NO: 61566 - DNA, 25 bp, Mus musculus
tgagagaagttaatgaaacagttac

SEQ ID NO: 61567 - DNA, 25 bp, Mus musculus
tgagagacccactgcaaagactgat

SEQ ID NO: 61568 - DNA, 25 bp, Mus musculus
tgagagacgggccatccctagaaag

SEQ ID NO: 61569 - DNA, 25 bp, Mus musculus
tgagagacttcgttttaagtgggag

SEQ ID NO: 61570 - DNA, 25 bp, Mus musculus
tgagagagatccgacagtacagatt

SEQ ID NO: 61571 - DNA, 25 bp, Mus musculus
tgagagagcagtaatgtgtgatacc

SEQ ID NO: 61572 - DNA, 25 bp, Mus musculus
tgagagaggtcctatcaaaaccaaa

SEQ ID NO: 61573 - DNA, 25 bp, Mus musculus
tgagagagtcaaacgcaaccaagag

SEQ ID NO: 61574 - DNA, 25 bp, Mus musculus
tgagagagtcctaccacagtgaaac

SEQ ID NO: 61575 - DNA, 25 bp, Mus musculus
tgagagatcaagagatagacgccgg

SEQ ID NO: 61576 - DNA, 25 bp, Mus musculus
tgagagatcctgacataaacccttg

SEQ ID NO: 61577 - DNA, 25 bp, Mus musculus
tgagagcaactcgacactctcgtgc

SEQ ID NO: 61578 - DNA, 25 bp, Mus musculus
tgagagcaagaactcagaagactcc

SEQ ID NO: 61579 - DNA, 25 bp, Mus musculus
tgagagcaagacaagcggagaccag

SEQ ID NO: 61580 - DNA, 25 bp, Mus musculus
tgagagcaagctccgaaccatctgc

SEQ ID NO: 61581 - DNA, 25 bp, Mus musculus
tgagagcacagagccgggataagca

SEQ ID NO: 61582 - DNA, 25 bp, Mus musculus
tgagagcagacacactaacaaccct

SEQ ID NO: 61583 - DNA, 25 bp, Mus musculus
tgagagcagactttaatcccagtgg

SEQ ID NO: 61584 - DNA, 25 bp, Mus musculus
tgagagcagatatcacacccagcat

SEQ ID NO: 61585 - DNA, 25 bp, Mus musculus
tgagagcagctgtggggccctcact

SEQ ID NO: 61586 - DNA, 25 bp, Mus musculus
tgagagcaggagcacatttcccttt

SEQ ID NO: 61587 - DNA, 25 bp, Mus musculus
tgagagccatgagaaagaaaggaga

SEQ ID NO: 61588 - DNA, 25 bp, Mus musculus
tgagagccccatggctttgttggct

SEQ ID NO: 61589 - DNA, 25 bp, Mus musculus
tgagagcctgaaactcacacggtct

SEQ ID NO: 61590 - DNA, 25 bp, Mus musculus
tgagagcgagccttggaagtacctg

SEQ ID NO: 61591 - DNA, 25 bp, Mus musculus
tgagagcgctggctacatggagccc

SEQ ID NO: 61592 - DNA, 25 bp, Mus musculus
tgagagctacctggcagttgcctcc

SEQ ID NO: 61593 - DNA, 25 bp, Mus musculus
tgagagctcctaccggaatagcctt

SEQ ID NO: 61594 - DNA, 25 bp, Mus musculus
tgagagctcgggacctttccccaaa

SEQ ID NO: 61595 - DNA, 25 bp, Mus musculus
tgagagctgaatccagtccggtccg

SEQ ID NO: 61596 - DNA, 25 bp, Mus musculus
tgagagcttttgtggaaaacatcac

SEQ ID NO: 61597 - DNA, 25 bp, Mus musculus
tgagaggaatgaaggctttcctttg

SEQ ID NO: 61598 - DNA, 25 bp, Mus musculus
tgagaggaccaggaccacaagattt

SEQ ID NO: 61599 - DNA, 25 bp, Mus musculus
tgagaggatttttcatcaaacaatg

SEQ ID NO: 61600 - DNA, 25 bp, Mus musculus
tgagaggcacaaatactggcatgat

SEQ ID NO: 61601 - DNA, 25 bp, Mus musculus
tgagaggctcccagcctttcacctt

SEQ ID NO: 61602 - DNA, 25 bp, Mus musculus
tgagaggcttggtccatgtctcctc

SEQ ID NO: 61603 - DNA, 25 bp, Mus musculus
tgagaggtactactagatcttccag

SEQ ID NO: 61604 - DNA, 25 bp, Mus musculus
tgagaggtactagtagatcttccag

SEQ ID NO: 61605 - DNA, 25 bp, Mus musculus
tgagaggtcactcccacttcgttag

SEQ ID NO: 61606 - DNA, 25 bp, Mus musculus
tgagagtactgtcgtcctgccctcc

SEQ ID NO: 61607 - DNA, 25 bp, Mus musculus
tgagagtaggtgtcccgcctcagaa

SEQ ID NO: 61608 - DNA, 25 bp, Mus musculus
tgagagtgacagtacttgagtgacc

SEQ ID NO: 61609 - DNA, 25 bp, Mus musculus
tgagagtgctgctgaagtcctccac

SEQ ID NO: 61610 - DNA, 25 bp, Mus musculus
tgagagtgtggttgaactgcccact

SEQ ID NO: 61611 - DNA, 25 bp, Mus musculus
tgagataaaatataccaggatttcc

SEQ ID NO: 61612 - DNA, 25 bp, Mus musculus
tgagataagtcctctattgggcagc

SEQ ID NO: 61613 - DNA, 25 bp, Mus musculus
tgagataatccaccatgacgactac

SEQ ID NO: 61614 - DNA, 25 bp, Mus musculus
tgagatactgcatcgtgtacgacag

SEQ ID NO: 61615 - DNA, 25 bp, Mus musculus
tgagatagacaaccaacccatagct

SEQ ID NO: 61616 - DNA, 25 bp, Mus musculus
tgagatagtagatgttggagacaaa

SEQ ID NO: 61617 - DNA, 25 bp, Mus musculus
tgagatatcctgctgatccttattc

SEQ ID NO: 61618 - DNA, 25 bp, Mus musculus
tgagatcaacctgacacacattgaa

SEQ ID NO: 61619 - DNA, 25 bp, Mus musculus
tgagatcaacttcgagaacatgagc

SEQ ID NO: 61620 - DNA, 25 bp, Mus musculus
tgagatcaagattgtgcgacccggg

SEQ ID NO: 61621 - DNA, 25 bp, Mus musculus
tgagatcaaggctcagtatgatgac

SEQ ID NO: 61622 - DNA, 25 bp, Mus musculus
tgagatcaagtctctgttggaagag

SEQ ID NO: 61623 - DNA, 25 bp, Mus musculus
tgagatcaattcttggagaacacaa

SEQ ID NO: 61624 - DNA, 25 bp, Mus musculus
tgagatcaccatggtagagcagcag

SEQ ID NO: 61625 - DNA, 25 bp, Mus musculus
tgagatcatgcccaccgtcatagat

SEQ ID NO: 61626 - DNA, 25 bp, Mus musculus
tgagatcattcaggaagtccgagaa

SEQ ID NO: 61627 - DNA, 25 bp, Mus musculus
tgagatcccaagtaaacaacccgag

SEQ ID NO: 61628 - DNA, 25 bp, Mus musculus
tgagatcccatttctctggctggag

SEQ ID NO: 61629 - DNA, 25 bp, Mus musculus
tgagatccccatgtagcaattgcca

SEQ ID NO: 61630 - DNA, 25 bp, Mus musculus
tgagatccgacaacagcagcagaaa

SEQ ID NO: 61631 - DNA, 25 bp, Mus musculus
tgagatcgagaatgccaagtgccag

SEQ ID NO: 61632 - DNA, 25 bp, Mus musculus
tgagatcgccagaccccacttctag

SEQ ID NO: 61633 - DNA, 25 bp, Mus musculus
tgagatcgtggaccgcaagtacagc

SEQ ID NO: 61634 - DNA, 25 bp, Mus musculus
tgagatctacctgaggtgccaggat

SEQ ID NO: 61635 - DNA, 25 bp, Mus musculus
tgagatctccagagggacactcctg

SEQ ID NO: 61636 - DNA, 25 bp, Mus musculus
tgagatgaacagattttgccaggga

SEQ ID NO: 61637 - DNA, 25 bp, Mus musculus
tgagatgaactacaagacccaagag

SEQ ID NO: 61638 - DNA, 25 bp, Mus musculus
tgagatgagagaaaggcaaatggct

SEQ ID NO: 61639 - DNA, 25 bp, Mus musculus
tgagatgatcattaccaaggcgggc

SEQ ID NO: 61640 - DNA, 25 bp, Mus musculus
tgagatgatctacacctggaccaaa

SEQ ID NO: 61641 - DNA, 25 bp, Mus musculus
tgagatgcagccgacagccgagtcg

SEQ ID NO: 61642 - DNA, 25 bp, Mus musculus
tgagatgcttctctttgggaagaag

SEQ ID NO: 61643 - DNA, 25 bp, Mus musculus
tgagatgcttgatgctgcgaagaac

SEQ ID NO: 61644 - DNA, 25 bp, Mus musculus
tgagatggacattcaggctgcagct

SEQ ID NO: 61645 - DNA, 25 bp, Mus musculus
tgagatggcatctcgtggagatagc

SEQ ID NO: 61646 - DNA, 25 bp, Mus musculus
tgagatggtagctggatgccaccag

SEQ ID NO: 61647 - DNA, 25 bp, Mus musculus
tgagatggtctttgaattggaaggc

SEQ ID NO: 61648 - DNA, 25 bp, Mus musculus
tgagattatccagaccctgcaaatg

SEQ ID NO: 61649 - DNA, 25 bp, Mus musculus
tgagattcagtttgaacttggcctc

SEQ ID NO: 61650 - DNA, 25 bp, Mus musculus
tgagattcgggtttactctgcctcc

SEQ ID NO: 61651 - DNA, 25 bp, Mus musculus
tgagattcttttcccgggctgtgtc

SEQ ID NO: 61652 - DNA, 25 bp, Mus musculus
tgagatttgatgacacaaacccaga

SEQ ID NO: 61653 - DNA, 25 bp, Mus musculus
tgagcaaacctctcacttgccgctg

SEQ ID NO: 61654 - DNA, 25 bp, Mus musculus
tgagcaaagaaatggtgacatagcc

SEQ ID NO: 61655 - DNA, 25 bp, Mus musculus
tgagcaaatttggaaaacacaacaa

SEQ ID NO: 61656 - DNA, 25 bp, Mus musculus
tgagcaacattaaggctttcagggc

SEQ ID NO: 61657 - DNA, 25 bp, Mus musculus
tgagcaaccctaattaacctgattt

SEQ ID NO: 61658 - DNA, 25 bp, Mus musculus
tgagcaactgggtgatcctctggac

SEQ ID NO: 61659 - DNA, 25 bp, Mus musculus
tgagcaactggtgactctctccctt

SEQ ID NO: 61660 - DNA, 25 bp, Mus musculus
tgagcaagagatacccgtagatggc

SEQ ID NO: 61661 - DNA, 25 bp, Mus musculus
tgagcaaggatgcagtgaaagcact

SEQ ID NO: 61662 - DNA, 25 bp, Mus musculus
tgagcaagttcgtgaaggatttccc

SEQ ID NO: 61663 - DNA, 25 bp, Mus musculus
tgagcaatgggaagcgacatctcag

SEQ ID NO: 61664 - DNA, 25 bp, Mus musculus
tgagcaattgaagcctggctctctg

SEQ ID NO: 61665 - DNA, 25 bp, Mus musculus
tgagcaattgcaggctgagcagaag

SEQ ID NO: 61666 - DNA, 25 bp, Mus musculus
tgagcacaacagagaatgcccttct

SEQ ID NO: 61667 - DNA, 25 bp, Mus musculus
tgagcacaccgtggacggagtaaaa

SEQ ID NO: 61668 - DNA, 25 bp, Mus musculus
tgagcacagccagctataaccagcg

SEQ ID NO: 61669 - DNA, 25 bp, Mus musculus
tgagcacagtgtacactgtccccac

SEQ ID NO: 61670 - DNA, 25 bp, Mus musculus
tgagcacatgtttgaagaagtgccg

SEQ ID NO: 61671 - DNA, 25 bp, Mus musculus
tgagcaccactctgtcatcctggtc

SEQ ID NO: 61672 - DNA, 25 bp, Mus musculus
tgagcaccattctatcatggaagga

SEQ ID NO: 61673 - DNA, 25 bp, Mus musculus
tgagcacccgccacatctgactcct

SEQ ID NO: 61674 - DNA, 25 bp, Mus musculus
tgagcaccctggaagtgccccgttt

SEQ ID NO: 61675 - DNA, 25 bp, Mus musculus
tgagcaccggaagctggaggccctt

SEQ ID NO: 61676 - DNA, 25 bp, Mus musculus
tgagcacggcaatgtgccacttcac

SEQ ID NO: 61677 - DNA, 25 bp, Mus musculus
tgagcacgttatagactgtggagac

SEQ ID NO: 61678 - DNA, 25 bp, Mus musculus
tgagcactagtgacccagctgaagt

SEQ ID NO: 61679 - DNA, 25 bp, Mus musculus
tgagcactatgtacgacatgcaggc

SEQ ID NO: 61680 - DNA, 25 bp, Mus musculus
tgagcactgggatccacagaacatc

SEQ ID NO: 61681 - DNA, 25 bp, Mus musculus
tgagcagaaggtaccgaagttggct

SEQ ID NO: 61682 - DNA, 25 bp, Mus musculus
tgagcagagcatacgcgaattaggc

SEQ ID NO: 61683 - DNA, 25 bp, Mus musculus
tgagcagagcctgccgacccaattg

SEQ ID NO: 61684 - DNA, 25 bp, Mus musculus
tgagcagagctctgcggataaagag

SEQ ID NO: 61685 - DNA, 25 bp, Mus musculus
tgagcagatcctcgctacactcttc

SEQ ID NO: 61686 - DNA, 25 bp, Mus musculus
tgagcagatcctggctacactcttc

SEQ ID NO: 61687 - DNA, 25 bp, Mus musculus
tgagcagattccaaacaaaaaggcc

SEQ ID NO: 61688 - DNA, 25 bp, Mus musculus
tgagcagcaacttcacgagcatttg

SEQ ID NO: 61689 - DNA, 25 bp, Mus musculus
tgagcagcacaccttctgggaggaa

SEQ ID NO: 61690 - DNA, 25 bp, Mus musculus
tgagcagcaccggaaggcttgccga

SEQ ID NO: 61691 - DNA, 25 bp, Mus musculus
tgagcagcacctccagacatctgaa

SEQ ID NO: 61692 - DNA, 25 bp, Mus musculus
tgagcagcagcacatcgctgcccag

SEQ ID NO: 61693 - DNA, 25 bp, Mus musculus
tgagcagcaggtgcattctgcctcc

SEQ ID NO: 61694 - DNA, 25 bp, Mus musculus
tgagcagcatcacatgcgggcaaca

SEQ ID NO: 61695 - DNA, 25 bp, Mus musculus
tgagcagccacgtcctggacaagga

SEQ ID NO: 61696 - DNA, 25 bp, Mus musculus
tgagcagcctcctcaacaatgggaa

SEQ ID NO: 61697 - DNA, 25 bp, Mus musculus
tgagcagcgagctggagactaccag

SEQ ID NO: 61698 - DNA, 25 bp, Mus musculus
tgagcagcggtgacaagatccgatt

SEQ ID NO: 61699 - DNA, 25 bp, Mus musculus
tgagcagctcaaggcccgatcatgg

SEQ ID NO: 61700 - DNA, 25 bp, Mus musculus
tgagcagctgttccatagaggctac

SEQ ID NO: 61701 - DNA, 25 bp, Mus musculus
tgagcagcttcctcgacagtacgcg

SEQ ID NO: 61702 - DNA, 25 bp, Mus musculus
tgagcaggtccggatacactggctg

SEQ ID NO: 61703 - DNA, 25 bp, Mus musculus
tgagcaggtctcatgggataactga

SEQ ID NO: 61704 - DNA, 25 bp, Mus musculus
tgagcagtcttatctcaggccggcc

SEQ ID NO: 61705 - DNA, 25 bp, Mus musculus
tgagcagtgtctcccgagtgtatga

SEQ ID NO: 61706 - DNA, 25 bp, Mus musculus
tgagcagtttgcacaccagccactg

SEQ ID NO: 61707 - DNA, 25 bp, Mus musculus
tgagcatccacatggtttctgagaa

SEQ ID NO: 61708 - DNA, 25 bp, Mus musculus
tgagcatcctgaagactgtcaacca

SEQ ID NO: 61709 - DNA, 25 bp, Mus musculus
tgagcatctgatggctcacgcgagc

SEQ ID NO: 61710 - DNA, 25 bp, Mus musculus
tgagcatcttctctatttccagctg

SEQ ID NO: 61711 - DNA, 25 bp, Mus musculus
tgagcatgaacattgaccttcctga

SEQ ID NO: 61712 - DNA, 25 bp, Mus musculus
tgagcatgactccagagtggtgatc

SEQ ID NO: 61713 - DNA, 25 bp, Mus musculus
tgagcatgctccagtgtgcaccagc

SEQ ID NO: 61714 - DNA, 25 bp, Mus musculus
tgagcatgctggtctactggtcccc

SEQ ID NO: 61715 - DNA, 25 bp, Mus musculus
tgagcatgtgacctacaggctgtac

SEQ ID NO: 61716 - DNA, 25 bp, Mus musculus
tgagcattaatgtgacagctacagc

SEQ ID NO: 61717 - DNA, 25 bp, Mus musculus
tgagcattccggtcgcaatggagac

SEQ ID NO: 61718 - DNA, 25 bp, Mus musculus
tgagccaaaagtagaagtggtcagc

SEQ ID NO: 61719 - DNA, 25 bp, Mus musculus
tgagccacagtgtgagcgctggaaa

SEQ ID NO: 61720 - DNA, 25 bp, Mus musculus
tgagccacctggaggttcagtataa

SEQ ID NO: 61721 - DNA, 25 bp, Mus musculus
tgagccagaaagaggcaaattcgac

SEQ ID NO: 61722 - DNA, 25 bp, Mus musculus
tgagccagacatcgcagaagacact

SEQ ID NO: 61723 - DNA, 25 bp, Mus musculus
tgagccagacattccccaatgctga

SEQ ID NO: 61724 - DNA, 25 bp, Mus musculus
tgagccagaggctctataggactgc

SEQ ID NO: 61725 - DNA, 25 bp, Mus musculus
tgagccagcagctaaaaagccgcca

SEQ ID NO: 61726 - DNA, 25 bp, Mus musculus
tgagccagccacctttaccgggtgg

SEQ ID NO: 61727 - DNA, 25 bp, Mus musculus
tgagccagcccaagatggagggcct

SEQ ID NO: 61728 - DNA, 25 bp, Mus musculus
tgagccaggagatatgctactgcag

SEQ ID NO: 61729 - DNA, 25 bp, Mus musculus
tgagccaggcgctaaagcttcggtg

SEQ ID NO: 61730 - DNA, 25 bp, Mus musculus
tgagccagtaaaagaagaaggttcg

SEQ ID NO: 61731 - DNA, 25 bp, Mus musculus
tgagccagtaccacatggctgtggc

SEQ ID NO: 61732 - DNA, 25 bp, Mus musculus
tgagccagtcccaggctttgacagc

SEQ ID NO: 61733 - DNA, 25 bp, Mus musculus
tgagccagttccagctggctcctgc

SEQ ID NO: 61734 - DNA, 25 bp, Mus musculus
tgagcccaccactttatatgcagat

SEQ ID NO: 61735 - DNA, 25 bp, Mus musculus
tgagcccacccagtacaagggtctg

SEQ ID NO: 61736 - DNA, 25 bp, Mus musculus
tgagcccaggcaccttctgcctcat

SEQ ID NO: 61737 - DNA, 25 bp, Mus musculus
tgagcccaggcataacgctcacact

SEQ ID NO: 61738 - DNA, 25 bp, Mus musculus
tgagcccagtgggaagtagcctccg

SEQ ID NO: 61739 - DNA, 25 bp, Mus musculus
tgagccccatctccagtatttcctt

SEQ ID NO: 61740 - DNA, 25 bp, Mus musculus
tgagccccgcagttaattctccatt

SEQ ID NO: 61741 - DNA, 25 bp, Mus musculus
tgagcccctgtgagcagacagatag

SEQ ID NO: 61742 - DNA, 25 bp, Mus musculus
tgagcccggtggcacagtcttcttc

SEQ ID NO: 61743 - DNA, 25 bp, Mus musculus
tgagccctatttctagagacagctg

SEQ ID NO: 61744 - DNA, 25 bp, Mus musculus
tgagcccttgtgtgtacagtagcag

SEQ ID NO: 61745 - DNA, 25 bp, Mus musculus
tgagccgagctacagtacatgaccc

SEQ ID NO: 61746 - DNA, 25 bp, Mus musculus
tgagccgaggaggtgaccccacact

SEQ ID NO: 61747 - DNA, 25 bp, Mus musculus
tgagccgagtaattgccttggaacc

SEQ ID NO: 61748 - DNA, 25 bp, Mus musculus
tgagccgcagagtgactctggagaa

SEQ ID NO: 61749 - DNA, 25 bp, Mus musculus
tgagccggatctcgatgacaatgag

SEQ ID NO: 61750 - DNA, 25 bp, Mus musculus
tgagccgggcacagaaacacagcag

SEQ ID NO: 61751 - DNA, 25 bp, Mus musculus
tgagccgtagaggaagagtattgcc

SEQ ID NO: 61752 - DNA, 25 bp, Mus musculus
tgagcctagggagagatcagatgcc

SEQ ID NO: 61753 - DNA, 25 bp, Mus musculus
tgagcctcagaggtacagacagaag

SEQ ID NO: 61754 - DNA, 25 bp, Mus musculus
tgagcctcagattaaggactctggg

SEQ ID NO: 61755 - DNA, 25 bp, Mus musculus
tgagcctcccaggagatcagcctgg

SEQ ID NO: 61756 - DNA, 25 bp, Mus musculus
tgagcctccctgagttgtcaggagc

SEQ ID NO: 61757 - DNA, 25 bp, Mus musculus
tgagcctgccaaacctggagatctc

SEQ ID NO: 61758 - DNA, 25 bp, Mus musculus
tgagcctgggagtttcctgaagaca

SEQ ID NO: 61759 - DNA, 25 bp, Mus musculus
tgagcctgtatctgcagcactggaa

SEQ ID NO: 61760 - DNA, 25 bp, Mus musculus
tgagcctgttgacaaggacttctac

SEQ ID NO: 61761 - DNA, 25 bp, Mus musculus
tgagccttatagcagatcttccaag

SEQ ID NO: 61762 - DNA, 25 bp, Mus musculus
tgagccttgctttgatgctgctgac

SEQ ID NO: 61763 - DNA, 25 bp, Mus musculus
tgagcctttcctgcgtctacagagg

SEQ ID NO: 61764 - DNA, 25 bp, Mus musculus
tgagcgaataggtgaggtgtggccc

SEQ ID NO: 61765 - DNA, 25 bp, Mus musculus
tgagcgagcaattctcccaggtgaa

SEQ ID NO: 61766 - DNA, 25 bp, Mus musculus
tgagcgagcgctggagctcctctgt

SEQ ID NO: 61767 - DNA, 25 bp, Mus musculus
tgagcgcagccgagcgtgccaagaa

SEQ ID NO: 61768 - DNA, 25 bp, Mus musculus
tgagcgcaggacctgatctcacaga

SEQ ID NO: 61769 - DNA, 25 bp, Mus musculus
tgagcgctacgtttgcgcagtgacc

SEQ ID NO: 61770 - DNA, 25 bp, Mus musculus
tgagcggcaactcgcactctgggac

SEQ ID NO: 61771 - DNA, 25 bp, Mus musculus
tgagcggcagcctgatgagcctatc

SEQ ID NO: 61772 - DNA, 25 bp, Mus musculus
tgagcggcccatgaaaagccaaatt

SEQ ID NO: 61773 - DNA, 25 bp, Mus musculus
tgagcggtgacacatcctcatgcct

SEQ ID NO: 61774 - DNA, 25 bp, Mus musculus
tgagcgtcgaacgactgaagccgcg

SEQ ID NO: 61775 - DNA, 25 bp, Mus musculus
tgagcgtgaagccatttttagaacc

SEQ ID NO: 61776 - DNA, 25 bp, Mus musculus
tgagcgtggaggaacaacatcttgg

SEQ ID NO: 61777 - DNA, 25 bp, Mus musculus
tgagctaagtattggtgaagagatt

SEQ ID NO: 61778 - DNA, 25 bp, Mus musculus
tgagctacagacagtgcagacttct

SEQ ID NO: 61779 - DNA, 25 bp, Mus musculus
tgagctagagctggcgccatctcga

SEQ ID NO: 61780 - DNA, 25 bp, Mus musculus
tgagctagcaatgccatcaaagagc

SEQ ID NO: 61781 - DNA, 25 bp, Mus musculus
tgagctaggagctgacagaaaacat

SEQ ID NO: 61782 - DNA, 25 bp, Mus musculus
tgagctaggcaccaactggaagagt

SEQ ID NO: 61783 - DNA, 25 bp, Mus musculus
tgagctaggccgtctgacactggat

SEQ ID NO: 61784 - DNA, 25 bp, Mus musculus
tgagctatgctgtcttccaactggg

SEQ ID NO: 61785 - DNA, 25 bp, Mus musculus
tgagctcacacctcactgctgtacg

SEQ ID NO: 61786 - DNA, 25 bp, Mus musculus
tgagctcaccgaaatgaagcgaacg

SEQ ID NO: 61787 - DNA, 25 bp, Mus musculus
tgagctcagcaagacactaggcaag

SEQ ID NO: 61788 - DNA, 25 bp, Mus musculus
tgagctccagcagaccataagggac

SEQ ID NO: 61789 - DNA, 25 bp, Mus musculus
tgagctcccctgagagtctctgcag

SEQ ID NO: 61790 - DNA, 25 bp, Mus musculus
tgagctcctacctggttttcgggcg

SEQ ID NO: 61791 - DNA, 25 bp, Mus musculus
tgagctcctggaggctgcatttcat

SEQ ID NO: 61792 - DNA, 25 bp, Mus musculus
tgagctcctgttacatgcacggcat

SEQ ID NO: 61793 - DNA, 25 bp, Mus musculus
tgagctcgatgaaaaggaatctttg

SEQ ID NO: 61794 - DNA, 25 bp, Mus musculus
tgagctcggtgactctgccactgca

SEQ ID NO: 61795 - DNA, 25 bp, Mus musculus
tgagctctcccctgtcagtgctctg

SEQ ID NO: 61796 - DNA, 25 bp, Mus musculus
tgagctctcgtctcttcatcgagcc

SEQ ID NO: 61797 - DNA, 25 bp, Mus musculus
tgagctctggaaaggacctgtcacc

SEQ ID NO: 61798 - DNA, 25 bp, Mus musculus
tgagctctggtaccgcaagatctgt

SEQ ID NO: 61799 - DNA, 25 bp, Mus musculus
tgagctgaagatgttcccagaacag

SEQ ID NO: 61800 - DNA, 25 bp, Mus musculus
tgagctgacccggatctgtgatgac

SEQ ID NO: 61801 - DNA, 25 bp, Mus musculus
tgagctgacggctgagaaaatcaca

SEQ ID NO: 61802 - DNA, 25 bp, Mus musculus
tgagctgaggacatataaactcaag

SEQ ID NO: 61803 - DNA, 25 bp, Mus musculus
tgagctgatgaagcaccaaaccaat

SEQ ID NO: 61804 - DNA, 25 bp, Mus musculus
tgagctgcacagtctcggagctgaa

SEQ ID NO: 61805 - DNA, 25 bp, Mus musculus
tgagctgcctgcgtcccaaagaaca

SEQ ID NO: 61806 - DNA, 25 bp, Mus musculus
tgagctgctacagaagggttacggc

SEQ ID NO: 61807 - DNA, 25 bp, Mus musculus
tgagctgctgatgtcagttaactct

SEQ ID NO: 61808 - DNA, 25 bp, Mus musculus
tgagctggatgctgacttggatcac

SEQ ID NO: 61809 - DNA, 25 bp, Mus musculus
tgagctgggcaacacccagcaacag

SEQ ID NO: 61810 - DNA, 25 bp, Mus musculus
tgagctgggcaagcccgacatagaa

SEQ ID NO: 61811 - DNA, 25 bp, Mus musculus
tgagctggtgcacacgtggcccttt

SEQ ID NO: 61812 - DNA, 25 bp, Mus musculus
tgagctggtgtgctgccttcctcaa

SEQ ID NO: 61813 - DNA, 25 bp, Mus musculus
tgagctgtagaagggcatctgactc

SEQ ID NO: 61814 - DNA, 25 bp, Mus musculus
tgagctgtcctccattagttcttct

SEQ ID NO: 61815 - DNA, 25 bp, Mus musculus
tgagctgtctcaacaacctcttcct

SEQ ID NO: 61816 - DNA, 25 bp, Mus musculus
tgagcttatcctggacatgtttgga

SEQ ID NO: 61817 - DNA, 25 bp, Mus musculus
tgagcttatctgcacaaggactgtg

SEQ ID NO: 61818 - DNA, 25 bp, Mus musculus
tgagcttatctggacaaggactgtg

SEQ ID NO: 61819 - DNA, 25 bp, Mus musculus
tgagcttccgaagcggagtctttgt

SEQ ID NO: 61820 - DNA, 25 bp, Mus musculus
tgagcttcgggttgagatcaccagg

SEQ ID NO: 61821 - DNA, 25 bp, Mus musculus
tgagcttcgtggtcacactgtgatc

SEQ ID NO: 61822 - DNA, 25 bp, Mus musculus
tgagcttgagccaaaccgggtctct

SEQ ID NO: 61823 - DNA, 25 bp, Mus musculus
tgagcttgagctgaaagcagagaaa

SEQ ID NO: 61824 - DNA, 25 bp, Mus musculus
tgagcttgatgaacccagtgttcaa

SEQ ID NO: 61825 - DNA, 25 bp, Mus musculus
tgagcttgatgatcccagtgttcaa

SEQ ID NO: 61826 - DNA, 25 bp, Mus musculus
tgagcttggcctgctgtcgtttagt

SEQ ID NO: 61827 - DNA, 25 bp, Mus musculus
tgagcttgtgatcttggaatggccc

SEQ ID NO: 61828 - DNA, 25 bp, Mus musculus
tgagcttgtgatgttggaatggccc

SEQ ID NO: 61829 - DNA, 25 bp, Mus musculus
tgagcttgtgcctagcgtgctttgg

SEQ ID NO: 61830 - DNA, 25 bp, Mus musculus
tgagcttgtttacccagagcctttg

SEQ ID NO: 61831 - DNA, 25 bp, Mus musculus
tgagctttcccgagacaaggaaaag

SEQ ID NO: 61832 - DNA, 25 bp, Mus musculus
tgaggaaaatctgcgctctcgatga

SEQ ID NO: 61833 - DNA, 25 bp, Mus musculus
tgaggaaacagtttacagtcatcac

SEQ ID NO: 61834 - DNA, 25 bp, Mus musculus
tgaggaaacccagacttgagaaaac

SEQ ID NO: 61835 - DNA, 25 bp, Mus musculus
tgaggaaacggccagtcttctcttg

SEQ ID NO: 61836 - DNA, 25 bp, Mus musculus
tgaggaaagccgaagaagaggaact

SEQ ID NO: 61837 - DNA, 25 bp, Mus musculus
tgaggaaagccgtagaagaggaact

SEQ ID NO: 61838 - DNA, 25 bp, Mus musculus
tgaggaaaggacacgactctatggt

SEQ ID NO: 61839 - DNA, 25 bp, Mus musculus
tgaggaaccctcacaaaacctttga

SEQ ID NO: 61840 - DNA, 25 bp, Mus musculus
tgaggaaccttacccaggcagttaa

SEQ ID NO: 61841 - DNA, 25 bp, Mus musculus
tgaggaagacccagacgaggattta

SEQ ID NO: 61842 - DNA, 25 bp, Mus musculus
tgaggaagctctcccgatgaaactg

SEQ ID NO: 61843 - DNA, 25 bp, Mus musculus
tgaggaagctgtggaaaaattccgt

SEQ ID NO: 61844 - DNA, 25 bp, Mus musculus
tgaggaaggcacaaatgcagaacca

SEQ ID NO: 61845 - DNA, 25 bp, Mus musculus
tgaggaaggcatgcagctggttacc

SEQ ID NO: 61846 - DNA, 25 bp, Mus musculus
tgaggaaggctttcagatcagttcg

SEQ ID NO: 61847 - DNA, 25 bp, Mus musculus
tgaggaaggtggaaagactccattg

SEQ ID NO: 61848 - DNA, 25 bp, Mus musculus
tgaggaaggttacccgcattgctta

SEQ ID NO: 61849 - DNA, 25 bp, Mus musculus
tgaggaagtagaatccagcttacaa

SEQ ID NO: 61850 - DNA, 25 bp, Mus musculus
tgaggaagtctcagctgcagaatga

SEQ ID NO: 61851 - DNA, 25 bp, Mus musculus
tgaggaagtggaatttgaacccagg

SEQ ID NO: 61852 - DNA, 25 bp, Mus musculus
tgaggaatacggcatcatgtgtccg

SEQ ID NO: 61853 - DNA, 25 bp, Mus musculus
tgaggaatagcaaggagagaattca

SEQ ID NO: 61854 - DNA, 25 bp, Mus musculus
tgaggaatgcccaggcactgatatc

SEQ ID NO: 61855 - DNA, 25 bp, Mus musculus
tgaggaattatatgcagatgaccct

SEQ ID NO: 61856 - DNA, 25 bp, Mus musculus
tgaggacaaaccctaccagtgcaag

SEQ ID NO: 61857 - DNA, 25 bp, Mus musculus
tgaggacaacggtcagagaaggcac

SEQ ID NO: 61858 - DNA, 25 bp, Mus musculus
tgaggacaagccacaggattacaag

SEQ ID NO: 61859 - DNA, 25 bp, Mus musculus
tgaggacacagaggatgtccgaaga

SEQ ID NO: 61860 - DNA, 25 bp, Mus musculus
tgaggacagaactttggaatcggca

SEQ ID NO: 61861 - DNA, 25 bp, Mus musculus
tgaggacataaacaatacgggaacc

SEQ ID NO: 61862 - DNA, 25 bp, Mus musculus
tgaggaccaaacgagacacagtgaa

SEQ ID NO: 61863 - DNA, 25 bp, Mus musculus
tgaggaccaggaagtgtgcaagaac

SEQ ID NO: 61864 - DNA, 25 bp, Mus musculus
tgaggaccatgagaaaaccaaggag

SEQ ID NO: 61865 - DNA, 25 bp, Mus musculus
tgaggaccccgaagttgaggtgacc

SEQ ID NO: 61866 - DNA, 25 bp, Mus musculus
tgaggacctagttgtgaccctgacg

SEQ ID NO: 61867 - DNA, 25 bp, Mus musculus
tgaggacgaaggtggaattgtctct

SEQ ID NO: 61868 - DNA, 25 bp, Mus musculus
tgaggacgacgccagcaaatgcacc

SEQ ID NO: 61869 - DNA, 25 bp, Mus musculus
tgaggacgatgctggtgcgtaccca

SEQ ID NO: 61870 - DNA, 25 bp, Mus musculus
tgaggacgtactggtgccgaagaaa

SEQ ID NO: 61871 - DNA, 25 bp, Mus musculus
tgaggacgtttctatcattccaccc

SEQ ID NO: 61872 - DNA, 25 bp, Mus musculus
tgaggactacatcgacttcctgcag

SEQ ID NO: 61873 - DNA, 25 bp, Mus musculus
tgaggactcagaacttatagcagaa

SEQ ID NO: 61874 - DNA, 25 bp, Mus musculus
tgaggactccaacaacttgggaacc

SEQ ID NO: 61875 - DNA, 25 bp, Mus musculus
tgaggacttctcagacatttgtaat

SEQ ID NO: 61876 - DNA, 25 bp, Mus musculus
tgaggactttgtgccattccggccc

SEQ ID NO: 61877 - DNA, 25 bp, Mus musculus
tgaggagaacatggccacccatttc

SEQ ID NO: 61878 - DNA, 25 bp, Mus musculus
tgaggagaacattcaagacagtgag

SEQ ID NO: 61879 - DNA, 25 bp, Mus musculus
tgaggagaagatcaagaagtcccca

SEQ ID NO: 61880 - DNA, 25 bp, Mus musculus
tgaggagaagctgcgttccctaacc

SEQ ID NO: 61881 - DNA, 25 bp, Mus musculus
tgaggagacaaagccgtcacatccg

SEQ ID NO: 61882 - DNA, 25 bp, Mus musculus
tgaggagactgaccttgccccaagt

SEQ ID NO: 61883 - DNA, 25 bp, Mus musculus
tgaggagcaccagatctcacttctc

SEQ ID NO: 61884 - DNA, 25 bp, Mus musculus
tgaggagcatcgtcaggtctgcaga

SEQ ID NO: 61885 - DNA, 25 bp, Mus musculus
tgaggagcccgtgcgccagaagatt

SEQ ID NO: 61886 - DNA, 25 bp, Mus musculus
tgaggagcgcctaccttcacaccat

SEQ ID NO: 61887 - DNA, 25 bp, Mus musculus
tgaggagctcctggacaaccgaaaa

SEQ ID NO: 61888 - DNA, 25 bp, Mus musculus
tgaggagctgcagccactgagccag

SEQ ID NO: 61889 - DNA, 25 bp, Mus musculus
tgaggagcttaagaagcagatgccc

SEQ ID NO: 61890 - DNA, 25 bp, Mus musculus
tgaggaggacacaaaaggaatcaag

SEQ ID NO: 61891 - DNA, 25 bp, Mus musculus
tgaggaggctgtagaaggcaccagt

SEQ ID NO: 61892 - DNA, 25 bp, Mus musculus
tgaggagtaactaccataactagtc

SEQ ID NO: 61893 - DNA, 25 bp, Mus musculus
tgaggagtatttgcagcgtcgatcc

SEQ ID NO: 61894 - DNA, 25 bp, Mus musculus
tgaggagtgaactgtcccactgtcg

SEQ ID NO: 61895 - DNA, 25 bp, Mus musculus
tgaggatacacaggatccgcaatcc

SEQ ID NO: 61896 - DNA, 25 bp, Mus musculus
tgaggatacattgtctcttcggagc

SEQ ID NO: 61897 - DNA, 25 bp, Mus musculus
tgaggatccacgaaaggcttgtggc

SEQ ID NO: 61898 - DNA, 25 bp, Mus musculus
tgaggatccagcagtttcggaagaa

SEQ ID NO: 61899 - DNA, 25 bp, Mus musculus
tgaggatcccagactttttgcagat

SEQ ID NO: 61900 - DNA, 25 bp, Mus musculus
tgaggatcctgcatgttaatgggtt

SEQ ID NO: 61901 - DNA, 25 bp, Mus musculus
tgaggatgacctttcgctcatggac

SEQ ID NO: 61902 - DNA, 25 bp, Mus musculus
tgaggatgacgtccagctccagctg

SEQ ID NO: 61903 - DNA, 25 bp, Mus musculus
tgaggatgaggtatacagcctgaca

SEQ ID NO: 61904 - DNA, 25 bp, Mus musculus
tgaggatgcaagcaactcctatata

SEQ ID NO: 61905 - DNA, 25 bp, Mus musculus
tgaggatgccatacgcaacctgcac

SEQ ID NO: 61906 - DNA, 25 bp, Mus musculus
tgaggatggacacttctcacactac

SEQ ID NO: 61907 - DNA, 25 bp, Mus musculus
tgaggatggatcagtaaccctgtgg

SEQ ID NO: 61908 - DNA, 25 bp, Mus musculus
tgaggatggctcagtacaaatagca

SEQ ID NO: 61909 - DNA, 25 bp, Mus musculus
tgaggatggtatgcgggatatccct

SEQ ID NO: 61910 - DNA, 25 bp, Mus musculus
tgaggatgtggaaatggaaccgtcc

SEQ ID NO: 61911 - DNA, 25 bp, Mus musculus
tgaggattactgaccgcctctttag

SEQ ID NO: 61912 - DNA, 25 bp, Mus musculus
tgaggattactgtccgcctctttag

SEQ ID NO: 61913 - DNA, 25 bp, Mus musculus
tgaggcaaaaatactttgtcggcta

SEQ ID NO: 61914 - DNA, 25 bp, Mus musculus
tgaggcaaagactccaaagcaacgc

SEQ ID NO: 61915 - DNA, 25 bp, Mus musculus
tgaggcaaaggtccgaggcatcatt

SEQ ID NO: 61916 - DNA, 25 bp, Mus musculus
tgaggcaaatgaagccactggctct

SEQ ID NO: 61917 - DNA, 25 bp, Mus musculus
tgaggcacacttatccatctaggaa

SEQ ID NO: 61918 - DNA, 25 bp, Mus musculus
tgaggcacatagaagcagcatttga

SEQ ID NO: 61919 - DNA, 25 bp, Mus musculus
tgaggcagaaaatatggacacaccc

SEQ ID NO: 61920 - DNA, 25 bp, Mus musculus
tgaggcagctcagacgcccagtcgt

SEQ ID NO: 61921 - DNA, 25 bp, Mus musculus
tgaggcagctgagagacactgcatg

SEQ ID NO: 61922 - DNA, 25 bp, Mus musculus
tgaggcaggaaaaccgagaaaaaat

SEQ ID NO: 61923 - DNA, 25 bp, Mus musculus
tgaggcagtgaaatccatgtttcac

SEQ ID NO: 61924 - DNA, 25 bp, Mus musculus
tgaggcagtttgacctggcctggca

SEQ ID NO: 61925 - DNA, 25 bp, Mus musculus
tgaggcatcccttccgtcttcggaa

SEQ ID NO: 61926 - DNA, 25 bp, Mus musculus
tgaggcatgaactccgctatggccc

SEQ ID NO: 61927 - DNA, 25 bp, Mus musculus
tgaggccaagagacagcagctaatg

SEQ ID NO: 61928 - DNA, 25 bp, Mus musculus
tgaggccagtgcacctttgacccaa

SEQ ID NO: 61929 - DNA, 25 bp, Mus musculus
tgaggcccaagctggagaaacggcc

SEQ ID NO: 61930 - DNA, 25 bp, Mus musculus
tgaggcccagaccaaggagaccctg

SEQ ID NO: 61931 - DNA, 25 bp, Mus musculus
tgaggccccgagagtacagtgactt

SEQ ID NO: 61932 - DNA, 25 bp, Mus musculus
tgaggccctgaggaattaaggcact

SEQ ID NO: 61933 - DNA, 25 bp, Mus musculus
tgaggcccttatgaatggagtaacg

SEQ ID NO: 61934 - DNA, 25 bp, Mus musculus
tgaggcctggattgctgctttcaat

SEQ ID NO: 61935 - DNA, 25 bp, Mus musculus
tgaggccttggacattgaaaaagca

SEQ ID NO: 61936 - DNA, 25 bp, Mus musculus
tgaggcgagccaccatttcaaaccc

SEQ ID NO: 61937 - DNA, 25 bp, Mus musculus
tgaggcgccagtctgaaatcaagag

SEQ ID NO: 61938 - DNA, 25 bp, Mus musculus
tgaggcggcctgaccccatcgactg

SEQ ID NO: 61939 - DNA, 25 bp, Mus musculus
tgaggcgggcgtgacgctcatctct

SEQ ID NO: 61940 - DNA, 25 bp, Mus musculus
tgaggctaagcaagacactgtaaag

SEQ ID NO: 61941 - DNA, 25 bp, Mus musculus
tgaggctaggcctgtattggctgtt

SEQ ID NO: 61942 - DNA, 25 bp, Mus musculus
tgaggctattgctaccctggctccc

SEQ ID NO: 61943 - DNA, 25 bp, Mus musculus
tgaggctcagtgatgggacaacagc

SEQ ID NO: 61944 - DNA, 25 bp, Mus musculus
tgaggctccagaactcatcacccag

SEQ ID NO: 61945 - DNA, 25 bp, Mus musculus
tgaggctccctgttcccctggcagt

SEQ ID NO: 61946 - DNA, 25 bp, Mus musculus
tgaggctccgtgacagaacgcggtt

SEQ ID NO: 61947 - DNA, 25 bp, Mus musculus
tgaggctctgaaacaagtaactaag

SEQ ID NO: 61948 - DNA, 25 bp, Mus musculus
tgaggctctgcaactgcgagcacag

SEQ ID NO: 61949 - DNA, 25 bp, Mus musculus
tgaggctgaggctgctcatgggaca

SEQ ID NO: 61950 - DNA, 25 bp, Mus musculus
tgaggcttgaataccataacttctt

SEQ ID NO: 61951 - DNA, 25 bp, Mus musculus
tgaggcttgttaccacatgctgagc

SEQ ID NO: 61952 - DNA, 25 bp, Mus musculus
tgaggctttaatagtgagatgcccc

SEQ ID NO: 61953 - DNA, 25 bp, Mus musculus
tgaggctttaattgtgagatgcccc

SEQ ID NO: 61954 - DNA, 25 bp, Mus musculus
tgagggaacggatcatcaagcgagc

SEQ ID NO: 61955 - DNA, 25 bp, Mus musculus
tgagggaagcgaacgtcaagcaagc

SEQ ID NO: 61956 - DNA, 25 bp, Mus musculus
tgagggacagagtagaagacaattc

SEQ ID NO: 61957 - DNA, 25 bp, Mus musculus
tgagggaggctttctataggcagaa

SEQ ID NO: 61958 - DNA, 25 bp, Mus musculus
tgagggagtttaacggtcagcactt

SEQ ID NO: 61959 - DNA, 25 bp, Mus musculus
tgagggatcaagagaaacaggcccg

SEQ ID NO: 61960 - DNA, 25 bp, Mus musculus
tgagggatctgctggaagtcacatc

SEQ ID NO: 61961 - DNA, 25 bp, Mus musculus
tgagggatgcccacaaggaaagcta

SEQ ID NO: 61962 - DNA, 25 bp, Mus musculus
tgagggatggactgcccctctcagc

SEQ ID NO: 61963 - DNA, 25 bp, Mus musculus
tgagggcacagatggagggagggct

SEQ ID NO: 61964 - DNA, 25 bp, Mus musculus
tgagggcagaagtgcagttgaccaa

SEQ ID NO: 61965 - DNA, 25 bp, Mus musculus
tgagggccaggaacatgaaaaggta

SEQ ID NO: 61966 - DNA, 25 bp, Mus musculus
tgagggccccgaatttggaagatac

SEQ ID NO: 61967 - DNA, 25 bp, Mus musculus
tgagggccttcgcttgagctcccct

SEQ ID NO: 61968 - DNA, 25 bp, Mus musculus
tgagggctattcgagtgtttgagtt

SEQ ID NO: 61969 - DNA, 25 bp, Mus musculus
tgagggctcctcacatcgagactga

SEQ ID NO: 61970 - DNA, 25 bp, Mus musculus
tgagggctgcacagctggtccagct

SEQ ID NO: 61971 - DNA, 25 bp, Mus musculus
tgagggctgccctgaagctggaacc

SEQ ID NO: 61972 - DNA, 25 bp, Mus musculus
tgagggcttaagagatttggaactg

SEQ ID NO: 61973 - DNA, 25 bp, Mus musculus
tgagggctttgttcagtgtgacagc

SEQ ID NO: 61974 - DNA, 25 bp, Mus musculus
tgagggtatcgccttcttctaccac

SEQ ID NO: 61975 - DNA, 25 bp, Mus musculus
tgagggtcagatggaggctcccttt

SEQ ID NO: 61976 - DNA, 25 bp, Mus musculus
tgagggtcaggatccaggcatgcct

SEQ ID NO: 61977 - DNA, 25 bp, Mus musculus
tgagggtcatgacactacagccagt

SEQ ID NO: 61978 - DNA, 25 bp, Mus musculus
tgagggtgcagagccggatctgatc

SEQ ID NO: 61979 - DNA, 25 bp, Mus musculus
tgagggtgccctgctggaagataac

SEQ ID NO: 61980 - DNA, 25 bp, Mus musculus
tgagggtggaactgttgcataatcc

SEQ ID NO: 61981 - DNA, 25 bp, Mus musculus
tgagggttctcatttcccagtcaac

SEQ ID NO: 61982 - DNA, 25 bp, Mus musculus
tgaggtaccaagagctactgctgag

SEQ ID NO: 61983 - DNA, 25 bp, Mus musculus
tgaggtaccattcgttcaaaccgag

SEQ ID NO: 61984 - DNA, 25 bp, Mus musculus
tgaggtagacgacattgatgaagaa

SEQ ID NO: 61985 - DNA, 25 bp, Mus musculus
tgaggtatctgtcatcaaagaaggc

SEQ ID NO: 61986 - DNA, 25 bp, Mus musculus
tgaggtatgggcttttggccgccat

SEQ ID NO: 61987 - DNA, 25 bp, Mus musculus
tgaggtcaatgcttggctggtccac

SEQ ID NO: 61988 - DNA, 25 bp, Mus musculus
tgaggtcacccaggcaatatgggac

SEQ ID NO: 61989 - DNA, 25 bp, Mus musculus
tgaggtcaccccagacaagaagggc

SEQ ID NO: 61990 - DNA, 25 bp, Mus musculus
tgaggtcacccctgacaagaagggc

SEQ ID NO: 61991 - DNA, 25 bp, Mus musculus
tgaggtcactaaataagcttccacg

SEQ ID NO: 61992 - DNA, 25 bp, Mus musculus
tgaggtcatcagctccaaatgcaca

SEQ ID NO: 61993 - DNA, 25 bp, Mus musculus
tgaggtcatggcagaactcaacagt

SEQ ID NO: 61994 - DNA, 25 bp, Mus musculus
tgaggtcatggctgaactcaacagt

SEQ ID NO: 61995 - DNA, 25 bp, Mus musculus
tgaggtccatccatcctcctacaag

SEQ ID NO: 61996 - DNA, 25 bp, Mus musculus
tgaggtcccattctgtgagtccaac

SEQ ID NO: 61997 - DNA, 25 bp, Mus musculus
tgaggtccccttggctgtccagcat

SEQ ID NO: 61998 - DNA, 25 bp, Mus musculus
tgaggtccgggatcatcattgaccg

SEQ ID NO: 61999 - DNA, 25 bp, Mus musculus
tgaggtgaaggaagtgtaccttgac

SEQ ID NO: 62000 - DNA, 25 bp, Mus musculus
tgaggtgaccgtggtggacaacttc

SEQ ID NO: 62001 - DNA, 25 bp, Mus musculus
tgaggtgacgcagaggatctatgac

SEQ ID NO: 62002 - DNA, 25 bp, Mus musculus
tgaggtgcacctggaatctacttgg

SEQ ID NO: 62003 - DNA, 25 bp, Mus musculus
tgaggtggccttgattgcttcgtcc

SEQ ID NO: 62004 - DNA, 25 bp, Mus musculus
tgaggtggtccctgatgtcaatgtc

SEQ ID NO: 62005 - DNA, 25 bp, Mus musculus
tgaggtgtagccactggacacagct

SEQ ID NO: 62006 - DNA, 25 bp, Mus musculus
tgaggtgtagcctctggacacagct

SEQ ID NO: 62007 - DNA, 25 bp, Mus musculus
tgaggttatgctggcaccactcgca

SEQ ID NO: 62008 - DNA, 25 bp, Mus musculus
tgaggttctggatttcatcacgcac

SEQ ID NO: 62009 - DNA, 25 bp, Mus musculus
tgagtaagcgagaggctagtcttat

SEQ ID NO: 62010 - DNA, 25 bp, Mus musculus
tgagtaatggacaaatgggccagcc

SEQ ID NO: 62011 - DNA, 25 bp, Mus musculus
tgagtacagactgaccgtccaggcc

SEQ ID NO: 62012 - DNA, 25 bp, Mus musculus
tgagtacagcccagtcgtctcggtg

SEQ ID NO: 62013 - DNA, 25 bp, Mus musculus
tgagtacagctctcaaacggaagtg

SEQ ID NO: 62014 - DNA, 25 bp, Mus musculus
tgagtacccaggagcgcctgaagca

SEQ ID NO: 62015 - DNA, 25 bp, Mus musculus
tgagtaccgcgtgaagctggaagaa

SEQ ID NO: 62016 - DNA, 25 bp, Mus musculus
tgagtacgcaggttttgatgagatg

SEQ ID NO: 62017 - DNA, 25 bp, Mus musculus
tgagtactccaagtttgatggcaag

SEQ ID NO: 62018 - DNA, 25 bp, Mus musculus
tgagtactgcggcatcatccaggct

SEQ ID NO: 62019 - DNA, 25 bp, Mus musculus
tgagtacttctgacataatatggac

SEQ ID NO: 62020 - DNA, 25 bp, Mus musculus
tgagtaggcatgtggagcactgcct

SEQ ID NO: 62021 - DNA, 25 bp, Mus musculus
tgagtatcaccgcaggatcgatgct

SEQ ID NO: 62022 - DNA, 25 bp, Mus musculus
tgagtatgaagctgcagcaaccaga

SEQ ID NO: 62023 - DNA, 25 bp, Mus musculus
tgagtatggatcctgagctcccgga

SEQ ID NO: 62024 - DNA, 25 bp, Mus musculus
tgagtatggtggacctgggcactta

SEQ ID NO: 62025 - DNA, 25 bp, Mus musculus
tgagtatgtctaacttcagatacac

SEQ ID NO: 62026 - DNA, 25 bp, Mus musculus
tgagtattatgatgctggcagtcac

SEQ ID NO: 62027 - DNA, 25 bp, Mus musculus
tgagtcactcagttccagccccaag

SEQ ID NO: 62028 - DNA, 25 bp, Mus musculus
tgagtcagaaacacctggtgagaga

SEQ ID NO: 62029 - DNA, 25 bp, Mus musculus
tgagtcaggattatgtcaatgggac

SEQ ID NO: 62030 - DNA, 25 bp, Mus musculus
tgagtcagtccaaaagcttccgtcg

SEQ ID NO: 62031 - DNA, 25 bp, Mus musculus
tgagtccaaagcagacacgaccaca

SEQ ID NO: 62032 - DNA, 25 bp, Mus musculus
tgagtccagaaattacaacagaaga

SEQ ID NO: 62033 - DNA, 25 bp, Mus musculus
tgagtccccaaagaaaagtgctctt

SEQ ID NO: 62034 - DNA, 25 bp, Mus musculus
tgagtcccctaggtaccagaacttc

SEQ ID NO: 62035 - DNA, 25 bp, Mus musculus
tgagtcccctgatccattccagcca

SEQ ID NO: 62036 - DNA, 25 bp, Mus musculus
tgagtcctcctagacacttggcagt

SEQ ID NO: 62037 - DNA, 25 bp, Mus musculus
tgagtcctttgagccttacccagaa

SEQ ID NO: 62038 - DNA, 25 bp, Mus musculus
tgagtcgccttgtgatcccagccat

SEQ ID NO: 62039 - DNA, 25 bp, Mus musculus
tgagtcgtgctctgttggtatagag

SEQ ID NO: 62040 - DNA, 25 bp, Mus musculus
tgagtctaaaccagcccagagtggc

SEQ ID NO: 62041 - DNA, 25 bp, Mus musculus
tgagtctatatctgaagagctggat

SEQ ID NO: 62042 - DNA, 25 bp, Mus musculus
tgagtctatccccagctccgcggga

SEQ ID NO: 62043 - DNA, 25 bp, Mus musculus
tgagtctcccttgggtgaaagagca

SEQ ID NO: 62044 - DNA, 25 bp, Mus musculus
tgagtctctggacgacttcacagac

SEQ ID NO: 62045 - DNA, 25 bp, Mus musculus
tgagtctgtagactacagagctact

SEQ ID NO: 62046 - DNA, 25 bp, Mus musculus
tgagtcttcaggtagtgtagggtcc

SEQ ID NO: 62047 - DNA, 25 bp, Mus musculus
tgagtgaaaatgagatgctgcaggc

SEQ ID NO: 62048 - DNA, 25 bp, Mus musculus
tgagtgaaaatgctgttcgccaaaa

SEQ ID NO: 62049 - DNA, 25 bp, Mus musculus
tgagtgaaaatggagcattcctagc

SEQ ID NO: 62050 - DNA, 25 bp, Mus musculus
tgagtgaaacaaacgcagaaaccaa

SEQ ID NO: 62051 - DNA, 25 bp, Mus musculus
tgagtgaactaagcaaggaaggaat

SEQ ID NO: 62052 - DNA, 25 bp, Mus musculus
tgagtgaatgaaagggtcccgctgc

SEQ ID NO: 62053 - DNA, 25 bp, Mus musculus
tgagtgaatgaatgggtcccgctgc

SEQ ID NO: 62054 - DNA, 25 bp, Mus musculus
tgagtgacatgaggagccacgtaga

SEQ ID NO: 62055 - DNA, 25 bp, Mus musculus
tgagtgaccacgaaatgctagtggc

SEQ ID NO: 62056 - DNA, 25 bp, Mus musculus
tgagtgacccacagggagaccatga

SEQ ID NO: 62057 - DNA, 25 bp, Mus musculus
tgagtgactacatcctcacgggaac

SEQ ID NO: 62058 - DNA, 25 bp, Mus musculus
tgagtgagcatgttaccaagtgctg

SEQ ID NO: 62059 - DNA, 25 bp, Mus musculus
tgagtgatgacaaaccctttctatg

SEQ ID NO: 62060 - DNA, 25 bp, Mus musculus
tgagtgccacttctcgtaaacggaa

SEQ ID NO: 62061 - DNA, 25 bp, Mus musculus
tgagtgccaggatccggctgcttgc

SEQ ID NO: 62062 - DNA, 25 bp, Mus musculus
tgagtgccgactcagcctcctacaa

SEQ ID NO: 62063 - DNA, 25 bp, Mus musculus
tgagtgccgataaaccagtgtgaag

SEQ ID NO: 62064 - DNA, 25 bp, Mus musculus
tgagtgctacaaacaaggagcattt

SEQ ID NO: 62065 - DNA, 25 bp, Mus musculus
tgagtgctccaaataccatggccag

SEQ ID NO: 62066 - DNA, 25 bp, Mus musculus
tgagtggacagccaatgtcacggcc

SEQ ID NO: 62067 - DNA, 25 bp, Mus musculus
tgagtggacagcgaatgtcacggcc

SEQ ID NO: 62068 - DNA, 25 bp, Mus musculus
tgagtggacatgataaaacagagac

SEQ ID NO: 62069 - DNA, 25 bp, Mus musculus
tgagtggcatatcaccaactttggg

SEQ ID NO: 62070 - DNA, 25 bp, Mus musculus
tgagtggcctaagttggttccagag

SEQ ID NO: 62071 - DNA, 25 bp, Mus musculus
tgagtggctttctgctcttaccaat

SEQ ID NO: 62072 - DNA, 25 bp, Mus musculus
tgagtggtattgttaagcccctttt

SEQ ID NO: 62073 - DNA, 25 bp, Mus musculus
tgagtggtctcgttagcagccagtg

SEQ ID NO: 62074 - DNA, 25 bp, Mus musculus
tgagtggtgattttatgcaatggct

SEQ ID NO: 62075 - DNA, 25 bp, Mus musculus
tgagtgtaaagggaccttcggcttg

SEQ ID NO: 62076 - DNA, 25 bp, Mus musculus
tgagtgtaggtgacaaacaagatgc

SEQ ID NO: 62077 - DNA, 25 bp, Mus musculus
tgagtgtcccagacgtcatcaactg

SEQ ID NO: 62078 - DNA, 25 bp, Mus musculus
tgagtgtgcaaacatgctctgcgac

SEQ ID NO: 62079 - DNA, 25 bp, Mus musculus
tgagtgtgcaaagatgctctgcgac

SEQ ID NO: 62080 - DNA, 25 bp, Mus musculus
tgagtgtgctgaagaactcgctccc

SEQ ID NO: 62081 - DNA, 25 bp, Mus musculus
tgagtgtgtgaacacagaaggctcc

SEQ ID NO: 62082 - DNA, 25 bp, Mus musculus
tgagtgtgtgaagacagaaggctcc

SEQ ID NO: 62083 - DNA, 25 bp, Mus musculus
tgagtgttcgagagaagaacaggaa

SEQ ID NO: 62084 - DNA, 25 bp, Mus musculus
tgagtgttgcagacggaagaggttc

SEQ ID NO: 62085 - DNA, 25 bp, Mus musculus
tgagttaatcgtccagaaaacctcc

SEQ ID NO: 62086 - DNA, 25 bp, Mus musculus
tgagttaatggacccagctacccat

SEQ ID NO: 62087 - DNA, 25 bp, Mus musculus
tgagttaatggagccagctacccat

SEQ ID NO: 62088 - DNA, 25 bp, Mus musculus
tgagttagtggtcgcttttagacat

SEQ ID NO: 62089 - DNA, 25 bp, Mus musculus
tgagttagtggtggcttttagacat

SEQ ID NO: 62090 - DNA, 25 bp, Mus musculus
tgagttatgctcttcaacaatgaca

SEQ ID NO: 62091 - DNA, 25 bp, Mus musculus
tgagttcaagaagatagtggaacgc

SEQ ID NO: 62092 - DNA, 25 bp, Mus musculus
tgagttcaaggagacccaagcacta

SEQ ID NO: 62093 - DNA, 25 bp, Mus musculus
tgagttcaccacacatgtcaccaac

SEQ ID NO: 62094 - DNA, 25 bp, Mus musculus
tgagttcatagccagagaaaccaaa

SEQ ID NO: 62095 - DNA, 25 bp, Mus musculus
tgagttcccagaagagctccttcat

SEQ ID NO: 62096 - DNA, 25 bp, Mus musculus
tgagttcccagatgagctccttcat

SEQ ID NO: 62097 - DNA, 25 bp, Mus musculus
tgagttccggcgagagcgcttcact

SEQ ID NO: 62098 - DNA, 25 bp, Mus musculus
tgagttccggcgtgagcgcttcact

SEQ ID NO: 62099 - DNA, 25 bp, Mus musculus
tgagttcctagaacatgcatgggca

SEQ ID NO: 62100 - DNA, 25 bp, Mus musculus
tgagttcctgaactttaagaggcta

SEQ ID NO: 62101 - DNA, 25 bp, Mus musculus
tgagttctacatggcctatgcagac

SEQ ID NO: 62102 - DNA, 25 bp, Mus musculus
tgagttctaggaatcgaacccgggt

SEQ ID NO: 62103 - DNA, 25 bp, Mus musculus
tgagttctcagcatcttgcttcacc

SEQ ID NO: 62104 - DNA, 25 bp, Mus musculus
tgagttctcagcttcttgcttcacc

SEQ ID NO: 62105 - DNA, 25 bp, Mus musculus
tgagttctgacttcgggaatcaccc

SEQ ID NO: 62106 - DNA, 25 bp, Mus musculus
tgagttcttccatgcagagctgaga

SEQ ID NO: 62107 - DNA, 25 bp, Mus musculus
tgagttcttcttcggcagcagcggt

SEQ ID NO: 62108 - DNA, 25 bp, Mus musculus
tgagttgaatactgctgaggactgg

SEQ ID NO: 62109 - DNA, 25 bp, Mus musculus
tgagttgacaaccttaaccaccaca

SEQ ID NO: 62110 - DNA, 25 bp, Mus musculus
tgagttgcagacattatgttacatc

SEQ ID NO: 62111 - DNA, 25 bp, Mus musculus
tgagttgcagccagtcttagtcact

SEQ ID NO: 62112 - DNA, 25 bp, Mus musculus
tgagttgccagaggatccaaagtgg

SEQ ID NO: 62113 - DNA, 25 bp, Mus musculus
tgagttgctaaaagtgagcctgact

SEQ ID NO: 62114 - DNA, 25 bp, Mus musculus
tgagttgggagatcaacctgtcttc

SEQ ID NO: 62115 - DNA, 25 bp, Mus musculus
tgagttgtgacaagtcaacacaaac

SEQ ID NO: 62116 - DNA, 25 bp, Mus musculus
tgagttgttctaccctgttaacagc

SEQ ID NO: 62117 - DNA, 25 bp, Mus musculus
tgagtttaaaaagaagctatgaggc

SEQ ID NO: 62118 - DNA, 25 bp, Mus musculus
tgagtttacttctccgccatcattg

SEQ ID NO: 62119 - DNA, 25 bp, Mus musculus
tgagtttcagcgtgacatcatgctg

SEQ ID NO: 62120 - DNA, 25 bp, Mus musculus
tgagtttcatcctgtccagtgcagc

SEQ ID NO: 62121 - DNA, 25 bp, Mus musculus
tgagtttctgattcctgtcactggg

SEQ ID NO: 62122 - DNA, 25 bp, Mus musculus
tgagtttggacatcaacacagtgca

SEQ ID NO: 62123 - DNA, 25 bp, Mus musculus
tgagtttgtaaggacagtggctgcc

SEQ ID NO: 62124 - DNA, 25 bp, Mus musculus
tgataaacatctaccctaagtgcct

SEQ ID NO: 62125 - DNA, 25 bp, Mus musculus
tgataaacctgggacacaccaggcc

SEQ ID NO: 62126 - DNA, 25 bp, Mus musculus
tgataaacttggtgaccaaatggcc

SEQ ID NO: 62127 - DNA, 25 bp, Mus musculus
tgataaagaagagcctgccaaccac

SEQ ID NO: 62128 - DNA, 25 bp, Mus musculus
tgataaatcatcattacagtctcca

SEQ ID NO: 62129 - DNA, 25 bp, Mus musculus
tgataacaaccggaagtgagagctg

SEQ ID NO: 62130 - DNA, 25 bp, Mus musculus
tgataacaccgcacctgttgggaac

SEQ ID NO: 62131 - DNA, 25 bp, Mus musculus
tgataacggaaggacgcatgaatgg

SEQ ID NO: 62132 - DNA, 25 bp, Mus musculus
tgataactatgacttggccagcgaa

SEQ ID NO: 62133 - DNA, 25 bp, Mus musculus
tgataactccctagtagagcaggtg

SEQ ID NO: 62134 - DNA, 25 bp, Mus musculus
tgataagaggacaagcaaaccagac

SEQ ID NO: 62135 - DNA, 25 bp, Mus musculus
tgataagctctctgagtcttgggca

SEQ ID NO: 62136 - DNA, 25 bp, Mus musculus
tgataagcttcatggtcactctggc

SEQ ID NO: 62137 - DNA, 25 bp, Mus musculus
tgataagtgaccaaacatctgaaac

SEQ ID NO: 62138 - DNA, 25 bp, Mus musculus
tgataataccagcaaagccgcctgt

SEQ ID NO: 62139 - DNA, 25 bp, Mus musculus
tgataatcaatgactctctaggagt

SEQ ID NO: 62140 - DNA, 25 bp, Mus musculus
tgataatcagccttaagctgtgtgt

SEQ ID NO: 62141 - DNA, 25 bp, Mus musculus
tgataatcatagtcaagtgctggga

SEQ ID NO: 62142 - DNA, 25 bp, Mus musculus
tgataatgcagataggatgtttaac

SEQ ID NO: 62143 - DNA, 25 bp, Mus musculus
tgataatgctgtgaacaagaaacag

SEQ ID NO: 62144 - DNA, 25 bp, Mus musculus
tgatacaaccattttagaagccagt

SEQ ID NO: 62145 - DNA, 25 bp, Mus musculus
tgatacaacttccaccggccttgct

SEQ ID NO: 62146 - DNA, 25 bp, Mus musculus
tgatacagaactgaactcaaggttt

SEQ ID NO: 62147 - DNA, 25 bp, Mus musculus
tgatacagccttccaacagacgggc

SEQ ID NO: 62148 - DNA, 25 bp, Mus musculus
tgatacagggtaccccgaatccatt

SEQ ID NO: 62149 - DNA, 25 bp, Mus musculus
tgataccatctccccaagtccagag

SEQ ID NO: 62150 - DNA, 25 bp, Mus musculus
tgatacccctggagatccgcttcct

SEQ ID NO: 62151 - DNA, 25 bp, Mus musculus
tgataccctggaacatgaactgaga

SEQ ID NO: 62152 - DNA, 25 bp, Mus musculus
tgataccgtcctctgctcgggcagc

SEQ ID NO: 62153 - DNA, 25 bp, Mus musculus
tgatacggccaaaaggaaatctggg

SEQ ID NO: 62154 - DNA, 25 bp, Mus musculus
tgatacggctcacccaaaggttgcg

SEQ ID NO: 62155 - DNA, 25 bp, Mus musculus
tgatactaactcacccatcgtggcc

SEQ ID NO: 62156 - DNA, 25 bp, Mus musculus
tgatactgatgcttcgcccacaacg

SEQ ID NO: 62157 - DNA, 25 bp, Mus musculus
tgatagaaagtcttggagccactaa

SEQ ID NO: 62158 - DNA, 25 bp, Mus musculus
tgatagaaggaagtcaaggcaccat

SEQ ID NO: 62159 - DNA, 25 bp, Mus musculus
tgatagaataaaagtgtccctctcc

SEQ ID NO: 62160 - DNA, 25 bp, Mus musculus
tgatagacaaggtcatggacgggaa

SEQ ID NO: 62161 - DNA, 25 bp, Mus musculus
tgatagacatctctgctcactggat

SEQ ID NO: 62162 - DNA, 25 bp, Mus musculus
tgatagaccctgtgtacgggcatgg

SEQ ID NO: 62163 - DNA, 25 bp, Mus musculus
tgatagatgctgcagatcgagaaaa

SEQ ID NO: 62164 - DNA, 25 bp, Mus musculus
tgatagcacaactacaaaactaagc

SEQ ID NO: 62165 - DNA, 25 bp, Mus musculus
tgatagcagtttgcccaagtgcagc

SEQ ID NO: 62166 - DNA, 25 bp, Mus musculus
tgatagccagctccaatctactgga

SEQ ID NO: 62167 - DNA, 25 bp, Mus musculus
tgatagcggcaagttccacagagcg

SEQ ID NO: 62168 - DNA, 25 bp, Mus musculus
tgatagctccgtgcagcgcccaggg

SEQ ID NO: 62169 - DNA, 25 bp, Mus musculus
tgatagctgagaggaaaagtggctt

SEQ ID NO: 62170 - DNA, 25 bp, Mus musculus
tgatagctgggtcaaaaaacatacc

SEQ ID NO: 62171 - DNA, 25 bp, Mus musculus
tgatagggttcaagaagcagttgaa

SEQ ID NO: 62172 - DNA, 25 bp, Mus musculus
tgataggtatacagctggttgttac

SEQ ID NO: 62173 - DNA, 25 bp, Mus musculus
tgatagtcagcttcgaatcaagcca

SEQ ID NO: 62174 - DNA, 25 bp, Mus musculus
tgatagtgccgttgatgaccgagac

SEQ ID NO: 62175 - DNA, 25 bp, Mus musculus
tgatagtgtgatcccttcccagaga

SEQ ID NO: 62176 - DNA, 25 bp, Mus musculus
tgatagttctcacggagtctggcag

SEQ ID NO: 62177 - DNA, 25 bp, Mus musculus
tgatatagaaacagatacagagctt

SEQ ID NO: 62178 - DNA, 25 bp, Mus musculus
tgatatagctcagttccgacagctc

SEQ ID NO: 62179 - DNA, 25 bp, Mus musculus
tgatatatgcccaagacaaagaaac

SEQ ID NO: 62180 - DNA, 25 bp, Mus musculus
tgatatatgccctagacaaagaaac

SEQ ID NO: 62181 - DNA, 25 bp, Mus musculus
tgatatccccgctaagggtcccaac

SEQ ID NO: 62182 - DNA, 25 bp, Mus musculus
tgatatctgtcatgaactcttggga

SEQ ID NO: 62183 - DNA, 25 bp, Mus musculus
tgatatgaagtcaattcctcttgct

SEQ ID NO: 62184 - DNA, 25 bp, Mus musculus
tgatatgaatcaacaaagtcgccca

SEQ ID NO: 62185 - DNA, 25 bp, Mus musculus
tgatatgactaaaaacttccaacag

SEQ ID NO: 62186 - DNA, 25 bp, Mus musculus
tgatatgtcctttgtgcccacctgg

SEQ ID NO: 62187 - DNA, 25 bp, Mus musculus
tgatattccagaaggaagaagtgga

SEQ ID NO: 62188 - DNA, 25 bp, Mus musculus
tgatattccagatggaagaagtgga

SEQ ID NO: 62189 - DNA, 25 bp, Mus musculus
tgatattgtctctggaactcgatac

SEQ ID NO: 62190 - DNA, 25 bp, Mus musculus
tgatattgttattctggcgagtgac

SEQ ID NO: 62191 - DNA, 25 bp, Mus musculus
tgatcaaaatcaatcaggacccctt

SEQ ID NO: 62192 - DNA, 25 bp, Mus musculus
tgatcaaagcaaagaggtactacgc

SEQ ID NO: 62193 - DNA, 25 bp, Mus musculus
tgatcaaaggtggtgttttgttccc

SEQ ID NO: 62194 - DNA, 25 bp, Mus musculus
tgatcaacgaggagtacaaaatatg

SEQ ID NO: 62195 - DNA, 25 bp, Mus musculus
tgatcaagaggaggatacaaagcga

SEQ ID NO: 62196 - DNA, 25 bp, Mus musculus
tgatcaagctgacttcaatgccgtt

SEQ ID NO: 62197 - DNA, 25 bp, Mus musculus
tgatcaaggacagcgaggccctcca

SEQ ID NO: 62198 - DNA, 25 bp, Mus musculus
tgatcaatcagacctagcagtaggc

SEQ ID NO: 62199 - DNA, 25 bp, Mus musculus
tgatcaatgtcactcacaggaactt

SEQ ID NO: 62200 - DNA, 25 bp, Mus musculus
tgatcacaatgcctcagtacctccg

SEQ ID NO: 62201 - DNA, 25 bp, Mus musculus
tgatcacaccagcagtagcctcatt

SEQ ID NO: 62202 - DNA, 25 bp, Mus musculus
tgatcacagaaggagtagatacgct

SEQ ID NO: 62203 - DNA, 25 bp, Mus musculus
tgatcacagcagaggttgaagctct

SEQ ID NO: 62204 - DNA, 25 bp, Mus musculus
tgatcacagctctctaagtatgcaa

SEQ ID NO: 62205 - DNA, 25 bp, Mus musculus
tgatcacagggaaatgggagaaacc

SEQ ID NO: 62206 - DNA, 25 bp, Mus musculus
tgatcacaggtggaagtctccaaga

SEQ ID NO: 62207 - DNA, 25 bp, Mus musculus
tgatcaccgcttttggtccaggagc

SEQ ID NO: 62208 - DNA, 25 bp, Mus musculus
tgatcaccttcacctttgctaatgg

SEQ ID NO: 62209 - DNA, 25 bp, Mus musculus
tgatcagaagaaagggaagtttgct

SEQ ID NO: 62210 - DNA, 25 bp, Mus musculus
tgatcagaccaagcccgggagtttg

SEQ ID NO: 62211 - DNA, 25 bp, Mus musculus
tgatcagagaaagcaagcgaatgcc

SEQ ID NO: 62212 - DNA, 25 bp, Mus musculus
tgatcagcaggtcccaagataaact

SEQ ID NO: 62213 - DNA, 25 bp, Mus musculus
tgatcagcattattcacagctgccg

SEQ ID NO: 62214 - DNA, 25 bp, Mus musculus
tgatcagctttctgcttcttccagc

SEQ ID NO: 62215 - DNA, 25 bp, Mus musculus
tgatcaggcatggaaaattctaggg

SEQ ID NO: 62216 - DNA, 25 bp, Mus musculus
tgatcatcaacacccaggaacaggg

SEQ ID NO: 62217 - DNA, 25 bp, Mus musculus
tgatcatgaagctgacagagcctca

SEQ ID NO: 62218 - DNA, 25 bp, Mus musculus
tgatcatgaaggacactgtgccccg

SEQ ID NO: 62219 - DNA, 25 bp, Mus musculus
tgatcatgacgttgacctagagaag

SEQ ID NO: 62220 - DNA, 25 bp, Mus musculus
tgatcatgagtttcctccctccaag

SEQ ID NO: 62221 - DNA, 25 bp, Mus musculus
tgatcatgggcagggacacactccg

SEQ ID NO: 62222 - DNA, 25 bp, Mus musculus
tgatcattaccattgggcaagccat

SEQ ID NO: 62223 - DNA, 25 bp, Mus musculus
tgatcattctaacctgcaagagaga

SEQ ID NO: 62224 - DNA, 25 bp, Mus musculus
tgatcatttcaaacctttgtgggcc

SEQ ID NO: 62225 - DNA, 25 bp, Mus musculus
tgatccaccttgaggcaaaggtccg

SEQ ID NO: 62226 - DNA, 25 bp, Mus musculus
tgatccacgcggacaagttaggtga

SEQ ID NO: 62227 - DNA, 25 bp, Mus musculus
tgatccacttgctgataaagttctt

SEQ ID NO: 62228 - DNA, 25 bp, Mus musculus
tgatccacttgtgccgactgccgtg

SEQ ID NO: 62229 - DNA, 25 bp, Mus musculus
tgatccagaaaaaccgccgggtagt

SEQ ID NO: 62230 - DNA, 25 bp, Mus musculus
tgatccagaactggagacggaaaag

SEQ ID NO: 62231 - DNA, 25 bp, Mus musculus
tgatccagaggctgactgctgagat

SEQ ID NO: 62232 - DNA, 25 bp, Mus musculus
tgatccagatttcatgtatgagctg

SEQ ID NO: 62233 - DNA, 25 bp, Mus musculus
tgatccagtccctgtcaagcaggag

SEQ ID NO: 62234 - DNA, 25 bp, Mus musculus
tgatccagtgccagggcctggccgc

SEQ ID NO: 62235 - DNA, 25 bp, Mus musculus
tgatccatctctgtgagaagacttt

SEQ ID NO: 62236 - DNA, 25 bp, Mus musculus
tgatcccaaccactatggcagctgc

SEQ ID NO: 62237 - DNA, 25 bp, Mus musculus
tgatcccaaccatagtggcctcgtg

SEQ ID NO: 62238 - DNA, 25 bp, Mus musculus
tgatcccagggaactaaaagaggtg

SEQ ID NO: 62239 - DNA, 25 bp, Mus musculus
tgatcccattcctcatccttctggt

SEQ ID NO: 62240 - DNA, 25 bp, Mus musculus
tgatccccaaaacggtatccactgt

SEQ ID NO: 62241 - DNA, 25 bp, Mus musculus
tgatccccaaagatcagtactactg

SEQ ID NO: 62242 - DNA, 25 bp, Mus musculus
tgatccccacgtaccaaatgaaatg

SEQ ID NO: 62243 - DNA, 25 bp, Mus musculus
tgatccccttcctcatcatagtggg

SEQ ID NO: 62244 - DNA, 25 bp, Mus musculus
tgatccctcctaaaatcgctgcatg

SEQ ID NO: 62245 - DNA, 25 bp, Mus musculus
tgatccctgccccaaagagggtgtg

SEQ ID NO: 62246 - DNA, 25 bp, Mus musculus
tgatccggcacaacaaagcctttgg

SEQ ID NO: 62247 - DNA, 25 bp, Mus musculus
tgatccgggacagcccagatgccgt

SEQ ID NO: 62248 - DNA, 25 bp, Mus musculus
tgatcctccaacagttaaaaaagaa

SEQ ID NO: 62249 - DNA, 25 bp, Mus musculus
tgatcctcttgccttcgttccaaat

SEQ ID NO: 62250 - DNA, 25 bp, Mus musculus
tgatcctgtcattagcaagcggctc

SEQ ID NO: 62251 - DNA, 25 bp, Mus musculus
tgatccttcttcgaaaatctatgaa

SEQ ID NO: 62252 - DNA, 25 bp, Mus musculus
tgatcgaaagaacctgaagaagacc

SEQ ID NO: 62253 - DNA, 25 bp, Mus musculus
tgatcgagaagctgctgacaagaac

SEQ ID NO: 62254 - DNA, 25 bp, Mus musculus
tgatcgagaagctggacatcaagct

SEQ ID NO: 62255 - DNA, 25 bp, Mus musculus
tgatcgataatactttgaatcctga

SEQ ID NO: 62256 - DNA, 25 bp, Mus musculus
tgatcgatgattactctggaagtgg

SEQ ID NO: 62257 - DNA, 25 bp, Mus musculus
tgatcgcagggatggaccaagctct

SEQ ID NO: 62258 - DNA, 25 bp, Mus musculus
tgatcgctctcgtgaacgcaaggtg

SEQ ID NO: 62259 - DNA, 25 bp, Mus musculus
tgatcggcagaacgccattgtagcc

SEQ ID NO: 62260 - DNA, 25 bp, Mus musculus
tgatcgtgtcctgagctgaagatgt

SEQ ID NO: 62261 - DNA, 25 bp, Mus musculus
tgatctaacaggacaaacccgacga

SEQ ID NO: 62262 - DNA, 25 bp, Mus musculus
tgatctaacagttcaccgggcaact

SEQ ID NO: 62263 - DNA, 25 bp, Mus musculus
tgatctacctagcagacggctctgg

SEQ ID NO: 62264 - DNA, 25 bp, Mus musculus
tgatctcacggcaactgctaacaga

SEQ ID NO: 62265 - DNA, 25 bp, Mus musculus
tgatctcattttcctcatgctagac

SEQ ID NO: 62266 - DNA, 25 bp, Mus musculus
tgatctccctgtggaaaaccaacag

SEQ ID NO: 62267 - DNA, 25 bp, Mus musculus
tgatctctataagcagctaaagcac

SEQ ID NO: 62268 - DNA, 25 bp, Mus musculus
tgatctctctgcacatctatgccct

SEQ ID NO: 62269 - DNA, 25 bp, Mus musculus
tgatctcttcattaacctctccagg

SEQ ID NO: 62270 - DNA, 25 bp, Mus musculus
tgatctctttggaccccatgactgt

SEQ ID NO: 62271 - DNA, 25 bp, Mus musculus
tgatctgaaatgtcccaggtgatgt

SEQ ID NO: 62272 - DNA, 25 bp, Mus musculus
tgatctgcgctctgctgcttctcgt

SEQ ID NO: 62273 - DNA, 25 bp, Mus musculus
tgatctggagacaagtgcggttcaa

SEQ ID NO: 62274 - DNA, 25 bp, Mus musculus
tgatctgggagatgatgagctgccc

SEQ ID NO: 62275 - DNA, 25 bp, Mus musculus
tgatctgtccccttgggcagtgagc

SEQ ID NO: 62276 - DNA, 25 bp, Mus musculus
tgatctgttcattaggccggacacc

SEQ ID NO: 62277 - DNA, 25 bp, Mus musculus
tgatcttgaacctcgatactgcaga

SEQ ID NO: 62278 - DNA, 25 bp, Mus musculus
tgatctttacgagaagcttggagaa

SEQ ID NO: 62279 - DNA, 25 bp, Mus musculus
tgatctttccctcttgtgtcctctg

SEQ ID NO: 62280 - DNA, 25 bp, Mus musculus
tgatctttccctgttgtgtcctctg

SEQ ID NO: 62281 - DNA, 25 bp, Mus musculus
tgatgaaaaaatacggcaagtcctt

SEQ ID NO: 62282 - DNA, 25 bp, Mus musculus
tgatgaaacatatgtccccaaagag

SEQ ID NO: 62283 - DNA, 25 bp, Mus musculus
tgatgaaaggaacctcagaggttgc

SEQ ID NO: 62284 - DNA, 25 bp, Mus musculus
tgatgaacaagtagctgctgtccgg

SEQ ID NO: 62285 - DNA, 25 bp, Mus musculus
tgatgaacagacctaatgcccgcaa

SEQ ID NO: 62286 - DNA, 25 bp, Mus musculus
tgatgaaccagctgtaaagttacat

SEQ ID NO: 62287 - DNA, 25 bp, Mus musculus
tgatgaacccacttggctacaggca

SEQ ID NO: 62288 - DNA, 25 bp, Mus musculus
tgatgaaccgcgttctcaccagccg

SEQ ID NO: 62289 - DNA, 25 bp, Mus musculus
tgatgaacgacatgatcgggaacat

SEQ ID NO: 62290 - DNA, 25 bp, Mus musculus
tgatgaactttacaggcagtgccct

SEQ ID NO: 62291 - DNA, 25 bp, Mus musculus
tgatgaagaacttccgccaggagct

SEQ ID NO: 62292 - DNA, 25 bp, Mus musculus
tgatgaagagtttgacgaactgtgt

SEQ ID NO: 62293 - DNA, 25 bp, Mus musculus
tgatgaagataagctatgatgtggt

SEQ ID NO: 62294 - DNA, 25 bp, Mus musculus
tgatgaagatcatagcagccctgct

SEQ ID NO: 62295 - DNA, 25 bp, Mus musculus
tgatgaataacagaacttgcagagt

SEQ ID NO: 62296 - DNA, 25 bp, Mus musculus
tgatgaatgataagaactggaaccc

SEQ ID NO: 62297 - DNA, 25 bp, Mus musculus
tgatgaatggactcagctggatatg

SEQ ID NO: 62298 - DNA, 25 bp, Mus musculus
tgatgacaaacctgaagaccaccca

SEQ ID NO: 62299 - DNA, 25 bp, Mus musculus
tgatgacaacaaacgtgtggctgaa

SEQ ID NO: 62300 - DNA, 25 bp, Mus musculus
tgatgacaagaagccaacgactaag

SEQ ID NO: 62301 - DNA, 25 bp, Mus musculus
tgatgacaatttcatcgaggaaagg

SEQ ID NO: 62302 - DNA, 25 bp, Mus musculus
tgatgacacagtacatccgcctcac

SEQ ID NO: 62303 - DNA, 25 bp, Mus musculus
tgatgacaccaatctcaagaagctg

SEQ ID NO: 62304 - DNA, 25 bp, Mus musculus
tgatgacacccactcaagaatagag

SEQ ID NO: 62305 - DNA, 25 bp, Mus musculus
tgatgacactcacacactcttactt

SEQ ID NO: 62306 - DNA, 25 bp, Mus musculus
tgatgacatctgtgctggtctgccc

SEQ ID NO: 62307 - DNA, 25 bp, Mus musculus
tgatgacatgaaggctttgaaaccc

SEQ ID NO: 62308 - DNA, 25 bp, Mus musculus
tgatgaccacggctctgagcacacc

SEQ ID NO: 62309 - DNA, 25 bp, Mus musculus
tgatgaccgagacagtgactaccgc

SEQ ID NO: 62310 - DNA, 25 bp, Mus musculus
tgatgacctacccaatggccatgtg

SEQ ID NO: 62311 - DNA, 25 bp, Mus musculus
tgatgacctgccttctcgactggag

SEQ ID NO: 62312 - DNA, 25 bp, Mus musculus
tgatgacgcaatatgccttgcagag

SEQ ID NO: 62313 - DNA, 25 bp, Mus musculus
tgatgacgtggaccttccagcctgg

SEQ ID NO: 62314 - DNA, 25 bp, Mus musculus
tgatgactacaaaagccatgtgaag

SEQ ID NO: 62315 - DNA, 25 bp, Mus musculus
tgatgactacgatgacacagatgac

SEQ ID NO: 62316 - DNA, 25 bp, Mus musculus
tgatgactaggctgcattcctctct

SEQ ID NO: 62317 - DNA, 25 bp, Mus musculus
tgatgactcggccttggcacgaagc

SEQ ID NO: 62318 - DNA, 25 bp, Mus musculus
tgatgactggctttgctccagacac

SEQ ID NO: 62319 - DNA, 25 bp, Mus musculus
tgatgactggtgaatcccaagcagg

SEQ ID NO: 62320 - DNA, 25 bp, Mus musculus
tgatgactggtgtatcccaagcagg

SEQ ID NO: 62321 - DNA, 25 bp, Mus musculus
tgatgagaaacctgcgcacggtagt

SEQ ID NO: 62322 - DNA, 25 bp, Mus musculus
tgatgagaagagagtgactaacaca

SEQ ID NO: 62323 - DNA, 25 bp, Mus musculus
tgatgagaagagtccggcgcttcca

SEQ ID NO: 62324 - DNA, 25 bp, Mus musculus
tgatgagaagcgtcatgactacctt

SEQ ID NO: 62325 - DNA, 25 bp, Mus musculus
tgatgagaagtgaccaggaaattcc

SEQ ID NO: 62326 - DNA, 25 bp, Mus musculus
tgatgagacgacagttcctacccag

SEQ ID NO: 62327 - DNA, 25 bp, Mus musculus
tgatgagacgactgttcctacccag

SEQ ID NO: 62328 - DNA, 25 bp, Mus musculus
tgatgagacttattctgaaatccgg

SEQ ID NO: 62329 - DNA, 25 bp, Mus musculus
tgatgagagaaaccatcaggaacct

SEQ ID NO: 62330 - DNA, 25 bp, Mus musculus
tgatgagatagtagaagttcttctg

SEQ ID NO: 62331 - DNA, 25 bp, Mus musculus
tgatgagatgttccagcaccgagag

SEQ ID NO: 62332 - DNA, 25 bp, Mus musculus
tgatgagccaccacgagatgaatgg

SEQ ID NO: 62333 - DNA, 25 bp, Mus musculus
tgatgagccctcagacggcaggatg

SEQ ID NO: 62334 - DNA, 25 bp, Mus musculus
tgatgagccctgaaactacactcct

SEQ ID NO: 62335 - DNA, 25 bp, Mus musculus
tgatgagcctgtgcacatccaggtc

SEQ ID NO: 62336 - DNA, 25 bp, Mus musculus
tgatgaggaataaggaagtattctc

SEQ ID NO: 62337 - DNA, 25 bp, Mus musculus
tgatgaggaatatgaagatgtgtcc

SEQ ID NO: 62338 - DNA, 25 bp, Mus musculus
tgatgaggaatatggaagtattctc

SEQ ID NO: 62339 - DNA, 25 bp, Mus musculus
tgatgaggaggacacaaaaggaatc

SEQ ID NO: 62340 - DNA, 25 bp, Mus musculus
tgatgaggatctgccctccggccag

SEQ ID NO: 62341 - DNA, 25 bp, Mus musculus
tgatgaggatgaaggacctcagaag

SEQ ID NO: 62342 - DNA, 25 bp, Mus musculus
tgatgaggatgatggacctcagaag

SEQ ID NO: 62343 - DNA, 25 bp, Mus musculus
tgatgaggcattcgtggatgacacc

SEQ ID NO: 62344 - DNA, 25 bp, Mus musculus
tgatgaggcgctaggaagttcaaac

SEQ ID NO: 62345 - DNA, 25 bp, Mus musculus
tgatgaggtccccttggctgtccag

SEQ ID NO: 62346 - DNA, 25 bp, Mus musculus
tgatgagtacatggcctacctccag

SEQ ID NO: 62347 - DNA, 25 bp, Mus musculus
tgatgagtacattgagaaactggcc

SEQ ID NO: 62348 - DNA, 25 bp, Mus musculus
tgatgagtgtctgccaggaaattcc

SEQ ID NO: 62349 - DNA, 25 bp, Mus musculus
tgatgagtttggtttccgtgtggac

SEQ ID NO: 62350 - DNA, 25 bp, Mus musculus
tgatgataaggcgtatgagaaaaac

SEQ ID NO: 62351 - DNA, 25 bp, Mus musculus
tgatgataagtgaccaaacatctga

SEQ ID NO: 62352 - DNA, 25 bp, Mus musculus
tgatgataatgaagtcatctcctga

SEQ ID NO: 62353 - DNA, 25 bp, Mus musculus
tgatgataatgatgtcatctcctga

SEQ ID NO: 62354 - DNA, 25 bp, Mus musculus
tgatgatagagaattgaccaagaaa

SEQ ID NO: 62355 - DNA, 25 bp, Mus musculus
tgatgatccctttgcacagccagac

SEQ ID NO: 62356 - DNA, 25 bp, Mus musculus
tgatgatcgatgcataaatatcacc

SEQ ID NO: 62357 - DNA, 25 bp, Mus musculus
tgatgatcgggcgatgcaaccgagc

SEQ ID NO: 62358 - DNA, 25 bp, Mus musculus
tgatgatgaccttgcctggaacatt

SEQ ID NO: 62359 - DNA, 25 bp, Mus musculus
tgatgatgagacatgccaggagcaa

SEQ ID NO: 62360 - DNA, 25 bp, Mus musculus
tgatgatgagacttgccaggagcaa

SEQ ID NO: 62361 - DNA, 25 bp, Mus musculus
tgatgatgcagctggcccgagagct

SEQ ID NO: 62362 - DNA, 25 bp, Mus musculus
tgatgatggcctgagccaagtacct

SEQ ID NO: 62363 - DNA, 25 bp, Mus musculus
tgatgcaaaacagcaggcatggatt

SEQ ID NO: 62364 - DNA, 25 bp, Mus musculus
tgatgcaactatcagccaggctgag

SEQ ID NO: 62365 - DNA, 25 bp, Mus musculus
tgatgcacacccagtgtcattccac

SEQ ID NO: 62366 - DNA, 25 bp, Mus musculus
tgatgcactataaagaagccatacg

SEQ ID NO: 62367 - DNA, 25 bp, Mus musculus
tgatgcagacaaggcgcctatgcac

SEQ ID NO: 62368 - DNA, 25 bp, Mus musculus
tgatgcagaccctcatggaagacta

SEQ ID NO: 62369 - DNA, 25 bp, Mus musculus
tgatgcagactacatgtgggactcc

SEQ ID NO: 62370 - DNA, 25 bp, Mus musculus
tgatgcagctagtgactgtctcttt

SEQ ID NO: 62371 - DNA, 25 bp, Mus musculus
tgatgcatgggctcccgtgatcctt

SEQ ID NO: 62372 - DNA, 25 bp, Mus musculus
tgatgccaaagtgagatacaagcgg

SEQ ID NO: 62373 - DNA, 25 bp, Mus musculus
tgatgccaacgataacgctccggag

SEQ ID NO: 62374 - DNA, 25 bp, Mus musculus
tgatgccaacgcaagttacttaaga

SEQ ID NO: 62375 - DNA, 25 bp, Mus musculus
tgatgccaccaatattcgtccccga

SEQ ID NO: 62376 - DNA, 25 bp, Mus musculus
tgatgccaccacaggcaatgtgctg

SEQ ID NO: 62377 - DNA, 25 bp, Mus musculus
tgatgccactggatgatgcaaaaaa

SEQ ID NO: 62378 - DNA, 25 bp, Mus musculus
tgatgccatttagagtggaaagcct

SEQ ID NO: 62379 - DNA, 25 bp, Mus musculus
tgatgcccaacaagggccccagtct

SEQ ID NO: 62380 - DNA, 25 bp, Mus musculus
tgatgcccacgctgtggatagtcct

SEQ ID NO: 62381 - DNA, 25 bp, Mus musculus
tgatgccctccgagtgaacaacaac

SEQ ID NO: 62382 - DNA, 25 bp, Mus musculus
tgatgccgttctccactcgtgcaca

SEQ ID NO: 62383 - DNA, 25 bp, Mus musculus
tgatgcctacggaccaagtgatgct

SEQ ID NO: 62384 - DNA, 25 bp, Mus musculus
tgatgcctatgattgctacctctgc

SEQ ID NO: 62385 - DNA, 25 bp, Mus musculus
tgatgcctatgtcttataccccaag

SEQ ID NO: 62386 - DNA, 25 bp, Mus musculus
tgatgcctggatccgtggagaacta

SEQ ID NO: 62387 - DNA, 25 bp, Mus musculus
tgatgcctggatgcgtggagaacta

SEQ ID NO: 62388 - DNA, 25 bp, Mus musculus
tgatgcgactcaccaatgtagatgg

SEQ ID NO: 62389 - DNA, 25 bp, Mus musculus
tgatgcgcagacatttgctgactgg

SEQ ID NO: 62390 - DNA, 25 bp, Mus musculus
tgatgcggcccgcatagcctggtac

SEQ ID NO: 62391 - DNA, 25 bp, Mus musculus
tgatgcgggaaaactacgagacgtt

SEQ ID NO: 62392 - DNA, 25 bp, Mus musculus
tgatgctacgtataatgaaattgtc

SEQ ID NO: 62393 - DNA, 25 bp, Mus musculus
tgatgctgaaagtggcccaccagcc

SEQ ID NO: 62394 - DNA, 25 bp, Mus musculus
tgatgctgaataatcccctatttgc

SEQ ID NO: 62395 - DNA, 25 bp, Mus musculus
tgatgctgatggctgacaaagtcct

SEQ ID NO: 62396 - DNA, 25 bp, Mus musculus
tgatgctgcgaagaacaagctccgg

SEQ ID NO: 62397 - DNA, 25 bp, Mus musculus
tgatgctgctgtcacatatgtgaac

SEQ ID NO: 62398 - DNA, 25 bp, Mus musculus
tgatgctgctttaccttgtaggagg

SEQ ID NO: 62399 - DNA, 25 bp, Mus musculus
tgatgctggctgtcgtcacacccgc

SEQ ID NO: 62400 - DNA, 25 bp, Mus musculus
tgatgctgggtatcgccacattgac

SEQ ID NO: 62401 - DNA, 25 bp, Mus musculus
tgatgctgggtatcggaagcatgct

SEQ ID NO: 62402 - DNA, 25 bp, Mus musculus
tgatgctggtctgccatgctagcct

SEQ ID NO: 62403 - DNA, 25 bp, Mus musculus
tgatgctgtctttgcatcagacagg

SEQ ID NO: 62404 - DNA, 25 bp, Mus musculus
tgatgctgttctgaattgcccagcc

SEQ ID NO: 62405 - DNA, 25 bp, Mus musculus
tgatgcttaagatccccaagtctgt

SEQ ID NO: 62406 - DNA, 25 bp, Mus musculus
tgatgcttacgctccccttacaaca

SEQ ID NO: 62407 - DNA, 25 bp, Mus musculus
tgatgcttcctggtacttgtcaaac

SEQ ID NO: 62408 - DNA, 25 bp, Mus musculus
tgatggaaactttgtggaagccact

SEQ ID NO: 62409 - DNA, 25 bp, Mus musculus
tgatggaaaggtcaatttacagcgc

SEQ ID NO: 62410 - DNA, 25 bp, Mus musculus
tgatggacacagacgatttccgcgc

SEQ ID NO: 62411 - DNA, 25 bp, Mus musculus
tgatggacatggaggaatacgagcc

SEQ ID NO: 62412 - DNA, 25 bp, Mus musculus
tgatggacgcattgagccaggagat

SEQ ID NO: 62413 - DNA, 25 bp, Mus musculus
tgatggactcttgctctcctagaac

SEQ ID NO: 62414 - DNA, 25 bp, Mus musculus
tgatggacttctcagttggcttcat

SEQ ID NO: 62415 - DNA, 25 bp, Mus musculus
tgatggagcaggagctcactgctga

SEQ ID NO: 62416 - DNA, 25 bp, Mus musculus
tgatggattctggacgagctccaaa

SEQ ID NO: 62417 - DNA, 25 bp, Mus musculus
tgatggatttggagaagcccaccca

SEQ ID NO: 62418 - DNA, 25 bp, Mus musculus
tgatggcaaaagcagagtacctctg

SEQ ID NO: 62419 - DNA, 25 bp, Mus musculus
tgatggcaagatctcttttgcagac

SEQ ID NO: 62420 - DNA, 25 bp, Mus musculus
tgatggcagcctcaccgtgctcaat

SEQ ID NO: 62421 - DNA, 25 bp, Mus musculus
tgatggcatatcgattcctgaactg

SEQ ID NO: 62422 - DNA, 25 bp, Mus musculus
tgatggcatcgctgtggttggcatt

SEQ ID NO: 62423 - DNA, 25 bp, Mus musculus
tgatggcatcttgggcatgggctac

SEQ ID NO: 62424 - DNA, 25 bp, Mus musculus
tgatggccacatcccggaaatatga

SEQ ID NO: 62425 - DNA, 25 bp, Mus musculus
tgatggccacgtgtccaactttgtg

SEQ ID NO: 62426 - DNA, 25 bp, Mus musculus
tgatggcccaatggagccagtttgc

SEQ ID NO: 62427 - DNA, 25 bp, Mus musculus
tgatggccctcagtacaattcgtct

SEQ ID NO: 62428 - DNA, 25 bp, Mus musculus
tgatggccctgaatacaattcttct

SEQ ID NO: 62429 - DNA, 25 bp, Mus musculus
tgatggccgattgcgtgtaggctat

SEQ ID NO: 62430 - DNA, 25 bp, Mus musculus
tgatggccgtgctggagtccctgac

SEQ ID NO: 62431 - DNA, 25 bp, Mus musculus
tgatggcctggcagaggacatcgat

SEQ ID NO: 62432 - DNA, 25 bp, Mus musculus
tgatggcgagtctgtctcaggaaag

SEQ ID NO: 62433 - DNA, 25 bp, Mus musculus
tgatggcgccgtcggctgcattcct

SEQ ID NO: 62434 - DNA, 25 bp, Mus musculus
tgatggcgccgtgggctgcattcct

SEQ ID NO: 62435 - DNA, 25 bp, Mus musculus
tgatggctactacgtggccctggcc

SEQ ID NO: 62436 - DNA, 25 bp, Mus musculus
tgatggctctgtacgttgctgcagc

SEQ ID NO: 62437 - DNA, 25 bp, Mus musculus
tgatggctgaccagggcaacctgac

SEQ ID NO: 62438 - DNA, 25 bp, Mus musculus
tgatggctgcctcaccaggaagcct

SEQ ID NO: 62439 - DNA, 25 bp, Mus musculus
tgatggctttaaaacagttctctgc

SEQ ID NO: 62440 - DNA, 25 bp, Mus musculus
tgatggctttggacccttcatgcca

SEQ ID NO: 62441 - DNA, 25 bp, Mus musculus
tgatgggaccacagtagagccaccg

SEQ ID NO: 62442 - DNA, 25 bp, Mus musculus
tgatgggacggaaccagactgctgt

SEQ ID NO: 62443 - DNA, 25 bp, Mus musculus
tgatgggactacacctctgcatata

SEQ ID NO: 62444 - DNA, 25 bp, Mus musculus
tgatgggcctgagcagaaagaagac

SEQ ID NO: 62445 - DNA, 25 bp, Mus musculus
tgatgggctaatacagcgctctggg

SEQ ID NO: 62446 - DNA, 25 bp, Mus musculus
tgatggtcagtttgccctctcgggc

SEQ ID NO: 62447 - DNA, 25 bp, Mus musculus
tgatggtccaagtctggtctccact

SEQ ID NO: 62448 - DNA, 25 bp, Mus musculus
tgatggtgaatgtagaggaaatctc

SEQ ID NO: 62449 - DNA, 25 bp, Mus musculus
tgatggtgccaccttagtgattcct

SEQ ID NO: 62450 - DNA, 25 bp, Mus musculus
tgatggtgccacgttagtgattcct

SEQ ID NO: 62451 - DNA, 25 bp, Mus musculus
tgatggtgctcactgcaacagaccc

SEQ ID NO: 62452 - DNA, 25 bp, Mus musculus
tgatggtgttgatgaaaagctcccc

SEQ ID NO: 62453 - DNA, 25 bp, Mus musculus
tgatgtaaaaacactgctggagaca

SEQ ID NO: 62454 - DNA, 25 bp, Mus musculus
tgatgtaccctagtccccatgcagt

SEQ ID NO: 62455 - DNA, 25 bp, Mus musculus
tgatgtactggagaagcttggagaa

SEQ ID NO: 62456 - DNA, 25 bp, Mus musculus
tgatgtaggaaacaaagaatccgca

SEQ ID NO: 62457 - DNA, 25 bp, Mus musculus
tgatgtcaatgtctctggccagaag

SEQ ID NO: 62458 - DNA, 25 bp, Mus musculus
tgatgtcactactttcttctctggg

SEQ ID NO: 62459 - DNA, 25 bp, Mus musculus
tgatgtcatcctgcgggtccaggct

SEQ ID NO: 62460 - DNA, 25 bp, Mus musculus
tgatgtccaagaagacgtacgcctt

SEQ ID NO: 62461 - DNA, 25 bp, Mus musculus
tgatgtccacccagctgaagcatga

SEQ ID NO: 62462 - DNA, 25 bp, Mus musculus
tgatgtcccctcagaagatgaggaa

SEQ ID NO: 62463 - DNA, 25 bp, Mus musculus
tgatgtcccgcacggccttcgggaa

SEQ ID NO: 62464 - DNA, 25 bp, Mus musculus
tgatgtccgagtgctaacacagttg

SEQ ID NO: 62465 - DNA, 25 bp, Mus musculus
tgatgtccgcgagacactgcacagg

SEQ ID NO: 62466 - DNA, 25 bp, Mus musculus
tgatgtcctcaagtgcaaagcttca

SEQ ID NO: 62467 - DNA, 25 bp, Mus musculus
tgatgtcctggttcggtgtcctgag

SEQ ID NO: 62468 - DNA, 25 bp, Mus musculus
tgatgtcgctgttcgttggaggcac

SEQ ID NO: 62469 - DNA, 25 bp, Mus musculus
tgatgtcgggatagattggaccaat

SEQ ID NO: 62470 - DNA, 25 bp, Mus musculus
tgatgtcgtcgtcatgatgctggat

SEQ ID NO: 62471 - DNA, 25 bp, Mus musculus
tgatgtctcagccaatgccgtgcgg

SEQ ID NO: 62472 - DNA, 25 bp, Mus musculus
tgatgtctctgaacagccagctact

SEQ ID NO: 62473 - DNA, 25 bp, Mus musculus
tgatgtgaccaagggaatgcagaca

SEQ ID NO: 62474 - DNA, 25 bp, Mus musculus
tgatgtgactgaagtgcaaatcttc

SEQ ID NO: 62475 - DNA, 25 bp, Mus musculus
tgatgtgagagatgaacagcaaatc

SEQ ID NO: 62476 - DNA, 25 bp, Mus musculus
tgatgtgatgtctcctgctggagac

SEQ ID NO: 62477 - DNA, 25 bp, Mus musculus
tgatgtgccaccgtagcctggacgg

SEQ ID NO: 62478 - DNA, 25 bp, Mus musculus
tgatgtgctgaagccctatgtggcc

SEQ ID NO: 62479 - DNA, 25 bp, Mus musculus
tgatgtgctgccagtgtccagccgg

SEQ ID NO: 62480 - DNA, 25 bp, Mus musculus
tgatgtggaagaaggagtaagctac

SEQ ID NO: 62481 - DNA, 25 bp, Mus musculus
tgatgtggacacctctggttttcag

SEQ ID NO: 62482 - DNA, 25 bp, Mus musculus
tgatgtggacacgtctggttttcag

SEQ ID NO: 62483 - DNA, 25 bp, Mus musculus
tgatgtggaccaggaaggaattgct

SEQ ID NO: 62484 - DNA, 25 bp, Mus musculus
tgatgtggacttacctgctcagcag

SEQ ID NO: 62485 - DNA, 25 bp, Mus musculus
tgatgtggagcctgcccaggtccga

SEQ ID NO: 62486 - DNA, 25 bp, Mus musculus
tgatgtggctgcagagcccacacgg

SEQ ID NO: 62487 - DNA, 25 bp, Mus musculus
tgatgtggtccatgcacgtggccaa

SEQ ID NO: 62488 - DNA, 25 bp, Mus musculus
tgatgtggtggttatcctcacctgc

SEQ ID NO: 62489 - DNA, 25 bp, Mus musculus
tgatgtgttctacctacactcccgc

SEQ ID NO: 62490 - DNA, 25 bp, Mus musculus
tgatgtgtttgacgtagatgatgca

SEQ ID NO: 62491 - DNA, 25 bp, Mus musculus
tgatgttcctatcggttctcgaggg

SEQ ID NO: 62492 - DNA, 25 bp, Mus musculus
tgatgttgattctaagagtcccaac

SEQ ID NO: 62493 - DNA, 25 bp, Mus musculus
tgatgttgcttttgacttctctaag

SEQ ID NO: 62494 - DNA, 25 bp, Mus musculus
tgatgttggaccttccatccagtgt

SEQ ID NO: 62495 - DNA, 25 bp, Mus musculus
tgatgttggttgattgcctgacaga

SEQ ID NO: 62496 - DNA, 25 bp, Mus musculus
tgatgtttataagacgagaggtggc

SEQ ID NO: 62497 - DNA, 25 bp, Mus musculus
tgattaaagtcatccacttgctggt

SEQ ID NO: 62498 - DNA, 25 bp, Mus musculus
tgattaactatcaggatgacgcgga

SEQ ID NO: 62499 - DNA, 25 bp, Mus musculus
tgattacggttatcagcaaccgtcg

SEQ ID NO: 62500 - DNA, 25 bp, Mus musculus
tgattactaccaagactacttctgt

SEQ ID NO: 62501 - DNA, 25 bp, Mus musculus
tgattactccaagcccatccaggga

SEQ ID NO: 62502 - DNA, 25 bp, Mus musculus
tgattactgacgcaaatggaagcgt

SEQ ID NO: 62503 - DNA, 25 bp, Mus musculus
tgattacttctgaaccttcgcatga

SEQ ID NO: 62504 - DNA, 25 bp, Mus musculus
tgattatactgggtataactatggg

SEQ ID NO: 62505 - DNA, 25 bp, Mus musculus
tgattatcaacctggctttcacgga

SEQ ID NO: 62506 - DNA, 25 bp, Mus musculus
tgattatgcaaacatctgagtctgg

SEQ ID NO: 62507 - DNA, 25 bp, Mus musculus
tgattatggacaatattctgctgat

SEQ ID NO: 62508 - DNA, 25 bp, Mus musculus
tgattattataccttcagccctgga

SEQ ID NO: 62509 - DNA, 25 bp, Mus musculus
tgattattggagctatgactacgtg

SEQ ID NO: 62510 - DNA, 25 bp, Mus musculus
tgattcaaatgttagtccagagagg

SEQ ID NO: 62511 - DNA, 25 bp, Mus musculus
tgattcactgagtgagcaggtgtcc

SEQ ID NO: 62512 - DNA, 25 bp, Mus musculus
tgattcacttcatgtccccaaaatg

SEQ ID NO: 62513 - DNA, 25 bp, Mus musculus
tgattcagggacaagaagttgttgc

SEQ ID NO: 62514 - DNA, 25 bp, Mus musculus
tgattcagtatagcctggaccagtc

SEQ ID NO: 62515 - DNA, 25 bp, Mus musculus
tgattcatccctggcctcggaaatg

SEQ ID NO: 62516 - DNA, 25 bp, Mus musculus
tgattccaccagtgggcagagggct

SEQ ID NO: 62517 - DNA, 25 bp, Mus musculus
tgattccagccttctcctgagttgg

SEQ ID NO: 62518 - DNA, 25 bp, Mus musculus
tgattcccaagagttcctccgagag

SEQ ID NO: 62519 - DNA, 25 bp, Mus musculus
tgattccctggaaaggatagaagct

SEQ ID NO: 62520 - DNA, 25 bp, Mus musculus
tgattcctagctacattcgagactc

SEQ ID NO: 62521 - DNA, 25 bp, Mus musculus
tgattctaagagtcccaacttgtcc

SEQ ID NO: 62522 - DNA, 25 bp, Mus musculus
tgattctacaattgctgatgaagga

SEQ ID NO: 62523 - DNA, 25 bp, Mus musculus
tgattctacctacacaagtctggaa

SEQ ID NO: 62524 - DNA, 25 bp, Mus musculus
tgattctcctcaaggcaagaccctg

SEQ ID NO: 62525 - DNA, 25 bp, Mus musculus
tgattctctggcaaagcgaggcagt

SEQ ID NO: 62526 - DNA, 25 bp, Mus musculus
tgattctctgttgccagcgccagca

SEQ ID NO: 62527 - DNA, 25 bp, Mus musculus
tgattctgaacaaccacattatgga

SEQ ID NO: 62528 - DNA, 25 bp, Mus musculus
tgattctgcgaccagggccctacat

SEQ ID NO: 62529 - DNA, 25 bp, Mus musculus
tgattcttctggctaggatggagca

SEQ ID NO: 62530 - DNA, 25 bp, Mus musculus
tgattcttttcttgcacaccgagaa

SEQ ID NO: 62531 - DNA, 25 bp, Mus musculus
tgattgaaagggacagcctgttttt

SEQ ID NO: 62532 - DNA, 25 bp, Mus musculus
tgattgaacatgcacagaaagagct

SEQ ID NO: 62533 - DNA, 25 bp, Mus musculus
tgattgaaccagagcagtgtacgtt

SEQ ID NO: 62534 - DNA, 25 bp, Mus musculus
tgattgaagcatacccacctgcaga

SEQ ID NO: 62535 - DNA, 25 bp, Mus musculus
tgattgactttcacaacccttcgga

SEQ ID NO: 62536 - DNA, 25 bp, Mus musculus
tgattgagccgctggtacccgagga

SEQ ID NO: 62537 - DNA, 25 bp, Mus musculus
tgattgagctggagaagcatatctc

SEQ ID NO: 62538 - DNA, 25 bp, Mus musculus
tgattgaggacctcctgaactggaa

SEQ ID NO: 62539 - DNA, 25 bp, Mus musculus
tgattgagggcatcatctcacccgt

SEQ ID NO: 62540 - DNA, 25 bp, Mus musculus
tgattgagtatgacaagctgcggaa

SEQ ID NO: 62541 - DNA, 25 bp, Mus musculus
tgattgatacagaactgaactcaag

SEQ ID NO: 62542 - DNA, 25 bp, Mus musculus
tgattgatgccctccgagtgaacaa

SEQ ID NO: 62543 - DNA, 25 bp, Mus musculus
tgattgcacagtcccagtctggtac

SEQ ID NO: 62544 - DNA, 25 bp, Mus musculus
tgattgcagacagcgacacgccgac

SEQ ID NO: 62545 - DNA, 25 bp, Mus musculus
tgattgcagtcatcattgcaggcat

SEQ ID NO: 62546 - DNA, 25 bp, Mus musculus
tgattgcgcacgacttcctggcctt

SEQ ID NO: 62547 - DNA, 25 bp, Mus musculus
tgattgcggcgttaaattctcggac

SEQ ID NO: 62548 - DNA, 25 bp, Mus musculus
tgattgctgggatgaaagatgtcac

SEQ ID NO: 62549 - DNA, 25 bp, Mus musculus
tgattgctgttaccagagaagagga

SEQ ID NO: 62550 - DNA, 25 bp, Mus musculus
tgattggctacctggacagtgatgt

SEQ ID NO: 62551 - DNA, 25 bp, Mus musculus
tgattggtgatcacggctcagcaag

SEQ ID NO: 62552 - DNA, 25 bp, Mus musculus
tgattggttgctccaccccagacaa

SEQ ID NO: 62553 - DNA, 25 bp, Mus musculus
tgattgtactcgcacgggctactca

SEQ ID NO: 62554 - DNA, 25 bp, Mus musculus
tgattgtactcggacgggctactca

SEQ ID NO: 62555 - DNA, 25 bp, Mus musculus
tgattgtaggagcacccatatggtt

SEQ ID NO: 62556 - DNA, 25 bp, Mus musculus
tgattgtgggtgacatcctgagtcc

SEQ ID NO: 62557 - DNA, 25 bp, Mus musculus
tgattgttacaccttcagtatcctg

SEQ ID NO: 62558 - DNA, 25 bp, Mus musculus
tgatttaagaaggatcctgacagat

SEQ ID NO: 62559 - DNA, 25 bp, Mus musculus
tgatttacgagcttgcaccaccctc

SEQ ID NO: 62560 - DNA, 25 bp, Mus musculus
tgatttacgcagagaaggacctggt

SEQ ID NO: 62561 - DNA, 25 bp, Mus musculus
tgatttagcacggatttgacggagc

SEQ ID NO: 62562 - DNA, 25 bp, Mus musculus
tgatttcatcccaagagcctctgag

SEQ ID NO: 62563 - DNA, 25 bp, Mus musculus
tgatttcccagctgacccgaggcaa

SEQ ID NO: 62564 - DNA, 25 bp, Mus musculus
tgatttccgatagccggcctgctga

SEQ ID NO: 62565 - DNA, 25 bp, Mus musculus
tgatttccggtgtctctgagaccac

SEQ ID NO: 62566 - DNA, 25 bp, Mus musculus
tgatttctgtcagggcaccaaggcg

SEQ ID NO: 62567 - DNA, 25 bp, Mus musculus
tgatttgccacatctgaggaacaaa

SEQ ID NO: 62568 - DNA, 25 bp, Mus musculus
tgatttgccgtgaaccctggcagcc

SEQ ID NO: 62569 - DNA, 25 bp, Mus musculus
tgatttgccttgactcagagagtct

SEQ ID NO: 62570 - DNA, 25 bp, Mus musculus
tgatttggacgctgccactcaacag

SEQ ID NO: 62571 - DNA, 25 bp, Mus musculus
tgatttggccaacaccttccgtggg

SEQ ID NO: 62572 - DNA, 25 bp, Mus musculus
tgatttggccaatttctagttgttg

SEQ ID NO: 62573 - DNA, 25 bp, Mus musculus
tgatttgttctcaccatatgtaccc

SEQ ID NO: 62574 - DNA, 25 bp, Mus musculus
tgattttatgcaatggcttcaagcc

SEQ ID NO: 62575 - DNA, 25 bp, Mus musculus
tgattttcctggttagaagaccaag

SEQ ID NO: 62576 - DNA, 25 bp, Mus musculus
tgattttgcacatcttaggacccat

SEQ ID NO: 62577 - DNA, 25 bp, Mus musculus
tgattttgttgaagacgactcagac

SEQ ID NO: 62578 - DNA, 25 bp, Mus musculus
tgcaaaaaacaagaaggacagcctc

SEQ ID NO: 62579 - DNA, 25 bp, Mus musculus
tgcaaaacagcaggcatggattcag

SEQ ID NO: 62580 - DNA, 25 bp, Mus musculus
tgcaaaacatgtctcaatccataga

SEQ ID NO: 62581 - DNA, 25 bp, Mus musculus
tgcaaaagttaatgccaagacgaag

SEQ ID NO: 62582 - DNA, 25 bp, Mus musculus
tgcaaaatcggcatcatgcctggcc

SEQ ID NO: 62583 - DNA, 25 bp, Mus musculus
tgcaaaatctactccctgaaggcaa

SEQ ID NO: 62584 - DNA, 25 bp, Mus musculus
tgcaaaatgtccctgaatcaatcta

SEQ ID NO: 62585 - DNA, 25 bp, Mus musculus
tgcaaacaaatgaagcagcactttg

SEQ ID NO: 62586 - DNA, 25 bp, Mus musculus
tgcaaacagtgtaacatcaccccac

SEQ ID NO: 62587 - DNA, 25 bp, Mus musculus
tgcaaaccaaactcatgaccaggtc

SEQ ID NO: 62588 - DNA, 25 bp, Mus musculus
tgcaaactatgaggcctgtctcaag

SEQ ID NO: 62589 - DNA, 25 bp, Mus musculus
tgcaaactccagactgtggttatct

SEQ ID NO: 62590 - DNA, 25 bp, Mus musculus
tgcaaactccagtctgtggttatct

SEQ ID NO: 62591 - DNA, 25 bp, Mus musculus
tgcaaactggaatgaagattgatag

SEQ ID NO: 62592 - DNA, 25 bp, Mus musculus
tgcaaacttgaaaagtcccccggtg

SEQ ID NO: 62593 - DNA, 25 bp, Mus musculus
tgcaaagaagtccacagaacccaag

SEQ ID NO: 62594 - DNA, 25 bp, Mus musculus
tgcaaagatgctctgcgaccagtat

SEQ ID NO: 62595 - DNA, 25 bp, Mus musculus
tgcaaagatgctgtgcgaccagtat

SEQ ID NO: 62596 - DNA, 25 bp, Mus musculus
tgcaaagcactattctgttctgaga

SEQ ID NO: 62597 - DNA, 25 bp, Mus musculus
tgcaaagccgacagctgcgggaaga

SEQ ID NO: 62598 - DNA, 25 bp, Mus musculus
tgcaaaggccacgtcagaaacaaca

SEQ ID NO: 62599 - DNA, 25 bp, Mus musculus
tgcaaaggccgatgagctgcctgtt

SEQ ID NO: 62600 - DNA, 25 bp, Mus musculus
tgcaaagtaaacagggtgccttgtg

SEQ ID NO: 62601 - DNA, 25 bp, Mus musculus
tgcaaagtcagcgttcacctctggt

SEQ ID NO: 62602 - DNA, 25 bp, Mus musculus
tgcaaagtccttcgcaagccttatg

SEQ ID NO: 62603 - DNA, 25 bp, Mus musculus
tgcaaatacagagctgagcatttct

SEQ ID NO: 62604 - DNA, 25 bp, Mus musculus
tgcaaatgctcggattcaaggcgtg

SEQ ID NO: 62605 - DNA, 25 bp, Mus musculus
tgcaaatggacatactcagcagaga

SEQ ID NO: 62606 - DNA, 25 bp, Mus musculus
tgcaaatggatgaagacacgctgga

SEQ ID NO: 62607 - DNA, 25 bp, Mus musculus
tgcaaatgtgaacagcttccagagg

SEQ ID NO: 62608 - DNA, 25 bp, Mus musculus
tgcaaatttgagaacaatagctggg

SEQ ID NO: 62609 - DNA, 25 bp, Mus musculus
tgcaacaaggatgactagaatgggc

SEQ ID NO: 62610 - DNA, 25 bp, Mus musculus
tgcaacaagtgtccccttcgcagca

SEQ ID NO: 62611 - DNA, 25 bp, Mus musculus
tgcaacaagtgtccttggttataaa

SEQ ID NO: 62612 - DNA, 25 bp, Mus musculus
tgcaacacatacaagaagcccgtgg

SEQ ID NO: 62613 - DNA, 25 bp, Mus musculus
tgcaacactccttcctgacagaggt

SEQ ID NO: 62614 - DNA, 25 bp, Mus musculus
tgcaacagtggcctgtgggacctgc

SEQ ID NO: 62615 - DNA, 25 bp, Mus musculus
tgcaacagttaaccgcctctgtgcc

SEQ ID NO: 62616 - DNA, 25 bp, Mus musculus
tgcaacatcttttctccctacacag

SEQ ID NO: 62617 - DNA, 25 bp, Mus musculus
tgcaacatgaacaaaaaccttccct

SEQ ID NO: 62618 - DNA, 25 bp, Mus musculus
tgcaaccacatcaccaagctgcgtg

SEQ ID NO: 62619 - DNA, 25 bp, Mus musculus
tgcaaccacgtttcgcctgctctgg

SEQ ID NO: 62620 - DNA, 25 bp, Mus musculus
tgcaaccccttgcaatcaagcatgg

SEQ ID NO: 62621 - DNA, 25 bp, Mus musculus
tgcaacccgaaagggcaacaaaatt

SEQ ID NO: 62622 - DNA, 25 bp, Mus musculus
tgcaaccgtgctattgctgaccgct

SEQ ID NO: 62623 - DNA, 25 bp, Mus musculus
tgcaaccgtgcttttgctgaccgct

SEQ ID NO: 62624 - DNA, 25 bp, Mus musculus
tgcaacctgagcagatcgagaaaat

SEQ ID NO: 62625 - DNA, 25 bp, Mus musculus
tgcaacctgctcaccagtacctgga

SEQ ID NO: 62626 - DNA, 25 bp, Mus musculus
tgcaactaagttaaggccaaaggca

SEQ ID NO: 62627 - DNA, 25 bp, Mus musculus
tgcaactaattaaaggcagactggc

SEQ ID NO: 62628 - DNA, 25 bp, Mus musculus
tgcaactgcgagcacagtggaaatt

SEQ ID NO: 62629 - DNA, 25 bp, Mus musculus
tgcaactgctggaggattacaagca

SEQ ID NO: 62630 - DNA, 25 bp, Mus musculus
tgcaactggacgagacctgtgctga

SEQ ID NO: 62631 - DNA, 25 bp, Mus musculus
tgcaactggtgacttacagcagccg

SEQ ID NO: 62632 - DNA, 25 bp, Mus musculus
tgcaacttcaaggatgggcacatct

SEQ ID NO: 62633 - DNA, 25 bp, Mus musculus
tgcaagaaacttcaatctgccaatg

SEQ ID NO: 62634 - DNA, 25 bp, Mus musculus
tgcaagaacacacaaggttcctacc

SEQ ID NO: 62635 - DNA, 25 bp, Mus musculus
tgcaagaacacagaaggttcctacc

SEQ ID NO: 62636 - DNA, 25 bp, Mus musculus
tgcaagaacatcaaacctcagtgcc

SEQ ID NO: 62637 - DNA, 25 bp, Mus musculus
tgcaagaactccaagctgaacagaa

SEQ ID NO: 62638 - DNA, 25 bp, Mus musculus
tgcaagacctagcaagtccccatgc

SEQ ID NO: 62639 - DNA, 25 bp, Mus musculus
tgcaagactggaattcctgaagatg

SEQ ID NO: 62640 - DNA, 25 bp, Mus musculus
tgcaagactggatttcctgaagatg

SEQ ID NO: 62641 - DNA, 25 bp, Mus musculus
tgcaagagagactgccctcccttgc

SEQ ID NO: 62642 - DNA, 25 bp, Mus musculus
tgcaagagagggaagagccacagca

SEQ ID NO: 62643 - DNA, 25 bp, Mus musculus
tgcaagagctgcaactatgtgctgg

SEQ ID NO: 62644 - DNA, 25 bp, Mus musculus
tgcaagaggccatcatcccctatat

SEQ ID NO: 62645 - DNA, 25 bp, Mus musculus
tgcaagaggcttactctgtcacctg

SEQ ID NO: 62646 - DNA, 25 bp, Mus musculus
tgcaagaggttcctgggagctgttg

SEQ ID NO: 62647 - DNA, 25 bp, Mus musculus
tgcaagaggttgttctgagcctgtt

SEQ ID NO: 62648 - DNA, 25 bp, Mus musculus
tgcaagatacttgacatagcctgct

SEQ ID NO: 62649 - DNA, 25 bp, Mus musculus
tgcaagatgcaatgtccttcttaaa

SEQ ID NO: 62650 - DNA, 25 bp, Mus musculus
tgcaagcaggagcagtcaagaatct

SEQ ID NO: 62651 - DNA, 25 bp, Mus musculus
tgcaagccactgcagcgttagaaac

SEQ ID NO: 62652 - DNA, 25 bp, Mus musculus
tgcaagcccttcagatgctcaagta

SEQ ID NO: 62653 - DNA, 25 bp, Mus musculus
tgcaagccgaggttacaggtaaact

SEQ ID NO: 62654 - DNA, 25 bp, Mus musculus
tgcaagctattaaaatggaaaggta

SEQ ID NO: 62655 - DNA, 25 bp, Mus musculus
tgcaagctggcggtgattcagtata

SEQ ID NO: 62656 - DNA, 25 bp, Mus musculus
tgcaagcttccacttatcccgaaag

SEQ ID NO: 62657 - DNA, 25 bp, Mus musculus
tgcaaggacaagtctgacgaggccg

SEQ ID NO: 62658 - DNA, 25 bp, Mus musculus
tgcaaggagagaagcagtttctgct

SEQ ID NO: 62659 - DNA, 25 bp, Mus musculus
tgcaaggcagtctcaagtgcaaacc

SEQ ID NO: 62660 - DNA, 25 bp, Mus musculus
tgcaaggctggtacggtcctcgaag

SEQ ID NO: 62661 - DNA, 25 bp, Mus musculus
tgcaaggctttgaaaatgacagagt

SEQ ID NO: 62662 - DNA, 25 bp, Mus musculus
tgcaagggaaagcagatccacaact

SEQ ID NO: 62663 - DNA, 25 bp, Mus musculus
tgcaagggagttgcagaaaagcctc

SEQ ID NO: 62664 - DNA, 25 bp, Mus musculus
tgcaagggagtttcagaaaggcccc

SEQ ID NO: 62665 - DNA, 25 bp, Mus musculus
tgcaaggtcatgactacgaggcagg

SEQ ID NO: 62666 - DNA, 25 bp, Mus musculus
tgcaaggtgtactgtacgtacacag

SEQ ID NO: 62667 - DNA, 25 bp, Mus musculus
tgcaaggtgttctccaagaccagaa

SEQ ID NO: 62668 - DNA, 25 bp, Mus musculus
tgcaagtagccatttcattaattga

SEQ ID NO: 62669 - DNA, 25 bp, Mus musculus
tgcaagtaggatgtttagcaaccct

SEQ ID NO: 62670 - DNA, 25 bp, Mus musculus
tgcaagtcaagcacccgtggaggat

SEQ ID NO: 62671 - DNA, 25 bp, Mus musculus
tgcaagtcaagctcccgtggaggat

SEQ ID NO: 62672 - DNA, 25 bp, Mus musculus
tgcaagtctcttcctgctctaaaag

SEQ ID NO: 62673 - DNA, 25 bp, Mus musculus
tgcaagtctcttgctgctctaaaag

SEQ ID NO: 62674 - DNA, 25 bp, Mus musculus
tgcaagtgagattgcaggagtagat

SEQ ID NO: 62675 - DNA, 25 bp, Mus musculus
tgcaagtgtgcactaagtaagcctc

SEQ ID NO: 62676 - DNA, 25 bp, Mus musculus
tgcaagttgggaagatgaaaaagtg

SEQ ID NO: 62677 - DNA, 25 bp, Mus musculus
tgcaagttgttcaggctgacattgc

SEQ ID NO: 62678 - DNA, 25 bp, Mus musculus
tgcaataagcgaaagaaagcccagg

SEQ ID NO: 62679 - DNA, 25 bp, Mus musculus
tgcaatacaaggctgacatcaatgc

SEQ ID NO: 62680 - DNA, 25 bp, Mus musculus
tgcaatacagtggatacagtttgct

SEQ ID NO: 62681 - DNA, 25 bp, Mus musculus
tgcaatagcaacaaacgggtttgtt

SEQ ID NO: 62682 - DNA, 25 bp, Mus musculus
tgcaataggccgaagtgctaaaact

SEQ ID NO: 62683 - DNA, 25 bp, Mus musculus
tgcaatcactgcaacaaaccccatt

SEQ ID NO: 62684 - DNA, 25 bp, Mus musculus
tgcaatcactgtatccaacggaggg

SEQ ID NO: 62685 - DNA, 25 bp, Mus musculus
tgcaatcattcaggcctaaggattt

SEQ ID NO: 62686 - DNA, 25 bp, Mus musculus
tgcaatcggaccaaatcctctggaa

SEQ ID NO: 62687 - DNA, 25 bp, Mus musculus
tgcaatctccagttccacagatccg

SEQ ID NO: 62688 - DNA, 25 bp, Mus musculus
tgcaatctgcccgagagggctcgag

SEQ ID NO: 62689 - DNA, 25 bp, Mus musculus
tgcaatgacaccctggaaccagggt

SEQ ID NO: 62690 - DNA, 25 bp, Mus musculus
tgcaatgaccagaataaacccaagg

SEQ ID NO: 62691 - DNA, 25 bp, Mus musculus
tgcaatgagttacaaaggctccacc

SEQ ID NO: 62692 - DNA, 25 bp, Mus musculus
tgcaatgattaaaatggtcgtccct

SEQ ID NO: 62693 - DNA, 25 bp, Mus musculus
tgcaatgcagaaatatccaaacccc

SEQ ID NO: 62694 - DNA, 25 bp, Mus musculus
tgcaatgcctgtgttgaccgcacca

SEQ ID NO: 62695 - DNA, 25 bp, Mus musculus
tgcaatgggaattgagaacagagcc

SEQ ID NO: 62696 - DNA, 25 bp, Mus musculus
tgcaatgggtttgctcaattttaag

SEQ ID NO: 62697 - DNA, 25 bp, Mus musculus
tgcaatggtacacccgaacccagca

SEQ ID NO: 62698 - DNA, 25 bp, Mus musculus
tgcaatgtggatccaagaggctgtt

SEQ ID NO: 62699 - DNA, 25 bp, Mus musculus
tgcaatgtggcccacccggcaagca

SEQ ID NO: 62700 - DNA, 25 bp, Mus musculus
tgcaatgtttctaggaatgacgtgc

SEQ ID NO: 62701 - DNA, 25 bp, Mus musculus
tgcaatgtttcttggaatgacgtgc

SEQ ID NO: 62702 - DNA, 25 bp, Mus musculus
tgcaattaagcaagtacctgttgag

SEQ ID NO: 62703 - DNA, 25 bp, Mus musculus
tgcaattatgggacacagcaggtca

SEQ ID NO: 62704 - DNA, 25 bp, Mus musculus
tgcaatttcaaatgacaaggaagct

SEQ ID NO: 62705 - DNA, 25 bp, Mus musculus
tgcacaaacatctcggatagtacct

SEQ ID NO: 62706 - DNA, 25 bp, Mus musculus
tgcacaaagaaccttctctgacaag

SEQ ID NO: 62707 - DNA, 25 bp, Mus musculus
tgcacaacaagcaggaacctacatt

SEQ ID NO: 62708 - DNA, 25 bp, Mus musculus
tgcacaaccaccatactgagaagag

SEQ ID NO: 62709 - DNA, 25 bp, Mus musculus
tgcacaacctcgttcctatcattaa

SEQ ID NO: 62710 - DNA, 25 bp, Mus musculus
tgcacaacgaagaccaaatggccgt

SEQ ID NO: 62711 - DNA, 25 bp, Mus musculus
tgcacaacggatggtacaaaaagcc

SEQ ID NO: 62712 - DNA, 25 bp, Mus musculus
tgcacaacttcatgatggacatcca

SEQ ID NO: 62713 - DNA, 25 bp, Mus musculus
tgcacaagaagaaagtagcccacgt

SEQ ID NO: 62714 - DNA, 25 bp, Mus musculus
tgcacaagaagcacagggagtgtga

SEQ ID NO: 62715 - DNA, 25 bp, Mus musculus
tgcacaagaggttcttcagccagag

SEQ ID NO: 62716 - DNA, 25 bp, Mus musculus
tgcacaaggagaggactggcagcaa

SEQ ID NO: 62717 - DNA, 25 bp, Mus musculus
tgcacaaggcggaggacagcctcct

SEQ ID NO: 62718 - DNA, 25 bp, Mus musculus
tgcacaagtttggaatgcacatggg

SEQ ID NO: 62719 - DNA, 25 bp, Mus musculus
tgcacaatgcccacaaagtgttgct

SEQ ID NO: 62720 - DNA, 25 bp, Mus musculus
tgcacaatggctgggacgacctgga

SEQ ID NO: 62721 - DNA, 25 bp, Mus musculus
tgcacacaaatgttgccactgctgt

SEQ ID NO: 62722 - DNA, 25 bp, Mus musculus
tgcacacaaggtggccaagttctgc

SEQ ID NO: 62723 - DNA, 25 bp, Mus musculus
tgcacacacgggtatcatctttcac

SEQ ID NO: 62724 - DNA, 25 bp, Mus musculus
tgcacacagaagtccctgaaaacta

SEQ ID NO: 62725 - DNA, 25 bp, Mus musculus
tgcacacagactatgcttgcctcct

SEQ ID NO: 62726 - DNA, 25 bp, Mus musculus
tgcacacagaggcttcccacggctg

SEQ ID NO: 62727 - DNA, 25 bp, Mus musculus
tgcacacagtacattaggcatggat

SEQ ID NO: 62728 - DNA, 25 bp, Mus musculus
tgcacaccagagactagtaaccagc

SEQ ID NO: 62729 - DNA, 25 bp, Mus musculus
tgcacaccttcaaggccaagttcac

SEQ ID NO: 62730 - DNA, 25 bp, Mus musculus
tgcacacgagggaaagatggaccct

SEQ ID NO: 62731 - DNA, 25 bp, Mus musculus
tgcacactggacagaagatgcctct

SEQ ID NO: 62732 - DNA, 25 bp, Mus musculus
tgcacactggcaagtacaagtctgt

SEQ ID NO: 62733 - DNA, 25 bp, Mus musculus
tgcacactgtggtgctggcgttacc

SEQ ID NO: 62734 - DNA, 25 bp, Mus musculus
tgcacagaaacggtcagatccatag

SEQ ID NO: 62735 - DNA, 25 bp, Mus musculus
tgcacagaactgagtatcccactag

SEQ ID NO: 62736 - DNA, 25 bp, Mus musculus
tgcacagcaagtggcagaggataaa

SEQ ID NO: 62737 - DNA, 25 bp, Mus musculus
tgcacagcagaggtaatcctgtaag

SEQ ID NO: 62738 - DNA, 25 bp, Mus musculus
tgcacagcagcggtttcttactgtt

SEQ ID NO: 62739 - DNA, 25 bp, Mus musculus
tgcacagggatgtgaaacctcacaa

SEQ ID NO: 62740 - DNA, 25 bp, Mus musculus
tgcacagggcctctgagttttatga

SEQ ID NO: 62741 - DNA, 25 bp, Mus musculus
tgcacagtcccagtctggtactggg

SEQ ID NO: 62742 - DNA, 25 bp, Mus musculus
tgcacagtgtacagcgggctcacaa

SEQ ID NO: 62743 - DNA, 25 bp, Mus musculus
tgcacagttgaacgcctgctgctgc

SEQ ID NO: 62744 - DNA, 25 bp, Mus musculus
tgcacataaaagctcacagtggtta

SEQ ID NO: 62745 - DNA, 25 bp, Mus musculus
tgcacataatctcaaaagaccagag

SEQ ID NO: 62746 - DNA, 25 bp, Mus musculus
tgcacataatctgaaaagaccagag

SEQ ID NO: 62747 - DNA, 25 bp, Mus musculus
tgcacatcgaatccgaggacttggt

SEQ ID NO: 62748 - DNA, 25 bp, Mus musculus
tgcacatcgaccctgaatccaagat

SEQ ID NO: 62749 - DNA, 25 bp, Mus musculus
tgcacatctctgtcctccaaactgg

SEQ ID NO: 62750 - DNA, 25 bp, Mus musculus
tgcacatcttaggacccattgtgga

SEQ ID NO: 62751 - DNA, 25 bp, Mus musculus
tgcacatgtatcgatggctaccagg

SEQ ID NO: 62752 - DNA, 25 bp, Mus musculus
tgcacatgtatgagtgtaagccagc

SEQ ID NO: 62753 - DNA, 25 bp, Mus musculus
tgcacatttgaccaagagcagatcc

SEQ ID NO: 62754 - DNA, 25 bp, Mus musculus
tgcaccaaacaaataacgccaggtt

SEQ ID NO: 62755 - DNA, 25 bp, Mus musculus
tgcaccaagacagggcgctggactg

SEQ ID NO: 62756 - DNA, 25 bp, Mus musculus
tgcaccaagtacaaagtcagcagtt

SEQ ID NO: 62757 - DNA, 25 bp, Mus musculus
tgcaccaccacgacttcagcttgga

SEQ ID NO: 62758 - DNA, 25 bp, Mus musculus
tgcaccagaacttaatcaggaaatt

SEQ ID NO: 62759 - DNA, 25 bp, Mus musculus
tgcaccagacacagatgggagactc

SEQ ID NO: 62760 - DNA, 25 bp, Mus musculus
tgcaccagcgaagtgacgtcacatg

SEQ ID NO: 62761 - DNA, 25 bp, Mus musculus
tgcaccaggaaccttatatgaaggg

SEQ ID NO: 62762 - DNA, 25 bp, Mus musculus
tgcaccatacacacctaatttgcct

SEQ ID NO: 62763 - DNA, 25 bp, Mus musculus
tgcaccattgccattcgatacagtg

SEQ ID NO: 62764 - DNA, 25 bp, Mus musculus
tgcaccattgtgcttcgtggtgcca

SEQ ID NO: 62765 - DNA, 25 bp, Mus musculus
tgcacccacaaactttgccaagtgg

SEQ ID NO: 62766 - DNA, 25 bp, Mus musculus
tgcacccacaaagtttgccaagtgg

SEQ ID NO: 62767 - DNA, 25 bp, Mus musculus
tgcacccagagggtgaatgggtatc

SEQ ID NO: 62768 - DNA, 25 bp, Mus musculus
tgcaccccagaaggtgtcgtctttg

SEQ ID NO: 62769 - DNA, 25 bp, Mus musculus
tgcaccccgactccggattctagaa

SEQ ID NO: 62770 - DNA, 25 bp, Mus musculus
tgcacccgaggcattaggaagcgcg

SEQ ID NO: 62771 - DNA, 25 bp, Mus musculus
tgcacccgcgactctgcagttcagg

SEQ ID NO: 62772 - DNA, 25 bp, Mus musculus
tgcacccgcttataaatgcctttgc

SEQ ID NO: 62773 - DNA, 25 bp, Mus musculus
tgcaccctgactggagttaccctga

SEQ ID NO: 62774 - DNA, 25 bp, Mus musculus
tgcaccctgcctatggttcatcgga

SEQ ID NO: 62775 - DNA, 25 bp, Mus musculus
tgcaccctgcctttggttcatcgga

SEQ ID NO: 62776 - DNA, 25 bp, Mus musculus
tgcacccttcaacaactggatggag

SEQ ID NO: 62777 - DNA, 25 bp, Mus musculus
tgcaccgagcaatggaagagtttcc

SEQ ID NO: 62778 - DNA, 25 bp, Mus musculus
tgcaccgatacaggaaaggagatgg

SEQ ID NO: 62779 - DNA, 25 bp, Mus musculus
tgcaccgatggatatgaatgggacc

SEQ ID NO: 62780 - DNA, 25 bp, Mus musculus
tgcaccggaagccattcaataccgg

SEQ ID NO: 62781 - DNA, 25 bp, Mus musculus
tgcaccggaaggaatattcccagag

SEQ ID NO: 62782 - DNA, 25 bp, Mus musculus
tgcaccgtcacattgctggaggcct

SEQ ID NO: 62783 - DNA, 25 bp, Mus musculus
tgcaccgtgcccttcgtgactggct

SEQ ID NO: 62784 - DNA, 25 bp, Mus musculus
tgcacctacagcatccgcctggagg

SEQ ID NO: 62785 - DNA, 25 bp, Mus musculus
tgcacctagcagaaatttcactacc

SEQ ID NO: 62786 - DNA, 25 bp, Mus musculus
tgcacctccaacctgggtcaaggct

SEQ ID NO: 62787 - DNA, 25 bp, Mus musculus
tgcacctcggcatcttcttcatggg

SEQ ID NO: 62788 - DNA, 25 bp, Mus musculus
tgcacctctagttgtccctgagagt

SEQ ID NO: 62789 - DNA, 25 bp, Mus musculus
tgcacctgaacaacgtgagcactgg

SEQ ID NO: 62790 - DNA, 25 bp, Mus musculus
tgcacctgagtgtaggtgacaaaca

SEQ ID NO: 62791 - DNA, 25 bp, Mus musculus
tgcaccttgcacgacattttactaa

SEQ ID NO: 62792 - DNA, 25 bp, Mus musculus
tgcacgaccagagcagctcagcttt

SEQ ID NO: 62793 - DNA, 25 bp, Mus musculus
tgcacgaccgttgttatgggcaact

SEQ ID NO: 62794 - DNA, 25 bp, Mus musculus
tgcacgatgatatggagagccagcc

SEQ ID NO: 62795 - DNA, 25 bp, Mus musculus
tgcacgattccgtcaaattaaagtt

SEQ ID NO: 62796 - DNA, 25 bp, Mus musculus
tgcacgcaaagctcttagcgcccga

SEQ ID NO: 62797 - DNA, 25 bp, Mus musculus
tgcacgccacttccgtgatgaggag

SEQ ID NO: 62798 - DNA, 25 bp, Mus musculus
tgcacgggtccgatccatggtgccc

SEQ ID NO: 62799 - DNA, 25 bp, Mus musculus
tgcacgtagctgctgatcttggaaa

SEQ ID NO: 62800 - DNA, 25 bp, Mus musculus
tgcacgtgtgtggaggctccctgct

SEQ ID NO: 62801 - DNA, 25 bp, Mus musculus
tgcactaatatgtgaacttatggac

SEQ ID NO: 62802 - DNA, 25 bp, Mus musculus
tgcactacagaggagagaccgtgaa

SEQ ID NO: 62803 - DNA, 25 bp, Mus musculus
tgcactaggccttccaatgaggggg

SEQ ID NO: 62804 - DNA, 25 bp, Mus musculus
tgcactatgtggagggctcgtaccg

SEQ ID NO: 62805 - DNA, 25 bp, Mus musculus
tgcactatttaatcggcacgctgct

SEQ ID NO: 62806 - DNA, 25 bp, Mus musculus
tgcactcaccaacccagagaagagc

SEQ ID NO: 62807 - DNA, 25 bp, Mus musculus
tgcactcacgcgaggctgtctgcag

SEQ ID NO: 62808 - DNA, 25 bp, Mus musculus
tgcactcacgggaccacggtctgga

SEQ ID NO: 62809 - DNA, 25 bp, Mus musculus
tgcactcaggctgcttcgtggggac

SEQ ID NO: 62810 - DNA, 25 bp, Mus musculus
tgcactccagggagcactgatgata

SEQ ID NO: 62811 - DNA, 25 bp, Mus musculus
tgcactccatgatcacgcgcaaggt

SEQ ID NO: 62812 - DNA, 25 bp, Mus musculus
tgcactcgcctttctggcgaatggg

SEQ ID NO: 62813 - DNA, 25 bp, Mus musculus
tgcactctgcgaagagcctgcaggc

SEQ ID NO: 62814 - DNA, 25 bp, Mus musculus
tgcactcttggctctgaagttcata

SEQ ID NO: 62815 - DNA, 25 bp, Mus musculus
tgcactgaggccaaaaaacattgct

SEQ ID NO: 62816 - DNA, 25 bp, Mus musculus
tgcactgaggtgcacacagtgtgcc

SEQ ID NO: 62817 - DNA, 25 bp, Mus musculus
tgcactgcaagctgaggtatgggct

SEQ ID NO: 62818 - DNA, 25 bp, Mus musculus
tgcactgcagctcatggcggagttc

SEQ ID NO: 62819 - DNA, 25 bp, Mus musculus
tgcactgccaacacaaacacctgta

SEQ ID NO: 62820 - DNA, 25 bp, Mus musculus
tgcactggaagctgtgcttatccct

SEQ ID NO: 62821 - DNA, 25 bp, Mus musculus
tgcactggacctccacaactatggc

SEQ ID NO: 62822 - DNA, 25 bp, Mus musculus
tgcactggcaggctcttcaaacggc

SEQ ID NO: 62823 - DNA, 25 bp, Mus musculus
tgcactggcccatggcaatgccgtg

SEQ ID NO: 62824 - DNA, 25 bp, Mus musculus
tgcactgggaaaggaacagtgactc

SEQ ID NO: 62825 - DNA, 25 bp, Mus musculus
tgcactgggacaggatcgaaggcct

SEQ ID NO: 62826 - DNA, 25 bp, Mus musculus
tgcactgtgactcctgcatgccggc

SEQ ID NO: 62827 - DNA, 25 bp, Mus musculus
tgcactgtgggtaacattgtccgaa

SEQ ID NO: 62828 - DNA, 25 bp, Mus musculus
tgcacttagtcacagaggtcttcca

SEQ ID NO: 62829 - DNA, 25 bp, Mus musculus
tgcacttatgaccaacttcagggac

SEQ ID NO: 62830 - DNA, 25 bp, Mus musculus
tgcacttccatacaagctagctggg

SEQ ID NO: 62831 - DNA, 25 bp, Mus musculus
tgcacttccatagaagctagctggg

SEQ ID NO: 62832 - DNA, 25 bp, Mus musculus
tgcacttcttgaatcatggtgtggc

SEQ ID NO: 62833 - DNA, 25 bp, Mus musculus
tgcacttgatgttccaaacacagca

SEQ ID NO: 62834 - DNA, 25 bp, Mus musculus
tgcacttgccatcagcgtctcgtga

SEQ ID NO: 62835 - DNA, 25 bp, Mus musculus
tgcacttggaaactgtattctggac

SEQ ID NO: 62836 - DNA, 25 bp, Mus musculus
tgcacttgtgtgaacaaagcttttc

SEQ ID NO: 62837 - DNA, 25 bp, Mus musculus
tgcacttgtttttgtgtcactggca

SEQ ID NO: 62838 - DNA, 25 bp, Mus musculus
tgcactttacttcggagaagaagta

SEQ ID NO: 62839 - DNA, 25 bp, Mus musculus
tgcactttacttgggagaagaagta

SEQ ID NO: 62840 - DNA, 25 bp, Mus musculus
tgcactttctgcctgagagcgtggc

SEQ ID NO: 62841 - DNA, 25 bp, Mus musculus
tgcactttgcacctcccgagtttct

SEQ ID NO: 62842 - DNA, 25 bp, Mus musculus
tgcagaaaagctgaagccaggagac

SEQ ID NO: 62843 - DNA, 25 bp, Mus musculus
tgcagaaactgaggccccgagagta

SEQ ID NO: 62844 - DNA, 25 bp, Mus musculus
tgcagaaagagagtcctgtcactcc

SEQ ID NO: 62845 - DNA, 25 bp, Mus musculus
tgcagaaagggaagaagtacctcat

SEQ ID NO: 62846 - DNA, 25 bp, Mus musculus
tgcagaaatgccaggaacaaaaaga

SEQ ID NO: 62847 - DNA, 25 bp, Mus musculus
tgcagaacacactgcggagagctac

SEQ ID NO: 62848 - DNA, 25 bp, Mus musculus
tgcagaacatgctggacctgcccac

SEQ ID NO: 62849 - DNA, 25 bp, Mus musculus
tgcagaaccactcgctggagatgac

SEQ ID NO: 62850 - DNA, 25 bp, Mus musculus
tgcagaagaacaaggctggaggaat

SEQ ID NO: 62851 - DNA, 25 bp, Mus musculus
tgcagaagacccagagaaatcagac

SEQ ID NO: 62852 - DNA, 25 bp, Mus musculus
tgcagaagagaccatcactagcccc

SEQ ID NO: 62853 - DNA, 25 bp, Mus musculus
tgcagaagagctcctggcacagagt

SEQ ID NO: 62854 - DNA, 25 bp, Mus musculus
tgcagaagaggaagcgaatgcacct

SEQ ID NO: 62855 - DNA, 25 bp, Mus musculus
tgcagaagcggccaatggccagtac

SEQ ID NO: 62856 - DNA, 25 bp, Mus musculus
tgcagaagctaacctgggcgtcagt

SEQ ID NO: 62857 - DNA, 25 bp, Mus musculus
tgcagaagctatacctgaaggagta

SEQ ID NO: 62858 - DNA, 25 bp, Mus musculus
tgcagaagctcggaaggagtcccgg

SEQ ID NO: 62859 - DNA, 25 bp, Mus musculus
tgcagaaggcactagcatttctgaa

SEQ ID NO: 62860 - DNA, 25 bp, Mus musculus
tgcagaagggacagatgacaggtca

SEQ ID NO: 62861 - DNA, 25 bp, Mus musculus
tgcagaagggactgatgacaggtca

SEQ ID NO: 62862 - DNA, 25 bp, Mus musculus
tgcagaagggcagctgaacggtctc

SEQ ID NO: 62863 - DNA, 25 bp, Mus musculus
tgcagaatccgaaagtcacagaatt

SEQ ID NO: 62864 - DNA, 25 bp, Mus musculus
tgcagaatgacacaaacgcggacgt

SEQ ID NO: 62865 - DNA, 25 bp, Mus musculus
tgcagaattcttccccagggcagtg

SEQ ID NO: 62866 - DNA, 25 bp, Mus musculus
tgcagacaagaacagcttcatttcc

SEQ ID NO: 62867 - DNA, 25 bp, Mus musculus
tgcagacacacaagagattaatttg

SEQ ID NO: 62868 - DNA, 25 bp, Mus musculus
tgcagacactgaaggagcacactga

SEQ ID NO: 62869 - DNA, 25 bp, Mus musculus
tgcagacagccttttcgaacatgaa

SEQ ID NO: 62870 - DNA, 25 bp, Mus musculus
tgcagacagcgacacgccgactata

SEQ ID NO: 62871 - DNA, 25 bp, Mus musculus
tgcagacagttcagcagtcaaaaat

SEQ ID NO: 62872 - DNA, 25 bp, Mus musculus
tgcagacatgctgagctctctgggc

SEQ ID NO: 62873 - DNA, 25 bp, Mus musculus
tgcagacattatgttacatcaccag

SEQ ID NO: 62874 - DNA, 25 bp, Mus musculus
tgcagacattgtaaaagaccctgtg

SEQ ID NO: 62875 - DNA, 25 bp, Mus musculus
tgcagaccaagctgcggctcagcaa

SEQ ID NO: 62876 - DNA, 25 bp, Mus musculus
tgcagaccagaactgtgaagatgcg

SEQ ID NO: 62877 - DNA, 25 bp, Mus musculus
tgcagaccagaagtgtgaagatgcg

SEQ ID NO: 62878 - DNA, 25 bp, Mus musculus
tgcagaccaggaatccacactagct

SEQ ID NO: 62879 - DNA, 25 bp, Mus musculus
tgcagaccagtgtattctaaaaagg

SEQ ID NO: 62880 - DNA, 25 bp, Mus musculus
tgcagaccccatgtgcttagagcct

SEQ ID NO: 62881 - DNA, 25 bp, Mus musculus
tgcagaccggcatcaaggctgtgga

SEQ ID NO: 62882 - DNA, 25 bp, Mus musculus
tgcagaccgtggatggcaaacacca

SEQ ID NO: 62883 - DNA, 25 bp, Mus musculus
tgcagacctatcaatcaacgccaag

SEQ ID NO: 62884 - DNA, 25 bp, Mus musculus
tgcagacctccctggctcgagtgat

SEQ ID NO: 62885 - DNA, 25 bp, Mus musculus
tgcagacctgatagtcttgaagatg

SEQ ID NO: 62886 - DNA, 25 bp, Mus musculus
tgcagacctggcttcaatgtgctca

SEQ ID NO: 62887 - DNA, 25 bp, Mus musculus
tgcagaccttgcttctgactgtcag

SEQ ID NO: 62888 - DNA, 25 bp, Mus musculus
tgcagaccttttgggtggtccctcc

SEQ ID NO: 62889 - DNA, 25 bp, Mus musculus
tgcagacgctgtgtatgaaaagatc

SEQ ID NO: 62890 - DNA, 25 bp, Mus musculus
tgcagactatgactccctgccggag

SEQ ID NO: 62891 - DNA, 25 bp, Mus musculus
tgcagactcggactccagttctgac

SEQ ID NO: 62892 - DNA, 25 bp, Mus musculus
tgcagactgtctgggtggcacccac

SEQ ID NO: 62893 - DNA, 25 bp, Mus musculus
tgcagacttcttcgctggattggcc

SEQ ID NO: 62894 - DNA, 25 bp, Mus musculus
tgcagacttcttggctggattggcc

SEQ ID NO: 62895 - DNA, 25 bp, Mus musculus
tgcagagaaactcagcacagctcag

SEQ ID NO: 62896 - DNA, 25 bp, Mus musculus
tgcagagaaagcacagcgggaacca

SEQ ID NO: 62897 - DNA, 25 bp, Mus musculus
tgcagagaaattgaatatcccttgg

SEQ ID NO: 62898 - DNA, 25 bp, Mus musculus
tgcagagaagagctcatacctctat

SEQ ID NO: 62899 - DNA, 25 bp, Mus musculus
tgcagagactcagcagaagtttgtt

SEQ ID NO: 62900 - DNA, 25 bp, Mus musculus
tgcagagagcccacatggagtcgct

SEQ ID NO: 62901 - DNA, 25 bp, Mus musculus
tgcagagatccaagatggcagattc

SEQ ID NO: 62902 - DNA, 25 bp, Mus musculus
tgcagagatctgtgggccgccatgt

SEQ ID NO: 62903 - DNA, 25 bp, Mus musculus
tgcagagcaatgtcagctctgggcg

SEQ ID NO: 62904 - DNA, 25 bp, Mus musculus
tgcagagcagtattctgagaaactg

SEQ ID NO: 62905 - DNA, 25 bp, Mus musculus
tgcagagcatcaactggctgcggga

SEQ ID NO: 62906 - DNA, 25 bp, Mus musculus
tgcagagccacctggccgcagggaa

SEQ ID NO: 62907 - DNA, 25 bp, Mus musculus
tgcagagctggagcccttagctgat

SEQ ID NO: 62908 - DNA, 25 bp, Mus musculus
tgcagagctggcagagtacacggcc

SEQ ID NO: 62909 - DNA, 25 bp, Mus musculus
tgcagaggcagtatcctggctgcgc

SEQ ID NO: 62910 - DNA, 25 bp, Mus musculus
tgcagaggccggagctgaagtctct

SEQ ID NO: 62911 - DNA, 25 bp, Mus musculus
tgcagagggaaaatccaggcgtgct

SEQ ID NO: 62912 - DNA, 25 bp, Mus musculus
tgcagagggaaattccaggcgtgct

SEQ ID NO: 62913 - DNA, 25 bp, Mus musculus
tgcagagggattttgcagtgactct

SEQ ID NO: 62914 - DNA, 25 bp, Mus musculus
tgcagagtgtcttaagggcattatc

SEQ ID NO: 62915 - DNA, 25 bp, Mus musculus
tgcagagttacgaccttgattatcc

SEQ ID NO: 62916 - DNA, 25 bp, Mus musculus
tgcagatacctgtgaactgtcccta

SEQ ID NO: 62917 - DNA, 25 bp, Mus musculus
tgcagatcagacattccagagacct

SEQ ID NO: 62918 - DNA, 25 bp, Mus musculus
tgcagatcgacaatgccaagctggc

SEQ ID NO: 62919 - DNA, 25 bp, Mus musculus
tgcagatgaccctaagaagtatcaa

SEQ ID NO: 62920 - DNA, 25 bp, Mus musculus
tgcagatgattctctgttgccagcg

SEQ ID NO: 62921 - DNA, 25 bp, Mus musculus
tgcagatgcaaaagtccaggtgctg

SEQ ID NO: 62922 - DNA, 25 bp, Mus musculus
tgcagatgcgggtgttcacctggta

SEQ ID NO: 62923 - DNA, 25 bp, Mus musculus
tgcagatggagagactgaaggccca

SEQ ID NO: 62924 - DNA, 25 bp, Mus musculus
tgcagatggcaatagaggagagcaa

SEQ ID NO: 62925 - DNA, 25 bp, Mus musculus
tgcagatggcagagctcatggtctc

SEQ ID NO: 62926 - DNA, 25 bp, Mus musculus
tgcagatggtcctcaacaacctggt

SEQ ID NO: 62927 - DNA, 25 bp, Mus musculus
tgcagatgtaattggcaacaagact

SEQ ID NO: 62928 - DNA, 25 bp, Mus musculus
tgcagattcggtcctatgtgtacgc

SEQ ID NO: 62929 - DNA, 25 bp, Mus musculus
tgcagattgcgagccggcctaaaag

SEQ ID NO: 62930 - DNA, 25 bp, Mus musculus
tgcagcaaaaagtctgtccccagag

SEQ ID NO: 62931 - DNA, 25 bp, Mus musculus
tgcagcaacaactcctgcaacaagt

SEQ ID NO: 62932 - DNA, 25 bp, Mus musculus
tgcagcaacaccaggcttaggccca

SEQ ID NO: 62933 - DNA, 25 bp, Mus musculus
tgcagcaacacgcagggctcgtacc

SEQ ID NO: 62934 - DNA, 25 bp, Mus musculus
tgcagcaacacggagggctcgtacc

SEQ ID NO: 62935 - DNA, 25 bp, Mus musculus
tgcagcaaccagagccatgtcagtg

SEQ ID NO: 62936 - DNA, 25 bp, Mus musculus
tgcagcaagatgacaagcaaatcct

SEQ ID NO: 62937 - DNA, 25 bp, Mus musculus
tgcagcaatctcaaccctacgctgt

SEQ ID NO: 62938 - DNA, 25 bp, Mus musculus
tgcagcactctgagcacacggtcac

SEQ ID NO: 62939 - DNA, 25 bp, Mus musculus
tgcagcactctgtgcacacggtcac

SEQ ID NO: 62940 - DNA, 25 bp, Mus musculus
tgcagcagaaatggagttcctatcc

SEQ ID NO: 62941 - DNA, 25 bp, Mus musculus
tgcagcagaagctagctggccctcg

SEQ ID NO: 62942 - DNA, 25 bp, Mus musculus
tgcagcagaagctggaggacttccg

SEQ ID NO: 62943 - DNA, 25 bp, Mus musculus
tgcagcagcagatcaccgaggacgt

SEQ ID NO: 62944 - DNA, 25 bp, Mus musculus
tgcagcagccgctgagccagaacca

SEQ ID NO: 62945 - DNA, 25 bp, Mus musculus
tgcagcaggcactccgagccagact

SEQ ID NO: 62946 - DNA, 25 bp, Mus musculus
tgcagcatgctttaatgagcgactg

SEQ ID NO: 62947 - DNA, 25 bp, Mus musculus
tgcagccaagcatagtgtcgacagt

SEQ ID NO: 62948 - DNA, 25 bp, Mus musculus
tgcagccactctcgcgccatgagag

SEQ ID NO: 62949 - DNA, 25 bp, Mus musculus
tgcagccactctggcgccatgagag

SEQ ID NO: 62950 - DNA, 25 bp, Mus musculus
tgcagccaggctgacaggtccttcg

SEQ ID NO: 62951 - DNA, 25 bp, Mus musculus
tgcagccattgtcttcccactcatg

SEQ ID NO: 62952 - DNA, 25 bp, Mus musculus
tgcagcccaaaattcacagcaaaca

SEQ ID NO: 62953 - DNA, 25 bp, Mus musculus
tgcagcccaagaagtataagaaccc

SEQ ID NO: 62954 - DNA, 25 bp, Mus musculus
tgcagcccacgaggggatgagaccc

SEQ ID NO: 62955 - DNA, 25 bp, Mus musculus
tgcagcccactaaacccaggaggcg

SEQ ID NO: 62956 - DNA, 25 bp, Mus musculus
tgcagccccagaaatccgctgctgt

SEQ ID NO: 62957 - DNA, 25 bp, Mus musculus
tgcagccctgaacaacctggaggtg

SEQ ID NO: 62958 - DNA, 25 bp, Mus musculus
tgcagcctgcctacggcggatggac

SEQ ID NO: 62959 - DNA, 25 bp, Mus musculus
tgcagcctgggtctctcacacggca

SEQ ID NO: 62960 - DNA, 25 bp, Mus musculus
tgcagcgaagggaaacaaaagagtt

SEQ ID NO: 62961 - DNA, 25 bp, Mus musculus
tgcagcgcaggctgttgaagatgtt

SEQ ID NO: 62962 - DNA, 25 bp, Mus musculus
tgcagcgtcccatcatgccttgtag

SEQ ID NO: 62963 - DNA, 25 bp, Mus musculus
tgcagcgtgcactgcaagacccctg

SEQ ID NO: 62964 - DNA, 25 bp, Mus musculus
tgcagctagtgactgtctctttctg

SEQ ID NO: 62965 - DNA, 25 bp, Mus musculus
tgcagctatcggctgggctgaccat

SEQ ID NO: 62966 - DNA, 25 bp, Mus musculus
tgcagctcagtcacctcagcagcga

SEQ ID NO: 62967 - DNA, 25 bp, Mus musculus
tgcagctcatctgtggatactgccg

SEQ ID NO: 62968 - DNA, 25 bp, Mus musculus
tgcagctcgtctagcgcaacaggaa

SEQ ID NO: 62969 - DNA, 25 bp, Mus musculus
tgcagctgacgctttcgacattggc

SEQ ID NO: 62970 - DNA, 25 bp, Mus musculus
tgcagctgagaacgaggatgggaac

SEQ ID NO: 62971 - DNA, 25 bp, Mus musculus
tgcagctgatcatgttaagccacct

SEQ ID NO: 62972 - DNA, 25 bp, Mus musculus
tgcagctgcagagtccttggtggac

SEQ ID NO: 62973 - DNA, 25 bp, Mus musculus
tgcagctgcagtatgagaaccgcgt

SEQ ID NO: 62974 - DNA, 25 bp, Mus musculus
tgcagctgccaatcagggtaaaaag

SEQ ID NO: 62975 - DNA, 25 bp, Mus musculus
tgcagctgccccagttccacagctt

SEQ ID NO: 62976 - DNA, 25 bp, Mus musculus
tgcagctgccgccaggtgaagatct

SEQ ID NO: 62977 - DNA, 25 bp, Mus musculus
tgcagctgcggtggactttgtgttt

SEQ ID NO: 62978 - DNA, 25 bp, Mus musculus
tgcagctggacacttgccactgtga

SEQ ID NO: 62979 - DNA, 25 bp, Mus musculus
tgcagctggatatcacggtgaaaca

SEQ ID NO: 62980 - DNA, 25 bp, Mus musculus
tgcagctggatctagcagagataga

SEQ ID NO: 62981 - DNA, 25 bp, Mus musculus
tgcagctggcatgcttaacttcacc

SEQ ID NO: 62982 - DNA, 25 bp, Mus musculus
tgcagctggcccgagagctcaagat

SEQ ID NO: 62983 - DNA, 25 bp, Mus musculus
tgcagctggcttcagaattagccat

SEQ ID NO: 62984 - DNA, 25 bp, Mus musculus
tgcagctgggggactttctcattaa

SEQ ID NO: 62985 - DNA, 25 bp, Mus musculus
tgcagctgggtctcagctcctcgca

SEQ ID NO: 62986 - DNA, 25 bp, Mus musculus
tgcagctgtcttagaggcttctctt

SEQ ID NO: 62987 - DNA, 25 bp, Mus musculus
tgcagctgtggatatctggaatcct

SEQ ID NO: 62988 - DNA, 25 bp, Mus musculus
tgcagctgtgggatactgcgggtca

SEQ ID NO: 62989 - DNA, 25 bp, Mus musculus
tgcagctgttctcagcatgattggg

SEQ ID NO: 62990 - DNA, 25 bp, Mus musculus
tgcagctgttctgagcatgattggg

SEQ ID NO: 62991 - DNA, 25 bp, Mus musculus
tgcaggaagccaaccagagccacca

SEQ ID NO: 62992 - DNA, 25 bp, Mus musculus
tgcaggaatgaggtcctgatttcaa

SEQ ID NO: 62993 - DNA, 25 bp, Mus musculus
tgcaggaccatggagcacagacacc

SEQ ID NO: 62994 - DNA, 25 bp, Mus musculus
tgcaggaccccgagggcaactgtgt

SEQ ID NO: 62995 - DNA, 25 bp, Mus musculus
tgcaggaccgggtgctgatcctaga

SEQ ID NO: 62996 - DNA, 25 bp, Mus musculus
tgcaggacctaaaggatgtgacccg

SEQ ID NO: 62997 - DNA, 25 bp, Mus musculus
tgcaggaccttctgcgtcgcgggct

SEQ ID NO: 62998 - DNA, 25 bp, Mus musculus
tgcaggacgttgtcccaataaccag

SEQ ID NO: 62999 - DNA, 25 bp, Mus musculus
tgcaggagaaacttcagtcttggct

SEQ ID NO: 63000 - DNA, 25 bp, Mus musculus
tgcaggagaccagattcctaagtac

SEQ ID NO: 63001 - DNA, 25 bp, Mus musculus
tgcaggagcggctcagcacagaaag

SEQ ID NO: 63002 - DNA, 25 bp, Mus musculus
tgcaggagtacatcctgatgtgctg

SEQ ID NO: 63003 - DNA, 25 bp, Mus musculus
tgcaggagtttgtgagaccagaaag

SEQ ID NO: 63004 - DNA, 25 bp, Mus musculus
tgcaggatcacatcgagaaaaccct

SEQ ID NO: 63005 - DNA, 25 bp, Mus musculus
tgcaggcattactaaacgaaccacc

SEQ ID NO: 63006 - DNA, 25 bp, Mus musculus
tgcaggccaagctgcccagtgggaa

SEQ ID NO: 63007 - DNA, 25 bp, Mus musculus
tgcaggccagcgtgctaatgatcaa

SEQ ID NO: 63008 - DNA, 25 bp, Mus musculus
tgcaggcccgaaagcggaaatactt

SEQ ID NO: 63009 - DNA, 25 bp, Mus musculus
tgcaggccctgaaagttcaagcaag

SEQ ID NO: 63010 - DNA, 25 bp, Mus musculus
tgcaggcctgcaaactggagtggat

SEQ ID NO: 63011 - DNA, 25 bp, Mus musculus
tgcaggcctggcctcatgctggatc

SEQ ID NO: 63012 - DNA, 25 bp, Mus musculus
tgcaggcctggcgtcatgctggatc

SEQ ID NO: 63013 - DNA, 25 bp, Mus musculus
tgcaggcgaagctacagctgcgcta

SEQ ID NO: 63014 - DNA, 25 bp, Mus musculus
tgcaggcgacttttagccaggacaa

SEQ ID NO: 63015 - DNA, 25 bp, Mus musculus
tgcaggcggcggctgtggaccaggc

SEQ ID NO: 63016 - DNA, 25 bp, Mus musculus
tgcaggctccgcctctataatagcc

SEQ ID NO: 63017 - DNA, 25 bp, Mus musculus
tgcaggctgtgtacacgctgcctca

SEQ ID NO: 63018 - DNA, 25 bp, Mus musculus
tgcaggctgtgttcacgctgcctca

SEQ ID NO: 63019 - DNA, 25 bp, Mus musculus
tgcagggaactcaacctaggacttc

SEQ ID NO: 63020 - DNA, 25 bp, Mus musculus
tgcagggaatggaacaattatatac

SEQ ID NO: 63021 - DNA, 25 bp, Mus musculus
tgcagggacctggacccagtcagct

SEQ ID NO: 63022 - DNA, 25 bp, Mus musculus
tgcagggcaatgtcattccaaaccc

SEQ ID NO: 63023 - DNA, 25 bp, Mus musculus
tgcaggggtcctcgctgcccagact

SEQ ID NO: 63024 - DNA, 25 bp, Mus musculus
tgcagggtgacaccggacctcttgt

SEQ ID NO: 63025 - DNA, 25 bp, Mus musculus
tgcaggtcatctcagtactacaatg

SEQ ID NO: 63026 - DNA, 25 bp, Mus musculus
tgcaggtcctggtgtcttcgtcgcg

SEQ ID NO: 63027 - DNA, 25 bp, Mus musculus
tgcaggtgaacaaggacccagaggt

SEQ ID NO: 63028 - DNA, 25 bp, Mus musculus
tgcaggtgaaccacgagaagagtca

SEQ ID NO: 63029 - DNA, 25 bp, Mus musculus
tgcaggtgcaaatggatgtgctcac

SEQ ID NO: 63030 - DNA, 25 bp, Mus musculus
tgcaggtgcacttcaagattcacgg

SEQ ID NO: 63031 - DNA, 25 bp, Mus musculus
tgcaggtggttcaggacccggcaac

SEQ ID NO: 63032 - DNA, 25 bp, Mus musculus
tgcaggtgtgcagcggcaaactgct

SEQ ID NO: 63033 - DNA, 25 bp, Mus musculus
tgcaggtgtgggtgacctttatctc

SEQ ID NO: 63034 - DNA, 25 bp, Mus musculus
tgcaggtgttcttactgatggagca

SEQ ID NO: 63035 - DNA, 25 bp, Mus musculus
tgcaggttctggactatgcccatcg

SEQ ID NO: 63036 - DNA, 25 bp, Mus musculus
tgcagtaacttctgccaaggtggct

SEQ ID NO: 63037 - DNA, 25 bp, Mus musculus
tgcagtaatgaatggaagaattcac

SEQ ID NO: 63038 - DNA, 25 bp, Mus musculus
tgcagtaatggatgctccgcgccgt

SEQ ID NO: 63039 - DNA, 25 bp, Mus musculus
tgcagtacacctatgaggaacgcag

SEQ ID NO: 63040 - DNA, 25 bp, Mus musculus
tgcagtaccttccatgagtgctacg

SEQ ID NO: 63041 - DNA, 25 bp, Mus musculus
tgcagtactcggctgccctgaatgc

SEQ ID NO: 63042 - DNA, 25 bp, Mus musculus
tgcagtattactgctagagtcacag

SEQ ID NO: 63043 - DNA, 25 bp, Mus musculus
tgcagtattgacctggagattgact

SEQ ID NO: 63044 - DNA, 25 bp, Mus musculus
tgcagtcagtcaacgtcggcctttt

SEQ ID NO: 63045 - DNA, 25 bp, Mus musculus
tgcagtcatagcctggccttcccag

SEQ ID NO: 63046 - DNA, 25 bp, Mus musculus
tgcagtcatcgcctaagaccacgga

SEQ ID NO: 63047 - DNA, 25 bp, Mus musculus
tgcagtccagtttgccagtctttct

SEQ ID NO: 63048 - DNA, 25 bp, Mus musculus
tgcagtcctggctattccagagctt

SEQ ID NO: 63049 - DNA, 25 bp, Mus musculus
tgcagtctcccttcagagcgaactc

SEQ ID NO: 63050 - DNA, 25 bp, Mus musculus
tgcagtgacaggaaatggattggcc

SEQ ID NO: 63051 - DNA, 25 bp, Mus musculus
tgcagtgacaggtaatggattggcc

SEQ ID NO: 63052 - DNA, 25 bp, Mus musculus
tgcagtgactcttgagctgggcgcc

SEQ ID NO: 63053 - DNA, 25 bp, Mus musculus
tgcagtgagagccaaccagagctgc

SEQ ID NO: 63054 - DNA, 25 bp, Mus musculus
tgcagtgagcactactcggagaccc

SEQ ID NO: 63055 - DNA, 25 bp, Mus musculus
tgcagtgatggtgacctgggccacc

SEQ ID NO: 63056 - DNA, 25 bp, Mus musculus
tgcagtgcccatgatcacaggtgcc

SEQ ID NO: 63057 - DNA, 25 bp, Mus musculus
tgcagtggacactgatgagatccca

SEQ ID NO: 63058 - DNA, 25 bp, Mus musculus
tgcagtggaggattacttcatcgcc

SEQ ID NO: 63059 - DNA, 25 bp, Mus musculus
tgcagtggcagtcttccatctgagc

SEQ ID NO: 63060 - DNA, 25 bp, Mus musculus
tgcagtggcctgtattacggagaca

SEQ ID NO: 63061 - DNA, 25 bp, Mus musculus
tgcagtgggaagtaacattgtggtt

SEQ ID NO: 63062 - DNA, 25 bp, Mus musculus
tgcagtgtagttggccaacaagcaa

SEQ ID NO: 63063 - DNA, 25 bp, Mus musculus
tgcagtgtatagtcaagccagcgcc

SEQ ID NO: 63064 - DNA, 25 bp, Mus musculus
tgcagttacaaaacatcggtgggcg

SEQ ID NO: 63065 - DNA, 25 bp, Mus musculus
tgcagttatctgtccagaaaccaga

SEQ ID NO: 63066 - DNA, 25 bp, Mus musculus
tgcagttccttttagataaccaaca

SEQ ID NO: 63067 - DNA, 25 bp, Mus musculus
tgcagttgaccaagcaggtggtgca

SEQ ID NO: 63068 - DNA, 25 bp, Mus musculus
tgcagttgatcaagagactgggaaa

SEQ ID NO: 63069 - DNA, 25 bp, Mus musculus
tgcagttgccttacaggaccaccta

SEQ ID NO: 63070 - DNA, 25 bp, Mus musculus
tgcagttggtgctggccccactgca

SEQ ID NO: 63071 - DNA, 25 bp, Mus musculus
tgcagtttggtagtgccagtggccc

SEQ ID NO: 63072 - DNA, 25 bp, Mus musculus
tgcagttttatagatcagagtggac

SEQ ID NO: 63073 - DNA, 25 bp, Mus musculus
tgcataaatggaagcagggtaccgc

SEQ ID NO: 63074 - DNA, 25 bp, Mus musculus
tgcatacagccatacttccaactga

SEQ ID NO: 63075 - DNA, 25 bp, Mus musculus
tgcatacagtctgccgggtgtggcc

SEQ ID NO: 63076 - DNA, 25 bp, Mus musculus
tgcatacatcccagggacttgggca

SEQ ID NO: 63077 - DNA, 25 bp, Mus musculus
tgcatactgttagcactagttaaga

SEQ ID NO: 63078 - DNA, 25 bp, Mus musculus
tgcatagcgtaagctcttccttgga

SEQ ID NO: 63079 - DNA, 25 bp, Mus musculus
tgcatatcccaaaagtgagatgatc

SEQ ID NO: 63080 - DNA, 25 bp, Mus musculus
tgcatatcttaaggaatggttgtgg

SEQ ID NO: 63081 - DNA, 25 bp, Mus musculus
tgcatatggagttgaaaatgctttc

SEQ ID NO: 63082 - DNA, 25 bp, Mus musculus
tgcatatggtactcccattcagctg

SEQ ID NO: 63083 - DNA, 25 bp, Mus musculus
tgcatcaaatttggctgcagccagg

SEQ ID NO: 63084 - DNA, 25 bp, Mus musculus
tgcatcagccctaccttcatctgtg

SEQ ID NO: 63085 - DNA, 25 bp, Mus musculus
tgcatcagcgggtcaacattgtgcc

SEQ ID NO: 63086 - DNA, 25 bp, Mus musculus
tgcatcagggatgaacatttgagac

SEQ ID NO: 63087 - DNA, 25 bp, Mus musculus
tgcatcagggatggccatagaacag

SEQ ID NO: 63088 - DNA, 25 bp, Mus musculus
tgcatcataagggacaaccaggtgg

SEQ ID NO: 63089 - DNA, 25 bp, Mus musculus
tgcatcatgctcacagtggtctgta

SEQ ID NO: 63090 - DNA, 25 bp, Mus musculus
tgcatcattcccaacgagcgaaagg

SEQ ID NO: 63091 - DNA, 25 bp, Mus musculus
tgcatccagctaaccatgggaccgt

SEQ ID NO: 63092 - DNA, 25 bp, Mus musculus
tgcatccaggacaccggcgtgcagg

SEQ ID NO: 63093 - DNA, 25 bp, Mus musculus
tgcatccatactgtgctcaaggaag

SEQ ID NO: 63094 - DNA, 25 bp, Mus musculus
tgcatcccctcagcaattgtgagct

SEQ ID NO: 63095 - DNA, 25 bp, Mus musculus
tgcatcccgttacaagaagtttgat

SEQ ID NO: 63096 - DNA, 25 bp, Mus musculus
tgcatcccgttagaagaagtttgat

SEQ ID NO: 63097 - DNA, 25 bp, Mus musculus
tgcatcctcagcctcttccaaatga

SEQ ID NO: 63098 - DNA, 25 bp, Mus musculus
tgcatccttctgaagaggggacctt

SEQ ID NO: 63099 - DNA, 25 bp, Mus musculus
tgcatccttttctagtactcttgag

SEQ ID NO: 63100 - DNA, 25 bp, Mus musculus
tgcatcgaaaggcaacctccgggaa

SEQ ID NO: 63101 - DNA, 25 bp, Mus musculus
tgcatcgtcaacaactccaatggct

SEQ ID NO: 63102 - DNA, 25 bp, Mus musculus
tgcatcgtggcttgctaggctcgag

SEQ ID NO: 63103 - DNA, 25 bp, Mus musculus
tgcatctattcaagccgtaaccgag

SEQ ID NO: 63104 - DNA, 25 bp, Mus musculus
tgcatctcatccacaactaacgtga

SEQ ID NO: 63105 - DNA, 25 bp, Mus musculus
tgcatctccgagtttgctgcggagg

SEQ ID NO: 63106 - DNA, 25 bp, Mus musculus
tgcatctgagcctgtgataccctcc

SEQ ID NO: 63107 - DNA, 25 bp, Mus musculus
tgcatctgatgctgtgactccagga

SEQ ID NO: 63108 - DNA, 25 bp, Mus musculus
tgcatctggagtgcactaataccgc

SEQ ID NO: 63109 - DNA, 25 bp, Mus musculus
tgcatctgtcagaacttcctcaact

SEQ ID NO: 63110 - DNA, 25 bp, Mus musculus
tgcatctgtcgtcaaggctggaaac

SEQ ID NO: 63111 - DNA, 25 bp, Mus musculus
tgcatcttaacagaaatacagagga

SEQ ID NO: 63112 - DNA, 25 bp, Mus musculus
tgcatgaccagtgaagaaatgccat

SEQ ID NO: 63113 - DNA, 25 bp, Mus musculus
tgcatgactaagagaagaaaccact

SEQ ID NO: 63114 - DNA, 25 bp, Mus musculus
tgcatgactgtacagcaggcgctct

SEQ ID NO: 63115 - DNA, 25 bp, Mus musculus
tgcatgagaaaacatggcatccaca

SEQ ID NO: 63116 - DNA, 25 bp, Mus musculus
tgcatgagaagaccccagtgagtga

SEQ ID NO: 63117 - DNA, 25 bp, Mus musculus
tgcatgagaagacccgtttctatct

SEQ ID NO: 63118 - DNA, 25 bp, Mus musculus
tgcatgagtacagccgagtgataac

SEQ ID NO: 63119 - DNA, 25 bp, Mus musculus
tgcatgatccggagacacttgtctg

SEQ ID NO: 63120 - DNA, 25 bp, Mus musculus
tgcatgatgcagctctgatttcttg

SEQ ID NO: 63121 - DNA, 25 bp, Mus musculus
tgcatgatgcccgttcctgatggga

SEQ ID NO: 63122 - DNA, 25 bp, Mus musculus
tgcatgatgcgatcggtatttaccc

SEQ ID NO: 63123 - DNA, 25 bp, Mus musculus
tgcatgatggtctccgccgctactt

SEQ ID NO: 63124 - DNA, 25 bp, Mus musculus
tgcatgcacatacaacatgaagaaa

SEQ ID NO: 63125 - DNA, 25 bp, Mus musculus
tgcatgcagtcagggcgggactact

SEQ ID NO: 63126 - DNA, 25 bp, Mus musculus
tgcatgccatgaagatacttccaag

SEQ ID NO: 63127 - DNA, 25 bp, Mus musculus
tgcatgccgagctaggcattaagcc

SEQ ID NO: 63128 - DNA, 25 bp, Mus musculus
tgcatgctgtaccatctcccaacta

SEQ ID NO: 63129 - DNA, 25 bp, Mus musculus
tgcatgcttcctactaccacaaggc

SEQ ID NO: 63130 - DNA, 25 bp, Mus musculus
tgcatggccatcattagcagctcct

SEQ ID NO: 63131 - DNA, 25 bp, Mus musculus
tgcatggccatctgctcgcgccagt

SEQ ID NO: 63132 - DNA, 25 bp, Mus musculus
tgcatggcccgtctgaagacaatcc

SEQ ID NO: 63133 - DNA, 25 bp, Mus musculus
tgcatggcgtctaatgagcaggaca

SEQ ID NO: 63134 - DNA, 25 bp, Mus musculus
tgcatgtaagctcgctcgtcgttgg

SEQ ID NO: 63135 - DNA, 25 bp, Mus musculus
tgcatgtcaccctgtgtgggacccc

SEQ ID NO: 63136 - DNA, 25 bp, Mus musculus
tgcatgtctgcgaccccagccaggg

SEQ ID NO: 63137 - DNA, 25 bp, Mus musculus
tgcatgtctgcgtccccagccaggg

SEQ ID NO: 63138 - DNA, 25 bp, Mus musculus
tgcatgtggacgtcccaaaggatgt

SEQ ID NO: 63139 - DNA, 25 bp, Mus musculus
tgcatgtggatcctgagaacttcag

SEQ ID NO: 63140 - DNA, 25 bp, Mus musculus
tgcatgtggctgaggatgtcatcaa

SEQ ID NO: 63141 - DNA, 25 bp, Mus musculus
tgcatgtggctgtggatgtcatcaa

SEQ ID NO: 63142 - DNA, 25 bp, Mus musculus
tgcattaactactacccactgcaca

SEQ ID NO: 63143 - DNA, 25 bp, Mus musculus
tgcattacaacatgggtgggattcc

SEQ ID NO: 63144 - DNA, 25 bp, Mus musculus
tgcattactgcggatggaatgtgag

SEQ ID NO: 63145 - DNA, 25 bp, Mus musculus
tgcattatgcctgcataccaagaag

SEQ ID NO: 63146 - DNA, 25 bp, Mus musculus
tgcattatgtctggagcccgcactg

SEQ ID NO: 63147 - DNA, 25 bp, Mus musculus
tgcattcatatctcaccaggctcat

SEQ ID NO: 63148 - DNA, 25 bp, Mus musculus
tgcattcattcatcaaccaatcaag

SEQ ID NO: 63149 - DNA, 25 bp, Mus musculus
tgcattccagtgacatcttcagtgg

SEQ ID NO: 63150 - DNA, 25 bp, Mus musculus
tgcattcccaacatagtagtttgaa

SEQ ID NO: 63151 - DNA, 25 bp, Mus musculus
tgcattgagtgctgcgccctggaga

SEQ ID NO: 63152 - DNA, 25 bp, Mus musculus
tgcattgccctgtccctatacgagg

SEQ ID NO: 63153 - DNA, 25 bp, Mus musculus
tgcattggggccctccgggaaaaca

SEQ ID NO: 63154 - DNA, 25 bp, Mus musculus
tgcattgtaaggctggtcgatccag

SEQ ID NO: 63155 - DNA, 25 bp, Mus musculus
tgcatttaggagagacattatcaga

SEQ ID NO: 63156 - DNA, 25 bp, Mus musculus
tgcatttagtactgagtcaccacag

SEQ ID NO: 63157 - DNA, 25 bp, Mus musculus
tgcatttccctagcgttctggatta

SEQ ID NO: 63158 - DNA, 25 bp, Mus musculus
tgcatttgtctcagctgctggttga

SEQ ID NO: 63159 - DNA, 25 bp, Mus musculus
tgcatttgtctctgctgctggttga

SEQ ID NO: 63160 - DNA, 25 bp, Mus musculus
tgcattttctggaaacaaatgggaa

SEQ ID NO: 63161 - DNA, 25 bp, Mus musculus
tgcattttgcagaggcatcagaaaa

SEQ ID NO: 63162 - DNA, 25 bp, Mus musculus
tgccaaaaactgcagaacagactgg

SEQ ID NO: 63163 - DNA, 25 bp, Mus musculus
tgccaaaaagagtgagcttatcctg

SEQ ID NO: 63164 - DNA, 25 bp, Mus musculus
tgccaaaagcctattgaacaagaag

SEQ ID NO: 63165 - DNA, 25 bp, Mus musculus
tgccaaaaggaaacagacttctctg

SEQ ID NO: 63166 - DNA, 25 bp, Mus musculus
tgccaaagaaggacacgacagaatc

SEQ ID NO: 63167 - DNA, 25 bp, Mus musculus
tgccaaagaccttgaaatgtttgcc

SEQ ID NO: 63168 - DNA, 25 bp, Mus musculus
tgccaaagacttgcctcctgatgca

SEQ ID NO: 63169 - DNA, 25 bp, Mus musculus
tgccaaagcaagtgctaagacaggc

SEQ ID NO: 63170 - DNA, 25 bp, Mus musculus
tgccaaagccagcaactctgggaaa

SEQ ID NO: 63171 - DNA, 25 bp, Mus musculus
tgccaaagcccacatagagaaggtg

SEQ ID NO: 63172 - DNA, 25 bp, Mus musculus
tgccaaaggcaaaggtgcaagatac

SEQ ID NO: 63173 - DNA, 25 bp, Mus musculus
tgccaaaggcaagatgaacctgctt

SEQ ID NO: 63174 - DNA, 25 bp, Mus musculus
tgccaaaggccggaaagataccttc

SEQ ID NO: 63175 - DNA, 25 bp, Mus musculus
tgccaaagggtaagacggccgagct

SEQ ID NO: 63176 - DNA, 25 bp, Mus musculus
tgccaaatccaggatgtccccgagt

SEQ ID NO: 63177 - DNA, 25 bp, Mus musculus
tgccaaatccccagcctgaatggtg

SEQ ID NO: 63178 - DNA, 25 bp, Mus musculus
tgccaaatcccctgcctgaatggtg

SEQ ID NO: 63179 - DNA, 25 bp, Mus musculus
tgccaaatccgactgatgtgtgtga

SEQ ID NO: 63180 - DNA, 25 bp, Mus musculus
tgccaaatccgagtgatgtgtgtga

SEQ ID NO: 63181 - DNA, 25 bp, Mus musculus
tgccaaatgggataacattgccggt

SEQ ID NO: 63182 - DNA, 25 bp, Mus musculus
tgccaacaacattgccaatgcaagg

SEQ ID NO: 63183 - DNA, 25 bp, Mus musculus
tgccaacacaaacacctgtaataag

SEQ ID NO: 63184 - DNA, 25 bp, Mus musculus
tgccaacacattcagctcccagatg

SEQ ID NO: 63185 - DNA, 25 bp, Mus musculus
tgccaacagctgagagaagggtgac

SEQ ID NO: 63186 - DNA, 25 bp, Mus musculus
tgccaacagctgtgagaagggtgac

SEQ ID NO: 63187 - DNA, 25 bp, Mus musculus
tgccaacatcgagtctataaatttg

SEQ ID NO: 63188 - DNA, 25 bp, Mus musculus
tgccaaccggatctgcaaggtgctg

SEQ ID NO: 63189 - DNA, 25 bp, Mus musculus
tgccaacctctgacaaaggccgctt

SEQ ID NO: 63190 - DNA, 25 bp, Mus musculus
tgccaacgagaaagctgacagtgcc

SEQ ID NO: 63191 - DNA, 25 bp, Mus musculus
tgccaacgagaatgctgacagtgcc

SEQ ID NO: 63192 - DNA, 25 bp, Mus musculus
tgccaacgctcccaatgccatgaaa

SEQ ID NO: 63193 - DNA, 25 bp, Mus musculus
tgccaactcgtttgctgtcacgtgc

SEQ ID NO: 63194 - DNA, 25 bp, Mus musculus
tgccaactggctcaaaatagacccc

SEQ ID NO: 63195 - DNA, 25 bp, Mus musculus
tgccaactggctgaaaatagacccc

SEQ ID NO: 63196 - DNA, 25 bp, Mus musculus
tgccaacttcgatgccttcagcagc

SEQ ID NO: 63197 - DNA, 25 bp, Mus musculus
tgccaacttctcacagagctgtacc

SEQ ID NO: 63198 - DNA, 25 bp, Mus musculus
tgccaactttgagaacttatctgaa

SEQ ID NO: 63199 - DNA, 25 bp, Mus musculus
tgccaagagcagagtggtggttaca

SEQ ID NO: 63200 - DNA, 25 bp, Mus musculus
tgccaagccaaactccaggacattc

SEQ ID NO: 63201 - DNA, 25 bp, Mus musculus
tgccaagcctatccttccggtgcag

SEQ ID NO: 63202 - DNA, 25 bp, Mus musculus
tgccaaggataaggcctgacactga

SEQ ID NO: 63203 - DNA, 25 bp, Mus musculus
tgccaaggatttcagccccataaac

SEQ ID NO: 63204 - DNA, 25 bp, Mus musculus
tgccaagggctatagaagtgtgcat

SEQ ID NO: 63205 - DNA, 25 bp, Mus musculus
tgccaaggttccaaagggtgccctg

SEQ ID NO: 63206 - DNA, 25 bp, Mus musculus
tgccaagtccgtgaatgggaaagag

SEQ ID NO: 63207 - DNA, 25 bp, Mus musculus
tgccaagtgtggacagaggagcctc

SEQ ID NO: 63208 - DNA, 25 bp, Mus musculus
tgccaagtttggtgagtaccccgaa

SEQ ID NO: 63209 - DNA, 25 bp, Mus musculus
tgccaatcaccaaagaaggccctcg

SEQ ID NO: 63210 - DNA, 25 bp, Mus musculus
tgccaatcagggtaaaaagtcagag

SEQ ID NO: 63211 - DNA, 25 bp, Mus musculus
tgccaatggcacttccagcatgatt

SEQ ID NO: 63212 - DNA, 25 bp, Mus musculus
tgccaatggccacctgatgtccaac

SEQ ID NO: 63213 - DNA, 25 bp, Mus musculus
tgccaatggccagctgatgtccaac

SEQ ID NO: 63214 - DNA, 25 bp, Mus musculus
tgccaatgggaacatccaatgcctg

SEQ ID NO: 63215 - DNA, 25 bp, Mus musculus
tgccacaaaaactggtctccccaag

SEQ ID NO: 63216 - DNA, 25 bp, Mus musculus
tgccacaacactctcggaagctatt

SEQ ID NO: 63217 - DNA, 25 bp, Mus musculus
tgccacaagttcgagaagaagaccg

SEQ ID NO: 63218 - DNA, 25 bp, Mus musculus
tgccacaatctctccaggaatggca

SEQ ID NO: 63219 - DNA, 25 bp, Mus musculus
tgccacacactaaagagcaacagag

SEQ ID NO: 63220 - DNA, 25 bp, Mus musculus
tgccacaccaaaaagcaacgacagc

SEQ ID NO: 63221 - DNA, 25 bp, Mus musculus
tgccacacccagattctccgtgggt

SEQ ID NO: 63222 - DNA, 25 bp, Mus musculus
tgccacacttgtgctgaccagtgat

SEQ ID NO: 63223 - DNA, 25 bp, Mus musculus
tgccacaggattaaacaatggtcgc

SEQ ID NO: 63224 - DNA, 25 bp, Mus musculus
tgccacagtccctaaagataccaga

SEQ ID NO: 63225 - DNA, 25 bp, Mus musculus
tgccacatcaggttcccaggtggtg

SEQ ID NO: 63226 - DNA, 25 bp, Mus musculus
tgccaccaaagaccaaaaacgaaga

SEQ ID NO: 63227 - DNA, 25 bp, Mus musculus
tgccaccaaagagcaaaaacgaaga

SEQ ID NO: 63228 - DNA, 25 bp, Mus musculus
tgccaccagccacgtatgacggtgc

SEQ ID NO: 63229 - DNA, 25 bp, Mus musculus
tgccaccagtgaccggaaatgcgag

SEQ ID NO: 63230 - DNA, 25 bp, Mus musculus
tgccacccctcaaaaaacagccttg

SEQ ID NO: 63231 - DNA, 25 bp, Mus musculus
tgccaccctggctttgagctaggag

SEQ ID NO: 63232 - DNA, 25 bp, Mus musculus
tgccaccgcagcattagagagactg

SEQ ID NO: 63233 - DNA, 25 bp, Mus musculus
tgccaccgcagtggcctgctggaga

SEQ ID NO: 63234 - DNA, 25 bp, Mus musculus
tgccaccgctccacggagggcatga

SEQ ID NO: 63235 - DNA, 25 bp, Mus musculus
tgccaccggcttatggaccatggga

SEQ ID NO: 63236 - DNA, 25 bp, Mus musculus
tgccaccgtcgctgtgtctggagcc

SEQ ID NO: 63237 - DNA, 25 bp, Mus musculus
tgccacctcttttatgacagtgctc

SEQ ID NO: 63238 - DNA, 25 bp, Mus musculus
tgccacctgatgtccgcgagacact

SEQ ID NO: 63239 - DNA, 25 bp, Mus musculus
tgccacctgtgtgctagcagagcag

SEQ ID NO: 63240 - DNA, 25 bp, Mus musculus
tgccaccttacaccatcgtctattt

SEQ ID NO: 63241 - DNA, 25 bp, Mus musculus
tgccaccttcgatggaacgcacagg

SEQ ID NO: 63242 - DNA, 25 bp, Mus musculus
tgccacggtcctggacctgaagaag

SEQ ID NO: 63243 - DNA, 25 bp, Mus musculus
tgccactaaatatttcctgcagcca

SEQ ID NO: 63244 - DNA, 25 bp, Mus musculus
tgccactagaccagcctgaactgag

SEQ ID NO: 63245 - DNA, 25 bp, Mus musculus
tgccactccctgtgggatgacttct

SEQ ID NO: 63246 - DNA, 25 bp, Mus musculus
tgccactgactgtactgcaaaagaa

SEQ ID NO: 63247 - DNA, 25 bp, Mus musculus
tgccactgtccactgaaattcatca

SEQ ID NO: 63248 - DNA, 25 bp, Mus musculus
tgccacttcctgcaaacagcaagat

SEQ ID NO: 63249 - DNA, 25 bp, Mus musculus
tgccagaaacaagcctgtgaaatac

SEQ ID NO: 63250 - DNA, 25 bp, Mus musculus
tgccagaacaccaagggctccttct

SEQ ID NO: 63251 - DNA, 25 bp, Mus musculus
tgccagaactgagtgtggctcagca

SEQ ID NO: 63252 - DNA, 25 bp, Mus musculus
tgccagaaggcgaaggtctccttct

SEQ ID NO: 63253 - DNA, 25 bp, Mus musculus
tgccagaagtgaaccatgaaggacc

SEQ ID NO: 63254 - DNA, 25 bp, Mus musculus
tgccagacaagagccatgaagatcc

SEQ ID NO: 63255 - DNA, 25 bp, Mus musculus
tgccagaccagagctatttgccaaa

SEQ ID NO: 63256 - DNA, 25 bp, Mus musculus
tgccagaccggcacggatgaaaacc

SEQ ID NO: 63257 - DNA, 25 bp, Mus musculus
tgccagacctaaagaatgtcaggtc

SEQ ID NO: 63258 - DNA, 25 bp, Mus musculus
tgccagacgagtatggatgaactcc

SEQ ID NO: 63259 - DNA, 25 bp, Mus musculus
tgccagagaaagacagccccatata

SEQ ID NO: 63260 - DNA, 25 bp, Mus musculus
tgccagagaaatatccctctgctgt

SEQ ID NO: 63261 - DNA, 25 bp, Mus musculus
tgccagagacaggaagtgacatcgc

SEQ ID NO: 63262 - DNA, 25 bp, Mus musculus
tgccagagagcttggctggttctcc

SEQ ID NO: 63263 - DNA, 25 bp, Mus musculus
tgccagagccctgatgagacttcag

SEQ ID NO: 63264 - DNA, 25 bp, Mus musculus
tgccagagcggcgaacatgttcaag

SEQ ID NO: 63265 - DNA, 25 bp, Mus musculus
tgccagaggatgacgagaggcctcc

SEQ ID NO: 63266 - DNA, 25 bp, Mus musculus
tgccagaggctccaaaagcaaataa

SEQ ID NO: 63267 - DNA, 25 bp, Mus musculus
tgccagagtacccaatagcaatcct

SEQ ID NO: 63268 - DNA, 25 bp, Mus musculus
tgccagagtgcttgtggaggactac

SEQ ID NO: 63269 - DNA, 25 bp, Mus musculus
tgccagagtggttgcctttgaaagt

SEQ ID NO: 63270 - DNA, 25 bp, Mus musculus
tgccagatagcccatgaccatacag

SEQ ID NO: 63271 - DNA, 25 bp, Mus musculus
tgccagatgtgtgtcccaaggaacc

SEQ ID NO: 63272 - DNA, 25 bp, Mus musculus
tgccagattatctcggagccttgct

SEQ ID NO: 63273 - DNA, 25 bp, Mus musculus
tgccagcaatttcgtgtgagagact

SEQ ID NO: 63274 - DNA, 25 bp, Mus musculus
tgccagcaccacatgatcagctttg

SEQ ID NO: 63275 - DNA, 25 bp, Mus musculus
tgccagcactgagggtttacaagct

SEQ ID NO: 63276 - DNA, 25 bp, Mus musculus
tgccagcactgataacactgtcatg

SEQ ID NO: 63277 - DNA, 25 bp, Mus musculus
tgccagcagaagagtcaggaagttt

SEQ ID NO: 63278 - DNA, 25 bp, Mus musculus
tgccagcagcagagggaccttcgag

SEQ ID NO: 63279 - DNA, 25 bp, Mus musculus
tgccagcaggtcaaagaaacccctc

SEQ ID NO: 63280 - DNA, 25 bp, Mus musculus
tgccagcagtcctgtcagcaacagt

SEQ ID NO: 63281 - DNA, 25 bp, Mus musculus
tgccagcccaacaccatctttggag

SEQ ID NO: 63282 - DNA, 25 bp, Mus musculus
tgccagcccaactccatctttggag

SEQ ID NO: 63283 - DNA, 25 bp, Mus musculus
tgccagccgtactattcacaacact

SEQ ID NO: 63284 - DNA, 25 bp, Mus musculus
tgccagcctcagtgagctccactgt

SEQ ID NO: 63285 - DNA, 25 bp, Mus musculus
tgccagctacgtccctgaaatcata

SEQ ID NO: 63286 - DNA, 25 bp, Mus musculus
tgccaggaacaaaaagacaccagtt

SEQ ID NO: 63287 - DNA, 25 bp, Mus musculus
tgccaggaacagcatacaaagttcg

SEQ ID NO: 63288 - DNA, 25 bp, Mus musculus
tgccaggacctgtgtgagctgcaaa

SEQ ID NO: 63289 - DNA, 25 bp, Mus musculus
tgccaggatcctatgctgcagtgag

SEQ ID NO: 63290 - DNA, 25 bp, Mus musculus
tgccaggatggcaggcatcatctga

SEQ ID NO: 63291 - DNA, 25 bp, Mus musculus
tgccaggccaggcatgcccatgtgc

SEQ ID NO: 63292 - DNA, 25 bp, Mus musculus
tgccaggcgtctctttgagctctgc

SEQ ID NO: 63293 - DNA, 25 bp, Mus musculus
tgccaggctcagagaaggacaatga

SEQ ID NO: 63294 - DNA, 25 bp, Mus musculus
tgccaggctgacttctagagtctgt

SEQ ID NO: 63295 - DNA, 25 bp, Mus musculus
tgccagggtccgagtcactccagaa

SEQ ID NO: 63296 - DNA, 25 bp, Mus musculus
tgccaggtaggagccaatgctctgt

SEQ ID NO: 63297 - DNA, 25 bp, Mus musculus
tgccaggtttggtgagcagactgtc

SEQ ID NO: 63298 - DNA, 25 bp, Mus musculus
tgccagtaattctcagccatcagct

SEQ ID NO: 63299 - DNA, 25 bp, Mus musculus
tgccagtacattcaggcttctaaag

SEQ ID NO: 63300 - DNA, 25 bp, Mus musculus
tgccagtaggtgaggcatgagcacc

SEQ ID NO: 63301 - DNA, 25 bp, Mus musculus
tgccagtccctgctgagagtactgt

SEQ ID NO: 63302 - DNA, 25 bp, Mus musculus
tgccagtctggaggctaccgttgac

SEQ ID NO: 63303 - DNA, 25 bp, Mus musculus
tgccagtgagctttgttgccagtcc

SEQ ID NO: 63304 - DNA, 25 bp, Mus musculus
tgccagtgctgaatatcccaagaac

SEQ ID NO: 63305 - DNA, 25 bp, Mus musculus
tgccagtggattcatattacagatg

SEQ ID NO: 63306 - DNA, 25 bp, Mus musculus
tgccagtggattgatattacagatg

SEQ ID NO: 63307 - DNA, 25 bp, Mus musculus
tgccagtggccaggatatccagctg

SEQ ID NO: 63308 - DNA, 25 bp, Mus musculus
tgccagtgttgtggtctccttcttc

SEQ ID NO: 63309 - DNA, 25 bp, Mus musculus
tgccagttcataacgtccgtgaccg

SEQ ID NO: 63310 - DNA, 25 bp, Mus musculus
tgccagttcctctcggagtgcctca

SEQ ID NO: 63311 - DNA, 25 bp, Mus musculus
tgccataaacagatcaaccgccttg

SEQ ID NO: 63312 - DNA, 25 bp, Mus musculus
tgccataaagttggagcggatgctc

SEQ ID NO: 63313 - DNA, 25 bp, Mus musculus
tgccataattagacacagccatgac

SEQ ID NO: 63314 - DNA, 25 bp, Mus musculus
tgccataattagtcacagccatgac

SEQ ID NO: 63315 - DNA, 25 bp, Mus musculus
tgccatagcaattagtgggaacctt

SEQ ID NO: 63316 - DNA, 25 bp, Mus musculus
tgccataggcaaacactggagctgt

SEQ ID NO: 63317 - DNA, 25 bp, Mus musculus
tgccatattcattcatccagtgatg

SEQ ID NO: 63318 - DNA, 25 bp, Mus musculus
tgccatcaaacctgacgcccagagt

SEQ ID NO: 63319 - DNA, 25 bp, Mus musculus
tgccatcaaagtgctaagaaaaaac

SEQ ID NO: 63320 - DNA, 25 bp, Mus musculus
tgccatcaagtgttgcaggagaaac

SEQ ID NO: 63321 - DNA, 25 bp, Mus musculus
tgccatcaatgagtatctccagagg

SEQ ID NO: 63322 - DNA, 25 bp, Mus musculus
tgccatcagcgtctcgtgactcgca

SEQ ID NO: 63323 - DNA, 25 bp, Mus musculus
tgccatcatgattgtgaggagggcc

SEQ ID NO: 63324 - DNA, 25 bp, Mus musculus
tgccatccaaatactgtgacttgct

SEQ ID NO: 63325 - DNA, 25 bp, Mus musculus
tgccatccacaaatgcagagctgag

SEQ ID NO: 63326 - DNA, 25 bp, Mus musculus
tgccatcgatccaacggtaccaaca

SEQ ID NO: 63327 - DNA, 25 bp, Mus musculus
tgccatcttcaaaatatcaggtctt

SEQ ID NO: 63328 - DNA, 25 bp, Mus musculus
tgccatgaagagtcaggtggacaag

SEQ ID NO: 63329 - DNA, 25 bp, Mus musculus
tgccatgaagatacttccaagatga

SEQ ID NO: 63330 - DNA, 25 bp, Mus musculus
tgccatgactgtgtcagagtgatcc

SEQ ID NO: 63331 - DNA, 25 bp, Mus musculus
tgccatgcagtgtgatccgacccat

SEQ ID NO: 63332 - DNA, 25 bp, Mus musculus
tgccatgccccacattcctgaggat

SEQ ID NO: 63333 - DNA, 25 bp, Mus musculus
tgccatgctagcctgtctcccagga

SEQ ID NO: 63334 - DNA, 25 bp, Mus musculus
tgccatggattggttcatagctgtc

SEQ ID NO: 63335 - DNA, 25 bp, Mus musculus
tgccatggttgtgcctccccaggaa

SEQ ID NO: 63336 - DNA, 25 bp, Mus musculus
tgccattaacaattctgaaatacga

SEQ ID NO: 63337 - DNA, 25 bp, Mus musculus
tgccattaacatgtctggagtcgac

SEQ ID NO: 63338 - DNA, 25 bp, Mus musculus
tgccattacccagggaggagcaata

SEQ ID NO: 63339 - DNA, 25 bp, Mus musculus
tgccattactgtggcggctcgggca

SEQ ID NO: 63340 - DNA, 25 bp, Mus musculus
tgccattcaacattcaacgaccctg

SEQ ID NO: 63341 - DNA, 25 bp, Mus musculus
tgccattcacggaggctgcattggc

SEQ ID NO: 63342 - DNA, 25 bp, Mus musculus
tgccattgcaccagatctctgccat

SEQ ID NO: 63343 - DNA, 25 bp, Mus musculus
tgccattggagggaatgtgaacaaa

SEQ ID NO: 63344 - DNA, 25 bp, Mus musculus
tgccattggctctctgatggacgac

SEQ ID NO: 63345 - DNA, 25 bp, Mus musculus
tgccatttgcctgaccgagttactc

SEQ ID NO: 63346 - DNA, 25 bp, Mus musculus
tgcccaaacacgtggactctataat

SEQ ID NO: 63347 - DNA, 25 bp, Mus musculus
tgcccaaactaactccatggtgacc

SEQ ID NO: 63348 - DNA, 25 bp, Mus musculus
tgcccaaaggaaatgccactaaaga

SEQ ID NO: 63349 - DNA, 25 bp, Mus musculus
tgcccaaagtcagcatccttcagag

SEQ ID NO: 63350 - DNA, 25 bp, Mus musculus
tgcccaacatcacaagagattaaat

SEQ ID NO: 63351 - DNA, 25 bp, Mus musculus
tgcccaagagggagctttggccagc

SEQ ID NO: 63352 - DNA, 25 bp, Mus musculus
tgcccaaggttagcacatgtgtttg

SEQ ID NO: 63353 - DNA, 25 bp, Mus musculus
tgcccaatgatccacttgtgccgac

SEQ ID NO: 63354 - DNA, 25 bp, Mus musculus
tgcccaatgccacaaccgtggacaa

SEQ ID NO: 63355 - DNA, 25 bp, Mus musculus
tgcccaattacctgccatcagtgag

SEQ ID NO: 63356 - DNA, 25 bp, Mus musculus
tgcccacaatgaccttgttgacaag

SEQ ID NO: 63357 - DNA, 25 bp, Mus musculus
tgcccacactttaactgtgctgttc

SEQ ID NO: 63358 - DNA, 25 bp, Mus musculus
tgcccaccaggtcgctctggatatc

SEQ ID NO: 63359 - DNA, 25 bp, Mus musculus
tgcccaccccacatgaggctgagaa

SEQ ID NO: 63360 - DNA, 25 bp, Mus musculus
tgcccaccgtcatagatgaatacct

SEQ ID NO: 63361 - DNA, 25 bp, Mus musculus
tgcccaccttatagtgctgaggaaa

SEQ ID NO: 63362 - DNA, 25 bp, Mus musculus
tgcccaccttcttcaaggagacctt

SEQ ID NO: 63363 - DNA, 25 bp, Mus musculus
tgcccacgctgtggatagtcctcat

SEQ ID NO: 63364 - DNA, 25 bp, Mus musculus
tgcccactatgggaacatcaatgtg

SEQ ID NO: 63365 - DNA, 25 bp, Mus musculus
tgcccactgaatagtaatcacacag

SEQ ID NO: 63366 - DNA, 25 bp, Mus musculus
tgcccactgaatatgactctcgggt

SEQ ID NO: 63367 - DNA, 25 bp, Mus musculus
tgcccacttggtggcacccttgaag

SEQ ID NO: 63368 - DNA, 25 bp, Mus musculus
tgcccagaagcagatgtttcggaac

SEQ ID NO: 63369 - DNA, 25 bp, Mus musculus
tgcccagagcatgcagcagagcgca

SEQ ID NO: 63370 - DNA, 25 bp, Mus musculus
tgcccagatcttcctgaacttgacc

SEQ ID NO: 63371 - DNA, 25 bp, Mus musculus
tgcccagcagaggagcacgcagctg

SEQ ID NO: 63372 - DNA, 25 bp, Mus musculus
tgcccagcagcaaaaagttgtcaac

SEQ ID NO: 63373 - DNA, 25 bp, Mus musculus
tgcccagcagtgtggaatgagagct

SEQ ID NO: 63374 - DNA, 25 bp, Mus musculus
tgcccagccatttctgggtacagtg

SEQ ID NO: 63375 - DNA, 25 bp, Mus musculus
tgcccagcccggtgctggcttcggt

SEQ ID NO: 63376 - DNA, 25 bp, Mus musculus
tgcccagcctgtatgacgacattgt

SEQ ID NO: 63377 - DNA, 25 bp, Mus musculus
tgcccagcggcttagaggagttgct

SEQ ID NO: 63378 - DNA, 25 bp, Mus musculus
tgcccagcgtgaagcagccagggca

SEQ ID NO: 63379 - DNA, 25 bp, Mus musculus
tgcccagctgctgaggttggataac

SEQ ID NO: 63380 - DNA, 25 bp, Mus musculus
tgcccaggacctggaaatgtatggg

SEQ ID NO: 63381 - DNA, 25 bp, Mus musculus
tgcccaggcgcaatgctcatgtgaa

SEQ ID NO: 63382 - DNA, 25 bp, Mus musculus
tgcccagggattgtggttgtaagcc

SEQ ID NO: 63383 - DNA, 25 bp, Mus musculus
tgcccagtcatgtcggcaggtccca

SEQ ID NO: 63384 - DNA, 25 bp, Mus musculus
tgcccagtgctcagctccgcatatg

SEQ ID NO: 63385 - DNA, 25 bp, Mus musculus
tgcccagtgggagaaagaaccagtc

SEQ ID NO: 63386 - DNA, 25 bp, Mus musculus
tgcccatacggattgaaaacccaaa

SEQ ID NO: 63387 - DNA, 25 bp, Mus musculus
tgcccatagacataggagagattta

SEQ ID NO: 63388 - DNA, 25 bp, Mus musculus
tgcccatagtcgtacaaagagccag

SEQ ID NO: 63389 - DNA, 25 bp, Mus musculus
tgcccatcatggcacctgcagaagc

SEQ ID NO: 63390 - DNA, 25 bp, Mus musculus
tgcccatccaagcagcctgttcaag

SEQ ID NO: 63391 - DNA, 25 bp, Mus musculus
tgcccatcgactttccagaagaaaa

SEQ ID NO: 63392 - DNA, 25 bp, Mus musculus
tgcccatgaacctgtttgaacagtt

SEQ ID NO: 63393 - DNA, 25 bp, Mus musculus
tgcccatgagagctactactagatc

SEQ ID NO: 63394 - DNA, 25 bp, Mus musculus
tgcccatgagaggtactactagatc

SEQ ID NO: 63395 - DNA, 25 bp, Mus musculus
tgcccatgcgccaatgatgctaatg

SEQ ID NO: 63396 - DNA, 25 bp, Mus musculus
tgcccatggtctagcttctcttcag

SEQ ID NO: 63397 - DNA, 25 bp, Mus musculus
tgcccatgtcacagaccccagagtg

SEQ ID NO: 63398 - DNA, 25 bp, Mus musculus
tgcccattcttgctgaagctgcaga

SEQ ID NO: 63399 - DNA, 25 bp, Mus musculus
tgcccattgagcagtgcctgccttc

SEQ ID NO: 63400 - DNA, 25 bp, Mus musculus
tgccccaacaggtccgaagtgggaa

SEQ ID NO: 63401 - DNA, 25 bp, Mus musculus
tgccccaaggaagaggacacaactc

SEQ ID NO: 63402 - DNA, 25 bp, Mus musculus
tgccccacaactctacaagaatcgt

SEQ ID NO: 63403 - DNA, 25 bp, Mus musculus
tgccccacattcctgaggatgagga

SEQ ID NO: 63404 - DNA, 25 bp, Mus musculus
tgccccacatttgaagtctctgagg

SEQ ID NO: 63405 - DNA, 25 bp, Mus musculus
tgccccagagtgatatagctgggcc

SEQ ID NO: 63406 - DNA, 25 bp, Mus musculus
tgccccagagtgttatagctgggcc

SEQ ID NO: 63407 - DNA, 25 bp, Mus musculus
tgccccatactttctttattggtga

SEQ ID NO: 63408 - DNA, 25 bp, Mus musculus
tgccccatttgttccaagtctgtgg

SEQ ID NO: 63409 - DNA, 25 bp, Mus musculus
tgccccgaaggttaaaacttcagca

SEQ ID NO: 63410 - DNA, 25 bp, Mus musculus
tgccccgcagatgaggttccaggtt

SEQ ID NO: 63411 - DNA, 25 bp, Mus musculus
tgccccgggagatcgacctcaacga

SEQ ID NO: 63412 - DNA, 25 bp, Mus musculus
tgccccgttctcaaaatgaccctga

SEQ ID NO: 63413 - DNA, 25 bp, Mus musculus
tgcccctacattattccttattcag

SEQ ID NO: 63414 - DNA, 25 bp, Mus musculus
tgcccctctgcgatgttgtcatcaa

SEQ ID NO: 63415 - DNA, 25 bp, Mus musculus
tgcccctctggccaccagatggtgg

SEQ ID NO: 63416 - DNA, 25 bp, Mus musculus
tgcccctgagaaagggaacaagagc

SEQ ID NO: 63417 - DNA, 25 bp, Mus musculus
tgcccctgagtatgaagctgcagca

SEQ ID NO: 63418 - DNA, 25 bp, Mus musculus
tgcccctgctttgtgcgagttccgg

SEQ ID NO: 63419 - DNA, 25 bp, Mus musculus
tgcccctggagacaccggcctttag

SEQ ID NO: 63420 - DNA, 25 bp, Mus musculus
tgcccctggagctagagaagacagc

SEQ ID NO: 63421 - DNA, 25 bp, Mus musculus
tgccccttctgctcatatttcctga

SEQ ID NO: 63422 - DNA, 25 bp, Mus musculus
tgccccttttcacagaggctcttca

SEQ ID NO: 63423 - DNA, 25 bp, Mus musculus
tgcccgacatgtggtggcacccatg

SEQ ID NO: 63424 - DNA, 25 bp, Mus musculus
tgcccgagaaccatttgtggcccat

SEQ ID NO: 63425 - DNA, 25 bp, Mus musculus
tgcccgagaaggcaaggactccaag

SEQ ID NO: 63426 - DNA, 25 bp, Mus musculus
tgcccgagaagggactcggagtcca

SEQ ID NO: 63427 - DNA, 25 bp, Mus musculus
tgcccgagccagaaacgggaaatac

SEQ ID NO: 63428 - DNA, 25 bp, Mus musculus
tgcccgcaaaccagatcaaggagcc

SEQ ID NO: 63429 - DNA, 25 bp, Mus musculus
tgcccgcagacatcagcgcaagatg

SEQ ID NO: 63430 - DNA, 25 bp, Mus musculus
tgcccgcatttgaacagcccatggc

SEQ ID NO: 63431 - DNA, 25 bp, Mus musculus
tgcccgccatggtataataaaaata

SEQ ID NO: 63432 - DNA, 25 bp, Mus musculus
tgcccgctctcttgtaggatacagt

SEQ ID NO: 63433 - DNA, 25 bp, Mus musculus
tgcccgctgtgctcctatctagaag

SEQ ID NO: 63434 - DNA, 25 bp, Mus musculus
tgcccggaaacagaaccgatgggtt

SEQ ID NO: 63435 - DNA, 25 bp, Mus musculus
tgcccggcaggatctgactcagtcc

SEQ ID NO: 63436 - DNA, 25 bp, Mus musculus
tgcccggcagtactgtacattttaa

SEQ ID NO: 63437 - DNA, 25 bp, Mus musculus
tgcccggccaagctttatggatcta

SEQ ID NO: 63438 - DNA, 25 bp, Mus musculus
tgcccggcgtcagagccggcgttta

SEQ ID NO: 63439 - DNA, 25 bp, Mus musculus
tgcccggctctgatctataagaaag

SEQ ID NO: 63440 - DNA, 25 bp, Mus musculus
tgcccggtgccatttgttccctggt

SEQ ID NO: 63441 - DNA, 25 bp, Mus musculus
tgcccgtactcatcgtaaaaagctg

SEQ ID NO: 63442 - DNA, 25 bp, Mus musculus
tgcccgtgcaagtcctgctcctttg

SEQ ID NO: 63443 - DNA, 25 bp, Mus musculus
tgcccgtgtgcgactttggcagtgt

SEQ ID NO: 63444 - DNA, 25 bp, Mus musculus
tgcccgttgctattcctgcatcaat

SEQ ID NO: 63445 - DNA, 25 bp, Mus musculus
tgccctaacagacttcacattcatg

SEQ ID NO: 63446 - DNA, 25 bp, Mus musculus
tgccctaaggccaagacatgtacca

SEQ ID NO: 63447 - DNA, 25 bp, Mus musculus
tgccctacaggctacactggatatt

SEQ ID NO: 63448 - DNA, 25 bp, Mus musculus
tgccctaccgagaacgagcctgatt

SEQ ID NO: 63449 - DNA, 25 bp, Mus musculus
tgccctacctcttgggagtcaccaa

SEQ ID NO: 63450 - DNA, 25 bp, Mus musculus
tgccctacctgaaggacgagctgca

SEQ ID NO: 63451 - DNA, 25 bp, Mus musculus
tgccctactactactccattcgagg

SEQ ID NO: 63452 - DNA, 25 bp, Mus musculus
tgccctcaaggtctcagtttctcag

SEQ ID NO: 63453 - DNA, 25 bp, Mus musculus
tgccctcagaggttaagaagtttaa

SEQ ID NO: 63454 - DNA, 25 bp, Mus musculus
tgccctcaggaactttcagcaccgg

SEQ ID NO: 63455 - DNA, 25 bp, Mus musculus
tgccctccacggtagattctccaga

SEQ ID NO: 63456 - DNA, 25 bp, Mus musculus
tgccctccatccttagctatagtca

SEQ ID NO: 63457 - DNA, 25 bp, Mus musculus
tgccctccatcggaacagtgctgtg

SEQ ID NO: 63458 - DNA, 25 bp, Mus musculus
tgccctcctcatgcagggtgaaagg

SEQ ID NO: 63459 - DNA, 25 bp, Mus musculus
tgccctcttaaatgttgagcttgag

SEQ ID NO: 63460 - DNA, 25 bp, Mus musculus
tgccctctttgagggccggagtcct

SEQ ID NO: 63461 - DNA, 25 bp, Mus musculus
tgccctgagacctgcagggtcctat

SEQ ID NO: 63462 - DNA, 25 bp, Mus musculus
tgccctgagtgttgcagacggaaga

SEQ ID NO: 63463 - DNA, 25 bp, Mus musculus
tgccctgatggaggcaaattccacc

SEQ ID NO: 63464 - DNA, 25 bp, Mus musculus
tgccctgatgggagatgcgtcaact

SEQ ID NO: 63465 - DNA, 25 bp, Mus musculus
tgccctgatgggtgatgcgtcaact

SEQ ID NO: 63466 - DNA, 25 bp, Mus musculus
tgccctgattgttagatgggtaaca

SEQ ID NO: 63467 - DNA, 25 bp, Mus musculus
tgccctgcacgtgcctcgggatgga

SEQ ID NO: 63468 - DNA, 25 bp, Mus musculus
tgccctgccagtccctgctgagagt

SEQ ID NO: 63469 - DNA, 25 bp, Mus musculus
tgccctggaagacatgctgcaggcc

SEQ ID NO: 63470 - DNA, 25 bp, Mus musculus
tgccctggagaagagaatcgacggt

SEQ ID NO: 63471 - DNA, 25 bp, Mus musculus
tgccctggagccattgatcacatcc

SEQ ID NO: 63472 - DNA, 25 bp, Mus musculus
tgccctggctaactacaagctacgg

SEQ ID NO: 63473 - DNA, 25 bp, Mus musculus
tgccctggctgccttcaacacacag

SEQ ID NO: 63474 - DNA, 25 bp, Mus musculus
tgccctgggacactactgcagataa

SEQ ID NO: 63475 - DNA, 25 bp, Mus musculus
tgccctgggctctgcaacatctgca

SEQ ID NO: 63476 - DNA, 25 bp, Mus musculus
tgccctgggtgtggtttgccaactt

SEQ ID NO: 63477 - DNA, 25 bp, Mus musculus
tgccctggttcccaaggaccattca

SEQ ID NO: 63478 - DNA, 25 bp, Mus musculus
tgccctgtaactgccatgcagaaga

SEQ ID NO: 63479 - DNA, 25 bp, Mus musculus
tgccctgtcctcatagacctgactg

SEQ ID NO: 63480 - DNA, 25 bp, Mus musculus
tgcccttaaccaatgaatcaccctt

SEQ ID NO: 63481 - DNA, 25 bp, Mus musculus
tgcccttacttgtgatgatttcagc

SEQ ID NO: 63482 - DNA, 25 bp, Mus musculus
tgcccttatgaacccttcgtctgca

SEQ ID NO: 63483 - DNA, 25 bp, Mus musculus
tgcccttatgaagccttcgtctgca

SEQ ID NO: 63484 - DNA, 25 bp, Mus musculus
tgcccttcggagatcgagtacaacg

SEQ ID NO: 63485 - DNA, 25 bp, Mus musculus
tgcccttcggagttcgagtacaacg

SEQ ID NO: 63486 - DNA, 25 bp, Mus musculus
tgcccttcgggtcctttcaggacac

SEQ ID NO: 63487 - DNA, 25 bp, Mus musculus
tgcccttctaagtaaacggcggaag

SEQ ID NO: 63488 - DNA, 25 bp, Mus musculus
tgcccttctgtgtccacatggagga

SEQ ID NO: 63489 - DNA, 25 bp, Mus musculus
tgcccttgaccaaactggacttctg

SEQ ID NO: 63490 - DNA, 25 bp, Mus musculus
tgcccttgggcagatggtgttagca

SEQ ID NO: 63491 - DNA, 25 bp, Mus musculus
tgcccttggtgaaccgaaatggatg

SEQ ID NO: 63492 - DNA, 25 bp, Mus musculus
tgcccttttgtcgtggtcctgggtg

SEQ ID NO: 63493 - DNA, 25 bp, Mus musculus
tgccgaaacagatgatgagatgtgt

SEQ ID NO: 63494 - DNA, 25 bp, Mus musculus
tgccgacccgagagtacccgtcaga

SEQ ID NO: 63495 - DNA, 25 bp, Mus musculus
tgccgacgtgaaagagtcccaggct

SEQ ID NO: 63496 - DNA, 25 bp, Mus musculus
tgccgactacaggtccattctgagc

SEQ ID NO: 63497 - DNA, 25 bp, Mus musculus
tgccgacttatgaaacatccaaaca

SEQ ID NO: 63498 - DNA, 25 bp, Mus musculus
tgccgagagatggatgaacagatca

SEQ ID NO: 63499 - DNA, 25 bp, Mus musculus
tgccgagattggtagcaatataaag

SEQ ID NO: 63500 - DNA, 25 bp, Mus musculus
tgccgagctgtctcctgtcactgac

SEQ ID NO: 63501 - DNA, 25 bp, Mus musculus
tgccgagcttcagcccactgagagt

SEQ ID NO: 63502 - DNA, 25 bp, Mus musculus
tgccgagtgctctattcctgtgtct

SEQ ID NO: 63503 - DNA, 25 bp, Mus musculus
tgccgatcagtaacgaggttgacct

SEQ ID NO: 63504 - DNA, 25 bp, Mus musculus
tgccgatttcctggcatatgacata

SEQ ID NO: 63505 - DNA, 25 bp, Mus musculus
tgccgcacttcattaaatgggccag

SEQ ID NO: 63506 - DNA, 25 bp, Mus musculus
tgccgcagaccttagcgaccaagtg

SEQ ID NO: 63507 - DNA, 25 bp, Mus musculus
tgccgcgctcaatggaggccactgt

SEQ ID NO: 63508 - DNA, 25 bp, Mus musculus
tgccgctccctggaagctgagggct

SEQ ID NO: 63509 - DNA, 25 bp, Mus musculus
tgccgctgcttcataggcactgtga

SEQ ID NO: 63510 - DNA, 25 bp, Mus musculus
tgccgctggagaaagaacatagctg

SEQ ID NO: 63511 - DNA, 25 bp, Mus musculus
tgccgctgtggtccatggaaaaagc

SEQ ID NO: 63512 - DNA, 25 bp, Mus musculus
tgccgcttcatcagggaacgggacc

SEQ ID NO: 63513 - DNA, 25 bp, Mus musculus
tgccggagtcgggagaggagcctcg

SEQ ID NO: 63514 - DNA, 25 bp, Mus musculus
tgccggatacaaagccagcagggac

SEQ ID NO: 63515 - DNA, 25 bp, Mus musculus
tgccggatacaatgccagcagggac

SEQ ID NO: 63516 - DNA, 25 bp, Mus musculus
tgccggatcggcgattggctccaag

SEQ ID NO: 63517 - DNA, 25 bp, Mus musculus
tgccggattgattgtgaaacccgtt

SEQ ID NO: 63518 - DNA, 25 bp, Mus musculus
tgccggctctcaattcgcttgtaat

SEQ ID NO: 63519 - DNA, 25 bp, Mus musculus
tgccggctctcatttcgcttgtaat

SEQ ID NO: 63520 - DNA, 25 bp, Mus musculus
tgccggctgaagaagtgcttacaag

SEQ ID NO: 63521 - DNA, 25 bp, Mus musculus
tgccggcttgttaattttatcccca

SEQ ID NO: 63522 - DNA, 25 bp, Mus musculus
tgccgggactctggtacattaatat

SEQ ID NO: 63523 - DNA, 25 bp, Mus musculus
tgccgggactgtaaggaagcatacc

SEQ ID NO: 63524 - DNA, 25 bp, Mus musculus
tgccgtccgttagtcctggagtcaa

SEQ ID NO: 63525 - DNA, 25 bp, Mus musculus
tgccgtgactcgaaatccccagact

SEQ ID NO: 63526 - DNA, 25 bp, Mus musculus
tgccgtgagcccttgtgtgtacagt

SEQ ID NO: 63527 - DNA, 25 bp, Mus musculus
tgccgtgatgccgtcaccaggaaca

SEQ ID NO: 63528 - DNA, 25 bp, Mus musculus
tgccgtgcctggtctcactccatgt

SEQ ID NO: 63529 - DNA, 25 bp, Mus musculus
tgccgtggcagagatccatttcaca

SEQ ID NO: 63530 - DNA, 25 bp, Mus musculus
tgccgtggtctgtctgcccactgaa

SEQ ID NO: 63531 - DNA, 25 bp, Mus musculus
tgccgtggtcttagtacccagtggg

SEQ ID NO: 63532 - DNA, 25 bp, Mus musculus
tgccgtttcaaccaggaccccgaag

SEQ ID NO: 63533 - DNA, 25 bp, Mus musculus
tgcctaaagaggaggtgttcttacc

SEQ ID NO: 63534 - DNA, 25 bp, Mus musculus
tgcctacaccagaggagcccttatc

SEQ ID NO: 63535 - DNA, 25 bp, Mus musculus
tgcctacagaaaattcgagacatga

SEQ ID NO: 63536 - DNA, 25 bp, Mus musculus
tgcctacagtgtcactctggatcct

SEQ ID NO: 63537 - DNA, 25 bp, Mus musculus
tgcctaccccgagggtgtccaagag

SEQ ID NO: 63538 - DNA, 25 bp, Mus musculus
tgcctaccccttcttgtttgacaac

SEQ ID NO: 63539 - DNA, 25 bp, Mus musculus
tgcctaccgcacagcaatcaaaatt

SEQ ID NO: 63540 - DNA, 25 bp, Mus musculus
tgcctagcacgggtggagggcgttc

SEQ ID NO: 63541 - DNA, 25 bp, Mus musculus
tgcctagccctcagtactttgtgga

SEQ ID NO: 63542 - DNA, 25 bp, Mus musculus
tgcctataaccagcccgaggaactg

SEQ ID NO: 63543 - DNA, 25 bp, Mus musculus
tgcctataatctgctgtgattccct

SEQ ID NO: 63544 - DNA, 25 bp, Mus musculus
tgcctatattgactggatcaaggag

SEQ ID NO: 63545 - DNA, 25 bp, Mus musculus
tgcctatctatgcttctccagttct

SEQ ID NO: 63546 - DNA, 25 bp, Mus musculus
tgcctatgcatcctgcagctgaaga

SEQ ID NO: 63547 - DNA, 25 bp, Mus musculus
tgcctatgccagacacagggctgcg

SEQ ID NO: 63548 - DNA, 25 bp, Mus musculus
tgcctatgctgccttcaacaaccgg

SEQ ID NO: 63549 - DNA, 25 bp, Mus musculus
tgcctatgtcaagtggggaaccctg

SEQ ID NO: 63550 - DNA, 25 bp, Mus musculus
tgcctatgtgtatcacaatgagaat

SEQ ID NO: 63551 - DNA, 25 bp, Mus musculus
tgcctcaagtatcggctcgtgggct

SEQ ID NO: 63552 - DNA, 25 bp, Mus musculus
tgcctcaagtgacggcgacccagag

SEQ ID NO: 63553 - DNA, 25 bp, Mus musculus
tgcctcacagggttcattataatcc

SEQ ID NO: 63554 - DNA, 25 bp, Mus musculus
tgcctcaggaatgagcgagatgtgc

SEQ ID NO: 63555 - DNA, 25 bp, Mus musculus
tgcctcaggagtctaggctgctgca

SEQ ID NO: 63556 - DNA, 25 bp, Mus musculus
tgcctcatgatgaaacatactgtga

SEQ ID NO: 63557 - DNA, 25 bp, Mus musculus
tgcctccagaaaagccagttcaagc

SEQ ID NO: 63558 - DNA, 25 bp, Mus musculus
tgcctccagagtgctaaagtccaga

SEQ ID NO: 63559 - DNA, 25 bp, Mus musculus
tgcctccagctcagtccatgttgtg

SEQ ID NO: 63560 - DNA, 25 bp, Mus musculus
tgcctccagggctatgttcgaatct

SEQ ID NO: 63561 - DNA, 25 bp, Mus musculus
tgcctccccggtcctagaggtcagg

SEQ ID NO: 63562 - DNA, 25 bp, Mus musculus
tgcctcccggcgtgccagtgataaa

SEQ ID NO: 63563 - DNA, 25 bp, Mus musculus
tgcctccctggacgcctttgttttt

SEQ ID NO: 63564 - DNA, 25 bp, Mus musculus
tgcctccggtgccagcgttttcatc

SEQ ID NO: 63565 - DNA, 25 bp, Mus musculus
tgcctcctaaggaagagactttaga

SEQ ID NO: 63566 - DNA, 25 bp, Mus musculus
tgcctcctagtggacaagtggaaac

SEQ ID NO: 63567 - DNA, 25 bp, Mus musculus
tgcctcctggcctagacagaaacag

SEQ ID NO: 63568 - DNA, 25 bp, Mus musculus
tgcctccttctgcagcggaagatgg

SEQ ID NO: 63569 - DNA, 25 bp, Mus musculus
tgcctcgcggagagaaaaatgcctc

SEQ ID NO: 63570 - DNA, 25 bp, Mus musculus
tgcctcggaagatgcatcacctcca

SEQ ID NO: 63571 - DNA, 25 bp, Mus musculus
tgcctcgtcatgtatgtcatcctca

SEQ ID NO: 63572 - DNA, 25 bp, Mus musculus
tgcctctacactctgagattatagg

SEQ ID NO: 63573 - DNA, 25 bp, Mus musculus
tgcctctacctttgatcacccagaa

SEQ ID NO: 63574 - DNA, 25 bp, Mus musculus
tgcctctattcacccttgctaaggg

SEQ ID NO: 63575 - DNA, 25 bp, Mus musculus
tgcctctcagcaagaaaagagggct

SEQ ID NO: 63576 - DNA, 25 bp, Mus musculus
tgcctctccaccttgacttccagct

SEQ ID NO: 63577 - DNA, 25 bp, Mus musculus
tgcctctccctcaatggtgcatgag

SEQ ID NO: 63578 - DNA, 25 bp, Mus musculus
tgcctctcgcccatatgtttgagac

SEQ ID NO: 63579 - DNA, 25 bp, Mus musculus
tgcctctctgcatttggacagattc

SEQ ID NO: 63580 - DNA, 25 bp, Mus musculus
tgcctctgcgtacaaggccctgttt

SEQ ID NO: 63581 - DNA, 25 bp, Mus musculus
tgcctctggctcacatgtttgagag

SEQ ID NO: 63582 - DNA, 25 bp, Mus musculus
tgcctctgtgcacccggctttgcta

SEQ ID NO: 63583 - DNA, 25 bp, Mus musculus
tgcctctgtgcagccggctttgcta

SEQ ID NO: 63584 - DNA, 25 bp, Mus musculus
tgcctcttacaaatccagaattatt

SEQ ID NO: 63585 - DNA, 25 bp, Mus musculus
tgcctcttgagttctagatttaaag

SEQ ID NO: 63586 - DNA, 25 bp, Mus musculus
tgcctctttccaagtgacttctcaa

SEQ ID NO: 63587 - DNA, 25 bp, Mus musculus
tgcctcttttgacgccatctttgtg

SEQ ID NO: 63588 - DNA, 25 bp, Mus musculus
tgcctgaacggtggcacctgcttga

SEQ ID NO: 63589 - DNA, 25 bp, Mus musculus
tgcctgaagatctatggcctttcct

SEQ ID NO: 63590 - DNA, 25 bp, Mus musculus
tgcctgaaggtcttgattccatcac

SEQ ID NO: 63591 - DNA, 25 bp, Mus musculus
tgcctgaatcagactacactaacaa

SEQ ID NO: 63592 - DNA, 25 bp, Mus musculus
tgcctgaatcagtctacactaacaa

SEQ ID NO: 63593 - DNA, 25 bp, Mus musculus
tgcctgaatggtcgccgctgcatcg

SEQ ID NO: 63594 - DNA, 25 bp, Mus musculus
tgcctgaatggtggccgctgcatcg

SEQ ID NO: 63595 - DNA, 25 bp, Mus musculus
tgcctgacaacctctacacctttgt

SEQ ID NO: 63596 - DNA, 25 bp, Mus musculus
tgcctgacaagacccagctccacag

SEQ ID NO: 63597 - DNA, 25 bp, Mus musculus
tgcctgaccgctaagtgaacactcc

SEQ ID NO: 63598 - DNA, 25 bp, Mus musculus
tgcctgaccgcttagtgaacactcc

SEQ ID NO: 63599 - DNA, 25 bp, Mus musculus
tgcctgactgggtttggattgtcgt

SEQ ID NO: 63600 - DNA, 25 bp, Mus musculus
tgcctgaggagcaccagatctcact

SEQ ID NO: 63601 - DNA, 25 bp, Mus musculus
tgcctgaggcggatcagaactcaac

SEQ ID NO: 63602 - DNA, 25 bp, Mus musculus
tgcctgatatccatgggtgccagaa

SEQ ID NO: 63603 - DNA, 25 bp, Mus musculus
tgcctgatgacagtcgggccagccg

SEQ ID NO: 63604 - DNA, 25 bp, Mus musculus
tgcctgcacccgcttataaatgcct

SEQ ID NO: 63605 - DNA, 25 bp, Mus musculus
tgcctgcactgtatactatttttca

SEQ ID NO: 63606 - DNA, 25 bp, Mus musculus
tgcctgcagcgtttagccttccagt

SEQ ID NO: 63607 - DNA, 25 bp, Mus musculus
tgcctgcatgcagacatgctgagct

SEQ ID NO: 63608 - DNA, 25 bp, Mus musculus
tgcctgccaagcacagctctggagt

SEQ ID NO: 63609 - DNA, 25 bp, Mus musculus
tgcctgccctttcaatactaagggt

SEQ ID NO: 63610 - DNA, 25 bp, Mus musculus
tgcctgccctttgaaatttgggagt

SEQ ID NO: 63611 - DNA, 25 bp, Mus musculus
tgcctgccgctgcttcataggcact

SEQ ID NO: 63612 - DNA, 25 bp, Mus musculus
tgcctgcctcaggaatgagcgagat

SEQ ID NO: 63613 - DNA, 25 bp, Mus musculus
tgcctgctaatactaggaaaacacc

SEQ ID NO: 63614 - DNA, 25 bp, Mus musculus
tgcctgctaatagtaggaaaacacc

SEQ ID NO: 63615 - DNA, 25 bp, Mus musculus
tgcctgctacgaaaagttaaaaaag

SEQ ID NO: 63616 - DNA, 25 bp, Mus musculus
tgcctgctatgccatggtcctgctg

SEQ ID NO: 63617 - DNA, 25 bp, Mus musculus
tgcctgctgctgctatatgaggata

SEQ ID NO: 63618 - DNA, 25 bp, Mus musculus
tgcctgcttggcctcagaacccgat

SEQ ID NO: 63619 - DNA, 25 bp, Mus musculus
tgcctgctttacatgatgctagtga

SEQ ID NO: 63620 - DNA, 25 bp, Mus musculus
tgcctgctttttgtcctccaggaaa

SEQ ID NO: 63621 - DNA, 25 bp, Mus musculus
tgcctggaacattgcccctcaggga

SEQ ID NO: 63622 - DNA, 25 bp, Mus musculus
tgcctggaagaaagaccgaatcgtc

SEQ ID NO: 63623 - DNA, 25 bp, Mus musculus
tgcctggaccactggtttgcactca

SEQ ID NO: 63624 - DNA, 25 bp, Mus musculus
tgcctggacctcacttgctacactg

SEQ ID NO: 63625 - DNA, 25 bp, Mus musculus
tgcctggcaagagtgataacgaacg

SEQ ID NO: 63626 - DNA, 25 bp, Mus musculus
tgcctggccacattcacaagaaggg

SEQ ID NO: 63627 - DNA, 25 bp, Mus musculus
tgcctggccttacagaataatgtgc

SEQ ID NO: 63628 - DNA, 25 bp, Mus musculus
tgcctggcgaggactctcctgccta

SEQ ID NO: 63629 - DNA, 25 bp, Mus musculus
tgcctgggaaggtcttccaaggtca

SEQ ID NO: 63630 - DNA, 25 bp, Mus musculus
tgcctgggaccatccagatgagatc

SEQ ID NO: 63631 - DNA, 25 bp, Mus musculus
tgcctgggctcatgggtccctgtcg

SEQ ID NO: 63632 - DNA, 25 bp, Mus musculus
tgcctggggactatccctgctatgt

SEQ ID NO: 63633 - DNA, 25 bp, Mus musculus
tgcctggtcatcaagtatgccaaag

SEQ ID NO: 63634 - DNA, 25 bp, Mus musculus
tgcctggtccatgggcacaaagagg

SEQ ID NO: 63635 - DNA, 25 bp, Mus musculus
tgcctggtggcagctggacagttcc

SEQ ID NO: 63636 - DNA, 25 bp, Mus musculus
tgcctggtgttctccagcggagcct

SEQ ID NO: 63637 - DNA, 25 bp, Mus musculus
tgcctgtccccaacatatgagctgg

SEQ ID NO: 63638 - DNA, 25 bp, Mus musculus
tgcctgtcccgcagccagacaggga

SEQ ID NO: 63639 - DNA, 25 bp, Mus musculus
tgcctgtcccgctgccagacaggga

SEQ ID NO: 63640 - DNA, 25 bp, Mus musculus
tgcctgtgcctatcatccagcagct

SEQ ID NO: 63641 - DNA, 25 bp, Mus musculus
tgcctgtgcgatacacgcattcctt

SEQ ID NO: 63642 - DNA, 25 bp, Mus musculus
tgcctgtggacacagcactcacggg

SEQ ID NO: 63643 - DNA, 25 bp, Mus musculus
tgcctgtgtacaatgcggaagtggt

SEQ ID NO: 63644 - DNA, 25 bp, Mus musculus
tgcctgtgtgcctccaggataataa

SEQ ID NO: 63645 - DNA, 25 bp, Mus musculus
tgcctgttcttggacccctggttgc

SEQ ID NO: 63646 - DNA, 25 bp, Mus musculus
tgcctgtttccttcagcaaagaaga

SEQ ID NO: 63647 - DNA, 25 bp, Mus musculus
tgccttactttgtgctcatcatcta

SEQ ID NO: 63648 - DNA, 25 bp, Mus musculus
tgccttagctacatggccctgctca

SEQ ID NO: 63649 - DNA, 25 bp, Mus musculus
tgccttatacacaaccttcatgaaa

SEQ ID NO: 63650 - DNA, 25 bp, Mus musculus
tgccttcaatttccccgtggctgtg

SEQ ID NO: 63651 - DNA, 25 bp, Mus musculus
tgccttcatgcctttttctgcaggg

SEQ ID NO: 63652 - DNA, 25 bp, Mus musculus
tgccttcatgtctttggactgacta

SEQ ID NO: 63653 - DNA, 25 bp, Mus musculus
tgccttccaacattaaagatagact

SEQ ID NO: 63654 - DNA, 25 bp, Mus musculus
tgccttcccctctgggcatttgctg

SEQ ID NO: 63655 - DNA, 25 bp, Mus musculus
tgccttccctgtgaactgacgtttg

SEQ ID NO: 63656 - DNA, 25 bp, Mus musculus
tgccttcgttccaaattgccagaat

SEQ ID NO: 63657 - DNA, 25 bp, Mus musculus
tgccttctacaccagcacagggtat

SEQ ID NO: 63658 - DNA, 25 bp, Mus musculus
tgccttctatatttaaccgtgtacc

SEQ ID NO: 63659 - DNA, 25 bp, Mus musculus
tgccttctatgataccagcaaaaga

SEQ ID NO: 63660 - DNA, 25 bp, Mus musculus
tgccttctcctgtcaggccgggata

SEQ ID NO: 63661 - DNA, 25 bp, Mus musculus
tgccttctctggacaactccaagta

SEQ ID NO: 63662 - DNA, 25 bp, Mus musculus
tgccttcttcgtggccgacctgggt

SEQ ID NO: 63663 - DNA, 25 bp, Mus musculus
tgccttgaaataactcacagctgag

SEQ ID NO: 63664 - DNA, 25 bp, Mus musculus
tgccttgaaatatctcacagctgag

SEQ ID NO: 63665 - DNA, 25 bp, Mus musculus
tgccttgaagaccaccttaagtaaa

SEQ ID NO: 63666 - DNA, 25 bp, Mus musculus
tgccttgcgtgtcaccgatggagct

SEQ ID NO: 63667 - DNA, 25 bp, Mus musculus
tgccttggactgactgttgctctgt

SEQ ID NO: 63668 - DNA, 25 bp, Mus musculus
tgccttgggaaaagcaaaggccgaa

SEQ ID NO: 63669 - DNA, 25 bp, Mus musculus
tgccttggtgtgttgtgatcatgaa

SEQ ID NO: 63670 - DNA, 25 bp, Mus musculus
tgccttgtctcaaagagaagagaac

SEQ ID NO: 63671 - DNA, 25 bp, Mus musculus
tgccttgtgccttggctatgtggga

SEQ ID NO: 63672 - DNA, 25 bp, Mus musculus
tgccttgtttgatttttggagatac

SEQ ID NO: 63673 - DNA, 25 bp, Mus musculus
tgcctttagcacacatgtttgagcg

SEQ ID NO: 63674 - DNA, 25 bp, Mus musculus
tgcctttatccggtttgacaaacgg

SEQ ID NO: 63675 - DNA, 25 bp, Mus musculus
tgcctttcagtaaaccggcctcaga

SEQ ID NO: 63676 - DNA, 25 bp, Mus musculus
tgcctttcatcatcctgaccctggt

SEQ ID NO: 63677 - DNA, 25 bp, Mus musculus
tgcctttgaaagtgaaaagactttt

SEQ ID NO: 63678 - DNA, 25 bp, Mus musculus
tgcctttgaaggagagtacacacat

SEQ ID NO: 63679 - DNA, 25 bp, Mus musculus
tgcctttgacaacctcctcaatctg

SEQ ID NO: 63680 - DNA, 25 bp, Mus musculus
tgcctttgacctggtggaccggagt

SEQ ID NO: 63681 - DNA, 25 bp, Mus musculus
tgcctttgagtgagcaaagatgctc

SEQ ID NO: 63682 - DNA, 25 bp, Mus musculus
tgcctttgagtgtgcaaagatgctc

SEQ ID NO: 63683 - DNA, 25 bp, Mus musculus
tgcctttgcctaccccttcttgttt

SEQ ID NO: 63684 - DNA, 25 bp, Mus musculus
tgcctttggattccgaagaccccgg

SEQ ID NO: 63685 - DNA, 25 bp, Mus musculus
tgcctttggcccacgtggccattgc

SEQ ID NO: 63686 - DNA, 25 bp, Mus musculus
tgcctttggtatcagtcaatcagga

SEQ ID NO: 63687 - DNA, 25 bp, Mus musculus
tgcctttggtcatcgagttcactga

SEQ ID NO: 63688 - DNA, 25 bp, Mus musculus
tgcctttgtcctagctatgctcagc

SEQ ID NO: 63689 - DNA, 25 bp, Mus musculus
tgcgaaaaccccacagttgaccttt

SEQ ID NO: 63690 - DNA, 25 bp, Mus musculus
tgcgaaaaccctgcgacagactctg

SEQ ID NO: 63691 - DNA, 25 bp, Mus musculus
tgcgaaacgtggctatgaagcacat

SEQ ID NO: 63692 - DNA, 25 bp, Mus musculus
tgcgaaacgtgggtatgaagcacat

SEQ ID NO: 63693 - DNA, 25 bp, Mus musculus
tgcgaacatctgatcccaggttgaa

SEQ ID NO: 63694 - DNA, 25 bp, Mus musculus
tgcgaagaacattaatcgctcttgt

SEQ ID NO: 63695 - DNA, 25 bp, Mus musculus
tgcgaagaagtgatttgcaccttta

SEQ ID NO: 63696 - DNA, 25 bp, Mus musculus
tgcgaagaagtgttttgcaccttta

SEQ ID NO: 63697 - DNA, 25 bp, Mus musculus
tgcgaagagtgggaaatcaggaact

SEQ ID NO: 63698 - DNA, 25 bp, Mus musculus
tgcgaagatcgatgccaagaccagg

SEQ ID NO: 63699 - DNA, 25 bp, Mus musculus
tgcgaaggaaattgcacgaggcccg

SEQ ID NO: 63700 - DNA, 25 bp, Mus musculus
tgcgaaggcaccaggaaaatgtcca

SEQ ID NO: 63701 - DNA, 25 bp, Mus musculus
tgcgaagtccccaagctcttcagct

SEQ ID NO: 63702 - DNA, 25 bp, Mus musculus
tgcgaattcccctaagttcttagcg

SEQ ID NO: 63703 - DNA, 25 bp, Mus musculus
tgcgaatttccacagaagccaatag

SEQ ID NO: 63704 - DNA, 25 bp, Mus musculus
tgcgacagtgacagcgaccaggaag

SEQ ID NO: 63705 - DNA, 25 bp, Mus musculus
tgcgaccaccggagggaagacgact

SEQ ID NO: 63706 - DNA, 25 bp, Mus musculus
tgcgacccaggatgggaacttcgat

SEQ ID NO: 63707 - DNA, 25 bp, Mus musculus
tgcgaccccagccagggcctggttt

SEQ ID NO: 63708 - DNA, 25 bp, Mus musculus
tgcgaccccagcgagggcctggttt

SEQ ID NO: 63709 - DNA, 25 bp, Mus musculus
tgcgacgggcttttcaaggtcttta

SEQ ID NO: 63710 - DNA, 25 bp, Mus musculus
tgcgactgcccaacagacgtgtgct

SEQ ID NO: 63711 - DNA, 25 bp, Mus musculus
tgcgagaagtatttgcccggcagct

SEQ ID NO: 63712 - DNA, 25 bp, Mus musculus
tgcgagagatccaagcactgaggcg

SEQ ID NO: 63713 - DNA, 25 bp, Mus musculus
tgcgagcacagtggaaattgttcct

SEQ ID NO: 63714 - DNA, 25 bp, Mus musculus
tgcgagccttgagggaggctttcta

SEQ ID NO: 63715 - DNA, 25 bp, Mus musculus
tgcgaggccaaaccgaagctcttta

SEQ ID NO: 63716 - DNA, 25 bp, Mus musculus
tgcgagtacaggtgatccagtgcca

SEQ ID NO: 63717 - DNA, 25 bp, Mus musculus
tgcgagtagcaatttacagctcaag

SEQ ID NO: 63718 - DNA, 25 bp, Mus musculus
tgcgagtcctcagcatcaccagacc

SEQ ID NO: 63719 - DNA, 25 bp, Mus musculus
tgcgagtgccaaataggtctttact

SEQ ID NO: 63720 - DNA, 25 bp, Mus musculus
tgcgagtgggaggagcaggaaacaa

SEQ ID NO: 63721 - DNA, 25 bp, Mus musculus
tgcgatacaaccagagaccccattg

SEQ ID NO: 63722 - DNA, 25 bp, Mus musculus
tgcgatcctactatcatgggtattg

SEQ ID NO: 63723 - DNA, 25 bp, Mus musculus
tgcgatcgtgcctggagcactctgg

SEQ ID NO: 63724 - DNA, 25 bp, Mus musculus
tgcgatctatggaagaaacggttac

SEQ ID NO: 63725 - DNA, 25 bp, Mus musculus
tgcgatgcggtgacgcctctaaaga

SEQ ID NO: 63726 - DNA, 25 bp, Mus musculus
tgcgatggtgaaaatgattgtgaca

SEQ ID NO: 63727 - DNA, 25 bp, Mus musculus
tgcgattgcaattatgggacacagc

SEQ ID NO: 63728 - DNA, 25 bp, Mus musculus
tgcgcaacatgatgagaagtttctc

SEQ ID NO: 63729 - DNA, 25 bp, Mus musculus
tgcgcaagatcctgtcaaggctgtt

SEQ ID NO: 63730 - DNA, 25 bp, Mus musculus
tgcgcaaggacaccaaaacaagttt

SEQ ID NO: 63731 - DNA, 25 bp, Mus musculus
tgcgcaatgggctggtcaatgcatc

SEQ ID NO: 63732 - DNA, 25 bp, Mus musculus
tgcgcaatgtgaccccaagggacag

SEQ ID NO: 63733 - DNA, 25 bp, Mus musculus
tgcgcacagaggaatagacgtgtca

SEQ ID NO: 63734 - DNA, 25 bp, Mus musculus
tgcgcactgcagaccatatatggtg

SEQ ID NO: 63735 - DNA, 25 bp, Mus musculus
tgcgcactttgggttgctcagtctc

SEQ ID NO: 63736 - DNA, 25 bp, Mus musculus
tgcgcagaacttaggacgcgggtct

SEQ ID NO: 63737 - DNA, 25 bp, Mus musculus
tgcgcagaactttggacgcgggtct

SEQ ID NO: 63738 - DNA, 25 bp, Mus musculus
tgcgcagaagcattggcagacccga

SEQ ID NO: 63739 - DNA, 25 bp, Mus musculus
tgcgcagagaggaatgcagtgtccc

SEQ ID NO: 63740 - DNA, 25 bp, Mus musculus
tgcgcagagccctacaaggtctcct

SEQ ID NO: 63741 - DNA, 25 bp, Mus musculus
tgcgcagccattggtacctgtattg

SEQ ID NO: 63742 - DNA, 25 bp, Mus musculus
tgcgcaggatcctggacgaactgac

SEQ ID NO: 63743 - DNA, 25 bp, Mus musculus
tgcgcatggacctagagcgagccaa

SEQ ID NO: 63744 - DNA, 25 bp, Mus musculus
tgcgcatgtcggacctgacgtcagt

SEQ ID NO: 63745 - DNA, 25 bp, Mus musculus
tgcgcattgagttcaagaagatagt

SEQ ID NO: 63746 - DNA, 25 bp, Mus musculus
tgcgccaaacctcatgggcagaatg

SEQ ID NO: 63747 - DNA, 25 bp, Mus musculus
tgcgccagaccatcaccacatttgg

SEQ ID NO: 63748 - DNA, 25 bp, Mus musculus
tgcgccaggcggagaatcctgtgaa

SEQ ID NO: 63749 - DNA, 25 bp, Mus musculus
tgcgccagttcttcgaccgtgtgcc

SEQ ID NO: 63750 - DNA, 25 bp, Mus musculus
tgcgccatggctccaaggctgtgac

SEQ ID NO: 63751 - DNA, 25 bp, Mus musculus
tgcgcccctagtggatgagagagct

SEQ ID NO: 63752 - DNA, 25 bp, Mus musculus
tgcgccctggagagagaagcgtcta

SEQ ID NO: 63753 - DNA, 25 bp, Mus musculus
tgcgcctatgtaccagtgctacaga

SEQ ID NO: 63754 - DNA, 25 bp, Mus musculus
tgcgcctcattaccgatactatgta

SEQ ID NO: 63755 - DNA, 25 bp, Mus musculus
tgcgcctcggagacaatgcggcctc

SEQ ID NO: 63756 - DNA, 25 bp, Mus musculus
tgcgccttgcttcaggcgatgccca

SEQ ID NO: 63757 - DNA, 25 bp, Mus musculus
tgcgcgaagagactgaactgaagac

SEQ ID NO: 63758 - DNA, 25 bp, Mus musculus
tgcgcgtcacggtacttgacccggg

SEQ ID NO: 63759 - DNA, 25 bp, Mus musculus
tgcgctaacccagagagtagctccg

SEQ ID NO: 63760 - DNA, 25 bp, Mus musculus
tgcgctacggtgactatgtcatcaa

SEQ ID NO: 63761 - DNA, 25 bp, Mus musculus
tgcgctacggtgtctatgtcatcaa

SEQ ID NO: 63762 - DNA, 25 bp, Mus musculus
tgcgctcatgttcaacaacgagctg

SEQ ID NO: 63763 - DNA, 25 bp, Mus musculus
tgcgctccagagtcctatgtacaat

SEQ ID NO: 63764 - DNA, 25 bp, Mus musculus
tgcgctcctgacagccaggtaccag

SEQ ID NO: 63765 - DNA, 25 bp, Mus musculus
tgcgctgaagcgcatcctctatgcc

SEQ ID NO: 63766 - DNA, 25 bp, Mus musculus
tgcgctggccaacaccctggagact

SEQ ID NO: 63767 - DNA, 25 bp, Mus musculus
tgcgctgtgccttgcttgtcctcgg

SEQ ID NO: 63768 - DNA, 25 bp, Mus musculus
tgcgcttccggtaagtgcgagcagc

SEQ ID NO: 63769 - DNA, 25 bp, Mus musculus
tgcgcttgtcaccatcatcaccgtg

SEQ ID NO: 63770 - DNA, 25 bp, Mus musculus
tgcgcttgtcttcttatttcgggaa

SEQ ID NO: 63771 - DNA, 25 bp, Mus musculus
tgcgctttcccaggcttttccagaa

SEQ ID NO: 63772 - DNA, 25 bp, Mus musculus
tgcggaaaaatctctggctcaaagt

SEQ ID NO: 63773 - DNA, 25 bp, Mus musculus
tgcggaaatctaacactcgccagtg

SEQ ID NO: 63774 - DNA, 25 bp, Mus musculus
tgcggaagcagaagattcagtaact

SEQ ID NO: 63775 - DNA, 25 bp, Mus musculus
tgcggaagcagttcggcatgccaga

SEQ ID NO: 63776 - DNA, 25 bp, Mus musculus
tgcggaagtctgcaatgaccccaag

SEQ ID NO: 63777 - DNA, 25 bp, Mus musculus
tgcggacaccacagtcacatcaaca

SEQ ID NO: 63778 - DNA, 25 bp, Mus musculus
tgcggacacccaccaatgcagtgat

SEQ ID NO: 63779 - DNA, 25 bp, Mus musculus
tgcggacagccctcaaccttttctt

SEQ ID NO: 63780 - DNA, 25 bp, Mus musculus
tgcggacgtccacttttcctacttg

SEQ ID NO: 63781 - DNA, 25 bp, Mus musculus
tgcggactcaacctgagaaacgtct

SEQ ID NO: 63782 - DNA, 25 bp, Mus musculus
tgcggagacagctcactcaggagcc

SEQ ID NO: 63783 - DNA, 25 bp, Mus musculus
tgcggagctcaacaagtacaagtac

SEQ ID NO: 63784 - DNA, 25 bp, Mus musculus
tgcggaggtcttatacacagggaga

SEQ ID NO: 63785 - DNA, 25 bp, Mus musculus
tgcggagtgtgcagactatgactcc

SEQ ID NO: 63786 - DNA, 25 bp, Mus musculus
tgcggagttctacctccaggtggat

SEQ ID NO: 63787 - DNA, 25 bp, Mus musculus
tgcggagttttatcagcttgtaagt

SEQ ID NO: 63788 - DNA, 25 bp, Mus musculus
tgcggatgatccaaatgccctgaat

SEQ ID NO: 63789 - DNA, 25 bp, Mus musculus
tgcggatgatcctaatgccctgaat

SEQ ID NO: 63790 - DNA, 25 bp, Mus musculus
tgcggatgcagcacctgtttatgat

SEQ ID NO: 63791 - DNA, 25 bp, Mus musculus
tgcggcagacagtgacgacagcaga

SEQ ID NO: 63792 - DNA, 25 bp, Mus musculus
tgcggcagcacaaagggcggctgga

SEQ ID NO: 63793 - DNA, 25 bp, Mus musculus
tgcggcagcagtggctacttcagca

SEQ ID NO: 63794 - DNA, 25 bp, Mus musculus
tgcggcaggagaagggatccctatt

SEQ ID NO: 63795 - DNA, 25 bp, Mus musculus
tgcggcagtaattgatgtgggtatc

SEQ ID NO: 63796 - DNA, 25 bp, Mus musculus
tgcggcatcgtctacaaacccattt

SEQ ID NO: 63797 - DNA, 25 bp, Mus musculus
tgcggcatgtcatccctgggcacat

SEQ ID NO: 63798 - DNA, 25 bp, Mus musculus
tgcggccatgtttggaggctacagc

SEQ ID NO: 63799 - DNA, 25 bp, Mus musculus
tgcggccattacaaagttgccaagg

SEQ ID NO: 63800 - DNA, 25 bp, Mus musculus
tgcggccttcaccatctcctatgtg

SEQ ID NO: 63801 - DNA, 25 bp, Mus musculus
tgcggctctctggtccactcaagga

SEQ ID NO: 63802 - DNA, 25 bp, Mus musculus
tgcggctggctctggtttaaagcaa

SEQ ID NO: 63803 - DNA, 25 bp, Mus musculus
tgcgggaaaactacgagacgttggt

SEQ ID NO: 63804 - DNA, 25 bp, Mus musculus
tgcgggaagaggtgactttcatcta

SEQ ID NO: 63805 - DNA, 25 bp, Mus musculus
tgcgggaccctgtacataccgtctc

SEQ ID NO: 63806 - DNA, 25 bp, Mus musculus
tgcgggactcatgccaggaaaatgg

SEQ ID NO: 63807 - DNA, 25 bp, Mus musculus
tgcgggagaaattctgagtcacccc

SEQ ID NO: 63808 - DNA, 25 bp, Mus musculus
tgcgggagcccgagtcttcgaatac

SEQ ID NO: 63809 - DNA, 25 bp, Mus musculus
tgcgggaggcatgcttgctaaacaa

SEQ ID NO: 63810 - DNA, 25 bp, Mus musculus
tgcgggccgactgtctatgatgcgt

SEQ ID NO: 63811 - DNA, 25 bp, Mus musculus
tgcgggccgtcttcaccgcagacgg

SEQ ID NO: 63812 - DNA, 25 bp, Mus musculus
tgcgggcctgtttagcacctcagtg

SEQ ID NO: 63813 - DNA, 25 bp, Mus musculus
tgcgggtcaggaacgtttccgtagc

SEQ ID NO: 63814 - DNA, 25 bp, Mus musculus
tgcgggtcgatgagtatgattactc

SEQ ID NO: 63815 - DNA, 25 bp, Mus musculus
tgcggtaccatgcaggtgactccag

SEQ ID NO: 63816 - DNA, 25 bp, Mus musculus
tgcggtacgacgaccacactgtgtg

SEQ ID NO: 63817 - DNA, 25 bp, Mus musculus
tgcggtatggacgagggaaaaatca

SEQ ID NO: 63818 - DNA, 25 bp, Mus musculus
tgcggtcgggcgctcggtatggatg

SEQ ID NO: 63819 - DNA, 25 bp, Mus musculus
tgcggtcgggcggtcggtatggatg

SEQ ID NO: 63820 - DNA, 25 bp, Mus musculus
tgcggtctaacctctatcgggtctg

SEQ ID NO: 63821 - DNA, 25 bp, Mus musculus
tgcggtcttggcatcgatgtagatg

SEQ ID NO: 63822 - DNA, 25 bp, Mus musculus
tgcggtgaatctgaggagcagatcc

SEQ ID NO: 63823 - DNA, 25 bp, Mus musculus
tgcggtgacgcctctaaagagtcat

SEQ ID NO: 63824 - DNA, 25 bp, Mus musculus
tgcggttcaatcagaaactgttccg

SEQ ID NO: 63825 - DNA, 25 bp, Mus musculus
tgcggttccaaggaagaggagtcca

SEQ ID NO: 63826 - DNA, 25 bp, Mus musculus
tgcgtacattcaccaggtgacgata

SEQ ID NO: 63827 - DNA, 25 bp, Mus musculus
tgcgtagaatcgagatttcttaggg

SEQ ID NO: 63828 - DNA, 25 bp, Mus musculus
tgcgtcccctgtgggtctctagagt

SEQ ID NO: 63829 - DNA, 25 bp, Mus musculus
tgcgtcctgcttcaatgacctatga

SEQ ID NO: 63830 - DNA, 25 bp, Mus musculus
tgcgtctccatgacagtatttctga

SEQ ID NO: 63831 - DNA, 25 bp, Mus musculus
tgcgtctcccgatgccgcagggaag

SEQ ID NO: 63832 - DNA, 25 bp, Mus musculus
tgcgtctgactggacatttttacac

SEQ ID NO: 63833 - DNA, 25 bp, Mus musculus
tgcgtctgggctgtggaagctcacc

SEQ ID NO: 63834 - DNA, 25 bp, Mus musculus
tgcgtctgggtgagatcccagtgta

SEQ ID NO: 63835 - DNA, 25 bp, Mus musculus
tgcgtctttcctcctgtggccttca

SEQ ID NO: 63836 - DNA, 25 bp, Mus musculus
tgcgtgacctagacttcaaccccaa

SEQ ID NO: 63837 - DNA, 25 bp, Mus musculus
tgcgtgatgcaaagaacttaattga

SEQ ID NO: 63838 - DNA, 25 bp, Mus musculus
tgcgtgctgaatgatgctgggaccc

SEQ ID NO: 63839 - DNA, 25 bp, Mus musculus
tgcgtggaccaacatagaccctggg

SEQ ID NO: 63840 - DNA, 25 bp, Mus musculus
tgcgtggaccaagatagaccctggg

SEQ ID NO: 63841 - DNA, 25 bp, Mus musculus
tgcgtgtcaccgatggagctctggt

SEQ ID NO: 63842 - DNA, 25 bp, Mus musculus
tgcgtgtgaacttggacatgggcaa

SEQ ID NO: 63843 - DNA, 25 bp, Mus musculus
tgcgtgttcatcatgttggccaatc

SEQ ID NO: 63844 - DNA, 25 bp, Mus musculus
tgcgtgttcatcttgttggccaatc

SEQ ID NO: 63845 - DNA, 25 bp, Mus musculus
tgcgttaactctccagaggaccctg

SEQ ID NO: 63846 - DNA, 25 bp, Mus musculus
tgcgttctatgagcgccggtcttgt

SEQ ID NO: 63847 - DNA, 25 bp, Mus musculus
tgcgttggacacaaaaggacagctg

SEQ ID NO: 63848 - DNA, 25 bp, Mus musculus
tgcgtttcgcctcggctgtgctcct

SEQ ID NO: 63849 - DNA, 25 bp, Mus musculus
tgcgtttcgcctgggctgtgctcct

SEQ ID NO: 63850 - DNA, 25 bp, Mus musculus
tgctaaaactgtccgggaatttctg

SEQ ID NO: 63851 - DNA, 25 bp, Mus musculus
tgctaaaactgtcttcgtagaagac

SEQ ID NO: 63852 - DNA, 25 bp, Mus musculus
tgctaacacatagcgaggaggagct

SEQ ID NO: 63853 - DNA, 25 bp, Mus musculus
tgctaacaggattttacggataggg

SEQ ID NO: 63854 - DNA, 25 bp, Mus musculus
tgctaaccaacagtctaggcctgat

SEQ ID NO: 63855 - DNA, 25 bp, Mus musculus
tgctaacgtgtacatgagaccttgg

SEQ ID NO: 63856 - DNA, 25 bp, Mus musculus
tgctaactcaggttctgcagcgggc

SEQ ID NO: 63857 - DNA, 25 bp, Mus musculus
tgctaagaggccaaaaagggaagag

SEQ ID NO: 63858 - DNA, 25 bp, Mus musculus
tgctaagatgcacaaggacttgaaa

SEQ ID NO: 63859 - DNA, 25 bp, Mus musculus
tgctaagattagagctacccgcccc

SEQ ID NO: 63860 - DNA, 25 bp, Mus musculus
tgctaaggcggctggtagccttgct

SEQ ID NO: 63861 - DNA, 25 bp, Mus musculus
tgctaatactagcaaaacacccacc

SEQ ID NO: 63862 - DNA, 25 bp, Mus musculus
tgctaatactaggaaaacacccacc

SEQ ID NO: 63863 - DNA, 25 bp, Mus musculus
tgctaatatgttccctcacctgaag

SEQ ID NO: 63864 - DNA, 25 bp, Mus musculus
tgctaatcatggaaggagccacaca

SEQ ID NO: 63865 - DNA, 25 bp, Mus musculus
tgctaatcattcagtaaatccaaac

SEQ ID NO: 63866 - DNA, 25 bp, Mus musculus
tgctaatcttagcagtgtcccgccc

SEQ ID NO: 63867 - DNA, 25 bp, Mus musculus
tgctaatgaagacaatgtcactcag

SEQ ID NO: 63868 - DNA, 25 bp, Mus musculus
tgctaatgcgcgaagagactgaact

SEQ ID NO: 63869 - DNA, 25 bp, Mus musculus
tgctaatggtcatagcagcactaac

SEQ ID NO: 63870 - DNA, 25 bp, Mus musculus
tgctacaactggctgcaccgaagac

SEQ ID NO: 63871 - DNA, 25 bp, Mus musculus
tgctacaaggcgctcacctgtgagc

SEQ ID NO: 63872 - DNA, 25 bp, Mus musculus
tgctacaccaggagaccctgccaga

SEQ ID NO: 63873 - DNA, 25 bp, Mus musculus
tgctacactgactacctctggacca

SEQ ID NO: 63874 - DNA, 25 bp, Mus musculus
tgctacaggactacgagcgtgctgc

SEQ ID NO: 63875 - DNA, 25 bp, Mus musculus
tgctacaggcagaggtgacagcctt

SEQ ID NO: 63876 - DNA, 25 bp, Mus musculus
tgctacagggatcccgggtacccag

SEQ ID NO: 63877 - DNA, 25 bp, Mus musculus
tgctacagtgccagggatgaagaag

SEQ ID NO: 63878 - DNA, 25 bp, Mus musculus
tgctacatgtgtgctttcagagcag

SEQ ID NO: 63879 - DNA, 25 bp, Mus musculus
tgctaccaagtacacagataaagac

SEQ ID NO: 63880 - DNA, 25 bp, Mus musculus
tgctaccaccattgccagcacaggt

SEQ ID NO: 63881 - DNA, 25 bp, Mus musculus
tgctaccggactgggctgatgtccc

SEQ ID NO: 63882 - DNA, 25 bp, Mus musculus
tgctacctcccaggagctggaacgt

SEQ ID NO: 63883 - DNA, 25 bp, Mus musculus
tgctacgagtgctatggagtgccaa

SEQ ID NO: 63884 - DNA, 25 bp, Mus musculus
tgctacgctgtcgacactggatcct

SEQ ID NO: 63885 - DNA, 25 bp, Mus musculus
tgctacggaagagcgaggcactatg

SEQ ID NO: 63886 - DNA, 25 bp, Mus musculus
tgctacgtgaccagacaggaggtgt

SEQ ID NO: 63887 - DNA, 25 bp, Mus musculus
tgctactacaaaacctacagaatgg

SEQ ID NO: 63888 - DNA, 25 bp, Mus musculus
tgctactacgctactatgagtctcc

SEQ ID NO: 63889 - DNA, 25 bp, Mus musculus
tgctactctcagaggcagtgagccg

SEQ ID NO: 63890 - DNA, 25 bp, Mus musculus
tgctactgggtggtgctttagcacc

SEQ ID NO: 63891 - DNA, 25 bp, Mus musculus
tgctactggtccttctgcggcatcg

SEQ ID NO: 63892 - DNA, 25 bp, Mus musculus
tgctacttcacgatgccatccagat

SEQ ID NO: 63893 - DNA, 25 bp, Mus musculus
tgctagaagaatttagaaggcatag

SEQ ID NO: 63894 - DNA, 25 bp, Mus musculus
tgctagaagctgagcggagactgca

SEQ ID NO: 63895 - DNA, 25 bp, Mus musculus
tgctagaatacctgaagattgccca

SEQ ID NO: 63896 - DNA, 25 bp, Mus musculus
tgctagaatcgcagtctcagctgga

SEQ ID NO: 63897 - DNA, 25 bp, Mus musculus
tgctagactcatcagtggagaggaa

SEQ ID NO: 63898 - DNA, 25 bp, Mus musculus
tgctagatgcctggagccagagtta

SEQ ID NO: 63899 - DNA, 25 bp, Mus musculus
tgctagatttgggtctgtggcgcaa

SEQ ID NO: 63900 - DNA, 25 bp, Mus musculus
tgctagcaagacagagcgaccagct

SEQ ID NO: 63901 - DNA, 25 bp, Mus musculus
tgctagcacatatgtatgggtccag

SEQ ID NO: 63902 - DNA, 25 bp, Mus musculus
tgctagccaggtcctgaattctctg

SEQ ID NO: 63903 - DNA, 25 bp, Mus musculus
tgctagccatcgctcagaaaaaagt

SEQ ID NO: 63904 - DNA, 25 bp, Mus musculus
tgctagcctggaccatttttcagat

SEQ ID NO: 63905 - DNA, 25 bp, Mus musculus
tgctagcgcttccaccagctctctt

SEQ ID NO: 63906 - DNA, 25 bp, Mus musculus
tgctagctacttaggaggtgtgtcg

SEQ ID NO: 63907 - DNA, 25 bp, Mus musculus
tgctagctactttggaggtgtgtcg

SEQ ID NO: 63908 - DNA, 25 bp, Mus musculus
tgctagctgtaggactaggtgttgc

SEQ ID NO: 63909 - DNA, 25 bp, Mus musculus
tgctagctgtccttgccacgttact

SEQ ID NO: 63910 - DNA, 25 bp, Mus musculus
tgctaggcaacggtgtggcccagcc

SEQ ID NO: 63911 - DNA, 25 bp, Mus musculus
tgctaggtagttcaaattggcctgg

SEQ ID NO: 63912 - DNA, 25 bp, Mus musculus
tgctaggtcttccagagtctcagaa

SEQ ID NO: 63913 - DNA, 25 bp, Mus musculus
tgctagtgattcaagttcatccaca

SEQ ID NO: 63914 - DNA, 25 bp, Mus musculus
tgctagtggctatcagaaattcaca

SEQ ID NO: 63915 - DNA, 25 bp, Mus musculus
tgctatacattgaacccggtgcttt

SEQ ID NO: 63916 - DNA, 25 bp, Mus musculus
tgctatatcatggtatcagaagaag

SEQ ID NO: 63917 - DNA, 25 bp, Mus musculus
tgctatccccattgtggcggccaag

SEQ ID NO: 63918 - DNA, 25 bp, Mus musculus
tgctatccccgacaaccacaagttt

SEQ ID NO: 63919 - DNA, 25 bp, Mus musculus
tgctatcctggcaacacactagtca

SEQ ID NO: 63920 - DNA, 25 bp, Mus musculus
tgctatcctggctacacactagtca

SEQ ID NO: 63921 - DNA, 25 bp, Mus musculus
tgctatctgtctggaggagtatgaa

SEQ ID NO: 63922 - DNA, 25 bp, Mus musculus
tgctatgatgagtttggtttccgtg

SEQ ID NO: 63923 - DNA, 25 bp, Mus musculus
tgctatggacgcaagccatccgtct

SEQ ID NO: 63924 - DNA, 25 bp, Mus musculus
tgctatggatatgagaccgtgcttg

SEQ ID NO: 63925 - DNA, 25 bp, Mus musculus
tgctatggtgacagactatggagct

SEQ ID NO: 63926 - DNA, 25 bp, Mus musculus
tgctatgtgcccagcccggtgctgg

SEQ ID NO: 63927 - DNA, 25 bp, Mus musculus
tgctatgtgtcgtgcttcagttcct

SEQ ID NO: 63928 - DNA, 25 bp, Mus musculus
tgctattcccatcacgggtgaacag

SEQ ID NO: 63929 - DNA, 25 bp, Mus musculus
tgctattgaaagagagtatgcacag

SEQ ID NO: 63930 - DNA, 25 bp, Mus musculus
tgctattggagatcctcgtggaagt

SEQ ID NO: 63931 - DNA, 25 bp, Mus musculus
tgctattttctggactatggtgccg

SEQ ID NO: 63932 - DNA, 25 bp, Mus musculus
tgctcaaactcaaggattccagctg

SEQ ID NO: 63933 - DNA, 25 bp, Mus musculus
tgctcaaagccctgggtcgcttgga

SEQ ID NO: 63934 - DNA, 25 bp, Mus musculus
tgctcaacgtgcagtcatagcctgg

SEQ ID NO: 63935 - DNA, 25 bp, Mus musculus
tgctcaagagtgcactgtgggtaac

SEQ ID NO: 63936 - DNA, 25 bp, Mus musculus
tgctcaaggcctacctgtgaccaag

SEQ ID NO: 63937 - DNA, 25 bp, Mus musculus
tgctcaaggctgtgatgcgccgctg

SEQ ID NO: 63938 - DNA, 25 bp, Mus musculus
tgctcaagggcctgtgtcaccctcg

SEQ ID NO: 63939 - DNA, 25 bp, Mus musculus
tgctcacaacttcacagtacctggt

SEQ ID NO: 63940 - DNA, 25 bp, Mus musculus
tgctcacacgggactgacagagagg

SEQ ID NO: 63941 - DNA, 25 bp, Mus musculus
tgctcacagagcgtggacagtgccg

SEQ ID NO: 63942 - DNA, 25 bp, Mus musculus
tgctcacagtggtctgtatcctgga

SEQ ID NO: 63943 - DNA, 25 bp, Mus musculus
tgctcacatagacgctgtaaacaga

SEQ ID NO: 63944 - DNA, 25 bp, Mus musculus
tgctcaccaaggctcatgcatctga

SEQ ID NO: 63945 - DNA, 25 bp, Mus musculus
tgctcacgaagagactggtggtgta

SEQ ID NO: 63946 - DNA, 25 bp, Mus musculus
tgctcactatccctccactgtgatg

SEQ ID NO: 63947 - DNA, 25 bp, Mus musculus
tgctcactggatgacagacttaaaa

SEQ ID NO: 63948 - DNA, 25 bp, Mus musculus
tgctcagaaaacttaacttggctcc

SEQ ID NO: 63949 - DNA, 25 bp, Mus musculus
tgctcagacacttcctgcagggttt

SEQ ID NO: 63950 - DNA, 25 bp, Mus musculus
tgctcagactactcgcacagcgtac

SEQ ID NO: 63951 - DNA, 25 bp, Mus musculus
tgctcagactgcctgctcacaggac

SEQ ID NO: 63952 - DNA, 25 bp, Mus musculus
tgctcagagaggagctggctgacct

SEQ ID NO: 63953 - DNA, 25 bp, Mus musculus
tgctcagatcctagagaaggatgcg

SEQ ID NO: 63954 - DNA, 25 bp, Mus musculus
tgctcagccaccaaaagtaactacc

SEQ ID NO: 63955 - DNA, 25 bp, Mus musculus
tgctcagccagttctgctcacctgt

SEQ ID NO: 63956 - DNA, 25 bp, Mus musculus
tgctcagcccagtaggcactgagta

SEQ ID NO: 63957 - DNA, 25 bp, Mus musculus
tgctcagctggctctagagaccatg

SEQ ID NO: 63958 - DNA, 25 bp, Mus musculus
tgctcaggaccaagatgagagactg

SEQ ID NO: 63959 - DNA, 25 bp, Mus musculus
tgctcaggagcactacagacgtgga

SEQ ID NO: 63960 - DNA, 25 bp, Mus musculus
tgctcagtctcgtgggtgcacaaag

SEQ ID NO: 63961 - DNA, 25 bp, Mus musculus
tgctcagtgatcaaggatgagggac

SEQ ID NO: 63962 - DNA, 25 bp, Mus musculus
tgctcagtgtgatccctgtatacca

SEQ ID NO: 63963 - DNA, 25 bp, Mus musculus
tgctcataaacgactttgggagaga

SEQ ID NO: 63964 - DNA, 25 bp, Mus musculus
tgctcatcaagaagacctgaattct

SEQ ID NO: 63965 - DNA, 25 bp, Mus musculus
tgctcatcaattttgtacagtagtg

SEQ ID NO: 63966 - DNA, 25 bp, Mus musculus
tgctcatcagcaaagaaaaaagcct

SEQ ID NO: 63967 - DNA, 25 bp, Mus musculus
tgctcatcccgaagtgacctgccag

SEQ ID NO: 63968 - DNA, 25 bp, Mus musculus
tgctcatctgtctgctggagtatcc

SEQ ID NO: 63969 - DNA, 25 bp, Mus musculus
tgctcatggccagcaagaaagatga

SEQ ID NO: 63970 - DNA, 25 bp, Mus musculus
tgctcatgggactggacactgcttc

SEQ ID NO: 63971 - DNA, 25 bp, Mus musculus
tgctcattaatcaccacgagtgtgg

SEQ ID NO: 63972 - DNA, 25 bp, Mus musculus
tgctcattcttttgatgtccgagtg

SEQ ID NO: 63973 - DNA, 25 bp, Mus musculus
tgctccaaatatacagacaggtcgg

SEQ ID NO: 63974 - DNA, 25 bp, Mus musculus
tgctccaagagccaatcacagtggg

SEQ ID NO: 63975 - DNA, 25 bp, Mus musculus
tgctccaaggagactaaaagccatg

SEQ ID NO: 63976 - DNA, 25 bp, Mus musculus
tgctccaaggttacagctccgtggt

SEQ ID NO: 63977 - DNA, 25 bp, Mus musculus
tgctccacagtgatcatgggcaggg

SEQ ID NO: 63978 - DNA, 25 bp, Mus musculus
tgctccacgggctcatcaggaggga

SEQ ID NO: 63979 - DNA, 25 bp, Mus musculus
tgctccagcacaagaatggcctctt

SEQ ID NO: 63980 - DNA, 25 bp, Mus musculus
tgctccaggatttgggacaggacgc

SEQ ID NO: 63981 - DNA, 25 bp, Mus musculus
tgctccagggtcttcgtcgaaaggt

SEQ ID NO: 63982 - DNA, 25 bp, Mus musculus
tgctccagtgtttggcagccctcct

SEQ ID NO: 63983 - DNA, 25 bp, Mus musculus
tgctccatggagtcagtgacacagt

SEQ ID NO: 63984 - DNA, 25 bp, Mus musculus
tgctcccactgcaaccgtgcttttg

SEQ ID NO: 63985 - DNA, 25 bp, Mus musculus
tgctcccactgctaccgtgcttttg

SEQ ID NO: 63986 - DNA, 25 bp, Mus musculus
tgctcccagctctgggatggtgccc

SEQ ID NO: 63987 - DNA, 25 bp, Mus musculus
tgctcccagttgtgctctgcttgct

SEQ ID NO: 63988 - DNA, 25 bp, Mus musculus
tgctcccctcagactatgatctctt

SEQ ID NO: 63989 - DNA, 25 bp, Mus musculus
tgctcccggagcagtagtgtgtgta

SEQ ID NO: 63990 - DNA, 25 bp, Mus musculus
tgctccctgagtatatatttgacgg

SEQ ID NO: 63991 - DNA, 25 bp, Mus musculus
tgctccctggatgactactacctgg

SEQ ID NO: 63992 - DNA, 25 bp, Mus musculus
tgctcccttcgatgttggcatcaag

SEQ ID NO: 63993 - DNA, 25 bp, Mus musculus
tgctcccttgggacactttggaact

SEQ ID NO: 63994 - DNA, 25 bp, Mus musculus
tgctccgcgccgtttgctggagaaa

SEQ ID NO: 63995 - DNA, 25 bp, Mus musculus
tgctccggaaatcttaaagggcaaa

SEQ ID NO: 63996 - DNA, 25 bp, Mus musculus
tgctccggaaattgcagtccctgag

SEQ ID NO: 63997 - DNA, 25 bp, Mus musculus
tgctccggcttcgagaaccattggg

SEQ ID NO: 63998 - DNA, 25 bp, Mus musculus
tgctccgtgccctgtgccgggactg

SEQ ID NO: 63999 - DNA, 25 bp, Mus musculus
tgctccgtggcttcctgctgcagaa

SEQ ID NO: 64000 - DNA, 25 bp, Mus musculus
tgctcctacgtactgaccattcgca

SEQ ID NO: 64001 - DNA, 25 bp, Mus musculus
tgctcctcatctgctcaggtacggt

SEQ ID NO: 64002 - DNA, 25 bp, Mus musculus
tgctcctgaggttcacagatgatac

SEQ ID NO: 64003 - DNA, 25 bp, Mus musculus
tgctcctgataatggctcctccctg

SEQ ID NO: 64004 - DNA, 25 bp, Mus musculus
tgctcctgcctcctatgacgtctag

SEQ ID NO: 64005 - DNA, 25 bp, Mus musculus
tgctcctgggaatttgctggctcgt

SEQ ID NO: 64006 - DNA, 25 bp, Mus musculus
tgctcctgttggacacggtgggatc

SEQ ID NO: 64007 - DNA, 25 bp, Mus musculus
tgctccttggtgtgcaaatggacat

SEQ ID NO: 64008 - DNA, 25 bp, Mus musculus
tgctcctttggtagaagacaagatg

SEQ ID NO: 64009 - DNA, 25 bp, Mus musculus
tgctcgagactccatcaaccttaca

SEQ ID NO: 64010 - DNA, 25 bp, Mus musculus
tgctcgatatctggccatgaataaa

SEQ ID NO: 64011 - DNA, 25 bp, Mus musculus
tgctcgatggctactctgtaatggc

SEQ ID NO: 64012 - DNA, 25 bp, Mus musculus
tgctcgccggctagttggttctgtg

SEQ ID NO: 64013 - DNA, 25 bp, Mus musculus
tgctcgccggcttgttggttctgtg

SEQ ID NO: 64014 - DNA, 25 bp, Mus musculus
tgctcggaggactcttcatctatga

SEQ ID NO: 64015 - DNA, 25 bp, Mus musculus
tgctcggattcaaggcgtgtgttat

SEQ ID NO: 64016 - DNA, 25 bp, Mus musculus
tgctcggctcctgtgtgcagctgat

SEQ ID NO: 64017 - DNA, 25 bp, Mus musculus
tgctcgggcagccagaccgaacaag

SEQ ID NO: 64018 - DNA, 25 bp, Mus musculus
tgctcgggccttggcacctgttgtg

SEQ ID NO: 64019 - DNA, 25 bp, Mus musculus
tgctcggtgagatcaagactgaaac

SEQ ID NO: 64020 - DNA, 25 bp, Mus musculus
tgctcgtctccatcggaaggcagca

SEQ ID NO: 64021 - DNA, 25 bp, Mus musculus
tgctctaaatactgaagaactgcgc

SEQ ID NO: 64022 - DNA, 25 bp, Mus musculus
tgctctacctggatcctcactactg

SEQ ID NO: 64023 - DNA, 25 bp, Mus musculus
tgctctagcaacaagccggccattg

SEQ ID NO: 64024 - DNA, 25 bp, Mus musculus
tgctctcaagggagaaattccatca

SEQ ID NO: 64025 - DNA, 25 bp, Mus musculus
tgctctcagctttttatgagggtgc

SEQ ID NO: 64026 - DNA, 25 bp, Mus musculus
tgctctcagtcaccaaacagttttg

SEQ ID NO: 64027 - DNA, 25 bp, Mus musculus
tgctctcatcgcaatgaggaaattc

SEQ ID NO: 64028 - DNA, 25 bp, Mus musculus
tgctctcatcgctatgaggaaattc

SEQ ID NO: 64029 - DNA, 25 bp, Mus musculus
tgctctccaatggacgtgatggtag

SEQ ID NO: 64030 - DNA, 25 bp, Mus musculus
tgctctcccaggagggattagaccc

SEQ ID NO: 64031 - DNA, 25 bp, Mus musculus
tgctctcccatcaaggtgaagtatg

SEQ ID NO: 64032 - DNA, 25 bp, Mus musculus
tgctctcccgacatctgcactagtg

SEQ ID NO: 64033 - DNA, 25 bp, Mus musculus
tgctctctagctctgacggatgact

SEQ ID NO: 64034 - DNA, 25 bp, Mus musculus
tgctctctaggaagataaggttttc

SEQ ID NO: 64035 - DNA, 25 bp, Mus musculus
tgctctgacgagagcaacagccagg

SEQ ID NO: 64036 - DNA, 25 bp, Mus musculus
tgctctgacggctcgggtcaggcca

SEQ ID NO: 64037 - DNA, 25 bp, Mus musculus
tgctctgagactcactgtcagatcc

SEQ ID NO: 64038 - DNA, 25 bp, Mus musculus
tgctctgatgctggcatttcatgcc

SEQ ID NO: 64039 - DNA, 25 bp, Mus musculus
tgctctgctgaagggaacatgatga

SEQ ID NO: 64040 - DNA, 25 bp, Mus musculus
tgctctgctttttgtcaataagaac

SEQ ID NO: 64041 - DNA, 25 bp, Mus musculus
tgctctggaaacagcctgctttcta

SEQ ID NO: 64042 - DNA, 25 bp, Mus musculus
tgctctggaaagaacgctggagcag

SEQ ID NO: 64043 - DNA, 25 bp, Mus musculus
tgctctggtgcagacagaacctgtg

SEQ ID NO: 64044 - DNA, 25 bp, Mus musculus
tgctctgtaaggagaagcccacaac

SEQ ID NO: 64045 - DNA, 25 bp, Mus musculus
tgctctgtagcatcggaaaggcgtg

SEQ ID NO: 64046 - DNA, 25 bp, Mus musculus
tgctctgtcctgactggaatctgct

SEQ ID NO: 64047 - DNA, 25 bp, Mus musculus
tgctctgtctacagatccgtgtctt

SEQ ID NO: 64048 - DNA, 25 bp, Mus musculus
tgctctgtggcacctgtcaagctga

SEQ ID NO: 64049 - DNA, 25 bp, Mus musculus
tgctctgttctgttgcaacaaagcc

SEQ ID NO: 64050 - DNA, 25 bp, Mus musculus
tgctcttaagacaggtggaccatcc

SEQ ID NO: 64051 - DNA, 25 bp, Mus musculus
tgctcttactggccctggtggctca

SEQ ID NO: 64052 - DNA, 25 bp, Mus musculus
tgctcttaggccagctcctattcag

SEQ ID NO: 64053 - DNA, 25 bp, Mus musculus
tgctcttattctccacagtcaccga

SEQ ID NO: 64054 - DNA, 25 bp, Mus musculus
tgctcttcaacaatgacatgcatga

SEQ ID NO: 64055 - DNA, 25 bp, Mus musculus
tgctcttcagctcactgacctactg

SEQ ID NO: 64056 - DNA, 25 bp, Mus musculus
tgctcttcagggaggtcagtttttt

SEQ ID NO: 64057 - DNA, 25 bp, Mus musculus
tgctcttcccggagagtgaactttc

SEQ ID NO: 64058 - DNA, 25 bp, Mus musculus
tgctcttccgcaatagacctgttcc

SEQ ID NO: 64059 - DNA, 25 bp, Mus musculus
tgctcttcgtcatctgaccagccgg

SEQ ID NO: 64060 - DNA, 25 bp, Mus musculus
tgctcttgagctttctgcactaatt

SEQ ID NO: 64061 - DNA, 25 bp, Mus musculus
tgctcttgctgcatcgtcaacaact

SEQ ID NO: 64062 - DNA, 25 bp, Mus musculus
tgctcttgggtgactgctcagccct

SEQ ID NO: 64063 - DNA, 25 bp, Mus musculus
tgctcttggtcaagcaggacggctc

SEQ ID NO: 64064 - DNA, 25 bp, Mus musculus
tgctctttaaaaactctcggactta

SEQ ID NO: 64065 - DNA, 25 bp, Mus musculus
tgctctttaccaataatggtcaccg

SEQ ID NO: 64066 - DNA, 25 bp, Mus musculus
tgctctttcaactacctgactgggc

SEQ ID NO: 64067 - DNA, 25 bp, Mus musculus
tgctctttcagaaggagagggcctg

SEQ ID NO: 64068 - DNA, 25 bp, Mus musculus
tgctctttgaggtgcactcgctgaa

SEQ ID NO: 64069 - DNA, 25 bp, Mus musculus
tgctgaaaaacctctcccggattca

SEQ ID NO: 64070 - DNA, 25 bp, Mus musculus
tgctgaaactgccacaggtgcttct

SEQ ID NO: 64071 - DNA, 25 bp, Mus musculus
tgctgaaaggaggacccctcagtga

SEQ ID NO: 64072 - DNA, 25 bp, Mus musculus
tgctgaagaaaccacctaccctaga

SEQ ID NO: 64073 - DNA, 25 bp, Mus musculus
tgctgaagagacctgtcacttctga

SEQ ID NO: 64074 - DNA, 25 bp, Mus musculus
tgctgaagaggatggtggtatatca

SEQ ID NO: 64075 - DNA, 25 bp, Mus musculus
tgctgaagagtcttgcaggatctcc

SEQ ID NO: 64076 - DNA, 25 bp, Mus musculus
tgctgaagcacaattcagtaagagc

SEQ ID NO: 64077 - DNA, 25 bp, Mus musculus
tgctgaagcatgtgaatggccagga

SEQ ID NO: 64078 - DNA, 25 bp, Mus musculus
tgctgaagctatcccagacacctct

SEQ ID NO: 64079 - DNA, 25 bp, Mus musculus
tgctgaaggaggagcatcccacgtg

SEQ ID NO: 64080 - DNA, 25 bp, Mus musculus
tgctgaaggaggtgcatcccacgtg

SEQ ID NO: 64081 - DNA, 25 bp, Mus musculus
tgctgaaggttctagccgaactggg

SEQ ID NO: 64082 - DNA, 25 bp, Mus musculus
tgctgaagtctggaaccatggacct

SEQ ID NO: 64083 - DNA, 25 bp, Mus musculus
tgctgaagtgctccagcagggtctg

SEQ ID NO: 64084 - DNA, 25 bp, Mus musculus
tgctgaatcacaggccgatgactgc

SEQ ID NO: 64085 - DNA, 25 bp, Mus musculus
tgctgaatggtctggccactctcca

SEQ ID NO: 64086 - DNA, 25 bp, Mus musculus
tgctgacaaatctgcctaccttatg

SEQ ID NO: 64087 - DNA, 25 bp, Mus musculus
tgctgacacagaggacagtttctct

SEQ ID NO: 64088 - DNA, 25 bp, Mus musculus
tgctgacacatgcatactggctctg

SEQ ID NO: 64089 - DNA, 25 bp, Mus musculus
tgctgacacatggatactggctctg

SEQ ID NO: 64090 - DNA, 25 bp, Mus musculus
tgctgacagcatgggggactgcact

SEQ ID NO: 64091 - DNA, 25 bp, Mus musculus
tgctgacattgacatcgacactgta

SEQ ID NO: 64092 - DNA, 25 bp, Mus musculus
tgctgacattgaccttaaagatgac

SEQ ID NO: 64093 - DNA, 25 bp, Mus musculus
tgctgaccaacaatagaatctggcg

SEQ ID NO: 64094 - DNA, 25 bp, Mus musculus
tgctgaccacgcacactgctcagga

SEQ ID NO: 64095 - DNA, 25 bp, Mus musculus
tgctgaccacgctcactgctcagga

SEQ ID NO: 64096 - DNA, 25 bp, Mus musculus
tgctgaccagaactttgactacatg

SEQ ID NO: 64097 - DNA, 25 bp, Mus musculus
tgctgaccagaagcaggaattcaac

SEQ ID NO: 64098 - DNA, 25 bp, Mus musculus
tgctgaccatctaagctgcaaagcc

SEQ ID NO: 64099 - DNA, 25 bp, Mus musculus
tgctgaccatcttagctgcaaagcc

SEQ ID NO: 64100 - DNA, 25 bp, Mus musculus
tgctgaccatgcacagttgaacgcc

SEQ ID NO: 64101 - DNA, 25 bp, Mus musculus
tgctgaccatggacacctacctagg

SEQ ID NO: 64102 - DNA, 25 bp, Mus musculus
tgctgaccgaggactgaccactcga

SEQ ID NO: 64103 - DNA, 25 bp, Mus musculus
tgctgaccgtggaggtgactcatcc

SEQ ID NO: 64104 - DNA, 25 bp, Mus musculus
tgctgaccttcatcatgttggcccg

SEQ ID NO: 64105 - DNA, 25 bp, Mus musculus
tgctgaccttggatagctcaatacc

SEQ ID NO: 64106 - DNA, 25 bp, Mus musculus
tgctgaccttggcaaatgacagggt

SEQ ID NO: 64107 - DNA, 25 bp, Mus musculus
tgctgacggtgatgaccaagtacca

SEQ ID NO: 64108 - DNA, 25 bp, Mus musculus
tgctgactaccaggaacgcttcaac

SEQ ID NO: 64109 - DNA, 25 bp, Mus musculus
tgctgactgtccaggtgtctgtgcc

SEQ ID NO: 64110 - DNA, 25 bp, Mus musculus
tgctgactgtgcatgggcgcaccaa

SEQ ID NO: 64111 - DNA, 25 bp, Mus musculus
tgctgagacaggaaagtgttaccat

SEQ ID NO: 64112 - DNA, 25 bp, Mus musculus
tgctgagactgcaaaacatcaggcc

SEQ ID NO: 64113 - DNA, 25 bp, Mus musculus
tgctgagagctttcgggatgccatg

SEQ ID NO: 64114 - DNA, 25 bp, Mus musculus
tgctgagagtactgtcgtcctgccc

SEQ ID NO: 64115 - DNA, 25 bp, Mus musculus
tgctgagatatcctgctgatcctta

SEQ ID NO: 64116 - DNA, 25 bp, Mus musculus
tgctgagatggtagctggatgccac

SEQ ID NO: 64117 - DNA, 25 bp, Mus musculus
tgctgagcaggaacttcgtgcagta

SEQ ID NO: 64118 - DNA, 25 bp, Mus musculus
tgctgagccagtttctcagtctacc

SEQ ID NO: 64119 - DNA, 25 bp, Mus musculus
tgctgagcctaaagctccctaggct

SEQ ID NO: 64120 - DNA, 25 bp, Mus musculus
tgctgagctcaaccatgcacaggag

SEQ ID NO: 64121 - DNA, 25 bp, Mus musculus
tgctgagctgtctcaacaacctctt

SEQ ID NO: 64122 - DNA, 25 bp, Mus musculus
tgctgaggaccggaagtctggtcct

SEQ ID NO: 64123 - DNA, 25 bp, Mus musculus
tgctgaggcagtttgacctggcctg

SEQ ID NO: 64124 - DNA, 25 bp, Mus musculus
tgctgaggtccgcacagcatcccag

SEQ ID NO: 64125 - DNA, 25 bp, Mus musculus
tgctgagtaccacctgcggcaccta

SEQ ID NO: 64126 - DNA, 25 bp, Mus musculus
tgctgagtccaaagcagacacgacc

SEQ ID NO: 64127 - DNA, 25 bp, Mus musculus
tgctgagtccacacgggtgatgctg

SEQ ID NO: 64128 - DNA, 25 bp, Mus musculus
tgctgagtccgcagcactcagacta

SEQ ID NO: 64129 - DNA, 25 bp, Mus musculus
tgctgagtgtatcgaggatcctcag

SEQ ID NO: 64130 - DNA, 25 bp, Mus musculus
tgctgagtgtggtaccagccgtgtc

SEQ ID NO: 64131 - DNA, 25 bp, Mus musculus
tgctgataatcactctcaatggaat

SEQ ID NO: 64132 - DNA, 25 bp, Mus musculus
tgctgatagagcctgctcgcattga

SEQ ID NO: 64133 - DNA, 25 bp, Mus musculus
tgctgatataattgacaatcaccgc

SEQ ID NO: 64134 - DNA, 25 bp, Mus musculus
tgctgatcatgaagctgacagagcc

SEQ ID NO: 64135 - DNA, 25 bp, Mus musculus
tgctgatctgggacgatgcccgaga

SEQ ID NO: 64136 - DNA, 25 bp, Mus musculus
tgctgatgaagaaagttacaggact

SEQ ID NO: 64137 - DNA, 25 bp, Mus musculus
tgctgatgaagatagttacaggact

SEQ ID NO: 64138 - DNA, 25 bp, Mus musculus
tgctgatgagctgcttccgagtctg

SEQ ID NO: 64139 - DNA, 25 bp, Mus musculus
tgctgatgctgctttaccttgtagg

SEQ ID NO: 64140 - DNA, 25 bp, Mus musculus
tgctgatgctggtctgccatgctag

SEQ ID NO: 64141 - DNA, 25 bp, Mus musculus
tgctgatgcttattccaatatggga

SEQ ID NO: 64142 - DNA, 25 bp, Mus musculus
tgctgatgggctaatacagcgctct

SEQ ID NO: 64143 - DNA, 25 bp, Mus musculus
tgctgatggtcacttagaccactca

SEQ ID NO: 64144 - DNA, 25 bp, Mus musculus
tgctgatgtaccacagttgagtagg

SEQ ID NO: 64145 - DNA, 25 bp, Mus musculus
tgctgatgtacctcagttgagtagg

SEQ ID NO: 64146 - DNA, 25 bp, Mus musculus
tgctgattcggtaccgcctgcactt

SEQ ID NO: 64147 - DNA, 25 bp, Mus musculus
tgctgattctatagctgagcagatc

SEQ ID NO: 64148 - DNA, 25 bp, Mus musculus
tgctgattctattgctgagcagatc

SEQ ID NO: 64149 - DNA, 25 bp, Mus musculus
tgctgattttcccagatcagtcttc

SEQ ID NO: 64150 - DNA, 25 bp, Mus musculus
tgctgattttccgagatcagtcttc

SEQ ID NO: 64151 - DNA, 25 bp, Mus musculus
tgctgcaaagcacaagaggactgca

SEQ ID NO: 64152 - DNA, 25 bp, Mus musculus
tgctgcaagagcgactgcaagctga

SEQ ID NO: 64153 - DNA, 25 bp, Mus musculus
tgctgcaagtgagaacgtatttaac

SEQ ID NO: 64154 - DNA, 25 bp, Mus musculus
tgctgcaataaaatgtgtgtggtac

SEQ ID NO: 64155 - DNA, 25 bp, Mus musculus
tgctgcaatagctaatactgaaatg

SEQ ID NO: 64156 - DNA, 25 bp, Mus musculus
tgctgcaatgcgcagagccctacaa

SEQ ID NO: 64157 - DNA, 25 bp, Mus musculus
tgctgcacagaatttgcaccagaac

SEQ ID NO: 64158 - DNA, 25 bp, Mus musculus
tgctgcacagcggagcacagagacc

SEQ ID NO: 64159 - DNA, 25 bp, Mus musculus
tgctgcacagctctcctggtggctg

SEQ ID NO: 64160 - DNA, 25 bp, Mus musculus
tgctgcacagttggatgtattaaac

SEQ ID NO: 64161 - DNA, 25 bp, Mus musculus
tgctgcacgctcgggacaagtggct

SEQ ID NO: 64162 - DNA, 25 bp, Mus musculus
tgctgcagaacgtgaggccctgttg

SEQ ID NO: 64163 - DNA, 25 bp, Mus musculus
tgctgcagaagatggtagaggaagt

SEQ ID NO: 64164 - DNA, 25 bp, Mus musculus
tgctgcagaatctcaccatggcctc

SEQ ID NO: 64165 - DNA, 25 bp, Mus musculus
tgctgcagacacactggacgctgga

SEQ ID NO: 64166 - DNA, 25 bp, Mus musculus
tgctgcagataacagataggatttc

SEQ ID NO: 64167 - DNA, 25 bp, Mus musculus
tgctgcagcagcgtgaggagtacca

SEQ ID NO: 64168 - DNA, 25 bp, Mus musculus
tgctgcagcaggaattcttacctgt

SEQ ID NO: 64169 - DNA, 25 bp, Mus musculus
tgctgcagcatcaagcccgaccggg

SEQ ID NO: 64170 - DNA, 25 bp, Mus musculus
tgctgcagcattctgcaaaagttaa

SEQ ID NO: 64171 - DNA, 25 bp, Mus musculus
tgctgcagccgtctgggcaaagcct

SEQ ID NO: 64172 - DNA, 25 bp, Mus musculus
tgctgcagccgtgtgggcaaagcct

SEQ ID NO: 64173 - DNA, 25 bp, Mus musculus
tgctgcagcgctgccgagatcatgg

SEQ ID NO: 64174 - DNA, 25 bp, Mus musculus
tgctgcaggtgagagcctcctcact

SEQ ID NO: 64175 - DNA, 25 bp, Mus musculus
tgctgcagtggctgatgggtgctcc

SEQ ID NO: 64176 - DNA, 25 bp, Mus musculus
tgctgcagttaattacaaaacaggg

SEQ ID NO: 64177 - DNA, 25 bp, Mus musculus
tgctgcatcacagaagctggaagtt

SEQ ID NO: 64178 - DNA, 25 bp, Mus musculus
tgctgcatcgtctgccatcagtgtg

SEQ ID NO: 64179 - DNA, 25 bp, Mus musculus
tgctgcatctgagcctgtgataccc

SEQ ID NO: 64180 - DNA, 25 bp, Mus musculus
tgctgccaagacacctgggcactct

SEQ ID NO: 64181 - DNA, 25 bp, Mus musculus
tgctgccaagattatcaacaccaag

SEQ ID NO: 64182 - DNA, 25 bp, Mus musculus
tgctgccacaaagactgtaaagtgc

SEQ ID NO: 64183 - DNA, 25 bp, Mus musculus
tgctgccaccatgaatgaggtatct

SEQ ID NO: 64184 - DNA, 25 bp, Mus musculus
tgctgccacgtctccagcggtgaag

SEQ ID NO: 64185 - DNA, 25 bp, Mus musculus
tgctgccagagaaatatccctctgc

SEQ ID NO: 64186 - DNA, 25 bp, Mus musculus
tgctgccaggcctagcactgctgag

SEQ ID NO: 64187 - DNA, 25 bp, Mus musculus
tgctgccatcgccaatgctttccgg

SEQ ID NO: 64188 - DNA, 25 bp, Mus musculus
tgctgccattcacggaggctgcatt

SEQ ID NO: 64189 - DNA, 25 bp, Mus musculus
tgctgcccaaactaactccatggtg

SEQ ID NO: 64190 - DNA, 25 bp, Mus musculus
tgctgcccagacaagtgctgttgcc

SEQ ID NO: 64191 - DNA, 25 bp, Mus musculus
tgctgcccaggaaggacaacatcaa

SEQ ID NO: 64192 - DNA, 25 bp, Mus musculus
tgctgcccaggatggacaacatcaa

SEQ ID NO: 64193 - DNA, 25 bp, Mus musculus
tgctgccccaagctgcttcttggtg

SEQ ID NO: 64194 - DNA, 25 bp, Mus musculus
tgctgccccgggagatcgacctcaa

SEQ ID NO: 64195 - DNA, 25 bp, Mus musculus
tgctgccctgtctacattcggcctg

SEQ ID NO: 64196 - DNA, 25 bp, Mus musculus
tgctgccgcgctcaatggaggccac

SEQ ID NO: 64197 - DNA, 25 bp, Mus musculus
tgctgccgcttcaggcggccttgct

SEQ ID NO: 64198 - DNA, 25 bp, Mus musculus
tgctgccgcttctggcggccttgct

SEQ ID NO: 64199 - DNA, 25 bp, Mus musculus
tgctgccggagcaactgtacttcct

SEQ ID NO: 64200 - DNA, 25 bp, Mus musculus
tgctgcctcagaagtggaccgaaga

SEQ ID NO: 64201 - DNA, 25 bp, Mus musculus
tgctgcctgacagacgtccttacag

SEQ ID NO: 64202 - DNA, 25 bp, Mus musculus
tgctgcctgccttcgcagggcatgt

SEQ ID NO: 64203 - DNA, 25 bp, Mus musculus
tgctgccttgaactgtgtggtgcct

SEQ ID NO: 64204 - DNA, 25 bp, Mus musculus
tgctgcggagaagatcattggagct

SEQ ID NO: 64205 - DNA, 25 bp, Mus musculus
tgctgcgggacagcaatgagcagac

SEQ ID NO: 64206 - DNA, 25 bp, Mus musculus
tgctgcgtcccgagatatcactctg

SEQ ID NO: 64207 - DNA, 25 bp, Mus musculus
tgctgctagcctgcagccagggcag

SEQ ID NO: 64208 - DNA, 25 bp, Mus musculus
tgctgctcagtctttaaatgtacag

SEQ ID NO: 64209 - DNA, 25 bp, Mus musculus
tgctgctcatcaagaagacctgaat

SEQ ID NO: 64210 - DNA, 25 bp, Mus musculus
tgctgctcgagaaggagctgcttca

SEQ ID NO: 64211 - DNA, 25 bp, Mus musculus
tgctgctgaaatgggctctgagctg

SEQ ID NO: 64212 - DNA, 25 bp, Mus musculus
tgctgctgaagagcagctcttggga

SEQ ID NO: 64213 - DNA, 25 bp, Mus musculus
tgctgctgacacagaggacagtttc

SEQ ID NO: 64214 - DNA, 25 bp, Mus musculus
tgctgctgaccctgtaactcaaagg

SEQ ID NO: 64215 - DNA, 25 bp, Mus musculus
tgctgctgagtgtatcgaggatcct

SEQ ID NO: 64216 - DNA, 25 bp, Mus musculus
tgctgctgattttgttgaggaccag

SEQ ID NO: 64217 - DNA, 25 bp, Mus musculus
tgctgctgcagtaggttgaaactgt

SEQ ID NO: 64218 - DNA, 25 bp, Mus musculus
tgctgctgcagttggttgaaactgt

SEQ ID NO: 64219 - DNA, 25 bp, Mus musculus
tgctgctgcctcaactcttctcagt

SEQ ID NO: 64220 - DNA, 25 bp, Mus musculus
tgctgctggccctgatcttcattac

SEQ ID NO: 64221 - DNA, 25 bp, Mus musculus
tgctgctgtcaaccctttctttgga

SEQ ID NO: 64222 - DNA, 25 bp, Mus musculus
tgctgctgttagatgagctgctaca

SEQ ID NO: 64223 - DNA, 25 bp, Mus musculus
tgctgctgttcacccagtttatggg

SEQ ID NO: 64224 - DNA, 25 bp, Mus musculus
tgctgctttaccttgtaggaggtgg

SEQ ID NO: 64225 - DNA, 25 bp, Mus musculus
tgctggaaaacgacaggtgctccgt

SEQ ID NO: 64226 - DNA, 25 bp, Mus musculus
tgctggaaatgatggcaagcagttg

SEQ ID NO: 64227 - DNA, 25 bp, Mus musculus
tgctggaacacagtccggtgctgca

SEQ ID NO: 64228 - DNA, 25 bp, Mus musculus
tgctggaagtcctctcaggagacag

SEQ ID NO: 64229 - DNA, 25 bp, Mus musculus
tgctggacaactaatccaaacctgt

SEQ ID NO: 64230 - DNA, 25 bp, Mus musculus
tgctggacaacttatccaaacctgt

SEQ ID NO: 64231 - DNA, 25 bp, Mus musculus
tgctggacagatgcagccacagatt

SEQ ID NO: 64232 - DNA, 25 bp, Mus musculus
tgctggaccctaggacagagcacgg

SEQ ID NO: 64233 - DNA, 25 bp, Mus musculus
tgctggacgttggaggttacatgaa

SEQ ID NO: 64234 - DNA, 25 bp, Mus musculus
tgctggactggatgctatgagttgc

SEQ ID NO: 64235 - DNA, 25 bp, Mus musculus
tgctggagaccaagtggcagttcta

SEQ ID NO: 64236 - DNA, 25 bp, Mus musculus
tgctggagactctcttcgtgcaccg

SEQ ID NO: 64237 - DNA, 25 bp, Mus musculus
tgctggagagtctggcaaaagcacc

SEQ ID NO: 64238 - DNA, 25 bp, Mus musculus
tgctggagcaccagccggacaacat

SEQ ID NO: 64239 - DNA, 25 bp, Mus musculus
tgctggagcctctcgtgtgcaagaa

SEQ ID NO: 64240 - DNA, 25 bp, Mus musculus
tgctggaggccaactgtaaacactg

SEQ ID NO: 64241 - DNA, 25 bp, Mus musculus
tgctggaggccatctgtaaacactg

SEQ ID NO: 64242 - DNA, 25 bp, Mus musculus
tgctggaggtcttattacaaaatca

SEQ ID NO: 64243 - DNA, 25 bp, Mus musculus
tgctggagtatgagccacgctcagg

SEQ ID NO: 64244 - DNA, 25 bp, Mus musculus
tgctggagtgccagccactcttcga

SEQ ID NO: 64245 - DNA, 25 bp, Mus musculus
tgctggagttgaatgaacttaggac

SEQ ID NO: 64246 - DNA, 25 bp, Mus musculus
tgctggatgagcctcagatcccagg

SEQ ID NO: 64247 - DNA, 25 bp, Mus musculus
tgctggatgtcactgaagacttctc

SEQ ID NO: 64248 - DNA, 25 bp, Mus musculus
tgctggattccaccttaactgagaa

SEQ ID NO: 64249 - DNA, 25 bp, Mus musculus
tgctggattcctgcatgccaacaca

SEQ ID NO: 64250 - DNA, 25 bp, Mus musculus
tgctggcaccctggtcatggaggac

SEQ ID NO: 64251 - DNA, 25 bp, Mus musculus
tgctggcagcccctaagggagcaaa

SEQ ID NO: 64252 - DNA, 25 bp, Mus musculus
tgctggcagtgattggaggaccacc

SEQ ID NO: 64253 - DNA, 25 bp, Mus musculus
tgctggcagttgcaggatttgccct

SEQ ID NO: 64254 - DNA, 25 bp, Mus musculus
tgctggcataatacacaccaaaacc

SEQ ID NO: 64255 - DNA, 25 bp, Mus musculus
tgctggcatcgctggaagagctgat

SEQ ID NO: 64256 - DNA, 25 bp, Mus musculus
tgctggccaacacagaatccgtggg

SEQ ID NO: 64257 - DNA, 25 bp, Mus musculus
tgctggccatggctacacctactcg

SEQ ID NO: 64258 - DNA, 25 bp, Mus musculus
tgctggccatgggtacacctactcg

SEQ ID NO: 64259 - DNA, 25 bp, Mus musculus
tgctggcccatgctaagtattttct

SEQ ID NO: 64260 - DNA, 25 bp, Mus musculus
tgctggcccattccttccagcagct

SEQ ID NO: 64261 - DNA, 25 bp, Mus musculus
tgctggccggcctcgccctgtgttg

SEQ ID NO: 64262 - DNA, 25 bp, Mus musculus
tgctggcctccatttgaccaaaaac

SEQ ID NO: 64263 - DNA, 25 bp, Mus musculus
tgctggcgagccagtacatcgtcct

SEQ ID NO: 64264 - DNA, 25 bp, Mus musculus
tgctggcgagcctgtacatcgtcct

SEQ ID NO: 64265 - DNA, 25 bp, Mus musculus
tgctggctacagaccgttcccacta

SEQ ID NO: 64266 - DNA, 25 bp, Mus musculus
tgctggctcacaagattcatgtgta

SEQ ID NO: 64267 - DNA, 25 bp, Mus musculus
tgctggctgatagctgtgctctact

SEQ ID NO: 64268 - DNA, 25 bp, Mus musculus
tgctggctgcagctacgtcacttcc

SEQ ID NO: 64269 - DNA, 25 bp, Mus musculus
tgctggctgcatgcttttgggtgat

SEQ ID NO: 64270 - DNA, 25 bp, Mus musculus
tgctggctgctaaaggataaaagac

SEQ ID NO: 64271 - DNA, 25 bp, Mus musculus
tgctggctgtgaaccaggaaaatga

SEQ ID NO: 64272 - DNA, 25 bp, Mus musculus
tgctggcttaaacactacacacgct

SEQ ID NO: 64273 - DNA, 25 bp, Mus musculus
tgctggcttgcgacgggcttttcaa

SEQ ID NO: 64274 - DNA, 25 bp, Mus musculus
tgctggcttttgtgtcactactggc

SEQ ID NO: 64275 - DNA, 25 bp, Mus musculus
tgctgggaaactcgacataagccag

SEQ ID NO: 64276 - DNA, 25 bp, Mus musculus
tgctgggaaactggacataagccag

SEQ ID NO: 64277 - DNA, 25 bp, Mus musculus
tgctgggaacgctttctgccaggct

SEQ ID NO: 64278 - DNA, 25 bp, Mus musculus
tgctgggaagaagccgctgcatggg

SEQ ID NO: 64279 - DNA, 25 bp, Mus musculus
tgctgggaatcagcggcctcctctt

SEQ ID NO: 64280 - DNA, 25 bp, Mus musculus
tgctgggacccaagtcctcgcggct

SEQ ID NO: 64281 - DNA, 25 bp, Mus musculus
tgctgggagttacaggccctacgac

SEQ ID NO: 64282 - DNA, 25 bp, Mus musculus
tgctgggagtttggacgtctccctc

SEQ ID NO: 64283 - DNA, 25 bp, Mus musculus
tgctgggatttggaagcttatttca

SEQ ID NO: 64284 - DNA, 25 bp, Mus musculus
tgctgggcaatcacatgtatgtctt

SEQ ID NO: 64285 - DNA, 25 bp, Mus musculus
tgctgggcctcatgtatatctactg

SEQ ID NO: 64286 - DNA, 25 bp, Mus musculus
tgctgggcgcacactttgtctgtga

SEQ ID NO: 64287 - DNA, 25 bp, Mus musculus
tgctgggctcttgtcatcctttgga

SEQ ID NO: 64288 - DNA, 25 bp, Mus musculus
tgctgggctgtcaagcactgtgacc

SEQ ID NO: 64289 - DNA, 25 bp, Mus musculus
tgctgggtgatcctcgtgtataact

SEQ ID NO: 64290 - DNA, 25 bp, Mus musculus
tgctgggtgccctgttttcttgtac

SEQ ID NO: 64291 - DNA, 25 bp, Mus musculus
tgctgggtgccggtggagttgggaa

SEQ ID NO: 64292 - DNA, 25 bp, Mus musculus
tgctgggtggctccttcggctttct

SEQ ID NO: 64293 - DNA, 25 bp, Mus musculus
tgctggtaactcaaacctaggtggc

SEQ ID NO: 64294 - DNA, 25 bp, Mus musculus
tgctggtacctgtgaggttggctcc

SEQ ID NO: 64295 - DNA, 25 bp, Mus musculus
tgctggtacttgttttcaaatccat

SEQ ID NO: 64296 - DNA, 25 bp, Mus musculus
tgctggtcttcttcctcatgggcct

SEQ ID NO: 64297 - DNA, 25 bp, Mus musculus
tgctggtgaacctgacggatgcccc

SEQ ID NO: 64298 - DNA, 25 bp, Mus musculus
tgctggtgaccatggtgatgcgact

SEQ ID NO: 64299 - DNA, 25 bp, Mus musculus
tgctggtgctcactggtcatcgtag

SEQ ID NO: 64300 - DNA, 25 bp, Mus musculus
tgctggtggagtcttaccaccatgg

SEQ ID NO: 64301 - DNA, 25 bp, Mus musculus
tgctggtggccacttatgtcttcgt

SEQ ID NO: 64302 - DNA, 25 bp, Mus musculus
tgctggtgttgcgttcaagaagact

SEQ ID NO: 64303 - DNA, 25 bp, Mus musculus
tgctggttgggcagccgcctttctt

SEQ ID NO: 64304 - DNA, 25 bp, Mus musculus
tgctgtaaagcagaagaactgggca

SEQ ID NO: 64305 - DNA, 25 bp, Mus musculus
tgctgtaagcagttctcactatggc

SEQ ID NO: 64306 - DNA, 25 bp, Mus musculus
tgctgtacattgagcttcgtggtca

SEQ ID NO: 64307 - DNA, 25 bp, Mus musculus
tgctgtacccgaacccagcagtgac

SEQ ID NO: 64308 - DNA, 25 bp, Mus musculus
tgctgtagacctcttccgtaatgcg

SEQ ID NO: 64309 - DNA, 25 bp, Mus musculus
tgctgtagactctgttaccctgtga

SEQ ID NO: 64310 - DNA, 25 bp, Mus musculus
tgctgtagatctctccgatccaaca

SEQ ID NO: 64311 - DNA, 25 bp, Mus musculus
tgctgtagatgaggaccggaaaatg

SEQ ID NO: 64312 - DNA, 25 bp, Mus musculus
tgctgtagccggctcagatacacct

SEQ ID NO: 64313 - DNA, 25 bp, Mus musculus
tgctgtagtccttccatgaaatgag

SEQ ID NO: 64314 - DNA, 25 bp, Mus musculus
tgctgtagtgaggaagcacttctgc

SEQ ID NO: 64315 - DNA, 25 bp, Mus musculus
tgctgtagtggatccctggtggaaa

SEQ ID NO: 64316 - DNA, 25 bp, Mus musculus
tgctgtatgagaagatccccagctg

SEQ ID NO: 64317 - DNA, 25 bp, Mus musculus
tgctgtatgaggaccccacagcagc

SEQ ID NO: 64318 - DNA, 25 bp, Mus musculus
tgctgtcaatcctgactcttggaat

SEQ ID NO: 64319 - DNA, 25 bp, Mus musculus
tgctgtcactagcaactggcaaaag

SEQ ID NO: 64320 - DNA, 25 bp, Mus musculus
tgctgtcagacataatctgtccttc

SEQ ID NO: 64321 - DNA, 25 bp, Mus musculus
tgctgtcagatgcacgaccgttgtt

SEQ ID NO: 64322 - DNA, 25 bp, Mus musculus
tgctgtcagggctgtgacccgtatg

SEQ ID NO: 64323 - DNA, 25 bp, Mus musculus
tgctgtcccacattggtgagcgcat

SEQ ID NO: 64324 - DNA, 25 bp, Mus musculus
tgctgtccgggaagggatggctcga

SEQ ID NO: 64325 - DNA, 25 bp, Mus musculus
tgctgtcctctgcaagccggagact

SEQ ID NO: 64326 - DNA, 25 bp, Mus musculus
tgctgtcctggctgcggctacttct

SEQ ID NO: 64327 - DNA, 25 bp, Mus musculus
tgctgtcgctggacctctttctgct

SEQ ID NO: 64328 - DNA, 25 bp, Mus musculus
tgctgtcgctggtcctctttctgct

SEQ ID NO: 64329 - DNA, 25 bp, Mus musculus
tgctgtcggagcaatgaactgggac

SEQ ID NO: 64330 - DNA, 25 bp, Mus musculus
tgctgtctccaagatgttaaataag

SEQ ID NO: 64331 - DNA, 25 bp, Mus musculus
tgctgtctccatcttgacaccacga

SEQ ID NO: 64332 - DNA, 25 bp, Mus musculus
tgctgtctcggacacacaggcatct

SEQ ID NO: 64333 - DNA, 25 bp, Mus musculus
tgctgtctcgggacatggcaggcta

SEQ ID NO: 64334 - DNA, 25 bp, Mus musculus
tgctgtctctgtccttctacaggaa

SEQ ID NO: 64335 - DNA, 25 bp, Mus musculus
tgctgtctctgtcgtatttaagaaa

SEQ ID NO: 64336 - DNA, 25 bp, Mus musculus
tgctgtctgctagccaggtcctgaa

SEQ ID NO: 64337 - DNA, 25 bp, Mus musculus
tgctgtctgtggtgttcctgagagc

SEQ ID NO: 64338 - DNA, 25 bp, Mus musculus
tgctgtcttcatgggacatgtaaat

SEQ ID NO: 64339 - DNA, 25 bp, Mus musculus
tgctgtgagccaggcgctaaagctt

SEQ ID NO: 64340 - DNA, 25 bp, Mus musculus
tgctgtgattccctcttggaagata

SEQ ID NO: 64341 - DNA, 25 bp, Mus musculus
tgctgtgcccaactctgcatcaact

SEQ ID NO: 64342 - DNA, 25 bp, Mus musculus
tgctgtgccggctggaggacttcaa

SEQ ID NO: 64343 - DNA, 25 bp, Mus musculus
tgctgtggagtgtacagtcatccct

SEQ ID NO: 64344 - DNA, 25 bp, Mus musculus
tgctgtggcacagtcgcactacctg

SEQ ID NO: 64345 - DNA, 25 bp, Mus musculus
tgctgtggcccaaaccgcacgggaa

SEQ ID NO: 64346 - DNA, 25 bp, Mus musculus
tgctgtggggttgatccatctcaac

SEQ ID NO: 64347 - DNA, 25 bp, Mus musculus
tgctgtggttagaaacgtgtattac

SEQ ID NO: 64348 - DNA, 25 bp, Mus musculus
tgctgtgtagccaggtgctaaagga

SEQ ID NO: 64349 - DNA, 25 bp, Mus musculus
tgctgtgtcaggtgccggcaccaac

SEQ ID NO: 64350 - DNA, 25 bp, Mus musculus
tgctgtgtcctgagacgtatgtctg

SEQ ID NO: 64351 - DNA, 25 bp, Mus musculus
tgctgtgtgcagagggctatatcct

SEQ ID NO: 64352 - DNA, 25 bp, Mus musculus
tgctgtgttgacgttctggagatcc

SEQ ID NO: 64353 - DNA, 25 bp, Mus musculus
tgctgttaaaagaaaccattgattc

SEQ ID NO: 64354 - DNA, 25 bp, Mus musculus
tgctgttaaaccgagcggctgctgt

SEQ ID NO: 64355 - DNA, 25 bp, Mus musculus
tgctgttatgtcgagagtcaacaag

SEQ ID NO: 64356 - DNA, 25 bp, Mus musculus
tgctgttcgagtcattgagttatgc

SEQ ID NO: 64357 - DNA, 25 bp, Mus musculus
tgctgttcgccaaaatggacagttg

SEQ ID NO: 64358 - DNA, 25 bp, Mus musculus
tgctgttctgaagtggctctaccat

SEQ ID NO: 64359 - DNA, 25 bp, Mus musculus
tgctgttcttctatgccccgtggtg

SEQ ID NO: 64360 - DNA, 25 bp, Mus musculus
tgctgttgaaacaggaacaatctct

SEQ ID NO: 64361 - DNA, 25 bp, Mus musculus
tgctgttgaggatgccattccaagc

SEQ ID NO: 64362 - DNA, 25 bp, Mus musculus
tgctgttggaacagcacctggagaa

SEQ ID NO: 64363 - DNA, 25 bp, Mus musculus
tgctgttggcatggtgttcaccatg

SEQ ID NO: 64364 - DNA, 25 bp, Mus musculus
tgctgttggtgtgcagcaactacac

SEQ ID NO: 64365 - DNA, 25 bp, Mus musculus
tgctgtttcacctcagtgggctgta

SEQ ID NO: 64366 - DNA, 25 bp, Mus musculus
tgctgtttctataggtccaacgtcg

SEQ ID NO: 64367 - DNA, 25 bp, Mus musculus
tgcttaagaagttcctagacccaaa

SEQ ID NO: 64368 - DNA, 25 bp, Mus musculus
tgcttaagtacccagatagtcacca

SEQ ID NO: 64369 - DNA, 25 bp, Mus musculus
tgcttacaagcaggcatgaaccaag

SEQ ID NO: 64370 - DNA, 25 bp, Mus musculus
tgcttacaatggaaatgacgtggac

SEQ ID NO: 64371 - DNA, 25 bp, Mus musculus
tgcttacaatggtaatgacgtggac

SEQ ID NO: 64372 - DNA, 25 bp, Mus musculus
tgcttaccatcctcgagatcctcga

SEQ ID NO: 64373 - DNA, 25 bp, Mus musculus
tgcttaccctcgacagctagagtca

SEQ ID NO: 64374 - DNA, 25 bp, Mus musculus
tgcttaccgcggaggctccctgaag

SEQ ID NO: 64375 - DNA, 25 bp, Mus musculus
tgcttactactgcaaagacatgagt

SEQ ID NO: 64376 - DNA, 25 bp, Mus musculus
tgcttagggcagaagtaacatacag

SEQ ID NO: 64377 - DNA, 25 bp, Mus musculus
tgcttagtaaccatcccagtgcagg

SEQ ID NO: 64378 - DNA, 25 bp, Mus musculus
tgcttataagactcacgggcacaga

SEQ ID NO: 64379 - DNA, 25 bp, Mus musculus
tgcttatagactccctgcaggatca

SEQ ID NO: 64380 - DNA, 25 bp, Mus musculus
tgcttatccctgttggcaccatggg

SEQ ID NO: 64381 - DNA, 25 bp, Mus musculus
tgcttatcctggtcggcgtgggact

SEQ ID NO: 64382 - DNA, 25 bp, Mus musculus
tgcttatctgtctatatgtgcacca

SEQ ID NO: 64383 - DNA, 25 bp, Mus musculus
tgcttatgacttcccagaagaactg

SEQ ID NO: 64384 - DNA, 25 bp, Mus musculus
tgcttatgtctcctggtggccctaa

SEQ ID NO: 64385 - DNA, 25 bp, Mus musculus
tgcttattaacaaacataaccaggc

SEQ ID NO: 64386 - DNA, 25 bp, Mus musculus
tgcttattaacatacataaccaggc

SEQ ID NO: 64387 - DNA, 25 bp, Mus musculus
tgcttattcacaatgaactcttggg

SEQ ID NO: 64388 - DNA, 25 bp, Mus musculus
tgcttatttagttctgggtgtcaac

SEQ ID NO: 64389 - DNA, 25 bp, Mus musculus
tgcttcaagagtagataaatccacg

SEQ ID NO: 64390 - DNA, 25 bp, Mus musculus
tgcttcaataccctgcgcaccaagg

SEQ ID NO: 64391 - DNA, 25 bp, Mus musculus
tgcttcacgagatggatttccagaa

SEQ ID NO: 64392 - DNA, 25 bp, Mus musculus
tgcttcagaagcagtaacatgacct

SEQ ID NO: 64393 - DNA, 25 bp, Mus musculus
tgcttcagactttgaacagcaaagc

SEQ ID NO: 64394 - DNA, 25 bp, Mus musculus
tgcttcaggaatgaaagccatcatg

SEQ ID NO: 64395 - DNA, 25 bp, Mus musculus
tgcttcaggccgtcagcaaagtgct

SEQ ID NO: 64396 - DNA, 25 bp, Mus musculus
tgcttcaggcgatgcccaagaggga

SEQ ID NO: 64397 - DNA, 25 bp, Mus musculus
tgcttcagttacagcgtccccaaca

SEQ ID NO: 64398 - DNA, 25 bp, Mus musculus
tgcttcataggcactgtgattaaag

SEQ ID NO: 64399 - DNA, 25 bp, Mus musculus
tgcttcatcagagtttgacccagaa

SEQ ID NO: 64400 - DNA, 25 bp, Mus musculus
tgcttcatctaaaggcgcaaatgcc

SEQ ID NO: 64401 - DNA, 25 bp, Mus musculus
tgcttcatgcaacagtcacaggaga

SEQ ID NO: 64402 - DNA, 25 bp, Mus musculus
tgcttcccatcttcatccagttcgg

SEQ ID NO: 64403 - DNA, 25 bp, Mus musculus
tgcttccccgaatcccagagtggtg

SEQ ID NO: 64404 - DNA, 25 bp, Mus musculus
tgcttcccttgtgagtcaggattat

SEQ ID NO: 64405 - DNA, 25 bp, Mus musculus
tgcttccgacccgtcagacgtgagg

SEQ ID NO: 64406 - DNA, 25 bp, Mus musculus
tgcttccgagccatcctggatcata

SEQ ID NO: 64407 - DNA, 25 bp, Mus musculus
tgcttcctaagaaagtgctgagata

SEQ ID NO: 64408 - DNA, 25 bp, Mus musculus
tgcttcctacctcaagacaaagggc

SEQ ID NO: 64409 - DNA, 25 bp, Mus musculus
tgcttcgaagcacaccagtggtacc

SEQ ID NO: 64410 - DNA, 25 bp, Mus musculus
tgcttcgagtcttcatccagaaacg

SEQ ID NO: 64411 - DNA, 25 bp, Mus musculus
tgcttcgcccacaacgatgactatg

SEQ ID NO: 64412 - DNA, 25 bp, Mus musculus
tgcttcggctggagcccaatgccca

SEQ ID NO: 64413 - DNA, 25 bp, Mus musculus
tgcttcggtggctggatcggcaact

SEQ ID NO: 64414 - DNA, 25 bp, Mus musculus
tgcttctaccttatgggccataatc

SEQ ID NO: 64415 - DNA, 25 bp, Mus musculus
tgcttctcagctgcgggaacaggag

SEQ ID NO: 64416 - DNA, 25 bp, Mus musculus
tgcttctctgctaaatgtttccaag

SEQ ID NO: 64417 - DNA, 25 bp, Mus musculus
tgcttctgaagaggcctgcctggga

SEQ ID NO: 64418 - DNA, 25 bp, Mus musculus
tgcttctggaatctgcagctgtcag

SEQ ID NO: 64419 - DNA, 25 bp, Mus musculus
tgcttctggaatgtgcagctgtcag

SEQ ID NO: 64420 - DNA, 25 bp, Mus musculus
tgcttctggtgaacatcggctcagg

SEQ ID NO: 64421 - DNA, 25 bp, Mus musculus
tgcttcttctttcgagcaatcgaag

SEQ ID NO: 64422 - DNA, 25 bp, Mus musculus
tgcttcttctttggagcaatcgaag

SEQ ID NO: 64423 - DNA, 25 bp, Mus musculus
tgcttcttgcgcacggatcagctgg

SEQ ID NO: 64424 - DNA, 25 bp, Mus musculus
tgcttgacaaagtcagcattgttca

SEQ ID NO: 64425 - DNA, 25 bp, Mus musculus
tgcttgacgggccaagacaatgaca

SEQ ID NO: 64426 - DNA, 25 bp, Mus musculus
tgcttgactgaactacacctgtggt

SEQ ID NO: 64427 - DNA, 25 bp, Mus musculus
tgcttgaggtgatcattctgactga

SEQ ID NO: 64428 - DNA, 25 bp, Mus musculus
tgcttgagtccacccaagaggccct

SEQ ID NO: 64429 - DNA, 25 bp, Mus musculus
tgcttgagtccagccaagaggccct

SEQ ID NO: 64430 - DNA, 25 bp, Mus musculus
tgcttgagtctggttttcttatccc

SEQ ID NO: 64431 - DNA, 25 bp, Mus musculus
tgcttgatacaagatttgagctgcc

SEQ ID NO: 64432 - DNA, 25 bp, Mus musculus
tgcttgcaatacttcttgcttggcc

SEQ ID NO: 64433 - DNA, 25 bp, Mus musculus
tgcttgcgggatggcatacacaggc

SEQ ID NO: 64434 - DNA, 25 bp, Mus musculus
tgcttgctgtggaaaagtcacacaa

SEQ ID NO: 64435 - DNA, 25 bp, Mus musculus
tgcttgcttactcgagatcgcctgc

SEQ ID NO: 64436 - DNA, 25 bp, Mus musculus
tgcttggctccataatctttcgaaa

SEQ ID NO: 64437 - DNA, 25 bp, Mus musculus
tgcttggctcctaccaaggccttgg

SEQ ID NO: 64438 - DNA, 25 bp, Mus musculus
tgcttgggaagttgcacgtgactcg

SEQ ID NO: 64439 - DNA, 25 bp, Mus musculus
tgcttggtctgaaaccgcatctgct

SEQ ID NO: 64440 - DNA, 25 bp, Mus musculus
tgcttggtgtcgctgcgcttgtcac

SEQ ID NO: 64441 - DNA, 25 bp, Mus musculus
tgcttggtttagtcactctacagaa

SEQ ID NO: 64442 - DNA, 25 bp, Mus musculus
tgcttgtagtgtccagaatcctgag

SEQ ID NO: 64443 - DNA, 25 bp, Mus musculus
tgcttgtgagaaatccaattcagct

SEQ ID NO: 64444 - DNA, 25 bp, Mus musculus
tgcttgtgcccttgaccaaactgga

SEQ ID NO: 64445 - DNA, 25 bp, Mus musculus
tgcttgtggaggactactgctgtct

SEQ ID NO: 64446 - DNA, 25 bp, Mus musculus
tgctttaccttgtaggaggtgggac

SEQ ID NO: 64447 - DNA, 25 bp, Mus musculus
tgctttagcacctgtgatggtccaa

SEQ ID NO: 64448 - DNA, 25 bp, Mus musculus
tgctttagccctcagtgctgtgacc

SEQ ID NO: 64449 - DNA, 25 bp, Mus musculus
tgctttatgtcctctgcgtgctgct

SEQ ID NO: 64450 - DNA, 25 bp, Mus musculus
tgctttcaagcgtttagggactggg

SEQ ID NO: 64451 - DNA, 25 bp, Mus musculus
tgctttcaagctcccacatacagca

SEQ ID NO: 64452 - DNA, 25 bp, Mus musculus
tgctttcaattactggcagacagaa

SEQ ID NO: 64453 - DNA, 25 bp, Mus musculus
tgctttcactaccagaatctatcac

SEQ ID NO: 64454 - DNA, 25 bp, Mus musculus
tgctttcatcaagaagggacagttt

SEQ ID NO: 64455 - DNA, 25 bp, Mus musculus
tgctttcccagaccgccagtagtct

SEQ ID NO: 64456 - DNA, 25 bp, Mus musculus
tgctttccgggatgccttttggcca

SEQ ID NO: 64457 - DNA, 25 bp, Mus musculus
tgctttcctgcagggtaactgtcga

SEQ ID NO: 64458 - DNA, 25 bp, Mus musculus
tgctttcctgggtatgacctacagt

SEQ ID NO: 64459 - DNA, 25 bp, Mus musculus
tgctttccttccaagggttagctga

SEQ ID NO: 64460 - DNA, 25 bp, Mus musculus
tgctttctactaaaagggtatcctg

SEQ ID NO: 64461 - DNA, 25 bp, Mus musculus
tgctttctccgagggcaaagaaggc

SEQ ID NO: 64462 - DNA, 25 bp, Mus musculus
tgctttctgaagcacctgcctcgag

SEQ ID NO: 64463 - DNA, 25 bp, Mus musculus
tgctttcttcagtccctgctctcaa

SEQ ID NO: 64464 - DNA, 25 bp, Mus musculus
tgctttgcaaagtgtgcctgggctc

SEQ ID NO: 64465 - DNA, 25 bp, Mus musculus
tgctttgccttttgaatcagagagt

SEQ ID NO: 64466 - DNA, 25 bp, Mus musculus
tgctttgcggatggaacccggtgac

SEQ ID NO: 64467 - DNA, 25 bp, Mus musculus
tgctttggaaggacccagtcctgac

SEQ ID NO: 64468 - DNA, 25 bp, Mus musculus
tgctttggacgctgctttgctcttc

SEQ ID NO: 64469 - DNA, 25 bp, Mus musculus
tgctttggattcagaagccatccca

SEQ ID NO: 64470 - DNA, 25 bp, Mus musculus
tgctttggtttctgatctagtggcc

SEQ ID NO: 64471 - DNA, 25 bp, Mus musculus
tgctttgtcatcgatctctccatgg

SEQ ID NO: 64472 - DNA, 25 bp, Mus musculus
tgctttgtgccccaactcatgatcc

SEQ ID NO: 64473 - DNA, 25 bp, Mus musculus
tgctttgtgcgagttccggcctctc

SEQ ID NO: 64474 - DNA, 25 bp, Mus musculus
tgctttgtgttgaaactcagtgacc

SEQ ID NO: 64475 - DNA, 25 bp, Mus musculus
tgcttttcaatatccgacaacaaca

SEQ ID NO: 64476 - DNA, 25 bp, Mus musculus
tgcttttcaatatgattccgtctaa

SEQ ID NO: 64477 - DNA, 25 bp, Mus musculus
tgcttttccagagcagaaaagaaac

SEQ ID NO: 64478 - DNA, 25 bp, Mus musculus
tgcttttccatgagagtgtcttgtg

SEQ ID NO: 64479 - DNA, 25 bp, Mus musculus
tgcttttcctatcggagttgcagta

SEQ ID NO: 64480 - DNA, 25 bp, Mus musculus
tgcttttgactctgatgtccttagt

SEQ ID NO: 64481 - DNA, 25 bp, Mus musculus
tgcttttgattgaaagggacagcct

SEQ ID NO: 64482 - DNA, 25 bp, Mus musculus
tgcttttgcctgtacactggcttcc

SEQ ID NO: 64483 - DNA, 25 bp, Mus musculus
tgcttttgcggagtatgttcatcac

SEQ ID NO: 64484 - DNA, 25 bp, Mus musculus
tgctttttatgtccaggagtcctgc

SEQ ID NO: 64485 - DNA, 25 bp, Mus musculus
tgctttttatgtgcaggagtcctgc

SEQ ID NO: 64486 - DNA, 25 bp, Mus musculus
tgctttttctcatcctcatcggata

SEQ ID NO: 64487 - DNA, 25 bp, Mus musculus
tggaaaaaatattagaacagatcac

SEQ ID NO: 64488 - DNA, 25 bp, Mus musculus
tggaaaaagtcgctctaattcttgg

SEQ ID NO: 64489 - DNA, 25 bp, Mus musculus
tggaaaaagtgctagggatccccgc

SEQ ID NO: 64490 - DNA, 25 bp, Mus musculus
tggaaaaattccagtaaggtggact

SEQ ID NO: 64491 - DNA, 25 bp, Mus musculus
tggaaaacattttacattggtggac

SEQ ID NO: 64492 - DNA, 25 bp, Mus musculus
tggaaaaccagtgaatctgggccta

SEQ ID NO: 64493 - DNA, 25 bp, Mus musculus
tggaaaactcggtctcctacagcgc

SEQ ID NO: 64494 - DNA, 25 bp, Mus musculus
tggaaaagaagtctccatctcctgc

SEQ ID NO: 64495 - DNA, 25 bp, Mus musculus
tggaaaagccgaagttcgaggacac

SEQ ID NO: 64496 - DNA, 25 bp, Mus musculus
tggaaaaggcctcgtcattttacag

SEQ ID NO: 64497 - DNA, 25 bp, Mus musculus
tggaaaagggcctcacaccaggcct

SEQ ID NO: 64498 - DNA, 25 bp, Mus musculus
tggaaaagttaaactccagcgacaa

SEQ ID NO: 64499 - DNA, 25 bp, Mus musculus
tggaaaatacagtctcaagagtctt

SEQ ID NO: 64500 - DNA, 25 bp, Mus musculus
tggaaaatcatctgcccggcatgtg

SEQ ID NO: 64501 - DNA, 25 bp, Mus musculus
tggaaacagccttgatgaagacatc

SEQ ID NO: 64502 - DNA, 25 bp, Mus musculus
tggaaacataccagaagattttgat

SEQ ID NO: 64503 - DNA, 25 bp, Mus musculus
tggaaaccatatcccctccagattc

SEQ ID NO: 64504 - DNA, 25 bp, Mus musculus
tggaaaccatccttggcttcacagg

SEQ ID NO: 64505 - DNA, 25 bp, Mus musculus
tggaaacgaggttgtcactgttgaa

SEQ ID NO: 64506 - DNA, 25 bp, Mus musculus
tggaaactatgaaagattcttggac

SEQ ID NO: 64507 - DNA, 25 bp, Mus musculus
tggaaactcgttactttgcaaagaa

SEQ ID NO: 64508 - DNA, 25 bp, Mus musculus
tggaaactgacctggctctgacctt

SEQ ID NO: 64509 - DNA, 25 bp, Mus musculus
tggaaactgacggataatatcaagt

SEQ ID NO: 64510 - DNA, 25 bp, Mus musculus
tggaaactgactttgtagaggtgcc

SEQ ID NO: 64511 - DNA, 25 bp, Mus musculus
tggaaactgtattctggacaaagac

SEQ ID NO: 64512 - DNA, 25 bp, Mus musculus
tggaaacttcgagcgctctgcaggc

SEQ ID NO: 64513 - DNA, 25 bp, Mus musculus
tggaaactttgtggaagccactgct

SEQ ID NO: 64514 - DNA, 25 bp, Mus musculus
tggaaagaacacctggtttagagcc

SEQ ID NO: 64515 - DNA, 25 bp, Mus musculus
tggaaagaacatatgagcttggcct

SEQ ID NO: 64516 - DNA, 25 bp, Mus musculus
tggaaagaagtttgactacagggcc

SEQ ID NO: 64517 - DNA, 25 bp, Mus musculus
tggaaagaatgtagcctgtgacttc

SEQ ID NO: 64518 - DNA, 25 bp, Mus musculus
tggaaagacagcaagcactacgttg

SEQ ID NO: 64519 - DNA, 25 bp, Mus musculus
tggaaagacgggtccactgccacgt

SEQ ID NO: 64520 - DNA, 25 bp, Mus musculus
tggaaagactatcgctgaatcagac

SEQ ID NO: 64521 - DNA, 25 bp, Mus musculus
tggaaagactccattgacggtggcc

SEQ ID NO: 64522 - DNA, 25 bp, Mus musculus
tggaaagagcgatggagtgactacc

SEQ ID NO: 64523 - DNA, 25 bp, Mus musculus
tggaaagccagtcgcacagattgac

SEQ ID NO: 64524 - DNA, 25 bp, Mus musculus
tggaaagccctttgacgccttcacg

SEQ ID NO: 64525 - DNA, 25 bp, Mus musculus
tggaaaggccataatatttctgaag

SEQ ID NO: 64526 - DNA, 25 bp, Mus musculus
tggaaaggcccaatccctaaaatag

SEQ ID NO: 64527 - DNA, 25 bp, Mus musculus
tggaaaggccttctagagatcatct

SEQ ID NO: 64528 - DNA, 25 bp, Mus musculus
tggaaagggtcttggaaatcattaa

SEQ ID NO: 64529 - DNA, 25 bp, Mus musculus
tggaaaggtataaggacaacttcac

SEQ ID NO: 64530 - DNA, 25 bp, Mus musculus
tggaaaggtcaatttacagcgcaag

SEQ ID NO: 64531 - DNA, 25 bp, Mus musculus
tggaaaggtcttccccactagccct

SEQ ID NO: 64532 - DNA, 25 bp, Mus musculus
tggaaaggtgttccctgctgcccgt

SEQ ID NO: 64533 - DNA, 25 bp, Mus musculus
tggaaagtactgatggcgagcgcct

SEQ ID NO: 64534 - DNA, 25 bp, Mus musculus
tggaaagtgagcatagaatctgaac

SEQ ID NO: 64535 - DNA, 25 bp, Mus musculus
tggaaagttcgaaggactctagcct

SEQ ID NO: 64536 - DNA, 25 bp, Mus musculus
tggaaataagcaggacagtgccttt

SEQ ID NO: 64537 - DNA, 25 bp, Mus musculus
tggaaatacctggtgatgaacccct

SEQ ID NO: 64538 - DNA, 25 bp, Mus musculus
tggaaatattcttctgggtgaggat

SEQ ID NO: 64539 - DNA, 25 bp, Mus musculus
tggaaatccggggactcaaggaaga

SEQ ID NO: 64540 - DNA, 25 bp, Mus musculus
tggaaatctaatggatgtcacagag

SEQ ID NO: 64541 - DNA, 25 bp, Mus musculus
tggaaatctacgaccgacgggagta

SEQ ID NO: 64542 - DNA, 25 bp, Mus musculus
tggaaatcttcctaaagcaattctg

SEQ ID NO: 64543 - DNA, 25 bp, Mus musculus
tggaaattagtggaagagaagaaac

SEQ ID NO: 64544 - DNA, 25 bp, Mus musculus
tggaaattctcagagcaagcaatac

SEQ ID NO: 64545 - DNA, 25 bp, Mus musculus
tggaaattgttcctgatcccaggaa

SEQ ID NO: 64546 - DNA, 25 bp, Mus musculus
tggaacaacaggtacaccgcctgct

SEQ ID NO: 64547 - DNA, 25 bp, Mus musculus
tggaacaagccaatgatgacctgga

SEQ ID NO: 64548 - DNA, 25 bp, Mus musculus
tggaacacagacctggtggagaccc

SEQ ID NO: 64549 - DNA, 25 bp, Mus musculus
tggaacactaccgtttacttacatg

SEQ ID NO: 64550 - DNA, 25 bp, Mus musculus
tggaacactgttcttcaccggcagg

SEQ ID NO: 64551 - DNA, 25 bp, Mus musculus
tggaacaggctatccctgtgcggca

SEQ ID NO: 64552 - DNA, 25 bp, Mus musculus
tggaacagtgatgagcacaccacgg

SEQ ID NO: 64553 - DNA, 25 bp, Mus musculus
tggaacatcctctatacactactaa

SEQ ID NO: 64554 - DNA, 25 bp, Mus musculus
tggaacatccttcgcagtgtggctg

SEQ ID NO: 64555 - DNA, 25 bp, Mus musculus
tggaacatctcaaagaacacgtccc

SEQ ID NO: 64556 - DNA, 25 bp, Mus musculus
tggaaccagattacagagattttca

SEQ ID NO: 64557 - DNA, 25 bp, Mus musculus
tggaaccagatttcagagattttca

SEQ ID NO: 64558 - DNA, 25 bp, Mus musculus
tggaacccacacatgaggaggacct

SEQ ID NO: 64559 - DNA, 25 bp, Mus musculus
tggaacccctggtagtcagctctct

SEQ ID NO: 64560 - DNA, 25 bp, Mus musculus
tggaacccctgtaaggttgagaggc

SEQ ID NO: 64561 - DNA, 25 bp, Mus musculus
tggaaccctcttcctggacatgctg

SEQ ID NO: 64562 - DNA, 25 bp, Mus musculus
tggaacctccatgagccagaaagag

SEQ ID NO: 64563 - DNA, 25 bp, Mus musculus
tggaacctccgaatgcacaagaaga

SEQ ID NO: 64564 - DNA, 25 bp, Mus musculus
tggaacctctccttctggtctgaac

SEQ ID NO: 64565 - DNA, 25 bp, Mus musculus
tggaacctgggcagcgccttctttt

SEQ ID NO: 64566 - DNA, 25 bp, Mus musculus
tggaaccttgggaaaacacagagaa

SEQ ID NO: 64567 - DNA, 25 bp, Mus musculus
tggaacgatccagaagcaggacacc

SEQ ID NO: 64568 - DNA, 25 bp, Mus musculus
tggaacggcttgaccacctggcaga

SEQ ID NO: 64569 - DNA, 25 bp, Mus musculus
tggaacgggtacaacgagatgcccg

SEQ ID NO: 64570 - DNA, 25 bp, Mus musculus
tggaacgtgacctcctggatacagg

SEQ ID NO: 64571 - DNA, 25 bp, Mus musculus
tggaacgttttttggcattgcaacc

SEQ ID NO: 64572 - DNA, 25 bp, Mus musculus
tggaactaaactaccccaaaggcag

SEQ ID NO: 64573 - DNA, 25 bp, Mus musculus
tggaactaagtggtaaagggctgct

SEQ ID NO: 64574 - DNA, 25 bp, Mus musculus
tggaactaccagaacaacactgaag

SEQ ID NO: 64575 - DNA, 25 bp, Mus musculus
tggaactactctgccgtggttaaat

SEQ ID NO: 64576 - DNA, 25 bp, Mus musculus
tggaactcagcatttagaccgggtt

SEQ ID NO: 64577 - DNA, 25 bp, Mus musculus
tggaactcagcgagatcaccctgcc

SEQ ID NO: 64578 - DNA, 25 bp, Mus musculus
tggaactcagtgatctgccagcttc

SEQ ID NO: 64579 - DNA, 25 bp, Mus musculus
tggaactcccgcttattggtccccg

SEQ ID NO: 64580 - DNA, 25 bp, Mus musculus
tggaactcctctagaagatagcagc

SEQ ID NO: 64581 - DNA, 25 bp, Mus musculus
tggaactcgccaagtgcaagatgga

SEQ ID NO: 64582 - DNA, 25 bp, Mus musculus
tggaactctgaaaattgttgaccgg

SEQ ID NO: 64583 - DNA, 25 bp, Mus musculus
tggaactgaagttctaggcgcctgt

SEQ ID NO: 64584 - DNA, 25 bp, Mus musculus
tggaactgacagagctcaaatacct

SEQ ID NO: 64585 - DNA, 25 bp, Mus musculus
tggaactggaaattctgagctgcca

SEQ ID NO: 64586 - DNA, 25 bp, Mus musculus
tggaactggcaatgttgttgtgagc

SEQ ID NO: 64587 - DNA, 25 bp, Mus musculus
tggaactgggactctgaggctacct

SEQ ID NO: 64588 - DNA, 25 bp, Mus musculus
tggaactggttctctagaccatgct

SEQ ID NO: 64589 - DNA, 25 bp, Mus musculus
tggaacttaggcaaaacgtataaca

SEQ ID NO: 64590 - DNA, 25 bp, Mus musculus
tggaacttctgggtccagcggcttc

SEQ ID NO: 64591 - DNA, 25 bp, Mus musculus
tggaagaactgaagtgatcgataat

SEQ ID NO: 64592 - DNA, 25 bp, Mus musculus
tggaagaagcccagcgctccctcaa

SEQ ID NO: 64593 - DNA, 25 bp, Mus musculus
tggaagaattcactggaaacagcgg

SEQ ID NO: 64594 - DNA, 25 bp, Mus musculus
tggaagacatcactgcgaagggatg

SEQ ID NO: 64595 - DNA, 25 bp, Mus musculus
tggaagacccattgagcaacagggc

SEQ ID NO: 64596 - DNA, 25 bp, Mus musculus
tggaagaccgagcaggccaccctct

SEQ ID NO: 64597 - DNA, 25 bp, Mus musculus
tggaagacctatcttctggcctggg

SEQ ID NO: 64598 - DNA, 25 bp, Mus musculus
tggaagacctgatcctcaaaggccc

SEQ ID NO: 64599 - DNA, 25 bp, Mus musculus
tggaagacgaaatttgcaaaagcct

SEQ ID NO: 64600 - DNA, 25 bp, Mus musculus
tggaagacgccaagatacactgatg

SEQ ID NO: 64601 - DNA, 25 bp, Mus musculus
tggaagactatgagacccacaaatc

SEQ ID NO: 64602 - DNA, 25 bp, Mus musculus
tggaagagaactactgccggaaccc

SEQ ID NO: 64603 - DNA, 25 bp, Mus musculus
tggaagagaagctagacctggtcac

SEQ ID NO: 64604 - DNA, 25 bp, Mus musculus
tggaagagaagtacagcctgcaaag

SEQ ID NO: 64605 - DNA, 25 bp, Mus musculus
tggaagagaagttcagcctgcaaag

SEQ ID NO: 64606 - DNA, 25 bp, Mus musculus
tggaagagctgatcaaatggctcaa

SEQ ID NO: 64607 - DNA, 25 bp, Mus musculus
tggaagaggcaaaacgcctccaccg

SEQ ID NO: 64608 - DNA, 25 bp, Mus musculus
tggaagataacccactgcattggac

SEQ ID NO: 64609 - DNA, 25 bp, Mus musculus
tggaagataatacagccatctctcc

SEQ ID NO: 64610 - DNA, 25 bp, Mus musculus
tggaagatacactacacaagcacag

SEQ ID NO: 64611 - DNA, 25 bp, Mus musculus
tggaagatcacaataaacagctgga

SEQ ID NO: 64612 - DNA, 25 bp, Mus musculus
tggaagatcttcctggagagaatga

SEQ ID NO: 64613 - DNA, 25 bp, Mus musculus
tggaagatgagctggtgtcactgca

SEQ ID NO: 64614 - DNA, 25 bp, Mus musculus
tggaagatgccagcgactgcatatg

SEQ ID NO: 64615 - DNA, 25 bp, Mus musculus
tggaagatgttacgcatgcactgta

SEQ ID NO: 64616 - DNA, 25 bp, Mus musculus
tggaagatgttaggcatgcactgta

SEQ ID NO: 64617 - DNA, 25 bp, Mus musculus
tggaagatgttgtggagacattgct

SEQ ID NO: 64618 - DNA, 25 bp, Mus musculus
tggaagcacctgagaagtcttcaaa

SEQ ID NO: 64619 - DNA, 25 bp, Mus musculus
tggaagcatgtctcagccagcggcg

SEQ ID NO: 64620 - DNA, 25 bp, Mus musculus
tggaagccacagaaaagtcatgaaa

SEQ ID NO: 64621 - DNA, 25 bp, Mus musculus
tggaagcccctacctcattggcttt

SEQ ID NO: 64622 - DNA, 25 bp, Mus musculus
tggaagccctttccttgtgtacaaa

SEQ ID NO: 64623 - DNA, 25 bp, Mus musculus
tggaagccctttgcttgtgtacaaa

SEQ ID NO: 64624 - DNA, 25 bp, Mus musculus
tggaagccgtccgataccttcacaa

SEQ ID NO: 64625 - DNA, 25 bp, Mus musculus
tggaagcctcatggccgtcgcctgg

SEQ ID NO: 64626 - DNA, 25 bp, Mus musculus
tggaagctacttaatacggaacatc

SEQ ID NO: 64627 - DNA, 25 bp, Mus musculus
tggaagctccccaagttattttcgc

SEQ ID NO: 64628 - DNA, 25 bp, Mus musculus
tggaagctctgtcaccggatctggt

SEQ ID NO: 64629 - DNA, 25 bp, Mus musculus
tggaagctgaaacttattgcagaat

SEQ ID NO: 64630 - DNA, 25 bp, Mus musculus
tggaagctgtttacatcgatgagac

SEQ ID NO: 64631 - DNA, 25 bp, Mus musculus
tggaagcttatttcagaagtctagg

SEQ ID NO: 64632 - DNA, 25 bp, Mus musculus
tggaagcttcccttagctcgggcca

SEQ ID NO: 64633 - DNA, 25 bp, Mus musculus
tggaagcttgaaaaagtactacctc

SEQ ID NO: 64634 - DNA, 25 bp, Mus musculus
tggaaggaagtataaagcaaggcat

SEQ ID NO: 64635 - DNA, 25 bp, Mus musculus
tggaaggaagtggacactccccacg

SEQ ID NO: 64636 - DNA, 25 bp, Mus musculus
tggaaggagcctcgacatttggaca

SEQ ID NO: 64637 - DNA, 25 bp, Mus musculus
tggaaggagcctggacatttggaca

SEQ ID NO: 64638 - DNA, 25 bp, Mus musculus
tggaaggaggaaatccacgtcggct

SEQ ID NO: 64639 - DNA, 25 bp, Mus musculus
tggaaggcccagacactctgacaga

SEQ ID NO: 64640 - DNA, 25 bp, Mus musculus
tggaaggcccagtcactctgacaga

SEQ ID NO: 64641 - DNA, 25 bp, Mus musculus
tggaaggcttcgttcctgcgcgctg

SEQ ID NO: 64642 - DNA, 25 bp, Mus musculus
tggaagggatcgatcacaacccctg

SEQ ID NO: 64643 - DNA, 25 bp, Mus musculus
tggaagggcatcaactgccaaatca

SEQ ID NO: 64644 - DNA, 25 bp, Mus musculus
tggaaggtccccagaagcaatccac

SEQ ID NO: 64645 - DNA, 25 bp, Mus musculus
tggaaggtcccctgaagcaatccac

SEQ ID NO: 64646 - DNA, 25 bp, Mus musculus
tggaaggtgccagaatctagccgtg

SEQ ID NO: 64647 - DNA, 25 bp, Mus musculus
tggaagtacacacagctcagacaca

SEQ ID NO: 64648 - DNA, 25 bp, Mus musculus
tggaagtaggactgcaccatacaca

SEQ ID NO: 64649 - DNA, 25 bp, Mus musculus
tggaagtatccattccccaaggaga

SEQ ID NO: 64650 - DNA, 25 bp, Mus musculus
tggaagtatcgacccaaactgtgat

SEQ ID NO: 64651 - DNA, 25 bp, Mus musculus
tggaagtatcgagccaaactgtgat

SEQ ID NO: 64652 - DNA, 25 bp, Mus musculus
tggaagtcagcacataaacccgtct

SEQ ID NO: 64653 - DNA, 25 bp, Mus musculus
tggaagtccctgttataaagataaa

SEQ ID NO: 64654 - DNA, 25 bp, Mus musculus
tggaagtcgtcaggttattctggac

SEQ ID NO: 64655 - DNA, 25 bp, Mus musculus
tggaagtgctcaacagcgatgctgt

SEQ ID NO: 64656 - DNA, 25 bp, Mus musculus
tggaagtggtgggagtcattcacat

SEQ ID NO: 64657 - DNA, 25 bp, Mus musculus
tggaagttactttgtaaaggattct

SEQ ID NO: 64658 - DNA, 25 bp, Mus musculus
tggaataaagaccagcaagctccct

SEQ ID NO: 64659 - DNA, 25 bp, Mus musculus
tggaataaggagagagtacaatggc

SEQ ID NO: 64660 - DNA, 25 bp, Mus musculus
tggaataaggagtgagtacaatggc

SEQ ID NO: 64661 - DNA, 25 bp, Mus musculus
tggaatacaaaggaggaggcaaagc

SEQ ID NO: 64662 - DNA, 25 bp, Mus musculus
tggaataccaggaatgcccgggaca

SEQ ID NO: 64663 - DNA, 25 bp, Mus musculus
tggaatatctcgtgaaatggaaggg

SEQ ID NO: 64664 - DNA, 25 bp, Mus musculus
tggaatcaacatgatgagtacctct

SEQ ID NO: 64665 - DNA, 25 bp, Mus musculus
tggaatcaccaaaaggaatctaaac

SEQ ID NO: 64666 - DNA, 25 bp, Mus musculus
tggaatcagggctacggcaactact

SEQ ID NO: 64667 - DNA, 25 bp, Mus musculus
tggaatcatccaaaagcatctcaag

SEQ ID NO: 64668 - DNA, 25 bp, Mus musculus
tggaatcatccagacgaaggccctg

SEQ ID NO: 64669 - DNA, 25 bp, Mus musculus
tggaatcccagagccttagcatcca

SEQ ID NO: 64670 - DNA, 25 bp, Mus musculus
tggaatccgcaagaatcagagacgg

SEQ ID NO: 64671 - DNA, 25 bp, Mus musculus
tggaatcctgggatgcccacagagt

SEQ ID NO: 64672 - DNA, 25 bp, Mus musculus
tggaatgaacaggaatcaggcattt

SEQ ID NO: 64673 - DNA, 25 bp, Mus musculus
tggaatgaagtaactcaagatgagc

SEQ ID NO: 64674 - DNA, 25 bp, Mus musculus
tggaatgagaaagtgacgcagtctg

SEQ ID NO: 64675 - DNA, 25 bp, Mus musculus
tggaatgagtggaagtaatgcagca

SEQ ID NO: 64676 - DNA, 25 bp, Mus musculus
tggaatgataccaggtggctgcctc

SEQ ID NO: 64677 - DNA, 25 bp, Mus musculus
tggaatgctccaaccagcatgggag

SEQ ID NO: 64678 - DNA, 25 bp, Mus musculus
tggaatgggcttaaggctccttgct

SEQ ID NO: 64679 - DNA, 25 bp, Mus musculus
tggaatgtgacgaagtggttactga

SEQ ID NO: 64680 - DNA, 25 bp, Mus musculus
tggaatgttcagctagccagctcag

SEQ ID NO: 64681 - DNA, 25 bp, Mus musculus
tggaatgttggagacaatcactggc

SEQ ID NO: 64682 - DNA, 25 bp, Mus musculus
tggaattcagcaatggcctcgattc

SEQ ID NO: 64683 - DNA, 25 bp, Mus musculus
tggaattccggaaacattgctgtga

SEQ ID NO: 64684 - DNA, 25 bp, Mus musculus
tggaattccggaagcaaaaggacat

SEQ ID NO: 64685 - DNA, 25 bp, Mus musculus
tggaattctgcagctatccatctag

SEQ ID NO: 64686 - DNA, 25 bp, Mus musculus
tggaattggaaaagcatatgcagaa

SEQ ID NO: 64687 - DNA, 25 bp, Mus musculus
tggaattgggctgctaacaactttt

SEQ ID NO: 64688 - DNA, 25 bp, Mus musculus
tggaatttgatgtgcagccagccta

SEQ ID NO: 64689 - DNA, 25 bp, Mus musculus
tggacaaaactgaaaacacagccta

SEQ ID NO: 64690 - DNA, 25 bp, Mus musculus
tggacaaaatctaccaggaggacat

SEQ ID NO: 64691 - DNA, 25 bp, Mus musculus
tggacaaacagagaccctaaccatg

SEQ ID NO: 64692 - DNA, 25 bp, Mus musculus
tggacaaaccatgcccgttgctatt

SEQ ID NO: 64693 - DNA, 25 bp, Mus musculus
tggacaaagcagtggagcagaagca

SEQ ID NO: 64694 - DNA, 25 bp, Mus musculus
tggacaaagcctgtcgcccgggact

SEQ ID NO: 64695 - DNA, 25 bp, Mus musculus
tggacaaagtctgcctcatcggctg

SEQ ID NO: 64696 - DNA, 25 bp, Mus musculus
tggacaaataagcaccctgaaagga

SEQ ID NO: 64697 - DNA, 25 bp, Mus musculus
tggacaacagcacaccagcgaagga

SEQ ID NO: 64698 - DNA, 25 bp, Mus musculus
tggacaacatcaaacagcaccaacc

SEQ ID NO: 64699 - DNA, 25 bp, Mus musculus
tggacaacatcatacagcaccaacc

SEQ ID NO: 64700 - DNA, 25 bp, Mus musculus
tggacaacccagacaatcagcaaga

SEQ ID NO: 64701 - DNA, 25 bp, Mus musculus
tggacaaccttgaggctcctcatga

SEQ ID NO: 64702 - DNA, 25 bp, Mus musculus
tggacaaccttgtggctcctcatga

SEQ ID NO: 64703 - DNA, 25 bp, Mus musculus
tggacaactccaagtactgccgttt

SEQ ID NO: 64704 - DNA, 25 bp, Mus musculus
tggacaactctgtggtggacctgga

SEQ ID NO: 64705 - DNA, 25 bp, Mus musculus
tggacaacttatccaaacctgtggc

SEQ ID NO: 64706 - DNA, 25 bp, Mus musculus
tggacaacttatgcaaacctgtggc

SEQ ID NO: 64707 - DNA, 25 bp, Mus musculus
tggacaagaaagtacactgtggatc

SEQ ID NO: 64708 - DNA, 25 bp, Mus musculus
tggacaagatgtctaagggacacat

SEQ ID NO: 64709 - DNA, 25 bp, Mus musculus
tggacaagctccctctgtggcctca

SEQ ID NO: 64710 - DNA, 25 bp, Mus musculus
tggacaagctgctggacgacagccg

SEQ ID NO: 64711 - DNA, 25 bp, Mus musculus
tggacaaggccacccatgtagagaa

SEQ ID NO: 64712 - DNA, 25 bp, Mus musculus
tggacaagtagaatccgtacgattt

SEQ ID NO: 64713 - DNA, 25 bp, Mus musculus
tggacaagtatattctgctgccaca

SEQ ID NO: 64714 - DNA, 25 bp, Mus musculus
tggacaatattcctgtagatcaatg

SEQ ID NO: 64715 - DNA, 25 bp, Mus musculus
tggacaatgacacggagaccgactc

SEQ ID NO: 64716 - DNA, 25 bp, Mus musculus
tggacaatgcagtgggaactgtcac

SEQ ID NO: 64717 - DNA, 25 bp, Mus musculus
tggacaattacttcactgcccggcg

SEQ ID NO: 64718 - DNA, 25 bp, Mus musculus
tggacaattggcctccaagaccgag

SEQ ID NO: 64719 - DNA, 25 bp, Mus musculus
tggacaatttgcttaatatggccta

SEQ ID NO: 64720 - DNA, 25 bp, Mus musculus
tggacaattttctagcccacactat

SEQ ID NO: 64721 - DNA, 25 bp, Mus musculus
tggacacaaaaggacagctgtgagg

SEQ ID NO: 64722 - DNA, 25 bp, Mus musculus
tggacacaccactgagatcttgacg

SEQ ID NO: 64723 - DNA, 25 bp, Mus musculus
tggacacactacagtattgcttcca

SEQ ID NO: 64724 - DNA, 25 bp, Mus musculus
tggacacagacgatttccgcgcctg

SEQ ID NO: 64725 - DNA, 25 bp, Mus musculus
tggacaccaaacaaggtgatttatg

SEQ ID NO: 64726 - DNA, 25 bp, Mus musculus
tggacaccagtgaaaacagacctga

SEQ ID NO: 64727 - DNA, 25 bp, Mus musculus
tggacacctacatgcggcggaaatg

SEQ ID NO: 64728 - DNA, 25 bp, Mus musculus
tggacacctatgacttcgtgtatga

SEQ ID NO: 64729 - DNA, 25 bp, Mus musculus
tggacacctgcctgtacatcttcac

SEQ ID NO: 64730 - DNA, 25 bp, Mus musculus
tggacacctttcatattttcttggg

SEQ ID NO: 64731 - DNA, 25 bp, Mus musculus
tggacacgcactactggacttggat

SEQ ID NO: 64732 - DNA, 25 bp, Mus musculus
tggacacgctatggtaaacaaactg

SEQ ID NO: 64733 - DNA, 25 bp, Mus musculus
tggacactcagcacgcctttgttgg

SEQ ID NO: 64734 - DNA, 25 bp, Mus musculus
tggacactgatgagatcccagccaa

SEQ ID NO: 64735 - DNA, 25 bp, Mus musculus
tggacactggccctgaaaacctaag

SEQ ID NO: 64736 - DNA, 25 bp, Mus musculus
tggacacttctcacactacaaagtc

SEQ ID NO: 64737 - DNA, 25 bp, Mus musculus
tggacagaactggtgctctcctctc

SEQ ID NO: 64738 - DNA, 25 bp, Mus musculus
tggacagaagatgcctctgattggt

SEQ ID NO: 64739 - DNA, 25 bp, Mus musculus
tggacagaatgcaggtccagccaca

SEQ ID NO: 64740 - DNA, 25 bp, Mus musculus
tggacagacagagaaaagagggtct

SEQ ID NO: 64741 - DNA, 25 bp, Mus musculus
tggacagacatgtcgatccctctgg

SEQ ID NO: 64742 - DNA, 25 bp, Mus musculus
tggacagactacaattcatcaacat

SEQ ID NO: 64743 - DNA, 25 bp, Mus musculus
tggacagatattccggcgcagttta

SEQ ID NO: 64744 - DNA, 25 bp, Mus musculus
tggacagatcctaagggtggagccc

SEQ ID NO: 64745 - DNA, 25 bp, Mus musculus
tggacagatgcagccacagattctg

SEQ ID NO: 64746 - DNA, 25 bp, Mus musculus
tggacagcagcaaagaatcagctga

SEQ ID NO: 64747 - DNA, 25 bp, Mus musculus
tggacagcccatagttacagaatgg

SEQ ID NO: 64748 - DNA, 25 bp, Mus musculus
tggacagctgctatagtggagatat

SEQ ID NO: 64749 - DNA, 25 bp, Mus musculus
tggacaggcattcacacttctcttg

SEQ ID NO: 64750 - DNA, 25 bp, Mus musculus
tggacaggcgaactcagagagacct

SEQ ID NO: 64751 - DNA, 25 bp, Mus musculus
tggacagggacgtgaagatgaagaa

SEQ ID NO: 64752 - DNA, 25 bp, Mus musculus
tggacaggtggtcttttctgagaca

SEQ ID NO: 64753 - DNA, 25 bp, Mus musculus
tggacagtaccacctatgatgggac

SEQ ID NO: 64754 - DNA, 25 bp, Mus musculus
tggacagtctggctcagcagactcc

SEQ ID NO: 64755 - DNA, 25 bp, Mus musculus
tggacagtctggtgtactacagcct

SEQ ID NO: 64756 - DNA, 25 bp, Mus musculus
tggacataagccagcagctctggag

SEQ ID NO: 64757 - DNA, 25 bp, Mus musculus
tggacataagcctgcagctctggag

SEQ ID NO: 64758 - DNA, 25 bp, Mus musculus
tggacatacattatctgagaaaaga

SEQ ID NO: 64759 - DNA, 25 bp, Mus musculus
tggacataccaagcgctggtacacg

SEQ ID NO: 64760 - DNA, 25 bp, Mus musculus
tggacatactaaaagtcttcatcgg

SEQ ID NO: 64761 - DNA, 25 bp, Mus musculus
tggacatactcagcagagaaaggtt

SEQ ID NO: 64762 - DNA, 25 bp, Mus musculus
tggacatagccacgtccctgctgga

SEQ ID NO: 64763 - DNA, 25 bp, Mus musculus
tggacatatggaaactatagattag

SEQ ID NO: 64764 - DNA, 25 bp, Mus musculus
tggacatatggatactatagattag

SEQ ID NO: 64765 - DNA, 25 bp, Mus musculus
tggacatcatctgcgcttatgtact

SEQ ID NO: 64766 - DNA, 25 bp, Mus musculus
tggacatcgagcatgcggacagcaa

SEQ ID NO: 64767 - DNA, 25 bp, Mus musculus
tggacatctgagcatgcagagacag

SEQ ID NO: 64768 - DNA, 25 bp, Mus musculus
tggacatgaagaacaccacatgcca

SEQ ID NO: 64769 - DNA, 25 bp, Mus musculus
tggacatgagagctgccacaacctc

SEQ ID NO: 64770 - DNA, 25 bp, Mus musculus
tggacatgataaaacagagacaaag

SEQ ID NO: 64771 - DNA, 25 bp, Mus musculus
tggacatggaagacctatcttctgg

SEQ ID NO: 64772 - DNA, 25 bp, Mus musculus
tggacatggaggaatacgagcctcg

SEQ ID NO: 64773 - DNA, 25 bp, Mus musculus
tggacatggcctccgaactcatgca

SEQ ID NO: 64774 - DNA, 25 bp, Mus musculus
tggacatggggatcttacccaaagg

SEQ ID NO: 64775 - DNA, 25 bp, Mus musculus
tggacatgttggctttatctttaaa

SEQ ID NO: 64776 - DNA, 25 bp, Mus musculus
tggacattcgaatactatcagacat

SEQ ID NO: 64777 - DNA, 25 bp, Mus musculus
tggacattgaaaaagcagagcacat

SEQ ID NO: 64778 - DNA, 25 bp, Mus musculus
tggacattgcaagaggcttgcccct

SEQ ID NO: 64779 - DNA, 25 bp, Mus musculus
tggacattgttcctccttctgaaga

SEQ ID NO: 64780 - DNA, 25 bp, Mus musculus
tggaccaaaccataaattgctcctg

SEQ ID NO: 64781 - DNA, 25 bp, Mus musculus
tggaccaacacaagctcagcaggga

SEQ ID NO: 64782 - DNA, 25 bp, Mus musculus
tggaccaagccctcaagtcgctgat

SEQ ID NO: 64783 - DNA, 25 bp, Mus musculus
tggaccaagtaccactaaatagtac

SEQ ID NO: 64784 - DNA, 25 bp, Mus musculus
tggaccaatagcagcaaccactcat

SEQ ID NO: 64785 - DNA, 25 bp, Mus musculus
tggaccacgccctcaatgacatgac

SEQ ID NO: 64786 - DNA, 25 bp, Mus musculus
tggaccacgctctcaacgatatgac

SEQ ID NO: 64787 - DNA, 25 bp, Mus musculus
tggaccacgggtttaccatcaagag

SEQ ID NO: 64788 - DNA, 25 bp, Mus musculus
tggaccacgtggaattcaagcactt

SEQ ID NO: 64789 - DNA, 25 bp, Mus musculus
tggaccactatattgccggctggaa

SEQ ID NO: 64790 - DNA, 25 bp, Mus musculus
tggaccactggtttgcactcagtgg

SEQ ID NO: 64791 - DNA, 25 bp, Mus musculus
tggaccagcacacagtgaccttgcc

SEQ ID NO: 64792 - DNA, 25 bp, Mus musculus
tggaccagcagcctgaggtctccaa

SEQ ID NO: 64793 - DNA, 25 bp, Mus musculus
tggaccagccgttaacccaggcact

SEQ ID NO: 64794 - DNA, 25 bp, Mus musculus
tggaccagcgagtgccctacacctt

SEQ ID NO: 64795 - DNA, 25 bp, Mus musculus
tggaccagggcatcgatcccaatag

SEQ ID NO: 64796 - DNA, 25 bp, Mus musculus
tggaccagtgcatgacagccctgga

SEQ ID NO: 64797 - DNA, 25 bp, Mus musculus
tggaccatagttactcctccaacac

SEQ ID NO: 64798 - DNA, 25 bp, Mus musculus
tggacccaacagtactctgatcatc

SEQ ID NO: 64799 - DNA, 25 bp, Mus musculus
tggacccaacatcctttgatccaga

SEQ ID NO: 64800 - DNA, 25 bp, Mus musculus
tggacccagcggtactttgatagct

SEQ ID NO: 64801 - DNA, 25 bp, Mus musculus
tggaccccaagccttagtaaacata

SEQ ID NO: 64802 - DNA, 25 bp, Mus musculus
tggaccccgttaccaatcaaaatct

SEQ ID NO: 64803 - DNA, 25 bp, Mus musculus
tggaccccgttagcaatcaaaatct

SEQ ID NO: 64804 - DNA, 25 bp, Mus musculus
tggacccctctgaacatggtggtgg

SEQ ID NO: 64805 - DNA, 25 bp, Mus musculus
tggacccctgggagagtgagcaggc

SEQ ID NO: 64806 - DNA, 25 bp, Mus musculus
tggacccctgtgacattgttggaca

SEQ ID NO: 64807 - DNA, 25 bp, Mus musculus
tggacccgaggcttcttcagcctca

SEQ ID NO: 64808 - DNA, 25 bp, Mus musculus
tggaccctcagaaccagcacacgtt

SEQ ID NO: 64809 - DNA, 25 bp, Mus musculus
tggaccctcgcagggactatcggcg

SEQ ID NO: 64810 - DNA, 25 bp, Mus musculus
tggaccctctttatcgccatccttg

SEQ ID NO: 64811 - DNA, 25 bp, Mus musculus
tggaccgccgaccagcatctgagag

SEQ ID NO: 64812 - DNA, 25 bp, Mus musculus
tggaccggagcagttgccagattgc

SEQ ID NO: 64813 - DNA, 25 bp, Mus musculus
tggaccgtgttcacatccatgccgc

SEQ ID NO: 64814 - DNA, 25 bp, Mus musculus
tggacctagagcgagccaagcggaa

SEQ ID NO: 64815 - DNA, 25 bp, Mus musculus
tggacctcaccgtcctgctgaacaa

SEQ ID NO: 64816 - DNA, 25 bp, Mus musculus
tggacctcttccttaccaaccagtt

SEQ ID NO: 64817 - DNA, 25 bp, Mus musculus
tggacctcttttcacggaattaaag

SEQ ID NO: 64818 - DNA, 25 bp, Mus musculus
tggacctgaagaaggctatccagag

SEQ ID NO: 64819 - DNA, 25 bp, Mus musculus
tggacctgcagtttcttcatgaatg

SEQ ID NO: 64820 - DNA, 25 bp, Mus musculus
tggacctgctgtggaatttggacaa

SEQ ID NO: 64821 - DNA, 25 bp, Mus musculus
tggacctggagacccttcaagctct

SEQ ID NO: 64822 - DNA, 25 bp, Mus musculus
tggacctgggcacttagacacagtg

SEQ ID NO: 64823 - DNA, 25 bp, Mus musculus
tggacctggtcttgtgctctccaac

SEQ ID NO: 64824 - DNA, 25 bp, Mus musculus
tggaccttcgggaaaaacagcagat

SEQ ID NO: 64825 - DNA, 25 bp, Mus musculus
tggaccttgcagcttcctgtaggaa

SEQ ID NO: 64826 - DNA, 25 bp, Mus musculus
tggaccttgcccagaaacacttgag

SEQ ID NO: 64827 - DNA, 25 bp, Mus musculus
tggacgaactgaccctctgcaagtc

SEQ ID NO: 64828 - DNA, 25 bp, Mus musculus
tggacgaagcaacatcagctctgga

SEQ ID NO: 64829 - DNA, 25 bp, Mus musculus
tggacgaatgtgtgacgggcacaca

SEQ ID NO: 64830 - DNA, 25 bp, Mus musculus
tggacgacctggacgcagacatgaa

SEQ ID NO: 64831 - DNA, 25 bp, Mus musculus
tggacgacttcgagacccatttaga

SEQ ID NO: 64832 - DNA, 25 bp, Mus musculus
tggacgagccatgaagtgccaagga

SEQ ID NO: 64833 - DNA, 25 bp, Mus musculus
tggacgcagactggttctgcactgc

SEQ ID NO: 64834 - DNA, 25 bp, Mus musculus
tggacgccttcttgctggagcacgg

SEQ ID NO: 64835 - DNA, 25 bp, Mus musculus
tggacgcttactctttaatgatccg

SEQ ID NO: 64836 - DNA, 25 bp, Mus musculus
tggacggaagctgctggcgtcatcc

SEQ ID NO: 64837 - DNA, 25 bp, Mus musculus
tggacggacgagttgaggccatcaa

SEQ ID NO: 64838 - DNA, 25 bp, Mus musculus
tggacggagaggagtacccaccttc

SEQ ID NO: 64839 - DNA, 25 bp, Mus musculus
tggacggagaggtgtacccaccttc

SEQ ID NO: 64840 - DNA, 25 bp, Mus musculus
tggacggcactctctttgactccag

SEQ ID NO: 64841 - DNA, 25 bp, Mus musculus
tggacgggctctggacgaccatcac

SEQ ID NO: 64842 - DNA, 25 bp, Mus musculus
tggacgtgaagaatagctggctgaa

SEQ ID NO: 64843 - DNA, 25 bp, Mus musculus
tggacgtggatctcctgagtaaaat

SEQ ID NO: 64844 - DNA, 25 bp, Mus musculus
tggactacagcctgcacaaggagag

SEQ ID NO: 64845 - DNA, 25 bp, Mus musculus
tggactacggcaagcatgagctcgt

SEQ ID NO: 64846 - DNA, 25 bp, Mus musculus
tggactactacctgatggatgctgc

SEQ ID NO: 64847 - DNA, 25 bp, Mus musculus
tggactacttcatggcatttggagg

SEQ ID NO: 64848 - DNA, 25 bp, Mus musculus
tggactagcggacatggccagacct

SEQ ID NO: 64849 - DNA, 25 bp, Mus musculus
tggactagctcatctcatggccctg

SEQ ID NO: 64850 - DNA, 25 bp, Mus musculus
tggactagctctctctgcccatgag

SEQ ID NO: 64851 - DNA, 25 bp, Mus musculus
tggactatacgacactgcaggacag

SEQ ID NO: 64852 - DNA, 25 bp, Mus musculus
tggactcagagctagaagacttatg

SEQ ID NO: 64853 - DNA, 25 bp, Mus musculus
tggactccacctctcgaattatgga

SEQ ID NO: 64854 - DNA, 25 bp, Mus musculus
tggactcccctggtgagccaagctt

SEQ ID NO: 64855 - DNA, 25 bp, Mus musculus
tggactcgccaggaatcacagtcat

SEQ ID NO: 64856 - DNA, 25 bp, Mus musculus
tggactctataatcaacaagcggct

SEQ ID NO: 64857 - DNA, 25 bp, Mus musculus
tggactctcctgaatgggaatcact

SEQ ID NO: 64858 - DNA, 25 bp, Mus musculus
tggactctgacactgttgcctcttc

SEQ ID NO: 64859 - DNA, 25 bp, Mus musculus
tggactcttctcagctgatcccaag

SEQ ID NO: 64860 - DNA, 25 bp, Mus musculus
tggactgactctaaagatgcagaat

SEQ ID NO: 64861 - DNA, 25 bp, Mus musculus
tggactgactcttaagatgcagaat

SEQ ID NO: 64862 - DNA, 25 bp, Mus musculus
tggactgactggaggaccccgaact

SEQ ID NO: 64863 - DNA, 25 bp, Mus musculus
tggactgagcccctatgtgaagttc

SEQ ID NO: 64864 - DNA, 25 bp, Mus musculus
tggactgatcggagattactctaag

SEQ ID NO: 64865 - DNA, 25 bp, Mus musculus
tggactgcgatgtgattgtagctga

SEQ ID NO: 64866 - DNA, 25 bp, Mus musculus
tggactggagccaacaagcagcagc

SEQ ID NO: 64867 - DNA, 25 bp, Mus musculus
tggactggcatagaaaagaggagaa

SEQ ID NO: 64868 - DNA, 25 bp, Mus musculus
tggactggtcactctaatgccacgg

SEQ ID NO: 64869 - DNA, 25 bp, Mus musculus
tggactgtgtcgtggctgagatcaa

SEQ ID NO: 64870 - DNA, 25 bp, Mus musculus
tggactgttctcacgctcaaggcaa

SEQ ID NO: 64871 - DNA, 25 bp, Mus musculus
tggacttacaatgcttctgactccg

SEQ ID NO: 64872 - DNA, 25 bp, Mus musculus
tggacttcctcgacattctcctggg

SEQ ID NO: 64873 - DNA, 25 bp, Mus musculus
tggacttcgtctcacaagatgaaat

SEQ ID NO: 64874 - DNA, 25 bp, Mus musculus
tggacttctacaagcctgtggtgtg

SEQ ID NO: 64875 - DNA, 25 bp, Mus musculus
tggacttctacatgcctgtggtgtg

SEQ ID NO: 64876 - DNA, 25 bp, Mus musculus
tggacttgtaaacatcgtggcccgg

SEQ ID NO: 64877 - DNA, 25 bp, Mus musculus
tggagaaaatctcatcgtccctggg

SEQ ID NO: 64878 - DNA, 25 bp, Mus musculus
tggagaaaatggagccaataaacac

SEQ ID NO: 64879 - DNA, 25 bp, Mus musculus
tggagaaatgcagcccaagtgttgg

SEQ ID NO: 64880 - DNA, 25 bp, Mus musculus
tggagaacaaggatcagcaggtagc

SEQ ID NO: 64881 - DNA, 25 bp, Mus musculus
tggagaacagcgagtgctccccaaa

SEQ ID NO: 64882 - DNA, 25 bp, Mus musculus
tggagaaccagagcgactggtacct

SEQ ID NO: 64883 - DNA, 25 bp, Mus musculus
tggagaacccagctcatgctgatgg

SEQ ID NO: 64884 - DNA, 25 bp, Mus musculus
tggagaacccaggtcatgctgatgg

SEQ ID NO: 64885 - DNA, 25 bp, Mus musculus
tggagaaccccaatgacattgtcat

SEQ ID NO: 64886 - DNA, 25 bp, Mus musculus
tggagaaccccattgacattgtcat

SEQ ID NO: 64887 - DNA, 25 bp, Mus musculus
tggagaacctggaagcagataccag

SEQ ID NO: 64888 - DNA, 25 bp, Mus musculus
tggagaacctggtacccctggaaat

SEQ ID NO: 64889 - DNA, 25 bp, Mus musculus
tggagaacctgttgctggacaagcg

SEQ ID NO: 64890 - DNA, 25 bp, Mus musculus
tggagaacgccgtgctcaaggctgt

SEQ ID NO: 64891 - DNA, 25 bp, Mus musculus
tggagaagacagcatgaacttcact

SEQ ID NO: 64892 - DNA, 25 bp, Mus musculus
tggagaagactgatcacaggctgaa

SEQ ID NO: 64893 - DNA, 25 bp, Mus musculus
tggagaagagcgaccagctcactag

SEQ ID NO: 64894 - DNA, 25 bp, Mus musculus
tggagaagagctagaaaccccacca

SEQ ID NO: 64895 - DNA, 25 bp, Mus musculus
tggagaagatccagcctcgggtcat

SEQ ID NO: 64896 - DNA, 25 bp, Mus musculus
tggagaagcatatctccctcctcca

SEQ ID NO: 64897 - DNA, 25 bp, Mus musculus
tggagaagctaaaaggagaacttga

SEQ ID NO: 64898 - DNA, 25 bp, Mus musculus
tggagaagctcccacccgtattgcc

SEQ ID NO: 64899 - DNA, 25 bp, Mus musculus
tggagaagctctgccacaaccttcg

SEQ ID NO: 64900 - DNA, 25 bp, Mus musculus
tggagaaggaacaggatgtactgcc

SEQ ID NO: 64901 - DNA, 25 bp, Mus musculus
tggagaaggaaggtcctggaaacac

SEQ ID NO: 64902 - DNA, 25 bp, Mus musculus
tggagaagggagacatcccgataca

SEQ ID NO: 64903 - DNA, 25 bp, Mus musculus
tggagaagtacaatagggaaatgga

SEQ ID NO: 64904 - DNA, 25 bp, Mus musculus
tggagaagtgccagcccaactccat

SEQ ID NO: 64905 - DNA, 25 bp, Mus musculus
tggagaagtgcctgcccaactccat

SEQ ID NO: 64906 - DNA, 25 bp, Mus musculus
tggagaagttatcagctggtgtttt

SEQ ID NO: 64907 - DNA, 25 bp, Mus musculus
tggagaatcaatttatggtggatac

SEQ ID NO: 64908 - DNA, 25 bp, Mus musculus
tggagaatcccctggacttgctgga

SEQ ID NO: 64909 - DNA, 25 bp, Mus musculus
tggagaatgacaagcttcagctgga

SEQ ID NO: 64910 - DNA, 25 bp, Mus musculus
tggagaattactagccacaggagat

SEQ ID NO: 64911 - DNA, 25 bp, Mus musculus
tggagacaactattccggaaggcct

SEQ ID NO: 64912 - DNA, 25 bp, Mus musculus
tggagacaccgctggatgtgttgtc

SEQ ID NO: 64913 - DNA, 25 bp, Mus musculus
tggagacactgagtcccaacatgct

SEQ ID NO: 64914 - DNA, 25 bp, Mus musculus
tggagacacttctgatacaacttcc

SEQ ID NO: 64915 - DNA, 25 bp, Mus musculus
tggagacagaagcacctgtatccac

SEQ ID NO: 64916 - DNA, 25 bp, Mus musculus
tggagacagaaggacctgtatccac

SEQ ID NO: 64917 - DNA, 25 bp, Mus musculus
tggagacagagtaaatgcagtttgc

SEQ ID NO: 64918 - DNA, 25 bp, Mus musculus
tggagacagagttaatgcagtttgc

SEQ ID NO: 64919 - DNA, 25 bp, Mus musculus
tggagacatagtccctccaacttgc

SEQ ID NO: 64920 - DNA, 25 bp, Mus musculus
tggagacatagtctggagtcttgct

SEQ ID NO: 64921 - DNA, 25 bp, Mus musculus
tggagaccaagacccacatccagga

SEQ ID NO: 64922 - DNA, 25 bp, Mus musculus
tggagaccaaggtgtgccctgtcct

SEQ ID NO: 64923 - DNA, 25 bp, Mus musculus
tggagaccagcctacagggacccca

SEQ ID NO: 64924 - DNA, 25 bp, Mus musculus
tggagacccagactaccgtggtagc

SEQ ID NO: 64925 - DNA, 25 bp, Mus musculus
tggagacccagagtaccgtggtagc

SEQ ID NO: 64926 - DNA, 25 bp, Mus musculus
tggagacccggatccctgtcatcaa

SEQ ID NO: 64927 - DNA, 25 bp, Mus musculus
tggagaccctcggagtaagcccaga

SEQ ID NO: 64928 - DNA, 25 bp, Mus musculus
tggagacctaggctcgccacaccgg

SEQ ID NO: 64929 - DNA, 25 bp, Mus musculus
tggagacctcatcatagtggaaaag

SEQ ID NO: 64930 - DNA, 25 bp, Mus musculus
tggagactagaaaaagaatattgcc

SEQ ID NO: 64931 - DNA, 25 bp, Mus musculus
tggagactctaaggatatccgcctc

SEQ ID NO: 64932 - DNA, 25 bp, Mus musculus
tggagactctcttcgtgcaccgatt

SEQ ID NO: 64933 - DNA, 25 bp, Mus musculus
tggagactggagaatcccctggact

SEQ ID NO: 64934 - DNA, 25 bp, Mus musculus
tggagagaaaacctcaggcacaatg

SEQ ID NO: 64935 - DNA, 25 bp, Mus musculus
tggagagaagaagactgtccctgga

SEQ ID NO: 64936 - DNA, 25 bp, Mus musculus
tggagagaccaaccccgcagactct

SEQ ID NO: 64937 - DNA, 25 bp, Mus musculus
tggagagactctaccagagggatag

SEQ ID NO: 64938 - DNA, 25 bp, Mus musculus
tggagagactgcatgtaagctcgct

SEQ ID NO: 64939 - DNA, 25 bp, Mus musculus
tggagagagtcaatgtcctagacac

SEQ ID NO: 64940 - DNA, 25 bp, Mus musculus
tggagagagtcattgtcctagacac

SEQ ID NO: 64941 - DNA, 25 bp, Mus musculus
tggagagcaaaggaattcctgtcaa

SEQ ID NO: 64942 - DNA, 25 bp, Mus musculus
tggagagcagaaggactcggacaca

SEQ ID NO: 64943 - DNA, 25 bp, Mus musculus
tggagagccaccctttttggcaaat

SEQ ID NO: 64944 - DNA, 25 bp, Mus musculus
tggagagccagtatgaccaggccac

SEQ ID NO: 64945 - DNA, 25 bp, Mus musculus
tggagagcccaagcctaatagaccc

SEQ ID NO: 64946 - DNA, 25 bp, Mus musculus
tggagagcctcagcacagaaaagaa

SEQ ID NO: 64947 - DNA, 25 bp, Mus musculus
tggagagctgcggttcagatttctt

SEQ ID NO: 64948 - DNA, 25 bp, Mus musculus
tggagagctggctccggagcaaccc

SEQ ID NO: 64949 - DNA, 25 bp, Mus musculus
tggagagcttcaagaaacagtcgtt

SEQ ID NO: 64950 - DNA, 25 bp, Mus musculus
tggagaggaaagacagccagaatag

SEQ ID NO: 64951 - DNA, 25 bp, Mus musculus
tggagaggaagtggtcactctaacc

SEQ ID NO: 64952 - DNA, 25 bp, Mus musculus
tggagaggccctccagaccaaaccg

SEQ ID NO: 64953 - DNA, 25 bp, Mus musculus
tggagagtctacacgccaggtcgtg

SEQ ID NO: 64954 - DNA, 25 bp, Mus musculus
tggagagtctctctcacatgccctc

SEQ ID NO: 64955 - DNA, 25 bp, Mus musculus
tggagagtctggcaaaagcaccatt

SEQ ID NO: 64956 - DNA, 25 bp, Mus musculus
tggagagtgactcggccattaatgt

SEQ ID NO: 64957 - DNA, 25 bp, Mus musculus
tggagagtgactgggccattaatgt

SEQ ID NO: 64958 - DNA, 25 bp, Mus musculus
tggagagtgccaccgcagcattaga

SEQ ID NO: 64959 - DNA, 25 bp, Mus musculus
tggagataaacctcgaatgcagacg

SEQ ID NO: 64960 - DNA, 25 bp, Mus musculus
tggagataatctcgaacgacagtat

SEQ ID NO: 64961 - DNA, 25 bp, Mus musculus
tggagataatctggaacgacagtat

SEQ ID NO: 64962 - DNA, 25 bp, Mus musculus
tggagatagatcgaggcagaattgc

SEQ ID NO: 64963 - DNA, 25 bp, Mus musculus
tggagatatcgacccctctgggagc

SEQ ID NO: 64964 - DNA, 25 bp, Mus musculus
tggagatcaaaaagagccggcgtca

SEQ ID NO: 64965 - DNA, 25 bp, Mus musculus
tggagatcacggtcgagaaggacaa

SEQ ID NO: 64966 - DNA, 25 bp, Mus musculus
tggagatcagcgctgtgcactcacg

SEQ ID NO: 64967 - DNA, 25 bp, Mus musculus
tggagatcagtgtgaatcaaatcct

SEQ ID NO: 64968 - DNA, 25 bp, Mus musculus
tggagatcattaccaatgcctcggg

SEQ ID NO: 64969 - DNA, 25 bp, Mus musculus
tggagatccacaaggccacagcaca

SEQ ID NO: 64970 - DNA, 25 bp, Mus musculus
tggagatcctctctcacctttgcaa

SEQ ID NO: 64971 - DNA, 25 bp, Mus musculus
tggagatcctgccttacctgtcctg

SEQ ID NO: 64972 - DNA, 25 bp, Mus musculus
tggagatcggatacagggacattcc

SEQ ID NO: 64973 - DNA, 25 bp, Mus musculus
tggagatgaactactgcaggaaccc

SEQ ID NO: 64974 - DNA, 25 bp, Mus musculus
tggagatgacttgattgtgaccccg

SEQ ID NO: 64975 - DNA, 25 bp, Mus musculus
tggagatgagttactcaaaataggg

SEQ ID NO: 64976 - DNA, 25 bp, Mus musculus
tggagatgagtttctcaaaataggg

SEQ ID NO: 64977 - DNA, 25 bp, Mus musculus
tggagatgatggctgacatgtacaa

SEQ ID NO: 64978 - DNA, 25 bp, Mus musculus
tggagatgcaggctccaaagctcct

SEQ ID NO: 64979 - DNA, 25 bp, Mus musculus
tggagatgctgctgtaacagaagct

SEQ ID NO: 64980 - DNA, 25 bp, Mus musculus
tggagattgagttcaaggagaccca

SEQ ID NO: 64981 - DNA, 25 bp, Mus musculus
tggagcaaacctcaagccagctgtg

SEQ ID NO: 64982 - DNA, 25 bp, Mus musculus
tggagcaactagaggtatttcaaag

SEQ ID NO: 64983 - DNA, 25 bp, Mus musculus
tggagcaactgcagaagctcccgtc

SEQ ID NO: 64984 - DNA, 25 bp, Mus musculus
tggagcaactggtggatggtttcct

SEQ ID NO: 64985 - DNA, 25 bp, Mus musculus
tggagcaactgtaaaacgaatgtac

SEQ ID NO: 64986 - DNA, 25 bp, Mus musculus
tggagcaagtcacagtcgtcgatgc

SEQ ID NO: 64987 - DNA, 25 bp, Mus musculus
tggagcaatcgaagatcttttacag

SEQ ID NO: 64988 - DNA, 25 bp, Mus musculus
tggagcaatcgatgatcttttacag

SEQ ID NO: 64989 - DNA, 25 bp, Mus musculus
tggagcacagcgtccagtgcgctgt

SEQ ID NO: 64990 - DNA, 25 bp, Mus musculus
tggagcacccggacaccgagttacc

SEQ ID NO: 64991 - DNA, 25 bp, Mus musculus
tggagcacctgcatagcaagctgtc

SEQ ID NO: 64992 - DNA, 25 bp, Mus musculus
tggagcacctgcttctcgcctgaca

SEQ ID NO: 64993 - DNA, 25 bp, Mus musculus
tggagcacgcgctgctcaatgacgc

SEQ ID NO: 64994 - DNA, 25 bp, Mus musculus
tggagcactctggttcccctatggc

SEQ ID NO: 64995 - DNA, 25 bp, Mus musculus
tggagcagagcctgctattggagaa

SEQ ID NO: 64996 - DNA, 25 bp, Mus musculus
tggagcagccaattataactcaagg

SEQ ID NO: 64997 - DNA, 25 bp, Mus musculus
tggagcagcttgtgacgtccgactc

SEQ ID NO: 64998 - DNA, 25 bp, Mus musculus
tggagcaggctgtgctgtatgccaa

SEQ ID NO: 64999 - DNA, 25 bp, Mus musculus
tggagcaggtcagaataccccactg

SEQ ID NO: 65000 - DNA, 25 bp, Mus musculus
tggagcagtgccctctgcagctgaa

SEQ ID NO: 65001 - DNA, 25 bp, Mus musculus
tggagcatcccaatatcgtaacctt

SEQ ID NO: 65002 - DNA, 25 bp, Mus musculus
tggagcatcggctcagcgccacctt

SEQ ID NO: 65003 - DNA, 25 bp, Mus musculus
tggagcatcttatctcacggatgtg

SEQ ID NO: 65004 - DNA, 25 bp, Mus musculus
tggagcattaatttgggagcaatcc

SEQ ID NO: 65005 - DNA, 25 bp, Mus musculus
tggagcattcctagcagaggagagc

SEQ ID NO: 65006 - DNA, 25 bp, Mus musculus
tggagcattgaccagcaacgcaata

SEQ ID NO: 65007 - DNA, 25 bp, Mus musculus
tggagccagcaaagcgctctgtgcc

SEQ ID NO: 65008 - DNA, 25 bp, Mus musculus
tggagccagcaatgcgctctgtgcc

SEQ ID NO: 65009 - DNA, 25 bp, Mus musculus
tggagccagctacccatactaattt

SEQ ID NO: 65010 - DNA, 25 bp, Mus musculus
tggagccagctagccatactaattt

SEQ ID NO: 65011 - DNA, 25 bp, Mus musculus
tggagccagttgctgagccagaaac

SEQ ID NO: 65012 - DNA, 25 bp, Mus musculus
tggagccccacgaattaagagaagt

SEQ ID NO: 65013 - DNA, 25 bp, Mus musculus
tggagccccagaccgaactaatttc

SEQ ID NO: 65014 - DNA, 25 bp, Mus musculus
tggagccctagtattaactacaaat

SEQ ID NO: 65015 - DNA, 25 bp, Mus musculus
tggagccctattgtgccgacatcac

SEQ ID NO: 65016 - DNA, 25 bp, Mus musculus
tggagccctgctggactggatgcta

SEQ ID NO: 65017 - DNA, 25 bp, Mus musculus
tggagcccttaaaacttcgagcgtg

SEQ ID NO: 65018 - DNA, 25 bp, Mus musculus
tggagccgccccaacatgggctgta

SEQ ID NO: 65019 - DNA, 25 bp, Mus musculus
tggagccggaagattgaaaagctct

SEQ ID NO: 65020 - DNA, 25 bp, Mus musculus
tggagcctcagtgatacagtgcaac

SEQ ID NO: 65021 - DNA, 25 bp, Mus musculus
tggagcctgcccaggtccgaagcag

SEQ ID NO: 65022 - DNA, 25 bp, Mus musculus
tggagcctgtggcacacaaagactc

SEQ ID NO: 65023 - DNA, 25 bp, Mus musculus
tggagcgctacctgggagccctccg

SEQ ID NO: 65024 - DNA, 25 bp, Mus musculus
tggagcggacagaagccaccctgga

SEQ ID NO: 65025 - DNA, 25 bp, Mus musculus
tggagcgtcagacttaacaggaagc

SEQ ID NO: 65026 - DNA, 25 bp, Mus musculus
tggagcgtcatctactgtgtgcagt

SEQ ID NO: 65027 - DNA, 25 bp, Mus musculus
tggagctaagccgagtaagaagaca

SEQ ID NO: 65028 - DNA, 25 bp, Mus musculus
tggagctacaatcaccctatccggg

SEQ ID NO: 65029 - DNA, 25 bp, Mus musculus
tggagctacctggtgactcaggccc

SEQ ID NO: 65030 - DNA, 25 bp, Mus musculus
tggagctcactgtcaccatcctgct

SEQ ID NO: 65031 - DNA, 25 bp, Mus musculus
tggagctcaggaggatgtagcacta

SEQ ID NO: 65032 - DNA, 25 bp, Mus musculus
tggagctgaagtacacaggaaatgc

SEQ ID NO: 65033 - DNA, 25 bp, Mus musculus
tggagctggaaaaccccgtgctcat

SEQ ID NO: 65034 - DNA, 25 bp, Mus musculus
tggagctggttctgctctgtaagga

SEQ ID NO: 65035 - DNA, 25 bp, Mus musculus
tggagctgttcattgttgtagacaa

SEQ ID NO: 65036 - DNA, 25 bp, Mus musculus
tggagcttcgagagtatcacaccat

SEQ ID NO: 65037 - DNA, 25 bp, Mus musculus
tggagcttggaggaaacaatgccat

SEQ ID NO: 65038 - DNA, 25 bp, Mus musculus
tggagcttggctactctacactagt

SEQ ID NO: 65039 - DNA, 25 bp, Mus musculus
tggagctttcaccatgggtgtcatt

SEQ ID NO: 65040 - DNA, 25 bp, Mus musculus
tggagctttgatcatgaagaagaaa

SEQ ID NO: 65041 - DNA, 25 bp, Mus musculus
tggaggaaaacttccataaagagat

SEQ ID NO: 65042 - DNA, 25 bp, Mus musculus
tggaggaaccttacctcggcaagtt

SEQ ID NO: 65043 - DNA, 25 bp, Mus musculus
tggaggaactgctccgccaccgctg

SEQ ID NO: 65044 - DNA, 25 bp, Mus musculus
tggaggaagccatcacgggagattt

SEQ ID NO: 65045 - DNA, 25 bp, Mus musculus
tggaggaccacccactgtgccgttg

SEQ ID NO: 65046 - DNA, 25 bp, Mus musculus
tggaggaccagattatccaggctaa

SEQ ID NO: 65047 - DNA, 25 bp, Mus musculus
tggaggacctgtctgtcctcagccc

SEQ ID NO: 65048 - DNA, 25 bp, Mus musculus
tggaggactaatcaacaaggtcaag

SEQ ID NO: 65049 - DNA, 25 bp, Mus musculus
tggaggacttcaagccccagaatac

SEQ ID NO: 65050 - DNA, 25 bp, Mus musculus
tggaggacttccgagactataggcg

SEQ ID NO: 65051 - DNA, 25 bp, Mus musculus
tggaggagaagctacaacgtgaccc

SEQ ID NO: 65052 - DNA, 25 bp, Mus musculus
tggaggagagccaaaaatactgcac

SEQ ID NO: 65053 - DNA, 25 bp, Mus musculus
tggaggagagctacttcaacagctc

SEQ ID NO: 65054 - DNA, 25 bp, Mus musculus
tggaggagcagtcccagtccaccat

SEQ ID NO: 65055 - DNA, 25 bp, Mus musculus
tggaggagcagtgtaaggcattccc

SEQ ID NO: 65056 - DNA, 25 bp, Mus musculus
tggaggaggaactttctttggtctc

SEQ ID NO: 65057 - DNA, 25 bp, Mus musculus
tggaggagtactactttgagcagca

SEQ ID NO: 65058 - DNA, 25 bp, Mus musculus
tggaggagtacttcatgagagagac

SEQ ID NO: 65059 - DNA, 25 bp, Mus musculus
tggaggatagacagtgcggctacat

SEQ ID NO: 65060 - DNA, 25 bp, Mus musculus
tggaggataggaacagcttgtctga

SEQ ID NO: 65061 - DNA, 25 bp, Mus musculus
tggaggatgaagataagacagctga

SEQ ID NO: 65062 - DNA, 25 bp, Mus musculus
tggaggatgacgatcccgtccaggc

SEQ ID NO: 65063 - DNA, 25 bp, Mus musculus
tggaggattacctacggctcaaaaa

SEQ ID NO: 65064 - DNA, 25 bp, Mus musculus
tggaggatttttcagattctagatg

SEQ ID NO: 65065 - DNA, 25 bp, Mus musculus
tggaggcaccaagaatagagatgtc

SEQ ID NO: 65066 - DNA, 25 bp, Mus musculus
tggaggcacttgagcagcctgcgcc

SEQ ID NO: 65067 - DNA, 25 bp, Mus musculus
tggaggcagaattcaacaacccgtg

SEQ ID NO: 65068 - DNA, 25 bp, Mus musculus
tggaggcagctccaggtacctccta

SEQ ID NO: 65069 - DNA, 25 bp, Mus musculus
tggaggcagctcgaggtacctccta

SEQ ID NO: 65070 - DNA, 25 bp, Mus musculus
tggaggcattattgtctcatccctg

SEQ ID NO: 65071 - DNA, 25 bp, Mus musculus
tggaggccaagaacccagctgacct

SEQ ID NO: 65072 - DNA, 25 bp, Mus musculus
tggaggccattgctctgtgattgac

SEQ ID NO: 65073 - DNA, 25 bp, Mus musculus
tggaggccccaatcgggacctgact

SEQ ID NO: 65074 - DNA, 25 bp, Mus musculus
tggaggcctctgttgcccctcttgt

SEQ ID NO: 65075 - DNA, 25 bp, Mus musculus
tggaggcgccattgccctgggtcac

SEQ ID NO: 65076 - DNA, 25 bp, Mus musculus
tggaggcggcagtagcaatgttggt

SEQ ID NO: 65077 - DNA, 25 bp, Mus musculus
tggaggcggtaatgtaacactagga

SEQ ID NO: 65078 - DNA, 25 bp, Mus musculus
tggaggctgaaagcatgggattttt

SEQ ID NO: 65079 - DNA, 25 bp, Mus musculus
tggaggctgtgctacactgccatca

SEQ ID NO: 65080 - DNA, 25 bp, Mus musculus
tggaggctgtggagaacaacactct

SEQ ID NO: 65081 - DNA, 25 bp, Mus musculus
tggaggctttgccaacttcgatgcc

SEQ ID NO: 65082 - DNA, 25 bp, Mus musculus
tggaggcttttttggtcccatttgt

SEQ ID NO: 65083 - DNA, 25 bp, Mus musculus
tggagggagactgtgacttccacat

SEQ ID NO: 65084 - DNA, 25 bp, Mus musculus
tggagggcaagctggccttcgcccc

SEQ ID NO: 65085 - DNA, 25 bp, Mus musculus
tggagggcagcaagcgtttgggagg

SEQ ID NO: 65086 - DNA, 25 bp, Mus musculus
tggagggcgttcagggaaagcggaa

SEQ ID NO: 65087 - DNA, 25 bp, Mus musculus
tggaggggaatcaagcaagaaaaga

SEQ ID NO: 65088 - DNA, 25 bp, Mus musculus
tggagggtccactaagactctcacc

SEQ ID NO: 65089 - DNA, 25 bp, Mus musculus
tggaggtagcagcagttctaagaca

SEQ ID NO: 65090 - DNA, 25 bp, Mus musculus
tggaggtaggcaagcttcacaccca

SEQ ID NO: 65091 - DNA, 25 bp, Mus musculus
tggaggtcaaaagcgccctagtggc

SEQ ID NO: 65092 - DNA, 25 bp, Mus musculus
tggaggtcaacccagcctattcagt

SEQ ID NO: 65093 - DNA, 25 bp, Mus musculus
tggaggtcaaggctgctgtcttcaa

SEQ ID NO: 65094 - DNA, 25 bp, Mus musculus
tggaggtcttattacaaaatcaaac

SEQ ID NO: 65095 - DNA, 25 bp, Mus musculus
tggaggtctttattttcccaaagat

SEQ ID NO: 65096 - DNA, 25 bp, Mus musculus
tggaggtgagcaacagaccagacct

SEQ ID NO: 65097 - DNA, 25 bp, Mus musculus
tggaggttcctagaagcaagaagaa

SEQ ID NO: 65098 - DNA, 25 bp, Mus musculus
tggagtacatatccctgcaggagga

SEQ ID NO: 65099 - DNA, 25 bp, Mus musculus
tggagtacgacaacatctccttggc

SEQ ID NO: 65100 - DNA, 25 bp, Mus musculus
tggagtactagctactgatacctgc

SEQ ID NO: 65101 - DNA, 25 bp, Mus musculus
tggagtactatctgatccccttcct

SEQ ID NO: 65102 - DNA, 25 bp, Mus musculus
tggagtagtttatctgggccaccta

SEQ ID NO: 65103 - DNA, 25 bp, Mus musculus
tggagtatactcagaacaaagatct

SEQ ID NO: 65104 - DNA, 25 bp, Mus musculus
tggagtatgccaagcgggctgcacc

SEQ ID NO: 65105 - DNA, 25 bp, Mus musculus
tggagtatgggagtccctacgcctg

SEQ ID NO: 65106 - DNA, 25 bp, Mus musculus
tggagtcacacaagctaaagacggg

SEQ ID NO: 65107 - DNA, 25 bp, Mus musculus
tggagtcagaatcagctggcttcct

SEQ ID NO: 65108 - DNA, 25 bp, Mus musculus
tggagtcagacctcaatggcctgcg

SEQ ID NO: 65109 - DNA, 25 bp, Mus musculus
tggagtccaggaatctgggtgtcac

SEQ ID NO: 65110 - DNA, 25 bp, Mus musculus
tggagtcccaaggagcaatacatgg

SEQ ID NO: 65111 - DNA, 25 bp, Mus musculus
tggagtccctggagccggacctgcc

SEQ ID NO: 65112 - DNA, 25 bp, Mus musculus
tggagtcgaatctgaagcaggtaga

SEQ ID NO: 65113 - DNA, 25 bp, Mus musculus
tggagtctctaacagggacacagag

SEQ ID NO: 65114 - DNA, 25 bp, Mus musculus
tggagtctctcctggtccaccctgg

SEQ ID NO: 65115 - DNA, 25 bp, Mus musculus
tggagtctgaggtagaaaagctgca

SEQ ID NO: 65116 - DNA, 25 bp, Mus musculus
tggagtctgccccacaggcgtctgc

SEQ ID NO: 65117 - DNA, 25 bp, Mus musculus
tggagtctgcccgacaggcgtctgc

SEQ ID NO: 65118 - DNA, 25 bp, Mus musculus
tggagtcttaccaccatggacctgt

SEQ ID NO: 65119 - DNA, 25 bp, Mus musculus
tggagtcttcagcttcctatttacc

SEQ ID NO: 65120 - DNA, 25 bp, Mus musculus
tggagtcttcgtcccgagtctctcc

SEQ ID NO: 65121 - DNA, 25 bp, Mus musculus
tggagtgaaagacgccatcgatgac

SEQ ID NO: 65122 - DNA, 25 bp, Mus musculus
tggagtgaggattacccggagaact

SEQ ID NO: 65123 - DNA, 25 bp, Mus musculus
tggagtgcactaataccgctcctgg

SEQ ID NO: 65124 - DNA, 25 bp, Mus musculus
tggagtgcatggaagagcctaatca

SEQ ID NO: 65125 - DNA, 25 bp, Mus musculus
tggagtgctccctgacggagaccga

SEQ ID NO: 65126 - DNA, 25 bp, Mus musculus
tggagtggacgtcaacatctgtaac

SEQ ID NO: 65127 - DNA, 25 bp, Mus musculus
tggagtggcacacactacctgcatc

SEQ ID NO: 65128 - DNA, 25 bp, Mus musculus
tggagtggcccagcttaactgccca

SEQ ID NO: 65129 - DNA, 25 bp, Mus musculus
tggagtgtcagtgctcccgtattag

SEQ ID NO: 65130 - DNA, 25 bp, Mus musculus
tggagttaataccaccgacaaggaa

SEQ ID NO: 65131 - DNA, 25 bp, Mus musculus
tggagttcaagctagcataattcag

SEQ ID NO: 65132 - DNA, 25 bp, Mus musculus
tggagttcaccttcaccaagccagt

SEQ ID NO: 65133 - DNA, 25 bp, Mus musculus
tggagttcagcaggttaagctggca

SEQ ID NO: 65134 - DNA, 25 bp, Mus musculus
tggagttccatgagaagagcccaga

SEQ ID NO: 65135 - DNA, 25 bp, Mus musculus
tggagttccatgtgaagagcccaga

SEQ ID NO: 65136 - DNA, 25 bp, Mus musculus
tggagttccccaggacttacggagg

SEQ ID NO: 65137 - DNA, 25 bp, Mus musculus
tggagtttctccagcgcctacttcc

SEQ ID NO: 65138 - DNA, 25 bp, Mus musculus
tggagtttgatgttcctatcggttc

SEQ ID NO: 65139 - DNA, 25 bp, Mus musculus
tggagtttgccatcggtcagaggct

SEQ ID NO: 65140 - DNA, 25 bp, Mus musculus
tggataaaaccaaaatgataactgc

SEQ ID NO: 65141 - DNA, 25 bp, Mus musculus
tggataaacgtagaaggagtagctc

SEQ ID NO: 65142 - DNA, 25 bp, Mus musculus
tggataaactcaaccggcagctgca

SEQ ID NO: 65143 - DNA, 25 bp, Mus musculus
tggataaagccgaacctggtgtttg

SEQ ID NO: 65144 - DNA, 25 bp, Mus musculus
tggataaagccgtacctggtgtttg

SEQ ID NO: 65145 - DNA, 25 bp, Mus musculus
tggataaatctggtctcagcagcac

SEQ ID NO: 65146 - DNA, 25 bp, Mus musculus
tggataaatgaagcccaagaagctg

SEQ ID NO: 65147 - DNA, 25 bp, Mus musculus
tggataaatgatgtgcactgccctg

SEQ ID NO: 65148 - DNA, 25 bp, Mus musculus
tggataacaaaacatctcccaggac

SEQ ID NO: 65149 - DNA, 25 bp, Mus musculus
tggataagcacgctgatgcccctgg

SEQ ID NO: 65150 - DNA, 25 bp, Mus musculus
tggataagccttctgagatagtaga

SEQ ID NO: 65151 - DNA, 25 bp, Mus musculus
tggatacacagcactgcaccaggct

SEQ ID NO: 65152 - DNA, 25 bp, Mus musculus
tggataccagcaccatgacatggac

SEQ ID NO: 65153 - DNA, 25 bp, Mus musculus
tggataccatgagagaaacacctcg

SEQ ID NO: 65154 - DNA, 25 bp, Mus musculus
tggatacccccctgggtcgtgttcg

SEQ ID NO: 65155 - DNA, 25 bp, Mus musculus
tggataccctatttgtgcccctgtt

SEQ ID NO: 65156 - DNA, 25 bp, Mus musculus
tggatacgagatgtgaaagaaactg

SEQ ID NO: 65157 - DNA, 25 bp, Mus musculus
tggatacggtgaaggaaaagtcctg

SEQ ID NO: 65158 - DNA, 25 bp, Mus musculus
tggatagaactcagaacagcttgcc

SEQ ID NO: 65159 - DNA, 25 bp, Mus musculus
tggatagatcagaatctaagaggga

SEQ ID NO: 65160 - DNA, 25 bp, Mus musculus
tggatagctcaataccatccctgtt

SEQ ID NO: 65161 - DNA, 25 bp, Mus musculus
tggatagggttaatccgggcagcca

SEQ ID NO: 65162 - DNA, 25 bp, Mus musculus
tggatagtcgttgccagttgcacct

SEQ ID NO: 65163 - DNA, 25 bp, Mus musculus
tggatagtgaagctaagaaactact

SEQ ID NO: 65164 - DNA, 25 bp, Mus musculus
tggatatagtcttcaagcatcttga

SEQ ID NO: 65165 - DNA, 25 bp, Mus musculus
tggatatcagaatgtgctcaggaac

SEQ ID NO: 65166 - DNA, 25 bp, Mus musculus
tggatatggcgcaagaaggagaatg

SEQ ID NO: 65167 - DNA, 25 bp, Mus musculus
tggatatgttcctgtcctgactagg

SEQ ID NO: 65168 - DNA, 25 bp, Mus musculus
tggatattctttcttcaagctctta

SEQ ID NO: 65169 - DNA, 25 bp, Mus musculus
tggatattgagctctcccctgtcag

SEQ ID NO: 65170 - DNA, 25 bp, Mus musculus
tggatcaaccactttgtcatctggg

SEQ ID NO: 65171 - DNA, 25 bp, Mus musculus
tggatcaagcaggaacaccagctga

SEQ ID NO: 65172 - DNA, 25 bp, Mus musculus
tggatcacattgtcccatccgtcct

SEQ ID NO: 65173 - DNA, 25 bp, Mus musculus
tggatcagaacccatactatggagg

SEQ ID NO: 65174 - DNA, 25 bp, Mus musculus
tggatcagacatagaatatctggac

SEQ ID NO: 65175 - DNA, 25 bp, Mus musculus
tggatcagacatggagaggtgaccc

SEQ ID NO: 65176 - DNA, 25 bp, Mus musculus
tggatcagacattgaatatctggac

SEQ ID NO: 65177 - DNA, 25 bp, Mus musculus
tggatcagctggagaaagtgctccc

SEQ ID NO: 65178 - DNA, 25 bp, Mus musculus
tggatcaggagcagagcatctccct

SEQ ID NO: 65179 - DNA, 25 bp, Mus musculus
tggatcatacctacagcaaacatgt

SEQ ID NO: 65180 - DNA, 25 bp, Mus musculus
tggatcatctcatcaaaggaaggct

SEQ ID NO: 65181 - DNA, 25 bp, Mus musculus
tggatcattatgaaaaccctcggaa

SEQ ID NO: 65182 - DNA, 25 bp, Mus musculus
tggatcccaagtctgctgctcagaa

SEQ ID NO: 65183 - DNA, 25 bp, Mus musculus
tggatcccaagtgtgctgctcagaa

SEQ ID NO: 65184 - DNA, 25 bp, Mus musculus
tggatcccagggtctcctctgagaa

SEQ ID NO: 65185 - DNA, 25 bp, Mus musculus
tggatcccgtttgtgtacttctact

SEQ ID NO: 65186 - DNA, 25 bp, Mus musculus
tggatccctcatctactcttggcat

SEQ ID NO: 65187 - DNA, 25 bp, Mus musculus
tggatccctgctgctccagaatgtc

SEQ ID NO: 65188 - DNA, 25 bp, Mus musculus
tggatccctgttccaagatgtacct

SEQ ID NO: 65189 - DNA, 25 bp, Mus musculus
tggatcctccagatagccactgcct

SEQ ID NO: 65190 - DNA, 25 bp, Mus musculus
tggatcctgagctcccggagaagca

SEQ ID NO: 65191 - DNA, 25 bp, Mus musculus
tggatcctgcacacagggccgtgat

SEQ ID NO: 65192 - DNA, 25 bp, Mus musculus
tggatcgaatcatcagggtctggaa

SEQ ID NO: 65193 - DNA, 25 bp, Mus musculus
tggatcgacccctggaccttgcaga

SEQ ID NO: 65194 - DNA, 25 bp, Mus musculus
tggatcgcccggaagctattctgct

SEQ ID NO: 65195 - DNA, 25 bp, Mus musculus
tggatcgtagacatggaaggtgcac

SEQ ID NO: 65196 - DNA, 25 bp, Mus musculus
tggatcgttctagggccctaccatg

SEQ ID NO: 65197 - DNA, 25 bp, Mus musculus
tggatctacttcatggcgtggtctg

SEQ ID NO: 65198 - DNA, 25 bp, Mus musculus
tggatctagcagagatagacctttc

SEQ ID NO: 65199 - DNA, 25 bp, Mus musculus
tggatctccggcttggagcagcata

SEQ ID NO: 65200 - DNA, 25 bp, Mus musculus
tggatctgcagcagcaaatcatgac

SEQ ID NO: 65201 - DNA, 25 bp, Mus musculus
tggatcttcagaagaagcaaagcca

SEQ ID NO: 65202 - DNA, 25 bp, Mus musculus
tggatcttcagatgaagcaaagcca

SEQ ID NO: 65203 - DNA, 25 bp, Mus musculus
tggatcttcatgtattgccacaagg

SEQ ID NO: 65204 - DNA, 25 bp, Mus musculus
tggatcttgccaaggaccccactga

SEQ ID NO: 65205 - DNA, 25 bp, Mus musculus
tggatcttgggactctactgtgaag

SEQ ID NO: 65206 - DNA, 25 bp, Mus musculus
tggatctttaaagcgcagtggctcc

SEQ ID NO: 65207 - DNA, 25 bp, Mus musculus
tggatgaaaatatggactacagact

SEQ ID NO: 65208 - DNA, 25 bp, Mus musculus
tggatgaaggagttgttaaagaaag

SEQ ID NO: 65209 - DNA, 25 bp, Mus musculus
tggatgacacaccagtcttgcatgt

SEQ ID NO: 65210 - DNA, 25 bp, Mus musculus
tggatgacagcaagaagaccaatgc

SEQ ID NO: 65211 - DNA, 25 bp, Mus musculus
tggatgacctggatgcagccctgaa

SEQ ID NO: 65212 - DNA, 25 bp, Mus musculus
tggatgaccttgtcacccgagagag

SEQ ID NO: 65213 - DNA, 25 bp, Mus musculus
tggatgacgtcacctccaacatgga

SEQ ID NO: 65214 - DNA, 25 bp, Mus musculus
tggatgactactacctggagcagta

SEQ ID NO: 65215 - DNA, 25 bp, Mus musculus
tggatgacttggacactcaggagag

SEQ ID NO: 65216 - DNA, 25 bp, Mus musculus
tggatgagagagctcccgacaagca

SEQ ID NO: 65217 - DNA, 25 bp, Mus musculus
tggatgagcgtggaggaacaacatc

SEQ ID NO: 65218 - DNA, 25 bp, Mus musculus
tggatgagctgctggctgaacacaa

SEQ ID NO: 65219 - DNA, 25 bp, Mus musculus
tggatgaggagatctgcttagctga

SEQ ID NO: 65220 - DNA, 25 bp, Mus musculus
tggatgaggcccaggactgtacccc

SEQ ID NO: 65221 - DNA, 25 bp, Mus musculus
tggatgaggctcttgccaaagaagt

SEQ ID NO: 65222 - DNA, 25 bp, Mus musculus
tggatgatcccctgttatctgtacg

SEQ ID NO: 65223 - DNA, 25 bp, Mus musculus
tggatgatgatcgtgaaccccgacc

SEQ ID NO: 65224 - DNA, 25 bp, Mus musculus
tggatgatttagataccgttcctgt

SEQ ID NO: 65225 - DNA, 25 bp, Mus musculus
tggatgattttgaacgtcgcagaga

SEQ ID NO: 65226 - DNA, 25 bp, Mus musculus
tggatgcaaagaccatggagactgc

SEQ ID NO: 65227 - DNA, 25 bp, Mus musculus
tggatgcaacccgaaagggcaacaa

SEQ ID NO: 65228 - DNA, 25 bp, Mus musculus
tggatgcagaaaagctgaagccagg

SEQ ID NO: 65229 - DNA, 25 bp, Mus musculus
tggatgcagccctgaacaacctgga

SEQ ID NO: 65230 - DNA, 25 bp, Mus musculus
tggatgcaggacaagcccctccagc

SEQ ID NO: 65231 - DNA, 25 bp, Mus musculus
tggatgccaccaggcccagtttaag

SEQ ID NO: 65232 - DNA, 25 bp, Mus musculus
tggatgcctcagatctgacgtggac

SEQ ID NO: 65233 - DNA, 25 bp, Mus musculus
tggatgccttccagccatacccagt

SEQ ID NO: 65234 - DNA, 25 bp, Mus musculus
tggatgcctttgacctggtggaccg

SEQ ID NO: 65235 - DNA, 25 bp, Mus musculus
tggatgcggcccacatggcctgtgt

SEQ ID NO: 65236 - DNA, 25 bp, Mus musculus
tggatgcggccctcatggcctgtgt

SEQ ID NO: 65237 - DNA, 25 bp, Mus musculus
tggatgctaccaacccaagacactc

SEQ ID NO: 65238 - DNA, 25 bp, Mus musculus
tggatgctcccaagcccaaaaaagc

SEQ ID NO: 65239 - DNA, 25 bp, Mus musculus
tggatgctctggaaagaacgctgga

SEQ ID NO: 65240 - DNA, 25 bp, Mus musculus
tggatggatatcgtttctggaaaac

SEQ ID NO: 65241 - DNA, 25 bp, Mus musculus
tggatggcagtgagcctcaagttcg

SEQ ID NO: 65242 - DNA, 25 bp, Mus musculus
tggatgggaaccaggaccttatcag

SEQ ID NO: 65243 - DNA, 25 bp, Mus musculus
tggatgggacactgtttgattccag

SEQ ID NO: 65244 - DNA, 25 bp, Mus musculus
tggatgggactctgctggactccac

SEQ ID NO: 65245 - DNA, 25 bp, Mus musculus
tggatgggttctacaacggccgtag

SEQ ID NO: 65246 - DNA, 25 bp, Mus musculus
tggatggtgcaacggattttaaaga

SEQ ID NO: 65247 - DNA, 25 bp, Mus musculus
tggatgtagtgaatgctttccagag

SEQ ID NO: 65248 - DNA, 25 bp, Mus musculus
tggatgtcacgagtatccgagatac

SEQ ID NO: 65249 - DNA, 25 bp, Mus musculus
tggatgtcatcaaggagtcccgaga

SEQ ID NO: 65250 - DNA, 25 bp, Mus musculus
tggatgtcatcatggagtcccgaga

SEQ ID NO: 65251 - DNA, 25 bp, Mus musculus
tggatgtccctgagatcgtcatatc

SEQ ID NO: 65252 - DNA, 25 bp, Mus musculus
tggatgtgagccactatggctgatt

SEQ ID NO: 65253 - DNA, 25 bp, Mus musculus
tggatgtgctcagctccgccttcca

SEQ ID NO: 65254 - DNA, 25 bp, Mus musculus
tggatgttccatcagcaggcgctgc

SEQ ID NO: 65255 - DNA, 25 bp, Mus musculus
tggattaaatgtcactctcaccatc

SEQ ID NO: 65256 - DNA, 25 bp, Mus musculus
tggattacatcatcactgatcagga

SEQ ID NO: 65257 - DNA, 25 bp, Mus musculus
tggattaggaatccaatgcattctt

SEQ ID NO: 65258 - DNA, 25 bp, Mus musculus
tggattatgtttccatacggagcca

SEQ ID NO: 65259 - DNA, 25 bp, Mus musculus
tggattcaggacatgagcggtgaca

SEQ ID NO: 65260 - DNA, 25 bp, Mus musculus
tggattcagtcccagatcttacttc

SEQ ID NO: 65261 - DNA, 25 bp, Mus musculus
tggattcatcgctgccatggcaaca

SEQ ID NO: 65262 - DNA, 25 bp, Mus musculus
tggattccatatcaggaaaggtgct

SEQ ID NO: 65263 - DNA, 25 bp, Mus musculus
tggattcccaacaaacattactctg

SEQ ID NO: 65264 - DNA, 25 bp, Mus musculus
tggattcccaactaacattactctg

SEQ ID NO: 65265 - DNA, 25 bp, Mus musculus
tggattccctcactaacgcccgagg

SEQ ID NO: 65266 - DNA, 25 bp, Mus musculus
tggattcctctcaaccaccggaagg

SEQ ID NO: 65267 - DNA, 25 bp, Mus musculus
tggattcctctcataaatgaaagaa

SEQ ID NO: 65268 - DNA, 25 bp, Mus musculus
tggattcgagtcaaccgcagacccc

SEQ ID NO: 65269 - DNA, 25 bp, Mus musculus
tggattctctttgccaacttttcag

SEQ ID NO: 65270 - DNA, 25 bp, Mus musculus
tggattctgccattctgacttctag

SEQ ID NO: 65271 - DNA, 25 bp, Mus musculus
tggattctggacgagctccaaagga

SEQ ID NO: 65272 - DNA, 25 bp, Mus musculus
tggattcttcatattagctctgagg

SEQ ID NO: 65273 - DNA, 25 bp, Mus musculus
tggattcttgcagacaagaacagct

SEQ ID NO: 65274 - DNA, 25 bp, Mus musculus
tggattcttggcagtcagcagtctg

SEQ ID NO: 65275 - DNA, 25 bp, Mus musculus
tggattgaagtggtgtagcgaccaa

SEQ ID NO: 65276 - DNA, 25 bp, Mus musculus
tggattgatccttgacgaccccacg

SEQ ID NO: 65277 - DNA, 25 bp, Mus musculus
tggattggccaaccagggcaacaac

SEQ ID NO: 65278 - DNA, 25 bp, Mus musculus
tggattggccaagcagggcaacaac

SEQ ID NO: 65279 - DNA, 25 bp, Mus musculus
tggattggccatgagaacttcgagc

SEQ ID NO: 65280 - DNA, 25 bp, Mus musculus
tggattggcctacttctacctgatg

SEQ ID NO: 65281 - DNA, 25 bp, Mus musculus
tggattggcctagttctacctgatg

SEQ ID NO: 65282 - DNA, 25 bp, Mus musculus
tggatttcatgatggagacccattg

SEQ ID NO: 65283 - DNA, 25 bp, Mus musculus
tggatttccccacgcaagaccaact

SEQ ID NO: 65284 - DNA, 25 bp, Mus musculus
tggatttcggaatttcggataaggg

SEQ ID NO: 65285 - DNA, 25 bp, Mus musculus
tggattttgaaagcacgggcgctga

SEQ ID NO: 65286 - DNA, 25 bp, Mus musculus
tggcaaacggactgttgcttcccag

SEQ ID NO: 65287 - DNA, 25 bp, Mus musculus
tggcaaagaaaggtctagctcccga

SEQ ID NO: 65288 - DNA, 25 bp, Mus musculus
tggcaaagatgatccaatcgaagtg

SEQ ID NO: 65289 - DNA, 25 bp, Mus musculus
tggcaaagatttgatggagaaggcc

SEQ ID NO: 65290 - DNA, 25 bp, Mus musculus
tggcaaaggtgtcctagaaatggcc

SEQ ID NO: 65291 - DNA, 25 bp, Mus musculus
tggcaaatgcaaacatgaactgttg

SEQ ID NO: 65292 - DNA, 25 bp, Mus musculus
tggcaaatggtccacagagacaaga

SEQ ID NO: 65293 - DNA, 25 bp, Mus musculus
tggcaacaaaagaatccggtacaaa

SEQ ID NO: 65294 - DNA, 25 bp, Mus musculus
tggcaacaagacttctgtgcagttc

SEQ ID NO: 65295 - DNA, 25 bp, Mus musculus
tggcaacagaccacatgatgaggtg

SEQ ID NO: 65296 - DNA, 25 bp, Mus musculus
tggcaacagacctgaccaaagtcaa

SEQ ID NO: 65297 - DNA, 25 bp, Mus musculus
tggcaacagcgatgatgaagatggt

SEQ ID NO: 65298 - DNA, 25 bp, Mus musculus
tggcaaccagaagcgccagaagtgt

SEQ ID NO: 65299 - DNA, 25 bp, Mus musculus
tggcaaccagccctttacacagact

SEQ ID NO: 65300 - DNA, 25 bp, Mus musculus
tggcaaccctgttcacctaaagtgt

SEQ ID NO: 65301 - DNA, 25 bp, Mus musculus
tggcaaccgaatgctggcccagcat

SEQ ID NO: 65302 - DNA, 25 bp, Mus musculus
tggcaacctaccacaagagggaggc

SEQ ID NO: 65303 - DNA, 25 bp, Mus musculus
tggcaacctcctgcgatcggaagag

SEQ ID NO: 65304 - DNA, 25 bp, Mus musculus
tggcaacgtataaagggattgagcc

SEQ ID NO: 65305 - DNA, 25 bp, Mus musculus
tggcaagaaggcctccaggtttttc

SEQ ID NO: 65306 - DNA, 25 bp, Mus musculus
tggcaagagatgaggaagacgccta

SEQ ID NO: 65307 - DNA, 25 bp, Mus musculus
tggcaagagccaagatactgcaaat

SEQ ID NO: 65308 - DNA, 25 bp, Mus musculus
tggcaagcacattttaaggtcccgt

SEQ ID NO: 65309 - DNA, 25 bp, Mus musculus
tggcaagcagccatggcaagtaaag

SEQ ID NO: 65310 - DNA, 25 bp, Mus musculus
tggcaagctggcaaacggactgttg

SEQ ID NO: 65311 - DNA, 25 bp, Mus musculus
tggcaagggctcgtatccagtgagc

SEQ ID NO: 65312 - DNA, 25 bp, Mus musculus
tggcaagggctttgctcacagaaac

SEQ ID NO: 65313 - DNA, 25 bp, Mus musculus
tggcaagggtactggaaacgtgatt

SEQ ID NO: 65314 - DNA, 25 bp, Mus musculus
tggcaagggtcccttccctcagagg

SEQ ID NO: 65315 - DNA, 25 bp, Mus musculus
tggcaagtaccaccctatggagtat

SEQ ID NO: 65316 - DNA, 25 bp, Mus musculus
tggcaagtgcaatgtacaccacggc

SEQ ID NO: 65317 - DNA, 25 bp, Mus musculus
tggcaatcagagacaagatgatctc

SEQ ID NO: 65318 - DNA, 25 bp, Mus musculus
tggcaatcatccagattcactgagg

SEQ ID NO: 65319 - DNA, 25 bp, Mus musculus
tggcaatctggtacacaaaggaccg

SEQ ID NO: 65320 - DNA, 25 bp, Mus musculus
tggcaatgaagccactgccgctggt

SEQ ID NO: 65321 - DNA, 25 bp, Mus musculus
tggcaatgacgagaagtacaaggct

SEQ ID NO: 65322 - DNA, 25 bp, Mus musculus
tggcaatgagactgagcctgcgacg

SEQ ID NO: 65323 - DNA, 25 bp, Mus musculus
tggcaattttggaccaggaccagga

SEQ ID NO: 65324 - DNA, 25 bp, Mus musculus
tggcacacgaaacttccaggacttt

SEQ ID NO: 65325 - DNA, 25 bp, Mus musculus
tggcacagacacatgggagcaagca

SEQ ID NO: 65326 - DNA, 25 bp, Mus musculus
tggcaccaaagaacttgaaacagag

SEQ ID NO: 65327 - DNA, 25 bp, Mus musculus
tggcaccacagaatctgggcaaccc

SEQ ID NO: 65328 - DNA, 25 bp, Mus musculus
tggcaccagaacagcatgatatgtc

SEQ ID NO: 65329 - DNA, 25 bp, Mus musculus
tggcaccaggagagccgctacctgg

SEQ ID NO: 65330 - DNA, 25 bp, Mus musculus
tggcaccatctgtgaccccgacaag

SEQ ID NO: 65331 - DNA, 25 bp, Mus musculus
tggcaccgaggaaggcatgttcttt

SEQ ID NO: 65332 - DNA, 25 bp, Mus musculus
tggcacctccaacaagaatccgaag

SEQ ID NO: 65333 - DNA, 25 bp, Mus musculus
tggcacctcgcagaacagtgtggga

SEQ ID NO: 65334 - DNA, 25 bp, Mus musculus
tggcacctgcagaagctatacctga

SEQ ID NO: 65335 - DNA, 25 bp, Mus musculus
tggcacggaggtatagctaccattt

SEQ ID NO: 65336 - DNA, 25 bp, Mus musculus
tggcacgggcgccatcatcgctatc

SEQ ID NO: 65337 - DNA, 25 bp, Mus musculus
tggcacgggcgcgatcatcgctatc

SEQ ID NO: 65338 - DNA, 25 bp, Mus musculus
tggcacgtatggcagcaagatgaac

SEQ ID NO: 65339 - DNA, 25 bp, Mus musculus
tggcactcagcacactgacggctgt

SEQ ID NO: 65340 - DNA, 25 bp, Mus musculus
tggcactcttatatcgactatgaga

SEQ ID NO: 65341 - DNA, 25 bp, Mus musculus
tggcactgatccacaaccgatcatt

SEQ ID NO: 65342 - DNA, 25 bp, Mus musculus
tggcactgatccagccctccaggga

SEQ ID NO: 65343 - DNA, 25 bp, Mus musculus
tggcactgatggaattggaaaagca

SEQ ID NO: 65344 - DNA, 25 bp, Mus musculus
tggcactgccaggacgacgtccgag

SEQ ID NO: 65345 - DNA, 25 bp, Mus musculus
tggcactggacaccctcatgaagtg

SEQ ID NO: 65346 - DNA, 25 bp, Mus musculus
tggcactggagcagcttctcagact

SEQ ID NO: 65347 - DNA, 25 bp, Mus musculus
tggcacttgctttggattcagaagc

SEQ ID NO: 65348 - DNA, 25 bp, Mus musculus
tggcagaagaaactgaccccggaac

SEQ ID NO: 65349 - DNA, 25 bp, Mus musculus
tggcagaagccacctctcaacagca

SEQ ID NO: 65350 - DNA, 25 bp, Mus musculus
tggcagaatatgaagcacggatcgt

SEQ ID NO: 65351 - DNA, 25 bp, Mus musculus
tggcagaatgggtcagccgcagaca

SEQ ID NO: 65352 - DNA, 25 bp, Mus musculus
tggcagacagaactcgtgtattcag

SEQ ID NO: 65353 - DNA, 25 bp, Mus musculus
tggcagacatcctgaagtaggcaac

SEQ ID NO: 65354 - DNA, 25 bp, Mus musculus
tggcagacccctatgagatcagagt

SEQ ID NO: 65355 - DNA, 25 bp, Mus musculus
tggcagagatggagaacctggtacc

SEQ ID NO: 65356 - DNA, 25 bp, Mus musculus
tggcagagctgggactcactttcag

SEQ ID NO: 65357 - DNA, 25 bp, Mus musculus
tggcagagtacacggccaagatcgc

SEQ ID NO: 65358 - DNA, 25 bp, Mus musculus
tggcagatagaaacgtctgggcaag

SEQ ID NO: 65359 - DNA, 25 bp, Mus musculus
tggcagatctgctactcattcttgg

SEQ ID NO: 65360 - DNA, 25 bp, Mus musculus
tggcagatgatatcttactggaaga

SEQ ID NO: 65361 - DNA, 25 bp, Mus musculus
tggcagatgtgagaagtggatacca

SEQ ID NO: 65362 - DNA, 25 bp, Mus musculus
tggcagcaaatttgatcttcggatc

SEQ ID NO: 65363 - DNA, 25 bp, Mus musculus
tggcagcaaggaccaaggcagctct

SEQ ID NO: 65364 - DNA, 25 bp, Mus musculus
tggcagcagcaaatcctattgagtc

SEQ ID NO: 65365 - DNA, 25 bp, Mus musculus
tggcagcagctgacgaactggcctt

SEQ ID NO: 65366 - DNA, 25 bp, Mus musculus
tggcagcaggtatccaatgggtgaa

SEQ ID NO: 65367 - DNA, 25 bp, Mus musculus
tggcagcatggagcctgcgtttcac

SEQ ID NO: 65368 - DNA, 25 bp, Mus musculus
tggcagccagaactgatacagcccc

SEQ ID NO: 65369 - DNA, 25 bp, Mus musculus
tggcagccatcccaatggtcctgag

SEQ ID NO: 65370 - DNA, 25 bp, Mus musculus
tggcagcccaggagaaccacctgga

SEQ ID NO: 65371 - DNA, 25 bp, Mus musculus
tggcagccctggagctaacgtgtct

SEQ ID NO: 65372 - DNA, 25 bp, Mus musculus
tggcagcctacttcacacactcaaa

SEQ ID NO: 65373 - DNA, 25 bp, Mus musculus
tggcagcggtgttgctgttgaaaca

SEQ ID NO: 65374 - DNA, 25 bp, Mus musculus
tggcagcgtctgtaaattctaaggc

SEQ ID NO: 65375 - DNA, 25 bp, Mus musculus
tggcagctagtttggaaaagaatct

SEQ ID NO: 65376 - DNA, 25 bp, Mus musculus
tggcagctcagcttaaagccaatgg

SEQ ID NO: 65377 - DNA, 25 bp, Mus musculus
tggcagctgatggacgcattgagcc

SEQ ID NO: 65378 - DNA, 25 bp, Mus musculus
tggcagctgcctctatggaaacaca

SEQ ID NO: 65379 - DNA, 25 bp, Mus musculus
tggcagctggacagacccagccatc

SEQ ID NO: 65380 - DNA, 25 bp, Mus musculus
tggcagctggattgatccttgacga

SEQ ID NO: 65381 - DNA, 25 bp, Mus musculus
tggcaggaaaaagtatatgaggaca

SEQ ID NO: 65382 - DNA, 25 bp, Mus musculus
tggcaggacggcctcatccctatga

SEQ ID NO: 65383 - DNA, 25 bp, Mus musculus
tggcaggcacaagctgcagaaatga

SEQ ID NO: 65384 - DNA, 25 bp, Mus musculus
tggcaggctccttggccggagccat

SEQ ID NO: 65385 - DNA, 25 bp, Mus musculus
tggcagggtcagctgcaagaacatc

SEQ ID NO: 65386 - DNA, 25 bp, Mus musculus
tggcaggtaccatgaagctggagtt

SEQ ID NO: 65387 - DNA, 25 bp, Mus musculus
tggcaggtggaagctgtccccagtc

SEQ ID NO: 65388 - DNA, 25 bp, Mus musculus
tggcaggtgtccaaaatggtctggt

SEQ ID NO: 65389 - DNA, 25 bp, Mus musculus
tggcagtacatattggctggagtca

SEQ ID NO: 65390 - DNA, 25 bp, Mus musculus
tggcagtaccatcagtctggaacac

SEQ ID NO: 65391 - DNA, 25 bp, Mus musculus
tggcagtagataccaagggcttcct

SEQ ID NO: 65392 - DNA, 25 bp, Mus musculus
tggcagtattcaggaccggcctgtc

SEQ ID NO: 65393 - DNA, 25 bp, Mus musculus
tggcagtcagcagtctgcggagctt

SEQ ID NO: 65394 - DNA, 25 bp, Mus musculus
tggcagtccctcttgagatgctgga

SEQ ID NO: 65395 - DNA, 25 bp, Mus musculus
tggcagtccttgatagaagcagcgc

SEQ ID NO: 65396 - DNA, 25 bp, Mus musculus
tggcagtgattggaggaccaccttt

SEQ ID NO: 65397 - DNA, 25 bp, Mus musculus
tggcagtgttaaaactgaacgagca

SEQ ID NO: 65398 - DNA, 25 bp, Mus musculus
tggcagtgttctgggacaagtcatc

SEQ ID NO: 65399 - DNA, 25 bp, Mus musculus
tggcagtgttgccattgccagcaag

SEQ ID NO: 65400 - DNA, 25 bp, Mus musculus
tggcataatacacaccaaaaccacc

SEQ ID NO: 65401 - DNA, 25 bp, Mus musculus
tggcataccaccacgacagcaggcg

SEQ ID NO: 65402 - DNA, 25 bp, Mus musculus
tggcatcagatttctgttacgaatg

SEQ ID NO: 65403 - DNA, 25 bp, Mus musculus
tggcatcagcccagacagtatcatc

SEQ ID NO: 65404 - DNA, 25 bp, Mus musculus
tggcatccacatgcagcacattgca

SEQ ID NO: 65405 - DNA, 25 bp, Mus musculus
tggcatccacgcttaaacaggtgaa

SEQ ID NO: 65406 - DNA, 25 bp, Mus musculus
tggcatccgccagcagctctatgtg

SEQ ID NO: 65407 - DNA, 25 bp, Mus musculus
tggcatcctcctggcctatgtggca

SEQ ID NO: 65408 - DNA, 25 bp, Mus musculus
tggcatcctctaaaaaggttactct

SEQ ID NO: 65409 - DNA, 25 bp, Mus musculus
tggcatcctgtgaaaatactcttaa

SEQ ID NO: 65410 - DNA, 25 bp, Mus musculus
tggcatcgacctagctgtctatgag

SEQ ID NO: 65411 - DNA, 25 bp, Mus musculus
tggcatcgccatctacgtcaggtca

SEQ ID NO: 65412 - DNA, 25 bp, Mus musculus
tggcatctacttacccaaacaagta

SEQ ID NO: 65413 - DNA, 25 bp, Mus musculus
tggcatctatgcctgcaatggctgc

SEQ ID NO: 65414 - DNA, 25 bp, Mus musculus
tggcatgccgacaacatccgtggta

SEQ ID NO: 65415 - DNA, 25 bp, Mus musculus
tggcatgcctgccaagagacgaaag

SEQ ID NO: 65416 - DNA, 25 bp, Mus musculus
tggcatggacaatcacagtggtggt

SEQ ID NO: 65417 - DNA, 25 bp, Mus musculus
tggcatggcgataaatgcgagttcc

SEQ ID NO: 65418 - DNA, 25 bp, Mus musculus
tggcattcaatcctgcgcaatgggc

SEQ ID NO: 65419 - DNA, 25 bp, Mus musculus
tggcattccttctaacaggattatt

SEQ ID NO: 65420 - DNA, 25 bp, Mus musculus
tggcattccttgtaatgttaaaatc

SEQ ID NO: 65421 - DNA, 25 bp, Mus musculus
tggcattgccggctctcatttcgct

SEQ ID NO: 65422 - DNA, 25 bp, Mus musculus
tggcattgccgggtctcatttcgct

SEQ ID NO: 65423 - DNA, 25 bp, Mus musculus
tggcattgtcctgggggccctgctc

SEQ ID NO: 65424 - DNA, 25 bp, Mus musculus
tggcattgtggcaggtaacagctct

SEQ ID NO: 65425 - DNA, 25 bp, Mus musculus
tggcattgtggctggtaacagctct

SEQ ID NO: 65426 - DNA, 25 bp, Mus musculus
tggccaaaaactgcaatgtggatcc

SEQ ID NO: 65427 - DNA, 25 bp, Mus musculus
tggccaaaacaaaagccggccccat

SEQ ID NO: 65428 - DNA, 25 bp, Mus musculus
tggccaaacagagggaacaaaggca

SEQ ID NO: 65429 - DNA, 25 bp, Mus musculus
tggccaaactgctcggctacaacac

SEQ ID NO: 65430 - DNA, 25 bp, Mus musculus
tggccaacaggatggtgccccttcc

SEQ ID NO: 65431 - DNA, 25 bp, Mus musculus
tggccaactcacctgatgcagcctt

SEQ ID NO: 65432 - DNA, 25 bp, Mus musculus
tggccaacttagcatttatacgagg

SEQ ID NO: 65433 - DNA, 25 bp, Mus musculus
tggccaaggagaaccaggatatccg

SEQ ID NO: 65434 - DNA, 25 bp, Mus musculus
tggccaaggagcagcgactcaactt

SEQ ID NO: 65435 - DNA, 25 bp, Mus musculus
tggccaaggataaagtcagtctgac

SEQ ID NO: 65436 - DNA, 25 bp, Mus musculus
tggccaagtatccagcgtccacagt

SEQ ID NO: 65437 - DNA, 25 bp, Mus musculus
tggccaagtcagtgtacgagaagat

SEQ ID NO: 65438 - DNA, 25 bp, Mus musculus
tggccaagttctgctatgctgataa

SEQ ID NO: 65439 - DNA, 25 bp, Mus musculus
tggccaagttggtggtcctcgccac

SEQ ID NO: 65440 - DNA, 25 bp, Mus musculus
tggccacaacacacagcaagtacat

SEQ ID NO: 65441 - DNA, 25 bp, Mus musculus
tggccacacaaggagaccatttaaa

SEQ ID NO: 65442 - DNA, 25 bp, Mus musculus
tggccacacagttgattatgcaaac

SEQ ID NO: 65443 - DNA, 25 bp, Mus musculus
tggccacaccccagaagaactttct

SEQ ID NO: 65444 - DNA, 25 bp, Mus musculus
tggccacattcaacagtctgtcact

SEQ ID NO: 65445 - DNA, 25 bp, Mus musculus
tggccacatttaaggagataatctg

SEQ ID NO: 65446 - DNA, 25 bp, Mus musculus
tggccacatttatggagataatctg

SEQ ID NO: 65447 - DNA, 25 bp, Mus musculus
tggccaccacttccctgatgatctt

SEQ ID NO: 65448 - DNA, 25 bp, Mus musculus
tggccaccagcgtgacactcctgaa

SEQ ID NO: 65449 - DNA, 25 bp, Mus musculus
tggccaccatggataagcacgctga

SEQ ID NO: 65450 - DNA, 25 bp, Mus musculus
tggccaccgccaagaatcgctactt

SEQ ID NO: 65451 - DNA, 25 bp, Mus musculus
tggccacctgcttggctgttccaga

SEQ ID NO: 65452 - DNA, 25 bp, Mus musculus
tggccaccttaaaacatgggaacca

SEQ ID NO: 65453 - DNA, 25 bp, Mus musculus
tggccacgaggtgttggagaactac

SEQ ID NO: 65454 - DNA, 25 bp, Mus musculus
tggccacgctcatgtgctcctggct

SEQ ID NO: 65455 - DNA, 25 bp, Mus musculus
tggccacgtgtcctagctgctcact

SEQ ID NO: 65456 - DNA, 25 bp, Mus musculus
tggccactccagtgcctattctaca

SEQ ID NO: 65457 - DNA, 25 bp, Mus musculus
tggccactctagctgcactggacct

SEQ ID NO: 65458 - DNA, 25 bp, Mus musculus
tggccactgtggatgtagaccctaa

SEQ ID NO: 65459 - DNA, 25 bp, Mus musculus
tggccagacgggtcacactgctgga

SEQ ID NO: 65460 - DNA, 25 bp, Mus musculus
tggccagactccacgtgttccggct

SEQ ID NO: 65461 - DNA, 25 bp, Mus musculus
tggccagagacgtcatcaagactgt

SEQ ID NO: 65462 - DNA, 25 bp, Mus musculus
tggccagagatgagcgtgtgaacct

SEQ ID NO: 65463 - DNA, 25 bp, Mus musculus
tggccagagcaggagagggccgaac

SEQ ID NO: 65464 - DNA, 25 bp, Mus musculus
tggccagaggcatcttaagtaactg

SEQ ID NO: 65465 - DNA, 25 bp, Mus musculus
tggccagagtgtcttcatcaccaag

SEQ ID NO: 65466 - DNA, 25 bp, Mus musculus
tggccagattttgagctgcccctga

SEQ ID NO: 65467 - DNA, 25 bp, Mus musculus
tggccagcaacttcatcagtcccaa

SEQ ID NO: 65468 - DNA, 25 bp, Mus musculus
tggccagcaagaaacctaaaaggga

SEQ ID NO: 65469 - DNA, 25 bp, Mus musculus
tggccagcccaagaaccaggaaagt

SEQ ID NO: 65470 - DNA, 25 bp, Mus musculus
tggccagctcagcaacactggaagg

SEQ ID NO: 65471 - DNA, 25 bp, Mus musculus
tggccagctcccagcgggatatgga

SEQ ID NO: 65472 - DNA, 25 bp, Mus musculus
tggccagctcctcggacagtgaaga

SEQ ID NO: 65473 - DNA, 25 bp, Mus musculus
tggccaggatcatctgttgaacacc

SEQ ID NO: 65474 - DNA, 25 bp, Mus musculus
tggccaggctgaagctgttccgaca

SEQ ID NO: 65475 - DNA, 25 bp, Mus musculus
tggccaggcttttcttacagctcct

SEQ ID NO: 65476 - DNA, 25 bp, Mus musculus
tggccagtatgtccccagaattgtg

SEQ ID NO: 65477 - DNA, 25 bp, Mus musculus
tggccagtgtggagagaaccttgcg

SEQ ID NO: 65478 - DNA, 25 bp, Mus musculus
tggccagttccgagggcttccagaa

SEQ ID NO: 65479 - DNA, 25 bp, Mus musculus
tggccagttgtgctcaggaaactgc

SEQ ID NO: 65480 - DNA, 25 bp, Mus musculus
tggccataaacgaagtgaaaacaaa

SEQ ID NO: 65481 - DNA, 25 bp, Mus musculus
tggccatagaacagatgtgctatgc

SEQ ID NO: 65482 - DNA, 25 bp, Mus musculus
tggccatattggagcacagtcaccg

SEQ ID NO: 65483 - DNA, 25 bp, Mus musculus
tggccatcaatacgctctgcaaaga

SEQ ID NO: 65484 - DNA, 25 bp, Mus musculus
tggccatcagcaaggtgttctgcaa

SEQ ID NO: 65485 - DNA, 25 bp, Mus musculus
tggccatcagcaccgtgaacatgac

SEQ ID NO: 65486 - DNA, 25 bp, Mus musculus
tggccatcagtgttgccagtcaatg

SEQ ID NO: 65487 - DNA, 25 bp, Mus musculus
tggccatccatacactggacccaga

SEQ ID NO: 65488 - DNA, 25 bp, Mus musculus
tggccatcccagacgatttctcaga

SEQ ID NO: 65489 - DNA, 25 bp, Mus musculus
tggccatctccttcacagcgctgat

SEQ ID NO: 65490 - DNA, 25 bp, Mus musculus
tggccatgatcaagttccagcccct

SEQ ID NO: 65491 - DNA, 25 bp, Mus musculus
tggccatggcataaggagcattatc

SEQ ID NO: 65492 - DNA, 25 bp, Mus musculus
tggccatgggcaagaccccaagtct

SEQ ID NO: 65493 - DNA, 25 bp, Mus musculus
tggccatgggcatgaccccaagtct

SEQ ID NO: 65494 - DNA, 25 bp, Mus musculus
tggccatgggctgcatcgacaccgt

SEQ ID NO: 65495 - DNA, 25 bp, Mus musculus
tggccattatccagcacatgatgac

SEQ ID NO: 65496 - DNA, 25 bp, Mus musculus
tggccattccctgggagttacagca

SEQ ID NO: 65497 - DNA, 25 bp, Mus musculus
tggccattgtccatctagaagggaa

SEQ ID NO: 65498 - DNA, 25 bp, Mus musculus
tggcccaaaatgactctgctagagg

SEQ ID NO: 65499 - DNA, 25 bp, Mus musculus
tggcccaaaccgcacgggaaaagct

SEQ ID NO: 65500 - DNA, 25 bp, Mus musculus
tggcccaagtagcagtgactactca

SEQ ID NO: 65501 - DNA, 25 bp, Mus musculus
tggcccaatggagccagtttgcacg

SEQ ID NO: 65502 - DNA, 25 bp, Mus musculus
tggcccacagaaaggatggccttct

SEQ ID NO: 65503 - DNA, 25 bp, Mus musculus
tggcccaccagtgttaccatggctt

SEQ ID NO: 65504 - DNA, 25 bp, Mus musculus
tggcccacctgtatgtggctaagcc

SEQ ID NO: 65505 - DNA, 25 bp, Mus musculus
tggcccagaaccaaatgtacaccct

SEQ ID NO: 65506 - DNA, 25 bp, Mus musculus
tggcccagaggatccgcctatttcc

SEQ ID NO: 65507 - DNA, 25 bp, Mus musculus
tggcccagcatctaccacacaatgg

SEQ ID NO: 65508 - DNA, 25 bp, Mus musculus
tggcccagctgggactattccactg

SEQ ID NO: 65509 - DNA, 25 bp, Mus musculus
tggcccaggaacacaaagctcatag

SEQ ID NO: 65510 - DNA, 25 bp, Mus musculus
tggcccagggtcagagccctgctca

SEQ ID NO: 65511 - DNA, 25 bp, Mus musculus
tggcccagggtctgagccctgctca

SEQ ID NO: 65512 - DNA, 25 bp, Mus musculus
tggcccaggtccacaaggcggtgtt

SEQ ID NO: 65513 - DNA, 25 bp, Mus musculus
tggcccagtgtaaggatttagcagc

SEQ ID NO: 65514 - DNA, 25 bp, Mus musculus
tggccccaaaggacatgacattttt

SEQ ID NO: 65515 - DNA, 25 bp, Mus musculus
tggccccaggcttccagacgtttgt

SEQ ID NO: 65516 - DNA, 25 bp, Mus musculus
tggccccaggtgtcctccagtgcag

SEQ ID NO: 65517 - DNA, 25 bp, Mus musculus
tggccccatgctgcaaagagctttg

SEQ ID NO: 65518 - DNA, 25 bp, Mus musculus
tggcccccacaatgacaaagatgct

SEQ ID NO: 65519 - DNA, 25 bp, Mus musculus
tggccccgtgatgtggcatattcac

SEQ ID NO: 65520 - DNA, 25 bp, Mus musculus
tggcccctgctgttgagtgcacaag

SEQ ID NO: 65521 - DNA, 25 bp, Mus musculus
tggcccgaaactggttttggaccag

SEQ ID NO: 65522 - DNA, 25 bp, Mus musculus
tggcccgagagctcaagatcctggc

SEQ ID NO: 65523 - DNA, 25 bp, Mus musculus
tggcccgagtctttttgcgccgctg

SEQ ID NO: 65524 - DNA, 25 bp, Mus musculus
tggcccggtctgcaataaacaccca

SEQ ID NO: 65525 - DNA, 25 bp, Mus musculus
tggcccggtctggaataaacaccca

SEQ ID NO: 65526 - DNA, 25 bp, Mus musculus
tggcccgtaagctggtcatcatcga

SEQ ID NO: 65527 - DNA, 25 bp, Mus musculus
tggccctcaagagtgtgagagttcc

SEQ ID NO: 65528 - DNA, 25 bp, Mus musculus
tggccctcagtacaattcgtctctc

SEQ ID NO: 65529 - DNA, 25 bp, Mus musculus
tggccctccggtacatgaagcagga

SEQ ID NO: 65530 - DNA, 25 bp, Mus musculus
tggccctctctgcaattgatgcctg

SEQ ID NO: 65531 - DNA, 25 bp, Mus musculus
tggccctgaaaacctaagcttggag

SEQ ID NO: 65532 - DNA, 25 bp, Mus musculus
tggccctgacacaaggcatgagagt

SEQ ID NO: 65533 - DNA, 25 bp, Mus musculus
tggccctgactatcaggacgtggca

SEQ ID NO: 65534 - DNA, 25 bp, Mus musculus
tggccctgccaagcttgggattcgt

SEQ ID NO: 65535 - DNA, 25 bp, Mus musculus
tggccctgctgaagcttacccagac

SEQ ID NO: 65536 - DNA, 25 bp, Mus musculus
tggccctggatctggttctcttgct

SEQ ID NO: 65537 - DNA, 25 bp, Mus musculus
tggccctggcaaactaaggcaattc

SEQ ID NO: 65538 - DNA, 25 bp, Mus musculus
tggccctgggacaactggatcgacc

SEQ ID NO: 65539 - DNA, 25 bp, Mus musculus
tggcccttactgaccgtgtccaaag

SEQ ID NO: 65540 - DNA, 25 bp, Mus musculus
tggcccttagtttgagccgagagga

SEQ ID NO: 65541 - DNA, 25 bp, Mus musculus
tggcccttcgggatatgaccagtaa

SEQ ID NO: 65542 - DNA, 25 bp, Mus musculus
tggcccttcgggttatgaccagtaa

SEQ ID NO: 65543 - DNA, 25 bp, Mus musculus
tggccgacaaggaactcctgccctg

SEQ ID NO: 65544 - DNA, 25 bp, Mus musculus
tggccgacgagatggatgtgaatat

SEQ ID NO: 65545 - DNA, 25 bp, Mus musculus
tggccgagatggaataccaggaatg

SEQ ID NO: 65546 - DNA, 25 bp, Mus musculus
tggccgagggagttctctctagctc

SEQ ID NO: 65547 - DNA, 25 bp, Mus musculus
tggccgagggcgtgttgctgaggtc

SEQ ID NO: 65548 - DNA, 25 bp, Mus musculus
tggccgaggtccttgtcaaccaggg

SEQ ID NO: 65549 - DNA, 25 bp, Mus musculus
tggccgatgtaaacacaccagtgag

SEQ ID NO: 65550 - DNA, 25 bp, Mus musculus
tggccgcaagttatcatctgatccg

SEQ ID NO: 65551 - DNA, 25 bp, Mus musculus
tggccgccacttcttctcgtcgtgg

SEQ ID NO: 65552 - DNA, 25 bp, Mus musculus
tggccgctctgaagacactcgtact

SEQ ID NO: 65553 - DNA, 25 bp, Mus musculus
tggccgcttctctcctggaagctct

SEQ ID NO: 65554 - DNA, 25 bp, Mus musculus
tggccggattcatcactgcatgagg

SEQ ID NO: 65555 - DNA, 25 bp, Mus musculus
tggccggcaagagtcagtatcttct

SEQ ID NO: 65556 - DNA, 25 bp, Mus musculus
tggccggccacaacagatctggtgc

SEQ ID NO: 65557 - DNA, 25 bp, Mus musculus
tggccgtgacctcatgattgttttg

SEQ ID NO: 65558 - DNA, 25 bp, Mus musculus
tggccgtggaccaagaagaaactgc

SEQ ID NO: 65559 - DNA, 25 bp, Mus musculus
tggccgtttgatgatggagctccac

SEQ ID NO: 65560 - DNA, 25 bp, Mus musculus
tggcctaacatggtactcagcgaga

SEQ ID NO: 65561 - DNA, 25 bp, Mus musculus
tggcctaactacctgtgacatgagt

SEQ ID NO: 65562 - DNA, 25 bp, Mus musculus
tggcctaaggccaaaatccactcca

SEQ ID NO: 65563 - DNA, 25 bp, Mus musculus
tggcctaagttggttccagagtcac

SEQ ID NO: 65564 - DNA, 25 bp, Mus musculus
tggcctaggccaaggtcacccttaa

SEQ ID NO: 65565 - DNA, 25 bp, Mus musculus
tggcctataacctcatcaagccctt

SEQ ID NO: 65566 - DNA, 25 bp, Mus musculus
tggcctatcacgtaattgaccgcgc

SEQ ID NO: 65567 - DNA, 25 bp, Mus musculus
tggcctatcttcaacagctacatag

SEQ ID NO: 65568 - DNA, 25 bp, Mus musculus
tggcctatgaggagctcctggacaa

SEQ ID NO: 65569 - DNA, 25 bp, Mus musculus
tggcctatgcagactatcatgacct

SEQ ID NO: 65570 - DNA, 25 bp, Mus musculus
tggcctcaaagctgtgaccctcttt

SEQ ID NO: 65571 - DNA, 25 bp, Mus musculus
tggcctcaagacaaggtcttccagc

SEQ ID NO: 65572 - DNA, 25 bp, Mus musculus
tggcctcactcctcatcgaggctgg

SEQ ID NO: 65573 - DNA, 25 bp, Mus musculus
tggcctcagactcaactggactgca

SEQ ID NO: 65574 - DNA, 25 bp, Mus musculus
tggcctcagagcatcccttatcaga

SEQ ID NO: 65575 - DNA, 25 bp, Mus musculus
tggcctcagatctggatcttttcct

SEQ ID NO: 65576 - DNA, 25 bp, Mus musculus
tggcctcagtggtcaaggtgcatct

SEQ ID NO: 65577 - DNA, 25 bp, Mus musculus
tggcctccaagcaggaaaaggatgg

SEQ ID NO: 65578 - DNA, 25 bp, Mus musculus
tggcctccaatgtagcaagctctgt

SEQ ID NO: 65579 - DNA, 25 bp, Mus musculus
tggcctccaggatcgcagagggctt

SEQ ID NO: 65580 - DNA, 25 bp, Mus musculus
tggcctccatttgaccaaaaacttg

SEQ ID NO: 65581 - DNA, 25 bp, Mus musculus
tggcctccctgctccagtaggagga

SEQ ID NO: 65582 - DNA, 25 bp, Mus musculus
tggcctcctgcccagactcagataa

SEQ ID NO: 65583 - DNA, 25 bp, Mus musculus
tggcctcggaggaattattagctgt

SEQ ID NO: 65584 - DNA, 25 bp, Mus musculus
tggcctctagagtggtaacagtact

SEQ ID NO: 65585 - DNA, 25 bp, Mus musculus
tggcctctcggtccacagagcatgg

SEQ ID NO: 65586 - DNA, 25 bp, Mus musculus
tggcctctgatgatctgagggatgt

SEQ ID NO: 65587 - DNA, 25 bp, Mus musculus
tggcctctgctttgcgggacttgta

SEQ ID NO: 65588 - DNA, 25 bp, Mus musculus
tggcctgagccaagtacctcatttg

SEQ ID NO: 65589 - DNA, 25 bp, Mus musculus
tggcctgagcctgatcagaaacctg

SEQ ID NO: 65590 - DNA, 25 bp, Mus musculus
tggcctgagcttcgatgaatcccgg

SEQ ID NO: 65591 - DNA, 25 bp, Mus musculus
tggcctgaggacaggaatactgttt

SEQ ID NO: 65592 - DNA, 25 bp, Mus musculus
tggcctgatgtacatgttcacacct

SEQ ID NO: 65593 - DNA, 25 bp, Mus musculus
tggcctgattgcttttgccagctac

SEQ ID NO: 65594 - DNA, 25 bp, Mus musculus
tggcctgctgtcgtttagttgatct

SEQ ID NO: 65595 - DNA, 25 bp, Mus musculus
tggcctggcagaggacatcgataag

SEQ ID NO: 65596 - DNA, 25 bp, Mus musculus
tggcctggcagtatgggccttgtac

SEQ ID NO: 65597 - DNA, 25 bp, Mus musculus
tggcctggcatacatgttcacacct

SEQ ID NO: 65598 - DNA, 25 bp, Mus musculus
tggcctggcctatctgaatggttca

SEQ ID NO: 65599 - DNA, 25 bp, Mus musculus
tggcctgggagtagatattgtcata

SEQ ID NO: 65600 - DNA, 25 bp, Mus musculus
tggcctgtgcctcgatgaggcaccc

SEQ ID NO: 65601 - DNA, 25 bp, Mus musculus
tggcctgtgcctggatgaggcaccc

SEQ ID NO: 65602 - DNA, 25 bp, Mus musculus
tggccttaggccattttgttcttcc

SEQ ID NO: 65603 - DNA, 25 bp, Mus musculus
tggccttatggcctgaagacatcct

SEQ ID NO: 65604 - DNA, 25 bp, Mus musculus
tggccttcatcgttttcacagaagc

SEQ ID NO: 65605 - DNA, 25 bp, Mus musculus
tggccttcccattctggagtggtgt

SEQ ID NO: 65606 - DNA, 25 bp, Mus musculus
tggccttcgcccctgtggtcatgcg

SEQ ID NO: 65607 - DNA, 25 bp, Mus musculus
tggccttctcgtgtcctgtctgatg

SEQ ID NO: 65608 - DNA, 25 bp, Mus musculus
tggccttctgatagctccgtgcagc

SEQ ID NO: 65609 - DNA, 25 bp, Mus musculus
tggccttgaaaatcgctgggcgaat

SEQ ID NO: 65610 - DNA, 25 bp, Mus musculus
tggccttgaacaaagtggacggacc

SEQ ID NO: 65611 - DNA, 25 bp, Mus musculus
tggccttgaacttactatttcctac

SEQ ID NO: 65612 - DNA, 25 bp, Mus musculus
tggccttgaatctacagaaaattgc

SEQ ID NO: 65613 - DNA, 25 bp, Mus musculus
tggccttgatgatgcagctggcccg

SEQ ID NO: 65614 - DNA, 25 bp, Mus musculus
tggccttgattgcttcgtcctgaac

SEQ ID NO: 65615 - DNA, 25 bp, Mus musculus
tggccttgggcctgacccagtcaga

SEQ ID NO: 65616 - DNA, 25 bp, Mus musculus
tggcctttcaggtttccacacgtac

SEQ ID NO: 65617 - DNA, 25 bp, Mus musculus
tggcgaaatggattcgagtcaaccg

SEQ ID NO: 65618 - DNA, 25 bp, Mus musculus
tggcgacaacacaacaaatgcttct

SEQ ID NO: 65619 - DNA, 25 bp, Mus musculus
tggcgacagaacctatagcagagtg

SEQ ID NO: 65620 - DNA, 25 bp, Mus musculus
tggcgacagagataagcctcgaagc

SEQ ID NO: 65621 - DNA, 25 bp, Mus musculus
tggcgacattagcagattcagattg

SEQ ID NO: 65622 - DNA, 25 bp, Mus musculus
tggcgaccctgcctttgccaatgga

SEQ ID NO: 65623 - DNA, 25 bp, Mus musculus
tggcgacctgctacagcttcgctgt

SEQ ID NO: 65624 - DNA, 25 bp, Mus musculus
tggcgactgctgatgggctaataca

SEQ ID NO: 65625 - DNA, 25 bp, Mus musculus
tggcgaggacccgtatgcaggctcc

SEQ ID NO: 65626 - DNA, 25 bp, Mus musculus
tggcgaggactctcctgcctattca

SEQ ID NO: 65627 - DNA, 25 bp, Mus musculus
tggcgaggcgcaggagcttctggag

SEQ ID NO: 65628 - DNA, 25 bp, Mus musculus
tggcgagggcctttcggaagcttct

SEQ ID NO: 65629 - DNA, 25 bp, Mus musculus
tggcgagtgactttgaatgtgtgca

SEQ ID NO: 65630 - DNA, 25 bp, Mus musculus
tggcgagttcgaaattccatgaata

SEQ ID NO: 65631 - DNA, 25 bp, Mus musculus
tggcgatatcggcatcggaaccccg

SEQ ID NO: 65632 - DNA, 25 bp, Mus musculus
tggcgatcactgaagagtctaaggc

SEQ ID NO: 65633 - DNA, 25 bp, Mus musculus
tggcgattgagacgctgcaaaagtc

SEQ ID NO: 65634 - DNA, 25 bp, Mus musculus
tggcgcacccagtgtaactgttacg

SEQ ID NO: 65635 - DNA, 25 bp, Mus musculus
tggcgccagacaatccaatgggaga

SEQ ID NO: 65636 - DNA, 25 bp, Mus musculus
tggcgccagacattccaatgggaga

SEQ ID NO: 65637 - DNA, 25 bp, Mus musculus
tggcgccatctcgactgtccaagga

SEQ ID NO: 65638 - DNA, 25 bp, Mus musculus
tggcgccatgttgacaaaggcacag

SEQ ID NO: 65639 - DNA, 25 bp, Mus musculus
tggcgcctctgaccaggacacactg

SEQ ID NO: 65640 - DNA, 25 bp, Mus musculus
tggcgcctgcggaatcagagaactt

SEQ ID NO: 65641 - DNA, 25 bp, Mus musculus
tggcgcctgcggtatcagagaactt

SEQ ID NO: 65642 - DNA, 25 bp, Mus musculus
tggcgctaacatggcaagactctca

SEQ ID NO: 65643 - DNA, 25 bp, Mus musculus
tggcgctggctgttctccgtcgtcg

SEQ ID NO: 65644 - DNA, 25 bp, Mus musculus
tggcgctttcgagctgaactggcag

SEQ ID NO: 65645 - DNA, 25 bp, Mus musculus
tggcggacagcatgccttcgctgcg

SEQ ID NO: 65646 - DNA, 25 bp, Mus musculus
tggcggagaaggaaaatctctcagc

SEQ ID NO: 65647 - DNA, 25 bp, Mus musculus
tggcggcactgatgtacacagacac

SEQ ID NO: 65648 - DNA, 25 bp, Mus musculus
tggcggccatcgtaaaagccatggc

SEQ ID NO: 65649 - DNA, 25 bp, Mus musculus
tggcgggacctttgttaggacctat

SEQ ID NO: 65650 - DNA, 25 bp, Mus musculus
tggcgggatgcaggttatgactatc

SEQ ID NO: 65651 - DNA, 25 bp, Mus musculus
tggcgggcattttagcacagcacgt

SEQ ID NO: 65652 - DNA, 25 bp, Mus musculus
tggcggtccctcagcactggaggct

SEQ ID NO: 65653 - DNA, 25 bp, Mus musculus
tggcggtggctgtcattgccgtcct

SEQ ID NO: 65654 - DNA, 25 bp, Mus musculus
tggcggtggtgtacatattcagccc

SEQ ID NO: 65655 - DNA, 25 bp, Mus musculus
tggcggtgttcttccacctcagagc

SEQ ID NO: 65656 - DNA, 25 bp, Mus musculus
tggcgtacgcatggcagaaatggta

SEQ ID NO: 65657 - DNA, 25 bp, Mus musculus
tggcgtcacatgagaacacggcacg

SEQ ID NO: 65658 - DNA, 25 bp, Mus musculus
tggcgtcaccgctgctaaggagaag

SEQ ID NO: 65659 - DNA, 25 bp, Mus musculus
tggcgtccccttgagctttctggtg

SEQ ID NO: 65660 - DNA, 25 bp, Mus musculus
tggcgtctaatgagcaggacagtga

SEQ ID NO: 65661 - DNA, 25 bp, Mus musculus
tggcgtgaaaccaccaatgatgatg

SEQ ID NO: 65662 - DNA, 25 bp, Mus musculus
tggcgtgcaggtgtacaagcacaca

SEQ ID NO: 65663 - DNA, 25 bp, Mus musculus
tggcgttaggctttaccatctttgt

SEQ ID NO: 65664 - DNA, 25 bp, Mus musculus
tggcgttcaaggcacggtcctctag

SEQ ID NO: 65665 - DNA, 25 bp, Mus musculus
tggcgttcttaacctctgaccaact

SEQ ID NO: 65666 - DNA, 25 bp, Mus musculus
tggctaaagataaatcagaaagcag

SEQ ID NO: 65667 - DNA, 25 bp, Mus musculus
tggctaaagcagagccggagccctc

SEQ ID NO: 65668 - DNA, 25 bp, Mus musculus
tggctaacttcctgcttgtcaacag

SEQ ID NO: 65669 - DNA, 25 bp, Mus musculus
tggctaagcccacgctcattcctga

SEQ ID NO: 65670 - DNA, 25 bp, Mus musculus
tggctaagtctgaccctatggtgca

SEQ ID NO: 65671 - DNA, 25 bp, Mus musculus
tggctaatcaagagtgaaaaacctg

SEQ ID NO: 65672 - DNA, 25 bp, Mus musculus
tggctaatcgcgatttgctaagcag

SEQ ID NO: 65673 - DNA, 25 bp, Mus musculus
tggctacacactagtcaccctcaga

SEQ ID NO: 65674 - DNA, 25 bp, Mus musculus
tggctacacacttgtcaccctcaga

SEQ ID NO: 65675 - DNA, 25 bp, Mus musculus
tggctacagctttgactatgattac

SEQ ID NO: 65676 - DNA, 25 bp, Mus musculus
tggctacaggcatgggagtgccccc

SEQ ID NO: 65677 - DNA, 25 bp, Mus musculus
tggctaccaggactgccaccgtgtg

SEQ ID NO: 65678 - DNA, 25 bp, Mus musculus
tggctacccacagacggaaggcttg

SEQ ID NO: 65679 - DNA, 25 bp, Mus musculus
tggctacctacagacaacctttggg

SEQ ID NO: 65680 - DNA, 25 bp, Mus musculus
tggctacctctacacctactgggct

SEQ ID NO: 65681 - DNA, 25 bp, Mus musculus
tggctactacgtggccctggcctgg

SEQ ID NO: 65682 - DNA, 25 bp, Mus musculus
tggctactgtttgggtaccaccctg

SEQ ID NO: 65683 - DNA, 25 bp, Mus musculus
tggctagaagcagatcgtcatggca

SEQ ID NO: 65684 - DNA, 25 bp, Mus musculus
tggctagacctagatgaaggacaca

SEQ ID NO: 65685 - DNA, 25 bp, Mus musculus
tggctagcagtgaaggtacagaact

SEQ ID NO: 65686 - DNA, 25 bp, Mus musculus
tggctagcagtgtaggtacagaact

SEQ ID NO: 65687 - DNA, 25 bp, Mus musculus
tggctagcgacccttctcagcctta

SEQ ID NO: 65688 - DNA, 25 bp, Mus musculus
tggctaggcaactggaagaaaagga

SEQ ID NO: 65689 - DNA, 25 bp, Mus musculus
tggctatcagatacgacgcttttgg

SEQ ID NO: 65690 - DNA, 25 bp, Mus musculus
tggctatcatcagtaaattcaatga

SEQ ID NO: 65691 - DNA, 25 bp, Mus musculus
tggctatccgtgacttcaaacaggc

SEQ ID NO: 65692 - DNA, 25 bp, Mus musculus
tggctatgccttccaccctcttgtg

SEQ ID NO: 65693 - DNA, 25 bp, Mus musculus
tggctattcaggaggcctgcggctg

SEQ ID NO: 65694 - DNA, 25 bp, Mus musculus
tggctattctaggtcttggcagcag

SEQ ID NO: 65695 - DNA, 25 bp, Mus musculus
tggctattgccttttgaacagactt

SEQ ID NO: 65696 - DNA, 25 bp, Mus musculus
tggctcaatatgaaagatgaggagc

SEQ ID NO: 65697 - DNA, 25 bp, Mus musculus
tggctcaatcctccgtcctttaggg

SEQ ID NO: 65698 - DNA, 25 bp, Mus musculus
tggctcacaactacaggaacagcag

SEQ ID NO: 65699 - DNA, 25 bp, Mus musculus
tggctcacagatgtgcccagggaag

SEQ ID NO: 65700 - DNA, 25 bp, Mus musculus
tggctcagataaaggctgctccaga

SEQ ID NO: 65701 - DNA, 25 bp, Mus musculus
tggctcaggcaataaaggatccggg

SEQ ID NO: 65702 - DNA, 25 bp, Mus musculus
tggctcaggccaaacgatggctcta

SEQ ID NO: 65703 - DNA, 25 bp, Mus musculus
tggctcagttgcagacatccatccg

SEQ ID NO: 65704 - DNA, 25 bp, Mus musculus
tggctcatcagaagttattaactgg

SEQ ID NO: 65705 - DNA, 25 bp, Mus musculus
tggctcatgtggaaagcacgtgcgt

SEQ ID NO: 65706 - DNA, 25 bp, Mus musculus
tggctccaaggagtactggttcgtg

SEQ ID NO: 65707 - DNA, 25 bp, Mus musculus
tggctccacattcctcctactttga

SEQ ID NO: 65708 - DNA, 25 bp, Mus musculus
tggctccaggttaaatcagtatgat

SEQ ID NO: 65709 - DNA, 25 bp, Mus musculus
tggctccatgaagtattatgcactg

SEQ ID NO: 65710 - DNA, 25 bp, Mus musculus
tggctcccagcattgggcctgtatc

SEQ ID NO: 65711 - DNA, 25 bp, Mus musculus
tggctcccgaggtctattccctaca

SEQ ID NO: 65712 - DNA, 25 bp, Mus musculus
tggctcctcggtgactctaggatgc

SEQ ID NO: 65713 - DNA, 25 bp, Mus musculus
tggctcctgagcaatgggaagcgac

SEQ ID NO: 65714 - DNA, 25 bp, Mus musculus
tggctcctgcttcgcagaatccggg

SEQ ID NO: 65715 - DNA, 25 bp, Mus musculus
tggctccttcggctttctgggtttc

SEQ ID NO: 65716 - DNA, 25 bp, Mus musculus
tggctcggaagctggagttcaacaa

SEQ ID NO: 65717 - DNA, 25 bp, Mus musculus
tggctcgtctgtaccgcacagggat

SEQ ID NO: 65718 - DNA, 25 bp, Mus musculus
tggctcgtggctggcccctgagaca

SEQ ID NO: 65719 - DNA, 25 bp, Mus musculus
tggctctcccatccacatagagaac

SEQ ID NO: 65720 - DNA, 25 bp, Mus musculus
tggctctctgatggacgactacttg

SEQ ID NO: 65721 - DNA, 25 bp, Mus musculus
tggctctctgccagcggtactacca

SEQ ID NO: 65722 - DNA, 25 bp, Mus musculus
tggctctgaaatctgatcctcatgc

SEQ ID NO: 65723 - DNA, 25 bp, Mus musculus
tggctctgaaatgtgatcctcatgc

SEQ ID NO: 65724 - DNA, 25 bp, Mus musculus
tggctctgatagtaagcctggccct

SEQ ID NO: 65725 - DNA, 25 bp, Mus musculus
tggctctgcacccagtccgatggga

SEQ ID NO: 65726 - DNA, 25 bp, Mus musculus
tggctctggtttaaagcaagcgttt

SEQ ID NO: 65727 - DNA, 25 bp, Mus musculus
tggctctgtcaatgttctccgtggc

SEQ ID NO: 65728 - DNA, 25 bp, Mus musculus
tggctctgtgtgctcatcccgaagt

SEQ ID NO: 65729 - DNA, 25 bp, Mus musculus
tggctgaaatgcttcctggagtcct

SEQ ID NO: 65730 - DNA, 25 bp, Mus musculus
tggctgaacacaagacgacctggga

SEQ ID NO: 65731 - DNA, 25 bp, Mus musculus
tggctgaagactggcagctgcctct

SEQ ID NO: 65732 - DNA, 25 bp, Mus musculus
tggctgaaggaggtctcaattctgg

SEQ ID NO: 65733 - DNA, 25 bp, Mus musculus
tggctgaaggccacaaagcaagctt

SEQ ID NO: 65734 - DNA, 25 bp, Mus musculus
tggctgaaggcctcaaagcaagctt

SEQ ID NO: 65735 - DNA, 25 bp, Mus musculus
tggctgaaggtagttccaatggaag

SEQ ID NO: 65736 - DNA, 25 bp, Mus musculus
tggctgacaaggctgcatcctggct

SEQ ID NO: 65737 - DNA, 25 bp, Mus musculus
tggctgacagggtggcttcctacct

SEQ ID NO: 65738 - DNA, 25 bp, Mus musculus
tggctgaccatcaagccccaaggat

SEQ ID NO: 65739 - DNA, 25 bp, Mus musculus
tggctgaccccactggagcctttgg

SEQ ID NO: 65740 - DNA, 25 bp, Mus musculus
tggctgaccgtcagcaacattggca

SEQ ID NO: 65741 - DNA, 25 bp, Mus musculus
tggctgacgtccacttcatcgtggg

SEQ ID NO: 65742 - DNA, 25 bp, Mus musculus
tggctgagaagagtttcaacactgt

SEQ ID NO: 65743 - DNA, 25 bp, Mus musculus
tggctgagcacatgatacgtgttac

SEQ ID NO: 65744 - DNA, 25 bp, Mus musculus
tggctgagcagcatcacatgcgggc

SEQ ID NO: 65745 - DNA, 25 bp, Mus musculus
tggctgagcttgaacatgatgtcag

SEQ ID NO: 65746 - DNA, 25 bp, Mus musculus
tggctgaggaatatctacaaagacc

SEQ ID NO: 65747 - DNA, 25 bp, Mus musculus
tggctgaggaccctgattcaattcc

SEQ ID NO: 65748 - DNA, 25 bp, Mus musculus
tggctgaggcccagaccaaggagac

SEQ ID NO: 65749 - DNA, 25 bp, Mus musculus
tggctgagtatcaccgcaggatcga

SEQ ID NO: 65750 - DNA, 25 bp, Mus musculus
tggctgagtcagcaaggcctcagat

SEQ ID NO: 65751 - DNA, 25 bp, Mus musculus
tggctgatcagccaatagaggcccc

SEQ ID NO: 65752 - DNA, 25 bp, Mus musculus
tggctgatcgcctgtgttccaggct

SEQ ID NO: 65753 - DNA, 25 bp, Mus musculus
tggctgcaagttgggaagatgaaaa

SEQ ID NO: 65754 - DNA, 25 bp, Mus musculus
tggctgcacaccaggaccgagtgga

SEQ ID NO: 65755 - DNA, 25 bp, Mus musculus
tggctgcaccgtcacattgctggag

SEQ ID NO: 65756 - DNA, 25 bp, Mus musculus
tggctgccagaaacgtgttggtaac

SEQ ID NO: 65757 - DNA, 25 bp, Mus musculus
tggctgccatgtcgtccgcacagat

SEQ ID NO: 65758 - DNA, 25 bp, Mus musculus
tggctgccccagtaccgccttaagg

SEQ ID NO: 65759 - DNA, 25 bp, Mus musculus
tggctgccccggatcatcctcgagg

SEQ ID NO: 65760 - DNA, 25 bp, Mus musculus
tggctgccctccgtgcacagggcca

SEQ ID NO: 65761 - DNA, 25 bp, Mus musculus
tggctgcctcttagactctactctg

SEQ ID NO: 65762 - DNA, 25 bp, Mus musculus
tggctgcctctttgactctactctg

SEQ ID NO: 65763 - DNA, 25 bp, Mus musculus
tggctgccttcacctcctttgtcta

SEQ ID NO: 65764 - DNA, 25 bp, Mus musculus
tggctgcgatttaagtactacagct

SEQ ID NO: 65765 - DNA, 25 bp, Mus musculus
tggctgctaaaggataaaagacata

SEQ ID NO: 65766 - DNA, 25 bp, Mus musculus
tggctgctccggaggccctcgctga

SEQ ID NO: 65767 - DNA, 25 bp, Mus musculus
tggctgctccggtggccctcgctga

SEQ ID NO: 65768 - DNA, 25 bp, Mus musculus
tggctgctctgagactcactgtcag

SEQ ID NO: 65769 - DNA, 25 bp, Mus musculus
tggctgctgacattgacatcgacac

SEQ ID NO: 65770 - DNA, 25 bp, Mus musculus
tggctgctgaccatcttagctgcaa

SEQ ID NO: 65771 - DNA, 25 bp, Mus musculus
tggctgctgaccttcttagctgcaa

SEQ ID NO: 65772 - DNA, 25 bp, Mus musculus
tggctgctgagctcaaccatgcaca

SEQ ID NO: 65773 - DNA, 25 bp, Mus musculus
tggctgctgcacctactactatgaa

SEQ ID NO: 65774 - DNA, 25 bp, Mus musculus
tggctgctgggttacatggacccca

SEQ ID NO: 65775 - DNA, 25 bp, Mus musculus
tggctgctgtgaggcaaataaactc

SEQ ID NO: 65776 - DNA, 25 bp, Mus musculus
tggctggaaagaacacctggtttag

SEQ ID NO: 65777 - DNA, 25 bp, Mus musculus
tggctggaacaaagtggctcacatc

SEQ ID NO: 65778 - DNA, 25 bp, Mus musculus
tggctggaacaatgtggctcacatc

SEQ ID NO: 65779 - DNA, 25 bp, Mus musculus
tggctggaagcctcatggccgtcgc

SEQ ID NO: 65780 - DNA, 25 bp, Mus musculus
tggctggagacacagatggcctcaa

SEQ ID NO: 65781 - DNA, 25 bp, Mus musculus
tggctggatccaaacaaaccaataa

SEQ ID NO: 65782 - DNA, 25 bp, Mus musculus
tggctggatcgttctagggccctac

SEQ ID NO: 65783 - DNA, 25 bp, Mus musculus
tggctggattcatctcggtgcctca

SEQ ID NO: 65784 - DNA, 25 bp, Mus musculus
tggctggcatttgactggaacacgc

SEQ ID NO: 65785 - DNA, 25 bp, Mus musculus
tggctggcctgggaacgcttccgct

SEQ ID NO: 65786 - DNA, 25 bp, Mus musculus
tggctggctgagcagcatcacatgc

SEQ ID NO: 65787 - DNA, 25 bp, Mus musculus
tggctggctgtatccatggcctcag

SEQ ID NO: 65788 - DNA, 25 bp, Mus musculus
tggctgggcaccaaggacccgtgcc

SEQ ID NO: 65789 - DNA, 25 bp, Mus musculus
tggctgggctgaatgctatccagat

SEQ ID NO: 65790 - DNA, 25 bp, Mus musculus
tggctggtgttgtcaaataccgagg

SEQ ID NO: 65791 - DNA, 25 bp, Mus musculus
tggctggttctccagcacttctgca

SEQ ID NO: 65792 - DNA, 25 bp, Mus musculus
tggctgtattaataacccagtagca

SEQ ID NO: 65793 - DNA, 25 bp, Mus musculus
tggctgtcccattctagatgaggat

SEQ ID NO: 65794 - DNA, 25 bp, Mus musculus
tggctgtcgaagagcttggctttga

SEQ ID NO: 65795 - DNA, 25 bp, Mus musculus
tggctgtctcccctgataaatagga

SEQ ID NO: 65796 - DNA, 25 bp, Mus musculus
tggctgtgcacttcacccaggacga

SEQ ID NO: 65797 - DNA, 25 bp, Mus musculus
tggctgtgcatcttacacgagagga

SEQ ID NO: 65798 - DNA, 25 bp, Mus musculus
tggctgtggtatggaaacagaatgt

SEQ ID NO: 65799 - DNA, 25 bp, Mus musculus
tggctgttcctggtgccagaagctg

SEQ ID NO: 65800 - DNA, 25 bp, Mus musculus
tggctgttctccgtcgtcgttcctg

SEQ ID NO: 65801 - DNA, 25 bp, Mus musculus
tggctgtttctcatggagccttcct

SEQ ID NO: 65802 - DNA, 25 bp, Mus musculus
tggcttaaacactacacacgctcac

SEQ ID NO: 65803 - DNA, 25 bp, Mus musculus
tggcttaacttctcccggagctaag

SEQ ID NO: 65804 - DNA, 25 bp, Mus musculus
tggcttaccacatcatggactgctg

SEQ ID NO: 65805 - DNA, 25 bp, Mus musculus
tggcttacctgtattcatcagcaga

SEQ ID NO: 65806 - DNA, 25 bp, Mus musculus
tggcttacttgtacggcgcctcgcc

SEQ ID NO: 65807 - DNA, 25 bp, Mus musculus
tggcttagaccttccggggcccagc

SEQ ID NO: 65808 - DNA, 25 bp, Mus musculus
tggcttatttatcggcctggctgga

SEQ ID NO: 65809 - DNA, 25 bp, Mus musculus
tggcttcacactggggacattggtc

SEQ ID NO: 65810 - DNA, 25 bp, Mus musculus
tggcttcactgaccacagaggttgt

SEQ ID NO: 65811 - DNA, 25 bp, Mus musculus
tggcttcagctgttctggaggctgt

SEQ ID NO: 65812 - DNA, 25 bp, Mus musculus
tggcttcaggccagcaaacggagga

SEQ ID NO: 65813 - DNA, 25 bp, Mus musculus
tggcttcatgaaggctgtccaggaa

SEQ ID NO: 65814 - DNA, 25 bp, Mus musculus
tggcttccattacaacgtgctgagc

SEQ ID NO: 65815 - DNA, 25 bp, Mus musculus
tggcttccgttgctgtggctaacaa

SEQ ID NO: 65816 - DNA, 25 bp, Mus musculus
tggcttcctaaaactacctcaacta

SEQ ID NO: 65817 - DNA, 25 bp, Mus musculus
tggcttcctacctggtgtcccacat

SEQ ID NO: 65818 - DNA, 25 bp, Mus musculus
tggcttcctggatgtaagcacagga

SEQ ID NO: 65819 - DNA, 25 bp, Mus musculus
tggcttccttctgaccctttatgga

SEQ ID NO: 65820 - DNA, 25 bp, Mus musculus
tggcttcggtgctgctccagtgttt

SEQ ID NO: 65821 - DNA, 25 bp, Mus musculus
tggcttctatgtcgcgccaaatgga

SEQ ID NO: 65822 - DNA, 25 bp, Mus musculus
tggcttctatgtggcgccaaatgga

SEQ ID NO: 65823 - DNA, 25 bp, Mus musculus
tggcttctccagaaccggtgtctgc

SEQ ID NO: 65824 - DNA, 25 bp, Mus musculus
tggcttctggtcttgctgtcatcaa

SEQ ID NO: 65825 - DNA, 25 bp, Mus musculus
tggcttctgtgacaacacggacggc

SEQ ID NO: 65826 - DNA, 25 bp, Mus musculus
tggcttctgtgagaacacggacggc

SEQ ID NO: 65827 - DNA, 25 bp, Mus musculus
tggcttcttcaagaggagtgtgaga

SEQ ID NO: 65828 - DNA, 25 bp, Mus musculus
tggcttcttcagagtttgctacttc

SEQ ID NO: 65829 - DNA, 25 bp, Mus musculus
tggcttcttcagatggcgcaagtct

SEQ ID NO: 65830 - DNA, 25 bp, Mus musculus
tggcttgcagctgatgcttacgctc

SEQ ID NO: 65831 - DNA, 25 bp, Mus musculus
tggcttggctgacaccataccttcc

SEQ ID NO: 65832 - DNA, 25 bp, Mus musculus
tggcttggtttcctacaacgaccct

SEQ ID NO: 65833 - DNA, 25 bp, Mus musculus
tggcttgtgactcccaggaagatgt

SEQ ID NO: 65834 - DNA, 25 bp, Mus musculus
tggctttaccaacgccttaggccac

SEQ ID NO: 65835 - DNA, 25 bp, Mus musculus
tggctttaccaaggccttaggccac

SEQ ID NO: 65836 - DNA, 25 bp, Mus musculus
tggctttcactcttcaccagtgacc

SEQ ID NO: 65837 - DNA, 25 bp, Mus musculus
tggctttccatgaacgtcttaatgc

SEQ ID NO: 65838 - DNA, 25 bp, Mus musculus
tggctttcctagacactgccctgtg

SEQ ID NO: 65839 - DNA, 25 bp, Mus musculus
tggctttctcttgtggcttctgtag

SEQ ID NO: 65840 - DNA, 25 bp, Mus musculus
tggctttgagcgatttcatgcatta

SEQ ID NO: 65841 - DNA, 25 bp, Mus musculus
tggctttgcaccttgcacgacattt

SEQ ID NO: 65842 - DNA, 25 bp, Mus musculus
tggctttgcaggagaccagattcct

SEQ ID NO: 65843 - DNA, 25 bp, Mus musculus
tggctttgcgggtcgcattcacctc

SEQ ID NO: 65844 - DNA, 25 bp, Mus musculus
tggctttgctccagacacaaaggac

SEQ ID NO: 65845 - DNA, 25 bp, Mus musculus
tggctttgggtacggactccccatt

SEQ ID NO: 65846 - DNA, 25 bp, Mus musculus
tggctttggtggctgcaccgtcaca

SEQ ID NO: 65847 - DNA, 25 bp, Mus musculus
tggctttgttggctgacccagctcc

SEQ ID NO: 65848 - DNA, 25 bp, Mus musculus
tgggaaaaaggcatatgctacaagc

SEQ ID NO: 65849 - DNA, 25 bp, Mus musculus
tgggaaaacaatcaagctacagata

SEQ ID NO: 65850 - DNA, 25 bp, Mus musculus
tgggaaaaccaccagaccaaggaga

SEQ ID NO: 65851 - DNA, 25 bp, Mus musculus
tgggaaaaggtgaagctcctgtttg

SEQ ID NO: 65852 - DNA, 25 bp, Mus musculus
tgggaaaagtcaatcgaacagactc

SEQ ID NO: 65853 - DNA, 25 bp, Mus musculus
tgggaaaagtctgttgaacaaagag

SEQ ID NO: 65854 - DNA, 25 bp, Mus musculus
tgggaaaatagtaccacattgattt

SEQ ID NO: 65855 - DNA, 25 bp, Mus musculus
tgggaaaatgaaacggaggaagcaa

SEQ ID NO: 65856 - DNA, 25 bp, Mus musculus
tgggaaacagaaactcatgactggt

SEQ ID NO: 65857 - DNA, 25 bp, Mus musculus
tgggaaaccctctcccgaggataca

SEQ ID NO: 65858 - DNA, 25 bp, Mus musculus
tgggaaaccgtatgagcctgtgttc

SEQ ID NO: 65859 - DNA, 25 bp, Mus musculus
tgggaaactatggtcccagaccaaa

SEQ ID NO: 65860 - DNA, 25 bp, Mus musculus
tgggaaactcccatggaagcctcca

SEQ ID NO: 65861 - DNA, 25 bp, Mus musculus
tgggaaacttcacggaggccacaac

SEQ ID NO: 65862 - DNA, 25 bp, Mus musculus
tgggaaagaaaactattgaagaccg

SEQ ID NO: 65863 - DNA, 25 bp, Mus musculus
tgggaaagagtctgctccttgaata

SEQ ID NO: 65864 - DNA, 25 bp, Mus musculus
tgggaaagccgaagactcttcagac

SEQ ID NO: 65865 - DNA, 25 bp, Mus musculus
tgggaaagcgatggcagtcaccagt

SEQ ID NO: 65866 - DNA, 25 bp, Mus musculus
tgggaaagctatacgtacaatggca

SEQ ID NO: 65867 - DNA, 25 bp, Mus musculus
tgggaaataccaagatggaactgct

SEQ ID NO: 65868 - DNA, 25 bp, Mus musculus
tgggaaatattggtccccaacatga

SEQ ID NO: 65869 - DNA, 25 bp, Mus musculus
tgggaaatcacgaggcaaacactac

SEQ ID NO: 65870 - DNA, 25 bp, Mus musculus
tgggaacaaaaagtgtactcctcac

SEQ ID NO: 65871 - DNA, 25 bp, Mus musculus
tgggaacaatcccatttcctgaggg

SEQ ID NO: 65872 - DNA, 25 bp, Mus musculus
tgggaacacagtgcagtgtctcctt

SEQ ID NO: 65873 - DNA, 25 bp, Mus musculus
tgggaacagcattcacacagcatca

SEQ ID NO: 65874 - DNA, 25 bp, Mus musculus
tgggaacatccaatgcctgcaggat

SEQ ID NO: 65875 - DNA, 25 bp, Mus musculus
tgggaacattcgaataaaaatcaag

SEQ ID NO: 65876 - DNA, 25 bp, Mus musculus
tgggaaccacacatgtggaggtaga

SEQ ID NO: 65877 - DNA, 25 bp, Mus musculus
tgggaaccgtgtggccacgtttcta

SEQ ID NO: 65878 - DNA, 25 bp, Mus musculus
tgggaacctcatggacttcctcgag

SEQ ID NO: 65879 - DNA, 25 bp, Mus musculus
tgggaacgaactggatgaacagaat

SEQ ID NO: 65880 - DNA, 25 bp, Mus musculus
tgggaactagtaacagaaactccaa

SEQ ID NO: 65881 - DNA, 25 bp, Mus musculus
tgggaactagtatcagaaactccaa

SEQ ID NO: 65882 - DNA, 25 bp, Mus musculus
tgggaacttcgcagtcctggtggat

SEQ ID NO: 65883 - DNA, 25 bp, Mus musculus
tgggaagaacggagtaacgagtctc

SEQ ID NO: 65884 - DNA, 25 bp, Mus musculus
tgggaagaattacgaacctgtgatt

SEQ ID NO: 65885 - DNA, 25 bp, Mus musculus
tgggaagagggaactacaagcatcc

SEQ ID NO: 65886 - DNA, 25 bp, Mus musculus
tgggaagagggatctacaagcatcc

SEQ ID NO: 65887 - DNA, 25 bp, Mus musculus
tgggaagagtgctgtgctcaccgca

SEQ ID NO: 65888 - DNA, 25 bp, Mus musculus
tgggaagcaaactccctcatctgtc

SEQ ID NO: 65889 - DNA, 25 bp, Mus musculus
tgggaaggaaacaattaaatccagt

SEQ ID NO: 65890 - DNA, 25 bp, Mus musculus
tgggaaggaagattttggaaacctg

SEQ ID NO: 65891 - DNA, 25 bp, Mus musculus
tgggaaggccccaatgtggtccata

SEQ ID NO: 65892 - DNA, 25 bp, Mus musculus
tgggaaggcctgactgttgatgaca

SEQ ID NO: 65893 - DNA, 25 bp, Mus musculus
tgggaaggccttgttgcagaatttc

SEQ ID NO: 65894 - DNA, 25 bp, Mus musculus
tgggaagtacatgtgccggatcata

SEQ ID NO: 65895 - DNA, 25 bp, Mus musculus
tgggaagtcacttctggagttagcc

SEQ ID NO: 65896 - DNA, 25 bp, Mus musculus
tgggaagttacaacaaacatagctg

SEQ ID NO: 65897 - DNA, 25 bp, Mus musculus
tgggaatactcacagtgcagtgtct

SEQ ID NO: 65898 - DNA, 25 bp, Mus musculus
tgggaatactcagagtgcagtgtct

SEQ ID NO: 65899 - DNA, 25 bp, Mus musculus
tgggaatactgcaacctgaagcggt

SEQ ID NO: 65900 - DNA, 25 bp, Mus musculus
tgggaatcagtgaccatcgcagggc

SEQ ID NO: 65901 - DNA, 25 bp, Mus musculus
tgggaatcagtgagaagatcaagga

SEQ ID NO: 65902 - DNA, 25 bp, Mus musculus
tgggaatccctgtgtttgccaatgg

SEQ ID NO: 65903 - DNA, 25 bp, Mus musculus
tgggaatgacctgactaacttcact

SEQ ID NO: 65904 - DNA, 25 bp, Mus musculus
tgggaatgccacaatttctcatgcc

SEQ ID NO: 65905 - DNA, 25 bp, Mus musculus
tgggaatggcagtggaaaacaaaga

SEQ ID NO: 65906 - DNA, 25 bp, Mus musculus
tgggaattctcaaagtagctcagct

SEQ ID NO: 65907 - DNA, 25 bp, Mus musculus
tgggacaacagcctacgtccagcag

SEQ ID NO: 65908 - DNA, 25 bp, Mus musculus
tgggacaacattacagactctgcca

SEQ ID NO: 65909 - DNA, 25 bp, Mus musculus
tgggacaagctcgtgttttcaaaga

SEQ ID NO: 65910 - DNA, 25 bp, Mus musculus
tgggacaagtgttttgtacattggg

SEQ ID NO: 65911 - DNA, 25 bp, Mus musculus
tgggacaagtttacaggctgctgct

SEQ ID NO: 65912 - DNA, 25 bp, Mus musculus
tgggacaatgcccaggtaatcctcg

SEQ ID NO: 65913 - DNA, 25 bp, Mus musculus
tgggacacatccaatatgacatggc

SEQ ID NO: 65914 - DNA, 25 bp, Mus musculus
tgggacaccatgaagtacagttggc

SEQ ID NO: 65915 - DNA, 25 bp, Mus musculus
tgggacacccaaccagcccaaagga

SEQ ID NO: 65916 - DNA, 25 bp, Mus musculus
tgggacaccctcttcagtttggcgc

SEQ ID NO: 65917 - DNA, 25 bp, Mus musculus
tgggacaggcactgctcatagactt

SEQ ID NO: 65918 - DNA, 25 bp, Mus musculus
tgggacatcattcttctgatgctgc

SEQ ID NO: 65919 - DNA, 25 bp, Mus musculus
tgggacatgatctgcatattgtcaa

SEQ ID NO: 65920 - DNA, 25 bp, Mus musculus
tgggacatggttcctcttgatgcac

SEQ ID NO: 65921 - DNA, 25 bp, Mus musculus
tgggaccagcaactgaaccttgcct

SEQ ID NO: 65922 - DNA, 25 bp, Mus musculus
tgggaccagctagaggatgccgcta

SEQ ID NO: 65923 - DNA, 25 bp, Mus musculus
tgggaccagtgatccctgtgctgag

SEQ ID NO: 65924 - DNA, 25 bp, Mus musculus
tgggaccatacgaggagacttctgc

SEQ ID NO: 65925 - DNA, 25 bp, Mus musculus
tgggacccaagtcctcgcggctgct

SEQ ID NO: 65926 - DNA, 25 bp, Mus musculus
tgggacccaccagagtatttcgagc

SEQ ID NO: 65927 - DNA, 25 bp, Mus musculus
tgggacccagttaggaggcgcttca

SEQ ID NO: 65928 - DNA, 25 bp, Mus musculus
tgggacccatacaaaaaaggattcg

SEQ ID NO: 65929 - DNA, 25 bp, Mus musculus
tgggaccctggccattccaatcctg

SEQ ID NO: 65930 - DNA, 25 bp, Mus musculus
tgggaccgggatctgcaatctctga

SEQ ID NO: 65931 - DNA, 25 bp, Mus musculus
tgggaccgtcttgtggacgagaccc

SEQ ID NO: 65932 - DNA, 25 bp, Mus musculus
tgggacctgccgtcgttctcgtacc

SEQ ID NO: 65933 - DNA, 25 bp, Mus musculus
tgggacctgcgcattgatagcaaga

SEQ ID NO: 65934 - DNA, 25 bp, Mus musculus
tgggaccttccctgctccatcatgg

SEQ ID NO: 65935 - DNA, 25 bp, Mus musculus
tgggacgcacattctaatgataacg

SEQ ID NO: 65936 - DNA, 25 bp, Mus musculus
tgggactagaggacaaaaatacttc

SEQ ID NO: 65937 - DNA, 25 bp, Mus musculus
tgggactagaggtcaaaaatacttc

SEQ ID NO: 65938 - DNA, 25 bp, Mus musculus
tgggactattccactgccccagaac

SEQ ID NO: 65939 - DNA, 25 bp, Mus musculus
tgggactctctcctggtaccccaag

SEQ ID NO: 65940 - DNA, 25 bp, Mus musculus
tgggactctctcgtggtaccccaag

SEQ ID NO: 65941 - DNA, 25 bp, Mus musculus
tgggactcttcgcttttggattacc

SEQ ID NO: 65942 - DNA, 25 bp, Mus musculus
tgggactgacctctgggatcctcct

SEQ ID NO: 65943 - DNA, 25 bp, Mus musculus
tgggactgtttatcggagccagcct

SEQ ID NO: 65944 - DNA, 25 bp, Mus musculus
tgggacttaagagacattgattttg

SEQ ID NO: 65945 - DNA, 25 bp, Mus musculus
tgggacttatccagcccgggtcggt

SEQ ID NO: 65946 - DNA, 25 bp, Mus musculus
tgggacttcatagcttcctacgaca

SEQ ID NO: 65947 - DNA, 25 bp, Mus musculus
tgggacttgcggaagacccagccct

SEQ ID NO: 65948 - DNA, 25 bp, Mus musculus
tgggagaaacccttccagaggaagt

SEQ ID NO: 65949 - DNA, 25 bp, Mus musculus
tgggagaacagaacactgaaaatgc

SEQ ID NO: 65950 - DNA, 25 bp, Mus musculus
tgggagaaggatgtcttttcagaag

SEQ ID NO: 65951 - DNA, 25 bp, Mus musculus
tgggagagatgggaagacttgcact

SEQ ID NO: 65952 - DNA, 25 bp, Mus musculus
tgggagatcaagtcacccctctgaa

SEQ ID NO: 65953 - DNA, 25 bp, Mus musculus
tgggagatcgccacccgaggccaaa

SEQ ID NO: 65954 - DNA, 25 bp, Mus musculus
tgggagatggacacttctgaggcaa

SEQ ID NO: 65955 - DNA, 25 bp, Mus musculus
tgggagatgtggacgccactatgtc

SEQ ID NO: 65956 - DNA, 25 bp, Mus musculus
tgggagccatattgtacatctgaag

SEQ ID NO: 65957 - DNA, 25 bp, Mus musculus
tgggagccctaaatgcggagcgact

SEQ ID NO: 65958 - DNA, 25 bp, Mus musculus
tgggagccgagaggctgcatcccct

SEQ ID NO: 65959 - DNA, 25 bp, Mus musculus
tgggagcgctagctgtgtccggtgc

SEQ ID NO: 65960 - DNA, 25 bp, Mus musculus
tgggagcgtcctgctgtctcggaca

SEQ ID NO: 65961 - DNA, 25 bp, Mus musculus
tgggagctgccggacgccatgcctt

SEQ ID NO: 65962 - DNA, 25 bp, Mus musculus
tgggagctgtcatagctaaagagaa

SEQ ID NO: 65963 - DNA, 25 bp, Mus musculus
tgggagctgttgatatactacttaa

SEQ ID NO: 65964 - DNA, 25 bp, Mus musculus
tgggaggataccagagagaacactg

SEQ ID NO: 65965 - DNA, 25 bp, Mus musculus
tgggaggatctgtctacttttccta

SEQ ID NO: 65966 - DNA, 25 bp, Mus musculus
tgggaggctgaaaggccgaggctgg

SEQ ID NO: 65967 - DNA, 25 bp, Mus musculus
tgggagggcttcttccctgtgcgct

SEQ ID NO: 65968 - DNA, 25 bp, Mus musculus
tgggagggtgagaaccccaaaccag

SEQ ID NO: 65969 - DNA, 25 bp, Mus musculus
tgggaggtcgacaaatcagaaccaa

SEQ ID NO: 65970 - DNA, 25 bp, Mus musculus
tgggaggttcactttttcagagtgg

SEQ ID NO: 65971 - DNA, 25 bp, Mus musculus
tgggagtaaaaaggcctccagagga

SEQ ID NO: 65972 - DNA, 25 bp, Mus musculus
tgggagtatggatgactgtgtcctt

SEQ ID NO: 65973 - DNA, 25 bp, Mus musculus
tgggagtcctactacaaaactgagg

SEQ ID NO: 65974 - DNA, 25 bp, Mus musculus
tgggagtctaatggcccttcacaat

SEQ ID NO: 65975 - DNA, 25 bp, Mus musculus
tgggagtctgatattgaaagttacc

SEQ ID NO: 65976 - DNA, 25 bp, Mus musculus
tgggagtgagcatgctcaacgtgtt

SEQ ID NO: 65977 - DNA, 25 bp, Mus musculus
tgggagtttatcgacttcggcatgg

SEQ ID NO: 65978 - DNA, 25 bp, Mus musculus
tgggagttttcactttcagagggtc

SEQ ID NO: 65979 - DNA, 25 bp, Mus musculus
tgggataaacccaactgttgtaggt

SEQ ID NO: 65980 - DNA, 25 bp, Mus musculus
tgggataacattgccggtggacttc

SEQ ID NO: 65981 - DNA, 25 bp, Mus musculus
tgggataagcatgtttatgggagcc

SEQ ID NO: 65982 - DNA, 25 bp, Mus musculus
tgggataatgagacagacgtctctc

SEQ ID NO: 65983 - DNA, 25 bp, Mus musculus
tgggatattgagaaataccagaggc

SEQ ID NO: 65984 - DNA, 25 bp, Mus musculus
tgggatcaaacacctcgcaaattac

SEQ ID NO: 65985 - DNA, 25 bp, Mus musculus
tgggatcaagttgtcagatgcagac

SEQ ID NO: 65986 - DNA, 25 bp, Mus musculus
tgggatcatagtcctagggcaccac

SEQ ID NO: 65987 - DNA, 25 bp, Mus musculus
tgggatccacagaacatcacctggc

SEQ ID NO: 65988 - DNA, 25 bp, Mus musculus
tgggatccagactccactggaaccc

SEQ ID NO: 65989 - DNA, 25 bp, Mus musculus
tgggatcccagtttctagcacagag

SEQ ID NO: 65990 - DNA, 25 bp, Mus musculus
tgggatctacaaatcagactttgac

SEQ ID NO: 65991 - DNA, 25 bp, Mus musculus
tgggatctcacaacgcaagtagctg

SEQ ID NO: 65992 - DNA, 25 bp, Mus musculus
tgggatctggtcatttggtgtcaat

SEQ ID NO: 65993 - DNA, 25 bp, Mus musculus
tgggatcttagtctttgttctgtac

SEQ ID NO: 65994 - DNA, 25 bp, Mus musculus
tgggatgacaagtcctttaaaggcg

SEQ ID NO: 65995 - DNA, 25 bp, Mus musculus
tgggatgagcatgccattgcaccag

SEQ ID NO: 65996 - DNA, 25 bp, Mus musculus
tgggatgccaatggatcccgagatt

SEQ ID NO: 65997 - DNA, 25 bp, Mus musculus
tgggatgccctcacgctcaactgga

SEQ ID NO: 65998 - DNA, 25 bp, Mus musculus
tgggatgctgtttaccctgggtctg

SEQ ID NO: 65999 - DNA, 25 bp, Mus musculus
tgggatggccacagttcaaactctg

SEQ ID NO: 66000 - DNA, 25 bp, Mus musculus
tgggatggggatgtacaacaccgac

SEQ ID NO: 66001 - DNA, 25 bp, Mus musculus
tgggatgtaccacgtataaactgtg

SEQ ID NO: 66002 - DNA, 25 bp, Mus musculus
tgggatgtaccaggtataaactgtg

SEQ ID NO: 66003 - DNA, 25 bp, Mus musculus
tgggatgtctgaagatcagacagtt

SEQ ID NO: 66004 - DNA, 25 bp, Mus musculus
tgggatgtctgatgatcagacagtt

SEQ ID NO: 66005 - DNA, 25 bp, Mus musculus
tgggatgtgctgacccacagaacga

SEQ ID NO: 66006 - DNA, 25 bp, Mus musculus
tgggattaatctcagcaattgggag

SEQ ID NO: 66007 - DNA, 25 bp, Mus musculus
tgggattacatgacaccagagcaga

SEQ ID NO: 66008 - DNA, 25 bp, Mus musculus
tgggattcctcttctggccagcaac

SEQ ID NO: 66009 - DNA, 25 bp, Mus musculus
tgggattcgaaaaggaataagtcct

SEQ ID NO: 66010 - DNA, 25 bp, Mus musculus
tgggattcgtggctctatactcact

SEQ ID NO: 66011 - DNA, 25 bp, Mus musculus
tgggattggctatgacctccagcat

SEQ ID NO: 66012 - DNA, 25 bp, Mus musculus
tgggatttccttctttgcctgtctc

SEQ ID NO: 66013 - DNA, 25 bp, Mus musculus
tgggatttggaagcttatttcagaa

SEQ ID NO: 66014 - DNA, 25 bp, Mus musculus
tgggcaaaagagatggcttgaatca

SEQ ID NO: 66015 - DNA, 25 bp, Mus musculus
tgggcaacctctggaagaaccatag

SEQ ID NO: 66016 - DNA, 25 bp, Mus musculus
tgggcaacgccatggtgatgacaca

SEQ ID NO: 66017 - DNA, 25 bp, Mus musculus
tgggcaacgtgtttctgcacctgct

SEQ ID NO: 66018 - DNA, 25 bp, Mus musculus
tgggcaactcggttgtcacagacct

SEQ ID NO: 66019 - DNA, 25 bp, Mus musculus
tgggcaagacatccttcctgttccg

SEQ ID NO: 66020 - DNA, 25 bp, Mus musculus
tgggcaagcactattgttgcatcag

SEQ ID NO: 66021 - DNA, 25 bp, Mus musculus
tgggcaagcccgacatagaattcac

SEQ ID NO: 66022 - DNA, 25 bp, Mus musculus
tgggcaaggacctcttccacagagc

SEQ ID NO: 66023 - DNA, 25 bp, Mus musculus
tgggcaaggctgacatttttctctg

SEQ ID NO: 66024 - DNA, 25 bp, Mus musculus
tgggcaatgctcacatcttcttggg

SEQ ID NO: 66025 - DNA, 25 bp, Mus musculus
tgggcacagccctactgggcctgaa

SEQ ID NO: 66026 - DNA, 25 bp, Mus musculus
tgggcacatagtgacctctcaggac

SEQ ID NO: 66027 - DNA, 25 bp, Mus musculus
tgggcacatctcacgtgaatgacga

SEQ ID NO: 66028 - DNA, 25 bp, Mus musculus
tgggcacatgtctgtccgcagctcg

SEQ ID NO: 66029 - DNA, 25 bp, Mus musculus
tgggcacatttatgataatcggata

SEQ ID NO: 66030 - DNA, 25 bp, Mus musculus
tgggcaccagacaccaatcacagat

SEQ ID NO: 66031 - DNA, 25 bp, Mus musculus
tgggcaccccgggagaggtggcttg

SEQ ID NO: 66032 - DNA, 25 bp, Mus musculus
tgggcaccctgatgggctcaggcct

SEQ ID NO: 66033 - DNA, 25 bp, Mus musculus
tgggcaccgacgaggtccgagcctt

SEQ ID NO: 66034 - DNA, 25 bp, Mus musculus
tgggcaccgtgtggattgcactgaa

SEQ ID NO: 66035 - DNA, 25 bp, Mus musculus
tgggcagacaaggtagcttcactct

SEQ ID NO: 66036 - DNA, 25 bp, Mus musculus
tgggcagacaccaaaacagctgttt

SEQ ID NO: 66037 - DNA, 25 bp, Mus musculus
tgggcagacacctcacactattgtc

SEQ ID NO: 66038 - DNA, 25 bp, Mus musculus
tgggcagactcagtaccagacactg

SEQ ID NO: 66039 - DNA, 25 bp, Mus musculus
tgggcagatggcactaatattaaaa

SEQ ID NO: 66040 - DNA, 25 bp, Mus musculus
tgggcagcacaatcagtgtcaaggt

SEQ ID NO: 66041 - DNA, 25 bp, Mus musculus
tgggcagcagacatagagttaaact

SEQ ID NO: 66042 - DNA, 25 bp, Mus musculus
tgggcagcccctggtgatactgttg

SEQ ID NO: 66043 - DNA, 25 bp, Mus musculus
tgggcagcctcagatgtacacagcc

SEQ ID NO: 66044 - DNA, 25 bp, Mus musculus
tgggcagcgccttctttttctcggg

SEQ ID NO: 66045 - DNA, 25 bp, Mus musculus
tgggcagcgctgagtgaacagcacc

SEQ ID NO: 66046 - DNA, 25 bp, Mus musculus
tgggcagcgctgtgtgaacagcacc

SEQ ID NO: 66047 - DNA, 25 bp, Mus musculus
tgggcagcttttgctccagacagtc

SEQ ID NO: 66048 - DNA, 25 bp, Mus musculus
tgggcagtcccagaaagaaaagatc

SEQ ID NO: 66049 - DNA, 25 bp, Mus musculus
tgggcagtggcttatttatcggcct

SEQ ID NO: 66050 - DNA, 25 bp, Mus musculus
tgggcataactaaccccgaaggcaa

SEQ ID NO: 66051 - DNA, 25 bp, Mus musculus
tgggcatctgcctcatcttaatagt

SEQ ID NO: 66052 - DNA, 25 bp, Mus musculus
tgggcatgacccattttacgaccga

SEQ ID NO: 66053 - DNA, 25 bp, Mus musculus
tgggcatgacctgcgaactctcaac

SEQ ID NO: 66054 - DNA, 25 bp, Mus musculus
tgggcatgctcacatagacgctgta

SEQ ID NO: 66055 - DNA, 25 bp, Mus musculus
tgggcatggatgaatcagaaatcat

SEQ ID NO: 66056 - DNA, 25 bp, Mus musculus
tgggcatgggatccacaaacttttc

SEQ ID NO: 66057 - DNA, 25 bp, Mus musculus
tgggcatgttcctgcccaccttgct

SEQ ID NO: 66058 - DNA, 25 bp, Mus musculus
tgggcatgttgtcaggagacctccc

SEQ ID NO: 66059 - DNA, 25 bp, Mus musculus
tgggcattgcccgttgcacacacaa

SEQ ID NO: 66060 - DNA, 25 bp, Mus musculus
tgggcatttataaacagcgcaagcc

SEQ ID NO: 66061 - DNA, 25 bp, Mus musculus
tgggcatttctagagtgcatctagg

SEQ ID NO: 66062 - DNA, 25 bp, Mus musculus
tgggccacactgtctctgccctgaa

SEQ ID NO: 66063 - DNA, 25 bp, Mus musculus
tgggccactgggttaaggactatgt

SEQ ID NO: 66064 - DNA, 25 bp, Mus musculus
tgggccaggaaattgggaacgaact

SEQ ID NO: 66065 - DNA, 25 bp, Mus musculus
tgggccagtaccgaagccgtgaaat

SEQ ID NO: 66066 - DNA, 25 bp, Mus musculus
tgggccagtcaattgggaaggaaac

SEQ ID NO: 66067 - DNA, 25 bp, Mus musculus
tgggccatttcattccaacaatgag

SEQ ID NO: 66068 - DNA, 25 bp, Mus musculus
tgggcccaacatcatcacacttgca

SEQ ID NO: 66069 - DNA, 25 bp, Mus musculus
tgggcccacagtcttctcgcaatgt

SEQ ID NO: 66070 - DNA, 25 bp, Mus musculus
tgggcccactaagaaaaaagcaagg

SEQ ID NO: 66071 - DNA, 25 bp, Mus musculus
tgggcccagctcatcatcaatacag

SEQ ID NO: 66072 - DNA, 25 bp, Mus musculus
tgggcccagtcttctgaggctgcat

SEQ ID NO: 66073 - DNA, 25 bp, Mus musculus
tgggcccgtttctgatgttgaaatg

SEQ ID NO: 66074 - DNA, 25 bp, Mus musculus
tgggccctggacgtcgcctttgtgt

SEQ ID NO: 66075 - DNA, 25 bp, Mus musculus
tgggccgagtggacatcgaattcac

SEQ ID NO: 66076 - DNA, 25 bp, Mus musculus
tgggccgagtggtcatcgaattcac

SEQ ID NO: 66077 - DNA, 25 bp, Mus musculus
tgggccgcccatcctctgaggagaa

SEQ ID NO: 66078 - DNA, 25 bp, Mus musculus
tgggccggcaccgtcatagcatcag

SEQ ID NO: 66079 - DNA, 25 bp, Mus musculus
tgggccgggccgctctctgtctcaa

SEQ ID NO: 66080 - DNA, 25 bp, Mus musculus
tgggccgtatcatctttgcctggtg

SEQ ID NO: 66081 - DNA, 25 bp, Mus musculus
tgggcctaccacacaacacattctg

SEQ ID NO: 66082 - DNA, 25 bp, Mus musculus
tgggcctaccttttcgaccgtcact

SEQ ID NO: 66083 - DNA, 25 bp, Mus musculus
tgggcctagattctgtctcctttgg

SEQ ID NO: 66084 - DNA, 25 bp, Mus musculus
tgggcctcacgctgggtctctggct

SEQ ID NO: 66085 - DNA, 25 bp, Mus musculus
tgggcctcatgtatatctactggac

SEQ ID NO: 66086 - DNA, 25 bp, Mus musculus
tgggcctctgatgtggagccgtctc

SEQ ID NO: 66087 - DNA, 25 bp, Mus musculus
tgggcctctgtggagccctattgtg

SEQ ID NO: 66088 - DNA, 25 bp, Mus musculus
tgggcctgctttgaaccatagagcc

SEQ ID NO: 66089 - DNA, 25 bp, Mus musculus
tgggcctgggtgtgttcgaaaactt

SEQ ID NO: 66090 - DNA, 25 bp, Mus musculus
tgggcctgtacatctcatccctggc

SEQ ID NO: 66091 - DNA, 25 bp, Mus musculus
tgggccttgtttgtctttgcactac

SEQ ID NO: 66092 - DNA, 25 bp, Mus musculus
tgggcctttcctagagaaaagaggc

SEQ ID NO: 66093 - DNA, 25 bp, Mus musculus
tgggcctttcctgttaacaccacga

SEQ ID NO: 66094 - DNA, 25 bp, Mus musculus
tgggcgaagctcaaggccaacattc

SEQ ID NO: 66095 - DNA, 25 bp, Mus musculus
tgggcgcagggactttccctctcag

SEQ ID NO: 66096 - DNA, 25 bp, Mus musculus
tgggcgccatggaactcattcatca

SEQ ID NO: 66097 - DNA, 25 bp, Mus musculus
tgggcgcctggatcaatggcctgtt

SEQ ID NO: 66098 - DNA, 25 bp, Mus musculus
tgggcgcttcttcctactatggact

SEQ ID NO: 66099 - DNA, 25 bp, Mus musculus
tgggcggagataagcaaccttgcac

SEQ ID NO: 66100 - DNA, 25 bp, Mus musculus
tgggcggcatggcaaatgcaaacat

SEQ ID NO: 66101 - DNA, 25 bp, Mus musculus
tgggcggttgcattgcccgtctacc

SEQ ID NO: 66102 - DNA, 25 bp, Mus musculus
tgggcgtagtccatcgggacctaaa

SEQ ID NO: 66103 - DNA, 25 bp, Mus musculus
tgggcgtgtgctcatcaaaacatcc

SEQ ID NO: 66104 - DNA, 25 bp, Mus musculus
tgggcgttttgaccaaatcatggcc

SEQ ID NO: 66105 - DNA, 25 bp, Mus musculus
tgggctaacaatataaaggtctcct

SEQ ID NO: 66106 - DNA, 25 bp, Mus musculus
tgggctaacaatttaaaggtctcct

SEQ ID NO: 66107 - DNA, 25 bp, Mus musculus
tgggctaccacaacgtgtacaagga

SEQ ID NO: 66108 - DNA, 25 bp, Mus musculus
tgggctaccacatcgtgtacaagga

SEQ ID NO: 66109 - DNA, 25 bp, Mus musculus
tgggctaccctcatatctctgttaa

SEQ ID NO: 66110 - DNA, 25 bp, Mus musculus
tgggctaccggcacttcgattgtgc

SEQ ID NO: 66111 - DNA, 25 bp, Mus musculus
tgggctacggaactctcctacagag

SEQ ID NO: 66112 - DNA, 25 bp, Mus musculus
tgggctaggctcatctgtggccccg

SEQ ID NO: 66113 - DNA, 25 bp, Mus musculus
tgggctatccgagtctgaaagcttc

SEQ ID NO: 66114 - DNA, 25 bp, Mus musculus
tgggctatggcatagactatacatg

SEQ ID NO: 66115 - DNA, 25 bp, Mus musculus
tgggctcaacccttgtcccaaaagc

SEQ ID NO: 66116 - DNA, 25 bp, Mus musculus
tgggctcactgaagccaagtcttct

SEQ ID NO: 66117 - DNA, 25 bp, Mus musculus
tgggctcagcactagccaacctgag

SEQ ID NO: 66118 - DNA, 25 bp, Mus musculus
tgggctcagcctaccgagaagagac

SEQ ID NO: 66119 - DNA, 25 bp, Mus musculus
tgggctccacagtgtgtacagatga

SEQ ID NO: 66120 - DNA, 25 bp, Mus musculus
tgggctcctcatcagggccaatcag

SEQ ID NO: 66121 - DNA, 25 bp, Mus musculus
tgggctcgtcattggtgctgtctac

SEQ ID NO: 66122 - DNA, 25 bp, Mus musculus
tgggctctagcacctccttggagac

SEQ ID NO: 66123 - DNA, 25 bp, Mus musculus
tgggctctgagaagctctttgcccc

SEQ ID NO: 66124 - DNA, 25 bp, Mus musculus
tgggctctgagctggagagtgccat

SEQ ID NO: 66125 - DNA, 25 bp, Mus musculus
tgggctctgccagtcacgtgcagca

SEQ ID NO: 66126 - DNA, 25 bp, Mus musculus
tgggctctggcaaccagtatggaga

SEQ ID NO: 66127 - DNA, 25 bp, Mus musculus
tgggctctggcatccagtatggaga

SEQ ID NO: 66128 - DNA, 25 bp, Mus musculus
tgggctctggtaaagctgtattcaa

SEQ ID NO: 66129 - DNA, 25 bp, Mus musculus
tgggctgagccttaaatctccagac

SEQ ID NO: 66130 - DNA, 25 bp, Mus musculus
tgggctgagtggagattatatctca

SEQ ID NO: 66131 - DNA, 25 bp, Mus musculus
tgggctgcagtgtcacccttcaaag

SEQ ID NO: 66132 - DNA, 25 bp, Mus musculus
tgggctggaagaacccacaggacag

SEQ ID NO: 66133 - DNA, 25 bp, Mus musculus
tgggctggccgtaccagacaccagc

SEQ ID NO: 66134 - DNA, 25 bp, Mus musculus
tgggctggtcaatgcatcctacacc

SEQ ID NO: 66135 - DNA, 25 bp, Mus musculus
tgggctggttttgatttcatgatcc

SEQ ID NO: 66136 - DNA, 25 bp, Mus musculus
tgggctgtaacgactctgaagtgct

SEQ ID NO: 66137 - DNA, 25 bp, Mus musculus
tgggctgtgacttgctgcctccagc

SEQ ID NO: 66138 - DNA, 25 bp, Mus musculus
tgggctgtgccttcatcaacctctg

SEQ ID NO: 66139 - DNA, 25 bp, Mus musculus
tgggctgtgtccagtacctcctgta

SEQ ID NO: 66140 - DNA, 25 bp, Mus musculus
tgggcttcaacatcgtcggtgggac

SEQ ID NO: 66141 - DNA, 25 bp, Mus musculus
tgggcttcaatcgaccgtccaagat

SEQ ID NO: 66142 - DNA, 25 bp, Mus musculus
tgggcttcaccctgagcctgctcag

SEQ ID NO: 66143 - DNA, 25 bp, Mus musculus
tgggcttcagtgaccagtaaaaacc

SEQ ID NO: 66144 - DNA, 25 bp, Mus musculus
tgggcttcccagctaagttcttaga

SEQ ID NO: 66145 - DNA, 25 bp, Mus musculus
tgggcttccccacagcattctgcat

SEQ ID NO: 66146 - DNA, 25 bp, Mus musculus
tgggcttctcgctgctgctgggcaa

SEQ ID NO: 66147 - DNA, 25 bp, Mus musculus
tgggcttctgctgatcattctgatc

SEQ ID NO: 66148 - DNA, 25 bp, Mus musculus
tgggcttgcccgtctttaatactgt

SEQ ID NO: 66149 - DNA, 25 bp, Mus musculus
tgggctttaccagtgcacagcaggc

SEQ ID NO: 66150 - DNA, 25 bp, Mus musculus
tgggctttgcctccggctacctgtt

SEQ ID NO: 66151 - DNA, 25 bp, Mus musculus
tgggctttggagatcctctctcacc

SEQ ID NO: 66152 - DNA, 25 bp, Mus musculus
tggggacagcgagcctcctgtagca

SEQ ID NO: 66153 - DNA, 25 bp, Mus musculus
tggggacattggtcgctggcttcca

SEQ ID NO: 66154 - DNA, 25 bp, Mus musculus
tggggcattcccagaggaagtgaca

SEQ ID NO: 66155 - DNA, 25 bp, Mus musculus
tggggccctcactgcctcatgcaga

SEQ ID NO: 66156 - DNA, 25 bp, Mus musculus
tgggtaaatgtcttgaacaaagcta

SEQ ID NO: 66157 - DNA, 25 bp, Mus musculus
tgggtaacacccactacctactggg

SEQ ID NO: 66158 - DNA, 25 bp, Mus musculus
tgggtacagtcatgaccgtgaggcc

SEQ ID NO: 66159 - DNA, 25 bp, Mus musculus
tgggtaccaccattaagaaatccgg

SEQ ID NO: 66160 - DNA, 25 bp, Mus musculus
tgggtaccagatagcagtggagact

SEQ ID NO: 66161 - DNA, 25 bp, Mus musculus
tgggtaccccacttatgaggtggag

SEQ ID NO: 66162 - DNA, 25 bp, Mus musculus
tgggtacccttacatgcccagcggg

SEQ ID NO: 66163 - DNA, 25 bp, Mus musculus
tgggtacctggtatgcagaacttcg

SEQ ID NO: 66164 - DNA, 25 bp, Mus musculus
tgggtagaccaacagaacggagtca

SEQ ID NO: 66165 - DNA, 25 bp, Mus musculus
tgggtagccaagtacccaagaggaa

SEQ ID NO: 66166 - DNA, 25 bp, Mus musculus
tgggtagcttctgtggaagtacaaa

SEQ ID NO: 66167 - DNA, 25 bp, Mus musculus
tgggtattgggattcctcttctggc

SEQ ID NO: 66168 - DNA, 25 bp, Mus musculus
tgggtattgtgcaccctccttctct

SEQ ID NO: 66169 - DNA, 25 bp, Mus musculus
tgggtcaaggctgtggcatctgtcc

SEQ ID NO: 66170 - DNA, 25 bp, Mus musculus
tgggtcagagaagctccgataacgt

SEQ ID NO: 66171 - DNA, 25 bp, Mus musculus
tgggtcagagagcaaacatgcctcc

SEQ ID NO: 66172 - DNA, 25 bp, Mus musculus
tgggtcagttagaggacaacctgca

SEQ ID NO: 66173 - DNA, 25 bp, Mus musculus
tgggtcatctctgagttagcctgtt

SEQ ID NO: 66174 - DNA, 25 bp, Mus musculus
tgggtccaggattgccgtcagtgcc

SEQ ID NO: 66175 - DNA, 25 bp, Mus musculus
tgggtccagtacgtatggcacacag

SEQ ID NO: 66176 - DNA, 25 bp, Mus musculus
tgggtcccacattgagaattggcat

SEQ ID NO: 66177 - DNA, 25 bp, Mus musculus
tgggtcccctgttccgaaactctca

SEQ ID NO: 66178 - DNA, 25 bp, Mus musculus
tgggtccgaaatccagaactgtctc

SEQ ID NO: 66179 - DNA, 25 bp, Mus musculus
tgggtcctatccttcctggtgctag

SEQ ID NO: 66180 - DNA, 25 bp, Mus musculus
tgggtcctggctataccaaggcctt

SEQ ID NO: 66181 - DNA, 25 bp, Mus musculus
tgggtcctggctttaccaaggcctt

SEQ ID NO: 66182 - DNA, 25 bp, Mus musculus
tgggtcgcttagagatccccgccca

SEQ ID NO: 66183 - DNA, 25 bp, Mus musculus
tgggtcggctcaatcacgtggctgt

SEQ ID NO: 66184 - DNA, 25 bp, Mus musculus
tgggtcggtgtcattcgctacctga

SEQ ID NO: 66185 - DNA, 25 bp, Mus musculus
tgggtcgttgtcactaagaagaaag

SEQ ID NO: 66186 - DNA, 25 bp, Mus musculus
tgggtctcggaaaagttcattgttg

SEQ ID NO: 66187 - DNA, 25 bp, Mus musculus
tgggtctctcacacggcagccatga

SEQ ID NO: 66188 - DNA, 25 bp, Mus musculus
tgggtcttccgcaggattgcgaagt

SEQ ID NO: 66189 - DNA, 25 bp, Mus musculus
tgggtgaagatggtgaccccgctaa

SEQ ID NO: 66190 - DNA, 25 bp, Mus musculus
tgggtgaagatttaaagggcattct

SEQ ID NO: 66191 - DNA, 25 bp, Mus musculus
tgggtgacatttgcaggcctctgcc

SEQ ID NO: 66192 - DNA, 25 bp, Mus musculus
tgggtgagaacagtttgcttccagc

SEQ ID NO: 66193 - DNA, 25 bp, Mus musculus
tgggtgatacctccctgaggatatt

SEQ ID NO: 66194 - DNA, 25 bp, Mus musculus
tgggtgatggaacctctgtcacatg

SEQ ID NO: 66195 - DNA, 25 bp, Mus musculus
tgggtgattttcatgttcatggtgg

SEQ ID NO: 66196 - DNA, 25 bp, Mus musculus
tgggtgcaactgaaagagcaagaag

SEQ ID NO: 66197 - DNA, 25 bp, Mus musculus
tgggtgcacactggatccatgggcc

SEQ ID NO: 66198 - DNA, 25 bp, Mus musculus
tgggtgcaggcagaattcttcacct

SEQ ID NO: 66199 - DNA, 25 bp, Mus musculus
tgggtgcaggccatccgccgtgtca

SEQ ID NO: 66200 - DNA, 25 bp, Mus musculus
tgggtgccactgtcaaacctgcatg

SEQ ID NO: 66201 - DNA, 25 bp, Mus musculus
tgggtgccctggaagacatgctgca

SEQ ID NO: 66202 - DNA, 25 bp, Mus musculus
tgggtgccctgttttcttgtacgag

SEQ ID NO: 66203 - DNA, 25 bp, Mus musculus
tgggtgccgacatcaactctacaga

SEQ ID NO: 66204 - DNA, 25 bp, Mus musculus
tgggtgcgaagaacattaatcgctc

SEQ ID NO: 66205 - DNA, 25 bp, Mus musculus
tgggtgctacatgtgtgctttcaga

SEQ ID NO: 66206 - DNA, 25 bp, Mus musculus
tgggtgctgactgctgcacattgct

SEQ ID NO: 66207 - DNA, 25 bp, Mus musculus
tgggtgcttgcctctccctcagggt

SEQ ID NO: 66208 - DNA, 25 bp, Mus musculus
tgggtggaccagaaacttaacaacg

SEQ ID NO: 66209 - DNA, 25 bp, Mus musculus
tgggtggaccatccgtcttcatctt

SEQ ID NO: 66210 - DNA, 25 bp, Mus musculus
tgggtggacttttaggagtaacgca

SEQ ID NO: 66211 - DNA, 25 bp, Mus musculus
tgggtggagctccttatggatatac

SEQ ID NO: 66212 - DNA, 25 bp, Mus musculus
tgggtgtccgtgctctgcaagaaca

SEQ ID NO: 66213 - DNA, 25 bp, Mus musculus
tgggtgtgctgatgggctccttcat

SEQ ID NO: 66214 - DNA, 25 bp, Mus musculus
tgggtgtggcggtcattcttcagtc

SEQ ID NO: 66215 - DNA, 25 bp, Mus musculus
tgggtgtggtttccctgctgttcct

SEQ ID NO: 66216 - DNA, 25 bp, Mus musculus
tgggtgtgtggagctccatccaccc

SEQ ID NO: 66217 - DNA, 25 bp, Mus musculus
tgggtgtgttttactaagcatcgtc

SEQ ID NO: 66218 - DNA, 25 bp, Mus musculus
tgggtgttgacttcgctttgcatca

SEQ ID NO: 66219 - DNA, 25 bp, Mus musculus
tgggttaaagggtctaatgccagga

SEQ ID NO: 66220 - DNA, 25 bp, Mus musculus
tgggttcagattgcccaaaccatag

SEQ ID NO: 66221 - DNA, 25 bp, Mus musculus
tgggttccatccttgataccaaaca

SEQ ID NO: 66222 - DNA, 25 bp, Mus musculus
tgggttcgacactcatcctatgaat

SEQ ID NO: 66223 - DNA, 25 bp, Mus musculus
tgggttctacaacggccgtagcctg

SEQ ID NO: 66224 - DNA, 25 bp, Mus musculus
tgggttctgtagcaggcttcactcg

SEQ ID NO: 66225 - DNA, 25 bp, Mus musculus
tgggttgcctggtgccacacctttc

SEQ ID NO: 66226 - DNA, 25 bp, Mus musculus
tgggttgctgagtggattgccatcc

SEQ ID NO: 66227 - DNA, 25 bp, Mus musculus
tgggttggaatactgtaaagaacat

SEQ ID NO: 66228 - DNA, 25 bp, Mus musculus
tgggttgtacccctcagatagatgg

SEQ ID NO: 66229 - DNA, 25 bp, Mus musculus
tgggttgtcaacttctgcaatagca

SEQ ID NO: 66230 - DNA, 25 bp, Mus musculus
tgggtttaatgccaaagtcaatagg

SEQ ID NO: 66231 - DNA, 25 bp, Mus musculus
tgggtttattgaccagatcgatgga

SEQ ID NO: 66232 - DNA, 25 bp, Mus musculus
tgggtttgacaaaccctaagacatt

SEQ ID NO: 66233 - DNA, 25 bp, Mus musculus
tgggtttttcgagtgctgaccccag

SEQ ID NO: 66234 - DNA, 25 bp, Mus musculus
tggtaaaacaccattgtggagcatg

SEQ ID NO: 66235 - DNA, 25 bp, Mus musculus
tggtaaagaagcgtgctgcacagcg

SEQ ID NO: 66236 - DNA, 25 bp, Mus musculus
tggtaaatgcagtcaactgcagcct

SEQ ID NO: 66237 - DNA, 25 bp, Mus musculus
tggtaaatgggtgcttcatcgctcc

SEQ ID NO: 66238 - DNA, 25 bp, Mus musculus
tggtaacagggaaacagatgaaaga

SEQ ID NO: 66239 - DNA, 25 bp, Mus musculus
tggtaaccgagctctctgttttctt

SEQ ID NO: 66240 - DNA, 25 bp, Mus musculus
tggtaactgggatcttgtgggaaac

SEQ ID NO: 66241 - DNA, 25 bp, Mus musculus
tggtaagcgaaacagactcagattt

SEQ ID NO: 66242 - DNA, 25 bp, Mus musculus
tggtaatatcggtttaagagctgaa

SEQ ID NO: 66243 - DNA, 25 bp, Mus musculus
tggtaatgcccgaaggagcggacac

SEQ ID NO: 66244 - DNA, 25 bp, Mus musculus
tggtaattactattcatctgagaga

SEQ ID NO: 66245 - DNA, 25 bp, Mus musculus
tggtaattatatggaagccaagagt

SEQ ID NO: 66246 - DNA, 25 bp, Mus musculus
tggtacagaggagtttcaacaaaga

SEQ ID NO: 66247 - DNA, 25 bp, Mus musculus
tggtacagagggaaatgtaggaacc

SEQ ID NO: 66248 - DNA, 25 bp, Mus musculus
tggtacagagggtaatgtaggaacc

SEQ ID NO: 66249 - DNA, 25 bp, Mus musculus
tggtacagttcaagatcaagaggca

SEQ ID NO: 66250 - DNA, 25 bp, Mus musculus
tggtacatgctgaagccttttctcg

SEQ ID NO: 66251 - DNA, 25 bp, Mus musculus
tggtaccaccctagacaaagtggag

SEQ ID NO: 66252 - DNA, 25 bp, Mus musculus
tggtaccagcctcgacacaatgtca

SEQ ID NO: 66253 - DNA, 25 bp, Mus musculus
tggtacccactttccagccggatgc

SEQ ID NO: 66254 - DNA, 25 bp, Mus musculus
tggtaccctcaccagagggcatgag

SEQ ID NO: 66255 - DNA, 25 bp, Mus musculus
tggtacctcaagcatgaggcccggc

SEQ ID NO: 66256 - DNA, 25 bp, Mus musculus
tggtacctgcccagatgggagatgc

SEQ ID NO: 66257 - DNA, 25 bp, Mus musculus
tggtacctgccctgatgggagatgc

SEQ ID NO: 66258 - DNA, 25 bp, Mus musculus
tggtacctgggcaacctctggaaga

SEQ ID NO: 66259 - DNA, 25 bp, Mus musculus
tggtaccttggatgatggtgaatac

SEQ ID NO: 66260 - DNA, 25 bp, Mus musculus
tggtacggtcctcgaagcaccatgg

SEQ ID NO: 66261 - DNA, 25 bp, Mus musculus
tggtacgtgggctgagtgcgggagc

SEQ ID NO: 66262 - DNA, 25 bp, Mus musculus
tggtactatttaacacctataatgg

SEQ ID NO: 66263 - DNA, 25 bp, Mus musculus
tggtactcattatgtagctccagct

SEQ ID NO: 66264 - DNA, 25 bp, Mus musculus
tggtactctggactgcaggactact

SEQ ID NO: 66265 - DNA, 25 bp, Mus musculus
tggtactgagcctgcaagcaacagc

SEQ ID NO: 66266 - DNA, 25 bp, Mus musculus
tggtactggagaaaaaaggcaacat

SEQ ID NO: 66267 - DNA, 25 bp, Mus musculus
tggtactgggaaaacagctgccttt

SEQ ID NO: 66268 - DNA, 25 bp, Mus musculus
tggtagaaataagcctgaagaagat

SEQ ID NO: 66269 - DNA, 25 bp, Mus musculus
tggtagaagcgcttcccaagccttg

SEQ ID NO: 66270 - DNA, 25 bp, Mus musculus
tggtagacgttgtgatatgtgttcc

SEQ ID NO: 66271 - DNA, 25 bp, Mus musculus
tggtagagattgagaaagctccaaa

SEQ ID NO: 66272 - DNA, 25 bp, Mus musculus
tggtagatggaaaaccagtgaatct

SEQ ID NO: 66273 - DNA, 25 bp, Mus musculus
tggtagcagctacagtggctccagt

SEQ ID NO: 66274 - DNA, 25 bp, Mus musculus
tggtagcccagtttgatcccaaggg

SEQ ID NO: 66275 - DNA, 25 bp, Mus musculus
tggtagcggcgcactccttcgtctt

SEQ ID NO: 66276 - DNA, 25 bp, Mus musculus
tggtagcggcgctctccttcgtctt

SEQ ID NO: 66277 - DNA, 25 bp, Mus musculus
tggtagctacctgctgcgggacagc

SEQ ID NO: 66278 - DNA, 25 bp, Mus musculus
tggtaggagtttgctaagaggccaa

SEQ ID NO: 66279 - DNA, 25 bp, Mus musculus
tggtagggctcagtaaatctccctc

SEQ ID NO: 66280 - DNA, 25 bp, Mus musculus
tggtagtaggaagaggaccccagat

SEQ ID NO: 66281 - DNA, 25 bp, Mus musculus
tggtagtgctgaagatgggttcttt

SEQ ID NO: 66282 - DNA, 25 bp, Mus musculus
tggtataatcacatcaagtcgtatg

SEQ ID NO: 66283 - DNA, 25 bp, Mus musculus
tggtatatcagacagcattcagaca

SEQ ID NO: 66284 - DNA, 25 bp, Mus musculus
tggtatcactccaggctctcttgga

SEQ ID NO: 66285 - DNA, 25 bp, Mus musculus
tggtatcatgcctgtttgacccaag

SEQ ID NO: 66286 - DNA, 25 bp, Mus musculus
tggtatctgcattatcgacggcgcc

SEQ ID NO: 66287 - DNA, 25 bp, Mus musculus
tggtatctgcgacagtttgggaatc

SEQ ID NO: 66288 - DNA, 25 bp, Mus musculus
tggtatctgcgagagtttgggaatc

SEQ ID NO: 66289 - DNA, 25 bp, Mus musculus
tggtatgtcagaactgagtgggacc

SEQ ID NO: 66290 - DNA, 25 bp, Mus musculus
tggtattagggctttcggaacagga

SEQ ID NO: 66291 - DNA, 25 bp, Mus musculus
tggtattcacactctctatataaag

SEQ ID NO: 66292 - DNA, 25 bp, Mus musculus
tggtatttctacagcaggctttgct

SEQ ID NO: 66293 - DNA, 25 bp, Mus musculus
tggtatttcttagaacttcagagaa

SEQ ID NO: 66294 - DNA, 25 bp, Mus musculus
tggtcaagtacgagagtggccctga

SEQ ID NO: 66295 - DNA, 25 bp, Mus musculus
tggtcaataccaacgaaaagcagcg

SEQ ID NO: 66296 - DNA, 25 bp, Mus musculus
tggtcaccaacaacccatacgacta

SEQ ID NO: 66297 - DNA, 25 bp, Mus musculus
tggtcaccacctggcagaactttga

SEQ ID NO: 66298 - DNA, 25 bp, Mus musculus
tggtcaccacgccatgactatatct

SEQ ID NO: 66299 - DNA, 25 bp, Mus musculus
tggtcaccgacccaattaatgatca

SEQ ID NO: 66300 - DNA, 25 bp, Mus musculus
tggtcacctgcagtaccagccaaaa

SEQ ID NO: 66301 - DNA, 25 bp, Mus musculus
tggtcacgtgcttgactcgcgacag

SEQ ID NO: 66302 - DNA, 25 bp, Mus musculus
tggtcacgtgtccatgtggcctgca

SEQ ID NO: 66303 - DNA, 25 bp, Mus musculus
tggtcagatctcaccaaatcgaccg

SEQ ID NO: 66304 - DNA, 25 bp, Mus musculus
tggtcagctcggtgacaaccaaagc

SEQ ID NO: 66305 - DNA, 25 bp, Mus musculus
tggtcagctgcagacagttcagcag

SEQ ID NO: 66306 - DNA, 25 bp, Mus musculus
tggtcagtgtcttcccagggaataa

SEQ ID NO: 66307 - DNA, 25 bp, Mus musculus
tggtcataaatacaaacgtgggcaa

SEQ ID NO: 66308 - DNA, 25 bp, Mus musculus
tggtcataagcatgtgcctgactgg

SEQ ID NO: 66309 - DNA, 25 bp, Mus musculus
tggtcatagcagcactaacaattct

SEQ ID NO: 66310 - DNA, 25 bp, Mus musculus
tggtcatatgctttagagaaaccca

SEQ ID NO: 66311 - DNA, 25 bp, Mus musculus
tggtcatcagaacatcacagctgat

SEQ ID NO: 66312 - DNA, 25 bp, Mus musculus
tggtcatcatcgagagcgacctgga

SEQ ID NO: 66313 - DNA, 25 bp, Mus musculus
tggtcatccagctggccaacatagg

SEQ ID NO: 66314 - DNA, 25 bp, Mus musculus
tggtcatgggactgtttgctgccct

SEQ ID NO: 66315 - DNA, 25 bp, Mus musculus
tggtcatgtcgagcaagagtagcaa

SEQ ID NO: 66316 - DNA, 25 bp, Mus musculus
tggtcattccattgcacagctaaat

SEQ ID NO: 66317 - DNA, 25 bp, Mus musculus
tggtcatttttcactcccttgctgc

SEQ ID NO: 66318 - DNA, 25 bp, Mus musculus
tggtccacactccttcggacagttt

SEQ ID NO: 66319 - DNA, 25 bp, Mus musculus
tggtccaccacctgctgacctgtgt

SEQ ID NO: 66320 - DNA, 25 bp, Mus musculus
tggtccaccagcctgaagaaagccg

SEQ ID NO: 66321 - DNA, 25 bp, Mus musculus
tggtccaccggactccagttgtaga

SEQ ID NO: 66322 - DNA, 25 bp, Mus musculus
tggtccactcaaggaggagtatgct

SEQ ID NO: 66323 - DNA, 25 bp, Mus musculus
tggtccagcgcacaggatatagctt

SEQ ID NO: 66324 - DNA, 25 bp, Mus musculus
tggtccaggatagaaaaacaagggc

SEQ ID NO: 66325 - DNA, 25 bp, Mus musculus
tggtccagtggtcgaattacacacg

SEQ ID NO: 66326 - DNA, 25 bp, Mus musculus
tggtccagttctctgcgacgctgtg

SEQ ID NO: 66327 - DNA, 25 bp, Mus musculus
tggtccagttctgtgcgacgctgtg

SEQ ID NO: 66328 - DNA, 25 bp, Mus musculus
tggtccatatctcaagggccatgat

SEQ ID NO: 66329 - DNA, 25 bp, Mus musculus
tggtccatcccttgcaccatgggaa

SEQ ID NO: 66330 - DNA, 25 bp, Mus musculus
tggtccatgcgtgtctctgaatgtg

SEQ ID NO: 66331 - DNA, 25 bp, Mus musculus
tggtcccagagaaagtttcttccaa

SEQ ID NO: 66332 - DNA, 25 bp, Mus musculus
tggtccctgccaaggaagccaatgt

SEQ ID NO: 66333 - DNA, 25 bp, Mus musculus
tggtcccttacaaactgatccggga

SEQ ID NO: 66334 - DNA, 25 bp, Mus musculus
tggtccgcacactcttgataggttt

SEQ ID NO: 66335 - DNA, 25 bp, Mus musculus
tggtccgccaaaacgtctcagagcg

SEQ ID NO: 66336 - DNA, 25 bp, Mus musculus
tggtccggaccccttggactatgtt

SEQ ID NO: 66337 - DNA, 25 bp, Mus musculus
tggtccgtatcacataggattaccg

SEQ ID NO: 66338 - DNA, 25 bp, Mus musculus
tggtcctcacagctctaaaaagaag

SEQ ID NO: 66339 - DNA, 25 bp, Mus musculus
tggtcctggccattgagcgctacgt

SEQ ID NO: 66340 - DNA, 25 bp, Mus musculus
tggtcctgtaaacaagattcaaaac

SEQ ID NO: 66341 - DNA, 25 bp, Mus musculus
tggtcctgtccgtctcgcaaaaggt

SEQ ID NO: 66342 - DNA, 25 bp, Mus musculus
tggtccttcagaccgagggctccat

SEQ ID NO: 66343 - DNA, 25 bp, Mus musculus
tggtccttcagcaccatcagcagca

SEQ ID NO: 66344 - DNA, 25 bp, Mus musculus
tggtccttctcgctcgtcgtggcag

SEQ ID NO: 66345 - DNA, 25 bp, Mus musculus
tggtccttctctactgctcacacag

SEQ ID NO: 66346 - DNA, 25 bp, Mus musculus
tggtcgcagtctcctgacttatggc

SEQ ID NO: 66347 - DNA, 25 bp, Mus musculus
tggtcgcctattacaagaatcttcg

SEQ ID NO: 66348 - DNA, 25 bp, Mus musculus
tggtcgtcctctacctgatcatcgg

SEQ ID NO: 66349 - DNA, 25 bp, Mus musculus
tggtcgtcctcttcctgatcatcgg

SEQ ID NO: 66350 - DNA, 25 bp, Mus musculus
tggtcgtcgtacagaatgccacggt

SEQ ID NO: 66351 - DNA, 25 bp, Mus musculus
tggtcgtctcttctccagccaagct

SEQ ID NO: 66352 - DNA, 25 bp, Mus musculus
tggtctaagcttgatccaaaggcaa

SEQ ID NO: 66353 - DNA, 25 bp, Mus musculus
tggtctacaactcctctggcacgga

SEQ ID NO: 66354 - DNA, 25 bp, Mus musculus
tggtctacactggaggcagagacgt

SEQ ID NO: 66355 - DNA, 25 bp, Mus musculus
tggtctacattcagccagctcaggg

SEQ ID NO: 66356 - DNA, 25 bp, Mus musculus
tggtctactgtgttgctacaaggag

SEQ ID NO: 66357 - DNA, 25 bp, Mus musculus
tggtctattttccattgctaactga

SEQ ID NO: 66358 - DNA, 25 bp, Mus musculus
tggtctcaaacgaagagattctgtc

SEQ ID NO: 66359 - DNA, 25 bp, Mus musculus
tggtctcaaatcacagtttgcatac

SEQ ID NO: 66360 - DNA, 25 bp, Mus musculus
tggtctcagcagcacttcagtcaca

SEQ ID NO: 66361 - DNA, 25 bp, Mus musculus
tggtctcagctctcggacaaaaaga

SEQ ID NO: 66362 - DNA, 25 bp, Mus musculus
tggtctccaatgctgctgtcaaccc

SEQ ID NO: 66363 - DNA, 25 bp, Mus musculus
tggtctccctttgaatcgttatgtg

SEQ ID NO: 66364 - DNA, 25 bp, Mus musculus
tggtctccgccgctacttctctgaa

SEQ ID NO: 66365 - DNA, 25 bp, Mus musculus
tggtctctggactgtcttcacgcta

SEQ ID NO: 66366 - DNA, 25 bp, Mus musculus
tggtctctggagatcactgtaaact

SEQ ID NO: 66367 - DNA, 25 bp, Mus musculus
tggtctgatacaccctcatgttatg

SEQ ID NO: 66368 - DNA, 25 bp, Mus musculus
tggtctgattcagaaggacgtgcca

SEQ ID NO: 66369 - DNA, 25 bp, Mus musculus
tggtctgcaaacagtggtatcgact

SEQ ID NO: 66370 - DNA, 25 bp, Mus musculus
tggtctgcacagcacccacacataa

SEQ ID NO: 66371 - DNA, 25 bp, Mus musculus
tggtctgcagtaccttccatgagtg

SEQ ID NO: 66372 - DNA, 25 bp, Mus musculus
tggtctgccatgctagcctgtctcc

SEQ ID NO: 66373 - DNA, 25 bp, Mus musculus
tggtctggccactctccactacaag

SEQ ID NO: 66374 - DNA, 25 bp, Mus musculus
tggtctgggccaattcccaggtgag

SEQ ID NO: 66375 - DNA, 25 bp, Mus musculus
tggtctggtcggcaagcctttgtct

SEQ ID NO: 66376 - DNA, 25 bp, Mus musculus
tggtctggttatgccctcagtgtac

SEQ ID NO: 66377 - DNA, 25 bp, Mus musculus
tggtctgtctccttttacccacaag

SEQ ID NO: 66378 - DNA, 25 bp, Mus musculus
tggtcttcaaggacttttacctcct

SEQ ID NO: 66379 - DNA, 25 bp, Mus musculus
tggtcttcctgaaacacagcgagca

SEQ ID NO: 66380 - DNA, 25 bp, Mus musculus
tggtcttctgctcctggatgacaca

SEQ ID NO: 66381 - DNA, 25 bp, Mus musculus
tggtcttgaatttaggacagtcctc

SEQ ID NO: 66382 - DNA, 25 bp, Mus musculus
tggtcttgctgtcatcaagccatga

SEQ ID NO: 66383 - DNA, 25 bp, Mus musculus
tggtcttggagcactcaccgggagc

SEQ ID NO: 66384 - DNA, 25 bp, Mus musculus
tggtcttggcccagagcaacgttgc

SEQ ID NO: 66385 - DNA, 25 bp, Mus musculus
tggtcttgggcaccctgttcattgg

SEQ ID NO: 66386 - DNA, 25 bp, Mus musculus
tggtctttgatatccccgctaaggg

SEQ ID NO: 66387 - DNA, 25 bp, Mus musculus
tggtcttttgtctctgtcacgtgcc

SEQ ID NO: 66388 - DNA, 25 bp, Mus musculus
tggtgaaagagttcaggaaacacgg

SEQ ID NO: 66389 - DNA, 25 bp, Mus musculus
tggtgaaatctacaaccacaaggcg

SEQ ID NO: 66390 - DNA, 25 bp, Mus musculus
tggtgaaattggtggtcacgctgaa

SEQ ID NO: 66391 - DNA, 25 bp, Mus musculus
tggtgaacaagcactgggacctgcg

SEQ ID NO: 66392 - DNA, 25 bp, Mus musculus
tggtgaacaccatccagagcaagtt

SEQ ID NO: 66393 - DNA, 25 bp, Mus musculus
tggtgaacactggatagaactcaga

SEQ ID NO: 66394 - DNA, 25 bp, Mus musculus
tggtgaaccgaaatggatggaacgt

SEQ ID NO: 66395 - DNA, 25 bp, Mus musculus
tggtgaacgccgagcgcaagctgca

SEQ ID NO: 66396 - DNA, 25 bp, Mus musculus
tggtgaacgccgtgcgcaagctgca

SEQ ID NO: 66397 - DNA, 25 bp, Mus musculus
tggtgaagcggttgaacacagactg

SEQ ID NO: 66398 - DNA, 25 bp, Mus musculus
tggtgaagcttttcgggcccctcac

SEQ ID NO: 66399 - DNA, 25 bp, Mus musculus
tggtgaaggccccaggctctcagct

SEQ ID NO: 66400 - DNA, 25 bp, Mus musculus
tggtgaagttcgacacccagtaccc

SEQ ID NO: 66401 - DNA, 25 bp, Mus musculus
tggtgaatatcgagccaaaaaactc

SEQ ID NO: 66402 - DNA, 25 bp, Mus musculus
tggtgaatcatcagctaattccctg

SEQ ID NO: 66403 - DNA, 25 bp, Mus musculus
tggtgaatgaaggatgacagctacg

SEQ ID NO: 66404 - DNA, 25 bp, Mus musculus
tggtgaatgagaatgtcagcctcgt

SEQ ID NO: 66405 - DNA, 25 bp, Mus musculus
tggtgaatggctaccgccaccagaa

SEQ ID NO: 66406 - DNA, 25 bp, Mus musculus
tggtgacagactatggagcttttat

SEQ ID NO: 66407 - DNA, 25 bp, Mus musculus
tggtgacattgtggtaccggcctcc

SEQ ID NO: 66408 - DNA, 25 bp, Mus musculus
tggtgaccattaatcgttctgctcg

SEQ ID NO: 66409 - DNA, 25 bp, Mus musculus
tggtgaccattattcgttctgctcg

SEQ ID NO: 66410 - DNA, 25 bp, Mus musculus
tggtgacccaagcagttgaactgaa

SEQ ID NO: 66411 - DNA, 25 bp, Mus musculus
tggtgaccccgctaatcaagaactt

SEQ ID NO: 66412 - DNA, 25 bp, Mus musculus
tggtgaccctgctgtctgactatga

SEQ ID NO: 66413 - DNA, 25 bp, Mus musculus
tggtgacctccgcaacctttgagca

SEQ ID NO: 66414 - DNA, 25 bp, Mus musculus
tggtgacctctggttgggtgttaac

SEQ ID NO: 66415 - DNA, 25 bp, Mus musculus
tggtgacctggccaactggatgata

SEQ ID NO: 66416 - DNA, 25 bp, Mus musculus
tggtgacgactgtaccacctgtgtc

SEQ ID NO: 66417 - DNA, 25 bp, Mus musculus
tggtgactcacgaccgcctgtcact

SEQ ID NO: 66418 - DNA, 25 bp, Mus musculus
tggtgactctgtgccagccaaacct

SEQ ID NO: 66419 - DNA, 25 bp, Mus musculus
tggtgactgctgacctaaggctcaa

SEQ ID NO: 66420 - DNA, 25 bp, Mus musculus
tggtgagacgcagggctacatatac

SEQ ID NO: 66421 - DNA, 25 bp, Mus musculus
tggtgaggagggtagctcccaaccc

SEQ ID NO: 66422 - DNA, 25 bp, Mus musculus
tggtgaggataacaacgcgtctgtc

SEQ ID NO: 66423 - DNA, 25 bp, Mus musculus
tggtgaggatataccagaaggactc

SEQ ID NO: 66424 - DNA, 25 bp, Mus musculus
tggtgaggtctgtttttccggtgcc

SEQ ID NO: 66425 - DNA, 25 bp, Mus musculus
tggtgatactctccctctacattgt

SEQ ID NO: 66426 - DNA, 25 bp, Mus musculus
tggtgatagcactaacagctctggg

SEQ ID NO: 66427 - DNA, 25 bp, Mus musculus
tggtgatcacattccacaatgaagc

SEQ ID NO: 66428 - DNA, 25 bp, Mus musculus
tggtgatcagttgaacatatgacct

SEQ ID NO: 66429 - DNA, 25 bp, Mus musculus
tggtgatcatggagacgggtttggc

SEQ ID NO: 66430 - DNA, 25 bp, Mus musculus
tggtgatgccattcatgggcactga

SEQ ID NO: 66431 - DNA, 25 bp, Mus musculus
tggtgatggcctggtgaccctctct

SEQ ID NO: 66432 - DNA, 25 bp, Mus musculus
tggtgatggtcttcgcatactgcct

SEQ ID NO: 66433 - DNA, 25 bp, Mus musculus
tggtgattaccaactcaagctaatt

SEQ ID NO: 66434 - DNA, 25 bp, Mus musculus
tggtgcaaagacaacagctatgtga

SEQ ID NO: 66435 - DNA, 25 bp, Mus musculus
tggtgcagaaagctgctcagactgc

SEQ ID NO: 66436 - DNA, 25 bp, Mus musculus
tggtgcagacagaacctgtgaaaag

SEQ ID NO: 66437 - DNA, 25 bp, Mus musculus
tggtgcagagcatgtatatctttaa

SEQ ID NO: 66438 - DNA, 25 bp, Mus musculus
tggtgcagatcgacaatgccaagct

SEQ ID NO: 66439 - DNA, 25 bp, Mus musculus
tggtgcagctcatctgtggatactg

SEQ ID NO: 66440 - DNA, 25 bp, Mus musculus
tggtgcaggcccagcaggttcctga

SEQ ID NO: 66441 - DNA, 25 bp, Mus musculus
tggtgcaggtgtgccactaggtctt

SEQ ID NO: 66442 - DNA, 25 bp, Mus musculus
tggtgcatgacatgagccaccctcc

SEQ ID NO: 66443 - DNA, 25 bp, Mus musculus
tggtgcatgggaaattgttcactgg

SEQ ID NO: 66444 - DNA, 25 bp, Mus musculus
tggtgccaccaccaacaccaatggg

SEQ ID NO: 66445 - DNA, 25 bp, Mus musculus
tggtgccactcagcaaattctggat

SEQ ID NO: 66446 - DNA, 25 bp, Mus musculus
tggtgccagagaaagacagccccat

SEQ ID NO: 66447 - DNA, 25 bp, Mus musculus
tggtgccagagtggttgcctttgaa

SEQ ID NO: 66448 - DNA, 25 bp, Mus musculus
tggtgccctctggaatgaccacagg

SEQ ID NO: 66449 - DNA, 25 bp, Mus musculus
tggtgcctctataaccagctggagg

SEQ ID NO: 66450 - DNA, 25 bp, Mus musculus
tggtgcctgtggatcagcatgtaga

SEQ ID NO: 66451 - DNA, 25 bp, Mus musculus
tggtgcgggtcaagcacagactgac

SEQ ID NO: 66452 - DNA, 25 bp, Mus musculus
tggtgcgtacccacatgcaggacct

SEQ ID NO: 66453 - DNA, 25 bp, Mus musculus
tggtgctcatccctaccttcagagg

SEQ ID NO: 66454 - DNA, 25 bp, Mus musculus
tggtgctcatccgtaccttcagagg

SEQ ID NO: 66455 - DNA, 25 bp, Mus musculus
tggtgctcggatcccgtgagtcttc

SEQ ID NO: 66456 - DNA, 25 bp, Mus musculus
tggtgctctaagaaggttcgagact

SEQ ID NO: 66457 - DNA, 25 bp, Mus musculus
tggtgctctgtgtgaagcctccaac

SEQ ID NO: 66458 - DNA, 25 bp, Mus musculus
tggtgctgactgcagacgccatgtc

SEQ ID NO: 66459 - DNA, 25 bp, Mus musculus
tggtgctgagcaggaacttcgtgca

SEQ ID NO: 66460 - DNA, 25 bp, Mus musculus
tggtgctgagtccaaagcagacacg

SEQ ID NO: 66461 - DNA, 25 bp, Mus musculus
tggtgctggcacaagaggaatcagc

SEQ ID NO: 66462 - DNA, 25 bp, Mus musculus
tggtgctggccctatatccccagac

SEQ ID NO: 66463 - DNA, 25 bp, Mus musculus
tggtgctgggatttcgaaagatgac

SEQ ID NO: 66464 - DNA, 25 bp, Mus musculus
tggtgcttcctgatccacgtgcaag

SEQ ID NO: 66465 - DNA, 25 bp, Mus musculus
tggtgcttgaaaatgagggcgccca

SEQ ID NO: 66466 - DNA, 25 bp, Mus musculus
tggtggaaccaggaaccactgttct

SEQ ID NO: 66467 - DNA, 25 bp, Mus musculus
tggtggaacccagtacagccttgtg

SEQ ID NO: 66468 - DNA, 25 bp, Mus musculus
tggtggaagacaacaaccgttcaca

SEQ ID NO: 66469 - DNA, 25 bp, Mus musculus
tggtggacacactaagatccaccct

SEQ ID NO: 66470 - DNA, 25 bp, Mus musculus
tggtggaccactatcacaccttcct

SEQ ID NO: 66471 - DNA, 25 bp, Mus musculus
tggtggactatgacagtgcccggca

SEQ ID NO: 66472 - DNA, 25 bp, Mus musculus
tggtggagatttcccgggctcaaaa

SEQ ID NO: 66473 - DNA, 25 bp, Mus musculus
tggtggaggagagctacttcaacag

SEQ ID NO: 66474 - DNA, 25 bp, Mus musculus
tggtggagggacaccgccctgttat

SEQ ID NO: 66475 - DNA, 25 bp, Mus musculus
tggtggagtacttcctgtccggaaa

SEQ ID NO: 66476 - DNA, 25 bp, Mus musculus
tggtggagtcttaccaccatggacc

SEQ ID NO: 66477 - DNA, 25 bp, Mus musculus
tggtggagttccatgagaagagccc

SEQ ID NO: 66478 - DNA, 25 bp, Mus musculus
tggtggagttccttgagaagagccc

SEQ ID NO: 66479 - DNA, 25 bp, Mus musculus
tggtggatattgagctctcccctgt

SEQ ID NO: 66480 - DNA, 25 bp, Mus musculus
tggtggatcatcctcctggctgttc

SEQ ID NO: 66481 - DNA, 25 bp, Mus musculus
tggtggatcgatacagcacccctgc

SEQ ID NO: 66482 - DNA, 25 bp, Mus musculus
tggtggatgcagaaaagctgaagcc

SEQ ID NO: 66483 - DNA, 25 bp, Mus musculus
tggtggatgcctactctcgccagag

SEQ ID NO: 66484 - DNA, 25 bp, Mus musculus
tggtggatgccttctctcgccagag

SEQ ID NO: 66485 - DNA, 25 bp, Mus musculus
tggtggatgtcttctctgacggccc

SEQ ID NO: 66486 - DNA, 25 bp, Mus musculus
tggtggattcccaaaagtgctccga

SEQ ID NO: 66487 - DNA, 25 bp, Mus musculus
tggtggcaaagaaaggtctagctcc

SEQ ID NO: 66488 - DNA, 25 bp, Mus musculus
tggtggcacaagtcagtggaagatc

SEQ ID NO: 66489 - DNA, 25 bp, Mus musculus
tggtggcagcaatattggtgtgatt

SEQ ID NO: 66490 - DNA, 25 bp, Mus musculus
tggtggccacgatgtaatcaaactt

SEQ ID NO: 66491 - DNA, 25 bp, Mus musculus
tggtggccataagcatcagctactg

SEQ ID NO: 66492 - DNA, 25 bp, Mus musculus
tggtggccccaaaggacatgacatt

SEQ ID NO: 66493 - DNA, 25 bp, Mus musculus
tggtggccctgttaacaggcaagtt

SEQ ID NO: 66494 - DNA, 25 bp, Mus musculus
tggtggcctgattgcttttgccagc

SEQ ID NO: 66495 - DNA, 25 bp, Mus musculus
tggtggccttgaatcgcaggacttg

SEQ ID NO: 66496 - DNA, 25 bp, Mus musculus
tggtggcgaaccacagatggccact

SEQ ID NO: 66497 - DNA, 25 bp, Mus musculus
tggtggcgagttcgaaattccatga

SEQ ID NO: 66498 - DNA, 25 bp, Mus musculus
tggtggctacagtgagtctatagca

SEQ ID NO: 66499 - DNA, 25 bp, Mus musculus
tggtggctctgagaaccattttgac

SEQ ID NO: 66500 - DNA, 25 bp, Mus musculus
tggtggctgcccagcaacagtgtaa

SEQ ID NO: 66501 - DNA, 25 bp, Mus musculus
tggtggctgctcttcgctgggtcca

SEQ ID NO: 66502 - DNA, 25 bp, Mus musculus
tggtggcttatgaccctgacgaacg

SEQ ID NO: 66503 - DNA, 25 bp, Mus musculus
tggtggcttcccagacagtacagag

SEQ ID NO: 66504 - DNA, 25 bp, Mus musculus
tggtgggaaaagtgccgctctgctt

SEQ ID NO: 66505 - DNA, 25 bp, Mus musculus
tggtgggaacatttggcccctccct

SEQ ID NO: 66506 - DNA, 25 bp, Mus musculus
tggtgggattttccttagatggtct

SEQ ID NO: 66507 - DNA, 25 bp, Mus musculus
tggtgggattttgcttagatggtct

SEQ ID NO: 66508 - DNA, 25 bp, Mus musculus
tggtgggcccactaagaaaaaagca

SEQ ID NO: 66509 - DNA, 25 bp, Mus musculus
tggtgggtcagctgccgccacttct

SEQ ID NO: 66510 - DNA, 25 bp, Mus musculus
tggtgggtcagttagaggacaacct

SEQ ID NO: 66511 - DNA, 25 bp, Mus musculus
tggtggtagaggatgcactgaatac

SEQ ID NO: 66512 - DNA, 25 bp, Mus musculus
tggtggtagtaaccattcaataccg

SEQ ID NO: 66513 - DNA, 25 bp, Mus musculus
tggtggtattaccagtatcagagag

SEQ ID NO: 66514 - DNA, 25 bp, Mus musculus
tggtggtcaccatggagcactctgc

SEQ ID NO: 66515 - DNA, 25 bp, Mus musculus
tggtggtcgttgtctgcctactgaa

SEQ ID NO: 66516 - DNA, 25 bp, Mus musculus
tggtggtctaaatgtcctgactaac

SEQ ID NO: 66517 - DNA, 25 bp, Mus musculus
tggtggtctcctccgcggctctgat

SEQ ID NO: 66518 - DNA, 25 bp, Mus musculus
tggtggtgacggtgtcatctctgcc

SEQ ID NO: 66519 - DNA, 25 bp, Mus musculus
tggtggtgactctgtgccagccaaa

SEQ ID NO: 66520 - DNA, 25 bp, Mus musculus
tggtggtgcagagcatgtatatctt

SEQ ID NO: 66521 - DNA, 25 bp, Mus musculus
tggtggtggcatgtaataaccagcc

SEQ ID NO: 66522 - DNA, 25 bp, Mus musculus
tggtggtgggcactgtcactgctgt

SEQ ID NO: 66523 - DNA, 25 bp, Mus musculus
tggtggtgtacgtctctcaggactg

SEQ ID NO: 66524 - DNA, 25 bp, Mus musculus
tggtggttctctgcccaatgttaac

SEQ ID NO: 66525 - DNA, 25 bp, Mus musculus
tggtgtacacaaaagcatccagatt

SEQ ID NO: 66526 - DNA, 25 bp, Mus musculus
tggtgtacacaatagcatccagatt

SEQ ID NO: 66527 - DNA, 25 bp, Mus musculus
tggtgtacgtctctcaggactgcac

SEQ ID NO: 66528 - DNA, 25 bp, Mus musculus
tggtgtactacagcctcagcttcca

SEQ ID NO: 66529 - DNA, 25 bp, Mus musculus
tggtgtaggtataccgacaattaat

SEQ ID NO: 66530 - DNA, 25 bp, Mus musculus
tggtgtcaactcagcccatgtcctc

SEQ ID NO: 66531 - DNA, 25 bp, Mus musculus
tggtgtcacacccttcatggataca

SEQ ID NO: 66532 - DNA, 25 bp, Mus musculus
tggtgtcactgacgctgcttccagc

SEQ ID NO: 66533 - DNA, 25 bp, Mus musculus
tggtgtcattaacggaccttctacc

SEQ ID NO: 66534 - DNA, 25 bp, Mus musculus
tggtgtccactgtcatcagtccctc

SEQ ID NO: 66535 - DNA, 25 bp, Mus musculus
tggtgtcccctgcagcttggtgtca

SEQ ID NO: 66536 - DNA, 25 bp, Mus musculus
tggtgtcctctggaagcccagcagc

SEQ ID NO: 66537 - DNA, 25 bp, Mus musculus
tggtgtcctgcacctaccagctggc

SEQ ID NO: 66538 - DNA, 25 bp, Mus musculus
tggtgtctctcgaagattcatcccc

SEQ ID NO: 66539 - DNA, 25 bp, Mus musculus
tggtgtctgcccaacgagagcggcc

SEQ ID NO: 66540 - DNA, 25 bp, Mus musculus
tggtgtctgcccagatgtctgtgag

SEQ ID NO: 66541 - DNA, 25 bp, Mus musculus
tggtgtgacaggatggatgcttctc

SEQ ID NO: 66542 - DNA, 25 bp, Mus musculus
tggtgtgagtaaggacattggcaca

SEQ ID NO: 66543 - DNA, 25 bp, Mus musculus
tggtgtgcgtctgaccgagttgcta

SEQ ID NO: 66544 - DNA, 25 bp, Mus musculus
tggtgtggaagaccaccttaggaac

SEQ ID NO: 66545 - DNA, 25 bp, Mus musculus
tggtgtggccagtccatcgctgcca

SEQ ID NO: 66546 - DNA, 25 bp, Mus musculus
tggtgtggtcataaatacaaacgtg

SEQ ID NO: 66547 - DNA, 25 bp, Mus musculus
tggtgtggtctgactttgggtttcc

SEQ ID NO: 66548 - DNA, 25 bp, Mus musculus
tggtgtgtcagatgtgtataaagct

SEQ ID NO: 66549 - DNA, 25 bp, Mus musculus
tggtgtgttagagtgaatacctgca

SEQ ID NO: 66550 - DNA, 25 bp, Mus musculus
tggtgtgttctccaagtaccagctg

SEQ ID NO: 66551 - DNA, 25 bp, Mus musculus
tggtgttatccctggcagtcgatgg

SEQ ID NO: 66552 - DNA, 25 bp, Mus musculus
tggtgttcacaatcctgttatgaca

SEQ ID NO: 66553 - DNA, 25 bp, Mus musculus
tggtgttctccagcggagcctctga

SEQ ID NO: 66554 - DNA, 25 bp, Mus musculus
tggtgtttctcagcgaacatttcga

SEQ ID NO: 66555 - DNA, 25 bp, Mus musculus
tggtgtttgtgtatgagaatgcgaa

SEQ ID NO: 66556 - DNA, 25 bp, Mus musculus
tggttaagaccgagggagccactct

SEQ ID NO: 66557 - DNA, 25 bp, Mus musculus
tggttaagccccagcctcttagaac

SEQ ID NO: 66558 - DNA, 25 bp, Mus musculus
tggttacaatggctgggcacactcc

SEQ ID NO: 66559 - DNA, 25 bp, Mus musculus
tggttacaccgggacagcagcacct

SEQ ID NO: 66560 - DNA, 25 bp, Mus musculus
tggttacaggagacaatatgggaca

SEQ ID NO: 66561 - DNA, 25 bp, Mus musculus
tggttaccgaaatgggccagacttt

SEQ ID NO: 66562 - DNA, 25 bp, Mus musculus
tggttaccgacacccacagagttcc

SEQ ID NO: 66563 - DNA, 25 bp, Mus musculus
tggttactgactgctgtgcccctgg

SEQ ID NO: 66564 - DNA, 25 bp, Mus musculus
tggttagagagtgtccaccatggac

SEQ ID NO: 66565 - DNA, 25 bp, Mus musculus
tggttagtgcaatttatggccgagg

SEQ ID NO: 66566 - DNA, 25 bp, Mus musculus
tggttatccacctggcctgcctgac

SEQ ID NO: 66567 - DNA, 25 bp, Mus musculus
tggttatgccctcagtgtactgaag

SEQ ID NO: 66568 - DNA, 25 bp, Mus musculus
tggttatgctgcgtaccgctatgcc

SEQ ID NO: 66569 - DNA, 25 bp, Mus musculus
tggttatggcttcccaatttctcgt

SEQ ID NO: 66570 - DNA, 25 bp, Mus musculus
tggttatggcttgccaatttctcgt

SEQ ID NO: 66571 - DNA, 25 bp, Mus musculus
tggttattcaggactgctgactggg

SEQ ID NO: 66572 - DNA, 25 bp, Mus musculus
tggttattgttagactcactgaacc

SEQ ID NO: 66573 - DNA, 25 bp, Mus musculus
tggttcacagggaagtcgcctggaa

SEQ ID NO: 66574 - DNA, 25 bp, Mus musculus
tggttcagaactttcaagatgaaac

SEQ ID NO: 66575 - DNA, 25 bp, Mus musculus
tggttcagaattacagtccagtgag

SEQ ID NO: 66576 - DNA, 25 bp, Mus musculus
tggttcagcacagcgggacctctga

SEQ ID NO: 66577 - DNA, 25 bp, Mus musculus
tggttcaggaaggtgaagccacaac

SEQ ID NO: 66578 - DNA, 25 bp, Mus musculus
tggttcaggatggacgccactcatg

SEQ ID NO: 66579 - DNA, 25 bp, Mus musculus
tggttcaggcacatagaagcgctcc

SEQ ID NO: 66580 - DNA, 25 bp, Mus musculus
tggttcatcatcacgcaggaaatcc

SEQ ID NO: 66581 - DNA, 25 bp, Mus musculus
tggttcatcggaacaccaagcagat

SEQ ID NO: 66582 - DNA, 25 bp, Mus musculus
tggttcatcggatcaccaagcagat

SEQ ID NO: 66583 - DNA, 25 bp, Mus musculus
tggttcattcctgcagtgccagact

SEQ ID NO: 66584 - DNA, 25 bp, Mus musculus
tggttccaagaagcgcgttcccaga

SEQ ID NO: 66585 - DNA, 25 bp, Mus musculus
tggttcccagtagcagacactagac

SEQ ID NO: 66586 - DNA, 25 bp, Mus musculus
tggttcccgctggtcccagattggc

SEQ ID NO: 66587 - DNA, 25 bp, Mus musculus
tggttcctaccgctgcatcctggac

SEQ ID NO: 66588 - DNA, 25 bp, Mus musculus
tggttcctaccggtgcatcctggac

SEQ ID NO: 66589 - DNA, 25 bp, Mus musculus
tggttcctatcatgaggacgtgggc

SEQ ID NO: 66590 - DNA, 25 bp, Mus musculus
tggttctccattaatcatgtcacag

SEQ ID NO: 66591 - DNA, 25 bp, Mus musculus
tggttctgaccaaaactctgcctgc

SEQ ID NO: 66592 - DNA, 25 bp, Mus musculus
tggttctgaccataactctgcctgc

SEQ ID NO: 66593 - DNA, 25 bp, Mus musculus
tggttctgagaccacccgaatgccc

SEQ ID NO: 66594 - DNA, 25 bp, Mus musculus
tggttcttggaacttgtattgcagt

SEQ ID NO: 66595 - DNA, 25 bp, Mus musculus
tggttgaaggatccccgcctgtcag

SEQ ID NO: 66596 - DNA, 25 bp, Mus musculus
tggttgatcggaaagtagagcttga

SEQ ID NO: 66597 - DNA, 25 bp, Mus musculus
tggttgattgcctgacagatgatca

SEQ ID NO: 66598 - DNA, 25 bp, Mus musculus
tggttgcacatccatggaggcacct

SEQ ID NO: 66599 - DNA, 25 bp, Mus musculus
tggttgcccacaggattgacttggc

SEQ ID NO: 66600 - DNA, 25 bp, Mus musculus
tggttgcctttgaaagtgaaaagac

SEQ ID NO: 66601 - DNA, 25 bp, Mus musculus
tggttgctacatgaagtcagccagc

SEQ ID NO: 66602 - DNA, 25 bp, Mus musculus
tggttgctgtctccaggaatatgca

SEQ ID NO: 66603 - DNA, 25 bp, Mus musculus
tggttggacagcatacggccacaaa

SEQ ID NO: 66604 - DNA, 25 bp, Mus musculus
tggttggagttcaccgcaggaagct

SEQ ID NO: 66605 - DNA, 25 bp, Mus musculus
tggttggcacttaccatggatccca

SEQ ID NO: 66606 - DNA, 25 bp, Mus musculus
tggttggtgataaacaaggtgaact

SEQ ID NO: 66607 - DNA, 25 bp, Mus musculus
tggttgtctacccttggacccagcg

SEQ ID NO: 66608 - DNA, 25 bp, Mus musculus
tggttgtggcggagttcctcagtct

SEQ ID NO: 66609 - DNA, 25 bp, Mus musculus
tggttgtgggctacccactgcgcaa

SEQ ID NO: 66610 - DNA, 25 bp, Mus musculus
tggtttacagttggctgacgattcc

SEQ ID NO: 66611 - DNA, 25 bp, Mus musculus
tggtttaccatgacctcttcagaga

SEQ ID NO: 66612 - DNA, 25 bp, Mus musculus
tggtttacctcgttttgaaaagcat

SEQ ID NO: 66613 - DNA, 25 bp, Mus musculus
tggtttataacatgtctcacgagga

SEQ ID NO: 66614 - DNA, 25 bp, Mus musculus
tggtttatgatccatctctgtgaga

SEQ ID NO: 66615 - DNA, 25 bp, Mus musculus
tggtttcaaagggagcttcgttact

SEQ ID NO: 66616 - DNA, 25 bp, Mus musculus
tggtttccacctgccatcatgggtg

SEQ ID NO: 66617 - DNA, 25 bp, Mus musculus
tggtttccaggttttctccctccag

SEQ ID NO: 66618 - DNA, 25 bp, Mus musculus
tggtttccagttgggttcaaccaat

SEQ ID NO: 66619 - DNA, 25 bp, Mus musculus
tggtttccgcctccgtcctgttgct

SEQ ID NO: 66620 - DNA, 25 bp, Mus musculus
tggtttcctcaaggcaccactgtcg

SEQ ID NO: 66621 - DNA, 25 bp, Mus musculus
tggtttcctcttcctattgggcctg

SEQ ID NO: 66622 - DNA, 25 bp, Mus musculus
tggtttctgagaagtgaattctggg

SEQ ID NO: 66623 - DNA, 25 bp, Mus musculus
tggtttgacactgattgagctctgg

SEQ ID NO: 66624 - DNA, 25 bp, Mus musculus
tggtttgcactcagtggtcagggcc

SEQ ID NO: 66625 - DNA, 25 bp, Mus musculus
tggtttgcagaatccttctgaaggt

SEQ ID NO: 66626 - DNA, 25 bp, Mus musculus
tggtttgccacaaaatcctctttcc

SEQ ID NO: 66627 - DNA, 25 bp, Mus musculus
tggtttgccatccacaaatgcagag

SEQ ID NO: 66628 - DNA, 25 bp, Mus musculus
tggtttggcaacaaaagaatccggt

SEQ ID NO: 66629 - DNA, 25 bp, Mus musculus
tggtttgtcacctgggacccttaca

SEQ ID NO: 66630 - DNA, 25 bp, Mus musculus
tggttttaatgaagctcaattttga

SEQ ID NO: 66631 - DNA, 25 bp, Mus musculus
tggttttacatgctgcgggccgcca

SEQ ID NO: 66632 - DNA, 25 bp, Mus musculus
tggttttactctgtaatctgaagcc

SEQ ID NO: 66633 - DNA, 25 bp, Mus musculus
tggttttcatccagtgtgtgatcaa

SEQ ID NO: 66634 - DNA, 25 bp, Mus musculus
tggttttcttcagccgcaggacaga

SEQ ID NO: 66635 - DNA, 25 bp, Mus musculus
tggtttttatgctgggaacaatccc

SEQ ID NO: 66636 - DNA, 25 bp, Mus musculus
tggtttttgccttggattatgaccc

SEQ ID NO: 66637 - DNA, 25 bp, Mus musculus
tggtttttgtcggaagctggatcat

SEQ ID NO: 66638 - DNA, 25 bp, Mus musculus
tgtaaaaccggtaagatcaagtgcc

SEQ ID NO: 66639 - DNA, 25 bp, Mus musculus
tgtaaaatataatgtgaactgacac

SEQ ID NO: 66640 - DNA, 25 bp, Mus musculus
tgtaaacaagatggccatgtgtttg

SEQ ID NO: 66641 - DNA, 25 bp, Mus musculus
tgtaaacatcgtggcccggtgtcca

SEQ ID NO: 66642 - DNA, 25 bp, Mus musculus
tgtaaactgcttgacaaagtcagca

SEQ ID NO: 66643 - DNA, 25 bp, Mus musculus
tgtaaagaggtgtctgctagatact

SEQ ID NO: 66644 - DNA, 25 bp, Mus musculus
tgtaaagcaattgtagatcagtttg

SEQ ID NO: 66645 - DNA, 25 bp, Mus musculus
tgtaaagccagactacgagactcca

SEQ ID NO: 66646 - DNA, 25 bp, Mus musculus
tgtaaagctcttcattgatggaaaa

SEQ ID NO: 66647 - DNA, 25 bp, Mus musculus
tgtaaagggaccttcggcttgagag

SEQ ID NO: 66648 - DNA, 25 bp, Mus musculus
tgtaaagtaaacaccagcagggtag

SEQ ID NO: 66649 - DNA, 25 bp, Mus musculus
tgtaaagtgccttcaggttggatgg

SEQ ID NO: 66650 - DNA, 25 bp, Mus musculus
tgtaaatacagagccgagttcgctg

SEQ ID NO: 66651 - DNA, 25 bp, Mus musculus
tgtaaatccctcgactggcagatgg

SEQ ID NO: 66652 - DNA, 25 bp, Mus musculus
tgtaaatgaagagtgcaccgaaatg

SEQ ID NO: 66653 - DNA, 25 bp, Mus musculus
tgtaaatgctgcagctccttccacc

SEQ ID NO: 66654 - DNA, 25 bp, Mus musculus
tgtaaattgagttccgctcgctggg

SEQ ID NO: 66655 - DNA, 25 bp, Mus musculus
tgtaacaaggagaacctcagcctgg

SEQ ID NO: 66656 - DNA, 25 bp, Mus musculus
tgtaacaaggagtacctcagcctgg

SEQ ID NO: 66657 - DNA, 25 bp, Mus musculus
tgtaacaagtccttcaagaggctcg

SEQ ID NO: 66658 - DNA, 25 bp, Mus musculus
tgtaacagctgaagtctcttcaatg

SEQ ID NO: 66659 - DNA, 25 bp, Mus musculus
tgtaacatgaccttttcctcccctg

SEQ ID NO: 66660 - DNA, 25 bp, Mus musculus
tgtaaccaaaagtgtccactcccct

SEQ ID NO: 66661 - DNA, 25 bp, Mus musculus
tgtaaccaagaaggcagcagtcgca

SEQ ID NO: 66662 - DNA, 25 bp, Mus musculus
tgtaaccgctataatgaggatgatg

SEQ ID NO: 66663 - DNA, 25 bp, Mus musculus
tgtaacgagcgatggctggagccac

SEQ ID NO: 66664 - DNA, 25 bp, Mus musculus
tgtaacgtggagaaggtgccctgta

SEQ ID NO: 66665 - DNA, 25 bp, Mus musculus
tgtaactcaacaaatgacagaaatg

SEQ ID NO: 66666 - DNA, 25 bp, Mus musculus
tgtaactccttcaagactggagtgg

SEQ ID NO: 66667 - DNA, 25 bp, Mus musculus
tgtaactgtgaagaccaagaatttt

SEQ ID NO: 66668 - DNA, 25 bp, Mus musculus
tgtaagaaaacaccagagcagctgc

SEQ ID NO: 66669 - DNA, 25 bp, Mus musculus
tgtaagaaaactcacctccatcctc

SEQ ID NO: 66670 - DNA, 25 bp, Mus musculus
tgtaagactcagaggcttagcccgg

SEQ ID NO: 66671 - DNA, 25 bp, Mus musculus
tgtaagagaaatgagaatccatgcg

SEQ ID NO: 66672 - DNA, 25 bp, Mus musculus
tgtaagagcaaagtcaagccagctc

SEQ ID NO: 66673 - DNA, 25 bp, Mus musculus
tgtaagagtggaatcaactgcccca

SEQ ID NO: 66674 - DNA, 25 bp, Mus musculus
tgtaagattgtactccaagccgggc

SEQ ID NO: 66675 - DNA, 25 bp, Mus musculus
tgtaagcagttctcactatggcagc

SEQ ID NO: 66676 - DNA, 25 bp, Mus musculus
tgtaagccatgtgcggactgtgcgc

SEQ ID NO: 66677 - DNA, 25 bp, Mus musculus
tgtaagcctttctgaggatccctgc

SEQ ID NO: 66678 - DNA, 25 bp, Mus musculus
tgtaagctgtgcagcgtgcactgca

SEQ ID NO: 66679 - DNA, 25 bp, Mus musculus
tgtaaggacccttcaacctggtctg

SEQ ID NO: 66680 - DNA, 25 bp, Mus musculus
tgtaaggtctccaattatatagggc

SEQ ID NO: 66681 - DNA, 25 bp, Mus musculus
tgtaagtaaagcttggagaagcctg

SEQ ID NO: 66682 - DNA, 25 bp, Mus musculus
tgtaataataatgagcaaatgtggc

SEQ ID NO: 66683 - DNA, 25 bp, Mus musculus
tgtaatagagagagctatccagatt

SEQ ID NO: 66684 - DNA, 25 bp, Mus musculus
tgtaataggaccatccatccactga

SEQ ID NO: 66685 - DNA, 25 bp, Mus musculus
tgtaatcagcatgagcagatggccc

SEQ ID NO: 66686 - DNA, 25 bp, Mus musculus
tgtaatcctaaacttctgactctcc

SEQ ID NO: 66687 - DNA, 25 bp, Mus musculus
tgtaatctgggactccagaccagta

SEQ ID NO: 66688 - DNA, 25 bp, Mus musculus
tgtaatgaccctgccaaatccagga

SEQ ID NO: 66689 - DNA, 25 bp, Mus musculus
tgtaatgcaccaaccacatgctgga

SEQ ID NO: 66690 - DNA, 25 bp, Mus musculus
tgtaatgccacactcacggaagatg

SEQ ID NO: 66691 - DNA, 25 bp, Mus musculus
tgtaatgcctgatacaccggagatt

SEQ ID NO: 66692 - DNA, 25 bp, Mus musculus
tgtaatgtcagccaacgcttgaagt

SEQ ID NO: 66693 - DNA, 25 bp, Mus musculus
tgtaattattcaacaagcagtacct

SEQ ID NO: 66694 - DNA, 25 bp, Mus musculus
tgtaattggcaacaagactgttggc

SEQ ID NO: 66695 - DNA, 25 bp, Mus musculus
tgtaattggcttagcttttggagcc

SEQ ID NO: 66696 - DNA, 25 bp, Mus musculus
tgtaattggctttgcttttggagcc

SEQ ID NO: 66697 - DNA, 25 bp, Mus musculus
tgtaattgtaagattgtactccaag

SEQ ID NO: 66698 - DNA, 25 bp, Mus musculus
tgtacaaaggtcacaatggacaact

SEQ ID NO: 66699 - DNA, 25 bp, Mus musculus
tgtacaaagtgggatttcctactgc

SEQ ID NO: 66700 - DNA, 25 bp, Mus musculus
tgtacaaatctgacacagagctgtt

SEQ ID NO: 66701 - DNA, 25 bp, Mus musculus
tgtacaaccctaacaagatcttcgg

SEQ ID NO: 66702 - DNA, 25 bp, Mus musculus
tgtacaacctggaaactacattcta

SEQ ID NO: 66703 - DNA, 25 bp, Mus musculus
tgtacaacctggtaactacattcta

SEQ ID NO: 66704 - DNA, 25 bp, Mus musculus
tgtacaacctggtccccagaggcca

SEQ ID NO: 66705 - DNA, 25 bp, Mus musculus
tgtacaagaccgagctaaccaacat

SEQ ID NO: 66706 - DNA, 25 bp, Mus musculus
tgtacaagctatgattttctccagg

SEQ ID NO: 66707 - DNA, 25 bp, Mus musculus
tgtacaaggaaagagggcagttgca

SEQ ID NO: 66708 - DNA, 25 bp, Mus musculus
tgtacaaggaggctcagttctatcc

SEQ ID NO: 66709 - DNA, 25 bp, Mus musculus
tgtacaaggagggtcagttctatcc

SEQ ID NO: 66710 - DNA, 25 bp, Mus musculus
tgtacaatagctcagaccatgatgt

SEQ ID NO: 66711 - DNA, 25 bp, Mus musculus
tgtacacaagaatgaaaagccagct

SEQ ID NO: 66712 - DNA, 25 bp, Mus musculus
tgtacacaatagcatccagatttgg

SEQ ID NO: 66713 - DNA, 25 bp, Mus musculus
tgtacacaataggatccagatttgg

SEQ ID NO: 66714 - DNA, 25 bp, Mus musculus
tgtacacaatggaaaatatttctgt

SEQ ID NO: 66715 - DNA, 25 bp, Mus musculus
tgtacacacatcatgcctccttgga

SEQ ID NO: 66716 - DNA, 25 bp, Mus musculus
tgtacacagctgcacgagaagccaa

SEQ ID NO: 66717 - DNA, 25 bp, Mus musculus
tgtacaccaaagtcactgacttccg

SEQ ID NO: 66718 - DNA, 25 bp, Mus musculus
tgtacactaccactgacgggcaaac

SEQ ID NO: 66719 - DNA, 25 bp, Mus musculus
tgtacactggcttcctcttccactg

SEQ ID NO: 66720 - DNA, 25 bp, Mus musculus
tgtacacttcaactactagagagta

SEQ ID NO: 66721 - DNA, 25 bp, Mus musculus
tgtacagatgaacgatgtcatggca

SEQ ID NO: 66722 - DNA, 25 bp, Mus musculus
tgtacagcctgttccagcagtccca

SEQ ID NO: 66723 - DNA, 25 bp, Mus musculus
tgtacagcgacagcacagagatggt

SEQ ID NO: 66724 - DNA, 25 bp, Mus musculus
tgtacagcggacacgccgtccacat

SEQ ID NO: 66725 - DNA, 25 bp, Mus musculus
tgtacagcgggctcacaaacactcg

SEQ ID NO: 66726 - DNA, 25 bp, Mus musculus
tgtacaggtgttcttcactctgatt

SEQ ID NO: 66727 - DNA, 25 bp, Mus musculus
tgtacagtagtgattttggtcctga

SEQ ID NO: 66728 - DNA, 25 bp, Mus musculus
tgtacagtctgtaccgagagcctga

SEQ ID NO: 66729 - DNA, 25 bp, Mus musculus
tgtacagtctgttccgagagcctga

SEQ ID NO: 66730 - DNA, 25 bp, Mus musculus
tgtacatcccaagtactatggccag

SEQ ID NO: 66731 - DNA, 25 bp, Mus musculus
tgtacatccgcagcaatccagatct

SEQ ID NO: 66732 - DNA, 25 bp, Mus musculus
tgtacatctcatccctggcttcctg

SEQ ID NO: 66733 - DNA, 25 bp, Mus musculus
tgtacatgaacacgcacccgggtcg

SEQ ID NO: 66734 - DNA, 25 bp, Mus musculus
tgtacatgactgcacatgcctaagg

SEQ ID NO: 66735 - DNA, 25 bp, Mus musculus
tgtacatgtgtaccagctgcgtgta

SEQ ID NO: 66736 - DNA, 25 bp, Mus musculus
tgtacattgtcttaattatcctcgc

SEQ ID NO: 66737 - DNA, 25 bp, Mus musculus
tgtaccacaggctgtcgcttaccgc

SEQ ID NO: 66738 - DNA, 25 bp, Mus musculus
tgtaccaccatagtccaactggcag

SEQ ID NO: 66739 - DNA, 25 bp, Mus musculus
tgtaccacgagctgatgaagcatgc

SEQ ID NO: 66740 - DNA, 25 bp, Mus musculus
tgtaccacttcttccggactcagaa

SEQ ID NO: 66741 - DNA, 25 bp, Mus musculus
tgtaccagagcccaaagaaccgtct

SEQ ID NO: 66742 - DNA, 25 bp, Mus musculus
tgtaccaggcatccagcccggatga

SEQ ID NO: 66743 - DNA, 25 bp, Mus musculus
tgtaccataaactggcggaataatg

SEQ ID NO: 66744 - DNA, 25 bp, Mus musculus
tgtaccatacaagcccttcactggg

SEQ ID NO: 66745 - DNA, 25 bp, Mus musculus
tgtaccatcatcctccgtggtggcg

SEQ ID NO: 66746 - DNA, 25 bp, Mus musculus
tgtaccatctcccaactacttcatg

SEQ ID NO: 66747 - DNA, 25 bp, Mus musculus
tgtaccatcttaaagaagaacttga

SEQ ID NO: 66748 - DNA, 25 bp, Mus musculus
tgtaccatgcaggagctaattggct

SEQ ID NO: 66749 - DNA, 25 bp, Mus musculus
tgtacccaacacaagaggagctgga

SEQ ID NO: 66750 - DNA, 25 bp, Mus musculus
tgtacccaccttccgtggaacaggc

SEQ ID NO: 66751 - DNA, 25 bp, Mus musculus
tgtacccaccttgcgtggaacaggc

SEQ ID NO: 66752 - DNA, 25 bp, Mus musculus
tgtaccccactatacctgtctggga

SEQ ID NO: 66753 - DNA, 25 bp, Mus musculus
tgtaccccgatttggcttgacttgc

SEQ ID NO: 66754 - DNA, 25 bp, Mus musculus
tgtacccctcaatggatcagttggc

SEQ ID NO: 66755 - DNA, 25 bp, Mus musculus
tgtacccctcggttccagcattcgt

SEQ ID NO: 66756 - DNA, 25 bp, Mus musculus
tgtaccctcaaaggcttccgaaggt

SEQ ID NO: 66757 - DNA, 25 bp, Mus musculus
tgtaccctggtgctgcctaaagagg

SEQ ID NO: 66758 - DNA, 25 bp, Mus musculus
tgtaccctgtttcgtgccaccgcgg

SEQ ID NO: 66759 - DNA, 25 bp, Mus musculus
tgtaccgaatcctgaaggcctatac

SEQ ID NO: 66760 - DNA, 25 bp, Mus musculus
tgtaccgagatatcacaaagccctg

SEQ ID NO: 66761 - DNA, 25 bp, Mus musculus
tgtaccgaggagtgcatgcacggcc

SEQ ID NO: 66762 - DNA, 25 bp, Mus musculus
tgtaccgcttcaccaaatatcaatg

SEQ ID NO: 66763 - DNA, 25 bp, Mus musculus
tgtaccgtgaacctggtccaggata

SEQ ID NO: 66764 - DNA, 25 bp, Mus musculus
tgtacctatagaagcagtcacatgc

SEQ ID NO: 66765 - DNA, 25 bp, Mus musculus
tgtacctcaaaagggaagcatagta

SEQ ID NO: 66766 - DNA, 25 bp, Mus musculus
tgtacctcacttgggaatcagtaaa

SEQ ID NO: 66767 - DNA, 25 bp, Mus musculus
tgtacctccacccaaaggtgccaag

SEQ ID NO: 66768 - DNA, 25 bp, Mus musculus
tgtacctccctacacagggcagggt

SEQ ID NO: 66769 - DNA, 25 bp, Mus musculus
tgtacctgaccccagtgtcctgaaa

SEQ ID NO: 66770 - DNA, 25 bp, Mus musculus
tgtacctgagagtaatatgaatgaa

SEQ ID NO: 66771 - DNA, 25 bp, Mus musculus
tgtacctgctggtcctgacttgaga

SEQ ID NO: 66772 - DNA, 25 bp, Mus musculus
tgtaccttcatcaagtccaaccttg

SEQ ID NO: 66773 - DNA, 25 bp, Mus musculus
tgtaccttccctggacagcacagta

SEQ ID NO: 66774 - DNA, 25 bp, Mus musculus
tgtaccttgaagctggtattggcta

SEQ ID NO: 66775 - DNA, 25 bp, Mus musculus
tgtaccttgtcaccagctcgtctga

SEQ ID NO: 66776 - DNA, 25 bp, Mus musculus
tgtacgaagacctccgtgatggcca

SEQ ID NO: 66777 - DNA, 25 bp, Mus musculus
tgtacgacaagcaacacaaccacag

SEQ ID NO: 66778 - DNA, 25 bp, Mus musculus
tgtacgaggtgccagctacacccaa

SEQ ID NO: 66779 - DNA, 25 bp, Mus musculus
tgtacgagttccagcatacacccag

SEQ ID NO: 66780 - DNA, 25 bp, Mus musculus
tgtacgatcccgtagaatacgagaa

SEQ ID NO: 66781 - DNA, 25 bp, Mus musculus
tgtacgctgaagagcccaacatcga

SEQ ID NO: 66782 - DNA, 25 bp, Mus musculus
tgtacgctgtgacattcgctacaca

SEQ ID NO: 66783 - DNA, 25 bp, Mus musculus
tgtacgctgtgagattcgctacaca

SEQ ID NO: 66784 - DNA, 25 bp, Mus musculus
tgtacggaaactatcgaagggctcg

SEQ ID NO: 66785 - DNA, 25 bp, Mus musculus
tgtacgggtcccactgtacacacag

SEQ ID NO: 66786 - DNA, 25 bp, Mus musculus
tgtacgtttctctgcctaccgcaca

SEQ ID NO: 66787 - DNA, 25 bp, Mus musculus
tgtactaacagacgactttaaaggt

SEQ ID NO: 66788 - DNA, 25 bp, Mus musculus
tgtactaagcttggcctggaggagc

SEQ ID NO: 66789 - DNA, 25 bp, Mus musculus
tgtactaccaaagtgaggagcaagt

SEQ ID NO: 66790 - DNA, 25 bp, Mus musculus
tgtactagagatcataagcccagcc

SEQ ID NO: 66791 - DNA, 25 bp, Mus musculus
tgtactaggtctaaggcagacacaa

SEQ ID NO: 66792 - DNA, 25 bp, Mus musculus
tgtactaggtcttaggcagacacaa

SEQ ID NO: 66793 - DNA, 25 bp, Mus musculus
tgtactcaaagacggaagcttcgtg

SEQ ID NO: 66794 - DNA, 25 bp, Mus musculus
tgtactcacaaagattcacctctct

SEQ ID NO: 66795 - DNA, 25 bp, Mus musculus
tgtactctatgaccttgagaacgcc

SEQ ID NO: 66796 - DNA, 25 bp, Mus musculus
tgtactctattaaccagacgatatg

SEQ ID NO: 66797 - DNA, 25 bp, Mus musculus
tgtactctgccctgtacttcctagc

SEQ ID NO: 66798 - DNA, 25 bp, Mus musculus
tgtactgccatggatcaggtcttcc

SEQ ID NO: 66799 - DNA, 25 bp, Mus musculus
tgtactggctctgtcaatgttctcc

SEQ ID NO: 66800 - DNA, 25 bp, Mus musculus
tgtactgtatctgcaggacacctta

SEQ ID NO: 66801 - DNA, 25 bp, Mus musculus
tgtactgtgggagaaagctgcaaga

SEQ ID NO: 66802 - DNA, 25 bp, Mus musculus
tgtactgtgtccaacttactctatt

SEQ ID NO: 66803 - DNA, 25 bp, Mus musculus
tgtactgttctccagtcactaagga

SEQ ID NO: 66804 - DNA, 25 bp, Mus musculus
tgtacttcaagtcaatcgggatgtc

SEQ ID NO: 66805 - DNA, 25 bp, Mus musculus
tgtacttcagacattgagaagttcc

SEQ ID NO: 66806 - DNA, 25 bp, Mus musculus
tgtacttcccagcttctcgaggtag

SEQ ID NO: 66807 - DNA, 25 bp, Mus musculus
tgtacttgagtgctgccgagcttca

SEQ ID NO: 66808 - DNA, 25 bp, Mus musculus
tgtactttgcgtactcagtgtggac

SEQ ID NO: 66809 - DNA, 25 bp, Mus musculus
tgtagaacaccttatatcccaaatg

SEQ ID NO: 66810 - DNA, 25 bp, Mus musculus
tgtagaagaagatttggagctccca

SEQ ID NO: 66811 - DNA, 25 bp, Mus musculus
tgtagaagagcctaagaacttggtc

SEQ ID NO: 66812 - DNA, 25 bp, Mus musculus
tgtagacacaccatgtctccttgtc

SEQ ID NO: 66813 - DNA, 25 bp, Mus musculus
tgtagacacctatcccaatgaggag

SEQ ID NO: 66814 - DNA, 25 bp, Mus musculus
tgtagacacgggtttttcctgcagc

SEQ ID NO: 66815 - DNA, 25 bp, Mus musculus
tgtagacagtggagctcctcacgct

SEQ ID NO: 66816 - DNA, 25 bp, Mus musculus
tgtagacagtggtgctcctcacgct

SEQ ID NO: 66817 - DNA, 25 bp, Mus musculus
tgtagaccagtgtggccttcagctc

SEQ ID NO: 66818 - DNA, 25 bp, Mus musculus
tgtagacccattcctgtgaaagcag

SEQ ID NO: 66819 - DNA, 25 bp, Mus musculus
tgtagaccgggctcatcttgtactc

SEQ ID NO: 66820 - DNA, 25 bp, Mus musculus
tgtagacctcttccgtaatgcggga

SEQ ID NO: 66821 - DNA, 25 bp, Mus musculus
tgtagacctgcaagtttgtaatccc

SEQ ID NO: 66822 - DNA, 25 bp, Mus musculus
tgtagacgtccaaaccctcgtttct

SEQ ID NO: 66823 - DNA, 25 bp, Mus musculus
tgtagactaagaggcaagagaaacc

SEQ ID NO: 66824 - DNA, 25 bp, Mus musculus
tgtagactctgatgacctgattagc

SEQ ID NO: 66825 - DNA, 25 bp, Mus musculus
tgtagacttcgaatccatcagtgga

SEQ ID NO: 66826 - DNA, 25 bp, Mus musculus
tgtagacttcgattccatcagtgga

SEQ ID NO: 66827 - DNA, 25 bp, Mus musculus
tgtagagacgagtactccagattgc

SEQ ID NO: 66828 - DNA, 25 bp, Mus musculus
tgtagagagtcctgttcaagtccat

SEQ ID NO: 66829 - DNA, 25 bp, Mus musculus
tgtagatggccgagatggaatacca

SEQ ID NO: 66830 - DNA, 25 bp, Mus musculus
tgtagatgggatatttgctgtctgt

SEQ ID NO: 66831 - DNA, 25 bp, Mus musculus
tgtagatttagaagaggctggaaaa

SEQ ID NO: 66832 - DNA, 25 bp, Mus musculus
tgtagcagactgtaggaagtgccgc

SEQ ID NO: 66833 - DNA, 25 bp, Mus musculus
tgtagcagcgcattacgataatcag

SEQ ID NO: 66834 - DNA, 25 bp, Mus musculus
tgtagcaggcttcactcggttccct

SEQ ID NO: 66835 - DNA, 25 bp, Mus musculus
tgtagcagttcgtggtgatcagcct

SEQ ID NO: 66836 - DNA, 25 bp, Mus musculus
tgtagccaacctaactgtcacggac

SEQ ID NO: 66837 - DNA, 25 bp, Mus musculus
tgtagccaaccttactgtcacggac

SEQ ID NO: 66838 - DNA, 25 bp, Mus musculus
tgtagccagctcagcgctggtctct

SEQ ID NO: 66839 - DNA, 25 bp, Mus musculus
tgtagccatcaaccagagtgcagtt

SEQ ID NO: 66840 - DNA, 25 bp, Mus musculus
tgtagcccagtgaatacccttcacc

SEQ ID NO: 66841 - DNA, 25 bp, Mus musculus
tgtagcccatccaaaagaagcaccc

SEQ ID NO: 66842 - DNA, 25 bp, Mus musculus
tgtagccctcttcaaggtctgccgg

SEQ ID NO: 66843 - DNA, 25 bp, Mus musculus
tgtagccggctcagatacacctgca

SEQ ID NO: 66844 - DNA, 25 bp, Mus musculus
tgtagcctgtgacttctagtaaaag

SEQ ID NO: 66845 - DNA, 25 bp, Mus musculus
tgtagcctttgagtctgtcctgtgt

SEQ ID NO: 66846 - DNA, 25 bp, Mus musculus
tgtagcggaactgaagaacttggag

SEQ ID NO: 66847 - DNA, 25 bp, Mus musculus
tgtagcggacccgaatcctttgcgg

SEQ ID NO: 66848 - DNA, 25 bp, Mus musculus
tgtagcgtcagcacagtctcgggat

SEQ ID NO: 66849 - DNA, 25 bp, Mus musculus
tgtagctacatttcctggccccgga

SEQ ID NO: 66850 - DNA, 25 bp, Mus musculus
tgtagctatggatcggtacctgacc

SEQ ID NO: 66851 - DNA, 25 bp, Mus musculus
tgtagctccgtcagacatgatggac

SEQ ID NO: 66852 - DNA, 25 bp, Mus musculus
tgtagctgagaaatgaaactgttgc

SEQ ID NO: 66853 - DNA, 25 bp, Mus musculus
tgtagctgagaattgaaactgttgc

SEQ ID NO: 66854 - DNA, 25 bp, Mus musculus
tgtagctgagatacactgaggcttt

SEQ ID NO: 66855 - DNA, 25 bp, Mus musculus
tgtagctgcatctgatggctctaag

SEQ ID NO: 66856 - DNA, 25 bp, Mus musculus
tgtagctgcccattaaagacagggc

SEQ ID NO: 66857 - DNA, 25 bp, Mus musculus
tgtagctgcttgcaaaacagagaaa

SEQ ID NO: 66858 - DNA, 25 bp, Mus musculus
tgtagctgtcttcttgccccggtca

SEQ ID NO: 66859 - DNA, 25 bp, Mus musculus
tgtaggaaacaaagaatccgcaatg

SEQ ID NO: 66860 - DNA, 25 bp, Mus musculus
tgtaggcagtgctgccgtgtcctcc

SEQ ID NO: 66861 - DNA, 25 bp, Mus musculus
tgtaggccacgcaggtgttgcagtt

SEQ ID NO: 66862 - DNA, 25 bp, Mus musculus
tgtaggcctaaagcttaatgacctg

SEQ ID NO: 66863 - DNA, 25 bp, Mus musculus
tgtaggcctgttgcccatgggagcc

SEQ ID NO: 66864 - DNA, 25 bp, Mus musculus
tgtagggccagaaggaatggaaaaa

SEQ ID NO: 66865 - DNA, 25 bp, Mus musculus
tgtaggtataccgacaattaattta

SEQ ID NO: 66866 - DNA, 25 bp, Mus musculus
tgtaggtctttttctagacactgga

SEQ ID NO: 66867 - DNA, 25 bp, Mus musculus
tgtaggtgaagtgctaaaacagtta

SEQ ID NO: 66868 - DNA, 25 bp, Mus musculus
tgtaggtgacaaacaagatgccctg

SEQ ID NO: 66869 - DNA, 25 bp, Mus musculus
tgtaggtgtggagggcttcattacc

SEQ ID NO: 66870 - DNA, 25 bp, Mus musculus
tgtaggttcatacatggcccttcac

SEQ ID NO: 66871 - DNA, 25 bp, Mus musculus
tgtaggtttctatgtcaacacgttc

SEQ ID NO: 66872 - DNA, 25 bp, Mus musculus
tgtagtaaaccagtcaagtccaaaa

SEQ ID NO: 66873 - DNA, 25 bp, Mus musculus
tgtagtcatgcctaagtcacactgt

SEQ ID NO: 66874 - DNA, 25 bp, Mus musculus
tgtagtccactaccaccgtgcttgc

SEQ ID NO: 66875 - DNA, 25 bp, Mus musculus
tgtagtccactagcaccgtgcttgc

SEQ ID NO: 66876 - DNA, 25 bp, Mus musculus
tgtagtcccctggatgctggcaatt

SEQ ID NO: 66877 - DNA, 25 bp, Mus musculus
tgtagtctccggtgcaggaaagatg

SEQ ID NO: 66878 - DNA, 25 bp, Mus musculus
tgtagtgagatttctgaccaaacgg

SEQ ID NO: 66879 - DNA, 25 bp, Mus musculus
tgtagtggccattccctgggagtta

SEQ ID NO: 66880 - DNA, 25 bp, Mus musculus
tgtagttggccaacaagcaacagaa

SEQ ID NO: 66881 - DNA, 25 bp, Mus musculus
tgtagtttctaacttgaaggtctgc

SEQ ID NO: 66882 - DNA, 25 bp, Mus musculus
tgtagttttggaggaacaactcaac

SEQ ID NO: 66883 - DNA, 25 bp, Mus musculus
tgtataacttccctgccggaggcgt

SEQ ID NO: 66884 - DNA, 25 bp, Mus musculus
tgtatacggaagagagactccaatc

SEQ ID NO: 66885 - DNA, 25 bp, Mus musculus
tgtatactctcacctattgctctgt

SEQ ID NO: 66886 - DNA, 25 bp, Mus musculus
tgtatactctcagctattgctctgt

SEQ ID NO: 66887 - DNA, 25 bp, Mus musculus
tgtatactctgtgtgagcctggcag

SEQ ID NO: 66888 - DNA, 25 bp, Mus musculus
tgtatagagaaaacgtgtgagaaac

SEQ ID NO: 66889 - DNA, 25 bp, Mus musculus
tgtataggaagaaccaagcaactgg

SEQ ID NO: 66890 - DNA, 25 bp, Mus musculus
tgtataggagatgccgaaacagatg

SEQ ID NO: 66891 - DNA, 25 bp, Mus musculus
tgtatagttaccctaatcgcaattg

SEQ ID NO: 66892 - DNA, 25 bp, Mus musculus
tgtatatcaggtactgctgtgatga

SEQ ID NO: 66893 - DNA, 25 bp, Mus musculus
tgtatatcatctggattacgtggct

SEQ ID NO: 66894 - DNA, 25 bp, Mus musculus
tgtatatgaactgagtctgtctgca

SEQ ID NO: 66895 - DNA, 25 bp, Mus musculus
tgtatatgggcacatacgcaccttt

SEQ ID NO: 66896 - DNA, 25 bp, Mus musculus
tgtatcaacgtgactcttggtgggt

SEQ ID NO: 66897 - DNA, 25 bp, Mus musculus
tgtatcaagagccagtgtatggcaa

SEQ ID NO: 66898 - DNA, 25 bp, Mus musculus
tgtatcaatgcacggccaagtctac

SEQ ID NO: 66899 - DNA, 25 bp, Mus musculus
tgtatcagcgctatcggcattgtga

SEQ ID NO: 66900 - DNA, 25 bp, Mus musculus
tgtatcataacgaagaggccaccgg

SEQ ID NO: 66901 - DNA, 25 bp, Mus musculus
tgtatcatcatcacttcatcacaag

SEQ ID NO: 66902 - DNA, 25 bp, Mus musculus
tgtatccaacacatgacgtcagtag

SEQ ID NO: 66903 - DNA, 25 bp, Mus musculus
tgtatccaacggagggcgcctcatg

SEQ ID NO: 66904 - DNA, 25 bp, Mus musculus
tgtatccagaactcccagaatactg

SEQ ID NO: 66905 - DNA, 25 bp, Mus musculus
tgtatccatcgagatttggctgcca

SEQ ID NO: 66906 - DNA, 25 bp, Mus musculus
tgtatccatggaagaactcaatgct

SEQ ID NO: 66907 - DNA, 25 bp, Mus musculus
tgtatccattcagactgctctttga

SEQ ID NO: 66908 - DNA, 25 bp, Mus musculus
tgtatcccagtcctggaagggcagc

SEQ ID NO: 66909 - DNA, 25 bp, Mus musculus
tgtatccgagacaagttcagccaga

SEQ ID NO: 66910 - DNA, 25 bp, Mus musculus
tgtatccgaggagcctcctgcatgt

SEQ ID NO: 66911 - DNA, 25 bp, Mus musculus
tgtatcgatggctaccaggactgcc

SEQ ID NO: 66912 - DNA, 25 bp, Mus musculus
tgtatcgggatattatactcgcact

SEQ ID NO: 66913 - DNA, 25 bp, Mus musculus
tgtatctcagaaacttcaaagtgcc

SEQ ID NO: 66914 - DNA, 25 bp, Mus musculus
tgtatctctatggtgaggcagctca

SEQ ID NO: 66915 - DNA, 25 bp, Mus musculus
tgtatctcttctatggcaacaagac

SEQ ID NO: 66916 - DNA, 25 bp, Mus musculus
tgtatctgactatgacggcaagctg

SEQ ID NO: 66917 - DNA, 25 bp, Mus musculus
tgtatctgcatagaagagttggctt

SEQ ID NO: 66918 - DNA, 25 bp, Mus musculus
tgtatctgctcttgacttgtcggaa

SEQ ID NO: 66919 - DNA, 25 bp, Mus musculus
tgtatctggactctcaaaagccaag

SEQ ID NO: 66920 - DNA, 25 bp, Mus musculus
tgtatctggactgtcaaaagccaag

SEQ ID NO: 66921 - DNA, 25 bp, Mus musculus
tgtatctggatattatgcatgcact

SEQ ID NO: 66922 - DNA, 25 bp, Mus musculus
tgtatctgtcagctaaagggccctc

SEQ ID NO: 66923 - DNA, 25 bp, Mus musculus
tgtatgaaaaactgtgtatctgctc

SEQ ID NO: 66924 - DNA, 25 bp, Mus musculus
tgtatgaaaagatcgtgcactgtca

SEQ ID NO: 66925 - DNA, 25 bp, Mus musculus
tgtatgaaaagcatgctaattggac

SEQ ID NO: 66926 - DNA, 25 bp, Mus musculus
tgtatgaaagcagagcgcacatttg

SEQ ID NO: 66927 - DNA, 25 bp, Mus musculus
tgtatgaagaagatgccgtgcctgg

SEQ ID NO: 66928 - DNA, 25 bp, Mus musculus
tgtatgaagaccaactagcaaaaca

SEQ ID NO: 66929 - DNA, 25 bp, Mus musculus
tgtatgaagcagcacaagaagctga

SEQ ID NO: 66930 - DNA, 25 bp, Mus musculus
tgtatgaagctagtataaaagattc

SEQ ID NO: 66931 - DNA, 25 bp, Mus musculus
tgtatgacatctgtgactacaatgt

SEQ ID NO: 66932 - DNA, 25 bp, Mus musculus
tgtatgacctgccatattcagtaag

SEQ ID NO: 66933 - DNA, 25 bp, Mus musculus
tgtatgagaagatccccagctgtgc

SEQ ID NO: 66934 - DNA, 25 bp, Mus musculus
tgtatgagacagacgtgtacgtggt

SEQ ID NO: 66935 - DNA, 25 bp, Mus musculus
tgtatgagctttagttctgaacatc

SEQ ID NO: 66936 - DNA, 25 bp, Mus musculus
tgtatgatttgccacatctgaggaa

SEQ ID NO: 66937 - DNA, 25 bp, Mus musculus
tgtatgcacggtctctgggcgcttc

SEQ ID NO: 66938 - DNA, 25 bp, Mus musculus
tgtatgcactgttctctgggcagcc

SEQ ID NO: 66939 - DNA, 25 bp, Mus musculus
tgtatgcccggcctgtgcaactgag

SEQ ID NO: 66940 - DNA, 25 bp, Mus musculus
tgtatgctgcggagaagatcattgg

SEQ ID NO: 66941 - DNA, 25 bp, Mus musculus
tgtatggacacaaagaatgatagaa

SEQ ID NO: 66942 - DNA, 25 bp, Mus musculus
tgtatggactccaagctcctggcca

SEQ ID NO: 66943 - DNA, 25 bp, Mus musculus
tgtatggagcagttgacgcgtagtc

SEQ ID NO: 66944 - DNA, 25 bp, Mus musculus
tgtatggatatgttaagattaactc

SEQ ID NO: 66945 - DNA, 25 bp, Mus musculus
tgtatggcaggtgcctcagccagga

SEQ ID NO: 66946 - DNA, 25 bp, Mus musculus
tgtatgggaaggttcgaaaagctgc

SEQ ID NO: 66947 - DNA, 25 bp, Mus musculus
tgtatgggacggtgttaagtcgcca

SEQ ID NO: 66948 - DNA, 25 bp, Mus musculus
tgtatggtgcttaccaaaggctcat

SEQ ID NO: 66949 - DNA, 25 bp, Mus musculus
tgtatgtaggcggtaccctgcaccc

SEQ ID NO: 66950 - DNA, 25 bp, Mus musculus
tgtatgtcaacatgctccggaacaa

SEQ ID NO: 66951 - DNA, 25 bp, Mus musculus
tgtatgtggctaagcccacgctcat

SEQ ID NO: 66952 - DNA, 25 bp, Mus musculus
tgtatgtgtcctgggcagtaaactc

SEQ ID NO: 66953 - DNA, 25 bp, Mus musculus
tgtattagtacaggaaaggaatctg

SEQ ID NO: 66954 - DNA, 25 bp, Mus musculus
tgtattattctgtgaggaggctgcc

SEQ ID NO: 66955 - DNA, 25 bp, Mus musculus
tgtattcaaaggatcccaagcactg

SEQ ID NO: 66956 - DNA, 25 bp, Mus musculus
tgtattcagagtcaacttcatcggg

SEQ ID NO: 66957 - DNA, 25 bp, Mus musculus
tgtattcagagtgaacttcatcggg

SEQ ID NO: 66958 - DNA, 25 bp, Mus musculus
tgtattccaaatgggaaagagaact

SEQ ID NO: 66959 - DNA, 25 bp, Mus musculus
tgtattccacaagaccaagtttcac

SEQ ID NO: 66960 - DNA, 25 bp, Mus musculus
tgtattctatctcctaaggatcgga

SEQ ID NO: 66961 - DNA, 25 bp, Mus musculus
tgtattctcatactagactccctga

SEQ ID NO: 66962 - DNA, 25 bp, Mus musculus
tgtattcttcccaccactgagatag

SEQ ID NO: 66963 - DNA, 25 bp, Mus musculus
tgtattcttggtttcggtttgcgaa

SEQ ID NO: 66964 - DNA, 25 bp, Mus musculus
tgtattgctttctgactgtgtttag

SEQ ID NO: 66965 - DNA, 25 bp, Mus musculus
tgtattgtaaatggactctgcctct

SEQ ID NO: 66966 - DNA, 25 bp, Mus musculus
tgtattttctagatccaggccgttc

SEQ ID NO: 66967 - DNA, 25 bp, Mus musculus
tgtattttcttcaaagccagagatg

SEQ ID NO: 66968 - DNA, 25 bp, Mus musculus
tgtattttcttctaagccagagatg

SEQ ID NO: 66969 - DNA, 25 bp, Mus musculus
tgtatttttagaagacagtcctgtt

SEQ ID NO: 66970 - DNA, 25 bp, Mus musculus
tgtcaaaaacagttccaggcagcag

SEQ ID NO: 66971 - DNA, 25 bp, Mus musculus
tgtcaaaagacagatctctcaagaa

SEQ ID NO: 66972 - DNA, 25 bp, Mus musculus
tgtcaaacaaaactcagctgtgaac

SEQ ID NO: 66973 - DNA, 25 bp, Mus musculus
tgtcaaacacaggttctcttcccgg

SEQ ID NO: 66974 - DNA, 25 bp, Mus musculus
tgtcaaacctgcatgtggacgtccc

SEQ ID NO: 66975 - DNA, 25 bp, Mus musculus
tgtcaaactattaacatggccagtc

SEQ ID NO: 66976 - DNA, 25 bp, Mus musculus
tgtcaaagggtgaaacaaagttcat

SEQ ID NO: 66977 - DNA, 25 bp, Mus musculus
tgtcaaagtaatcccatcacaagct

SEQ ID NO: 66978 - DNA, 25 bp, Mus musculus
tgtcaaataccgaggagtaaggatt

SEQ ID NO: 66979 - DNA, 25 bp, Mus musculus
tgtcaaatacctccggagacacgga

SEQ ID NO: 66980 - DNA, 25 bp, Mus musculus
tgtcaaatcctgcaaccttccgaga

SEQ ID NO: 66981 - DNA, 25 bp, Mus musculus
tgtcaaatcgacagcacggtttact

SEQ ID NO: 66982 - DNA, 25 bp, Mus musculus
tgtcaacaaggctcaaggagcagga

SEQ ID NO: 66983 - DNA, 25 bp, Mus musculus
tgtcaacaataactgttctactggt

SEQ ID NO: 66984 - DNA, 25 bp, Mus musculus
tgtcaacaggagcaaactaatttgg

SEQ ID NO: 66985 - DNA, 25 bp, Mus musculus
tgtcaacagggaggcttgccttctg

SEQ ID NO: 66986 - DNA, 25 bp, Mus musculus
tgtcaacagtgtcggctcctactcc

SEQ ID NO: 66987 - DNA, 25 bp, Mus musculus
tgtcaacagtgtgggctcctactcc

SEQ ID NO: 66988 - DNA, 25 bp, Mus musculus
tgtcaacatgctccggaacaaccca

SEQ ID NO: 66989 - DNA, 25 bp, Mus musculus
tgtcaaccacagaatatctctagag

SEQ ID NO: 66990 - DNA, 25 bp, Mus musculus
tgtcaaccacagtgcaaacacggag

SEQ ID NO: 66991 - DNA, 25 bp, Mus musculus
tgtcaaccgcatcattacagaaaag

SEQ ID NO: 66992 - DNA, 25 bp, Mus musculus
tgtcaaccgcctagtgaacacacca

SEQ ID NO: 66993 - DNA, 25 bp, Mus musculus
tgtcaaccgcctcgtgcaggcgcat

SEQ ID NO: 66994 - DNA, 25 bp, Mus musculus
tgtcaaccgccttgtgaacacacca

SEQ ID NO: 66995 - DNA, 25 bp, Mus musculus
tgtcaacgactatggcaaaggctgg

SEQ ID NO: 66996 - DNA, 25 bp, Mus musculus
tgtcaacgtcaaccgcagcgtgtca

SEQ ID NO: 66997 - DNA, 25 bp, Mus musculus
tgtcaactgttcctgaaaccaagct

SEQ ID NO: 66998 - DNA, 25 bp, Mus musculus
tgtcaactgttcgtgaaaccaagct

SEQ ID NO: 66999 - DNA, 25 bp, Mus musculus
tgtcaagaacaaggtaccacccctg

SEQ ID NO: 67000 - DNA, 25 bp, Mus musculus
tgtcaagacctctgatcactcgatc

SEQ ID NO: 67001 - DNA, 25 bp, Mus musculus
tgtcaagagtgaaaaggtttatacc

SEQ ID NO: 67002 - DNA, 25 bp, Mus musculus
tgtcaagatgtttaacaccagggtg

SEQ ID NO: 67003 - DNA, 25 bp, Mus musculus
tgtcaagattctgagctccccatgg

SEQ ID NO: 67004 - DNA, 25 bp, Mus musculus
tgtcaagcccgctggcttccgttgc

SEQ ID NO: 67005 - DNA, 25 bp, Mus musculus
tgtcaagggtcaccagcacaacgaa

SEQ ID NO: 67006 - DNA, 25 bp, Mus musculus
tgtcaaggtcctttaattccaatct

SEQ ID NO: 67007 - DNA, 25 bp, Mus musculus
tgtcaaggtggaaggaaacagcaaa

SEQ ID NO: 67008 - DNA, 25 bp, Mus musculus
tgtcaagtgcttagctgtgctccct

SEQ ID NO: 67009 - DNA, 25 bp, Mus musculus
tgtcaagtgtacagcagatattttg

SEQ ID NO: 67010 - DNA, 25 bp, Mus musculus
tgtcaagttgcttagcaacaaaagg

SEQ ID NO: 67011 - DNA, 25 bp, Mus musculus
tgtcaatatcctacgacaaaaaggt

SEQ ID NO: 67012 - DNA, 25 bp, Mus musculus
tgtcaatcaatatgctaagtggtgg

SEQ ID NO: 67013 - DNA, 25 bp, Mus musculus
tgtcaatcatgccaaggtgaaactg

SEQ ID NO: 67014 - DNA, 25 bp, Mus musculus
tgtcaatgacaagaattggcctggc

SEQ ID NO: 67015 - DNA, 25 bp, Mus musculus
tgtcaatgagtgactgacccctggg

SEQ ID NO: 67016 - DNA, 25 bp, Mus musculus
tgtcaatgagtgtctgacccctggg

SEQ ID NO: 67017 - DNA, 25 bp, Mus musculus
tgtcaatgcactcaccaatggcgtt

SEQ ID NO: 67018 - DNA, 25 bp, Mus musculus
tgtcaatggatacaccaactgctgc

SEQ ID NO: 67019 - DNA, 25 bp, Mus musculus
tgtcaatggctggtacatcctgctg

SEQ ID NO: 67020 - DNA, 25 bp, Mus musculus
tgtcaatgggactgatcaggaagaa

SEQ ID NO: 67021 - DNA, 25 bp, Mus musculus
tgtcaatgggagaccagcttcatgc

SEQ ID NO: 67022 - DNA, 25 bp, Mus musculus
tgtcaatgtgactgtttagtggaac

SEQ ID NO: 67023 - DNA, 25 bp, Mus musculus
tgtcaattagcaccaaaccacgagg

SEQ ID NO: 67024 - DNA, 25 bp, Mus musculus
tgtcaattagcagcaaaccacgagg

SEQ ID NO: 67025 - DNA, 25 bp, Mus musculus
tgtcaattgctcctgataatggctc

SEQ ID NO: 67026 - DNA, 25 bp, Mus musculus
tgtcacaaagggatgccaaggctta

SEQ ID NO: 67027 - DNA, 25 bp, Mus musculus
tgtcacaacgtgtctgtgttcctgg

SEQ ID NO: 67028 - DNA, 25 bp, Mus musculus
tgtcacaagaatggccagtgcacaa

SEQ ID NO: 67029 - DNA, 25 bp, Mus musculus
tgtcacaataagatccccaggagct

SEQ ID NO: 67030 - DNA, 25 bp, Mus musculus
tgtcacacagtgctgtcaggaggat

SEQ ID NO: 67031 - DNA, 25 bp, Mus musculus
tgtcacagcgtctggagtcatcccg

SEQ ID NO: 67032 - DNA, 25 bp, Mus musculus
tgtcacagtaacaagcttgcgctgc

SEQ ID NO: 67033 - DNA, 25 bp, Mus musculus
tgtcacagtgtcctccatttctcgc

SEQ ID NO: 67034 - DNA, 25 bp, Mus musculus
tgtcaccaacaacctcaagtctctt

SEQ ID NO: 67035 - DNA, 25 bp, Mus musculus
tgtcaccaacacaattccacaagag

SEQ ID NO: 67036 - DNA, 25 bp, Mus musculus
tgtcaccaatgagaacccagaaatt

SEQ ID NO: 67037 - DNA, 25 bp, Mus musculus
tgtcaccacgaagctggtgctgccg

SEQ ID NO: 67038 - DNA, 25 bp, Mus musculus
tgtcaccaggataacctgtaatggg

SEQ ID NO: 67039 - DNA, 25 bp, Mus musculus
tgtcaccagttaagcaggctccacg

SEQ ID NO: 67040 - DNA, 25 bp, Mus musculus
tgtcacccacagtgtctatcgcagc

SEQ ID NO: 67041 - DNA, 25 bp, Mus musculus
tgtcacccagaggacatttaagctc

SEQ ID NO: 67042 - DNA, 25 bp, Mus musculus
tgtcaccccatgttgcaagcactga

SEQ ID NO: 67043 - DNA, 25 bp, Mus musculus
tgtcaccctgctgatcatgaagctg

SEQ ID NO: 67044 - DNA, 25 bp, Mus musculus
tgtcacccttcaaagcccctattag

SEQ ID NO: 67045 - DNA, 25 bp, Mus musculus
tgtcacccttgacccaaattttctg

SEQ ID NO: 67046 - DNA, 25 bp, Mus musculus
tgtcaccgagtacgtcgtccgagtc

SEQ ID NO: 67047 - DNA, 25 bp, Mus musculus
tgtcaccggaggtatagctgtgccc

SEQ ID NO: 67048 - DNA, 25 bp, Mus musculus
tgtcaccgtacagattgagaatacc

SEQ ID NO: 67049 - DNA, 25 bp, Mus musculus
tgtcacctcacgttcagcctgtgtg

SEQ ID NO: 67050 - DNA, 25 bp, Mus musculus
tgtcacctccgtgggaacaagatcg

SEQ ID NO: 67051 - DNA, 25 bp, Mus musculus
tgtcacctgagccttggaacatcct

SEQ ID NO: 67052 - DNA, 25 bp, Mus musculus
tgtcacctgtgcatagagcagcaac

SEQ ID NO: 67053 - DNA, 25 bp, Mus musculus
tgtcaccttcgcctgcatcaggatt

SEQ ID NO: 67054 - DNA, 25 bp, Mus musculus
tgtcaccttggtcggctgcttcaag

SEQ ID NO: 67055 - DNA, 25 bp, Mus musculus
tgtcacgagtatccgagatactcgc

SEQ ID NO: 67056 - DNA, 25 bp, Mus musculus
tgtcacgatttcacctttggatggg

SEQ ID NO: 67057 - DNA, 25 bp, Mus musculus
tgtcacggccgacttcaaggaaacg

SEQ ID NO: 67058 - DNA, 25 bp, Mus musculus
tgtcacggccgagttcaaggaaacg

SEQ ID NO: 67059 - DNA, 25 bp, Mus musculus
tgtcactaatctaacctggaggagg

SEQ ID NO: 67060 - DNA, 25 bp, Mus musculus
tgtcactacctggagtaacaaaact

SEQ ID NO: 67061 - DNA, 25 bp, Mus musculus
tgtcactatcgaggctatgtggagg

SEQ ID NO: 67062 - DNA, 25 bp, Mus musculus
tgtcactcagaagatcacgacgttg

SEQ ID NO: 67063 - DNA, 25 bp, Mus musculus
tgtcactccagagattgagagagtc

SEQ ID NO: 67064 - DNA, 25 bp, Mus musculus
tgtcactcctttgggccacaagagg

SEQ ID NO: 67065 - DNA, 25 bp, Mus musculus
tgtcactctggatcctctttgttta

SEQ ID NO: 67066 - DNA, 25 bp, Mus musculus
tgtcactgcaaaagaaactcaaggg

SEQ ID NO: 67067 - DNA, 25 bp, Mus musculus
tgtcactgcactcagttgctggctt

SEQ ID NO: 67068 - DNA, 25 bp, Mus musculus
tgtcactggcaggtacgtgccatca

SEQ ID NO: 67069 - DNA, 25 bp, Mus musculus
tgtcactgggctgaatggtaaccta

SEQ ID NO: 67070 - DNA, 25 bp, Mus musculus
tgtcactgtccagtatcgccttggg

SEQ ID NO: 67071 - DNA, 25 bp, Mus musculus
tgtcacttgagaaaatagaaccaac

SEQ ID NO: 67072 - DNA, 25 bp, Mus musculus
tgtcacttgagataatagaaccaac

SEQ ID NO: 67073 - DNA, 25 bp, Mus musculus
tgtcactttcctggcaagcctgcta

SEQ ID NO: 67074 - DNA, 25 bp, Mus musculus
tgtcagaaacgatggcagccctggc

SEQ ID NO: 67075 - DNA, 25 bp, Mus musculus
tgtcagaaagatggatcttgggacc

SEQ ID NO: 67076 - DNA, 25 bp, Mus musculus
tgtcagaactatccaccattactct

SEQ ID NO: 67077 - DNA, 25 bp, Mus musculus
tgtcagaagaacagatccgcttgaa

SEQ ID NO: 67078 - DNA, 25 bp, Mus musculus
tgtcagaatctccatgactcagaac

SEQ ID NO: 67079 - DNA, 25 bp, Mus musculus
tgtcagaatgctacctcccaggagc

SEQ ID NO: 67080 - DNA, 25 bp, Mus musculus
tgtcagaattatgccaaggaggtgg

SEQ ID NO: 67081 - DNA, 25 bp, Mus musculus
tgtcagacataatctgtccttcagc

SEQ ID NO: 67082 - DNA, 25 bp, Mus musculus
tgtcagacatcaaagctctgatccg

SEQ ID NO: 67083 - DNA, 25 bp, Mus musculus
tgtcagacgcgcctcgagcagattt

SEQ ID NO: 67084 - DNA, 25 bp, Mus musculus
tgtcagactcctgtgctttcggctc

SEQ ID NO: 67085 - DNA, 25 bp, Mus musculus
tgtcagagactaagaccacagggta

SEQ ID NO: 67086 - DNA, 25 bp, Mus musculus
tgtcagagactatgaccacagggta

SEQ ID NO: 67087 - DNA, 25 bp, Mus musculus
tgtcagagtgggagtcctactacaa

SEQ ID NO: 67088 - DNA, 25 bp, Mus musculus
tgtcagatatcctggcggagggcat

SEQ ID NO: 67089 - DNA, 25 bp, Mus musculus
tgtcagcaaccagagggaaaccaca

SEQ ID NO: 67090 - DNA, 25 bp, Mus musculus
tgtcagcacctcaacagaaagtgct

SEQ ID NO: 67091 - DNA, 25 bp, Mus musculus
tgtcagcagcgtcaagagcatttcc

SEQ ID NO: 67092 - DNA, 25 bp, Mus musculus
tgtcagcagcgtgaagagcatttcc

SEQ ID NO: 67093 - DNA, 25 bp, Mus musculus
tgtcagcaggacagaggtgttagct

SEQ ID NO: 67094 - DNA, 25 bp, Mus musculus
tgtcagccggatccttgggcccatt

SEQ ID NO: 67095 - DNA, 25 bp, Mus musculus
tgtcagccggatgcttgggcccatt

SEQ ID NO: 67096 - DNA, 25 bp, Mus musculus
tgtcagcctttgattttattaagaa

SEQ ID NO: 67097 - DNA, 25 bp, Mus musculus
tgtcagcgaagaagccattaaacga

SEQ ID NO: 67098 - DNA, 25 bp, Mus musculus
tgtcagcgctcctaaagcaaatgcc

SEQ ID NO: 67099 - DNA, 25 bp, Mus musculus
tgtcagctgcaacattccagtggtg

SEQ ID NO: 67100 - DNA, 25 bp, Mus musculus
tgtcagctgccctcatatccctggg

SEQ ID NO: 67101 - DNA, 25 bp, Mus musculus
tgtcaggagccctggaagaccgtgt

SEQ ID NO: 67102 - DNA, 25 bp, Mus musculus
tgtcaggccagcttgtgcaccggtg

SEQ ID NO: 67103 - DNA, 25 bp, Mus musculus
tgtcaggctcagaaggctgtctact

SEQ ID NO: 67104 - DNA, 25 bp, Mus musculus
tgtcagggcctgagaaccgctccca

SEQ ID NO: 67105 - DNA, 25 bp, Mus musculus
tgtcagtaatatatgcaatcacgca

SEQ ID NO: 67106 - DNA, 25 bp, Mus musculus
tgtcagtagttatgcctggccttac

SEQ ID NO: 67107 - DNA, 25 bp, Mus musculus
tgtcagtgacttggatcccgtatgc

SEQ ID NO: 67108 - DNA, 25 bp, Mus musculus
tgtcagtgagcttccagactgtaac

SEQ ID NO: 67109 - DNA, 25 bp, Mus musculus
tgtcagtgctaacatttctgtcaaa

SEQ ID NO: 67110 - DNA, 25 bp, Mus musculus
tgtcagtgctgacccagcatcgtca

SEQ ID NO: 67111 - DNA, 25 bp, Mus musculus
tgtcagtggcaacagaacggttgaa

SEQ ID NO: 67112 - DNA, 25 bp, Mus musculus
tgtcataaactcattatcagtggat

SEQ ID NO: 67113 - DNA, 25 bp, Mus musculus
tgtcataagaaggtgtcagacccct

SEQ ID NO: 67114 - DNA, 25 bp, Mus musculus
tgtcatagcatctcctctcggagtg

SEQ ID NO: 67115 - DNA, 25 bp, Mus musculus
tgtcatagccatcctgagagagcca

SEQ ID NO: 67116 - DNA, 25 bp, Mus musculus
tgtcatagccatgctgagagagcca

SEQ ID NO: 67117 - DNA, 25 bp, Mus musculus
tgtcatatacaacgcagtctgccag

SEQ ID NO: 67118 - DNA, 25 bp, Mus musculus
tgtcatatgcctggaccttgcagct

SEQ ID NO: 67119 - DNA, 25 bp, Mus musculus
tgtcatcaacacctgggctctttgg

SEQ ID NO: 67120 - DNA, 25 bp, Mus musculus
tgtcatcaacctggctggagagaat

SEQ ID NO: 67121 - DNA, 25 bp, Mus musculus
tgtcatcaagtacggaaacaggaag

SEQ ID NO: 67122 - DNA, 25 bp, Mus musculus
tgtcatcaatagtactactgccata

SEQ ID NO: 67123 - DNA, 25 bp, Mus musculus
tgtcatcaatggcatcctcttcatt

SEQ ID NO: 67124 - DNA, 25 bp, Mus musculus
tgtcatcagcaagattctggaagac

SEQ ID NO: 67125 - DNA, 25 bp, Mus musculus
tgtcatcaggcagcggaaggcagct

SEQ ID NO: 67126 - DNA, 25 bp, Mus musculus
tgtcatcaggttctggcgtagagcc

SEQ ID NO: 67127 - DNA, 25 bp, Mus musculus
tgtcatccattacagcggtaatcaa

SEQ ID NO: 67128 - DNA, 25 bp, Mus musculus
tgtcatccattagagcggtaatcaa

SEQ ID NO: 67129 - DNA, 25 bp, Mus musculus
tgtcatcctgaacgatatcactcag

SEQ ID NO: 67130 - DNA, 25 bp, Mus musculus
tgtcatcctgttgtaaaatgtcaga

SEQ ID NO: 67131 - DNA, 25 bp, Mus musculus
tgtcatcgggcccaagatctgcctc

SEQ ID NO: 67132 - DNA, 25 bp, Mus musculus
tgtcatcgggctccaaaaccaagtc

SEQ ID NO: 67133 - DNA, 25 bp, Mus musculus
tgtcatctatgaagcgtatcagcag

SEQ ID NO: 67134 - DNA, 25 bp, Mus musculus
tgtcatctgggtgattctcagtgtg

SEQ ID NO: 67135 - DNA, 25 bp, Mus musculus
tgtcatcttagcaactgcaggctat

SEQ ID NO: 67136 - DNA, 25 bp, Mus musculus
tgtcatgaactcttgggacatgtgc

SEQ ID NO: 67137 - DNA, 25 bp, Mus musculus
tgtcatgactgctgaaggaaacatc

SEQ ID NO: 67138 - DNA, 25 bp, Mus musculus
tgtcatgagaaataagctgaaacaa

SEQ ID NO: 67139 - DNA, 25 bp, Mus musculus
tgtcatgatagatcaccaacaaaaa

SEQ ID NO: 67140 - DNA, 25 bp, Mus musculus
tgtcatgcagtgtcccaaacacaag

SEQ ID NO: 67141 - DNA, 25 bp, Mus musculus
tgtcatgctcaccaacaggctaagg

SEQ ID NO: 67142 - DNA, 25 bp, Mus musculus
tgtcatgctcaccacgcaactgctg

SEQ ID NO: 67143 - DNA, 25 bp, Mus musculus
tgtcattaacggaccttctaccatg

SEQ ID NO: 67144 - DNA, 25 bp, Mus musculus
tgtcattcattatcggaaaacggat

SEQ ID NO: 67145 - DNA, 25 bp, Mus musculus
tgtcattgaagacgactgcctcccc

SEQ ID NO: 67146 - DNA, 25 bp, Mus musculus
tgtcattgaatggtctgtagttaag

SEQ ID NO: 67147 - DNA, 25 bp, Mus musculus
tgtcattgatatctgccctgtaggg

SEQ ID NO: 67148 - DNA, 25 bp, Mus musculus
tgtcattgatcagagtgaaccgctt

SEQ ID NO: 67149 - DNA, 25 bp, Mus musculus
tgtcattggttatcttgaggatcaa

SEQ ID NO: 67150 - DNA, 25 bp, Mus musculus
tgtcattgtggactgcagatacccc

SEQ ID NO: 67151 - DNA, 25 bp, Mus musculus
tgtcatttcgctgatggagatgggc

SEQ ID NO: 67152 - DNA, 25 bp, Mus musculus
tgtccaacaagaacgacaagcagcc

SEQ ID NO: 67153 - DNA, 25 bp, Mus musculus
tgtccaacaagaagccggagctgct

SEQ ID NO: 67154 - DNA, 25 bp, Mus musculus
tgtccaacagtactgtgagcctcat

SEQ ID NO: 67155 - DNA, 25 bp, Mus musculus
tgtccaacagtagtgtgagcctcat

SEQ ID NO: 67156 - DNA, 25 bp, Mus musculus
tgtccaagaattcctcacagcaatg

SEQ ID NO: 67157 - DNA, 25 bp, Mus musculus
tgtccaatagatcgttcgggccgcg

SEQ ID NO: 67158 - DNA, 25 bp, Mus musculus
tgtccaatcactatggagccatggg

SEQ ID NO: 67159 - DNA, 25 bp, Mus musculus
tgtccaatgcctattcaccaaggca

SEQ ID NO: 67160 - DNA, 25 bp, Mus musculus
tgtccaatgtgaaggctccgctgta

SEQ ID NO: 67161 - DNA, 25 bp, Mus musculus
tgtccaccatgattgacgggagtgg

SEQ ID NO: 67162 - DNA, 25 bp, Mus musculus
tgtccacccacaagcccattgaagt

SEQ ID NO: 67163 - DNA, 25 bp, Mus musculus
tgtccacgtgatcagttttgtaaga

SEQ ID NO: 67164 - DNA, 25 bp, Mus musculus
tgtccacgtgatgagttttgtaaga

SEQ ID NO: 67165 - DNA, 25 bp, Mus musculus
tgtccacgttacaacaaaccactgc

SEQ ID NO: 67166 - DNA, 25 bp, Mus musculus
tgtccactagtctgtaaacacttgt

SEQ ID NO: 67167 - DNA, 25 bp, Mus musculus
tgtccactctccaagctttatctca

SEQ ID NO: 67168 - DNA, 25 bp, Mus musculus
tgtccactgaaattcatcagctgca

SEQ ID NO: 67169 - DNA, 25 bp, Mus musculus
tgtccagaaaccagatcaagttatc

SEQ ID NO: 67170 - DNA, 25 bp, Mus musculus
tgtccagaagtggttgctccaaaat

SEQ ID NO: 67171 - DNA, 25 bp, Mus musculus
tgtccagcaccatttagagccaaca

SEQ ID NO: 67172 - DNA, 25 bp, Mus musculus
tgtccagcaggttaaccaggaaaag

SEQ ID NO: 67173 - DNA, 25 bp, Mus musculus
tgtccagcatcctgacccatgaatc

SEQ ID NO: 67174 - DNA, 25 bp, Mus musculus
tgtccagccaacaccacaggaaagt

SEQ ID NO: 67175 - DNA, 25 bp, Mus musculus
tgtccagccaactccacaggaaagt

SEQ ID NO: 67176 - DNA, 25 bp, Mus musculus
tgtccagccacctagacgaagtcgt

SEQ ID NO: 67177 - DNA, 25 bp, Mus musculus
tgtccagccttccttttggaggagt

SEQ ID NO: 67178 - DNA, 25 bp, Mus musculus
tgtccagctgctccaatgacagaga

SEQ ID NO: 67179 - DNA, 25 bp, Mus musculus
tgtccaggaactcattccataaacc

SEQ ID NO: 67180 - DNA, 25 bp, Mus musculus
tgtccaggctctgagggcagttccc

SEQ ID NO: 67181 - DNA, 25 bp, Mus musculus
tgtccaggtttattgctgctggaag

SEQ ID NO: 67182 - DNA, 25 bp, Mus musculus
tgtccaggtttctgcccattgcaga

SEQ ID NO: 67183 - DNA, 25 bp, Mus musculus
tgtccagtgattaacaggttaaggg

SEQ ID NO: 67184 - DNA, 25 bp, Mus musculus
tgtccagtgcagtgagcactactcg

SEQ ID NO: 67185 - DNA, 25 bp, Mus musculus
tgtccagtgtagagatgataaaatg

SEQ ID NO: 67186 - DNA, 25 bp, Mus musculus
tgtccatcctcaccatagcatgctg

SEQ ID NO: 67187 - DNA, 25 bp, Mus musculus
tgtccatcgtaaggagaatacaggg

SEQ ID NO: 67188 - DNA, 25 bp, Mus musculus
tgtccatcgtgtaccagagcagcga

SEQ ID NO: 67189 - DNA, 25 bp, Mus musculus
tgtccatctagaagggaagtttgag

SEQ ID NO: 67190 - DNA, 25 bp, Mus musculus
tgtccatcttcacatgtctcttcaa

SEQ ID NO: 67191 - DNA, 25 bp, Mus musculus
tgtccatcttcagatgtctcttcaa

SEQ ID NO: 67192 - DNA, 25 bp, Mus musculus
tgtccatcttttcggatatcatcgc

SEQ ID NO: 67193 - DNA, 25 bp, Mus musculus
tgtccatgaagcagctgctggactt

SEQ ID NO: 67194 - DNA, 25 bp, Mus musculus
tgtccatgaagctgctgctggactt

SEQ ID NO: 67195 - DNA, 25 bp, Mus musculus
tgtccatgcgatcgtgcctggagca

SEQ ID NO: 67196 - DNA, 25 bp, Mus musculus
tgtccatggaggtgcagacgtaagc

SEQ ID NO: 67197 - DNA, 25 bp, Mus musculus
tgtccatggatcaggtcaactggct

SEQ ID NO: 67198 - DNA, 25 bp, Mus musculus
tgtccatgttgtggccatctccttc

SEQ ID NO: 67199 - DNA, 25 bp, Mus musculus
tgtccattgggcatcacattcggga

SEQ ID NO: 67200 - DNA, 25 bp, Mus musculus
tgtcccaaataaagtgacagtatcc

SEQ ID NO: 67201 - DNA, 25 bp, Mus musculus
tgtcccaaataatgtgacagtatcc

SEQ ID NO: 67202 - DNA, 25 bp, Mus musculus
tgtcccacattggtgagcgcatggc

SEQ ID NO: 67203 - DNA, 25 bp, Mus musculus
tgtcccatttaagataggagacaaa

SEQ ID NO: 67204 - DNA, 25 bp, Mus musculus
tgtcccattttttgggcaaggaatg

SEQ ID NO: 67205 - DNA, 25 bp, Mus musculus
tgtccccaccaaatgactcatttag

SEQ ID NO: 67206 - DNA, 25 bp, Mus musculus
tgtccccaccaattgactcatttag

SEQ ID NO: 67207 - DNA, 25 bp, Mus musculus
tgtccccagccaagcgccgtggtag

SEQ ID NO: 67208 - DNA, 25 bp, Mus musculus
tgtccccaggatcatttctggcaag

SEQ ID NO: 67209 - DNA, 25 bp, Mus musculus
tgtccccaggtttgctgtacccgaa

SEQ ID NO: 67210 - DNA, 25 bp, Mus musculus
tgtccccatcagactacggtgactg

SEQ ID NO: 67211 - DNA, 25 bp, Mus musculus
tgtccccatgggaagaactgcactg

SEQ ID NO: 67212 - DNA, 25 bp, Mus musculus
tgtcccccaggaagaggatgcagag

SEQ ID NO: 67213 - DNA, 25 bp, Mus musculus
tgtccccgaggagcagatgaccttc

SEQ ID NO: 67214 - DNA, 25 bp, Mus musculus
tgtccccgctacacggcagtgctgg

SEQ ID NO: 67215 - DNA, 25 bp, Mus musculus
tgtcccctaaagctgggagcgcgtc

SEQ ID NO: 67216 - DNA, 25 bp, Mus musculus
tgtcccctaaaggtgggagcgcgtc

SEQ ID NO: 67217 - DNA, 25 bp, Mus musculus
tgtcccggatcactagaagaacctc

SEQ ID NO: 67218 - DNA, 25 bp, Mus musculus
tgtcccggccagagtataacttctt

SEQ ID NO: 67219 - DNA, 25 bp, Mus musculus
tgtcccgtgtgcatgcctgatatcc

SEQ ID NO: 67220 - DNA, 25 bp, Mus musculus
tgtccctatacgaggacctgtcagc

SEQ ID NO: 67221 - DNA, 25 bp, Mus musculus
tgtccctcggaaactgaagctccag

SEQ ID NO: 67222 - DNA, 25 bp, Mus musculus
tgtccctcggaatctgaagctccag

SEQ ID NO: 67223 - DNA, 25 bp, Mus musculus
tgtccctctggtgtgcagtactcgg

SEQ ID NO: 67224 - DNA, 25 bp, Mus musculus
tgtccctgagatcagcgtgaccacc

SEQ ID NO: 67225 - DNA, 25 bp, Mus musculus
tgtccctgattctgatgatattaag

SEQ ID NO: 67226 - DNA, 25 bp, Mus musculus
tgtccctgccttgcagataaccgtg

SEQ ID NO: 67227 - DNA, 25 bp, Mus musculus
tgtccctggagacctccttgcatga

SEQ ID NO: 67228 - DNA, 25 bp, Mus musculus
tgtccctggtatgtcagaactgagt

SEQ ID NO: 67229 - DNA, 25 bp, Mus musculus
tgtcccttaagtatgtccctgccgg

SEQ ID NO: 67230 - DNA, 25 bp, Mus musculus
tgtcccttgcactgaggtgcacaca

SEQ ID NO: 67231 - DNA, 25 bp, Mus musculus
tgtccgaggactgctcggctcctgt

SEQ ID NO: 67232 - DNA, 25 bp, Mus musculus
tgtccgaggcacaattcctgatatg

SEQ ID NO: 67233 - DNA, 25 bp, Mus musculus
tgtccgatgtctctatccattttct

SEQ ID NO: 67234 - DNA, 25 bp, Mus musculus
tgtccgatgtctgtatccattttct

SEQ ID NO: 67235 - DNA, 25 bp, Mus musculus
tgtccgcagagcagaaccttaaaag

SEQ ID NO: 67236 - DNA, 25 bp, Mus musculus
tgtccgcagcttttgaacgtctagt

SEQ ID NO: 67237 - DNA, 25 bp, Mus musculus
tgtccggaaagtacatcacagctct

SEQ ID NO: 67238 - DNA, 25 bp, Mus musculus
tgtccggaaccttcatagccaccgt

SEQ ID NO: 67239 - DNA, 25 bp, Mus musculus
tgtccgggccattggtgccgatccc

SEQ ID NO: 67240 - DNA, 25 bp, Mus musculus
tgtccggtacctgtggatgccagat

SEQ ID NO: 67241 - DNA, 25 bp, Mus musculus
tgtccggtgctggaatgggaccctc

SEQ ID NO: 67242 - DNA, 25 bp, Mus musculus
tgtccgtagtcttcatcacagatgg

SEQ ID NO: 67243 - DNA, 25 bp, Mus musculus
tgtccgtgactcagggatgatgtgc

SEQ ID NO: 67244 - DNA, 25 bp, Mus musculus
tgtccgtgtggcaccgggaaagtct

SEQ ID NO: 67245 - DNA, 25 bp, Mus musculus
tgtccgttttactctaggagtctgt

SEQ ID NO: 67246 - DNA, 25 bp, Mus musculus
tgtcctaaactcatggcacttgcgg

SEQ ID NO: 67247 - DNA, 25 bp, Mus musculus
tgtcctaaactcttggcacttgcgg

SEQ ID NO: 67248 - DNA, 25 bp, Mus musculus
tgtcctactcatgcagactctttga

SEQ ID NO: 67249 - DNA, 25 bp, Mus musculus
tgtcctaggaagaaagggagcgatt

SEQ ID NO: 67250 - DNA, 25 bp, Mus musculus
tgtcctatttgtgaccagggaggtg

SEQ ID NO: 67251 - DNA, 25 bp, Mus musculus
tgtcctcaaagcctttaccgtacct

SEQ ID NO: 67252 - DNA, 25 bp, Mus musculus
tgtcctcaacatcatggctgccaga

SEQ ID NO: 67253 - DNA, 25 bp, Mus musculus
tgtcctcaccctggctgtggcaaga

SEQ ID NO: 67254 - DNA, 25 bp, Mus musculus
tgtcctcagagcatgtggtcaccta

SEQ ID NO: 67255 - DNA, 25 bp, Mus musculus
tgtcctccattgtgatgaaggcaga

SEQ ID NO: 67256 - DNA, 25 bp, Mus musculus
tgtcctccccatatgctacctgaag

SEQ ID NO: 67257 - DNA, 25 bp, Mus musculus
tgtcctcccttaaacatggcctctt

SEQ ID NO: 67258 - DNA, 25 bp, Mus musculus
tgtcctcgagctcatggagcgccac

SEQ ID NO: 67259 - DNA, 25 bp, Mus musculus
tgtcctctcagtgcaagacccggat

SEQ ID NO: 67260 - DNA, 25 bp, Mus musculus
tgtcctctctcaaaagtgccagccg

SEQ ID NO: 67261 - DNA, 25 bp, Mus musculus
tgtcctctgggttcttataggatgt

SEQ ID NO: 67262 - DNA, 25 bp, Mus musculus
tgtcctgaaacaaggcttctgtaag

SEQ ID NO: 67263 - DNA, 25 bp, Mus musculus
tgtcctgaagagcacctgagctttc

SEQ ID NO: 67264 - DNA, 25 bp, Mus musculus
tgtcctgaaggacaggttttctgtc

SEQ ID NO: 67265 - DNA, 25 bp, Mus musculus
tgtcctgactaactgtgcatctccg

SEQ ID NO: 67266 - DNA, 25 bp, Mus musculus
tgtcctgactggaatctgctgtgtg

SEQ ID NO: 67267 - DNA, 25 bp, Mus musculus
tgtcctgagctgaagatgttcccag

SEQ ID NO: 67268 - DNA, 25 bp, Mus musculus
tgtcctgatcagcaggtcccaagat

SEQ ID NO: 67269 - DNA, 25 bp, Mus musculus
tgtcctgatgctacccctgctgctg

SEQ ID NO: 67270 - DNA, 25 bp, Mus musculus
tgtcctgcacctagctgccaaagaa

SEQ ID NO: 67271 - DNA, 25 bp, Mus musculus
tgtcctgcacctgtcctgcagaggg

SEQ ID NO: 67272 - DNA, 25 bp, Mus musculus
tgtcctgcacgaagtcacttaaccc

SEQ ID NO: 67273 - DNA, 25 bp, Mus musculus
tgtcctgcactcaattgcaatgaca

SEQ ID NO: 67274 - DNA, 25 bp, Mus musculus
tgtcctgctggctgagatctctggg

SEQ ID NO: 67275 - DNA, 25 bp, Mus musculus
tgtcctggaaaatcggaggaaaaat

SEQ ID NO: 67276 - DNA, 25 bp, Mus musculus
tgtcctggacattgccggctttgag

SEQ ID NO: 67277 - DNA, 25 bp, Mus musculus
tgtcctggagaagcatcgggaatca

SEQ ID NO: 67278 - DNA, 25 bp, Mus musculus
tgtcctggagtgtcctttttggtgc

SEQ ID NO: 67279 - DNA, 25 bp, Mus musculus
tgtcctggagttccgatttgaatac

SEQ ID NO: 67280 - DNA, 25 bp, Mus musculus
tgtcctgggagaacgccccgaagta

SEQ ID NO: 67281 - DNA, 25 bp, Mus musculus
tgtcctgggcctcctacatgaagag

SEQ ID NO: 67282 - DNA, 25 bp, Mus musculus
tgtcctggtggaagatacctgtctg

SEQ ID NO: 67283 - DNA, 25 bp, Mus musculus
tgtcctggttcggtgtcctgagctg

SEQ ID NO: 67284 - DNA, 25 bp, Mus musculus
tgtcctgtggcacattaacaaaaca

SEQ ID NO: 67285 - DNA, 25 bp, Mus musculus
tgtcctgtggcagattaacaaaaca

SEQ ID NO: 67286 - DNA, 25 bp, Mus musculus
tgtcctgtgtgactctccatatcaa

SEQ ID NO: 67287 - DNA, 25 bp, Mus musculus
tgtcctgtttttccataccatgcgt

SEQ ID NO: 67288 - DNA, 25 bp, Mus musculus
tgtccttcactctgtccgctgcagg

SEQ ID NO: 67289 - DNA, 25 bp, Mus musculus
tgtccttcagcattgctgctcctag

SEQ ID NO: 67290 - DNA, 25 bp, Mus musculus
tgtccttcatcaactacctctgcta

SEQ ID NO: 67291 - DNA, 25 bp, Mus musculus
tgtccttcgagataccactgcagcc

SEQ ID NO: 67292 - DNA, 25 bp, Mus musculus
tgtccttctacaggaagtgttccgt

SEQ ID NO: 67293 - DNA, 25 bp, Mus musculus
tgtccttcttaataatgggtttcca

SEQ ID NO: 67294 - DNA, 25 bp, Mus musculus
tgtccttcttggaggaacatctggg

SEQ ID NO: 67295 - DNA, 25 bp, Mus musculus
tgtccttgaactgaacactgcaaag

SEQ ID NO: 67296 - DNA, 25 bp, Mus musculus
tgtccttgccacgttacttttgttg

SEQ ID NO: 67297 - DNA, 25 bp, Mus musculus
tgtccttgcctttagtatgggctca

SEQ ID NO: 67298 - DNA, 25 bp, Mus musculus
tgtccttgtcaatggattggtccac

SEQ ID NO: 67299 - DNA, 25 bp, Mus musculus
tgtccttgttggcatgggtcagatc

SEQ ID NO: 67300 - DNA, 25 bp, Mus musculus
tgtcctttcaatggccccattaagg

SEQ ID NO: 67301 - DNA, 25 bp, Mus musculus
tgtcctttgtctagaatgaatcgca

SEQ ID NO: 67302 - DNA, 25 bp, Mus musculus
tgtcctttgtcttgaatgaatcgca

SEQ ID NO: 67303 - DNA, 25 bp, Mus musculus
tgtccttttaggatgcggccttggc

SEQ ID NO: 67304 - DNA, 25 bp, Mus musculus
tgtccttttctgtgttacagtgccc

SEQ ID NO: 67305 - DNA, 25 bp, Mus musculus
tgtcgaagagcttggctttgagcga

SEQ ID NO: 67306 - DNA, 25 bp, Mus musculus
tgtcgaaggtggagaggccctttac

SEQ ID NO: 67307 - DNA, 25 bp, Mus musculus
tgtcgaagtggccagattttgagct

SEQ ID NO: 67308 - DNA, 25 bp, Mus musculus
tgtcgaatctgcgagaagggtagac

SEQ ID NO: 67309 - DNA, 25 bp, Mus musculus
tgtcgacactggatcctcacaggaa

SEQ ID NO: 67310 - DNA, 25 bp, Mus musculus
tgtcgacctgtctgcatttggcttg

SEQ ID NO: 67311 - DNA, 25 bp, Mus musculus
tgtcgactccgtgtggagttcccca

SEQ ID NO: 67312 - DNA, 25 bp, Mus musculus
tgtcgactgggatgtccaccatggc

SEQ ID NO: 67313 - DNA, 25 bp, Mus musculus
tgtcgaggaattatcactgaaataa

SEQ ID NO: 67314 - DNA, 25 bp, Mus musculus
tgtcgataacgctcgtgggcagcca

SEQ ID NO: 67315 - DNA, 25 bp, Mus musculus
tgtcgatgatccgaagattcctcag

SEQ ID NO: 67316 - DNA, 25 bp, Mus musculus
tgtcgatgctatccccattgtggcg

SEQ ID NO: 67317 - DNA, 25 bp, Mus musculus
tgtcgcaattcacatactgagtttt

SEQ ID NO: 67318 - DNA, 25 bp, Mus musculus
tgtcgcagagatgaaccccaatgta

SEQ ID NO: 67319 - DNA, 25 bp, Mus musculus
tgtcgccaaagcaaggtatccatct

SEQ ID NO: 67320 - DNA, 25 bp, Mus musculus
tgtcgccaacgtcatccgaggctga

SEQ ID NO: 67321 - DNA, 25 bp, Mus musculus
tgtcgcccacgtgacaaaagtgcag

SEQ ID NO: 67322 - DNA, 25 bp, Mus musculus
tgtcgccgcacatcaagtcagttga

SEQ ID NO: 67323 - DNA, 25 bp, Mus musculus
tgtcgcctcgtgctcgtcacatctg

SEQ ID NO: 67324 - DNA, 25 bp, Mus musculus
tgtcgccttcttcttctgcatcctg

SEQ ID NO: 67325 - DNA, 25 bp, Mus musculus
tgtcgcgtcgcctgatcctgttcaa

SEQ ID NO: 67326 - DNA, 25 bp, Mus musculus
tgtcgctaacaagggactactgcac

SEQ ID NO: 67327 - DNA, 25 bp, Mus musculus
tgtcgctaaccatggcgtctggaga

SEQ ID NO: 67328 - DNA, 25 bp, Mus musculus
tgtcgctgttcgttggaggcacgct

SEQ ID NO: 67329 - DNA, 25 bp, Mus musculus
tgtcggaattcagcaaagcccaggt

SEQ ID NO: 67330 - DNA, 25 bp, Mus musculus
tgtcggacggccaaagcacatgcgg

SEQ ID NO: 67331 - DNA, 25 bp, Mus musculus
tgtcggagacgcaggctaaaagcaa

SEQ ID NO: 67332 - DNA, 25 bp, Mus musculus
tgtcggaggccattgggtaacaaca

SEQ ID NO: 67333 - DNA, 25 bp, Mus musculus
tgtcggcacagttaccaaaaccgag

SEQ ID NO: 67334 - DNA, 25 bp, Mus musculus
tgtcggcctgcagatttcaagatgg

SEQ ID NO: 67335 - DNA, 25 bp, Mus musculus
tgtcggctgccctgcgagcttccag

SEQ ID NO: 67336 - DNA, 25 bp, Mus musculus
tgtcgggccaggctgccaagaaaaa

SEQ ID NO: 67337 - DNA, 25 bp, Mus musculus
tgtcgtaactggctgaagactggca

SEQ ID NO: 67338 - DNA, 25 bp, Mus musculus
tgtcgtaggcatccccgtgaccgaa

SEQ ID NO: 67339 - DNA, 25 bp, Mus musculus
tgtcgtatagactagaagacttatc

SEQ ID NO: 67340 - DNA, 25 bp, Mus musculus
tgtcgtcactgtggcctttgttcag

SEQ ID NO: 67341 - DNA, 25 bp, Mus musculus
tgtcgtccgcacagatcgtctcggc

SEQ ID NO: 67342 - DNA, 25 bp, Mus musculus
tgtcgtcctgtcgagtggataagcc

SEQ ID NO: 67343 - DNA, 25 bp, Mus musculus
tgtcgtcgctacatattctgcattt

SEQ ID NO: 67344 - DNA, 25 bp, Mus musculus
tgtcgtcgctacttattctgcattt

SEQ ID NO: 67345 - DNA, 25 bp, Mus musculus
tgtcgtcttgggaaaagaagacctt

SEQ ID NO: 67346 - DNA, 25 bp, Mus musculus
tgtcgtcttgggtaaagaagacctt

SEQ ID NO: 67347 - DNA, 25 bp, Mus musculus
tgtcgtctttctgattctccagaag

SEQ ID NO: 67348 - DNA, 25 bp, Mus musculus
tgtcgtgagttcaccacacatgtca

SEQ ID NO: 67349 - DNA, 25 bp, Mus musculus
tgtcgttgcatccttcagagggcca

SEQ ID NO: 67350 - DNA, 25 bp, Mus musculus
tgtcgtttatccgagacagcctgga

SEQ ID NO: 67351 - DNA, 25 bp, Mus musculus
tgtcgtttgaccaggccaataacct

SEQ ID NO: 67352 - DNA, 25 bp, Mus musculus
tgtctaaaccaacagatgcttatta

SEQ ID NO: 67353 - DNA, 25 bp, Mus musculus
tgtctaaaccaagagatgcttatta

SEQ ID NO: 67354 - DNA, 25 bp, Mus musculus
tgtctaacaagcacccgtttgtgga

SEQ ID NO: 67355 - DNA, 25 bp, Mus musculus
tgtctaactcctttctcaaccggca

SEQ ID NO: 67356 - DNA, 25 bp, Mus musculus
tgtctaagggacacatgttggcaga

SEQ ID NO: 67357 - DNA, 25 bp, Mus musculus
tgtctaatgggaaagtccatgttgc

SEQ ID NO: 67358 - DNA, 25 bp, Mus musculus
tgtctaatgggttttctcactgtag

SEQ ID NO: 67359 - DNA, 25 bp, Mus musculus
tgtctacagtctgagaagacagctg

SEQ ID NO: 67360 - DNA, 25 bp, Mus musculus
tgtctaccaagaactgacccagttg

SEQ ID NO: 67361 - DNA, 25 bp, Mus musculus
tgtctaccactacaatggattgaag

SEQ ID NO: 67362 - DNA, 25 bp, Mus musculus
tgtctaccagcgctggcagaatgag

SEQ ID NO: 67363 - DNA, 25 bp, Mus musculus
tgtctacctattatcctgatgccac

SEQ ID NO: 67364 - DNA, 25 bp, Mus musculus
tgtctacctggctgacctcctgatg

SEQ ID NO: 67365 - DNA, 25 bp, Mus musculus
tgtctactggacagcacctgcaatt

SEQ ID NO: 67366 - DNA, 25 bp, Mus musculus
tgtctactggactgcacctgcaatt

SEQ ID NO: 67367 - DNA, 25 bp, Mus musculus
tgtctaggagctggcatgatgtgca

SEQ ID NO: 67368 - DNA, 25 bp, Mus musculus
tgtctagtgacaatgccagagcaga

SEQ ID NO: 67369 - DNA, 25 bp, Mus musculus
tgtctagtgacattgccagagcaga

SEQ ID NO: 67370 - DNA, 25 bp, Mus musculus
tgtctatagagaagatttgggcccg

SEQ ID NO: 67371 - DNA, 25 bp, Mus musculus
tgtctatatagctgaattgctggct

SEQ ID NO: 67372 - DNA, 25 bp, Mus musculus
tgtctatgctgtcccctcgccttac

SEQ ID NO: 67373 - DNA, 25 bp, Mus musculus
tgtctatgttgtacagcctgttcca

SEQ ID NO: 67374 - DNA, 25 bp, Mus musculus
tgtctcaaaccaggtgaaaaagtca

SEQ ID NO: 67375 - DNA, 25 bp, Mus musculus
tgtctcaagaaagagagtctaccat

SEQ ID NO: 67376 - DNA, 25 bp, Mus musculus
tgtctcaatccatagaagtcttgga

SEQ ID NO: 67377 - DNA, 25 bp, Mus musculus
tgtctcagagccagcagagtctctg

SEQ ID NO: 67378 - DNA, 25 bp, Mus musculus
tgtctcagcaacagtatttacagga

SEQ ID NO: 67379 - DNA, 25 bp, Mus musculus
tgtctcagccaatgccgtgcggcgg

SEQ ID NO: 67380 - DNA, 25 bp, Mus musculus
tgtctcagcccatttctcagcatgg

SEQ ID NO: 67381 - DNA, 25 bp, Mus musculus
tgtctcatcatatgggccgcctgtg

SEQ ID NO: 67382 - DNA, 25 bp, Mus musculus
tgtctcatgccccagcttagagtgc

SEQ ID NO: 67383 - DNA, 25 bp, Mus musculus
tgtctccaacgacagtggcatctac

SEQ ID NO: 67384 - DNA, 25 bp, Mus musculus
tgtctccagcatcaggcttccagag

SEQ ID NO: 67385 - DNA, 25 bp, Mus musculus
tgtctccagccactatatcgaagag

SEQ ID NO: 67386 - DNA, 25 bp, Mus musculus
tgtctccaggatatcttggctaatg

SEQ ID NO: 67387 - DNA, 25 bp, Mus musculus
tgtctccagtgcaagtaggatgttt

SEQ ID NO: 67388 - DNA, 25 bp, Mus musculus
tgtctcccagcgtgggtaccaagaa

SEQ ID NO: 67389 - DNA, 25 bp, Mus musculus
tgtctcccaggaccaggtgacctgt

SEQ ID NO: 67390 - DNA, 25 bp, Mus musculus
tgtctcccagtatggccaaaaagca

SEQ ID NO: 67391 - DNA, 25 bp, Mus musculus
tgtctcccagttgtggccagctttg

SEQ ID NO: 67392 - DNA, 25 bp, Mus musculus
tgtctcccggcctcgtgtgatcatc

SEQ ID NO: 67393 - DNA, 25 bp, Mus musculus
tgtctccgagtgagcggcaatgtgt

SEQ ID NO: 67394 - DNA, 25 bp, Mus musculus
tgtctccgttacagtcagtttcaga

SEQ ID NO: 67395 - DNA, 25 bp, Mus musculus
tgtctcctcatgactttgtcactcg

SEQ ID NO: 67396 - DNA, 25 bp, Mus musculus
tgtctcctgtccatggtggatgagg

SEQ ID NO: 67397 - DNA, 25 bp, Mus musculus
tgtctcgcacctttgttgtcagcag

SEQ ID NO: 67398 - DNA, 25 bp, Mus musculus
tgtctcgctgcttgagaaagccgcc

SEQ ID NO: 67399 - DNA, 25 bp, Mus musculus
tgtctcggacacacaggcatctcct

SEQ ID NO: 67400 - DNA, 25 bp, Mus musculus
tgtctcgtaatctacttaaggacca

SEQ ID NO: 67401 - DNA, 25 bp, Mus musculus
tgtctcgtgctcaactggaacagga

SEQ ID NO: 67402 - DNA, 25 bp, Mus musculus
tgtctcgttcgatccagttttctgg

SEQ ID NO: 67403 - DNA, 25 bp, Mus musculus
tgtctctactacaggatcaagtaga

SEQ ID NO: 67404 - DNA, 25 bp, Mus musculus
tgtctctatccaacgctgtggcgag

SEQ ID NO: 67405 - DNA, 25 bp, Mus musculus
tgtctctatccatcgctgtggcgag

SEQ ID NO: 67406 - DNA, 25 bp, Mus musculus
tgtctctctccaaaggcctcttaga

SEQ ID NO: 67407 - DNA, 25 bp, Mus musculus
tgtctctctccttcatcctgtgagg

SEQ ID NO: 67408 - DNA, 25 bp, Mus musculus
tgtctctgaatgtgaaagggccatg

SEQ ID NO: 67409 - DNA, 25 bp, Mus musculus
tgtctctgccaggaagtcacgctga

SEQ ID NO: 67410 - DNA, 25 bp, Mus musculus
tgtctctggacaaatcacctatgtg

SEQ ID NO: 67411 - DNA, 25 bp, Mus musculus
tgtctcttcagagacccatgcctgg

SEQ ID NO: 67412 - DNA, 25 bp, Mus musculus
tgtctcttcggagccttggcagtca

SEQ ID NO: 67413 - DNA, 25 bp, Mus musculus
tgtctgaagaagtatgaaactgtgc

SEQ ID NO: 67414 - DNA, 25 bp, Mus musculus
tgtctgaagacaaaaaggcctgcga

SEQ ID NO: 67415 - DNA, 25 bp, Mus musculus
tgtctgacaacatgcaccatcagtg

SEQ ID NO: 67416 - DNA, 25 bp, Mus musculus
tgtctgactatgaagtatgcaaaga

SEQ ID NO: 67417 - DNA, 25 bp, Mus musculus
tgtctgagaaactgtctgagcaaga

SEQ ID NO: 67418 - DNA, 25 bp, Mus musculus
tgtctgagactctaccaagtggttc

SEQ ID NO: 67419 - DNA, 25 bp, Mus musculus
tgtctgagactgacatcggagccag

SEQ ID NO: 67420 - DNA, 25 bp, Mus musculus
tgtctgagactgagcgggaagacct

SEQ ID NO: 67421 - DNA, 25 bp, Mus musculus
tgtctgagattgttcccgagcactg

SEQ ID NO: 67422 - DNA, 25 bp, Mus musculus
tgtctgagcaccttcatgagtggat

SEQ ID NO: 67423 - DNA, 25 bp, Mus musculus
tgtctgagctcagcgatgaagccag

SEQ ID NO: 67424 - DNA, 25 bp, Mus musculus
tgtctgataaacatctaccctaagt

SEQ ID NO: 67425 - DNA, 25 bp, Mus musculus
tgtctgatccacatattcaaatctg

SEQ ID NO: 67426 - DNA, 25 bp, Mus musculus
tgtctgatgaggagatcaaaaagaa

SEQ ID NO: 67427 - DNA, 25 bp, Mus musculus
tgtctgcaatcctgaaccgtgtgtg

SEQ ID NO: 67428 - DNA, 25 bp, Mus musculus
tgtctgcacgtagctcagaaaccag

SEQ ID NO: 67429 - DNA, 25 bp, Mus musculus
tgtctgcagcaggaataggccttct

SEQ ID NO: 67430 - DNA, 25 bp, Mus musculus
tgtctgccagacaatgctgttgaaa

SEQ ID NO: 67431 - DNA, 25 bp, Mus musculus
tgtctgccaggcactcaagcagctg

SEQ ID NO: 67432 - DNA, 25 bp, Mus musculus
tgtctgccatgtggatgcccctggc

SEQ ID NO: 67433 - DNA, 25 bp, Mus musculus
tgtctgcccactgaatagtaatcac

SEQ ID NO: 67434 - DNA, 25 bp, Mus musculus
tgtctgcccagttgttacaacaccc

SEQ ID NO: 67435 - DNA, 25 bp, Mus musculus
tgtctgcccgcctgactgatcttga

SEQ ID NO: 67436 - DNA, 25 bp, Mus musculus
tgtctgccggtgagacctcatctgt

SEQ ID NO: 67437 - DNA, 25 bp, Mus musculus
tgtctgccgttgtctatattacagt

SEQ ID NO: 67438 - DNA, 25 bp, Mus musculus
tgtctgccttattgggcagaatccc

SEQ ID NO: 67439 - DNA, 25 bp, Mus musculus
tgtctgctgggctcttccacagagc

SEQ ID NO: 67440 - DNA, 25 bp, Mus musculus
tgtctgctggtaggacatcatgttc

SEQ ID NO: 67441 - DNA, 25 bp, Mus musculus
tgtctgctgtccacttgtcgccttc

SEQ ID NO: 67442 - DNA, 25 bp, Mus musculus
tgtctgcttcggctggagcccaatg

SEQ ID NO: 67443 - DNA, 25 bp, Mus musculus
tgtctggaggagactgtgtgataaa

SEQ ID NO: 67444 - DNA, 25 bp, Mus musculus
tgtctggatgatccaccaggtccat

SEQ ID NO: 67445 - DNA, 25 bp, Mus musculus
tgtctggatttggaatgaacaggaa

SEQ ID NO: 67446 - DNA, 25 bp, Mus musculus
tgtctggcagtaccatcagtctgga

SEQ ID NO: 67447 - DNA, 25 bp, Mus musculus
tgtctggccttacatcaggatgtcc

SEQ ID NO: 67448 - DNA, 25 bp, Mus musculus
tgtctggctgccttataagaggatt

SEQ ID NO: 67449 - DNA, 25 bp, Mus musculus
tgtctgggaaaacaattcaggattt

SEQ ID NO: 67450 - DNA, 25 bp, Mus musculus
tgtctgggaatattccagccctaga

SEQ ID NO: 67451 - DNA, 25 bp, Mus musculus
tgtctgggtcctggaccggtgatct

SEQ ID NO: 67452 - DNA, 25 bp, Mus musculus
tgtctggtgagaaggttcgcaccac

SEQ ID NO: 67453 - DNA, 25 bp, Mus musculus
tgtctgtaactgactggactgtggc

SEQ ID NO: 67454 - DNA, 25 bp, Mus musculus
tgtctgtcatcaatagtactactgc

SEQ ID NO: 67455 - DNA, 25 bp, Mus musculus
tgtctgtccgcagctcgcagtggtc

SEQ ID NO: 67456 - DNA, 25 bp, Mus musculus
tgtctgtgaccggtcagcaaggcct

SEQ ID NO: 67457 - DNA, 25 bp, Mus musculus
tgtctgtgcttcatggaattgccaa

SEQ ID NO: 67458 - DNA, 25 bp, Mus musculus
tgtctgtgcttcttggaattgccaa

SEQ ID NO: 67459 - DNA, 25 bp, Mus musculus
tgtctgtgcttggaggctgttgctt

SEQ ID NO: 67460 - DNA, 25 bp, Mus musculus
tgtctgtggcctcccagagatgtcc

SEQ ID NO: 67461 - DNA, 25 bp, Mus musculus
tgtctgtgtccgctttggcctcgac

SEQ ID NO: 67462 - DNA, 25 bp, Mus musculus
tgtctgtgtccggtttggcctcgac

SEQ ID NO: 67463 - DNA, 25 bp, Mus musculus
tgtctgttctcactcatcaacggag

SEQ ID NO: 67464 - DNA, 25 bp, Mus musculus
tgtctgttgatggacttctcagttg

SEQ ID NO: 67465 - DNA, 25 bp, Mus musculus
tgtctgttgctggaaattgcaggat

SEQ ID NO: 67466 - DNA, 25 bp, Mus musculus
tgtctgttgggtcctcagggacacc

SEQ ID NO: 67467 - DNA, 25 bp, Mus musculus
tgtcttaaggcatcgtctctttcaa

SEQ ID NO: 67468 - DNA, 25 bp, Mus musculus
tgtcttaagggcattatctactaca

SEQ ID NO: 67469 - DNA, 25 bp, Mus musculus
tgtcttacacttagccatcatccac

SEQ ID NO: 67470 - DNA, 25 bp, Mus musculus
tgtcttacatgaaaagcatcagtag

SEQ ID NO: 67471 - DNA, 25 bp, Mus musculus
tgtcttacatgataagcatcagtag

SEQ ID NO: 67472 - DNA, 25 bp, Mus musculus
tgtcttaccactgagtggaagatgg

SEQ ID NO: 67473 - DNA, 25 bp, Mus musculus
tgtcttatacaacgacagtgtggag

SEQ ID NO: 67474 - DNA, 25 bp, Mus musculus
tgtcttatacaaggacagtgtggag

SEQ ID NO: 67475 - DNA, 25 bp, Mus musculus
tgtcttattcatcaactggagtata

SEQ ID NO: 67476 - DNA, 25 bp, Mus musculus
tgtcttattcgccccttcccggaag

SEQ ID NO: 67477 - DNA, 25 bp, Mus musculus
tgtcttcaaagatggcttcaacccg

SEQ ID NO: 67478 - DNA, 25 bp, Mus musculus
tgtcttcaagaagtcccaaagattt

SEQ ID NO: 67479 - DNA, 25 bp, Mus musculus
tgtcttcagtggcatccgttgctag

SEQ ID NO: 67480 - DNA, 25 bp, Mus musculus
tgtcttccctcagcagtcggatggg

SEQ ID NO: 67481 - DNA, 25 bp, Mus musculus
tgtcttcgccattcagtacagtgcc

SEQ ID NO: 67482 - DNA, 25 bp, Mus musculus
tgtcttctaaaacagcaagagaaga

SEQ ID NO: 67483 - DNA, 25 bp, Mus musculus
tgtcttctagacaggtagttgaatc

SEQ ID NO: 67484 - DNA, 25 bp, Mus musculus
tgtcttctcagaatgctccccgggt

SEQ ID NO: 67485 - DNA, 25 bp, Mus musculus
tgtcttctctacaccaggactggct

SEQ ID NO: 67486 - DNA, 25 bp, Mus musculus
tgtcttctgacacacttctgcagca

SEQ ID NO: 67487 - DNA, 25 bp, Mus musculus
tgtcttctggacatcgccccgcatg

SEQ ID NO: 67488 - DNA, 25 bp, Mus musculus
tgtcttctggtgtcattaacggacc

SEQ ID NO: 67489 - DNA, 25 bp, Mus musculus
tgtcttctgtagtattaccaggagt

SEQ ID NO: 67490 - DNA, 25 bp, Mus musculus
tgtcttgcctaccattcaaaacacg

SEQ ID NO: 67491 - DNA, 25 bp, Mus musculus
tgtcttggataaagagttccatcct

SEQ ID NO: 67492 - DNA, 25 bp, Mus musculus
tgtcttgggcggtatggcaacactc

SEQ ID NO: 67493 - DNA, 25 bp, Mus musculus
tgtcttgggtggtcaacacgttctc

SEQ ID NO: 67494 - DNA, 25 bp, Mus musculus
tgtcttgtcattgccctgtgtcatg

SEQ ID NO: 67495 - DNA, 25 bp, Mus musculus
tgtctttacactaacaacggccgtg

SEQ ID NO: 67496 - DNA, 25 bp, Mus musculus
tgtctttacacttacaacggccgtg

SEQ ID NO: 67497 - DNA, 25 bp, Mus musculus
tgtctttatacactgctctcaccac

SEQ ID NO: 67498 - DNA, 25 bp, Mus musculus
tgtctttcacctcccaattccaaag

SEQ ID NO: 67499 - DNA, 25 bp, Mus musculus
tgtctttctgcttgactgaactaca

SEQ ID NO: 67500 - DNA, 25 bp, Mus musculus
tgtctttcttcgctcccttcaatgg

SEQ ID NO: 67501 - DNA, 25 bp, Mus musculus
tgtctttgccatgaaacagaggaca

SEQ ID NO: 67502 - DNA, 25 bp, Mus musculus
tgtctttggactgactatcttttgg

SEQ ID NO: 67503 - DNA, 25 bp, Mus musculus
tgtctttggtgctgagaaatcaccc

SEQ ID NO: 67504 - DNA, 25 bp, Mus musculus
tgtgaaaaaactccgctcttccgtc

SEQ ID NO: 67505 - DNA, 25 bp, Mus musculus
tgtgaaaccagacctcatcgatgtt

SEQ ID NO: 67506 - DNA, 25 bp, Mus musculus
tgtgaaaccattgtctggaaggcct

SEQ ID NO: 67507 - DNA, 25 bp, Mus musculus
tgtgaaacgacaaagagcaggcacc

SEQ ID NO: 67508 - DNA, 25 bp, Mus musculus
tgtgaaactggctgtaactgttctc

SEQ ID NO: 67509 - DNA, 25 bp, Mus musculus
tgtgaaaggccgtacttggaccttg

SEQ ID NO: 67510 - DNA, 25 bp, Mus musculus
tgtgaacacagaaggctccttccat

SEQ ID NO: 67511 - DNA, 25 bp, Mus musculus
tgtgaacacagatggctccttccat

SEQ ID NO: 67512 - DNA, 25 bp, Mus musculus
tgtgaacacatctcctagaaagcag

SEQ ID NO: 67513 - DNA, 25 bp, Mus musculus
tgtgaacaccgggaaactggagacc

SEQ ID NO: 67514 - DNA, 25 bp, Mus musculus
tgtgaacacgccaggttccttccaa

SEQ ID NO: 67515 - DNA, 25 bp, Mus musculus
tgtgaacacgctccatttctgccca

SEQ ID NO: 67516 - DNA, 25 bp, Mus musculus
tgtgaacatggctacgcctcatcgt

SEQ ID NO: 67517 - DNA, 25 bp, Mus musculus
tgtgaaccacaacaataacccgtat

SEQ ID NO: 67518 - DNA, 25 bp, Mus musculus
tgtgaacgagtgagaagacttgaac

SEQ ID NO: 67519 - DNA, 25 bp, Mus musculus
tgtgaacgagtgtgaagacttgaac

SEQ ID NO: 67520 - DNA, 25 bp, Mus musculus
tgtgaacgctaatgcacccagagag

SEQ ID NO: 67521 - DNA, 25 bp, Mus musculus
tgtgaacggcactacaatcgaagga

SEQ ID NO: 67522 - DNA, 25 bp, Mus musculus
tgtgaactgcttcttattggagagg

SEQ ID NO: 67523 - DNA, 25 bp, Mus musculus
tgtgaacttggacaactctgtggtg

SEQ ID NO: 67524 - DNA, 25 bp, Mus musculus
tgtgaacttgtaccacgagctgatg

SEQ ID NO: 67525 - DNA, 25 bp, Mus musculus
tgtgaacttttccagattacaacag

SEQ ID NO: 67526 - DNA, 25 bp, Mus musculus
tgtgaagaaggagactagtgtagac

SEQ ID NO: 67527 - DNA, 25 bp, Mus musculus
tgtgaagacttgaacgggcctgcag

SEQ ID NO: 67528 - DNA, 25 bp, Mus musculus
tgtgaagacttgtacgggcctgcag

SEQ ID NO: 67529 - DNA, 25 bp, Mus musculus
tgtgaagagactcctgcagaatccg

SEQ ID NO: 67530 - DNA, 25 bp, Mus musculus
tgtgaagagataccagtgccaggcc

SEQ ID NO: 67531 - DNA, 25 bp, Mus musculus
tgtgaagagatagcagtgccaggcc

SEQ ID NO: 67532 - DNA, 25 bp, Mus musculus
tgtgaagagtcaagcagacatctct

SEQ ID NO: 67533 - DNA, 25 bp, Mus musculus
tgtgaagatcctagtttccaatggc

SEQ ID NO: 67534 - DNA, 25 bp, Mus musculus
tgtgaagattgctcccggagcagta

SEQ ID NO: 67535 - DNA, 25 bp, Mus musculus
tgtgaagccacgttcccttctagac

SEQ ID NO: 67536 - DNA, 25 bp, Mus musculus
tgtgaagccctgatacaactattgc

SEQ ID NO: 67537 - DNA, 25 bp, Mus musculus
tgtgaagccctgttacaactattgc

SEQ ID NO: 67538 - DNA, 25 bp, Mus musculus
tgtgaagcctccagcaaacaagtac

SEQ ID NO: 67539 - DNA, 25 bp, Mus musculus
tgtgaagcgatagcccgtaaccctc

SEQ ID NO: 67540 - DNA, 25 bp, Mus musculus
tgtgaagctcgttgcagatttccga

SEQ ID NO: 67541 - DNA, 25 bp, Mus musculus
tgtgaagctcttggaacagtttgtc

SEQ ID NO: 67542 - DNA, 25 bp, Mus musculus
tgtgaagctgccagaaaccagtctc

SEQ ID NO: 67543 - DNA, 25 bp, Mus musculus
tgtgaagctgcgactgctgtgtagc

SEQ ID NO: 67544 - DNA, 25 bp, Mus musculus
tgtgaaggacacagaccgcatggta

SEQ ID NO: 67545 - DNA, 25 bp, Mus musculus
tgtgaaggccagaagtaggtatttg

SEQ ID NO: 67546 - DNA, 25 bp, Mus musculus
tgtgaagggacagtgctgctctcag

SEQ ID NO: 67547 - DNA, 25 bp, Mus musculus
tgtgaagtcctctctggccacacgg

SEQ ID NO: 67548 - DNA, 25 bp, Mus musculus
tgtgaatatcagcagtgcccttcgg

SEQ ID NO: 67549 - DNA, 25 bp, Mus musculus
tgtgaatatcaggagtgcccttcgg

SEQ ID NO: 67550 - DNA, 25 bp, Mus musculus
tgtgaatattctcttggactgaccc

SEQ ID NO: 67551 - DNA, 25 bp, Mus musculus
tgtgaatcccgtggacattgtcagc

SEQ ID NO: 67552 - DNA, 25 bp, Mus musculus
tgtgaatccgttaagtggactctcc

SEQ ID NO: 67553 - DNA, 25 bp, Mus musculus
tgtgaatctgaagaacggaagtggc

SEQ ID NO: 67554 - DNA, 25 bp, Mus musculus
tgtgaatgacagaggtggtgccttc

SEQ ID NO: 67555 - DNA, 25 bp, Mus musculus
tgtgaatgacatagacatctttgag

SEQ ID NO: 67556 - DNA, 25 bp, Mus musculus
tgtgaatgagcacagtgtacactgt

SEQ ID NO: 67557 - DNA, 25 bp, Mus musculus
tgtgaatgagtgcatctccgggcaa

SEQ ID NO: 67558 - DNA, 25 bp, Mus musculus
tgtgaatgagtgtcaagatactacc

SEQ ID NO: 67559 - DNA, 25 bp, Mus musculus
tgtgaatgatctaacagttcaccgg

SEQ ID NO: 67560 - DNA, 25 bp, Mus musculus
tgtgaatgatgatcgccacgtgatg

SEQ ID NO: 67561 - DNA, 25 bp, Mus musculus
tgtgaatgtgtacaatgacactcag

SEQ ID NO: 67562 - DNA, 25 bp, Mus musculus
tgtgaattggagaatcaagagacac

SEQ ID NO: 67563 - DNA, 25 bp, Mus musculus
tgtgaatttcgactttctcggagtc

SEQ ID NO: 67564 - DNA, 25 bp, Mus musculus
tgtgaatttggctccatgaagtatt

SEQ ID NO: 67565 - DNA, 25 bp, Mus musculus
tgtgacaaacggaagcgcatgctac

SEQ ID NO: 67566 - DNA, 25 bp, Mus musculus
tgtgacaacatctcaacatgctgag

SEQ ID NO: 67567 - DNA, 25 bp, Mus musculus
tgtgacaatatgctgatgctccttg

SEQ ID NO: 67568 - DNA, 25 bp, Mus musculus
tgtgacaatggctgggtgcctgtct

SEQ ID NO: 67569 - DNA, 25 bp, Mus musculus
tgtgacacccttgtaagagagctag

SEQ ID NO: 67570 - DNA, 25 bp, Mus musculus
tgtgacagctacagccatgatgatt

SEQ ID NO: 67571 - DNA, 25 bp, Mus musculus
tgtgacattcgctgccgaaagggct

SEQ ID NO: 67572 - DNA, 25 bp, Mus musculus
tgtgacattgttggacagttctacc

SEQ ID NO: 67573 - DNA, 25 bp, Mus musculus
tgtgacatttcctgttgtgaagtaa

SEQ ID NO: 67574 - DNA, 25 bp, Mus musculus
tgtgaccaacacttctcagcttgga

SEQ ID NO: 67575 - DNA, 25 bp, Mus musculus
tgtgaccaccatcagtgacctggac

SEQ ID NO: 67576 - DNA, 25 bp, Mus musculus
tgtgaccacctgaaacctgcattat

SEQ ID NO: 67577 - DNA, 25 bp, Mus musculus
tgtgaccagcactagtgtcaaccgc

SEQ ID NO: 67578 - DNA, 25 bp, Mus musculus
tgtgaccagggcatcgagacctcac

SEQ ID NO: 67579 - DNA, 25 bp, Mus musculus
tgtgaccagggcttcgagacctcac

SEQ ID NO: 67580 - DNA, 25 bp, Mus musculus
tgtgaccatccagccgcttaagagg

SEQ ID NO: 67581 - DNA, 25 bp, Mus musculus
tgtgacccgagagacacactacgag

SEQ ID NO: 67582 - DNA, 25 bp, Mus musculus
tgtgacccgccactggcgagtcatg

SEQ ID NO: 67583 - DNA, 25 bp, Mus musculus
tgtgacccgtatgggcatatatgtg

SEQ ID NO: 67584 - DNA, 25 bp, Mus musculus
tgtgaccctaaacagagcagcagtg

SEQ ID NO: 67585 - DNA, 25 bp, Mus musculus
tgtgaccctctctgtgaaggatagt

SEQ ID NO: 67586 - DNA, 25 bp, Mus musculus
tgtgaccctgcatctctgttccatg

SEQ ID NO: 67587 - DNA, 25 bp, Mus musculus
tgtgaccctttagttcccctaatgt

SEQ ID NO: 67588 - DNA, 25 bp, Mus musculus
tgtgaccgctgcatccagctaacca

SEQ ID NO: 67589 - DNA, 25 bp, Mus musculus
tgtgaccggtcagcaaggccttatg

SEQ ID NO: 67590 - DNA, 25 bp, Mus musculus
tgtgaccgtctgttcacacagaggg

SEQ ID NO: 67591 - DNA, 25 bp, Mus musculus
tgtgacctcagtggtgaccagaagc

SEQ ID NO: 67592 - DNA, 25 bp, Mus musculus
tgtgacctctctttccccagcaata

SEQ ID NO: 67593 - DNA, 25 bp, Mus musculus
tgtgacctctgtggatgacagcaac

SEQ ID NO: 67594 - DNA, 25 bp, Mus musculus
tgtgacctgctcatggaaattgagc

SEQ ID NO: 67595 - DNA, 25 bp, Mus musculus
tgtgaccttgggatatacatgcaaa

SEQ ID NO: 67596 - DNA, 25 bp, Mus musculus
tgtgaccttttcatccccatgcagt

SEQ ID NO: 67597 - DNA, 25 bp, Mus musculus
tgtgacgaagtggttactgactgct

SEQ ID NO: 67598 - DNA, 25 bp, Mus musculus
tgtgacgagaagctactacagaggt

SEQ ID NO: 67599 - DNA, 25 bp, Mus musculus
tgtgacgagaaggtactacagaggt

SEQ ID NO: 67600 - DNA, 25 bp, Mus musculus
tgtgacgggaaagaccaagttagtt

SEQ ID NO: 67601 - DNA, 25 bp, Mus musculus
tgtgacgtcatgttccaaataccag

SEQ ID NO: 67602 - DNA, 25 bp, Mus musculus
tgtgacgtttctggctggcaaccga

SEQ ID NO: 67603 - DNA, 25 bp, Mus musculus
tgtgactactacaccaacagtgtgg

SEQ ID NO: 67604 - DNA, 25 bp, Mus musculus
tgtgactatgggaaccacaggcgct

SEQ ID NO: 67605 - DNA, 25 bp, Mus musculus
tgtgactatgggtaccacaggcgct

SEQ ID NO: 67606 - DNA, 25 bp, Mus musculus
tgtgactcacgagaagggatgccca

SEQ ID NO: 67607 - DNA, 25 bp, Mus musculus
tgtgactccctacagccctgtacaa

SEQ ID NO: 67608 - DNA, 25 bp, Mus musculus
tgtgactcctgcatgccggcccagt

SEQ ID NO: 67609 - DNA, 25 bp, Mus musculus
tgtgactcgagacgtttgccctgaa

SEQ ID NO: 67610 - DNA, 25 bp, Mus musculus
tgtgactctgggtttaacaaacaga

SEQ ID NO: 67611 - DNA, 25 bp, Mus musculus
tgtgactggtttacattggagaaga

SEQ ID NO: 67612 - DNA, 25 bp, Mus musculus
tgtgactgtcatcctgaatttctgc

SEQ ID NO: 67613 - DNA, 25 bp, Mus musculus
tgtgactgtgaatgagtggcctgat

SEQ ID NO: 67614 - DNA, 25 bp, Mus musculus
tgtgacttaaagtctggatcctgtt

SEQ ID NO: 67615 - DNA, 25 bp, Mus musculus
tgtgagaacgtgcaaggctccttcc

SEQ ID NO: 67616 - DNA, 25 bp, Mus musculus
tgtgagaacgtggaaggctccttcc

SEQ ID NO: 67617 - DNA, 25 bp, Mus musculus
tgtgagaagagaatccgaatcctgg

SEQ ID NO: 67618 - DNA, 25 bp, Mus musculus
tgtgagagagcctgttcactgtcac

SEQ ID NO: 67619 - DNA, 25 bp, Mus musculus
tgtgagagatgaacagcaaatcaac

SEQ ID NO: 67620 - DNA, 25 bp, Mus musculus
tgtgagagcaacatggagcctctgt

SEQ ID NO: 67621 - DNA, 25 bp, Mus musculus
tgtgagagcagccttacctacaccc

SEQ ID NO: 67622 - DNA, 25 bp, Mus musculus
tgtgagaggatttttcatcaaacaa

SEQ ID NO: 67623 - DNA, 25 bp, Mus musculus
tgtgagatgcccatgaggccagata

SEQ ID NO: 67624 - DNA, 25 bp, Mus musculus
tgtgagattccatcctgcgagtcct

SEQ ID NO: 67625 - DNA, 25 bp, Mus musculus
tgtgagattgtgaccctagaccggg

SEQ ID NO: 67626 - DNA, 25 bp, Mus musculus
tgtgagcacaagacagtgatttctc

SEQ ID NO: 67627 - DNA, 25 bp, Mus musculus
tgtgagcagcctccatgaggccctg

SEQ ID NO: 67628 - DNA, 25 bp, Mus musculus
tgtgagcatctatcagttttgttcc

SEQ ID NO: 67629 - DNA, 25 bp, Mus musculus
tgtgagcatgccttctgcaacgcct

SEQ ID NO: 67630 - DNA, 25 bp, Mus musculus
tgtgagcatgctgtatgagaagatc

SEQ ID NO: 67631 - DNA, 25 bp, Mus musculus
tgtgagccagctctgaaccaggcag

SEQ ID NO: 67632 - DNA, 25 bp, Mus musculus
tgtgagcccagaacaaaaggatcgc

SEQ ID NO: 67633 - DNA, 25 bp, Mus musculus
tgtgagccgggcaatgaggtcaccc

SEQ ID NO: 67634 - DNA, 25 bp, Mus musculus
tgtgagccgggctatgaggtcaccc

SEQ ID NO: 67635 - DNA, 25 bp, Mus musculus
tgtgagcctgctctgcaattataca

SEQ ID NO: 67636 - DNA, 25 bp, Mus musculus
tgtgagcgctactggcctttgtatg

SEQ ID NO: 67637 - DNA, 25 bp, Mus musculus
tgtgagctactaaactcgcattctg

SEQ ID NO: 67638 - DNA, 25 bp, Mus musculus
tgtgagctactatactcgcattctg

SEQ ID NO: 67639 - DNA, 25 bp, Mus musculus
tgtgagctgtgcaataaggcctttg

SEQ ID NO: 67640 - DNA, 25 bp, Mus musculus
tgtgaggaaaggacacgactctatg

SEQ ID NO: 67641 - DNA, 25 bp, Mus musculus
tgtgaggagctgcaaaacggactca

SEQ ID NO: 67642 - DNA, 25 bp, Mus musculus
tgtgaggcagtcgtgcgctttccca

SEQ ID NO: 67643 - DNA, 25 bp, Mus musculus
tgtgaggccaccatacccatgggct

SEQ ID NO: 67644 - DNA, 25 bp, Mus musculus
tgtgaggccagcatcaaagtcaaat

SEQ ID NO: 67645 - DNA, 25 bp, Mus musculus
tgtgaggccagtgcacctttgaccc

SEQ ID NO: 67646 - DNA, 25 bp, Mus musculus
tgtgaggccgagaacatccttggga

SEQ ID NO: 67647 - DNA, 25 bp, Mus musculus
tgtgaggtaccactacaacggaacg

SEQ ID NO: 67648 - DNA, 25 bp, Mus musculus
tgtgaggtcagcaactgcagcctac

SEQ ID NO: 67649 - DNA, 25 bp, Mus musculus
tgtgaggtcagcaaggcccagagac

SEQ ID NO: 67650 - DNA, 25 bp, Mus musculus
tgtgaggtgaatcgccgcaggtacc

SEQ ID NO: 67651 - DNA, 25 bp, Mus musculus
tgtgaggtgaatggccgcaggtacc

SEQ ID NO: 67652 - DNA, 25 bp, Mus musculus
tgtgaggtttcatggaagtattaag

SEQ ID NO: 67653 - DNA, 25 bp, Mus musculus
tgtgagtagttctgagacggaagaa

SEQ ID NO: 67654 - DNA, 25 bp, Mus musculus
tgtgagtatgtggagccccacgaat

SEQ ID NO: 67655 - DNA, 25 bp, Mus musculus
tgtgagtccactgctcatcgtcggc

SEQ ID NO: 67656 - DNA, 25 bp, Mus musculus
tgtgagtcgcgtcatttctccatgc

SEQ ID NO: 67657 - DNA, 25 bp, Mus musculus
tgtgagtgacaccacctggcaggaa

SEQ ID NO: 67658 - DNA, 25 bp, Mus musculus
tgtgagtttcttctcctgagagatc

SEQ ID NO: 67659 - DNA, 25 bp, Mus musculus
tgtgataaaaagagctggcatgtct

SEQ ID NO: 67660 - DNA, 25 bp, Mus musculus
tgtgataaggttggccaatctcgca

SEQ ID NO: 67661 - DNA, 25 bp, Mus musculus
tgtgatactgccctgaatgtgattg

SEQ ID NO: 67662 - DNA, 25 bp, Mus musculus
tgtgatactggtccaaacctgctcc

SEQ ID NO: 67663 - DNA, 25 bp, Mus musculus
tgtgatagaaaccaacctgacaggc

SEQ ID NO: 67664 - DNA, 25 bp, Mus musculus
tgtgatagctggtcaaattcaaacc

SEQ ID NO: 67665 - DNA, 25 bp, Mus musculus
tgtgatcaacaaagagaggcgcggt

SEQ ID NO: 67666 - DNA, 25 bp, Mus musculus
tgtgatcacccacagatcatgagtc

SEQ ID NO: 67667 - DNA, 25 bp, Mus musculus
tgtgatcatccaactccagcgtggt

SEQ ID NO: 67668 - DNA, 25 bp, Mus musculus
tgtgatcatgaaggacactgtgccc

SEQ ID NO: 67669 - DNA, 25 bp, Mus musculus
tgtgatccacacctgaaatgctaaa

SEQ ID NO: 67670 - DNA, 25 bp, Mus musculus
tgtgatccacacgtgaaatgctaaa

SEQ ID NO: 67671 - DNA, 25 bp, Mus musculus
tgtgatccctgtataccaggcacct

SEQ ID NO: 67672 - DNA, 25 bp, Mus musculus
tgtgatcctactgacagccattgtt

SEQ ID NO: 67673 - DNA, 25 bp, Mus musculus
tgtgatcctgttgagcacagatggc

SEQ ID NO: 67674 - DNA, 25 bp, Mus musculus
tgtgatcgctggctattaccaagct

SEQ ID NO: 67675 - DNA, 25 bp, Mus musculus
tgtgatctatcaattcttccacccc

SEQ ID NO: 67676 - DNA, 25 bp, Mus musculus
tgtgatctctactgtcattttccag

SEQ ID NO: 67677 - DNA, 25 bp, Mus musculus
tgtgatctggaatatgtctccagtc

SEQ ID NO: 67678 - DNA, 25 bp, Mus musculus
tgtgatcttgaaccaggcagaaaat

SEQ ID NO: 67679 - DNA, 25 bp, Mus musculus
tgtgatcttgaagcaggcagaaaat

SEQ ID NO: 67680 - DNA, 25 bp, Mus musculus
tgtgatgagagatgacaagtggtta

SEQ ID NO: 67681 - DNA, 25 bp, Mus musculus
tgtgatgagcgtttacagtggagac

SEQ ID NO: 67682 - DNA, 25 bp, Mus musculus
tgtgatgatagcgactcagggccac

SEQ ID NO: 67683 - DNA, 25 bp, Mus musculus
tgtgatgcatgtaaagccttgttcc

SEQ ID NO: 67684 - DNA, 25 bp, Mus musculus
tgtgatgcgttacaccactgctggg

SEQ ID NO: 67685 - DNA, 25 bp, Mus musculus
tgtgatggacaaatcccggaatgcc

SEQ ID NO: 67686 - DNA, 25 bp, Mus musculus
tgtgatggacaattcccggaatgcc

SEQ ID NO: 67687 - DNA, 25 bp, Mus musculus
tgtgatggactcttgctctcctaga

SEQ ID NO: 67688 - DNA, 25 bp, Mus musculus
tgtgatggagaagttatcagctggt

SEQ ID NO: 67689 - DNA, 25 bp, Mus musculus
tgtgatggctcagatgggagcagca

SEQ ID NO: 67690 - DNA, 25 bp, Mus musculus
tgtgatgtcactctgctgaagacgc

SEQ ID NO: 67691 - DNA, 25 bp, Mus musculus
tgtgatgtggtaccagtagtccaag

SEQ ID NO: 67692 - DNA, 25 bp, Mus musculus
tgtgatgtggtagcagtagtccaag

SEQ ID NO: 67693 - DNA, 25 bp, Mus musculus
tgtgatgtgtcagggctttgttcca

SEQ ID NO: 67694 - DNA, 25 bp, Mus musculus
tgtgattatcatcggcttagccgtg

SEQ ID NO: 67695 - DNA, 25 bp, Mus musculus
tgtgattattataccttcagccctg

SEQ ID NO: 67696 - DNA, 25 bp, Mus musculus
tgtgattcagacctatctgccttgc

SEQ ID NO: 67697 - DNA, 25 bp, Mus musculus
tgtgattcatcaccgggattggcag

SEQ ID NO: 67698 - DNA, 25 bp, Mus musculus
tgtgattcatccctggcctcggaaa

SEQ ID NO: 67699 - DNA, 25 bp, Mus musculus
tgtgattctcactttgtgaagttgc

SEQ ID NO: 67700 - DNA, 25 bp, Mus musculus
tgtgattcttgaaaccaatggaccc

SEQ ID NO: 67701 - DNA, 25 bp, Mus musculus
tgtgattgagctggagaagcatatc

SEQ ID NO: 67702 - DNA, 25 bp, Mus musculus
tgtgattggccagatcgcctgccag

SEQ ID NO: 67703 - DNA, 25 bp, Mus musculus
tgtgattggctaataaatgtttgtc

SEQ ID NO: 67704 - DNA, 25 bp, Mus musculus
tgtgattgtactcgcacgggctact

SEQ ID NO: 67705 - DNA, 25 bp, Mus musculus
tgtgattgtactggcacgggctact

SEQ ID NO: 67706 - DNA, 25 bp, Mus musculus
tgtgatttccgatagccggcctgct

SEQ ID NO: 67707 - DNA, 25 bp, Mus musculus
tgtgcaaaacccagatgacgtggca

SEQ ID NO: 67708 - DNA, 25 bp, Mus musculus
tgtgcaaatccttgatgccaacgat

SEQ ID NO: 67709 - DNA, 25 bp, Mus musculus
tgtgcaaccattctctgaggatgga

SEQ ID NO: 67710 - DNA, 25 bp, Mus musculus
tgtgcaactgctggaggattacaag

SEQ ID NO: 67711 - DNA, 25 bp, Mus musculus
tgtgcaagaattcaagtcatccttc

SEQ ID NO: 67712 - DNA, 25 bp, Mus musculus
tgtgcaagttctctgccctgcgcaa

SEQ ID NO: 67713 - DNA, 25 bp, Mus musculus
tgtgcaatagaaaatgtacctcagt

SEQ ID NO: 67714 - DNA, 25 bp, Mus musculus
tgtgcacccggcattgctagtgctg

SEQ ID NO: 67715 - DNA, 25 bp, Mus musculus
tgtgcacccggctttgctagtgctg

SEQ ID NO: 67716 - DNA, 25 bp, Mus musculus
tgtgcaccctgcaatgtcattgcgg

SEQ ID NO: 67717 - DNA, 25 bp, Mus musculus
tgtgcaccgcctcataaagggagag

SEQ ID NO: 67718 - DNA, 25 bp, Mus musculus
tgtgcacctccctttttggagacac

SEQ ID NO: 67719 - DNA, 25 bp, Mus musculus
tgtgcaccttgtggctctggacaaa

SEQ ID NO: 67720 - DNA, 25 bp, Mus musculus
tgtgcacgcgcagcgggaatatgct

SEQ ID NO: 67721 - DNA, 25 bp, Mus musculus
tgtgcactatatccaatgtttgggt

SEQ ID NO: 67722 - DNA, 25 bp, Mus musculus
tgtgcactgtgtaggcctgttgccc

SEQ ID NO: 67723 - DNA, 25 bp, Mus musculus
tgtgcagaagaccatagctggacag

SEQ ID NO: 67724 - DNA, 25 bp, Mus musculus
tgtgcagaagcatggctccaggagt

SEQ ID NO: 67725 - DNA, 25 bp, Mus musculus
tgtgcagaaggcgtcgtggtcttcc

SEQ ID NO: 67726 - DNA, 25 bp, Mus musculus
tgtgcagactatgactccctgccgg

SEQ ID NO: 67727 - DNA, 25 bp, Mus musculus
tgtgcagatctgcagaccaaaatcc

SEQ ID NO: 67728 - DNA, 25 bp, Mus musculus
tgtgcagatggtcctcaacaacctg

SEQ ID NO: 67729 - DNA, 25 bp, Mus musculus
tgtgcagcacagaaagctttgctgg

SEQ ID NO: 67730 - DNA, 25 bp, Mus musculus
tgtgcagcagagaagacaataccga

SEQ ID NO: 67731 - DNA, 25 bp, Mus musculus
tgtgcagctcagtcacctcagcagc

SEQ ID NO: 67732 - DNA, 25 bp, Mus musculus
tgtgcagctgatggttgtcactggc

SEQ ID NO: 67733 - DNA, 25 bp, Mus musculus
tgtgcaggaccatggagcacagaca

SEQ ID NO: 67734 - DNA, 25 bp, Mus musculus
tgtgcaggagtttgtgagaccagaa

SEQ ID NO: 67735 - DNA, 25 bp, Mus musculus
tgtgcagggacactacgttcaacag

SEQ ID NO: 67736 - DNA, 25 bp, Mus musculus
tgtgcagggtcagtctttaaaagtc

SEQ ID NO: 67737 - DNA, 25 bp, Mus musculus
tgtgcagtattactgctagagtcac

SEQ ID NO: 67738 - DNA, 25 bp, Mus musculus
tgtgcagtattcaacctatacagag

SEQ ID NO: 67739 - DNA, 25 bp, Mus musculus
tgtgcagtgcctgcaatcaggtcgt

SEQ ID NO: 67740 - DNA, 25 bp, Mus musculus
tgtgcagtggcagtcttccatctga

SEQ ID NO: 67741 - DNA, 25 bp, Mus musculus
tgtgcagttttgcaaactcactgtc

SEQ ID NO: 67742 - DNA, 25 bp, Mus musculus
tgtgcagttttggaaactcactgtc

SEQ ID NO: 67743 - DNA, 25 bp, Mus musculus
tgtgcatagagcagcaacagctgga

SEQ ID NO: 67744 - DNA, 25 bp, Mus musculus
tgtgcatatggaagacactggaccc

SEQ ID NO: 67745 - DNA, 25 bp, Mus musculus
tgtgcatatggatgacactggaccc

SEQ ID NO: 67746 - DNA, 25 bp, Mus musculus
tgtgcatcaaggtcttcatctcaag

SEQ ID NO: 67747 - DNA, 25 bp, Mus musculus
tgtgcatcaccatggcgacagacct

SEQ ID NO: 67748 - DNA, 25 bp, Mus musculus
tgtgcatcccaggagaggcctatgg

SEQ ID NO: 67749 - DNA, 25 bp, Mus musculus
tgtgcatccgcgaggcggtcagcca

SEQ ID NO: 67750 - DNA, 25 bp, Mus musculus
tgtgcatccgttgctgcagctcgtc

SEQ ID NO: 67751 - DNA, 25 bp, Mus musculus
tgtgcatcgacaagagcttcatctg

SEQ ID NO: 67752 - DNA, 25 bp, Mus musculus
tgtgcatctatccatttcacatccc

SEQ ID NO: 67753 - DNA, 25 bp, Mus musculus
tgtgcatcttacacgagaggagtgg

SEQ ID NO: 67754 - DNA, 25 bp, Mus musculus
tgtgcatgtgaacagcgagcgctct

SEQ ID NO: 67755 - DNA, 25 bp, Mus musculus
tgtgcattacggaaggtattccgca

SEQ ID NO: 67756 - DNA, 25 bp, Mus musculus
tgtgcattcaaaactgcgtatgagc

SEQ ID NO: 67757 - DNA, 25 bp, Mus musculus
tgtgcattcgagtaaaagaggccgc

SEQ ID NO: 67758 - DNA, 25 bp, Mus musculus
tgtgccaaagcccacatagagaagg

SEQ ID NO: 67759 - DNA, 25 bp, Mus musculus
tgtgccaaagcctacatacataaag

SEQ ID NO: 67760 - DNA, 25 bp, Mus musculus
tgtgccaactcgtttgctgtcacgt

SEQ ID NO: 67761 - DNA, 25 bp, Mus musculus
tgtgccaaggtctttgtggctaggc

SEQ ID NO: 67762 - DNA, 25 bp, Mus musculus
tgtgccacagctagcccttcttcaa

SEQ ID NO: 67763 - DNA, 25 bp, Mus musculus
tgtgccacagtgaaatgtgccggtg

SEQ ID NO: 67764 - DNA, 25 bp, Mus musculus
tgtgccaccaaatgtagcggaactg

SEQ ID NO: 67765 - DNA, 25 bp, Mus musculus
tgtgccactcagaatcacggctgta

SEQ ID NO: 67766 - DNA, 25 bp, Mus musculus
tgtgccactgaaaatcgtgccgatg

SEQ ID NO: 67767 - DNA, 25 bp, Mus musculus
tgtgccacttcactatgcatgtttc

SEQ ID NO: 67768 - DNA, 25 bp, Mus musculus
tgtgccacttttgaacgggagcagc

SEQ ID NO: 67769 - DNA, 25 bp, Mus musculus
tgtgccagacaagagccatgaagat

SEQ ID NO: 67770 - DNA, 25 bp, Mus musculus
tgtgccagacgatctggaagccggc

SEQ ID NO: 67771 - DNA, 25 bp, Mus musculus
tgtgccagcaggtgcccagagcaga

SEQ ID NO: 67772 - DNA, 25 bp, Mus musculus
tgtgccagcagtgacaatcccaaag

SEQ ID NO: 67773 - DNA, 25 bp, Mus musculus
tgtgccaggacaggcactgtcagaa

SEQ ID NO: 67774 - DNA, 25 bp, Mus musculus
tgtgccaggcaccagctggaatccg

SEQ ID NO: 67775 - DNA, 25 bp, Mus musculus
tgtgccatgaacaaggagtccccac

SEQ ID NO: 67776 - DNA, 25 bp, Mus musculus
tgtgccattcggacccagtcctatg

SEQ ID NO: 67777 - DNA, 25 bp, Mus musculus
tgtgcccaaaagtcgcctgaccatc

SEQ ID NO: 67778 - DNA, 25 bp, Mus musculus
tgtgcccactgggaaccttcagttg

SEQ ID NO: 67779 - DNA, 25 bp, Mus musculus
tgtgcccagctaaccttgtaagatg

SEQ ID NO: 67780 - DNA, 25 bp, Mus musculus
tgtgcccagtggataaggcccatcg

SEQ ID NO: 67781 - DNA, 25 bp, Mus musculus
tgtgcccatccaagcagcctgttca

SEQ ID NO: 67782 - DNA, 25 bp, Mus musculus
tgtgcccatcccaactcgagattct

SEQ ID NO: 67783 - DNA, 25 bp, Mus musculus
tgtgcccattacatctcctgctgta

SEQ ID NO: 67784 - DNA, 25 bp, Mus musculus
tgtgccccaaagtccctaagcagga

SEQ ID NO: 67785 - DNA, 25 bp, Mus musculus
tgtgccccaagactgggacgtttcc

SEQ ID NO: 67786 - DNA, 25 bp, Mus musculus
tgtgcccggatgagtggcccctgct

SEQ ID NO: 67787 - DNA, 25 bp, Mus musculus
tgtgcccgtactaacatctactgaa

SEQ ID NO: 67788 - DNA, 25 bp, Mus musculus
tgtgcccgtacttacatctactgaa

SEQ ID NO: 67789 - DNA, 25 bp, Mus musculus
tgtgcccttgttttcagatagaagc

SEQ ID NO: 67790 - DNA, 25 bp, Mus musculus
tgtgccgcactgacctggagattca

SEQ ID NO: 67791 - DNA, 25 bp, Mus musculus
tgtgccggctggaggacttcaagcc

SEQ ID NO: 67792 - DNA, 25 bp, Mus musculus
tgtgccgtgcttgcctgtcaggatt

SEQ ID NO: 67793 - DNA, 25 bp, Mus musculus
tgtgccgttgccctacaggctacac

SEQ ID NO: 67794 - DNA, 25 bp, Mus musculus
tgtgcctaccgtgctagccatcaag

SEQ ID NO: 67795 - DNA, 25 bp, Mus musculus
tgtgcctacgtggtgactcggacag

SEQ ID NO: 67796 - DNA, 25 bp, Mus musculus
tgtgcctatcatccagcagctatat

SEQ ID NO: 67797 - DNA, 25 bp, Mus musculus
tgtgcctatcttggctaaggcggac

SEQ ID NO: 67798 - DNA, 25 bp, Mus musculus
tgtgcctccaggataataatggact

SEQ ID NO: 67799 - DNA, 25 bp, Mus musculus
tgtgcctgaaaccaatatcctgtct

SEQ ID NO: 67800 - DNA, 25 bp, Mus musculus
tgtgcctgaacggtggcacctgctt

SEQ ID NO: 67801 - DNA, 25 bp, Mus musculus
tgtgcctgccgcagaccttagcgac

SEQ ID NO: 67802 - DNA, 25 bp, Mus musculus
tgtgcctggatgaggcacccgtctc

SEQ ID NO: 67803 - DNA, 25 bp, Mus musculus
tgtgcctggatgtggcacccgtctc

SEQ ID NO: 67804 - DNA, 25 bp, Mus musculus
tgtgcctgtccagagcaagcgcagg

SEQ ID NO: 67805 - DNA, 25 bp, Mus musculus
tgtgccttcctggtccaaatggatc

SEQ ID NO: 67806 - DNA, 25 bp, Mus musculus
tgtgccttcctgtggtttgccattc

SEQ ID NO: 67807 - DNA, 25 bp, Mus musculus
tgtgccttgttgtttctggtcccgg

SEQ ID NO: 67808 - DNA, 25 bp, Mus musculus
tgtgcctttgtcaacgccagacagg

SEQ ID NO: 67809 - DNA, 25 bp, Mus musculus
tgtgcgaagcctcaagcgcagactc

SEQ ID NO: 67810 - DNA, 25 bp, Mus musculus
tgtgcgacactgtgttcactctgca

SEQ ID NO: 67811 - DNA, 25 bp, Mus musculus
tgtgcgacctgcagctgggtctcag

SEQ ID NO: 67812 - DNA, 25 bp, Mus musculus
tgtgcgagaactttcttcagaatct

SEQ ID NO: 67813 - DNA, 25 bp, Mus musculus
tgtgcgagggcgaccgatgctaccc

SEQ ID NO: 67814 - DNA, 25 bp, Mus musculus
tgtgcgatttcacagtttgaaaggc

SEQ ID NO: 67815 - DNA, 25 bp, Mus musculus
tgtgcgcaggaactcctgttcttca

SEQ ID NO: 67816 - DNA, 25 bp, Mus musculus
tgtgcgccagcaacgtctgctgttc

SEQ ID NO: 67817 - DNA, 25 bp, Mus musculus
tgtgcgccccgcacgagttccagtg

SEQ ID NO: 67818 - DNA, 25 bp, Mus musculus
tgtgcgctcactggccagagtaagc

SEQ ID NO: 67819 - DNA, 25 bp, Mus musculus
tgtgcgctgctccaatcagtctctc

SEQ ID NO: 67820 - DNA, 25 bp, Mus musculus
tgtgcgctgggctacgtgactctcc

SEQ ID NO: 67821 - DNA, 25 bp, Mus musculus
tgtgcggcaacacccttgtccacta

SEQ ID NO: 67822 - DNA, 25 bp, Mus musculus
tgtgcgtaaacgagaggcgtcttgt

SEQ ID NO: 67823 - DNA, 25 bp, Mus musculus
tgtgcgtctccgaaattacttcaag

SEQ ID NO: 67824 - DNA, 25 bp, Mus musculus
tgtgcgtggtaacgtggacaccctt

SEQ ID NO: 67825 - DNA, 25 bp, Mus musculus
tgtgctaacctgcaagggtccaacc

SEQ ID NO: 67826 - DNA, 25 bp, Mus musculus
tgtgctacagcgctgctgtcacact

SEQ ID NO: 67827 - DNA, 25 bp, Mus musculus
tgtgctacgtgctgtgccgtgcttg

SEQ ID NO: 67828 - DNA, 25 bp, Mus musculus
tgtgctagaggctgtaatatgcttc

SEQ ID NO: 67829 - DNA, 25 bp, Mus musculus
tgtgctatactctgtttgccctgtg

SEQ ID NO: 67830 - DNA, 25 bp, Mus musculus
tgtgctatgcctgtaatgaagggct

SEQ ID NO: 67831 - DNA, 25 bp, Mus musculus
tgtgctcaaggacttcaccctgaag

SEQ ID NO: 67832 - DNA, 25 bp, Mus musculus
tgtgctcaccaaggctcatgcatct

SEQ ID NO: 67833 - DNA, 25 bp, Mus musculus
tgtgctcaccgcactcatagttggt

SEQ ID NO: 67834 - DNA, 25 bp, Mus musculus
tgtgctcaggaaactgctaccttgt

SEQ ID NO: 67835 - DNA, 25 bp, Mus musculus
tgtgctcagggttcaccatgtcatg

SEQ ID NO: 67836 - DNA, 25 bp, Mus musculus
tgtgctcccagtagaaacagaggcc

SEQ ID NO: 67837 - DNA, 25 bp, Mus musculus
tgtgctcctgcccaatgatgtttag

SEQ ID NO: 67838 - DNA, 25 bp, Mus musculus
tgtgctctacatgacagagtggttc

SEQ ID NO: 67839 - DNA, 25 bp, Mus musculus
tgtgctctacttcacctggctggca

SEQ ID NO: 67840 - DNA, 25 bp, Mus musculus
tgtgctctgcttgctccttcttcat

SEQ ID NO: 67841 - DNA, 25 bp, Mus musculus
tgtgctgaagtccagtcttggctca

SEQ ID NO: 67842 - DNA, 25 bp, Mus musculus
tgtgctgaccagtgatcagtcctcc

SEQ ID NO: 67843 - DNA, 25 bp, Mus musculus
tgtgctgacccaccagcagttcagt

SEQ ID NO: 67844 - DNA, 25 bp, Mus musculus
tgtgctgagggagctccaatcggga

SEQ ID NO: 67845 - DNA, 25 bp, Mus musculus
tgtgctgagtacactcatttctatg

SEQ ID NO: 67846 - DNA, 25 bp, Mus musculus
tgtgctgccaactttgagaacttat

SEQ ID NO: 67847 - DNA, 25 bp, Mus musculus
tgtgctgccagagaaatatccctct

SEQ ID NO: 67848 - DNA, 25 bp, Mus musculus
tgtgctgccccacacatagagaagg

SEQ ID NO: 67849 - DNA, 25 bp, Mus musculus
tgtgctgccctgtatgaaggattgc

SEQ ID NO: 67850 - DNA, 25 bp, Mus musculus
tgtgctgctagacacactgagcaga

SEQ ID NO: 67851 - DNA, 25 bp, Mus musculus
tgtgctgctcctggaggcaaatccg

SEQ ID NO: 67852 - DNA, 25 bp, Mus musculus
tgtgctgctctctagcaaggctgtg

SEQ ID NO: 67853 - DNA, 25 bp, Mus musculus
tgtgctgcttaaactccagggctga

SEQ ID NO: 67854 - DNA, 25 bp, Mus musculus
tgtgctggactagcggacatggcca

SEQ ID NO: 67855 - DNA, 25 bp, Mus musculus
tgtgctggagcctgagtctgacccc

SEQ ID NO: 67856 - DNA, 25 bp, Mus musculus
tgtgctggagcgacgagactccttc

SEQ ID NO: 67857 - DNA, 25 bp, Mus musculus
tgtgctggctgctaaaggataaaag

SEQ ID NO: 67858 - DNA, 25 bp, Mus musculus
tgtgctgggactgagccttcttttc

SEQ ID NO: 67859 - DNA, 25 bp, Mus musculus
tgtgctggtcccttacaaactgatc

SEQ ID NO: 67860 - DNA, 25 bp, Mus musculus
tgtgctggtctccatcaccctggag

SEQ ID NO: 67861 - DNA, 25 bp, Mus musculus
tgtgctggtgaaggtggatacttcc

SEQ ID NO: 67862 - DNA, 25 bp, Mus musculus
tgtgctgtatgtgtatcctcctctg

SEQ ID NO: 67863 - DNA, 25 bp, Mus musculus
tgtgctgtccctccaaagtacatga

SEQ ID NO: 67864 - DNA, 25 bp, Mus musculus
tgtgctgtcctccctggagcgcaca

SEQ ID NO: 67865 - DNA, 25 bp, Mus musculus
tgtgctgtgaagtcctctctggcca

SEQ ID NO: 67866 - DNA, 25 bp, Mus musculus
tgtgctgtgatagcccactcttcag

SEQ ID NO: 67867 - DNA, 25 bp, Mus musculus
tgtgcttagagacaaagtcactttg

SEQ ID NO: 67868 - DNA, 25 bp, Mus musculus
tgtgcttcagcccagcatacagact

SEQ ID NO: 67869 - DNA, 25 bp, Mus musculus
tgtgcttcatggaattgccaatgaa

SEQ ID NO: 67870 - DNA, 25 bp, Mus musculus
tgtgcttcatggtattgccaatgaa

SEQ ID NO: 67871 - DNA, 25 bp, Mus musculus
tgtgcttccctcatcaggtcacgtg

SEQ ID NO: 67872 - DNA, 25 bp, Mus musculus
tgtgcttcgcttcctcaaggccaag

SEQ ID NO: 67873 - DNA, 25 bp, Mus musculus
tgtgcttcgtggtgccactcagcaa

SEQ ID NO: 67874 - DNA, 25 bp, Mus musculus
tgtgcttctactccttcctgctggg

SEQ ID NO: 67875 - DNA, 25 bp, Mus musculus
tgtgcttctcactacgctacgtgcc

SEQ ID NO: 67876 - DNA, 25 bp, Mus musculus
tgtgcttctgtatatggcaatgaaa

SEQ ID NO: 67877 - DNA, 25 bp, Mus musculus
tgtgcttgaccctgtccggactgag

SEQ ID NO: 67878 - DNA, 25 bp, Mus musculus
tgtgcttgagccgaaacttccagat

SEQ ID NO: 67879 - DNA, 25 bp, Mus musculus
tgtgcttgggagaaatgctgttacc

SEQ ID NO: 67880 - DNA, 25 bp, Mus musculus
tgtgctttccgttggactgcttgcc

SEQ ID NO: 67881 - DNA, 25 bp, Mus musculus
tgtgctttcctcttgggtctattaa

SEQ ID NO: 67882 - DNA, 25 bp, Mus musculus
tgtgcttttcataagcagtacaaac

SEQ ID NO: 67883 - DNA, 25 bp, Mus musculus
tgtggaaaacatcactgtcttggag

SEQ ID NO: 67884 - DNA, 25 bp, Mus musculus
tgtggaaaacatcgcgagctgatac

SEQ ID NO: 67885 - DNA, 25 bp, Mus musculus
tgtggaaaacatggcgagctgatac

SEQ ID NO: 67886 - DNA, 25 bp, Mus musculus
tgtggaaaaccaacagcctaatgct

SEQ ID NO: 67887 - DNA, 25 bp, Mus musculus
tgtggaaagaaaaaacagtgctcgg

SEQ ID NO: 67888 - DNA, 25 bp, Mus musculus
tgtggaacagttacaaaaagtccat

SEQ ID NO: 67889 - DNA, 25 bp, Mus musculus
tgtggaacatctcaaagaacacgtc

SEQ ID NO: 67890 - DNA, 25 bp, Mus musculus
tgtggaactgttaacagatcgggtg

SEQ ID NO: 67891 - DNA, 25 bp, Mus musculus
tgtggaagaccaccttaggaacaga

SEQ ID NO: 67892 - DNA, 25 bp, Mus musculus
tgtggaagacctcagcaaggcacct

SEQ ID NO: 67893 - DNA, 25 bp, Mus musculus
tgtggaagagcagctagagaggatc

SEQ ID NO: 67894 - DNA, 25 bp, Mus musculus
tgtggaagagccctaacggaacgat

SEQ ID NO: 67895 - DNA, 25 bp, Mus musculus
tgtggaagctgggtcggctcaatca

SEQ ID NO: 67896 - DNA, 25 bp, Mus musculus
tgtggaatacacaggaactacagta

SEQ ID NO: 67897 - DNA, 25 bp, Mus musculus
tgtggaatacggaggcaccatgaca

SEQ ID NO: 67898 - DNA, 25 bp, Mus musculus
tgtggaatctgctctcacgaggcct

SEQ ID NO: 67899 - DNA, 25 bp, Mus musculus
tgtggaattatgactaagccaagga

SEQ ID NO: 67900 - DNA, 25 bp, Mus musculus
tgtggaattccggaagcaaaaggac

SEQ ID NO: 67901 - DNA, 25 bp, Mus musculus
tgtggacaaacagagacacctagag

SEQ ID NO: 67902 - DNA, 25 bp, Mus musculus
tgtggacaacatcctgtatatcgcc

SEQ ID NO: 67903 - DNA, 25 bp, Mus musculus
tgtggacaagacagcattctctggc

SEQ ID NO: 67904 - DNA, 25 bp, Mus musculus
tgtggacacactacagtattgcttc

SEQ ID NO: 67905 - DNA, 25 bp, Mus musculus
tgtggacacactgacttctgcgtgc

SEQ ID NO: 67906 - DNA, 25 bp, Mus musculus
tgtggacacctcaggttttcagtgt

SEQ ID NO: 67907 - DNA, 25 bp, Mus musculus
tgtggacacctctggttttcagtgt

SEQ ID NO: 67908 - DNA, 25 bp, Mus musculus
tgtggacagctggaaggcttcgttc

SEQ ID NO: 67909 - DNA, 25 bp, Mus musculus
tgtggacagctgtatgcctacgact

SEQ ID NO: 67910 - DNA, 25 bp, Mus musculus
tgtggacatcggttcagtctccgcg

SEQ ID NO: 67911 - DNA, 25 bp, Mus musculus
tgtggacatggtagtcagtgaactc

SEQ ID NO: 67912 - DNA, 25 bp, Mus musculus
tgtggaccacctagtgctgaccgtt

SEQ ID NO: 67913 - DNA, 25 bp, Mus musculus
tgtggaccccagtggacctgcagcc

SEQ ID NO: 67914 - DNA, 25 bp, Mus musculus
tgtggaccgcaatcggctatgctgt

SEQ ID NO: 67915 - DNA, 25 bp, Mus musculus
tgtggaccgcagaaatagccaggag

SEQ ID NO: 67916 - DNA, 25 bp, Mus musculus
tgtggaccgcgtgggactcatcaca

SEQ ID NO: 67917 - DNA, 25 bp, Mus musculus
tgtggacctccgatatacagtacca

SEQ ID NO: 67918 - DNA, 25 bp, Mus musculus
tgtggacctggtccctatggatgac

SEQ ID NO: 67919 - DNA, 25 bp, Mus musculus
tgtggacctggtgcctatggatgac

SEQ ID NO: 67920 - DNA, 25 bp, Mus musculus
tgtggacgctggcaatgctttcaag

SEQ ID NO: 67921 - DNA, 25 bp, Mus musculus
tgtggacggctactgagaaaagaac

SEQ ID NO: 67922 - DNA, 25 bp, Mus musculus
tgtggacgtcccaaaggatgtgacc

SEQ ID NO: 67923 - DNA, 25 bp, Mus musculus
tgtggactatatcacaggccctgaa

SEQ ID NO: 67924 - DNA, 25 bp, Mus musculus
tgtggactccaagcaagcaatgtgg

SEQ ID NO: 67925 - DNA, 25 bp, Mus musculus
tgtggactccgcacccaggcaggct

SEQ ID NO: 67926 - DNA, 25 bp, Mus musculus
tgtggactcgtagccctatcatgca

SEQ ID NO: 67927 - DNA, 25 bp, Mus musculus
tgtggactttgtgttcaggctacac

SEQ ID NO: 67928 - DNA, 25 bp, Mus musculus
tgtggagaaagaagggcactaccag

SEQ ID NO: 67929 - DNA, 25 bp, Mus musculus
tgtggagaagacagcatgaacttca

SEQ ID NO: 67930 - DNA, 25 bp, Mus musculus
tgtggagacagaaagccgagaatca

SEQ ID NO: 67931 - DNA, 25 bp, Mus musculus
tgtggagacagaattcattgctttc

SEQ ID NO: 67932 - DNA, 25 bp, Mus musculus
tgtggagacagatttcattgctttc

SEQ ID NO: 67933 - DNA, 25 bp, Mus musculus
tgtggagaccacgttgtcataataa

SEQ ID NO: 67934 - DNA, 25 bp, Mus musculus
tgtggagactctacgctacttgacc

SEQ ID NO: 67935 - DNA, 25 bp, Mus musculus
tgtggagagagtgaagataccattg

SEQ ID NO: 67936 - DNA, 25 bp, Mus musculus
tgtggagatgactccatccggtacc

SEQ ID NO: 67937 - DNA, 25 bp, Mus musculus
tgtggagccctattgtgccgacatc

SEQ ID NO: 67938 - DNA, 25 bp, Mus musculus
tgtggagctggaactcgccaagtgc

SEQ ID NO: 67939 - DNA, 25 bp, Mus musculus
tgtggagctgttcattgttgtagac

SEQ ID NO: 67940 - DNA, 25 bp, Mus musculus
tgtggaggagtttctggactcatcc

SEQ ID NO: 67941 - DNA, 25 bp, Mus musculus
tgtggaggcatccttctgtgaaagc

SEQ ID NO: 67942 - DNA, 25 bp, Mus musculus
tgtggaggctccctgctcagtccag

SEQ ID NO: 67943 - DNA, 25 bp, Mus musculus
tgtggaggcttcaggtgaaattgca

SEQ ID NO: 67944 - DNA, 25 bp, Mus musculus
tgtggaggcttctggtgaaattgca

SEQ ID NO: 67945 - DNA, 25 bp, Mus musculus
tgtggagtccatggccacccagtag

SEQ ID NO: 67946 - DNA, 25 bp, Mus musculus
tgtggagtctgtggatgaataccaa

SEQ ID NO: 67947 - DNA, 25 bp, Mus musculus
tgtggagtgtacagtcatcccttag

SEQ ID NO: 67948 - DNA, 25 bp, Mus musculus
tgtggagttctccaacaagattgcc

SEQ ID NO: 67949 - DNA, 25 bp, Mus musculus
tgtggagttgagatgttatccctgc

SEQ ID NO: 67950 - DNA, 25 bp, Mus musculus
tgtggagtttcctttgattggtgcg

SEQ ID NO: 67951 - DNA, 25 bp, Mus musculus
tgtggataaagaccccgtgaaggaa

SEQ ID NO: 67952 - DNA, 25 bp, Mus musculus
tgtggataagctggaacagatctat

SEQ ID NO: 67953 - DNA, 25 bp, Mus musculus
tgtggataccctatttgtgcccctg

SEQ ID NO: 67954 - DNA, 25 bp, Mus musculus
tgtggatagtcctcatcctggtctt

SEQ ID NO: 67955 - DNA, 25 bp, Mus musculus
tgtggatagtgaagctaagaaacta

SEQ ID NO: 67956 - DNA, 25 bp, Mus musculus
tgtggatcacaggttgccaggaaac

SEQ ID NO: 67957 - DNA, 25 bp, Mus musculus
tgtggatcattatgaaaaccctcgg

SEQ ID NO: 67958 - DNA, 25 bp, Mus musculus
tgtggatccattccctggactgtga

SEQ ID NO: 67959 - DNA, 25 bp, Mus musculus
tgtggatcgaaaccacagcctatgc

SEQ ID NO: 67960 - DNA, 25 bp, Mus musculus
tgtggatctgcagcagcaaatcatg

SEQ ID NO: 67961 - DNA, 25 bp, Mus musculus
tgtggatctgtaccagcccggcacc

SEQ ID NO: 67962 - DNA, 25 bp, Mus musculus
tgtggatgacagcaacagttactgg

SEQ ID NO: 67963 - DNA, 25 bp, Mus musculus
tgtggatgacttggacactcaggag

SEQ ID NO: 67964 - DNA, 25 bp, Mus musculus
tgtggatgagtatgagaaaaggtca

SEQ ID NO: 67965 - DNA, 25 bp, Mus musculus
tgtggatgagtgctccaggaattca

SEQ ID NO: 67966 - DNA, 25 bp, Mus musculus
tgtggatgccatgctggtccatgga

SEQ ID NO: 67967 - DNA, 25 bp, Mus musculus
tgtggatgcctttcgggtcaatgtc

SEQ ID NO: 67968 - DNA, 25 bp, Mus musculus
tgtggatggcaatgcaaagatgacc

SEQ ID NO: 67969 - DNA, 25 bp, Mus musculus
tgtggatgtagaccctaagtctccc

SEQ ID NO: 67970 - DNA, 25 bp, Mus musculus
tgtggatgtccctgaattcttggtc

SEQ ID NO: 67971 - DNA, 25 bp, Mus musculus
tgtggattatctttgaatgcgctgc

SEQ ID NO: 67972 - DNA, 25 bp, Mus musculus
tgtggattcgcaggagaaactggtc

SEQ ID NO: 67973 - DNA, 25 bp, Mus musculus
tgtggattcttgcagacaagaacag

SEQ ID NO: 67974 - DNA, 25 bp, Mus musculus
tgtggatttcaagatacgaactata

SEQ ID NO: 67975 - DNA, 25 bp, Mus musculus
tgtggcaaaacatctgaaaaccatt

SEQ ID NO: 67976 - DNA, 25 bp, Mus musculus
tgtggcaaggcatccctctagagaa

SEQ ID NO: 67977 - DNA, 25 bp, Mus musculus
tgtggcacaacacatacagcattgg

SEQ ID NO: 67978 - DNA, 25 bp, Mus musculus
tgtggcacaggaggtctgaacaccg

SEQ ID NO: 67979 - DNA, 25 bp, Mus musculus
tgtggcaccatgatcgactttggcc

SEQ ID NO: 67980 - DNA, 25 bp, Mus musculus
tgtggcacccactttattcagaggc

SEQ ID NO: 67981 - DNA, 25 bp, Mus musculus
tgtggcaccgtataagatagagcgg

SEQ ID NO: 67982 - DNA, 25 bp, Mus musculus
tgtggcagaccttattcgcaaggga

SEQ ID NO: 67983 - DNA, 25 bp, Mus musculus
tgtggcagagcagaaacaatggacc

SEQ ID NO: 67984 - DNA, 25 bp, Mus musculus
tgtggcagccactgttgctttggaa

SEQ ID NO: 67985 - DNA, 25 bp, Mus musculus
tgtggcagctggagatcacttagtc

SEQ ID NO: 67986 - DNA, 25 bp, Mus musculus
tgtggcaggaaaaagtatatgagga

SEQ ID NO: 67987 - DNA, 25 bp, Mus musculus
tgtggcatgtgtgcccatgaagctc

SEQ ID NO: 67988 - DNA, 25 bp, Mus musculus
tgtggcattccacatcaacaagggt

SEQ ID NO: 67989 - DNA, 25 bp, Mus musculus
tgtggccaaatcagttttgaaggag

SEQ ID NO: 67990 - DNA, 25 bp, Mus musculus
tgtggccacgtgtcctagctgctca

SEQ ID NO: 67991 - DNA, 25 bp, Mus musculus
tgtggccacgttgctgttaaaccga

SEQ ID NO: 67992 - DNA, 25 bp, Mus musculus
tgtggccatccatacactggaccca

SEQ ID NO: 67993 - DNA, 25 bp, Mus musculus
tgtggccatggactttacgccagag

SEQ ID NO: 67994 - DNA, 25 bp, Mus musculus
tgtggcccagacgtgttcagcggta

SEQ ID NO: 67995 - DNA, 25 bp, Mus musculus
tgtggccccaaagcccaaagtgaat

SEQ ID NO: 67996 - DNA, 25 bp, Mus musculus
tgtggccctcaagagtgtgagagtt

SEQ ID NO: 67997 - DNA, 25 bp, Mus musculus
tgtggccctgcagcgcaccatgaat

SEQ ID NO: 67998 - DNA, 25 bp, Mus musculus
tgtggccctgctgcactcacatgga

SEQ ID NO: 67999 - DNA, 25 bp, Mus musculus
tgtggccctggctgacggaggtgca

SEQ ID NO: 68000 - DNA, 25 bp, Mus musculus
tgtggccctgggacaactggatcga

SEQ ID NO: 68001 - DNA, 25 bp, Mus musculus
tgtggccggaagctaaaagatgacc

SEQ ID NO: 68002 - DNA, 25 bp, Mus musculus
tgtggccgtggctgacactaaagac

SEQ ID NO: 68003 - DNA, 25 bp, Mus musculus
tgtggcctataacctcatcaagccc

SEQ ID NO: 68004 - DNA, 25 bp, Mus musculus
tgtggcctcatgagcatgtgaccta

SEQ ID NO: 68005 - DNA, 25 bp, Mus musculus
tgtggcctccctgctccagtaggag

SEQ ID NO: 68006 - DNA, 25 bp, Mus musculus
tgtggcctcctctgctgtaccactg

SEQ ID NO: 68007 - DNA, 25 bp, Mus musculus
tgtggcctcggcagagtgtcccagt

SEQ ID NO: 68008 - DNA, 25 bp, Mus musculus
tgtggcctgaggacaggaatactgt

SEQ ID NO: 68009 - DNA, 25 bp, Mus musculus
tgtggcgacatgatgagcaccacct

SEQ ID NO: 68010 - DNA, 25 bp, Mus musculus
tgtggcgagcaacaccaagtgtagc

SEQ ID NO: 68011 - DNA, 25 bp, Mus musculus
tgtggcgagcaagaccaagtgtagc

SEQ ID NO: 68012 - DNA, 25 bp, Mus musculus
tgtggcgcagcagatcatcagtgct

SEQ ID NO: 68013 - DNA, 25 bp, Mus musculus
tgtggcgccatgttgacaaaggcac

SEQ ID NO: 68014 - DNA, 25 bp, Mus musculus
tgtggcgcccgttctactcagtgta

SEQ ID NO: 68015 - DNA, 25 bp, Mus musculus
tgtggcgctacttccgagactactt

SEQ ID NO: 68016 - DNA, 25 bp, Mus musculus
tgtggcggataagcacgaattgctc

SEQ ID NO: 68017 - DNA, 25 bp, Mus musculus
tgtggcgggtaaaaaggaaacactg

SEQ ID NO: 68018 - DNA, 25 bp, Mus musculus
tgtggctacaggaaccaatctgtct

SEQ ID NO: 68019 - DNA, 25 bp, Mus musculus
tgtggctacgacttggacggctgcc

SEQ ID NO: 68020 - DNA, 25 bp, Mus musculus
tgtggctaggataatgaaaaatgcc

SEQ ID NO: 68021 - DNA, 25 bp, Mus musculus
tgtggctatgaacaagctgacgcta

SEQ ID NO: 68022 - DNA, 25 bp, Mus musculus
tgtggctatggcacgaaagttgcag

SEQ ID NO: 68023 - DNA, 25 bp, Mus musculus
tgtggctcagcagaacaagctgaag

SEQ ID NO: 68024 - DNA, 25 bp, Mus musculus
tgtggctcgaaggataatatcaaac

SEQ ID NO: 68025 - DNA, 25 bp, Mus musculus
tgtggctctggacaaagcctgtcgc

SEQ ID NO: 68026 - DNA, 25 bp, Mus musculus
tgtggctcttcaagatttcccagca

SEQ ID NO: 68027 - DNA, 25 bp, Mus musculus
tgtggctcttcatgatttcccagca

SEQ ID NO: 68028 - DNA, 25 bp, Mus musculus
tgtggctgacatgaactacttttca

SEQ ID NO: 68029 - DNA, 25 bp, Mus musculus
tgtggctgagtatgagcccttgcta

SEQ ID NO: 68030 - DNA, 25 bp, Mus musculus
tgtggctgccctggtggtcaacttc

SEQ ID NO: 68031 - DNA, 25 bp, Mus musculus
tgtggctgccttgcctgtaactcaa

SEQ ID NO: 68032 - DNA, 25 bp, Mus musculus
tgtggctggccaactgtcagcggct

SEQ ID NO: 68033 - DNA, 25 bp, Mus musculus
tgtggctggcccgagtctttttgcg

SEQ ID NO: 68034 - DNA, 25 bp, Mus musculus
tgtggctgtcctggatatcaatgac

SEQ ID NO: 68035 - DNA, 25 bp, Mus musculus
tgtggctgtcttcgccgtggccata

SEQ ID NO: 68036 - DNA, 25 bp, Mus musculus
tgtggctgtgaccaacacttctcag

SEQ ID NO: 68037 - DNA, 25 bp, Mus musculus
tgtggcttcgtaacctacagctcgg

SEQ ID NO: 68038 - DNA, 25 bp, Mus musculus
tgtggctttcatccatagactgcta

SEQ ID NO: 68039 - DNA, 25 bp, Mus musculus
tgtggctttgcagaagatcaagtgc

SEQ ID NO: 68040 - DNA, 25 bp, Mus musculus
tgtgggaaccttcgcgagagcccta

SEQ ID NO: 68041 - DNA, 25 bp, Mus musculus
tgtgggaatgatagtagctgaaata

SEQ ID NO: 68042 - DNA, 25 bp, Mus musculus
tgtgggacacaacagttcggctttc

SEQ ID NO: 68043 - DNA, 25 bp, Mus musculus
tgtgggacatccacgaagagatcct

SEQ ID NO: 68044 - DNA, 25 bp, Mus musculus
tgtgggacccctgagtacttggccc

SEQ ID NO: 68045 - DNA, 25 bp, Mus musculus
tgtgggacccttcaaagaggacatc

SEQ ID NO: 68046 - DNA, 25 bp, Mus musculus
tgtgggacctgcttagaaaactgag

SEQ ID NO: 68047 - DNA, 25 bp, Mus musculus
tgtgggacttagagtatgtgtgact

SEQ ID NO: 68048 - DNA, 25 bp, Mus musculus
tgtgggacttagtgtatgtgtgact

SEQ ID NO: 68049 - DNA, 25 bp, Mus musculus
tgtgggagaacctgtcgatgatccg

SEQ ID NO: 68050 - DNA, 25 bp, Mus musculus
tgtgggatccgacctctgagtacat

SEQ ID NO: 68051 - DNA, 25 bp, Mus musculus
tgtgggcaaacctttggatggatga

SEQ ID NO: 68052 - DNA, 25 bp, Mus musculus
tgtgggcaagcactattgttgcatc

SEQ ID NO: 68053 - DNA, 25 bp, Mus musculus
tgtgggcacaatgtctcacccctat

SEQ ID NO: 68054 - DNA, 25 bp, Mus musculus
tgtgggccgccatgttccagaagca

SEQ ID NO: 68055 - DNA, 25 bp, Mus musculus
tgtgggctacccactgcgcaatgag

SEQ ID NO: 68056 - DNA, 25 bp, Mus musculus
tgtgggctctgagaagctctttgcc

SEQ ID NO: 68057 - DNA, 25 bp, Mus musculus
tgtgggcttgcaaaaactatgatgg

SEQ ID NO: 68058 - DNA, 25 bp, Mus musculus
tgtgggtaacattgtccgaagtacc

SEQ ID NO: 68059 - DNA, 25 bp, Mus musculus
tgtgggtacacagcatcagtcaagt

SEQ ID NO: 68060 - DNA, 25 bp, Mus musculus
tgtgggtaccccacttatgaggtgg

SEQ ID NO: 68061 - DNA, 25 bp, Mus musculus
tgtgggtcccctccattcattgcaa

SEQ ID NO: 68062 - DNA, 25 bp, Mus musculus
tgtgggtctttggtcttgcttttgg

SEQ ID NO: 68063 - DNA, 25 bp, Mus musculus
tgtgggtgaagggtaacatactctg

SEQ ID NO: 68064 - DNA, 25 bp, Mus musculus
tgtgggtgagaacagtttgcttcca

SEQ ID NO: 68065 - DNA, 25 bp, Mus musculus
tgtgggtgatacctccctgaggata

SEQ ID NO: 68066 - DNA, 25 bp, Mus musculus
tgtgggttctgtagcaggcttcact

SEQ ID NO: 68067 - DNA, 25 bp, Mus musculus
tgtggtaaacgacggcactccagtg

SEQ ID NO: 68068 - DNA, 25 bp, Mus musculus
tgtggtaagcgagatccggagaaca

SEQ ID NO: 68069 - DNA, 25 bp, Mus musculus
tgtggtacccatgcctacagcagtg

SEQ ID NO: 68070 - DNA, 25 bp, Mus musculus
tgtggtacgaggaagtaaaccatgc

SEQ ID NO: 68071 - DNA, 25 bp, Mus musculus
tgtggtatccaaagctgataatgtg

SEQ ID NO: 68072 - DNA, 25 bp, Mus musculus
tgtggtatttctactcagccctgcc

SEQ ID NO: 68073 - DNA, 25 bp, Mus musculus
tgtggtcaagtgtaagagagctgca

SEQ ID NO: 68074 - DNA, 25 bp, Mus musculus
tgtggtcagacctcatccatggctg

SEQ ID NO: 68075 - DNA, 25 bp, Mus musculus
tgtggtcataaatacaaacgtgggc

SEQ ID NO: 68076 - DNA, 25 bp, Mus musculus
tgtggtcatctgtgatacaccccaa

SEQ ID NO: 68077 - DNA, 25 bp, Mus musculus
tgtggtccaaagctccttgggcccc

SEQ ID NO: 68078 - DNA, 25 bp, Mus musculus
tgtggtccaccagaggtggaactcc

SEQ ID NO: 68079 - DNA, 25 bp, Mus musculus
tgtggtccatcagtctctgcaggag

SEQ ID NO: 68080 - DNA, 25 bp, Mus musculus
tgtggtccatccattggcaaaacca

SEQ ID NO: 68081 - DNA, 25 bp, Mus musculus
tgtggtccctacaatggctcaaggc

SEQ ID NO: 68082 - DNA, 25 bp, Mus musculus
tgtggtccctactatggctcaaggc

SEQ ID NO: 68083 - DNA, 25 bp, Mus musculus
tgtggtccggatcagacccatgctg

SEQ ID NO: 68084 - DNA, 25 bp, Mus musculus
tgtggtcctaggacccccactgtgc

SEQ ID NO: 68085 - DNA, 25 bp, Mus musculus
tgtggtcgtcgtacagaatgccacg

SEQ ID NO: 68086 - DNA, 25 bp, Mus musculus
tgtggtctttggaaccataatgtta

SEQ ID NO: 68087 - DNA, 25 bp, Mus musculus
tgtggtctttggtaccataatgtta

SEQ ID NO: 68088 - DNA, 25 bp, Mus musculus
tgtggtgaagcttttcgggcccctc

SEQ ID NO: 68089 - DNA, 25 bp, Mus musculus
tgtggtgacaagtagaccctctgca

SEQ ID NO: 68090 - DNA, 25 bp, Mus musculus
tgtggtgaccctgctgtctgactat

SEQ ID NO: 68091 - DNA, 25 bp, Mus musculus
tgtggtgagtggctagacggtcact

SEQ ID NO: 68092 - DNA, 25 bp, Mus musculus
tgtggtgcctggaaactcttccaag

SEQ ID NO: 68093 - DNA, 25 bp, Mus musculus
tgtggtgcctggtttgagacccgca

SEQ ID NO: 68094 - DNA, 25 bp, Mus musculus
tgtggtgcgttcaatcctcagtggg

SEQ ID NO: 68095 - DNA, 25 bp, Mus musculus
tgtggtgctgaacaaaatagacctg

SEQ ID NO: 68096 - DNA, 25 bp, Mus musculus
tgtggtgcttgttgcctgacgccct

SEQ ID NO: 68097 - DNA, 25 bp, Mus musculus
tgtggtggacaccacacaaggcaaa

SEQ ID NO: 68098 - DNA, 25 bp, Mus musculus
tgtggtggacctggagacccttcaa

SEQ ID NO: 68099 - DNA, 25 bp, Mus musculus
tgtggtggatatctatcattccagg

SEQ ID NO: 68100 - DNA, 25 bp, Mus musculus
tgtggtggatcttaagaagttcagg

SEQ ID NO: 68101 - DNA, 25 bp, Mus musculus
tgtggtggccttgaatcgcaggact

SEQ ID NO: 68102 - DNA, 25 bp, Mus musculus
tgtggtgggacttcatagcttccta

SEQ ID NO: 68103 - DNA, 25 bp, Mus musculus
tgtggtgggaggaaccaattattac

SEQ ID NO: 68104 - DNA, 25 bp, Mus musculus
tgtggtggttatcctcacctgctcc

SEQ ID NO: 68105 - DNA, 25 bp, Mus musculus
tgtggtgtaccctgccacagagaaa

SEQ ID NO: 68106 - DNA, 25 bp, Mus musculus
tgtggtgtactgataaacagaaccc

SEQ ID NO: 68107 - DNA, 25 bp, Mus musculus
tgtggtgtcacacccttcatggata

SEQ ID NO: 68108 - DNA, 25 bp, Mus musculus
tgtggttaagaaatgtttcacgtca

SEQ ID NO: 68109 - DNA, 25 bp, Mus musculus
tgtggttccaaggacaatattaagc

SEQ ID NO: 68110 - DNA, 25 bp, Mus musculus
tgtggttctgaggtgccccttggca

SEQ ID NO: 68111 - DNA, 25 bp, Mus musculus
tgtggttgctggagctctgctccag

SEQ ID NO: 68112 - DNA, 25 bp, Mus musculus
tgtggttgctgtctccaggaatatg

SEQ ID NO: 68113 - DNA, 25 bp, Mus musculus
tgtggttggagttcccctacaccat

SEQ ID NO: 68114 - DNA, 25 bp, Mus musculus
tgtggttggtaaccttccctcccag

SEQ ID NO: 68115 - DNA, 25 bp, Mus musculus
tgtggtttcccttacagactcggag

SEQ ID NO: 68116 - DNA, 25 bp, Mus musculus
tgtggtttcctctcctacgagtccg

SEQ ID NO: 68117 - DNA, 25 bp, Mus musculus
tgtggtttgccattcactcctacca

SEQ ID NO: 68118 - DNA, 25 bp, Mus musculus
tgtggtttgccttctcacgcagtaa

SEQ ID NO: 68119 - DNA, 25 bp, Mus musculus
tgtggtttggtttgcagaatccttc

SEQ ID NO: 68120 - DNA, 25 bp, Mus musculus
tgtgtaaattttgatgatgctccgg

SEQ ID NO: 68121 - DNA, 25 bp, Mus musculus
tgtgtaaccaagaaggcagcagtcg

SEQ ID NO: 68122 - DNA, 25 bp, Mus musculus
tgtgtaactgaaggctggcttacag

SEQ ID NO: 68123 - DNA, 25 bp, Mus musculus
tgtgtaaggatgactggaaagcccc

SEQ ID NO: 68124 - DNA, 25 bp, Mus musculus
tgtgtaagtcagattatgtgtctgc

SEQ ID NO: 68125 - DNA, 25 bp, Mus musculus
tgtgtaataaagatgccgtcgggtg

SEQ ID NO: 68126 - DNA, 25 bp, Mus musculus
tgtgtaatccttccctcagcgagct

SEQ ID NO: 68127 - DNA, 25 bp, Mus musculus
tgtgtacaagtcagatctccagtgg

SEQ ID NO: 68128 - DNA, 25 bp, Mus musculus
tgtgtacactgctgagctcttcccc

SEQ ID NO: 68129 - DNA, 25 bp, Mus musculus
tgtgtaccacgccaagggcaaacag

SEQ ID NO: 68130 - DNA, 25 bp, Mus musculus
tgtgtacccagcaccatgctaagtg

SEQ ID NO: 68131 - DNA, 25 bp, Mus musculus
tgtgtaccgcttcaccaaatatcaa

SEQ ID NO: 68132 - DNA, 25 bp, Mus musculus
tgtgtaccttgtcaccagctcgtct

SEQ ID NO: 68133 - DNA, 25 bp, Mus musculus
tgtgtacgaagaaggtatagagagt

SEQ ID NO: 68134 - DNA, 25 bp, Mus musculus
tgtgtacgaagctccgttccgatcg

SEQ ID NO: 68135 - DNA, 25 bp, Mus musculus
tgtgtacgttccatcacaccttcac

SEQ ID NO: 68136 - DNA, 25 bp, Mus musculus
tgtgtacgttccttcacaccttcac

SEQ ID NO: 68137 - DNA, 25 bp, Mus musculus
tgtgtactgtggaggaattgcttcg

SEQ ID NO: 68138 - DNA, 25 bp, Mus musculus
tgtgtactgtttcggcctgctctct

SEQ ID NO: 68139 - DNA, 25 bp, Mus musculus
tgtgtactgtttgggcctgctctct

SEQ ID NO: 68140 - DNA, 25 bp, Mus musculus
tgtgtacttcatcctatcgcttggg

SEQ ID NO: 68141 - DNA, 25 bp, Mus musculus
tgtgtacttctactacgaagagaag

SEQ ID NO: 68142 - DNA, 25 bp, Mus musculus
tgtgtagaaagcgaaatcagaggag

SEQ ID NO: 68143 - DNA, 25 bp, Mus musculus
tgtgtagaagccgagattgcaaact

SEQ ID NO: 68144 - DNA, 25 bp, Mus musculus
tgtgtagagcctgaggagaccacgt

SEQ ID NO: 68145 - DNA, 25 bp, Mus musculus
tgtgtagatcttccccaactgctgg

SEQ ID NO: 68146 - DNA, 25 bp, Mus musculus
tgtgtagcattcacttcaaatatca

SEQ ID NO: 68147 - DNA, 25 bp, Mus musculus
tgtgtagtccttgctaaagtgttac

SEQ ID NO: 68148 - DNA, 25 bp, Mus musculus
tgtgtataacgcaccacacccagga

SEQ ID NO: 68149 - DNA, 25 bp, Mus musculus
tgtgtataacgctccacacccagga

SEQ ID NO: 68150 - DNA, 25 bp, Mus musculus
tgtgtatacggaagagagactccaa

SEQ ID NO: 68151 - DNA, 25 bp, Mus musculus
tgtgtatatcattttgtcagcgctc

SEQ ID NO: 68152 - DNA, 25 bp, Mus musculus
tgtgtatcaaagtaacggatgatct

SEQ ID NO: 68153 - DNA, 25 bp, Mus musculus
tgtgtatcacgtccctgacaacagg

SEQ ID NO: 68154 - DNA, 25 bp, Mus musculus
tgtgtatccaggtgattgtgaaagc

SEQ ID NO: 68155 - DNA, 25 bp, Mus musculus
tgtgtatccttttccggaatggacg

SEQ ID NO: 68156 - DNA, 25 bp, Mus musculus
tgtgtatctctcacatactggtgtg

SEQ ID NO: 68157 - DNA, 25 bp, Mus musculus
tgtgtatgagacagacgtgtacgtg

SEQ ID NO: 68158 - DNA, 25 bp, Mus musculus
tgtgtattctctgtgcatcaaggtc

SEQ ID NO: 68159 - DNA, 25 bp, Mus musculus
tgtgtcaacacacagggctccttca

SEQ ID NO: 68160 - DNA, 25 bp, Mus musculus
tgtgtcaacacagagggctccttca

SEQ ID NO: 68161 - DNA, 25 bp, Mus musculus
tgtgtcaatcagtgggatggttccc

SEQ ID NO: 68162 - DNA, 25 bp, Mus musculus
tgtgtcaccctgaccacgtctatct

SEQ ID NO: 68163 - DNA, 25 bp, Mus musculus
tgtgtcaccgatccttgtcaggccg

SEQ ID NO: 68164 - DNA, 25 bp, Mus musculus
tgtgtcactatcttcggtaactctg

SEQ ID NO: 68165 - DNA, 25 bp, Mus musculus
tgtgtcactggcaggtacgtgccat

SEQ ID NO: 68166 - DNA, 25 bp, Mus musculus
tgtgtcagagaatgctcatgttgct

SEQ ID NO: 68167 - DNA, 25 bp, Mus musculus
tgtgtcaggagagctcaactggagc

SEQ ID NO: 68168 - DNA, 25 bp, Mus musculus
tgtgtcaggccatggctgggctcat

SEQ ID NO: 68169 - DNA, 25 bp, Mus musculus
tgtgtcatcagccaaactcgacaag

SEQ ID NO: 68170 - DNA, 25 bp, Mus musculus
tgtgtcatccctatggcccagagct

SEQ ID NO: 68171 - DNA, 25 bp, Mus musculus
tgtgtcatctgtggtatcatgcctg

SEQ ID NO: 68172 - DNA, 25 bp, Mus musculus
tgtgtcatctgttgctattgccacc

SEQ ID NO: 68173 - DNA, 25 bp, Mus musculus
tgtgtccacgttacaacaaaccact

SEQ ID NO: 68174 - DNA, 25 bp, Mus musculus
tgtgtccagcaaactaaagtggcct

SEQ ID NO: 68175 - DNA, 25 bp, Mus musculus
tgtgtccagcctcaattcctctacg

SEQ ID NO: 68176 - DNA, 25 bp, Mus musculus
tgtgtcccaggaatgcaccaagtac

SEQ ID NO: 68177 - DNA, 25 bp, Mus musculus
tgtgtcccagtttgaatcctcctcc

SEQ ID NO: 68178 - DNA, 25 bp, Mus musculus
tgtgtccccctcactttgtcctttg

SEQ ID NO: 68179 - DNA, 25 bp, Mus musculus
tgtgtccccctctctttgtcctttg

SEQ ID NO: 68180 - DNA, 25 bp, Mus musculus
tgtgtccgcagcaacaacatctgcc

SEQ ID NO: 68181 - DNA, 25 bp, Mus musculus
tgtgtccgctttcgcctcgacaact

SEQ ID NO: 68182 - DNA, 25 bp, Mus musculus
tgtgtccgctttggcctcgacaact

SEQ ID NO: 68183 - DNA, 25 bp, Mus musculus
tgtgtcctcagagtcattcccgagc

SEQ ID NO: 68184 - DNA, 25 bp, Mus musculus
tgtgtcctctctggtgaaaaacagt

SEQ ID NO: 68185 - DNA, 25 bp, Mus musculus
tgtgtcctgacatcagatggtcccc

SEQ ID NO: 68186 - DNA, 25 bp, Mus musculus
tgtgtcctgacctcacgttcggtct

SEQ ID NO: 68187 - DNA, 25 bp, Mus musculus
tgtgtcctgagagccatgagaaaga

SEQ ID NO: 68188 - DNA, 25 bp, Mus musculus
tgtgtcctgcagtacggagccagct

SEQ ID NO: 68189 - DNA, 25 bp, Mus musculus
tgtgtcctgctcagacgtcactgtt

SEQ ID NO: 68190 - DNA, 25 bp, Mus musculus
tgtgtcctggcttaacttctcccgg

SEQ ID NO: 68191 - DNA, 25 bp, Mus musculus
tgtgtcctgggcagtaaactcttgg

SEQ ID NO: 68192 - DNA, 25 bp, Mus musculus
tgtgtcgcaaattctgcaaggtggt

SEQ ID NO: 68193 - DNA, 25 bp, Mus musculus
tgtgtcgcacttctttttagatgaa

SEQ ID NO: 68194 - DNA, 25 bp, Mus musculus
tgtgtcgcgctgacttcacgattct

SEQ ID NO: 68195 - DNA, 25 bp, Mus musculus
tgtgtcggcagttgttgaatatggt

SEQ ID NO: 68196 - DNA, 25 bp, Mus musculus
tgtgtcgtacagaccacttgtgccg

SEQ ID NO: 68197 - DNA, 25 bp, Mus musculus
tgtgtcgtgcttcagttcctcatcc

SEQ ID NO: 68198 - DNA, 25 bp, Mus musculus
tgtgtcgtggctgagatcaaggctc

SEQ ID NO: 68199 - DNA, 25 bp, Mus musculus
tgtgtctacaaaatggaagatttga

SEQ ID NO: 68200 - DNA, 25 bp, Mus musculus
tgtgtctaccatgcaccactttggc

SEQ ID NO: 68201 - DNA, 25 bp, Mus musculus
tgtgtctacggctactcgctgttca

SEQ ID NO: 68202 - DNA, 25 bp, Mus musculus
tgtgtctagcacatgtgaaccttgc

SEQ ID NO: 68203 - DNA, 25 bp, Mus musculus
tgtgtctagctaagagctgcctggt

SEQ ID NO: 68204 - DNA, 25 bp, Mus musculus
tgtgtctccaggaagaacctccggt

SEQ ID NO: 68205 - DNA, 25 bp, Mus musculus
tgtgtctccaggctacttaatatcc

SEQ ID NO: 68206 - DNA, 25 bp, Mus musculus
tgtgtctcgatccatgactcttgag

SEQ ID NO: 68207 - DNA, 25 bp, Mus musculus
tgtgtctgcatactcttcacctagc

SEQ ID NO: 68208 - DNA, 25 bp, Mus musculus
tgtgtctggcggtggtacatcctca

SEQ ID NO: 68209 - DNA, 25 bp, Mus musculus
tgtgtctggtgctccaagagccaat

SEQ ID NO: 68210 - DNA, 25 bp, Mus musculus
tgtgtctgtaaacgttctgtccctc

SEQ ID NO: 68211 - DNA, 25 bp, Mus musculus
tgtgtcttctgtagtattaccagga

SEQ ID NO: 68212 - DNA, 25 bp, Mus musculus
tgtgtctttctaccgaagtccacgg

SEQ ID NO: 68213 - DNA, 25 bp, Mus musculus
tgtgtcttttgtacagcccaatgga

SEQ ID NO: 68214 - DNA, 25 bp, Mus musculus
tgtgtgaaatcctaagtggactgca

SEQ ID NO: 68215 - DNA, 25 bp, Mus musculus
tgtgtgaacaccctgggatccttct

SEQ ID NO: 68216 - DNA, 25 bp, Mus musculus
tgtgtgaagacagcatctctgggac

SEQ ID NO: 68217 - DNA, 25 bp, Mus musculus
tgtgtgaagacattggtcgcagtct

SEQ ID NO: 68218 - DNA, 25 bp, Mus musculus
tgtgtgaaggtttccagtgcatact

SEQ ID NO: 68219 - DNA, 25 bp, Mus musculus
tgtgtgacagacctgcacacgtgca

SEQ ID NO: 68220 - DNA, 25 bp, Mus musculus
tgtgtgacatccctctgtatgacat

SEQ ID NO: 68221 - DNA, 25 bp, Mus musculus
tgtgtgacatcttcctgatctggaa

SEQ ID NO: 68222 - DNA, 25 bp, Mus musculus
tgtgtgaccggcaaaaggagtcatc

SEQ ID NO: 68223 - DNA, 25 bp, Mus musculus
tgtgtgacctctgtgaccggatcat

SEQ ID NO: 68224 - DNA, 25 bp, Mus musculus
tgtgtgacgggcacacacaactgcc

SEQ ID NO: 68225 - DNA, 25 bp, Mus musculus
tgtgtgataccgtgctcaccttttc

SEQ ID NO: 68226 - DNA, 25 bp, Mus musculus
tgtgtgatcaatgctatgtttgcca

SEQ ID NO: 68227 - DNA, 25 bp, Mus musculus
tgtgtgatcacaccagcagtagcct

SEQ ID NO: 68228 - DNA, 25 bp, Mus musculus
tgtgtgatgggtccaatggatcttt

SEQ ID NO: 68229 - DNA, 25 bp, Mus musculus
tgtgtgcaaacctctcatctcccgg

SEQ ID NO: 68230 - DNA, 25 bp, Mus musculus
tgtgtgcagacaaagtttcttcagt

SEQ ID NO: 68231 - DNA, 25 bp, Mus musculus
tgtgtgcagccaccccttgcgtggg

SEQ ID NO: 68232 - DNA, 25 bp, Mus musculus
tgtgtgcagccagcccttgcgtggg

SEQ ID NO: 68233 - DNA, 25 bp, Mus musculus
tgtgtgccagctctcctacgcttac

SEQ ID NO: 68234 - DNA, 25 bp, Mus musculus
tgtgtgcccatgaagctcccacaga

SEQ ID NO: 68235 - DNA, 25 bp, Mus musculus
tgtgtgcctccaggataataatgga

SEQ ID NO: 68236 - DNA, 25 bp, Mus musculus
tgtgtgcctcccctagtcatgccag

SEQ ID NO: 68237 - DNA, 25 bp, Mus musculus
tgtgtgcctgcgaagccgcctctcg

SEQ ID NO: 68238 - DNA, 25 bp, Mus musculus
tgtgtgctatctgtctggaggagta

SEQ ID NO: 68239 - DNA, 25 bp, Mus musculus
tgtgtgctctctacaacattaggtc

SEQ ID NO: 68240 - DNA, 25 bp, Mus musculus
tgtgtgctctcttcaacattaggtc

SEQ ID NO: 68241 - DNA, 25 bp, Mus musculus
tgtgtgctgctgagctcgtgtgcaa

SEQ ID NO: 68242 - DNA, 25 bp, Mus musculus
tgtgtgctggaagctgccaaacaag

SEQ ID NO: 68243 - DNA, 25 bp, Mus musculus
tgtgtgctggattcctgccgctccc

SEQ ID NO: 68244 - DNA, 25 bp, Mus musculus
tgtgtggaaacatgcaggccctggt

SEQ ID NO: 68245 - DNA, 25 bp, Mus musculus
tgtgtggaaggcagctctgaccctg

SEQ ID NO: 68246 - DNA, 25 bp, Mus musculus
tgtgtggacatggttatctcggagc

SEQ ID NO: 68247 - DNA, 25 bp, Mus musculus
tgtgtggactggtcactctaatgcc

SEQ ID NO: 68248 - DNA, 25 bp, Mus musculus
tgtgtggagagccaccctttttggc

SEQ ID NO: 68249 - DNA, 25 bp, Mus musculus
tgtgtggagattgtcaagagtgaca

SEQ ID NO: 68250 - DNA, 25 bp, Mus musculus
tgtgtggagctccatccaccctgct

SEQ ID NO: 68251 - DNA, 25 bp, Mus musculus
tgtgtggcatctgggccctcttcgg

SEQ ID NO: 68252 - DNA, 25 bp, Mus musculus
tgtgtggcgactggtttcccattga

SEQ ID NO: 68253 - DNA, 25 bp, Mus musculus
tgtgtggcgatcactgaagagtcta

SEQ ID NO: 68254 - DNA, 25 bp, Mus musculus
tgtgtggctaattatataaaggaaa

SEQ ID NO: 68255 - DNA, 25 bp, Mus musculus
tgtgtgggacagatgaactaatgct

SEQ ID NO: 68256 - DNA, 25 bp, Mus musculus
tgtgtgggacttggcgtgaaaccac

SEQ ID NO: 68257 - DNA, 25 bp, Mus musculus
tgtgtgggctacctgcatctcatct

SEQ ID NO: 68258 - DNA, 25 bp, Mus musculus
tgtgtggtacgggtgactgtacagt

SEQ ID NO: 68259 - DNA, 25 bp, Mus musculus
tgtgtgtacagtagcaggctgtaac

SEQ ID NO: 68260 - DNA, 25 bp, Mus musculus
tgtgtgtagaaagcgaaatcagagg

SEQ ID NO: 68261 - DNA, 25 bp, Mus musculus
tgtgtgtctcgctgcagcacagaga

SEQ ID NO: 68262 - DNA, 25 bp, Mus musculus
tgtgtgtctttcagcatagtctcca

SEQ ID NO: 68263 - DNA, 25 bp, Mus musculus
tgtgtgtgattctgctcatcctggt

SEQ ID NO: 68264 - DNA, 25 bp, Mus musculus
tgtgtgtgcggctgccagaagctag

SEQ ID NO: 68265 - DNA, 25 bp, Mus musculus
tgtgtgtgctgtgatagcccactct

SEQ ID NO: 68266 - DNA, 25 bp, Mus musculus
tgtgtgtggactctagtttccgcaa

SEQ ID NO: 68267 - DNA, 25 bp, Mus musculus
tgtgtgtggactgtagtttccgcaa

SEQ ID NO: 68268 - DNA, 25 bp, Mus musculus
tgtgttaaggcaaaaggccaaggaa

SEQ ID NO: 68269 - DNA, 25 bp, Mus musculus
tgtgttacactctgtcaagccctac

SEQ ID NO: 68270 - DNA, 25 bp, Mus musculus
tgtgttagaaagaggtaaatcttca

SEQ ID NO: 68271 - DNA, 25 bp, Mus musculus
tgtgttagaaagtggtaaatcttca

SEQ ID NO: 68272 - DNA, 25 bp, Mus musculus
tgtgttagcgttcctcagctcctca

SEQ ID NO: 68273 - DNA, 25 bp, Mus musculus
tgtgttagcttacacgttttagcca

SEQ ID NO: 68274 - DNA, 25 bp, Mus musculus
tgtgttaggaacgatcgaacggctc

SEQ ID NO: 68275 - DNA, 25 bp, Mus musculus
tgtgttatattgaaggtcatcgggt

SEQ ID NO: 68276 - DNA, 25 bp, Mus musculus
tgtgttatcgaggttcatgacgcca

SEQ ID NO: 68277 - DNA, 25 bp, Mus musculus
tgtgttcaaaggctacctaaaggac

SEQ ID NO: 68278 - DNA, 25 bp, Mus musculus
tgtgttcacacctgatgagtctctg

SEQ ID NO: 68279 - DNA, 25 bp, Mus musculus
tgtgttcacagaaggacagacgcca

SEQ ID NO: 68280 - DNA, 25 bp, Mus musculus
tgtgttcactctgcaaaccttgctg

SEQ ID NO: 68281 - DNA, 25 bp, Mus musculus
tgtgttcagcctgtcggaggccgac

SEQ ID NO: 68282 - DNA, 25 bp, Mus musculus
tgtgttcagctccaagcccaaattc

SEQ ID NO: 68283 - DNA, 25 bp, Mus musculus
tgtgttcatcaaactcctcagtgat

SEQ ID NO: 68284 - DNA, 25 bp, Mus musculus
tgtgttcatccgacagcatcccaac

SEQ ID NO: 68285 - DNA, 25 bp, Mus musculus
tgtgttccaggctgtggaagatctt

SEQ ID NO: 68286 - DNA, 25 bp, Mus musculus
tgtgttcccttctctaggcacttcg

SEQ ID NO: 68287 - DNA, 25 bp, Mus musculus
tgtgttccgacatatacctaaagtt

SEQ ID NO: 68288 - DNA, 25 bp, Mus musculus
tgtgttccgagtctgctcaggagct

SEQ ID NO: 68289 - DNA, 25 bp, Mus musculus
tgtgttccgtgtccacaagggagtc

SEQ ID NO: 68290 - DNA, 25 bp, Mus musculus
tgtgttcgcgggatgcccgcacaaa

SEQ ID NO: 68291 - DNA, 25 bp, Mus musculus
tgtgttctacctgtcgggcccagct

SEQ ID NO: 68292 - DNA, 25 bp, Mus musculus
tgtgttctcaaagtgacgcagcaaa

SEQ ID NO: 68293 - DNA, 25 bp, Mus musculus
tgtgttcttctggatcccgtttgtg

SEQ ID NO: 68294 - DNA, 25 bp, Mus musculus
tgtgttctttccagtgtctcgttcg

SEQ ID NO: 68295 - DNA, 25 bp, Mus musculus
tgtgttgacctggtggtgtcggagc

SEQ ID NO: 68296 - DNA, 25 bp, Mus musculus
tgtgttgagaacagataatggtgta

SEQ ID NO: 68297 - DNA, 25 bp, Mus musculus
tgtgttgcaaaagctgttgaatgcc

SEQ ID NO: 68298 - DNA, 25 bp, Mus musculus
tgtgttgcctcctagtggacaagtg

SEQ ID NO: 68299 - DNA, 25 bp, Mus musculus
tgtgttggacattcttcgggacacc

SEQ ID NO: 68300 - DNA, 25 bp, Mus musculus
tgtgttggaggcactgtccccaccc

SEQ ID NO: 68301 - DNA, 25 bp, Mus musculus
tgtgttggcctttggcttcctcgga

SEQ ID NO: 68302 - DNA, 25 bp, Mus musculus
tgtgttggcttcttcagatggcgca

SEQ ID NO: 68303 - DNA, 25 bp, Mus musculus
tgtgttgggagaagatggcagtgct

SEQ ID NO: 68304 - DNA, 25 bp, Mus musculus
tgtgtttacatatgcctgggtgtgg

SEQ ID NO: 68305 - DNA, 25 bp, Mus musculus
tgtgtttaccatgaagaacgcagca

SEQ ID NO: 68306 - DNA, 25 bp, Mus musculus
tgtgtttacctgaatgttgcctgac

SEQ ID NO: 68307 - DNA, 25 bp, Mus musculus
tgtgtttagtgaatcagagggatct

SEQ ID NO: 68308 - DNA, 25 bp, Mus musculus
tgtgtttcacgttcaagcctgtgat

SEQ ID NO: 68309 - DNA, 25 bp, Mus musculus
tgtgtttcccttgtctgtatcaacg

SEQ ID NO: 68310 - DNA, 25 bp, Mus musculus
tgtgtttccttcaacaaagatctgc

SEQ ID NO: 68311 - DNA, 25 bp, Mus musculus
tgtgtttctcttcgtccctcctgaa

SEQ ID NO: 68312 - DNA, 25 bp, Mus musculus
tgtgtttgacgtagatgatgcaagg

SEQ ID NO: 68313 - DNA, 25 bp, Mus musculus
tgtgtttgaggtaccaagagctact

SEQ ID NO: 68314 - DNA, 25 bp, Mus musculus
tgtgtttgcccaaatcgactgcttt

SEQ ID NO: 68315 - DNA, 25 bp, Mus musculus
tgtgtttgctctcttaaccctgctg

SEQ ID NO: 68316 - DNA, 25 bp, Mus musculus
tgtgtttggtggaaaaacacacacc

SEQ ID NO: 68317 - DNA, 25 bp, Mus musculus
tgtgttttactaagcatcgtctttc

SEQ ID NO: 68318 - DNA, 25 bp, Mus musculus
tgtgttttcaagaggctcgtatgag

SEQ ID NO: 68319 - DNA, 25 bp, Mus musculus
tgtgttttcaagtggctcgtatgag

SEQ ID NO: 68320 - DNA, 25 bp, Mus musculus
tgtgttttcagaaagttgcagcaga

SEQ ID NO: 68321 - DNA, 25 bp, Mus musculus
tgtgttttcctgatccgggctcggg

SEQ ID NO: 68322 - DNA, 25 bp, Mus musculus
tgttaaaaattcagacggtcaagca

SEQ ID NO: 68323 - DNA, 25 bp, Mus musculus
tgttaaagaaagtggtaatgatacc

SEQ ID NO: 68324 - DNA, 25 bp, Mus musculus
tgttaaatccagcttgtgctgccca

SEQ ID NO: 68325 - DNA, 25 bp, Mus musculus
tgttaaatccaggttgtgctgccca

SEQ ID NO: 68326 - DNA, 25 bp, Mus musculus
tgttaaatgactactgggctcgcct

SEQ ID NO: 68327 - DNA, 25 bp, Mus musculus
tgttaaatgacttctgggctcgcct

SEQ ID NO: 68328 - DNA, 25 bp, Mus musculus
tgttaacaagcaggaaacctggatg

SEQ ID NO: 68329 - DNA, 25 bp, Mus musculus
tgttaacacagagtgccctgggctc

SEQ ID NO: 68330 - DNA, 25 bp, Mus musculus
tgttaacaccacgactctggctgct

SEQ ID NO: 68331 - DNA, 25 bp, Mus musculus
tgttaacaggcaaatcagaaggctg

SEQ ID NO: 68332 - DNA, 25 bp, Mus musculus
tgttaacatgcaggtccagattcag

SEQ ID NO: 68333 - DNA, 25 bp, Mus musculus
tgttaaccggcttgattcggtggaa

SEQ ID NO: 68334 - DNA, 25 bp, Mus musculus
tgttaacctggaccagtagagctgg

SEQ ID NO: 68335 - DNA, 25 bp, Mus musculus
tgttaacgaatgtcttcaaagtgac

SEQ ID NO: 68336 - DNA, 25 bp, Mus musculus
tgttaacgacaaagtagaaaattca

SEQ ID NO: 68337 - DNA, 25 bp, Mus musculus
tgttaactgtaaagtcagaggatgt

SEQ ID NO: 68338 - DNA, 25 bp, Mus musculus
tgttaagacattgtcacggagtgac

SEQ ID NO: 68339 - DNA, 25 bp, Mus musculus
tgttaagcttatcaaaactctgtgt

SEQ ID NO: 68340 - DNA, 25 bp, Mus musculus
tgttaagcttatgaaaactctgtgt

SEQ ID NO: 68341 - DNA, 25 bp, Mus musculus
tgttaagtgggaccctcagcctacc

SEQ ID NO: 68342 - DNA, 25 bp, Mus musculus
tgttaatcaagtcttccccgctgaa

SEQ ID NO: 68343 - DNA, 25 bp, Mus musculus
tgttaattctaggaggatcacctta

SEQ ID NO: 68344 - DNA, 25 bp, Mus musculus
tgttacaaattcatcaacatccagt

SEQ ID NO: 68345 - DNA, 25 bp, Mus musculus
tgttacaacacagcccagccctgaa

SEQ ID NO: 68346 - DNA, 25 bp, Mus musculus
tgttacaagctgtgaatcagaaaaa

SEQ ID NO: 68347 - DNA, 25 bp, Mus musculus
tgttacaatgaacctagaagaaaga

SEQ ID NO: 68348 - DNA, 25 bp, Mus musculus
tgttacacggaataaagtcagaaaa

SEQ ID NO: 68349 - DNA, 25 bp, Mus musculus
tgttacagagggaagaaatgtgatt

SEQ ID NO: 68350 - DNA, 25 bp, Mus musculus
tgttacagatcttatagcagtcggt

SEQ ID NO: 68351 - DNA, 25 bp, Mus musculus
tgttacagatgacctggatgctccc

SEQ ID NO: 68352 - DNA, 25 bp, Mus musculus
tgttacataaaagtctcacttctga

SEQ ID NO: 68353 - DNA, 25 bp, Mus musculus
tgttaccaacaacttgaaatccctg

SEQ ID NO: 68354 - DNA, 25 bp, Mus musculus
tgttaccaagacaacagtacgtcat

SEQ ID NO: 68355 - DNA, 25 bp, Mus musculus
tgttaccctgtgacgtgctggtgcg

SEQ ID NO: 68356 - DNA, 25 bp, Mus musculus
tgttaccgtcagaacacccagcaga

SEQ ID NO: 68357 - DNA, 25 bp, Mus musculus
tgttacctcaagaggcggagacctg

SEQ ID NO: 68358 - DNA, 25 bp, Mus musculus
tgttacctcaagtggcggagacctg

SEQ ID NO: 68359 - DNA, 25 bp, Mus musculus
tgttacgaatgtgttggtgagccac

SEQ ID NO: 68360 - DNA, 25 bp, Mus musculus
tgttactcacagcaaagcagccatc

SEQ ID NO: 68361 - DNA, 25 bp, Mus musculus
tgttactggcttgaagacatcctgt

SEQ ID NO: 68362 - DNA, 25 bp, Mus musculus
tgttactgtgacaaccgtcccaact

SEQ ID NO: 68363 - DNA, 25 bp, Mus musculus
tgttagaacgcttttaagaaatgca

SEQ ID NO: 68364 - DNA, 25 bp, Mus musculus
tgttagaagaagatacagtgacttt

SEQ ID NO: 68365 - DNA, 25 bp, Mus musculus
tgttagcaatgacgccgactgggac

SEQ ID NO: 68366 - DNA, 25 bp, Mus musculus
tgttagcagccgtttggtttcgaac

SEQ ID NO: 68367 - DNA, 25 bp, Mus musculus
tgttagcattcaagtcaggaggctc

SEQ ID NO: 68368 - DNA, 25 bp, Mus musculus
tgttagccctgtgttggcctttggc

SEQ ID NO: 68369 - DNA, 25 bp, Mus musculus
tgttagctctaaccacagtcgcacc

SEQ ID NO: 68370 - DNA, 25 bp, Mus musculus
tgttagctgctaacccacaggaccg

SEQ ID NO: 68371 - DNA, 25 bp, Mus musculus
tgttaggatgaaatcagatctacta

SEQ ID NO: 68372 - DNA, 25 bp, Mus musculus
tgttagtccagagaggttatgaatc

SEQ ID NO: 68373 - DNA, 25 bp, Mus musculus
tgttagtcggtatgcagagtttaaa

SEQ ID NO: 68374 - DNA, 25 bp, Mus musculus
tgttagtggaatctccagaccttca

SEQ ID NO: 68375 - DNA, 25 bp, Mus musculus
tgttatacaaaagtttgaagatgag

SEQ ID NO: 68376 - DNA, 25 bp, Mus musculus
tgttatagctaaaagggcactgttt

SEQ ID NO: 68377 - DNA, 25 bp, Mus musculus
tgttataggctccagttcactcctc

SEQ ID NO: 68378 - DNA, 25 bp, Mus musculus
tgttatcaatcggatgaggagcctg

SEQ ID NO: 68379 - DNA, 25 bp, Mus musculus
tgttatcagctcaccacagttggca

SEQ ID NO: 68380 - DNA, 25 bp, Mus musculus
tgttatccctggcagtcgatgggct

SEQ ID NO: 68381 - DNA, 25 bp, Mus musculus
tgttatcgaggttcatgacgccagg

SEQ ID NO: 68382 - DNA, 25 bp, Mus musculus
tgttatctgtacgaacctccaccat

SEQ ID NO: 68383 - DNA, 25 bp, Mus musculus
tgttatgaaatgcaagacagtctcc

SEQ ID NO: 68384 - DNA, 25 bp, Mus musculus
tgttatgaaatggaagacagtctcc

SEQ ID NO: 68385 - DNA, 25 bp, Mus musculus
tgttatgaacaaagatcagtggtac

SEQ ID NO: 68386 - DNA, 25 bp, Mus musculus
tgttatgacaccaatgcggcagaca

SEQ ID NO: 68387 - DNA, 25 bp, Mus musculus
tgttatgacacctatgcggcagaca

SEQ ID NO: 68388 - DNA, 25 bp, Mus musculus
tgttatgctggctggaatttcacag

SEQ ID NO: 68389 - DNA, 25 bp, Mus musculus
tgttatggtagatggaaaaccagtg

SEQ ID NO: 68390 - DNA, 25 bp, Mus musculus
tgttattgagttcatagccagagaa

SEQ ID NO: 68391 - DNA, 25 bp, Mus musculus
tgttcaaaagctccgcttcacatac

SEQ ID NO: 68392 - DNA, 25 bp, Mus musculus
tgttcaaactgagaccaaaaccatc

SEQ ID NO: 68393 - DNA, 25 bp, Mus musculus
tgttcaacaacgagctgatggctga

SEQ ID NO: 68394 - DNA, 25 bp, Mus musculus
tgttcaacaagtgggaccccagggc

SEQ ID NO: 68395 - DNA, 25 bp, Mus musculus
tgttcaacaccaacgctaccattgt

SEQ ID NO: 68396 - DNA, 25 bp, Mus musculus
tgttcaactccttccatttctggag

SEQ ID NO: 68397 - DNA, 25 bp, Mus musculus
tgttcaagcaacagattatccagag

SEQ ID NO: 68398 - DNA, 25 bp, Mus musculus
tgttcaagccctggagatcacctaa

SEQ ID NO: 68399 - DNA, 25 bp, Mus musculus
tgttcaagcggctgcacctgggtac

SEQ ID NO: 68400 - DNA, 25 bp, Mus musculus
tgttcaaggcataggagcagcctca

SEQ ID NO: 68401 - DNA, 25 bp, Mus musculus
tgttcaaggcattggagcagcctca

SEQ ID NO: 68402 - DNA, 25 bp, Mus musculus
tgttcaagggattgatgcacatcga

SEQ ID NO: 68403 - DNA, 25 bp, Mus musculus
tgttcaagtgggattacatgacacc

SEQ ID NO: 68404 - DNA, 25 bp, Mus musculus
tgttcaagttgcaaaccacaagcga

SEQ ID NO: 68405 - DNA, 25 bp, Mus musculus
tgttcaatgtgacagaggcccagag

SEQ ID NO: 68406 - DNA, 25 bp, Mus musculus
tgttcacaaacagagagtggctgaa

SEQ ID NO: 68407 - DNA, 25 bp, Mus musculus
tgttcacaataatgataaactcacc

SEQ ID NO: 68408 - DNA, 25 bp, Mus musculus
tgttcacacctgatgagtctctgga

SEQ ID NO: 68409 - DNA, 25 bp, Mus musculus
tgttcacatccacggaggcggcttt

SEQ ID NO: 68410 - DNA, 25 bp, Mus musculus
tgttcaccatccataaaagcacggg

SEQ ID NO: 68411 - DNA, 25 bp, Mus musculus
tgttcacctaatgactaagaattgg

SEQ ID NO: 68412 - DNA, 25 bp, Mus musculus
tgttcacgaggcaccatctcaggag

SEQ ID NO: 68413 - DNA, 25 bp, Mus musculus
tgttcactttcagcagtcagctcag

SEQ ID NO: 68414 - DNA, 25 bp, Mus musculus
tgttcagagctattctgctgcttca

SEQ ID NO: 68415 - DNA, 25 bp, Mus musculus
tgttcagaggcaaggagaatgcgct

SEQ ID NO: 68416 - DNA, 25 bp, Mus musculus
tgttcagagtaaagtgtgccaccag

SEQ ID NO: 68417 - DNA, 25 bp, Mus musculus
tgttcagatgtcacaaaacttgcaa

SEQ ID NO: 68418 - DNA, 25 bp, Mus musculus
tgttcagcaccgaaaaggagatcct

SEQ ID NO: 68419 - DNA, 25 bp, Mus musculus
tgttcagcctgtgaccagatcttcc

SEQ ID NO: 68420 - DNA, 25 bp, Mus musculus
tgttcagcgaacagcacaagcgtgc

SEQ ID NO: 68421 - DNA, 25 bp, Mus musculus
tgttcagcggtacctcgtaccccgg

SEQ ID NO: 68422 - DNA, 25 bp, Mus musculus
tgttcagctagccagctcagctgtc

SEQ ID NO: 68423 - DNA, 25 bp, Mus musculus
tgttcagctcgtgctgtcctgcttc

SEQ ID NO: 68424 - DNA, 25 bp, Mus musculus
tgttcagctgatcccaaccactatg

SEQ ID NO: 68425 - DNA, 25 bp, Mus musculus
tgttcaggacagacatagaaacaga

SEQ ID NO: 68426 - DNA, 25 bp, Mus musculus
tgttcaggtaccagtgagggcgcct

SEQ ID NO: 68427 - DNA, 25 bp, Mus musculus
tgttcaggtcacgtttggaagaacc

SEQ ID NO: 68428 - DNA, 25 bp, Mus musculus
tgttcagtcctacaaccacaactgc

SEQ ID NO: 68429 - DNA, 25 bp, Mus musculus
tgttcagtgaccgagggattcccga

SEQ ID NO: 68430 - DNA, 25 bp, Mus musculus
tgttcagtgtcacaaccgttgacct

SEQ ID NO: 68431 - DNA, 25 bp, Mus musculus
tgttcagtgtgacagccgtgccaac

SEQ ID NO: 68432 - DNA, 25 bp, Mus musculus
tgttcagttatcacgaccctcaagg

SEQ ID NO: 68433 - DNA, 25 bp, Mus musculus
tgttcatatccatgctgtccagtgg

SEQ ID NO: 68434 - DNA, 25 bp, Mus musculus
tgttcatcaaactcctcagtgatcc

SEQ ID NO: 68435 - DNA, 25 bp, Mus musculus
tgttcatcgcctgacaatggtggat

SEQ ID NO: 68436 - DNA, 25 bp, Mus musculus
tgttcatcgtccacaccatcgagga

SEQ ID NO: 68437 - DNA, 25 bp, Mus musculus
tgttcatctccaataactacatctg

SEQ ID NO: 68438 - DNA, 25 bp, Mus musculus
tgttcatgaacatgcagagtctgaa

SEQ ID NO: 68439 - DNA, 25 bp, Mus musculus
tgttcatgaagatgacaaaaatggg

SEQ ID NO: 68440 - DNA, 25 bp, Mus musculus
tgttcatgactgacaacgggctccg

SEQ ID NO: 68441 - DNA, 25 bp, Mus musculus
tgttcatgagcgtgcagtcactcaa

SEQ ID NO: 68442 - DNA, 25 bp, Mus musculus
tgttcatggatgtgcagacatgtga

SEQ ID NO: 68443 - DNA, 25 bp, Mus musculus
tgttcattctgcttggaaacaactg

SEQ ID NO: 68444 - DNA, 25 bp, Mus musculus
tgttcattggaaatctgccccggga

SEQ ID NO: 68445 - DNA, 25 bp, Mus musculus
tgttccaaatccaggagaccaacca

SEQ ID NO: 68446 - DNA, 25 bp, Mus musculus
tgttccaagtctgtggcttccgatg

SEQ ID NO: 68447 - DNA, 25 bp, Mus musculus
tgttccacacagaactctgagagct

SEQ ID NO: 68448 - DNA, 25 bp, Mus musculus
tgttccacagaaaccctagccagag

SEQ ID NO: 68449 - DNA, 25 bp, Mus musculus
tgttccacagaatccctagccagag

SEQ ID NO: 68450 - DNA, 25 bp, Mus musculus
tgttccacgacaggcgactgcagta

SEQ ID NO: 68451 - DNA, 25 bp, Mus musculus
tgttccagaccctcaagtacctggc

SEQ ID NO: 68452 - DNA, 25 bp, Mus musculus
tgttccagactatcaggctgaaagt

SEQ ID NO: 68453 - DNA, 25 bp, Mus musculus
tgttccagcaccgagagggctgtgt

SEQ ID NO: 68454 - DNA, 25 bp, Mus musculus
tgttccagcagtcccagttgcctaa

SEQ ID NO: 68455 - DNA, 25 bp, Mus musculus
tgttccagtgatggcaatcagagac

SEQ ID NO: 68456 - DNA, 25 bp, Mus musculus
tgttccagttgtacaacagacgatc

SEQ ID NO: 68457 - DNA, 25 bp, Mus musculus
tgttccatcagcaggcgctgcagga

SEQ ID NO: 68458 - DNA, 25 bp, Mus musculus
tgttccatcatatcagccaatctac

SEQ ID NO: 68459 - DNA, 25 bp, Mus musculus
tgttccatgagcagggcatcctctt

SEQ ID NO: 68460 - DNA, 25 bp, Mus musculus
tgttccatgcccattcgggcaagga

SEQ ID NO: 68461 - DNA, 25 bp, Mus musculus
tgttcccatatcaagcgtcatctgc

SEQ ID NO: 68462 - DNA, 25 bp, Mus musculus
tgttccccagacaccatctatgagg

SEQ ID NO: 68463 - DNA, 25 bp, Mus musculus
tgttccccaggctctgaaggacctg

SEQ ID NO: 68464 - DNA, 25 bp, Mus musculus
tgttcccctgaagagttcacaaggc

SEQ ID NO: 68465 - DNA, 25 bp, Mus musculus
tgttcccctggacttagtaaagtgc

SEQ ID NO: 68466 - DNA, 25 bp, Mus musculus
tgttcccgcttcaggtggcctggtg

SEQ ID NO: 68467 - DNA, 25 bp, Mus musculus
tgttcccgtctaactgagcgtgctc

SEQ ID NO: 68468 - DNA, 25 bp, Mus musculus
tgttccctctactctgcctggcgag

SEQ ID NO: 68469 - DNA, 25 bp, Mus musculus
tgttccctgagtcagtcatcagaaa

SEQ ID NO: 68470 - DNA, 25 bp, Mus musculus
tgttccctgcagatgagctctatgg

SEQ ID NO: 68471 - DNA, 25 bp, Mus musculus
tgttccctgcttgccgggactattg

SEQ ID NO: 68472 - DNA, 25 bp, Mus musculus
tgttcccttctctaggcacttcgga

SEQ ID NO: 68473 - DNA, 25 bp, Mus musculus
tgttccgaaactctcagctggccca

SEQ ID NO: 68474 - DNA, 25 bp, Mus musculus
tgttccgaacagcagtgtccagcag

SEQ ID NO: 68475 - DNA, 25 bp, Mus musculus
tgttccgagcccagttccaatatcg

SEQ ID NO: 68476 - DNA, 25 bp, Mus musculus
tgttccgagccctgttccaatatcg

SEQ ID NO: 68477 - DNA, 25 bp, Mus musculus
tgttccgaggttctctgtacaagag

SEQ ID NO: 68478 - DNA, 25 bp, Mus musculus
tgttccgagtctgctcaggagctag

SEQ ID NO: 68479 - DNA, 25 bp, Mus musculus
tgttccggaggaattttcagccccg

SEQ ID NO: 68480 - DNA, 25 bp, Mus musculus
tgttccggatctcacctgttatagt

SEQ ID NO: 68481 - DNA, 25 bp, Mus musculus
tgttccggcacacagacagcctctt

SEQ ID NO: 68482 - DNA, 25 bp, Mus musculus
tgttccggcagatcgtggatgctca

SEQ ID NO: 68483 - DNA, 25 bp, Mus musculus
tgttccgtaatctcaccccaagatg

SEQ ID NO: 68484 - DNA, 25 bp, Mus musculus
tgttcctaaacattggcgagacctt

SEQ ID NO: 68485 - DNA, 25 bp, Mus musculus
tgttcctaagctgacatcaccagtt

SEQ ID NO: 68486 - DNA, 25 bp, Mus musculus
tgttcctacagacatatgcccgagg

SEQ ID NO: 68487 - DNA, 25 bp, Mus musculus
tgttcctcagttccggatattggtg

SEQ ID NO: 68488 - DNA, 25 bp, Mus musculus
tgttcctccttctgaagacagcaac

SEQ ID NO: 68489 - DNA, 25 bp, Mus musculus
tgttcctcggttaccccgcggacag

SEQ ID NO: 68490 - DNA, 25 bp, Mus musculus
tgttcctctgagcattactgaccgc

SEQ ID NO: 68491 - DNA, 25 bp, Mus musculus
tgttcctctgaggattactgaccgc

SEQ ID NO: 68492 - DNA, 25 bp, Mus musculus
tgttcctgaaaccaagctagaagtt

SEQ ID NO: 68493 - DNA, 25 bp, Mus musculus
tgttcctgaaacgaagctagaagtt

SEQ ID NO: 68494 - DNA, 25 bp, Mus musculus
tgttcctgacactccagaccgttgc

SEQ ID NO: 68495 - DNA, 25 bp, Mus musculus
tgttcctgactcctaatgagcacag

SEQ ID NO: 68496 - DNA, 25 bp, Mus musculus
tgttcctggccattggcctctgggc

SEQ ID NO: 68497 - DNA, 25 bp, Mus musculus
tgttcctgggaaatattggtcccca

SEQ ID NO: 68498 - DNA, 25 bp, Mus musculus
tgttcctggtggctaacttcctgct

SEQ ID NO: 68499 - DNA, 25 bp, Mus musculus
tgttccttggaaagacgtctagtca

SEQ ID NO: 68500 - DNA, 25 bp, Mus musculus
tgttccttttgatttccaagcagaa

SEQ ID NO: 68501 - DNA, 25 bp, Mus musculus
tgttcgaagtaaagttggcagcagg

SEQ ID NO: 68502 - DNA, 25 bp, Mus musculus
tgttcgaagtcattgaaacggaaaa

SEQ ID NO: 68503 - DNA, 25 bp, Mus musculus
tgttcgaatttgctctaggaatcta

SEQ ID NO: 68504 - DNA, 25 bp, Mus musculus
tgttcgacctggaggtgaactgcct

SEQ ID NO: 68505 - DNA, 25 bp, Mus musculus
tgttcgagccccaggaagagtcaac

SEQ ID NO: 68506 - DNA, 25 bp, Mus musculus
tgttcgatacagagaactgggaaac

SEQ ID NO: 68507 - DNA, 25 bp, Mus musculus
tgttcgccaaaatggacagttggtc

SEQ ID NO: 68508 - DNA, 25 bp, Mus musculus
tgttcgcccctcaagaatggcatga

SEQ ID NO: 68509 - DNA, 25 bp, Mus musculus
tgttcggaaaccacttatcctgggc

SEQ ID NO: 68510 - DNA, 25 bp, Mus musculus
tgttcggtttccagcactgaccagt

SEQ ID NO: 68511 - DNA, 25 bp, Mus musculus
tgttcgtaaagctggccaacccgca

SEQ ID NO: 68512 - DNA, 25 bp, Mus musculus
tgttcgtctcagcttctcacttcag

SEQ ID NO: 68513 - DNA, 25 bp, Mus musculus
tgttcgtgaagacttcaaggccctg

SEQ ID NO: 68514 - DNA, 25 bp, Mus musculus
tgttcgtgcacgtgtacatccacca

SEQ ID NO: 68515 - DNA, 25 bp, Mus musculus
tgttcgtgcactctgcgaagagcct

SEQ ID NO: 68516 - DNA, 25 bp, Mus musculus
tgttcgtgggctgcagtgtcaccct

SEQ ID NO: 68517 - DNA, 25 bp, Mus musculus
tgttcgttaaagcaggcagtagata

SEQ ID NO: 68518 - DNA, 25 bp, Mus musculus
tgttctaccacagacccgctatgtg

SEQ ID NO: 68519 - DNA, 25 bp, Mus musculus
tgttctataccattgagccctggac

SEQ ID NO: 68520 - DNA, 25 bp, Mus musculus
tgttctatggaaagtctctgcccct

SEQ ID NO: 68521 - DNA, 25 bp, Mus musculus
tgttctatggcgtgctaaccaacag

SEQ ID NO: 68522 - DNA, 25 bp, Mus musculus
tgttctatgtctgcctgtgccagat

SEQ ID NO: 68523 - DNA, 25 bp, Mus musculus
tgttctcaaacagtgatgaggctgt

SEQ ID NO: 68524 - DNA, 25 bp, Mus musculus
tgttctcaagaagcaacacactaag

SEQ ID NO: 68525 - DNA, 25 bp, Mus musculus
tgttctcaagcctgcacaggagaag

SEQ ID NO: 68526 - DNA, 25 bp, Mus musculus
tgttctcaccaccaacaatacagca

SEQ ID NO: 68527 - DNA, 25 bp, Mus musculus
tgttctcaccatatgtaccctcaaa

SEQ ID NO: 68528 - DNA, 25 bp, Mus musculus
tgttctcagaaggacagtctacccc

SEQ ID NO: 68529 - DNA, 25 bp, Mus musculus
tgttctcatcactgcgagcctgcaa

SEQ ID NO: 68530 - DNA, 25 bp, Mus musculus
tgttctcatgaagatcacatttgag

SEQ ID NO: 68531 - DNA, 25 bp, Mus musculus
tgttctccagtcactaaggagctgt

SEQ ID NO: 68532 - DNA, 25 bp, Mus musculus
tgttctcctccgagaagtcgtcctg

SEQ ID NO: 68533 - DNA, 25 bp, Mus musculus
tgttctctgaggaccgcacacgttt

SEQ ID NO: 68534 - DNA, 25 bp, Mus musculus
tgttctctgcagttgagtggccgga

SEQ ID NO: 68535 - DNA, 25 bp, Mus musculus
tgttctgaccgccaaagattttaac

SEQ ID NO: 68536 - DNA, 25 bp, Mus musculus
tgttctgagaagacaaccaaccagg

SEQ ID NO: 68537 - DNA, 25 bp, Mus musculus
tgttctgagaatcaggtgccactaa

SEQ ID NO: 68538 - DNA, 25 bp, Mus musculus
tgttctgagtacaggaattcactgt

SEQ ID NO: 68539 - DNA, 25 bp, Mus musculus
tgttctgatatctccatcactatgg

SEQ ID NO: 68540 - DNA, 25 bp, Mus musculus
tgttctgcagcagagctcctccttg

SEQ ID NO: 68541 - DNA, 25 bp, Mus musculus
tgttctggagaaccatcacgccgct

SEQ ID NO: 68542 - DNA, 25 bp, Mus musculus
tgttctggctatcagatacgacgct

SEQ ID NO: 68543 - DNA, 25 bp, Mus musculus
tgttctggtcccatacctaatagga

SEQ ID NO: 68544 - DNA, 25 bp, Mus musculus
tgttctgtcaaaagctgagattgct

SEQ ID NO: 68545 - DNA, 25 bp, Mus musculus
tgttctgtgactccctacagccctg

SEQ ID NO: 68546 - DNA, 25 bp, Mus musculus
tgttcttaccttttgacaacttcac

SEQ ID NO: 68547 - DNA, 25 bp, Mus musculus
tgttcttactgatggagcaggagct

SEQ ID NO: 68548 - DNA, 25 bp, Mus musculus
tgttcttaggctacctaacttctaa

SEQ ID NO: 68549 - DNA, 25 bp, Mus musculus
tgttcttcctgtttcctgcctcagt

SEQ ID NO: 68550 - DNA, 25 bp, Mus musculus
tgttcttcgagagcctgcagcggcg

SEQ ID NO: 68551 - DNA, 25 bp, Mus musculus
tgttcttggaagaagcatcctggct

SEQ ID NO: 68552 - DNA, 25 bp, Mus musculus
tgttcttggtcaattccatgttgaa

SEQ ID NO: 68553 - DNA, 25 bp, Mus musculus
tgttctttacgtctccatggcctgc

SEQ ID NO: 68554 - DNA, 25 bp, Mus musculus
tgttctttacgtgtccatggcctgc

SEQ ID NO: 68555 - DNA, 25 bp, Mus musculus
tgttctttggctattcccactggtc

SEQ ID NO: 68556 - DNA, 25 bp, Mus musculus
tgttctttggctctgcacccagtcc

SEQ ID NO: 68557 - DNA, 25 bp, Mus musculus
tgttctttggcttttcccactggtc

SEQ ID NO: 68558 - DNA, 25 bp, Mus musculus
tgttcttttccaactgccagagcct

SEQ ID NO: 68559 - DNA, 25 bp, Mus musculus
tgttgaaacaggaacaatctcttca

SEQ ID NO: 68560 - DNA, 25 bp, Mus musculus
tgttgaaactcagtgacctgcagtc

SEQ ID NO: 68561 - DNA, 25 bp, Mus musculus
tgttgaaagtgaagaaatcaatggg

SEQ ID NO: 68562 - DNA, 25 bp, Mus musculus
tgttgaaattgatctaaagccagtc

SEQ ID NO: 68563 - DNA, 25 bp, Mus musculus
tgttgaacgggcagaccggaagctg

SEQ ID NO: 68564 - DNA, 25 bp, Mus musculus
tgttgaagaagctggtgcactgcag

SEQ ID NO: 68565 - DNA, 25 bp, Mus musculus
tgttgaagaccattataaaaatccc

SEQ ID NO: 68566 - DNA, 25 bp, Mus musculus
tgttgaagacgactcagacatctta

SEQ ID NO: 68567 - DNA, 25 bp, Mus musculus
tgttgaagatgaagcagtggataaa

SEQ ID NO: 68568 - DNA, 25 bp, Mus musculus
tgttgaagcatcaccagtcgtggct

SEQ ID NO: 68569 - DNA, 25 bp, Mus musculus
tgttgaagtgatgaacctgatggca

SEQ ID NO: 68570 - DNA, 25 bp, Mus musculus
tgttgaatcccgaacctgcacccgg

SEQ ID NO: 68571 - DNA, 25 bp, Mus musculus
tgttgacaaagggacttacgatgcc

SEQ ID NO: 68572 - DNA, 25 bp, Mus musculus
tgttgacaaggacttctactcagaa

SEQ ID NO: 68573 - DNA, 25 bp, Mus musculus
tgttgaccaagatgatggccctaga

SEQ ID NO: 68574 - DNA, 25 bp, Mus musculus
tgttgacctaaagaagaatatcgaa

SEQ ID NO: 68575 - DNA, 25 bp, Mus musculus
tgttgacgctgctgaaagatggctg

SEQ ID NO: 68576 - DNA, 25 bp, Mus musculus
tgttgacggcatggacctgggcaaa

SEQ ID NO: 68577 - DNA, 25 bp, Mus musculus
tgttgactgcagatcaagccataga

SEQ ID NO: 68578 - DNA, 25 bp, Mus musculus
tgttgacttactttgctgcatttga

SEQ ID NO: 68579 - DNA, 25 bp, Mus musculus
tgttgacttcgctttgcatcaggga

SEQ ID NO: 68580 - DNA, 25 bp, Mus musculus
tgttgactttgaatctgtgtttgga

SEQ ID NO: 68581 - DNA, 25 bp, Mus musculus
tgttgagactatgaaagactgctca

SEQ ID NO: 68582 - DNA, 25 bp, Mus musculus
tgttgagcagcccaccgtctttatg

SEQ ID NO: 68583 - DNA, 25 bp, Mus musculus
tgttgagcctttcctgcgtctacag

SEQ ID NO: 68584 - DNA, 25 bp, Mus musculus
tgttgagcttgagccaaaccgggtc

SEQ ID NO: 68585 - DNA, 25 bp, Mus musculus
tgttgagggcttaagagatttggaa

SEQ ID NO: 68586 - DNA, 25 bp, Mus musculus
tgttgaggtgtgaacgtggacactt

SEQ ID NO: 68587 - DNA, 25 bp, Mus musculus
tgttgatcacatagcatggtcatcc

SEQ ID NO: 68588 - DNA, 25 bp, Mus musculus
tgttgatcctgtcattagcaagcgg

SEQ ID NO: 68589 - DNA, 25 bp, Mus musculus
tgttgatcttgaacctcgatactgc

SEQ ID NO: 68590 - DNA, 25 bp, Mus musculus
tgttgatgccaaggaaacatcagcc

SEQ ID NO: 68591 - DNA, 25 bp, Mus musculus
tgttgatgccatttagagtggaaag

SEQ ID NO: 68592 - DNA, 25 bp, Mus musculus
tgttgatggacttctcagttggctt

SEQ ID NO: 68593 - DNA, 25 bp, Mus musculus
tgttgatgttgtaccgcaggacgga

SEQ ID NO: 68594 - DNA, 25 bp, Mus musculus
tgttgattctaagagtcccaacttg

SEQ ID NO: 68595 - DNA, 25 bp, Mus musculus
tgttgattgccgagtatgtgacgag

SEQ ID NO: 68596 - DNA, 25 bp, Mus musculus
tgttgatttctcctatactgtgggc

SEQ ID NO: 68597 - DNA, 25 bp, Mus musculus
tgttgcaaaagctgttgaatgcccc

SEQ ID NO: 68598 - DNA, 25 bp, Mus musculus
tgttgcaaaatctactccctgaagg

SEQ ID NO: 68599 - DNA, 25 bp, Mus musculus
tgttgcaaatgaaaaggcgctagct

SEQ ID NO: 68600 - DNA, 25 bp, Mus musculus
tgttgcaagataaataagaagctca

SEQ ID NO: 68601 - DNA, 25 bp, Mus musculus
tgttgcacagtcaagccccacagag

SEQ ID NO: 68602 - DNA, 25 bp, Mus musculus
tgttgcacagtcttccagcagttcg

SEQ ID NO: 68603 - DNA, 25 bp, Mus musculus
tgttgcagcctctctcaggcctggt

SEQ ID NO: 68604 - DNA, 25 bp, Mus musculus
tgttgcagctagtcaccagtgtttt

SEQ ID NO: 68605 - DNA, 25 bp, Mus musculus
tgttgcaggagaaacttcagtcttg

SEQ ID NO: 68606 - DNA, 25 bp, Mus musculus
tgttgcaggcctggcggtgggactg

SEQ ID NO: 68607 - DNA, 25 bp, Mus musculus
tgttgcagggaatggaacaattata

SEQ ID NO: 68608 - DNA, 25 bp, Mus musculus
tgttgcagtggccataaaaaccctg

SEQ ID NO: 68609 - DNA, 25 bp, Mus musculus
tgttgcatatgccactggacaggga

SEQ ID NO: 68610 - DNA, 25 bp, Mus musculus
tgttgcatggatatgaggcagtgaa

SEQ ID NO: 68611 - DNA, 25 bp, Mus musculus
tgttgcatgtgtactggcccaggag

SEQ ID NO: 68612 - DNA, 25 bp, Mus musculus
tgttgccagtcctggaacactgttc

SEQ ID NO: 68613 - DNA, 25 bp, Mus musculus
tgttgccagtgttgtggtctccttc

SEQ ID NO: 68614 - DNA, 25 bp, Mus musculus
tgttgccatattacacggaaagcct

SEQ ID NO: 68615 - DNA, 25 bp, Mus musculus
tgttgcccatcttgatagacaaggt

SEQ ID NO: 68616 - DNA, 25 bp, Mus musculus
tgttgcccatgtcttcacactgttg

SEQ ID NO: 68617 - DNA, 25 bp, Mus musculus
tgttgccctgacgacttcgtgggac

SEQ ID NO: 68618 - DNA, 25 bp, Mus musculus
tgttgccctgatacatgcatccacc

SEQ ID NO: 68619 - DNA, 25 bp, Mus musculus
tgttgccgggagacaccactgtcat

SEQ ID NO: 68620 - DNA, 25 bp, Mus musculus
tgttgcctaaggacgtccaccacta

SEQ ID NO: 68621 - DNA, 25 bp, Mus musculus
tgttgcctatcccaggaagtgctgc

SEQ ID NO: 68622 - DNA, 25 bp, Mus musculus
tgttgcctgaccttaggattctatg

SEQ ID NO: 68623 - DNA, 25 bp, Mus musculus
tgttgcctgcacagtgagccccatg

SEQ ID NO: 68624 - DNA, 25 bp, Mus musculus
tgttgcctgcccagcccatgatatc

SEQ ID NO: 68625 - DNA, 25 bp, Mus musculus
tgttgcgagccaagctgcgggatac

SEQ ID NO: 68626 - DNA, 25 bp, Mus musculus
tgttgcgcagccattggtacctgta

SEQ ID NO: 68627 - DNA, 25 bp, Mus musculus
tgttgcgctggaaagaagatccttc

SEQ ID NO: 68628 - DNA, 25 bp, Mus musculus
tgttgcgcttacagcaggaggccat

SEQ ID NO: 68629 - DNA, 25 bp, Mus musculus
tgttgcgggccgactgtctatgatg

SEQ ID NO: 68630 - DNA, 25 bp, Mus musculus
tgttgcgtcaacaaacaaataagga

SEQ ID NO: 68631 - DNA, 25 bp, Mus musculus
tgttgctaacaccactaaccaggaa

SEQ ID NO: 68632 - DNA, 25 bp, Mus musculus
tgttgctaagggaggagtcgaccac

SEQ ID NO: 68633 - DNA, 25 bp, Mus musculus
tgttgctacaacaggatctttccag

SEQ ID NO: 68634 - DNA, 25 bp, Mus musculus
tgttgctccagtaatggacggaagc

SEQ ID NO: 68635 - DNA, 25 bp, Mus musculus
tgttgctcctcctgcttctaacgct

SEQ ID NO: 68636 - DNA, 25 bp, Mus musculus
tgttgctgaacaccccaggagtagc

SEQ ID NO: 68637 - DNA, 25 bp, Mus musculus
tgttgctgaggtccgcacagcatcc

SEQ ID NO: 68638 - DNA, 25 bp, Mus musculus
tgttgctgatcataagaaaggagca

SEQ ID NO: 68639 - DNA, 25 bp, Mus musculus
tgttgctgctactggtccttctgcg

SEQ ID NO: 68640 - DNA, 25 bp, Mus musculus
tgttgctgctgacgctgctggcctt

SEQ ID NO: 68641 - DNA, 25 bp, Mus musculus
tgttgctggaggtcttattacaaaa

SEQ ID NO: 68642 - DNA, 25 bp, Mus musculus
tgttgctggcttactgtcgtctcga

SEQ ID NO: 68643 - DNA, 25 bp, Mus musculus
tgttgctgtgcttgccagacctggc

SEQ ID NO: 68644 - DNA, 25 bp, Mus musculus
tgttgcttagtaaccatcccagtgc

SEQ ID NO: 68645 - DNA, 25 bp, Mus musculus
tgttgcttggtagagattcctgctg

SEQ ID NO: 68646 - DNA, 25 bp, Mus musculus
tgttgcttgtcagggcctgagaacc

SEQ ID NO: 68647 - DNA, 25 bp, Mus musculus
tgttgctttggaaggacccagtcct

SEQ ID NO: 68648 - DNA, 25 bp, Mus musculus
tgttggaatcaatagctattggtat

SEQ ID NO: 68649 - DNA, 25 bp, Mus musculus
tgttggacagcaaaatgcccgccat

SEQ ID NO: 68650 - DNA, 25 bp, Mus musculus
tgttggacctggaacctcggggcta

SEQ ID NO: 68651 - DNA, 25 bp, Mus musculus
tgttggagacaatcactggctgtat

SEQ ID NO: 68652 - DNA, 25 bp, Mus musculus
tgttggagacctgggcaatgtgact

SEQ ID NO: 68653 - DNA, 25 bp, Mus musculus
tgttggagcttggaggaaacaatgc

SEQ ID NO: 68654 - DNA, 25 bp, Mus musculus
tgttggaggcatttggaccatgttt

SEQ ID NO: 68655 - DNA, 25 bp, Mus musculus
tgttggagggtccactaagactctc

SEQ ID NO: 68656 - DNA, 25 bp, Mus musculus
tgttggatatccttcagcctgatga

SEQ ID NO: 68657 - DNA, 25 bp, Mus musculus
tgttggatggatgtttgggaactca

SEQ ID NO: 68658 - DNA, 25 bp, Mus musculus
tgttggatggtccaccagcctgaag

SEQ ID NO: 68659 - DNA, 25 bp, Mus musculus
tgttggatgtttgaacaccatcaat

SEQ ID NO: 68660 - DNA, 25 bp, Mus musculus
tgttggcaccattactgagcaattg

SEQ ID NO: 68661 - DNA, 25 bp, Mus musculus
tgttggcagagtgcccaaggttagc

SEQ ID NO: 68662 - DNA, 25 bp, Mus musculus
tgttggcagcgctgaatgggctctc

SEQ ID NO: 68663 - DNA, 25 bp, Mus musculus
tgttggcagctacactttcctggtc

SEQ ID NO: 68664 - DNA, 25 bp, Mus musculus
tgttggcagtacatattggctggag

SEQ ID NO: 68665 - DNA, 25 bp, Mus musculus
tgttggcataacgacaggctgtact

SEQ ID NO: 68666 - DNA, 25 bp, Mus musculus
tgttggcccgactggccactctttg

SEQ ID NO: 68667 - DNA, 25 bp, Mus musculus
tgttggctacgacatatggtaatac

SEQ ID NO: 68668 - DNA, 25 bp, Mus musculus
tgttggctacgagatatggtaatac

SEQ ID NO: 68669 - DNA, 25 bp, Mus musculus
tgttggctcacgaagtaggttttgg

SEQ ID NO: 68670 - DNA, 25 bp, Mus musculus
tgttggctccaacacagatgttctt

SEQ ID NO: 68671 - DNA, 25 bp, Mus musculus
tgttggctccattcctagctcacgc

SEQ ID NO: 68672 - DNA, 25 bp, Mus musculus
tgttggctgacccagctccagctgc

SEQ ID NO: 68673 - DNA, 25 bp, Mus musculus
tgttggcttcttcagatggcgcaag

SEQ ID NO: 68674 - DNA, 25 bp, Mus musculus
tgttggctttatcctggactatgga

SEQ ID NO: 68675 - DNA, 25 bp, Mus musculus
tgttgggaagatcaagtttgcctcc

SEQ ID NO: 68676 - DNA, 25 bp, Mus musculus
tgttgggaagtattccaccagcctc

SEQ ID NO: 68677 - DNA, 25 bp, Mus musculus
tgttgggaataaaacctgtgcaggt

SEQ ID NO: 68678 - DNA, 25 bp, Mus musculus
tgttgggactccagtggcttgcaat

SEQ ID NO: 68679 - DNA, 25 bp, Mus musculus
tgttgggagttttcactttcagagg

SEQ ID NO: 68680 - DNA, 25 bp, Mus musculus
tgttgggccgtatcatctttgcctg

SEQ ID NO: 68681 - DNA, 25 bp, Mus musculus
tgttggtaaaggagtgagcacctat

SEQ ID NO: 68682 - DNA, 25 bp, Mus musculus
tgttggtaaaggtgtgagcacctat

SEQ ID NO: 68683 - DNA, 25 bp, Mus musculus
tgttggtaccccatgttggatggcc

SEQ ID NO: 68684 - DNA, 25 bp, Mus musculus
tgttggtagtaagtccgggtataag

SEQ ID NO: 68685 - DNA, 25 bp, Mus musculus
tgttggtccgcacactcttgatagg

SEQ ID NO: 68686 - DNA, 25 bp, Mus musculus
tgttggtctcagtacagaggttaaa

SEQ ID NO: 68687 - DNA, 25 bp, Mus musculus
tgttggtgcgtgaaactacaaaagc

SEQ ID NO: 68688 - DNA, 25 bp, Mus musculus
tgttggtgggaagtctgtgctcctc

SEQ ID NO: 68689 - DNA, 25 bp, Mus musculus
tgttggtgtgcagcaactacacccc

SEQ ID NO: 68690 - DNA, 25 bp, Mus musculus
tgttggttcacagggaagtcgcctg

SEQ ID NO: 68691 - DNA, 25 bp, Mus musculus
tgttgtaaaacttcctccagggatg

SEQ ID NO: 68692 - DNA, 25 bp, Mus musculus
tgttgtaccacaagcgttactggat

SEQ ID NO: 68693 - DNA, 25 bp, Mus musculus
tgttgtaccgcaggacggacggaat

SEQ ID NO: 68694 - DNA, 25 bp, Mus musculus
tgttgtacgctgagacattcgctac

SEQ ID NO: 68695 - DNA, 25 bp, Mus musculus
tgttgtacgctgtgacattcgctac

SEQ ID NO: 68696 - DNA, 25 bp, Mus musculus
tgttgtagataaatatttcagtagc

SEQ ID NO: 68697 - DNA, 25 bp, Mus musculus
tgttgtcaaataccgaggagtaagg

SEQ ID NO: 68698 - DNA, 25 bp, Mus musculus
tgttgtcagcaggacagaggtgtta

SEQ ID NO: 68699 - DNA, 25 bp, Mus musculus
tgttgtccttgaccacgttttccgt

SEQ ID NO: 68700 - DNA, 25 bp, Mus musculus
tgttgtccttgggtgccgacatcaa

SEQ ID NO: 68701 - DNA, 25 bp, Mus musculus
tgttgtctgtggaactccgttgttc

SEQ ID NO: 68702 - DNA, 25 bp, Mus musculus
tgttgtgaacttggacaactctgtg

SEQ ID NO: 68703 - DNA, 25 bp, Mus musculus
tgttgtgagcagtgtacctctcctc

SEQ ID NO: 68704 - DNA, 25 bp, Mus musculus
tgttgtgcatccgttgctgcagctc

SEQ ID NO: 68705 - DNA, 25 bp, Mus musculus
tgttgtgctgctctgctcagggtca

SEQ ID NO: 68706 - DNA, 25 bp, Mus musculus
tgttgtgctgctgtgctcagggtca

SEQ ID NO: 68707 - DNA, 25 bp, Mus musculus
tgttgtggaaaaggacctttgccag

SEQ ID NO: 68708 - DNA, 25 bp, Mus musculus
tgttgtggaacagttacaaaaagtc

SEQ ID NO: 68709 - DNA, 25 bp, Mus musculus
tgttgtgtcacaagcagaggccttg

SEQ ID NO: 68710 - DNA, 25 bp, Mus musculus
tgttgtgtcctcagtgaatttggcc

SEQ ID NO: 68711 - DNA, 25 bp, Mus musculus
tgttgtgtcctctgtgaatttggcc

SEQ ID NO: 68712 - DNA, 25 bp, Mus musculus
tgttgtgtctgtggcttccctggga

SEQ ID NO: 68713 - DNA, 25 bp, Mus musculus
tgttgttaactagcccaaagtacag

SEQ ID NO: 68714 - DNA, 25 bp, Mus musculus
tgttgttacagatcttatagcagtc

SEQ ID NO: 68715 - DNA, 25 bp, Mus musculus
tgttgttacccaactaaagacttgc

SEQ ID NO: 68716 - DNA, 25 bp, Mus musculus
tgttgttaccctgtgtcgctgtgct

SEQ ID NO: 68717 - DNA, 25 bp, Mus musculus
tgttgttattcgaccccaggaagag

SEQ ID NO: 68718 - DNA, 25 bp, Mus musculus
tgttgttcccaactcggctgttcct

SEQ ID NO: 68719 - DNA, 25 bp, Mus musculus
tgttgttcccctggacttagtaaag

SEQ ID NO: 68720 - DNA, 25 bp, Mus musculus
tgttgttctgggagctggacttgcc

SEQ ID NO: 68721 - DNA, 25 bp, Mus musculus
tgttgttgctgtagacgtccaaacc

SEQ ID NO: 68722 - DNA, 25 bp, Mus musculus
tgttgttggagggagcgatctgagc

SEQ ID NO: 68723 - DNA, 25 bp, Mus musculus
tgttgtttcgccagtgaaaaatcag

SEQ ID NO: 68724 - DNA, 25 bp, Mus musculus
tgtttaaaaacagacctacagatgg

SEQ ID NO: 68725 - DNA, 25 bp, Mus musculus
tgtttaaatgggtgcgaagaacatt

SEQ ID NO: 68726 - DNA, 25 bp, Mus musculus
tgtttaacaccagggtgttccgtct

SEQ ID NO: 68727 - DNA, 25 bp, Mus musculus
tgtttaactggactcactggagtgt

SEQ ID NO: 68728 - DNA, 25 bp, Mus musculus
tgtttaaggcctttcctatcccaga

SEQ ID NO: 68729 - DNA, 25 bp, Mus musculus
tgtttacctactggatggctcaccc

SEQ ID NO: 68730 - DNA, 25 bp, Mus musculus
tgtttacctgaatgttgcctgacct

SEQ ID NO: 68731 - DNA, 25 bp, Mus musculus
tgtttacgaggaaccctatgcagca

SEQ ID NO: 68732 - DNA, 25 bp, Mus musculus
tgtttacgtgacttcttatgatcct

SEQ ID NO: 68733 - DNA, 25 bp, Mus musculus
tgtttactgggaaggcatcgatgag

SEQ ID NO: 68734 - DNA, 25 bp, Mus musculus
tgtttagccaatctttgcccggaga

SEQ ID NO: 68735 - DNA, 25 bp, Mus musculus
tgtttagtgaatcagagggatctgc

SEQ ID NO: 68736 - DNA, 25 bp, Mus musculus
tgtttatcccaagtgtttctccagg

SEQ ID NO: 68737 - DNA, 25 bp, Mus musculus
tgtttatcgcggcatccctcggtta

SEQ ID NO: 68738 - DNA, 25 bp, Mus musculus
tgtttatcttcacaaggcgcttgca

SEQ ID NO: 68739 - DNA, 25 bp, Mus musculus
tgtttatgattctggcctcgccaag

SEQ ID NO: 68740 - DNA, 25 bp, Mus musculus
tgtttattgtcaagaccacttcccg

SEQ ID NO: 68741 - DNA, 25 bp, Mus musculus
tgtttcatcatagtcgtgtgacccc

SEQ ID NO: 68742 - DNA, 25 bp, Mus musculus
tgtttcatcccctgacctatgaagg

SEQ ID NO: 68743 - DNA, 25 bp, Mus musculus
tgtttcatgatgacacccactcaag

SEQ ID NO: 68744 - DNA, 25 bp, Mus musculus
tgtttccaaaggcttcctcaacgtg

SEQ ID NO: 68745 - DNA, 25 bp, Mus musculus
tgtttccacaatatgacagcccttc

SEQ ID NO: 68746 - DNA, 25 bp, Mus musculus
tgtttcccatggacacacaacgctg

SEQ ID NO: 68747 - DNA, 25 bp, Mus musculus
tgtttccccgccatgcaaagcttgg

SEQ ID NO: 68748 - DNA, 25 bp, Mus musculus
tgtttccccgccttgcaaagcttgg

SEQ ID NO: 68749 - DNA, 25 bp, Mus musculus
tgtttcccgacagtgtggtgacctt

SEQ ID NO: 68750 - DNA, 25 bp, Mus musculus
tgtttcccttggagcccctgatcaa

SEQ ID NO: 68751 - DNA, 25 bp, Mus musculus
tgtttccggaagtgcatcgggaagc

SEQ ID NO: 68752 - DNA, 25 bp, Mus musculus
tgtttccggatttaacactcacaga

SEQ ID NO: 68753 - DNA, 25 bp, Mus musculus
tgtttccttctgttcggatcaaggt

SEQ ID NO: 68754 - DNA, 25 bp, Mus musculus
tgtttcgaaatatgcagaacgcaga

SEQ ID NO: 68755 - DNA, 25 bp, Mus musculus
tgtttctaaatggttacagcacaaa

SEQ ID NO: 68756 - DNA, 25 bp, Mus musculus
tgtttctaggaaagacgtgctttcc

SEQ ID NO: 68757 - DNA, 25 bp, Mus musculus
tgtttctaggaatgacgtgctttcc

SEQ ID NO: 68758 - DNA, 25 bp, Mus musculus
tgtttctataggtccaacgtcggaa

SEQ ID NO: 68759 - DNA, 25 bp, Mus musculus
tgtttctcactaaatgactcacaag

SEQ ID NO: 68760 - DNA, 25 bp, Mus musculus
tgtttctcagaagctccaacgatgt

SEQ ID NO: 68761 - DNA, 25 bp, Mus musculus
tgtttctgacaaggaggacaaatgc

SEQ ID NO: 68762 - DNA, 25 bp, Mus musculus
tgtttctgccaagagcagagtggtg

SEQ ID NO: 68763 - DNA, 25 bp, Mus musculus
tgtttctgcctttaaagtggctcag

SEQ ID NO: 68764 - DNA, 25 bp, Mus musculus
tgtttctgctacttctaggaaggaa

SEQ ID NO: 68765 - DNA, 25 bp, Mus musculus
tgtttctggaacattgcgatttgga

SEQ ID NO: 68766 - DNA, 25 bp, Mus musculus
tgtttctgtgtctccaggaagaacc

SEQ ID NO: 68767 - DNA, 25 bp, Mus musculus
tgtttcttccctcggcctctgctgg

SEQ ID NO: 68768 - DNA, 25 bp, Mus musculus
tgtttcttccctgggcctctgctgg

SEQ ID NO: 68769 - DNA, 25 bp, Mus musculus
tgtttcttttaggaagagcaccata

SEQ ID NO: 68770 - DNA, 25 bp, Mus musculus
tgtttgaagcttatggccaaacaga

SEQ ID NO: 68771 - DNA, 25 bp, Mus musculus
tgtttgacaacctcccactgttcta

SEQ ID NO: 68772 - DNA, 25 bp, Mus musculus
tgtttgacctccaagagaccctgct

SEQ ID NO: 68773 - DNA, 25 bp, Mus musculus
tgtttgacttcttcacccatatgca

SEQ ID NO: 68774 - DNA, 25 bp, Mus musculus
tgtttgagctgtatgacaatgcacc

SEQ ID NO: 68775 - DNA, 25 bp, Mus musculus
tgtttgaggatcatgtgtgaaatcc

SEQ ID NO: 68776 - DNA, 25 bp, Mus musculus
tgtttgaggtaccaagagctactgc

SEQ ID NO: 68777 - DNA, 25 bp, Mus musculus
tgtttgagtgaactaagcaaggaag

SEQ ID NO: 68778 - DNA, 25 bp, Mus musculus
tgtttgatccacacaagacagaccc

SEQ ID NO: 68779 - DNA, 25 bp, Mus musculus
tgtttgatcgccttggtgctgagtc

SEQ ID NO: 68780 - DNA, 25 bp, Mus musculus
tgtttgattctacaattgctgatga

SEQ ID NO: 68781 - DNA, 25 bp, Mus musculus
tgtttgcaaattcccaggacatccg

SEQ ID NO: 68782 - DNA, 25 bp, Mus musculus
tgtttgcaacaaccatcatggagaa

SEQ ID NO: 68783 - DNA, 25 bp, Mus musculus
tgtttgccaacctgaatcagctggg

SEQ ID NO: 68784 - DNA, 25 bp, Mus musculus
tgtttgcccaaatcgactgctttga

SEQ ID NO: 68785 - DNA, 25 bp, Mus musculus
tgtttgcccgaggaattgctgccag

SEQ ID NO: 68786 - DNA, 25 bp, Mus musculus
tgtttgcgcatttcaagaaaaacaa

SEQ ID NO: 68787 - DNA, 25 bp, Mus musculus
tgtttgctcagcttcacgtctcctc

SEQ ID NO: 68788 - DNA, 25 bp, Mus musculus
tgtttgctctcttaaccctgctgcc

SEQ ID NO: 68789 - DNA, 25 bp, Mus musculus
tgtttgctgcatgctgcatgacacc

SEQ ID NO: 68790 - DNA, 25 bp, Mus musculus
tgtttgctggtgtcataagaaggtg

SEQ ID NO: 68791 - DNA, 25 bp, Mus musculus
tgtttgctgtaagaaagtcttctga

SEQ ID NO: 68792 - DNA, 25 bp, Mus musculus
tgtttgctttgtgtaccaggaggtg

SEQ ID NO: 68793 - DNA, 25 bp, Mus musculus
tgtttggaaataagcaggacagtgc

SEQ ID NO: 68794 - DNA, 25 bp, Mus musculus
tgtttggatggtgcaacggatttta

SEQ ID NO: 68795 - DNA, 25 bp, Mus musculus
tgtttggccaaccaaggagaccttg

SEQ ID NO: 68796 - DNA, 25 bp, Mus musculus
tgtttggccaacgaaggagaccttg

SEQ ID NO: 68797 - DNA, 25 bp, Mus musculus
tgtttggctggaacaatgccatagc

SEQ ID NO: 68798 - DNA, 25 bp, Mus musculus
tgtttggctgtgacctctttgtggc

SEQ ID NO: 68799 - DNA, 25 bp, Mus musculus
tgtttggctgtgtcctctttgtggc

SEQ ID NO: 68800 - DNA, 25 bp, Mus musculus
tgtttgggccacaactgaagaatga

SEQ ID NO: 68801 - DNA, 25 bp, Mus musculus
tgtttgggtaccaccctgagctcct

SEQ ID NO: 68802 - DNA, 25 bp, Mus musculus
tgtttggtctttggcctctgtgttc

SEQ ID NO: 68803 - DNA, 25 bp, Mus musculus
tgtttggttctcttactgttgaaag

SEQ ID NO: 68804 - DNA, 25 bp, Mus musculus
tgtttgtagacacctatcccaatga

SEQ ID NO: 68805 - DNA, 25 bp, Mus musculus
tgtttgtaggagcagccatgagatc

SEQ ID NO: 68806 - DNA, 25 bp, Mus musculus
tgtttgtatggcaggtgcctcagcc

SEQ ID NO: 68807 - DNA, 25 bp, Mus musculus
tgtttgtcacaagtgtccagaggag

SEQ ID NO: 68808 - DNA, 25 bp, Mus musculus
tgtttgtctgcctgtgctcattata

SEQ ID NO: 68809 - DNA, 25 bp, Mus musculus
tgtttgtgacgttcgcggccatgca

SEQ ID NO: 68810 - DNA, 25 bp, Mus musculus
tgtttgtgcctgtccccaacatatg

SEQ ID NO: 68811 - DNA, 25 bp, Mus musculus
tgtttgtggataaaagagccagagc

SEQ ID NO: 68812 - DNA, 25 bp, Mus musculus
tgtttgtggctgtcctggatatcaa

SEQ ID NO: 68813 - DNA, 25 bp, Mus musculus
tgtttgttcaggatctgcgatctgc

SEQ ID NO: 68814 - DNA, 25 bp, Mus musculus
tgtttgttggtgacctcagtccaga

SEQ ID NO: 68815 - DNA, 25 bp, Mus musculus
tgttttaaagaacggacctcaggct

SEQ ID NO: 68816 - DNA, 25 bp, Mus musculus
tgttttaaaggaaatgtgtcatccc

SEQ ID NO: 68817 - DNA, 25 bp, Mus musculus
tgttttaactgcttgccgatagcag

SEQ ID NO: 68818 - DNA, 25 bp, Mus musculus
tgttttactaagcatcgtctttcag

SEQ ID NO: 68819 - DNA, 25 bp, Mus musculus
tgttttactgccttaatgggaatgt

SEQ ID NO: 68820 - DNA, 25 bp, Mus musculus
tgttttactggctgacatgaatgac

SEQ ID NO: 68821 - DNA, 25 bp, Mus musculus
tgttttagagacaagcactccagag

SEQ ID NO: 68822 - DNA, 25 bp, Mus musculus
tgttttattttgacaggtggccagg

SEQ ID NO: 68823 - DNA, 25 bp, Mus musculus
tgttttattttgtcaggtggccagg

SEQ ID NO: 68824 - DNA, 25 bp, Mus musculus
tgttttcaatgaaggcactgccact

SEQ ID NO: 68825 - DNA, 25 bp, Mus musculus
tgttttcagactggactcaggctgg

SEQ ID NO: 68826 - DNA, 25 bp, Mus musculus
tgttttccaacatcattcctatcag

SEQ ID NO: 68827 - DNA, 25 bp, Mus musculus
tgttttcctgatccgggctcgggcc

SEQ ID NO: 68828 - DNA, 25 bp, Mus musculus
tgttttctaaggaatccaaaatgct

SEQ ID NO: 68829 - DNA, 25 bp, Mus musculus
tgttttctacacctcggaagtctgg

SEQ ID NO: 68830 - DNA, 25 bp, Mus musculus
tgttttctactgcagtggacactga

SEQ ID NO: 68831 - DNA, 25 bp, Mus musculus
tgttttctctgctaggagttgctgc

SEQ ID NO: 68832 - DNA, 25 bp, Mus musculus
tgttttctgctctaactcacaagct

SEQ ID NO: 68833 - DNA, 25 bp, Mus musculus
tgttttctgggccaccagtcactgc

SEQ ID NO: 68834 - DNA, 25 bp, Mus musculus
tgttttgaagaacacctggccaaag

SEQ ID NO: 68835 - DNA, 25 bp, Mus musculus
tgttttgagtcaggcaacccctcag

SEQ ID NO: 68836 - DNA, 25 bp, Mus musculus
tgttttgcaaggagctatgatggcg

SEQ ID NO: 68837 - DNA, 25 bp, Mus musculus
tgttttgcacagatgacgacctgtg

SEQ ID NO: 68838 - DNA, 25 bp, Mus musculus
tgttttgctgggacattcatgttct

SEQ ID NO: 68839 - DNA, 25 bp, Mus musculus
tgttttggagtcacacaagctaaag

SEQ ID NO: 68840 - DNA, 25 bp, Mus musculus
tgttttggtccgtatcacataggat

SEQ ID NO: 68841 - DNA, 25 bp, Mus musculus
tgttttggtgctgagcaggaacttc

SEQ ID NO: 68842 - DNA, 25 bp, Mus musculus
tgttttgtcaagagaaccggccttc

SEQ ID NO: 68843 - DNA, 25 bp, Mus musculus
tgtttttagccatttggccctgctg

SEQ ID NO: 68844 - DNA, 25 bp, Mus musculus
tgtttttaggtgctgaagattcagc

SEQ ID NO: 68845 - DNA, 25 bp, Mus musculus
tgtttttccggtgcctgctgctgtg

SEQ ID NO: 68846 - DNA, 25 bp, Mus musculus
tgtttttcctgggacaggccctcat

SEQ ID NO: 68847 - DNA, 25 bp, Mus musculus
tgtttttgctttagccgggctaacg

SEQ ID NO: 68848 - DNA, 25 bp, Mus musculus
tgtttttgtgtcactggcaggtacg

SEQ ID NO: 68849 - DNA, 25 bp, Mus musculus
ttaaaaaatcaaagtcgcaccctgc

SEQ ID NO: 68850 - DNA, 25 bp, Mus musculus
ttaaaaacagacctacagatggccc

SEQ ID NO: 68851 - DNA, 25 bp, Mus musculus
ttaaaaacattacgaggattcttgc

SEQ ID NO: 68852 - DNA, 25 bp, Mus musculus
ttaaaaacattgattcagggacaag

SEQ ID NO: 68853 - DNA, 25 bp, Mus musculus
ttaaaaaggccagataaagcattcc

SEQ ID NO: 68854 - DNA, 25 bp, Mus musculus
ttaaaaagggatcaggaatacctct

SEQ ID NO: 68855 - DNA, 25 bp, Mus musculus
ttaaaaccatgtatacgatctgcag

SEQ ID NO: 68856 - DNA, 25 bp, Mus musculus
ttaaaactgtcccaaataatgtgac

SEQ ID NO: 68857 - DNA, 25 bp, Mus musculus
ttaaaactgtccgaaataatgtgac

SEQ ID NO: 68858 - DNA, 25 bp, Mus musculus
ttaaaagaagacagctcagaagctt

SEQ ID NO: 68859 - DNA, 25 bp, Mus musculus
ttaaaagagaagtacagtgaactgg

SEQ ID NO: 68860 - DNA, 25 bp, Mus musculus
ttaaaagatgaagaatgtgagagac

SEQ ID NO: 68861 - DNA, 25 bp, Mus musculus
ttaaaagcaaaactctgctgggcat

SEQ ID NO: 68862 - DNA, 25 bp, Mus musculus
ttaaaatcacaagaattgaagtggg

SEQ ID NO: 68863 - DNA, 25 bp, Mus musculus
ttaaaattgggcaaagtatatccat

SEQ ID NO: 68864 - DNA, 25 bp, Mus musculus
ttaaacactcgggaatgcaccacag

SEQ ID NO: 68865 - DNA, 25 bp, Mus musculus
ttaaaccctggcacatctccttcat

SEQ ID NO: 68866 - DNA, 25 bp, Mus musculus
ttaaaccctggctcatctccttcat

SEQ ID NO: 68867 - DNA, 25 bp, Mus musculus
ttaaactcactttctgcttcggacg

SEQ ID NO: 68868 - DNA, 25 bp, Mus musculus
ttaaactctgtgaaagctatcaggt

SEQ ID NO: 68869 - DNA, 25 bp, Mus musculus
ttaaactgcagacctcaggaaatgt

SEQ ID NO: 68870 - DNA, 25 bp, Mus musculus
ttaaactgcagagctcaggaaatgt

SEQ ID NO: 68871 - DNA, 25 bp, Mus musculus
ttaaacttgatgagctcaatgggag

SEQ ID NO: 68872 - DNA, 25 bp, Mus musculus
ttaaagaggccaaagagcagcaccc

SEQ ID NO: 68873 - DNA, 25 bp, Mus musculus
ttaaagatcgaggtccagaagccac

SEQ ID NO: 68874 - DNA, 25 bp, Mus musculus
ttaaagatgttcctcagttccggat

SEQ ID NO: 68875 - DNA, 25 bp, Mus musculus
ttaaagcagccactgtaatcatggg

SEQ ID NO: 68876 - DNA, 25 bp, Mus musculus
ttaaagccccagctaatacctacgc

SEQ ID NO: 68877 - DNA, 25 bp, Mus musculus
ttaaaggaccagattcaggatgtag

SEQ ID NO: 68878 - DNA, 25 bp, Mus musculus
ttaaaggagcaacccggccataagt

SEQ ID NO: 68879 - DNA, 25 bp, Mus musculus
ttaaaggcagatgtcgtgccaaaga

SEQ ID NO: 68880 - DNA, 25 bp, Mus musculus
ttaaaggcttcacctccgctgccag

SEQ ID NO: 68881 - DNA, 25 bp, Mus musculus
ttaaataatcacgaacagctagttc

SEQ ID NO: 68882 - DNA, 25 bp, Mus musculus
ttaaatattagaacactgacagatg

SEQ ID NO: 68883 - DNA, 25 bp, Mus musculus
ttaaatattatttccccgagagagt

SEQ ID NO: 68884 - DNA, 25 bp, Mus musculus
ttaaatggttgattctggagaaaca

SEQ ID NO: 68885 - DNA, 25 bp, Mus musculus
ttaaattagcctgccaggagaggac

SEQ ID NO: 68886 - DNA, 25 bp, Mus musculus
ttaaattctaatgacacttttgtcc

SEQ ID NO: 68887 - DNA, 25 bp, Mus musculus
ttaaatttagagcattcgcagccgc

SEQ ID NO: 68888 - DNA, 25 bp, Mus musculus
ttaacaacgacggactggaggaggc

SEQ ID NO: 68889 - DNA, 25 bp, Mus musculus
ttaacaagcaggaaacctggatgaa

SEQ ID NO: 68890 - DNA, 25 bp, Mus musculus
ttaacaagtggtggaatagcctaag

SEQ ID NO: 68891 - DNA, 25 bp, Mus musculus
ttaacacagagtgccctgggctctg

SEQ ID NO: 68892 - DNA, 25 bp, Mus musculus
ttaacaccacgactctggctgcttc

SEQ ID NO: 68893 - DNA, 25 bp, Mus musculus
ttaacagatcgggtgaaccgtggcc

SEQ ID NO: 68894 - DNA, 25 bp, Mus musculus
ttaacaggcaagttcagcaacatcg

SEQ ID NO: 68895 - DNA, 25 bp, Mus musculus
ttaacatccattcccggctacctga

SEQ ID NO: 68896 - DNA, 25 bp, Mus musculus
ttaaccacagagagaacaccagact

SEQ ID NO: 68897 - DNA, 25 bp, Mus musculus
ttaaccaccctgatttaagaaggat

SEQ ID NO: 68898 - DNA, 25 bp, Mus musculus
ttaaccagaacaatcacaactttgg

SEQ ID NO: 68899 - DNA, 25 bp, Mus musculus
ttaaccagcaataacttacagagct

SEQ ID NO: 68900 - DNA, 25 bp, Mus musculus
ttaaccatgaccaatgcagctgcca

SEQ ID NO: 68901 - DNA, 25 bp, Mus musculus
ttaacccagcgctggcactttctct

SEQ ID NO: 68902 - DNA, 25 bp, Mus musculus
ttaacccggagctggagggaagcca

SEQ ID NO: 68903 - DNA, 25 bp, Mus musculus
ttaaccggcttgattcggtggaatc

SEQ ID NO: 68904 - DNA, 25 bp, Mus musculus
ttaacctccaggaaggacagctgta

SEQ ID NO: 68905 - DNA, 25 bp, Mus musculus
ttaacctggaccagtagagctggat

SEQ ID NO: 68906 - DNA, 25 bp, Mus musculus
ttaacgtcttgtggctctaacagcc

SEQ ID NO: 68907 - DNA, 25 bp, Mus musculus
ttaactctccagaggaccctgaggg

SEQ ID NO: 68908 - DNA, 25 bp, Mus musculus
ttaactctgagaagtcgtcctcttc

SEQ ID NO: 68909 - DNA, 25 bp, Mus musculus
ttaactctgctgtttgctgcatgct

SEQ ID NO: 68910 - DNA, 25 bp, Mus musculus
ttaactctgtttcccatggacacac

SEQ ID NO: 68911 - DNA, 25 bp, Mus musculus
ttaactgagggatggacctttctcc

SEQ ID NO: 68912 - DNA, 25 bp, Mus musculus
ttaactgcctcttgcagcctctctg

SEQ ID NO: 68913 - DNA, 25 bp, Mus musculus
ttaactggactcactggagtgtggg

SEQ ID NO: 68914 - DNA, 25 bp, Mus musculus
ttaactggtcaaagcctggagaagc

SEQ ID NO: 68915 - DNA, 25 bp, Mus musculus
ttaacttaactgtggtttcatcaag

SEQ ID NO: 68916 - DNA, 25 bp, Mus musculus
ttaagaaatcggcaacacggaagct

SEQ ID NO: 68917 - DNA, 25 bp, Mus musculus
ttaagaaccttgagtatggtggacc

SEQ ID NO: 68918 - DNA, 25 bp, Mus musculus
ttaagaaggagtaagaggtgtcgcc

SEQ ID NO: 68919 - DNA, 25 bp, Mus musculus
ttaagaatgcccgagaagggactcg

SEQ ID NO: 68920 - DNA, 25 bp, Mus musculus
ttaagaccgagggagccactctcag

SEQ ID NO: 68921 - DNA, 25 bp, Mus musculus
ttaagagactcctgtactgacaact

SEQ ID NO: 68922 - DNA, 25 bp, Mus musculus
ttaagagccctagttctactgaaag

SEQ ID NO: 68923 - DNA, 25 bp, Mus musculus
ttaagcaagacattcttactggaag

SEQ ID NO: 68924 - DNA, 25 bp, Mus musculus
ttaagcagcagaggagcaccaggat

SEQ ID NO: 68925 - DNA, 25 bp, Mus musculus
ttaagccatggcctatcagttatac

SEQ ID NO: 68926 - DNA, 25 bp, Mus musculus
ttaagctcactcatgtggttctgga

SEQ ID NO: 68927 - DNA, 25 bp, Mus musculus
ttaaggaggatacactttccacagg

SEQ ID NO: 68928 - DNA, 25 bp, Mus musculus
ttaaggaggtggcagggccaacaga

SEQ ID NO: 68929 - DNA, 25 bp, Mus musculus
ttaaggcacaaacaaagaccctcaa

SEQ ID NO: 68930 - DNA, 25 bp, Mus musculus
ttaaggcagcttctgctagaatcgc

SEQ ID NO: 68931 - DNA, 25 bp, Mus musculus
ttaaggcgacgtcttcatgaagcct

SEQ ID NO: 68932 - DNA, 25 bp, Mus musculus
ttaaggctttcagggcttttcttgg

SEQ ID NO: 68933 - DNA, 25 bp, Mus musculus
ttaagggccccagcagttagagcgt

SEQ ID NO: 68934 - DNA, 25 bp, Mus musculus
ttaaggtccagcacccgaaggttca

SEQ ID NO: 68935 - DNA, 25 bp, Mus musculus
ttaaggtgtggaacaaccaattcct

SEQ ID NO: 68936 - DNA, 25 bp, Mus musculus
ttaagtatacccatgaagagttcac

SEQ ID NO: 68937 - DNA, 25 bp, Mus musculus
ttaagtatgtccctgccggctcaga

SEQ ID NO: 68938 - DNA, 25 bp, Mus musculus
ttaagtgcaaggtgcccacagaagc

SEQ ID NO: 68939 - DNA, 25 bp, Mus musculus
ttaataacccagtagcactaatgtg

SEQ ID NO: 68940 - DNA, 25 bp, Mus musculus
ttaataatgcgctccccaaacagaa

SEQ ID NO: 68941 - DNA, 25 bp, Mus musculus
ttaataatgggtttccaacagccgc

SEQ ID NO: 68942 - DNA, 25 bp, Mus musculus
ttaatagctcggatgcggaggtgct

SEQ ID NO: 68943 - DNA, 25 bp, Mus musculus
ttaataggatatggccgaatatttc

SEQ ID NO: 68944 - DNA, 25 bp, Mus musculus
ttaatatagaatggcatcggttccg

SEQ ID NO: 68945 - DNA, 25 bp, Mus musculus
ttaatatggcctatggcgtaaagag

SEQ ID NO: 68946 - DNA, 25 bp, Mus musculus
ttaatattaagaaattcggtcatgc

SEQ ID NO: 68947 - DNA, 25 bp, Mus musculus
ttaatcatggaatatgcaagtggag

SEQ ID NO: 68948 - DNA, 25 bp, Mus musculus
ttaatcgctcttgttcaggtcacgt

SEQ ID NO: 68949 - DNA, 25 bp, Mus musculus
ttaatgacagcgacagcccaacaga

SEQ ID NO: 68950 - DNA, 25 bp, Mus musculus
ttaatgagacaaggcatctgatgac

SEQ ID NO: 68951 - DNA, 25 bp, Mus musculus
ttaatgatagggttcaagaagcagt

SEQ ID NO: 68952 - DNA, 25 bp, Mus musculus
ttaatgattgtccagaaggcggcta

SEQ ID NO: 68953 - DNA, 25 bp, Mus musculus
ttaatgcaaatgaaggatgaacctg

SEQ ID NO: 68954 - DNA, 25 bp, Mus musculus
ttaatgcagctggatatcacggtga

SEQ ID NO: 68955 - DNA, 25 bp, Mus musculus
ttaatgcccgttggaccacagagga

SEQ ID NO: 68956 - DNA, 25 bp, Mus musculus
ttaatgcgggcctggatctgcggtt

SEQ ID NO: 68957 - DNA, 25 bp, Mus musculus
ttaatggaacccctggtagtcagct

SEQ ID NO: 68958 - DNA, 25 bp, Mus musculus
ttaatggagatttgctaagtgctgg

SEQ ID NO: 68959 - DNA, 25 bp, Mus musculus
ttaattctaggaggatcaccttaca

SEQ ID NO: 68960 - DNA, 25 bp, Mus musculus
ttaattgtccttttaggatgcggcc

SEQ ID NO: 68961 - DNA, 25 bp, Mus musculus
ttaattttcctgacggccccagaag

SEQ ID NO: 68962 - DNA, 25 bp, Mus musculus
ttacaaactgatccgggacagccca

SEQ ID NO: 68963 - DNA, 25 bp, Mus musculus
ttacaaatccgccacaagttgccac

SEQ ID NO: 68964 - DNA, 25 bp, Mus musculus
ttacaaatttccacatctgcatagc

SEQ ID NO: 68965 - DNA, 25 bp, Mus musculus
ttacaacaaccctggccgagtgctg

SEQ ID NO: 68966 - DNA, 25 bp, Mus musculus
ttacaacaccagactctcgcggatc

SEQ ID NO: 68967 - DNA, 25 bp, Mus musculus
ttacaacagcaaattcaagagcacg

SEQ ID NO: 68968 - DNA, 25 bp, Mus musculus
ttacaacggcgagcggacactggac

SEQ ID NO: 68969 - DNA, 25 bp, Mus musculus
ttacaactccccaggtggtggtggg

SEQ ID NO: 68970 - DNA, 25 bp, Mus musculus
ttacaagagttttcggccaggtgac

SEQ ID NO: 68971 - DNA, 25 bp, Mus musculus
ttacaagcaggcatgaaccaagatg

SEQ ID NO: 68972 - DNA, 25 bp, Mus musculus
ttacaatgaagccatgctctataag

SEQ ID NO: 68973 - DNA, 25 bp, Mus musculus
ttacacctctttccaggagctcaca

SEQ ID NO: 68974 - DNA, 25 bp, Mus musculus
ttacacctctttgcaggagctcaca

SEQ ID NO: 68975 - DNA, 25 bp, Mus musculus
ttacacgtttccgaagatgatgggc

SEQ ID NO: 68976 - DNA, 25 bp, Mus musculus
ttacactagccaaaagaggagagaa

SEQ ID NO: 68977 - DNA, 25 bp, Mus musculus
ttacagaagaaataacttatggcag

SEQ ID NO: 68978 - DNA, 25 bp, Mus musculus
ttacagaattttgaaggcaatgctg

SEQ ID NO: 68979 - DNA, 25 bp, Mus musculus
ttacagagaatgaaacaagggcaga

SEQ ID NO: 68980 - DNA, 25 bp, Mus musculus
ttacagatcttatagcagtcggttt

SEQ ID NO: 68981 - DNA, 25 bp, Mus musculus
ttacagcctcgacggacgcaagttt

SEQ ID NO: 68982 - DNA, 25 bp, Mus musculus
ttacagctcacgatccccggaggga

SEQ ID NO: 68983 - DNA, 25 bp, Mus musculus
ttacagctctggagggacgagacac

SEQ ID NO: 68984 - DNA, 25 bp, Mus musculus
ttacaggcccaaaaactgcgactgg

SEQ ID NO: 68985 - DNA, 25 bp, Mus musculus
ttacaggctgatactctccgggcag

SEQ ID NO: 68986 - DNA, 25 bp, Mus musculus
ttacaggctgattctctccgggcag

SEQ ID NO: 68987 - DNA, 25 bp, Mus musculus
ttacaggtccttggctggaagaggc

SEQ ID NO: 68988 - DNA, 25 bp, Mus musculus
ttacagtctgatcggatgatgaccg

SEQ ID NO: 68989 - DNA, 25 bp, Mus musculus
ttacagtctgatgggatgatgaccg

SEQ ID NO: 68990 - DNA, 25 bp, Mus musculus
ttacataaataccaagcaagagtgg

SEQ ID NO: 68991 - DNA, 25 bp, Mus musculus
ttacatcaggcagtgatgctcaggg

SEQ ID NO: 68992 - DNA, 25 bp, Mus musculus
ttacatctcggtggttgacacactg

SEQ ID NO: 68993 - DNA, 25 bp, Mus musculus
ttacattccgaaaagcaaatgggag

SEQ ID NO: 68994 - DNA, 25 bp, Mus musculus
ttacatttcacagggaagacagtgc

SEQ ID NO: 68995 - DNA, 25 bp, Mus musculus
ttaccaaaaccgagcgcctcgttca

SEQ ID NO: 68996 - DNA, 25 bp, Mus musculus
ttaccaagcagtttctcaaaggact

SEQ ID NO: 68997 - DNA, 25 bp, Mus musculus
ttaccaaggaagtggacatagcgcc

SEQ ID NO: 68998 - DNA, 25 bp, Mus musculus
ttaccaaggagaacagctcaggctg

SEQ ID NO: 68999 - DNA, 25 bp, Mus musculus
ttaccaaggagataacagatctgtt

SEQ ID NO: 69000 - DNA, 25 bp, Mus musculus
ttaccaagttgacacactaaggatg

SEQ ID NO: 69001 - DNA, 25 bp, Mus musculus
ttaccaagttgagacactaaggatg

SEQ ID NO: 69002 - DNA, 25 bp, Mus musculus
ttaccacaaataccctccaatgaaa

SEQ ID NO: 69003 - DNA, 25 bp, Mus musculus
ttaccaccttcttcataggcgaggg

SEQ ID NO: 69004 - DNA, 25 bp, Mus musculus
ttaccagaagtccaggctagtcacc

SEQ ID NO: 69005 - DNA, 25 bp, Mus musculus
ttaccagccctactaaaggaggacg

SEQ ID NO: 69006 - DNA, 25 bp, Mus musculus
ttaccaggagacgtcggagatgcgc

SEQ ID NO: 69007 - DNA, 25 bp, Mus musculus
ttaccagtcagtcacctcaggtcac

SEQ ID NO: 69008 - DNA, 25 bp, Mus musculus
ttaccatccaagtgcccagaacaat

SEQ ID NO: 69009 - DNA, 25 bp, Mus musculus
ttaccatcgcgcctacctgagcatg

SEQ ID NO: 69010 - DNA, 25 bp, Mus musculus
ttaccatgttggatgagctgctggc

SEQ ID NO: 69011 - DNA, 25 bp, Mus musculus
ttaccattgagccttctgaggagcc

SEQ ID NO: 69012 - DNA, 25 bp, Mus musculus
ttaccattgggcaagccattgtgta

SEQ ID NO: 69013 - DNA, 25 bp, Mus musculus
ttacccacaagtgatccagaactgg

SEQ ID NO: 69014 - DNA, 25 bp, Mus musculus
ttacccatgtcaagggcagtccctg

SEQ ID NO: 69015 - DNA, 25 bp, Mus musculus
ttaccccagaagaagctgtgaactt

SEQ ID NO: 69016 - DNA, 25 bp, Mus musculus
ttacccgagctgttttgggaacact

SEQ ID NO: 69017 - DNA, 25 bp, Mus musculus
ttaccctcctcagggtccatgatgg

SEQ ID NO: 69018 - DNA, 25 bp, Mus musculus
ttaccgaagtgcatgtttgggattt

SEQ ID NO: 69019 - DNA, 25 bp, Mus musculus
ttaccgagtggaacagtgatgagca

SEQ ID NO: 69020 - DNA, 25 bp, Mus musculus
ttaccgcagccaagacatgtctagc

SEQ ID NO: 69021 - DNA, 25 bp, Mus musculus
ttaccgcccctcctatgaagagatg

SEQ ID NO: 69022 - DNA, 25 bp, Mus musculus
ttaccggacaaagcttcgaggcctc

SEQ ID NO: 69023 - DNA, 25 bp, Mus musculus
ttaccggacgcagcaaccagaaggg

SEQ ID NO: 69024 - DNA, 25 bp, Mus musculus
ttaccggcccaggtgcattgccaag

SEQ ID NO: 69025 - DNA, 25 bp, Mus musculus
ttacctaatttatggatacttacag

SEQ ID NO: 69026 - DNA, 25 bp, Mus musculus
ttacctagctctgaaaacgctgtct

SEQ ID NO: 69027 - DNA, 25 bp, Mus musculus
ttacctatgccatgtctaaatgaca

SEQ ID NO: 69028 - DNA, 25 bp, Mus musculus
ttacctcatcaaggcactgtccaag

SEQ ID NO: 69029 - DNA, 25 bp, Mus musculus
ttacctccctgtgcagaagagcggg

SEQ ID NO: 69030 - DNA, 25 bp, Mus musculus
ttacctcctaaaatagagacacagg

SEQ ID NO: 69031 - DNA, 25 bp, Mus musculus
ttacctctagacattagaagccagg

SEQ ID NO: 69032 - DNA, 25 bp, Mus musculus
ttacctctagatacactacttgtgg

SEQ ID NO: 69033 - DNA, 25 bp, Mus musculus
ttacctgctcgcaccactgaatcca

SEQ ID NO: 69034 - DNA, 25 bp, Mus musculus
ttacctgctttccattggatctgcc

SEQ ID NO: 69035 - DNA, 25 bp, Mus musculus
ttacctggcttatgtcggtgctatg

SEQ ID NO: 69036 - DNA, 25 bp, Mus musculus
ttacctgggcggatccatggacctc

SEQ ID NO: 69037 - DNA, 25 bp, Mus musculus
ttacctgtccgaggcacaattcctg

SEQ ID NO: 69038 - DNA, 25 bp, Mus musculus
ttacctttgatgcttgctttgaaag

SEQ ID NO: 69039 - DNA, 25 bp, Mus musculus
ttacgaatgtgttggtgagccacca

SEQ ID NO: 69040 - DNA, 25 bp, Mus musculus
ttacgacccatctgagtggagccct

SEQ ID NO: 69041 - DNA, 25 bp, Mus musculus
ttacgagaccctagcgtcggacatg

SEQ ID NO: 69042 - DNA, 25 bp, Mus musculus
ttacgagagacactgccaccgagat

SEQ ID NO: 69043 - DNA, 25 bp, Mus musculus
ttacgtcaatatggagaggcaccca

SEQ ID NO: 69044 - DNA, 25 bp, Mus musculus
ttacgtcatggagcacaggcacaga

SEQ ID NO: 69045 - DNA, 25 bp, Mus musculus
ttacgtccccattctgtactaacag

SEQ ID NO: 69046 - DNA, 25 bp, Mus musculus
ttactagccacaggagataaaggtg

SEQ ID NO: 69047 - DNA, 25 bp, Mus musculus
ttactagtccagtatggagtggtgg

SEQ ID NO: 69048 - DNA, 25 bp, Mus musculus
ttactataagacaggaatcatccgc

SEQ ID NO: 69049 - DNA, 25 bp, Mus musculus
ttactatcctctctacccctgaagg

SEQ ID NO: 69050 - DNA, 25 bp, Mus musculus
ttactccaagcccatccagggacag

SEQ ID NO: 69051 - DNA, 25 bp, Mus musculus
ttactccactccaggaatgaaggcg

SEQ ID NO: 69052 - DNA, 25 bp, Mus musculus
ttactccatatacagaaatcgaagc

SEQ ID NO: 69053 - DNA, 25 bp, Mus musculus
ttactctttgatgatcttccgcctg

SEQ ID NO: 69054 - DNA, 25 bp, Mus musculus
ttactgcctggggaccttgtccgca

SEQ ID NO: 69055 - DNA, 25 bp, Mus musculus
ttactggcaggtggcctggctgccc

SEQ ID NO: 69056 - DNA, 25 bp, Mus musculus
ttactggctgtagtacttttgaaga

SEQ ID NO: 69057 - DNA, 25 bp, Mus musculus
ttactggtgtacacaatagcatcca

SEQ ID NO: 69058 - DNA, 25 bp, Mus musculus
ttactggtgtactcaatagcatcca

SEQ ID NO: 69059 - DNA, 25 bp, Mus musculus
ttactgtgacaaccgtcccaacttc

SEQ ID NO: 69060 - DNA, 25 bp, Mus musculus
ttactgtgactatggagttgtgatc

SEQ ID NO: 69061 - DNA, 25 bp, Mus musculus
ttactgtgatgagaaatagaatgtg

SEQ ID NO: 69062 - DNA, 25 bp, Mus musculus
ttactgtgtagcctgcagctgaaaa

SEQ ID NO: 69063 - DNA, 25 bp, Mus musculus
ttactgtgtatctctggttgaccca

SEQ ID NO: 69064 - DNA, 25 bp, Mus musculus
ttactgttccactgaggtcacccag

SEQ ID NO: 69065 - DNA, 25 bp, Mus musculus
ttacttaaacccaggcacatctcct

SEQ ID NO: 69066 - DNA, 25 bp, Mus musculus
ttacttaaaccctggcacatctcct

SEQ ID NO: 69067 - DNA, 25 bp, Mus musculus
ttacttcaagaaagaagagctgaac

SEQ ID NO: 69068 - DNA, 25 bp, Mus musculus
ttacttctggagttatacagtccca

SEQ ID NO: 69069 - DNA, 25 bp, Mus musculus
ttacttctgtgatcgcagtgcacag

SEQ ID NO: 69070 - DNA, 25 bp, Mus musculus
ttacttgatgctcagagatcccagg

SEQ ID NO: 69071 - DNA, 25 bp, Mus musculus
ttacttgatgctgagagatcccagg

SEQ ID NO: 69072 - DNA, 25 bp, Mus musculus
ttactttatcgtgagtaacatccag

SEQ ID NO: 69073 - DNA, 25 bp, Mus musculus
ttactttcatgctttggagatcgga

SEQ ID NO: 69074 - DNA, 25 bp, Mus musculus
ttactttgagtattttggaccagac

SEQ ID NO: 69075 - DNA, 25 bp, Mus musculus
ttagaaaaaagatctctatgcacgg

SEQ ID NO: 69076 - DNA, 25 bp, Mus musculus
ttagaaaaagatccttatgcacttg

SEQ ID NO: 69077 - DNA, 25 bp, Mus musculus
ttagaaaagtcctgggatcccaggg

SEQ ID NO: 69078 - DNA, 25 bp, Mus musculus
ttagaaaccaaattgagacccaagt

SEQ ID NO: 69079 - DNA, 25 bp, Mus musculus
ttagaaacctctacagaaactgcct

SEQ ID NO: 69080 - DNA, 25 bp, Mus musculus
ttagaacagtggtgcctagtgtgtg

SEQ ID NO: 69081 - DNA, 25 bp, Mus musculus
ttagaacctgccatctcagcccaag

SEQ ID NO: 69082 - DNA, 25 bp, Mus musculus
ttagaacctggagcatcactgtatg

SEQ ID NO: 69083 - DNA, 25 bp, Mus musculus
ttagaacgcttttaagaaatgcaga

SEQ ID NO: 69084 - DNA, 25 bp, Mus musculus
ttagaactgcagctgtaagaactgg

SEQ ID NO: 69085 - DNA, 25 bp, Mus musculus
ttagaactgcaggtgtaagaactgg

SEQ ID NO: 69086 - DNA, 25 bp, Mus musculus
ttagaagcctcacatgaccatgcat

SEQ ID NO: 69087 - DNA, 25 bp, Mus musculus
ttagaaggagacactaaccagaagc

SEQ ID NO: 69088 - DNA, 25 bp, Mus musculus
ttagaaggcattattcctggagcaa

SEQ ID NO: 69089 - DNA, 25 bp, Mus musculus
ttagaaggcatttttcctggagcaa

SEQ ID NO: 69090 - DNA, 25 bp, Mus musculus
ttagaattgcccctactgtcactac

SEQ ID NO: 69091 - DNA, 25 bp, Mus musculus
ttagaccggtttaacatgaaccgca

SEQ ID NO: 69092 - DNA, 25 bp, Mus musculus
ttagaccggttttacatgaaccgca

SEQ ID NO: 69093 - DNA, 25 bp, Mus musculus
ttagacctcaagaggaactccctgg

SEQ ID NO: 69094 - DNA, 25 bp, Mus musculus
ttagactgccgtctgcacttaacag

SEQ ID NO: 69095 - DNA, 25 bp, Mus musculus
ttagagaggcagagaccgaaatccc

SEQ ID NO: 69096 - DNA, 25 bp, Mus musculus
ttagaggacacactggttaaaaatt

SEQ ID NO: 69097 - DNA, 25 bp, Mus musculus
ttagaggagagacgcaaagaataca

SEQ ID NO: 69098 - DNA, 25 bp, Mus musculus
ttagaggcttcctagagaaggaggc

SEQ ID NO: 69099 - DNA, 25 bp, Mus musculus
ttagagtactggatgaggctgtgcc

SEQ ID NO: 69100 - DNA, 25 bp, Mus musculus
ttagatataggagatgccacccaag

SEQ ID NO: 69101 - DNA, 25 bp, Mus musculus
ttagatatgactcccgtgcacccag

SEQ ID NO: 69102 - DNA, 25 bp, Mus musculus
ttagatgaaaaaaggaacgtggagc

SEQ ID NO: 69103 - DNA, 25 bp, Mus musculus
ttagcaacaaaaggtcacaagcagt

SEQ ID NO: 69104 - DNA, 25 bp, Mus musculus
ttagcaacaggtgctgtagatctct

SEQ ID NO: 69105 - DNA, 25 bp, Mus musculus
ttagcaagctggtccagagtgggcc

SEQ ID NO: 69106 - DNA, 25 bp, Mus musculus
ttagcaataatccaagatcaacttg

SEQ ID NO: 69107 - DNA, 25 bp, Mus musculus
ttagcacaagcaccggcgacagtgt

SEQ ID NO: 69108 - DNA, 25 bp, Mus musculus
ttagcagttgtcttcccaacacttg

SEQ ID NO: 69109 - DNA, 25 bp, Mus musculus
ttagcatgggcagcatgcagccact

SEQ ID NO: 69110 - DNA, 25 bp, Mus musculus
ttagcattctctcagggaagccccg

SEQ ID NO: 69111 - DNA, 25 bp, Mus musculus
ttagcatttatacgagggcagcttg

SEQ ID NO: 69112 - DNA, 25 bp, Mus musculus
ttagccaatctttgcccggagactg

SEQ ID NO: 69113 - DNA, 25 bp, Mus musculus
ttagccagactacgatagacagtgc

SEQ ID NO: 69114 - DNA, 25 bp, Mus musculus
ttagccaggacaataccccaactgg

SEQ ID NO: 69115 - DNA, 25 bp, Mus musculus
ttagccatcacaccagtgttctatc

SEQ ID NO: 69116 - DNA, 25 bp, Mus musculus
ttagccattcaagggaagagaaatc

SEQ ID NO: 69117 - DNA, 25 bp, Mus musculus
ttagccccggacagcaagcactgtt

SEQ ID NO: 69118 - DNA, 25 bp, Mus musculus
ttagcccctgaagaggctgccggaa

SEQ ID NO: 69119 - DNA, 25 bp, Mus musculus
ttagccgcaagcttgcaagggcagc

SEQ ID NO: 69120 - DNA, 25 bp, Mus musculus
ttagcctcataaactgacctctcta

SEQ ID NO: 69121 - DNA, 25 bp, Mus musculus
ttagcctcatgtggcttggacagag

SEQ ID NO: 69122 - DNA, 25 bp, Mus musculus
ttagccttacaagaggagaagttaa

SEQ ID NO: 69123 - DNA, 25 bp, Mus musculus
ttagcgaccaagtgccagacacaga

SEQ ID NO: 69124 - DNA, 25 bp, Mus musculus
ttagcgacgagctggaccacgccct

SEQ ID NO: 69125 - DNA, 25 bp, Mus musculus
ttagcgatgcaactaagttaaggcc

SEQ ID NO: 69126 - DNA, 25 bp, Mus musculus
ttagcgcaggctaccgccacattga

SEQ ID NO: 69127 - DNA, 25 bp, Mus musculus
ttagcgttcctcagctcctcattgc

SEQ ID NO: 69128 - DNA, 25 bp, Mus musculus
ttagctcaagacttctacaagctgg

SEQ ID NO: 69129 - DNA, 25 bp, Mus musculus
ttagctccatgtcgcctcgtgctcg

SEQ ID NO: 69130 - DNA, 25 bp, Mus musculus
ttagctcgggccaagatccgtgtca

SEQ ID NO: 69131 - DNA, 25 bp, Mus musculus
ttagctgaacattgtgacatcacaa

SEQ ID NO: 69132 - DNA, 25 bp, Mus musculus
ttagctgactcgtcccaccatggtg

SEQ ID NO: 69133 - DNA, 25 bp, Mus musculus
ttagctgctcatcgtaacaactatg

SEQ ID NO: 69134 - DNA, 25 bp, Mus musculus
ttagctgggcagaaagagtggcatc

SEQ ID NO: 69135 - DNA, 25 bp, Mus musculus
ttagcttatggcaatcaagagagca

SEQ ID NO: 69136 - DNA, 25 bp, Mus musculus
ttagcttgtgagagtctctgggacc

SEQ ID NO: 69137 - DNA, 25 bp, Mus musculus
ttaggacactgcatttactcaaacc

SEQ ID NO: 69138 - DNA, 25 bp, Mus musculus
ttaggaccctgcaggcgcagtggaa

SEQ ID NO: 69139 - DNA, 25 bp, Mus musculus
ttaggacctgcttcagaggagaaga

SEQ ID NO: 69140 - DNA, 25 bp, Mus musculus
ttaggagggtatatcattgttggag

SEQ ID NO: 69141 - DNA, 25 bp, Mus musculus
ttaggagggtatttcattgttggag

SEQ ID NO: 69142 - DNA, 25 bp, Mus musculus
ttaggatgcggccttggcagcacct

SEQ ID NO: 69143 - DNA, 25 bp, Mus musculus
ttaggccaaggagcacaaccaagtc

SEQ ID NO: 69144 - DNA, 25 bp, Mus musculus
ttaggccagccgaagttagaagact

SEQ ID NO: 69145 - DNA, 25 bp, Mus musculus
ttaggccctgagatctttgaaaaga

SEQ ID NO: 69146 - DNA, 25 bp, Mus musculus
ttaggccggacacctgtaatccacg

SEQ ID NO: 69147 - DNA, 25 bp, Mus musculus
ttaggcgccgggtctaaatgcctcc

SEQ ID NO: 69148 - DNA, 25 bp, Mus musculus
ttaggctcggggactccagctgctg

SEQ ID NO: 69149 - DNA, 25 bp, Mus musculus
ttaggctggagggataagaccgctt

SEQ ID NO: 69150 - DNA, 25 bp, Mus musculus
ttagggctttcggaacaggatgact

SEQ ID NO: 69151 - DNA, 25 bp, Mus musculus
ttaggtccagagttgaagttcccct

SEQ ID NO: 69152 - DNA, 25 bp, Mus musculus
ttaggtccagcagcgcggcaggaat

SEQ ID NO: 69153 - DNA, 25 bp, Mus musculus
ttagtaaatcacacaaaaatccagc

SEQ ID NO: 69154 - DNA, 25 bp, Mus musculus
ttagtaggcgtcagtggcaccacgc

SEQ ID NO: 69155 - DNA, 25 bp, Mus musculus
ttagtaggcgtctgtggcaccacgc

SEQ ID NO: 69156 - DNA, 25 bp, Mus musculus
ttagtatcagcaggaaactggctgc

SEQ ID NO: 69157 - DNA, 25 bp, Mus musculus
ttagtcaaccttaggaagttccgat

SEQ ID NO: 69158 - DNA, 25 bp, Mus musculus
ttagtccaccactgtccaacatggc

SEQ ID NO: 69159 - DNA, 25 bp, Mus musculus
ttagtctttgtccttctgatggcta

SEQ ID NO: 69160 - DNA, 25 bp, Mus musculus
ttagtgaacactccttcggtgcagc

SEQ ID NO: 69161 - DNA, 25 bp, Mus musculus
ttagtgaacactgcttcggtgcagc

SEQ ID NO: 69162 - DNA, 25 bp, Mus musculus
ttagtgcaatgcctgtgttgaccgc

SEQ ID NO: 69163 - DNA, 25 bp, Mus musculus
ttagtgcaatttatggccgagggat

SEQ ID NO: 69164 - DNA, 25 bp, Mus musculus
ttagtgcagtttgccttttactccg

SEQ ID NO: 69165 - DNA, 25 bp, Mus musculus
ttagtggcagtttccagcagcctgc

SEQ ID NO: 69166 - DNA, 25 bp, Mus musculus
ttagtgggaccattttcataaggaa

SEQ ID NO: 69167 - DNA, 25 bp, Mus musculus
ttagtttgaacctgaagtaccagca

SEQ ID NO: 69168 - DNA, 25 bp, Mus musculus
ttataaacttcaaaatggcatcctc

SEQ ID NO: 69169 - DNA, 25 bp, Mus musculus
ttataaatgcctttgctcctgcctc

SEQ ID NO: 69170 - DNA, 25 bp, Mus musculus
ttataatgtgacatactggcccctc

SEQ ID NO: 69171 - DNA, 25 bp, Mus musculus
ttatacacagactcttgttgcccag

SEQ ID NO: 69172 - DNA, 25 bp, Mus musculus
ttatacagctgtcccttgactcact

SEQ ID NO: 69173 - DNA, 25 bp, Mus musculus
ttatacagggatgtgacattggaga

SEQ ID NO: 69174 - DNA, 25 bp, Mus musculus
ttataccattctctcggcccggtga

SEQ ID NO: 69175 - DNA, 25 bp, Mus musculus
ttatacctcaagatgggaagaaggt

SEQ ID NO: 69176 - DNA, 25 bp, Mus musculus
ttatactaagacatggagagggcca

SEQ ID NO: 69177 - DNA, 25 bp, Mus musculus
ttatagacgaatatgcttatgggag

SEQ ID NO: 69178 - DNA, 25 bp, Mus musculus
ttataggcactcatcaccctgccta

SEQ ID NO: 69179 - DNA, 25 bp, Mus musculus
ttataggcatttccgtgggactctc

SEQ ID NO: 69180 - DNA, 25 bp, Mus musculus
ttatatggagcaaaactgattgcac

SEQ ID NO: 69181 - DNA, 25 bp, Mus musculus
ttatatgtgacaggaagtgaagctc

SEQ ID NO: 69182 - DNA, 25 bp, Mus musculus
ttatatgttggatgcactgagaaaa

SEQ ID NO: 69183 - DNA, 25 bp, Mus musculus
ttatatttcagagccaccggtactg

SEQ ID NO: 69184 - DNA, 25 bp, Mus musculus
ttatatttctagagctgagtctcag

SEQ ID NO: 69185 - DNA, 25 bp, Mus musculus
ttatatttggcagggatgaattccc

SEQ ID NO: 69186 - DNA, 25 bp, Mus musculus
ttatcaatcggatgaggagcctgct

SEQ ID NO: 69187 - DNA, 25 bp, Mus musculus
ttatcacaaccaccagatcccatag

SEQ ID NO: 69188 - DNA, 25 bp, Mus musculus
ttatcacagtatcccagatgccaaa

SEQ ID NO: 69189 - DNA, 25 bp, Mus musculus
ttatcaccaagcaaaagccctggag

SEQ ID NO: 69190 - DNA, 25 bp, Mus musculus
ttatcaccgtgatgggagcgcggca

SEQ ID NO: 69191 - DNA, 25 bp, Mus musculus
ttatcactcagcccaagaggtgggt

SEQ ID NO: 69192 - DNA, 25 bp, Mus musculus
ttatcagcagctcctcccaagcaag

SEQ ID NO: 69193 - DNA, 25 bp, Mus musculus
ttatcaggagaacagatcagtggag

SEQ ID NO: 69194 - DNA, 25 bp, Mus musculus
ttatcatctgatccgaggccccagt

SEQ ID NO: 69195 - DNA, 25 bp, Mus musculus
ttatccaaaaccagggcggccagcg

SEQ ID NO: 69196 - DNA, 25 bp, Mus musculus
ttatccaaaacctgggcggccagcg

SEQ ID NO: 69197 - DNA, 25 bp, Mus musculus
ttatccagaggggtgaaccagacag

SEQ ID NO: 69198 - DNA, 25 bp, Mus musculus
ttatccagtcttctactcgtagggc

SEQ ID NO: 69199 - DNA, 25 bp, Mus musculus
ttatccataacccagtggacgggat

SEQ ID NO: 69200 - DNA, 25 bp, Mus musculus
ttatccatgacccaagatgactaca

SEQ ID NO: 69201 - DNA, 25 bp, Mus musculus
ttatcccaacccagaggcagccttg

SEQ ID NO: 69202 - DNA, 25 bp, Mus musculus
ttatccccgaaaatttgagactgct

SEQ ID NO: 69203 - DNA, 25 bp, Mus musculus
ttatccctggcagtcgatgggctgg

SEQ ID NO: 69204 - DNA, 25 bp, Mus musculus
ttatcccttcagctctacatcagag

SEQ ID NO: 69205 - DNA, 25 bp, Mus musculus
ttatccgagacagcctggagaagag

SEQ ID NO: 69206 - DNA, 25 bp, Mus musculus
ttatccgggaacccctatcactcag

SEQ ID NO: 69207 - DNA, 25 bp, Mus musculus
ttatcctgtattcatcgtaatgctg

SEQ ID NO: 69208 - DNA, 25 bp, Mus musculus
ttatcgagcataagattgtcatagc

SEQ ID NO: 69209 - DNA, 25 bp, Mus musculus
ttatcgcatagaaaaccagacttgc

SEQ ID NO: 69210 - DNA, 25 bp, Mus musculus
ttatcgcatagataaccagacttgc

SEQ ID NO: 69211 - DNA, 25 bp, Mus musculus
ttatcgcggcatccctcggttacat

SEQ ID NO: 69212 - DNA, 25 bp, Mus musculus
ttatcggagccagcctgcttaccat

SEQ ID NO: 69213 - DNA, 25 bp, Mus musculus
ttatcgttcatctattccacggaga

SEQ ID NO: 69214 - DNA, 25 bp, Mus musculus
ttatctatgtggcttagcaacacct

SEQ ID NO: 69215 - DNA, 25 bp, Mus musculus
ttatctgggccacctaccttcaaca

SEQ ID NO: 69216 - DNA, 25 bp, Mus musculus
ttatctgggttctctgcctccacct

SEQ ID NO: 69217 - DNA, 25 bp, Mus musculus
ttatctgtgcaaccattctctgagg

SEQ ID NO: 69218 - DNA, 25 bp, Mus musculus
ttatcttcaactgggcatgctcaca

SEQ ID NO: 69219 - DNA, 25 bp, Mus musculus
ttatcttctaccgagagggctccgc

SEQ ID NO: 69220 - DNA, 25 bp, Mus musculus
ttatctttgagtaaatggagccagc

SEQ ID NO: 69221 - DNA, 25 bp, Mus musculus
ttatctttgagttaatggagccagc

SEQ ID NO: 69222 - DNA, 25 bp, Mus musculus
ttatgaacagccctgattgtggaca

SEQ ID NO: 69223 - DNA, 25 bp, Mus musculus
ttatgaacccttcgtctgcatctat

SEQ ID NO: 69224 - DNA, 25 bp, Mus musculus
ttatgaacccttggtctgcatctat

SEQ ID NO: 69225 - DNA, 25 bp, Mus musculus
ttatgaatgaagtggagaaagcccc

SEQ ID NO: 69226 - DNA, 25 bp, Mus musculus
ttatgaatgcgagccagggatgatc

SEQ ID NO: 69227 - DNA, 25 bp, Mus musculus
ttatgacacgctacagtattgcgac

SEQ ID NO: 69228 - DNA, 25 bp, Mus musculus
ttatgacatagacccaaacgccggg

SEQ ID NO: 69229 - DNA, 25 bp, Mus musculus
ttatgacatagagccaaacgccggg

SEQ ID NO: 69230 - DNA, 25 bp, Mus musculus
ttatgagaaaatggtggatcacaga

SEQ ID NO: 69231 - DNA, 25 bp, Mus musculus
ttatgagaagaaatagagaccggta

SEQ ID NO: 69232 - DNA, 25 bp, Mus musculus
ttatgagaagaaccaggaggacaga

SEQ ID NO: 69233 - DNA, 25 bp, Mus musculus
ttatgagaccaactgatgtaccaga

SEQ ID NO: 69234 - DNA, 25 bp, Mus musculus
ttatgagcctcccaggagatcagcc

SEQ ID NO: 69235 - DNA, 25 bp, Mus musculus
ttatgagtgcgaggtcgtccctgtc

SEQ ID NO: 69236 - DNA, 25 bp, Mus musculus
ttatgattacctacgacccatcgct

SEQ ID NO: 69237 - DNA, 25 bp, Mus musculus
ttatgcagaaaagccggatgaaata

SEQ ID NO: 69238 - DNA, 25 bp, Mus musculus
ttatgcagacacacaagagattaat

SEQ ID NO: 69239 - DNA, 25 bp, Mus musculus
ttatgcaggctaggctgaccctgaa

SEQ ID NO: 69240 - DNA, 25 bp, Mus musculus
ttatgcatggaacaaaacgcaccga

SEQ ID NO: 69241 - DNA, 25 bp, Mus musculus
ttatgcatggaagaaaacgcaccga

SEQ ID NO: 69242 - DNA, 25 bp, Mus musculus
ttatgcctgcataccaagaagacag

SEQ ID NO: 69243 - DNA, 25 bp, Mus musculus
ttatgctgacctttctgctctatgc

SEQ ID NO: 69244 - DNA, 25 bp, Mus musculus
ttatgctgcgtaccgctatgcccag

SEQ ID NO: 69245 - DNA, 25 bp, Mus musculus
ttatgctggagggagtcagctcagc

SEQ ID NO: 69246 - DNA, 25 bp, Mus musculus
ttatgctgggaacaatcccatttcc

SEQ ID NO: 69247 - DNA, 25 bp, Mus musculus
ttatggaagaagtattgctcctggg

SEQ ID NO: 69248 - DNA, 25 bp, Mus musculus
ttatggaatactctgggtgtctgca

SEQ ID NO: 69249 - DNA, 25 bp, Mus musculus
ttatggatcccaacgatgtgaagat

SEQ ID NO: 69250 - DNA, 25 bp, Mus musculus
ttatggatcccatcgatgtgaagat

SEQ ID NO: 69251 - DNA, 25 bp, Mus musculus
ttatggcattccttgctccaggatt

SEQ ID NO: 69252 - DNA, 25 bp, Mus musculus
ttatggcgtttccaaagagacattc

SEQ ID NO: 69253 - DNA, 25 bp, Mus musculus
ttatgggaaagtatccaggcgaggt

SEQ ID NO: 69254 - DNA, 25 bp, Mus musculus
ttatgggacagacgctatcatctac

SEQ ID NO: 69255 - DNA, 25 bp, Mus musculus
ttatgggacagaggctatcatctac

SEQ ID NO: 69256 - DNA, 25 bp, Mus musculus
ttatgggtgctacatgtgtgctttc

SEQ ID NO: 69257 - DNA, 25 bp, Mus musculus
ttatggtggtcgatttgagagctcc

SEQ ID NO: 69258 - DNA, 25 bp, Mus musculus
ttatgtacacctccaaaaacagttg

SEQ ID NO: 69259 - DNA, 25 bp, Mus musculus
ttatgtacaggtgttcttcactctg

SEQ ID NO: 69260 - DNA, 25 bp, Mus musculus
ttatgtatatgtccggtacctgtgg

SEQ ID NO: 69261 - DNA, 25 bp, Mus musculus
ttatgtatgcaaacaaaagcattgt

SEQ ID NO: 69262 - DNA, 25 bp, Mus musculus
ttatgtcaagaagccttctggaccc

SEQ ID NO: 69263 - DNA, 25 bp, Mus musculus
ttatgtctggaggagactgtgtgat

SEQ ID NO: 69264 - DNA, 25 bp, Mus musculus
ttatgtgcctgccaagcagtgagca

SEQ ID NO: 69265 - DNA, 25 bp, Mus musculus
ttatgtttccatacggagccacccc

SEQ ID NO: 69266 - DNA, 25 bp, Mus musculus
ttatgtttgtctgcctgtgctcatt

SEQ ID NO: 69267 - DNA, 25 bp, Mus musculus
ttattaacagctgtcctctaggaga

SEQ ID NO: 69268 - DNA, 25 bp, Mus musculus
ttattataccttcagccctggactt

SEQ ID NO: 69269 - DNA, 25 bp, Mus musculus
ttattatcaataatcagagcccatg

SEQ ID NO: 69270 - DNA, 25 bp, Mus musculus
ttattcaatagagttcggacaattc

SEQ ID NO: 69271 - DNA, 25 bp, Mus musculus
ttattccaaatgtctaccaaggagt

SEQ ID NO: 69272 - DNA, 25 bp, Mus musculus
ttattcccgggaaaagcgcgagtag

SEQ ID NO: 69273 - DNA, 25 bp, Mus musculus
ttattccctcaaagttgccccgaag

SEQ ID NO: 69274 - DNA, 25 bp, Mus musculus
ttattggaacatgggaaggagcctt

SEQ ID NO: 69275 - DNA, 25 bp, Mus musculus
ttattggagctatgactacgtggag

SEQ ID NO: 69276 - DNA, 25 bp, Mus musculus
ttattggcccctgctgagattccag

SEQ ID NO: 69277 - DNA, 25 bp, Mus musculus
ttattgtgtccatcatcaacagctc

SEQ ID NO: 69278 - DNA, 25 bp, Mus musculus
ttatttatccaaccacctgcgacgc

SEQ ID NO: 69279 - DNA, 25 bp, Mus musculus
ttatttatcggcctggctggaacag

SEQ ID NO: 69280 - DNA, 25 bp, Mus musculus
ttatttccccgagagagtttgttga

SEQ ID NO: 69281 - DNA, 25 bp, Mus musculus
ttatttctgctaatcagctgaagcg

SEQ ID NO: 69282 - DNA, 25 bp, Mus musculus
ttatttggccagtgtctgaagtcac

SEQ ID NO: 69283 - DNA, 25 bp, Mus musculus
ttatttgggatagctatacgacaaa

SEQ ID NO: 69284 - DNA, 25 bp, Mus musculus
ttattttggatagcaaagaggcagc

SEQ ID NO: 69285 - DNA, 25 bp, Mus musculus
ttattttgttcagcctgtgaccaga

SEQ ID NO: 69286 - DNA, 25 bp, Mus musculus
ttcaaaacaccagcgaaagtgggtc

SEQ ID NO: 69287 - DNA, 25 bp, Mus musculus
ttcaaaactgcgtatgagctttggg

SEQ ID NO: 69288 - DNA, 25 bp, Mus musculus
ttcaaaatactgaatggttcatccc

SEQ ID NO: 69289 - DNA, 25 bp, Mus musculus
ttcaaaatactgtatggttcatccc

SEQ ID NO: 69290 - DNA, 25 bp, Mus musculus
ttcaaacccggacaggacaggtact

SEQ ID NO: 69291 - DNA, 25 bp, Mus musculus
ttcaaacctttgtgggccaggaatg

SEQ ID NO: 69292 - DNA, 25 bp, Mus musculus
ttcaaacggcgacctgtacatctgg

SEQ ID NO: 69293 - DNA, 25 bp, Mus musculus
ttcaaacttcaactcaggcgccaac

SEQ ID NO: 69294 - DNA, 25 bp, Mus musculus
ttcaaagactgtggcaagattgcat

SEQ ID NO: 69295 - DNA, 25 bp, Mus musculus
ttcaaagccaaccacccgatggatg

SEQ ID NO: 69296 - DNA, 25 bp, Mus musculus
ttcaaagccagacatgattttacag

SEQ ID NO: 69297 - DNA, 25 bp, Mus musculus
ttcaaagccagagatgattttacag

SEQ ID NO: 69298 - DNA, 25 bp, Mus musculus
ttcaaagcggtcgttggcaaaaact

SEQ ID NO: 69299 - DNA, 25 bp, Mus musculus
ttcaaagggaaagccggttcttgcg

SEQ ID NO: 69300 - DNA, 25 bp, Mus musculus
ttcaaagtcttgcatcagccatcgc

SEQ ID NO: 69301 - DNA, 25 bp, Mus musculus
ttcaaatgccatcgatccaacggta

SEQ ID NO: 69302 - DNA, 25 bp, Mus musculus
ttcaaatgctgccagggatctgaag

SEQ ID NO: 69303 - DNA, 25 bp, Mus musculus
ttcaaatgtcgtttccctcaccctg

SEQ ID NO: 69304 - DNA, 25 bp, Mus musculus
ttcaaattgcaactaggaggccggc

SEQ ID NO: 69305 - DNA, 25 bp, Mus musculus
ttcaaattgccaaaggcaaaggtgc

SEQ ID NO: 69306 - DNA, 25 bp, Mus musculus
ttcaaattggcctggactcaggatc

SEQ ID NO: 69307 - DNA, 25 bp, Mus musculus
ttcaacaaacgtcccaccaaaatcg

SEQ ID NO: 69308 - DNA, 25 bp, Mus musculus
ttcaacaaagaagcctaatgtaaag

SEQ ID NO: 69309 - DNA, 25 bp, Mus musculus
ttcaacaaatccagacgtcatcaag

SEQ ID NO: 69310 - DNA, 25 bp, Mus musculus
ttcaacaacgaacccaatctcaaag

SEQ ID NO: 69311 - DNA, 25 bp, Mus musculus
ttcaacaacgaagccaatctcaaag

SEQ ID NO: 69312 - DNA, 25 bp, Mus musculus
ttcaacaaggcggagaaacacgtgc

SEQ ID NO: 69313 - DNA, 25 bp, Mus musculus
ttcaacagctacatagtcagcacga

SEQ ID NO: 69314 - DNA, 25 bp, Mus musculus
ttcaacagtctgtcactgaagccag

SEQ ID NO: 69315 - DNA, 25 bp, Mus musculus
ttcaaccactatctcagtgcaatgg

SEQ ID NO: 69316 - DNA, 25 bp, Mus musculus
ttcaaccagctgctgattcacgcgg

SEQ ID NO: 69317 - DNA, 25 bp, Mus musculus
ttcaacccggctcatgtggaggctg

SEQ ID NO: 69318 - DNA, 25 bp, Mus musculus
ttcaacctgcccaaggagcgggagg

SEQ ID NO: 69319 - DNA, 25 bp, Mus musculus
ttcaacgccaagattcagacagaaa

SEQ ID NO: 69320 - DNA, 25 bp, Mus musculus
ttcaactggcatgttgggccgtatc

SEQ ID NO: 69321 - DNA, 25 bp, Mus musculus
ttcaactgggacgacgaaacagcca

SEQ ID NO: 69322 - DNA, 25 bp, Mus musculus
ttcaagaaagcaggatggaccatag

SEQ ID NO: 69323 - DNA, 25 bp, Mus musculus
ttcaagacatggagtgtgtgccctg

SEQ ID NO: 69324 - DNA, 25 bp, Mus musculus
ttcaagactggtctgccaccaagca

SEQ ID NO: 69325 - DNA, 25 bp, Mus musculus
ttcaagactgtctgcagctgattgc

SEQ ID NO: 69326 - DNA, 25 bp, Mus musculus
ttcaagaggaagcacgttgccttgt

SEQ ID NO: 69327 - DNA, 25 bp, Mus musculus
ttcaagcactatcaggccgttcatg

SEQ ID NO: 69328 - DNA, 25 bp, Mus musculus
ttcaagcaggtggaggagagccata

SEQ ID NO: 69329 - DNA, 25 bp, Mus musculus
ttcaagcattccctagacccatggg

SEQ ID NO: 69330 - DNA, 25 bp, Mus musculus
ttcaagccatgagccaatgcagcca

SEQ ID NO: 69331 - DNA, 25 bp, Mus musculus
ttcaagcgctgtcttcctgttggcc

SEQ ID NO: 69332 - DNA, 25 bp, Mus musculus
ttcaagctcttgcattagaatctcg

SEQ ID NO: 69333 - DNA, 25 bp, Mus musculus
ttcaaggaacagctgacccacctgg

SEQ ID NO: 69334 - DNA, 25 bp, Mus musculus
ttcaaggaagttgggtactacaatg

SEQ ID NO: 69335 - DNA, 25 bp, Mus musculus
ttcaaggagaaaccgaaggagtatc

SEQ ID NO: 69336 - DNA, 25 bp, Mus musculus
ttcaaggagacaacatctacacact

SEQ ID NO: 69337 - DNA, 25 bp, Mus musculus
ttcaaggagatcagaatctctactc

SEQ ID NO: 69338 - DNA, 25 bp, Mus musculus
ttcaaggagatctgaatctctactc

SEQ ID NO: 69339 - DNA, 25 bp, Mus musculus
ttcaaggccaagttcacgcagcctc

SEQ ID NO: 69340 - DNA, 25 bp, Mus musculus
ttcaaggcccttattagcccatatg

SEQ ID NO: 69341 - DNA, 25 bp, Mus musculus
ttcaaggtgcttatggaccagctgc

SEQ ID NO: 69342 - DNA, 25 bp, Mus musculus
ttcaagtacctaagtcctggcacca

SEQ ID NO: 69343 - DNA, 25 bp, Mus musculus
ttcaagtatttaacaacagtcctga

SEQ ID NO: 69344 - DNA, 25 bp, Mus musculus
ttcaagtccaccctgccagatgctg

SEQ ID NO: 69345 - DNA, 25 bp, Mus musculus
ttcaagtgcacctaacctacaggat

SEQ ID NO: 69346 - DNA, 25 bp, Mus musculus
ttcaagtgggattacatgacaccag

SEQ ID NO: 69347 - DNA, 25 bp, Mus musculus
ttcaagttggtcttcaccccaaagg

SEQ ID NO: 69348 - DNA, 25 bp, Mus musculus
ttcaatacacaattcaggcattagt

SEQ ID NO: 69349 - DNA, 25 bp, Mus musculus
ttcaataccggaagttcacctcagc

SEQ ID NO: 69350 - DNA, 25 bp, Mus musculus
ttcaataccggccacgctacatcgt

SEQ ID NO: 69351 - DNA, 25 bp, Mus musculus
ttcaatacctcattcctgggtacag

SEQ ID NO: 69352 - DNA, 25 bp, Mus musculus
ttcaatagagttcggacaattcaga

SEQ ID NO: 69353 - DNA, 25 bp, Mus musculus
ttcaatattaacagggttgcagcgc

SEQ ID NO: 69354 - DNA, 25 bp, Mus musculus
ttcaatcaccacaaatacaaactgt

SEQ ID NO: 69355 - DNA, 25 bp, Mus musculus
ttcaatcagaacaacggaaatatca

SEQ ID NO: 69356 - DNA, 25 bp, Mus musculus
ttcaatcccaagacagaattatggt

SEQ ID NO: 69357 - DNA, 25 bp, Mus musculus
ttcaatccccgactcggaaagcaat

SEQ ID NO: 69358 - DNA, 25 bp, Mus musculus
ttcaatctgccaatgtgcaaagctg

SEQ ID NO: 69359 - DNA, 25 bp, Mus musculus
ttcaatctgctacgcctggagctag

SEQ ID NO: 69360 - DNA, 25 bp, Mus musculus
ttcaatgaagtgaaaaatggcatca

SEQ ID NO: 69361 - DNA, 25 bp, Mus musculus
ttcaatgacatccacaagttcaggg

SEQ ID NO: 69362 - DNA, 25 bp, Mus musculus
ttcaatgacatcgacaagttcaggg

SEQ ID NO: 69363 - DNA, 25 bp, Mus musculus
ttcaatgcagaagctgtcaagaaca

SEQ ID NO: 69364 - DNA, 25 bp, Mus musculus
ttcaatgcgagctcttgggcatgtt

SEQ ID NO: 69365 - DNA, 25 bp, Mus musculus
ttcaatgctcccttcgatgttggca

SEQ ID NO: 69366 - DNA, 25 bp, Mus musculus
ttcaatggtgtgcttctggtttcaa

SEQ ID NO: 69367 - DNA, 25 bp, Mus musculus
ttcaatgtatctatgcctgcctact

SEQ ID NO: 69368 - DNA, 25 bp, Mus musculus
ttcaatgtgacggagatggatgctg

SEQ ID NO: 69369 - DNA, 25 bp, Mus musculus
ttcaattgaaatgggccctgcccac

SEQ ID NO: 69370 - DNA, 25 bp, Mus musculus
ttcacaaataaaagatgcaacaata

SEQ ID NO: 69371 - DNA, 25 bp, Mus musculus
ttcacaaatgagagaacacagatcc

SEQ ID NO: 69372 - DNA, 25 bp, Mus musculus
ttcacaacccttcggattccatcag

SEQ ID NO: 69373 - DNA, 25 bp, Mus musculus
ttcacaagtttgtggctcctgaaga

SEQ ID NO: 69374 - DNA, 25 bp, Mus musculus
ttcacacaacgaactagaaaagcac

SEQ ID NO: 69375 - DNA, 25 bp, Mus musculus
ttcacacacatctgcgagtatacgc

SEQ ID NO: 69376 - DNA, 25 bp, Mus musculus
ttcacacactcaaatctgcagcctg

SEQ ID NO: 69377 - DNA, 25 bp, Mus musculus
ttcacacgcctccatctccaagcag

SEQ ID NO: 69378 - DNA, 25 bp, Mus musculus
ttcacacgggcccaaggaccttgag

SEQ ID NO: 69379 - DNA, 25 bp, Mus musculus
ttcacacttataccagcctcctggg

SEQ ID NO: 69380 - DNA, 25 bp, Mus musculus
ttcacagaaggacagacgccacggt

SEQ ID NO: 69381 - DNA, 25 bp, Mus musculus
ttcacagacgaggagaccgaggccc

SEQ ID NO: 69382 - DNA, 25 bp, Mus musculus
ttcacagatagcctcaaaatgaggg

SEQ ID NO: 69383 - DNA, 25 bp, Mus musculus
ttcacaggagctatgccagcagcag

SEQ ID NO: 69384 - DNA, 25 bp, Mus musculus
ttcacaggttggacagaaacatcag

SEQ ID NO: 69385 - DNA, 25 bp, Mus musculus
ttcacagtctccgtcattagaaaca

SEQ ID NO: 69386 - DNA, 25 bp, Mus musculus
ttcacagttctgaatctggctgtag

SEQ ID NO: 69387 - DNA, 25 bp, Mus musculus
ttcacatagatgctttagagaccag

SEQ ID NO: 69388 - DNA, 25 bp, Mus musculus
ttcacatcagatccttcagcattgc

SEQ ID NO: 69389 - DNA, 25 bp, Mus musculus
ttcaccaaccacaatggcacaggag

SEQ ID NO: 69390 - DNA, 25 bp, Mus musculus
ttcaccaagtgggtcaacaaacacc

SEQ ID NO: 69391 - DNA, 25 bp, Mus musculus
ttcaccacccacagagaacactaaa

SEQ ID NO: 69392 - DNA, 25 bp, Mus musculus
ttcaccagcgcttccgggacaagaa

SEQ ID NO: 69393 - DNA, 25 bp, Mus musculus
ttcaccatgggtgtcattggtggtg

SEQ ID NO: 69394 - DNA, 25 bp, Mus musculus
ttcacccagttatacaacctgtggg

SEQ ID NO: 69395 - DNA, 25 bp, Mus musculus
ttcaccccggtgtgcattcaaaact

SEQ ID NO: 69396 - DNA, 25 bp, Mus musculus
ttcaccctcttggtaaagaacaaca

SEQ ID NO: 69397 - DNA, 25 bp, Mus musculus
ttcaccgcgattggaggcaacctgg

SEQ ID NO: 69398 - DNA, 25 bp, Mus musculus
ttcaccgtgccaagtgccagtggcc

SEQ ID NO: 69399 - DNA, 25 bp, Mus musculus
ttcacctacccgaaaggagctggag

SEQ ID NO: 69400 - DNA, 25 bp, Mus musculus
ttcacctcgtgggaaaggctacagc

SEQ ID NO: 69401 - DNA, 25 bp, Mus musculus
ttcacctctgcgtgccctgggcgtt

SEQ ID NO: 69402 - DNA, 25 bp, Mus musculus
ttcacctgcattaccagcgcgtggg

SEQ ID NO: 69403 - DNA, 25 bp, Mus musculus
ttcacctgccgcagcggcgagtgca

SEQ ID NO: 69404 - DNA, 25 bp, Mus musculus
ttcacctgggcaatgacagcagccg

SEQ ID NO: 69405 - DNA, 25 bp, Mus musculus
ttcacctgggcagtcacgaaaccaa

SEQ ID NO: 69406 - DNA, 25 bp, Mus musculus
ttcacctgtcaggtggctggctgtt

SEQ ID NO: 69407 - DNA, 25 bp, Mus musculus
ttcaccttcaccaagccagtgctgg

SEQ ID NO: 69408 - DNA, 25 bp, Mus musculus
ttcaccttccactctgatatctgca

SEQ ID NO: 69409 - DNA, 25 bp, Mus musculus
ttcacgagtacctgaccactgaggg

SEQ ID NO: 69410 - DNA, 25 bp, Mus musculus
ttcacgatggactgcgcagcgccca

SEQ ID NO: 69411 - DNA, 25 bp, Mus musculus
ttcacggatcattgagcgtctctta

SEQ ID NO: 69412 - DNA, 25 bp, Mus musculus
ttcacggatctcaagaatgggtccc

SEQ ID NO: 69413 - DNA, 25 bp, Mus musculus
ttcacgtctgcaggcatgagtggag

SEQ ID NO: 69414 - DNA, 25 bp, Mus musculus
ttcacgtggatgagtatggatcctg

SEQ ID NO: 69415 - DNA, 25 bp, Mus musculus
ttcactaatccacgtggcttgtttt

SEQ ID NO: 69416 - DNA, 25 bp, Mus musculus
ttcactaatccaggtggcttgtttt

SEQ ID NO: 69417 - DNA, 25 bp, Mus musculus
ttcactacacggtcggctgtctctg

SEQ ID NO: 69418 - DNA, 25 bp, Mus musculus
ttcactcagtaagttgaccaggctt

SEQ ID NO: 69419 - DNA, 25 bp, Mus musculus
ttcactcttcaccagtgaccaaaga

SEQ ID NO: 69420 - DNA, 25 bp, Mus musculus
ttcactgagggcaaagaagagacct

SEQ ID NO: 69421 - DNA, 25 bp, Mus musculus
ttcactgcagtcctggctattccag

SEQ ID NO: 69422 - DNA, 25 bp, Mus musculus
ttcactgcattgaggacttccacaa

SEQ ID NO: 69423 - DNA, 25 bp, Mus musculus
ttcactggaaacagcggaagatggg

SEQ ID NO: 69424 - DNA, 25 bp, Mus musculus
ttcactgggcggcatctgggaaact

SEQ ID NO: 69425 - DNA, 25 bp, Mus musculus
ttcacttcctttataggatggagtg

SEQ ID NO: 69426 - DNA, 25 bp, Mus musculus
ttcagaaaatattaacaatgcagcc

SEQ ID NO: 69427 - DNA, 25 bp, Mus musculus
ttcagaaaccagtgaggaccccgaa

SEQ ID NO: 69428 - DNA, 25 bp, Mus musculus
ttcagaaacccaagactcacattca

SEQ ID NO: 69429 - DNA, 25 bp, Mus musculus
ttcagaactcacaaggacccttggg

SEQ ID NO: 69430 - DNA, 25 bp, Mus musculus
ttcagaaggagcttgcagaaatcac

SEQ ID NO: 69431 - DNA, 25 bp, Mus musculus
ttcagaaggccatcagggaccggga

SEQ ID NO: 69432 - DNA, 25 bp, Mus musculus
ttcagaagggtgagatcctctccga

SEQ ID NO: 69433 - DNA, 25 bp, Mus musculus
ttcagaagtctagggagaaatttga

SEQ ID NO: 69434 - DNA, 25 bp, Mus musculus
ttcagaagttgagcaagaactggcc

SEQ ID NO: 69435 - DNA, 25 bp, Mus musculus
ttcagaattttgttaatactagaaa

SEQ ID NO: 69436 - DNA, 25 bp, Mus musculus
ttcagaccctcccaaaaagcactta

SEQ ID NO: 69437 - DNA, 25 bp, Mus musculus
ttcagacgcagagcgagcccttgct

SEQ ID NO: 69438 - DNA, 25 bp, Mus musculus
ttcagactcgacctcccaagtactg

SEQ ID NO: 69439 - DNA, 25 bp, Mus musculus
ttcagacttccctgagtcccctgat

SEQ ID NO: 69440 - DNA, 25 bp, Mus musculus
ttcagacttggtctatacactggct

SEQ ID NO: 69441 - DNA, 25 bp, Mus musculus
ttcagactttgaacagcaaagctcc

SEQ ID NO: 69442 - DNA, 25 bp, Mus musculus
ttcagagacagtttaagtacaacca

SEQ ID NO: 69443 - DNA, 25 bp, Mus musculus
ttcagagaggtgacagaacttatta

SEQ ID NO: 69444 - DNA, 25 bp, Mus musculus
ttcagagatgcccagtacagtgtcc

SEQ ID NO: 69445 - DNA, 25 bp, Mus musculus
ttcagagatgccgagtacagtgtcc

SEQ ID NO: 69446 - DNA, 25 bp, Mus musculus
ttcagagcagaaccggacactagca

SEQ ID NO: 69447 - DNA, 25 bp, Mus musculus
ttcagagcagaagcggacactagca

SEQ ID NO: 69448 - DNA, 25 bp, Mus musculus
ttcagagcagtagtgtgaggaaact

SEQ ID NO: 69449 - DNA, 25 bp, Mus musculus
ttcagaggagatactctccttcccc

SEQ ID NO: 69450 - DNA, 25 bp, Mus musculus
ttcagaggaggaggctattcagatt

SEQ ID NO: 69451 - DNA, 25 bp, Mus musculus
ttcagaggccccagaggccccagga

SEQ ID NO: 69452 - DNA, 25 bp, Mus musculus
ttcagagggttggttaggccaagga

SEQ ID NO: 69453 - DNA, 25 bp, Mus musculus
ttcagaggtgacagctgccttgcgt

SEQ ID NO: 69454 - DNA, 25 bp, Mus musculus
ttcagaggttcagccaccaaggcgt

SEQ ID NO: 69455 - DNA, 25 bp, Mus musculus
ttcagagtggaaacacagcaacatc

SEQ ID NO: 69456 - DNA, 25 bp, Mus musculus
ttcagatacacacaacgtagcctcc

SEQ ID NO: 69457 - DNA, 25 bp, Mus musculus
ttcagatacgaaatatcccgcccca

SEQ ID NO: 69458 - DNA, 25 bp, Mus musculus
ttcagatgagtgagtgactttctgc

SEQ ID NO: 69459 - DNA, 25 bp, Mus musculus
ttcagatgctgtttcacctcagtgg

SEQ ID NO: 69460 - DNA, 25 bp, Mus musculus
ttcagatgggaagagtcatattgac

SEQ ID NO: 69461 - DNA, 25 bp, Mus musculus
ttcagattcaggaagctgaaacaag

SEQ ID NO: 69462 - DNA, 25 bp, Mus musculus
ttcagattttccttccccgcagcag

SEQ ID NO: 69463 - DNA, 25 bp, Mus musculus
ttcagcaagcgccttggtcttatgc

SEQ ID NO: 69464 - DNA, 25 bp, Mus musculus
ttcagcaaggctctccgcacggctg

SEQ ID NO: 69465 - DNA, 25 bp, Mus musculus
ttcagcaatatcctccagcactgtg

SEQ ID NO: 69466 - DNA, 25 bp, Mus musculus
ttcagcacaacggacattgttctgt

SEQ ID NO: 69467 - DNA, 25 bp, Mus musculus
ttcagcaccgaaaaggagatcctgc

SEQ ID NO: 69468 - DNA, 25 bp, Mus musculus
ttcagcacctccaacattgggccaa

SEQ ID NO: 69469 - DNA, 25 bp, Mus musculus
ttcagcagaaagaatcatgaacagc

SEQ ID NO: 69470 - DNA, 25 bp, Mus musculus
ttcagcagataatgcgtctgacggg

SEQ ID NO: 69471 - DNA, 25 bp, Mus musculus
ttcagcagcccctggaggagtgcct

SEQ ID NO: 69472 - DNA, 25 bp, Mus musculus
ttcagcaggaagatggatgattaag

SEQ ID NO: 69473 - DNA, 25 bp, Mus musculus
ttcagcaggacttggaactggaaga

SEQ ID NO: 69474 - DNA, 25 bp, Mus musculus
ttcagcagtgaagacaggggacacc

SEQ ID NO: 69475 - DNA, 25 bp, Mus musculus
ttcagcagtgcaacagatcagtatg

SEQ ID NO: 69476 - DNA, 25 bp, Mus musculus
ttcagcatccccactctgtggagtc

SEQ ID NO: 69477 - DNA, 25 bp, Mus musculus
ttcagcatcgcagacaagaagcgca

SEQ ID NO: 69478 - DNA, 25 bp, Mus musculus
ttcagcattcgattagcatgcctgc

SEQ ID NO: 69479 - DNA, 25 bp, Mus musculus
ttcagcattggctcagagagtcagg

SEQ ID NO: 69480 - DNA, 25 bp, Mus musculus
ttcagccagtcctattcttggggtc

SEQ ID NO: 69481 - DNA, 25 bp, Mus musculus
ttcagccatgcccaatatgtaaaga

SEQ ID NO: 69482 - DNA, 25 bp, Mus musculus
ttcagccccgctggaactgttgcag

SEQ ID NO: 69483 - DNA, 25 bp, Mus musculus
ttcagccgctgtcatagcatctcct

SEQ ID NO: 69484 - DNA, 25 bp, Mus musculus
ttcagcctagcggttgcagggacct

SEQ ID NO: 69485 - DNA, 25 bp, Mus musculus
ttcagcctcaccatcgcgtgcatgg

SEQ ID NO: 69486 - DNA, 25 bp, Mus musculus
ttcagcctgactctccatgaagggc

SEQ ID NO: 69487 - DNA, 25 bp, Mus musculus
ttcagcctgatggatatgagcaaac

SEQ ID NO: 69488 - DNA, 25 bp, Mus musculus
ttcagcctgtgaccagatcttccag

SEQ ID NO: 69489 - DNA, 25 bp, Mus musculus
ttcagcctgtgtgtctacccagcgg

SEQ ID NO: 69490 - DNA, 25 bp, Mus musculus
ttcagcctttcttgacccctgggtg

SEQ ID NO: 69491 - DNA, 25 bp, Mus musculus
ttcagcgaacagcacaagcgtgcac

SEQ ID NO: 69492 - DNA, 25 bp, Mus musculus
ttcagcgctaatcaacctctccagt

SEQ ID NO: 69493 - DNA, 25 bp, Mus musculus
ttcagctacaagatagactttgcag

SEQ ID NO: 69494 - DNA, 25 bp, Mus musculus
ttcagctccagtcagccgcaaagaa

SEQ ID NO: 69495 - DNA, 25 bp, Mus musculus
ttcagctgatcccaaccactatggc

SEQ ID NO: 69496 - DNA, 25 bp, Mus musculus
ttcagcttccaagtaccttctgctt

SEQ ID NO: 69497 - DNA, 25 bp, Mus musculus
ttcagcttcctcaaacagggccacg

SEQ ID NO: 69498 - DNA, 25 bp, Mus musculus
ttcagcttctgtactaagatgcccg

SEQ ID NO: 69499 - DNA, 25 bp, Mus musculus
ttcagcttggagtttccaagtgcag

SEQ ID NO: 69500 - DNA, 25 bp, Mus musculus
ttcaggaacctgctaagaatcggcc

SEQ ID NO: 69501 - DNA, 25 bp, Mus musculus
ttcaggaagaggaccctcccgatgc

SEQ ID NO: 69502 - DNA, 25 bp, Mus musculus
ttcaggacagacatagaaacagaag

SEQ ID NO: 69503 - DNA, 25 bp, Mus musculus
ttcaggacccggcaactggaggaac

SEQ ID NO: 69504 - DNA, 25 bp, Mus musculus
ttcaggagaccgtgggaatctggct

SEQ ID NO: 69505 - DNA, 25 bp, Mus musculus
ttcaggagatccagtctcacatggg

SEQ ID NO: 69506 - DNA, 25 bp, Mus musculus
ttcaggagcttgattcctagctaca

SEQ ID NO: 69507 - DNA, 25 bp, Mus musculus
ttcaggagtgcagcaggcctctcgg

SEQ ID NO: 69508 - DNA, 25 bp, Mus musculus
ttcaggattttgatgcatgcagggc

SEQ ID NO: 69509 - DNA, 25 bp, Mus musculus
ttcaggcacatatggaagatctcga

SEQ ID NO: 69510 - DNA, 25 bp, Mus musculus
ttcaggcagccactaactaccgcaa

SEQ ID NO: 69511 - DNA, 25 bp, Mus musculus
ttcaggccagaaagcggaggccgaa

SEQ ID NO: 69512 - DNA, 25 bp, Mus musculus
ttcaggccgtcagcaaagtgctcag

SEQ ID NO: 69513 - DNA, 25 bp, Mus musculus
ttcaggctcgcttcaatcttctcag

SEQ ID NO: 69514 - DNA, 25 bp, Mus musculus
ttcagggcagcaacggtgacaagag

SEQ ID NO: 69515 - DNA, 25 bp, Mus musculus
ttcaggtgtagaatggaaaaactgt

SEQ ID NO: 69516 - DNA, 25 bp, Mus musculus
ttcaggttgtgttcatggtccggag

SEQ ID NO: 69517 - DNA, 25 bp, Mus musculus
ttcagtacttggctccctactccgg

SEQ ID NO: 69518 - DNA, 25 bp, Mus musculus
ttcagtatcctggtgagcaactggg

SEQ ID NO: 69519 - DNA, 25 bp, Mus musculus
ttcagtatgaaaccagcgagccagc

SEQ ID NO: 69520 - DNA, 25 bp, Mus musculus
ttcagtatgaaagcagcgagccagc

SEQ ID NO: 69521 - DNA, 25 bp, Mus musculus
ttcagtcaaactaagcaggtattca

SEQ ID NO: 69522 - DNA, 25 bp, Mus musculus
ttcagtcagctcagccccagtggtc

SEQ ID NO: 69523 - DNA, 25 bp, Mus musculus
ttcagtcagctctgccccagtggtc

SEQ ID NO: 69524 - DNA, 25 bp, Mus musculus
ttcagtcccaagtccaagatccctg

SEQ ID NO: 69525 - DNA, 25 bp, Mus musculus
ttcagtccctatgactacagccagt

SEQ ID NO: 69526 - DNA, 25 bp, Mus musculus
ttcagtccgctggatttcctacaag

SEQ ID NO: 69527 - DNA, 25 bp, Mus musculus
ttcagtcctgcgcattgcattttac

SEQ ID NO: 69528 - DNA, 25 bp, Mus musculus
ttcagtccttctccagttgcacagc

SEQ ID NO: 69529 - DNA, 25 bp, Mus musculus
ttcagtctccgcgtcttccaaggat

SEQ ID NO: 69530 - DNA, 25 bp, Mus musculus
ttcagtcttggagcccgttctgcca

SEQ ID NO: 69531 - DNA, 25 bp, Mus musculus
ttcagtgacccttctcccaaattcg

SEQ ID NO: 69532 - DNA, 25 bp, Mus musculus
ttcagtgagaactatacctgctcgg

SEQ ID NO: 69533 - DNA, 25 bp, Mus musculus
ttcagtgcgccccaggaattgaact

SEQ ID NO: 69534 - DNA, 25 bp, Mus musculus
ttcagtgcttctctcctcccagagg

SEQ ID NO: 69535 - DNA, 25 bp, Mus musculus
ttcagtgtataggagatgccgaaac

SEQ ID NO: 69536 - DNA, 25 bp, Mus musculus
ttcagtgttcctcataggcacaggg

SEQ ID NO: 69537 - DNA, 25 bp, Mus musculus
ttcagttctcaagccattccagatg

SEQ ID NO: 69538 - DNA, 25 bp, Mus musculus
ttcagttggtctgggatggaacccg

SEQ ID NO: 69539 - DNA, 25 bp, Mus musculus
ttcagtttccatcatctagagatgg

SEQ ID NO: 69540 - DNA, 25 bp, Mus musculus
ttcataaacaagattttgcctcagt

SEQ ID NO: 69541 - DNA, 25 bp, Mus musculus
ttcataacggattctaacggaagac

SEQ ID NO: 69542 - DNA, 25 bp, Mus musculus
ttcataagatcccagagacagctca

SEQ ID NO: 69543 - DNA, 25 bp, Mus musculus
ttcataagccagaaaaggtgtcatg

SEQ ID NO: 69544 - DNA, 25 bp, Mus musculus
ttcataaggccctggagcagcggaa

SEQ ID NO: 69545 - DNA, 25 bp, Mus musculus
ttcatacaaggtcggtgattatcac

SEQ ID NO: 69546 - DNA, 25 bp, Mus musculus
ttcatacaaggtgggtgattatcac

SEQ ID NO: 69547 - DNA, 25 bp, Mus musculus
ttcatacctcagcaagaactagttg

SEQ ID NO: 69548 - DNA, 25 bp, Mus musculus
ttcatactccattcagccaactcgg

SEQ ID NO: 69549 - DNA, 25 bp, Mus musculus
ttcatagagatgagtgttgagcagg

SEQ ID NO: 69550 - DNA, 25 bp, Mus musculus
ttcatagagcccctgacagaggatc

SEQ ID NO: 69551 - DNA, 25 bp, Mus musculus
ttcatagtggcgcaatgcacgcaga

SEQ ID NO: 69552 - DNA, 25 bp, Mus musculus
ttcatatccagatcaccagagaaga

SEQ ID NO: 69553 - DNA, 25 bp, Mus musculus
ttcatattcacttgacagaaagcag

SEQ ID NO: 69554 - DNA, 25 bp, Mus musculus
ttcatcaacatattccatttaactg

SEQ ID NO: 69555 - DNA, 25 bp, Mus musculus
ttcatcaacccctattgagcagtcc

SEQ ID NO: 69556 - DNA, 25 bp, Mus musculus
ttcatcaacctctgcatcttggcac

SEQ ID NO: 69557 - DNA, 25 bp, Mus musculus
ttcatcacagaagtgaagcgggcac

SEQ ID NO: 69558 - DNA, 25 bp, Mus musculus
ttcatcactcactctttggagatgt

SEQ ID NO: 69559 - DNA, 25 bp, Mus musculus
ttcatcagacagaattaggcccttc

SEQ ID NO: 69560 - DNA, 25 bp, Mus musculus
ttcatcatccggtgcgcactgtcct

SEQ ID NO: 69561 - DNA, 25 bp, Mus musculus
ttcatcatcctgaccctggtgaatg

SEQ ID NO: 69562 - DNA, 25 bp, Mus musculus
ttcatcatgaccagttctgtgacct

SEQ ID NO: 69563 - DNA, 25 bp, Mus musculus
ttcatccaggatgaaagcggtggag

SEQ ID NO: 69564 - DNA, 25 bp, Mus musculus
ttcatccagtgtgtgatcaatgcta

SEQ ID NO: 69565 - DNA, 25 bp, Mus musculus
ttcatccctggcctcggaaatgggc

SEQ ID NO: 69566 - DNA, 25 bp, Mus musculus
ttcatcctatctaagatccgggccc

SEQ ID NO: 69567 - DNA, 25 bp, Mus musculus
ttcatcctcacctgtgcgctgggct

SEQ ID NO: 69568 - DNA, 25 bp, Mus musculus
ttcatcgtaatgctgtggatggctg

SEQ ID NO: 69569 - DNA, 25 bp, Mus musculus
ttcatcgtaattctgcagctagtgg

SEQ ID NO: 69570 - DNA, 25 bp, Mus musculus
ttcatcgtgctgtcagtgtgaacga

SEQ ID NO: 69571 - DNA, 25 bp, Mus musculus
ttcatctcaaagaaggacccagagg

SEQ ID NO: 69572 - DNA, 25 bp, Mus musculus
ttcatctgacagacccaagtcagcg

SEQ ID NO: 69573 - DNA, 25 bp, Mus musculus
ttcatctgggagtacgatccaaccc

SEQ ID NO: 69574 - DNA, 25 bp, Mus musculus
ttcatcttgggcatccttatcatcc

SEQ ID NO: 69575 - DNA, 25 bp, Mus musculus
ttcatcttgggctttgcctccggct

SEQ ID NO: 69576 - DNA, 25 bp, Mus musculus
ttcatgaggtatcgtgcgcccaagc

SEQ ID NO: 69577 - DNA, 25 bp, Mus musculus
ttcatgatgggagcgctcatgatgt

SEQ ID NO: 69578 - DNA, 25 bp, Mus musculus
ttcatgcactgaccgacctcagcag

SEQ ID NO: 69579 - DNA, 25 bp, Mus musculus
ttcatgcctttttctgcagggccca

SEQ ID NO: 69580 - DNA, 25 bp, Mus musculus
ttcatgctagcctggaccatttttc

SEQ ID NO: 69581 - DNA, 25 bp, Mus musculus
ttcatggaaggaagtggacactccc

SEQ ID NO: 69582 - DNA, 25 bp, Mus musculus
ttcatggacgaggttttacaggagc

SEQ ID NO: 69583 - DNA, 25 bp, Mus musculus
ttcatggaggaacaagctgccacag

SEQ ID NO: 69584 - DNA, 25 bp, Mus musculus
ttcatggaggagcagtcccagtcca

SEQ ID NO: 69585 - DNA, 25 bp, Mus musculus
ttcatggctcttcccagctcatctg

SEQ ID NO: 69586 - DNA, 25 bp, Mus musculus
ttcatggtccggagagcagacatct

SEQ ID NO: 69587 - DNA, 25 bp, Mus musculus
ttcatgtacgtcctctgggctcttc

SEQ ID NO: 69588 - DNA, 25 bp, Mus musculus
ttcatgtgcaacgtggccctcagca

SEQ ID NO: 69589 - DNA, 25 bp, Mus musculus
ttcattacagatactctgtcaaagg

SEQ ID NO: 69590 - DNA, 25 bp, Mus musculus
ttcattaccgaaccagcaaggtgcg

SEQ ID NO: 69591 - DNA, 25 bp, Mus musculus
ttcattcaagacaaagtccattcca

SEQ ID NO: 69592 - DNA, 25 bp, Mus musculus
ttcattcaaggccaccatgtcaagg

SEQ ID NO: 69593 - DNA, 25 bp, Mus musculus
ttcattcttagaccggagcaggcag

SEQ ID NO: 69594 - DNA, 25 bp, Mus musculus
ttcattgagcgcaggacctgatctc

SEQ ID NO: 69595 - DNA, 25 bp, Mus musculus
ttcatttccaaactcattgactgct

SEQ ID NO: 69596 - DNA, 25 bp, Mus musculus
ttcatttccaaagtcattgactgct

SEQ ID NO: 69597 - DNA, 25 bp, Mus musculus
ttcatttgaacaagtggctgatgcc

SEQ ID NO: 69598 - DNA, 25 bp, Mus musculus
ttcatttggtgagggcaaggacgcc

SEQ ID NO: 69599 - DNA, 25 bp, Mus musculus
ttccaaaatgatgcaaatcaacctg

SEQ ID NO: 69600 - DNA, 25 bp, Mus musculus
ttccaaacagtaattgcaattccag

SEQ ID NO: 69601 - DNA, 25 bp, Mus musculus
ttccaaagaatgaccacaacctctt

SEQ ID NO: 69602 - DNA, 25 bp, Mus musculus
ttccaaaggcctttattagtccttg

SEQ ID NO: 69603 - DNA, 25 bp, Mus musculus
ttccaaatgaccaatgagaccctca

SEQ ID NO: 69604 - DNA, 25 bp, Mus musculus
ttccaacgacatccacaagctggat

SEQ ID NO: 69605 - DNA, 25 bp, Mus musculus
ttccaactctggctgcgggcgggcg

SEQ ID NO: 69606 - DNA, 25 bp, Mus musculus
ttccaactgggtgacctgcaccgtg

SEQ ID NO: 69607 - DNA, 25 bp, Mus musculus
ttccaagacccgcagacgagtgggc

SEQ ID NO: 69608 - DNA, 25 bp, Mus musculus
ttccaagactgttaccatatcccaa

SEQ ID NO: 69609 - DNA, 25 bp, Mus musculus
ttccaagagtggtccagagggtgac

SEQ ID NO: 69610 - DNA, 25 bp, Mus musculus
ttccaagcattaaggcaaaggacaa

SEQ ID NO: 69611 - DNA, 25 bp, Mus musculus
ttccaaggacttatcccaaagcctg

SEQ ID NO: 69612 - DNA, 25 bp, Mus musculus
ttccaagggattcaacagtatctac

SEQ ID NO: 69613 - DNA, 25 bp, Mus musculus
ttccaatgctacaaggcgctcacct

SEQ ID NO: 69614 - DNA, 25 bp, Mus musculus
ttccaatggaagcagtggctcaccc

SEQ ID NO: 69615 - DNA, 25 bp, Mus musculus
ttccaatggcacagatgtgaatctg

SEQ ID NO: 69616 - DNA, 25 bp, Mus musculus
ttccacagaagcgtccctgcggaag

SEQ ID NO: 69617 - DNA, 25 bp, Mus musculus
ttccacagagccatatcgcagagtg

SEQ ID NO: 69618 - DNA, 25 bp, Mus musculus
ttccacaggacaggcagctgggtga

SEQ ID NO: 69619 - DNA, 25 bp, Mus musculus
ttccacaggatgagtaacagccacc

SEQ ID NO: 69620 - DNA, 25 bp, Mus musculus
ttccacagggtgatcccagccttca

SEQ ID NO: 69621 - DNA, 25 bp, Mus musculus
ttccacatctgcatagctgcttcag

SEQ ID NO: 69622 - DNA, 25 bp, Mus musculus
ttccaccagaagtttgctctcagtc

SEQ ID NO: 69623 - DNA, 25 bp, Mus musculus
ttccaccatagaaaaggactctaat

SEQ ID NO: 69624 - DNA, 25 bp, Mus musculus
ttccaccgcctatgatccagtgagg

SEQ ID NO: 69625 - DNA, 25 bp, Mus musculus
ttccacctgggcgatgcagcagggc

SEQ ID NO: 69626 - DNA, 25 bp, Mus musculus
ttccactaccaacacagttatagca

SEQ ID NO: 69627 - DNA, 25 bp, Mus musculus
ttccactaccaagacagttatagca

SEQ ID NO: 69628 - DNA, 25 bp, Mus musculus
ttccactcttggagctcacacacag

SEQ ID NO: 69629 - DNA, 25 bp, Mus musculus
ttccacttcaccaacagagactgtg

SEQ ID NO: 69630 - DNA, 25 bp, Mus musculus
ttccagaaacttgcatctgaagata

SEQ ID NO: 69631 - DNA, 25 bp, Mus musculus
ttccagaaatcctgcagaattctga

SEQ ID NO: 69632 - DNA, 25 bp, Mus musculus
ttccagaacaagtacctccctcatg

SEQ ID NO: 69633 - DNA, 25 bp, Mus musculus
ttccagaagaagagaccaaaagagc

SEQ ID NO: 69634 - DNA, 25 bp, Mus musculus
ttccagaaggggtctccagatcatg

SEQ ID NO: 69635 - DNA, 25 bp, Mus musculus
ttccagacctgtgtatgacatccag

SEQ ID NO: 69636 - DNA, 25 bp, Mus musculus
ttccagacttctgcggttcaaattg

SEQ ID NO: 69637 - DNA, 25 bp, Mus musculus
ttccagagagaaaatgggaccttct

SEQ ID NO: 69638 - DNA, 25 bp, Mus musculus
ttccagagcatcttcaatcgctttt

SEQ ID NO: 69639 - DNA, 25 bp, Mus musculus
ttccagagccattaagagaagagcg

SEQ ID NO: 69640 - DNA, 25 bp, Mus musculus
ttccagagcctgtgggttgagaatc

SEQ ID NO: 69641 - DNA, 25 bp, Mus musculus
ttccagaggaagtaggtgagtacag

SEQ ID NO: 69642 - DNA, 25 bp, Mus musculus
ttccagaggatgctgttcatgaaga

SEQ ID NO: 69643 - DNA, 25 bp, Mus musculus
ttccagagtctacagttccggctgc

SEQ ID NO: 69644 - DNA, 25 bp, Mus musculus
ttccagattgtcagtagttcacatg

SEQ ID NO: 69645 - DNA, 25 bp, Mus musculus
ttccagcacaagcactgctgcaaag

SEQ ID NO: 69646 - DNA, 25 bp, Mus musculus
ttccagccgcctgttcaggtgttag

SEQ ID NO: 69647 - DNA, 25 bp, Mus musculus
ttccagcctgtacctccttggagtt

SEQ ID NO: 69648 - DNA, 25 bp, Mus musculus
ttccagcgccctcagcgaggtcagc

SEQ ID NO: 69649 - DNA, 25 bp, Mus musculus
ttccagcgctcaggaagaggtagaa

SEQ ID NO: 69650 - DNA, 25 bp, Mus musculus
ttccagcggcagaagctgatggcta

SEQ ID NO: 69651 - DNA, 25 bp, Mus musculus
ttccagctccctacctggaggaggt

SEQ ID NO: 69652 - DNA, 25 bp, Mus musculus
ttccagctcgactgaagaaagtgct

SEQ ID NO: 69653 - DNA, 25 bp, Mus musculus
ttccagctgaagacaattaacctgc

SEQ ID NO: 69654 - DNA, 25 bp, Mus musculus
ttccaggagcaaagcaaggactctg

SEQ ID NO: 69655 - DNA, 25 bp, Mus musculus
ttccaggagctgactgcctatcatc

SEQ ID NO: 69656 - DNA, 25 bp, Mus musculus
ttccaggcggtcaccgctcaactgg

SEQ ID NO: 69657 - DNA, 25 bp, Mus musculus
ttccaggtgacagacacgattcacg

SEQ ID NO: 69658 - DNA, 25 bp, Mus musculus
ttccagtaaacaaacagttggaagg

SEQ ID NO: 69659 - DNA, 25 bp, Mus musculus
ttccagtcttctggtatctctccag

SEQ ID NO: 69660 - DNA, 25 bp, Mus musculus
ttccagtggccccattgatccctta

SEQ ID NO: 69661 - DNA, 25 bp, Mus musculus
ttccatatatcctggttctgcctca

SEQ ID NO: 69662 - DNA, 25 bp, Mus musculus
ttccatcaagacatcaaagtatggt

SEQ ID NO: 69663 - DNA, 25 bp, Mus musculus
ttccatcagtggatgccaacattgg

SEQ ID NO: 69664 - DNA, 25 bp, Mus musculus
ttccatcagtggttgccaacattgg

SEQ ID NO: 69665 - DNA, 25 bp, Mus musculus
ttccatcataaggagaagattctgg

SEQ ID NO: 69666 - DNA, 25 bp, Mus musculus
ttccatccacgaggcctggactgat

SEQ ID NO: 69667 - DNA, 25 bp, Mus musculus
ttccatccggataggtagcactggg

SEQ ID NO: 69668 - DNA, 25 bp, Mus musculus
ttccatctgtttcttcgggatcatc

SEQ ID NO: 69669 - DNA, 25 bp, Mus musculus
ttccatgacagatagtgacgacact

SEQ ID NO: 69670 - DNA, 25 bp, Mus musculus
ttccatggacaaaactgaaaacaca

SEQ ID NO: 69671 - DNA, 25 bp, Mus musculus
ttccatggacggctctgaagatgac

SEQ ID NO: 69672 - DNA, 25 bp, Mus musculus
ttccatggactcttaccgaagggtt

SEQ ID NO: 69673 - DNA, 25 bp, Mus musculus
ttccatggccggtggtacacggatg

SEQ ID NO: 69674 - DNA, 25 bp, Mus musculus
ttccatgtctcaactgaagaatgtg

SEQ ID NO: 69675 - DNA, 25 bp, Mus musculus
ttccatgttgaaatatatgtctgag

SEQ ID NO: 69676 - DNA, 25 bp, Mus musculus
ttccattgatgaatcggaaaatgcc

SEQ ID NO: 69677 - DNA, 25 bp, Mus musculus
ttcccaaataatctgctcttgccat

SEQ ID NO: 69678 - DNA, 25 bp, Mus musculus
ttcccaaatccagagaggaactttg

SEQ ID NO: 69679 - DNA, 25 bp, Mus musculus
ttcccaacaagcctcactctgagga

SEQ ID NO: 69680 - DNA, 25 bp, Mus musculus
ttcccaacacttgtacaactctagt

SEQ ID NO: 69681 - DNA, 25 bp, Mus musculus
ttcccaagaaagacaaccccaggcg

SEQ ID NO: 69682 - DNA, 25 bp, Mus musculus
ttcccaagagttcctgtttctcctg

SEQ ID NO: 69683 - DNA, 25 bp, Mus musculus
ttcccaaggaccattcaggagctgg

SEQ ID NO: 69684 - DNA, 25 bp, Mus musculus
ttcccaaggtttactcaagcctgcc

SEQ ID NO: 69685 - DNA, 25 bp, Mus musculus
ttcccacagcaacaaggagaagacg

SEQ ID NO: 69686 - DNA, 25 bp, Mus musculus
ttcccacatcaaagaaaagctgcaa

SEQ ID NO: 69687 - DNA, 25 bp, Mus musculus
ttcccaccactgagatagacaacca

SEQ ID NO: 69688 - DNA, 25 bp, Mus musculus
ttcccaccctgacaaactcaaaagg

SEQ ID NO: 69689 - DNA, 25 bp, Mus musculus
ttcccacctaatatcctggacagca

SEQ ID NO: 69690 - DNA, 25 bp, Mus musculus
ttcccactggacacagttgaggtcc

SEQ ID NO: 69691 - DNA, 25 bp, Mus musculus
ttcccacttgaagctaaaacctgag

SEQ ID NO: 69692 - DNA, 25 bp, Mus musculus
ttcccagaggcagagaatagaaagt

SEQ ID NO: 69693 - DNA, 25 bp, Mus musculus
ttcccagagggaacacagatggctg

SEQ ID NO: 69694 - DNA, 25 bp, Mus musculus
ttcccagagtatggcctcagaacct

SEQ ID NO: 69695 - DNA, 25 bp, Mus musculus
ttcccaggacatccgacacatgcat

SEQ ID NO: 69696 - DNA, 25 bp, Mus musculus
ttcccaggacttcatggacgaggtt

SEQ ID NO: 69697 - DNA, 25 bp, Mus musculus
ttcccatatcaagcgtcatctgcaa

SEQ ID NO: 69698 - DNA, 25 bp, Mus musculus
ttcccatggccggaagttatggtgt

SEQ ID NO: 69699 - DNA, 25 bp, Mus musculus
ttcccatggctgaacaagacaaact

SEQ ID NO: 69700 - DNA, 25 bp, Mus musculus
ttcccatggtgcacggtgctacgcc

SEQ ID NO: 69701 - DNA, 25 bp, Mus musculus
ttccccacagtcagattgctgtact

SEQ ID NO: 69702 - DNA, 25 bp, Mus musculus
ttccccagacaccatctatgaggac

SEQ ID NO: 69703 - DNA, 25 bp, Mus musculus
ttccccagtcagctccgtttttcat

SEQ ID NO: 69704 - DNA, 25 bp, Mus musculus
ttccccatcttccacaagattaaga

SEQ ID NO: 69705 - DNA, 25 bp, Mus musculus
ttccccatgagggaagcccaggaga

SEQ ID NO: 69706 - DNA, 25 bp, Mus musculus
ttccccatgattgatgagaataacg

SEQ ID NO: 69707 - DNA, 25 bp, Mus musculus
ttccccattcgcctcataggcgagt

SEQ ID NO: 69708 - DNA, 25 bp, Mus musculus
ttccccattcgcgtcataggcgagt

SEQ ID NO: 69709 - DNA, 25 bp, Mus musculus
ttccccgaggtgcagtcaaagccat

SEQ ID NO: 69710 - DNA, 25 bp, Mus musculus
ttccccgtgtgcatccgcgaggcgg

SEQ ID NO: 69711 - DNA, 25 bp, Mus musculus
ttcccctcggtggtagatatgctcc

SEQ ID NO: 69712 - DNA, 25 bp, Mus musculus
ttcccctggacttagtaaagtgccg

SEQ ID NO: 69713 - DNA, 25 bp, Mus musculus
ttccccttcctgaactgcttcgtgg

SEQ ID NO: 69714 - DNA, 25 bp, Mus musculus
ttcccctttgactggcagaactgct

SEQ ID NO: 69715 - DNA, 25 bp, Mus musculus
ttcccgacgagaacttcacactgaa

SEQ ID NO: 69716 - DNA, 25 bp, Mus musculus
ttcccgaggaattcctggatcccca

SEQ ID NO: 69717 - DNA, 25 bp, Mus musculus
ttcccgaggagatccagcttgtccc

SEQ ID NO: 69718 - DNA, 25 bp, Mus musculus
ttcccgagtgggaacaggtgccaag

SEQ ID NO: 69719 - DNA, 25 bp, Mus musculus
ttcccgcaggaaacacagtgaccga

SEQ ID NO: 69720 - DNA, 25 bp, Mus musculus
ttcccgggaaaagcgcgagtagatt

SEQ ID NO: 69721 - DNA, 25 bp, Mus musculus
ttcccgtctaactgagcgtgctctg

SEQ ID NO: 69722 - DNA, 25 bp, Mus musculus
ttccctagcatggaggactatacct

SEQ ID NO: 69723 - DNA, 25 bp, Mus musculus
ttccctcagggtgttcgtgaatgcc

SEQ ID NO: 69724 - DNA, 25 bp, Mus musculus
ttccctcatgcaggcacttggctag

SEQ ID NO: 69725 - DNA, 25 bp, Mus musculus
ttccctccaggctttcagctgtcga

SEQ ID NO: 69726 - DNA, 25 bp, Mus musculus
ttccctccatggagactgcgtggcc

SEQ ID NO: 69727 - DNA, 25 bp, Mus musculus
ttccctctactctgcctggcgagga

SEQ ID NO: 69728 - DNA, 25 bp, Mus musculus
ttccctctggccagatgcggcagct

SEQ ID NO: 69729 - DNA, 25 bp, Mus musculus
ttccctcttcttagagcctgtgctg

SEQ ID NO: 69730 - DNA, 25 bp, Mus musculus
ttccctgagtctatatctgaagagc

SEQ ID NO: 69731 - DNA, 25 bp, Mus musculus
ttccctgatttgtctccagggtacc

SEQ ID NO: 69732 - DNA, 25 bp, Mus musculus
ttccctgggagttacagcagcccag

SEQ ID NO: 69733 - DNA, 25 bp, Mus musculus
ttccctggtttgtggtggagcagat

SEQ ID NO: 69734 - DNA, 25 bp, Mus musculus
ttccctgtctttcactcttctggca

SEQ ID NO: 69735 - DNA, 25 bp, Mus musculus
ttcccttatatgacgcacccttcag

SEQ ID NO: 69736 - DNA, 25 bp, Mus musculus
ttcccttattgacagaaccatcaag

SEQ ID NO: 69737 - DNA, 25 bp, Mus musculus
ttcccttctctaggcacttcggagg

SEQ ID NO: 69738 - DNA, 25 bp, Mus musculus
ttcccttggaagcaactggcatacc

SEQ ID NO: 69739 - DNA, 25 bp, Mus musculus
ttcccttgtcgagaaaatatcaagc

SEQ ID NO: 69740 - DNA, 25 bp, Mus musculus
ttccgaagcggagtctttgttccct

SEQ ID NO: 69741 - DNA, 25 bp, Mus musculus
ttccgagtccgaggggtcgctgact

SEQ ID NO: 69742 - DNA, 25 bp, Mus musculus
ttccgagtcttccactgcacacagt

SEQ ID NO: 69743 - DNA, 25 bp, Mus musculus
ttccgatcacattcctgaccattgg

SEQ ID NO: 69744 - DNA, 25 bp, Mus musculus
ttccgatgaagaggtgtacacagct

SEQ ID NO: 69745 - DNA, 25 bp, Mus musculus
ttccgcaatagacctgttcccgtct

SEQ ID NO: 69746 - DNA, 25 bp, Mus musculus
ttccgcaggattgcgaagttctctg

SEQ ID NO: 69747 - DNA, 25 bp, Mus musculus
ttccggaagcaaaaggacattgaca

SEQ ID NO: 69748 - DNA, 25 bp, Mus musculus
ttccggaagtgcatcgggaagcccg

SEQ ID NO: 69749 - DNA, 25 bp, Mus musculus
ttccggatctgggacgtggccgact

SEQ ID NO: 69750 - DNA, 25 bp, Mus musculus
ttccggcatcggcttctctgttggc

SEQ ID NO: 69751 - DNA, 25 bp, Mus musculus
ttccggccagactatgacttcagca

SEQ ID NO: 69752 - DNA, 25 bp, Mus musculus
ttccgggaccatgctgagcagcagc

SEQ ID NO: 69753 - DNA, 25 bp, Mus musculus
ttccgggagctgctgagcaaccaga

SEQ ID NO: 69754 - DNA, 25 bp, Mus musculus
ttccggtgaagaatgaatacccctc

SEQ ID NO: 69755 - DNA, 25 bp, Mus musculus
ttccgtaaggaggaagaccaggtcg

SEQ ID NO: 69756 - DNA, 25 bp, Mus musculus
ttccgtagatttccagtggccccat

SEQ ID NO: 69757 - DNA, 25 bp, Mus musculus
ttccgtcggaacagtccaagctcct

SEQ ID NO: 69758 - DNA, 25 bp, Mus musculus
ttccgtcttccctgctcaagaagtg

SEQ ID NO: 69759 - DNA, 25 bp, Mus musculus
ttccgtggaacacgcgtccgtgttg

SEQ ID NO: 69760 - DNA, 25 bp, Mus musculus
ttccgtggaacaggcgtccgtgttg

SEQ ID NO: 69761 - DNA, 25 bp, Mus musculus
ttccgtggccgcaaggctgacttcg

SEQ ID NO: 69762 - DNA, 25 bp, Mus musculus
ttccgttccaacaagcaataccgca

SEQ ID NO: 69763 - DNA, 25 bp, Mus musculus
ttccgttccaactagcaataccgca

SEQ ID NO: 69764 - DNA, 25 bp, Mus musculus
ttcctaaacctgctgcctgtagaag

SEQ ID NO: 69765 - DNA, 25 bp, Mus musculus
ttcctaagctcacaatttggcttca

SEQ ID NO: 69766 - DNA, 25 bp, Mus musculus
ttcctaaggctcttcaatacagtag

SEQ ID NO: 69767 - DNA, 25 bp, Mus musculus
ttcctaatggacaaaccatgcccgt

SEQ ID NO: 69768 - DNA, 25 bp, Mus musculus
ttcctacctcaagacaaagggctac

SEQ ID NO: 69769 - DNA, 25 bp, Mus musculus
ttcctagacactgccctgtgctggt

SEQ ID NO: 69770 - DNA, 25 bp, Mus musculus
ttcctagagaaggaggcggccatcg

SEQ ID NO: 69771 - DNA, 25 bp, Mus musculus
ttcctagcgttctgcatcatgctca

SEQ ID NO: 69772 - DNA, 25 bp, Mus musculus
ttcctaggcctaggcacggtcactg

SEQ ID NO: 69773 - DNA, 25 bp, Mus musculus
ttcctaggcgcgcacactgcagggc

SEQ ID NO: 69774 - DNA, 25 bp, Mus musculus
ttcctaggcgcggacactgcagggc

SEQ ID NO: 69775 - DNA, 25 bp, Mus musculus
ttcctagtatctattacggagagat

SEQ ID NO: 69776 - DNA, 25 bp, Mus musculus
ttcctatcgaaaaccgggatgtact

SEQ ID NO: 69777 - DNA, 25 bp, Mus musculus
ttcctatgcctgattccaaaaccac

SEQ ID NO: 69778 - DNA, 25 bp, Mus musculus
ttcctatttccccaagaggtcttgg

SEQ ID NO: 69779 - DNA, 25 bp, Mus musculus
ttcctcaaccaacggttccagaagg

SEQ ID NO: 69780 - DNA, 25 bp, Mus musculus
ttcctcaacgtgaatgacctagctg

SEQ ID NO: 69781 - DNA, 25 bp, Mus musculus
ttcctcaccgcaggagtgatcacag

SEQ ID NO: 69782 - DNA, 25 bp, Mus musculus
ttcctcagggcccagtgagtacatg

SEQ ID NO: 69783 - DNA, 25 bp, Mus musculus
ttcctccctacgtcctgtggacatg

SEQ ID NO: 69784 - DNA, 25 bp, Mus musculus
ttcctccgagagtatgtgctctttc

SEQ ID NO: 69785 - DNA, 25 bp, Mus musculus
ttcctcctagattttccactcacga

SEQ ID NO: 69786 - DNA, 25 bp, Mus musculus
ttcctcctgccatcaaagtgctaag

SEQ ID NO: 69787 - DNA, 25 bp, Mus musculus
ttcctcgtgggaagtgcagctcaga

SEQ ID NO: 69788 - DNA, 25 bp, Mus musculus
ttcctctagatgaagacacctagca

SEQ ID NO: 69789 - DNA, 25 bp, Mus musculus
ttcctctcaggccaggatcctggga

SEQ ID NO: 69790 - DNA, 25 bp, Mus musculus
ttcctctcggagtgcctcacatcaa

SEQ ID NO: 69791 - DNA, 25 bp, Mus musculus
ttcctctcgtggctgaagtttatgg

SEQ ID NO: 69792 - DNA, 25 bp, Mus musculus
ttcctctctgagagcaactcgacac

SEQ ID NO: 69793 - DNA, 25 bp, Mus musculus
ttcctctgggactataacctttctg

SEQ ID NO: 69794 - DNA, 25 bp, Mus musculus
ttcctctgggtgtgatatcaagaat

SEQ ID NO: 69795 - DNA, 25 bp, Mus musculus
ttcctcttcagctaaacctcctaag

SEQ ID NO: 69796 - DNA, 25 bp, Mus musculus
ttcctgaaattcgtgcggcagattg

SEQ ID NO: 69797 - DNA, 25 bp, Mus musculus
ttcctgaactgcttcgtggaggagc

SEQ ID NO: 69798 - DNA, 25 bp, Mus musculus
ttcctgaactttaagaggctacagt

SEQ ID NO: 69799 - DNA, 25 bp, Mus musculus
ttcctgaagacatctggccccactt

SEQ ID NO: 69800 - DNA, 25 bp, Mus musculus
ttcctgaagctaggtcgcgaccacg

SEQ ID NO: 69801 - DNA, 25 bp, Mus musculus
ttcctgaatcagtctctcaaacagc

SEQ ID NO: 69802 - DNA, 25 bp, Mus musculus
ttcctgaatgtgttcccgatgctcc

SEQ ID NO: 69803 - DNA, 25 bp, Mus musculus
ttcctgacaggagagagctatgctg

SEQ ID NO: 69804 - DNA, 25 bp, Mus musculus
ttcctgagaaaacgcggccacccag

SEQ ID NO: 69805 - DNA, 25 bp, Mus musculus
ttcctgaggacgtcagagaaaaacg

SEQ ID NO: 69806 - DNA, 25 bp, Mus musculus
ttcctgatccgagagagcgagagcg

SEQ ID NO: 69807 - DNA, 25 bp, Mus musculus
ttcctgcaatacagtggatacagtt

SEQ ID NO: 69808 - DNA, 25 bp, Mus musculus
ttcctgcagagataagagaccttgt

SEQ ID NO: 69809 - DNA, 25 bp, Mus musculus
ttcctgcaggcagtgcgcaagatcc

SEQ ID NO: 69810 - DNA, 25 bp, Mus musculus
ttcctgccagctgcaactcggtggg

SEQ ID NO: 69811 - DNA, 25 bp, Mus musculus
ttcctgcccagcagttacctgccgc

SEQ ID NO: 69812 - DNA, 25 bp, Mus musculus
ttcctgcctgagctgggcaagcccg

SEQ ID NO: 69813 - DNA, 25 bp, Mus musculus
ttcctgcggctgtgtgttctcaaag

SEQ ID NO: 69814 - DNA, 25 bp, Mus musculus
ttcctgctcttttgcagtgcctacc

SEQ ID NO: 69815 - DNA, 25 bp, Mus musculus
ttcctgctgagctctcgtctcttca

SEQ ID NO: 69816 - DNA, 25 bp, Mus musculus
ttcctgctgcagctcagagagccga

SEQ ID NO: 69817 - DNA, 25 bp, Mus musculus
ttcctgctgcatctgagcctgtgat

SEQ ID NO: 69818 - DNA, 25 bp, Mus musculus
ttcctgctgcctttcagtaaaccgg

SEQ ID NO: 69819 - DNA, 25 bp, Mus musculus
ttcctggaagatcttaggcatgcac

SEQ ID NO: 69820 - DNA, 25 bp, Mus musculus
ttcctggaagatgttaggcatgcac

SEQ ID NO: 69821 - DNA, 25 bp, Mus musculus
ttcctggacgccattcccacaagtg

SEQ ID NO: 69822 - DNA, 25 bp, Mus musculus
ttcctggactctaccttggaaactt

SEQ ID NO: 69823 - DNA, 25 bp, Mus musculus
ttcctggagaagctgcctcttacct

SEQ ID NO: 69824 - DNA, 25 bp, Mus musculus
ttcctggatgtaagcacaggattga

SEQ ID NO: 69825 - DNA, 25 bp, Mus musculus
ttcctggatgtcacgagtatccgag

SEQ ID NO: 69826 - DNA, 25 bp, Mus musculus
ttcctggcaggatacagaaccctct

SEQ ID NO: 69827 - DNA, 25 bp, Mus musculus
ttcctgggaaagtcaagaaatcagt

SEQ ID NO: 69828 - DNA, 25 bp, Mus musculus
ttcctgggcacctcccgggatgtga

SEQ ID NO: 69829 - DNA, 25 bp, Mus musculus
ttcctgggcgcagttccaccgggat

SEQ ID NO: 69830 - DNA, 25 bp, Mus musculus
ttcctggtcaggaagccgtccgacc

SEQ ID NO: 69831 - DNA, 25 bp, Mus musculus
ttcctggtcaggtagccgtccgacc

SEQ ID NO: 69832 - DNA, 25 bp, Mus musculus
ttcctggtgcggcagagtgagtccc

SEQ ID NO: 69833 - DNA, 25 bp, Mus musculus
ttcctggtgtgattcgcagaagtag

SEQ ID NO: 69834 - DNA, 25 bp, Mus musculus
ttcctggttagaagaccaagagatg

SEQ ID NO: 69835 - DNA, 25 bp, Mus musculus
ttcctgtaaccccagggcagccatg

SEQ ID NO: 69836 - DNA, 25 bp, Mus musculus
ttcctgtatgtaggcggtaccctgc

SEQ ID NO: 69837 - DNA, 25 bp, Mus musculus
ttcctgtccggaaccttcatagcca

SEQ ID NO: 69838 - DNA, 25 bp, Mus musculus
ttcctgtccggtgagcgtcgaacga

SEQ ID NO: 69839 - DNA, 25 bp, Mus musculus
ttcctgtgattatgagggtggctcc

SEQ ID NO: 69840 - DNA, 25 bp, Mus musculus
ttcctgtgccttctgacctagtgac

SEQ ID NO: 69841 - DNA, 25 bp, Mus musculus
ttcctgtggcgcctcctggcgttag

SEQ ID NO: 69842 - DNA, 25 bp, Mus musculus
ttcctgttccctggagcttcattct

SEQ ID NO: 69843 - DNA, 25 bp, Mus musculus
ttcctgtttattacccacaggtggg

SEQ ID NO: 69844 - DNA, 25 bp, Mus musculus
ttccttactgaatatagaagtcact

SEQ ID NO: 69845 - DNA, 25 bp, Mus musculus
ttccttagcggcaggagaagccggt

SEQ ID NO: 69846 - DNA, 25 bp, Mus musculus
ttccttcacggattgggagatacag

SEQ ID NO: 69847 - DNA, 25 bp, Mus musculus
ttccttccaagggttagctgagttg

SEQ ID NO: 69848 - DNA, 25 bp, Mus musculus
ttccttgagcaagttccagttaaaa

SEQ ID NO: 69849 - DNA, 25 bp, Mus musculus
ttccttgctcaaggcctacctgtga

SEQ ID NO: 69850 - DNA, 25 bp, Mus musculus
ttccttggtcctcgagctgctgggc

SEQ ID NO: 69851 - DNA, 25 bp, Mus musculus
ttccttgttccgacttcccaaacag

SEQ ID NO: 69852 - DNA, 25 bp, Mus musculus
ttcctttataggatggagtgtggtg

SEQ ID NO: 69853 - DNA, 25 bp, Mus musculus
ttcctttccagagtgtgtttgaagt

SEQ ID NO: 69854 - DNA, 25 bp, Mus musculus
ttcctttcgaatcctgcgggtgcag

SEQ ID NO: 69855 - DNA, 25 bp, Mus musculus
ttcctttctctgttactcactccag

SEQ ID NO: 69856 - DNA, 25 bp, Mus musculus
ttcctttgattggtgcgctacagta

SEQ ID NO: 69857 - DNA, 25 bp, Mus musculus
ttcctttgctgtacctggagtttgc

SEQ ID NO: 69858 - DNA, 25 bp, Mus musculus
ttcgaaaatagtgcggatgcggaca

SEQ ID NO: 69859 - DNA, 25 bp, Mus musculus
ttcgaaaccaccttgttcataaact

SEQ ID NO: 69860 - DNA, 25 bp, Mus musculus
ttcgaaatatgcagaacgcagaaat

SEQ ID NO: 69861 - DNA, 25 bp, Mus musculus
ttcgaaccatggaccaagccctcaa

SEQ ID NO: 69862 - DNA, 25 bp, Mus musculus
ttcgaagaggattaagaaggaccag

SEQ ID NO: 69863 - DNA, 25 bp, Mus musculus
ttcgacaagacggtgattgaggagc

SEQ ID NO: 69864 - DNA, 25 bp, Mus musculus
ttcgaccagtacttccggctgacgg

SEQ ID NO: 69865 - DNA, 25 bp, Mus musculus
ttcgactaccacaagaagaagggct

SEQ ID NO: 69866 - DNA, 25 bp, Mus musculus
ttcgactccagtgacatgaccatca

SEQ ID NO: 69867 - DNA, 25 bp, Mus musculus
ttcgactctcagaaggccaagggca

SEQ ID NO: 69868 - DNA, 25 bp, Mus musculus
ttcgactgcgaggaccgctcggatg

SEQ ID NO: 69869 - DNA, 25 bp, Mus musculus
ttcgagaaccgaatgcacaagtgtc

SEQ ID NO: 69870 - DNA, 25 bp, Mus musculus
ttcgagaagagctggccaaagtgaa

SEQ ID NO: 69871 - DNA, 25 bp, Mus musculus
ttcgagaagggggagccaagtcact

SEQ ID NO: 69872 - DNA, 25 bp, Mus musculus
ttcgagacatttatggaggagacta

SEQ ID NO: 69873 - DNA, 25 bp, Mus musculus
ttcgagacccatttagaattacggc

SEQ ID NO: 69874 - DNA, 25 bp, Mus musculus
ttcgagacctcaccatcaggctggg

SEQ ID NO: 69875 - DNA, 25 bp, Mus musculus
ttcgagacctcagcatcaggctggg

SEQ ID NO: 69876 - DNA, 25 bp, Mus musculus
ttcgagactttgttaggagccacct

SEQ ID NO: 69877 - DNA, 25 bp, Mus musculus
ttcgagagcaaaaccgacaagacat

SEQ ID NO: 69878 - DNA, 25 bp, Mus musculus
ttcgagcatcagacaaacggatagc

SEQ ID NO: 69879 - DNA, 25 bp, Mus musculus
ttcgagcctctgcagctctagaaaa

SEQ ID NO: 69880 - DNA, 25 bp, Mus musculus
ttcgagcgctctgcaggcctgcaaa

SEQ ID NO: 69881 - DNA, 25 bp, Mus musculus
ttcgagctgattaaccatgatgtgg

SEQ ID NO: 69882 - DNA, 25 bp, Mus musculus
ttcgagctgcagctcagagcccaac

SEQ ID NO: 69883 - DNA, 25 bp, Mus musculus
ttcgaggccggcaggtgggtgtgaa

SEQ ID NO: 69884 - DNA, 25 bp, Mus musculus
ttcgagggctacatcgaggcgctga

SEQ ID NO: 69885 - DNA, 25 bp, Mus musculus
ttcgaggtgacaggatcccatccct

SEQ ID NO: 69886 - DNA, 25 bp, Mus musculus
ttcgagtgagccaagacgggcagtt

SEQ ID NO: 69887 - DNA, 25 bp, Mus musculus
ttcgagtgggcacccgtaagagcca

SEQ ID NO: 69888 - DNA, 25 bp, Mus musculus
ttcgagttaatccaagagtgagcaa

SEQ ID NO: 69889 - DNA, 25 bp, Mus musculus
ttcgatgtggagacgcaccctgaag

SEQ ID NO: 69890 - DNA, 25 bp, Mus musculus
ttcgcacaataaaagcagccttggt

SEQ ID NO: 69891 - DNA, 25 bp, Mus musculus
ttcgcaccagcaaacataggctatg

SEQ ID NO: 69892 - DNA, 25 bp, Mus musculus
ttcgcagacccagcaagcagtgaga

SEQ ID NO: 69893 - DNA, 25 bp, Mus musculus
ttcgcatttccagcgtcccatgaga

SEQ ID NO: 69894 - DNA, 25 bp, Mus musculus
ttcgccacaggagaatgtcgtgttc

SEQ ID NO: 69895 - DNA, 25 bp, Mus musculus
ttcgccagccaagccaatatggtgg

SEQ ID NO: 69896 - DNA, 25 bp, Mus musculus
ttcgccatgttatcagccagacagg

SEQ ID NO: 69897 - DNA, 25 bp, Mus musculus
ttcgccattatctggcagaggttca

SEQ ID NO: 69898 - DNA, 25 bp, Mus musculus
ttcgccattggtatcacattgagac

SEQ ID NO: 69899 - DNA, 25 bp, Mus musculus
ttcgcccaggagagcgcctcatcgg

SEQ ID NO: 69900 - DNA, 25 bp, Mus musculus
ttcgcccaggagtgcgcctcatcgg

SEQ ID NO: 69901 - DNA, 25 bp, Mus musculus
ttcgcccctgtggaggatccctggg

SEQ ID NO: 69902 - DNA, 25 bp, Mus musculus
ttcgcccttttcacactcgcctgag

SEQ ID NO: 69903 - DNA, 25 bp, Mus musculus
ttcgccgcttaccttttgaccactg

SEQ ID NO: 69904 - DNA, 25 bp, Mus musculus
ttcgccggactgatgtacctgtttg

SEQ ID NO: 69905 - DNA, 25 bp, Mus musculus
ttcgccggtacaaggccaacaagga

SEQ ID NO: 69906 - DNA, 25 bp, Mus musculus
ttcgcctgaagctgcccgctgtggt

SEQ ID NO: 69907 - DNA, 25 bp, Mus musculus
ttcgcctgcagctggacacttgcca

SEQ ID NO: 69908 - DNA, 25 bp, Mus musculus
ttcgcctgctctgggaaaatggcaa

SEQ ID NO: 69909 - DNA, 25 bp, Mus musculus
ttcgctgctcttcccggagagtgaa

SEQ ID NO: 69910 - DNA, 25 bp, Mus musculus
ttcgctgtagggaggagaaatgtca

SEQ ID NO: 69911 - DNA, 25 bp, Mus musculus
ttcgcttccacattctgagccagtc

SEQ ID NO: 69912 - DNA, 25 bp, Mus musculus
ttcgcttgagctcccctgagagtct

SEQ ID NO: 69913 - DNA, 25 bp, Mus musculus
ttcgcttgcgcacagaggaatagac

SEQ ID NO: 69914 - DNA, 25 bp, Mus musculus
ttcggaagatgaaatgggagcagat

SEQ ID NO: 69915 - DNA, 25 bp, Mus musculus
ttcggaagatgatatgggagcagat

SEQ ID NO: 69916 - DNA, 25 bp, Mus musculus
ttcggaagatggaaaagaactgtcg

SEQ ID NO: 69917 - DNA, 25 bp, Mus musculus
ttcggaagcttcttatatgaaccaa

SEQ ID NO: 69918 - DNA, 25 bp, Mus musculus
ttcggagcattgtggagcacgttgc

SEQ ID NO: 69919 - DNA, 25 bp, Mus musculus
ttcggattccatcagcatcacttcc

SEQ ID NO: 69920 - DNA, 25 bp, Mus musculus
ttcggcaccaacgtgatggtgacag

SEQ ID NO: 69921 - DNA, 25 bp, Mus musculus
ttcggcagccaagcttgcacatgag

SEQ ID NO: 69922 - DNA, 25 bp, Mus musculus
ttcggccaggtgacatagttttggc

SEQ ID NO: 69923 - DNA, 25 bp, Mus musculus
ttcggcctgcgagagttgtgtcttc

SEQ ID NO: 69924 - DNA, 25 bp, Mus musculus
ttcggcttcgcgctcggctacagct

SEQ ID NO: 69925 - DNA, 25 bp, Mus musculus
ttcgggaaaaacagcagattacgcc

SEQ ID NO: 69926 - DNA, 25 bp, Mus musculus
ttcgggaagaccagcaagtccgggt

SEQ ID NO: 69927 - DNA, 25 bp, Mus musculus
ttcgggaattaatagctcggatgcg

SEQ ID NO: 69928 - DNA, 25 bp, Mus musculus
ttcgggagattgtgcacaagccagg

SEQ ID NO: 69929 - DNA, 25 bp, Mus musculus
ttcgggagtcgcagctgttggactt

SEQ ID NO: 69930 - DNA, 25 bp, Mus musculus
ttcgggcccctcaccaggaattact

SEQ ID NO: 69931 - DNA, 25 bp, Mus musculus
ttcgggccctccagcaaacatggca

SEQ ID NO: 69932 - DNA, 25 bp, Mus musculus
ttcgggtcctttcaggacaccttat

SEQ ID NO: 69933 - DNA, 25 bp, Mus musculus
ttcgggttgcatagtgtttccaggg

SEQ ID NO: 69934 - DNA, 25 bp, Mus musculus
ttcgggtttactctgcctcccagtg

SEQ ID NO: 69935 - DNA, 25 bp, Mus musculus
ttcggtaactctgctggaggcatta

SEQ ID NO: 69936 - DNA, 25 bp, Mus musculus
ttcggtatcgcccaagcttcgtgtc

SEQ ID NO: 69937 - DNA, 25 bp, Mus musculus
ttcggtcatcgctctcttgggcatc

SEQ ID NO: 69938 - DNA, 25 bp, Mus musculus
ttcggtgtcgtaggcatccccgtga

SEQ ID NO: 69939 - DNA, 25 bp, Mus musculus
ttcgtaagcaaggagatgttcgtgc

SEQ ID NO: 69940 - DNA, 25 bp, Mus musculus
ttcgtagcagcagcaaacattgatg

SEQ ID NO: 69941 - DNA, 25 bp, Mus musculus
ttcgtccccacggagagctacggaa

SEQ ID NO: 69942 - DNA, 25 bp, Mus musculus
ttcgtcgaaaggtccagtcaatggg

SEQ ID NO: 69943 - DNA, 25 bp, Mus musculus
ttcgtcggccagtcacccctggtgg

SEQ ID NO: 69944 - DNA, 25 bp, Mus musculus
ttcgtgaagacttcaaggccctgaa

SEQ ID NO: 69945 - DNA, 25 bp, Mus musculus
ttcgtgaaggcttccgctgtcgagt

SEQ ID NO: 69946 - DNA, 25 bp, Mus musculus
ttcgtgacgactgagtttgagcctt

SEQ ID NO: 69947 - DNA, 25 bp, Mus musculus
ttcgtgactgcatgtacggcatggg

SEQ ID NO: 69948 - DNA, 25 bp, Mus musculus
ttcgtgcagtatgcctgctttgggc

SEQ ID NO: 69949 - DNA, 25 bp, Mus musculus
ttcgtggagatctgcaaacgggaag

SEQ ID NO: 69950 - DNA, 25 bp, Mus musculus
ttcgtgggacaatgccaccagccgc

SEQ ID NO: 69951 - DNA, 25 bp, Mus musculus
ttcgtggtgatcagccttcctggga

SEQ ID NO: 69952 - DNA, 25 bp, Mus musculus
ttcgtgtctgacaagagaccccaga

SEQ ID NO: 69953 - DNA, 25 bp, Mus musculus
ttcgtgtgcgatggtgacgatgact

SEQ ID NO: 69954 - DNA, 25 bp, Mus musculus
ttcgttgacatggtagagacttacc

SEQ ID NO: 69955 - DNA, 25 bp, Mus musculus
ttcgtttctgacagagcaaacagca

SEQ ID NO: 69956 - DNA, 25 bp, Mus musculus
ttctaaaaaccaagccgtcgcacag

SEQ ID NO: 69957 - DNA, 25 bp, Mus musculus
ttctaaacctactggtcccagagaa

SEQ ID NO: 69958 - DNA, 25 bp, Mus musculus
ttctaaatggttacagcacaaataa

SEQ ID NO: 69959 - DNA, 25 bp, Mus musculus
ttctaacaaaaggaggacattccag

SEQ ID NO: 69960 - DNA, 25 bp, Mus musculus
ttctaacattgcaccagctgatcct

SEQ ID NO: 69961 - DNA, 25 bp, Mus musculus
ttctaacctgcaagagagactgccc

SEQ ID NO: 69962 - DNA, 25 bp, Mus musculus
ttctaagagtcccaacttgtccaaa

SEQ ID NO: 69963 - DNA, 25 bp, Mus musculus
ttctaagctgcttgcttattactgc

SEQ ID NO: 69964 - DNA, 25 bp, Mus musculus
ttctaaggactacaacagtctcaaa

SEQ ID NO: 69965 - DNA, 25 bp, Mus musculus
ttctaaggtgattctggccatccgg

SEQ ID NO: 69966 - DNA, 25 bp, Mus musculus
ttctaatcctcatcatgacaacgtc

SEQ ID NO: 69967 - DNA, 25 bp, Mus musculus
ttctacaggtcaaggaaaaaacact

SEQ ID NO: 69968 - DNA, 25 bp, Mus musculus
ttctacattccaccgtgtggttaaa

SEQ ID NO: 69969 - DNA, 25 bp, Mus musculus
ttctaccaatacaacgacacagatg

SEQ ID NO: 69970 - DNA, 25 bp, Mus musculus
ttctaccacagacccgctatgtgga

SEQ ID NO: 69971 - DNA, 25 bp, Mus musculus
ttctacctctccatcaatgcaggga

SEQ ID NO: 69972 - DNA, 25 bp, Mus musculus
ttctacctctgaaagctctgcgctt

SEQ ID NO: 69973 - DNA, 25 bp, Mus musculus
ttctacggctgctactgtggctggg

SEQ ID NO: 69974 - DNA, 25 bp, Mus musculus
ttctactcggatcctcatgaatcag

SEQ ID NO: 69975 - DNA, 25 bp, Mus musculus
ttctactcggatgctcatgaatcag

SEQ ID NO: 69976 - DNA, 25 bp, Mus musculus
ttctactcttctcggcagcatgcca

SEQ ID NO: 69977 - DNA, 25 bp, Mus musculus
ttctactgcagtggacactgatgag

SEQ ID NO: 69978 - DNA, 25 bp, Mus musculus
ttctagaagaagtgaattctgactc

SEQ ID NO: 69979 - DNA, 25 bp, Mus musculus
ttctagcacttaagccagtgcaagg

SEQ ID NO: 69980 - DNA, 25 bp, Mus musculus
ttctagccatctcccaagagacaga

SEQ ID NO: 69981 - DNA, 25 bp, Mus musculus
ttctaggcgcctgtgaacagccagc

SEQ ID NO: 69982 - DNA, 25 bp, Mus musculus
ttctagggccagctctgcaagggcc

SEQ ID NO: 69983 - DNA, 25 bp, Mus musculus
ttctagtacctgagaaaaggtgcag

SEQ ID NO: 69984 - DNA, 25 bp, Mus musculus
ttctagtcctggcagcatacgagcc

SEQ ID NO: 69985 - DNA, 25 bp, Mus musculus
ttctagtgttgccttggaccttgtg

SEQ ID NO: 69986 - DNA, 25 bp, Mus musculus
ttctatcagcggctggtggagttca

SEQ ID NO: 69987 - DNA, 25 bp, Mus musculus
ttctatcgggcattgcgagacgtcc

SEQ ID NO: 69988 - DNA, 25 bp, Mus musculus
ttctatctcatttgctcgacaccca

SEQ ID NO: 69989 - DNA, 25 bp, Mus musculus
ttctatgaaaacagagactttaggc

SEQ ID NO: 69990 - DNA, 25 bp, Mus musculus
ttctatgaccctgaagctggctcgg

SEQ ID NO: 69991 - DNA, 25 bp, Mus musculus
ttctatgataccagcaaaagaaaag

SEQ ID NO: 69992 - DNA, 25 bp, Mus musculus
ttctatgattgtttcaggccaaatt

SEQ ID NO: 69993 - DNA, 25 bp, Mus musculus
ttctatgcagcccagtccagccagg

SEQ ID NO: 69994 - DNA, 25 bp, Mus musculus
ttctatgcctttggtagagtgttcc

SEQ ID NO: 69995 - DNA, 25 bp, Mus musculus
ttctatgcggattttggaccactca

SEQ ID NO: 69996 - DNA, 25 bp, Mus musculus
ttctatgctgggaacaggaaggagt

SEQ ID NO: 69997 - DNA, 25 bp, Mus musculus
ttctatggcctctactatggagttc

SEQ ID NO: 69998 - DNA, 25 bp, Mus musculus
ttctatgttcccacatcggtcagag

SEQ ID NO: 69999 - DNA, 25 bp, Mus musculus
ttctattcagaatgcaccaaaacct

SEQ ID NO: 70000 - DNA, 25 bp, Mus musculus
ttctcaaagggcagaaatgcctgca

SEQ ID NO: 70001 - DNA, 25 bp, Mus musculus
ttctcaagaaccctgataccgtcct

SEQ ID NO: 70002 - DNA, 25 bp, Mus musculus
ttctcaccaaataacactgtcctgg

SEQ ID NO: 70003 - DNA, 25 bp, Mus musculus
ttctcaccatgttccctgggaacaa

SEQ ID NO: 70004 - DNA, 25 bp, Mus musculus
ttctcacgtcctcagattgccagcg

SEQ ID NO: 70005 - DNA, 25 bp, Mus musculus
ttctcactgggcttgggttttggca

SEQ ID NO: 70006 - DNA, 25 bp, Mus musculus
ttctcactgtggatgggaggctctg

SEQ ID NO: 70007 - DNA, 25 bp, Mus musculus
ttctcagactatgtgcagtgtgtcc

SEQ ID NO: 70008 - DNA, 25 bp, Mus musculus
ttctcagagggacaagtcattattc

SEQ ID NO: 70009 - DNA, 25 bp, Mus musculus
ttctcagagggagaagtcattattc

SEQ ID NO: 70010 - DNA, 25 bp, Mus musculus
ttctcagctcaaccactcagggagg

SEQ ID NO: 70011 - DNA, 25 bp, Mus musculus
ttctcagctctcttgatcatcccag

SEQ ID NO: 70012 - DNA, 25 bp, Mus musculus
ttctcaggaggcacctctttgtggc

SEQ ID NO: 70013 - DNA, 25 bp, Mus musculus
ttctcaggattcagaccaaagaagc

SEQ ID NO: 70014 - DNA, 25 bp, Mus musculus
ttctcatcagttaagtacaagagcg

SEQ ID NO: 70015 - DNA, 25 bp, Mus musculus
ttctcatgccagaacaccaagggct

SEQ ID NO: 70016 - DNA, 25 bp, Mus musculus
ttctccaacaagattgccaagctca

SEQ ID NO: 70017 - DNA, 25 bp, Mus musculus
ttctccaagggcagttgactacgtg

SEQ ID NO: 70018 - DNA, 25 bp, Mus musculus
ttctccagcatgtgaaagggtcacg

SEQ ID NO: 70019 - DNA, 25 bp, Mus musculus
ttctccataattaggacagagatcg

SEQ ID NO: 70020 - DNA, 25 bp, Mus musculus
ttctccatctatggcttcaaggcca

SEQ ID NO: 70021 - DNA, 25 bp, Mus musculus
ttctccatctcctgaaggacacagg

SEQ ID NO: 70022 - DNA, 25 bp, Mus musculus
ttctccccagggaggaagcacaagg

SEQ ID NO: 70023 - DNA, 25 bp, Mus musculus
ttctccccttgaatggcgtgcctct

SEQ ID NO: 70024 - DNA, 25 bp, Mus musculus
ttctcccgactcagcctacataatg

SEQ ID NO: 70025 - DNA, 25 bp, Mus musculus
ttctccgagttgtatcagcgctatc

SEQ ID NO: 70026 - DNA, 25 bp, Mus musculus
ttctccgcccgagaacggctggaga

SEQ ID NO: 70027 - DNA, 25 bp, Mus musculus
ttctccggcgcctattaaatatctg

SEQ ID NO: 70028 - DNA, 25 bp, Mus musculus
ttctccgtgaaaatggttgaagaca

SEQ ID NO: 70029 - DNA, 25 bp, Mus musculus
ttctccgtggcgctggctgttctcc

SEQ ID NO: 70030 - DNA, 25 bp, Mus musculus
ttctcctccgagaagtcgtcctggc

SEQ ID NO: 70031 - DNA, 25 bp, Mus musculus
ttctcctctgacaaccggcagattg

SEQ ID NO: 70032 - DNA, 25 bp, Mus musculus
ttctcctgagagatctgctcatccg

SEQ ID NO: 70033 - DNA, 25 bp, Mus musculus
ttctcctgcaagcactgtgacaggg

SEQ ID NO: 70034 - DNA, 25 bp, Mus musculus
ttctcctgcaaggactgtgacaggg

SEQ ID NO: 70035 - DNA, 25 bp, Mus musculus
ttctcctgctgtagccggctcagat

SEQ ID NO: 70036 - DNA, 25 bp, Mus musculus
ttctccttaggtgaggcatgcacca

SEQ ID NO: 70037 - DNA, 25 bp, Mus musculus
ttctccttatgtctggaggagactg

SEQ ID NO: 70038 - DNA, 25 bp, Mus musculus
ttctccttctggctctgggttggct

SEQ ID NO: 70039 - DNA, 25 bp, Mus musculus
ttctccttgcctgactgcttacagg

SEQ ID NO: 70040 - DNA, 25 bp, Mus musculus
ttctccttggtccactatgctggca

SEQ ID NO: 70041 - DNA, 25 bp, Mus musculus
ttctcgaagctgaggagaagcagag

SEQ ID NO: 70042 - DNA, 25 bp, Mus musculus
ttctcgaggagacctcaccacggag

SEQ ID NO: 70043 - DNA, 25 bp, Mus musculus
ttctcgctgcgctacgagcctggca

SEQ ID NO: 70044 - DNA, 25 bp, Mus musculus
ttctcgctgctgctgggcaactcgg

SEQ ID NO: 70045 - DNA, 25 bp, Mus musculus
ttctcggagtctggaatgctgagaa

SEQ ID NO: 70046 - DNA, 25 bp, Mus musculus
ttctcgtcactgagctctatcacga

SEQ ID NO: 70047 - DNA, 25 bp, Mus musculus
ttctctaaatgccatgtggtatgca

SEQ ID NO: 70048 - DNA, 25 bp, Mus musculus
ttctctagaccatgctagcgtcaga

SEQ ID NO: 70049 - DNA, 25 bp, Mus musculus
ttctctaggcacctgggacgtggca

SEQ ID NO: 70050 - DNA, 25 bp, Mus musculus
ttctctatatggtatgccaaacagc

SEQ ID NO: 70051 - DNA, 25 bp, Mus musculus
ttctctctaacagccaaaggaaaag

SEQ ID NO: 70052 - DNA, 25 bp, Mus musculus
ttctctctacgaactcgctctgaca

SEQ ID NO: 70053 - DNA, 25 bp, Mus musculus
ttctctctaggtgaagccgagcttg

SEQ ID NO: 70054 - DNA, 25 bp, Mus musculus
ttctctctttagctgtgagcaagga

SEQ ID NO: 70055 - DNA, 25 bp, Mus musculus
ttctctgaagaggaatggcggctcc

SEQ ID NO: 70056 - DNA, 25 bp, Mus musculus
ttctctgacatccttgttgtacccc

SEQ ID NO: 70057 - DNA, 25 bp, Mus musculus
ttctctgagagccacggccgagaat

SEQ ID NO: 70058 - DNA, 25 bp, Mus musculus
ttctctgatcatgggcccgtgtgct

SEQ ID NO: 70059 - DNA, 25 bp, Mus musculus
ttctctgcagagacacctgttaatc

SEQ ID NO: 70060 - DNA, 25 bp, Mus musculus
ttctctgccgcattaacttcagtct

SEQ ID NO: 70061 - DNA, 25 bp, Mus musculus
ttctctggcggctgaccaagaagca

SEQ ID NO: 70062 - DNA, 25 bp, Mus musculus
ttctctgggccagctatttccagaa

SEQ ID NO: 70063 - DNA, 25 bp, Mus musculus
ttctctgtctggtccatcattggcc

SEQ ID NO: 70064 - DNA, 25 bp, Mus musculus
ttctctgtgtatcccagctgcctag

SEQ ID NO: 70065 - DNA, 25 bp, Mus musculus
ttctcttctcccagtactggctctg

SEQ ID NO: 70066 - DNA, 25 bp, Mus musculus
ttctcttgaggaggttccactctga

SEQ ID NO: 70067 - DNA, 25 bp, Mus musculus
ttctcttgccacatcaggttcccag

SEQ ID NO: 70068 - DNA, 25 bp, Mus musculus
ttctcttgtcttcaaaactgaaaga

SEQ ID NO: 70069 - DNA, 25 bp, Mus musculus
ttctctttgggctcagcaaccagct

SEQ ID NO: 70070 - DNA, 25 bp, Mus musculus
ttctcttttcaagcagacattccaa

SEQ ID NO: 70071 - DNA, 25 bp, Mus musculus
ttctgaagaagacgaccctcaccct

SEQ ID NO: 70072 - DNA, 25 bp, Mus musculus
ttctgaagaagatgacggatttgtg

SEQ ID NO: 70073 - DNA, 25 bp, Mus musculus
ttctgaagaagggtttcactacctc

SEQ ID NO: 70074 - DNA, 25 bp, Mus musculus
ttctgaaggcttcagtaattactcc

SEQ ID NO: 70075 - DNA, 25 bp, Mus musculus
ttctgaaggcttgagtaattactcc

SEQ ID NO: 70076 - DNA, 25 bp, Mus musculus
ttctgaagggcatgctgcaggccga

SEQ ID NO: 70077 - DNA, 25 bp, Mus musculus
ttctgaaggtttggatacgagatgt

SEQ ID NO: 70078 - DNA, 25 bp, Mus musculus
ttctgaatgccaccttcttgaacca

SEQ ID NO: 70079 - DNA, 25 bp, Mus musculus
ttctgacactgagagctctatcatc

SEQ ID NO: 70080 - DNA, 25 bp, Mus musculus
ttctgaccaccacggtaacttctct

SEQ ID NO: 70081 - DNA, 25 bp, Mus musculus
ttctgaccatgaagaaagacgagct

SEQ ID NO: 70082 - DNA, 25 bp, Mus musculus
ttctgaccccatgccagtgttgtaa

SEQ ID NO: 70083 - DNA, 25 bp, Mus musculus
ttctgacctagtgacctcggctggg

SEQ ID NO: 70084 - DNA, 25 bp, Mus musculus
ttctgacgaagacgagcgcttgtcc

SEQ ID NO: 70085 - DNA, 25 bp, Mus musculus
ttctgacggacttccagaccctgga

SEQ ID NO: 70086 - DNA, 25 bp, Mus musculus
ttctgactaagaatgaatgttcacc

SEQ ID NO: 70087 - DNA, 25 bp, Mus musculus
ttctgactggaaagatcgccgaggg

SEQ ID NO: 70088 - DNA, 25 bp, Mus musculus
ttctgactgtcagtcttggctgcag

SEQ ID NO: 70089 - DNA, 25 bp, Mus musculus
ttctgacttacacatcttggacttc

SEQ ID NO: 70090 - DNA, 25 bp, Mus musculus
ttctgagacagtcattacatctgta

SEQ ID NO: 70091 - DNA, 25 bp, Mus musculus
ttctgagacggaagaagacaaggag

SEQ ID NO: 70092 - DNA, 25 bp, Mus musculus
ttctgagatagtagatgttggagac

SEQ ID NO: 70093 - DNA, 25 bp, Mus musculus
ttctgagctacacccggatcatcac

SEQ ID NO: 70094 - DNA, 25 bp, Mus musculus
ttctgaggactttatcacttgagcc

SEQ ID NO: 70095 - DNA, 25 bp, Mus musculus
ttctgaggcaggcacaccccaagga

SEQ ID NO: 70096 - DNA, 25 bp, Mus musculus
ttctgagtgccgataaaccagtgtg

SEQ ID NO: 70097 - DNA, 25 bp, Mus musculus
ttctgatccagacaccgcccagtta

SEQ ID NO: 70098 - DNA, 25 bp, Mus musculus
ttctgatcttcctacacaacctgtg

SEQ ID NO: 70099 - DNA, 25 bp, Mus musculus
ttctgatgacctggaattggttgca

SEQ ID NO: 70100 - DNA, 25 bp, Mus musculus
ttctgatggacaaataagcaccctg

SEQ ID NO: 70101 - DNA, 25 bp, Mus musculus
ttctgatgggaattctcaaagtagc

SEQ ID NO: 70102 - DNA, 25 bp, Mus musculus
ttctgattctcctcaaggcaagacc

SEQ ID NO: 70103 - DNA, 25 bp, Mus musculus
ttctgattggagagctggctccgga

SEQ ID NO: 70104 - DNA, 25 bp, Mus musculus
ttctgcaatgaagctactggagcgg

SEQ ID NO: 70105 - DNA, 25 bp, Mus musculus
ttctgcacacaagcatactgttgag

SEQ ID NO: 70106 - DNA, 25 bp, Mus musculus
ttctgcacagcagcggtttcttact

SEQ ID NO: 70107 - DNA, 25 bp, Mus musculus
ttctgcaggagtcagtggaacccca

SEQ ID NO: 70108 - DNA, 25 bp, Mus musculus
ttctgcagtacagccacatactgga

SEQ ID NO: 70109 - DNA, 25 bp, Mus musculus
ttctgcatatggtccaggagcccac

SEQ ID NO: 70110 - DNA, 25 bp, Mus musculus
ttctgcatcaaactcctggtaccct

SEQ ID NO: 70111 - DNA, 25 bp, Mus musculus
ttctgcatcgggtcgcagctgctga

SEQ ID NO: 70112 - DNA, 25 bp, Mus musculus
ttctgcattggcctgcactcggcac

SEQ ID NO: 70113 - DNA, 25 bp, Mus musculus
ttctgccaaagccagcaactctggg

SEQ ID NO: 70114 - DNA, 25 bp, Mus musculus
ttctgccaaatcctcgccttctaaa

SEQ ID NO: 70115 - DNA, 25 bp, Mus musculus
ttctgccaacatccctgagcactgg

SEQ ID NO: 70116 - DNA, 25 bp, Mus musculus
ttctgccagaccagagctatttgcc

SEQ ID NO: 70117 - DNA, 25 bp, Mus musculus
ttctgcccaatctcttcctgagaaa

SEQ ID NO: 70118 - DNA, 25 bp, Mus musculus
ttctgccctctgaacccaaagactg

SEQ ID NO: 70119 - DNA, 25 bp, Mus musculus
ttctgccctctgtacccaaagactg

SEQ ID NO: 70120 - DNA, 25 bp, Mus musculus
ttctgccgcaatccagacagcagta

SEQ ID NO: 70121 - DNA, 25 bp, Mus musculus
ttctgcctctgtcaagatcaaagtg

SEQ ID NO: 70122 - DNA, 25 bp, Mus musculus
ttctgccttagctacatggccctgc

SEQ ID NO: 70123 - DNA, 25 bp, Mus musculus
ttctgcctttggattccgaagaccc

SEQ ID NO: 70124 - DNA, 25 bp, Mus musculus
ttctgcgagatgtgctgtgactgtc

SEQ ID NO: 70125 - DNA, 25 bp, Mus musculus
ttctgcggtacctgcaccagcaatg

SEQ ID NO: 70126 - DNA, 25 bp, Mus musculus
ttctgctccaggaacaccggtctag

SEQ ID NO: 70127 - DNA, 25 bp, Mus musculus
ttctgctgctggtagggatttaaag

SEQ ID NO: 70128 - DNA, 25 bp, Mus musculus
ttctgcttaccctcgacagctagag

SEQ ID NO: 70129 - DNA, 25 bp, Mus musculus
ttctgcttctggtgtgttgaggtga

SEQ ID NO: 70130 - DNA, 25 bp, Mus musculus
ttctgctttgggaaaatagtaccac

SEQ ID NO: 70131 - DNA, 25 bp, Mus musculus
ttctggatagcaggttttgtgaaga

SEQ ID NO: 70132 - DNA, 25 bp, Mus musculus
ttctggatatgccacaaaaggatcc

SEQ ID NO: 70133 - DNA, 25 bp, Mus musculus
ttctggccagcaacttcatcagtcc

SEQ ID NO: 70134 - DNA, 25 bp, Mus musculus
ttctggccagccctacgtgagcaag

SEQ ID NO: 70135 - DNA, 25 bp, Mus musculus
ttctggcgtagagccctccgatgag

SEQ ID NO: 70136 - DNA, 25 bp, Mus musculus
ttctggcgtgcaggtgtacaagcac

SEQ ID NO: 70137 - DNA, 25 bp, Mus musculus
ttctggctcggcagctcagctggga

SEQ ID NO: 70138 - DNA, 25 bp, Mus musculus
ttctggctgggcaccaaggacccgt

SEQ ID NO: 70139 - DNA, 25 bp, Mus musculus
ttctggctttatgctgcttgtgttc

SEQ ID NO: 70140 - DNA, 25 bp, Mus musculus
ttctgggaccccattggacgttaca

SEQ ID NO: 70141 - DNA, 25 bp, Mus musculus
ttctgggattatggccgcatagccc

SEQ ID NO: 70142 - DNA, 25 bp, Mus musculus
ttctgggcacatgtctgtccgcagc

SEQ ID NO: 70143 - DNA, 25 bp, Mus musculus
ttctgggcaggcacagcagctcctg

SEQ ID NO: 70144 - DNA, 25 bp, Mus musculus
ttctgggtaaaggaagctcagagcc

SEQ ID NO: 70145 - DNA, 25 bp, Mus musculus
ttctgggtaaatctgctgttcctaa

SEQ ID NO: 70146 - DNA, 25 bp, Mus musculus
ttctgggtagccaagtacccaagag

SEQ ID NO: 70147 - DNA, 25 bp, Mus musculus
ttctgggtaggcagataattactcc

SEQ ID NO: 70148 - DNA, 25 bp, Mus musculus
ttctggtatctctccagttcttgaa

SEQ ID NO: 70149 - DNA, 25 bp, Mus musculus
ttctggtcactggatcctctggagc

SEQ ID NO: 70150 - DNA, 25 bp, Mus musculus
ttctggtgagcactggagccatcat

SEQ ID NO: 70151 - DNA, 25 bp, Mus musculus
ttctggtgtaaattgttagaacgct

SEQ ID NO: 70152 - DNA, 25 bp, Mus musculus
ttctggtgtccatgaggtgcctagg

SEQ ID NO: 70153 - DNA, 25 bp, Mus musculus
ttctggttgccagaccggcacggat

SEQ ID NO: 70154 - DNA, 25 bp, Mus musculus
ttctgtaagggagcgaccacccgaa

SEQ ID NO: 70155 - DNA, 25 bp, Mus musculus
ttctgtagcaggcttcactcggttc

SEQ ID NO: 70156 - DNA, 25 bp, Mus musculus
ttctgtccagagaagcagcgcagta

SEQ ID NO: 70157 - DNA, 25 bp, Mus musculus
ttctgtctcttatctcccatgtctg

SEQ ID NO: 70158 - DNA, 25 bp, Mus musculus
ttctgtctgaggtacacaaaggagg

SEQ ID NO: 70159 - DNA, 25 bp, Mus musculus
ttctgtgactccctacagccctgta

SEQ ID NO: 70160 - DNA, 25 bp, Mus musculus
ttctgtgaggtgtgcaagaaactgg

SEQ ID NO: 70161 - DNA, 25 bp, Mus musculus
ttctgtgcaggtgggtgcccagtca

SEQ ID NO: 70162 - DNA, 25 bp, Mus musculus
ttctgtgctggctatcctgagggtg

SEQ ID NO: 70163 - DNA, 25 bp, Mus musculus
ttctgtggacacactacagtattgc

SEQ ID NO: 70164 - DNA, 25 bp, Mus musculus
ttctgtggccgcttcctcagcatgg

SEQ ID NO: 70165 - DNA, 25 bp, Mus musculus
ttctgtggcctccagattgcgaccc

SEQ ID NO: 70166 - DNA, 25 bp, Mus musculus
ttctgtggctggatcgttctagggc

SEQ ID NO: 70167 - DNA, 25 bp, Mus musculus
ttctgtgtcttctgtagtattacca

SEQ ID NO: 70168 - DNA, 25 bp, Mus musculus
ttctgtgtgttcttctggatcccgt

SEQ ID NO: 70169 - DNA, 25 bp, Mus musculus
ttctgtgttacaggatggcagctcc

SEQ ID NO: 70170 - DNA, 25 bp, Mus musculus
ttctgtgttacagtgccctggttcc

SEQ ID NO: 70171 - DNA, 25 bp, Mus musculus
ttctgttccccaggctctgaaggac

SEQ ID NO: 70172 - DNA, 25 bp, Mus musculus
ttctgttctcctccgagaagtcgtc

SEQ ID NO: 70173 - DNA, 25 bp, Mus musculus
ttctgttctgatggcttctaactca

SEQ ID NO: 70174 - DNA, 25 bp, Mus musculus
ttctgttgatgccatttagagtgga

SEQ ID NO: 70175 - DNA, 25 bp, Mus musculus
ttctgttttgcacagccgtgttggg

SEQ ID NO: 70176 - DNA, 25 bp, Mus musculus
ttctgttttgcagagccgtgttggg

SEQ ID NO: 70177 - DNA, 25 bp, Mus musculus
ttctgttttggtccgtatcacatag

SEQ ID NO: 70178 - DNA, 25 bp, Mus musculus
ttcttaacccagctccaggagcttg

SEQ ID NO: 70179 - DNA, 25 bp, Mus musculus
ttcttacaagaactaaatagcgatg

SEQ ID NO: 70180 - DNA, 25 bp, Mus musculus
ttcttactgagataggagccattgg

SEQ ID NO: 70181 - DNA, 25 bp, Mus musculus
ttcttactgatggagcaggagctca

SEQ ID NO: 70182 - DNA, 25 bp, Mus musculus
ttcttaggcctgaagccacggccgg

SEQ ID NO: 70183 - DNA, 25 bp, Mus musculus
ttcttagttaacctggaccacgtgg

SEQ ID NO: 70184 - DNA, 25 bp, Mus musculus
ttcttatcatggaaggcaacaggtg

SEQ ID NO: 70185 - DNA, 25 bp, Mus musculus
ttcttcaaacttcaactcaggcgcc

SEQ ID NO: 70186 - DNA, 25 bp, Mus musculus
ttcttcaaccaccacatgttcgtgc

SEQ ID NO: 70187 - DNA, 25 bp, Mus musculus
ttcttcaccggcaggagagtggaag

SEQ ID NO: 70188 - DNA, 25 bp, Mus musculus
ttcttcagaaagttgccccctgtgg

SEQ ID NO: 70189 - DNA, 25 bp, Mus musculus
ttcttcagcagagtggactttgcca

SEQ ID NO: 70190 - DNA, 25 bp, Mus musculus
ttcttcagggctgcaatgggatgtt

SEQ ID NO: 70191 - DNA, 25 bp, Mus musculus
ttcttcagtccagtgaccagactgt

SEQ ID NO: 70192 - DNA, 25 bp, Mus musculus
ttcttcagtccagtgttcagagctg

SEQ ID NO: 70193 - DNA, 25 bp, Mus musculus
ttcttcatcttcctgctctggaagc

SEQ ID NO: 70194 - DNA, 25 bp, Mus musculus
ttcttcattctactctcctggctgc

SEQ ID NO: 70195 - DNA, 25 bp, Mus musculus
ttcttccgccagcaggatgggctgc

SEQ ID NO: 70196 - DNA, 25 bp, Mus musculus
ttcttccgtcggaacagtccaagct

SEQ ID NO: 70197 - DNA, 25 bp, Mus musculus
ttcttcctcggctgttctgcgcttg

SEQ ID NO: 70198 - DNA, 25 bp, Mus musculus
ttcttccttttttgtgaggcgaggt

SEQ ID NO: 70199 - DNA, 25 bp, Mus musculus
ttcttcgactcctacagcatcacgg

SEQ ID NO: 70200 - DNA, 25 bp, Mus musculus
ttcttcgagtttggctttgtgatcc

SEQ ID NO: 70201 - DNA, 25 bp, Mus musculus
ttcttcgggcccctgggattcggct

SEQ ID NO: 70202 - DNA, 25 bp, Mus musculus
ttcttcgtgatgagtgattacagag

SEQ ID NO: 70203 - DNA, 25 bp, Mus musculus
ttcttctcaggtctgccagctccat

SEQ ID NO: 70204 - DNA, 25 bp, Mus musculus
ttcttctctgggaaagccgaagact

SEQ ID NO: 70205 - DNA, 25 bp, Mus musculus
ttcttctggctaggatggagcatcc

SEQ ID NO: 70206 - DNA, 25 bp, Mus musculus
ttcttgaacatcatcccattgagaa

SEQ ID NO: 70207 - DNA, 25 bp, Mus musculus
ttcttgaccagcctccgtgtgttca

SEQ ID NO: 70208 - DNA, 25 bp, Mus musculus
ttcttgacccctgggtgttttgcat

SEQ ID NO: 70209 - DNA, 25 bp, Mus musculus
ttcttgcaaaaacctgattggcggc

SEQ ID NO: 70210 - DNA, 25 bp, Mus musculus
ttcttgcagatacagcgctaggaaa

SEQ ID NO: 70211 - DNA, 25 bp, Mus musculus
ttcttgccatggctgccgtaagaat

SEQ ID NO: 70212 - DNA, 25 bp, Mus musculus
ttcttgcccagcctagggctctgct

SEQ ID NO: 70213 - DNA, 25 bp, Mus musculus
ttcttgctggagcacgggctaccgc

SEQ ID NO: 70214 - DNA, 25 bp, Mus musculus
ttcttggcagtcagcagtctgcgga

SEQ ID NO: 70215 - DNA, 25 bp, Mus musculus
ttcttgggaggctcgagacctcgga

SEQ ID NO: 70216 - DNA, 25 bp, Mus musculus
ttcttgggctatggcatagactata

SEQ ID NO: 70217 - DNA, 25 bp, Mus musculus
ttcttggggtctggcactgctctca

SEQ ID NO: 70218 - DNA, 25 bp, Mus musculus
ttcttggtccctcctgagaaatcta

SEQ ID NO: 70219 - DNA, 25 bp, Mus musculus
ttcttgtcgtcttaaccatggtggg

SEQ ID NO: 70220 - DNA, 25 bp, Mus musculus
ttcttgtctcagagagcagtagaga

SEQ ID NO: 70221 - DNA, 25 bp, Mus musculus
ttcttgttcctaggtggacacacca

SEQ ID NO: 70222 - DNA, 25 bp, Mus musculus
ttcttgttcctatgaccttgaccag

SEQ ID NO: 70223 - DNA, 25 bp, Mus musculus
ttctttctgcactggtgcttggtct

SEQ ID NO: 70224 - DNA, 25 bp, Mus musculus
ttctttgaatagcatagccctgaaa

SEQ ID NO: 70225 - DNA, 25 bp, Mus musculus
ttctttggccaagaggacttggaca

SEQ ID NO: 70226 - DNA, 25 bp, Mus musculus
ttctttggctttacccactggtcaa

SEQ ID NO: 70227 - DNA, 25 bp, Mus musculus
ttctttggcttttcccactggtcaa

SEQ ID NO: 70228 - DNA, 25 bp, Mus musculus
ttcttttaggaagagcaccatatcc

SEQ ID NO: 70229 - DNA, 25 bp, Mus musculus
ttcttttctcagtcctcagggcctc

SEQ ID NO: 70230 - DNA, 25 bp, Mus musculus
ttcttttgatgtccgagtgctaaca

SEQ ID NO: 70231 - DNA, 25 bp, Mus musculus
ttcttttggagacgtgctagagagt

SEQ ID NO: 70232 - DNA, 25 bp, Mus musculus
ttgaaaaaaatgactagccctttgg

SEQ ID NO: 70233 - DNA, 25 bp, Mus musculus
ttgaaaagtactgttaacgaatcct

SEQ ID NO: 70234 - DNA, 25 bp, Mus musculus
ttgaaaccaatggacccatagactc

SEQ ID NO: 70235 - DNA, 25 bp, Mus musculus
ttgaaacccagaaggagagggccat

SEQ ID NO: 70236 - DNA, 25 bp, Mus musculus
ttgaaacggaattcaacacacagcc

SEQ ID NO: 70237 - DNA, 25 bp, Mus musculus
ttgaaactctggcagctgagcaaac

SEQ ID NO: 70238 - DNA, 25 bp, Mus musculus
ttgaaactcttcatggaccactggg

SEQ ID NO: 70239 - DNA, 25 bp, Mus musculus
ttgaaagaagaatcagggactattt

SEQ ID NO: 70240 - DNA, 25 bp, Mus musculus
ttgaaagaagcggtgaaccactgat

SEQ ID NO: 70241 - DNA, 25 bp, Mus musculus
ttgaaagagactcactcttggctaa

SEQ ID NO: 70242 - DNA, 25 bp, Mus musculus
ttgaaagccacacacccagagctga

SEQ ID NO: 70243 - DNA, 25 bp, Mus musculus
ttgaaagggacagcctgtttttcca

SEQ ID NO: 70244 - DNA, 25 bp, Mus musculus
ttgaaagtcacttattggcccctgc

SEQ ID NO: 70245 - DNA, 25 bp, Mus musculus
ttgaaatcctgtcatgcagtgtccc

SEQ ID NO: 70246 - DNA, 25 bp, Mus musculus
ttgaaatggccaactcacctgatgc

SEQ ID NO: 70247 - DNA, 25 bp, Mus musculus
ttgaaatggctcttccccacgtcca

SEQ ID NO: 70248 - DNA, 25 bp, Mus musculus
ttgaacaaagtggacggacccgatg

SEQ ID NO: 70249 - DNA, 25 bp, Mus musculus
ttgaacaagaagtcagatggcggtg

SEQ ID NO: 70250 - DNA, 25 bp, Mus musculus
ttgaaccatagagcctgcctatggg

SEQ ID NO: 70251 - DNA, 25 bp, Mus musculus
ttgaacctgagccagagcctcagcc

SEQ ID NO: 70252 - DNA, 25 bp, Mus musculus
ttgaacgaaatgcattcttagaaag

SEQ ID NO: 70253 - DNA, 25 bp, Mus musculus
ttgaacgggcctccagcactctgtg

SEQ ID NO: 70254 - DNA, 25 bp, Mus musculus
ttgaacgggcctgcagcactctgtg

SEQ ID NO: 70255 - DNA, 25 bp, Mus musculus
ttgaactaaatggacttgctgtcaa

SEQ ID NO: 70256 - DNA, 25 bp, Mus musculus
ttgaactccggcagcacgtcatggt

SEQ ID NO: 70257 - DNA, 25 bp, Mus musculus
ttgaacttccgatcctcatcctgca

SEQ ID NO: 70258 - DNA, 25 bp, Mus musculus
ttgaacttgaaacccgaatggacca

SEQ ID NO: 70259 - DNA, 25 bp, Mus musculus
ttgaactttccaaaacctagcgagg

SEQ ID NO: 70260 - DNA, 25 bp, Mus musculus
ttgaactttccataacctagcgagg

SEQ ID NO: 70261 - DNA, 25 bp, Mus musculus
ttgaagaaaattatcctgaaacact

SEQ ID NO: 70262 - DNA, 25 bp, Mus musculus
ttgaagaagctcttgagatggcatc

SEQ ID NO: 70263 - DNA, 25 bp, Mus musculus
ttgaagaaggaagagataaagcaga

SEQ ID NO: 70264 - DNA, 25 bp, Mus musculus
ttgaagacaaatcggcctatgcact

SEQ ID NO: 70265 - DNA, 25 bp, Mus musculus
ttgaagaccattataaaaatccctg

SEQ ID NO: 70266 - DNA, 25 bp, Mus musculus
ttgaagacccggttggccagttccg

SEQ ID NO: 70267 - DNA, 25 bp, Mus musculus
ttgaagactgaaactgagtggtggc

SEQ ID NO: 70268 - DNA, 25 bp, Mus musculus
ttgaagactgagaccatagagttct

SEQ ID NO: 70269 - DNA, 25 bp, Mus musculus
ttgaagaggctcgaagaagaactcg

SEQ ID NO: 70270 - DNA, 25 bp, Mus musculus
ttgaagatagaagaaagggctgaaa

SEQ ID NO: 70271 - DNA, 25 bp, Mus musculus
ttgaagatgaagcagtggataaaac

SEQ ID NO: 70272 - DNA, 25 bp, Mus musculus
ttgaagatggtcagcccgtgcagct

SEQ ID NO: 70273 - DNA, 25 bp, Mus musculus
ttgaagcggagctgtcattttgaca

SEQ ID NO: 70274 - DNA, 25 bp, Mus musculus
ttgaagctagggatttatgcagatg

SEQ ID NO: 70275 - DNA, 25 bp, Mus musculus
ttgaagctggctccacaagggacac

SEQ ID NO: 70276 - DNA, 25 bp, Mus musculus
ttgaagctggctgcacaagggacac

SEQ ID NO: 70277 - DNA, 25 bp, Mus musculus
ttgaagctggtattggctatgcgtg

SEQ ID NO: 70278 - DNA, 25 bp, Mus musculus
ttgaagcttactgctgatgccaagt

SEQ ID NO: 70279 - DNA, 25 bp, Mus musculus
ttgaagcttcctggtgttctggctg

SEQ ID NO: 70280 - DNA, 25 bp, Mus musculus
ttgaaggacggttgcggtgctccct

SEQ ID NO: 70281 - DNA, 25 bp, Mus musculus
ttgaaggcactacaaagtgttggac

SEQ ID NO: 70282 - DNA, 25 bp, Mus musculus
ttgaaggcctagaaccaaggacact

SEQ ID NO: 70283 - DNA, 25 bp, Mus musculus
ttgaaggtgcaaggtcatgactacg

SEQ ID NO: 70284 - DNA, 25 bp, Mus musculus
ttgaaggtgctccatgctcagatcc

SEQ ID NO: 70285 - DNA, 25 bp, Mus musculus
ttgaagtacagaatgacgaggtggc

SEQ ID NO: 70286 - DNA, 25 bp, Mus musculus
ttgaagtctcctgggctaagccata

SEQ ID NO: 70287 - DNA, 25 bp, Mus musculus
ttgaagtcttcgtggcttatttgcc

SEQ ID NO: 70288 - DNA, 25 bp, Mus musculus
ttgaagtgatcccttgcaagatctg

SEQ ID NO: 70289 - DNA, 25 bp, Mus musculus
ttgaagtgctgaatagtttcttggg

SEQ ID NO: 70290 - DNA, 25 bp, Mus musculus
ttgaatcccgtgaaaggcaggtgcc

SEQ ID NO: 70291 - DNA, 25 bp, Mus musculus
ttgaatctctgctctggaaagttct

SEQ ID NO: 70292 - DNA, 25 bp, Mus musculus
ttgaatctctttgcctatgcctgtg

SEQ ID NO: 70293 - DNA, 25 bp, Mus musculus
ttgaattagcaaccggagcagcgcc

SEQ ID NO: 70294 - DNA, 25 bp, Mus musculus
ttgaattcagtcagctctgccccag

SEQ ID NO: 70295 - DNA, 25 bp, Mus musculus
ttgaattcagtctgctctgccccag

SEQ ID NO: 70296 - DNA, 25 bp, Mus musculus
ttgaattggactgatcctcctgctc

SEQ ID NO: 70297 - DNA, 25 bp, Mus musculus
ttgaatttaggacagtcctcctccc

SEQ ID NO: 70298 - DNA, 25 bp, Mus musculus
ttgacaaaatcatcagctggcagcc

SEQ ID NO: 70299 - DNA, 25 bp, Mus musculus
ttgacaaactcggaaaaatctaaga

SEQ ID NO: 70300 - DNA, 25 bp, Mus musculus
ttgacaaagggccagccacattcta

SEQ ID NO: 70301 - DNA, 25 bp, Mus musculus
ttgacaaagggcgagccacattcta

SEQ ID NO: 70302 - DNA, 25 bp, Mus musculus
ttgacaacgggcagaacccacagcg

SEQ ID NO: 70303 - DNA, 25 bp, Mus musculus
ttgacaaggaggagaccgcgctctt

SEQ ID NO: 70304 - DNA, 25 bp, Mus musculus
ttgacaaggagtagtggatgccaca

SEQ ID NO: 70305 - DNA, 25 bp, Mus musculus
ttgacaatgccaggctcacggctga

SEQ ID NO: 70306 - DNA, 25 bp, Mus musculus
ttgacaattgctggcccatgctaag

SEQ ID NO: 70307 - DNA, 25 bp, Mus musculus
ttgacaccactactgggcacaatgt

SEQ ID NO: 70308 - DNA, 25 bp, Mus musculus
ttgacactgagatcgctaagcactg

SEQ ID NO: 70309 - DNA, 25 bp, Mus musculus
ttgacactgattgagctctgggaag

SEQ ID NO: 70310 - DNA, 25 bp, Mus musculus
ttgacactgtacaaggcaccccgat

SEQ ID NO: 70311 - DNA, 25 bp, Mus musculus
ttgacagagtaggaggcatgaacac

SEQ ID NO: 70312 - DNA, 25 bp, Mus musculus
ttgacagccagcatgtcatccacaa

SEQ ID NO: 70313 - DNA, 25 bp, Mus musculus
ttgacagcggcctcaaaacggaggg

SEQ ID NO: 70314 - DNA, 25 bp, Mus musculus
ttgacaggacagatgcaatcagtga

SEQ ID NO: 70315 - DNA, 25 bp, Mus musculus
ttgacagtgctgagcgggaacgact

SEQ ID NO: 70316 - DNA, 25 bp, Mus musculus
ttgacatactaaatgggaaaccgta

SEQ ID NO: 70317 - DNA, 25 bp, Mus musculus
ttgacatccactacggctcaggaag

SEQ ID NO: 70318 - DNA, 25 bp, Mus musculus
ttgacatcctcagaccctactttga

SEQ ID NO: 70319 - DNA, 25 bp, Mus musculus
ttgacatctgtcttgctcgggccaa

SEQ ID NO: 70320 - DNA, 25 bp, Mus musculus
ttgacatgaatgataacagagctcg

SEQ ID NO: 70321 - DNA, 25 bp, Mus musculus
ttgacatgaatgttaacagagctcg

SEQ ID NO: 70322 - DNA, 25 bp, Mus musculus
ttgacattgttatgtgtgctgactg

SEQ ID NO: 70323 - DNA, 25 bp, Mus musculus
ttgaccaagatgatggccctagagc

SEQ ID NO: 70324 - DNA, 25 bp, Mus musculus
ttgaccaaggcagtgaacagcctct

SEQ ID NO: 70325 - DNA, 25 bp, Mus musculus
ttgaccacaacatagtcaacctcct

SEQ ID NO: 70326 - DNA, 25 bp, Mus musculus
ttgaccagatcttggctggaaagct

SEQ ID NO: 70327 - DNA, 25 bp, Mus musculus
ttgaccaggccaataacctgctgat

SEQ ID NO: 70328 - DNA, 25 bp, Mus musculus
ttgaccatgatctctgcccggccgt

SEQ ID NO: 70329 - DNA, 25 bp, Mus musculus
ttgacccaagcaatatgccccctgg

SEQ ID NO: 70330 - DNA, 25 bp, Mus musculus
ttgacccaggtgtggtccaccggac

SEQ ID NO: 70331 - DNA, 25 bp, Mus musculus
ttgacccattgatcgatgattactc

SEQ ID NO: 70332 - DNA, 25 bp, Mus musculus
ttgaccccagttcgagacagcccat

SEQ ID NO: 70333 - DNA, 25 bp, Mus musculus
ttgacccctgggtgttttgcatagg

SEQ ID NO: 70334 - DNA, 25 bp, Mus musculus
ttgacccgttctcttcctggcatgc

SEQ ID NO: 70335 - DNA, 25 bp, Mus musculus
ttgaccgtcgctcacgggtctttcc

SEQ ID NO: 70336 - DNA, 25 bp, Mus musculus
ttgacctatgcagatcttattccag

SEQ ID NO: 70337 - DNA, 25 bp, Mus musculus
ttgacctggcctggcagtatgggcc

SEQ ID NO: 70338 - DNA, 25 bp, Mus musculus
ttgaccttcaacatggaggctgtgg

SEQ ID NO: 70339 - DNA, 25 bp, Mus musculus
ttgaccttccgcgacgtggccgttg

SEQ ID NO: 70340 - DNA, 25 bp, Mus musculus
ttgacgatgtcccatttaagatagg

SEQ ID NO: 70341 - DNA, 25 bp, Mus musculus
ttgacgcataacttaacccaggtgg

SEQ ID NO: 70342 - DNA, 25 bp, Mus musculus
ttgacgttcacacccggctgcagat

SEQ ID NO: 70343 - DNA, 25 bp, Mus musculus
ttgactacagtcagtggggccagtg

SEQ ID NO: 70344 - DNA, 25 bp, Mus musculus
ttgactagagtcattcctggcctgg

SEQ ID NO: 70345 - DNA, 25 bp, Mus musculus
ttgactattcagaaacattggaggg

SEQ ID NO: 70346 - DNA, 25 bp, Mus musculus
ttgactcctggagctcttttgaggg

SEQ ID NO: 70347 - DNA, 25 bp, Mus musculus
ttgactcgtggtgcaaagacaacag

SEQ ID NO: 70348 - DNA, 25 bp, Mus musculus
ttgactctactcagcataccagcca

SEQ ID NO: 70349 - DNA, 25 bp, Mus musculus
ttgactctactctgcataccagcca

SEQ ID NO: 70350 - DNA, 25 bp, Mus musculus
ttgactctgatgtccttagttcttg

SEQ ID NO: 70351 - DNA, 25 bp, Mus musculus
ttgactgatgacatcactataaagg

SEQ ID NO: 70352 - DNA, 25 bp, Mus musculus
ttgactgcagatcaagccatagaac

SEQ ID NO: 70353 - DNA, 25 bp, Mus musculus
ttgactgcattcagccagtgccaaa

SEQ ID NO: 70354 - DNA, 25 bp, Mus musculus
ttgactgtgcagctctttgcattcc

SEQ ID NO: 70355 - DNA, 25 bp, Mus musculus
ttgacttcgctttgcatcagggatg

SEQ ID NO: 70356 - DNA, 25 bp, Mus musculus
ttgacttgtaagttctactgaaaca

SEQ ID NO: 70357 - DNA, 25 bp, Mus musculus
ttgacttgtccaggccacttttcac

SEQ ID NO: 70358 - DNA, 25 bp, Mus musculus
ttgagaaatggtgcatgggaaattg

SEQ ID NO: 70359 - DNA, 25 bp, Mus musculus
ttgagaacaatgatagatgaccagc

SEQ ID NO: 70360 - DNA, 25 bp, Mus musculus
ttgagaacaccttgtggcgcaccca

SEQ ID NO: 70361 - DNA, 25 bp, Mus musculus
ttgagaacacgctgtgggccggcac

SEQ ID NO: 70362 - DNA, 25 bp, Mus musculus
ttgagaaccccagggtagttcagcc

SEQ ID NO: 70363 - DNA, 25 bp, Mus musculus
ttgagaacttcaaatatgaggatgc

SEQ ID NO: 70364 - DNA, 25 bp, Mus musculus
ttgagacaactgttgcaagcctcaa

SEQ ID NO: 70365 - DNA, 25 bp, Mus musculus
ttgagaccaaggtagcccagagggc

SEQ ID NO: 70366 - DNA, 25 bp, Mus musculus
ttgagacccaagtaaaacctctctc

SEQ ID NO: 70367 - DNA, 25 bp, Mus musculus
ttgagaccctacatggctccctgca

SEQ ID NO: 70368 - DNA, 25 bp, Mus musculus
ttgagacgaacaggggggatcccac

SEQ ID NO: 70369 - DNA, 25 bp, Mus musculus
ttgagacgctgcaaaagtctgacgg

SEQ ID NO: 70370 - DNA, 25 bp, Mus musculus
ttgagacggaccactggccgggtcc

SEQ ID NO: 70371 - DNA, 25 bp, Mus musculus
ttgagactgctcctggtatgataca

SEQ ID NO: 70372 - DNA, 25 bp, Mus musculus
ttgagactttaaaacaagaattgcc

SEQ ID NO: 70373 - DNA, 25 bp, Mus musculus
ttgagaggcaaaagaaccaatcatt

SEQ ID NO: 70374 - DNA, 25 bp, Mus musculus
ttgagaggcaaatgaaccaatcatt

SEQ ID NO: 70375 - DNA, 25 bp, Mus musculus
ttgagagggattgagcaggctgttc

SEQ ID NO: 70376 - DNA, 25 bp, Mus musculus
ttgagatcaatgaggcctttgcaag

SEQ ID NO: 70377 - DNA, 25 bp, Mus musculus
ttgagatgaaagacatccatggctg

SEQ ID NO: 70378 - DNA, 25 bp, Mus musculus
ttgagattttggctccttcctccct

SEQ ID NO: 70379 - DNA, 25 bp, Mus musculus
ttgagcaagtgaacagtctgcgaga

SEQ ID NO: 70380 - DNA, 25 bp, Mus musculus
ttgagcaggtggacatgctagagaa

SEQ ID NO: 70381 - DNA, 25 bp, Mus musculus
ttgagccagctccagcaaccagata

SEQ ID NO: 70382 - DNA, 25 bp, Mus musculus
ttgagccagctcgagcaaccagata

SEQ ID NO: 70383 - DNA, 25 bp, Mus musculus
ttgagccgggcacagaaacacagca

SEQ ID NO: 70384 - DNA, 25 bp, Mus musculus
ttgagccttccccaaatacctggta

SEQ ID NO: 70385 - DNA, 25 bp, Mus musculus
ttgagcgctacgtggtggtctgcaa

SEQ ID NO: 70386 - DNA, 25 bp, Mus musculus
ttgagcggtttcatatccagatcac

SEQ ID NO: 70387 - DNA, 25 bp, Mus musculus
ttgagcgtgactttgcagaaatgtg

SEQ ID NO: 70388 - DNA, 25 bp, Mus musculus
ttgagctactcacttgacactgacc

SEQ ID NO: 70389 - DNA, 25 bp, Mus musculus
ttgagctcctacctctgctcggcgg

SEQ ID NO: 70390 - DNA, 25 bp, Mus musculus
ttgagctgtatgacaatgcaccggg

SEQ ID NO: 70391 - DNA, 25 bp, Mus musculus
ttgagctgtcctgccacaaagttga

SEQ ID NO: 70392 - DNA, 25 bp, Mus musculus
ttgaggaagaatgcctggagtttca

SEQ ID NO: 70393 - DNA, 25 bp, Mus musculus
ttgaggacataaacaatacgggaac

SEQ ID NO: 70394 - DNA, 25 bp, Mus musculus
ttgaggaggacaggcacagcatcga

SEQ ID NO: 70395 - DNA, 25 bp, Mus musculus
ttgaggaggccttcactgatggaca

SEQ ID NO: 70396 - DNA, 25 bp, Mus musculus
ttgaggagtgagatctcggaactca

SEQ ID NO: 70397 - DNA, 25 bp, Mus musculus
ttgaggatcctgatgaaaaagtagc

SEQ ID NO: 70398 - DNA, 25 bp, Mus musculus
ttgaggatgtggaaatggaaccgtc

SEQ ID NO: 70399 - DNA, 25 bp, Mus musculus
ttgaggccaacccataggcgacaca

SEQ ID NO: 70400 - DNA, 25 bp, Mus musculus
ttgaggccatcaaggctgccctgct

SEQ ID NO: 70401 - DNA, 25 bp, Mus musculus
ttgaggccgcccagaggtacaatga

SEQ ID NO: 70402 - DNA, 25 bp, Mus musculus
ttgaggctctccagaaggtgaacaa

SEQ ID NO: 70403 - DNA, 25 bp, Mus musculus
ttgaggctgggaagtcatattcggt

SEQ ID NO: 70404 - DNA, 25 bp, Mus musculus
ttgaggtgcactcgctgaagctgct

SEQ ID NO: 70405 - DNA, 25 bp, Mus musculus
ttgagtacacagatggcacctttag

SEQ ID NO: 70406 - DNA, 25 bp, Mus musculus
ttgagtccagaaattacaacagaag

SEQ ID NO: 70407 - DNA, 25 bp, Mus musculus
ttgagtcctacaggacctggaagag

SEQ ID NO: 70408 - DNA, 25 bp, Mus musculus
ttgagtcctggaagttatgacacct

SEQ ID NO: 70409 - DNA, 25 bp, Mus musculus
ttgagtcctggatgttatgacacct

SEQ ID NO: 70410 - DNA, 25 bp, Mus musculus
ttgagtccttgtgtcatcgtcatac

SEQ ID NO: 70411 - DNA, 25 bp, Mus musculus
ttgagtggcccagacacccttggat

SEQ ID NO: 70412 - DNA, 25 bp, Mus musculus
ttgagttaatggagccagctaccca

SEQ ID NO: 70413 - DNA, 25 bp, Mus musculus
ttgagttaatggtgccagctaccca

SEQ ID NO: 70414 - DNA, 25 bp, Mus musculus
ttgagttatggtggctgaaacatca

SEQ ID NO: 70415 - DNA, 25 bp, Mus musculus
ttgagttcaaggagacccaagcact

SEQ ID NO: 70416 - DNA, 25 bp, Mus musculus
ttgagttgacaaccttaaccaccac

SEQ ID NO: 70417 - DNA, 25 bp, Mus musculus
ttgagttgggagtttatcgacttcg

SEQ ID NO: 70418 - DNA, 25 bp, Mus musculus
ttgagtttatctcatcaaccctggc

SEQ ID NO: 70419 - DNA, 25 bp, Mus musculus
ttgagtttctaggacaccgccttca

SEQ ID NO: 70420 - DNA, 25 bp, Mus musculus
ttgagtttggtggaccagaagtgct

SEQ ID NO: 70421 - DNA, 25 bp, Mus musculus
ttgagttttggagccgcaccttggg

SEQ ID NO: 70422 - DNA, 25 bp, Mus musculus
ttgatacaagatttgagctgccttt

SEQ ID NO: 70423 - DNA, 25 bp, Mus musculus
ttgataccgaggaccatccccagta

SEQ ID NO: 70424 - DNA, 25 bp, Mus musculus
ttgatagaccagacatgaggcgcgc

SEQ ID NO: 70425 - DNA, 25 bp, Mus musculus
ttgatagtaaaactcctgagtgtcg

SEQ ID NO: 70426 - DNA, 25 bp, Mus musculus
ttgatattacagatgtacaacctgg

SEQ ID NO: 70427 - DNA, 25 bp, Mus musculus
ttgatattacagttgtacaacctgg

SEQ ID NO: 70428 - DNA, 25 bp, Mus musculus
ttgatattccagaaggaagaagtgg

SEQ ID NO: 70429 - DNA, 25 bp, Mus musculus
ttgatattccagtaggaagaagtgg

SEQ ID NO: 70430 - DNA, 25 bp, Mus musculus
ttgatcaagaggaggatacaaagcg

SEQ ID NO: 70431 - DNA, 25 bp, Mus musculus
ttgatcacatagcatggtcatccac

SEQ ID NO: 70432 - DNA, 25 bp, Mus musculus
ttgatcatctgctacaactggctgc

SEQ ID NO: 70433 - DNA, 25 bp, Mus musculus
ttgatccagaaaaaccgccgggtag

SEQ ID NO: 70434 - DNA, 25 bp, Mus musculus
ttgatcctcaccacttctggcactg

SEQ ID NO: 70435 - DNA, 25 bp, Mus musculus
ttgatcgatgattactctggaagtg

SEQ ID NO: 70436 - DNA, 25 bp, Mus musculus
ttgatctaggatatgccaaggagct

SEQ ID NO: 70437 - DNA, 25 bp, Mus musculus
ttgatctccatcaggccatggctag

SEQ ID NO: 70438 - DNA, 25 bp, Mus musculus
ttgatctggacctggagacccggat

SEQ ID NO: 70439 - DNA, 25 bp, Mus musculus
ttgatcttctcaaaataccttcaag

SEQ ID NO: 70440 - DNA, 25 bp, Mus musculus
ttgatgaaagttgtctcaggagaat

SEQ ID NO: 70441 - DNA, 25 bp, Mus musculus
ttgatgaccggcagcggctagccag

SEQ ID NO: 70442 - DNA, 25 bp, Mus musculus
ttgatgactcctgccttgacccgtt

SEQ ID NO: 70443 - DNA, 25 bp, Mus musculus
ttgatgagcaccaaatctgagctgg

SEQ ID NO: 70444 - DNA, 25 bp, Mus musculus
ttgatgagcgaatcaagattcggga

SEQ ID NO: 70445 - DNA, 25 bp, Mus musculus
ttgatgagctgacccggatctgtga

SEQ ID NO: 70446 - DNA, 25 bp, Mus musculus
ttgatgaggcctggaagaattgaca

SEQ ID NO: 70447 - DNA, 25 bp, Mus musculus
ttgatgatctgctgaggcacatgga

SEQ ID NO: 70448 - DNA, 25 bp, Mus musculus
ttgatgcatgcagggcaagcattct

SEQ ID NO: 70449 - DNA, 25 bp, Mus musculus
ttgatgccaacagcgaggaggaaag

SEQ ID NO: 70450 - DNA, 25 bp, Mus musculus
ttgatgccacatttgctgaccttgg

SEQ ID NO: 70451 - DNA, 25 bp, Mus musculus
ttgatgccatttagagtggaaagcc

SEQ ID NO: 70452 - DNA, 25 bp, Mus musculus
ttgatgctgggtatcgccacattga

SEQ ID NO: 70453 - DNA, 25 bp, Mus musculus
ttgatggacttctcagttggcttca

SEQ ID NO: 70454 - DNA, 25 bp, Mus musculus
ttgatggcacgaaggaagcagcagc

SEQ ID NO: 70455 - DNA, 25 bp, Mus musculus
ttgatgtcaggttcaaaaagagccc

SEQ ID NO: 70456 - DNA, 25 bp, Mus musculus
ttgatgtgctgagcttcacggcaga

SEQ ID NO: 70457 - DNA, 25 bp, Mus musculus
ttgatgtggctgctgaacattacaa

SEQ ID NO: 70458 - DNA, 25 bp, Mus musculus
ttgatgttcctatcggttctcgagg

SEQ ID NO: 70459 - DNA, 25 bp, Mus musculus
ttgattatccagagcgtcgggccct

SEQ ID NO: 70460 - DNA, 25 bp, Mus musculus
ttgattcactgagtgagcaggtgtc

SEQ ID NO: 70461 - DNA, 25 bp, Mus musculus
ttgattcagaaattgcagccctacg

SEQ ID NO: 70462 - DNA, 25 bp, Mus musculus
ttgattcctgttgccggcctggcgg

SEQ ID NO: 70463 - DNA, 25 bp, Mus musculus
ttgattcggtggaatctgttcttcc

SEQ ID NO: 70464 - DNA, 25 bp, Mus musculus
ttgattctaacattgcaccagctga

SEQ ID NO: 70465 - DNA, 25 bp, Mus musculus
ttgattgcttcgtcctgaaccctgg

SEQ ID NO: 70466 - DNA, 25 bp, Mus musculus
ttgattggagtcctggtgtcattcc

SEQ ID NO: 70467 - DNA, 25 bp, Mus musculus
ttgattgggtattcagagagggccc

SEQ ID NO: 70468 - DNA, 25 bp, Mus musculus
ttgatttcttggatctccggcttgg

SEQ ID NO: 70469 - DNA, 25 bp, Mus musculus
ttgcaaaaagaaataaacatcttga

SEQ ID NO: 70470 - DNA, 25 bp, Mus musculus
ttgcaaaaagtgctgaaatagccgg

SEQ ID NO: 70471 - DNA, 25 bp, Mus musculus
ttgcaaaatctactccctgaaggca

SEQ ID NO: 70472 - DNA, 25 bp, Mus musculus
ttgcaaagacctgcgggtgctccac

SEQ ID NO: 70473 - DNA, 25 bp, Mus musculus
ttgcaaatatatcaccattggcaag

SEQ ID NO: 70474 - DNA, 25 bp, Mus musculus
ttgcaaccatctctttagcaactgg

SEQ ID NO: 70475 - DNA, 25 bp, Mus musculus
ttgcaacccgaacccctgtgaaaat

SEQ ID NO: 70476 - DNA, 25 bp, Mus musculus
ttgcaactaggaggccggcctaatc

SEQ ID NO: 70477 - DNA, 25 bp, Mus musculus
ttgcaagataaataagaagctcaag

SEQ ID NO: 70478 - DNA, 25 bp, Mus musculus
ttgcaagtgtgcactaagtaagcct

SEQ ID NO: 70479 - DNA, 25 bp, Mus musculus
ttgcaatcaagaagctcagccggcc

SEQ ID NO: 70480 - DNA, 25 bp, Mus musculus
ttgcaattatgggacacagcaggtc

SEQ ID NO: 70481 - DNA, 25 bp, Mus musculus
ttgcacatccctccgctgactggga

SEQ ID NO: 70482 - DNA, 25 bp, Mus musculus
ttgcaccaactacgcgaggctttga

SEQ ID NO: 70483 - DNA, 25 bp, Mus musculus
ttgcactcatcaccggcgcctatga

SEQ ID NO: 70484 - DNA, 25 bp, Mus musculus
ttgcagaaaagcctcatgttcatcg

SEQ ID NO: 70485 - DNA, 25 bp, Mus musculus
ttgcagaaactgaggccccgagagt

SEQ ID NO: 70486 - DNA, 25 bp, Mus musculus
ttgcagaggcatcagaaaactaaag

SEQ ID NO: 70487 - DNA, 25 bp, Mus musculus
ttgcagatgatgataccagactact

SEQ ID NO: 70488 - DNA, 25 bp, Mus musculus
ttgcagatgttagtcaggagggact

SEQ ID NO: 70489 - DNA, 25 bp, Mus musculus
ttgcagcaacaactaagacccgtgg

SEQ ID NO: 70490 - DNA, 25 bp, Mus musculus
ttgcagcagaaatcctgggaatcaa

SEQ ID NO: 70491 - DNA, 25 bp, Mus musculus
ttgcagcggcgcagcatctacggcg

SEQ ID NO: 70492 - DNA, 25 bp, Mus musculus
ttgcagctgatgcttacgctcccct

SEQ ID NO: 70493 - DNA, 25 bp, Mus musculus
ttgcaggccaacaatagaaggttca

SEQ ID NO: 70494 - DNA, 25 bp, Mus musculus
ttgcaggccgtgtgtcaccctgacc

SEQ ID NO: 70495 - DNA, 25 bp, Mus musculus
ttgcagggacctacgtggcccctca

SEQ ID NO: 70496 - DNA, 25 bp, Mus musculus
ttgcaggtgacgaccctcctgcgag

SEQ ID NO: 70497 - DNA, 25 bp, Mus musculus
ttgcagtagcctggagtaatctcgg

SEQ ID NO: 70498 - DNA, 25 bp, Mus musculus
ttgcatacatcccagggacttgggc

SEQ ID NO: 70499 - DNA, 25 bp, Mus musculus
ttgcatatgtgcaccagcagctggg

SEQ ID NO: 70500 - DNA, 25 bp, Mus musculus
ttgcatcaagatcaggcctgaagta

SEQ ID NO: 70501 - DNA, 25 bp, Mus musculus
ttgcatcagtgacaacacctcagtg

SEQ ID NO: 70502 - DNA, 25 bp, Mus musculus
ttgcatctgactgtctgtcctcggg

SEQ ID NO: 70503 - DNA, 25 bp, Mus musculus
ttgcatctgattccagcactcccta

SEQ ID NO: 70504 - DNA, 25 bp, Mus musculus
ttgcatctgggtattggcagtcacc

SEQ ID NO: 70505 - DNA, 25 bp, Mus musculus
ttgcatgaggctaaatctgagaacc

SEQ ID NO: 70506 - DNA, 25 bp, Mus musculus
ttgcatgcctcgttccatgagagga

SEQ ID NO: 70507 - DNA, 25 bp, Mus musculus
ttgcattcggctgcaaggtgtactg

SEQ ID NO: 70508 - DNA, 25 bp, Mus musculus
ttgcattgcccgtctacctccttat

SEQ ID NO: 70509 - DNA, 25 bp, Mus musculus
ttgccaaagaccttgaaatgtttgc

SEQ ID NO: 70510 - DNA, 25 bp, Mus musculus
ttgccaacatcaaacgggaacaggg

SEQ ID NO: 70511 - DNA, 25 bp, Mus musculus
ttgccaactcgggatgcaggcttca

SEQ ID NO: 70512 - DNA, 25 bp, Mus musculus
ttgccacaaaatcctctttccagga

SEQ ID NO: 70513 - DNA, 25 bp, Mus musculus
ttgccacatcaggttcccaggtggt

SEQ ID NO: 70514 - DNA, 25 bp, Mus musculus
ttgccaccaatgctgctggctggag

SEQ ID NO: 70515 - DNA, 25 bp, Mus musculus
ttgccaccatggaagaaagaataca

SEQ ID NO: 70516 - DNA, 25 bp, Mus musculus
ttgccactccctactgaataaagct

SEQ ID NO: 70517 - DNA, 25 bp, Mus musculus
ttgccagaaaacaccagaggaccct

SEQ ID NO: 70518 - DNA, 25 bp, Mus musculus
ttgccagaaaactccagaggaccct

SEQ ID NO: 70519 - DNA, 25 bp, Mus musculus
ttgccagaacacaggtagtaagcca

SEQ ID NO: 70520 - DNA, 25 bp, Mus musculus
ttgccagaacactggtagtaagcca

SEQ ID NO: 70521 - DNA, 25 bp, Mus musculus
ttgccagactggtgtgcctcacagg

SEQ ID NO: 70522 - DNA, 25 bp, Mus musculus
ttgccagatctcttacagcaaagcc

SEQ ID NO: 70523 - DNA, 25 bp, Mus musculus
ttgccagcacagcttccaatcgagg

SEQ ID NO: 70524 - DNA, 25 bp, Mus musculus
ttgccagcgcatgggctatggagcc

SEQ ID NO: 70525 - DNA, 25 bp, Mus musculus
ttgccagcttcccagcgagaaggat

SEQ ID NO: 70526 - DNA, 25 bp, Mus musculus
ttgccaggacaaacacccgagactg

SEQ ID NO: 70527 - DNA, 25 bp, Mus musculus
ttgccagggtttcacaggcaaacag

SEQ ID NO: 70528 - DNA, 25 bp, Mus musculus
ttgccagttgcacctgctgccttca

SEQ ID NO: 70529 - DNA, 25 bp, Mus musculus
ttgccataattactcacagccatga

SEQ ID NO: 70530 - DNA, 25 bp, Mus musculus
ttgccataattagtcacagccatga

SEQ ID NO: 70531 - DNA, 25 bp, Mus musculus
ttgccatcaaacctgacgcccagag

SEQ ID NO: 70532 - DNA, 25 bp, Mus musculus
ttgccatcacccagaactttgccag

SEQ ID NO: 70533 - DNA, 25 bp, Mus musculus
ttgccatctccaagcacactgaaga

SEQ ID NO: 70534 - DNA, 25 bp, Mus musculus
ttgccatcttcaacacagagcagag

SEQ ID NO: 70535 - DNA, 25 bp, Mus musculus
ttgccatgatgagccaccacgagat

SEQ ID NO: 70536 - DNA, 25 bp, Mus musculus
ttgccatggttgtgcctccccagga

SEQ ID NO: 70537 - DNA, 25 bp, Mus musculus
ttgccattggctctctgatggacga

SEQ ID NO: 70538 - DNA, 25 bp, Mus musculus
ttgcccaaatcgactgctttgaaag

SEQ ID NO: 70539 - DNA, 25 bp, Mus musculus
ttgcccacaggattgacttggcctc

SEQ ID NO: 70540 - DNA, 25 bp, Mus musculus
ttgcccactggctgaagaggcagcg

SEQ ID NO: 70541 - DNA, 25 bp, Mus musculus
ttgcccagctgctacaggagcggga

SEQ ID NO: 70542 - DNA, 25 bp, Mus musculus
ttgcccatgcagaatggaggaagcc

SEQ ID NO: 70543 - DNA, 25 bp, Mus musculus
ttgccccaaatcctaaaatcattcg

SEQ ID NO: 70544 - DNA, 25 bp, Mus musculus
ttgccccaaatcgtaaaatcattcg

SEQ ID NO: 70545 - DNA, 25 bp, Mus musculus
ttgccccgtcactgctggagcagga

SEQ ID NO: 70546 - DNA, 25 bp, Mus musculus
ttgcccctactgtcactacctggag

SEQ ID NO: 70547 - DNA, 25 bp, Mus musculus
ttgcccctgctttgtgcgagttccg

SEQ ID NO: 70548 - DNA, 25 bp, Mus musculus
ttgcccgaggaattgctgccagcgt

SEQ ID NO: 70549 - DNA, 25 bp, Mus musculus
ttgccctgagtggaaaatcctttca

SEQ ID NO: 70550 - DNA, 25 bp, Mus musculus
ttgccctgggcgtctcaggctctgt

SEQ ID NO: 70551 - DNA, 25 bp, Mus musculus
ttgccgagagatggatgaacagatc

SEQ ID NO: 70552 - DNA, 25 bp, Mus musculus
ttgccgaggtgtgccaaactgaagg

SEQ ID NO: 70553 - DNA, 25 bp, Mus musculus
ttgccgctggtctgggctgctcgct

SEQ ID NO: 70554 - DNA, 25 bp, Mus musculus
ttgccggtcagaagcgaagctctcc

SEQ ID NO: 70555 - DNA, 25 bp, Mus musculus
ttgcctaccactttcatgtccctgg

SEQ ID NO: 70556 - DNA, 25 bp, Mus musculus
ttgcctatgccagacacagggctgc

SEQ ID NO: 70557 - DNA, 25 bp, Mus musculus
ttgcctcagaatgtgggaggatacc

SEQ ID NO: 70558 - DNA, 25 bp, Mus musculus
ttgcctccgccttccgggaagtgtg

SEQ ID NO: 70559 - DNA, 25 bp, Mus musculus
ttgcctcgatcgacagtgatgctgt

SEQ ID NO: 70560 - DNA, 25 bp, Mus musculus
ttgcctctcgcccatatgtttgaga

SEQ ID NO: 70561 - DNA, 25 bp, Mus musculus
ttgcctgatatagacagtcttccat

SEQ ID NO: 70562 - DNA, 25 bp, Mus musculus
ttgcctgcactgtatactatttttc

SEQ ID NO: 70563 - DNA, 25 bp, Mus musculus
ttgcctgcggagtcgcctcactagt

SEQ ID NO: 70564 - DNA, 25 bp, Mus musculus
ttgcctggcccgcttgctgactctg

SEQ ID NO: 70565 - DNA, 25 bp, Mus musculus
ttgcctgggtggacaagccaatgcc

SEQ ID NO: 70566 - DNA, 25 bp, Mus musculus
ttgcctgtacactggcttcctcttc

SEQ ID NO: 70567 - DNA, 25 bp, Mus musculus
ttgcctgtccacagtgtgaatcgag

SEQ ID NO: 70568 - DNA, 25 bp, Mus musculus
ttgccttccattggcccagtactgg

SEQ ID NO: 70569 - DNA, 25 bp, Mus musculus
ttgccttgaattctcaccaaataac

SEQ ID NO: 70570 - DNA, 25 bp, Mus musculus
ttgcctttgaagtgtgtcgggaaga

SEQ ID NO: 70571 - DNA, 25 bp, Mus musculus
ttgcgaagtccccaagctcttcagc

SEQ ID NO: 70572 - DNA, 25 bp, Mus musculus
ttgcgaccaggagagcatttcttaa

SEQ ID NO: 70573 - DNA, 25 bp, Mus musculus
ttgcgctgcagacagtgtggacatc

SEQ ID NO: 70574 - DNA, 25 bp, Mus musculus
ttgcggaatataagcgagttcaagt

SEQ ID NO: 70575 - DNA, 25 bp, Mus musculus
ttgcggaatatatgcgagttcaagt

SEQ ID NO: 70576 - DNA, 25 bp, Mus musculus
ttgcggatggaacccggtgacccca

SEQ ID NO: 70577 - DNA, 25 bp, Mus musculus
ttgcggcctcacagctgaagctgga

SEQ ID NO: 70578 - DNA, 25 bp, Mus musculus
ttgcggtgctccctggaacaagtga

SEQ ID NO: 70579 - DNA, 25 bp, Mus musculus
ttgcgtacccgggatatggtccgtg

SEQ ID NO: 70580 - DNA, 25 bp, Mus musculus
ttgcgtcgaacagccaagaccaagg

SEQ ID NO: 70581 - DNA, 25 bp, Mus musculus
ttgctaaacaattcctaccagggtg

SEQ ID NO: 70582 - DNA, 25 bp, Mus musculus
ttgctaacgccatttctgaagtgaa

SEQ ID NO: 70583 - DNA, 25 bp, Mus musculus
ttgctagctgtaggactaggtgttg

SEQ ID NO: 70584 - DNA, 25 bp, Mus musculus
ttgctagctttacccgagaggcttc

SEQ ID NO: 70585 - DNA, 25 bp, Mus musculus
ttgctcacatgtcaagttgttacca

SEQ ID NO: 70586 - DNA, 25 bp, Mus musculus
ttgctcagaagtcagccgcctggtg

SEQ ID NO: 70587 - DNA, 25 bp, Mus musculus
ttgctcagccaccaaaagtaactac

SEQ ID NO: 70588 - DNA, 25 bp, Mus musculus
ttgctcagctagctgggaactccga

SEQ ID NO: 70589 - DNA, 25 bp, Mus musculus
ttgctcatggcaccgtcactaggga

SEQ ID NO: 70590 - DNA, 25 bp, Mus musculus
ttgctcccaagaacccaactatttc

SEQ ID NO: 70591 - DNA, 25 bp, Mus musculus
ttgctcgcgctaccatttcttctgt

SEQ ID NO: 70592 - DNA, 25 bp, Mus musculus
ttgctctcaagtaccaggcactggg

SEQ ID NO: 70593 - DNA, 25 bp, Mus musculus
ttgctctgagcccacccagtacaag

SEQ ID NO: 70594 - DNA, 25 bp, Mus musculus
ttgctctgccccaaaggcaagcgga

SEQ ID NO: 70595 - DNA, 25 bp, Mus musculus
ttgctctgctcattgccatcagcat

SEQ ID NO: 70596 - DNA, 25 bp, Mus musculus
ttgctctgttgcagcccctgggaac

SEQ ID NO: 70597 - DNA, 25 bp, Mus musculus
ttgctcttgagctttctgcactaat

SEQ ID NO: 70598 - DNA, 25 bp, Mus musculus
ttgctgaaatcagagcaggagcaga

SEQ ID NO: 70599 - DNA, 25 bp, Mus musculus
ttgctgatgtcctggttcggtgtcc

SEQ ID NO: 70600 - DNA, 25 bp, Mus musculus
ttgctgcaaagcacaagaggactgc

SEQ ID NO: 70601 - DNA, 25 bp, Mus musculus
ttgctgcagaaaggcggctccagga

SEQ ID NO: 70602 - DNA, 25 bp, Mus musculus
ttgctgcagcgcctaaagaccctgc

SEQ ID NO: 70603 - DNA, 25 bp, Mus musculus
ttgctgccataggaagagtctttgt

SEQ ID NO: 70604 - DNA, 25 bp, Mus musculus
ttgctgccgatgaaagaagacttgg

SEQ ID NO: 70605 - DNA, 25 bp, Mus musculus
ttgctgcgacagatagaaaacttac

SEQ ID NO: 70606 - DNA, 25 bp, Mus musculus
ttgctgcgtgatgaggatcggctcc

SEQ ID NO: 70607 - DNA, 25 bp, Mus musculus
ttgctgctcagaaaggttacaccag

SEQ ID NO: 70608 - DNA, 25 bp, Mus musculus
ttgctgctcatcaagaagacctgaa

SEQ ID NO: 70609 - DNA, 25 bp, Mus musculus
ttgctgctgcttccctttgtctcta

SEQ ID NO: 70610 - DNA, 25 bp, Mus musculus
ttgctgcttcgtcaatgtgtgtgga

SEQ ID NO: 70611 - DNA, 25 bp, Mus musculus
ttgctgcttcgtgaatgtgtgtgga

SEQ ID NO: 70612 - DNA, 25 bp, Mus musculus
ttgctggaaattgcaggatgtgcct

SEQ ID NO: 70613 - DNA, 25 bp, Mus musculus
ttgctggccgtgcaacgccatctca

SEQ ID NO: 70614 - DNA, 25 bp, Mus musculus
ttgctggcctctacaagggactggg

SEQ ID NO: 70615 - DNA, 25 bp, Mus musculus
ttgctggctcagcactaccgctggg

SEQ ID NO: 70616 - DNA, 25 bp, Mus musculus
ttgctgggataaggcgggacatttc

SEQ ID NO: 70617 - DNA, 25 bp, Mus musculus
ttgctgtcatcaccgcggcccggga

SEQ ID NO: 70618 - DNA, 25 bp, Mus musculus
ttgctgtcgacttttcattggatga

SEQ ID NO: 70619 - DNA, 25 bp, Mus musculus
ttgctgtctcgggacatggcaggct

SEQ ID NO: 70620 - DNA, 25 bp, Mus musculus
ttgctgtctgccatgtggatgcccc

SEQ ID NO: 70621 - DNA, 25 bp, Mus musculus
ttgctgtggtgcacgccccatctcg

SEQ ID NO: 70622 - DNA, 25 bp, Mus musculus
ttgctgttctggctgaggccatcta

SEQ ID NO: 70623 - DNA, 25 bp, Mus musculus
ttgcttaacaagcagaatcagcttc

SEQ ID NO: 70624 - DNA, 25 bp, Mus musculus
ttgcttacgcctgcccggagatctt

SEQ ID NO: 70625 - DNA, 25 bp, Mus musculus
ttgcttatttaagagtgctggacag

SEQ ID NO: 70626 - DNA, 25 bp, Mus musculus
ttgcttcacttggaactcggccttg

SEQ ID NO: 70627 - DNA, 25 bp, Mus musculus
ttgcttcatgaacgcatgctcccga

SEQ ID NO: 70628 - DNA, 25 bp, Mus musculus
ttgcttccttcagtggtgttggtag

SEQ ID NO: 70629 - DNA, 25 bp, Mus musculus
ttgcttcgggcaagtagtcatggct

SEQ ID NO: 70630 - DNA, 25 bp, Mus musculus
ttgcttgatcccattgcagccctgc

SEQ ID NO: 70631 - DNA, 25 bp, Mus musculus
ttgcttgcttactcgagatcgcctg

SEQ ID NO: 70632 - DNA, 25 bp, Mus musculus
ttgcttggactatacgacactgcag

SEQ ID NO: 70633 - DNA, 25 bp, Mus musculus
ttgctttgggatacctctcagtgtg

SEQ ID NO: 70634 - DNA, 25 bp, Mus musculus
ttgcttttaccagaagaaggaggag

SEQ ID NO: 70635 - DNA, 25 bp, Mus musculus
ttggaaaaatgccagacgagtatgg

SEQ ID NO: 70636 - DNA, 25 bp, Mus musculus
ttggaaaatcctccataggaatggc

SEQ ID NO: 70637 - DNA, 25 bp, Mus musculus
ttggaaacaatgattgggctctatg

SEQ ID NO: 70638 - DNA, 25 bp, Mus musculus
ttggaaaccacccagcaagattttt

SEQ ID NO: 70639 - DNA, 25 bp, Mus musculus
ttggaaactgcagttgataaatgac

SEQ ID NO: 70640 - DNA, 25 bp, Mus musculus
ttggaaatcggtagtaatggttatc

SEQ ID NO: 70641 - DNA, 25 bp, Mus musculus
ttggaaatgcagaccgctggattgc

SEQ ID NO: 70642 - DNA, 25 bp, Mus musculus
ttggaaatgcagtccgctggattgc

SEQ ID NO: 70643 - DNA, 25 bp, Mus musculus
ttggaacagcgctaggagagaaact

SEQ ID NO: 70644 - DNA, 25 bp, Mus musculus
ttggaactcaaagcccagaatggca

SEQ ID NO: 70645 - DNA, 25 bp, Mus musculus
ttggaaggacccagtcctgaccctc

SEQ ID NO: 70646 - DNA, 25 bp, Mus musculus
ttggaaggcttccatgaagtgaacc

SEQ ID NO: 70647 - DNA, 25 bp, Mus musculus
ttggaagtcatacttgacaattcag

SEQ ID NO: 70648 - DNA, 25 bp, Mus musculus
ttggaatgagtggaagtaatgcagc

SEQ ID NO: 70649 - DNA, 25 bp, Mus musculus
ttggaatgccccagggttgacgact

SEQ ID NO: 70650 - DNA, 25 bp, Mus musculus
ttggacaactcaatggcacggccca

SEQ ID NO: 70651 - DNA, 25 bp, Mus musculus
ttggacaatagccaccagtcttagc

SEQ ID NO: 70652 - DNA, 25 bp, Mus musculus
ttggacacagcttccccaagggttc

SEQ ID NO: 70653 - DNA, 25 bp, Mus musculus
ttggacagacagtttctcatccgtg

SEQ ID NO: 70654 - DNA, 25 bp, Mus musculus
ttggacagattcttcgaacgccagc

SEQ ID NO: 70655 - DNA, 25 bp, Mus musculus
ttggacagcatacggccacaaaagg

SEQ ID NO: 70656 - DNA, 25 bp, Mus musculus
ttggacagtttgtattgattcaggg

SEQ ID NO: 70657 - DNA, 25 bp, Mus musculus
ttggacatactgcagctgcttttgg

SEQ ID NO: 70658 - DNA, 25 bp, Mus musculus
ttggacccaccctctgatctgcaga

SEQ ID NO: 70659 - DNA, 25 bp, Mus musculus
ttggacgctgccactcaacagctct

SEQ ID NO: 70660 - DNA, 25 bp, Mus musculus
ttggactagctcatctcatggccct

SEQ ID NO: 70661 - DNA, 25 bp, Mus musculus
ttggactatacgacactgcaggaca

SEQ ID NO: 70662 - DNA, 25 bp, Mus musculus
ttggactcacaggatctgggcttgg

SEQ ID NO: 70663 - DNA, 25 bp, Mus musculus
ttggactcaggcgatgcttcttcag

SEQ ID NO: 70664 - DNA, 25 bp, Mus musculus
ttggacttctctgacaaggaaaggg

SEQ ID NO: 70665 - DNA, 25 bp, Mus musculus
ttggagacacatgtggtaaagatag

SEQ ID NO: 70666 - DNA, 25 bp, Mus musculus
ttggagacagaagcgtcggaatcga

SEQ ID NO: 70667 - DNA, 25 bp, Mus musculus
ttggagacaggagcagcccctgcgc

SEQ ID NO: 70668 - DNA, 25 bp, Mus musculus
ttggagaccgcctcaacgtagaggt

SEQ ID NO: 70669 - DNA, 25 bp, Mus musculus
ttggagacggctgttttccagactc

SEQ ID NO: 70670 - DNA, 25 bp, Mus musculus
ttggagacgggagacaccaagcctg

SEQ ID NO: 70671 - DNA, 25 bp, Mus musculus
ttggagatcctctctcacctttgca

SEQ ID NO: 70672 - DNA, 25 bp, Mus musculus
ttggagattactccggaccgaagca

SEQ ID NO: 70673 - DNA, 25 bp, Mus musculus
ttggagattgagttcaaggagaccc

SEQ ID NO: 70674 - DNA, 25 bp, Mus musculus
ttggagcaactcctttatgggaatc

SEQ ID NO: 70675 - DNA, 25 bp, Mus musculus
ttggagcaagcgtcttggcatagca

SEQ ID NO: 70676 - DNA, 25 bp, Mus musculus
ttggagcacagtcaccgaattcggt

SEQ ID NO: 70677 - DNA, 25 bp, Mus musculus
ttggagcaggagtccgagcacagcc

SEQ ID NO: 70678 - DNA, 25 bp, Mus musculus
ttggagcataggtgtcataatgttc

SEQ ID NO: 70679 - DNA, 25 bp, Mus musculus
ttggagcatatgatcagcagatatg

SEQ ID NO: 70680 - DNA, 25 bp, Mus musculus
ttggagcctgagttgcctgcggcct

SEQ ID NO: 70681 - DNA, 25 bp, Mus musculus
ttggagccttcagaaaaaccctttg

SEQ ID NO: 70682 - DNA, 25 bp, Mus musculus
ttggagctcatgatgtgagcaagac

SEQ ID NO: 70683 - DNA, 25 bp, Mus musculus
ttggagctgataggaaaatggctgc

SEQ ID NO: 70684 - DNA, 25 bp, Mus musculus
ttggagcttggaggaaacaatgcca

SEQ ID NO: 70685 - DNA, 25 bp, Mus musculus
ttggaggaaatacccataatgatac

SEQ ID NO: 70686 - DNA, 25 bp, Mus musculus
ttggaggatcggctcttcccaccta

SEQ ID NO: 70687 - DNA, 25 bp, Mus musculus
ttggaggatgaaccctctgcccaac

SEQ ID NO: 70688 - DNA, 25 bp, Mus musculus
ttggaggcaacctggcaggcgctcc

SEQ ID NO: 70689 - DNA, 25 bp, Mus musculus
ttggaggccctctcaggttccctaa

SEQ ID NO: 70690 - DNA, 25 bp, Mus musculus
ttggaggtagagtgggaggtgaaac

SEQ ID NO: 70691 - DNA, 25 bp, Mus musculus
ttggaggttacatgaaggcgctcga

SEQ ID NO: 70692 - DNA, 25 bp, Mus musculus
ttggagtacggcaccaaactcgtgg

SEQ ID NO: 70693 - DNA, 25 bp, Mus musculus
ttggagtactccaacaagcaagtgt

SEQ ID NO: 70694 - DNA, 25 bp, Mus musculus
ttggagtcaagtctgagttccggca

SEQ ID NO: 70695 - DNA, 25 bp, Mus musculus
ttggagtgcacagtacagttggtgc

SEQ ID NO: 70696 - DNA, 25 bp, Mus musculus
ttggagtgtcccactggcaggccgc

SEQ ID NO: 70697 - DNA, 25 bp, Mus musculus
ttggagttgctcctggcacctcagt

SEQ ID NO: 70698 - DNA, 25 bp, Mus musculus
ttggagtttggagctggagacctcc

SEQ ID NO: 70699 - DNA, 25 bp, Mus musculus
ttggataaccacgaaatgactaatc

SEQ ID NO: 70700 - DNA, 25 bp, Mus musculus
ttggatacagatgagcaagaagtgg

SEQ ID NO: 70701 - DNA, 25 bp, Mus musculus
ttggatagaaaaggcagatactccc

SEQ ID NO: 70702 - DNA, 25 bp, Mus musculus
ttggatatcatcaaatacatcgtta

SEQ ID NO: 70703 - DNA, 25 bp, Mus musculus
ttggatccagctcgagtcaacgtgc

SEQ ID NO: 70704 - DNA, 25 bp, Mus musculus
ttggatctaggacaagctggatcag

SEQ ID NO: 70705 - DNA, 25 bp, Mus musculus
ttggatctccggcttggagcagcat

SEQ ID NO: 70706 - DNA, 25 bp, Mus musculus
ttggatctgccagccgtacatccgg

SEQ ID NO: 70707 - DNA, 25 bp, Mus musculus
ttggatgaatgtcccttccctggag

SEQ ID NO: 70708 - DNA, 25 bp, Mus musculus
ttggatgaatgtgccttccctggag

SEQ ID NO: 70709 - DNA, 25 bp, Mus musculus
ttggatgactcagaggagccgtccc

SEQ ID NO: 70710 - DNA, 25 bp, Mus musculus
ttggatgatttagataccgttcctg

SEQ ID NO: 70711 - DNA, 25 bp, Mus musculus
ttggatgctgatctggactcctccg

SEQ ID NO: 70712 - DNA, 25 bp, Mus musculus
ttggatggcccctgaagtcatggaa

SEQ ID NO: 70713 - DNA, 25 bp, Mus musculus
ttggatgggaaagtgtcaaaactac

SEQ ID NO: 70714 - DNA, 25 bp, Mus musculus
ttggatgggcatgacctgcgaactc

SEQ ID NO: 70715 - DNA, 25 bp, Mus musculus
ttggattacccacctcttacggcct

SEQ ID NO: 70716 - DNA, 25 bp, Mus musculus
ttggattccgaagaccccgggctct

SEQ ID NO: 70717 - DNA, 25 bp, Mus musculus
ttggattctaggacctcctcgaaat

SEQ ID NO: 70718 - DNA, 25 bp, Mus musculus
ttggattgatgtctctctccaaagg

SEQ ID NO: 70719 - DNA, 25 bp, Mus musculus
ttggattgtcgtgggcatcctcaac

SEQ ID NO: 70720 - DNA, 25 bp, Mus musculus
ttggatttcatgatggagacccatt

SEQ ID NO: 70721 - DNA, 25 bp, Mus musculus
ttggcaaaggtgtcctagaaatggc

SEQ ID NO: 70722 - DNA, 25 bp, Mus musculus
ttggcaaattcagaagaaaagctct

SEQ ID NO: 70723 - DNA, 25 bp, Mus musculus
ttggcaaggtcttccctgggaaaag

SEQ ID NO: 70724 - DNA, 25 bp, Mus musculus
ttggcaccgacaggagactcctgac

SEQ ID NO: 70725 - DNA, 25 bp, Mus musculus
ttggcaccgtcttcgcgggacaccg

SEQ ID NO: 70726 - DNA, 25 bp, Mus musculus
ttggcacctccttaaaattgcctgt

SEQ ID NO: 70727 - DNA, 25 bp, Mus musculus
ttggcactcagtctcaaaacatatg

SEQ ID NO: 70728 - DNA, 25 bp, Mus musculus
ttggcactgtcaatgagatctataa

SEQ ID NO: 70729 - DNA, 25 bp, Mus musculus
ttggcagagccagggagatacccct

SEQ ID NO: 70730 - DNA, 25 bp, Mus musculus
ttggcagatagaaacgtctgggcaa

SEQ ID NO: 70731 - DNA, 25 bp, Mus musculus
ttggcagatattccgcagcgtcccc

SEQ ID NO: 70732 - DNA, 25 bp, Mus musculus
ttggcagcaagtgaccttacaccga

SEQ ID NO: 70733 - DNA, 25 bp, Mus musculus
ttggcagcccagagcaaggcttcag

SEQ ID NO: 70734 - DNA, 25 bp, Mus musculus
ttggcagcctagagcacgcagatgc

SEQ ID NO: 70735 - DNA, 25 bp, Mus musculus
ttggcaggaaggtaacgttctttca

SEQ ID NO: 70736 - DNA, 25 bp, Mus musculus
ttggcaggctaaaaagagagcgttc

SEQ ID NO: 70737 - DNA, 25 bp, Mus musculus
ttggcagtatgtgtgctttccgttg

SEQ ID NO: 70738 - DNA, 25 bp, Mus musculus
ttggcagtcagcagtctgcggagct

SEQ ID NO: 70739 - DNA, 25 bp, Mus musculus
ttggcatagcagtgaggcgtcccca

SEQ ID NO: 70740 - DNA, 25 bp, Mus musculus
ttggcatcaccataaccgttggata

SEQ ID NO: 70741 - DNA, 25 bp, Mus musculus
ttggcatcccatgtccccacactac

SEQ ID NO: 70742 - DNA, 25 bp, Mus musculus
ttggcatggcctgttagtgctcccc

SEQ ID NO: 70743 - DNA, 25 bp, Mus musculus
ttggcattcaagcattccctagacc

SEQ ID NO: 70744 - DNA, 25 bp, Mus musculus
ttggcattgcaaccatctctttagc

SEQ ID NO: 70745 - DNA, 25 bp, Mus musculus
ttggccaaacgggaaactggcacct

SEQ ID NO: 70746 - DNA, 25 bp, Mus musculus
ttggccaatctcctggtcatggtgg

SEQ ID NO: 70747 - DNA, 25 bp, Mus musculus
ttggccaatctcgtggtcatggtgg

SEQ ID NO: 70748 - DNA, 25 bp, Mus musculus
ttggccagcctctggctctagctct

SEQ ID NO: 70749 - DNA, 25 bp, Mus musculus
ttggccagtgtcatcgcagagaaga

SEQ ID NO: 70750 - DNA, 25 bp, Mus musculus
ttggccatgatgaaccccagcctgc

SEQ ID NO: 70751 - DNA, 25 bp, Mus musculus
ttggccccagaacatacagcctcgg

SEQ ID NO: 70752 - DNA, 25 bp, Mus musculus
ttggccggagccattgcccagagta

SEQ ID NO: 70753 - DNA, 25 bp, Mus musculus
ttggccgtttgatgatggagctcca

SEQ ID NO: 70754 - DNA, 25 bp, Mus musculus
ttggcctgccggagcatcccagagt

SEQ ID NO: 70755 - DNA, 25 bp, Mus musculus
ttggcctgctgtcgtttagttgatc

SEQ ID NO: 70756 - DNA, 25 bp, Mus musculus
ttggccttgaacaaagtggacggac

SEQ ID NO: 70757 - DNA, 25 bp, Mus musculus
ttggccttgcgctgggcccgcatac

SEQ ID NO: 70758 - DNA, 25 bp, Mus musculus
ttggcgatttgaaggagctgcagac

SEQ ID NO: 70759 - DNA, 25 bp, Mus musculus
ttggcgctgagctatgacaagagag

SEQ ID NO: 70760 - DNA, 25 bp, Mus musculus
ttggcgggtaactctatcggactct

SEQ ID NO: 70761 - DNA, 25 bp, Mus musculus
ttggcgggtaattctatcgggatat

SEQ ID NO: 70762 - DNA, 25 bp, Mus musculus
ttggcgtcgacgtgctggacagaca

SEQ ID NO: 70763 - DNA, 25 bp, Mus musculus
ttggctatgcgtggtggaccgataa

SEQ ID NO: 70764 - DNA, 25 bp, Mus musculus
ttggctcaggcctggccaaggaact

SEQ ID NO: 70765 - DNA, 25 bp, Mus musculus
ttggctcagtcattcttggtggatt

SEQ ID NO: 70766 - DNA, 25 bp, Mus musculus
ttggctcagtttgaccaggtaaacc

SEQ ID NO: 70767 - DNA, 25 bp, Mus musculus
ttggctcctactaccagagccatgg

SEQ ID NO: 70768 - DNA, 25 bp, Mus musculus
ttggctcctcagcaggatcctccgg

SEQ ID NO: 70769 - DNA, 25 bp, Mus musculus
ttggctcctggacaggcattgcatc

SEQ ID NO: 70770 - DNA, 25 bp, Mus musculus
ttggctctctgatggacgactactt

SEQ ID NO: 70771 - DNA, 25 bp, Mus musculus
ttggctctgagaatgccgctgggcc

SEQ ID NO: 70772 - DNA, 25 bp, Mus musculus
ttggctctgatagtaagcctggccc

SEQ ID NO: 70773 - DNA, 25 bp, Mus musculus
ttggctctggcttggcgctcctagg

SEQ ID NO: 70774 - DNA, 25 bp, Mus musculus
ttggctgagcctgtggagctgagcg

SEQ ID NO: 70775 - DNA, 25 bp, Mus musculus
ttggctgctgacattgacatcgaca

SEQ ID NO: 70776 - DNA, 25 bp, Mus musculus
ttggctggctcccaatcttataacc

SEQ ID NO: 70777 - DNA, 25 bp, Mus musculus
ttggctgggcaagcggaagtggtca

SEQ ID NO: 70778 - DNA, 25 bp, Mus musculus
ttggctgtcatcattggcatcacca

SEQ ID NO: 70779 - DNA, 25 bp, Mus musculus
ttggctgtggcctggctgagttcca

SEQ ID NO: 70780 - DNA, 25 bp, Mus musculus
ttggcttggataaaatgttggtgga

SEQ ID NO: 70781 - DNA, 25 bp, Mus musculus
ttggcttttcccactggtcaacaca

SEQ ID NO: 70782 - DNA, 25 bp, Mus musculus
ttggcttttccctctggtcaacaca

SEQ ID NO: 70783 - DNA, 25 bp, Mus musculus
ttgggaaaatgaaacggaggaagca

SEQ ID NO: 70784 - DNA, 25 bp, Mus musculus
ttgggaaagacgaaagcgtaatcac

SEQ ID NO: 70785 - DNA, 25 bp, Mus musculus
ttgggaaagcaaaactcacatcctg

SEQ ID NO: 70786 - DNA, 25 bp, Mus musculus
ttgggaaagctggtctccatggccg

SEQ ID NO: 70787 - DNA, 25 bp, Mus musculus
ttgggaacaataaaaggacttcagc

SEQ ID NO: 70788 - DNA, 25 bp, Mus musculus
ttgggaacatggagggtgtcattac

SEQ ID NO: 70789 - DNA, 25 bp, Mus musculus
ttgggaagccctaaactcggagcag

SEQ ID NO: 70790 - DNA, 25 bp, Mus musculus
ttgggaaggacattacggagcgcct

SEQ ID NO: 70791 - DNA, 25 bp, Mus musculus
ttgggaagtcgtcgccaacgctgct

SEQ ID NO: 70792 - DNA, 25 bp, Mus musculus
ttgggaagtcgtggccaacgctgct

SEQ ID NO: 70793 - DNA, 25 bp, Mus musculus
ttgggaatggcaagaacagcagtat

SEQ ID NO: 70794 - DNA, 25 bp, Mus musculus
ttgggacactttggaacttgcacag

SEQ ID NO: 70795 - DNA, 25 bp, Mus musculus
ttgggactcgcttcatcattgaaac

SEQ ID NO: 70796 - DNA, 25 bp, Mus musculus
ttgggagaacagaacactgaaaatg

SEQ ID NO: 70797 - DNA, 25 bp, Mus musculus
ttgggagaaggaatcataactgata

SEQ ID NO: 70798 - DNA, 25 bp, Mus musculus
ttgggagcaacaccagccacaacta

SEQ ID NO: 70799 - DNA, 25 bp, Mus musculus
ttgggagtcacacagcactaaggca

SEQ ID NO: 70800 - DNA, 25 bp, Mus musculus
ttgggagtctaatggcccttcacaa

SEQ ID NO: 70801 - DNA, 25 bp, Mus musculus
ttgggatagctatacgacaaataag

SEQ ID NO: 70802 - DNA, 25 bp, Mus musculus
ttgggatctcccctggccagcttgt

SEQ ID NO: 70803 - DNA, 25 bp, Mus musculus
ttgggatgatgaacgacatgatcgg

SEQ ID NO: 70804 - DNA, 25 bp, Mus musculus
ttgggattttctgcccgacaggaag

SEQ ID NO: 70805 - DNA, 25 bp, Mus musculus
ttgggcaagccattgtgtatgtcat

SEQ ID NO: 70806 - DNA, 25 bp, Mus musculus
ttgggcagatgcacagagtcagctg

SEQ ID NO: 70807 - DNA, 25 bp, Mus musculus
ttgggcaggagttggaagaactcac

SEQ ID NO: 70808 - DNA, 25 bp, Mus musculus
ttgggcatgttgtcaggagacctcc

SEQ ID NO: 70809 - DNA, 25 bp, Mus musculus
ttgggccaacttcccaagcagctgg

SEQ ID NO: 70810 - DNA, 25 bp, Mus musculus
ttgggccaacttgccaagcagctgg

SEQ ID NO: 70811 - DNA, 25 bp, Mus musculus
ttgggccgattcacagccccagtct

SEQ ID NO: 70812 - DNA, 25 bp, Mus musculus
ttgggccgccgtcctacttacgtgg

SEQ ID NO: 70813 - DNA, 25 bp, Mus musculus
ttgggcctgacccagtcagagatcg

SEQ ID NO: 70814 - DNA, 25 bp, Mus musculus
ttgggcctgttggaaacttcaactc

SEQ ID NO: 70815 - DNA, 25 bp, Mus musculus
ttgggctatcccatcggtaataagg

SEQ ID NO: 70816 - DNA, 25 bp, Mus musculus
ttgggctatggcatagactatacat

SEQ ID NO: 70817 - DNA, 25 bp, Mus musculus
ttgggctgacttttcttatgctggg

SEQ ID NO: 70818 - DNA, 25 bp, Mus musculus
ttgggctgatgctgggatcctgcat

SEQ ID NO: 70819 - DNA, 25 bp, Mus musculus
ttgggctggtgcaatgtcatgtact

SEQ ID NO: 70820 - DNA, 25 bp, Mus musculus
ttgggctggttggaaatgccacagt

SEQ ID NO: 70821 - DNA, 25 bp, Mus musculus
ttgggcttcaaagacccagagtgag

SEQ ID NO: 70822 - DNA, 25 bp, Mus musculus
ttgggctttgcaaggaaggagattc

SEQ ID NO: 70823 - DNA, 25 bp, Mus musculus
ttgggtaacctggacaacaacagcc

SEQ ID NO: 70824 - DNA, 25 bp, Mus musculus
ttgggtaccaccctgagctcctgga

SEQ ID NO: 70825 - DNA, 25 bp, Mus musculus
ttgggtcccacaaggagcagtgcgc

SEQ ID NO: 70826 - DNA, 25 bp, Mus musculus
ttgggtcccgaagagttcaaagcct

SEQ ID NO: 70827 - DNA, 25 bp, Mus musculus
ttgggtgaaagagcagagagatatt

SEQ ID NO: 70828 - DNA, 25 bp, Mus musculus
ttgggtgcaactgaaagagcaagaa

SEQ ID NO: 70829 - DNA, 25 bp, Mus musculus
ttgggtggaagtcagcacataaacc

SEQ ID NO: 70830 - DNA, 25 bp, Mus musculus
ttgggtgtttgattaagcactggcc

SEQ ID NO: 70831 - DNA, 25 bp, Mus musculus
ttgggttatgatattggcaacgacc

SEQ ID NO: 70832 - DNA, 25 bp, Mus musculus
ttgggttcaggatcagcttgatgac

SEQ ID NO: 70833 - DNA, 25 bp, Mus musculus
ttgggttttagttgatgccagacat

SEQ ID NO: 70834 - DNA, 25 bp, Mus musculus
ttggtaaacatttgaccattcaggg

SEQ ID NO: 70835 - DNA, 25 bp, Mus musculus
ttggtacagaggagtttcaacaaag

SEQ ID NO: 70836 - DNA, 25 bp, Mus musculus
ttggtataccgggaaggagatcagc

SEQ ID NO: 70837 - DNA, 25 bp, Mus musculus
ttggtatcagtcaatcaggaaaaaa

SEQ ID NO: 70838 - DNA, 25 bp, Mus musculus
ttggtcaaacatttcggctgccgag

SEQ ID NO: 70839 - DNA, 25 bp, Mus musculus
ttggtcactgcgaccccaagcgctg

SEQ ID NO: 70840 - DNA, 25 bp, Mus musculus
ttggtcatcacatccacaccagcct

SEQ ID NO: 70841 - DNA, 25 bp, Mus musculus
ttggtccaccctttaaacacacaca

SEQ ID NO: 70842 - DNA, 25 bp, Mus musculus
ttggtccagtttcccttgtgggaat

SEQ ID NO: 70843 - DNA, 25 bp, Mus musculus
ttggtccatgtctcctctaggtcag

SEQ ID NO: 70844 - DNA, 25 bp, Mus musculus
ttggtcctaagaatcgttcaattgg

SEQ ID NO: 70845 - DNA, 25 bp, Mus musculus
ttggtcctgaccagagcctgctatc

SEQ ID NO: 70846 - DNA, 25 bp, Mus musculus
ttggtctatacactggctttctctt

SEQ ID NO: 70847 - DNA, 25 bp, Mus musculus
ttggtctccaaaaacgagagattag

SEQ ID NO: 70848 - DNA, 25 bp, Mus musculus
ttggtctcttcatgtatgccaagag

SEQ ID NO: 70849 - DNA, 25 bp, Mus musculus
ttggtcttggtggaaaagcagttgc

SEQ ID NO: 70850 - DNA, 25 bp, Mus musculus
ttggtgacgtcatcaatgcagcggg

SEQ ID NO: 70851 - DNA, 25 bp, Mus musculus
ttggtgagagagatccgacagtaca

SEQ ID NO: 70852 - DNA, 25 bp, Mus musculus
ttggtgagccacctactgaggagca

SEQ ID NO: 70853 - DNA, 25 bp, Mus musculus
ttggtgagccacgtactgaggagca

SEQ ID NO: 70854 - DNA, 25 bp, Mus musculus
ttggtgatcatgctaatatgttccc

SEQ ID NO: 70855 - DNA, 25 bp, Mus musculus
ttggtgcgctacctgttggctaatg

SEQ ID NO: 70856 - DNA, 25 bp, Mus musculus
ttggtgcggctgtcctaaaccctga

SEQ ID NO: 70857 - DNA, 25 bp, Mus musculus
ttggtgctacaccactgacccgagc

SEQ ID NO: 70858 - DNA, 25 bp, Mus musculus
ttggtgctgagcaggaacttcgtgc

SEQ ID NO: 70859 - DNA, 25 bp, Mus musculus
ttggtggcaatcgactctgaagtag

SEQ ID NO: 70860 - DNA, 25 bp, Mus musculus
ttggtggcactgactccaagtacta

SEQ ID NO: 70861 - DNA, 25 bp, Mus musculus
ttggtggccccaaaggacatgacat

SEQ ID NO: 70862 - DNA, 25 bp, Mus musculus
ttggtgggaccagcccagattggcc

SEQ ID NO: 70863 - DNA, 25 bp, Mus musculus
ttggtggtggagtcttccaggctat

SEQ ID NO: 70864 - DNA, 25 bp, Mus musculus
ttggtgtaactataaattccttctg

SEQ ID NO: 70865 - DNA, 25 bp, Mus musculus
ttggtgtaggtataccgacaattaa

SEQ ID NO: 70866 - DNA, 25 bp, Mus musculus
ttggtgtgcagcaactacaccccac

SEQ ID NO: 70867 - DNA, 25 bp, Mus musculus
ttggtgttatgtgaagaccatcggg

SEQ ID NO: 70868 - DNA, 25 bp, Mus musculus
ttggtgttgctgatgtcctggttcg

SEQ ID NO: 70869 - DNA, 25 bp, Mus musculus
ttggtgttggtgttgctgatgtcct

SEQ ID NO: 70870 - DNA, 25 bp, Mus musculus
ttggtgttgtgagcggcccatgaaa

SEQ ID NO: 70871 - DNA, 25 bp, Mus musculus
ttggttatggctagccaatttctcg

SEQ ID NO: 70872 - DNA, 25 bp, Mus musculus
ttggttatggcttgccaatttctcg

SEQ ID NO: 70873 - DNA, 25 bp, Mus musculus
ttggttattgttagactcactgaac

SEQ ID NO: 70874 - DNA, 25 bp, Mus musculus
ttggttcacagggaagtcgcctgga

SEQ ID NO: 70875 - DNA, 25 bp, Mus musculus
ttggttcagctaatgcaccaatgtg

SEQ ID NO: 70876 - DNA, 25 bp, Mus musculus
ttggttctgtgtcgccgcgctcgcc

SEQ ID NO: 70877 - DNA, 25 bp, Mus musculus
ttggttctgtgtggccgcgctcgcc

SEQ ID NO: 70878 - DNA, 25 bp, Mus musculus
ttggttgcatttagtactgagtcac

SEQ ID NO: 70879 - DNA, 25 bp, Mus musculus
ttggttgcccacaggattgacttgg

SEQ ID NO: 70880 - DNA, 25 bp, Mus musculus
ttggttgctccaccccagacaactg

SEQ ID NO: 70881 - DNA, 25 bp, Mus musculus
ttggttttcaagacatggagtgtgt

SEQ ID NO: 70882 - DNA, 25 bp, Mus musculus
ttgtaacaccgcctgagggctctgc

SEQ ID NO: 70883 - DNA, 25 bp, Mus musculus
ttgtaactgtctggccctggatctg

SEQ ID NO: 70884 - DNA, 25 bp, Mus musculus
ttgtaacttggctcattgcctacag

SEQ ID NO: 70885 - DNA, 25 bp, Mus musculus
ttgtaagattgtactccaagccggg

SEQ ID NO: 70886 - DNA, 25 bp, Mus musculus
ttgtaagggctatgcctggatttcc

SEQ ID NO: 70887 - DNA, 25 bp, Mus musculus
ttgtaatgcaccaaccacatgctgg

SEQ ID NO: 70888 - DNA, 25 bp, Mus musculus
ttgtacacacaaatgaccaggccag

SEQ ID NO: 70889 - DNA, 25 bp, Mus musculus
ttgtacatagctcccgtgtgccacc

SEQ ID NO: 70890 - DNA, 25 bp, Mus musculus
ttgtacatgccagatcctaagcaaa

SEQ ID NO: 70891 - DNA, 25 bp, Mus musculus
ttgtaccaaccaagagcttcgggcc

SEQ ID NO: 70892 - DNA, 25 bp, Mus musculus
ttgtaccgcaggacggacggaatga

SEQ ID NO: 70893 - DNA, 25 bp, Mus musculus
ttgtacgaacgagggaactgcagtg

SEQ ID NO: 70894 - DNA, 25 bp, Mus musculus
ttgtactggtttccgcctccgtcct

SEQ ID NO: 70895 - DNA, 25 bp, Mus musculus
ttgtactgtgttcgcagtgacctgg

SEQ ID NO: 70896 - DNA, 25 bp, Mus musculus
ttgtagccctggaagccgctaccac

SEQ ID NO: 70897 - DNA, 25 bp, Mus musculus
ttgtagcggacagcaaagacaagga

SEQ ID NO: 70898 - DNA, 25 bp, Mus musculus
ttgtagctcaaactaacctgctccg

SEQ ID NO: 70899 - DNA, 25 bp, Mus musculus
ttgtagctgttctagacccaccacg

SEQ ID NO: 70900 - DNA, 25 bp, Mus musculus
ttgtaggatacagtctagaaggcac

SEQ ID NO: 70901 - DNA, 25 bp, Mus musculus
ttgtagggccagaaggaatggaaaa

SEQ ID NO: 70902 - DNA, 25 bp, Mus musculus
ttgtaggtgaagtgctaaaacagtt

SEQ ID NO: 70903 - DNA, 25 bp, Mus musculus
ttgtatcatctctccctacctgtag

SEQ ID NO: 70904 - DNA, 25 bp, Mus musculus
ttgtatggcaggtgcctcagccagg

SEQ ID NO: 70905 - DNA, 25 bp, Mus musculus
ttgtcaaaatataaccaagagacca

SEQ ID NO: 70906 - DNA, 25 bp, Mus musculus
ttgtcaaaatattaccaagagacca

SEQ ID NO: 70907 - DNA, 25 bp, Mus musculus
ttgtcaacgggcggccactgccgga

SEQ ID NO: 70908 - DNA, 25 bp, Mus musculus
ttgtcaatgaccgacccttctcgag

SEQ ID NO: 70909 - DNA, 25 bp, Mus musculus
ttgtcacaaatcagctctggacttg

SEQ ID NO: 70910 - DNA, 25 bp, Mus musculus
ttgtcacaggcctagagctgccagc

SEQ ID NO: 70911 - DNA, 25 bp, Mus musculus
ttgtcaccagctcgtctgatccttc

SEQ ID NO: 70912 - DNA, 25 bp, Mus musculus
ttgtcacccgagagagactgctcct

SEQ ID NO: 70913 - DNA, 25 bp, Mus musculus
ttgtcaccgagttcaacctcattga

SEQ ID NO: 70914 - DNA, 25 bp, Mus musculus
ttgtcacctaaatggcatagttcac

SEQ ID NO: 70915 - DNA, 25 bp, Mus musculus
ttgtcactcagtccattaaaatgat

SEQ ID NO: 70916 - DNA, 25 bp, Mus musculus
ttgtcactcagtgcattaaaatgat

SEQ ID NO: 70917 - DNA, 25 bp, Mus musculus
ttgtcactcatctcgcctccttgga

SEQ ID NO: 70918 - DNA, 25 bp, Mus musculus
ttgtcagatgcagacctccgggctg

SEQ ID NO: 70919 - DNA, 25 bp, Mus musculus
ttgtcagccaccagcgtggtgatca

SEQ ID NO: 70920 - DNA, 25 bp, Mus musculus
ttgtcagccacgtggaaggcagtca

SEQ ID NO: 70921 - DNA, 25 bp, Mus musculus
ttgtcagtgagaacaggagcaacca

SEQ ID NO: 70922 - DNA, 25 bp, Mus musculus
ttgtcatcttcatccgctacaagag

SEQ ID NO: 70923 - DNA, 25 bp, Mus musculus
ttgtcatgtgggatagcaaggattg

SEQ ID NO: 70924 - DNA, 25 bp, Mus musculus
ttgtccagggcagcctctctggtgc

SEQ ID NO: 70925 - DNA, 25 bp, Mus musculus
ttgtcccaagcctccagctacaacg

SEQ ID NO: 70926 - DNA, 25 bp, Mus musculus
ttgtcccacacatactgagcacggt

SEQ ID NO: 70927 - DNA, 25 bp, Mus musculus
ttgtcccggaggcagaagcaccgtt

SEQ ID NO: 70928 - DNA, 25 bp, Mus musculus
ttgtcccgggctattgctgagttgg

SEQ ID NO: 70929 - DNA, 25 bp, Mus musculus
ttgtccctgtctcgcacctttgttg

SEQ ID NO: 70930 - DNA, 25 bp, Mus musculus
ttgtccgggttccaggagttcctga

SEQ ID NO: 70931 - DNA, 25 bp, Mus musculus
ttgtcctaggaagaaagggagcgat

SEQ ID NO: 70932 - DNA, 25 bp, Mus musculus
ttgtcctggagtgtcctttttggtg

SEQ ID NO: 70933 - DNA, 25 bp, Mus musculus
ttgtccttttccgagcggctcagtg

SEQ ID NO: 70934 - DNA, 25 bp, Mus musculus
ttgtcgctgtaaatgtgccagcaac

SEQ ID NO: 70935 - DNA, 25 bp, Mus musculus
ttgtcggctatctgggagagagaac

SEQ ID NO: 70936 - DNA, 25 bp, Mus musculus
ttgtcggtagtgatcaggagacgct

SEQ ID NO: 70937 - DNA, 25 bp, Mus musculus
ttgtcggtgatctggcctccgcgga

SEQ ID NO: 70938 - DNA, 25 bp, Mus musculus
ttgtcgtgggcatcctcaactttgc

SEQ ID NO: 70939 - DNA, 25 bp, Mus musculus
ttgtctcaaccgagagaggccagcg

SEQ ID NO: 70940 - DNA, 25 bp, Mus musculus
ttgtctcagctgctggttgagcctc

SEQ ID NO: 70941 - DNA, 25 bp, Mus musculus
ttgtctcagctggtggttgagcctc

SEQ ID NO: 70942 - DNA, 25 bp, Mus musculus
ttgtctcccccagctagactgtgag

SEQ ID NO: 70943 - DNA, 25 bp, Mus musculus
ttgtctccgttacagtcagtttcag

SEQ ID NO: 70944 - DNA, 25 bp, Mus musculus
ttgtctctggaactcgatacaaggg

SEQ ID NO: 70945 - DNA, 25 bp, Mus musculus
ttgtctcttcggagccttggcagtc

SEQ ID NO: 70946 - DNA, 25 bp, Mus musculus
ttgtctgaaggaggacctctccggc

SEQ ID NO: 70947 - DNA, 25 bp, Mus musculus
ttgtctgtacgcctggagcagtgcc

SEQ ID NO: 70948 - DNA, 25 bp, Mus musculus
ttgtctgtggaactccgttgttcaa

SEQ ID NO: 70949 - DNA, 25 bp, Mus musculus
ttgtctgttgatggacttctcagtt

SEQ ID NO: 70950 - DNA, 25 bp, Mus musculus
ttgtcttcctcccttatgccgatga

SEQ ID NO: 70951 - DNA, 25 bp, Mus musculus
ttgtcttgcacaagagagctcagtg

SEQ ID NO: 70952 - DNA, 25 bp, Mus musculus
ttgtctttcatgcatatggagggag

SEQ ID NO: 70953 - DNA, 25 bp, Mus musculus
ttgtgaacacaaggcaccccaagat

SEQ ID NO: 70954 - DNA, 25 bp, Mus musculus
ttgtgaactgttcaggtctccctgc

SEQ ID NO: 70955 - DNA, 25 bp, Mus musculus
ttgtgacaccacatcctcgaaggat

SEQ ID NO: 70956 - DNA, 25 bp, Mus musculus
ttgtgacagaaaagacgaacatact

SEQ ID NO: 70957 - DNA, 25 bp, Mus musculus
ttgtgacatcacaatgctacccaca

SEQ ID NO: 70958 - DNA, 25 bp, Mus musculus
ttgtgaccagctacaccgtggtgga

SEQ ID NO: 70959 - DNA, 25 bp, Mus musculus
ttgtgaccctagaccgggacagcag

SEQ ID NO: 70960 - DNA, 25 bp, Mus musculus
ttgtgaccctttagttcccctaatg

SEQ ID NO: 70961 - DNA, 25 bp, Mus musculus
ttgtgagcagtgtacctctcctccc

SEQ ID NO: 70962 - DNA, 25 bp, Mus musculus
ttgtgagcggccattgagttctagg

SEQ ID NO: 70963 - DNA, 25 bp, Mus musculus
ttgtgagcggcccatgaaaagccaa

SEQ ID NO: 70964 - DNA, 25 bp, Mus musculus
ttgtgagggatctgctggaagtcac

SEQ ID NO: 70965 - DNA, 25 bp, Mus musculus
ttgtgagtgagtgcccaaagacgag

SEQ ID NO: 70966 - DNA, 25 bp, Mus musculus
ttgtgagttctcaccaggaccccag

SEQ ID NO: 70967 - DNA, 25 bp, Mus musculus
ttgtgatctgcgctctgctgcttct

SEQ ID NO: 70968 - DNA, 25 bp, Mus musculus
ttgtgatggcgtgaggcagtgtccc

SEQ ID NO: 70969 - DNA, 25 bp, Mus musculus
ttgtgatggttccaatggctctttc

SEQ ID NO: 70970 - DNA, 25 bp, Mus musculus
ttgtgattcaaaagaccagaagtaa

SEQ ID NO: 70971 - DNA, 25 bp, Mus musculus
ttgtgattcagcaagccatgccttc

SEQ ID NO: 70972 - DNA, 25 bp, Mus musculus
ttgtgcaccgaaaagggaagaccaa

SEQ ID NO: 70973 - DNA, 25 bp, Mus musculus
ttgtgcacttggaagatctttgatg

SEQ ID NO: 70974 - DNA, 25 bp, Mus musculus
ttgtgcagtactacggctgcctgcg

SEQ ID NO: 70975 - DNA, 25 bp, Mus musculus
ttgtgcatggagatagaaaggaaga

SEQ ID NO: 70976 - DNA, 25 bp, Mus musculus
ttgtgccaacaacattgccaatgca

SEQ ID NO: 70977 - DNA, 25 bp, Mus musculus
ttgtgccagccgacgggccaacctt

SEQ ID NO: 70978 - DNA, 25 bp, Mus musculus
ttgtgcctgagatctgagtgagccc

SEQ ID NO: 70979 - DNA, 25 bp, Mus musculus
ttgtgccttggctatgtgggagctt

SEQ ID NO: 70980 - DNA, 25 bp, Mus musculus
ttgtgcgtctgggtgagatcccagt

SEQ ID NO: 70981 - DNA, 25 bp, Mus musculus
ttgtgctacggaagagcgaggcact

SEQ ID NO: 70982 - DNA, 25 bp, Mus musculus
ttgtgctcctcacggcgagtgcctc

SEQ ID NO: 70983 - DNA, 25 bp, Mus musculus
ttgtgctcctcagggcgagtgcctc

SEQ ID NO: 70984 - DNA, 25 bp, Mus musculus
ttgtgctgcatcttaccggcccatc

SEQ ID NO: 70985 - DNA, 25 bp, Mus musculus
ttgtgctgcgctggagacggccggc

SEQ ID NO: 70986 - DNA, 25 bp, Mus musculus
ttgtgctgggccagcacccagtcct

SEQ ID NO: 70987 - DNA, 25 bp, Mus musculus
ttgtgctgggcctgcacccagtcct

SEQ ID NO: 70988 - DNA, 25 bp, Mus musculus
ttgtgctggtagagaccatagctgt

SEQ ID NO: 70989 - DNA, 25 bp, Mus musculus
ttgtggaacgcaggagaaatgtctc

SEQ ID NO: 70990 - DNA, 25 bp, Mus musculus
ttgtggaagccactgctctgcacac

SEQ ID NO: 70991 - DNA, 25 bp, Mus musculus
ttgtggaagtgactggccacgctca

SEQ ID NO: 70992 - DNA, 25 bp, Mus musculus
ttgtggacacaatctttgctttgga

SEQ ID NO: 70993 - DNA, 25 bp, Mus musculus
ttgtggacgagaccccgaagagaca

SEQ ID NO: 70994 - DNA, 25 bp, Mus musculus
ttgtggactgcagatacccctatga

SEQ ID NO: 70995 - DNA, 25 bp, Mus musculus
ttgtggagaagctaaaaggagaact

SEQ ID NO: 70996 - DNA, 25 bp, Mus musculus
ttgtggagccaacaagacgtttgca

SEQ ID NO: 70997 - DNA, 25 bp, Mus musculus
ttgtggatgttgaacctaaggtgaa

SEQ ID NO: 70998 - DNA, 25 bp, Mus musculus
ttgtggcaccgtataagatagagcg

SEQ ID NO: 70999 - DNA, 25 bp, Mus musculus
ttgtggcagctggagatcacttagt

SEQ ID NO: 71000 - DNA, 25 bp, Mus musculus
ttgtggcccatttcactctccctag

SEQ ID NO: 71001 - DNA, 25 bp, Mus musculus
ttgtggccgtcaacctctactttga

SEQ ID NO: 71002 - DNA, 25 bp, Mus musculus
ttgtggccgtcatcctctactttga

SEQ ID NO: 71003 - DNA, 25 bp, Mus musculus
ttgtggcctgaggacaggaatactg

SEQ ID NO: 71004 - DNA, 25 bp, Mus musculus
ttgtgggacctaagacagactagag

SEQ ID NO: 71005 - DNA, 25 bp, Mus musculus
ttgtgggactcctggctcagctgga

SEQ ID NO: 71006 - DNA, 25 bp, Mus musculus
ttgtggtccctcctcacctgggcta

SEQ ID NO: 71007 - DNA, 25 bp, Mus musculus
ttgtggttgtaagccttgcatatgt

SEQ ID NO: 71008 - DNA, 25 bp, Mus musculus
ttgtgtagcctgaccctgaagaagc

SEQ ID NO: 71009 - DNA, 25 bp, Mus musculus
ttgtgtatgagaatgcgaaagaagg

SEQ ID NO: 71010 - DNA, 25 bp, Mus musculus
ttgtgtcactggcaggtacgtgcca

SEQ ID NO: 71011 - DNA, 25 bp, Mus musculus
ttgtgtcggcagttgttgaatatgg

SEQ ID NO: 71012 - DNA, 25 bp, Mus musculus
ttgtgtgactcctgtgaagaaccag

SEQ ID NO: 71013 - DNA, 25 bp, Mus musculus
ttgtgtgcctttgatcagcgctgct

SEQ ID NO: 71014 - DNA, 25 bp, Mus musculus
ttgtgtgcgggctcatccccagctg

SEQ ID NO: 71015 - DNA, 25 bp, Mus musculus
ttgtgttaaggcaaaaggccaagga

SEQ ID NO: 71016 - DNA, 25 bp, Mus musculus
ttgtgttcatggtccggagagcaga

SEQ ID NO: 71017 - DNA, 25 bp, Mus musculus
ttgttaattctaggaggatcacctt

SEQ ID NO: 71018 - DNA, 25 bp, Mus musculus
ttgttacagatcttatagcagtcgg

SEQ ID NO: 71019 - DNA, 25 bp, Mus musculus
ttgttaccacatgctgagccggcca

SEQ ID NO: 71020 - DNA, 25 bp, Mus musculus
ttgttatatgatacagtccagagtg

SEQ ID NO: 71021 - DNA, 25 bp, Mus musculus
ttgttcaggctgtggattatctttg

SEQ ID NO: 71022 - DNA, 25 bp, Mus musculus
ttgttcccaccaagcggcggcgggt

SEQ ID NO: 71023 - DNA, 25 bp, Mus musculus
ttgttcccatatcaagcgtcatctg

SEQ ID NO: 71024 - DNA, 25 bp, Mus musculus
ttgttccctggtttgtggtggagca

SEQ ID NO: 71025 - DNA, 25 bp, Mus musculus
ttgttcctagcgttctgcatcatgc

SEQ ID NO: 71026 - DNA, 25 bp, Mus musculus
ttgttcctaggtggacacaccactg

SEQ ID NO: 71027 - DNA, 25 bp, Mus musculus
ttgttcctgtaacctaggactcggg

SEQ ID NO: 71028 - DNA, 25 bp, Mus musculus
ttgttcggacatcggcttgggccca

SEQ ID NO: 71029 - DNA, 25 bp, Mus musculus
ttgttctaccctgttaacagcacag

SEQ ID NO: 71030 - DNA, 25 bp, Mus musculus
ttgttctataaaggcatccgccctg

SEQ ID NO: 71031 - DNA, 25 bp, Mus musculus
ttgttctgttttctctcatcgtggg

SEQ ID NO: 71032 - DNA, 25 bp, Mus musculus
ttgttctttgtaccgtgaacctggt

SEQ ID NO: 71033 - DNA, 25 bp, Mus musculus
ttgttgacagaaacattgacctggc

SEQ ID NO: 71034 - DNA, 25 bp, Mus musculus
ttgttgaggaccaggaagtgtgcaa

SEQ ID NO: 71035 - DNA, 25 bp, Mus musculus
ttgttgctcagcactccatggacag

SEQ ID NO: 71036 - DNA, 25 bp, Mus musculus
ttgttgctcagctctccatggacag

SEQ ID NO: 71037 - DNA, 25 bp, Mus musculus
ttgttggaaatgaccttcacggtcc

SEQ ID NO: 71038 - DNA, 25 bp, Mus musculus
ttgttggataaaagcaagactctac

SEQ ID NO: 71039 - DNA, 25 bp, Mus musculus
ttgttggctacctggagaaaactga

SEQ ID NO: 71040 - DNA, 25 bp, Mus musculus
ttgtttacccagagcctttggaaag

SEQ ID NO: 71041 - DNA, 25 bp, Mus musculus
ttgtttactgttgccgggagacacc

SEQ ID NO: 71042 - DNA, 25 bp, Mus musculus
ttgtttcttccagcgcggtgtctgc

SEQ ID NO: 71043 - DNA, 25 bp, Mus musculus
ttgtttgagaaccagctgctgcaga

SEQ ID NO: 71044 - DNA, 25 bp, Mus musculus
ttgttttgaagaacacctggccaaa

SEQ ID NO: 71045 - DNA, 25 bp, Mus musculus
ttgttttggccgttacgattgcacg

SEQ ID NO: 71046 - DNA, 25 bp, Mus musculus
tttaaaaaatcaaagtcgcaccctg

SEQ ID NO: 71047 - DNA, 25 bp, Mus musculus
tttaaaaacagacctacagatggcc

SEQ ID NO: 71048 - DNA, 25 bp, Mus musculus
tttaaaaaggaagtgagcccctgtg

SEQ ID NO: 71049 - DNA, 25 bp, Mus musculus
tttaaaactcaccacgagatgaaag

SEQ ID NO: 71050 - DNA, 25 bp, Mus musculus
tttaaaagagaggttgccaccgtcg

SEQ ID NO: 71051 - DNA, 25 bp, Mus musculus
tttaaaagataaaccagaaggcagc

SEQ ID NO: 71052 - DNA, 25 bp, Mus musculus
tttaaaagatgcctcgaagaagaag

SEQ ID NO: 71053 - DNA, 25 bp, Mus musculus
tttaaaagcaaaactctgctgggca

SEQ ID NO: 71054 - DNA, 25 bp, Mus musculus
tttaaaagcatcgatggaaaccggc

SEQ ID NO: 71055 - DNA, 25 bp, Mus musculus
tttaaaaggctttgtgaaagctgga

SEQ ID NO: 71056 - DNA, 25 bp, Mus musculus
tttaaaagtaaacaggacactcctg

SEQ ID NO: 71057 - DNA, 25 bp, Mus musculus
tttaaaattcagctggagcccttaa

SEQ ID NO: 71058 - DNA, 25 bp, Mus musculus
tttaaagaactgttgaagacgaagg

SEQ ID NO: 71059 - DNA, 25 bp, Mus musculus
tttaaagcaagactgagaaatgcat

SEQ ID NO: 71060 - DNA, 25 bp, Mus musculus
tttaaagccagccatatcctcattt

SEQ ID NO: 71061 - DNA, 25 bp, Mus musculus
tttaaaggctgcagaaaacttcacc

SEQ ID NO: 71062 - DNA, 25 bp, Mus musculus
tttaaatcagcgaaaccaatggtgt

SEQ ID NO: 71063 - DNA, 25 bp, Mus musculus
tttaaattggcctgcgtgacccgcc

SEQ ID NO: 71064 - DNA, 25 bp, Mus musculus
tttaacaagctacatatccccggcc

SEQ ID NO: 71065 - DNA, 25 bp, Mus musculus
tttaacaatcacaatgaggccattg

SEQ ID NO: 71066 - DNA, 25 bp, Mus musculus
tttaacactcacagaccagactctg

SEQ ID NO: 71067 - DNA, 25 bp, Mus musculus
tttaacagtgcgttccatttgtggc

SEQ ID NO: 71068 - DNA, 25 bp, Mus musculus
tttaaccatgcacacaaggtggcca

SEQ ID NO: 71069 - DNA, 25 bp, Mus musculus
tttaaccgctccacctctgacatgg

SEQ ID NO: 71070 - DNA, 25 bp, Mus musculus
tttaaccgctcctcctctgacatgg

SEQ ID NO: 71071 - DNA, 25 bp, Mus musculus
tttaactgcgagagcaagcctgagc

SEQ ID NO: 71072 - DNA, 25 bp, Mus musculus
tttaactggactcactggagtgtgg

SEQ ID NO: 71073 - DNA, 25 bp, Mus musculus
tttaagaaagcctttgctgagctct

SEQ ID NO: 71074 - DNA, 25 bp, Mus musculus
tttaagaaatgcagatcaccattca

SEQ ID NO: 71075 - DNA, 25 bp, Mus musculus
tttaagacaccttctgaccatgaag

SEQ ID NO: 71076 - DNA, 25 bp, Mus musculus
tttaagcaacagcagccagtcagag

SEQ ID NO: 71077 - DNA, 25 bp, Mus musculus
tttaagctcgactacagccgggacc

SEQ ID NO: 71078 - DNA, 25 bp, Mus musculus
tttaagctcgacttcggcaatttcc

SEQ ID NO: 71079 - DNA, 25 bp, Mus musculus
tttaaggaaggctttgtggctgtgc

SEQ ID NO: 71080 - DNA, 25 bp, Mus musculus
tttaaggaggcagaaactttcccat

SEQ ID NO: 71081 - DNA, 25 bp, Mus musculus
tttaaggatgaaaggtgccagcaac

SEQ ID NO: 71082 - DNA, 25 bp, Mus musculus
tttaagtccagaacagcctatttgc

SEQ ID NO: 71083 - DNA, 25 bp, Mus musculus
tttaagtcttgaacaaacaatgctg

SEQ ID NO: 71084 - DNA, 25 bp, Mus musculus
tttaataaacaacagcttctcttcc

SEQ ID NO: 71085 - DNA, 25 bp, Mus musculus
tttaatgaagagcttgggaaccctt

SEQ ID NO: 71086 - DNA, 25 bp, Mus musculus
tttaatgacaccgaaactaatctgg

SEQ ID NO: 71087 - DNA, 25 bp, Mus musculus
tttaatgcagccgataaagtcaact

SEQ ID NO: 71088 - DNA, 25 bp, Mus musculus
tttaatgggatttgtggccagagtc

SEQ ID NO: 71089 - DNA, 25 bp, Mus musculus
tttaatgttgccaaatgctgccagc

SEQ ID NO: 71090 - DNA, 25 bp, Mus musculus
tttaattgtgccaacaacattgcca

SEQ ID NO: 71091 - DNA, 25 bp, Mus musculus
tttacaagccctctgggctcgacgg

SEQ ID NO: 71092 - DNA, 25 bp, Mus musculus
tttacacaacagagttttgggacgc

SEQ ID NO: 71093 - DNA, 25 bp, Mus musculus
tttacacaagtcctcaactagggaa

SEQ ID NO: 71094 - DNA, 25 bp, Mus musculus
tttacacacggacacatgggatatg

SEQ ID NO: 71095 - DNA, 25 bp, Mus musculus
tttacacatcgggaaggcttcccag

SEQ ID NO: 71096 - DNA, 25 bp, Mus musculus
tttacactagccaaaagaggagaga

SEQ ID NO: 71097 - DNA, 25 bp, Mus musculus
tttacagagccaaccagggacacag

SEQ ID NO: 71098 - DNA, 25 bp, Mus musculus
tttacagcagccacaggaagaagag

SEQ ID NO: 71099 - DNA, 25 bp, Mus musculus
tttacatctcacataccctcggaag

SEQ ID NO: 71100 - DNA, 25 bp, Mus musculus
tttacatggaatgggcttaaggctc

SEQ ID NO: 71101 - DNA, 25 bp, Mus musculus
tttaccactcggcacaaattttaca

SEQ ID NO: 71102 - DNA, 25 bp, Mus musculus
tttaccatgaagaacgcagcaacgg

SEQ ID NO: 71103 - DNA, 25 bp, Mus musculus
tttaccccagacatggcctttgaaa

SEQ ID NO: 71104 - DNA, 25 bp, Mus musculus
tttacctggattctttatgaccttc

SEQ ID NO: 71105 - DNA, 25 bp, Mus musculus
tttaccttatgagcctcccaggaga

SEQ ID NO: 71106 - DNA, 25 bp, Mus musculus
tttacgaacattctcagacgaatct

SEQ ID NO: 71107 - DNA, 25 bp, Mus musculus
tttacgatgggataatgagacagac

SEQ ID NO: 71108 - DNA, 25 bp, Mus musculus
tttacgccccgcagaagaagttcgc

SEQ ID NO: 71109 - DNA, 25 bp, Mus musculus
tttacgtgttgctggtgatcgaacc

SEQ ID NO: 71110 - DNA, 25 bp, Mus musculus
tttacgttacaagagcgacaaatgc

SEQ ID NO: 71111 - DNA, 25 bp, Mus musculus
tttactaagcatcgtctttcagcta

SEQ ID NO: 71112 - DNA, 25 bp, Mus musculus
tttactagtccagtatggagtggtg

SEQ ID NO: 71113 - DNA, 25 bp, Mus musculus
tttactctgaacaaagagccatccg

SEQ ID NO: 71114 - DNA, 25 bp, Mus musculus
tttactctgtaatctgaagcctgca

SEQ ID NO: 71115 - DNA, 25 bp, Mus musculus
tttactgagaaggtgacggccaacc

SEQ ID NO: 71116 - DNA, 25 bp, Mus musculus
tttactgccttaatgggaatgttta

SEQ ID NO: 71117 - DNA, 25 bp, Mus musculus
tttactggctcacaccacatggccg

SEQ ID NO: 71118 - DNA, 25 bp, Mus musculus
tttagaaaaatgagatggtcccagc

SEQ ID NO: 71119 - DNA, 25 bp, Mus musculus
tttagaaaactgtggacggctactg

SEQ ID NO: 71120 - DNA, 25 bp, Mus musculus
tttagaaaggaaaactcatcatacc

SEQ ID NO: 71121 - DNA, 25 bp, Mus musculus
tttagaccaagaccaaagaattgtt

SEQ ID NO: 71122 - DNA, 25 bp, Mus musculus
tttagaccaagagcaaagaattgtt

SEQ ID NO: 71123 - DNA, 25 bp, Mus musculus
tttagactgccgtctgcacttaaca

SEQ ID NO: 71124 - DNA, 25 bp, Mus musculus
tttagagaaacccaacactggcagc

SEQ ID NO: 71125 - DNA, 25 bp, Mus musculus
tttagagacaagcactccagagaac

SEQ ID NO: 71126 - DNA, 25 bp, Mus musculus
tttagagcgaaaaatatctatgcga

SEQ ID NO: 71127 - DNA, 25 bp, Mus musculus
tttagataaccaacaacagtgatgc

SEQ ID NO: 71128 - DNA, 25 bp, Mus musculus
tttagcacagcacgtacagctagtc

SEQ ID NO: 71129 - DNA, 25 bp, Mus musculus
tttagcagggactgaagaacacctc

SEQ ID NO: 71130 - DNA, 25 bp, Mus musculus
tttagccctcagtgctgtgacccag

SEQ ID NO: 71131 - DNA, 25 bp, Mus musculus
tttagccctcgatgtcccggagacc

SEQ ID NO: 71132 - DNA, 25 bp, Mus musculus
tttagccttcagaagaggatctggg

SEQ ID NO: 71133 - DNA, 25 bp, Mus musculus
tttagcttcagacatttcagaggac

SEQ ID NO: 71134 - DNA, 25 bp, Mus musculus
tttaggacactgcatttactcaaac

SEQ ID NO: 71135 - DNA, 25 bp, Mus musculus
tttagggaggagttagatgccctca

SEQ ID NO: 71136 - DNA, 25 bp, Mus musculus
tttagggcagatgaaagttttaact

SEQ ID NO: 71137 - DNA, 25 bp, Mus musculus
tttagggctatcacctccaccctgg

SEQ ID NO: 71138 - DNA, 25 bp, Mus musculus
tttagggtagccaggagtgagtcct

SEQ ID NO: 71139 - DNA, 25 bp, Mus musculus
tttagtactgagtcaccacagaaga

SEQ ID NO: 71140 - DNA, 25 bp, Mus musculus
tttagtagcctgttggtccgcacac

SEQ ID NO: 71141 - DNA, 25 bp, Mus musculus
tttagtagtcgatacccttttgact

SEQ ID NO: 71142 - DNA, 25 bp, Mus musculus
tttagtcactctacagaaacccatg

SEQ ID NO: 71143 - DNA, 25 bp, Mus musculus
tttagtgaatcagagggatctgcat

SEQ ID NO: 71144 - DNA, 25 bp, Mus musculus
tttagttctgctgatctcatccatg

SEQ ID NO: 71145 - DNA, 25 bp, Mus musculus
tttagttggaaagaattgggacatg

SEQ ID NO: 71146 - DNA, 25 bp, Mus musculus
tttataagaatcgtgaacctgtcag

SEQ ID NO: 71147 - DNA, 25 bp, Mus musculus
tttataagacgagaggtggcggaca

SEQ ID NO: 71148 - DNA, 25 bp, Mus musculus
tttatagactttcccaagcctctgg

SEQ ID NO: 71149 - DNA, 25 bp, Mus musculus
tttatagatatcaacgaatgccgtc

SEQ ID NO: 71150 - DNA, 25 bp, Mus musculus
tttatagatatctacgaatgccgtc

SEQ ID NO: 71151 - DNA, 25 bp, Mus musculus
tttatagctgcagtgttgatcttga

SEQ ID NO: 71152 - DNA, 25 bp, Mus musculus
tttatccagtgttcaggatgtcgag

SEQ ID NO: 71153 - DNA, 25 bp, Mus musculus
tttatccctaccttgctgaatcagg

SEQ ID NO: 71154 - DNA, 25 bp, Mus musculus
tttatccctttaccaagttgagaca

SEQ ID NO: 71155 - DNA, 25 bp, Mus musculus
tttatccctttagcaagttgagaca

SEQ ID NO: 71156 - DNA, 25 bp, Mus musculus
tttatcctatgcaccagcagcgatg

SEQ ID NO: 71157 - DNA, 25 bp, Mus musculus
tttatcgccatccttgctgctggag

SEQ ID NO: 71158 - DNA, 25 bp, Mus musculus
tttatcggaggccaaaacttgcaca

SEQ ID NO: 71159 - DNA, 25 bp, Mus musculus
tttatcgtgagtaacatccagctgt

SEQ ID NO: 71160 - DNA, 25 bp, Mus musculus
tttatctcaagtctcaactgaactg

SEQ ID NO: 71161 - DNA, 25 bp, Mus musculus
tttatctccggcatcctggcagcct

SEQ ID NO: 71162 - DNA, 25 bp, Mus musculus
tttatctgagcaggctggacctctg

SEQ ID NO: 71163 - DNA, 25 bp, Mus musculus
tttatctgcagtaggttcccttgag

SEQ ID NO: 71164 - DNA, 25 bp, Mus musculus
tttatctggaagaaatgatcctccc

SEQ ID NO: 71165 - DNA, 25 bp, Mus musculus
tttatcttccaattgcaaatgtggc

SEQ ID NO: 71166 - DNA, 25 bp, Mus musculus
tttatcttgccacatcagcaggttg

SEQ ID NO: 71167 - DNA, 25 bp, Mus musculus
tttatgaagtgggtcctgggcccgg

SEQ ID NO: 71168 - DNA, 25 bp, Mus musculus
tttatgactgtgaaggactcggcct

SEQ ID NO: 71169 - DNA, 25 bp, Mus musculus
tttatgatcacaggtggaagtctcc

SEQ ID NO: 71170 - DNA, 25 bp, Mus musculus
tttatgctctacattacgagcgcca

SEQ ID NO: 71171 - DNA, 25 bp, Mus musculus
tttatgctttcccagaccgccagta

SEQ ID NO: 71172 - DNA, 25 bp, Mus musculus
tttatggccacgctgtatctgagaa

SEQ ID NO: 71173 - DNA, 25 bp, Mus musculus
tttatggtaaccgagctctctgttt

SEQ ID NO: 71174 - DNA, 25 bp, Mus musculus
tttatggtaccttctggactcttgt

SEQ ID NO: 71175 - DNA, 25 bp, Mus musculus
tttatgtccaggagtcctgcacagc

SEQ ID NO: 71176 - DNA, 25 bp, Mus musculus
tttatgtccaggtgtcctgcacagc

SEQ ID NO: 71177 - DNA, 25 bp, Mus musculus
tttatgtccagtcaaagcatgaagc

SEQ ID NO: 71178 - DNA, 25 bp, Mus musculus
tttatgtgctatgtgcccagcccgg

SEQ ID NO: 71179 - DNA, 25 bp, Mus musculus
tttattaaccttgcaagaactcttc

SEQ ID NO: 71180 - DNA, 25 bp, Mus musculus
tttattacaccagagccattgaata

SEQ ID NO: 71181 - DNA, 25 bp, Mus musculus
tttattacttgaaggccaacctggc

SEQ ID NO: 71182 - DNA, 25 bp, Mus musculus
tttattacttgatggccaacctggc

SEQ ID NO: 71183 - DNA, 25 bp, Mus musculus
tttattcagaggcatgccagcacac

SEQ ID NO: 71184 - DNA, 25 bp, Mus musculus
tttattcagccgacaccaggatggt

SEQ ID NO: 71185 - DNA, 25 bp, Mus musculus
tttattcgcagtggcatggatggtg

SEQ ID NO: 71186 - DNA, 25 bp, Mus musculus
tttattcgccattatctggcagagg

SEQ ID NO: 71187 - DNA, 25 bp, Mus musculus
tttattgaaactcgccaggatggtg

SEQ ID NO: 71188 - DNA, 25 bp, Mus musculus
tttatttcgttcatccaacattccg

SEQ ID NO: 71189 - DNA, 25 bp, Mus musculus
tttatttggtctcaagctgttccgt

SEQ ID NO: 71190 - DNA, 25 bp, Mus musculus
tttcaaaaggcattcagatcatgac

SEQ ID NO: 71191 - DNA, 25 bp, Mus musculus
tttcaaacctttgtgggccaggaat

SEQ ID NO: 71192 - DNA, 25 bp, Mus musculus
tttcaaactcgggaagtcgaatcgt

SEQ ID NO: 71193 - DNA, 25 bp, Mus musculus
tttcaaagactgtggcaagattgca

SEQ ID NO: 71194 - DNA, 25 bp, Mus musculus
tttcaaagggagcttcgttactcac

SEQ ID NO: 71195 - DNA, 25 bp, Mus musculus
tttcaaagtagcacccatgccacgt

SEQ ID NO: 71196 - DNA, 25 bp, Mus musculus
tttcaaagtcctggcgacgaagtgt

SEQ ID NO: 71197 - DNA, 25 bp, Mus musculus
tttcaacagttttcttcataccgca

SEQ ID NO: 71198 - DNA, 25 bp, Mus musculus
tttcaagacatggagtgtgtgccct

SEQ ID NO: 71199 - DNA, 25 bp, Mus musculus
tttcaagccccgatatctttgactc

SEQ ID NO: 71200 - DNA, 25 bp, Mus musculus
tttcaagggagtcaaccatacatgt

SEQ ID NO: 71201 - DNA, 25 bp, Mus musculus
tttcacaaatcttcgaaggactcct

SEQ ID NO: 71202 - DNA, 25 bp, Mus musculus
tttcacaacgctccacaaggaccag

SEQ ID NO: 71203 - DNA, 25 bp, Mus musculus
tttcacaagtttgtggctcctgaag

SEQ ID NO: 71204 - DNA, 25 bp, Mus musculus
tttcacacgtcccaatgagaaggga

SEQ ID NO: 71205 - DNA, 25 bp, Mus musculus
tttcacagcagacaccagcgaggac

SEQ ID NO: 71206 - DNA, 25 bp, Mus musculus
tttcacagcagagaccagcgaggac

SEQ ID NO: 71207 - DNA, 25 bp, Mus musculus
tttcaccaagagcttccctcaggac

SEQ ID NO: 71208 - DNA, 25 bp, Mus musculus
tttcacctatctggataagcgtagc

SEQ ID NO: 71209 - DNA, 25 bp, Mus musculus
tttcacctcagtgggctgtactctg

SEQ ID NO: 71210 - DNA, 25 bp, Mus musculus
tttcacgggccaatgagtttactca

SEQ ID NO: 71211 - DNA, 25 bp, Mus musculus
tttcacgggccattgagtttactca

SEQ ID NO: 71212 - DNA, 25 bp, Mus musculus
tttcactcttcaccagtgaccaaag

SEQ ID NO: 71213 - DNA, 25 bp, Mus musculus
tttcactgggcacaaacacactggt

SEQ ID NO: 71214 - DNA, 25 bp, Mus musculus
tttcactgggcagaaacacactggt

SEQ ID NO: 71215 - DNA, 25 bp, Mus musculus
tttcagaaatatagaggcctcaaga

SEQ ID NO: 71216 - DNA, 25 bp, Mus musculus
tttcagaggaaagggtctgctgagc

SEQ ID NO: 71217 - DNA, 25 bp, Mus musculus
tttcagaggcagttcaagttgaatc

SEQ ID NO: 71218 - DNA, 25 bp, Mus musculus
tttcagagggccaactgctcacaca

SEQ ID NO: 71219 - DNA, 25 bp, Mus musculus
tttcagatagaagctttgcccagtt

SEQ ID NO: 71220 - DNA, 25 bp, Mus musculus
tttcagatgaaagactgttccagag

SEQ ID NO: 71221 - DNA, 25 bp, Mus musculus
tttcagattcttggctctatcacag

SEQ ID NO: 71222 - DNA, 25 bp, Mus musculus
tttcagcagcatcacagactccact

SEQ ID NO: 71223 - DNA, 25 bp, Mus musculus
tttcagcagcttaagtgggactcac

SEQ ID NO: 71224 - DNA, 25 bp, Mus musculus
tttcagcagtcagctcagatctcca

SEQ ID NO: 71225 - DNA, 25 bp, Mus musculus
tttcagcattgacctctttaaagag

SEQ ID NO: 71226 - DNA, 25 bp, Mus musculus
tttcagccagacgacgaagtggtcg

SEQ ID NO: 71227 - DNA, 25 bp, Mus musculus
tttcagccccataaaccctgagtgt

SEQ ID NO: 71228 - DNA, 25 bp, Mus musculus
tttcagccctcttgtgcaggaccat

SEQ ID NO: 71229 - DNA, 25 bp, Mus musculus
tttcagcccttccagacagacacat

SEQ ID NO: 71230 - DNA, 25 bp, Mus musculus
tttcagctccccacaaaaacagaag

SEQ ID NO: 71231 - DNA, 25 bp, Mus musculus
tttcagctcccctcaaaaacagaag

SEQ ID NO: 71232 - DNA, 25 bp, Mus musculus
tttcagctctgctccataccctgag

SEQ ID NO: 71233 - DNA, 25 bp, Mus musculus
tttcaggcaggtgtcaccataccca

SEQ ID NO: 71234 - DNA, 25 bp, Mus musculus
tttcaggcatttgcagggctgatga

SEQ ID NO: 71235 - DNA, 25 bp, Mus musculus
tttcaggcctacttggatgactgtc

SEQ ID NO: 71236 - DNA, 25 bp, Mus musculus
tttcagggacacgtgctgatcctgc

SEQ ID NO: 71237 - DNA, 25 bp, Mus musculus
tttcaggtcagagtttcttccgggc

SEQ ID NO: 71238 - DNA, 25 bp, Mus musculus
tttcagtcgatgacggcccatggga

SEQ ID NO: 71239 - DNA, 25 bp, Mus musculus
tttcagtggcctgcaagttattcca

SEQ ID NO: 71240 - DNA, 25 bp, Mus musculus
tttcagttaccttgacgatgtccca

SEQ ID NO: 71241 - DNA, 25 bp, Mus musculus
tttcataaacaagattttgcctcag

SEQ ID NO: 71242 - DNA, 25 bp, Mus musculus
tttcatatccagatcaccagagaag

SEQ ID NO: 71243 - DNA, 25 bp, Mus musculus
tttcatcaaggtgggccagcacctg

SEQ ID NO: 71244 - DNA, 25 bp, Mus musculus
tttcatccactaaagtttgcagctc

SEQ ID NO: 71245 - DNA, 25 bp, Mus musculus
tttcatcccctgacctatgaaggtg

SEQ ID NO: 71246 - DNA, 25 bp, Mus musculus
tttcatccctcattatcatcatggg

SEQ ID NO: 71247 - DNA, 25 bp, Mus musculus
tttcatgcagattgaggctcttttc

SEQ ID NO: 71248 - DNA, 25 bp, Mus musculus
tttcatggatcgctgggtgccctga

SEQ ID NO: 71249 - DNA, 25 bp, Mus musculus
tttcatggatgcctgccctcgtaag

SEQ ID NO: 71250 - DNA, 25 bp, Mus musculus
tttcatggcgtccacacctgagcct

SEQ ID NO: 71251 - DNA, 25 bp, Mus musculus
tttcatggttgagaggaaggacccc

SEQ ID NO: 71252 - DNA, 25 bp, Mus musculus
tttcatttgctgtctcctcaaacac

SEQ ID NO: 71253 - DNA, 25 bp, Mus musculus
tttccaaagggagatctccgttgct

SEQ ID NO: 71254 - DNA, 25 bp, Mus musculus
tttccaaagtatctggacctgttat

SEQ ID NO: 71255 - DNA, 25 bp, Mus musculus
tttccaacagaagagccagccattg

SEQ ID NO: 71256 - DNA, 25 bp, Mus musculus
tttccaagaccaggcatctatattg

SEQ ID NO: 71257 - DNA, 25 bp, Mus musculus
tttccaagcagaatacggactttcc

SEQ ID NO: 71258 - DNA, 25 bp, Mus musculus
tttccaagtgggaggagtctgttct

SEQ ID NO: 71259 - DNA, 25 bp, Mus musculus
tttccacacaggcattcgaagaccc

SEQ ID NO: 71260 - DNA, 25 bp, Mus musculus
tttccaccatagaaaaggactctaa

SEQ ID NO: 71261 - DNA, 25 bp, Mus musculus
tttccactgggtgtcccagtgccta

SEQ ID NO: 71262 - DNA, 25 bp, Mus musculus
tttccagactccaaactatcatgtc

SEQ ID NO: 71263 - DNA, 25 bp, Mus musculus
tttccagaggaagaactgtgcagtg

SEQ ID NO: 71264 - DNA, 25 bp, Mus musculus
tttccaggcacttgggctagtgggc

SEQ ID NO: 71265 - DNA, 25 bp, Mus musculus
tttccaggccaaccaatccacattg

SEQ ID NO: 71266 - DNA, 25 bp, Mus musculus
tttccaggccaagcaatccacattg

SEQ ID NO: 71267 - DNA, 25 bp, Mus musculus
tttccagtatgtgggcgcctctgct

SEQ ID NO: 71268 - DNA, 25 bp, Mus musculus
tttccataatgcaacaatgtgacag

SEQ ID NO: 71269 - DNA, 25 bp, Mus musculus
tttccatagcatccaaccccagtat

SEQ ID NO: 71270 - DNA, 25 bp, Mus musculus
tttccatatatcctggttctgcctc

SEQ ID NO: 71271 - DNA, 25 bp, Mus musculus
tttccatccaggaattggaactccg

SEQ ID NO: 71272 - DNA, 25 bp, Mus musculus
tttccatccggataggtagcactgg

SEQ ID NO: 71273 - DNA, 25 bp, Mus musculus
tttccatcgtgtgggaagaacggag

SEQ ID NO: 71274 - DNA, 25 bp, Mus musculus
tttccatctctgaccacaggagtgg

SEQ ID NO: 71275 - DNA, 25 bp, Mus musculus
tttccatcttctcattacctgccaa

SEQ ID NO: 71276 - DNA, 25 bp, Mus musculus
tttccattgagaataaggtggttcc

SEQ ID NO: 71277 - DNA, 25 bp, Mus musculus
tttccattgatgaatcggaaaatgc

SEQ ID NO: 71278 - DNA, 25 bp, Mus musculus
tttccattgcccaagtccattctca

SEQ ID NO: 71279 - DNA, 25 bp, Mus musculus
tttcccagcctggtgtcaagatgct

SEQ ID NO: 71280 - DNA, 25 bp, Mus musculus
tttcccagctgacccgaggcaagct

SEQ ID NO: 71281 - DNA, 25 bp, Mus musculus
tttccccatatgagagcgagccttg

SEQ ID NO: 71282 - DNA, 25 bp, Mus musculus
tttccccgtggtccagttctgtgcg

SEQ ID NO: 71283 - DNA, 25 bp, Mus musculus
tttccccgtggtgcagttctgtgcg

SEQ ID NO: 71284 - DNA, 25 bp, Mus musculus
tttcccctggatccaagaagttggt

SEQ ID NO: 71285 - DNA, 25 bp, Mus musculus
tttcccgtggacaaccttagagcct

SEQ ID NO: 71286 - DNA, 25 bp, Mus musculus
tttccctcagggtgttcgtgaatgc

SEQ ID NO: 71287 - DNA, 25 bp, Mus musculus
tttccctcatgcagcccatggatag

SEQ ID NO: 71288 - DNA, 25 bp, Mus musculus
tttccctgcgaaggtgaccagacgg

SEQ ID NO: 71289 - DNA, 25 bp, Mus musculus
tttccctggataaacgtagaaggag

SEQ ID NO: 71290 - DNA, 25 bp, Mus musculus
tttccctggtctgtgatggttcacg

SEQ ID NO: 71291 - DNA, 25 bp, Mus musculus
tttccctgtacagcagagactctgg

SEQ ID NO: 71292 - DNA, 25 bp, Mus musculus
tttccctttcttctcccgctggtgg

SEQ ID NO: 71293 - DNA, 25 bp, Mus musculus
tttccgaagctcctgttcatggaga

SEQ ID NO: 71294 - DNA, 25 bp, Mus musculus
tttccgacgacagaagcaatatcct

SEQ ID NO: 71295 - DNA, 25 bp, Mus musculus
tttccgctgtgtccccatctttggc

SEQ ID NO: 71296 - DNA, 25 bp, Mus musculus
tttccggaagtgcatcgggaagccc

SEQ ID NO: 71297 - DNA, 25 bp, Mus musculus
tttccggaatcatgccgcccatgta

SEQ ID NO: 71298 - DNA, 25 bp, Mus musculus
tttccggaatggacggaagctgacg

SEQ ID NO: 71299 - DNA, 25 bp, Mus musculus
tttccggagaatcctgttagctgag

SEQ ID NO: 71300 - DNA, 25 bp, Mus musculus
tttccggagcttcccacacttctgg

SEQ ID NO: 71301 - DNA, 25 bp, Mus musculus
tttccggatttaacactcacagacc

SEQ ID NO: 71302 - DNA, 25 bp, Mus musculus
tttccgtagatttccagtggcccca

SEQ ID NO: 71303 - DNA, 25 bp, Mus musculus
tttccgtatcagttcatggactctc

SEQ ID NO: 71304 - DNA, 25 bp, Mus musculus
tttccgtcacataaacctcgtggag

SEQ ID NO: 71305 - DNA, 25 bp, Mus musculus
tttccgtggacgatcgccttaagca

SEQ ID NO: 71306 - DNA, 25 bp, Mus musculus
tttccgtggccgcaaggctgacttc

SEQ ID NO: 71307 - DNA, 25 bp, Mus musculus
tttcctaccaaatgcagcccaaaat

SEQ ID NO: 71308 - DNA, 25 bp, Mus musculus
tttcctatcccagagagttttgtca

SEQ ID NO: 71309 - DNA, 25 bp, Mus musculus
tttcctatttggaccaagtaccact

SEQ ID NO: 71310 - DNA, 25 bp, Mus musculus
tttcctcaagggagcaacggtggct

SEQ ID NO: 71311 - DNA, 25 bp, Mus musculus
tttcctcagagtctatgaacaccag

SEQ ID NO: 71312 - DNA, 25 bp, Mus musculus
tttcctccaacccatcaattgatga

SEQ ID NO: 71313 - DNA, 25 bp, Mus musculus
tttcctccatgcagcagttcaagtc

SEQ ID NO: 71314 - DNA, 25 bp, Mus musculus
tttcctgagcttcctgaggagggca

SEQ ID NO: 71315 - DNA, 25 bp, Mus musculus
tttcctgatccaattcaaagacggg

SEQ ID NO: 71316 - DNA, 25 bp, Mus musculus
tttcctgcaatacagtggatacagt

SEQ ID NO: 71317 - DNA, 25 bp, Mus musculus
tttcctgcgtctacagaggtctgtg

SEQ ID NO: 71318 - DNA, 25 bp, Mus musculus
tttcctgggcgaaggcgaggcgttg

SEQ ID NO: 71319 - DNA, 25 bp, Mus musculus
tttcctggtctctgaaggctgcact

SEQ ID NO: 71320 - DNA, 25 bp, Mus musculus
tttcctgtactctattaaccagacg

SEQ ID NO: 71321 - DNA, 25 bp, Mus musculus
tttcctgtggcctataacctcatca

SEQ ID NO: 71322 - DNA, 25 bp, Mus musculus
tttcctgttaacaccacgactctgg

SEQ ID NO: 71323 - DNA, 25 bp, Mus musculus
tttccttagcggcagagcctggccc

SEQ ID NO: 71324 - DNA, 25 bp, Mus musculus
tttccttcacggattgggagataca

SEQ ID NO: 71325 - DNA, 25 bp, Mus musculus
tttccttctagatcgacttctgcag

SEQ ID NO: 71326 - DNA, 25 bp, Mus musculus
tttccttgagcaagttccagttaaa

SEQ ID NO: 71327 - DNA, 25 bp, Mus musculus
tttccttgcctgctatgccatggtc

SEQ ID NO: 71328 - DNA, 25 bp, Mus musculus
tttccttgccttgaagatctgcatg

SEQ ID NO: 71329 - DNA, 25 bp, Mus musculus
tttccttgtggtactctggactgca

SEQ ID NO: 71330 - DNA, 25 bp, Mus musculus
tttcctttgataaggatgccatggt

SEQ ID NO: 71331 - DNA, 25 bp, Mus musculus
tttcgaacaccacggcaagtagctg

SEQ ID NO: 71332 - DNA, 25 bp, Mus musculus
tttcgacggcatgaggcatctgtgg

SEQ ID NO: 71333 - DNA, 25 bp, Mus musculus
tttcgagagttcacccgtcctgagg

SEQ ID NO: 71334 - DNA, 25 bp, Mus musculus
tttcgagatcaaaaacaagaaagga

SEQ ID NO: 71335 - DNA, 25 bp, Mus musculus
tttcgagcaacagatcatggatctg

SEQ ID NO: 71336 - DNA, 25 bp, Mus musculus
tttcgaggccgaataccgacttggc

SEQ ID NO: 71337 - DNA, 25 bp, Mus musculus
tttcgcatggcccaatgatggcgcc

SEQ ID NO: 71338 - DNA, 25 bp, Mus musculus
tttcgcatttccagcgtcccatgag

SEQ ID NO: 71339 - DNA, 25 bp, Mus musculus
tttcgccaccgttctccgagcaggt

SEQ ID NO: 71340 - DNA, 25 bp, Mus musculus
tttcgccctgtgcttagtggcctta

SEQ ID NO: 71341 - DNA, 25 bp, Mus musculus
tttcgcctgcagctggacacttgcc

SEQ ID NO: 71342 - DNA, 25 bp, Mus musculus
tttcgctcaaagtcgctgtgtcatg

SEQ ID NO: 71343 - DNA, 25 bp, Mus musculus
tttcgctcatggacttcctgtttcc

SEQ ID NO: 71344 - DNA, 25 bp, Mus musculus
tttcgctgggcgtgctcaagaggca

SEQ ID NO: 71345 - DNA, 25 bp, Mus musculus
tttcggaagcggagccatgttgcac

SEQ ID NO: 71346 - DNA, 25 bp, Mus musculus
tttcggagtgctcctatggaccaag

SEQ ID NO: 71347 - DNA, 25 bp, Mus musculus
tttcggataagggattatggacctg

SEQ ID NO: 71348 - DNA, 25 bp, Mus musculus
tttcggatatcatcgcccttctcac

SEQ ID NO: 71349 - DNA, 25 bp, Mus musculus
tttcggcgaatcttgaacgtgacac

SEQ ID NO: 71350 - DNA, 25 bp, Mus musculus
tttcgggaaacttcgactctgttgg

SEQ ID NO: 71351 - DNA, 25 bp, Mus musculus
tttcgggtcaatgtcattcatgcac

SEQ ID NO: 71352 - DNA, 25 bp, Mus musculus
tttcgtaagctcaggaatttccact

SEQ ID NO: 71353 - DNA, 25 bp, Mus musculus
tttcgtgaacagacaccttctgaga

SEQ ID NO: 71354 - DNA, 25 bp, Mus musculus
tttcgttcatccaacattccgttca

SEQ ID NO: 71355 - DNA, 25 bp, Mus musculus
tttctaaaggccaagctccatgtga

SEQ ID NO: 71356 - DNA, 25 bp, Mus musculus
tttctaacgagcgtaatgctggagc

SEQ ID NO: 71357 - DNA, 25 bp, Mus musculus
tttctaacttcctaatccatctggg

SEQ ID NO: 71358 - DNA, 25 bp, Mus musculus
tttctaaggaatccaaaatgctaca

SEQ ID NO: 71359 - DNA, 25 bp, Mus musculus
tttctacaaacaacccttcgctgac

SEQ ID NO: 71360 - DNA, 25 bp, Mus musculus
tttctacaagctaatgatcagcagg

SEQ ID NO: 71361 - DNA, 25 bp, Mus musculus
tttctacctcttgtcatctgccagt

SEQ ID NO: 71362 - DNA, 25 bp, Mus musculus
tttctacgtggaaatgaaatgggag

SEQ ID NO: 71363 - DNA, 25 bp, Mus musculus
tttctagagctgagtctcagagcag

SEQ ID NO: 71364 - DNA, 25 bp, Mus musculus
tttctagcgcatgagaagatctggt

SEQ ID NO: 71365 - DNA, 25 bp, Mus musculus
tttctagtatggaaggctgcctgcc

SEQ ID NO: 71366 - DNA, 25 bp, Mus musculus
tttctagtatggtaggctgcctgcc

SEQ ID NO: 71367 - DNA, 25 bp, Mus musculus
tttctatgattgtttcaggccaaat

SEQ ID NO: 71368 - DNA, 25 bp, Mus musculus
tttctattactcttccggtaccgtg

SEQ ID NO: 71369 - DNA, 25 bp, Mus musculus
tttctattgttctgaccgccaaaga

SEQ ID NO: 71370 - DNA, 25 bp, Mus musculus
tttctcaaccggcacggcagcttgc

SEQ ID NO: 71371 - DNA, 25 bp, Mus musculus
tttctcaagggaggagtcgtttgaa

SEQ ID NO: 71372 - DNA, 25 bp, Mus musculus
tttctcacacgcagatgaacactgg

SEQ ID NO: 71373 - DNA, 25 bp, Mus musculus
tttctcagtgaagaggaggtacccg

SEQ ID NO: 71374 - DNA, 25 bp, Mus musculus
tttctcatcagttaagtacaagagc

SEQ ID NO: 71375 - DNA, 25 bp, Mus musculus
tttctcatgatgcacccctggtaca

SEQ ID NO: 71376 - DNA, 25 bp, Mus musculus
tttctccacctaccatgtgctagga

SEQ ID NO: 71377 - DNA, 25 bp, Mus musculus
tttctcccgactcagcctacataat

SEQ ID NO: 71378 - DNA, 25 bp, Mus musculus
tttctccctccggtggttgcaggag

SEQ ID NO: 71379 - DNA, 25 bp, Mus musculus
tttctccgaattcattaagtgcatc

SEQ ID NO: 71380 - DNA, 25 bp, Mus musculus
tttctccggctgtctgaccgcacgg

SEQ ID NO: 71381 - DNA, 25 bp, Mus musculus
tttctcctcatctatacagtgtcac

SEQ ID NO: 71382 - DNA, 25 bp, Mus musculus
tttctcctgggcttcagtgaccagt

SEQ ID NO: 71383 - DNA, 25 bp, Mus musculus
tttctccttattaccggacaaagct

SEQ ID NO: 71384 - DNA, 25 bp, Mus musculus
tttctctaagctgaaggtggagatc

SEQ ID NO: 71385 - DNA, 25 bp, Mus musculus
tttctctatggagggctttgggaca

SEQ ID NO: 71386 - DNA, 25 bp, Mus musculus
tttctctctactgtaggaggagctg

SEQ ID NO: 71387 - DNA, 25 bp, Mus musculus
tttctctcttgatgcaaacctctct

SEQ ID NO: 71388 - DNA, 25 bp, Mus musculus
tttctctgccattgggaaagtcctg

SEQ ID NO: 71389 - DNA, 25 bp, Mus musculus
tttctctgcctggtggcagctggac

SEQ ID NO: 71390 - DNA, 25 bp, Mus musculus
tttctcttctcttctatggcctcta

SEQ ID NO: 71391 - DNA, 25 bp, Mus musculus
tttctcttggaattgggctgctaac

SEQ ID NO: 71392 - DNA, 25 bp, Mus musculus
tttctgaagacacttcgggctggcc

SEQ ID NO: 71393 - DNA, 25 bp, Mus musculus
tttctgaccgagcaggcggtgttcc

SEQ ID NO: 71394 - DNA, 25 bp, Mus musculus
tttctgaccgaggaggcggtgttcc

SEQ ID NO: 71395 - DNA, 25 bp, Mus musculus
tttctgacggctttaaattcatgaa

SEQ ID NO: 71396 - DNA, 25 bp, Mus musculus
tttctgagacagtcattacatctgt

SEQ ID NO: 71397 - DNA, 25 bp, Mus musculus
tttctgaggatcaatggctttccca

SEQ ID NO: 71398 - DNA, 25 bp, Mus musculus
tttctgaggatctatggctttccca

SEQ ID NO: 71399 - DNA, 25 bp, Mus musculus
tttctgagggtcaggatccaggcat

SEQ ID NO: 71400 - DNA, 25 bp, Mus musculus
tttctgattggctgtgcaccctgca

SEQ ID NO: 71401 - DNA, 25 bp, Mus musculus
tttctgcacctgctgccggaggcgt

SEQ ID NO: 71402 - DNA, 25 bp, Mus musculus
tttctgcagcagttgggttagagga

SEQ ID NO: 71403 - DNA, 25 bp, Mus musculus
tttctgcattaactactacccactg

SEQ ID NO: 71404 - DNA, 25 bp, Mus musculus
tttctgccaggctgcccaactacac

SEQ ID NO: 71405 - DNA, 25 bp, Mus musculus
tttctgcccgacaggaaggggacct

SEQ ID NO: 71406 - DNA, 25 bp, Mus musculus
tttctgcccttttgcggctctggac

SEQ ID NO: 71407 - DNA, 25 bp, Mus musculus
tttctgcctttaaagtggctcagag

SEQ ID NO: 71408 - DNA, 25 bp, Mus musculus
tttctgctacttctaggaaggaatg

SEQ ID NO: 71409 - DNA, 25 bp, Mus musculus
tttctgctagcagccaggactcctg

SEQ ID NO: 71410 - DNA, 25 bp, Mus musculus
tttctgctataacctgctgcggagc

SEQ ID NO: 71411 - DNA, 25 bp, Mus musculus
tttctgctctacctggatcctcact

SEQ ID NO: 71412 - DNA, 25 bp, Mus musculus
tttctgctgctggtagggatttaaa

SEQ ID NO: 71413 - DNA, 25 bp, Mus musculus
tttctgctgttaatgaggtcatggt

SEQ ID NO: 71414 - DNA, 25 bp, Mus musculus
tttctgcttctggtgtgttgaggtg

SEQ ID NO: 71415 - DNA, 25 bp, Mus musculus
tttctgctttaaggaattggaaggc

SEQ ID NO: 71416 - DNA, 25 bp, Mus musculus
tttctggaatacctgtcctccctgg

SEQ ID NO: 71417 - DNA, 25 bp, Mus musculus
tttctggagagcagcatgtcaaggg

SEQ ID NO: 71418 - DNA, 25 bp, Mus musculus
tttctggatatgtccgccatcggcc

SEQ ID NO: 71419 - DNA, 25 bp, Mus musculus
tttctggatgctggaacctaggata

SEQ ID NO: 71420 - DNA, 25 bp, Mus musculus
tttctggcaagagaaaatgctgggc

SEQ ID NO: 71421 - DNA, 25 bp, Mus musculus
tttctggcacaaaacaaactatgtt

SEQ ID NO: 71422 - DNA, 25 bp, Mus musculus
tttctggctttcaaggagatgttcc

SEQ ID NO: 71423 - DNA, 25 bp, Mus musculus
tttctggtctcccctccaagcagat

SEQ ID NO: 71424 - DNA, 25 bp, Mus musculus
tttctgtccacaggggccagcgatg

SEQ ID NO: 71425 - DNA, 25 bp, Mus musculus
tttctgtcccattctgttccccagg

SEQ ID NO: 71426 - DNA, 25 bp, Mus musculus
tttctgtggtcttgcccgtcttggg

SEQ ID NO: 71427 - DNA, 25 bp, Mus musculus
tttctgtgttacagtgccctggttc

SEQ ID NO: 71428 - DNA, 25 bp, Mus musculus
tttcttacagctcctgggtctacct

SEQ ID NO: 71429 - DNA, 25 bp, Mus musculus
tttcttcaaagccagagatgatttt

SEQ ID NO: 71430 - DNA, 25 bp, Mus musculus
tttcttcaaagcgagagatgatttt

SEQ ID NO: 71431 - DNA, 25 bp, Mus musculus
tttcttccacctggaccatggtcag

SEQ ID NO: 71432 - DNA, 25 bp, Mus musculus
tttcttccgtgtggtagatagaggg

SEQ ID NO: 71433 - DNA, 25 bp, Mus musculus
tttcttcgggatcatcttcacctct

SEQ ID NO: 71434 - DNA, 25 bp, Mus musculus
tttcttctcctgagagatctgctca

SEQ ID NO: 71435 - DNA, 25 bp, Mus musculus
tttcttctctgggaaagccgaagac

SEQ ID NO: 71436 - DNA, 25 bp, Mus musculus
tttcttctggagagtggagccaatg

SEQ ID NO: 71437 - DNA, 25 bp, Mus musculus
tttcttgacccctgggtgttttgca

SEQ ID NO: 71438 - DNA, 25 bp, Mus musculus
tttcttgcgggcctgccagatagcc

SEQ ID NO: 71439 - DNA, 25 bp, Mus musculus
tttcttgcgtggacaggaacagctc

SEQ ID NO: 71440 - DNA, 25 bp, Mus musculus
tttcttggaaggaaggcaagactgg

SEQ ID NO: 71441 - DNA, 25 bp, Mus musculus
tttcttggaaggtaggcaagactgg

SEQ ID NO: 71442 - DNA, 25 bp, Mus musculus
tttcttggatctccggcttggagca

SEQ ID NO: 71443 - DNA, 25 bp, Mus musculus
tttcttgggtttctgaagtcgtcct

SEQ ID NO: 71444 - DNA, 25 bp, Mus musculus
tttcttggtccctcctgagaaatct

SEQ ID NO: 71445 - DNA, 25 bp, Mus musculus
tttcttgtgtaaaccagagctgtcc

SEQ ID NO: 71446 - DNA, 25 bp, Mus musculus
tttcttgtgtaatccagagctgtcc

SEQ ID NO: 71447 - DNA, 25 bp, Mus musculus
tttcttgttacctccagctcaccag

SEQ ID NO: 71448 - DNA, 25 bp, Mus musculus
tttctttacacaacagagttttggg

SEQ ID NO: 71449 - DNA, 25 bp, Mus musculus
tttctttagggggagccttagctgg

SEQ ID NO: 71450 - DNA, 25 bp, Mus musculus
tttctttgagaaggtatttctgtcc

SEQ ID NO: 71451 - DNA, 25 bp, Mus musculus
tttctttgagtaaacaagtagtgga

SEQ ID NO: 71452 - DNA, 25 bp, Mus musculus
tttctttggtcttgctcctggctgg

SEQ ID NO: 71453 - DNA, 25 bp, Mus musculus
tttcttttaggaagagcaccatatc

SEQ ID NO: 71454 - DNA, 25 bp, Mus musculus
tttgaaaaacaatttgaactgtcag

SEQ ID NO: 71455 - DNA, 25 bp, Mus musculus
tttgaaaaagcagtgaaagaagacg

SEQ ID NO: 71456 - DNA, 25 bp, Mus musculus
tttgaaaagataagccaagactgat

SEQ ID NO: 71457 - DNA, 25 bp, Mus musculus
tttgaaaagtctagaaattgaagaa

SEQ ID NO: 71458 - DNA, 25 bp, Mus musculus
tttgaaaatccagtctgggaatctg

SEQ ID NO: 71459 - DNA, 25 bp, Mus musculus
tttgaaacatttcaaggcacctgga

SEQ ID NO: 71460 - DNA, 25 bp, Mus musculus
tttgaaacatttgaaggcacctgga

SEQ ID NO: 71461 - DNA, 25 bp, Mus musculus
tttgaaacttacaaattgaaaggct

SEQ ID NO: 71462 - DNA, 25 bp, Mus musculus
tttgaaaggaccactaacttctggg

SEQ ID NO: 71463 - DNA, 25 bp, Mus musculus
tttgaaatcctgtcatgcagtgtcc

SEQ ID NO: 71464 - DNA, 25 bp, Mus musculus
tttgaacaacaaggagacagggatg

SEQ ID NO: 71465 - DNA, 25 bp, Mus musculus
tttgaacactgtctgccaggcactg

SEQ ID NO: 71466 - DNA, 25 bp, Mus musculus
tttgaacagcctgtggccgtcttcc

SEQ ID NO: 71467 - DNA, 25 bp, Mus musculus
tttgaaccagatgcaatatctcagc

SEQ ID NO: 71468 - DNA, 25 bp, Mus musculus
tttgaacgcctagttggttgaactg

SEQ ID NO: 71469 - DNA, 25 bp, Mus musculus
tttgaacggaacttggacttctggc

SEQ ID NO: 71470 - DNA, 25 bp, Mus musculus
tttgaactgaatcacctttcccacg

SEQ ID NO: 71471 - DNA, 25 bp, Mus musculus
tttgaactggaagtttctgggaagg

SEQ ID NO: 71472 - DNA, 25 bp, Mus musculus
tttgaagactgagaccatagagttc

SEQ ID NO: 71473 - DNA, 25 bp, Mus musculus
tttgaagagaacgaagtgcctggga

SEQ ID NO: 71474 - DNA, 25 bp, Mus musculus
tttgaagaggatggagtcccagtcc

SEQ ID NO: 71475 - DNA, 25 bp, Mus musculus
tttgaagatggtcagcccgtgcagc

SEQ ID NO: 71476 - DNA, 25 bp, Mus musculus
tttgaagattctacgtgcctcaagg

SEQ ID NO: 71477 - DNA, 25 bp, Mus musculus
tttgaagctcagaagaaacttttac

SEQ ID NO: 71478 - DNA, 25 bp, Mus musculus
tttgaagcttatggccaaacagaat

SEQ ID NO: 71479 - DNA, 25 bp, Mus musculus
tttgaaggaaggaactgtgaattag

SEQ ID NO: 71480 - DNA, 25 bp, Mus musculus
tttgaaggagctgcagacactagac

SEQ ID NO: 71481 - DNA, 25 bp, Mus musculus
tttgaaggctactgggtggacaacg

SEQ ID NO: 71482 - DNA, 25 bp, Mus musculus
tttgaaggctccattgcaagcaagg

SEQ ID NO: 71483 - DNA, 25 bp, Mus musculus
tttgaaggctgagtcaacgggcaga

SEQ ID NO: 71484 - DNA, 25 bp, Mus musculus
tttgaaggtgcagtcatagctctgt

SEQ ID NO: 71485 - DNA, 25 bp, Mus musculus
tttgaagtctctgaggtcccagcct

SEQ ID NO: 71486 - DNA, 25 bp, Mus musculus
tttgaagttatgtgcgccaggcccc

SEQ ID NO: 71487 - DNA, 25 bp, Mus musculus
tttgaagttgctggagagggagccc

SEQ ID NO: 71488 - DNA, 25 bp, Mus musculus
tttgaataaaccctgtcaaatggcg

SEQ ID NO: 71489 - DNA, 25 bp, Mus musculus
tttgaatatgaatcaccagaacatg

SEQ ID NO: 71490 - DNA, 25 bp, Mus musculus
tttgaatcgaaggaaagcaacacag

SEQ ID NO: 71491 - DNA, 25 bp, Mus musculus
tttgaatgccatttgcctggagagg

SEQ ID NO: 71492 - DNA, 25 bp, Mus musculus
tttgaatgtgtgcagatcatccctg

SEQ ID NO: 71493 - DNA, 25 bp, Mus musculus
tttgacaacgtgtggagcaaggctg

SEQ ID NO: 71494 - DNA, 25 bp, Mus musculus
tttgacaataaagcgcacagtgggc

SEQ ID NO: 71495 - DNA, 25 bp, Mus musculus
tttgacacaatgcagcaagagctac

SEQ ID NO: 71496 - DNA, 25 bp, Mus musculus
tttgacacagcaatccaggaaatcc

SEQ ID NO: 71497 - DNA, 25 bp, Mus musculus
tttgacactggtgacgaccgcctct

SEQ ID NO: 71498 - DNA, 25 bp, Mus musculus
tttgacagaataaaagggtccctgc

SEQ ID NO: 71499 - DNA, 25 bp, Mus musculus
tttgacagcggcctcaaaacggagg

SEQ ID NO: 71500 - DNA, 25 bp, Mus musculus
tttgacagctgctgaagcccagaag

SEQ ID NO: 71501 - DNA, 25 bp, Mus musculus
tttgacaggcacaagccagattgag

SEQ ID NO: 71502 - DNA, 25 bp, Mus musculus
tttgacatcgaactgctggagcttg

SEQ ID NO: 71503 - DNA, 25 bp, Mus musculus
tttgacatctcagttgattccaagg

SEQ ID NO: 71504 - DNA, 25 bp, Mus musculus
tttgacatgtcaacggaacctgtct

SEQ ID NO: 71505 - DNA, 25 bp, Mus musculus
tttgaccaagagcagatccttcacc

SEQ ID NO: 71506 - DNA, 25 bp, Mus musculus
tttgaccacacagttgtagtatggg

SEQ ID NO: 71507 - DNA, 25 bp, Mus musculus
tttgacccatcatgcctgttccctg

SEQ ID NO: 71508 - DNA, 25 bp, Mus musculus
tttgaccctgccaacaacaacgaac

SEQ ID NO: 71509 - DNA, 25 bp, Mus musculus
tttgacctcatagatcattctgact

SEQ ID NO: 71510 - DNA, 25 bp, Mus musculus
tttgacctctcgctcttcgtggctc

SEQ ID NO: 71511 - DNA, 25 bp, Mus musculus
tttgacctgcctgaggagcaccaga

SEQ ID NO: 71512 - DNA, 25 bp, Mus musculus
tttgacctggcctggcagtatgggc

SEQ ID NO: 71513 - DNA, 25 bp, Mus musculus
tttgacctggtggaccggagtctga

SEQ ID NO: 71514 - DNA, 25 bp, Mus musculus
tttgacctggtgtgtgatcgaaaga

SEQ ID NO: 71515 - DNA, 25 bp, Mus musculus
tttgacggagctacacgagatgatg

SEQ ID NO: 71516 - DNA, 25 bp, Mus musculus
tttgacgtggacaagaaaaatggtt

SEQ ID NO: 71517 - DNA, 25 bp, Mus musculus
tttgacgtggagaccaaggtgtgcc

SEQ ID NO: 71518 - DNA, 25 bp, Mus musculus
tttgactcaatcacacctaagggag

SEQ ID NO: 71519 - DNA, 25 bp, Mus musculus
tttgactgcaactccatctccacag

SEQ ID NO: 71520 - DNA, 25 bp, Mus musculus
tttgactggaacacgcccaagaaag

SEQ ID NO: 71521 - DNA, 25 bp, Mus musculus
tttgactggccagccgcctgcattg

SEQ ID NO: 71522 - DNA, 25 bp, Mus musculus
tttgagaacaatagctgggtcttca

SEQ ID NO: 71523 - DNA, 25 bp, Mus musculus
tttgagacacaatctgcatcctact

SEQ ID NO: 71524 - DNA, 25 bp, Mus musculus
tttgagacactctgctcggagctga

SEQ ID NO: 71525 - DNA, 25 bp, Mus musculus
tttgagacccgcaagggcctgtcca

SEQ ID NO: 71526 - DNA, 25 bp, Mus musculus
tttgagacgctgcacaacctagtcc

SEQ ID NO: 71527 - DNA, 25 bp, Mus musculus
tttgagagtgctgctgaagtcctcc

SEQ ID NO: 71528 - DNA, 25 bp, Mus musculus
tttgagatcaattcttggagaacac

SEQ ID NO: 71529 - DNA, 25 bp, Mus musculus
tttgagatcacaggcccaggatgct

SEQ ID NO: 71530 - DNA, 25 bp, Mus musculus
tttgagcagccaagatcctgccttt

SEQ ID NO: 71531 - DNA, 25 bp, Mus musculus
tttgagcagtggtcagagtctgatc

SEQ ID NO: 71532 - DNA, 25 bp, Mus musculus
tttgagctctcgtgcccgcagtctg

SEQ ID NO: 71533 - DNA, 25 bp, Mus musculus
tttgagctgcccctgactagagtta

SEQ ID NO: 71534 - DNA, 25 bp, Mus musculus
tttgagcttcaacatggcctcgctg

SEQ ID NO: 71535 - DNA, 25 bp, Mus musculus
tttgaggaaacagtggccaaggtgc

SEQ ID NO: 71536 - DNA, 25 bp, Mus musculus
tttgaggaaacagtttacagtcatc

SEQ ID NO: 71537 - DNA, 25 bp, Mus musculus
tttgaggaaccttacccaggcagtt

SEQ ID NO: 71538 - DNA, 25 bp, Mus musculus
tttgaggaagaatgcctggagtttc

SEQ ID NO: 71539 - DNA, 25 bp, Mus musculus
tttgaggaggataacaaaggcctgg

SEQ ID NO: 71540 - DNA, 25 bp, Mus musculus
tttgaggataaacgaagccaggctc

SEQ ID NO: 71541 - DNA, 25 bp, Mus musculus
tttgaggataaaggaagccaggctc

SEQ ID NO: 71542 - DNA, 25 bp, Mus musculus
tttgaggatgtggaaatggaaccgt

SEQ ID NO: 71543 - DNA, 25 bp, Mus musculus
tttgaggccatcaactcacagttga

SEQ ID NO: 71544 - DNA, 25 bp, Mus musculus
tttgaggctcgggacctagagctgc

SEQ ID NO: 71545 - DNA, 25 bp, Mus musculus
tttgaggtaccaagagctactgctg

SEQ ID NO: 71546 - DNA, 25 bp, Mus musculus
tttgagtatattcgagaccagaagg

SEQ ID NO: 71547 - DNA, 25 bp, Mus musculus
tttgagtatattggagaccagaagg

SEQ ID NO: 71548 - DNA, 25 bp, Mus musculus
tttgagtgaactaagcaaggaagga

SEQ ID NO: 71549 - DNA, 25 bp, Mus musculus
tttgagtgctatccaccaggcatga

SEQ ID NO: 71550 - DNA, 25 bp, Mus musculus
tttgagtggcttcgaagtgaactag

SEQ ID NO: 71551 - DNA, 25 bp, Mus musculus
tttgagtttatattcacaaacctgg

SEQ ID NO: 71552 - DNA, 25 bp, Mus musculus
tttgataaaactctgaaagtgtggg

SEQ ID NO: 71553 - DNA, 25 bp, Mus musculus
tttgataaagctactaatggaatgg

SEQ ID NO: 71554 - DNA, 25 bp, Mus musculus
tttgataccacacccaatgaacttg

SEQ ID NO: 71555 - DNA, 25 bp, Mus musculus
tttgatactagcgaaattgattcag

SEQ ID NO: 71556 - DNA, 25 bp, Mus musculus
tttgatagagataatgctgatactg

SEQ ID NO: 71557 - DNA, 25 bp, Mus musculus
tttgatagagattatgctgatactg

SEQ ID NO: 71558 - DNA, 25 bp, Mus musculus
tttgatcaagaggaggatacaaagc

SEQ ID NO: 71559 - DNA, 25 bp, Mus musculus
tttgatccagaacttgcagcaacaa

SEQ ID NO: 71560 - DNA, 25 bp, Mus musculus
tttgatctactgtggccggaagcta

SEQ ID NO: 71561 - DNA, 25 bp, Mus musculus
tttgatgaactttacaggcagtgcc

SEQ ID NO: 71562 - DNA, 25 bp, Mus musculus
tttgatgactcctgccttgacccgt

SEQ ID NO: 71563 - DNA, 25 bp, Mus musculus
tttgatgaggactttagcccgaggg

SEQ ID NO: 71564 - DNA, 25 bp, Mus musculus
tttgatgagtacaccatgaccatcc

SEQ ID NO: 71565 - DNA, 25 bp, Mus musculus
tttgatgatcttccgcctgctgcca

SEQ ID NO: 71566 - DNA, 25 bp, Mus musculus
tttgatgatgaagacccagagcctg

SEQ ID NO: 71567 - DNA, 25 bp, Mus musculus
tttgatggaacagactacaaagttc

SEQ ID NO: 71568 - DNA, 25 bp, Mus musculus
tttgatggcagagcccaagatgtct

SEQ ID NO: 71569 - DNA, 25 bp, Mus musculus
tttgatgggcactcacgattgtagc

SEQ ID NO: 71570 - DNA, 25 bp, Mus musculus
tttgatggttctcagcctccagagg

SEQ ID NO: 71571 - DNA, 25 bp, Mus musculus
tttgatgtgcaaaacccagatgacg

SEQ ID NO: 71572 - DNA, 25 bp, Mus musculus
tttgatgtgctcctggattgggttt

SEQ ID NO: 71573 - DNA, 25 bp, Mus musculus
tttgatgttcctatcggttctcgag

SEQ ID NO: 71574 - DNA, 25 bp, Mus musculus
tttgattcttcagacgaagaacctg

SEQ ID NO: 71575 - DNA, 25 bp, Mus musculus
tttgatttccaagcagaatacggac

SEQ ID NO: 71576 - DNA, 25 bp, Mus musculus
tttgatttcgcgaatggcattggca

SEQ ID NO: 71577 - DNA, 25 bp, Mus musculus
tttgcaaagcccaactggtgctgga

SEQ ID NO: 71578 - DNA, 25 bp, Mus musculus
tttgcaagccatctttgcatcccgt

SEQ ID NO: 71579 - DNA, 25 bp, Mus musculus
tttgcaagccatgtttgcatcccgt

SEQ ID NO: 71580 - DNA, 25 bp, Mus musculus
tttgcaagcccatgagcatctcagc

SEQ ID NO: 71581 - DNA, 25 bp, Mus musculus
tttgcaagcctggaaagagcgatgg

SEQ ID NO: 71582 - DNA, 25 bp, Mus musculus
tttgcaaggagctatgatggcgatt

SEQ ID NO: 71583 - DNA, 25 bp, Mus musculus
tttgcaagtgtgcactaagtaagcc

SEQ ID NO: 71584 - DNA, 25 bp, Mus musculus
tttgcacaccggttggtcctcagcc

SEQ ID NO: 71585 - DNA, 25 bp, Mus musculus
tttgcacatccctccgctgactggg

SEQ ID NO: 71586 - DNA, 25 bp, Mus musculus
tttgcacatgtggtggagcagcgct

SEQ ID NO: 71587 - DNA, 25 bp, Mus musculus
tttgcacctcccgagtttcttttgg

SEQ ID NO: 71588 - DNA, 25 bp, Mus musculus
tttgcaccttatgcctgtggttctg

SEQ ID NO: 71589 - DNA, 25 bp, Mus musculus
tttgcagacacgaagtacccatggg

SEQ ID NO: 71590 - DNA, 25 bp, Mus musculus
tttgcagacacgtagtacccatggg

SEQ ID NO: 71591 - DNA, 25 bp, Mus musculus
tttgcagacctgatagtcttgaaga

SEQ ID NO: 71592 - DNA, 25 bp, Mus musculus
tttgcagagcagtccctgatgaaga

SEQ ID NO: 71593 - DNA, 25 bp, Mus musculus
tttgcagatcaaggagatgccccag

SEQ ID NO: 71594 - DNA, 25 bp, Mus musculus
tttgcagcaaatgcccatgctggcc

SEQ ID NO: 71595 - DNA, 25 bp, Mus musculus
tttgcagcacaggttttctctccag

SEQ ID NO: 71596 - DNA, 25 bp, Mus musculus
tttgcagcatcactttttgaaagat

SEQ ID NO: 71597 - DNA, 25 bp, Mus musculus
tttgcagcatcagtttttgaaagat

SEQ ID NO: 71598 - DNA, 25 bp, Mus musculus
tttgcagctacatccacacgatgcc

SEQ ID NO: 71599 - DNA, 25 bp, Mus musculus
tttgcaggaggccacacacgcaatc

SEQ ID NO: 71600 - DNA, 25 bp, Mus musculus
tttgcaggccaacaatagaaggttc

SEQ ID NO: 71601 - DNA, 25 bp, Mus musculus
tttgcaggctttgcgtgttggcaga

SEQ ID NO: 71602 - DNA, 25 bp, Mus musculus
tttgcagtgtagttggccaacaagc

SEQ ID NO: 71603 - DNA, 25 bp, Mus musculus
tttgcatgaaggattccagggaatt

SEQ ID NO: 71604 - DNA, 25 bp, Mus musculus
tttgcatgaaggtttccagggaatt

SEQ ID NO: 71605 - DNA, 25 bp, Mus musculus
tttgcattgaagcaagaaggccaca

SEQ ID NO: 71606 - DNA, 25 bp, Mus musculus
tttgcatttgcaacatgtggtggct

SEQ ID NO: 71607 - DNA, 25 bp, Mus musculus
tttgccaaaaggaaacagacttctc

SEQ ID NO: 71608 - DNA, 25 bp, Mus musculus
tttgccaaacatcctcggcttggct

SEQ ID NO: 71609 - DNA, 25 bp, Mus musculus
tttgccaaagaagaaacgctgcagt

SEQ ID NO: 71610 - DNA, 25 bp, Mus musculus
tttgccaaagaccttgaaatgtttg

SEQ ID NO: 71611 - DNA, 25 bp, Mus musculus
tttgccaacttgtcaatgaaggcct

SEQ ID NO: 71612 - DNA, 25 bp, Mus musculus
tttgccaagatggaccccagctgta

SEQ ID NO: 71613 - DNA, 25 bp, Mus musculus
tttgccaatggattgctgggatgac

SEQ ID NO: 71614 - DNA, 25 bp, Mus musculus
tttgccacaaaatcctctttccagg

SEQ ID NO: 71615 - DNA, 25 bp, Mus musculus
tttgccacatctgaggaacaaactg

SEQ ID NO: 71616 - DNA, 25 bp, Mus musculus
tttgccaccaggcaggtggctagca

SEQ ID NO: 71617 - DNA, 25 bp, Mus musculus
tttgccagataccttcactcagctg

SEQ ID NO: 71618 - DNA, 25 bp, Mus musculus
tttgccagcagactacggtgattct

SEQ ID NO: 71619 - DNA, 25 bp, Mus musculus
tttgccaggcagtacagcaggaatg

SEQ ID NO: 71620 - DNA, 25 bp, Mus musculus
tttgccataattagtcacagccatg

SEQ ID NO: 71621 - DNA, 25 bp, Mus musculus
tttgccataatttgtcacagccatg

SEQ ID NO: 71622 - DNA, 25 bp, Mus musculus
tttgccatccacaaatgcagagctg

SEQ ID NO: 71623 - DNA, 25 bp, Mus musculus
tttgccatcggtcagaggctacgca

SEQ ID NO: 71624 - DNA, 25 bp, Mus musculus
tttgccatgaaacagaggacatgat

SEQ ID NO: 71625 - DNA, 25 bp, Mus musculus
tttgccattgctggaattctctcca

SEQ ID NO: 71626 - DNA, 25 bp, Mus musculus
tttgccattggctctctgatggacg

SEQ ID NO: 71627 - DNA, 25 bp, Mus musculus
tttgcccaccttatagtgctgagga

SEQ ID NO: 71628 - DNA, 25 bp, Mus musculus
tttgcccagggccagagatgatcag

SEQ ID NO: 71629 - DNA, 25 bp, Mus musculus
tttgcccagtttggttctgatttgg

SEQ ID NO: 71630 - DNA, 25 bp, Mus musculus
tttgcccgacgcctgctggaacttg

SEQ ID NO: 71631 - DNA, 25 bp, Mus musculus
tttgcccgagccagaaacgggaaat

SEQ ID NO: 71632 - DNA, 25 bp, Mus musculus
tttgcccgaggaattgctgccagcg

SEQ ID NO: 71633 - DNA, 25 bp, Mus musculus
tttgcccggagactgctgaagagtc

SEQ ID NO: 71634 - DNA, 25 bp, Mus musculus
tttgccctaaggtcaggtgtacgac

SEQ ID NO: 71635 - DNA, 25 bp, Mus musculus
tttgccgacatcctcaacgatgtag

SEQ ID NO: 71636 - DNA, 25 bp, Mus musculus
tttgccgacccagaggatcacagga

SEQ ID NO: 71637 - DNA, 25 bp, Mus musculus
tttgccgccatagaagactaccagc

SEQ ID NO: 71638 - DNA, 25 bp, Mus musculus
tttgccggccgctggtacctgcaga

SEQ ID NO: 71639 - DNA, 25 bp, Mus musculus
tttgccggcgcccatggattgccca

SEQ ID NO: 71640 - DNA, 25 bp, Mus musculus
tttgcctcagtaccgggatgctgtc

SEQ ID NO: 71641 - DNA, 25 bp, Mus musculus
tttgcctcggatggaacaccaacac

SEQ ID NO: 71642 - DNA, 25 bp, Mus musculus
tttgcctgagtctcccttgggtgaa

SEQ ID NO: 71643 - DNA, 25 bp, Mus musculus
tttgcctgtacactggcttcctctt

SEQ ID NO: 71644 - DNA, 25 bp, Mus musculus
tttgccttcactctcagccacagag

SEQ ID NO: 71645 - DNA, 25 bp, Mus musculus
tttgccttcttaccatcaggctcca

SEQ ID NO: 71646 - DNA, 25 bp, Mus musculus
tttgcgagggccctcaagtgtctca

SEQ ID NO: 71647 - DNA, 25 bp, Mus musculus
tttgcgcagtgacccgagacagtct

SEQ ID NO: 71648 - DNA, 25 bp, Mus musculus
tttgcggaagtctgcaatgacccca

SEQ ID NO: 71649 - DNA, 25 bp, Mus musculus
tttgcggagttttatcagcttgtaa

SEQ ID NO: 71650 - DNA, 25 bp, Mus musculus
tttgcggcagcttccttttagagga

SEQ ID NO: 71651 - DNA, 25 bp, Mus musculus
tttgcggctgctggacacctatgta

SEQ ID NO: 71652 - DNA, 25 bp, Mus musculus
tttgcggtatgcagccgcagccaag

SEQ ID NO: 71653 - DNA, 25 bp, Mus musculus
tttgcggtatgctgccgcagccaag

SEQ ID NO: 71654 - DNA, 25 bp, Mus musculus
tttgctaaaaagagacatgaagtcc

SEQ ID NO: 71655 - DNA, 25 bp, Mus musculus
tttgctaagcagtgtaagccgagaa

SEQ ID NO: 71656 - DNA, 25 bp, Mus musculus
tttgctaatggaggtgtggccacca

SEQ ID NO: 71657 - DNA, 25 bp, Mus musculus
tttgctactgcccaccctggctatg

SEQ ID NO: 71658 - DNA, 25 bp, Mus musculus
tttgctagttggcagggtccctttg

SEQ ID NO: 71659 - DNA, 25 bp, Mus musculus
tttgctccctcctgttacaacacag

SEQ ID NO: 71660 - DNA, 25 bp, Mus musculus
tttgctcgagacaaaattcccattg

SEQ ID NO: 71661 - DNA, 25 bp, Mus musculus
tttgctctaggaatctaaagatgaa

SEQ ID NO: 71662 - DNA, 25 bp, Mus musculus
tttgctctcttaaccctgctgcctt

SEQ ID NO: 71663 - DNA, 25 bp, Mus musculus
tttgctgaattcttcccaaaagagg

SEQ ID NO: 71664 - DNA, 25 bp, Mus musculus
tttgctgcaggaggctacatgcccc

SEQ ID NO: 71665 - DNA, 25 bp, Mus musculus
tttgctgcatgctgcatgacaccca

SEQ ID NO: 71666 - DNA, 25 bp, Mus musculus
tttgctgccctgatgagccgctgga

SEQ ID NO: 71667 - DNA, 25 bp, Mus musculus
tttgctgcttattcacaatgaactc

SEQ ID NO: 71668 - DNA, 25 bp, Mus musculus
tttgctggagcaaaaagtacaggaa

SEQ ID NO: 71669 - DNA, 25 bp, Mus musculus
tttgctggatactctgagggaagtc

SEQ ID NO: 71670 - DNA, 25 bp, Mus musculus
tttgctggatgcactgaacacgcag

SEQ ID NO: 71671 - DNA, 25 bp, Mus musculus
tttgctggccgtccagagcaccagt

SEQ ID NO: 71672 - DNA, 25 bp, Mus musculus
tttgctggccgtgcagagcaccagt

SEQ ID NO: 71673 - DNA, 25 bp, Mus musculus
tttgctgggtgccacacgaaaaata

SEQ ID NO: 71674 - DNA, 25 bp, Mus musculus
tttgctgtgagctctgtccccgggt

SEQ ID NO: 71675 - DNA, 25 bp, Mus musculus
tttgctgtggcctggcccagccaga

SEQ ID NO: 71676 - DNA, 25 bp, Mus musculus
tttgctgttgatccccgatttctag

SEQ ID NO: 71677 - DNA, 25 bp, Mus musculus
tttgctgttggtgtgcagcaactac

SEQ ID NO: 71678 - DNA, 25 bp, Mus musculus
tttgcttatgatggactaaaacgtc

SEQ ID NO: 71679 - DNA, 25 bp, Mus musculus
tttgcttcagccctggtacccgata

SEQ ID NO: 71680 - DNA, 25 bp, Mus musculus
tttgcttgcctcttttgacgccatc

SEQ ID NO: 71681 - DNA, 25 bp, Mus musculus
tttggaaacaagcaccgaaatgtca

SEQ ID NO: 71682 - DNA, 25 bp, Mus musculus
tttggaaacaaggaccgaaatgtca

SEQ ID NO: 71683 - DNA, 25 bp, Mus musculus
tttggaaccccagtccatggtgtgg

SEQ ID NO: 71684 - DNA, 25 bp, Mus musculus
tttggaataacatggaacttgaaga

SEQ ID NO: 71685 - DNA, 25 bp, Mus musculus
tttggaatcggcagttgtcagagtc

SEQ ID NO: 71686 - DNA, 25 bp, Mus musculus
tttggaatcttcctgtcctacattg

SEQ ID NO: 71687 - DNA, 25 bp, Mus musculus
tttggaatgaacaggaatcaggcat

SEQ ID NO: 71688 - DNA, 25 bp, Mus musculus
tttggaatgactgtatatcatctgg

SEQ ID NO: 71689 - DNA, 25 bp, Mus musculus
tttggacaagatgtctaagggacac

SEQ ID NO: 71690 - DNA, 25 bp, Mus musculus
tttggacaagcaggggaacaacttc

SEQ ID NO: 71691 - DNA, 25 bp, Mus musculus
tttggacaccaagtactaggttggg

SEQ ID NO: 71692 - DNA, 25 bp, Mus musculus
tttggaccaagtaccactaaatagt

SEQ ID NO: 71693 - DNA, 25 bp, Mus musculus
tttggaccactcaatctggccatgg

SEQ ID NO: 71694 - DNA, 25 bp, Mus musculus
tttggaccagccgttaacccaggca

SEQ ID NO: 71695 - DNA, 25 bp, Mus musculus
tttggactactaccaacaaccagga

SEQ ID NO: 71696 - DNA, 25 bp, Mus musculus
tttggactctcagaaacctttcaga

SEQ ID NO: 71697 - DNA, 25 bp, Mus musculus
tttggacttgtaaacatcgtggccc

SEQ ID NO: 71698 - DNA, 25 bp, Mus musculus
tttggagaaactgcctttgcgattg

SEQ ID NO: 71699 - DNA, 25 bp, Mus musculus
tttggagaagccaccaagcagcctg

SEQ ID NO: 71700 - DNA, 25 bp, Mus musculus
tttggagaagcccacccagtgtcca

SEQ ID NO: 71701 - DNA, 25 bp, Mus musculus
tttggagacggctgttttccagact

SEQ ID NO: 71702 - DNA, 25 bp, Mus musculus
tttggagagtctgcccagtgcttag

SEQ ID NO: 71703 - DNA, 25 bp, Mus musculus
tttggagcagtggaaatgcctggcc

SEQ ID NO: 71704 - DNA, 25 bp, Mus musculus
tttggagcccaagtcttatcaccag

SEQ ID NO: 71705 - DNA, 25 bp, Mus musculus
tttggagccctcagacctctcggaa

SEQ ID NO: 71706 - DNA, 25 bp, Mus musculus
tttggagctgggaactccggctcca

SEQ ID NO: 71707 - DNA, 25 bp, Mus musculus
tttggaggaaaacagttcaggtgac

SEQ ID NO: 71708 - DNA, 25 bp, Mus musculus
tttggaggaacaactcaaccttctc

SEQ ID NO: 71709 - DNA, 25 bp, Mus musculus
tttggaggaccatccacaggcagag

SEQ ID NO: 71710 - DNA, 25 bp, Mus musculus
tttggaggtgagatcaagacacaca

SEQ ID NO: 71711 - DNA, 25 bp, Mus musculus
tttggaggtggcagattggttcatc

SEQ ID NO: 71712 - DNA, 25 bp, Mus musculus
tttggagtcacacaagctaaagacg

SEQ ID NO: 71713 - DNA, 25 bp, Mus musculus
tttggataaaagagaaagaagtgcg

SEQ ID NO: 71714 - DNA, 25 bp, Mus musculus
tttggataaaagtgaaagaagtgcg

SEQ ID NO: 71715 - DNA, 25 bp, Mus musculus
tttggatagcaaagaggcagctacc

SEQ ID NO: 71716 - DNA, 25 bp, Mus musculus
tttggatccgcccttgtgcccactg

SEQ ID NO: 71717 - DNA, 25 bp, Mus musculus
tttggatgaaatgccactgatgatg

SEQ ID NO: 71718 - DNA, 25 bp, Mus musculus
tttggatgatttagataccgttcct

SEQ ID NO: 71719 - DNA, 25 bp, Mus musculus
tttggatgcaaggtcacaacacacc

SEQ ID NO: 71720 - DNA, 25 bp, Mus musculus
tttggatggatttggacaggagatc

SEQ ID NO: 71721 - DNA, 25 bp, Mus musculus
tttggattcatctcggagcactcgg

SEQ ID NO: 71722 - DNA, 25 bp, Mus musculus
tttggattgcaaaggccacgtcaga

SEQ ID NO: 71723 - DNA, 25 bp, Mus musculus
tttggcaaaggcactcacttcttgg

SEQ ID NO: 71724 - DNA, 25 bp, Mus musculus
tttggcaaaggctctcacttcttgg

SEQ ID NO: 71725 - DNA, 25 bp, Mus musculus
tttggcaaaggtgtcctagaaatgg

SEQ ID NO: 71726 - DNA, 25 bp, Mus musculus
tttggcaaatatggaaactcgttac

SEQ ID NO: 71727 - DNA, 25 bp, Mus musculus
tttggcaacattctggatgtccctg

SEQ ID NO: 71728 - DNA, 25 bp, Mus musculus
tttggcaagccctttgaaactcttc

SEQ ID NO: 71729 - DNA, 25 bp, Mus musculus
tttggcaaggtgaagcagtttgact

SEQ ID NO: 71730 - DNA, 25 bp, Mus musculus
tttggcactcctgcccagtatagtc

SEQ ID NO: 71731 - DNA, 25 bp, Mus musculus
tttggcaggaatttggacccctctg

SEQ ID NO: 71732 - DNA, 25 bp, Mus musculus
tttggccaaggagcagcgactcaac

SEQ ID NO: 71733 - DNA, 25 bp, Mus musculus
tttggccatgcttccacaggacagg

SEQ ID NO: 71734 - DNA, 25 bp, Mus musculus
tttggccccagaacatacagcctcg

SEQ ID NO: 71735 - DNA, 25 bp, Mus musculus
tttggcccggaagccaggagtgtac

SEQ ID NO: 71736 - DNA, 25 bp, Mus musculus
tttggccctgaagcctgaagattca

SEQ ID NO: 71737 - DNA, 25 bp, Mus musculus
tttggccgaagtgcctcagaaaaga

SEQ ID NO: 71738 - DNA, 25 bp, Mus musculus
tttggccgcttctctcctggaagct

SEQ ID NO: 71739 - DNA, 25 bp, Mus musculus
tttggcctctcactggtcatctggg

SEQ ID NO: 71740 - DNA, 25 bp, Mus musculus
tttggccttgccaggcaggcagaca

SEQ ID NO: 71741 - DNA, 25 bp, Mus musculus
tttggcgccgagttccgaaggttct

SEQ ID NO: 71742 - DNA, 25 bp, Mus musculus
tttggctatagagcgaggtccactc

SEQ ID NO: 71743 - DNA, 25 bp, Mus musculus
tttggctcaaagataataaatgtcg

SEQ ID NO: 71744 - DNA, 25 bp, Mus musculus
tttggctcaaagttaataaatgtcg

SEQ ID NO: 71745 - DNA, 25 bp, Mus musculus
tttggctccatgaagtattatgcac

SEQ ID NO: 71746 - DNA, 25 bp, Mus musculus
tttggctgcagatgccacattggct

SEQ ID NO: 71747 - DNA, 25 bp, Mus musculus
tttggctggctagggaacccaactc

SEQ ID NO: 71748 - DNA, 25 bp, Mus musculus
tttggcttttcccactggtcaacac

SEQ ID NO: 71749 - DNA, 25 bp, Mus musculus
tttggcttttccgactggtcaacac

SEQ ID NO: 71750 - DNA, 25 bp, Mus musculus
tttgggaatggcaagaacagcagta

SEQ ID NO: 71751 - DNA, 25 bp, Mus musculus
tttgggacaggacgctgattttgca

SEQ ID NO: 71752 - DNA, 25 bp, Mus musculus
tttgggacatcatacgccttttatg

SEQ ID NO: 71753 - DNA, 25 bp, Mus musculus
tttgggaccagtgaaaggcagtgtc

SEQ ID NO: 71754 - DNA, 25 bp, Mus musculus
tttgggacccaaagctggagatgag

SEQ ID NO: 71755 - DNA, 25 bp, Mus musculus
tttgggagagtacaaagaaatcttc

SEQ ID NO: 71756 - DNA, 25 bp, Mus musculus
tttgggatacctctcagtgtgtcag

SEQ ID NO: 71757 - DNA, 25 bp, Mus musculus
tttgggatgatgaacgacatgatcg

SEQ ID NO: 71758 - DNA, 25 bp, Mus musculus
tttgggatttgatgaaaggaacctc

SEQ ID NO: 71759 - DNA, 25 bp, Mus musculus
tttgggcagacaaggtagcttcact

SEQ ID NO: 71760 - DNA, 25 bp, Mus musculus
tttgggcagtataacaaagaagacc

SEQ ID NO: 71761 - DNA, 25 bp, Mus musculus
tttgggccagttggcttggataaaa

SEQ ID NO: 71762 - DNA, 25 bp, Mus musculus
tttgggcccgagagatcttggactc

SEQ ID NO: 71763 - DNA, 25 bp, Mus musculus
tttgggccctgcagatgtgctggct

SEQ ID NO: 71764 - DNA, 25 bp, Mus musculus
tttgggctcagcaaccagctggtgg

SEQ ID NO: 71765 - DNA, 25 bp, Mus musculus
tttgggctgactaccgccgcaacca

SEQ ID NO: 71766 - DNA, 25 bp, Mus musculus
tttgggctgtcagcttcgggcccag

SEQ ID NO: 71767 - DNA, 25 bp, Mus musculus
tttgggcttactggcttggatcgaa

SEQ ID NO: 71768 - DNA, 25 bp, Mus musculus
tttgggtacacacctgctgtctggg

SEQ ID NO: 71769 - DNA, 25 bp, Mus musculus
tttgggtactgcatttgggcccctt

SEQ ID NO: 71770 - DNA, 25 bp, Mus musculus
tttggtaaacatttgaccattcagg

SEQ ID NO: 71771 - DNA, 25 bp, Mus musculus
tttggtaaagaagataacctgtggg

SEQ ID NO: 71772 - DNA, 25 bp, Mus musculus
tttggtagctgcactaggaaacaca

SEQ ID NO: 71773 - DNA, 25 bp, Mus musculus
tttggtagtgccagtggccctctgg

SEQ ID NO: 71774 - DNA, 25 bp, Mus musculus
tttggtatgatcattaccattgggc

SEQ ID NO: 71775 - DNA, 25 bp, Mus musculus
tttggtatgcttaagaccaagagca

SEQ ID NO: 71776 - DNA, 25 bp, Mus musculus
tttggtatgctttagaccaagagca

SEQ ID NO: 71777 - DNA, 25 bp, Mus musculus
tttggtcatcgagttcactgaacag

SEQ ID NO: 71778 - DNA, 25 bp, Mus musculus
tttggtccaagccatccccgtaagc

SEQ ID NO: 71779 - DNA, 25 bp, Mus musculus
tttggtccgtatcacataggattac

SEQ ID NO: 71780 - DNA, 25 bp, Mus musculus
tttggtcctgatgtagtacagaaac

SEQ ID NO: 71781 - DNA, 25 bp, Mus musculus
tttggtctcaagctgttccgtaatc

SEQ ID NO: 71782 - DNA, 25 bp, Mus musculus
tttggtgatcctccaggacctaagg

SEQ ID NO: 71783 - DNA, 25 bp, Mus musculus
tttggtggaatctattgtcttcgcc

SEQ ID NO: 71784 - DNA, 25 bp, Mus musculus
tttggtgtacatgaggaaagcacag

SEQ ID NO: 71785 - DNA, 25 bp, Mus musculus
tttggtgtcagctactagaaggagg

SEQ ID NO: 71786 - DNA, 25 bp, Mus musculus
tttggttagtgccaccataccatcc

SEQ ID NO: 71787 - DNA, 25 bp, Mus musculus
tttggttctaacgtcaactttgttg

SEQ ID NO: 71788 - DNA, 25 bp, Mus musculus
tttggtttccgtgtggacaaggaag

SEQ ID NO: 71789 - DNA, 25 bp, Mus musculus
tttggttttcatccagtgtgtgatc

SEQ ID NO: 71790 - DNA, 25 bp, Mus musculus
tttgtaaagatcttgcagaaactta

SEQ ID NO: 71791 - DNA, 25 bp, Mus musculus
tttgtaatgcaccaaccacatgctg

SEQ ID NO: 71792 - DNA, 25 bp, Mus musculus
tttgtacaaagctttgcctgggtgc

SEQ ID NO: 71793 - DNA, 25 bp, Mus musculus
tttgtacaccaagtgcatgcagtgc

SEQ ID NO: 71794 - DNA, 25 bp, Mus musculus
tttgtacagcccaatggagccatct

SEQ ID NO: 71795 - DNA, 25 bp, Mus musculus
tttgtacattttcaccaagatctcg

SEQ ID NO: 71796 - DNA, 25 bp, Mus musculus
tttgtacccacagcccgcgttttgg

SEQ ID NO: 71797 - DNA, 25 bp, Mus musculus
tttgtacccgccagcgggaacttca

SEQ ID NO: 71798 - DNA, 25 bp, Mus musculus
tttgtaccgtgaacctggtccagga

SEQ ID NO: 71799 - DNA, 25 bp, Mus musculus
tttgtagacacctatcccaatgagg

SEQ ID NO: 71800 - DNA, 25 bp, Mus musculus
tttgtagacttcacggctgccaaca

SEQ ID NO: 71801 - DNA, 25 bp, Mus musculus
tttgtagacttctcggctgccaaca

SEQ ID NO: 71802 - DNA, 25 bp, Mus musculus
tttgtagccatcaaccagagtgcag

SEQ ID NO: 71803 - DNA, 25 bp, Mus musculus
tttgtaggagcagccatgagatctg

SEQ ID NO: 71804 - DNA, 25 bp, Mus musculus
tttgtagtacaagaccctgttctcc

SEQ ID NO: 71805 - DNA, 25 bp, Mus musculus
tttgtatgagtttctcttacacgcg

SEQ ID NO: 71806 - DNA, 25 bp, Mus musculus
tttgtatggcaggtgcctcagccag

SEQ ID NO: 71807 - DNA, 25 bp, Mus musculus
tttgtcaaatcctgcaaccttccga

SEQ ID NO: 71808 - DNA, 25 bp, Mus musculus
tttgtcaacaaagccacgtgggatg

SEQ ID NO: 71809 - DNA, 25 bp, Mus musculus
tttgtcaaccccatgcgacttcgta

SEQ ID NO: 71810 - DNA, 25 bp, Mus musculus
tttgtcacagtaacaagcttgcgct

SEQ ID NO: 71811 - DNA, 25 bp, Mus musculus
tttgtcatcgatctctccatggtga

SEQ ID NO: 71812 - DNA, 25 bp, Mus musculus
tttgtcattcaggtacaggaagcca

SEQ ID NO: 71813 - DNA, 25 bp, Mus musculus
tttgtccctgagatcagcgtgacca

SEQ ID NO: 71814 - DNA, 25 bp, Mus musculus
tttgtccggtccattccggacggct

SEQ ID NO: 71815 - DNA, 25 bp, Mus musculus
tttgtcctccgaggcacacagtcgg

SEQ ID NO: 71816 - DNA, 25 bp, Mus musculus
tttgtcgaccgtttgctgctcactg

SEQ ID NO: 71817 - DNA, 25 bp, Mus musculus
tttgtctcagctcctggttgagcct

SEQ ID NO: 71818 - DNA, 25 bp, Mus musculus
tttgtctcagctgctggttgagcct

SEQ ID NO: 71819 - DNA, 25 bp, Mus musculus
tttgtctccaggtctgatcaaaaag

SEQ ID NO: 71820 - DNA, 25 bp, Mus musculus
tttgtctcgttccatctctcagtca

SEQ ID NO: 71821 - DNA, 25 bp, Mus musculus
tttgtctggatgatccaccaggtcc

SEQ ID NO: 71822 - DNA, 25 bp, Mus musculus
tttgtctgtggaggatggaagttcc

SEQ ID NO: 71823 - DNA, 25 bp, Mus musculus
tttgtcttcacagggactggcaatg

SEQ ID NO: 71824 - DNA, 25 bp, Mus musculus
tttgtctttgatgactctgaagcta

SEQ ID NO: 71825 - DNA, 25 bp, Mus musculus
tttgtctttgcgctatgcagccgca

SEQ ID NO: 71826 - DNA, 25 bp, Mus musculus
tttgtctttgcggtatgcagccgca

SEQ ID NO: 71827 - DNA, 25 bp, Mus musculus
tttgtgaagaaggtagaggcggccc

SEQ ID NO: 71828 - DNA, 25 bp, Mus musculus
tttgtgacttaaagtctggatcctg

SEQ ID NO: 71829 - DNA, 25 bp, Mus musculus
tttgtgaggctgtacatccgcagca

SEQ ID NO: 71830 - DNA, 25 bp, Mus musculus
tttgtgagtgagcaaggcatagtcc

SEQ ID NO: 71831 - DNA, 25 bp, Mus musculus
tttgtgataaggttggccaatctcg

SEQ ID NO: 71832 - DNA, 25 bp, Mus musculus
tttgtgcaagttctctgccctgcgc

SEQ ID NO: 71833 - DNA, 25 bp, Mus musculus
tttgtgcaccctcggttgctcagcg

SEQ ID NO: 71834 - DNA, 25 bp, Mus musculus
tttgtgcagtggcagtcttccatct

SEQ ID NO: 71835 - DNA, 25 bp, Mus musculus
tttgtgccagtgtatctgaccgctg

SEQ ID NO: 71836 - DNA, 25 bp, Mus musculus
tttgtgccccaactcatgatcctct

SEQ ID NO: 71837 - DNA, 25 bp, Mus musculus
tttgtgcccctgttggtgggtacag

SEQ ID NO: 71838 - DNA, 25 bp, Mus musculus
tttgtgcctggcactgcagtgcagg

SEQ ID NO: 71839 - DNA, 25 bp, Mus musculus
tttgtgcctggctctgcagtgcagg

SEQ ID NO: 71840 - DNA, 25 bp, Mus musculus
tttgtgcgagttccggcctctcaga

SEQ ID NO: 71841 - DNA, 25 bp, Mus musculus
tttgtggaatacacaggaactacag

SEQ ID NO: 71842 - DNA, 25 bp, Mus musculus
tttgtggatgccgaacccagtccct

SEQ ID NO: 71843 - DNA, 25 bp, Mus musculus
tttgtggcagctggagatcacttag

SEQ ID NO: 71844 - DNA, 25 bp, Mus musculus
tttgtggccaccacttccctgatga

SEQ ID NO: 71845 - DNA, 25 bp, Mus musculus
tttgtggccctcaagagtgtgagag

SEQ ID NO: 71846 - DNA, 25 bp, Mus musculus
tttgtggccctttgaagacattcag

SEQ ID NO: 71847 - DNA, 25 bp, Mus musculus
tttgtggctcagttgcagacatcca

SEQ ID NO: 71848 - DNA, 25 bp, Mus musculus
tttgtggctgcctcgtgtaggtgct

SEQ ID NO: 71849 - DNA, 25 bp, Mus musculus
tttgtggtacgaggaagtaaaccat

SEQ ID NO: 71850 - DNA, 25 bp, Mus musculus
tttgtggtggatgcaacccgaaagg

SEQ ID NO: 71851 - DNA, 25 bp, Mus musculus
tttgtgtgcaaagccgacagctgcg

SEQ ID NO: 71852 - DNA, 25 bp, Mus musculus
tttgtgtgcagctgcccaggttccc

SEQ ID NO: 71853 - DNA, 25 bp, Mus musculus
tttgtgtggaaaacgacagcagcag

SEQ ID NO: 71854 - DNA, 25 bp, Mus musculus
tttgtgttgcaaaagctgttgaatg

SEQ ID NO: 71855 - DNA, 25 bp, Mus musculus
tttgttaaccggcttgattcggtgg

SEQ ID NO: 71856 - DNA, 25 bp, Mus musculus
tttgttaattctaggaggatcacct

SEQ ID NO: 71857 - DNA, 25 bp, Mus musculus
tttgttcaggacagacatagaaaca

SEQ ID NO: 71858 - DNA, 25 bp, Mus musculus
tttgttcaggccaggtgttcacagg

SEQ ID NO: 71859 - DNA, 25 bp, Mus musculus
tttgttctcaccatatgtaccctca

SEQ ID NO: 71860 - DNA, 25 bp, Mus musculus
tttgttggctgacccagctccagct

SEQ ID NO: 71861 - DNA, 25 bp, Mus musculus
tttgttggtgattgtatcgcttgga

SEQ ID NO: 71862 - DNA, 25 bp, Mus musculus
tttgttgtattcatgtggcggcggc

SEQ ID NO: 71863 - DNA, 25 bp, Mus musculus
tttgttgtgatctgcgctctgctgc

SEQ ID NO: 71864 - DNA, 25 bp, Mus musculus
ttttaaagaccccaatccaatgcac

SEQ ID NO: 71865 - DNA, 25 bp, Mus musculus
ttttaaaggcaacattctcagagtt

SEQ ID NO: 71866 - DNA, 25 bp, Mus musculus
ttttaaattagcctgccaggagagg

SEQ ID NO: 71867 - DNA, 25 bp, Mus musculus
ttttaaattggcctgcgtgacccgc

SEQ ID NO: 71868 - DNA, 25 bp, Mus musculus
ttttaaccacatcagtattgaggat

SEQ ID NO: 71869 - DNA, 25 bp, Mus musculus
ttttaacccagagaaatatgccgcc

SEQ ID NO: 71870 - DNA, 25 bp, Mus musculus
ttttaacccctaagatccatcagga

SEQ ID NO: 71871 - DNA, 25 bp, Mus musculus
ttttaactgcttgccgatagcagcc

SEQ ID NO: 71872 - DNA, 25 bp, Mus musculus
ttttaagagaccctgcccaatgtgc

SEQ ID NO: 71873 - DNA, 25 bp, Mus musculus
ttttaataaaccttagagacagcca

SEQ ID NO: 71874 - DNA, 25 bp, Mus musculus
ttttaatccttacaaagtacagcct

SEQ ID NO: 71875 - DNA, 25 bp, Mus musculus
ttttaccaaggagaacagctcaggc

SEQ ID NO: 71876 - DNA, 25 bp, Mus musculus
ttttaccagctaagtgactgccacg

SEQ ID NO: 71877 - DNA, 25 bp, Mus musculus
ttttaccagctatgtgactgccacg

SEQ ID NO: 71878 - DNA, 25 bp, Mus musculus
ttttacctggataggactctgtggc

SEQ ID NO: 71879 - DNA, 25 bp, Mus musculus
ttttacctggtgcacctcttccgct

SEQ ID NO: 71880 - DNA, 25 bp, Mus musculus
ttttacgggtgctgtgccgtgtccg

SEQ ID NO: 71881 - DNA, 25 bp, Mus musculus
ttttacgtcgcagaaagctgacggc

SEQ ID NO: 71882 - DNA, 25 bp, Mus musculus
ttttactagatggtacaacccacgc

SEQ ID NO: 71883 - DNA, 25 bp, Mus musculus
ttttactctgtaatctgaagcctgc

SEQ ID NO: 71884 - DNA, 25 bp, Mus musculus
ttttactgcatgtggatgcaggaca

SEQ ID NO: 71885 - DNA, 25 bp, Mus musculus
ttttactggctgacatgaatgactt

SEQ ID NO: 71886 - DNA, 25 bp, Mus musculus
ttttagaaaagcaagacgcatttgg

SEQ ID NO: 71887 - DNA, 25 bp, Mus musculus
ttttagagcgaaaaatatctatgcg

SEQ ID NO: 71888 - DNA, 25 bp, Mus musculus
ttttagcagcgaggtgccaatattt

SEQ ID NO: 71889 - DNA, 25 bp, Mus musculus
ttttagcatggaaattggaggctga

SEQ ID NO: 71890 - DNA, 25 bp, Mus musculus
ttttagccatttggccctgctgctg

SEQ ID NO: 71891 - DNA, 25 bp, Mus musculus
ttttagcttctgtgctggatttgag

SEQ ID NO: 71892 - DNA, 25 bp, Mus musculus
ttttaggagtaacgcagcagctgtc

SEQ ID NO: 71893 - DNA, 25 bp, Mus musculus
ttttaggccctgtcatcaaagctga

SEQ ID NO: 71894 - DNA, 25 bp, Mus musculus
ttttagtatcagcaggaaactggct

SEQ ID NO: 71895 - DNA, 25 bp, Mus musculus
ttttagtggagtgtgatactggtcc

SEQ ID NO: 71896 - DNA, 25 bp, Mus musculus
ttttatagatcagagtggacatgtc

SEQ ID NO: 71897 - DNA, 25 bp, Mus musculus
ttttatatgcagtctgggctgaagc

SEQ ID NO: 71898 - DNA, 25 bp, Mus musculus
ttttatcagcagctcctcccaagca

SEQ ID NO: 71899 - DNA, 25 bp, Mus musculus
ttttatcagtcagttgttcatgcag

SEQ ID NO: 71900 - DNA, 25 bp, Mus musculus
ttttatccaggcaattcagtctcgc

SEQ ID NO: 71901 - DNA, 25 bp, Mus musculus
ttttatccatgacccaagatgacta

SEQ ID NO: 71902 - DNA, 25 bp, Mus musculus
ttttatctgggttctctgcctccac

SEQ ID NO: 71903 - DNA, 25 bp, Mus musculus
ttttatgtccagcagtcctgcacag

SEQ ID NO: 71904 - DNA, 25 bp, Mus musculus
ttttatgtccaggagtcctgcacag

SEQ ID NO: 71905 - DNA, 25 bp, Mus musculus
ttttattcaatagagttcggacaat

SEQ ID NO: 71906 - DNA, 25 bp, Mus musculus
ttttattccagaaacatgcctctag

SEQ ID NO: 71907 - DNA, 25 bp, Mus musculus
ttttattcgccacaggagaatgtcg

SEQ ID NO: 71908 - DNA, 25 bp, Mus musculus
ttttattcgccattatctggcagag

SEQ ID NO: 71909 - DNA, 25 bp, Mus musculus
ttttatttgagccatatatgtccag

SEQ ID NO: 71910 - DNA, 25 bp, Mus musculus
ttttcaaaaatgtatcacgtgccag

SEQ ID NO: 71911 - DNA, 25 bp, Mus musculus
ttttcaagaaagcaggatggaccat

SEQ ID NO: 71912 - DNA, 25 bp, Mus musculus
ttttcaagacatggagtgtgtgccc

SEQ ID NO: 71913 - DNA, 25 bp, Mus musculus
ttttcaatataaatggtaaccaggc

SEQ ID NO: 71914 - DNA, 25 bp, Mus musculus
ttttcaatgccatcgccaatggcaa

SEQ ID NO: 71915 - DNA, 25 bp, Mus musculus
ttttcaatggccatgcttggctggg

SEQ ID NO: 71916 - DNA, 25 bp, Mus musculus
ttttcacagaggctcttcatgatcc

SEQ ID NO: 71917 - DNA, 25 bp, Mus musculus
ttttcacatttctgtggacaaagaa

SEQ ID NO: 71918 - DNA, 25 bp, Mus musculus
ttttcactggatacgaactggagac

SEQ ID NO: 71919 - DNA, 25 bp, Mus musculus
ttttcagactggactcaggctggcc

SEQ ID NO: 71920 - DNA, 25 bp, Mus musculus
ttttcagagaaacgtgtgaaattgc

SEQ ID NO: 71921 - DNA, 25 bp, Mus musculus
ttttcagagccaatctctgcgtgac

SEQ ID NO: 71922 - DNA, 25 bp, Mus musculus
ttttcagcaggaccgggaagcgttt

SEQ ID NO: 71923 - DNA, 25 bp, Mus musculus
ttttcagccgctacagtacccgaag

SEQ ID NO: 71924 - DNA, 25 bp, Mus musculus
ttttcagccgcttcagtacccgaag

SEQ ID NO: 71925 - DNA, 25 bp, Mus musculus
ttttcatcataacacacatatgtgg

SEQ ID NO: 71926 - DNA, 25 bp, Mus musculus
ttttcatccagtgtgtgatcaatgc

SEQ ID NO: 71927 - DNA, 25 bp, Mus musculus
ttttcatccggatccgcaggcgctg

SEQ ID NO: 71928 - DNA, 25 bp, Mus musculus
ttttcattcaagacaaagtccattc

SEQ ID NO: 71929 - DNA, 25 bp, Mus musculus
ttttccaacgacatccacaagctgg

SEQ ID NO: 71930 - DNA, 25 bp, Mus musculus
ttttccaagtcaagaccgactgaag

SEQ ID NO: 71931 - DNA, 25 bp, Mus musculus
ttttccaataccaacaggctctagc

SEQ ID NO: 71932 - DNA, 25 bp, Mus musculus
ttttccacgtgcaagggaccgagag

SEQ ID NO: 71933 - DNA, 25 bp, Mus musculus
ttttccagactccaaactatcatgt

SEQ ID NO: 71934 - DNA, 25 bp, Mus musculus
ttttccagagaagggctattcgttt

SEQ ID NO: 71935 - DNA, 25 bp, Mus musculus
ttttccagattacaacagatctcag

SEQ ID NO: 71936 - DNA, 25 bp, Mus musculus
ttttccatcagctctctgaccttga

SEQ ID NO: 71937 - DNA, 25 bp, Mus musculus
ttttccatgacagatagtgacgaca

SEQ ID NO: 71938 - DNA, 25 bp, Mus musculus
ttttccattgaagatgtgcagctcg

SEQ ID NO: 71939 - DNA, 25 bp, Mus musculus
ttttccatttgcaactactggcacg

SEQ ID NO: 71940 - DNA, 25 bp, Mus musculus
ttttcccaatgttgcacacctcttc

SEQ ID NO: 71941 - DNA, 25 bp, Mus musculus
ttttcccacacaataaaagctcagg

SEQ ID NO: 71942 - DNA, 25 bp, Mus musculus
ttttcccactggatgtaattacctc

SEQ ID NO: 71943 - DNA, 25 bp, Mus musculus
ttttcccactggttgtaattacctc

SEQ ID NO: 71944 - DNA, 25 bp, Mus musculus
ttttcccgggagaatatcaagcttc

SEQ ID NO: 71945 - DNA, 25 bp, Mus musculus
ttttcccggttctcaccagagaggc

SEQ ID NO: 71946 - DNA, 25 bp, Mus musculus
ttttccgagatcagtcttctcacac

SEQ ID NO: 71947 - DNA, 25 bp, Mus musculus
ttttccgagatctgtcttctcacac

SEQ ID NO: 71948 - DNA, 25 bp, Mus musculus
ttttccgagtactgtaaattcctgt

SEQ ID NO: 71949 - DNA, 25 bp, Mus musculus
ttttccggaaaatgtaatgcagagt

SEQ ID NO: 71950 - DNA, 25 bp, Mus musculus
ttttccggagcaaatccatgatgtc

SEQ ID NO: 71951 - DNA, 25 bp, Mus musculus
ttttcctagtatctattacggagag

SEQ ID NO: 71952 - DNA, 25 bp, Mus musculus
ttttcctgcaatacagtggatacag

SEQ ID NO: 71953 - DNA, 25 bp, Mus musculus
ttttcctgggacaggccctcatggc

SEQ ID NO: 71954 - DNA, 25 bp, Mus musculus
ttttcctggttagaagaccaagaga

SEQ ID NO: 71955 - DNA, 25 bp, Mus musculus
ttttccttcacggattgggagatac

SEQ ID NO: 71956 - DNA, 25 bp, Mus musculus
ttttcctttcctacagagaagggtg

SEQ ID NO: 71957 - DNA, 25 bp, Mus musculus
ttttcgatgttaacgacaaagtaga

SEQ ID NO: 71958 - DNA, 25 bp, Mus musculus
ttttcgcataccatcttttactaga

SEQ ID NO: 71959 - DNA, 25 bp, Mus musculus
ttttcgcatttccagcgtcccatga

SEQ ID NO: 71960 - DNA, 25 bp, Mus musculus
ttttcggaaggaccagatggctgac

SEQ ID NO: 71961 - DNA, 25 bp, Mus musculus
ttttcggccaggtgacatagttttg

SEQ ID NO: 71962 - DNA, 25 bp, Mus musculus
ttttcggtgctggagccagatggat

SEQ ID NO: 71963 - DNA, 25 bp, Mus musculus
ttttctaagggtgaagtttgcaacg

SEQ ID NO: 71964 - DNA, 25 bp, Mus musculus
ttttctacagcatcacagggcctgg

SEQ ID NO: 71965 - DNA, 25 bp, Mus musculus
ttttctagacacatacaagctgcca

SEQ ID NO: 71966 - DNA, 25 bp, Mus musculus
ttttctagacacttacaagctgcca

SEQ ID NO: 71967 - DNA, 25 bp, Mus musculus
ttttctatctcatttgctcgacacc

SEQ ID NO: 71968 - DNA, 25 bp, Mus musculus
ttttctattgctgaagcctctgatg

SEQ ID NO: 71969 - DNA, 25 bp, Mus musculus
ttttctccagccatcaaacaatgaa

SEQ ID NO: 71970 - DNA, 25 bp, Mus musculus
ttttctcctgaactccttatcccaa

SEQ ID NO: 71971 - DNA, 25 bp, Mus musculus
ttttctctgtggctgtggatagtcg

SEQ ID NO: 71972 - DNA, 25 bp, Mus musculus
ttttctgacacctgccagcctggac

SEQ ID NO: 71973 - DNA, 25 bp, Mus musculus
ttttctgcccttttgcggctctgga

SEQ ID NO: 71974 - DNA, 25 bp, Mus musculus
ttttctgccgggactgtaaggaagc

SEQ ID NO: 71975 - DNA, 25 bp, Mus musculus
ttttctgcggcaagagctgcccgtc

SEQ ID NO: 71976 - DNA, 25 bp, Mus musculus
ttttctgcggcatgagctgcccgtc

SEQ ID NO: 71977 - DNA, 25 bp, Mus musculus
ttttctggaagatgagatgcaaaac

SEQ ID NO: 71978 - DNA, 25 bp, Mus musculus
ttttctggtggtctccagcgaagac

SEQ ID NO: 71979 - DNA, 25 bp, Mus musculus
ttttctgtgttacagtgccctggtt

SEQ ID NO: 71980 - DNA, 25 bp, Mus musculus
ttttcttacagctcctgggtctacc

SEQ ID NO: 71981 - DNA, 25 bp, Mus musculus
ttttcttcatcagggatgccatatt

SEQ ID NO: 71982 - DNA, 25 bp, Mus musculus
ttttcttcctaaccacagtccagct

SEQ ID NO: 71983 - DNA, 25 bp, Mus musculus
ttttcttgtgctcggccagcaccca

SEQ ID NO: 71984 - DNA, 25 bp, Mus musculus
ttttcttgtgctgggccagcaccca

SEQ ID NO: 71985 - DNA, 25 bp, Mus musculus
ttttgaaaaaactgaggccctgagg

SEQ ID NO: 71986 - DNA, 25 bp, Mus musculus
ttttgaaatcctgtcatgcagtgtc

SEQ ID NO: 71987 - DNA, 25 bp, Mus musculus
ttttgaacatgcaagaactacttga

SEQ ID NO: 71988 - DNA, 25 bp, Mus musculus
ttttgaacatgctagaactacttga

SEQ ID NO: 71989 - DNA, 25 bp, Mus musculus
ttttgaacgggagcagcgggaactc

SEQ ID NO: 71990 - DNA, 25 bp, Mus musculus
ttttgaacgtcgcagagaactcagg

SEQ ID NO: 71991 - DNA, 25 bp, Mus musculus
ttttgaagagggagagtggctttca

SEQ ID NO: 71992 - DNA, 25 bp, Mus musculus
ttttgaagatgataggtcacatgac

SEQ ID NO: 71993 - DNA, 25 bp, Mus musculus
ttttgaagctagaaaaggatacagc

SEQ ID NO: 71994 - DNA, 25 bp, Mus musculus
ttttgaaggactctatcccacatac

SEQ ID NO: 71995 - DNA, 25 bp, Mus musculus
ttttgaaggcaatgctgtggcagcg

SEQ ID NO: 71996 - DNA, 25 bp, Mus musculus
ttttgaatgggaagaatgctagaga

SEQ ID NO: 71997 - DNA, 25 bp, Mus musculus
ttttgacaagacctgtaaactctgg

SEQ ID NO: 71998 - DNA, 25 bp, Mus musculus
ttttgacaatgggaagcactatcag

SEQ ID NO: 71999 - DNA, 25 bp, Mus musculus
ttttgaccaaatcatggcctctgtg

SEQ ID NO: 72000 - DNA, 25 bp, Mus musculus
ttttgaccctacctttctgattggc

SEQ ID NO: 72001 - DNA, 25 bp, Mus musculus
ttttgagacacaatctgcatcctac

SEQ ID NO: 72002 - DNA, 25 bp, Mus musculus
ttttgagcagcaccggaaggcttgc

SEQ ID NO: 72003 - DNA, 25 bp, Mus musculus
ttttgagcattaatgtgacagctac

SEQ ID NO: 72004 - DNA, 25 bp, Mus musculus
ttttgagccaacaggattaaccccg

SEQ ID NO: 72005 - DNA, 25 bp, Mus musculus
ttttgaggatgtggaaatggaaccg

SEQ ID NO: 72006 - DNA, 25 bp, Mus musculus
ttttgatattgtctctggaactcga

SEQ ID NO: 72007 - DNA, 25 bp, Mus musculus
ttttgatgacgcatttgtccctgag

SEQ ID NO: 72008 - DNA, 25 bp, Mus musculus
ttttgatgagatccgacaacagcag

SEQ ID NO: 72009 - DNA, 25 bp, Mus musculus
ttttgatgagatgcagccgacagcc

SEQ ID NO: 72010 - DNA, 25 bp, Mus musculus
ttttgatggcagagcccaagatgtc

SEQ ID NO: 72011 - DNA, 25 bp, Mus musculus
ttttgatgtccgagtgctaacacag

SEQ ID NO: 72012 - DNA, 25 bp, Mus musculus
ttttgcaggccaacaatagaaggtt

SEQ ID NO: 72013 - DNA, 25 bp, Mus musculus
ttttgcaggtgacgaccctcctgcg

SEQ ID NO: 72014 - DNA, 25 bp, Mus musculus
ttttgcatgtatgacgcagaccagc

SEQ ID NO: 72015 - DNA, 25 bp, Mus musculus
ttttgcattacttaacacaagaagg

SEQ ID NO: 72016 - DNA, 25 bp, Mus musculus
ttttgccaaagaccttgaaatgttt

SEQ ID NO: 72017 - DNA, 25 bp, Mus musculus
ttttgccaagcgtgtgaaaggccgt

SEQ ID NO: 72018 - DNA, 25 bp, Mus musculus
ttttgccataataagtcacagccat

SEQ ID NO: 72019 - DNA, 25 bp, Mus musculus
ttttgccataattagtcacagccat

SEQ ID NO: 72020 - DNA, 25 bp, Mus musculus
ttttgcccacaatgaccttgttgac

SEQ ID NO: 72021 - DNA, 25 bp, Mus musculus
ttttgcccgagaaccatttgtggcc

SEQ ID NO: 72022 - DNA, 25 bp, Mus musculus
ttttgcccggcaggatctgactcag

SEQ ID NO: 72023 - DNA, 25 bp, Mus musculus
ttttgccgtgattgtagtcctcctg

SEQ ID NO: 72024 - DNA, 25 bp, Mus musculus
ttttgcctcaccgaagaagtattcc

SEQ ID NO: 72025 - DNA, 25 bp, Mus musculus
ttttgcctctggaagcttctcccca

SEQ ID NO: 72026 - DNA, 25 bp, Mus musculus
ttttgcctgtacactggcttcctct

SEQ ID NO: 72027 - DNA, 25 bp, Mus musculus
ttttgcgagacagaactacggagtc

SEQ ID NO: 72028 - DNA, 25 bp, Mus musculus
ttttgcggctctggaccagcagcct

SEQ ID NO: 72029 - DNA, 25 bp, Mus musculus
ttttgctgaccgctccaacctgcgt

SEQ ID NO: 72030 - DNA, 25 bp, Mus musculus
ttttgctgaccggtccaacctgcgt

SEQ ID NO: 72031 - DNA, 25 bp, Mus musculus
ttttggaagaactcctctaattaag

SEQ ID NO: 72032 - DNA, 25 bp, Mus musculus
ttttggacacacagaagttcagcct

SEQ ID NO: 72033 - DNA, 25 bp, Mus musculus
ttttggaggagaagattttcgagcc

SEQ ID NO: 72034 - DNA, 25 bp, Mus musculus
ttttggaggatgaaccctctgccca

SEQ ID NO: 72035 - DNA, 25 bp, Mus musculus
ttttggagttacagtttcctcagag

SEQ ID NO: 72036 - DNA, 25 bp, Mus musculus
ttttggatgatttagataccgttcc

SEQ ID NO: 72037 - DNA, 25 bp, Mus musculus
ttttggattctcacaagcaagtgca

SEQ ID NO: 72038 - DNA, 25 bp, Mus musculus
ttttggcacgtgactgacttacatc

SEQ ID NO: 72039 - DNA, 25 bp, Mus musculus
ttttggccatgaccatgagtggtga

SEQ ID NO: 72040 - DNA, 25 bp, Mus musculus
ttttgggacatcattcttctgatgc

SEQ ID NO: 72041 - DNA, 25 bp, Mus musculus
ttttgggagtctgccgaacacctga

SEQ ID NO: 72042 - DNA, 25 bp, Mus musculus
ttttgggcttctggtgagcactgga

SEQ ID NO: 72043 - DNA, 25 bp, Mus musculus
ttttgggtttcagctgaaggaagcc

SEQ ID NO: 72044 - DNA, 25 bp, Mus musculus
ttttggtacaaagggttgactatgt

SEQ ID NO: 72045 - DNA, 25 bp, Mus musculus
ttttggtcaatagtctgaagctgga

SEQ ID NO: 72046 - DNA, 25 bp, Mus musculus
ttttggtccaggagcttaactgcct

SEQ ID NO: 72047 - DNA, 25 bp, Mus musculus
ttttggtgcctggtacagatctgcg

SEQ ID NO: 72048 - DNA, 25 bp, Mus musculus
ttttgtaccaatggctagaagcaga

SEQ ID NO: 72049 - DNA, 25 bp, Mus musculus
ttttgtactaagaggacgacgagcc

SEQ ID NO: 72050 - DNA, 25 bp, Mus musculus
ttttgtcaacctgggaaataccaag

SEQ ID NO: 72051 - DNA, 25 bp, Mus musculus
ttttgtccagaaatcgggtcatgca

SEQ ID NO: 72052 - DNA, 25 bp, Mus musculus
ttttgtcctgagtacctggctgcag

SEQ ID NO: 72053 - DNA, 25 bp, Mus musculus
ttttgtctctgtcacgtgccccgga

SEQ ID NO: 72054 - DNA, 25 bp, Mus musculus
ttttgtgcgtctgggtgagatccca

SEQ ID NO: 72055 - DNA, 25 bp, Mus musculus
ttttgtgtcactactggcccctgca

SEQ ID NO: 72056 - DNA, 25 bp, Mus musculus
ttttgtgtcactggcaggtacgtgc

SEQ ID NO: 72057 - DNA, 25 bp, Mus musculus
ttttgtgttcgaatatcccaggccg

SEQ ID NO: 72058 - DNA, 25 bp, Mus musculus
ttttgttaattctaggaggatcacc

SEQ ID NO: 72059 - DNA, 25 bp, Mus musculus
ttttgttcagcctgtgaccagatct

SEQ ID NO: 72060 - DNA, 25 bp, Mus musculus
ttttgttgaagacgactcagacatc

SEQ ID NO: 72061 - DNA, 25 bp, Mus musculus
ttttgttgacaagccagggacctga

SEQ ID NO: 72062 - DNA, 25 bp, Mus musculus
ttttgttgacctcaacaatggcaag

SEQ ID NO: 72063 - DNA, 25 bp, Mus musculus
ttttgttggaggcatttggaccatg

SEQ ID NO: 72064 - DNA, 25 bp, Mus musculus
tttttaaggaagttgtggtacatct

SEQ ID NO: 72065 - DNA, 25 bp, Mus musculus
tttttaattcgagcctctgcagctc

SEQ ID NO: 72066 - DNA, 25 bp, Mus musculus
tttttacttcctctatgggaagagc

SEQ ID NO: 72067 - DNA, 25 bp, Mus musculus
tttttacttgcctcctccgtcatct

SEQ ID NO: 72068 - DNA, 25 bp, Mus musculus
tttttagcagggactgaagaacacc

SEQ ID NO: 72069 - DNA, 25 bp, Mus musculus
tttttatcaccgtgaattgcctgag

SEQ ID NO: 72070 - DNA, 25 bp, Mus musculus
tttttatgcgaagcaagcatcatgg

SEQ ID NO: 72071 - DNA, 25 bp, Mus musculus
tttttatgggaagtcacttctggag

SEQ ID NO: 72072 - DNA, 25 bp, Mus musculus
tttttatgtccacgagtcctgcaca

SEQ ID NO: 72073 - DNA, 25 bp, Mus musculus
tttttatgtccaggagtcctgcaca

SEQ ID NO: 72074 - DNA, 25 bp, Mus musculus
tttttattaagctgtgccgatggca

SEQ ID NO: 72075 - DNA, 25 bp, Mus musculus
tttttcactcccttgctgctgttca

SEQ ID NO: 72076 - DNA, 25 bp, Mus musculus
tttttcagattctagatggaacaag

SEQ ID NO: 72077 - DNA, 25 bp, Mus musculus
tttttccagcgctggaagcagctga

SEQ ID NO: 72078 - DNA, 25 bp, Mus musculus
tttttcccggatgtttggcattgcc

SEQ ID NO: 72079 - DNA, 25 bp, Mus musculus
tttttcccgggaattagcacaggca

SEQ ID NO: 72080 - DNA, 25 bp, Mus musculus
tttttcccgggatttagcacaggca

SEQ ID NO: 72081 - DNA, 25 bp, Mus musculus
tttttcctaggttgactacagtcag

SEQ ID NO: 72082 - DNA, 25 bp, Mus musculus
tttttcctctctgcggtgtccagca

SEQ ID NO: 72083 - DNA, 25 bp, Mus musculus
tttttctaccatggcagcccaaggc

SEQ ID NO: 72084 - DNA, 25 bp, Mus musculus
tttttctccagatgtgtaaggccca

SEQ ID NO: 72085 - DNA, 25 bp, Mus musculus
tttttctccagccatcaaacaatga

SEQ ID NO: 72086 - DNA, 25 bp, Mus musculus
tttttctcctttccggagtgtcaca

SEQ ID NO: 72087 - DNA, 25 bp, Mus musculus
tttttctcggggaccatcatcacta

SEQ ID NO: 72088 - DNA, 25 bp, Mus musculus
tttttctggcccctgtgacagttcc

SEQ ID NO: 72089 - DNA, 25 bp, Mus musculus
tttttctgggctcctgctcctcggg

SEQ ID NO: 72090 - DNA, 25 bp, Mus musculus
tttttcttcccttagatgatgttgg

SEQ ID NO: 72091 - DNA, 25 bp, Mus musculus
tttttctttgtgaccctgctggtgt

SEQ ID NO: 72092 - DNA, 25 bp, Mus musculus
tttttctttgtgtccctgctggtgt

SEQ ID NO: 72093 - DNA, 25 bp, Mus musculus
tttttgaaggttccagggctgcaga

SEQ ID NO: 72094 - DNA, 25 bp, Mus musculus
tttttgaatcgaaggaaagcaacac

SEQ ID NO: 72095 - DNA, 25 bp, Mus musculus
tttttgaatctgaaatcagatgtcc

SEQ ID NO: 72096 - DNA, 25 bp, Mus musculus
tttttgagacaactatcaagttcgc

SEQ ID NO: 72097 - DNA, 25 bp, Mus musculus
tttttgagctgcacgtccaccaggc

SEQ ID NO: 72098 - DNA, 25 bp, Mus musculus
tttttgaggatgtggaaatggaacc

SEQ ID NO: 72099 - DNA, 25 bp, Mus musculus
tttttgatgtactggagaagcttgg

SEQ ID NO: 72100 - DNA, 25 bp, Mus musculus
tttttgcaaatttctgacggcttta

SEQ ID NO: 72101 - DNA, 25 bp, Mus musculus
tttttgcactcctgcgccgggtctc

SEQ ID NO: 72102 - DNA, 25 bp, Mus musculus
tttttgcagatcaaggagatgcccc

SEQ ID NO: 72103 - DNA, 25 bp, Mus musculus
tttttgccagcatcgtacgggtgag

SEQ ID NO: 72104 - DNA, 25 bp, Mus musculus
tttttgccatgatgtgctcaccaag

SEQ ID NO: 72105 - DNA, 25 bp, Mus musculus
tttttgcgccgctgctgtgggaacg

SEQ ID NO: 72106 - DNA, 25 bp, Mus musculus
tttttggacattgcaagacagacag

SEQ ID NO: 72107 - DNA, 25 bp, Mus musculus
tttttggaggatgaaccctctgccc

SEQ ID NO: 72108 - DNA, 25 bp, Mus musculus
tttttgtacccatataaagtctctg

SEQ ID NO: 72109 - DNA, 25 bp, Mus musculus
tttttgtagaaaacctgtatagaag

SEQ ID NO: 72110 - DNA, 25 bp, Mus musculus
tttttgtgcgtctgggtgagatccc

SEQ ID NO: 72111 - DNA, 25 bp, Mus musculus
tttttgttaattctaggaggatcac

SEQ ID NO: 72112 - DNA, 25 bp, Mus musculus
ttttttcgctgctagcacatatgta

SEQ ID NO: 72113 - DNA, 25 bp, Mus musculus
ttttttctatcagcggctggtggag

SEQ ID NO: 72114 - DNA, 25 bp, Mus musculus
ttttttggttacgtcagcttcactg

SEQ ID NO: 72115 - DNA, 25 bp, Mus musculus
aaaaaacagttcatcgtcaggcagc

SEQ ID NO: 72116 - DNA, 25 bp, Mus musculus
aaaaaacctgtgtgatgtatggcgc

SEQ ID NO: 72117 - DNA, 25 bp, Mus musculus
aaaaaacttgatcctcggagagaag

SEQ ID NO: 72118 - DNA, 25 bp, Mus musculus
aaaaaaggacatgcccactgagttc

SEQ ID NO: 72119 - DNA, 25 bp, Mus musculus
aaaaaaggcccctctgtcatgggag

SEQ ID NO: 72120 - DNA, 25 bp, Mus musculus
aaaaaatcgacaacctgctgcggga

SEQ ID NO: 72121 - DNA, 25 bp, Mus musculus
aaaaaatctgtctgctctgcccgag

SEQ ID NO: 72122 - DNA, 25 bp, Mus musculus
aaaaaatggtgcctccggatgctcc

SEQ ID NO: 72123 - DNA, 25 bp, Mus musculus
aaaaaattcatagagcccctgacag

SEQ ID NO: 72124 - DNA, 25 bp, Mus musculus
aaaaaattcctgttgctggctgcag

SEQ ID NO: 72125 - DNA, 25 bp, Mus musculus
aaaaacaggagagtgagaaaccgct

SEQ ID NO: 72126 - DNA, 25 bp, Mus musculus
aaaaacagtgtttgcaggatccagc

SEQ ID NO: 72127 - DNA, 25 bp, Mus musculus
aaaaacatggccgatctccagctca

SEQ ID NO: 72128 - DNA, 25 bp, Mus musculus
aaaaacatgggcattgatgtccggc

SEQ ID NO: 72129 - DNA, 25 bp, Mus musculus
aaaaaccagatgttgggctcaaggc

SEQ ID NO: 72130 - DNA, 25 bp, Mus musculus
aaaaaccatttcttgggcatcgcca

SEQ ID NO: 72131 - DNA, 25 bp, Mus musculus
aaaaaccgggttgcagctcagagga

SEQ ID NO: 72132 - DNA, 25 bp, Mus musculus
aaaaaccgtctggagcagtgtcacc

SEQ ID NO: 72133 - DNA, 25 bp, Mus musculus
aaaaacggcctagctgtgttagccg

SEQ ID NO: 72134 - DNA, 25 bp, Mus musculus
aaaaacgggtatgtgactgtcagtg

SEQ ID NO: 72135 - DNA, 25 bp, Mus musculus
aaaaacgtccggcaggctgatatac

SEQ ID NO: 72136 - DNA, 25 bp, Mus musculus
aaaaactcgacgcagagctgtgggc

SEQ ID NO: 72137 - DNA, 25 bp, Mus musculus
aaaaactcttccattatctacagtg

SEQ ID NO: 72138 - DNA, 25 bp, Mus musculus
aaaaactgtctgtgaagtcgtgaac

SEQ ID NO: 72139 - DNA, 25 bp, Mus musculus
aaaaacttacacacagcgctgtcgg

SEQ ID NO: 72140 - DNA, 25 bp, Mus musculus
aaaaacttctgtgtggtgcaccgaa

SEQ ID NO: 72141 - DNA, 25 bp, Mus musculus
aaaaagaagcatattccgcggccac

SEQ ID NO: 72142 - DNA, 25 bp, Mus musculus
aaaaagaatccctcaggctcctggg

SEQ ID NO: 72143 - DNA, 25 bp, Mus musculus
aaaaagacgacactctgaccttggc

SEQ ID NO: 72144 - DNA, 25 bp, Mus musculus
aaaaagacgattcctgcctgggcga

SEQ ID NO: 72145 - DNA, 25 bp, Mus musculus
aaaaagagcaagaccgagccctggt

SEQ ID NO: 72146 - DNA, 25 bp, Mus musculus
aaaaagaggtatttgccagcccagc

SEQ ID NO: 72147 - DNA, 25 bp, Mus musculus
aaaaagatgctagcgttgtgccgcc

SEQ ID NO: 72148 - DNA, 25 bp, Mus musculus
aaaaagcggcttagtccatcaggaa

SEQ ID NO: 72149 - DNA, 25 bp, Mus musculus
aaaaagctggcgattggtatggacc

SEQ ID NO: 72150 - DNA, 25 bp, Mus musculus
aaaaagcttgctaactcggaacctg

SEQ ID NO: 72151 - DNA, 25 bp, Mus musculus
aaaaaggactccagtatctgtgccc

SEQ ID NO: 72152 - DNA, 25 bp, Mus musculus
aaaaaggcttcgatgaagaaggtgg

SEQ ID NO: 72153 - DNA, 25 bp, Mus musculus
aaaaaggcttgtctgggagatacca

SEQ ID NO: 72154 - DNA, 25 bp, Mus musculus
aaaaagggagcctatgacatgccag

SEQ ID NO: 72155 - DNA, 25 bp, Mus musculus
aaaaaggtctttggcactcatctca

SEQ ID NO: 72156 - DNA, 25 bp, Mus musculus
aaaaaggtgaagatgcgccggaagc

SEQ ID NO: 72157 - DNA, 25 bp, Mus musculus
aaaaagtgccaagcttcccaaatgg

SEQ ID NO: 72158 - DNA, 25 bp, Mus musculus
aaaaagttttcgcagactgtgccgg

SEQ ID NO: 72159 - DNA, 25 bp, Mus musculus
aaaaatatatatacccaagatgggc

SEQ ID NO: 72160 - DNA, 25 bp, Mus musculus
aaaaatatgctctcggaggccacgc

SEQ ID NO: 72161 - DNA, 25 bp, Mus musculus
aaaaatattatctgtcggccaaggc

SEQ ID NO: 72162 - DNA, 25 bp, Mus musculus
aaaaatcatctctaagcttccaaag

SEQ ID NO: 72163 - DNA, 25 bp, Mus musculus
aaaaatccgcatcctggttggaagc

SEQ ID NO: 72164 - DNA, 25 bp, Mus musculus
aaaaatcctcgatgaagacggcctg

SEQ ID NO: 72165 - DNA, 25 bp, Mus musculus
aaaaatcgagcggaggtatcccagc

SEQ ID NO: 72166 - DNA, 25 bp, Mus musculus
aaaaatgaaccagcaacgcgggagg

SEQ ID NO: 72167 - DNA, 25 bp, Mus musculus
aaaaatgagtagtgtggctgccgcg

SEQ ID NO: 72168 - DNA, 25 bp, Mus musculus
aaaaatgatttccacaaagctggcc

SEQ ID NO: 72169 - DNA, 25 bp, Mus musculus
aaaaatgcattgaatcccatcaagg

SEQ ID NO: 72170 - DNA, 25 bp, Mus musculus
aaaaatggccacctcgaatccagtg

SEQ ID NO: 72171 - DNA, 25 bp, Mus musculus
aaaaatggcggagcggagccagaca

SEQ ID NO: 72172 - DNA, 25 bp, Mus musculus
aaaaatggtgagtttgtatggatca

SEQ ID NO: 72173 - DNA, 25 bp, Mus musculus
aaaaatgttcccaagcttggtgata

SEQ ID NO: 72174 - DNA, 25 bp, Mus musculus
aaaaattgcttgaaccactggaggc

SEQ ID NO: 72175 - DNA, 25 bp, Mus musculus
aaaacaaagatgttgccgcagaggc

SEQ ID NO: 72176 - DNA, 25 bp, Mus musculus
aaaacaagtggctgcggccgtcgcc

SEQ ID NO: 72177 - DNA, 25 bp, Mus musculus
aaaacaataatcaacctgcagcgcc

SEQ ID NO: 72178 - DNA, 25 bp, Mus musculus
aaaacaatccggagggagcagtgct

SEQ ID NO: 72179 - DNA, 25 bp, Mus musculus
aaaacacaccaactgctgtgtgagg

SEQ ID NO: 72180 - DNA, 25 bp, Mus musculus
aaaacacagactcgcgttgcaaggc

SEQ ID NO: 72181 - DNA, 25 bp, Mus musculus
aaaacacaggcaacagcagggtgca

SEQ ID NO: 72182 - DNA, 25 bp, Mus musculus
aaaacacccttaaagatcacatgag

SEQ ID NO: 72183 - DNA, 25 bp, Mus musculus
aaaacacctcggctgcagcaagcta

SEQ ID NO: 72184 - DNA, 25 bp, Mus musculus
aaaacacgtcttctctccgagtaca

SEQ ID NO: 72185 - DNA, 25 bp, Mus musculus
aaaacactagctggactggtggtgc

SEQ ID NO: 72186 - DNA, 25 bp, Mus musculus
aaaacactgtgattgtacctgggag

SEQ ID NO: 72187 - DNA, 25 bp, Mus musculus
aaaacagaaacgctggcctccttgg

SEQ ID NO: 72188 - DNA, 25 bp, Mus musculus
aaaacagacatccaaaagcgacaga

SEQ ID NO: 72189 - DNA, 25 bp, Mus musculus
aaaacagcccactctttcgagcagg

SEQ ID NO: 72190 - DNA, 25 bp, Mus musculus
aaaacaggcagatcctggctcggca

SEQ ID NO: 72191 - DNA, 25 bp, Mus musculus
aaaacagttggcttacgtgaggtct

SEQ ID NO: 72192 - DNA, 25 bp, Mus musculus
aaaacagtttcagagtggatcagtc

SEQ ID NO: 72193 - DNA, 25 bp, Mus musculus
aaaacatccagccagcactgggcaa

SEQ ID NO: 72194 - DNA, 25 bp, Mus musculus
aaaacatccctacagtgggcttggg

SEQ ID NO: 72195 - DNA, 25 bp, Mus musculus
aaaacatccctttcgcagtcgttgg

SEQ ID NO: 72196 - DNA, 25 bp, Mus musculus
aaaacatcggaccagtgtgggacca

SEQ ID NO: 72197 - DNA, 25 bp, Mus musculus
aaaacatcgtcgtatttgaccatcg

SEQ ID NO: 72198 - DNA, 25 bp, Mus musculus
aaaacatgaccgctgagcccatgag

SEQ ID NO: 72199 - DNA, 25 bp, Mus musculus
aaaacattcaagtggtcgagctccc

SEQ ID NO: 72200 - DNA, 25 bp, Mus musculus
aaaacattccaggatggtgccacca

SEQ ID NO: 72201 - DNA, 25 bp, Mus musculus
aaaacattgttccttcttagaggct

SEQ ID NO: 72202 - DNA, 25 bp, Mus musculus
aaaaccaagaattcctgcacagcgg

SEQ ID NO: 72203 - DNA, 25 bp, Mus musculus
aaaaccactcttcttcacatgctga

SEQ ID NO: 72204 - DNA, 25 bp, Mus musculus
aaaaccagtatagaattgttagaat

SEQ ID NO: 72205 - DNA, 25 bp, Mus musculus
aaaacccaagcaactgctgccatgg

SEQ ID NO: 72206 - DNA, 25 bp, Mus musculus
aaaacccaaggctcgatcagaggac

SEQ ID NO: 72207 - DNA, 25 bp, Mus musculus
aaaacccagaggactgttgaagctg

SEQ ID NO: 72208 - DNA, 25 bp, Mus musculus
aaaacccaggagtaaggctgcaaca

SEQ ID NO: 72209 - DNA, 25 bp, Mus musculus
aaaaccctcgacagttgggcctgca

SEQ ID NO: 72210 - DNA, 25 bp, Mus musculus
aaaaccctggtactgattggcgcgc

SEQ ID NO: 72211 - DNA, 25 bp, Mus musculus
aaaaccctttggatgctaagctcgt

SEQ ID NO: 72212 - DNA, 25 bp, Mus musculus
aaaaccgggaagacatactgaatgc

SEQ ID NO: 72213 - DNA, 25 bp, Mus musculus
aaaaccgtcaaggaagtactgcgct

SEQ ID NO: 72214 - DNA, 25 bp, Mus musculus
aaaaccgtcgggatgtagaggcctg

SEQ ID NO: 72215 - DNA, 25 bp, Mus musculus
aaaaccgtggtcgagtcctgctggt

SEQ ID NO: 72216 - DNA, 25 bp, Mus musculus
aaaacctgcggactttggatctgtg

SEQ ID NO: 72217 - DNA, 25 bp, Mus musculus
aaaacgagctggctctccaccagag

SEQ ID NO: 72218 - DNA, 25 bp, Mus musculus
aaaacgaggctctggctatgcagaa

SEQ ID NO: 72219 - DNA, 25 bp, Mus musculus
aaaacgccgtagcaggaagaccagt

SEQ ID NO: 72220 - DNA, 25 bp, Mus musculus
aaaacgcgctaagccggcggagcat

SEQ ID NO: 72221 - DNA, 25 bp, Mus musculus
aaaacggatcaagattccccaggag

SEQ ID NO: 72222 - DNA, 25 bp, Mus musculus
aaaacggcctcgcactaaaatgctt

SEQ ID NO: 72223 - DNA, 25 bp, Mus musculus
aaaactaattagctgcttggcggcc

SEQ ID NO: 72224 - DNA, 25 bp, Mus musculus
aaaactagatctgtcctcagcaggc

SEQ ID NO: 72225 - DNA, 25 bp, Mus musculus
aaaactccagcaatgggcagcgtga

SEQ ID NO: 72226 - DNA, 25 bp, Mus musculus
aaaactccagtggagggctggcccg

SEQ ID NO: 72227 - DNA, 25 bp, Mus musculus
aaaactccccaggacacagagctgg

SEQ ID NO: 72228 - DNA, 25 bp, Mus musculus
aaaactctggagcttctgaaatcaa

SEQ ID NO: 72229 - DNA, 25 bp, Mus musculus
aaaactgaactgtccttcgccctgg

SEQ ID NO: 72230 - DNA, 25 bp, Mus musculus
aaaactgcttggtgcaggtacaggc

SEQ ID NO: 72231 - DNA, 25 bp, Mus musculus
aaaactgggtgtgggacattgactc

SEQ ID NO: 72232 - DNA, 25 bp, Mus musculus
aaaactggtgtggtgtagacacggc

SEQ ID NO: 72233 - DNA, 25 bp, Mus musculus
aaaactgtattgtataggcgccaac

SEQ ID NO: 72234 - DNA, 25 bp, Mus musculus
aaaactgtggttggaagctagtggc

SEQ ID NO: 72235 - DNA, 25 bp, Mus musculus
aaaacttcattgctgagctgctgcc

SEQ ID NO: 72236 - DNA, 25 bp, Mus musculus
aaaacttggcggatacagaattctg

SEQ ID NO: 72237 - DNA, 25 bp, Mus musculus
aaaactttattctcaaacatgacag

SEQ ID NO: 72238 - DNA, 25 bp, Mus musculus
aaaagaaaaatgattcagcatgctg

SEQ ID NO: 72239 - DNA, 25 bp, Mus musculus
aaaagaaaatcattgcggacatcaa

SEQ ID NO: 72240 - DNA, 25 bp, Mus musculus
aaaagaaagttggaccatggttctg

SEQ ID NO: 72241 - DNA, 25 bp, Mus musculus
aaaagaaccgctgtctccagtagcc

SEQ ID NO: 72242 - DNA, 25 bp, Mus musculus
aaaagaagaatttgaccagggctgc

SEQ ID NO: 72243 - DNA, 25 bp, Mus musculus
aaaagaagccttccgctgctctgga

SEQ ID NO: 72244 - DNA, 25 bp, Mus musculus
aaaagaaggatttgctcactctggc

SEQ ID NO: 72245 - DNA, 25 bp, Mus musculus
aaaagacacatgttggacccactgg

SEQ ID NO: 72246 - DNA, 25 bp, Mus musculus
aaaagacatgctgcccttcacgaag

SEQ ID NO: 72247 - DNA, 25 bp, Mus musculus
aaaagacggacagcccatcgcgtga

SEQ ID NO: 72248 - DNA, 25 bp, Mus musculus
aaaagactgcatcggccaacctagt

SEQ ID NO: 72249 - DNA, 25 bp, Mus musculus
aaaagagactgggacttctcgctgg

SEQ ID NO: 72250 - DNA, 25 bp, Mus musculus
aaaagagggcatctatccttcaaga

SEQ ID NO: 72251 - DNA, 25 bp, Mus musculus
aaaagagggccgtcagcttgccagt

SEQ ID NO: 72252 - DNA, 25 bp, Mus musculus
aaaagagtatggaatagccctgccc

SEQ ID NO: 72253 - DNA, 25 bp, Mus musculus
aaaagatagactgtagcccaccacg

SEQ ID NO: 72254 - DNA, 25 bp, Mus musculus
aaaagatcggaaggactcagccagg

SEQ ID NO: 72255 - DNA, 25 bp, Mus musculus
aaaagatgccctctcctcaccaggg

SEQ ID NO: 72256 - DNA, 25 bp, Mus musculus
aaaagatggtcaacgtgctgaaagg

SEQ ID NO: 72257 - DNA, 25 bp, Mus musculus
aaaagatggtcccagattctgcgac

SEQ ID NO: 72258 - DNA, 25 bp, Mus musculus
aaaagatggtgacccagaaagctgc

SEQ ID NO: 72259 - DNA, 25 bp, Mus musculus
aaaagatgttgtccgacaactgtgc

SEQ ID NO: 72260 - DNA, 25 bp, Mus musculus
aaaagatgtttattctgcagccaag

SEQ ID NO: 72261 - DNA, 25 bp, Mus musculus
aaaagattaccaagcccgcaagatg

SEQ ID NO: 72262 - DNA, 25 bp, Mus musculus
aaaagcaacagatgggcgcagacgg

SEQ ID NO: 72263 - DNA, 25 bp, Mus musculus
aaaagcaacctgaaaacgactggcg

SEQ ID NO: 72264 - DNA, 25 bp, Mus musculus
aaaagcaagcctccgtgactagatg

SEQ ID NO: 72265 - DNA, 25 bp, Mus musculus
aaaagcaagcctgacatttcagcgg

SEQ ID NO: 72266 - DNA, 25 bp, Mus musculus
aaaagcaaggaagacatatacaaag

SEQ ID NO: 72267 - DNA, 25 bp, Mus musculus
aaaagcaataaagaggcaggccgcc

SEQ ID NO: 72268 - DNA, 25 bp, Mus musculus
aaaagcattttcaacgtctgcgggc

SEQ ID NO: 72269 - DNA, 25 bp, Mus musculus
aaaagccaaacatcagccaccattc

SEQ ID NO: 72270 - DNA, 25 bp, Mus musculus
aaaagccagaaacggccgtgtccag

SEQ ID NO: 72271 - DNA, 25 bp, Mus musculus
aaaagccccagggaggctggaccat

SEQ ID NO: 72272 - DNA, 25 bp, Mus musculus
aaaagccccggatgttgaactgaag

SEQ ID NO: 72273 - DNA, 25 bp, Mus musculus
aaaagcccggtcaaatcctcaggtg

SEQ ID NO: 72274 - DNA, 25 bp, Mus musculus
aaaagccgcgcaggatggaagtcca

SEQ ID NO: 72275 - DNA, 25 bp, Mus musculus
aaaagccggcttctgttgactgaca

SEQ ID NO: 72276 - DNA, 25 bp, Mus musculus
aaaagcctccaatccaatatgtccg

SEQ ID NO: 72277 - DNA, 25 bp, Mus musculus
aaaagcctggagatgagagctctca

SEQ ID NO: 72278 - DNA, 25 bp, Mus musculus
aaaagcctgttcgagcaagtagatc

SEQ ID NO: 72279 - DNA, 25 bp, Mus musculus
aaaagctgcacttgaggcccagaat

SEQ ID NO: 72280 - DNA, 25 bp, Mus musculus
aaaagctgcccgtgggtgtcctcct

SEQ ID NO: 72281 - DNA, 25 bp, Mus musculus
aaaagctgtgttcactgtgtctggc

SEQ ID NO: 72282 - DNA, 25 bp, Mus musculus
aaaagcttttgcttcgccacggcca

SEQ ID NO: 72283 - DNA, 25 bp, Mus musculus
aaaaggaactgcagggccttcggag

SEQ ID NO: 72284 - DNA, 25 bp, Mus musculus
aaaaggagctcgaaagatgccgggc

SEQ ID NO: 72285 - DNA, 25 bp, Mus musculus
aaaaggcaaactgtggctctggaac

SEQ ID NO: 72286 - DNA, 25 bp, Mus musculus
aaaaggcaaattcaaggcagctggc

SEQ ID NO: 72287 - DNA, 25 bp, Mus musculus
aaaaggcatttcgtggatcaccgga

SEQ ID NO: 72288 - DNA, 25 bp, Mus musculus
aaaaggccacactatgtaccctacg

SEQ ID NO: 72289 - DNA, 25 bp, Mus musculus
aaaaggctaggactgacttacagac

SEQ ID NO: 72290 - DNA, 25 bp, Mus musculus
aaaaggctggcagtcagggatctca

SEQ ID NO: 72291 - DNA, 25 bp, Mus musculus
aaaaggctggccatagttgacaccc

SEQ ID NO: 72292 - DNA, 25 bp, Mus musculus
aaaagggcgtccatcccggcaagct

SEQ ID NO: 72293 - DNA, 25 bp, Mus musculus
aaaagggtcatacacgtacttcgcg

SEQ ID NO: 72294 - DNA, 25 bp, Mus musculus
aaaaggtgccgctggaagtgtccga

SEQ ID NO: 72295 - DNA, 25 bp, Mus musculus
aaaaggtgctcacctgctacctgct

SEQ ID NO: 72296 - DNA, 25 bp, Mus musculus
aaaaggtggctaaggattcgcaggc

SEQ ID NO: 72297 - DNA, 25 bp, Mus musculus
aaaagtaccctcttcgacagactcg

SEQ ID NO: 72298 - DNA, 25 bp, Mus musculus
aaaagtcaaggacgttggcacagac

SEQ ID NO: 72299 - DNA, 25 bp, Mus musculus
aaaagtcggtgtgtaggcctcagcc

SEQ ID NO: 72300 - DNA, 25 bp, Mus musculus
aaaagtcgtgtttctgtgtctccag

SEQ ID NO: 72301 - DNA, 25 bp, Mus musculus
aaaagtgctagtagtgaccctcagg

SEQ ID NO: 72302 - DNA, 25 bp, Mus musculus
aaaagtgctgcagttgaggccggca

SEQ ID NO: 72303 - DNA, 25 bp, Mus musculus
aaaagtggattcttgcctggcccgc

SEQ ID NO: 72304 - DNA, 25 bp, Mus musculus
aaaagtggcgcgcaaaaagtgcaga

SEQ ID NO: 72305 - DNA, 25 bp, Mus musculus
aaaagtgtattgtcagcggcatcgg

SEQ ID NO: 72306 - DNA, 25 bp, Mus musculus
aaaagtgttggcgtgttcagctctg

SEQ ID NO: 72307 - DNA, 25 bp, Mus musculus
aaaagttgccgatcgctgaagagga

SEQ ID NO: 72308 - DNA, 25 bp, Mus musculus
aaaagtttcgatcccagtaagcctg

SEQ ID NO: 72309 - DNA, 25 bp, Mus musculus
aaaataagaatagccatgccgctgg

SEQ ID NO: 72310 - DNA, 25 bp, Mus musculus
aaaataagcctctcagcgtgggccg

SEQ ID NO: 72311 - DNA, 25 bp, Mus musculus
aaaatacaacctgtgtagggcagcc

SEQ ID NO: 72312 - DNA, 25 bp, Mus musculus
aaaatagcagcatgaggacttctcc

SEQ ID NO: 72313 - DNA, 25 bp, Mus musculus
aaaatagccgcggagaatagcctcc

SEQ ID NO: 72314 - DNA, 25 bp, Mus musculus
aaaatatcaccgcagcttctcctgg

SEQ ID NO: 72315 - DNA, 25 bp, Mus musculus
aaaatatcttcgtctgccctctgag

SEQ ID NO: 72316 - DNA, 25 bp, Mus musculus
aaaatcaaatgcaacaccagctgcc

SEQ ID NO: 72317 - DNA, 25 bp, Mus musculus
aaaatcaacggagcctgggatgacc

SEQ ID NO: 72318 - DNA, 25 bp, Mus musculus
aaaatcactacaaccaaacagcagg

SEQ ID NO: 72319 - DNA, 25 bp, Mus musculus
aaaatcagcggagtcttcagtcccg

SEQ ID NO: 72320 - DNA, 25 bp, Mus musculus
aaaatcagggcctgggagacgcagc

SEQ ID NO: 72321 - DNA, 25 bp, Mus musculus
aaaatcatgcgtgccagagctaagg

SEQ ID NO: 72322 - DNA, 25 bp, Mus musculus
aaaatcatttaagtcccagtgccag

SEQ ID NO: 72323 - DNA, 25 bp, Mus musculus
aaaatccactgtcgtgttgcagcag

SEQ ID NO: 72324 - DNA, 25 bp, Mus musculus
aaaatccatcgctgccaagtactcg

SEQ ID NO: 72325 - DNA, 25 bp, Mus musculus
aaaatccattgaggaagctgcagcc

SEQ ID NO: 72326 - DNA, 25 bp, Mus musculus
aaaatccctggctcagttgctagag

SEQ ID NO: 72327 - DNA, 25 bp, Mus musculus
aaaatcgccgcagatatgagcaacc

SEQ ID NO: 72328 - DNA, 25 bp, Mus musculus
aaaatcggttacagccatgacagtg

SEQ ID NO: 72329 - DNA, 25 bp, Mus musculus
aaaatctttgtgtgacggtctggaa

SEQ ID NO: 72330 - DNA, 25 bp, Mus musculus
aaaatgaaagtgagccggaagagcc

SEQ ID NO: 72331 - DNA, 25 bp, Mus musculus
aaaatgaagcaccatctcgtgggcc

SEQ ID NO: 72332 - DNA, 25 bp, Mus musculus
aaaatgacatcacattccacctcgg

SEQ ID NO: 72333 - DNA, 25 bp, Mus musculus
aaaatgatagcgaaccctggcagcc

SEQ ID NO: 72334 - DNA, 25 bp, Mus musculus
aaaatgccctcttcagattgaccag

SEQ ID NO: 72335 - DNA, 25 bp, Mus musculus
aaaatgcctcaaggagacgacagag

SEQ ID NO: 72336 - DNA, 25 bp, Mus musculus
aaaatgctagaatgtttggagtccc

SEQ ID NO: 72337 - DNA, 25 bp, Mus musculus
aaaatgctctgtgatagctggtgca

SEQ ID NO: 72338 - DNA, 25 bp, Mus musculus
aaaatgctggcatagtccacccgga

SEQ ID NO: 72339 - DNA, 25 bp, Mus musculus
aaaatggaagatgtagccccagtcc

SEQ ID NO: 72340 - DNA, 25 bp, Mus musculus
aaaatggatggaagtggagcagctc

SEQ ID NO: 72341 - DNA, 25 bp, Mus musculus
aaaatggcagaggaagacggatccc

SEQ ID NO: 72342 - DNA, 25 bp, Mus musculus
aaaatggccatagcccagagagacc

SEQ ID NO: 72343 - DNA, 25 bp, Mus musculus
aaaatggggcgaatgtgaaccaagc

SEQ ID NO: 72344 - DNA, 25 bp, Mus musculus
aaaatggtcattatgcgctgcagtc

SEQ ID NO: 72345 - DNA, 25 bp, Mus musculus
aaaatggtgagtttgtatggatcac

SEQ ID NO: 72346 - DNA, 25 bp, Mus musculus
aaaatggttccagtaagcggcaggc

SEQ ID NO: 72347 - DNA, 25 bp, Mus musculus
aaaatgtcgaggctgcatccgtgcc

SEQ ID NO: 72348 - DNA, 25 bp, Mus musculus
aaaatgtctcacgacgttcacaggg

SEQ ID NO: 72349 - DNA, 25 bp, Mus musculus
aaaatgtttcctgtcgccaaatgca

SEQ ID NO: 72350 - DNA, 25 bp, Mus musculus
aaaatgttttgtgctcattgagctg

SEQ ID NO: 72351 - DNA, 25 bp, Mus musculus
aaaattacaacaccagactctcgcg

SEQ ID NO: 72352 - DNA, 25 bp, Mus musculus
aaaattatccttttggcagtcagaa

SEQ ID NO: 72353 - DNA, 25 bp, Mus musculus
aaaattattgccaggacaccaagac

SEQ ID NO: 72354 - DNA, 25 bp, Mus musculus
aaaattcattatacctgagtacaga

SEQ ID NO: 72355 - DNA, 25 bp, Mus musculus
aaaattcctgaagcttatgggtggc

SEQ ID NO: 72356 - DNA, 25 bp, Mus musculus
aaaattctatggtccagagaggcgg

SEQ ID NO: 72357 - DNA, 25 bp, Mus musculus
aaaattgacaacagccaggtggagt

SEQ ID NO: 72358 - DNA, 25 bp, Mus musculus
aaaattgagaatgctgatgacacgg

SEQ ID NO: 72359 - DNA, 25 bp, Mus musculus
aaaattgcaactgaagtgtacctcg

SEQ ID NO: 72360 - DNA, 25 bp, Mus musculus
aaaattgccatcctgacttacggag

SEQ ID NO: 72361 - DNA, 25 bp, Mus musculus
aaaattgctgaccacgccgtatgag

SEQ ID NO: 72362 - DNA, 25 bp, Mus musculus
aaaattgtgcaagcaggtgacaagg

SEQ ID NO: 72363 - DNA, 25 bp, Mus musculus
aaaattgtgctcaactctggctcgg

SEQ ID NO: 72364 - DNA, 25 bp, Mus musculus
aaaatttacgctctggagtgtcccg

SEQ ID NO: 72365 - DNA, 25 bp, Mus musculus
aaaatttcttccatggagcgtgggc

SEQ ID NO: 72366 - DNA, 25 bp, Mus musculus
aaacaaacagggagcactgtttaat

SEQ ID NO: 72367 - DNA, 25 bp, Mus musculus
aaacaaactgttcggctactggaca

SEQ ID NO: 72368 - DNA, 25 bp, Mus musculus
aaacaaagaaatgggctgtggagcg

SEQ ID NO: 72369 - DNA, 25 bp, Mus musculus
aaacaaaggctgtcccaagctgggc

SEQ ID NO: 72370 - DNA, 25 bp, Mus musculus
aaacaactcctatgaggatgccggg

SEQ ID NO: 72371 - DNA, 25 bp, Mus musculus
aaacaactcctgtgttgggcagaac

SEQ ID NO: 72372 - DNA, 25 bp, Mus musculus
aaacaactctcgctggatggcccag

SEQ ID NO: 72373 - DNA, 25 bp, Mus musculus
aaacaactgcatgcgaagatcgacg

SEQ ID NO: 72374 - DNA, 25 bp, Mus musculus
aaacaacttgttttggagcacagag

SEQ ID NO: 72375 - DNA, 25 bp, Mus musculus
aaacaagaagcgatccctgggagtc

SEQ ID NO: 72376 - DNA, 25 bp, Mus musculus
aaacaagaggatgcggactgtcacc

SEQ ID NO: 72377 - DNA, 25 bp, Mus musculus
aaacaagcgcccctgagttcgtggg

SEQ ID NO: 72378 - DNA, 25 bp, Mus musculus
aaacaagtgcaaaagcggcacctgc

SEQ ID NO: 72379 - DNA, 25 bp, Mus musculus
aaacaatacatgagtggcgtgggca

SEQ ID NO: 72380 - DNA, 25 bp, Mus musculus
aaacaatagagtggagttgctggct

SEQ ID NO: 72381 - DNA, 25 bp, Mus musculus
aaacaccattggataaagctcgaga

SEQ ID NO: 72382 - DNA, 25 bp, Mus musculus
aaacaccgatattcaggccagccag

SEQ ID NO: 72383 - DNA, 25 bp, Mus musculus
aaacacctttcggatgctgatgacc

SEQ ID NO: 72384 - DNA, 25 bp, Mus musculus
aaacacgagcatgataccgaggcca

SEQ ID NO: 72385 - DNA, 25 bp, Mus musculus
aaacactcccggctgctggtgcatg

SEQ ID NO: 72386 - DNA, 25 bp, Mus musculus
aaacactgtcctggagcgggtggaa

SEQ ID NO: 72387 - DNA, 25 bp, Mus musculus
aaacagaagtgagacgtggaggcca

SEQ ID NO: 72388 - DNA, 25 bp, Mus musculus
aaacagaagtgtccggctgtcctgg

SEQ ID NO: 72389 - DNA, 25 bp, Mus musculus
aaacagacatgttggctcaggcccc

SEQ ID NO: 72390 - DNA, 25 bp, Mus musculus
aaacagagcagcagtgcagtgccac

SEQ ID NO: 72391 - DNA, 25 bp, Mus musculus
aaacagaggtggctacaatttggag

SEQ ID NO: 72392 - DNA, 25 bp, Mus musculus
aaacagagtatcaagcaactgaagg

SEQ ID NO: 72393 - DNA, 25 bp, Mus musculus
aaacagatgagggtcaccctttcaa

SEQ ID NO: 72394 - DNA, 25 bp, Mus musculus
aaacagatgtgggatggcggactcc

SEQ ID NO: 72395 - DNA, 25 bp, Mus musculus
aaacagatgtggttgagatcgaggc

SEQ ID NO: 72396 - DNA, 25 bp, Mus musculus
aaacagcagtggtcttcaatggccg

SEQ ID NO: 72397 - DNA, 25 bp, Mus musculus
aaacagcctcttcagcgcagtgaca

SEQ ID NO: 72398 - DNA, 25 bp, Mus musculus
aaacagcctggtgtagccactgcgg

SEQ ID NO: 72399 - DNA, 25 bp, Mus musculus
aaacagctgcttcggcggaggacat

SEQ ID NO: 72400 - DNA, 25 bp, Mus musculus
aaacaggatctggattgccggatgc

SEQ ID NO: 72401 - DNA, 25 bp, Mus musculus
aaacaggcataaagctctccgggtg

SEQ ID NO: 72402 - DNA, 25 bp, Mus musculus
aaacaggcctgggacctggtgagct

SEQ ID NO: 72403 - DNA, 25 bp, Mus musculus
aaacaggtgtcccaagaatccgcag

SEQ ID NO: 72404 - DNA, 25 bp, Mus musculus
aaacagtcttatctgcgtgcagccc

SEQ ID NO: 72405 - DNA, 25 bp, Mus musculus
aaacagtgtccatgctacctggctg

SEQ ID NO: 72406 - DNA, 25 bp, Mus musculus
aaacagttcagagggcccaactcag

SEQ ID NO: 72407 - DNA, 25 bp, Mus musculus
aaacataagcctgagtgagctggta

SEQ ID NO: 72408 - DNA, 25 bp, Mus musculus
aaacataagcgtgtactcatctttg

SEQ ID NO: 72409 - DNA, 25 bp, Mus musculus
aaacatactctggataggccatggc

SEQ ID NO: 72410 - DNA, 25 bp, Mus musculus
aaacatactgcagaaacaatcgtga

SEQ ID NO: 72411 - DNA, 25 bp, Mus musculus
aaacatactgtgtgaatctccagaa

SEQ ID NO: 72412 - DNA, 25 bp, Mus musculus
aaacatagaactcaacgtggcccgc

SEQ ID NO: 72413 - DNA, 25 bp, Mus musculus
aaacatcacactccagaagcgattg

SEQ ID NO: 72414 - DNA, 25 bp, Mus musculus
aaacatcagggagtttctgcccact

SEQ ID NO: 72415 - DNA, 25 bp, Mus musculus
aaacatcgctctcaaagatctgtag

SEQ ID NO: 72416 - DNA, 25 bp, Mus musculus
aaacatgagctctggcctcgcacag

SEQ ID NO: 72417 - DNA, 25 bp, Mus musculus
aaacatggctcggaccttggagggc

SEQ ID NO: 72418 - DNA, 25 bp, Mus musculus
aaacatgtcattgtgggctatccag

SEQ ID NO: 72419 - DNA, 25 bp, Mus musculus
aaaccaacatgcgtccgaatcgggc

SEQ ID NO: 72420 - DNA, 25 bp, Mus musculus
aaaccaaccaaaggagcggctggtg

SEQ ID NO: 72421 - DNA, 25 bp, Mus musculus
aaaccaactggtggcattgattcca

SEQ ID NO: 72422 - DNA, 25 bp, Mus musculus
aaaccaactgtgatcgatgtggaca

SEQ ID NO: 72423 - DNA, 25 bp, Mus musculus
aaaccaagaaggtactgggcctgca

SEQ ID NO: 72424 - DNA, 25 bp, Mus musculus
aaaccaatgacatcaggtagcagcc

SEQ ID NO: 72425 - DNA, 25 bp, Mus musculus
aaaccacagcaggtgccgtcatggt

SEQ ID NO: 72426 - DNA, 25 bp, Mus musculus
aaaccacccgctacgagttcgagca

SEQ ID NO: 72427 - DNA, 25 bp, Mus musculus
aaaccagagtgctgatgtactgtca

SEQ ID NO: 72428 - DNA, 25 bp, Mus musculus
aaaccagcggttagcaggctctgcg

SEQ ID NO: 72429 - DNA, 25 bp, Mus musculus
aaaccagcgtttggcctgccgtgaa

SEQ ID NO: 72430 - DNA, 25 bp, Mus musculus
aaaccagctctgaatagacggccag

SEQ ID NO: 72431 - DNA, 25 bp, Mus musculus
aaaccaggaagatcatgaccagaca

SEQ ID NO: 72432 - DNA, 25 bp, Mus musculus
aaaccaggaggttcttgctgaccca

SEQ ID NO: 72433 - DNA, 25 bp, Mus musculus
aaaccaggccacttctccaggtggg

SEQ ID NO: 72434 - DNA, 25 bp, Mus musculus
aaaccagggctgtcagtagctctga

SEQ ID NO: 72435 - DNA, 25 bp, Mus musculus
aaaccagtgggctgacatctgtgac

SEQ ID NO: 72436 - DNA, 25 bp, Mus musculus
aaaccatttgtagggcttagagctg

SEQ ID NO: 72437 - DNA, 25 bp, Mus musculus
aaacccaaggctggccatagtggta

SEQ ID NO: 72438 - DNA, 25 bp, Mus musculus
aaacccaatcttggagctgagcaga

SEQ ID NO: 72439 - DNA, 25 bp, Mus musculus
aaacccagcacaatccacatggtct

SEQ ID NO: 72440 - DNA, 25 bp, Mus musculus
aaaccccaggcaaggtccatcgttg

SEQ ID NO: 72441 - DNA, 25 bp, Mus musculus
aaaccccatttcctgacttgctgaa

SEQ ID NO: 72442 - DNA, 25 bp, Mus musculus
aaacccgactgaatggtgagtcccg

SEQ ID NO: 72443 - DNA, 25 bp, Mus musculus
aaacccggtagagacaagcctggag

SEQ ID NO: 72444 - DNA, 25 bp, Mus musculus
aaacccgtgaagcacatgctggctg

SEQ ID NO: 72445 - DNA, 25 bp, Mus musculus
aaaccctgaggccaaagctgtgctg

SEQ ID NO: 72446 - DNA, 25 bp, Mus musculus
aaacccttcgcaagatacttctctg

SEQ ID NO: 72447 - DNA, 25 bp, Mus musculus
aaacccttcttcagcgatgacccag

SEQ ID NO: 72448 - DNA, 25 bp, Mus musculus
aaaccctttggatgctaagctcgtg

SEQ ID NO: 72449 - DNA, 25 bp, Mus musculus
aaaccgacgccctgtgatgctgact

SEQ ID NO: 72450 - DNA, 25 bp, Mus musculus
aaaccgatacttgtcacagctgaag

SEQ ID NO: 72451 - DNA, 25 bp, Mus musculus
aaaccgcggattttgccctggctgg

SEQ ID NO: 72452 - DNA, 25 bp, Mus musculus
aaaccggacctcatgtcacagatgg

SEQ ID NO: 72453 - DNA, 25 bp, Mus musculus
aaaccggttcccatgtgcagagtca

SEQ ID NO: 72454 - DNA, 25 bp, Mus musculus
aaaccgttgattgcctgtgtggaga

SEQ ID NO: 72455 - DNA, 25 bp, Mus musculus
aaaccgttggtcaaagcagatgagc

SEQ ID NO: 72456 - DNA, 25 bp, Mus musculus
aaacctaagacctgtagacatgagc

SEQ ID NO: 72457 - DNA, 25 bp, Mus musculus
aaacctactctgaagatacttacag

SEQ ID NO: 72458 - DNA, 25 bp, Mus musculus
aaacctccgccctttggcagtgctg

SEQ ID NO: 72459 - DNA, 25 bp, Mus musculus
aaacctcctactctgacatgcaggg

SEQ ID NO: 72460 - DNA, 25 bp, Mus musculus
aaacctcgaccttgaagatggtgag

SEQ ID NO: 72461 - DNA, 25 bp, Mus musculus
aaacctcgtaggacagaagtgctcg

SEQ ID NO: 72462 - DNA, 25 bp, Mus musculus
aaacctctgtgagtgtgaacaacac

SEQ ID NO: 72463 - DNA, 25 bp, Mus musculus
aaacctggacggtcgctgtcctggg

SEQ ID NO: 72464 - DNA, 25 bp, Mus musculus
aaacctggctgttgatttacatacc

SEQ ID NO: 72465 - DNA, 25 bp, Mus musculus
aaacctgtatcagcttctgtcggag

SEQ ID NO: 72466 - DNA, 25 bp, Mus musculus
aaacctgtctctgtgtgcgctggga

SEQ ID NO: 72467 - DNA, 25 bp, Mus musculus
aaacctgtcttatcagtcagtgcga

SEQ ID NO: 72468 - DNA, 25 bp, Mus musculus
aaacctgtgctgaatggagtggacc

SEQ ID NO: 72469 - DNA, 25 bp, Mus musculus
aaaccttgaaagcacagcacgcgag

SEQ ID NO: 72470 - DNA, 25 bp, Mus musculus
aaaccttgggccctgctcattccag

SEQ ID NO: 72471 - DNA, 25 bp, Mus musculus
aaacctttctggtgggcaatgtgga

SEQ ID NO: 72472 - DNA, 25 bp, Mus musculus
aaacctttggcgctttggatctcgg

SEQ ID NO: 72473 - DNA, 25 bp, Mus musculus
aaacctttgtgagaacggccagtgc

SEQ ID NO: 72474 - DNA, 25 bp, Mus musculus
aaacgaaaacgcttggctgaccaca

SEQ ID NO: 72475 - DNA, 25 bp, Mus musculus
aaacgaaagagtggtgccggcagtc

SEQ ID NO: 72476 - DNA, 25 bp, Mus musculus
aaacgaagtccatcagtgtccaggg

SEQ ID NO: 72477 - DNA, 25 bp, Mus musculus
aaacgaatcgaaggcctggacagca

SEQ ID NO: 72478 - DNA, 25 bp, Mus musculus
aaacgaattgttgtctatcacccca

SEQ ID NO: 72479 - DNA, 25 bp, Mus musculus
aaacgactgcagaaggagacttgac

SEQ ID NO: 72480 - DNA, 25 bp, Mus musculus
aaacgagaactaatcaggatgttgc

SEQ ID NO: 72481 - DNA, 25 bp, Mus musculus
aaacgatccagactatgacccaaag

SEQ ID NO: 72482 - DNA, 25 bp, Mus musculus
aaacgattgccatgagcagccccta

SEQ ID NO: 72483 - DNA, 25 bp, Mus musculus
aaacgcaccttttgaactctgagca

SEQ ID NO: 72484 - DNA, 25 bp, Mus musculus
aaacgccggcgacttaatgatcttg

SEQ ID NO: 72485 - DNA, 25 bp, Mus musculus
aaacgctgcacaggctcgggtcgct

SEQ ID NO: 72486 - DNA, 25 bp, Mus musculus
aaacgctttgtgacgggaggtcagc

SEQ ID NO: 72487 - DNA, 25 bp, Mus musculus
aaacggaaaaagtcatcaccagctg

SEQ ID NO: 72488 - DNA, 25 bp, Mus musculus
aaacggaagtgttgctgctcgagca

SEQ ID NO: 72489 - DNA, 25 bp, Mus musculus
aaacggaggcttaccacaatctggg

SEQ ID NO: 72490 - DNA, 25 bp, Mus musculus
aaacggatatactctgaacactggg

SEQ ID NO: 72491 - DNA, 25 bp, Mus musculus
aaacggatcgttcagcagctcagca

SEQ ID NO: 72492 - DNA, 25 bp, Mus musculus
aaacggcctgtcaagctgtgcagca

SEQ ID NO: 72493 - DNA, 25 bp, Mus musculus
aaacggcgacgggacttctatgcag

SEQ ID NO: 72494 - DNA, 25 bp, Mus musculus
aaacgggaccgagagcagactctgg

SEQ ID NO: 72495 - DNA, 25 bp, Mus musculus
aaacgggacgtctttcttgtcgctg

SEQ ID NO: 72496 - DNA, 25 bp, Mus musculus
aaacgggaggccttcatggagcagt

SEQ ID NO: 72497 - DNA, 25 bp, Mus musculus
aaacgggatctttcacagagacgtg

SEQ ID NO: 72498 - DNA, 25 bp, Mus musculus
aaacgggctgcgtgctgtggctcca

SEQ ID NO: 72499 - DNA, 25 bp, Mus musculus
aaacgtaaagcagcagtgtggcccc

SEQ ID NO: 72500 - DNA, 25 bp, Mus musculus
aaacgtagtcccgtcaggacgcgct

SEQ ID NO: 72501 - DNA, 25 bp, Mus musculus
aaacgtcatccggtggcacaatcag

SEQ ID NO: 72502 - DNA, 25 bp, Mus musculus
aaacgtgacacctgggaactgctgg

SEQ ID NO: 72503 - DNA, 25 bp, Mus musculus
aaacgtgccaggatagcgaaagagc

SEQ ID NO: 72504 - DNA, 25 bp, Mus musculus
aaacgtgcctgccagttcaaccgga

SEQ ID NO: 72505 - DNA, 25 bp, Mus musculus
aaacgttgcgcaggttcaaaaatgg

SEQ ID NO: 72506 - DNA, 25 bp, Mus musculus
aaactaaattctgaccctcagttcg

SEQ ID NO: 72507 - DNA, 25 bp, Mus musculus
aaactacacaggacattcttcgggc

SEQ ID NO: 72508 - DNA, 25 bp, Mus musculus
aaactacggaatgtgtggcagagca

SEQ ID NO: 72509 - DNA, 25 bp, Mus musculus
aaactagagtatggtggcatgggcc

SEQ ID NO: 72510 - DNA, 25 bp, Mus musculus
aaactaggatgggtggagctccaca

SEQ ID NO: 72511 - DNA, 25 bp, Mus musculus
aaactattataaatggcgagcagaa

SEQ ID NO: 72512 - DNA, 25 bp, Mus musculus
aaactatttcagatggagagacagc

SEQ ID NO: 72513 - DNA, 25 bp, Mus musculus
aaactcaagaggttcacttgcctct

SEQ ID NO: 72514 - DNA, 25 bp, Mus musculus
aaactcaagggtggattctcggctc

SEQ ID NO: 72515 - DNA, 25 bp, Mus musculus
aaactcactcaccaggcgcgggagg

SEQ ID NO: 72516 - DNA, 25 bp, Mus musculus
aaactccaagccctggcaaggaggg

SEQ ID NO: 72517 - DNA, 25 bp, Mus musculus
aaactccaccccttgctatggtctg

SEQ ID NO: 72518 - DNA, 25 bp, Mus musculus
aaactccgtcgtcagatctacaagg

SEQ ID NO: 72519 - DNA, 25 bp, Mus musculus
aaactcgagaacatgctgcagaact

SEQ ID NO: 72520 - DNA, 25 bp, Mus musculus
aaactcgccgccttctctgatgacg

SEQ ID NO: 72521 - DNA, 25 bp, Mus musculus
aaactcgggccgtctttgactgcag

SEQ ID NO: 72522 - DNA, 25 bp, Mus musculus
aaactcgtagccgtgtgtatgaacc

SEQ ID NO: 72523 - DNA, 25 bp, Mus musculus
aaactctccggcgaccgtgagactg

SEQ ID NO: 72524 - DNA, 25 bp, Mus musculus
aaactctctgttgctgcggacctga

SEQ ID NO: 72525 - DNA, 25 bp, Mus musculus
aaactctgtcactaccagccatggc

SEQ ID NO: 72526 - DNA, 25 bp, Mus musculus
aaactcttctatctggtggacccca

SEQ ID NO: 72527 - DNA, 25 bp, Mus musculus
aaactcttggctttctcagtataaa

SEQ ID NO: 72528 - DNA, 25 bp, Mus musculus
aaactcttgggcatcgctatggaac

SEQ ID NO: 72529 - DNA, 25 bp, Mus musculus
aaactcttgggtgaagacaaatggg

SEQ ID NO: 72530 - DNA, 25 bp, Mus musculus
aaactgaaggaactcgatggtgaac

SEQ ID NO: 72531 - DNA, 25 bp, Mus musculus
aaactgaggcagaagtcaccctcag

SEQ ID NO: 72532 - DNA, 25 bp, Mus musculus
aaactgaggcccagtcgacgtggca

SEQ ID NO: 72533 - DNA, 25 bp, Mus musculus
aaactgaggctggtgttcaagagtc

SEQ ID NO: 72534 - DNA, 25 bp, Mus musculus
aaactgatggtagagctttggcaaa

SEQ ID NO: 72535 - DNA, 25 bp, Mus musculus
aaactgcacctggagtgtagcctgc

SEQ ID NO: 72536 - DNA, 25 bp, Mus musculus
aaactgcacttcagggctgtggacc

SEQ ID NO: 72537 - DNA, 25 bp, Mus musculus
aaactgcagctgagttaaaaaagcg

SEQ ID NO: 72538 - DNA, 25 bp, Mus musculus
aaactgcagttggtgctggccccac

SEQ ID NO: 72539 - DNA, 25 bp, Mus musculus
aaactgcattgttcaccgggacctg

SEQ ID NO: 72540 - DNA, 25 bp, Mus musculus
aaactgccacatgtttctggtaacc

SEQ ID NO: 72541 - DNA, 25 bp, Mus musculus
aaactgccacgtaaaccgcaagcga

SEQ ID NO: 72542 - DNA, 25 bp, Mus musculus
aaactgcccactctgtatccctaat

SEQ ID NO: 72543 - DNA, 25 bp, Mus musculus
aaactgcgctgtcaggacctggcga

SEQ ID NO: 72544 - DNA, 25 bp, Mus musculus
aaactgctcttcacagacgacagcg

SEQ ID NO: 72545 - DNA, 25 bp, Mus musculus
aaactgctgtcattcagagatgtgg

SEQ ID NO: 72546 - DNA, 25 bp, Mus musculus
aaactggaatttcccgcggagctga

SEQ ID NO: 72547 - DNA, 25 bp, Mus musculus
aaactggatcttcttgaacaggaat

SEQ ID NO: 72548 - DNA, 25 bp, Mus musculus
aaactggcagacctttctctccgga

SEQ ID NO: 72549 - DNA, 25 bp, Mus musculus
aaactggcccgtgctgacagtgacg

SEQ ID NO: 72550 - DNA, 25 bp, Mus musculus
aaactgggagatggcctatactgaa

SEQ ID NO: 72551 - DNA, 25 bp, Mus musculus
aaactggtaatcagcctaggtgacg

SEQ ID NO: 72552 - DNA, 25 bp, Mus musculus
aaactgtgacggagccagagcaaca

SEQ ID NO: 72553 - DNA, 25 bp, Mus musculus
aaactgtgagacttccggcgtgggt

SEQ ID NO: 72554 - DNA, 25 bp, Mus musculus
aaactgtggtggtatcccagcgctg

SEQ ID NO: 72555 - DNA, 25 bp, Mus musculus
aaacttcatcactcgggagaacctg

SEQ ID NO: 72556 - DNA, 25 bp, Mus musculus
aaacttcgtgaagcatcggccgacg

SEQ ID NO: 72557 - DNA, 25 bp, Mus musculus
aaacttctaccagtacgcttgcgga

SEQ ID NO: 72558 - DNA, 25 bp, Mus musculus
aaacttctgccggtcctgttgctgc

SEQ ID NO: 72559 - DNA, 25 bp, Mus musculus
aaacttcttccaggcgatagagcgc

SEQ ID NO: 72560 - DNA, 25 bp, Mus musculus
aaacttgacgaacatcaggctgcca

SEQ ID NO: 72561 - DNA, 25 bp, Mus musculus
aaacttgactcgctgcctcctgtaa

SEQ ID NO: 72562 - DNA, 25 bp, Mus musculus
aaacttgatggtgggtggaagcacc

SEQ ID NO: 72563 - DNA, 25 bp, Mus musculus
aaacttgcacaatctaatggctggg

SEQ ID NO: 72564 - DNA, 25 bp, Mus musculus
aaacttgcctgtgttttccaacctg

SEQ ID NO: 72565 - DNA, 25 bp, Mus musculus
aaacttgggctcaagccctcggtgg

SEQ ID NO: 72566 - DNA, 25 bp, Mus musculus
aaacttggtgagagtgtccaggacc

SEQ ID NO: 72567 - DNA, 25 bp, Mus musculus
aaacttgtacgtcatttcccagatg

SEQ ID NO: 72568 - DNA, 25 bp, Mus musculus
aaactttaaagcaagacctggccag

SEQ ID NO: 72569 - DNA, 25 bp, Mus musculus
aaactttaaggcagatgatcccggg

SEQ ID NO: 72570 - DNA, 25 bp, Mus musculus
aaactttgagtctactgcgcaggcg

SEQ ID NO: 72571 - DNA, 25 bp, Mus musculus
aaactttttggcagacttttatctg

SEQ ID NO: 72572 - DNA, 25 bp, Mus musculus
aaagaaaagcaataggcggagccgc

SEQ ID NO: 72573 - DNA, 25 bp, Mus musculus
aaagaaaagctctacgcagtcaacg

SEQ ID NO: 72574 - DNA, 25 bp, Mus musculus
aaagaaacaagctgtgcggacctgg

SEQ ID NO: 72575 - DNA, 25 bp, Mus musculus
aaagaaacggatcctcctgccagag

SEQ ID NO: 72576 - DNA, 25 bp, Mus musculus
aaagaaagcggccaaatgttgcgac

SEQ ID NO: 72577 - DNA, 25 bp, Mus musculus
aaagaaaggtgtgtcctcagtgcct

SEQ ID NO: 72578 - DNA, 25 bp, Mus musculus
aaagaaatcctgagcttggccctga

SEQ ID NO: 72579 - DNA, 25 bp, Mus musculus
aaagaaatttcctctagggctggag

SEQ ID NO: 72580 - DNA, 25 bp, Mus musculus
aaagaaccgtagaggaccacgagct

SEQ ID NO: 72581 - DNA, 25 bp, Mus musculus
aaagaacctagcctcacagtggtgg

SEQ ID NO: 72582 - DNA, 25 bp, Mus musculus
aaagaacctgctgcttagaagccag

SEQ ID NO: 72583 - DNA, 25 bp, Mus musculus
aaagaacgccatccttattggaatg

SEQ ID NO: 72584 - DNA, 25 bp, Mus musculus
aaagaacgcgagtgatcggagtgcc

SEQ ID NO: 72585 - DNA, 25 bp, Mus musculus
aaagaactcaggtgggacctctctg

SEQ ID NO: 72586 - DNA, 25 bp, Mus musculus
aaagaagatggcatcagcgccgcca

SEQ ID NO: 72587 - DNA, 25 bp, Mus musculus
aaagaagcactgtttcacactccag

SEQ ID NO: 72588 - DNA, 25 bp, Mus musculus
aaagaagcaggtatcggcagagttt

SEQ ID NO: 72589 - DNA, 25 bp, Mus musculus
aaagaagcctttctgcgtctgccca

SEQ ID NO: 72590 - DNA, 25 bp, Mus musculus
aaagaagctagtgcgctgggcaaac

SEQ ID NO: 72591 - DNA, 25 bp, Mus musculus
aaagaagctggtgtacctgtacttg

SEQ ID NO: 72592 - DNA, 25 bp, Mus musculus
aaagaaggctgctcagaacgtggac

SEQ ID NO: 72593 - DNA, 25 bp, Mus musculus
aaagaatcagaatccgtcctccagg

SEQ ID NO: 72594 - DNA, 25 bp, Mus musculus
aaagaatctactgttctacaccagg

SEQ ID NO: 72595 - DNA, 25 bp, Mus musculus
aaagaatctcagagcgccagcgcat

SEQ ID NO: 72596 - DNA, 25 bp, Mus musculus
aaagaatggctcaagaagtactgac

SEQ ID NO: 72597 - DNA, 25 bp, Mus musculus
aaagaatgtaaagtactcattttct

SEQ ID NO: 72598 - DNA, 25 bp, Mus musculus
aaagaatgtttccatagccatcgag

SEQ ID NO: 72599 - DNA, 25 bp, Mus musculus
aaagacaacctgaagctgctgcgag

SEQ ID NO: 72600 - DNA, 25 bp, Mus musculus
aaagacaagagcaacccagatgagt

SEQ ID NO: 72601 - DNA, 25 bp, Mus musculus
aaagacaagatcgattcctccaaag

SEQ ID NO: 72602 - DNA, 25 bp, Mus musculus
aaagacagcaaagcagtcacaggcg

SEQ ID NO: 72603 - DNA, 25 bp, Mus musculus
aaagacagcgctgcagcagtcacca

SEQ ID NO: 72604 - DNA, 25 bp, Mus musculus
aaagacatggtccaagacctgctgg

SEQ ID NO: 72605 - DNA, 25 bp, Mus musculus
aaagacattcttttggctttgttgc

SEQ ID NO: 72606 - DNA, 25 bp, Mus musculus
aaagaccacgataatgaagaatatt

SEQ ID NO: 72607 - DNA, 25 bp, Mus musculus
aaagacccgcgccaatgtggacaag

SEQ ID NO: 72608 - DNA, 25 bp, Mus musculus
aaagacccttgagcggctccgaggt

SEQ ID NO: 72609 - DNA, 25 bp, Mus musculus
aaagaccgactggacttccatcagg

SEQ ID NO: 72610 - DNA, 25 bp, Mus musculus
aaagaccgcccaaaacctggtgctg

SEQ ID NO: 72611 - DNA, 25 bp, Mus musculus
aaagacctgatgacgttggtgccac

SEQ ID NO: 72612 - DNA, 25 bp, Mus musculus
aaagacctggtacacaaacttgacg

SEQ ID NO: 72613 - DNA, 25 bp, Mus musculus
aaagaccttattcctgcagtgtgtg

SEQ ID NO: 72614 - DNA, 25 bp, Mus musculus
aaagacctttggctcgcagaggaga

SEQ ID NO: 72615 - DNA, 25 bp, Mus musculus
aaagacgccaaggaggatgacagcg

SEQ ID NO: 72616 - DNA, 25 bp, Mus musculus
aaagacgctccttggaccggcgtat

SEQ ID NO: 72617 - DNA, 25 bp, Mus musculus
aaagacgtccttgttgattgcacct

SEQ ID NO: 72618 - DNA, 25 bp, Mus musculus
aaagactagttagggacatttgctc

SEQ ID NO: 72619 - DNA, 25 bp, Mus musculus
aaagactgaaaggagagtgacggac

SEQ ID NO: 72620 - DNA, 25 bp, Mus musculus
aaagactgcactttgaggcctcccc

SEQ ID NO: 72621 - DNA, 25 bp, Mus musculus
aaagagacagtgtggcttgctgcca

SEQ ID NO: 72622 - DNA, 25 bp, Mus musculus
aaagagaccttgttcagcctgtcag

SEQ ID NO: 72623 - DNA, 25 bp, Mus musculus
aaagagattgacgtttccaaagccg

SEQ ID NO: 72624 - DNA, 25 bp, Mus musculus
aaagagcccgagtatttctccaagg

SEQ ID NO: 72625 - DNA, 25 bp, Mus musculus
aaagagctacgggatccaagacgtg

SEQ ID NO: 72626 - DNA, 25 bp, Mus musculus
aaagagctgatctcgagccaggaca

SEQ ID NO: 72627 - DNA, 25 bp, Mus musculus
aaagagctgttgcttgccttgctgc

SEQ ID NO: 72628 - DNA, 25 bp, Mus musculus
aaagaggaatctgctcaggctgtgg

SEQ ID NO: 72629 - DNA, 25 bp, Mus musculus
aaagaggacctttggagccattgga

SEQ ID NO: 72630 - DNA, 25 bp, Mus musculus
aaagaggagctgaatgcagtgcgca

SEQ ID NO: 72631 - DNA, 25 bp, Mus musculus
aaagaggccttgaccaaccagaagt

SEQ ID NO: 72632 - DNA, 25 bp, Mus musculus
aaagagtaactgtggccaagctcac

SEQ ID NO: 72633 - DNA, 25 bp, Mus musculus
aaagagtcctgtacacaccagtccg

SEQ ID NO: 72634 - DNA, 25 bp, Mus musculus
aaagagtctccaagtcacggtctcg

SEQ ID NO: 72635 - DNA, 25 bp, Mus musculus
aaagagttagatgcctttcccaagg

SEQ ID NO: 72636 - DNA, 25 bp, Mus musculus
aaagagttggcgttcgagggctgaa

SEQ ID NO: 72637 - DNA, 25 bp, Mus musculus
aaagagttttttcaatgcgccagtg

SEQ ID NO: 72638 - DNA, 25 bp, Mus musculus
aaagataggaagtgacgtctgggcc

SEQ ID NO: 72639 - DNA, 25 bp, Mus musculus
aaagatcagccccagaaggaaactg

SEQ ID NO: 72640 - DNA, 25 bp, Mus musculus
aaagatcattgatttgggtggctgc

SEQ ID NO: 72641 - DNA, 25 bp, Mus musculus
aaagatccagccagtggccggcagt

SEQ ID NO: 72642 - DNA, 25 bp, Mus musculus
aaagatccatcagcggcagtctcag

SEQ ID NO: 72643 - DNA, 25 bp, Mus musculus
aaagatcccgattggttggctcagc

SEQ ID NO: 72644 - DNA, 25 bp, Mus musculus
aaagatcctcctgggatgttcggca

SEQ ID NO: 72645 - DNA, 25 bp, Mus musculus
aaagatcctcggtctcaggacagca

SEQ ID NO: 72646 - DNA, 25 bp, Mus musculus
aaagatctcagcacaatagagccgc

SEQ ID NO: 72647 - DNA, 25 bp, Mus musculus
aaagatctcagtacagtagaagcgc

SEQ ID NO: 72648 - DNA, 25 bp, Mus musculus
aaagatcttccgctggagggtcaac

SEQ ID NO: 72649 - DNA, 25 bp, Mus musculus
aaagatgactgtgcgtccgagctga

SEQ ID NO: 72650 - DNA, 25 bp, Mus musculus
aaagatgagaatgaccaggtacccc

SEQ ID NO: 72651 - DNA, 25 bp, Mus musculus
aaagatgcctgtacaagcttctagc

SEQ ID NO: 72652 - DNA, 25 bp, Mus musculus
aaagatggacccctcgtgagcatgg

SEQ ID NO: 72653 - DNA, 25 bp, Mus musculus
aaagatggatgcatcggttgggccc

SEQ ID NO: 72654 - DNA, 25 bp, Mus musculus
aaagatggcaagaccaccaagcgag

SEQ ID NO: 72655 - DNA, 25 bp, Mus musculus
aaagatggcttcaacccggctcatg

SEQ ID NO: 72656 - DNA, 25 bp, Mus musculus
aaagatgggattctcctggccaccg

SEQ ID NO: 72657 - DNA, 25 bp, Mus musculus
aaagatgtagccctcgtcctgactg

SEQ ID NO: 72658 - DNA, 25 bp, Mus musculus
aaagatgtgggacggaagcctccta

SEQ ID NO: 72659 - DNA, 25 bp, Mus musculus
aaagattccagtgtcattttcaaca

SEQ ID NO: 72660 - DNA, 25 bp, Mus musculus
aaagattgacttggcaggcagcgca

SEQ ID NO: 72661 - DNA, 25 bp, Mus musculus
aaagattgagcggaatcggcagccc

SEQ ID NO: 72662 - DNA, 25 bp, Mus musculus
aaagattggcgatgccttccgggag

SEQ ID NO: 72663 - DNA, 25 bp, Mus musculus
aaagattggcgatggtcctctacga

SEQ ID NO: 72664 - DNA, 25 bp, Mus musculus
aaagattgggtcctgcgtggcaacc

SEQ ID NO: 72665 - DNA, 25 bp, Mus musculus
aaagattgtgctcatctccgttgct

SEQ ID NO: 72666 - DNA, 25 bp, Mus musculus
aaagatttggaggttccctggcagg

SEQ ID NO: 72667 - DNA, 25 bp, Mus musculus
aaagattttacaggaccagcccagc

SEQ ID NO: 72668 - DNA, 25 bp, Mus musculus
aaagcaaaacttagacgtcgtcagc

SEQ ID NO: 72669 - DNA, 25 bp, Mus musculus
aaagcaaagagactccaccaaagag

SEQ ID NO: 72670 - DNA, 25 bp, Mus musculus
aaagcaaaggctcctctcataccgg

SEQ ID NO: 72671 - DNA, 25 bp, Mus musculus
aaagcaagatgtcgtctgcatcggg

SEQ ID NO: 72672 - DNA, 25 bp, Mus musculus
aaagcaagctgttctgcggcaccag

SEQ ID NO: 72673 - DNA, 25 bp, Mus musculus
aaagcaaggtggcatcaccagtgag

SEQ ID NO: 72674 - DNA, 25 bp, Mus musculus
aaagcacactaagaagcctgacggg

SEQ ID NO: 72675 - DNA, 25 bp, Mus musculus
aaagcacactgccactgcctgaggt

SEQ ID NO: 72676 - DNA, 25 bp, Mus musculus
aaagcaccgagacttcgtggcagag

SEQ ID NO: 72677 - DNA, 25 bp, Mus musculus
aaagcactggtgagcctcttggcca

SEQ ID NO: 72678 - DNA, 25 bp, Mus musculus
aaagcactgttgctgtccagctacg

SEQ ID NO: 72679 - DNA, 25 bp, Mus musculus
aaagcacttcaaagaatgcgtccac

SEQ ID NO: 72680 - DNA, 25 bp, Mus musculus
aaagcactttctggatgcgggtgcc

SEQ ID NO: 72681 - DNA, 25 bp, Mus musculus
aaagcagcaccaaggtctcactgaa

SEQ ID NO: 72682 - DNA, 25 bp, Mus musculus
aaagcagccaccaagcgtcagaagt

SEQ ID NO: 72683 - DNA, 25 bp, Mus musculus
aaagcagcgtttccttcaatcccga

SEQ ID NO: 72684 - DNA, 25 bp, Mus musculus
aaagcagctgcttccggaggaggac

SEQ ID NO: 72685 - DNA, 25 bp, Mus musculus
aaagcagcttgcttgattcaagcct

SEQ ID NO: 72686 - DNA, 25 bp, Mus musculus
aaagcagtactatcggcgagcccag

SEQ ID NO: 72687 - DNA, 25 bp, Mus musculus
aaagcagtggcgtccttgaaggcaa

SEQ ID NO: 72688 - DNA, 25 bp, Mus musculus
aaagcagttctacccaagcctgagg

SEQ ID NO: 72689 - DNA, 25 bp, Mus musculus
aaagcatactcaaggactttgacgg

SEQ ID NO: 72690 - DNA, 25 bp, Mus musculus
aaagcatctgtctctgaaagcggcc

SEQ ID NO: 72691 - DNA, 25 bp, Mus musculus
aaagcatggccgctagccctgtgct

SEQ ID NO: 72692 - DNA, 25 bp, Mus musculus
aaagcatgtgaatggctccgggcca

SEQ ID NO: 72693 - DNA, 25 bp, Mus musculus
aaagcattcatgagacagtcctggc

SEQ ID NO: 72694 - DNA, 25 bp, Mus musculus
aaagcattcctgatgagtcgaggcc

SEQ ID NO: 72695 - DNA, 25 bp, Mus musculus
aaagcattcttcatggtgctcaggc

SEQ ID NO: 72696 - DNA, 25 bp, Mus musculus
aaagcattgggcagcacttgggaag

SEQ ID NO: 72697 - DNA, 25 bp, Mus musculus
aaagcattgttcttcagggcccttg

SEQ ID NO: 72698 - DNA, 25 bp, Mus musculus
aaagccaaagtggattcatcctgca

SEQ ID NO: 72699 - DNA, 25 bp, Mus musculus
aaagccaacttcatgagctcgcaga

SEQ ID NO: 72700 - DNA, 25 bp, Mus musculus
aaagccaaggttccagcgaggcaga

SEQ ID NO: 72701 - DNA, 25 bp, Mus musculus
aaagccagcatgcatcccgtgactg

SEQ ID NO: 72702 - DNA, 25 bp, Mus musculus
aaagccagccctacgcggtgttgcg

SEQ ID NO: 72703 - DNA, 25 bp, Mus musculus
aaagccagccgccagtgaagagtga

SEQ ID NO: 72704 - DNA, 25 bp, Mus musculus
aaagccaggctagctcccaagggct

SEQ ID NO: 72705 - DNA, 25 bp, Mus musculus
aaagccatgctaagactgggaccag

SEQ ID NO: 72706 - DNA, 25 bp, Mus musculus
aaagccattgacgaagtctctgcag

SEQ ID NO: 72707 - DNA, 25 bp, Mus musculus
aaagccatttggcacgccttcaccg

SEQ ID NO: 72708 - DNA, 25 bp, Mus musculus
aaagcccacttggatgaagctcgga

SEQ ID NO: 72709 - DNA, 25 bp, Mus musculus
aaagcccagtacgaggagatagccc

SEQ ID NO: 72710 - DNA, 25 bp, Mus musculus
aaagcccatggtggtattgccatac

SEQ ID NO: 72711 - DNA, 25 bp, Mus musculus
aaagcccctgggtctgtttgacttg

SEQ ID NO: 72712 - DNA, 25 bp, Mus musculus
aaagcccggacgcaattcgtgcaga

SEQ ID NO: 72713 - DNA, 25 bp, Mus musculus
aaagccctcgtgtgcgcgggaccca

SEQ ID NO: 72714 - DNA, 25 bp, Mus musculus
aaagccctggtcaagattgtgcccg

SEQ ID NO: 72715 - DNA, 25 bp, Mus musculus
aaagccggccagacatgggattgca

SEQ ID NO: 72716 - DNA, 25 bp, Mus musculus
aaagcctcgatgagaattgctggtg

SEQ ID NO: 72717 - DNA, 25 bp, Mus musculus
aaagcctctactcctcagttccggg

SEQ ID NO: 72718 - DNA, 25 bp, Mus musculus
aaagcctctttcctgtcaacctggg

SEQ ID NO: 72719 - DNA, 25 bp, Mus musculus
aaagcctgacagagcagtactgctg

SEQ ID NO: 72720 - DNA, 25 bp, Mus musculus
aaagcctgatagtaaccttcctgag

SEQ ID NO: 72721 - DNA, 25 bp, Mus musculus
aaagcctgcctcacaaagactcgga

SEQ ID NO: 72722 - DNA, 25 bp, Mus musculus
aaagcctgggtgagcgtgcgctccc

SEQ ID NO: 72723 - DNA, 25 bp, Mus musculus
aaagccttcagttaccggcactgtg

SEQ ID NO: 72724 - DNA, 25 bp, Mus musculus
aaagcctttgtgacccgaagccagt

SEQ ID NO: 72725 - DNA, 25 bp, Mus musculus
aaagcgacggtctactggagtctcc

SEQ ID NO: 72726 - DNA, 25 bp, Mus musculus
aaagcgagcccacatgttgattgac

SEQ ID NO: 72727 - DNA, 25 bp, Mus musculus
aaagcgatgcgacggacgggcgctc

SEQ ID NO: 72728 - DNA, 25 bp, Mus musculus
aaagcgcctctactgggagacagga

SEQ ID NO: 72729 - DNA, 25 bp, Mus musculus
aaagcgcctgctagcctctgtgtca

SEQ ID NO: 72730 - DNA, 25 bp, Mus musculus
aaagcggacctttgactctgcagtg

SEQ ID NO: 72731 - DNA, 25 bp, Mus musculus
aaagcggtgccaaaagaaggcgcca

SEQ ID NO: 72732 - DNA, 25 bp, Mus musculus
aaagcgtgcagcctgaataaggacc

SEQ ID NO: 72733 - DNA, 25 bp, Mus musculus
aaagcgttgagaaaagacaccccag

SEQ ID NO: 72734 - DNA, 25 bp, Mus musculus
aaagctacagatctaactcattttc

SEQ ID NO: 72735 - DNA, 25 bp, Mus musculus
aaagctactggtctccgtcctggag

SEQ ID NO: 72736 - DNA, 25 bp, Mus musculus
aaagctatccactacttctcgctgg

SEQ ID NO: 72737 - DNA, 25 bp, Mus musculus
aaagctatcggtgtcctgaccagcg

SEQ ID NO: 72738 - DNA, 25 bp, Mus musculus
aaagctattggtacctcagagccgg

SEQ ID NO: 72739 - DNA, 25 bp, Mus musculus
aaagctccgagactgtaggccatgc

SEQ ID NO: 72740 - DNA, 25 bp, Mus musculus
aaagctcctcgtgtctggggctgca

SEQ ID NO: 72741 - DNA, 25 bp, Mus musculus
aaagctcctgctctgaatcgtggga

SEQ ID NO: 72742 - DNA, 25 bp, Mus musculus
aaagctctagtcacccgtgggaggg

SEQ ID NO: 72743 - DNA, 25 bp, Mus musculus
aaagctgaagcctttagctgcaaag

SEQ ID NO: 72744 - DNA, 25 bp, Mus musculus
aaagctgaatggtctcctcctggag

SEQ ID NO: 72745 - DNA, 25 bp, Mus musculus
aaagctgaggctatgatggcggcaa

SEQ ID NO: 72746 - DNA, 25 bp, Mus musculus
aaagctgcgggttctaattgctgcc

SEQ ID NO: 72747 - DNA, 25 bp, Mus musculus
aaagctggaggagcgtctctactcg

SEQ ID NO: 72748 - DNA, 25 bp, Mus musculus
aaagctggctcctgaattttcaaaa

SEQ ID NO: 72749 - DNA, 25 bp, Mus musculus
aaagctggtgtcatcctctaatgca

SEQ ID NO: 72750 - DNA, 25 bp, Mus musculus
aaagctgtcaccgagggcgctcagg

SEQ ID NO: 72751 - DNA, 25 bp, Mus musculus
aaagctgtcttatggtcctcactgc

SEQ ID NO: 72752 - DNA, 25 bp, Mus musculus
aaagctgtgagcgagctgccttcag

SEQ ID NO: 72753 - DNA, 25 bp, Mus musculus
aaagctgtgattctcattggaggcc

SEQ ID NO: 72754 - DNA, 25 bp, Mus musculus
aaagctgttccgtagccagagtgcg

SEQ ID NO: 72755 - DNA, 25 bp, Mus musculus
aaagctgttgaagacatggtggcca

SEQ ID NO: 72756 - DNA, 25 bp, Mus musculus
aaagcttaagtcctcctggcctacg

SEQ ID NO: 72757 - DNA, 25 bp, Mus musculus
aaagcttcatgcagccaaggtccag

SEQ ID NO: 72758 - DNA, 25 bp, Mus musculus
aaagcttgcagcctgtgacagttca

SEQ ID NO: 72759 - DNA, 25 bp, Mus musculus
aaagcttggccagtctatagagtca

SEQ ID NO: 72760 - DNA, 25 bp, Mus musculus
aaagcttgggcgagctggactcctc

SEQ ID NO: 72761 - DNA, 25 bp, Mus musculus
aaagctttcagctgttcttctaacc

SEQ ID NO: 72762 - DNA, 25 bp, Mus musculus
aaagcttttctggatcgagtggacc

SEQ ID NO: 72763 - DNA, 25 bp, Mus musculus
aaagcttttggactgctgaaggccc

SEQ ID NO: 72764 - DNA, 25 bp, Mus musculus
aaaggaaaccgctgacgtgagtcgc

SEQ ID NO: 72765 - DNA, 25 bp, Mus musculus
aaaggaaagcgcgaggagacgccgc

SEQ ID NO: 72766 - DNA, 25 bp, Mus musculus
aaaggaaatcgtctctctgaagcag

SEQ ID NO: 72767 - DNA, 25 bp, Mus musculus
aaaggaacccagatccgtcaacgag

SEQ ID NO: 72768 - DNA, 25 bp, Mus musculus
aaaggaacccttgagttacagtgtg

SEQ ID NO: 72769 - DNA, 25 bp, Mus musculus
aaaggaagcttaaccatacagcagg

SEQ ID NO: 72770 - DNA, 25 bp, Mus musculus
aaaggaatgtgttctcgctgtggca

SEQ ID NO: 72771 - DNA, 25 bp, Mus musculus
aaaggacactagagaagagcttcca

SEQ ID NO: 72772 - DNA, 25 bp, Mus musculus
aaaggacactcgctttatcccaggg

SEQ ID NO: 72773 - DNA, 25 bp, Mus musculus
aaaggacagccttcgttaacatgct

SEQ ID NO: 72774 - DNA, 25 bp, Mus musculus
aaaggacatcatgacgcccctggtg

SEQ ID NO: 72775 - DNA, 25 bp, Mus musculus
aaaggacccagcgttatggaggctc

SEQ ID NO: 72776 - DNA, 25 bp, Mus musculus
aaaggacctcagtgacacatcgagc

SEQ ID NO: 72777 - DNA, 25 bp, Mus musculus
aaaggactcagcttgcagggaaggt

SEQ ID NO: 72778 - DNA, 25 bp, Mus musculus
aaaggactccgcctagaggatccag

SEQ ID NO: 72779 - DNA, 25 bp, Mus musculus
aaaggactgcttcccatgatcgccc

SEQ ID NO: 72780 - DNA, 25 bp, Mus musculus
aaaggagaccagttcagcagccatc

SEQ ID NO: 72781 - DNA, 25 bp, Mus musculus
aaaggagacggctctgtgacgacct

SEQ ID NO: 72782 - DNA, 25 bp, Mus musculus
aaaggagcagggagcagtcgcagct

SEQ ID NO: 72783 - DNA, 25 bp, Mus musculus
aaaggagccaggacttgaaccacca

SEQ ID NO: 72784 - DNA, 25 bp, Mus musculus
aaaggagcgctccattatccctgga

SEQ ID NO: 72785 - DNA, 25 bp, Mus musculus
aaaggaggcacagacagcaaaggct

SEQ ID NO: 72786 - DNA, 25 bp, Mus musculus
aaaggaggcccactttctatcaggg

SEQ ID NO: 72787 - DNA, 25 bp, Mus musculus
aaaggaggcctttgatagcaccagc

SEQ ID NO: 72788 - DNA, 25 bp, Mus musculus
aaaggagggactatggcgtcaaaca

SEQ ID NO: 72789 - DNA, 25 bp, Mus musculus
aaaggagtacttgatgcgtgcccac

SEQ ID NO: 72790 - DNA, 25 bp, Mus musculus
aaaggagtcggggtctgggcgtgcg

SEQ ID NO: 72791 - DNA, 25 bp, Mus musculus
aaaggagtttcgcatgagcctgccg

SEQ ID NO: 72792 - DNA, 25 bp, Mus musculus
aaaggataccagcatcgaggtcacg

SEQ ID NO: 72793 - DNA, 25 bp, Mus musculus
aaaggatagatgcaacctggtgcgc

SEQ ID NO: 72794 - DNA, 25 bp, Mus musculus
aaaggatctgcagctggcgccactg

SEQ ID NO: 72795 - DNA, 25 bp, Mus musculus
aaaggatgtgttctctgtacccagc

SEQ ID NO: 72796 - DNA, 25 bp, Mus musculus
aaaggattcaggatatacggtgcac

SEQ ID NO: 72797 - DNA, 25 bp, Mus musculus
aaaggatttctcttgtgcagaccgc

SEQ ID NO: 72798 - DNA, 25 bp, Mus musculus
aaaggcacctgtgtagagggcacca

SEQ ID NO: 72799 - DNA, 25 bp, Mus musculus
aaaggcatccactaagctcgttctc

SEQ ID NO: 72800 - DNA, 25 bp, Mus musculus
aaaggcatccagttgtacgacaccc

SEQ ID NO: 72801 - DNA, 25 bp, Mus musculus
aaaggccaggatttgttcgaccaga

SEQ ID NO: 72802 - DNA, 25 bp, Mus musculus
aaaggccagtacatcttcaaagaga

SEQ ID NO: 72803 - DNA, 25 bp, Mus musculus
aaaggccctgggtactaagtgacat

SEQ ID NO: 72804 - DNA, 25 bp, Mus musculus
aaaggccgcctcctgctggccgagt

SEQ ID NO: 72805 - DNA, 25 bp, Mus musculus
aaaggcctgggctacgggcactgaa

SEQ ID NO: 72806 - DNA, 25 bp, Mus musculus
aaaggctagcttcgtaaccatcaga

SEQ ID NO: 72807 - DNA, 25 bp, Mus musculus
aaaggctcgcctattctgggatccc

SEQ ID NO: 72808 - DNA, 25 bp, Mus musculus
aaaggctctgcagtgtagcgcggca

SEQ ID NO: 72809 - DNA, 25 bp, Mus musculus
aaaggctgggcttgcataccacatg

SEQ ID NO: 72810 - DNA, 25 bp, Mus musculus
aaaggcttaattttgctatcacccg

SEQ ID NO: 72811 - DNA, 25 bp, Mus musculus
aaaggcttatttggaggcggtgcac

SEQ ID NO: 72812 - DNA, 25 bp, Mus musculus
aaaggcttgtgtggcctgtgccgca

SEQ ID NO: 72813 - DNA, 25 bp, Mus musculus
aaagggactagtgcttgccaaaggg

SEQ ID NO: 72814 - DNA, 25 bp, Mus musculus
aaagggagatccacaaattgcaggc

SEQ ID NO: 72815 - DNA, 25 bp, Mus musculus
aaagggagcatgtcttcctcggagg

SEQ ID NO: 72816 - DNA, 25 bp, Mus musculus
aaagggaggcatgatcacgaacgga

SEQ ID NO: 72817 - DNA, 25 bp, Mus musculus
aaagggcaccgcttgtctgtctccg

SEQ ID NO: 72818 - DNA, 25 bp, Mus musculus
aaagggccagtccatcgacgacatg

SEQ ID NO: 72819 - DNA, 25 bp, Mus musculus
aaagggcgtagtcccacagtgatcc

SEQ ID NO: 72820 - DNA, 25 bp, Mus musculus
aaagggctccatgacctggtggaca

SEQ ID NO: 72821 - DNA, 25 bp, Mus musculus
aaagggctcccttagccagacgtag

SEQ ID NO: 72822 - DNA, 25 bp, Mus musculus
aaagggctggcattcaagacccagg

SEQ ID NO: 72823 - DNA, 25 bp, Mus musculus
aaagggtcaaagtctttgaggaatg

SEQ ID NO: 72824 - DNA, 25 bp, Mus musculus
aaagggtctccatttcagcctccag

SEQ ID NO: 72825 - DNA, 25 bp, Mus musculus
aaagggtctgctacatcttcgggag

SEQ ID NO: 72826 - DNA, 25 bp, Mus musculus
aaagggttggaatccacagggtcag

SEQ ID NO: 72827 - DNA, 25 bp, Mus musculus
aaaggtcaatacaaaggctccggag

SEQ ID NO: 72828 - DNA, 25 bp, Mus musculus
aaaggtcacagaactgccactatgg

SEQ ID NO: 72829 - DNA, 25 bp, Mus musculus
aaaggtcagctgtggtaccgatcca

SEQ ID NO: 72830 - DNA, 25 bp, Mus musculus
aaaggtccttgttctccacattggg

SEQ ID NO: 72831 - DNA, 25 bp, Mus musculus
aaaggtctcacctgtctcctgctgc

SEQ ID NO: 72832 - DNA, 25 bp, Mus musculus
aaaggtgaaacccatcaaggcgtgg

SEQ ID NO: 72833 - DNA, 25 bp, Mus musculus
aaaggtgacgtcctctatcttggcc

SEQ ID NO: 72834 - DNA, 25 bp, Mus musculus
aaaggtgagacctatctgccagggc

SEQ ID NO: 72835 - DNA, 25 bp, Mus musculus
aaaggtgctgcagtgtcacaagccc

SEQ ID NO: 72836 - DNA, 25 bp, Mus musculus
aaaggtggtctttacgaggcaatcg

SEQ ID NO: 72837 - DNA, 25 bp, Mus musculus
aaaggtgtaagcaggagtccgcact

SEQ ID NO: 72838 - DNA, 25 bp, Mus musculus
aaaggtgtacgctatcccagaaggg

SEQ ID NO: 72839 - DNA, 25 bp, Mus musculus
aaaggtgtcatcctctccaatccag

SEQ ID NO: 72840 - DNA, 25 bp, Mus musculus
aaaggtgtccagcatccctaggcaa

SEQ ID NO: 72841 - DNA, 25 bp, Mus musculus
aaaggttcaacacaagcatccggga

SEQ ID NO: 72842 - DNA, 25 bp, Mus musculus
aaaggttccgaatcctgcctgctgg

SEQ ID NO: 72843 - DNA, 25 bp, Mus musculus
aaaggttccggagcactgatgtggc

SEQ ID NO: 72844 - DNA, 25 bp, Mus musculus
aaaggttctacaggcatggaagttc

SEQ ID NO: 72845 - DNA, 25 bp, Mus musculus
aaaggttctctcagtcggcggaaga

SEQ ID NO: 72846 - DNA, 25 bp, Mus musculus
aaaggttgccgccacaaaaagccag

SEQ ID NO: 72847 - DNA, 25 bp, Mus musculus
aaaggttggatggaagcccgatgcc

SEQ ID NO: 72848 - DNA, 25 bp, Mus musculus
aaagtaaacacaggagtcgccacca

SEQ ID NO: 72849 - DNA, 25 bp, Mus musculus
aaagtaatgagtgagatcaagaaag

SEQ ID NO: 72850 - DNA, 25 bp, Mus musculus
aaagtacacctacgccatctgcagg

SEQ ID NO: 72851 - DNA, 25 bp, Mus musculus
aaagtaccaggcactaggtcggcgc

SEQ ID NO: 72852 - DNA, 25 bp, Mus musculus
aaagtaccatgtctcgatcccggca

SEQ ID NO: 72853 - DNA, 25 bp, Mus musculus
aaagtacgctactgtggccaccaga

SEQ ID NO: 72854 - DNA, 25 bp, Mus musculus
aaagtactcgcgcaagcttggaggc

SEQ ID NO: 72855 - DNA, 25 bp, Mus musculus
aaagtagactctgcttctgcgcatg

SEQ ID NO: 72856 - DNA, 25 bp, Mus musculus
aaagtaggccccagtccataaggag

SEQ ID NO: 72857 - DNA, 25 bp, Mus musculus
aaagtagttcttgttggtgccttca

SEQ ID NO: 72858 - DNA, 25 bp, Mus musculus
aaagtatcatctttgtggccacggg

SEQ ID NO: 72859 - DNA, 25 bp, Mus musculus
aaagtattcggcagtgacagcgccc

SEQ ID NO: 72860 - DNA, 25 bp, Mus musculus
aaagtcacaactccaaacacacagg

SEQ ID NO: 72861 - DNA, 25 bp, Mus musculus
aaagtcaccttcgagattgcccaga

SEQ ID NO: 72862 - DNA, 25 bp, Mus musculus
aaagtcatgttcgtactcacacggg

SEQ ID NO: 72863 - DNA, 25 bp, Mus musculus
aaagtcccatcacttacacaaacag

SEQ ID NO: 72864 - DNA, 25 bp, Mus musculus
aaagtccccacatcaaatacatctg

SEQ ID NO: 72865 - DNA, 25 bp, Mus musculus
aaagtcctgatcagtggccactgaa

SEQ ID NO: 72866 - DNA, 25 bp, Mus musculus
aaagtcctgcggtcaagcatccgtg

SEQ ID NO: 72867 - DNA, 25 bp, Mus musculus
aaagtctacatgtattactggcccg

SEQ ID NO: 72868 - DNA, 25 bp, Mus musculus
aaagtctctcctgttgtggatgccc

SEQ ID NO: 72869 - DNA, 25 bp, Mus musculus
aaagtctgctttctggtgaccagaa

SEQ ID NO: 72870 - DNA, 25 bp, Mus musculus
aaagtctggctcctccagtctggag

SEQ ID NO: 72871 - DNA, 25 bp, Mus musculus
aaagtctggcttagcgggcaacaca

SEQ ID NO: 72872 - DNA, 25 bp, Mus musculus
aaagtcttcagaaatgctccagcag

SEQ ID NO: 72873 - DNA, 25 bp, Mus musculus
aaagtcttcagccagaggtccggtc

SEQ ID NO: 72874 - DNA, 25 bp, Mus musculus
aaagtcttggatgcttccaacaagg

SEQ ID NO: 72875 - DNA, 25 bp, Mus musculus
aaagtgaaactctccattggccgga

SEQ ID NO: 72876 - DNA, 25 bp, Mus musculus
aaagtgaaagatgcccagcaggtcg

SEQ ID NO: 72877 - DNA, 25 bp, Mus musculus
aaagtgaagcgccataagtctgacg

SEQ ID NO: 72878 - DNA, 25 bp, Mus musculus
aaagtgaagtccctgagtgtctacc

SEQ ID NO: 72879 - DNA, 25 bp, Mus musculus
aaagtgacaatcagattactgatag

SEQ ID NO: 72880 - DNA, 25 bp, Mus musculus
aaagtgactggcgaagaccgactgg

SEQ ID NO: 72881 - DNA, 25 bp, Mus musculus
aaagtgagacgattctgggataaga

SEQ ID NO: 72882 - DNA, 25 bp, Mus musculus
aaagtgatgagagtgttcccggcct

SEQ ID NO: 72883 - DNA, 25 bp, Mus musculus
aaagtgcaaagtcacggctacccca

SEQ ID NO: 72884 - DNA, 25 bp, Mus musculus
aaagtgcacagtatcttggaccagg

SEQ ID NO: 72885 - DNA, 25 bp, Mus musculus
aaagtgcagagctcttccagtcaga

SEQ ID NO: 72886 - DNA, 25 bp, Mus musculus
aaagtgcatagtcgttgaagaaggc

SEQ ID NO: 72887 - DNA, 25 bp, Mus musculus
aaagtgcatgcagggaagtcttcac

SEQ ID NO: 72888 - DNA, 25 bp, Mus musculus
aaagtgcccgccttgcaagcttaga

SEQ ID NO: 72889 - DNA, 25 bp, Mus musculus
aaagtgcgcccttttgctgtagcag

SEQ ID NO: 72890 - DNA, 25 bp, Mus musculus
aaagtgctgctaagctggtgtggtc

SEQ ID NO: 72891 - DNA, 25 bp, Mus musculus
aaagtgcttcgggaaaaatggctgc

SEQ ID NO: 72892 - DNA, 25 bp, Mus musculus
aaagtgcttttctatggccggaaga

SEQ ID NO: 72893 - DNA, 25 bp, Mus musculus
aaagtggaatctctgtggcccatct

SEQ ID NO: 72894 - DNA, 25 bp, Mus musculus
aaagtggagcgaagtgtgacgccca

SEQ ID NO: 72895 - DNA, 25 bp, Mus musculus
aaagtggaggagtttctgcagcacg

SEQ ID NO: 72896 - DNA, 25 bp, Mus musculus
aaagtggatgatccctccagaagcc

SEQ ID NO: 72897 - DNA, 25 bp, Mus musculus
aaagtggcagacaaaacgggcagca

SEQ ID NO: 72898 - DNA, 25 bp, Mus musculus
aaagtggcatctgagaaagtgcagg

SEQ ID NO: 72899 - DNA, 25 bp, Mus musculus
aaagtggccaggatgtacagtgacc

SEQ ID NO: 72900 - DNA, 25 bp, Mus musculus
aaagtggccccatcttgcccaagag

SEQ ID NO: 72901 - DNA, 25 bp, Mus musculus
aaagtggcctgaacctgtattcggg

SEQ ID NO: 72902 - DNA, 25 bp, Mus musculus
aaagtggcctttgtcagtgcccaga

SEQ ID NO: 72903 - DNA, 25 bp, Mus musculus
aaagtgggctcgaacaatggaggca

SEQ ID NO: 72904 - DNA, 25 bp, Mus musculus
aaagtggtatgcagaggctatgccc

SEQ ID NO: 72905 - DNA, 25 bp, Mus musculus
aaagtggtctctatacatcgcatgg

SEQ ID NO: 72906 - DNA, 25 bp, Mus musculus
aaagtgtcccaagcactgtttgcaa

SEQ ID NO: 72907 - DNA, 25 bp, Mus musculus
aaagtgtgaacctgcggattgctgc

SEQ ID NO: 72908 - DNA, 25 bp, Mus musculus
aaagtgttcatcaagaccagcctgg

SEQ ID NO: 72909 - DNA, 25 bp, Mus musculus
aaagtgtttatgaactctcagccca

SEQ ID NO: 72910 - DNA, 25 bp, Mus musculus
aaagttacctgatatgtgcgaagcc

SEQ ID NO: 72911 - DNA, 25 bp, Mus musculus
aaagttcagagaagggcaacagccc

SEQ ID NO: 72912 - DNA, 25 bp, Mus musculus
aaagttcatctaacacagctgctgg

SEQ ID NO: 72913 - DNA, 25 bp, Mus musculus
aaagttccaaactctcggacgcagg

SEQ ID NO: 72914 - DNA, 25 bp, Mus musculus
aaagttcggctgaagacagtgagca

SEQ ID NO: 72915 - DNA, 25 bp, Mus musculus
aaagttcgtcggctcttcatcagaa

SEQ ID NO: 72916 - DNA, 25 bp, Mus musculus
aaagttctccgttcaattgtgggca

SEQ ID NO: 72917 - DNA, 25 bp, Mus musculus
aaagttctgttgctctctcaggccc

SEQ ID NO: 72918 - DNA, 25 bp, Mus musculus
aaagttgattcggtgcatgaaagca

SEQ ID NO: 72919 - DNA, 25 bp, Mus musculus
aaagttgcagcagaaatcctgggaa

SEQ ID NO: 72920 - DNA, 25 bp, Mus musculus
aaagttgctaaaaagtctggaggag

SEQ ID NO: 72921 - DNA, 25 bp, Mus musculus
aaagttggaccatggttctgaagtt

SEQ ID NO: 72922 - DNA, 25 bp, Mus musculus
aaagttgggtacacacgtggactgc

SEQ ID NO: 72923 - DNA, 25 bp, Mus musculus
aaagttggtcaaggctgtgccacac

SEQ ID NO: 72924 - DNA, 25 bp, Mus musculus
aaagttgtacttgccagccagcctg

SEQ ID NO: 72925 - DNA, 25 bp, Mus musculus
aaagtttgccgtcgacgcttgcggc

SEQ ID NO: 72926 - DNA, 25 bp, Mus musculus
aaagtttgggattacacagcctgcc

SEQ ID NO: 72927 - DNA, 25 bp, Mus musculus
aaataaaatcagaatccagccctcc

SEQ ID NO: 72928 - DNA, 25 bp, Mus musculus
aaataaagacattgtgaccgtggcc

SEQ ID NO: 72929 - DNA, 25 bp, Mus musculus
aaataaataaacgtcagctggccac

SEQ ID NO: 72930 - DNA, 25 bp, Mus musculus
aaatacaaagatgcccagcatgctt

SEQ ID NO: 72931 - DNA, 25 bp, Mus musculus
aaatacaaagtgaagctggtggaga

SEQ ID NO: 72932 - DNA, 25 bp, Mus musculus
aaatacaaccgactgctggagctgg

SEQ ID NO: 72933 - DNA, 25 bp, Mus musculus
aaatacacagaacagatcaccaacg

SEQ ID NO: 72934 - DNA, 25 bp, Mus musculus
aaatacaccgagtacagtgagccgc

SEQ ID NO: 72935 - DNA, 25 bp, Mus musculus
aaatacagtcaggaaggcacccaag

SEQ ID NO: 72936 - DNA, 25 bp, Mus musculus
aaataccaaccgaggctgcacatcg

SEQ ID NO: 72937 - DNA, 25 bp, Mus musculus
aaataccgatcgtgtctgtgttccg

SEQ ID NO: 72938 - DNA, 25 bp, Mus musculus
aaatacgccaaatgcaccaggaagg

SEQ ID NO: 72939 - DNA, 25 bp, Mus musculus
aaatacgtggaggaaatcgagcgtg

SEQ ID NO: 72940 - DNA, 25 bp, Mus musculus
aaatactaattttgcatcagggcag

SEQ ID NO: 72941 - DNA, 25 bp, Mus musculus
aaatactcagggttgcccgagcacg

SEQ ID NO: 72942 - DNA, 25 bp, Mus musculus
aaatacttcaccacaaccaagaaag

SEQ ID NO: 72943 - DNA, 25 bp, Mus musculus
aaatactttgctccggacgtggtgc

SEQ ID NO: 72944 - DNA, 25 bp, Mus musculus
aaatagcaagtcttgattcagagaa

SEQ ID NO: 72945 - DNA, 25 bp, Mus musculus
aaatagcagccttccatccgcatgg

SEQ ID NO: 72946 - DNA, 25 bp, Mus musculus
aaatagcagctctggttccagctac

SEQ ID NO: 72947 - DNA, 25 bp, Mus musculus
aaatagctgctgtgctacctccaag

SEQ ID NO: 72948 - DNA, 25 bp, Mus musculus
aaatagtcctggttctcacagaggg

SEQ ID NO: 72949 - DNA, 25 bp, Mus musculus
aaatagtctcttgtaccccaggctg

SEQ ID NO: 72950 - DNA, 25 bp, Mus musculus
aaatatctgccaggcagtgacccgg

SEQ ID NO: 72951 - DNA, 25 bp, Mus musculus
aaatatgagaacgacctggcactgc

SEQ ID NO: 72952 - DNA, 25 bp, Mus musculus
aaatatgaggacatcccagctgccc

SEQ ID NO: 72953 - DNA, 25 bp, Mus musculus
aaatatgggtcaaatgggcacctcc

SEQ ID NO: 72954 - DNA, 25 bp, Mus musculus
aaatatgtcaacaagctggcactgg

SEQ ID NO: 72955 - DNA, 25 bp, Mus musculus
aaatattactatgtcgctgggtacc

SEQ ID NO: 72956 - DNA, 25 bp, Mus musculus
aaatattctccagagctactcaaat

SEQ ID NO: 72957 - DNA, 25 bp, Mus musculus
aaatattttgaagatggcctgcccc

SEQ ID NO: 72958 - DNA, 25 bp, Mus musculus
aaatcaaagggcagcagggcacagt

SEQ ID NO: 72959 - DNA, 25 bp, Mus musculus
aaatcaaatccgtctccaaggctgg

SEQ ID NO: 72960 - DNA, 25 bp, Mus musculus
aaatcaacctggatgtaggctacca

SEQ ID NO: 72961 - DNA, 25 bp, Mus musculus
aaatcaaggtgtgggctcagcgcta

SEQ ID NO: 72962 - DNA, 25 bp, Mus musculus
aaatcaagtgtacagaaaatccgtg

SEQ ID NO: 72963 - DNA, 25 bp, Mus musculus
aaatcacactgtggaccgtggtgcc

SEQ ID NO: 72964 - DNA, 25 bp, Mus musculus
aaatcagaactaactgggcaacccg

SEQ ID NO: 72965 - DNA, 25 bp, Mus musculus
aaatcagagaaggtgccgagctgcc

SEQ ID NO: 72966 - DNA, 25 bp, Mus musculus
aaatcagcatccgaggaatccgtgg

SEQ ID NO: 72967 - DNA, 25 bp, Mus musculus
aaatcagcgctgagtgtctgtggcc

SEQ ID NO: 72968 - DNA, 25 bp, Mus musculus
aaatcagtagcctgggtagacccaa

SEQ ID NO: 72969 - DNA, 25 bp, Mus musculus
aaatcatgcaggctgtgcgcttacc

SEQ ID NO: 72970 - DNA, 25 bp, Mus musculus
aaatcatggcagtattctaaacagc

SEQ ID NO: 72971 - DNA, 25 bp, Mus musculus
aaatcatgggccagtaacaagcaag

SEQ ID NO: 72972 - DNA, 25 bp, Mus musculus
aaatcattgatgctgcattgcgagc

SEQ ID NO: 72973 - DNA, 25 bp, Mus musculus
aaatcattggccctaagcgacttgc

SEQ ID NO: 72974 - DNA, 25 bp, Mus musculus
aaatccaactggctccatggctggg

SEQ ID NO: 72975 - DNA, 25 bp, Mus musculus
aaatccatcgctgccaagtactcgg

SEQ ID NO: 72976 - DNA, 25 bp, Mus musculus
aaatcccaagtacgttcatgccatg

SEQ ID NO: 72977 - DNA, 25 bp, Mus musculus
aaatcccatgatcaagctgtccaca

SEQ ID NO: 72978 - DNA, 25 bp, Mus musculus
aaatcccggcatggatgtgagccag

SEQ ID NO: 72979 - DNA, 25 bp, Mus musculus
aaatccctcgactggcagatggacg

SEQ ID NO: 72980 - DNA, 25 bp, Mus musculus
aaatccctcgattctgttaccatga

SEQ ID NO: 72981 - DNA, 25 bp, Mus musculus
aaatccctggattgaagcgcaaagc

SEQ ID NO: 72982 - DNA, 25 bp, Mus musculus
aaatccgatttctctgtccagttgc

SEQ ID NO: 72983 - DNA, 25 bp, Mus musculus
aaatccgcaagcttgacaatggtgg

SEQ ID NO: 72984 - DNA, 25 bp, Mus musculus
aaatccggtacgatgctgtgacaat

SEQ ID NO: 72985 - DNA, 25 bp, Mus musculus
aaatccgtgaaaagaggatttgaat

SEQ ID NO: 72986 - DNA, 25 bp, Mus musculus
aaatcctacgaacatatggctaaaa

SEQ ID NO: 72987 - DNA, 25 bp, Mus musculus
aaatcctacttgatgaaccgcttgg

SEQ ID NO: 72988 - DNA, 25 bp, Mus musculus
aaatcctggaattgagtccttcaag

SEQ ID NO: 72989 - DNA, 25 bp, Mus musculus
aaatcctggccgcacttgagaaggg

SEQ ID NO: 72990 - DNA, 25 bp, Mus musculus
aaatccttctcaggagcatccctgg

SEQ ID NO: 72991 - DNA, 25 bp, Mus musculus
aaatccttctgggagaacaagtgca

SEQ ID NO: 72992 - DNA, 25 bp, Mus musculus
aaatcgaaccttggccatgaaccgg

SEQ ID NO: 72993 - DNA, 25 bp, Mus musculus
aaatcgagcaagacacggacactaa

SEQ ID NO: 72994 - DNA, 25 bp, Mus musculus
aaatcgcaatcgagggaaccgaggc

SEQ ID NO: 72995 - DNA, 25 bp, Mus musculus
aaatcgcctggagaatgacggagcc

SEQ ID NO: 72996 - DNA, 25 bp, Mus musculus
aaatcgctcaaggaacccagtcagg

SEQ ID NO: 72997 - DNA, 25 bp, Mus musculus
aaatcgctgcccatgaaggttacac

SEQ ID NO: 72998 - DNA, 25 bp, Mus musculus
aaatcgctgtgttatgacatctcgc

SEQ ID NO: 72999 - DNA, 25 bp, Mus musculus
aaatcgctttgctctgctggctcta

SEQ ID NO: 73000 - DNA, 25 bp, Mus musculus
aaatcggagaatcccacgtcacagg

SEQ ID NO: 73001 - DNA, 25 bp, Mus musculus
aaatcgggcgttgcgggtcctatct

SEQ ID NO: 73002 - DNA, 25 bp, Mus musculus
aaatcgttgtcattagcatcctggc

SEQ ID NO: 73003 - DNA, 25 bp, Mus musculus
aaatctaacatcatggcctcgctgg

SEQ ID NO: 73004 - DNA, 25 bp, Mus musculus
aaatctaagcctgcatttgctacag

SEQ ID NO: 73005 - DNA, 25 bp, Mus musculus
aaatctacctctcctaggtgggcgg

SEQ ID NO: 73006 - DNA, 25 bp, Mus musculus
aaatctcaagagtcacagctgcctg

SEQ ID NO: 73007 - DNA, 25 bp, Mus musculus
aaatctcatgcataatcttggtggg

SEQ ID NO: 73008 - DNA, 25 bp, Mus musculus
aaatctcctcccaaagtgcccattg

SEQ ID NO: 73009 - DNA, 25 bp, Mus musculus
aaatctctccaagctcaggaggacg

SEQ ID NO: 73010 - DNA, 25 bp, Mus musculus
aaatctctccaggacatcattgcca

SEQ ID NO: 73011 - DNA, 25 bp, Mus musculus
aaatctctgccattgtaccatgggc

SEQ ID NO: 73012 - DNA, 25 bp, Mus musculus
aaatctgcgtgagccaaggtgaggt

SEQ ID NO: 73013 - DNA, 25 bp, Mus musculus
aaatctggatgacaaagcgtaccgc

SEQ ID NO: 73014 - DNA, 25 bp, Mus musculus
aaatctggtctcagcagcacttcag

SEQ ID NO: 73015 - DNA, 25 bp, Mus musculus
aaatctggtgatggcgagagcacac

SEQ ID NO: 73016 - DNA, 25 bp, Mus musculus
aaatcttatcctgaatgtggacggc

SEQ ID NO: 73017 - DNA, 25 bp, Mus musculus
aaatcttcaaagacaccacctgagg

SEQ ID NO: 73018 - DNA, 25 bp, Mus musculus
aaatcttcatgaacaagccgcaccg

SEQ ID NO: 73019 - DNA, 25 bp, Mus musculus
aaatcttggagcaaccgcatgcagt

SEQ ID NO: 73020 - DNA, 25 bp, Mus musculus
aaatgaaacaggactgcgctgcttg

SEQ ID NO: 73021 - DNA, 25 bp, Mus musculus
aaatgaaatgcattagctgtctgcc

SEQ ID NO: 73022 - DNA, 25 bp, Mus musculus
aaatgaaatgtttgcaataaaagcc

SEQ ID NO: 73023 - DNA, 25 bp, Mus musculus
aaatgaagatggcacatggccccgg

SEQ ID NO: 73024 - DNA, 25 bp, Mus musculus
aaatgaagccctgcggtcaggccag

SEQ ID NO: 73025 - DNA, 25 bp, Mus musculus
aaatgaagctgttgtctggccaagc

SEQ ID NO: 73026 - DNA, 25 bp, Mus musculus
aaatgaaggccctctggcaggctgc

SEQ ID NO: 73027 - DNA, 25 bp, Mus musculus
aaatgaagtcccagatggctcctgc

SEQ ID NO: 73028 - DNA, 25 bp, Mus musculus
aaatgacagaaatggactggcctcc

SEQ ID NO: 73029 - DNA, 25 bp, Mus musculus
aaatgaccagtgtggaacgctgacg

SEQ ID NO: 73030 - DNA, 25 bp, Mus musculus
aaatgaccgtgaaaagcccctggct

SEQ ID NO: 73031 - DNA, 25 bp, Mus musculus
aaatgacgtggacaacaagcgctgc

SEQ ID NO: 73032 - DNA, 25 bp, Mus musculus
aaatgagagccaccccgaagtttgg

SEQ ID NO: 73033 - DNA, 25 bp, Mus musculus
aaatgagagctcaggttggcgctga

SEQ ID NO: 73034 - DNA, 25 bp, Mus musculus
aaatgagagttcctggcacagcggt

SEQ ID NO: 73035 - DNA, 25 bp, Mus musculus
aaatgagattgggtgatctggaccg

SEQ ID NO: 73036 - DNA, 25 bp, Mus musculus
aaatgaggcgctggccgttttccga

SEQ ID NO: 73037 - DNA, 25 bp, Mus musculus
aaatgagtctctccagaatagtggc

SEQ ID NO: 73038 - DNA, 25 bp, Mus musculus
aaatgagtgagaacccgagtgatcc

SEQ ID NO: 73039 - DNA, 25 bp, Mus musculus
aaatgatgggaaagaaccacctcct

SEQ ID NO: 73040 - DNA, 25 bp, Mus musculus
aaatgattctgctgcttccaaggcc

SEQ ID NO: 73041 - DNA, 25 bp, Mus musculus
aaatgattctgttcctgagactgcc

SEQ ID NO: 73042 - DNA, 25 bp, Mus musculus
aaatgcaacgctcgcagcctgtgca

SEQ ID NO: 73043 - DNA, 25 bp, Mus musculus
aaatgcaagtccatccaaccttgta

SEQ ID NO: 73044 - DNA, 25 bp, Mus musculus
aaatgcaccatgaccaaccgtacgg

SEQ ID NO: 73045 - DNA, 25 bp, Mus musculus
aaatgcaggctagtttgggactgaa

SEQ ID NO: 73046 - DNA, 25 bp, Mus musculus
aaatgcagtgcaggccttagggtct

SEQ ID NO: 73047 - DNA, 25 bp, Mus musculus
aaatgcatcatgttggcgtctcgcc

SEQ ID NO: 73048 - DNA, 25 bp, Mus musculus
aaatgccaccagatggcgggttagg

SEQ ID NO: 73049 - DNA, 25 bp, Mus musculus
aaatgccacggtcctgctctggtca

SEQ ID NO: 73050 - DNA, 25 bp, Mus musculus
aaatgccattggaggaccagctgcc

SEQ ID NO: 73051 - DNA, 25 bp, Mus musculus
aaatgcccccgtgaatggagccaaa

SEQ ID NO: 73052 - DNA, 25 bp, Mus musculus
aaatgcccgtgtgaggacgagctgc

SEQ ID NO: 73053 - DNA, 25 bp, Mus musculus
aaatgcctcgagacctgggagtggc

SEQ ID NO: 73054 - DNA, 25 bp, Mus musculus
aaatgcctggcgtcatacctagtga

SEQ ID NO: 73055 - DNA, 25 bp, Mus musculus
aaatgcctttcgtcctagcactaag

SEQ ID NO: 73056 - DNA, 25 bp, Mus musculus
aaatgctaacgttgcctcatggtgc

SEQ ID NO: 73057 - DNA, 25 bp, Mus musculus
aaatgctagctgtgagggagcccgc

SEQ ID NO: 73058 - DNA, 25 bp, Mus musculus
aaatgctagttagtgcagtcgtacc

SEQ ID NO: 73059 - DNA, 25 bp, Mus musculus
aaatgctcaacccacagagtccaga

SEQ ID NO: 73060 - DNA, 25 bp, Mus musculus
aaatgctctcagttcagccagacac

SEQ ID NO: 73061 - DNA, 25 bp, Mus musculus
aaatgctgggcgtacactggacaag

SEQ ID NO: 73062 - DNA, 25 bp, Mus musculus
aaatgctgttggagaacattccaga

SEQ ID NO: 73063 - DNA, 25 bp, Mus musculus
aaatgcttcccctgcccagatcaag

SEQ ID NO: 73064 - DNA, 25 bp, Mus musculus
aaatgcttctgggaactggaggacc

SEQ ID NO: 73065 - DNA, 25 bp, Mus musculus
aaatgcttgcacattgacccagaca

SEQ ID NO: 73066 - DNA, 25 bp, Mus musculus
aaatgcttggttcggtcagggctca

SEQ ID NO: 73067 - DNA, 25 bp, Mus musculus
aaatgctttaagttcgctctgggga

SEQ ID NO: 73068 - DNA, 25 bp, Mus musculus
aaatggaaagaccacgataatgaag

SEQ ID NO: 73069 - DNA, 25 bp, Mus musculus
aaatggaaccacacccgaggagtgc

SEQ ID NO: 73070 - DNA, 25 bp, Mus musculus
aaatggaagaagaccagcgctggct

SEQ ID NO: 73071 - DNA, 25 bp, Mus musculus
aaatggacacatgccagagtcagcc

SEQ ID NO: 73072 - DNA, 25 bp, Mus musculus
aaatggacagatcacttcaaggagc

SEQ ID NO: 73073 - DNA, 25 bp, Mus musculus
aaatggacagtcctggtgaagaacc

SEQ ID NO: 73074 - DNA, 25 bp, Mus musculus
aaatggaccacattctgatttgctg

SEQ ID NO: 73075 - DNA, 25 bp, Mus musculus
aaatggactgtctatagcacctgca

SEQ ID NO: 73076 - DNA, 25 bp, Mus musculus
aaatggagcctttggtgggacaagt

SEQ ID NO: 73077 - DNA, 25 bp, Mus musculus
aaatggatccccttagtgctctgaa

SEQ ID NO: 73078 - DNA, 25 bp, Mus musculus
aaatggatggaaaatctgatatatg

SEQ ID NO: 73079 - DNA, 25 bp, Mus musculus
aaatggcaagtggaacgatgtcccc

SEQ ID NO: 73080 - DNA, 25 bp, Mus musculus
aaatggcactggtgtgattcggaag

SEQ ID NO: 73081 - DNA, 25 bp, Mus musculus
aaatggcagtcgctagtctctattg

SEQ ID NO: 73082 - DNA, 25 bp, Mus musculus
aaatggcagttcaaccaacgtcgac

SEQ ID NO: 73083 - DNA, 25 bp, Mus musculus
aaatggccaccacagaagatgctca

SEQ ID NO: 73084 - DNA, 25 bp, Mus musculus
aaatggccgaaaaaggcagaagcag

SEQ ID NO: 73085 - DNA, 25 bp, Mus musculus
aaatggcgccagatgctgcagttcc

SEQ ID NO: 73086 - DNA, 25 bp, Mus musculus
aaatggcgtcggcataggccttgct

SEQ ID NO: 73087 - DNA, 25 bp, Mus musculus
aaatggctcctggatggaatcggca

SEQ ID NO: 73088 - DNA, 25 bp, Mus musculus
aaatggctctactccctgtgtgtga

SEQ ID NO: 73089 - DNA, 25 bp, Mus musculus
aaatggctgctgttctcctaagacg

SEQ ID NO: 73090 - DNA, 25 bp, Mus musculus
aaatgggagactgtttgctggcttg

SEQ ID NO: 73091 - DNA, 25 bp, Mus musculus
aaatgggcatccttggtgtagtcac

SEQ ID NO: 73092 - DNA, 25 bp, Mus musculus
aaatgggtcgcttccaagtgcacgg

SEQ ID NO: 73093 - DNA, 25 bp, Mus musculus
aaatgggttcagtattcccaggaca

SEQ ID NO: 73094 - DNA, 25 bp, Mus musculus
aaatggtacccgctgatctgaacgc

SEQ ID NO: 73095 - DNA, 25 bp, Mus musculus
aaatggtcaacaacatcgagagaaa

SEQ ID NO: 73096 - DNA, 25 bp, Mus musculus
aaatggtcagtggaatgacgtcccc

SEQ ID NO: 73097 - DNA, 25 bp, Mus musculus
aaatggtcgcgctttgcccgagtga

SEQ ID NO: 73098 - DNA, 25 bp, Mus musculus
aaatggtctgtgatcctagccaggc

SEQ ID NO: 73099 - DNA, 25 bp, Mus musculus
aaatggtgacccctgggcagaagct

SEQ ID NO: 73100 - DNA, 25 bp, Mus musculus
aaatggtgagtttgtatggatcaca

SEQ ID NO: 73101 - DNA, 25 bp, Mus musculus
aaatggtgatgcatgccaggtcagg

SEQ ID NO: 73102 - DNA, 25 bp, Mus musculus
aaatggtgcccaacaacctagcaag

SEQ ID NO: 73103 - DNA, 25 bp, Mus musculus
aaatggtgggctcagtcgttcctcc

SEQ ID NO: 73104 - DNA, 25 bp, Mus musculus
aaatggtgtcatccacgtcgtggac

SEQ ID NO: 73105 - DNA, 25 bp, Mus musculus
aaatggttccggatccactgacggg

SEQ ID NO: 73106 - DNA, 25 bp, Mus musculus
aaatggttgcctcagaagttgctcg

SEQ ID NO: 73107 - DNA, 25 bp, Mus musculus
aaatggtttaagcagcgcctggcag

SEQ ID NO: 73108 - DNA, 25 bp, Mus musculus
aaatgtaccccgactacgcagagga

SEQ ID NO: 73109 - DNA, 25 bp, Mus musculus
aaatgtactccagagaatggaaccg

SEQ ID NO: 73110 - DNA, 25 bp, Mus musculus
aaatgtatcctgtaagaactgtagc

SEQ ID NO: 73111 - DNA, 25 bp, Mus musculus
aaatgtatctctgccaggacctggc

SEQ ID NO: 73112 - DNA, 25 bp, Mus musculus
aaatgtcagaaacaggcgccatcca

SEQ ID NO: 73113 - DNA, 25 bp, Mus musculus
aaatgtcagttgctgcgtccccaga

SEQ ID NO: 73114 - DNA, 25 bp, Mus musculus
aaatgtcatgaaagactttttggga

SEQ ID NO: 73115 - DNA, 25 bp, Mus musculus
aaatgtccagcgtggctcgcaaagc

SEQ ID NO: 73116 - DNA, 25 bp, Mus musculus
aaatgtccatgaggttctgcaagcg

SEQ ID NO: 73117 - DNA, 25 bp, Mus musculus
aaatgtcgagtggtcccgttgccga

SEQ ID NO: 73118 - DNA, 25 bp, Mus musculus
aaatgtcgggtcatatggcttcgcg

SEQ ID NO: 73119 - DNA, 25 bp, Mus musculus
aaatgtctccctatgtcccgcttga

SEQ ID NO: 73120 - DNA, 25 bp, Mus musculus
aaatgtctcggccagtgatgcaggc

SEQ ID NO: 73121 - DNA, 25 bp, Mus musculus
aaatgtctggtgactttggacacac

SEQ ID NO: 73122 - DNA, 25 bp, Mus musculus
aaatgtctgtatgtgagtgcgttca

SEQ ID NO: 73123 - DNA, 25 bp, Mus musculus
aaatgtgaagaggaggaaccgcgtc

SEQ ID NO: 73124 - DNA, 25 bp, Mus musculus
aaatgtgagcgtgttctcctggccc

SEQ ID NO: 73125 - DNA, 25 bp, Mus musculus
aaatgtgatcttcggcaccctccag

SEQ ID NO: 73126 - DNA, 25 bp, Mus musculus
aaatgtgcaagcagcccgtctaggc

SEQ ID NO: 73127 - DNA, 25 bp, Mus musculus
aaatgtgcactcttcctgtagcggg

SEQ ID NO: 73128 - DNA, 25 bp, Mus musculus
aaatgtggacgccattctggaggca

SEQ ID NO: 73129 - DNA, 25 bp, Mus musculus
aaatgtgggacagcatgcaagaagg

SEQ ID NO: 73130 - DNA, 25 bp, Mus musculus
aaatgtggtggtaacgcaggctgac

SEQ ID NO: 73131 - DNA, 25 bp, Mus musculus
aaatgtgtgacctttcggcttccta

SEQ ID NO: 73132 - DNA, 25 bp, Mus musculus
aaattacagctggataagcggccac

SEQ ID NO: 73133 - DNA, 25 bp, Mus musculus
aaattaccactgtgcacccgatgag

SEQ ID NO: 73134 - DNA, 25 bp, Mus musculus
aaattaggaaaggtagcagtgactc

SEQ ID NO: 73135 - DNA, 25 bp, Mus musculus
aaattagggaagatgaggagcctcc

SEQ ID NO: 73136 - DNA, 25 bp, Mus musculus
aaattatccgaaaccgcctcactgg

SEQ ID NO: 73137 - DNA, 25 bp, Mus musculus
aaattcaagcttcggcacaacctgg

SEQ ID NO: 73138 - DNA, 25 bp, Mus musculus
aaattcaccctgctcgctctacggg

SEQ ID NO: 73139 - DNA, 25 bp, Mus musculus
aaattcagcagccagtccagtaggg

SEQ ID NO: 73140 - DNA, 25 bp, Mus musculus
aaattcattatacctgagtacagaa

SEQ ID NO: 73141 - DNA, 25 bp, Mus musculus
aaattcattcttcacgaggctctag

SEQ ID NO: 73142 - DNA, 25 bp, Mus musculus
aaattccagttgcatcatctgagcg

SEQ ID NO: 73143 - DNA, 25 bp, Mus musculus
aaattcctgatgtgtcgccgaccgg

SEQ ID NO: 73144 - DNA, 25 bp, Mus musculus
aaattccttcggctgcatggcaaca

SEQ ID NO: 73145 - DNA, 25 bp, Mus musculus
aaattctgatgcagatggactcccg

SEQ ID NO: 73146 - DNA, 25 bp, Mus musculus
aaattctggcttggcggcggttcat

SEQ ID NO: 73147 - DNA, 25 bp, Mus musculus
aaattctgtgacattgcccggctca

SEQ ID NO: 73148 - DNA, 25 bp, Mus musculus
aaattcttcatggagcaacacgtgg

SEQ ID NO: 73149 - DNA, 25 bp, Mus musculus
aaattcttctcagagcgggaggcca

SEQ ID NO: 73150 - DNA, 25 bp, Mus musculus
aaattcttggcctggattccttgga

SEQ ID NO: 73151 - DNA, 25 bp, Mus musculus
aaattgaccccagcgcagttgcagt

SEQ ID NO: 73152 - DNA, 25 bp, Mus musculus
aaattgagtggtcgaccgtatcggc

SEQ ID NO: 73153 - DNA, 25 bp, Mus musculus
aaattgatgccaagacctaccgcga

SEQ ID NO: 73154 - DNA, 25 bp, Mus musculus
aaattgatggcaaaccgcggtgacc

SEQ ID NO: 73155 - DNA, 25 bp, Mus musculus
aaattgatgtgaccctgccccgggt

SEQ ID NO: 73156 - DNA, 25 bp, Mus musculus
aaattgcatccccatattctgaggt

SEQ ID NO: 73157 - DNA, 25 bp, Mus musculus
aaattgccaacttctcacagagctg

SEQ ID NO: 73158 - DNA, 25 bp, Mus musculus
aaattgccagtgtggacgccttcca

SEQ ID NO: 73159 - DNA, 25 bp, Mus musculus
aaattgcccgtcaagtggctggccc

SEQ ID NO: 73160 - DNA, 25 bp, Mus musculus
aaattgcggtggctgggcttccaca

SEQ ID NO: 73161 - DNA, 25 bp, Mus musculus
aaattgctcaagaagaatacatgtt

SEQ ID NO: 73162 - DNA, 25 bp, Mus musculus
aaattgctgtgtcgccctatgtggg

SEQ ID NO: 73163 - DNA, 25 bp, Mus musculus
aaattggcaaatgaccctcggtgga

SEQ ID NO: 73164 - DNA, 25 bp, Mus musculus
aaattggcccagatgttgtcacgac

SEQ ID NO: 73165 - DNA, 25 bp, Mus musculus
aaattgggtgcctcctacagtgtga

SEQ ID NO: 73166 - DNA, 25 bp, Mus musculus
aaattgtctctgaaggcggactcca

SEQ ID NO: 73167 - DNA, 25 bp, Mus musculus
aaattgtctgatgttctgaatacgg

SEQ ID NO: 73168 - DNA, 25 bp, Mus musculus
aaatttagcacgtctgtccctgtgg

SEQ ID NO: 73169 - DNA, 25 bp, Mus musculus
aaatttcagctgagaggtgccaggc

SEQ ID NO: 73170 - DNA, 25 bp, Mus musculus
aaatttccatcatcctcaagtcacg

SEQ ID NO: 73171 - DNA, 25 bp, Mus musculus
aaatttctgcccagcgtgttcatgg

SEQ ID NO: 73172 - DNA, 25 bp, Mus musculus
aaatttgcgataccatcctgagggc

SEQ ID NO: 73173 - DNA, 25 bp, Mus musculus
aaatttgcttcctacatgctaccag

SEQ ID NO: 73174 - DNA, 25 bp, Mus musculus
aaatttggaactgcagggaacctca

SEQ ID NO: 73175 - DNA, 25 bp, Mus musculus
aaatttgtgactttgacttgggcag

SEQ ID NO: 73176 - DNA, 25 bp, Mus musculus
aacaaaatcgacagcgccgtggaga

SEQ ID NO: 73177 - DNA, 25 bp, Mus musculus
aacaaaatcgctctgtatagtgacg

SEQ ID NO: 73178 - DNA, 25 bp, Mus musculus
aacaaacacaaggacggaggctgac

SEQ ID NO: 73179 - DNA, 25 bp, Mus musculus
aacaaacacgctgagcacatcggtg

SEQ ID NO: 73180 - DNA, 25 bp, Mus musculus
aacaaactattggagagacctggcc

SEQ ID NO: 73181 - DNA, 25 bp, Mus musculus
aacaaactgtaccagctggatgggc

SEQ ID NO: 73182 - DNA, 25 bp, Mus musculus
aacaaagcccacatggtaaccctgg

SEQ ID NO: 73183 - DNA, 25 bp, Mus musculus
aacaaagctttgactgaatctacgc

SEQ ID NO: 73184 - DNA, 25 bp, Mus musculus
aacaaaggatcttcaggctggagca

SEQ ID NO: 73185 - DNA, 25 bp, Mus musculus
aacaaatacaacttctcctttgatt

SEQ ID NO: 73186 - DNA, 25 bp, Mus musculus
aacaaatattccctggccacacggg

SEQ ID NO: 73187 - DNA, 25 bp, Mus musculus
aacaaatctgtgtgccacgtgggag

SEQ ID NO: 73188 - DNA, 25 bp, Mus musculus
aacaacccccggaggtgcagcggct

SEQ ID NO: 73189 - DNA, 25 bp, Mus musculus
aacaacctgcggcactaggtcccac

SEQ ID NO: 73190 - DNA, 25 bp, Mus musculus
aacaacgtatttgaagtgggctgtc

SEQ ID NO: 73191 - DNA, 25 bp, Mus musculus
aacaactatgtgaaagggacccagc

SEQ ID NO: 73192 - DNA, 25 bp, Mus musculus
aacaactgatggtgtcccttcctgg

SEQ ID NO: 73193 - DNA, 25 bp, Mus musculus
aacaactggagcaagcttcccctca

SEQ ID NO: 73194 - DNA, 25 bp, Mus musculus
aacaacttagttacaaaatggcaca

SEQ ID NO: 73195 - DNA, 25 bp, Mus musculus
aacaacttcatgagattccagcctt

SEQ ID NO: 73196 - DNA, 25 bp, Mus musculus
aacaagaacaagctccaggtcctcc

SEQ ID NO: 73197 - DNA, 25 bp, Mus musculus
aacaagaagcttctgggctaccagc

SEQ ID NO: 73198 - DNA, 25 bp, Mus musculus
aacaagaagcttttgtgctccttgg

SEQ ID NO: 73199 - DNA, 25 bp, Mus musculus
aacaagaagttgacacctcgacgtg

SEQ ID NO: 73200 - DNA, 25 bp, Mus musculus
aacaagaatggtaagtccagcatcc

SEQ ID NO: 73201 - DNA, 25 bp, Mus musculus
aacaagaggaaactagagctggcag

SEQ ID NO: 73202 - DNA, 25 bp, Mus musculus
aacaagccaattcaggatatcccag

SEQ ID NO: 73203 - DNA, 25 bp, Mus musculus
aacaagccagttcgatatgcagcaa

SEQ ID NO: 73204 - DNA, 25 bp, Mus musculus
aacaagcgggtcatggacgtcatcc

SEQ ID NO: 73205 - DNA, 25 bp, Mus musculus
aacaagctctggagtgggtacagcc

SEQ ID NO: 73206 - DNA, 25 bp, Mus musculus
aacaagctgacctggatttggcccg

SEQ ID NO: 73207 - DNA, 25 bp, Mus musculus
aacaagctggatactttctgtggca

SEQ ID NO: 73208 - DNA, 25 bp, Mus musculus
aacaagctggtggacggctgctact

SEQ ID NO: 73209 - DNA, 25 bp, Mus musculus
aacaaggcgcagtttgaagatcgaa

SEQ ID NO: 73210 - DNA, 25 bp, Mus musculus
aacaaggcttttctccagggtccag

SEQ ID NO: 73211 - DNA, 25 bp, Mus musculus
aacaagggcgactatttctggtggc

SEQ ID NO: 73212 - DNA, 25 bp, Mus musculus
aacaagtgcttatgctgagccagag

SEQ ID NO: 73213 - DNA, 25 bp, Mus musculus
aacaagtggcagaatttcctggacc

SEQ ID NO: 73214 - DNA, 25 bp, Mus musculus
aacaagtttggcagcatccggcaga

SEQ ID NO: 73215 - DNA, 25 bp, Mus musculus
aacaatcagtaacctccagctaggg

SEQ ID NO: 73216 - DNA, 25 bp, Mus musculus
aacaatcggcagacgaggtcctggc

SEQ ID NO: 73217 - DNA, 25 bp, Mus musculus
aacaatcggtgtcctgcacaagtgg

SEQ ID NO: 73218 - DNA, 25 bp, Mus musculus
aacaatgaaaattcccagggtctgc

SEQ ID NO: 73219 - DNA, 25 bp, Mus musculus
aacaatgaactggatcaacacggcc

SEQ ID NO: 73220 - DNA, 25 bp, Mus musculus
aacaatgcgagttgcttccgaaggc

SEQ ID NO: 73221 - DNA, 25 bp, Mus musculus
aacaatgtacttggaggatagaacc

SEQ ID NO: 73222 - DNA, 25 bp, Mus musculus
aacaatgtatgcgtataaacaaaat

SEQ ID NO: 73223 - DNA, 25 bp, Mus musculus
aacaatgtgcgagtagtgggtgccc

SEQ ID NO: 73224 - DNA, 25 bp, Mus musculus
aacaatttcgaagagccagtggccc

SEQ ID NO: 73225 - DNA, 25 bp, Mus musculus
aacacaactggatggttgaccacgg

SEQ ID NO: 73226 - DNA, 25 bp, Mus musculus
aacacaaggacctctgggagttcca

SEQ ID NO: 73227 - DNA, 25 bp, Mus musculus
aacacacagaggtttatataaaagc

SEQ ID NO: 73228 - DNA, 25 bp, Mus musculus
aacacactggccttggttctgcaga

SEQ ID NO: 73229 - DNA, 25 bp, Mus musculus
aacacagatcgaaagtaagacgggc

SEQ ID NO: 73230 - DNA, 25 bp, Mus musculus
aacacagctccaggctcatcggaat

SEQ ID NO: 73231 - DNA, 25 bp, Mus musculus
aacacaggacttctttaatgagccc

SEQ ID NO: 73232 - DNA, 25 bp, Mus musculus
aacacaggctgttggatcgcggatc

SEQ ID NO: 73233 - DNA, 25 bp, Mus musculus
aacacagggaaggaggtgctcttca

SEQ ID NO: 73234 - DNA, 25 bp, Mus musculus
aacacagtgaggaggacgggtccat

SEQ ID NO: 73235 - DNA, 25 bp, Mus musculus
aacacagttactgggctggagcgct

SEQ ID NO: 73236 - DNA, 25 bp, Mus musculus
aacacatacgcctcgcgacgttgga

SEQ ID NO: 73237 - DNA, 25 bp, Mus musculus
aacacatcgtcagtgggagaaacca

SEQ ID NO: 73238 - DNA, 25 bp, Mus musculus
aacacattctgtgaggagtggcagc

SEQ ID NO: 73239 - DNA, 25 bp, Mus musculus
aacaccaacgctgctgtgggaggca

SEQ ID NO: 73240 - DNA, 25 bp, Mus musculus
aacaccatgagtttcgtggcatacg

SEQ ID NO: 73241 - DNA, 25 bp, Mus musculus
aacaccatgtcgagtctgcacaaga

SEQ ID NO: 73242 - DNA, 25 bp, Mus musculus
aacaccccggtggagacgaatctca

SEQ ID NO: 73243 - DNA, 25 bp, Mus musculus
aacacctagcaaaagcccagtatct

SEQ ID NO: 73244 - DNA, 25 bp, Mus musculus
aacacctgagggaggcagagcaacg

SEQ ID NO: 73245 - DNA, 25 bp, Mus musculus
aacacctggatctcacgtcctgcgt

SEQ ID NO: 73246 - DNA, 25 bp, Mus musculus
aacacctgggtctgagccggaaagg

SEQ ID NO: 73247 - DNA, 25 bp, Mus musculus
aacacctgtgtcctaatgatgggac

SEQ ID NO: 73248 - DNA, 25 bp, Mus musculus
aacacgaaagatcttcagactgtac

SEQ ID NO: 73249 - DNA, 25 bp, Mus musculus
aacacgacgtgaaggtccctctgga

SEQ ID NO: 73250 - DNA, 25 bp, Mus musculus
aacacggatggccactttgacatgg

SEQ ID NO: 73251 - DNA, 25 bp, Mus musculus
aacacgggcttccttcatcacatgc

SEQ ID NO: 73252 - DNA, 25 bp, Mus musculus
aacactaagactgtgctgtgcatgg

SEQ ID NO: 73253 - DNA, 25 bp, Mus musculus
aacactaatgagctatgaagttccg

SEQ ID NO: 73254 - DNA, 25 bp, Mus musculus
aacactatgggaatgctatgcagcc

SEQ ID NO: 73255 - DNA, 25 bp, Mus musculus
aacactatttccttcgccacgttgg

SEQ ID NO: 73256 - DNA, 25 bp, Mus musculus
aacactcacagcagcgcgggaggcc

SEQ ID NO: 73257 - DNA, 25 bp, Mus musculus
aacactcacggcttcaaggctggca

SEQ ID NO: 73258 - DNA, 25 bp, Mus musculus
aacactcctctggataaactcttgg

SEQ ID NO: 73259 - DNA, 25 bp, Mus musculus
aacactcgtgaaggaagagaccagg

SEQ ID NO: 73260 - DNA, 25 bp, Mus musculus
aacactctccccacgtctgtgacag

SEQ ID NO: 73261 - DNA, 25 bp, Mus musculus
aacactgactacttgcagaccggca

SEQ ID NO: 73262 - DNA, 25 bp, Mus musculus
aacactgagaagcccaccttgaaca

SEQ ID NO: 73263 - DNA, 25 bp, Mus musculus
aacactgcgagctgtggagcacact

SEQ ID NO: 73264 - DNA, 25 bp, Mus musculus
aacactggccacgagaattcacgac

SEQ ID NO: 73265 - DNA, 25 bp, Mus musculus
aacactggctcccactggatgaggc

SEQ ID NO: 73266 - DNA, 25 bp, Mus musculus
aacactggtcatgttcctcgggcag

SEQ ID NO: 73267 - DNA, 25 bp, Mus musculus
aacactggtgagcaaagtatgatcc

SEQ ID NO: 73268 - DNA, 25 bp, Mus musculus
aacactggtgggtcagtctttggcc

SEQ ID NO: 73269 - DNA, 25 bp, Mus musculus
aacactggttgagcatggagggaca

SEQ ID NO: 73270 - DNA, 25 bp, Mus musculus
aacactggtttttgccatggaatcc

SEQ ID NO: 73271 - DNA, 25 bp, Mus musculus
aacactgtaccttcctggtccctgg

SEQ ID NO: 73272 - DNA, 25 bp, Mus musculus
aacactgtatgacgtgcctcgcgag

SEQ ID NO: 73273 - DNA, 25 bp, Mus musculus
aacactgtcctcatttagaacgcca

SEQ ID NO: 73274 - DNA, 25 bp, Mus musculus
aacactgtcctcttagtccagatcc

SEQ ID NO: 73275 - DNA, 25 bp, Mus musculus
aacactgtgagctctggcagcggca

SEQ ID NO: 73276 - DNA, 25 bp, Mus musculus
aacactgttgacttggagggcccac

SEQ ID NO: 73277 - DNA, 25 bp, Mus musculus
aacacttgaagaactggacctcctg

SEQ ID NO: 73278 - DNA, 25 bp, Mus musculus
aacacttgactatcaggctgactgg

SEQ ID NO: 73279 - DNA, 25 bp, Mus musculus
aacacttggaagctattggaatttg

SEQ ID NO: 73280 - DNA, 25 bp, Mus musculus
aacacttgggttgaagcgacgctgc

SEQ ID NO: 73281 - DNA, 25 bp, Mus musculus
aacacttgggttttcagcgatgcac

SEQ ID NO: 73282 - DNA, 25 bp, Mus musculus
aacacttgtgtctcccagttgtggc

SEQ ID NO: 73283 - DNA, 25 bp, Mus musculus
aacagaaacgctggcctccttggag

SEQ ID NO: 73284 - DNA, 25 bp, Mus musculus
aacagaacatggtgtgtgtcagcac

SEQ ID NO: 73285 - DNA, 25 bp, Mus musculus
aacagaactaactcgtcccagggct

SEQ ID NO: 73286 - DNA, 25 bp, Mus musculus
aacagaaggaggatctgcagcggca

SEQ ID NO: 73287 - DNA, 25 bp, Mus musculus
aacagaagtgcgagttcgggccctc

SEQ ID NO: 73288 - DNA, 25 bp, Mus musculus
aacagaatcagcaccatcgagaggg

SEQ ID NO: 73289 - DNA, 25 bp, Mus musculus
aacagaatcgagagctgcgtggcac

SEQ ID NO: 73290 - DNA, 25 bp, Mus musculus
aacagaattcatcagagggccgggc

SEQ ID NO: 73291 - DNA, 25 bp, Mus musculus
aacagacaacatggctccgacggaa

SEQ ID NO: 73292 - DNA, 25 bp, Mus musculus
aacagacaccgtgaaagctgccggc

SEQ ID NO: 73293 - DNA, 25 bp, Mus musculus
aacagacatccaaaagcgacagata

SEQ ID NO: 73294 - DNA, 25 bp, Mus musculus
aacagaccctgacagccttcctgag

SEQ ID NO: 73295 - DNA, 25 bp, Mus musculus
aacagactaccagaatcgagcagct

SEQ ID NO: 73296 - DNA, 25 bp, Mus musculus
aacagagaaggatgggcctgaacga

SEQ ID NO: 73297 - DNA, 25 bp, Mus musculus
aacagagattcgctttggctagtcg

SEQ ID NO: 73298 - DNA, 25 bp, Mus musculus
aacagagattgaccgccaaagaggc

SEQ ID NO: 73299 - DNA, 25 bp, Mus musculus
aacagagcccgggtagagtgccaga

SEQ ID NO: 73300 - DNA, 25 bp, Mus musculus
aacagagtagcccaagggaagccca

SEQ ID NO: 73301 - DNA, 25 bp, Mus musculus
aacagagtctgttccagtggcccta

SEQ ID NO: 73302 - DNA, 25 bp, Mus musculus
aacagagtgagtctgtgaacacagc

SEQ ID NO: 73303 - DNA, 25 bp, Mus musculus
aacagatcctgtgaagagtgcctca

SEQ ID NO: 73304 - DNA, 25 bp, Mus musculus
aacagcaagaggaacaacaggagca

SEQ ID NO: 73305 - DNA, 25 bp, Mus musculus
aacagcacggatcttggaggcccat

SEQ ID NO: 73306 - DNA, 25 bp, Mus musculus
aacagcacgggcaagcgtgaaggct

SEQ ID NO: 73307 - DNA, 25 bp, Mus musculus
aacagcactatttcattgacagaga

SEQ ID NO: 73308 - DNA, 25 bp, Mus musculus
aacagcagcgtggtgtgctccgtcc

SEQ ID NO: 73309 - DNA, 25 bp, Mus musculus
aacagcaggcggagaagattcttaa

SEQ ID NO: 73310 - DNA, 25 bp, Mus musculus
aacagcagtgtttgtcctggccaca

SEQ ID NO: 73311 - DNA, 25 bp, Mus musculus
aacagccaacagaggtgccaagggt

SEQ ID NO: 73312 - DNA, 25 bp, Mus musculus
aacagccagcccaaagaagcgaaag

SEQ ID NO: 73313 - DNA, 25 bp, Mus musculus
aacagccagtgctaccagtctgagc

SEQ ID NO: 73314 - DNA, 25 bp, Mus musculus
aacagccagtttctgccttgagagc

SEQ ID NO: 73315 - DNA, 25 bp, Mus musculus
aacagccatcgtttccctctgagga

SEQ ID NO: 73316 - DNA, 25 bp, Mus musculus
aacagcccgctgaaaacgtaagagg

SEQ ID NO: 73317 - DNA, 25 bp, Mus musculus
aacagccgctgcgtccattggagga

SEQ ID NO: 73318 - DNA, 25 bp, Mus musculus
aacagccggctggacgattgcaaat

SEQ ID NO: 73319 - DNA, 25 bp, Mus musculus
aacagctccgtgtacctgtggccga

SEQ ID NO: 73320 - DNA, 25 bp, Mus musculus
aacagctcgctagtggactccaaca

SEQ ID NO: 73321 - DNA, 25 bp, Mus musculus
aacagctgaaatagcaagtcttgat

SEQ ID NO: 73322 - DNA, 25 bp, Mus musculus
aacagctgccgggctgcctgttgtt

SEQ ID NO: 73323 - DNA, 25 bp, Mus musculus
aacagctggtggctgaggccattca

SEQ ID NO: 73324 - DNA, 25 bp, Mus musculus
aacagcttcggaaacttgagcagca

SEQ ID NO: 73325 - DNA, 25 bp, Mus musculus
aacaggaagcgcctggcctatgcca

SEQ ID NO: 73326 - DNA, 25 bp, Mus musculus
aacaggacctagatgggcttgaccc

SEQ ID NO: 73327 - DNA, 25 bp, Mus musculus
aacaggacgactggacctttcacta

SEQ ID NO: 73328 - DNA, 25 bp, Mus musculus
aacaggatgagaagccggagcattc

SEQ ID NO: 73329 - DNA, 25 bp, Mus musculus
aacaggccatccaggagcttgtgcg

SEQ ID NO: 73330 - DNA, 25 bp, Mus musculus
aacaggccgctgacaataaatctgg

SEQ ID NO: 73331 - DNA, 25 bp, Mus musculus
aacaggcgatcttggtgttgtccac

SEQ ID NO: 73332 - DNA, 25 bp, Mus musculus
aacaggcgcagcatcccttgcatag

SEQ ID NO: 73333 - DNA, 25 bp, Mus musculus
aacaggcgccatccatcagtgactc

SEQ ID NO: 73334 - DNA, 25 bp, Mus musculus
aacaggcgcggctgcggcgccatat

SEQ ID NO: 73335 - DNA, 25 bp, Mus musculus
aacaggcggcaggtctcagcctaga

SEQ ID NO: 73336 - DNA, 25 bp, Mus musculus
aacaggctggagttgttgcccatcc

SEQ ID NO: 73337 - DNA, 25 bp, Mus musculus
aacaggctggccaacaaggcagtgc

SEQ ID NO: 73338 - DNA, 25 bp, Mus musculus
aacaggctgggcatcttggaactcc

SEQ ID NO: 73339 - DNA, 25 bp, Mus musculus
aacagggcgcagacattgaccagag

SEQ ID NO: 73340 - DNA, 25 bp, Mus musculus
aacagggtgctcgagaaccttgacc

SEQ ID NO: 73341 - DNA, 25 bp, Mus musculus
aacagggttggttcacacagcccca

SEQ ID NO: 73342 - DNA, 25 bp, Mus musculus
aacaggtagtagaagaggagccgac

SEQ ID NO: 73343 - DNA, 25 bp, Mus musculus
aacaggtccgccagttacagaagct

SEQ ID NO: 73344 - DNA, 25 bp, Mus musculus
aacaggtgccctccaaaacgagagc

SEQ ID NO: 73345 - DNA, 25 bp, Mus musculus
aacagtatctgcagtccatcgagga

SEQ ID NO: 73346 - DNA, 25 bp, Mus musculus
aacagtatgcagtcgtttcgggagc

SEQ ID NO: 73347 - DNA, 25 bp, Mus musculus
aacagtcaggaaaagaagtgcccgc

SEQ ID NO: 73348 - DNA, 25 bp, Mus musculus
aacagtgagatcgtgtggtccgtca

SEQ ID NO: 73349 - DNA, 25 bp, Mus musculus
aacagtggcgcatcattcaagtgca

SEQ ID NO: 73350 - DNA, 25 bp, Mus musculus
aacagtgggcgattcagcatgggca

SEQ ID NO: 73351 - DNA, 25 bp, Mus musculus
aacagtgtaccgtgaatttacgtgg

SEQ ID NO: 73352 - DNA, 25 bp, Mus musculus
aacagttctgcaggagggtttctca

SEQ ID NO: 73353 - DNA, 25 bp, Mus musculus
aacagttctggaaagctgctaagcc

SEQ ID NO: 73354 - DNA, 25 bp, Mus musculus
aacagttggctgtaatcactccttg

SEQ ID NO: 73355 - DNA, 25 bp, Mus musculus
aacagtttccccagatgacagtcag

SEQ ID NO: 73356 - DNA, 25 bp, Mus musculus
aacagtttcggttccatcgctgaga

SEQ ID NO: 73357 - DNA, 25 bp, Mus musculus
aacagtttgtaggtggagaccgcgc

SEQ ID NO: 73358 - DNA, 25 bp, Mus musculus
aacagtttgtctgagctgagaaggc

SEQ ID NO: 73359 - DNA, 25 bp, Mus musculus
aacataagcgtgtactcatctttgc

SEQ ID NO: 73360 - DNA, 25 bp, Mus musculus
aacataatcggacagcagggtgacc

SEQ ID NO: 73361 - DNA, 25 bp, Mus musculus
aacataatgtgcacgctgacccctg

SEQ ID NO: 73362 - DNA, 25 bp, Mus musculus
aacatacaagcattcccggcaaggc

SEQ ID NO: 73363 - DNA, 25 bp, Mus musculus
aacatacgcctgactttggagaagc

SEQ ID NO: 73364 - DNA, 25 bp, Mus musculus
aacatacgtgaacatacctgacagg

SEQ ID NO: 73365 - DNA, 25 bp, Mus musculus
aacatactcggattctgctggacca

SEQ ID NO: 73366 - DNA, 25 bp, Mus musculus
aacatactggtggatgctgtcagcc

SEQ ID NO: 73367 - DNA, 25 bp, Mus musculus
aacatagcagtttccagtggagccc

SEQ ID NO: 73368 - DNA, 25 bp, Mus musculus
aacataggatgttttggcgagagat

SEQ ID NO: 73369 - DNA, 25 bp, Mus musculus
aacatatggctaaaataagaacggc

SEQ ID NO: 73370 - DNA, 25 bp, Mus musculus
aacatcaccttcatgggcctggaga

SEQ ID NO: 73371 - DNA, 25 bp, Mus musculus
aacatcagttgtctacaagatcgac

SEQ ID NO: 73372 - DNA, 25 bp, Mus musculus
aacatcatcatggaaactctgggcc

SEQ ID NO: 73373 - DNA, 25 bp, Mus musculus
aacatccccgatgagagccaagtgg

SEQ ID NO: 73374 - DNA, 25 bp, Mus musculus
aacatccgcagtggctgtgtccgca

SEQ ID NO: 73375 - DNA, 25 bp, Mus musculus
aacatcgaaacgctgcagaatgcag

SEQ ID NO: 73376 - DNA, 25 bp, Mus musculus
aacatcgaagatggccacgtgctac

SEQ ID NO: 73377 - DNA, 25 bp, Mus musculus
aacatcggagatggtagtactggcc

SEQ ID NO: 73378 - DNA, 25 bp, Mus musculus
aacatcgttattttaggagttgcct

SEQ ID NO: 73379 - DNA, 25 bp, Mus musculus
aacatctgatgctaacgttctgact

SEQ ID NO: 73380 - DNA, 25 bp, Mus musculus
aacatctgggagtttctgcggcagc

SEQ ID NO: 73381 - DNA, 25 bp, Mus musculus
aacatctgtggcatctcctgtgaca

SEQ ID NO: 73382 - DNA, 25 bp, Mus musculus
aacatctttgatggcgtcattgtgg

SEQ ID NO: 73383 - DNA, 25 bp, Mus musculus
aacatgagtgccgagctggagctgc

SEQ ID NO: 73384 - DNA, 25 bp, Mus musculus
aacatgatggagagcctaagcccga

SEQ ID NO: 73385 - DNA, 25 bp, Mus musculus
aacatgcctagcctgtctgcagcca

SEQ ID NO: 73386 - DNA, 25 bp, Mus musculus
aacatgcctctggacagccgctatg

SEQ ID NO: 73387 - DNA, 25 bp, Mus musculus
aacatgcctgccgtcaaagctatca

SEQ ID NO: 73388 - DNA, 25 bp, Mus musculus
aacatgctgctggataagtctggac

SEQ ID NO: 73389 - DNA, 25 bp, Mus musculus
aacatggagggaagagaagccgcct

SEQ ID NO: 73390 - DNA, 25 bp, Mus musculus
aacatggagtcagcaggcattgccc

SEQ ID NO: 73391 - DNA, 25 bp, Mus musculus
aacatggatgggtggcaggctaaca

SEQ ID NO: 73392 - DNA, 25 bp, Mus musculus
aacatggccatgtgagaatctcgga

SEQ ID NO: 73393 - DNA, 25 bp, Mus musculus
aacatggccgaagtcggcgaggaca

SEQ ID NO: 73394 - DNA, 25 bp, Mus musculus
aacatggccgttcctaactttgaag

SEQ ID NO: 73395 - DNA, 25 bp, Mus musculus
aacatggcgaccgagggaatgatcc

SEQ ID NO: 73396 - DNA, 25 bp, Mus musculus
aacatggcggccgtgtcggtcctag

SEQ ID NO: 73397 - DNA, 25 bp, Mus musculus
aacatggtccaggtgatccgtcaga

SEQ ID NO: 73398 - DNA, 25 bp, Mus musculus
aacatggtcctcctcgtgactgcgg

SEQ ID NO: 73399 - DNA, 25 bp, Mus musculus
aacatggtggccaacgagacagggc

SEQ ID NO: 73400 - DNA, 25 bp, Mus musculus
aacatgtagtgttcccgggtgtccg

SEQ ID NO: 73401 - DNA, 25 bp, Mus musculus
aacatgtcgcaggtataagcctccc

SEQ ID NO: 73402 - DNA, 25 bp, Mus musculus
aacatgtcgtctgtggcctccagca

SEQ ID NO: 73403 - DNA, 25 bp, Mus musculus
aacatgttgagggaagcaaagccca

SEQ ID NO: 73404 - DNA, 25 bp, Mus musculus
aacatgttggagcagctcctgatcc

SEQ ID NO: 73405 - DNA, 25 bp, Mus musculus
aacatgtttgggatgtggaagccta

SEQ ID NO: 73406 - DNA, 25 bp, Mus musculus
aacattaagatggtgtgagaggccc

SEQ ID NO: 73407 - DNA, 25 bp, Mus musculus
aacattaggctggatgcgaccttca

SEQ ID NO: 73408 - DNA, 25 bp, Mus musculus
aacattattgattcggttccagagg

SEQ ID NO: 73409 - DNA, 25 bp, Mus musculus
aacattcctgagaaggctgactgga

SEQ ID NO: 73410 - DNA, 25 bp, Mus musculus
aacattcctgagaagtggaccccag

SEQ ID NO: 73411 - DNA, 25 bp, Mus musculus
aacattgaggcttggatgaaggaca

SEQ ID NO: 73412 - DNA, 25 bp, Mus musculus
aacattgagtgttacgtctgcgggc

SEQ ID NO: 73413 - DNA, 25 bp, Mus musculus
aacattgccaaggaattttactgga

SEQ ID NO: 73414 - DNA, 25 bp, Mus musculus
aacattgcctggaatagcactggcc

SEQ ID NO: 73415 - DNA, 25 bp, Mus musculus
aacattgcgtggtcaaccctcaggg

SEQ ID NO: 73416 - DNA, 25 bp, Mus musculus
aacattgctagtgtgcgggtcagcc

SEQ ID NO: 73417 - DNA, 25 bp, Mus musculus
aacattggagctgcactctgtgacc

SEQ ID NO: 73418 - DNA, 25 bp, Mus musculus
aacattggccgcaaggactacctgg

SEQ ID NO: 73419 - DNA, 25 bp, Mus musculus
aacattggcgatgtgggctgctaca

SEQ ID NO: 73420 - DNA, 25 bp, Mus musculus
aacattgggacggtgtacgagcgct

SEQ ID NO: 73421 - DNA, 25 bp, Mus musculus
aacattggtcctctgattcgaatca

SEQ ID NO: 73422 - DNA, 25 bp, Mus musculus
aacattgtaaatgcaacaataaggg

SEQ ID NO: 73423 - DNA, 25 bp, Mus musculus
aacattgtcccagattccagtgagc

SEQ ID NO: 73424 - DNA, 25 bp, Mus musculus
aacatttacagaagccccggagcga

SEQ ID NO: 73425 - DNA, 25 bp, Mus musculus
aacatttctaccagaccagcggcaa

SEQ ID NO: 73426 - DNA, 25 bp, Mus musculus
aaccaaaagcctcatcgagccagtg

SEQ ID NO: 73427 - DNA, 25 bp, Mus musculus
aaccaaagggctatggcttctgcga

SEQ ID NO: 73428 - DNA, 25 bp, Mus musculus
aaccaactgtgagagcggagctgat

SEQ ID NO: 73429 - DNA, 25 bp, Mus musculus
aaccaaggacctttgcgtacagaag

SEQ ID NO: 73430 - DNA, 25 bp, Mus musculus
aaccaaggcattgctcctgtccaag

SEQ ID NO: 73431 - DNA, 25 bp, Mus musculus
aaccaagggccagaatactactaca

SEQ ID NO: 73432 - DNA, 25 bp, Mus musculus
aaccaagtggtttgccctgctccag

SEQ ID NO: 73433 - DNA, 25 bp, Mus musculus
aaccaagtgtcctatgtgcggcccg

SEQ ID NO: 73434 - DNA, 25 bp, Mus musculus
aaccaagtgtttgaggccaagtgcc

SEQ ID NO: 73435 - DNA, 25 bp, Mus musculus
aaccaataaacatgttctaggacgg

SEQ ID NO: 73436 - DNA, 25 bp, Mus musculus
aaccacagcaggtgccgtcatggtg

SEQ ID NO: 73437 - DNA, 25 bp, Mus musculus
aaccaccgtggtacataatgctaca

SEQ ID NO: 73438 - DNA, 25 bp, Mus musculus
aaccacctgcgctgtgagaagctca

SEQ ID NO: 73439 - DNA, 25 bp, Mus musculus
aaccaccttcagtgtgaggagccca

SEQ ID NO: 73440 - DNA, 25 bp, Mus musculus
aaccacgcgtttggaggtctgggca

SEQ ID NO: 73441 - DNA, 25 bp, Mus musculus
aaccacgtggtggaacctgtgacct

SEQ ID NO: 73442 - DNA, 25 bp, Mus musculus
aaccactgaagaagcgaaatcgggc

SEQ ID NO: 73443 - DNA, 25 bp, Mus musculus
aaccactggctatgaggaagctgca

SEQ ID NO: 73444 - DNA, 25 bp, Mus musculus
aaccactgtacttgcccatgaggaa

SEQ ID NO: 73445 - DNA, 25 bp, Mus musculus
aaccactgtggacttgccaccgcgg

SEQ ID NO: 73446 - DNA, 25 bp, Mus musculus
aaccagactagtaggcatggcggcg

SEQ ID NO: 73447 - DNA, 25 bp, Mus musculus
aaccagagccccaacagatgacagt

SEQ ID NO: 73448 - DNA, 25 bp, Mus musculus
aaccagagggttcagtgccagtgct

SEQ ID NO: 73449 - DNA, 25 bp, Mus musculus
aaccagaggtatgagatgcacgagc

SEQ ID NO: 73450 - DNA, 25 bp, Mus musculus
aaccagagtccagagcttgtgcaaa

SEQ ID NO: 73451 - DNA, 25 bp, Mus musculus
aaccagattagaagacggattgttc

SEQ ID NO: 73452 - DNA, 25 bp, Mus musculus
aaccagcaccttccatattttatca

SEQ ID NO: 73453 - DNA, 25 bp, Mus musculus
aaccagcagcaattaggacgtttca

SEQ ID NO: 73454 - DNA, 25 bp, Mus musculus
aaccagcatcttcgagtcggctggg

SEQ ID NO: 73455 - DNA, 25 bp, Mus musculus
aaccagccacgacctgctgataagg

SEQ ID NO: 73456 - DNA, 25 bp, Mus musculus
aaccagccagtctccctgcagaaga

SEQ ID NO: 73457 - DNA, 25 bp, Mus musculus
aaccagcccaccagggctctgaata

SEQ ID NO: 73458 - DNA, 25 bp, Mus musculus
aaccaggactcgtggccgggctaag

SEQ ID NO: 73459 - DNA, 25 bp, Mus musculus
aaccaggcactgaaaactccgaggc

SEQ ID NO: 73460 - DNA, 25 bp, Mus musculus
aaccaggccgacatcatcttcgaca

SEQ ID NO: 73461 - DNA, 25 bp, Mus musculus
aaccaggtgccttctagggagagga

SEQ ID NO: 73462 - DNA, 25 bp, Mus musculus
aaccagtcttaaatgggagacggag

SEQ ID NO: 73463 - DNA, 25 bp, Mus musculus
aaccagtgatatttgaagatgaggc

SEQ ID NO: 73464 - DNA, 25 bp, Mus musculus
aaccagttccgtgccggccgtgcag

SEQ ID NO: 73465 - DNA, 25 bp, Mus musculus
aaccatagtacccagttgtcgggca

SEQ ID NO: 73466 - DNA, 25 bp, Mus musculus
aaccatgaaactcctcatcctcacc

SEQ ID NO: 73467 - DNA, 25 bp, Mus musculus
aaccatggaggttgtgcctgtccgg

SEQ ID NO: 73468 - DNA, 25 bp, Mus musculus
aaccatggggttccttctgctttgg

SEQ ID NO: 73469 - DNA, 25 bp, Mus musculus
aaccatgtcaggtcagctgtgccca

SEQ ID NO: 73470 - DNA, 25 bp, Mus musculus
aaccatgtttggtgacgggagcacc

SEQ ID NO: 73471 - DNA, 25 bp, Mus musculus
aaccattttacacaggccaagggcg

SEQ ID NO: 73472 - DNA, 25 bp, Mus musculus
aacccaaaaatggtgagtttgtatg

SEQ ID NO: 73473 - DNA, 25 bp, Mus musculus
aacccaagagatgaagggtctcctc

SEQ ID NO: 73474 - DNA, 25 bp, Mus musculus
aacccacacccaggagacttgattg

SEQ ID NO: 73475 - DNA, 25 bp, Mus musculus
aacccacacctgtgttttacagcac

SEQ ID NO: 73476 - DNA, 25 bp, Mus musculus
aacccaccaccatgaagaacatcgg

SEQ ID NO: 73477 - DNA, 25 bp, Mus musculus
aacccagaagtggaaacatttcagt

SEQ ID NO: 73478 - DNA, 25 bp, Mus musculus
aacccagcagcgtctgacttctaag

SEQ ID NO: 73479 - DNA, 25 bp, Mus musculus
aacccagcatgaacctgataccacg

SEQ ID NO: 73480 - DNA, 25 bp, Mus musculus
aacccagcttgggtactatgtaaca

SEQ ID NO: 73481 - DNA, 25 bp, Mus musculus
aacccatagggctgaggaacattgt

SEQ ID NO: 73482 - DNA, 25 bp, Mus musculus
aacccattccagaacccattcgaga

SEQ ID NO: 73483 - DNA, 25 bp, Mus musculus
aaccccagcgaccaaagtgtttcag

SEQ ID NO: 73484 - DNA, 25 bp, Mus musculus
aaccccaggagcagttgatgttcac

SEQ ID NO: 73485 - DNA, 25 bp, Mus musculus
aaccccatttcctgacttgctgaag

SEQ ID NO: 73486 - DNA, 25 bp, Mus musculus
aaccccctgatcaggtgtgacggga

SEQ ID NO: 73487 - DNA, 25 bp, Mus musculus
aaccccgtgggctgatcaataaagg

SEQ ID NO: 73488 - DNA, 25 bp, Mus musculus
aacccctgagggacgtgaacagcta

SEQ ID NO: 73489 - DNA, 25 bp, Mus musculus
aacccgacgtaggatctttgatgcc

SEQ ID NO: 73490 - DNA, 25 bp, Mus musculus
aacccgccgccaccgaggtagtgat

SEQ ID NO: 73491 - DNA, 25 bp, Mus musculus
aacccgctcgtgtacttggacgtgg

SEQ ID NO: 73492 - DNA, 25 bp, Mus musculus
aacccgctgcagttcaccgatgagg

SEQ ID NO: 73493 - DNA, 25 bp, Mus musculus
aacccgtggtgctccagttcatgga

SEQ ID NO: 73494 - DNA, 25 bp, Mus musculus
aaccctccggtgtgcggtgaccagg

SEQ ID NO: 73495 - DNA, 25 bp, Mus musculus
aaccctcggtacctgcagccaggag

SEQ ID NO: 73496 - DNA, 25 bp, Mus musculus
aaccctgcgtcccagaaggctggtc

SEQ ID NO: 73497 - DNA, 25 bp, Mus musculus
aaccctgctatgcttgtccttggaa

SEQ ID NO: 73498 - DNA, 25 bp, Mus musculus
aaccctgtacggcaccgctctcttt

SEQ ID NO: 73499 - DNA, 25 bp, Mus musculus
aacccttaccagtttgatgtgctcg

SEQ ID NO: 73500 - DNA, 25 bp, Mus musculus
aacccttcactgctgcccgcctggt

SEQ ID NO: 73501 - DNA, 25 bp, Mus musculus
aacccttggtgctgttccgaggagg

SEQ ID NO: 73502 - DNA, 25 bp, Mus musculus
aaccctttggatgctaagctcgtgt

SEQ ID NO: 73503 - DNA, 25 bp, Mus musculus
aaccgaatgatagctgtctgccaga

SEQ ID NO: 73504 - DNA, 25 bp, Mus musculus
aaccgacccgcttagagctcaagct

SEQ ID NO: 73505 - DNA, 25 bp, Mus musculus
aaccgagtgctgtagaattctggcc

SEQ ID NO: 73506 - DNA, 25 bp, Mus musculus
aaccgcctgcgggacaataagggca

SEQ ID NO: 73507 - DNA, 25 bp, Mus musculus
aaccgcgtctcttaggcaacaggca

SEQ ID NO: 73508 - DNA, 25 bp, Mus musculus
aaccgctacctccaggcaacctggt

SEQ ID NO: 73509 - DNA, 25 bp, Mus musculus
aaccggacagatgtgcagtgccaac

SEQ ID NO: 73510 - DNA, 25 bp, Mus musculus
aaccggacggagtgcgctttgaccg

SEQ ID NO: 73511 - DNA, 25 bp, Mus musculus
aaccggatttgtcagagcatgggcc

SEQ ID NO: 73512 - DNA, 25 bp, Mus musculus
aaccggctgttaaggatctctcgaa

SEQ ID NO: 73513 - DNA, 25 bp, Mus musculus
aaccgggtgacagctgagaggaacc

SEQ ID NO: 73514 - DNA, 25 bp, Mus musculus
aaccgggttgcagctcagaggagcc

SEQ ID NO: 73515 - DNA, 25 bp, Mus musculus
aaccgtagtggcgaccagggctact

SEQ ID NO: 73516 - DNA, 25 bp, Mus musculus
aaccgtctggcttccgcgctggagt

SEQ ID NO: 73517 - DNA, 25 bp, Mus musculus
aaccgtggagttctcagcacatgca

SEQ ID NO: 73518 - DNA, 25 bp, Mus musculus
aacctactgacaaactgcctgctct

SEQ ID NO: 73519 - DNA, 25 bp, Mus musculus
aacctagaagaagagggactgccca

SEQ ID NO: 73520 - DNA, 25 bp, Mus musculus
aacctaggagaagtagccatcttgc

SEQ ID NO: 73521 - DNA, 25 bp, Mus musculus
aacctcagctggaggacacaagcca

SEQ ID NO: 73522 - DNA, 25 bp, Mus musculus
aacctcagtgtactgcagctgccag

SEQ ID NO: 73523 - DNA, 25 bp, Mus musculus
aacctcatggtgtgcagtgctcgga

SEQ ID NO: 73524 - DNA, 25 bp, Mus musculus
aacctcattgttgtgggccgatacc

SEQ ID NO: 73525 - DNA, 25 bp, Mus musculus
aacctccccagcatatgcgtgcaga

SEQ ID NO: 73526 - DNA, 25 bp, Mus musculus
aacctccgggtccagtcagctctgg

SEQ ID NO: 73527 - DNA, 25 bp, Mus musculus
aacctcctgaaatgggcagccagca

SEQ ID NO: 73528 - DNA, 25 bp, Mus musculus
aacctcgctgacacggtgctcaaga

SEQ ID NO: 73529 - DNA, 25 bp, Mus musculus
aacctgaagatctgcgcccggagat

SEQ ID NO: 73530 - DNA, 25 bp, Mus musculus
aacctgaagcacgagcagagtcacc

SEQ ID NO: 73531 - DNA, 25 bp, Mus musculus
aacctgaagcggaagtgcaaatgcc

SEQ ID NO: 73532 - DNA, 25 bp, Mus musculus
aacctgacgtcatcactgggcgccg

SEQ ID NO: 73533 - DNA, 25 bp, Mus musculus
aacctgagtgttgcgttagtggaca

SEQ ID NO: 73534 - DNA, 25 bp, Mus musculus
aacctgatcaccagcaacaggcgca

SEQ ID NO: 73535 - DNA, 25 bp, Mus musculus
aacctgcaggatgggagaacaagtc

SEQ ID NO: 73536 - DNA, 25 bp, Mus musculus
aacctgccgggcttagaccgtcatg

SEQ ID NO: 73537 - DNA, 25 bp, Mus musculus
aacctgcgcatagtggtgattgacc

SEQ ID NO: 73538 - DNA, 25 bp, Mus musculus
aacctgctggcagtggttgcccctg

SEQ ID NO: 73539 - DNA, 25 bp, Mus musculus
aacctggagacctcatcttcgccaa

SEQ ID NO: 73540 - DNA, 25 bp, Mus musculus
aacctggccacggaattgctgactg

SEQ ID NO: 73541 - DNA, 25 bp, Mus musculus
aacctggctgcctgagtgtcgtgga

SEQ ID NO: 73542 - DNA, 25 bp, Mus musculus
aacctgggctacatgcacgagaagg

SEQ ID NO: 73543 - DNA, 25 bp, Mus musculus
aacctggtgggtgagccctccttat

SEQ ID NO: 73544 - DNA, 25 bp, Mus musculus
aacctgtagaagttgtcctagacga

SEQ ID NO: 73545 - DNA, 25 bp, Mus musculus
aacctgtggagtacatgaacttatc

SEQ ID NO: 73546 - DNA, 25 bp, Mus musculus
aaccttaagcagagagatccccggc

SEQ ID NO: 73547 - DNA, 25 bp, Mus musculus
aaccttccctgtttgaggacattgg

SEQ ID NO: 73548 - DNA, 25 bp, Mus musculus
aaccttctagatcaaaccttcatca

SEQ ID NO: 73549 - DNA, 25 bp, Mus musculus
aaccttgacgcccaggatgagcctg

SEQ ID NO: 73550 - DNA, 25 bp, Mus musculus
aaccttgagctgtctgcacggagcc

SEQ ID NO: 73551 - DNA, 25 bp, Mus musculus
aaccttgagggtgactactactgcg

SEQ ID NO: 73552 - DNA, 25 bp, Mus musculus
aaccttgcctctctctgaccagtga

SEQ ID NO: 73553 - DNA, 25 bp, Mus musculus
aacctttagcgggacctgcagagga

SEQ ID NO: 73554 - DNA, 25 bp, Mus musculus
aacctttctacaactcagacaggag

SEQ ID NO: 73555 - DNA, 25 bp, Mus musculus
aacctttctcgagatgtgacagaag

SEQ ID NO: 73556 - DNA, 25 bp, Mus musculus
aacctttgacatggagacgtccagc

SEQ ID NO: 73557 - DNA, 25 bp, Mus musculus
aaccttttgaatagagcctcaccac

SEQ ID NO: 73558 - DNA, 25 bp, Mus musculus
aacgaaacggtggatctgggatctc

SEQ ID NO: 73559 - DNA, 25 bp, Mus musculus
aacgaacaagtacgagggatggcct

SEQ ID NO: 73560 - DNA, 25 bp, Mus musculus
aacgaagatgtccatgacctgctgg

SEQ ID NO: 73561 - DNA, 25 bp, Mus musculus
aacgaagattttccagcattacctg

SEQ ID NO: 73562 - DNA, 25 bp, Mus musculus
aacgaagcggtatttgcggcggact

SEQ ID NO: 73563 - DNA, 25 bp, Mus musculus
aacgaagggcctggttacgacagag

SEQ ID NO: 73564 - DNA, 25 bp, Mus musculus
aacgaagtgactttccatgaatgcc

SEQ ID NO: 73565 - DNA, 25 bp, Mus musculus
aacgaagttcatcccgtcaggccga

SEQ ID NO: 73566 - DNA, 25 bp, Mus musculus
aacgaatgagcttgtgtttcacaca

SEQ ID NO: 73567 - DNA, 25 bp, Mus musculus
aacgaatgtggttgggcaaatcccg

SEQ ID NO: 73568 - DNA, 25 bp, Mus musculus
aacgacgctgcaaaggaactcatgg

SEQ ID NO: 73569 - DNA, 25 bp, Mus musculus
aacgacttccatgggcttgtgcaga

SEQ ID NO: 73570 - DNA, 25 bp, Mus musculus
aacgagaagacagcagtgaggaaga

SEQ ID NO: 73571 - DNA, 25 bp, Mus musculus
aacgagaagccgcaccgatgcccca

SEQ ID NO: 73572 - DNA, 25 bp, Mus musculus
aacgagaccgtgtgcagaagaaaac

SEQ ID NO: 73573 - DNA, 25 bp, Mus musculus
aacgagatcgatgagctgaggaccg

SEQ ID NO: 73574 - DNA, 25 bp, Mus musculus
aacgagatgatgcagacccggatga

SEQ ID NO: 73575 - DNA, 25 bp, Mus musculus
aacgagcacgtcatcagtattggag

SEQ ID NO: 73576 - DNA, 25 bp, Mus musculus
aacgagcgcagcttggccttctacg

SEQ ID NO: 73577 - DNA, 25 bp, Mus musculus
aacgagctttgctgggctacgctga

SEQ ID NO: 73578 - DNA, 25 bp, Mus musculus
aacgaggacagtgacagctccttgc

SEQ ID NO: 73579 - DNA, 25 bp, Mus musculus
aacgaggagaccatactgaacgcgc

SEQ ID NO: 73580 - DNA, 25 bp, Mus musculus
aacgaggccaagacaggtgctgaca

SEQ ID NO: 73581 - DNA, 25 bp, Mus musculus
aacgaggctgtgaacgtgtggaccc

SEQ ID NO: 73582 - DNA, 25 bp, Mus musculus
aacgagtcaggcacttcggcagctg

SEQ ID NO: 73583 - DNA, 25 bp, Mus musculus
aacgagtccgcagcctttgtgcagg

SEQ ID NO: 73584 - DNA, 25 bp, Mus musculus
aacgagttccatgggcatgctgcag

SEQ ID NO: 73585 - DNA, 25 bp, Mus musculus
aacgatccagacttccaacatgagg

SEQ ID NO: 73586 - DNA, 25 bp, Mus musculus
aacgatggcaacatgacctgctaag

SEQ ID NO: 73587 - DNA, 25 bp, Mus musculus
aacgatggccttaaacctaagcagg

SEQ ID NO: 73588 - DNA, 25 bp, Mus musculus
aacgatgggacagtgtcggtcagcc

SEQ ID NO: 73589 - DNA, 25 bp, Mus musculus
aacgatgtggatgcgagccttgtcc

SEQ ID NO: 73590 - DNA, 25 bp, Mus musculus
aacgcaaccatctctgtggacggga

SEQ ID NO: 73591 - DNA, 25 bp, Mus musculus
aacgcactcaggacagccactgtga

SEQ ID NO: 73592 - DNA, 25 bp, Mus musculus
aacgcagatgtcgtgcacctgggca

SEQ ID NO: 73593 - DNA, 25 bp, Mus musculus
aacgcagccgtagtggtaaattccg

SEQ ID NO: 73594 - DNA, 25 bp, Mus musculus
aacgcagttcctaatgggagtgcca

SEQ ID NO: 73595 - DNA, 25 bp, Mus musculus
aacgcctcagccaacgggaagtaga

SEQ ID NO: 73596 - DNA, 25 bp, Mus musculus
aacgcctctgctctgttcctgttgc

SEQ ID NO: 73597 - DNA, 25 bp, Mus musculus
aacgccttggctaacagtgtctggg

SEQ ID NO: 73598 - DNA, 25 bp, Mus musculus
aacgcgggccacgatgacagattac

SEQ ID NO: 73599 - DNA, 25 bp, Mus musculus
aacgctccgagaagataagaaccac

SEQ ID NO: 73600 - DNA, 25 bp, Mus musculus
aacgctgagccctggctatatccga

SEQ ID NO: 73601 - DNA, 25 bp, Mus musculus
aacgctgcctgaagggtcccagaat

SEQ ID NO: 73602 - DNA, 25 bp, Mus musculus
aacgctgtgggctctgtgctcagca

SEQ ID NO: 73603 - DNA, 25 bp, Mus musculus
aacgctgttgaattagccgaaggca

SEQ ID NO: 73604 - DNA, 25 bp, Mus musculus
aacgcttcagcccatcttcagaagc

SEQ ID NO: 73605 - DNA, 25 bp, Mus musculus
aacgcttccgggtcgccgccggctg

SEQ ID NO: 73606 - DNA, 25 bp, Mus musculus
aacggaagtaggaagcatgtctgac

SEQ ID NO: 73607 - DNA, 25 bp, Mus musculus
aacggaagtcgttctctgagcaggc

SEQ ID NO: 73608 - DNA, 25 bp, Mus musculus
aacggagacctcacgcctgagatga

SEQ ID NO: 73609 - DNA, 25 bp, Mus musculus
aacggagactggaacactacgctgg

SEQ ID NO: 73610 - DNA, 25 bp, Mus musculus
aacggattcatcgttactcagtaga

SEQ ID NO: 73611 - DNA, 25 bp, Mus musculus
aacggcagatgcgtctggagcaaca

SEQ ID NO: 73612 - DNA, 25 bp, Mus musculus
aacggcagcttcttagtgcgggaga

SEQ ID NO: 73613 - DNA, 25 bp, Mus musculus
aacggccagggaggcacctttagag

SEQ ID NO: 73614 - DNA, 25 bp, Mus musculus
aacggcccagcaacttcagattttg

SEQ ID NO: 73615 - DNA, 25 bp, Mus musculus
aacggcggctctcatgctggaaaca

SEQ ID NO: 73616 - DNA, 25 bp, Mus musculus
aacggctaccgtggtgtctgcatca

SEQ ID NO: 73617 - DNA, 25 bp, Mus musculus
aacggctgattgaggacactgagga

SEQ ID NO: 73618 - DNA, 25 bp, Mus musculus
aacggctggatcctcttcctggcga

SEQ ID NO: 73619 - DNA, 25 bp, Mus musculus
aacggcttccagagcgtacacgagg

SEQ ID NO: 73620 - DNA, 25 bp, Mus musculus
aacggctttgcaccatacttacggg

SEQ ID NO: 73621 - DNA, 25 bp, Mus musculus
aacgggaacatgagcaccatcggac

SEQ ID NO: 73622 - DNA, 25 bp, Mus musculus
aacgggaatttcagcgggtcatcat

SEQ ID NO: 73623 - DNA, 25 bp, Mus musculus
aacgggacagcacgctttgaatgcc

SEQ ID NO: 73624 - DNA, 25 bp, Mus musculus
aacgggcactgcttaaaagatagaa

SEQ ID NO: 73625 - DNA, 25 bp, Mus musculus
aacgggctgggcatctactgtggca

SEQ ID NO: 73626 - DNA, 25 bp, Mus musculus
aacgggtatgtgactgtcagtgaaa

SEQ ID NO: 73627 - DNA, 25 bp, Mus musculus
aacgggtcagaaccgctgtggatca

SEQ ID NO: 73628 - DNA, 25 bp, Mus musculus
aacggtcaagttaaagcctcggctg

SEQ ID NO: 73629 - DNA, 25 bp, Mus musculus
aacggtcctggtacgctgttactga

SEQ ID NO: 73630 - DNA, 25 bp, Mus musculus
aacggtctacagtgtcattcttggg

SEQ ID NO: 73631 - DNA, 25 bp, Mus musculus
aacggtggtacatgcatctcgggcc

SEQ ID NO: 73632 - DNA, 25 bp, Mus musculus
aacggttcagccaagtctggagcgc

SEQ ID NO: 73633 - DNA, 25 bp, Mus musculus
aacggttctcactagcgagggctga

SEQ ID NO: 73634 - DNA, 25 bp, Mus musculus
aacggttctgccacgtcagcgagat

SEQ ID NO: 73635 - DNA, 25 bp, Mus musculus
aacgtaacgtcctcggtcaagatca

SEQ ID NO: 73636 - DNA, 25 bp, Mus musculus
aacgtacaatagaatccctgatgga

SEQ ID NO: 73637 - DNA, 25 bp, Mus musculus
aacgtcatctagaggaatttgcccc

SEQ ID NO: 73638 - DNA, 25 bp, Mus musculus
aacgtcctgcatagcatgaaccggg

SEQ ID NO: 73639 - DNA, 25 bp, Mus musculus
aacgtcctgcattcggccttcgagg

SEQ ID NO: 73640 - DNA, 25 bp, Mus musculus
aacgtgaactttcctctggtggaca

SEQ ID NO: 73641 - DNA, 25 bp, Mus musculus
aacgtgatgggcaacggtctctccc

SEQ ID NO: 73642 - DNA, 25 bp, Mus musculus
aacgtgctcgagaattgctttacag

SEQ ID NO: 73643 - DNA, 25 bp, Mus musculus
aacgtgctgaagatccgaaggcgaa

SEQ ID NO: 73644 - DNA, 25 bp, Mus musculus
aacgtgcttcctgttgctcggtaag

SEQ ID NO: 73645 - DNA, 25 bp, Mus musculus
aacgtggacggcttgacagccctgc

SEQ ID NO: 73646 - DNA, 25 bp, Mus musculus
aacgtggagaggagaaccggcactt

SEQ ID NO: 73647 - DNA, 25 bp, Mus musculus
aacgtggctttagtggctggagaca

SEQ ID NO: 73648 - DNA, 25 bp, Mus musculus
aacgtggtggccgatttctcgggct

SEQ ID NO: 73649 - DNA, 25 bp, Mus musculus
aacgtggtgtgtctattcgccggca

SEQ ID NO: 73650 - DNA, 25 bp, Mus musculus
aacgtggttccacaagggtgcatgc

SEQ ID NO: 73651 - DNA, 25 bp, Mus musculus
aacgtgtatggcatcctgcgggccc

SEQ ID NO: 73652 - DNA, 25 bp, Mus musculus
aacgtgtcatcgaagacctctcagg

SEQ ID NO: 73653 - DNA, 25 bp, Mus musculus
aacgtgtctgtgttcctggctccca

SEQ ID NO: 73654 - DNA, 25 bp, Mus musculus
aacgtgtggctaccttcaacggcaa

SEQ ID NO: 73655 - DNA, 25 bp, Mus musculus
aacgtgttcatcacagctacgggca

SEQ ID NO: 73656 - DNA, 25 bp, Mus musculus
aacgtgtttaagaagatccgaggca

SEQ ID NO: 73657 - DNA, 25 bp, Mus musculus
aacgttatagcacacctcagatggc

SEQ ID NO: 73658 - DNA, 25 bp, Mus musculus
aacgttcagaccgtagccatggctg

SEQ ID NO: 73659 - DNA, 25 bp, Mus musculus
aacgttcagagagcctgacctcgga

SEQ ID NO: 73660 - DNA, 25 bp, Mus musculus
aacgttcgcgtcactgattggccca

SEQ ID NO: 73661 - DNA, 25 bp, Mus musculus
aacgttgaggacagttgaggacacc

SEQ ID NO: 73662 - DNA, 25 bp, Mus musculus
aacgttgcatactctttcaaaagga

SEQ ID NO: 73663 - DNA, 25 bp, Mus musculus
aacgttggtgagaagcacagaaacc

SEQ ID NO: 73664 - DNA, 25 bp, Mus musculus
aacgtttgcggcatgtcatccctgg

SEQ ID NO: 73665 - DNA, 25 bp, Mus musculus
aactaactggctaatgaactggtcg

SEQ ID NO: 73666 - DNA, 25 bp, Mus musculus
aactaactgtccctctgtggctggg

SEQ ID NO: 73667 - DNA, 25 bp, Mus musculus
aactaacttattttgcccagctggg

SEQ ID NO: 73668 - DNA, 25 bp, Mus musculus
aactaagaagatcgatgtggcccgg

SEQ ID NO: 73669 - DNA, 25 bp, Mus musculus
aactaagcatcctaatccctatgaa

SEQ ID NO: 73670 - DNA, 25 bp, Mus musculus
aactaagcgaagagacctcatggcc

SEQ ID NO: 73671 - DNA, 25 bp, Mus musculus
aactaatcttttgatgttgaaagga

SEQ ID NO: 73672 - DNA, 25 bp, Mus musculus
aactaatgaagaagtggtcaaccac

SEQ ID NO: 73673 - DNA, 25 bp, Mus musculus
aactacaaggcggagctggcgtctt

SEQ ID NO: 73674 - DNA, 25 bp, Mus musculus
aactacagcccgaatccgggatact

SEQ ID NO: 73675 - DNA, 25 bp, Mus musculus
aactacagtagtgccaagtcctcca

SEQ ID NO: 73676 - DNA, 25 bp, Mus musculus
aactacatcatgaacaaggacttgc

SEQ ID NO: 73677 - DNA, 25 bp, Mus musculus
aactaccaccaggacgcggaggctg

SEQ ID NO: 73678 - DNA, 25 bp, Mus musculus
aactaccgaggcctggaacatcaac

SEQ ID NO: 73679 - DNA, 25 bp, Mus musculus
aactacctgaagacgcaagcctaca

SEQ ID NO: 73680 - DNA, 25 bp, Mus musculus
aactacgagacgatgggagaaccgc

SEQ ID NO: 73681 - DNA, 25 bp, Mus musculus
aactacgccggttatgatgatgcct

SEQ ID NO: 73682 - DNA, 25 bp, Mus musculus
aactacgctgccatgaagctggtga

SEQ ID NO: 73683 - DNA, 25 bp, Mus musculus
aactacgtgggagacgacagagaga

SEQ ID NO: 73684 - DNA, 25 bp, Mus musculus
aactactgggttgagatattttcta

SEQ ID NO: 73685 - DNA, 25 bp, Mus musculus
aactacttggcacccttcgactgga

SEQ ID NO: 73686 - DNA, 25 bp, Mus musculus
aactactttgagagctacctggcag

SEQ ID NO: 73687 - DNA, 25 bp, Mus musculus
aactagaatgtacaggtggcatgcc

SEQ ID NO: 73688 - DNA, 25 bp, Mus musculus
aactagagagatcaccctcgacctg

SEQ ID NO: 73689 - DNA, 25 bp, Mus musculus
aactagagattgcaacgaccatggg

SEQ ID NO: 73690 - DNA, 25 bp, Mus musculus
aactagaggtcatcattgaagagtc

SEQ ID NO: 73691 - DNA, 25 bp, Mus musculus
aactagcagagaacgaggatgcgct

SEQ ID NO: 73692 - DNA, 25 bp, Mus musculus
aactagctttgacgagatgctgcca

SEQ ID NO: 73693 - DNA, 25 bp, Mus musculus
aactaggcataaggaagaatgtctc

SEQ ID NO: 73694 - DNA, 25 bp, Mus musculus
aactagttccaaagtggcacaggcc

SEQ ID NO: 73695 - DNA, 25 bp, Mus musculus
aactatagcagcctggtatccttgg

SEQ ID NO: 73696 - DNA, 25 bp, Mus musculus
aactatatccagaccttgggccgtg

SEQ ID NO: 73697 - DNA, 25 bp, Mus musculus
aactatgacagggaaaggtgttcca

SEQ ID NO: 73698 - DNA, 25 bp, Mus musculus
aactatgggagcttctgggcagaca

SEQ ID NO: 73699 - DNA, 25 bp, Mus musculus
aactatgtagcagcaagacggcagc

SEQ ID NO: 73700 - DNA, 25 bp, Mus musculus
aactatgtagctgatcttggcgcca

SEQ ID NO: 73701 - DNA, 25 bp, Mus musculus
aactattcctgtgtggtgggcaaca

SEQ ID NO: 73702 - DNA, 25 bp, Mus musculus
aactattggcttagagaccgtgggc

SEQ ID NO: 73703 - DNA, 25 bp, Mus musculus
aactcaaataaccatctggcagctg

SEQ ID NO: 73704 - DNA, 25 bp, Mus musculus
aactcagaccgcagcatggacatgg

SEQ ID NO: 73705 - DNA, 25 bp, Mus musculus
aactcagactgtgcctatgaccgga

SEQ ID NO: 73706 - DNA, 25 bp, Mus musculus
aactcagagcctcgtccggtgcagg

SEQ ID NO: 73707 - DNA, 25 bp, Mus musculus
aactcagcggtttggtactatcacc

SEQ ID NO: 73708 - DNA, 25 bp, Mus musculus
aactcagctctctgaactccgaggg

SEQ ID NO: 73709 - DNA, 25 bp, Mus musculus
aactcaggacgttcattcacgagcg

SEQ ID NO: 73710 - DNA, 25 bp, Mus musculus
aactcagttctgaagaggaatctca

SEQ ID NO: 73711 - DNA, 25 bp, Mus musculus
aactcatcggtgaagctgcagggaa

SEQ ID NO: 73712 - DNA, 25 bp, Mus musculus
aactcatggatttgctggacagaca

SEQ ID NO: 73713 - DNA, 25 bp, Mus musculus
aactccaaacacacaggtcagtcct

SEQ ID NO: 73714 - DNA, 25 bp, Mus musculus
aactccaatgatcccaatgtctgta

SEQ ID NO: 73715 - DNA, 25 bp, Mus musculus
aactccacttctccgttgggattgg

SEQ ID NO: 73716 - DNA, 25 bp, Mus musculus
aactccagatggttgtaagggctcg

SEQ ID NO: 73717 - DNA, 25 bp, Mus musculus
aactccagcgagaatatgtacacca

SEQ ID NO: 73718 - DNA, 25 bp, Mus musculus
aactccaggctacggaagatgacaa

SEQ ID NO: 73719 - DNA, 25 bp, Mus musculus
aactccagtggctggctgaacatga

SEQ ID NO: 73720 - DNA, 25 bp, Mus musculus
aactccccaaccgtgattgtgatgg

SEQ ID NO: 73721 - DNA, 25 bp, Mus musculus
aactccgagggctgtccacaggctc

SEQ ID NO: 73722 - DNA, 25 bp, Mus musculus
aactccgggaggtcttcaacatgga

SEQ ID NO: 73723 - DNA, 25 bp, Mus musculus
aactcctcagttttgtgatggatca

SEQ ID NO: 73724 - DNA, 25 bp, Mus musculus
aactcctccaactccgtgttcagtg

SEQ ID NO: 73725 - DNA, 25 bp, Mus musculus
aactcctgaggaacttgatgctgca

SEQ ID NO: 73726 - DNA, 25 bp, Mus musculus
aactcctggagcagaaccctggcaa

SEQ ID NO: 73727 - DNA, 25 bp, Mus musculus
aactcctggctgtcattgacattgt

SEQ ID NO: 73728 - DNA, 25 bp, Mus musculus
aactcctgtcctctgggcttcggct

SEQ ID NO: 73729 - DNA, 25 bp, Mus musculus
aactcgatccgtgagaaattccccg

SEQ ID NO: 73730 - DNA, 25 bp, Mus musculus
aactcggccacagagagtgcggaca

SEQ ID NO: 73731 - DNA, 25 bp, Mus musculus
aactcggctcgcatcagggtcttga

SEQ ID NO: 73732 - DNA, 25 bp, Mus musculus
aactcgtgaagctttgagccaggcc

SEQ ID NO: 73733 - DNA, 25 bp, Mus musculus
aactcgtgtttgagggtcagaggca

SEQ ID NO: 73734 - DNA, 25 bp, Mus musculus
aactctaagagtgtgggacctgaaa

SEQ ID NO: 73735 - DNA, 25 bp, Mus musculus
aactctatcacagggagctgccgga

SEQ ID NO: 73736 - DNA, 25 bp, Mus musculus
aactctcagcaagatgaagcgggac

SEQ ID NO: 73737 - DNA, 25 bp, Mus musculus
aactctcagcagaagcatttgaggg

SEQ ID NO: 73738 - DNA, 25 bp, Mus musculus
aactctctgctgaaactggagggcg

SEQ ID NO: 73739 - DNA, 25 bp, Mus musculus
aactctgaagaaggtggccggtgcc

SEQ ID NO: 73740 - DNA, 25 bp, Mus musculus
aactctgatgctagcgtcgcagccc

SEQ ID NO: 73741 - DNA, 25 bp, Mus musculus
aactctgcagcaggtgttgaagacc

SEQ ID NO: 73742 - DNA, 25 bp, Mus musculus
aactctgccacatctgcccaggaag

SEQ ID NO: 73743 - DNA, 25 bp, Mus musculus
aactctgcccgggaaacaagtatga

SEQ ID NO: 73744 - DNA, 25 bp, Mus musculus
aactctggcagttttgggagcgatc

SEQ ID NO: 73745 - DNA, 25 bp, Mus musculus
aactctggctctattggacaaagga

SEQ ID NO: 73746 - DNA, 25 bp, Mus musculus
aactctgtgttgaagggccgcatcg

SEQ ID NO: 73747 - DNA, 25 bp, Mus musculus
aactcttagaagtggttcaaccctg

SEQ ID NO: 73748 - DNA, 25 bp, Mus musculus
aactcttctatataccctggcgcca

SEQ ID NO: 73749 - DNA, 25 bp, Mus musculus
aactcttgaaggacgtgaatgccca

SEQ ID NO: 73750 - DNA, 25 bp, Mus musculus
aactcttgggacagtttcctgtggc

SEQ ID NO: 73751 - DNA, 25 bp, Mus musculus
aactctttgatgagcacgtggaccc

SEQ ID NO: 73752 - DNA, 25 bp, Mus musculus
aactgaaacgggtgatggcttgtac

SEQ ID NO: 73753 - DNA, 25 bp, Mus musculus
aactgaaataccgtgcagggaggca

SEQ ID NO: 73754 - DNA, 25 bp, Mus musculus
aactgaacggttatggctggaagac

SEQ ID NO: 73755 - DNA, 25 bp, Mus musculus
aactgaactgtaactgccttgcacc

SEQ ID NO: 73756 - DNA, 25 bp, Mus musculus
aactgaagaagcacatgctatgtga

SEQ ID NO: 73757 - DNA, 25 bp, Mus musculus
aactgaataatgtgcgcctgccacg

SEQ ID NO: 73758 - DNA, 25 bp, Mus musculus
aactgacactgggaattcgaattcg

SEQ ID NO: 73759 - DNA, 25 bp, Mus musculus
aactgagaatttgtatccttgcccc

SEQ ID NO: 73760 - DNA, 25 bp, Mus musculus
aactgagcagagcatccaagccgct

SEQ ID NO: 73761 - DNA, 25 bp, Mus musculus
aactgagcccagaagctgcacggaa

SEQ ID NO: 73762 - DNA, 25 bp, Mus musculus
aactgaggtggcttacgaagtgacg

SEQ ID NO: 73763 - DNA, 25 bp, Mus musculus
aactgagtccatccagagctctctg

SEQ ID NO: 73764 - DNA, 25 bp, Mus musculus
aactgatccagatagcggagcgtgc

SEQ ID NO: 73765 - DNA, 25 bp, Mus musculus
aactgcaaatggaccacgctggcct

SEQ ID NO: 73766 - DNA, 25 bp, Mus musculus
aactgcaactttcattgcggcaggg

SEQ ID NO: 73767 - DNA, 25 bp, Mus musculus
aactgcacaatagtacagtatcaca

SEQ ID NO: 73768 - DNA, 25 bp, Mus musculus
aactgcactgcaggggccgtctaca

SEQ ID NO: 73769 - DNA, 25 bp, Mus musculus
aactgcaggcagatggaaccattga

SEQ ID NO: 73770 - DNA, 25 bp, Mus musculus
aactgcatctgcgtggactggaaga

SEQ ID NO: 73771 - DNA, 25 bp, Mus musculus
aactgccaagctcgccaggagttct

SEQ ID NO: 73772 - DNA, 25 bp, Mus musculus
aactgcccgtgagggaatcccgaag

SEQ ID NO: 73773 - DNA, 25 bp, Mus musculus
aactgccgctatagtagtgataagc

SEQ ID NO: 73774 - DNA, 25 bp, Mus musculus
aactgcctcagctacaactgccaag

SEQ ID NO: 73775 - DNA, 25 bp, Mus musculus
aactgccttgcataccgcgtctgga

SEQ ID NO: 73776 - DNA, 25 bp, Mus musculus
aactgcgcaggagaacaaggcgtcg

SEQ ID NO: 73777 - DNA, 25 bp, Mus musculus
aactgcgtgggcgagaggaactatc

SEQ ID NO: 73778 - DNA, 25 bp, Mus musculus
aactgctgacgcagcttcttcgctg

SEQ ID NO: 73779 - DNA, 25 bp, Mus musculus
aactgctgccatccaaatactgtga

SEQ ID NO: 73780 - DNA, 25 bp, Mus musculus
aactgctggagttggccaatgttca

SEQ ID NO: 73781 - DNA, 25 bp, Mus musculus
aactgctgggcgctgcgcacggcat

SEQ ID NO: 73782 - DNA, 25 bp, Mus musculus
aactgctgtatgacctggcagatca

SEQ ID NO: 73783 - DNA, 25 bp, Mus musculus
aactgctgtcataaaatttgtttaa

SEQ ID NO: 73784 - DNA, 25 bp, Mus musculus
aactgcttgctagcccagtggagcc

SEQ ID NO: 73785 - DNA, 25 bp, Mus musculus
aactggaaaccagcattcgagagct

SEQ ID NO: 73786 - DNA, 25 bp, Mus musculus
aactggagaaatgccgcggcgtctt

SEQ ID NO: 73787 - DNA, 25 bp, Mus musculus
aactggagaccgtattgtggcatgc

SEQ ID NO: 73788 - DNA, 25 bp, Mus musculus
aactggaggatactgactttaagaa

SEQ ID NO: 73789 - DNA, 25 bp, Mus musculus
aactggagggctgttatccacagag

SEQ ID NO: 73790 - DNA, 25 bp, Mus musculus
aactggattcttaccgcctggacaa

SEQ ID NO: 73791 - DNA, 25 bp, Mus musculus
aactggcaccgggactctgctgata

SEQ ID NO: 73792 - DNA, 25 bp, Mus musculus
aactggccaaggagtggtgcttcaa

SEQ ID NO: 73793 - DNA, 25 bp, Mus musculus
aactggccagaatcttgaatgggtc

SEQ ID NO: 73794 - DNA, 25 bp, Mus musculus
aactggcccaccagcgggaacagaa

SEQ ID NO: 73795 - DNA, 25 bp, Mus musculus
aactggctatgcactctatccggga

SEQ ID NO: 73796 - DNA, 25 bp, Mus musculus
aactggctcaacatggttcgggctg

SEQ ID NO: 73797 - DNA, 25 bp, Mus musculus
aactggcttcgacttggaccctgga

SEQ ID NO: 73798 - DNA, 25 bp, Mus musculus
aactggctttctgaggtacctggca

SEQ ID NO: 73799 - DNA, 25 bp, Mus musculus
aactgggaaggtacatgctgctctg

SEQ ID NO: 73800 - DNA, 25 bp, Mus musculus
aactgggcagtataaactcggatcc

SEQ ID NO: 73801 - DNA, 25 bp, Mus musculus
aactgggctgggactggccttctca

SEQ ID NO: 73802 - DNA, 25 bp, Mus musculus
aactgggtacagatcagcctctgga

SEQ ID NO: 73803 - DNA, 25 bp, Mus musculus
aactgggttaaaacaggcaccactg

SEQ ID NO: 73804 - DNA, 25 bp, Mus musculus
aactggtgcagaaagcccggctggc

SEQ ID NO: 73805 - DNA, 25 bp, Mus musculus
aactggtgcatcaagcgacggtcac

SEQ ID NO: 73806 - DNA, 25 bp, Mus musculus
aactggtggacagcgtgcagacact

SEQ ID NO: 73807 - DNA, 25 bp, Mus musculus
aactggtgtagcctagctggtctga

SEQ ID NO: 73808 - DNA, 25 bp, Mus musculus
aactggtgtctgtgccagatttgca

SEQ ID NO: 73809 - DNA, 25 bp, Mus musculus
aactggttaaacatggtctgcgtgc

SEQ ID NO: 73810 - DNA, 25 bp, Mus musculus
aactggttcggcaatcttggctggc

SEQ ID NO: 73811 - DNA, 25 bp, Mus musculus
aactggttgcgaactgtggacgtca

SEQ ID NO: 73812 - DNA, 25 bp, Mus musculus
aactggttttcaggtcacttgggca

SEQ ID NO: 73813 - DNA, 25 bp, Mus musculus
aactgtcacatacatcgctcttggg

SEQ ID NO: 73814 - DNA, 25 bp, Mus musculus
aactgtcatcagagcctgcagaggg

SEQ ID NO: 73815 - DNA, 25 bp, Mus musculus
aactgtcattattgaggttcctcag

SEQ ID NO: 73816 - DNA, 25 bp, Mus musculus
aactgtccatatgattacaaagcag

SEQ ID NO: 73817 - DNA, 25 bp, Mus musculus
aactgtctaggaactggagataacc

SEQ ID NO: 73818 - DNA, 25 bp, Mus musculus
aactgtctggaagggactgagagct

SEQ ID NO: 73819 - DNA, 25 bp, Mus musculus
aactgtctggcctttagcgcttcat

SEQ ID NO: 73820 - DNA, 25 bp, Mus musculus
aactgtgagtggattgtctacgccc

SEQ ID NO: 73821 - DNA, 25 bp, Mus musculus
aactgtggaaggtccatgtgaggcc

SEQ ID NO: 73822 - DNA, 25 bp, Mus musculus
aactgtggccaagctcacactggag

SEQ ID NO: 73823 - DNA, 25 bp, Mus musculus
aactgtgggaaccaaagcgcggatc

SEQ ID NO: 73824 - DNA, 25 bp, Mus musculus
aactgtggtggtccctaagtgccaa

SEQ ID NO: 73825 - DNA, 25 bp, Mus musculus
aactgtggttcatgggaggcgcttc

SEQ ID NO: 73826 - DNA, 25 bp, Mus musculus
aactgtgtgactcctttgactgggc

SEQ ID NO: 73827 - DNA, 25 bp, Mus musculus
aactgtgtgatctacggctgggacc

SEQ ID NO: 73828 - DNA, 25 bp, Mus musculus
aactgttatggtttcctgtattgag

SEQ ID NO: 73829 - DNA, 25 bp, Mus musculus
aactgttcctagcagctgtccggga

SEQ ID NO: 73830 - DNA, 25 bp, Mus musculus
aactgttcctgtcccaaatgcctgg

SEQ ID NO: 73831 - DNA, 25 bp, Mus musculus
aacttagaacaagtactactgtcaa

SEQ ID NO: 73832 - DNA, 25 bp, Mus musculus
aacttagagacctccgggctgagat

SEQ ID NO: 73833 - DNA, 25 bp, Mus musculus
aacttagtgcagtgtcccgagtcga

SEQ ID NO: 73834 - DNA, 25 bp, Mus musculus
aacttatcgctcagaaagttcgagg

SEQ ID NO: 73835 - DNA, 25 bp, Mus musculus
aacttatgcagaactgctgtgagga

SEQ ID NO: 73836 - DNA, 25 bp, Mus musculus
aacttcaactacagcccagagcagg

SEQ ID NO: 73837 - DNA, 25 bp, Mus musculus
aacttcaagttcaagcgctccgtcg

SEQ ID NO: 73838 - DNA, 25 bp, Mus musculus
aacttcaatagtcaggactcctgaa

SEQ ID NO: 73839 - DNA, 25 bp, Mus musculus
aacttcacactgatccccgagggag

SEQ ID NO: 73840 - DNA, 25 bp, Mus musculus
aacttcacgtgcgatcgctgcggga

SEQ ID NO: 73841 - DNA, 25 bp, Mus musculus
aacttcactattgggcgcgtggtca

SEQ ID NO: 73842 - DNA, 25 bp, Mus musculus
aacttcagcaaacagaccatcgcgg

SEQ ID NO: 73843 - DNA, 25 bp, Mus musculus
aacttcatcagctgcttggtcaggc

SEQ ID NO: 73844 - DNA, 25 bp, Mus musculus
aacttcatctctagagcctttgcca

SEQ ID NO: 73845 - DNA, 25 bp, Mus musculus
aacttccaagtaaaacagttgctgc

SEQ ID NO: 73846 - DNA, 25 bp, Mus musculus
aacttccagatgtggacgcgggcgc

SEQ ID NO: 73847 - DNA, 25 bp, Mus musculus
aacttccgcttagagggacagggca

SEQ ID NO: 73848 - DNA, 25 bp, Mus musculus
aacttcctggtgcagtgggtaccac

SEQ ID NO: 73849 - DNA, 25 bp, Mus musculus
aacttcctgtcccatgcgggcagga

SEQ ID NO: 73850 - DNA, 25 bp, Mus musculus
aacttcctttctatgacaccatgga

SEQ ID NO: 73851 - DNA, 25 bp, Mus musculus
aacttcgaagtggaggctgatgact

SEQ ID NO: 73852 - DNA, 25 bp, Mus musculus
aacttcgactcggaggagcggagta

SEQ ID NO: 73853 - DNA, 25 bp, Mus musculus
aacttcgagggctacatgctggccc

SEQ ID NO: 73854 - DNA, 25 bp, Mus musculus
aacttcgattctcagggctaccaga

SEQ ID NO: 73855 - DNA, 25 bp, Mus musculus
aacttcggaatcagctctgtggacc

SEQ ID NO: 73856 - DNA, 25 bp, Mus musculus
aacttcgtctgggagcgcgttcgga

SEQ ID NO: 73857 - DNA, 25 bp, Mus musculus
aacttcgtgcgtgaggtggtgacca

SEQ ID NO: 73858 - DNA, 25 bp, Mus musculus
aacttctcagttagagcccggcgca

SEQ ID NO: 73859 - DNA, 25 bp, Mus musculus
aacttctccaagctgaacctgcagc

SEQ ID NO: 73860 - DNA, 25 bp, Mus musculus
aacttctggagagcgcctattgcca

SEQ ID NO: 73861 - DNA, 25 bp, Mus musculus
aacttcttcgtctgggtgctgccgc

SEQ ID NO: 73862 - DNA, 25 bp, Mus musculus
aacttcttcttcttcgacggcatga

SEQ ID NO: 73863 - DNA, 25 bp, Mus musculus
aacttcttgaggaaactgtgcaggc

SEQ ID NO: 73864 - DNA, 25 bp, Mus musculus
aacttcttgttctttggctgccgcc

SEQ ID NO: 73865 - DNA, 25 bp, Mus musculus
aacttgaaagtgtgctgtctcaggc

SEQ ID NO: 73866 - DNA, 25 bp, Mus musculus
aacttgaatttttagaaccatgaat

SEQ ID NO: 73867 - DNA, 25 bp, Mus musculus
aacttgactgctgggcgggaaagcc

SEQ ID NO: 73868 - DNA, 25 bp, Mus musculus
aacttgagcctcttggtgaaacacg

SEQ ID NO: 73869 - DNA, 25 bp, Mus musculus
aacttgagtgttctgtgtgagacca

SEQ ID NO: 73870 - DNA, 25 bp, Mus musculus
aacttgatcggagcactcttggcca

SEQ ID NO: 73871 - DNA, 25 bp, Mus musculus
aacttgatgtgcgatggctgctgcc

SEQ ID NO: 73872 - DNA, 25 bp, Mus musculus
aacttgccagacagagaagagcgga

SEQ ID NO: 73873 - DNA, 25 bp, Mus musculus
aacttgctgatgttgggagaccctg

SEQ ID NO: 73874 - DNA, 25 bp, Mus musculus
aacttgcttagcttagaggtggcca

SEQ ID NO: 73875 - DNA, 25 bp, Mus musculus
aacttggagaggaccgcggctgtct

SEQ ID NO: 73876 - DNA, 25 bp, Mus musculus
aacttggagcagagaagggcctcct

SEQ ID NO: 73877 - DNA, 25 bp, Mus musculus
aacttggcccaggatttaggcatca

SEQ ID NO: 73878 - DNA, 25 bp, Mus musculus
aacttggcttcattctgcgcacagg

SEQ ID NO: 73879 - DNA, 25 bp, Mus musculus
aacttgtgacattttagggcctggc

SEQ ID NO: 73880 - DNA, 25 bp, Mus musculus
aacttgtgaccatcattcgcagcgg

SEQ ID NO: 73881 - DNA, 25 bp, Mus musculus
aacttgtgtctgatgccaacgagca

SEQ ID NO: 73882 - DNA, 25 bp, Mus musculus
aacttgttccggaggcatggccctg

SEQ ID NO: 73883 - DNA, 25 bp, Mus musculus
aactttaccgcctgcgatttcggca

SEQ ID NO: 73884 - DNA, 25 bp, Mus musculus
aactttagcaaaacagcaccactgg

SEQ ID NO: 73885 - DNA, 25 bp, Mus musculus
aactttatgagtgtcatagccggcc

SEQ ID NO: 73886 - DNA, 25 bp, Mus musculus
aactttctgcgtgaggtgagcatca

SEQ ID NO: 73887 - DNA, 25 bp, Mus musculus
aactttgaccctgacgcctgtgaag

SEQ ID NO: 73888 - DNA, 25 bp, Mus musculus
aactttggagagcagggcatcaccg

SEQ ID NO: 73889 - DNA, 25 bp, Mus musculus
aactttgtttgtctggcacaaggac

SEQ ID NO: 73890 - DNA, 25 bp, Mus musculus
aacttttcgggcatcagcgtcacca

SEQ ID NO: 73891 - DNA, 25 bp, Mus musculus
aactttttgggtggcagattccagc

SEQ ID NO: 73892 - DNA, 25 bp, Mus musculus
aacttttttggctctgcccaggatg

SEQ ID NO: 73893 - DNA, 25 bp, Mus musculus
aagaaaaacatcctgctgcggctgc

SEQ ID NO: 73894 - DNA, 25 bp, Mus musculus
aagaaaaaggagctgttcagaccca

SEQ ID NO: 73895 - DNA, 25 bp, Mus musculus
aagaaaaccttcacctgctggataa

SEQ ID NO: 73896 - DNA, 25 bp, Mus musculus
aagaaaagaccagatgcaaccaggg

SEQ ID NO: 73897 - DNA, 25 bp, Mus musculus
aagaaaaggatgtcattccgtaaag

SEQ ID NO: 73898 - DNA, 25 bp, Mus musculus
aagaaaaggccgaagcctgtgccag

SEQ ID NO: 73899 - DNA, 25 bp, Mus musculus
aagaaaatccgtccgcatcgcccga

SEQ ID NO: 73900 - DNA, 25 bp, Mus musculus
aagaaaatgagggaccaggaggcca

SEQ ID NO: 73901 - DNA, 25 bp, Mus musculus
aagaaaatgggcgtatgtgggctac

SEQ ID NO: 73902 - DNA, 25 bp, Mus musculus
aagaaacaagttctgtgggccgaga

SEQ ID NO: 73903 - DNA, 25 bp, Mus musculus
aagaaacaatcagagtcatccaggg

SEQ ID NO: 73904 - DNA, 25 bp, Mus musculus
aagaaacagcgatggactcccctgg

SEQ ID NO: 73905 - DNA, 25 bp, Mus musculus
aagaaacagcgcgtgaggttccagc

SEQ ID NO: 73906 - DNA, 25 bp, Mus musculus
aagaaaccagcctcatagaatatga

SEQ ID NO: 73907 - DNA, 25 bp, Mus musculus
aagaaaccttgaactgacagccccg

SEQ ID NO: 73908 - DNA, 25 bp, Mus musculus
aagaaacgttctttgtcggagctgc

SEQ ID NO: 73909 - DNA, 25 bp, Mus musculus
aagaaagcaatgacaatggaatatc

SEQ ID NO: 73910 - DNA, 25 bp, Mus musculus
aagaaagcactgaccaccggagata

SEQ ID NO: 73911 - DNA, 25 bp, Mus musculus
aagaaagccaaagtcctgcacaagg

SEQ ID NO: 73912 - DNA, 25 bp, Mus musculus
aagaaagctggagcgtggaaactac

SEQ ID NO: 73913 - DNA, 25 bp, Mus musculus
aagaaagctgtttccgtatgacccg

SEQ ID NO: 73914 - DNA, 25 bp, Mus musculus
aagaaaggagaatggcgttcagcaa

SEQ ID NO: 73915 - DNA, 25 bp, Mus musculus
aagaaagttggaccatggttctgaa

SEQ ID NO: 73916 - DNA, 25 bp, Mus musculus
aagaaatagagtgcctgacaggacc

SEQ ID NO: 73917 - DNA, 25 bp, Mus musculus
aagaaatatctcgatgtcatcagca

SEQ ID NO: 73918 - DNA, 25 bp, Mus musculus
aagaaatcaagtggattggcctgcc

SEQ ID NO: 73919 - DNA, 25 bp, Mus musculus
aagaaatccttgtgcagtgcccatg

SEQ ID NO: 73920 - DNA, 25 bp, Mus musculus
aagaaatctctatcctcccgacacg

SEQ ID NO: 73921 - DNA, 25 bp, Mus musculus
aagaaatgcttcctcgtctctaagg

SEQ ID NO: 73922 - DNA, 25 bp, Mus musculus
aagaaatgggaaaacgggcactgct

SEQ ID NO: 73923 - DNA, 25 bp, Mus musculus
aagaaatgggctgtggagcgaaccc

SEQ ID NO: 73924 - DNA, 25 bp, Mus musculus
aagaaattcgagctggtgccgtcgc

SEQ ID NO: 73925 - DNA, 25 bp, Mus musculus
aagaacaagtgtgacgccaggacct

SEQ ID NO: 73926 - DNA, 25 bp, Mus musculus
aagaacagaataccagccggaacag

SEQ ID NO: 73927 - DNA, 25 bp, Mus musculus
aagaacagagcctgctggccgaaga

SEQ ID NO: 73928 - DNA, 25 bp, Mus musculus
aagaacagcagccaacggccaggag

SEQ ID NO: 73929 - DNA, 25 bp, Mus musculus
aagaacagtgtcaggtgcttccaga

SEQ ID NO: 73930 - DNA, 25 bp, Mus musculus
aagaacatatgaacactggccagct

SEQ ID NO: 73931 - DNA, 25 bp, Mus musculus
aagaacatggatgctctccccacag

SEQ ID NO: 73932 - DNA, 25 bp, Mus musculus
aagaaccacctccagctgatggaag

SEQ ID NO: 73933 - DNA, 25 bp, Mus musculus
aagaaccaggaggacccctcagagg

SEQ ID NO: 73934 - DNA, 25 bp, Mus musculus
aagaacccaaactagaagctgctgc

SEQ ID NO: 73935 - DNA, 25 bp, Mus musculus
aagaacccagcctacctgaagagtg

SEQ ID NO: 73936 - DNA, 25 bp, Mus musculus
aagaacccgatcctgcttgtgcacg

SEQ ID NO: 73937 - DNA, 25 bp, Mus musculus
aagaaccggcccatgatcctcatcg

SEQ ID NO: 73938 - DNA, 25 bp, Mus musculus
aagaacctgaatgacgactcctgcc

SEQ ID NO: 73939 - DNA, 25 bp, Mus musculus
aagaacctggagttggcacggaagc

SEQ ID NO: 73940 - DNA, 25 bp, Mus musculus
aagaacgagaagcttgaatgggcag

SEQ ID NO: 73941 - DNA, 25 bp, Mus musculus
aagaacgccctcaagaacatgatgg

SEQ ID NO: 73942 - DNA, 25 bp, Mus musculus
aagaacgctacctactgctgcggga

SEQ ID NO: 73943 - DNA, 25 bp, Mus musculus
aagaacggcaacgagcttggcaggt

SEQ ID NO: 73944 - DNA, 25 bp, Mus musculus
aagaactacctgagctacctgacgg

SEQ ID NO: 73945 - DNA, 25 bp, Mus musculus
aagaactcgcagtccttcttctccg

SEQ ID NO: 73946 - DNA, 25 bp, Mus musculus
aagaactcggagtctggctacatcc

SEQ ID NO: 73947 - DNA, 25 bp, Mus musculus
aagaactcgggctggcaatcacagt

SEQ ID NO: 73948 - DNA, 25 bp, Mus musculus
aagaactggcaggtgacggctgtca

SEQ ID NO: 73949 - DNA, 25 bp, Mus musculus
aagaactggcggaggcactaaggac

SEQ ID NO: 73950 - DNA, 25 bp, Mus musculus
aagaacttccagatagtgcacccgg

SEQ ID NO: 73951 - DNA, 25 bp, Mus musculus
aagaacttcgcggagctggctcggc

SEQ ID NO: 73952 - DNA, 25 bp, Mus musculus
aagaacttgcggcttccgcgtgaac

SEQ ID NO: 73953 - DNA, 25 bp, Mus musculus
aagaagaaattgaccatgctgaacg

SEQ ID NO: 73954 - DNA, 25 bp, Mus musculus
aagaagaacctgctgtgcgctcctg

SEQ ID NO: 73955 - DNA, 25 bp, Mus musculus
aagaagaagttggtaatattgaagc

SEQ ID NO: 73956 - DNA, 25 bp, Mus musculus
aagaagaagttgttcaagcgccgca

SEQ ID NO: 73957 - DNA, 25 bp, Mus musculus
aagaagacagtgttccagcccgtgc

SEQ ID NO: 73958 - DNA, 25 bp, Mus musculus
aagaagacccttcagcacgctctgg

SEQ ID NO: 73959 - DNA, 25 bp, Mus musculus
aagaagacgctggtgctcagagacc

SEQ ID NO: 73960 - DNA, 25 bp, Mus musculus
aagaagactctgaacatctgattcg

SEQ ID NO: 73961 - DNA, 25 bp, Mus musculus
aagaagagatcacatagcagcgccc

SEQ ID NO: 73962 - DNA, 25 bp, Mus musculus
aagaagaggaaatgaccgagtctga

SEQ ID NO: 73963 - DNA, 25 bp, Mus musculus
aagaagatcacggagctgcgggtta

SEQ ID NO: 73964 - DNA, 25 bp, Mus musculus
aagaagatcgcatgcggactcggca

SEQ ID NO: 73965 - DNA, 25 bp, Mus musculus
aagaagatgccacccaagcgcatag

SEQ ID NO: 73966 - DNA, 25 bp, Mus musculus
aagaagatgtcaacgccaatcgagg

SEQ ID NO: 73967 - DNA, 25 bp, Mus musculus
aagaagattctgtcccagaggagag

SEQ ID NO: 73968 - DNA, 25 bp, Mus musculus
aagaagcagattaacgtggcccggc

SEQ ID NO: 73969 - DNA, 25 bp, Mus musculus
aagaagcagtttgtggagcgagccc

SEQ ID NO: 73970 - DNA, 25 bp, Mus musculus
aagaagcccagctttttcatccggg

SEQ ID NO: 73971 - DNA, 25 bp, Mus musculus
aagaagccccatcatgacctgtgcc

SEQ ID NO: 73972 - DNA, 25 bp, Mus musculus
aagaagccgccatgaggtcacgtaa

SEQ ID NO: 73973 - DNA, 25 bp, Mus musculus
aagaagccgggctctaaggccatgt

SEQ ID NO: 73974 - DNA, 25 bp, Mus musculus
aagaagcctaatcccttaatctaca

SEQ ID NO: 73975 - DNA, 25 bp, Mus musculus
aagaagcctctggatgacactctgg

SEQ ID NO: 73976 - DNA, 25 bp, Mus musculus
aagaagcgcctgaaccggatgaaga

SEQ ID NO: 73977 - DNA, 25 bp, Mus musculus
aagaagcgcttcattggcatccgga

SEQ ID NO: 73978 - DNA, 25 bp, Mus musculus
aagaagcgtggcctcacttcctctc

SEQ ID NO: 73979 - DNA, 25 bp, Mus musculus
aagaagctcctctggacttgacgca

SEQ ID NO: 73980 - DNA, 25 bp, Mus musculus
aagaagctgacataggtgagtgctg

SEQ ID NO: 73981 - DNA, 25 bp, Mus musculus
aagaagctgaggtagccagttcgtg

SEQ ID NO: 73982 - DNA, 25 bp, Mus musculus
aagaagcttgggaaccctgaggtgt

SEQ ID NO: 73983 - DNA, 25 bp, Mus musculus
aagaaggagaaccaggcactaccac

SEQ ID NO: 73984 - DNA, 25 bp, Mus musculus
aagaaggatacgtgccccaagagga

SEQ ID NO: 73985 - DNA, 25 bp, Mus musculus
aagaaggcgcgcgttgttcagcagc

SEQ ID NO: 73986 - DNA, 25 bp, Mus musculus
aagaaggcgcggtacaatgcccagt

SEQ ID NO: 73987 - DNA, 25 bp, Mus musculus
aagaaggcggtcagcaacaagctcc

SEQ ID NO: 73988 - DNA, 25 bp, Mus musculus
aagaaggctaggattgaagaagaca

SEQ ID NO: 73989 - DNA, 25 bp, Mus musculus
aagaaggctctgcagtggcacccag

SEQ ID NO: 73990 - DNA, 25 bp, Mus musculus
aagaagggacatggagctactcagc

SEQ ID NO: 73991 - DNA, 25 bp, Mus musculus
aagaagggcacgacctgaagctggc

SEQ ID NO: 73992 - DNA, 25 bp, Mus musculus
aagaaggtggctcacgcagagaacc

SEQ ID NO: 73993 - DNA, 25 bp, Mus musculus
aagaagtcctcgcttatggtggccc

SEQ ID NO: 73994 - DNA, 25 bp, Mus musculus
aagaagtcctctgcctctaccgaag

SEQ ID NO: 73995 - DNA, 25 bp, Mus musculus
aagaagtctgatcccagggacccca

SEQ ID NO: 73996 - DNA, 25 bp, Mus musculus
aagaagtcttgcaatacctcgcgcg

SEQ ID NO: 73997 - DNA, 25 bp, Mus musculus
aagaagtggtaaatgacaggagctg

SEQ ID NO: 73998 - DNA, 25 bp, Mus musculus
aagaagtgtacctgacctgcctggg

SEQ ID NO: 73999 - DNA, 25 bp, Mus musculus
aagaagtgtgacaagggagccatca

SEQ ID NO: 74000 - DNA, 25 bp, Mus musculus
aagaagttcacggtgcgcaggttct

SEQ ID NO: 74001 - DNA, 25 bp, Mus musculus
aagaagttcgcctgctggctgcact

SEQ ID NO: 74002 - DNA, 25 bp, Mus musculus
aagaagttctccatccctgacctag

SEQ ID NO: 74003 - DNA, 25 bp, Mus musculus
aagaagttgaagctcccaggtgaca

SEQ ID NO: 74004 - DNA, 25 bp, Mus musculus
aagaagtttggcttgaaccccagca

SEQ ID NO: 74005 - DNA, 25 bp, Mus musculus
aagaataagacgtccatcacccggc

SEQ ID NO: 74006 - DNA, 25 bp, Mus musculus
aagaatatgtctacctccgaagcag

SEQ ID NO: 74007 - DNA, 25 bp, Mus musculus
aagaatccattggttcggaactggg

SEQ ID NO: 74008 - DNA, 25 bp, Mus musculus
aagaatcccagaaacaccaggcggt

SEQ ID NO: 74009 - DNA, 25 bp, Mus musculus
aagaatctcatctagctcagcccag

SEQ ID NO: 74010 - DNA, 25 bp, Mus musculus
aagaatctgactgtgcagcaagaca

SEQ ID NO: 74011 - DNA, 25 bp, Mus musculus
aagaatgagtggtctgcccagggcc

SEQ ID NO: 74012 - DNA, 25 bp, Mus musculus
aagaatgatgtctgccgtccagggc

SEQ ID NO: 74013 - DNA, 25 bp, Mus musculus
aagaatgcaggagcccatcatgacg

SEQ ID NO: 74014 - DNA, 25 bp, Mus musculus
aagaatgctactaccttacttgtca

SEQ ID NO: 74015 - DNA, 25 bp, Mus musculus
aagaatggagcctatccggtggctc

SEQ ID NO: 74016 - DNA, 25 bp, Mus musculus
aagaatgtacgccagaggaacgcca

SEQ ID NO: 74017 - DNA, 25 bp, Mus musculus
aagaatgtgactcccgcagcaatgc

SEQ ID NO: 74018 - DNA, 25 bp, Mus musculus
aagaatgtttcttgaacctagaggc

SEQ ID NO: 74019 - DNA, 25 bp, Mus musculus
aagaattccagagggtgccatttgc

SEQ ID NO: 74020 - DNA, 25 bp, Mus musculus
aagaatttccgtgtggccgctgcga

SEQ ID NO: 74021 - DNA, 25 bp, Mus musculus
aagaatttggagacagagtgaaccc

SEQ ID NO: 74022 - DNA, 25 bp, Mus musculus
aagacaaacactggctcggcgatgc

SEQ ID NO: 74023 - DNA, 25 bp, Mus musculus
aagacaaaccgtaccagtgcgcaga

SEQ ID NO: 74024 - DNA, 25 bp, Mus musculus
aagacaaccagcgtctgaggagcca

SEQ ID NO: 74025 - DNA, 25 bp, Mus musculus
aagacaaggctctactggtgaagag

SEQ ID NO: 74026 - DNA, 25 bp, Mus musculus
aagacaagggcatcgccgcttcagt

SEQ ID NO: 74027 - DNA, 25 bp, Mus musculus
aagacaatcttacccctcactggtg

SEQ ID NO: 74028 - DNA, 25 bp, Mus musculus
aagacacaaacttggctggacagca

SEQ ID NO: 74029 - DNA, 25 bp, Mus musculus
aagacacaggttctgtcccctgcaa

SEQ ID NO: 74030 - DNA, 25 bp, Mus musculus
aagacaccacaggaagtggagctgc

SEQ ID NO: 74031 - DNA, 25 bp, Mus musculus
aagacaccagtgaacagaacccagt

SEQ ID NO: 74032 - DNA, 25 bp, Mus musculus
aagacaccgggagcattgtaatcgc

SEQ ID NO: 74033 - DNA, 25 bp, Mus musculus
aagacactaaactggagcgcagccg

SEQ ID NO: 74034 - DNA, 25 bp, Mus musculus
aagacactgagtgccatctacagcc

SEQ ID NO: 74035 - DNA, 25 bp, Mus musculus
aagacactgcgggtgaagctcaccg

SEQ ID NO: 74036 - DNA, 25 bp, Mus musculus
aagacactggtgaatgcgtcgagca

SEQ ID NO: 74037 - DNA, 25 bp, Mus musculus
aagacactgtccaaaagcctgccaa

SEQ ID NO: 74038 - DNA, 25 bp, Mus musculus
aagacagcccccgagaagagtgtgt

SEQ ID NO: 74039 - DNA, 25 bp, Mus musculus
aagacagctttcacagtttgcggga

SEQ ID NO: 74040 - DNA, 25 bp, Mus musculus
aagacaggctgatggactccgtcga

SEQ ID NO: 74041 - DNA, 25 bp, Mus musculus
aagacagtccccagaacctaagagg

SEQ ID NO: 74042 - DNA, 25 bp, Mus musculus
aagacagtgccagccttctgcaacg

SEQ ID NO: 74043 - DNA, 25 bp, Mus musculus
aagacatcgccagccctgtagaagg

SEQ ID NO: 74044 - DNA, 25 bp, Mus musculus
aagacatctgttaaagacgtggctg

SEQ ID NO: 74045 - DNA, 25 bp, Mus musculus
aagacatggctcaggtctcgggacc

SEQ ID NO: 74046 - DNA, 25 bp, Mus musculus
aagacatttctgaatgtaggccacc

SEQ ID NO: 74047 - DNA, 25 bp, Mus musculus
aagaccaagactcccgcagcgtgag

SEQ ID NO: 74048 - DNA, 25 bp, Mus musculus
aagaccacctatcctattgacgaga

SEQ ID NO: 74049 - DNA, 25 bp, Mus musculus
aagaccacgataatgaagaatattg

SEQ ID NO: 74050 - DNA, 25 bp, Mus musculus
aagaccagccaagaccggaaggatc

SEQ ID NO: 74051 - DNA, 25 bp, Mus musculus
aagaccagcgcacactatgaggaga

SEQ ID NO: 74052 - DNA, 25 bp, Mus musculus
aagaccagcttctacatgggcctga

SEQ ID NO: 74053 - DNA, 25 bp, Mus musculus
aagacccactggaattggccaacac

SEQ ID NO: 74054 - DNA, 25 bp, Mus musculus
aagacccctgtctgcgtgtacatga

SEQ ID NO: 74055 - DNA, 25 bp, Mus musculus
aagacccggaactcctgctgcaaaa

SEQ ID NO: 74056 - DNA, 25 bp, Mus musculus
aagacccttgcctgcctcagtactt

SEQ ID NO: 74057 - DNA, 25 bp, Mus musculus
aagaccgaggcttctgaacgctgcg

SEQ ID NO: 74058 - DNA, 25 bp, Mus musculus
aagaccgggtctgagtgggccttct

SEQ ID NO: 74059 - DNA, 25 bp, Mus musculus
aagaccgtctctgtcgattccagga

SEQ ID NO: 74060 - DNA, 25 bp, Mus musculus
aagaccgttccatcgctgtgtggga

SEQ ID NO: 74061 - DNA, 25 bp, Mus musculus
aagacctgactgctcagggacccag

SEQ ID NO: 74062 - DNA, 25 bp, Mus musculus
aagacctgatcaactactgtctgag

SEQ ID NO: 74063 - DNA, 25 bp, Mus musculus
aagacctgtgcccactcagatgcag

SEQ ID NO: 74064 - DNA, 25 bp, Mus musculus
aagaccttctgccacaatttgcggg

SEQ ID NO: 74065 - DNA, 25 bp, Mus musculus
aagaccttttacagattgtccaggg

SEQ ID NO: 74066 - DNA, 25 bp, Mus musculus
aagacgaagacgatcaagagggtga

SEQ ID NO: 74067 - DNA, 25 bp, Mus musculus
aagacgaggttgactggcaggacac

SEQ ID NO: 74068 - DNA, 25 bp, Mus musculus
aagacgcaccatggaactcagacgg

SEQ ID NO: 74069 - DNA, 25 bp, Mus musculus
aagacgccactgttccgaaaccagg

SEQ ID NO: 74070 - DNA, 25 bp, Mus musculus
aagacgcctatatgatgcaggtgcc

SEQ ID NO: 74071 - DNA, 25 bp, Mus musculus
aagacgctgttgagttaagacccct

SEQ ID NO: 74072 - DNA, 25 bp, Mus musculus
aagacgtttatgtcccagaggccag

SEQ ID NO: 74073 - DNA, 25 bp, Mus musculus
aagactaaaggttccagatggtgcc

SEQ ID NO: 74074 - DNA, 25 bp, Mus musculus
aagactactgccgtgcccaagaggc

SEQ ID NO: 74075 - DNA, 25 bp, Mus musculus
aagactatcgaagtagacggcatca

SEQ ID NO: 74076 - DNA, 25 bp, Mus musculus
aagactcagtgttctgggccacgca

SEQ ID NO: 74077 - DNA, 25 bp, Mus musculus
aagactcatcattccagggcacgga

SEQ ID NO: 74078 - DNA, 25 bp, Mus musculus
aagactccagcaaagtggtacccgg

SEQ ID NO: 74079 - DNA, 25 bp, Mus musculus
aagactccatgcctgagagcctgcg

SEQ ID NO: 74080 - DNA, 25 bp, Mus musculus
aagactcctacgtcctcatggccag

SEQ ID NO: 74081 - DNA, 25 bp, Mus musculus
aagactcgagtctacagggacacaa

SEQ ID NO: 74082 - DNA, 25 bp, Mus musculus
aagactcggtcatctcatcgcctgg

SEQ ID NO: 74083 - DNA, 25 bp, Mus musculus
aagactctggtggaactgcaaggat

SEQ ID NO: 74084 - DNA, 25 bp, Mus musculus
aagactgccgccagcttggtagtgg

SEQ ID NO: 74085 - DNA, 25 bp, Mus musculus
aagactggaaatgttgctcgggccg

SEQ ID NO: 74086 - DNA, 25 bp, Mus musculus
aagactggacagcatcgttgggccc

SEQ ID NO: 74087 - DNA, 25 bp, Mus musculus
aagactggagaattgccgaccgagg

SEQ ID NO: 74088 - DNA, 25 bp, Mus musculus
aagactgtacagtggacaagcgcca

SEQ ID NO: 74089 - DNA, 25 bp, Mus musculus
aagactgtaggatgtgcaagtgcac

SEQ ID NO: 74090 - DNA, 25 bp, Mus musculus
aagacttcacgccagcatcccttta

SEQ ID NO: 74091 - DNA, 25 bp, Mus musculus
aagacttccagctcacctgactgcg

SEQ ID NO: 74092 - DNA, 25 bp, Mus musculus
aagacttcgagttgctctgccctga

SEQ ID NO: 74093 - DNA, 25 bp, Mus musculus
aagacttcgcagcttcctaacgtga

SEQ ID NO: 74094 - DNA, 25 bp, Mus musculus
aagacttcgtgagtgtgtccccgca

SEQ ID NO: 74095 - DNA, 25 bp, Mus musculus
aagacttgatgcttcgcttcctggg

SEQ ID NO: 74096 - DNA, 25 bp, Mus musculus
aagactttgtagtgtacatgacaca

SEQ ID NO: 74097 - DNA, 25 bp, Mus musculus
aagagaaaacagaaacgctggcctc

SEQ ID NO: 74098 - DNA, 25 bp, Mus musculus
aagagaaaggaaagcgcgaggagac

SEQ ID NO: 74099 - DNA, 25 bp, Mus musculus
aagagaactctaagcctgaacctgg

SEQ ID NO: 74100 - DNA, 25 bp, Mus musculus
aagagaacttcgtgtgagctgcagc

SEQ ID NO: 74101 - DNA, 25 bp, Mus musculus
aagagaagagcagcggcttccggct

SEQ ID NO: 74102 - DNA, 25 bp, Mus musculus
aagagaagctgccaggctagccaga

SEQ ID NO: 74103 - DNA, 25 bp, Mus musculus
aagagaagctgggtcctgtggacat

SEQ ID NO: 74104 - DNA, 25 bp, Mus musculus
aagagaagtcatttgggctacccag

SEQ ID NO: 74105 - DNA, 25 bp, Mus musculus
aagagaatgaagcaagctctgtggt

SEQ ID NO: 74106 - DNA, 25 bp, Mus musculus
aagagaattgctgcttgccaggagc

SEQ ID NO: 74107 - DNA, 25 bp, Mus musculus
aagagacaactggagaagggcccct

SEQ ID NO: 74108 - DNA, 25 bp, Mus musculus
aagagacagagtaatgttcaagccc

SEQ ID NO: 74109 - DNA, 25 bp, Mus musculus
aagagacagttcgatgggcagacgc

SEQ ID NO: 74110 - DNA, 25 bp, Mus musculus
aagagaccctcatccgattcgaccg

SEQ ID NO: 74111 - DNA, 25 bp, Mus musculus
aagagaccgggcgaagctcggagcc

SEQ ID NO: 74112 - DNA, 25 bp, Mus musculus
aagagacctccctcgcctgatgtga

SEQ ID NO: 74113 - DNA, 25 bp, Mus musculus
aagagactcggcacctctaaggacc

SEQ ID NO: 74114 - DNA, 25 bp, Mus musculus
aagagactttggaggctggctacac

SEQ ID NO: 74115 - DNA, 25 bp, Mus musculus
aagagagaccctgtgtggagaagca

SEQ ID NO: 74116 - DNA, 25 bp, Mus musculus
aagagagagggtctctacgctgccc

SEQ ID NO: 74117 - DNA, 25 bp, Mus musculus
aagagagcagttgagatcaccggca

SEQ ID NO: 74118 - DNA, 25 bp, Mus musculus
aagagagccctctgtcaccaaggag

SEQ ID NO: 74119 - DNA, 25 bp, Mus musculus
aagagagcggatgctgtattccagc

SEQ ID NO: 74120 - DNA, 25 bp, Mus musculus
aagagagtaagagctgggatttgcc

SEQ ID NO: 74121 - DNA, 25 bp, Mus musculus
aagagatgaagggtctcctcacact

SEQ ID NO: 74122 - DNA, 25 bp, Mus musculus
aagagatgctggacaacgggttccc

SEQ ID NO: 74123 - DNA, 25 bp, Mus musculus
aagagatgtgttgctccggccactg

SEQ ID NO: 74124 - DNA, 25 bp, Mus musculus
aagagcaacttcagcaggttccacg

SEQ ID NO: 74125 - DNA, 25 bp, Mus musculus
aagagcactttcttccagattgtga

SEQ ID NO: 74126 - DNA, 25 bp, Mus musculus
aagagcagctttgactacacacatg

SEQ ID NO: 74127 - DNA, 25 bp, Mus musculus
aagagccaaatgtcagacacactgc

SEQ ID NO: 74128 - DNA, 25 bp, Mus musculus
aagagcccaaccaagtaccctcaga

SEQ ID NO: 74129 - DNA, 25 bp, Mus musculus
aagagcccactctccctggaaggaa

SEQ ID NO: 74130 - DNA, 25 bp, Mus musculus
aagagccggagctgcagcgaagtcc

SEQ ID NO: 74131 - DNA, 25 bp, Mus musculus
aagagcgccatcaactctccaatgg

SEQ ID NO: 74132 - DNA, 25 bp, Mus musculus
aagagcgcccgactcaggtattgag

SEQ ID NO: 74133 - DNA, 25 bp, Mus musculus
aagagcgcgtttccgttcagtgaca

SEQ ID NO: 74134 - DNA, 25 bp, Mus musculus
aagagcgcttccgtctgaccagtga

SEQ ID NO: 74135 - DNA, 25 bp, Mus musculus
aagagcggaagctcatgatgatgtt

SEQ ID NO: 74136 - DNA, 25 bp, Mus musculus
aagagcgggtgtccagtgccttaca

SEQ ID NO: 74137 - DNA, 25 bp, Mus musculus
aagagcgtaactggctgtcaggaag

SEQ ID NO: 74138 - DNA, 25 bp, Mus musculus
aagagctacccacaactttggctgg

SEQ ID NO: 74139 - DNA, 25 bp, Mus musculus
aagagctccagtctgagtcgcctcg

SEQ ID NO: 74140 - DNA, 25 bp, Mus musculus
aagagctcgtacttctgactgtggc

SEQ ID NO: 74141 - DNA, 25 bp, Mus musculus
aagagctgagaggttttcacagacg

SEQ ID NO: 74142 - DNA, 25 bp, Mus musculus
aagagctgcggctactggctgagca

SEQ ID NO: 74143 - DNA, 25 bp, Mus musculus
aagagctgcggctcctcgtgtgcgg

SEQ ID NO: 74144 - DNA, 25 bp, Mus musculus
aagagctggccctgcgcttttaccc

SEQ ID NO: 74145 - DNA, 25 bp, Mus musculus
aagagcttcaaggataccccgctgg

SEQ ID NO: 74146 - DNA, 25 bp, Mus musculus
aagaggaacctggaagcacgggttg

SEQ ID NO: 74147 - DNA, 25 bp, Mus musculus
aagaggaagacgatgcagagtccag

SEQ ID NO: 74148 - DNA, 25 bp, Mus musculus
aagaggacagcagcaacgacgatga

SEQ ID NO: 74149 - DNA, 25 bp, Mus musculus
aagaggaccagctctcccagttgct

SEQ ID NO: 74150 - DNA, 25 bp, Mus musculus
aagaggacttgctgccactggatga

SEQ ID NO: 74151 - DNA, 25 bp, Mus musculus
aagaggagaccaacgccttcaactg

SEQ ID NO: 74152 - DNA, 25 bp, Mus musculus
aagaggagattgaccgtgcggccat

SEQ ID NO: 74153 - DNA, 25 bp, Mus musculus
aagaggagccaagcgtaagcagcaa

SEQ ID NO: 74154 - DNA, 25 bp, Mus musculus
aagaggagggaactttccgcagctc

SEQ ID NO: 74155 - DNA, 25 bp, Mus musculus
aagaggcaagtatcccccagtctgc

SEQ ID NO: 74156 - DNA, 25 bp, Mus musculus
aagaggcccttaagccactgcgagc

SEQ ID NO: 74157 - DNA, 25 bp, Mus musculus
aagaggccggttacaccattgagca

SEQ ID NO: 74158 - DNA, 25 bp, Mus musculus
aagaggcctcccttgtgagtcggac

SEQ ID NO: 74159 - DNA, 25 bp, Mus musculus
aagaggctatgtccagcccgacaca

SEQ ID NO: 74160 - DNA, 25 bp, Mus musculus
aagaggctgaccttctgctggagca

SEQ ID NO: 74161 - DNA, 25 bp, Mus musculus
aagagggactcttcctgatggctga

SEQ ID NO: 74162 - DNA, 25 bp, Mus musculus
aagagggactgcctatcctacagcc

SEQ ID NO: 74163 - DNA, 25 bp, Mus musculus
aagagggccacaccaggaacctgtt

SEQ ID NO: 74164 - DNA, 25 bp, Mus musculus
aagagggcctcttccggatgcctgg

SEQ ID NO: 74165 - DNA, 25 bp, Mus musculus
aagagggcgctctctgccagcagca

SEQ ID NO: 74166 - DNA, 25 bp, Mus musculus
aagagggctccaaaggtgggaagtg

SEQ ID NO: 74167 - DNA, 25 bp, Mus musculus
aagagggctgccatgacttcctgga

SEQ ID NO: 74168 - DNA, 25 bp, Mus musculus
aagaggggaaatatgatgaataaag

SEQ ID NO: 74169 - DNA, 25 bp, Mus musculus
aagagggtgaaaacagtgtggcaac

SEQ ID NO: 74170 - DNA, 25 bp, Mus musculus
aagaggtacatggtatggcccagcc

SEQ ID NO: 74171 - DNA, 25 bp, Mus musculus
aagaggtccgagactgggtgctcac

SEQ ID NO: 74172 - DNA, 25 bp, Mus musculus
aagaggtgcagttgaacttctacga

SEQ ID NO: 74173 - DNA, 25 bp, Mus musculus
aagaggtgctgagattcgcagtaaa

SEQ ID NO: 74174 - DNA, 25 bp, Mus musculus
aagaggtgggtctcttcagcgagct

SEQ ID NO: 74175 - DNA, 25 bp, Mus musculus
aagaggtgtctcagtggctggaaca

SEQ ID NO: 74176 - DNA, 25 bp, Mus musculus
aagaggtgttgaagaaatgtgcgca

SEQ ID NO: 74177 - DNA, 25 bp, Mus musculus
aagaggttcagctggtggtcgtccc

SEQ ID NO: 74178 - DNA, 25 bp, Mus musculus
aagaggttcttcagcagcttcaggc

SEQ ID NO: 74179 - DNA, 25 bp, Mus musculus
aagaggttgaaagcaagaggaagcc

SEQ ID NO: 74180 - DNA, 25 bp, Mus musculus
aagagtacgcggaggattgtcctga

SEQ ID NO: 74181 - DNA, 25 bp, Mus musculus
aagagtcacctaaagttcggcggca

SEQ ID NO: 74182 - DNA, 25 bp, Mus musculus
aagagtcagtgaggacgtccctggc

SEQ ID NO: 74183 - DNA, 25 bp, Mus musculus
aagagtccgggtacgctggcttcat

SEQ ID NO: 74184 - DNA, 25 bp, Mus musculus
aagagtcctaaatgcacaacccaag

SEQ ID NO: 74185 - DNA, 25 bp, Mus musculus
aagagtcctcggagctggtctcacc

SEQ ID NO: 74186 - DNA, 25 bp, Mus musculus
aagagtcggcatctggcagcaacag

SEQ ID NO: 74187 - DNA, 25 bp, Mus musculus
aagagtctctaggaccctggctgga

SEQ ID NO: 74188 - DNA, 25 bp, Mus musculus
aagagtgagcttgaatccagcgcca

SEQ ID NO: 74189 - DNA, 25 bp, Mus musculus
aagagtgcccgctacgaccgcttct

SEQ ID NO: 74190 - DNA, 25 bp, Mus musculus
aagagtgctgcttccgcagctgcga

SEQ ID NO: 74191 - DNA, 25 bp, Mus musculus
aagagtggtctctggagtcatcgcc

SEQ ID NO: 74192 - DNA, 25 bp, Mus musculus
aagagtgtgctctttctgcacccgg

SEQ ID NO: 74193 - DNA, 25 bp, Mus musculus
aagagtgttcgctccaaggtcggct

SEQ ID NO: 74194 - DNA, 25 bp, Mus musculus
aagagttcagccgtgtctattcagc

SEQ ID NO: 74195 - DNA, 25 bp, Mus musculus
aagagttccccgacactggactctg

SEQ ID NO: 74196 - DNA, 25 bp, Mus musculus
aagagttctcccgaccatgttgatc

SEQ ID NO: 74197 - DNA, 25 bp, Mus musculus
aagagttggcgttcgagggctgaaa

SEQ ID NO: 74198 - DNA, 25 bp, Mus musculus
aagagtttgctcagctactggcgca

SEQ ID NO: 74199 - DNA, 25 bp, Mus musculus
aagagttttctggtccctgatacat

SEQ ID NO: 74200 - DNA, 25 bp, Mus musculus
aagataaggaggctgcccgactacg

SEQ ID NO: 74201 - DNA, 25 bp, Mus musculus
aagatactgcaaggttcaaggatga

SEQ ID NO: 74202 - DNA, 25 bp, Mus musculus
aagatactgtgcctcgagctgcgga

SEQ ID NO: 74203 - DNA, 25 bp, Mus musculus
aagatagccgagttcaccgtcagca

SEQ ID NO: 74204 - DNA, 25 bp, Mus musculus
aagatagggtccaacagcgagagcc

SEQ ID NO: 74205 - DNA, 25 bp, Mus musculus
aagatatcctgttgcggcctgagct

SEQ ID NO: 74206 - DNA, 25 bp, Mus musculus
aagatatcggactttggcttcgcca

SEQ ID NO: 74207 - DNA, 25 bp, Mus musculus
aagatcaaacggcagctgtcaatga

SEQ ID NO: 74208 - DNA, 25 bp, Mus musculus
aagatcaaccgtgaactgggctcag

SEQ ID NO: 74209 - DNA, 25 bp, Mus musculus
aagatcaatgttacgggaattcccg

SEQ ID NO: 74210 - DNA, 25 bp, Mus musculus
aagatcactgctctgcccctgtact

SEQ ID NO: 74211 - DNA, 25 bp, Mus musculus
aagatcatcaactacctgcgcgagc

SEQ ID NO: 74212 - DNA, 25 bp, Mus musculus
aagatcatcttttgcatggctggcg

SEQ ID NO: 74213 - DNA, 25 bp, Mus musculus
aagatccatggaagatgctcgggca

SEQ ID NO: 74214 - DNA, 25 bp, Mus musculus
aagatccgtttccatgacctccaag

SEQ ID NO: 74215 - DNA, 25 bp, Mus musculus
aagatccttctgtctggcgtggcat

SEQ ID NO: 74216 - DNA, 25 bp, Mus musculus
aagatcgagatggtccgagcctacc

SEQ ID NO: 74217 - DNA, 25 bp, Mus musculus
aagatcgcgatcttcggtgccaccg

SEQ ID NO: 74218 - DNA, 25 bp, Mus musculus
aagatcgtgaacagtaatggtgagc

SEQ ID NO: 74219 - DNA, 25 bp, Mus musculus
aagatcgtggccagagactgggaac

SEQ ID NO: 74220 - DNA, 25 bp, Mus musculus
aagatctaggacttgggagcccggc

SEQ ID NO: 74221 - DNA, 25 bp, Mus musculus
aagatctctggctgcagtgggacca

SEQ ID NO: 74222 - DNA, 25 bp, Mus musculus
aagatctgctccctagtgtacctgg

SEQ ID NO: 74223 - DNA, 25 bp, Mus musculus
aagatctgcttgctacaaccgcaca

SEQ ID NO: 74224 - DNA, 25 bp, Mus musculus
aagatctggtaaaccttggtgccca

SEQ ID NO: 74225 - DNA, 25 bp, Mus musculus
aagatgaacagttgtgggcctcgcc

SEQ ID NO: 74226 - DNA, 25 bp, Mus musculus
aagatgaacattctggcgcccgtgc

SEQ ID NO: 74227 - DNA, 25 bp, Mus musculus
aagatgaacctgtccctcaacgacg

SEQ ID NO: 74228 - DNA, 25 bp, Mus musculus
aagatgaatcgggaaaggctacgac

SEQ ID NO: 74229 - DNA, 25 bp, Mus musculus
aagatgacacaccagagcgggagca

SEQ ID NO: 74230 - DNA, 25 bp, Mus musculus
aagatgacattttggcagctacccc

SEQ ID NO: 74231 - DNA, 25 bp, Mus musculus
aagatgacgtgtaagaccccgccgt

SEQ ID NO: 74232 - DNA, 25 bp, Mus musculus
aagatgacttcatcccagagctggg

SEQ ID NO: 74233 - DNA, 25 bp, Mus musculus
aagatgaggacaccatgacgaggct

SEQ ID NO: 74234 - DNA, 25 bp, Mus musculus
aagatgagggctctttacggcgacc

SEQ ID NO: 74235 - DNA, 25 bp, Mus musculus
aagatgatatcaagagggtcatggc

SEQ ID NO: 74236 - DNA, 25 bp, Mus musculus
aagatgatcatctcagagctggtgc

SEQ ID NO: 74237 - DNA, 25 bp, Mus musculus
aagatgatccccttcggaggacagg

SEQ ID NO: 74238 - DNA, 25 bp, Mus musculus
aagatgatctccgtgttgcaacaag

SEQ ID NO: 74239 - DNA, 25 bp, Mus musculus
aagatgatggcgacctacaaggaga

SEQ ID NO: 74240 - DNA, 25 bp, Mus musculus
aagatgatggctacttccgggaact

SEQ ID NO: 74241 - DNA, 25 bp, Mus musculus
aagatgatgtttccacccagtgccg

SEQ ID NO: 74242 - DNA, 25 bp, Mus musculus
aagatgattattaccagatcctggg

SEQ ID NO: 74243 - DNA, 25 bp, Mus musculus
aagatgatttaagtcagacccgggc

SEQ ID NO: 74244 - DNA, 25 bp, Mus musculus
aagatgcagatggagtcgccgctcc

SEQ ID NO: 74245 - DNA, 25 bp, Mus musculus
aagatgcaggagttggagtccaaac

SEQ ID NO: 74246 - DNA, 25 bp, Mus musculus
aagatgcagggctccagagcagcaa

SEQ ID NO: 74247 - DNA, 25 bp, Mus musculus
aagatgcctgtatttctttgtcctg

SEQ ID NO: 74248 - DNA, 25 bp, Mus musculus
aagatgcgcacaggtgtccaggagc

SEQ ID NO: 74249 - DNA, 25 bp, Mus musculus
aagatgcgcctactcttggcaatga

SEQ ID NO: 74250 - DNA, 25 bp, Mus musculus
aagatgctagcacctttcctggctg

SEQ ID NO: 74251 - DNA, 25 bp, Mus musculus
aagatgctcagcaaacagtgtccga

SEQ ID NO: 74252 - DNA, 25 bp, Mus musculus
aagatgctctgaaccggacttcgtc

SEQ ID NO: 74253 - DNA, 25 bp, Mus musculus
aagatggaaccttggctcagcttca

SEQ ID NO: 74254 - DNA, 25 bp, Mus musculus
aagatggacgacatgtcgcccaggc

SEQ ID NO: 74255 - DNA, 25 bp, Mus musculus
aagatggagcagcacactagtaacc

SEQ ID NO: 74256 - DNA, 25 bp, Mus musculus
aagatggcattggatccccggaact

SEQ ID NO: 74257 - DNA, 25 bp, Mus musculus
aagatggccgcggaactgtacccgc

SEQ ID NO: 74258 - DNA, 25 bp, Mus musculus
aagatggcctcggtgcctgtgtatt

SEQ ID NO: 74259 - DNA, 25 bp, Mus musculus
aagatggcggcagtgatggcggcgc

SEQ ID NO: 74260 - DNA, 25 bp, Mus musculus
aagatggcggcctgggccccttgtc

SEQ ID NO: 74261 - DNA, 25 bp, Mus musculus
aagatggcgtcgtcggagcaggcag

SEQ ID NO: 74262 - DNA, 25 bp, Mus musculus
aagatggctgcagcgatacctgccc

SEQ ID NO: 74263 - DNA, 25 bp, Mus musculus
aagatgggctccttccgccggccta

SEQ ID NO: 74264 - DNA, 25 bp, Mus musculus
aagatggtcacttgcttccctcccg

SEQ ID NO: 74265 - DNA, 25 bp, Mus musculus
aagatggtcgacctttgccagcgag

SEQ ID NO: 74266 - DNA, 25 bp, Mus musculus
aagatggtgcctcctccagacgtag

SEQ ID NO: 74267 - DNA, 25 bp, Mus musculus
aagatggtgccttctagccagcctg

SEQ ID NO: 74268 - DNA, 25 bp, Mus musculus
aagatgtccgcccaagagagttgcc

SEQ ID NO: 74269 - DNA, 25 bp, Mus musculus
aagatgtgaagaaggcgctgctgct

SEQ ID NO: 74270 - DNA, 25 bp, Mus musculus
aagatgtgcaacatctgccacggcc

SEQ ID NO: 74271 - DNA, 25 bp, Mus musculus
aagattaaaaatggccatagcccag

SEQ ID NO: 74272 - DNA, 25 bp, Mus musculus
aagattcatttatgccaccagggag

SEQ ID NO: 74273 - DNA, 25 bp, Mus musculus
aagattcggagtcgcctggaacaca

SEQ ID NO: 74274 - DNA, 25 bp, Mus musculus
aagattcgtgtcagcgcggcgtcta

SEQ ID NO: 74275 - DNA, 25 bp, Mus musculus
aagattctcctcagcaaaggcctcg

SEQ ID NO: 74276 - DNA, 25 bp, Mus musculus
aagattcttgcttcggcttcctcag

SEQ ID NO: 74277 - DNA, 25 bp, Mus musculus
aagattgtacactgcagctgccagg

SEQ ID NO: 74278 - DNA, 25 bp, Mus musculus
aagattgtgctcatctccgttgctg

SEQ ID NO: 74279 - DNA, 25 bp, Mus musculus
aagattgtggaaggcgtgtcccagc

SEQ ID NO: 74280 - DNA, 25 bp, Mus musculus
aagcaaactttaccgcgtggcgaca

SEQ ID NO: 74281 - DNA, 25 bp, Mus musculus
aagcaaagcaagatgcgcaagaggg

SEQ ID NO: 74282 - DNA, 25 bp, Mus musculus
aagcaaagccaggactagccgtgac

SEQ ID NO: 74283 - DNA, 25 bp, Mus musculus
aagcaacagggcagaatggagatcc

SEQ ID NO: 74284 - DNA, 25 bp, Mus musculus
aagcaacagttctgcatcagcgacg

SEQ ID NO: 74285 - DNA, 25 bp, Mus musculus
aagcaacccttatcaatattatcag

SEQ ID NO: 74286 - DNA, 25 bp, Mus musculus
aagcaagagcgtgggcaaatatgtc

SEQ ID NO: 74287 - DNA, 25 bp, Mus musculus
aagcaagcagaagtgctcctgcgcc

SEQ ID NO: 74288 - DNA, 25 bp, Mus musculus
aagcaagggcagacccgactgtcta

SEQ ID NO: 74289 - DNA, 25 bp, Mus musculus
aagcaagtcctcctgaaatctggag

SEQ ID NO: 74290 - DNA, 25 bp, Mus musculus
aagcaagtgtctcaggcccagacga

SEQ ID NO: 74291 - DNA, 25 bp, Mus musculus
aagcaagtgtgtcacgatccccagg

SEQ ID NO: 74292 - DNA, 25 bp, Mus musculus
aagcaatagtgagcacgccaggacc

SEQ ID NO: 74293 - DNA, 25 bp, Mus musculus
aagcacactacaaggcctgcgacag

SEQ ID NO: 74294 - DNA, 25 bp, Mus musculus
aagcacccaatcaggccaacaagga

SEQ ID NO: 74295 - DNA, 25 bp, Mus musculus
aagcacccatgaccagccatcagcc

SEQ ID NO: 74296 - DNA, 25 bp, Mus musculus
aagcaccgcaggcacagcattatgt

SEQ ID NO: 74297 - DNA, 25 bp, Mus musculus
aagcaccgcgggtcatggctggcac

SEQ ID NO: 74298 - DNA, 25 bp, Mus musculus
aagcacctgaaggtaggcggagccc

SEQ ID NO: 74299 - DNA, 25 bp, Mus musculus
aagcacctgtacttcgagtccgacg

SEQ ID NO: 74300 - DNA, 25 bp, Mus musculus
aagcacgaattatcgcggaggccgg

SEQ ID NO: 74301 - DNA, 25 bp, Mus musculus
aagcacgggcttccggcgaggcccg

SEQ ID NO: 74302 - DNA, 25 bp, Mus musculus
aagcacgtctctacttcctccggga

SEQ ID NO: 74303 - DNA, 25 bp, Mus musculus
aagcactacaagtccaccgtgggag

SEQ ID NO: 74304 - DNA, 25 bp, Mus musculus
aagcagaagctgtttaccgaggtgg

SEQ ID NO: 74305 - DNA, 25 bp, Mus musculus
aagcagaatgtagaggatagcactt

SEQ ID NO: 74306 - DNA, 25 bp, Mus musculus
aagcagagagcttcatgcacgtgca

SEQ ID NO: 74307 - DNA, 25 bp, Mus musculus
aagcagagcttgacccatggcagca

SEQ ID NO: 74308 - DNA, 25 bp, Mus musculus
aagcagagcttttctagtggcgcgc

SEQ ID NO: 74309 - DNA, 25 bp, Mus musculus
aagcagatattgatggcgacggaca

SEQ ID NO: 74310 - DNA, 25 bp, Mus musculus
aagcagatgtacagtggcatccctg

SEQ ID NO: 74311 - DNA, 25 bp, Mus musculus
aagcagcaaccggaagggcttgacg

SEQ ID NO: 74312 - DNA, 25 bp, Mus musculus
aagcagccccgacctcggaggagaa

SEQ ID NO: 74313 - DNA, 25 bp, Mus musculus
aagcagccgggcaagcaaaactgcc

SEQ ID NO: 74314 - DNA, 25 bp, Mus musculus
aagcagcgctgagacatgtgaccca

SEQ ID NO: 74315 - DNA, 25 bp, Mus musculus
aagcagctgctgttcagtgaccacg

SEQ ID NO: 74316 - DNA, 25 bp, Mus musculus
aagcagctgcttcactgtatggcct

SEQ ID NO: 74317 - DNA, 25 bp, Mus musculus
aagcaggcagacttccaggctgcgc

SEQ ID NO: 74318 - DNA, 25 bp, Mus musculus
aagcaggcggcattgtgattgacac

SEQ ID NO: 74319 - DNA, 25 bp, Mus musculus
aagcaggctcttccgatcgcggcct

SEQ ID NO: 74320 - DNA, 25 bp, Mus musculus
aagcaggctggtggcggcgcagaga

SEQ ID NO: 74321 - DNA, 25 bp, Mus musculus
aagcaggtctccctcctgggctgga

SEQ ID NO: 74322 - DNA, 25 bp, Mus musculus
aagcaggtggcagactaaaggacac

SEQ ID NO: 74323 - DNA, 25 bp, Mus musculus
aagcaggtgtcatgatgttgtccgc

SEQ ID NO: 74324 - DNA, 25 bp, Mus musculus
aagcagtcagcggagtcagtgtcca

SEQ ID NO: 74325 - DNA, 25 bp, Mus musculus
aagcagtgggtcgaacctcggaact

SEQ ID NO: 74326 - DNA, 25 bp, Mus musculus
aagcatatctactcctccataacta

SEQ ID NO: 74327 - DNA, 25 bp, Mus musculus
aagcatatctccctcctccatgagt

SEQ ID NO: 74328 - DNA, 25 bp, Mus musculus
aagcatcctaatccctatgaagtca

SEQ ID NO: 74329 - DNA, 25 bp, Mus musculus
aagcatctgcacaagaatccagaag

SEQ ID NO: 74330 - DNA, 25 bp, Mus musculus
aagcatctggactgcccatttccgg

SEQ ID NO: 74331 - DNA, 25 bp, Mus musculus
aagcatgcgactctgttctcgtaat

SEQ ID NO: 74332 - DNA, 25 bp, Mus musculus
aagcatttaaagagccacagaacag

SEQ ID NO: 74333 - DNA, 25 bp, Mus musculus
aagcatttttgctgtttgcgggaac

SEQ ID NO: 74334 - DNA, 25 bp, Mus musculus
aagccaaagggatcggttcagacca

SEQ ID NO: 74335 - DNA, 25 bp, Mus musculus
aagccaaggctcgtcgtaacagtca

SEQ ID NO: 74336 - DNA, 25 bp, Mus musculus
aagccacacttgtgtgacacgtgcg

SEQ ID NO: 74337 - DNA, 25 bp, Mus musculus
aagccacatacaacagccaggcggg

SEQ ID NO: 74338 - DNA, 25 bp, Mus musculus
aagccagagcgctccgacgatgcgc

SEQ ID NO: 74339 - DNA, 25 bp, Mus musculus
aagccagatcttcgtctttggccca

SEQ ID NO: 74340 - DNA, 25 bp, Mus musculus
aagccagcaagcactctcgagcgca

SEQ ID NO: 74341 - DNA, 25 bp, Mus musculus
aagccagccctacgcggtgttgcgg

SEQ ID NO: 74342 - DNA, 25 bp, Mus musculus
aagccagcggagacaaggtatcagc

SEQ ID NO: 74343 - DNA, 25 bp, Mus musculus
aagccaggcccttggtaagtccaga

SEQ ID NO: 74344 - DNA, 25 bp, Mus musculus
aagccaggctcaagatgaggctgca

SEQ ID NO: 74345 - DNA, 25 bp, Mus musculus
aagccagtcacctgaccagctgcca

SEQ ID NO: 74346 - DNA, 25 bp, Mus musculus
aagccatccggaaggaacgaaacat

SEQ ID NO: 74347 - DNA, 25 bp, Mus musculus
aagccatccgtcttcaccagggtct

SEQ ID NO: 74348 - DNA, 25 bp, Mus musculus
aagccatgagcagcgacgccgcggt

SEQ ID NO: 74349 - DNA, 25 bp, Mus musculus
aagccatgttctagatcagcgatca

SEQ ID NO: 74350 - DNA, 25 bp, Mus musculus
aagccattcgagcagctgcttgctg

SEQ ID NO: 74351 - DNA, 25 bp, Mus musculus
aagccattctcatgccacgtctgcg

SEQ ID NO: 74352 - DNA, 25 bp, Mus musculus
aagccattttccaagtgaagtcggg

SEQ ID NO: 74353 - DNA, 25 bp, Mus musculus
aagcccacagatttttgggtcttct

SEQ ID NO: 74354 - DNA, 25 bp, Mus musculus
aagcccagacactaaggaccgctgg

SEQ ID NO: 74355 - DNA, 25 bp, Mus musculus
aagcccagtcttggtatctcagaag

SEQ ID NO: 74356 - DNA, 25 bp, Mus musculus
aagcccagtgactgcggccgaagaa

SEQ ID NO: 74357 - DNA, 25 bp, Mus musculus
aagcccatgaatgtggagtatctca

SEQ ID NO: 74358 - DNA, 25 bp, Mus musculus
aagcccatggcagacgaatctgacg

SEQ ID NO: 74359 - DNA, 25 bp, Mus musculus
aagcccattggaatattaagcccgg

SEQ ID NO: 74360 - DNA, 25 bp, Mus musculus
aagccccactggagctaatggcaga

SEQ ID NO: 74361 - DNA, 25 bp, Mus musculus
aagccccagcgccattttggaaaga

SEQ ID NO: 74362 - DNA, 25 bp, Mus musculus
aagcccgaagacagtagcgcagtgc

SEQ ID NO: 74363 - DNA, 25 bp, Mus musculus
aagcccgagagcgtgactatgcaga

SEQ ID NO: 74364 - DNA, 25 bp, Mus musculus
aagcccgcaagatgcattacctgct

SEQ ID NO: 74365 - DNA, 25 bp, Mus musculus
aagcccgccagcaaagagaactgct

SEQ ID NO: 74366 - DNA, 25 bp, Mus musculus
aagcccggagcatctggttcctaga

SEQ ID NO: 74367 - DNA, 25 bp, Mus musculus
aagcccggtgagctagcctttcgaa

SEQ ID NO: 74368 - DNA, 25 bp, Mus musculus
aagccctcggtgactcaagccctag

SEQ ID NO: 74369 - DNA, 25 bp, Mus musculus
aagccctcgtgtgcgcgggacccag

SEQ ID NO: 74370 - DNA, 25 bp, Mus musculus
aagccctgaggtgccgtgtcatcaa

SEQ ID NO: 74371 - DNA, 25 bp, Mus musculus
aagccctgtgggaactctctctgaa

SEQ ID NO: 74372 - DNA, 25 bp, Mus musculus
aagccctgtgggtgtggtgttatcc

SEQ ID NO: 74373 - DNA, 25 bp, Mus musculus
aagccctgtgtcctatgtgcccaga

SEQ ID NO: 74374 - DNA, 25 bp, Mus musculus
aagccgaccgcttggtgcagatgag

SEQ ID NO: 74375 - DNA, 25 bp, Mus musculus
aagccgagaacgagacaaggagaga

SEQ ID NO: 74376 - DNA, 25 bp, Mus musculus
aagccgagcaggttccagcacatgt

SEQ ID NO: 74377 - DNA, 25 bp, Mus musculus
aagccgaggagagaggataagtcac

SEQ ID NO: 74378 - DNA, 25 bp, Mus musculus
aagccgagttgcaggtctttccaga

SEQ ID NO: 74379 - DNA, 25 bp, Mus musculus
aagccgccagtacaggcctcttgac

SEQ ID NO: 74380 - DNA, 25 bp, Mus musculus
aagccgccggcaagcggagacgcct

SEQ ID NO: 74381 - DNA, 25 bp, Mus musculus
aagccggaggaagctcagtcctggt

SEQ ID NO: 74382 - DNA, 25 bp, Mus musculus
aagccggcatcaccgagaaggtcgt

SEQ ID NO: 74383 - DNA, 25 bp, Mus musculus
aagccgggtactttcagagcatcac

SEQ ID NO: 74384 - DNA, 25 bp, Mus musculus
aagccgtatatctgcaccgactgcg

SEQ ID NO: 74385 - DNA, 25 bp, Mus musculus
aagccgtcctttagttacagatcag

SEQ ID NO: 74386 - DNA, 25 bp, Mus musculus
aagccgttatccaggattctaccat

SEQ ID NO: 74387 - DNA, 25 bp, Mus musculus
aagccgttcatctccacagactggg

SEQ ID NO: 74388 - DNA, 25 bp, Mus musculus
aagcctattccaaccctgggtacag

SEQ ID NO: 74389 - DNA, 25 bp, Mus musculus
aagcctcacttcatggccttgcact

SEQ ID NO: 74390 - DNA, 25 bp, Mus musculus
aagcctcatcgagccagtgtccatg

SEQ ID NO: 74391 - DNA, 25 bp, Mus musculus
aagcctcgggaatggccttgctgca

SEQ ID NO: 74392 - DNA, 25 bp, Mus musculus
aagcctgcctggaaagacgggtcca

SEQ ID NO: 74393 - DNA, 25 bp, Mus musculus
aagcctggccctgatccctattgga

SEQ ID NO: 74394 - DNA, 25 bp, Mus musculus
aagcctggctacaccgggaatggaa

SEQ ID NO: 74395 - DNA, 25 bp, Mus musculus
aagcctgtgggagcccgtggccttt

SEQ ID NO: 74396 - DNA, 25 bp, Mus musculus
aagcctgttcggagctgcaaccaaa

SEQ ID NO: 74397 - DNA, 25 bp, Mus musculus
aagccttaagtgacttcctcctcag

SEQ ID NO: 74398 - DNA, 25 bp, Mus musculus
aagccttcatggtcagcgggacaga

SEQ ID NO: 74399 - DNA, 25 bp, Mus musculus
aagccttcctacgacacggaggcag

SEQ ID NO: 74400 - DNA, 25 bp, Mus musculus
aagccttctggatcttctcgtggga

SEQ ID NO: 74401 - DNA, 25 bp, Mus musculus
aagccttgtcctctacttccgcggg

SEQ ID NO: 74402 - DNA, 25 bp, Mus musculus
aagcctttgtctgagtctgggtcca

SEQ ID NO: 74403 - DNA, 25 bp, Mus musculus
aagcgacagagctcacagagggcgt

SEQ ID NO: 74404 - DNA, 25 bp, Mus musculus
aagcgaccggaagaatgtgactgcc

SEQ ID NO: 74405 - DNA, 25 bp, Mus musculus
aagcgacgccaggatccgatgtggt

SEQ ID NO: 74406 - DNA, 25 bp, Mus musculus
aagcgcaaggtcttctccgaaagtg

SEQ ID NO: 74407 - DNA, 25 bp, Mus musculus
aagcgcagagcggacggaagggacc

SEQ ID NO: 74408 - DNA, 25 bp, Mus musculus
aagcgcaggagctcggtgtgaacca

SEQ ID NO: 74409 - DNA, 25 bp, Mus musculus
aagcgccgggtgttcatcattgaga

SEQ ID NO: 74410 - DNA, 25 bp, Mus musculus
aagcgcgaggagacgccgccgccgc

SEQ ID NO: 74411 - DNA, 25 bp, Mus musculus
aagcgctttacgttaacagcgctcg

SEQ ID NO: 74412 - DNA, 25 bp, Mus musculus
aagcggaacccctgcaacaggctag

SEQ ID NO: 74413 - DNA, 25 bp, Mus musculus
aagcggagcctctcgttggtagacg

SEQ ID NO: 74414 - DNA, 25 bp, Mus musculus
aagcggagcgcaaggtgaagaactc

SEQ ID NO: 74415 - DNA, 25 bp, Mus musculus
aagcggatggagattcaagaggcca

SEQ ID NO: 74416 - DNA, 25 bp, Mus musculus
aagcggatttcagccaaagcagccc

SEQ ID NO: 74417 - DNA, 25 bp, Mus musculus
aagcggcaagccactgaactcatga

SEQ ID NO: 74418 - DNA, 25 bp, Mus musculus
aagcggcagcagtatgggaaaccca

SEQ ID NO: 74419 - DNA, 25 bp, Mus musculus
aagcggcagccaatcctggatgcca

SEQ ID NO: 74420 - DNA, 25 bp, Mus musculus
aagcggcatcaaagagagcggcagc

SEQ ID NO: 74421 - DNA, 25 bp, Mus musculus
aagcggccgtccctacagatgagta

SEQ ID NO: 74422 - DNA, 25 bp, Mus musculus
aagcggcgcgggagtcgtgcgagcc

SEQ ID NO: 74423 - DNA, 25 bp, Mus musculus
aagcggctgaactctgtcgacccgg

SEQ ID NO: 74424 - DNA, 25 bp, Mus musculus
aagcggctgtggaggtgttggctgc

SEQ ID NO: 74425 - DNA, 25 bp, Mus musculus
aagcggtacaagaacaggacgatcc

SEQ ID NO: 74426 - DNA, 25 bp, Mus musculus
aagcggtctacctgttgattgccaa

SEQ ID NO: 74427 - DNA, 25 bp, Mus musculus
aagcggttacggctgtacagaaaca

SEQ ID NO: 74428 - DNA, 25 bp, Mus musculus
aagcgtccacaacttgcacagcagg

SEQ ID NO: 74429 - DNA, 25 bp, Mus musculus
aagcgtcccgcgatgggcagtgcca

SEQ ID NO: 74430 - DNA, 25 bp, Mus musculus
aagcgtgggcggttgcgattcccca

SEQ ID NO: 74431 - DNA, 25 bp, Mus musculus
aagcgtgtaccagaagctccgggag

SEQ ID NO: 74432 - DNA, 25 bp, Mus musculus
aagcgttacagttgcactcccagga

SEQ ID NO: 74433 - DNA, 25 bp, Mus musculus
aagctaatgatgaacctcctccgag

SEQ ID NO: 74434 - DNA, 25 bp, Mus musculus
aagctaatgcagctgccatgtgtgc

SEQ ID NO: 74435 - DNA, 25 bp, Mus musculus
aagctacaagcgaaaaatgggaagg

SEQ ID NO: 74436 - DNA, 25 bp, Mus musculus
aagctacgaagcagggtacagatcg

SEQ ID NO: 74437 - DNA, 25 bp, Mus musculus
aagctacttatgatggcaaccacga

SEQ ID NO: 74438 - DNA, 25 bp, Mus musculus
aagctagcccggcagcacccagagg

SEQ ID NO: 74439 - DNA, 25 bp, Mus musculus
aagctagtcctctctgggtttctgg

SEQ ID NO: 74440 - DNA, 25 bp, Mus musculus
aagctcaagtttatcaaaggcaccg

SEQ ID NO: 74441 - DNA, 25 bp, Mus musculus
aagctcagactactattgttccaga

SEQ ID NO: 74442 - DNA, 25 bp, Mus musculus
aagctcagatgtgccgctgggacag

SEQ ID NO: 74443 - DNA, 25 bp, Mus musculus
aagctcatctctctccgggactgga

SEQ ID NO: 74444 - DNA, 25 bp, Mus musculus
aagctcattgcgtccgttgcagatg

SEQ ID NO: 74445 - DNA, 25 bp, Mus musculus
aagctccgagagctcctggttggca

SEQ ID NO: 74446 - DNA, 25 bp, Mus musculus
aagctcctgattgacagtgtacacg

SEQ ID NO: 74447 - DNA, 25 bp, Mus musculus
aagctcctggagtggcaccgcgcga

SEQ ID NO: 74448 - DNA, 25 bp, Mus musculus
aagctcgagtcagacaagcgcctgg

SEQ ID NO: 74449 - DNA, 25 bp, Mus musculus
aagctcgtgtttaagtagacgcgta

SEQ ID NO: 74450 - DNA, 25 bp, Mus musculus
aagctctaggaaacaccagtgctga

SEQ ID NO: 74451 - DNA, 25 bp, Mus musculus
aagctctgattgaccagggagatga

SEQ ID NO: 74452 - DNA, 25 bp, Mus musculus
aagctcttccagttcgcagtccagg

SEQ ID NO: 74453 - DNA, 25 bp, Mus musculus
aagctcttgcgcaaagcctgggaga

SEQ ID NO: 74454 - DNA, 25 bp, Mus musculus
aagctgaaataattgaggaggagcg

SEQ ID NO: 74455 - DNA, 25 bp, Mus musculus
aagctgaagttaccataacccaggg

SEQ ID NO: 74456 - DNA, 25 bp, Mus musculus
aagctgaggagcgaactaagggccc

SEQ ID NO: 74457 - DNA, 25 bp, Mus musculus
aagctgattccatccggcgcaggcc

SEQ ID NO: 74458 - DNA, 25 bp, Mus musculus
aagctgcacctcctgaaaaagacgg

SEQ ID NO: 74459 - DNA, 25 bp, Mus musculus
aagctgcagagagcattgagcaccc

SEQ ID NO: 74460 - DNA, 25 bp, Mus musculus
aagctgcagcagtacttcccaaagg

SEQ ID NO: 74461 - DNA, 25 bp, Mus musculus
aagctgcaggcggacgcaacgctgt

SEQ ID NO: 74462 - DNA, 25 bp, Mus musculus
aagctgcctggactctggagcacaa

SEQ ID NO: 74463 - DNA, 25 bp, Mus musculus
aagctgctgccgctcacgcagagat

SEQ ID NO: 74464 - DNA, 25 bp, Mus musculus
aagctgctttccagactccacgggc

SEQ ID NO: 74465 - DNA, 25 bp, Mus musculus
aagctggagtcttccgagagccgga

SEQ ID NO: 74466 - DNA, 25 bp, Mus musculus
aagctggcagcatcgcagatcgaga

SEQ ID NO: 74467 - DNA, 25 bp, Mus musculus
aagctggctaccatggcgtgctcag

SEQ ID NO: 74468 - DNA, 25 bp, Mus musculus
aagctggctgcccacgaggccatca

SEQ ID NO: 74469 - DNA, 25 bp, Mus musculus
aagctgggcaccgacttctcatgga

SEQ ID NO: 74470 - DNA, 25 bp, Mus musculus
aagctggtgaagcaccgcgtgcggc

SEQ ID NO: 74471 - DNA, 25 bp, Mus musculus
aagctgtcccctctcagaggagagt

SEQ ID NO: 74472 - DNA, 25 bp, Mus musculus
aagctgtgccccacctggaggcggc

SEQ ID NO: 74473 - DNA, 25 bp, Mus musculus
aagctgtgctctctcgaagtcccag

SEQ ID NO: 74474 - DNA, 25 bp, Mus musculus
aagctgtgggcctccgcttttggtg

SEQ ID NO: 74475 - DNA, 25 bp, Mus musculus
aagctgttcagatctagggctggac

SEQ ID NO: 74476 - DNA, 25 bp, Mus musculus
aagctgttgctcagcttcggtggcg

SEQ ID NO: 74477 - DNA, 25 bp, Mus musculus
aagcttagtcgggagaactttccag

SEQ ID NO: 74478 - DNA, 25 bp, Mus musculus
aagcttcaaaactggcacggcgcaa

SEQ ID NO: 74479 - DNA, 25 bp, Mus musculus
aagcttcagaacctggaccgggcag

SEQ ID NO: 74480 - DNA, 25 bp, Mus musculus
aagcttctggcttcctgttcagcag

SEQ ID NO: 74481 - DNA, 25 bp, Mus musculus
aagcttgccaaagagcgccgagaag

SEQ ID NO: 74482 - DNA, 25 bp, Mus musculus
aagcttgctttgaccgagcctcaga

SEQ ID NO: 74483 - DNA, 25 bp, Mus musculus
aagcttggctgatagaggccctgcc

SEQ ID NO: 74484 - DNA, 25 bp, Mus musculus
aagctttaagttggccgtgttctgg

SEQ ID NO: 74485 - DNA, 25 bp, Mus musculus
aagctttcccacagcccaagatggc

SEQ ID NO: 74486 - DNA, 25 bp, Mus musculus
aagctttgcaacaccctctggagga

SEQ ID NO: 74487 - DNA, 25 bp, Mus musculus
aagctttggtcgctctcgtgaggac

SEQ ID NO: 74488 - DNA, 25 bp, Mus musculus
aagctttgtgcaagggtaaacccat

SEQ ID NO: 74489 - DNA, 25 bp, Mus musculus
aagcttttgtcaactcctagtccag

SEQ ID NO: 74490 - DNA, 25 bp, Mus musculus
aaggaaaacactgagacacctgcgg

SEQ ID NO: 74491 - DNA, 25 bp, Mus musculus
aaggaaaatctggttggtgtctcac

SEQ ID NO: 74492 - DNA, 25 bp, Mus musculus
aaggaaaccccgtgctggattgaga

SEQ ID NO: 74493 - DNA, 25 bp, Mus musculus
aaggaaacgccatggccagatccgg

SEQ ID NO: 74494 - DNA, 25 bp, Mus musculus
aaggaaagcgcgaggagacgccgcc

SEQ ID NO: 74495 - DNA, 25 bp, Mus musculus
aaggaaatgggctcactgctcgcgt

SEQ ID NO: 74496 - DNA, 25 bp, Mus musculus
aaggaacagggtggcagagtaccac

SEQ ID NO: 74497 - DNA, 25 bp, Mus musculus
aaggaacccgccatcagcttggaat

SEQ ID NO: 74498 - DNA, 25 bp, Mus musculus
aaggaacctggaactagctctctcg

SEQ ID NO: 74499 - DNA, 25 bp, Mus musculus
aaggaactcgatggtgaacttgctc

SEQ ID NO: 74500 - DNA, 25 bp, Mus musculus
aaggaagcccagaacacgtgtgcaa

SEQ ID NO: 74501 - DNA, 25 bp, Mus musculus
aaggaagccttcagtgcacgttggg

SEQ ID NO: 74502 - DNA, 25 bp, Mus musculus
aaggaagctcgtcagcccagtgcat

SEQ ID NO: 74503 - DNA, 25 bp, Mus musculus
aaggaagtcccacagcactgagagc

SEQ ID NO: 74504 - DNA, 25 bp, Mus musculus
aaggaatcgccttgctcgtcagaac

SEQ ID NO: 74505 - DNA, 25 bp, Mus musculus
aaggaatgtcctctcactggccaag

SEQ ID NO: 74506 - DNA, 25 bp, Mus musculus
aaggacaaggagaagccgaagccca

SEQ ID NO: 74507 - DNA, 25 bp, Mus musculus
aaggacagatagagaagcagccgcc

SEQ ID NO: 74508 - DNA, 25 bp, Mus musculus
aaggacaggccaccccatttgatgc

SEQ ID NO: 74509 - DNA, 25 bp, Mus musculus
aaggacatccacgtaatgtgccagg

SEQ ID NO: 74510 - DNA, 25 bp, Mus musculus
aaggacatgccaaccaggctgggaa

SEQ ID NO: 74511 - DNA, 25 bp, Mus musculus
aaggacattcccctcggcatcaggg

SEQ ID NO: 74512 - DNA, 25 bp, Mus musculus
aaggaccacggagattgtttcttgc

SEQ ID NO: 74513 - DNA, 25 bp, Mus musculus
aaggaccactgaggccttcagcggg

SEQ ID NO: 74514 - DNA, 25 bp, Mus musculus
aaggaccattgcgacaacagcggca

SEQ ID NO: 74515 - DNA, 25 bp, Mus musculus
aaggacccgcttttctcacatggca

SEQ ID NO: 74516 - DNA, 25 bp, Mus musculus
aaggacctacctttgccccatggag

SEQ ID NO: 74517 - DNA, 25 bp, Mus musculus
aaggacctcttcgactgggtggcag

SEQ ID NO: 74518 - DNA, 25 bp, Mus musculus
aaggacgttcacaggaggctacaga

SEQ ID NO: 74519 - DNA, 25 bp, Mus musculus
aaggactacagggttatcaaggaga

SEQ ID NO: 74520 - DNA, 25 bp, Mus musculus
aaggactactgctacagtgcccgga

SEQ ID NO: 74521 - DNA, 25 bp, Mus musculus
aaggactatgtccaggctaaccccg

SEQ ID NO: 74522 - DNA, 25 bp, Mus musculus
aaggactctgctcttctgttggctg

SEQ ID NO: 74523 - DNA, 25 bp, Mus musculus
aaggactgcatgctgaccaaccctg

SEQ ID NO: 74524 - DNA, 25 bp, Mus musculus
aaggactggcactgggcactagact

SEQ ID NO: 74525 - DNA, 25 bp, Mus musculus
aaggactggtccatgagaaggcccg

SEQ ID NO: 74526 - DNA, 25 bp, Mus musculus
aaggacttcaatgtgcccctctcta

SEQ ID NO: 74527 - DNA, 25 bp, Mus musculus
aaggacttctcttccacagtggccg

SEQ ID NO: 74528 - DNA, 25 bp, Mus musculus
aaggagaacgagttttacatgcagc

SEQ ID NO: 74529 - DNA, 25 bp, Mus musculus
aaggagaatgccatcgaccgcgcgg

SEQ ID NO: 74530 - DNA, 25 bp, Mus musculus
aaggagaattgtcacctggagcaga

SEQ ID NO: 74531 - DNA, 25 bp, Mus musculus
aaggagacaacccagatgaaccgca

SEQ ID NO: 74532 - DNA, 25 bp, Mus musculus
aaggagacatcctgagaatccggga

SEQ ID NO: 74533 - DNA, 25 bp, Mus musculus
aaggagagagaggtgcaccagaaac

SEQ ID NO: 74534 - DNA, 25 bp, Mus musculus
aaggagagccttatgagccggaaga

SEQ ID NO: 74535 - DNA, 25 bp, Mus musculus
aaggagagctcgtccagcctctcgg

SEQ ID NO: 74536 - DNA, 25 bp, Mus musculus
aaggagatacgcttctacaccgcag

SEQ ID NO: 74537 - DNA, 25 bp, Mus musculus
aaggagatcattggccttgaaggtg

SEQ ID NO: 74538 - DNA, 25 bp, Mus musculus
aaggagatccagctgatgcatcgcg

SEQ ID NO: 74539 - DNA, 25 bp, Mus musculus
aaggagatgtcattcggctgtagtc

SEQ ID NO: 74540 - DNA, 25 bp, Mus musculus
aaggagcaccctcggaccacacttc

SEQ ID NO: 74541 - DNA, 25 bp, Mus musculus
aaggagcacgagacgggacgcccct

SEQ ID NO: 74542 - DNA, 25 bp, Mus musculus
aaggagcatgttgggcctccgtcat

SEQ ID NO: 74543 - DNA, 25 bp, Mus musculus
aaggagccattcttccacgggcagg

SEQ ID NO: 74544 - DNA, 25 bp, Mus musculus
aaggagcccagtagtgacacgagcg

SEQ ID NO: 74545 - DNA, 25 bp, Mus musculus
aaggagcccgcacggacggtggtgg

SEQ ID NO: 74546 - DNA, 25 bp, Mus musculus
aaggagctgaccacgagaacatgac

SEQ ID NO: 74547 - DNA, 25 bp, Mus musculus
aaggagctggcaagactggaactac

SEQ ID NO: 74548 - DNA, 25 bp, Mus musculus
aaggagctggctcacatccacaagg

SEQ ID NO: 74549 - DNA, 25 bp, Mus musculus
aaggagctgggaatgctgatcccca

SEQ ID NO: 74550 - DNA, 25 bp, Mus musculus
aaggaggagtttgccactgtccact

SEQ ID NO: 74551 - DNA, 25 bp, Mus musculus
aaggaggcgctctatcatcaactgg

SEQ ID NO: 74552 - DNA, 25 bp, Mus musculus
aaggaggcgtacgacagcacgctac

SEQ ID NO: 74553 - DNA, 25 bp, Mus musculus
aaggaggctttcagggccgctgcaa

SEQ ID NO: 74554 - DNA, 25 bp, Mus musculus
aaggagggtccacgtctcatggcct

SEQ ID NO: 74555 - DNA, 25 bp, Mus musculus
aaggaggtgaccgagttttgcaaca

SEQ ID NO: 74556 - DNA, 25 bp, Mus musculus
aaggagtcgtacaaagggcacagct

SEQ ID NO: 74557 - DNA, 25 bp, Mus musculus
aaggagtgggccttgattccacagg

SEQ ID NO: 74558 - DNA, 25 bp, Mus musculus
aaggagttgtatctcccaggagtgc

SEQ ID NO: 74559 - DNA, 25 bp, Mus musculus
aaggataaatatgcaaacttcagca

SEQ ID NO: 74560 - DNA, 25 bp, Mus musculus
aaggatccaccacctttttgacagg

SEQ ID NO: 74561 - DNA, 25 bp, Mus musculus
aaggatcgcctttgttctcaccaga

SEQ ID NO: 74562 - DNA, 25 bp, Mus musculus
aaggatcgggagcaacatatgttca

SEQ ID NO: 74563 - DNA, 25 bp, Mus musculus
aaggatctgccctgtcacgcgaggg

SEQ ID NO: 74564 - DNA, 25 bp, Mus musculus
aaggatctgtttcccctgcccagta

SEQ ID NO: 74565 - DNA, 25 bp, Mus musculus
aaggatgcagagagcaagcccggaa

SEQ ID NO: 74566 - DNA, 25 bp, Mus musculus
aaggatgcccgcactgtgaaactgc

SEQ ID NO: 74567 - DNA, 25 bp, Mus musculus
aaggatgctgagtcccgagcgccta

SEQ ID NO: 74568 - DNA, 25 bp, Mus musculus
aaggatggattcacactgcagggac

SEQ ID NO: 74569 - DNA, 25 bp, Mus musculus
aaggatggcatctctgtcaagggtg

SEQ ID NO: 74570 - DNA, 25 bp, Mus musculus
aaggatggtcctccacatcaggtgc

SEQ ID NO: 74571 - DNA, 25 bp, Mus musculus
aaggatgtcactctccgggacgagc

SEQ ID NO: 74572 - DNA, 25 bp, Mus musculus
aaggattatggcgtggcttccctca

SEQ ID NO: 74573 - DNA, 25 bp, Mus musculus
aaggatttagtgatgcggagattcg

SEQ ID NO: 74574 - DNA, 25 bp, Mus musculus
aaggattttagcagtctttgcgaca

SEQ ID NO: 74575 - DNA, 25 bp, Mus musculus
aaggcaagaagcaggacccgaaact

SEQ ID NO: 74576 - DNA, 25 bp, Mus musculus
aaggcaagcggtgcagtctcttcct

SEQ ID NO: 74577 - DNA, 25 bp, Mus musculus
aaggcaaggatgcacctgctgtgtt

SEQ ID NO: 74578 - DNA, 25 bp, Mus musculus
aaggcacaatgggttgggccaagcc

SEQ ID NO: 74579 - DNA, 25 bp, Mus musculus
aaggcacagagaggatggaagatca

SEQ ID NO: 74580 - DNA, 25 bp, Mus musculus
aaggcaccactctcacagtctcctc

SEQ ID NO: 74581 - DNA, 25 bp, Mus musculus
aaggcactgggactttgctggtcac

SEQ ID NO: 74582 - DNA, 25 bp, Mus musculus
aaggcagaatgtcctcagtgttgtc

SEQ ID NO: 74583 - DNA, 25 bp, Mus musculus
aaggcagaggtctgaaggctacgaa

SEQ ID NO: 74584 - DNA, 25 bp, Mus musculus
aaggcagctcgcactacaggatgaa

SEQ ID NO: 74585 - DNA, 25 bp, Mus musculus
aaggcagggccgtgaagattcgacc

SEQ ID NO: 74586 - DNA, 25 bp, Mus musculus
aaggcatcccgaagcccatggtgat

SEQ ID NO: 74587 - DNA, 25 bp, Mus musculus
aaggcattgtcacgtgcttgagagc

SEQ ID NO: 74588 - DNA, 25 bp, Mus musculus
aaggccaaagactctggaaccagcc

SEQ ID NO: 74589 - DNA, 25 bp, Mus musculus
aaggccaacaaggagcacgtcctgc

SEQ ID NO: 74590 - DNA, 25 bp, Mus musculus
aaggccacgggctgcttctgatccc

SEQ ID NO: 74591 - DNA, 25 bp, Mus musculus
aaggccattggagtgctgaccagcg

SEQ ID NO: 74592 - DNA, 25 bp, Mus musculus
aaggcccagtttgcacggcggagaa

SEQ ID NO: 74593 - DNA, 25 bp, Mus musculus
aaggcccctgggatgaacagtctgg

SEQ ID NO: 74594 - DNA, 25 bp, Mus musculus
aaggcccgagcacctcggaggtggc

SEQ ID NO: 74595 - DNA, 25 bp, Mus musculus
aaggccctggagctcttccggaatg

SEQ ID NO: 74596 - DNA, 25 bp, Mus musculus
aaggccgtttcgatctgtcgtgtga

SEQ ID NO: 74597 - DNA, 25 bp, Mus musculus
aaggccgtttgctgcggcgcacgct

SEQ ID NO: 74598 - DNA, 25 bp, Mus musculus
aaggcctagcaagcggtattcccga

SEQ ID NO: 74599 - DNA, 25 bp, Mus musculus
aaggcctattctggacggtacaggg

SEQ ID NO: 74600 - DNA, 25 bp, Mus musculus
aaggcctccagtctcctagctgcag

SEQ ID NO: 74601 - DNA, 25 bp, Mus musculus
aaggcctccgagactttgacacgct

SEQ ID NO: 74602 - DNA, 25 bp, Mus musculus
aaggcctctgtggactacatccgga

SEQ ID NO: 74603 - DNA, 25 bp, Mus musculus
aaggcctggatcaatgcagccacgc

SEQ ID NO: 74604 - DNA, 25 bp, Mus musculus
aaggcctggatgtctcactactgag

SEQ ID NO: 74605 - DNA, 25 bp, Mus musculus
aaggccttcctgtgcggtaaaaatg

SEQ ID NO: 74606 - DNA, 25 bp, Mus musculus
aaggccttcgtactggatgtgatca

SEQ ID NO: 74607 - DNA, 25 bp, Mus musculus
aaggccttcgtgtcccggcattcag

SEQ ID NO: 74608 - DNA, 25 bp, Mus musculus
aaggccttcgttgcttcaggattgc

SEQ ID NO: 74609 - DNA, 25 bp, Mus musculus
aaggccttctttgccttggtagcca

SEQ ID NO: 74610 - DNA, 25 bp, Mus musculus
aaggccttgaactacccatgctggg

SEQ ID NO: 74611 - DNA, 25 bp, Mus musculus
aaggccttgcggactgtgtatgacc

SEQ ID NO: 74612 - DNA, 25 bp, Mus musculus
aaggcgacttgctgcctcgcagaag

SEQ ID NO: 74613 - DNA, 25 bp, Mus musculus
aaggcgagggagctttcagacttca

SEQ ID NO: 74614 - DNA, 25 bp, Mus musculus
aaggcgccactcctgtcttgtaatg

SEQ ID NO: 74615 - DNA, 25 bp, Mus musculus
aaggcgccctctgcttggactggtg

SEQ ID NO: 74616 - DNA, 25 bp, Mus musculus
aaggcgccctggagcgttcgctgcc

SEQ ID NO: 74617 - DNA, 25 bp, Mus musculus
aaggcgcctgagagtcgccgctgcc

SEQ ID NO: 74618 - DNA, 25 bp, Mus musculus
aaggcgcgccggctcttttgtctga

SEQ ID NO: 74619 - DNA, 25 bp, Mus musculus
aaggcgctggcggttgaggttgctc

SEQ ID NO: 74620 - DNA, 25 bp, Mus musculus
aaggcgcttcgctcatcgtggagtg

SEQ ID NO: 74621 - DNA, 25 bp, Mus musculus
aaggcggcgttcagcacatcagctg

SEQ ID NO: 74622 - DNA, 25 bp, Mus musculus
aaggctacagctccatgtgcggtca

SEQ ID NO: 74623 - DNA, 25 bp, Mus musculus
aaggctagcttggttcatttactgg

SEQ ID NO: 74624 - DNA, 25 bp, Mus musculus
aaggctcatcgacctcatggccaac

SEQ ID NO: 74625 - DNA, 25 bp, Mus musculus
aaggctcatctcttcatgtggtagg

SEQ ID NO: 74626 - DNA, 25 bp, Mus musculus
aaggctcccttgtgtaccccatcga

SEQ ID NO: 74627 - DNA, 25 bp, Mus musculus
aaggctcctatcctcattgccacgg

SEQ ID NO: 74628 - DNA, 25 bp, Mus musculus
aaggctcgatcagaggactcagggc

SEQ ID NO: 74629 - DNA, 25 bp, Mus musculus
aaggctcgctcctactggaactgga

SEQ ID NO: 74630 - DNA, 25 bp, Mus musculus
aaggctctactggtgaagagagaca

SEQ ID NO: 74631 - DNA, 25 bp, Mus musculus
aaggctctgaggagtcagctggaca

SEQ ID NO: 74632 - DNA, 25 bp, Mus musculus
aaggctctgcagtggcacccagaca

SEQ ID NO: 74633 - DNA, 25 bp, Mus musculus
aaggctctgctcaacgtggtggaca

SEQ ID NO: 74634 - DNA, 25 bp, Mus musculus
aaggctctggcagcagatgacggca

SEQ ID NO: 74635 - DNA, 25 bp, Mus musculus
aaggctcttaactgcttccgcggaa

SEQ ID NO: 74636 - DNA, 25 bp, Mus musculus
aaggctgaatggactaaacatgaag

SEQ ID NO: 74637 - DNA, 25 bp, Mus musculus
aaggctgagctgacgactctccagt

SEQ ID NO: 74638 - DNA, 25 bp, Mus musculus
aaggctgccattcaagatcgctccg

SEQ ID NO: 74639 - DNA, 25 bp, Mus musculus
aaggctgcttccattgctcccggtg

SEQ ID NO: 74640 - DNA, 25 bp, Mus musculus
aaggctggcagaactggcacgccgg

SEQ ID NO: 74641 - DNA, 25 bp, Mus musculus
aaggctggctccacccagaggacag

SEQ ID NO: 74642 - DNA, 25 bp, Mus musculus
aaggctgggccctgcgtgatcaatg

SEQ ID NO: 74643 - DNA, 25 bp, Mus musculus
aaggctgtctttggaggctggaccc

SEQ ID NO: 74644 - DNA, 25 bp, Mus musculus
aaggctgtgcgcgtgcttctcaaca

SEQ ID NO: 74645 - DNA, 25 bp, Mus musculus
aaggctgtgggtctgacgtctccca

SEQ ID NO: 74646 - DNA, 25 bp, Mus musculus
aaggctgtgtcccggacctcctcgg

SEQ ID NO: 74647 - DNA, 25 bp, Mus musculus
aaggcttccaaaccacacaaggtgg

SEQ ID NO: 74648 - DNA, 25 bp, Mus musculus
aaggcttccctagaggagctgcagt

SEQ ID NO: 74649 - DNA, 25 bp, Mus musculus
aaggcttgcccgtctacaacaagag

SEQ ID NO: 74650 - DNA, 25 bp, Mus musculus
aaggcttgccttcggaatgcagatc

SEQ ID NO: 74651 - DNA, 25 bp, Mus musculus
aaggcttgctgcttgacttctaaag

SEQ ID NO: 74652 - DNA, 25 bp, Mus musculus
aaggcttggaatgcagtgtgtcctc

SEQ ID NO: 74653 - DNA, 25 bp, Mus musculus
aaggcttgtattttcaacagagttc

SEQ ID NO: 74654 - DNA, 25 bp, Mus musculus
aaggctttgcatttaatcatttcca

SEQ ID NO: 74655 - DNA, 25 bp, Mus musculus
aaggctttggtagctcctgcctcag

SEQ ID NO: 74656 - DNA, 25 bp, Mus musculus
aaggctttgtggtgcgagatgctcc

SEQ ID NO: 74657 - DNA, 25 bp, Mus musculus
aagggaacaccaagaagcgcatcgg

SEQ ID NO: 74658 - DNA, 25 bp, Mus musculus
aagggaagatgatgtcctggcactc

SEQ ID NO: 74659 - DNA, 25 bp, Mus musculus
aagggactaccactctgtccgccgg

SEQ ID NO: 74660 - DNA, 25 bp, Mus musculus
aagggactccctgaagctctgtggc

SEQ ID NO: 74661 - DNA, 25 bp, Mus musculus
aagggagagccagtctttacaagtc

SEQ ID NO: 74662 - DNA, 25 bp, Mus musculus
aagggagcctgcacttggacctggc

SEQ ID NO: 74663 - DNA, 25 bp, Mus musculus
aagggagctgcccactcattctgac

SEQ ID NO: 74664 - DNA, 25 bp, Mus musculus
aagggattagctcatctcgccgcga

SEQ ID NO: 74665 - DNA, 25 bp, Mus musculus
aagggattgaggttcgcctggtcaa

SEQ ID NO: 74666 - DNA, 25 bp, Mus musculus
aagggcaagagcgtcgtggttctca

SEQ ID NO: 74667 - DNA, 25 bp, Mus musculus
aagggcagttttctctataggcaca

SEQ ID NO: 74668 - DNA, 25 bp, Mus musculus
aagggcattctttcagaagcaccgg

SEQ ID NO: 74669 - DNA, 25 bp, Mus musculus
aagggcatttatcaacggcactggc

SEQ ID NO: 74670 - DNA, 25 bp, Mus musculus
aagggccgtgctctgcatcaggaaa

SEQ ID NO: 74671 - DNA, 25 bp, Mus musculus
aagggcgtgaagaccgtgacctctg

SEQ ID NO: 74672 - DNA, 25 bp, Mus musculus
aagggctctccctaggtggatcgga

SEQ ID NO: 74673 - DNA, 25 bp, Mus musculus
aagggcttagcttcccgctgctggg

SEQ ID NO: 74674 - DNA, 25 bp, Mus musculus
aagggcttcaccacagcgagcagta

SEQ ID NO: 74675 - DNA, 25 bp, Mus musculus
aagggcttctactgcctgcgggaca

SEQ ID NO: 74676 - DNA, 25 bp, Mus musculus
aagggcttctgctcaaccatcactc

SEQ ID NO: 74677 - DNA, 25 bp, Mus musculus
aagggctttaccacggcagtccagt

SEQ ID NO: 74678 - DNA, 25 bp, Mus musculus
aagggggtctccagccaacaccgag

SEQ ID NO: 74679 - DNA, 25 bp, Mus musculus
aagggtaacatcaaattagcaaagg

SEQ ID NO: 74680 - DNA, 25 bp, Mus musculus
aagggtgctccaaggtcaataaagc

SEQ ID NO: 74681 - DNA, 25 bp, Mus musculus
aagggtgtgtagaacctctgcggcc

SEQ ID NO: 74682 - DNA, 25 bp, Mus musculus
aagggttaatatgcagccaggctgc

SEQ ID NO: 74683 - DNA, 25 bp, Mus musculus
aagggttactcctgtggtgtcagag

SEQ ID NO: 74684 - DNA, 25 bp, Mus musculus
aagggttcagctttccagcgtgcac

SEQ ID NO: 74685 - DNA, 25 bp, Mus musculus
aaggtattagcggattgttactgaa

SEQ ID NO: 74686 - DNA, 25 bp, Mus musculus
aaggtcaaggtctgtctgggctcca

SEQ ID NO: 74687 - DNA, 25 bp, Mus musculus
aaggtcactccttccaggctgaggg

SEQ ID NO: 74688 - DNA, 25 bp, Mus musculus
aaggtccagcgtccccgctgagtga

SEQ ID NO: 74689 - DNA, 25 bp, Mus musculus
aaggtcccagagagatagtttatca

SEQ ID NO: 74690 - DNA, 25 bp, Mus musculus
aaggtccctgggttctcgtgggcat

SEQ ID NO: 74691 - DNA, 25 bp, Mus musculus
aaggtcctaaaaaactgagctggca

SEQ ID NO: 74692 - DNA, 25 bp, Mus musculus
aaggtcctccgtatagcccactgga

SEQ ID NO: 74693 - DNA, 25 bp, Mus musculus
aaggtcgggaccttccggcagatgc

SEQ ID NO: 74694 - DNA, 25 bp, Mus musculus
aaggtctacaccagaccaggctgta

SEQ ID NO: 74695 - DNA, 25 bp, Mus musculus
aaggtcttccatctgcaggctgcgt

SEQ ID NO: 74696 - DNA, 25 bp, Mus musculus
aaggtgaatgattgctgcccgtccc

SEQ ID NO: 74697 - DNA, 25 bp, Mus musculus
aaggtgacacacattctttctgtgc

SEQ ID NO: 74698 - DNA, 25 bp, Mus musculus
aaggtgagatgatccgacagcccag

SEQ ID NO: 74699 - DNA, 25 bp, Mus musculus
aaggtgcaaaccagggacatatccc

SEQ ID NO: 74700 - DNA, 25 bp, Mus musculus
aaggtgccacacctagagactccgg

SEQ ID NO: 74701 - DNA, 25 bp, Mus musculus
aaggtgccatcagcctcggattcag

SEQ ID NO: 74702 - DNA, 25 bp, Mus musculus
aaggtgcccgctgtgcagcctgaaa

SEQ ID NO: 74703 - DNA, 25 bp, Mus musculus
aaggtgcctcttcgcttgtctgtgg

SEQ ID NO: 74704 - DNA, 25 bp, Mus musculus
aaggtgcgcctgatccgtgctagca

SEQ ID NO: 74705 - DNA, 25 bp, Mus musculus
aaggtgctcagcctcctagtgcaga

SEQ ID NO: 74706 - DNA, 25 bp, Mus musculus
aaggtggaccagagttcagaaagca

SEQ ID NO: 74707 - DNA, 25 bp, Mus musculus
aaggtggacccgtttgatgtgctga

SEQ ID NO: 74708 - DNA, 25 bp, Mus musculus
aaggtggcagcccaaaactgtcgca

SEQ ID NO: 74709 - DNA, 25 bp, Mus musculus
aaggtggcccataaacaagtcgccg

SEQ ID NO: 74710 - DNA, 25 bp, Mus musculus
aaggtggcctaccagtcctacgaga

SEQ ID NO: 74711 - DNA, 25 bp, Mus musculus
aaggtggcgctaaagagaagatctc

SEQ ID NO: 74712 - DNA, 25 bp, Mus musculus
aaggtggcgtatgaccgcagtccca

SEQ ID NO: 74713 - DNA, 25 bp, Mus musculus
aaggtggtacccaaagccatgagcc

SEQ ID NO: 74714 - DNA, 25 bp, Mus musculus
aaggtggtgtagagtcggcatttca

SEQ ID NO: 74715 - DNA, 25 bp, Mus musculus
aaggtgtacagcgatgcacagccac

SEQ ID NO: 74716 - DNA, 25 bp, Mus musculus
aaggtgtacctggagccggagcaca

SEQ ID NO: 74717 - DNA, 25 bp, Mus musculus
aaggtgtatctcaaagtgcggccgg

SEQ ID NO: 74718 - DNA, 25 bp, Mus musculus
aaggtgtctccggttccatccagga

SEQ ID NO: 74719 - DNA, 25 bp, Mus musculus
aaggtgttctgcatgttctacgcgc

SEQ ID NO: 74720 - DNA, 25 bp, Mus musculus
aaggttaagcttgactagacgccac

SEQ ID NO: 74721 - DNA, 25 bp, Mus musculus
aaggttatcagaaatgtgtccgccc

SEQ ID NO: 74722 - DNA, 25 bp, Mus musculus
aaggttcacataccacgtcctggag

SEQ ID NO: 74723 - DNA, 25 bp, Mus musculus
aaggttccagcgaggcagaaaacac

SEQ ID NO: 74724 - DNA, 25 bp, Mus musculus
aaggttcgcccttggaaatggatgc

SEQ ID NO: 74725 - DNA, 25 bp, Mus musculus
aaggttgtctgaaggtcaagaggaa

SEQ ID NO: 74726 - DNA, 25 bp, Mus musculus
aaggttttactgtgatgaacgaggc

SEQ ID NO: 74727 - DNA, 25 bp, Mus musculus
aaggttttgcatcaacagtgtggcc

SEQ ID NO: 74728 - DNA, 25 bp, Mus musculus
aagtaaagcaggatcctgaccaggg

SEQ ID NO: 74729 - DNA, 25 bp, Mus musculus
aagtaaatggatggaaaatctgata

SEQ ID NO: 74730 - DNA, 25 bp, Mus musculus
aagtaaccgcttgtgatgtctccgc

SEQ ID NO: 74731 - DNA, 25 bp, Mus musculus
aagtaactttaggtggaagatgcca

SEQ ID NO: 74732 - DNA, 25 bp, Mus musculus
aagtaatgagtgagatcaagaaaga

SEQ ID NO: 74733 - DNA, 25 bp, Mus musculus
aagtaatgcgtcttgggaacaccca

SEQ ID NO: 74734 - DNA, 25 bp, Mus musculus
aagtaatggataacagaaaagagcc

SEQ ID NO: 74735 - DNA, 25 bp, Mus musculus
aagtacacatgcatgtcactaatat

SEQ ID NO: 74736 - DNA, 25 bp, Mus musculus
aagtacatcgtttctgcctctggag

SEQ ID NO: 74737 - DNA, 25 bp, Mus musculus
aagtacatgattggccgtcttcgac

SEQ ID NO: 74738 - DNA, 25 bp, Mus musculus
aagtaccatgcaaggctctcccaga

SEQ ID NO: 74739 - DNA, 25 bp, Mus musculus
aagtaccgcagcctcaatgacctgg

SEQ ID NO: 74740 - DNA, 25 bp, Mus musculus
aagtacctgatggtgccagcgttgc

SEQ ID NO: 74741 - DNA, 25 bp, Mus musculus
aagtacgcaacggaagaggccctga

SEQ ID NO: 74742 - DNA, 25 bp, Mus musculus
aagtacgcttggctttccacaggga

SEQ ID NO: 74743 - DNA, 25 bp, Mus musculus
aagtacgggctgaccttggacccag

SEQ ID NO: 74744 - DNA, 25 bp, Mus musculus
aagtacgttaacgtgggagatctag

SEQ ID NO: 74745 - DNA, 25 bp, Mus musculus
aagtactcgggctcccagcttctgc

SEQ ID NO: 74746 - DNA, 25 bp, Mus musculus
aagtacttgtggatgagggctcagc

SEQ ID NO: 74747 - DNA, 25 bp, Mus musculus
aagtagacgcgtaggccaccggacg

SEQ ID NO: 74748 - DNA, 25 bp, Mus musculus
aagtagagcaagtccccattgtgga

SEQ ID NO: 74749 - DNA, 25 bp, Mus musculus
aagtagcggctcatcaggcttcagg

SEQ ID NO: 74750 - DNA, 25 bp, Mus musculus
aagtagcgtctcttcagtgggtgcc

SEQ ID NO: 74751 - DNA, 25 bp, Mus musculus
aagtagctcttcaagggccaagggt

SEQ ID NO: 74752 - DNA, 25 bp, Mus musculus
aagtagttcctaggctcagctcggg

SEQ ID NO: 74753 - DNA, 25 bp, Mus musculus
aagtagttcgcctctcctgtcgttg

SEQ ID NO: 74754 - DNA, 25 bp, Mus musculus
aagtatctgctgctcggcttcaacc

SEQ ID NO: 74755 - DNA, 25 bp, Mus musculus
aagtatctttgtgcatccagagccc

SEQ ID NO: 74756 - DNA, 25 bp, Mus musculus
aagtatgaccgccttcagaacaaga

SEQ ID NO: 74757 - DNA, 25 bp, Mus musculus
aagtatgctccagttgttgctccga

SEQ ID NO: 74758 - DNA, 25 bp, Mus musculus
aagtatgtctccgtatcagagccag

SEQ ID NO: 74759 - DNA, 25 bp, Mus musculus
aagtatttatcccagcatggaccag

SEQ ID NO: 74760 - DNA, 25 bp, Mus musculus
aagtcaaatcacattagcaggcagc

SEQ ID NO: 74761 - DNA, 25 bp, Mus musculus
aagtcaacctctttcctggcctgag

SEQ ID NO: 74762 - DNA, 25 bp, Mus musculus
aagtcaagacccagcattggtggcc

SEQ ID NO: 74763 - DNA, 25 bp, Mus musculus
aagtcaagctccgtagtatccacag

SEQ ID NO: 74764 - DNA, 25 bp, Mus musculus
aagtcaagtcttgggttatagatca

SEQ ID NO: 74765 - DNA, 25 bp, Mus musculus
aagtcaatatcatcccggtcatcgg

SEQ ID NO: 74766 - DNA, 25 bp, Mus musculus
aagtcacaggcatctgcgatcccag

SEQ ID NO: 74767 - DNA, 25 bp, Mus musculus
aagtcaccaggtagcttccatgagg

SEQ ID NO: 74768 - DNA, 25 bp, Mus musculus
aagtcaccgtctcggccagtgagaa

SEQ ID NO: 74769 - DNA, 25 bp, Mus musculus
aagtcaccgtggagctgagtagcca

SEQ ID NO: 74770 - DNA, 25 bp, Mus musculus
aagtcacggtctcgagctctcagct

SEQ ID NO: 74771 - DNA, 25 bp, Mus musculus
aagtcactgcttactcagcaccaga

SEQ ID NO: 74772 - DNA, 25 bp, Mus musculus
aagtcagaacttagagaagccctcg

SEQ ID NO: 74773 - DNA, 25 bp, Mus musculus
aagtcagaccttgccgatttccggg

SEQ ID NO: 74774 - DNA, 25 bp, Mus musculus
aagtcagatccaagctgtcccctct

SEQ ID NO: 74775 - DNA, 25 bp, Mus musculus
aagtcagcatcatcgagagaggcgc

SEQ ID NO: 74776 - DNA, 25 bp, Mus musculus
aagtcagccagtgtatcagtcagca

SEQ ID NO: 74777 - DNA, 25 bp, Mus musculus
aagtcagcctgtggataaccgagga

SEQ ID NO: 74778 - DNA, 25 bp, Mus musculus
aagtcagctgccttcactgtggaaa

SEQ ID NO: 74779 - DNA, 25 bp, Mus musculus
aagtcagctggcttcttctcatggc

SEQ ID NO: 74780 - DNA, 25 bp, Mus musculus
aagtcagtcacctgagtgccaaggg

SEQ ID NO: 74781 - DNA, 25 bp, Mus musculus
aagtcatcgggctaccactatggcg

SEQ ID NO: 74782 - DNA, 25 bp, Mus musculus
aagtcatctgcaccgtctgcctggg

SEQ ID NO: 74783 - DNA, 25 bp, Mus musculus
aagtccaactcttactttgagtttg

SEQ ID NO: 74784 - DNA, 25 bp, Mus musculus
aagtccagagaatggtcactgccca

SEQ ID NO: 74785 - DNA, 25 bp, Mus musculus
aagtccagccagctcggcgaggact

SEQ ID NO: 74786 - DNA, 25 bp, Mus musculus
aagtccagcgaaagagacccaaggg

SEQ ID NO: 74787 - DNA, 25 bp, Mus musculus
aagtccatgcctcatctgcctggta

SEQ ID NO: 74788 - DNA, 25 bp, Mus musculus
aagtcccagcccagtgaagtacaga

SEQ ID NO: 74789 - DNA, 25 bp, Mus musculus
aagtccccaaagatgtaaccgtgcg

SEQ ID NO: 74790 - DNA, 25 bp, Mus musculus
aagtccccagcagtttgcttggccg

SEQ ID NO: 74791 - DNA, 25 bp, Mus musculus
aagtccctgctggagcattctttgc

SEQ ID NO: 74792 - DNA, 25 bp, Mus musculus
aagtccgagctcagaattcccatgg

SEQ ID NO: 74793 - DNA, 25 bp, Mus musculus
aagtccgagggttgtgtatcaagtc

SEQ ID NO: 74794 - DNA, 25 bp, Mus musculus
aagtccggcacacagctggcagaag

SEQ ID NO: 74795 - DNA, 25 bp, Mus musculus
aagtccgggcacaggatgagaataa

SEQ ID NO: 74796 - DNA, 25 bp, Mus musculus
aagtcctgtttgctgtggtgttcac

SEQ ID NO: 74797 - DNA, 25 bp, Mus musculus
aagtccttgcagagggattttgcag

SEQ ID NO: 74798 - DNA, 25 bp, Mus musculus
aagtcgccgcagacttgctcgacag

SEQ ID NO: 74799 - DNA, 25 bp, Mus musculus
aagtcgcctccgtcccgcaagaagg

SEQ ID NO: 74800 - DNA, 25 bp, Mus musculus
aagtcgcgctctctggaccaggaga

SEQ ID NO: 74801 - DNA, 25 bp, Mus musculus
aagtcgctcagttgacccaggtgaa

SEQ ID NO: 74802 - DNA, 25 bp, Mus musculus
aagtcggacacccactgtggctgcc

SEQ ID NO: 74803 - DNA, 25 bp, Mus musculus
aagtcggactccaggtcttggcagg

SEQ ID NO: 74804 - DNA, 25 bp, Mus musculus
aagtcggaggatcattcaaggccag

SEQ ID NO: 74805 - DNA, 25 bp, Mus musculus
aagtcggccagctacaacctgagcc

SEQ ID NO: 74806 - DNA, 25 bp, Mus musculus
aagtctaaggtcagcctttccccag

SEQ ID NO: 74807 - DNA, 25 bp, Mus musculus
aagtctcagcacctaagatgggcag

SEQ ID NO: 74808 - DNA, 25 bp, Mus musculus
aagtctgtcagggagttccaccagg

SEQ ID NO: 74809 - DNA, 25 bp, Mus musculus
aagtcttagaacaaccccatgcgga

SEQ ID NO: 74810 - DNA, 25 bp, Mus musculus
aagtgaaaccgtcctcgaatggccg

SEQ ID NO: 74811 - DNA, 25 bp, Mus musculus
aagtgaaagtgaattgggcaacaac

SEQ ID NO: 74812 - DNA, 25 bp, Mus musculus
aagtgaactctctcctttggcaggc

SEQ ID NO: 74813 - DNA, 25 bp, Mus musculus
aagtgaagccctacaggagtgaaga

SEQ ID NO: 74814 - DNA, 25 bp, Mus musculus
aagtgacagacctggatgatgcccg

SEQ ID NO: 74815 - DNA, 25 bp, Mus musculus
aagtgaccagagagcgagctgcctt

SEQ ID NO: 74816 - DNA, 25 bp, Mus musculus
aagtgacgaactgtgacgatgctgc

SEQ ID NO: 74817 - DNA, 25 bp, Mus musculus
aagtgacgtgaagcacatgcgcgcg

SEQ ID NO: 74818 - DNA, 25 bp, Mus musculus
aagtgacttccccttgcagatcaag

SEQ ID NO: 74819 - DNA, 25 bp, Mus musculus
aagtgacttctgtctgcttctaatg

SEQ ID NO: 74820 - DNA, 25 bp, Mus musculus
aagtgagaaagttgccggcgtcccg

SEQ ID NO: 74821 - DNA, 25 bp, Mus musculus
aagtgagccgtcagggagccggtct

SEQ ID NO: 74822 - DNA, 25 bp, Mus musculus
aagtgaggacccttgctgacgccaa

SEQ ID NO: 74823 - DNA, 25 bp, Mus musculus
aagtgaggacttactgggcagctgc

SEQ ID NO: 74824 - DNA, 25 bp, Mus musculus
aagtgagtgactcccaggcaggaca

SEQ ID NO: 74825 - DNA, 25 bp, Mus musculus
aagtgataccgctcagcccagggtt

SEQ ID NO: 74826 - DNA, 25 bp, Mus musculus
aagtgatcaacataaacctggtggg

SEQ ID NO: 74827 - DNA, 25 bp, Mus musculus
aagtgatctctccaatccatgctag

SEQ ID NO: 74828 - DNA, 25 bp, Mus musculus
aagtgatgctgagaacctgctgcga

SEQ ID NO: 74829 - DNA, 25 bp, Mus musculus
aagtgcagagcgtctttcccctggg

SEQ ID NO: 74830 - DNA, 25 bp, Mus musculus
aagtgccagctacagttcgttaagg

SEQ ID NO: 74831 - DNA, 25 bp, Mus musculus
aagtgccatgtgtcgccttgaccag

SEQ ID NO: 74832 - DNA, 25 bp, Mus musculus
aagtgcccatcttggtggcccagga

SEQ ID NO: 74833 - DNA, 25 bp, Mus musculus
aagtgcccattgtgattcaagacga

SEQ ID NO: 74834 - DNA, 25 bp, Mus musculus
aagtgccccagtcccatggtgacag

SEQ ID NO: 74835 - DNA, 25 bp, Mus musculus
aagtgcccgccttgctcggcttggg

SEQ ID NO: 74836 - DNA, 25 bp, Mus musculus
aagtgccctgacctaccggatgtgg

SEQ ID NO: 74837 - DNA, 25 bp, Mus musculus
aagtgccgtcatattccaccttcag

SEQ ID NO: 74838 - DNA, 25 bp, Mus musculus
aagtgctccgttcctcagctcgaga

SEQ ID NO: 74839 - DNA, 25 bp, Mus musculus
aagtgctctcctggacgatagccgg

SEQ ID NO: 74840 - DNA, 25 bp, Mus musculus
aagtgctgtatctccctcagtggca

SEQ ID NO: 74841 - DNA, 25 bp, Mus musculus
aagtgcttgtgaagggacgacagcc

SEQ ID NO: 74842 - DNA, 25 bp, Mus musculus
aagtggaccctcaagctcatgcaag

SEQ ID NO: 74843 - DNA, 25 bp, Mus musculus
aagtggagccctcaggcatcacgtg

SEQ ID NO: 74844 - DNA, 25 bp, Mus musculus
aagtggaggagatcagcctgctgct

SEQ ID NO: 74845 - DNA, 25 bp, Mus musculus
aagtggaggtcccagtccctcagga

SEQ ID NO: 74846 - DNA, 25 bp, Mus musculus
aagtggatacagagcccaaggcgga

SEQ ID NO: 74847 - DNA, 25 bp, Mus musculus
aagtggatcacagtagggagcctca

SEQ ID NO: 74848 - DNA, 25 bp, Mus musculus
aagtggatcccgcttgtgaatggca

SEQ ID NO: 74849 - DNA, 25 bp, Mus musculus
aagtggatcgccatcgagagcctgg

SEQ ID NO: 74850 - DNA, 25 bp, Mus musculus
aagtggatcgtgttctggccctgca

SEQ ID NO: 74851 - DNA, 25 bp, Mus musculus
aagtggccaactacagcaactcagg

SEQ ID NO: 74852 - DNA, 25 bp, Mus musculus
aagtggcctctgcttccgcctaaga

SEQ ID NO: 74853 - DNA, 25 bp, Mus musculus
aagtggcctgcagactgtcctgaac

SEQ ID NO: 74854 - DNA, 25 bp, Mus musculus
aagtggccttcgtcagctctgccgg

SEQ ID NO: 74855 - DNA, 25 bp, Mus musculus
aagtggctaagctcgcatgtctgcg

SEQ ID NO: 74856 - DNA, 25 bp, Mus musculus
aagtggctaatatgcagcaggcaca

SEQ ID NO: 74857 - DNA, 25 bp, Mus musculus
aagtggctatgtcctctcagtggca

SEQ ID NO: 74858 - DNA, 25 bp, Mus musculus
aagtggctcaagaagcattgtcctc

SEQ ID NO: 74859 - DNA, 25 bp, Mus musculus
aagtggctgagcattcacgtttgca

SEQ ID NO: 74860 - DNA, 25 bp, Mus musculus
aagtggctgcacttgcgtgagaccg

SEQ ID NO: 74861 - DNA, 25 bp, Mus musculus
aagtggctgcggagttgaacccaga

SEQ ID NO: 74862 - DNA, 25 bp, Mus musculus
aagtggctgcgtgactgcagcccgt

SEQ ID NO: 74863 - DNA, 25 bp, Mus musculus
aagtgggaagccaagcctttctgca

SEQ ID NO: 74864 - DNA, 25 bp, Mus musculus
aagtgggccagccttccctcatgac

SEQ ID NO: 74865 - DNA, 25 bp, Mus musculus
aagtgggctaaagcctaggcacaca

SEQ ID NO: 74866 - DNA, 25 bp, Mus musculus
aagtggtacatcactgacttcgtgg

SEQ ID NO: 74867 - DNA, 25 bp, Mus musculus
aagtgtacatggctgacgaccccta

SEQ ID NO: 74868 - DNA, 25 bp, Mus musculus
aagtgtatcaggtgccaggtggtca

SEQ ID NO: 74869 - DNA, 25 bp, Mus musculus
aagtgtcaaagagtgtgcgggccca

SEQ ID NO: 74870 - DNA, 25 bp, Mus musculus
aagtgtcaatgaccagccatctggg

SEQ ID NO: 74871 - DNA, 25 bp, Mus musculus
aagtgtcacagttggtggtgtcccc

SEQ ID NO: 74872 - DNA, 25 bp, Mus musculus
aagtgtcaccgtgggtaggcctacg

SEQ ID NO: 74873 - DNA, 25 bp, Mus musculus
aagtgtcactttcattgcgtgggcc

SEQ ID NO: 74874 - DNA, 25 bp, Mus musculus
aagtgtccgagagcccaggcagtgt

SEQ ID NO: 74875 - DNA, 25 bp, Mus musculus
aagtgtctgaacaaccttgcggcct

SEQ ID NO: 74876 - DNA, 25 bp, Mus musculus
aagtgtctgcaaatgaaggttttat

SEQ ID NO: 74877 - DNA, 25 bp, Mus musculus
aagtgtgactctctacgtggacggc

SEQ ID NO: 74878 - DNA, 25 bp, Mus musculus
aagtgtgatgatgtcatgcaactcc

SEQ ID NO: 74879 - DNA, 25 bp, Mus musculus
aagtgtgcctgctgcgactgccgtt

SEQ ID NO: 74880 - DNA, 25 bp, Mus musculus
aagtgtgcgatgacagccctgagct

SEQ ID NO: 74881 - DNA, 25 bp, Mus musculus
aagtgtggcccgagtataagaaccg

SEQ ID NO: 74882 - DNA, 25 bp, Mus musculus
aagtgtgggatctcaaaggcgtgcc

SEQ ID NO: 74883 - DNA, 25 bp, Mus musculus
aagtgtgtattacagggtcaccgca

SEQ ID NO: 74884 - DNA, 25 bp, Mus musculus
aagtgtgtcccctatctgcatgctg

SEQ ID NO: 74885 - DNA, 25 bp, Mus musculus
aagtgtgtcctctctcagaatctcg

SEQ ID NO: 74886 - DNA, 25 bp, Mus musculus
aagtgtgtgcagaaaaatgagcggc

SEQ ID NO: 74887 - DNA, 25 bp, Mus musculus
aagtgttagccaagagcttccaagg

SEQ ID NO: 74888 - DNA, 25 bp, Mus musculus
aagtgttggttatctcaccccgcgg

SEQ ID NO: 74889 - DNA, 25 bp, Mus musculus
aagttaacaagacagccagtggccg

SEQ ID NO: 74890 - DNA, 25 bp, Mus musculus
aagttacaaataaggcaagtggcca

SEQ ID NO: 74891 - DNA, 25 bp, Mus musculus
aagttatagaactgtaagaggcagc

SEQ ID NO: 74892 - DNA, 25 bp, Mus musculus
aagttatgtcgtctctgtttgtgga

SEQ ID NO: 74893 - DNA, 25 bp, Mus musculus
aagttatgtgagctacaaaatgcgg

SEQ ID NO: 74894 - DNA, 25 bp, Mus musculus
aagttcaagagtgccatatgccgcg

SEQ ID NO: 74895 - DNA, 25 bp, Mus musculus
aagttcacaggtgcctcctgctcag

SEQ ID NO: 74896 - DNA, 25 bp, Mus musculus
aagttcaccactagcgacgtagccg

SEQ ID NO: 74897 - DNA, 25 bp, Mus musculus
aagttcaccggcttatccaaggagg

SEQ ID NO: 74898 - DNA, 25 bp, Mus musculus
aagttcatcgcttctgcagtcaggg

SEQ ID NO: 74899 - DNA, 25 bp, Mus musculus
aagttcatgatggacattgcccagg

SEQ ID NO: 74900 - DNA, 25 bp, Mus musculus
aagttccatcagttcctggtcagcg

SEQ ID NO: 74901 - DNA, 25 bp, Mus musculus
aagttccccaattccctagtgagag

SEQ ID NO: 74902 - DNA, 25 bp, Mus musculus
aagttcccgaagctgaccatcatag

SEQ ID NO: 74903 - DNA, 25 bp, Mus musculus
aagttccgtcgtggcagtggctcag

SEQ ID NO: 74904 - DNA, 25 bp, Mus musculus
aagttcctactgtccggctgcgccg

SEQ ID NO: 74905 - DNA, 25 bp, Mus musculus
aagttcctctgcgtagcatgtgagc

SEQ ID NO: 74906 - DNA, 25 bp, Mus musculus
aagttcctcttttaaagctggcagt

SEQ ID NO: 74907 - DNA, 25 bp, Mus musculus
aagttcgatcttgtatgtgtcgcca

SEQ ID NO: 74908 - DNA, 25 bp, Mus musculus
aagttcgctacgcacaccatgagga

SEQ ID NO: 74909 - DNA, 25 bp, Mus musculus
aagttctccaaggttttggcctgca

SEQ ID NO: 74910 - DNA, 25 bp, Mus musculus
aagttctctctcgaggtcggctgcg

SEQ ID NO: 74911 - DNA, 25 bp, Mus musculus
aagttcttggccagcggctgccgcc

SEQ ID NO: 74912 - DNA, 25 bp, Mus musculus
aagttgaacgagtaccgcctggacg

SEQ ID NO: 74913 - DNA, 25 bp, Mus musculus
aagttgacatcattgcggacgctgc

SEQ ID NO: 74914 - DNA, 25 bp, Mus musculus
aagttgactttcgacacatggctcc

SEQ ID NO: 74915 - DNA, 25 bp, Mus musculus
aagttgatctttcaccggcatccgg

SEQ ID NO: 74916 - DNA, 25 bp, Mus musculus
aagttgatgcacaagagccctggcc

SEQ ID NO: 74917 - DNA, 25 bp, Mus musculus
aagttgcagcaaggattggtcccgc

SEQ ID NO: 74918 - DNA, 25 bp, Mus musculus
aagttgcatcctggatagcccgggc

SEQ ID NO: 74919 - DNA, 25 bp, Mus musculus
aagttgcccctgactgacctgcaga

SEQ ID NO: 74920 - DNA, 25 bp, Mus musculus
aagttgcccgacaccctagaagacg

SEQ ID NO: 74921 - DNA, 25 bp, Mus musculus
aagttgcctcccctgcgtctaatgg

SEQ ID NO: 74922 - DNA, 25 bp, Mus musculus
aagttgctacgtgctcgctcagccg

SEQ ID NO: 74923 - DNA, 25 bp, Mus musculus
aagttgctggaagtgaactggacgc

SEQ ID NO: 74924 - DNA, 25 bp, Mus musculus
aagttgtccgggttccagatgccca

SEQ ID NO: 74925 - DNA, 25 bp, Mus musculus
aagttgtctactggctgcactggca

SEQ ID NO: 74926 - DNA, 25 bp, Mus musculus
aagttgtgggtactacacctggcca

SEQ ID NO: 74927 - DNA, 25 bp, Mus musculus
aagttgttcattgcttggcaccaca

SEQ ID NO: 74928 - DNA, 25 bp, Mus musculus
aagttgttgcactatcggccctcag

SEQ ID NO: 74929 - DNA, 25 bp, Mus musculus
aagttgttttcagcagcatggccac

SEQ ID NO: 74930 - DNA, 25 bp, Mus musculus
aagtttactgcctgtggagcgggca

SEQ ID NO: 74931 - DNA, 25 bp, Mus musculus
aagtttatctacataaccccagagg

SEQ ID NO: 74932 - DNA, 25 bp, Mus musculus
aagtttcatctggaagcgctgttga

SEQ ID NO: 74933 - DNA, 25 bp, Mus musculus
aagtttcggctgaggagtaaacgcg

SEQ ID NO: 74934 - DNA, 25 bp, Mus musculus
aagtttcttcgctcagaggccgtgg

SEQ ID NO: 74935 - DNA, 25 bp, Mus musculus
aagtttgggccagtccacgagccgt

SEQ ID NO: 74936 - DNA, 25 bp, Mus musculus
aagttttgctgggttctgctcctga

SEQ ID NO: 74937 - DNA, 25 bp, Mus musculus
aataaaacggtctcccagctgctgg

SEQ ID NO: 74938 - DNA, 25 bp, Mus musculus
aataaaagacatattgactgattct

SEQ ID NO: 74939 - DNA, 25 bp, Mus musculus
aataaaagagcagtgaccgccgcac

SEQ ID NO: 74940 - DNA, 25 bp, Mus musculus
aataaacaaacactgagcatgctgg

SEQ ID NO: 74941 - DNA, 25 bp, Mus musculus
aataaacaagatatcgggagccacc

SEQ ID NO: 74942 - DNA, 25 bp, Mus musculus
aataaacactggaggcagggagtcc

SEQ ID NO: 74943 - DNA, 25 bp, Mus musculus
aataaaccacagcaggtgccgtcat

SEQ ID NO: 74944 - DNA, 25 bp, Mus musculus
aataaagatcatgttccctcctccg

SEQ ID NO: 74945 - DNA, 25 bp, Mus musculus
aataaagcagtttatgccgccatca

SEQ ID NO: 74946 - DNA, 25 bp, Mus musculus
aataaagcgagacttcatggctgcg

SEQ ID NO: 74947 - DNA, 25 bp, Mus musculus
aataaagctcataaaggcgggcggc

SEQ ID NO: 74948 - DNA, 25 bp, Mus musculus
aataaaggatctgccctgtcacgcg

SEQ ID NO: 74949 - DNA, 25 bp, Mus musculus
aataaagttgaatacagtgcccgcc

SEQ ID NO: 74950 - DNA, 25 bp, Mus musculus
aataaatacctggtctggcagcacc

SEQ ID NO: 74951 - DNA, 25 bp, Mus musculus
aataacatagccctcctgaagacag

SEQ ID NO: 74952 - DNA, 25 bp, Mus musculus
aataacccggagtggatagctggcc

SEQ ID NO: 74953 - DNA, 25 bp, Mus musculus
aataacgactaatgactcctcgtgg

SEQ ID NO: 74954 - DNA, 25 bp, Mus musculus
aataactgctgctacctagctatag

SEQ ID NO: 74955 - DNA, 25 bp, Mus musculus
aataacttcctccagtggttgtgac

SEQ ID NO: 74956 - DNA, 25 bp, Mus musculus
aataagaacggccagggaggcacct

SEQ ID NO: 74957 - DNA, 25 bp, Mus musculus
aataagaagggtactgagctgtggc

SEQ ID NO: 74958 - DNA, 25 bp, Mus musculus
aataagagtgttccaggtgaccagc

SEQ ID NO: 74959 - DNA, 25 bp, Mus musculus
aataagatgtggcaccagacccaag

SEQ ID NO: 74960 - DNA, 25 bp, Mus musculus
aataagcctgccttcctacctggaa

SEQ ID NO: 74961 - DNA, 25 bp, Mus musculus
aataagctcttgtgtgactcctgtc

SEQ ID NO: 74962 - DNA, 25 bp, Mus musculus
aataaggagccaggatgcgtcgtcg

SEQ ID NO: 74963 - DNA, 25 bp, Mus musculus
aataaggatcctgtgggcactgctg

SEQ ID NO: 74964 - DNA, 25 bp, Mus musculus
aataaggcagagatccctgagcggc

SEQ ID NO: 74965 - DNA, 25 bp, Mus musculus
aataagggatgaaccaaagattaag

SEQ ID NO: 74966 - DNA, 25 bp, Mus musculus
aataagtggagagtcagagggcacc

SEQ ID NO: 74967 - DNA, 25 bp, Mus musculus
aataagttcaaggagagtggagcca

SEQ ID NO: 74968 - DNA, 25 bp, Mus musculus
aataatagaataatggaatccacgc

SEQ ID NO: 74969 - DNA, 25 bp, Mus musculus
aataatcaatctacctcacagcggg

SEQ ID NO: 74970 - DNA, 25 bp, Mus musculus
aataatcgctttacaagtgctggac

SEQ ID NO: 74971 - DNA, 25 bp, Mus musculus
aataatctgagggagagggccagcc

SEQ ID NO: 74972 - DNA, 25 bp, Mus musculus
aataatgcagcgacacacttaggcc

SEQ ID NO: 74973 - DNA, 25 bp, Mus musculus
aataatgcggctggtcgctgagtgc

SEQ ID NO: 74974 - DNA, 25 bp, Mus musculus
aataatgtaactcctgcacgtgcag

SEQ ID NO: 74975 - DNA, 25 bp, Mus musculus
aatacaacttctcctttgattacca

SEQ ID NO: 74976 - DNA, 25 bp, Mus musculus
aatacactagctggtctccaatggg

SEQ ID NO: 74977 - DNA, 25 bp, Mus musculus
aatacactgcaggatgagaagcgcc

SEQ ID NO: 74978 - DNA, 25 bp, Mus musculus
aatacagagtatggaccgggtagac

SEQ ID NO: 74979 - DNA, 25 bp, Mus musculus
aatacatcagacttacagggtacag

SEQ ID NO: 74980 - DNA, 25 bp, Mus musculus
aatacatcttttgcaaccctttggg

SEQ ID NO: 74981 - DNA, 25 bp, Mus musculus
aataccaaaccatgggaccctgcgg

SEQ ID NO: 74982 - DNA, 25 bp, Mus musculus
aataccacaggcagaaggcggctat

SEQ ID NO: 74983 - DNA, 25 bp, Mus musculus
aataccacgttgtcatgcccatgtc

SEQ ID NO: 74984 - DNA, 25 bp, Mus musculus
aataccagctgtgctaccgtgcggc

SEQ ID NO: 74985 - DNA, 25 bp, Mus musculus
aataccaggcatcgtgtcagtgaca

SEQ ID NO: 74986 - DNA, 25 bp, Mus musculus
aataccaggctgagagtgtctactc

SEQ ID NO: 74987 - DNA, 25 bp, Mus musculus
aataccatgctaggagtgggtcacg

SEQ ID NO: 74988 - DNA, 25 bp, Mus musculus
aatacccaaccctgtccaaggagcg

SEQ ID NO: 74989 - DNA, 25 bp, Mus musculus
aatacccagaggaagacacggatcg

SEQ ID NO: 74990 - DNA, 25 bp, Mus musculus
aatacccctggaaaacacctgtgca

SEQ ID NO: 74991 - DNA, 25 bp, Mus musculus
aataccgagcgatcgaaagactggt

SEQ ID NO: 74992 - DNA, 25 bp, Mus musculus
aatacctacccgcagtaaagcagga

SEQ ID NO: 74993 - DNA, 25 bp, Mus musculus
aatacctgtgctgggatgtgctatg

SEQ ID NO: 74994 - DNA, 25 bp, Mus musculus
aatacgaccagggacttgtcaggga

SEQ ID NO: 74995 - DNA, 25 bp, Mus musculus
aatacgactttacgtccagtcggca

SEQ ID NO: 74996 - DNA, 25 bp, Mus musculus
aatacggaggtgtccacgagcagac

SEQ ID NO: 74997 - DNA, 25 bp, Mus musculus
aatacgggagctttggtggcctgtc

SEQ ID NO: 74998 - DNA, 25 bp, Mus musculus
aatacggtgtgcagagtcggcttcc

SEQ ID NO: 74999 - DNA, 25 bp, Mus musculus
aatactacatatgctgtgaagagac

SEQ ID NO: 75000 - DNA, 25 bp, Mus musculus
aatactatttccgaggcgacctggg

SEQ ID NO: 75001 - DNA, 25 bp, Mus musculus
aatactcgggtgcatcacatgagcg

SEQ ID NO: 75002 - DNA, 25 bp, Mus musculus
aatactcggtgagtcgtggagacca

SEQ ID NO: 75003 - DNA, 25 bp, Mus musculus
aatactctttcttctaaggatcaga

SEQ ID NO: 75004 - DNA, 25 bp, Mus musculus
aatactggagagataaaaggctcgc

SEQ ID NO: 75005 - DNA, 25 bp, Mus musculus
aatactgtcacaacggaggcacctg

SEQ ID NO: 75006 - DNA, 25 bp, Mus musculus
aatactgtgcgggaagttgaccacc

SEQ ID NO: 75007 - DNA, 25 bp, Mus musculus
aatactgtggtagaagcaaattcag

SEQ ID NO: 75008 - DNA, 25 bp, Mus musculus
aatactgtgttggtgagcccctcgc

SEQ ID NO: 75009 - DNA, 25 bp, Mus musculus
aatacttatccattgcggagcgcgc

SEQ ID NO: 75010 - DNA, 25 bp, Mus musculus
aatacttcaaagcatcttacctctg

SEQ ID NO: 75011 - DNA, 25 bp, Mus musculus
aatacttctagtttgttagactgtc

SEQ ID NO: 75012 - DNA, 25 bp, Mus musculus
aatagaagattcttcctatcttctg

SEQ ID NO: 75013 - DNA, 25 bp, Mus musculus
aatagaaggaaaagccctgcattct

SEQ ID NO: 75014 - DNA, 25 bp, Mus musculus
aatagacacccttagctgctgggcg

SEQ ID NO: 75015 - DNA, 25 bp, Mus musculus
aatagaccgatgagcgaaagcacca

SEQ ID NO: 75016 - DNA, 25 bp, Mus musculus
aatagacctgattccttcctgaggc

SEQ ID NO: 75017 - DNA, 25 bp, Mus musculus
aatagacgcccagaaaaacttcgag

SEQ ID NO: 75018 - DNA, 25 bp, Mus musculus
aatagacgcctactaccaccgccta

SEQ ID NO: 75019 - DNA, 25 bp, Mus musculus
aatagagatcgtattccaggtccgg

SEQ ID NO: 75020 - DNA, 25 bp, Mus musculus
aatagattctcaccttccagcctgc

SEQ ID NO: 75021 - DNA, 25 bp, Mus musculus
aatagcaagtcttgattcagagaat

SEQ ID NO: 75022 - DNA, 25 bp, Mus musculus
aatagcagcctccacaaatcgttag

SEQ ID NO: 75023 - DNA, 25 bp, Mus musculus
aatagcccacttacggatcgacaga

SEQ ID NO: 75024 - DNA, 25 bp, Mus musculus
aatagcctcaacgtgcatgtggtag

SEQ ID NO: 75025 - DNA, 25 bp, Mus musculus
aatagcctccggcttccacaaggag

SEQ ID NO: 75026 - DNA, 25 bp, Mus musculus
aatagcctcctcagtttccaccgtg

SEQ ID NO: 75027 - DNA, 25 bp, Mus musculus
aataggaatcctatgcctgctgagg

SEQ ID NO: 75028 - DNA, 25 bp, Mus musculus
aataggaggcaaacgagggaccatc

SEQ ID NO: 75029 - DNA, 25 bp, Mus musculus
aataggcaactatggctcgagaacc

SEQ ID NO: 75030 - DNA, 25 bp, Mus musculus
aataggctcctcatgaaccacccat

SEQ ID NO: 75031 - DNA, 25 bp, Mus musculus
aatagtatcttctcagttggtgggc

SEQ ID NO: 75032 - DNA, 25 bp, Mus musculus
aatagtattggctgcgtggaaggcc

SEQ ID NO: 75033 - DNA, 25 bp, Mus musculus
aatagtctagagaggtgatccccag

SEQ ID NO: 75034 - DNA, 25 bp, Mus musculus
aatagtcttaggcagggcatactcc

SEQ ID NO: 75035 - DNA, 25 bp, Mus musculus
aatagtgctctttcaacaagactcg

SEQ ID NO: 75036 - DNA, 25 bp, Mus musculus
aatagtgctgattcaagggctggga

SEQ ID NO: 75037 - DNA, 25 bp, Mus musculus
aatagtgctgcggaggcacgagcta

SEQ ID NO: 75038 - DNA, 25 bp, Mus musculus
aatagtgggctgtacgcacatcacg

SEQ ID NO: 75039 - DNA, 25 bp, Mus musculus
aatagtggtgacgagtgaagccagc

SEQ ID NO: 75040 - DNA, 25 bp, Mus musculus
aatatacggaacctcttggcgggct

SEQ ID NO: 75041 - DNA, 25 bp, Mus musculus
aatatagtcaacgtccctcagccgg

SEQ ID NO: 75042 - DNA, 25 bp, Mus musculus
aatatatgagtagcgcccgcagcct

SEQ ID NO: 75043 - DNA, 25 bp, Mus musculus
aatatatttcaagtcaacggccaga

SEQ ID NO: 75044 - DNA, 25 bp, Mus musculus
aatatcacttactcgttaggcctgg

SEQ ID NO: 75045 - DNA, 25 bp, Mus musculus
aatatcagatggatggacctagggc

SEQ ID NO: 75046 - DNA, 25 bp, Mus musculus
aatatcaggcgatgcgggagaatca

SEQ ID NO: 75047 - DNA, 25 bp, Mus musculus
aatatcatatgagcagagcccaggc

SEQ ID NO: 75048 - DNA, 25 bp, Mus musculus
aatatccagtggagtgtagacccag

SEQ ID NO: 75049 - DNA, 25 bp, Mus musculus
aatatcgccaggctgcaggtagcac

SEQ ID NO: 75050 - DNA, 25 bp, Mus musculus
aatatcgggcaaggtgaaggtcagc

SEQ ID NO: 75051 - DNA, 25 bp, Mus musculus
aatatctgaagcacttactgcccag

SEQ ID NO: 75052 - DNA, 25 bp, Mus musculus
aatatctgctggatttgctccggct

SEQ ID NO: 75053 - DNA, 25 bp, Mus musculus
aatatgaacagtgctacctggcccg

SEQ ID NO: 75054 - DNA, 25 bp, Mus musculus
aatatgaatgctccagtccctcctg

SEQ ID NO: 75055 - DNA, 25 bp, Mus musculus
aatatgacacctggagacagtccgc

SEQ ID NO: 75056 - DNA, 25 bp, Mus musculus
aatatgacgtcttggagaagaagcg

SEQ ID NO: 75057 - DNA, 25 bp, Mus musculus
aatatgactcttcctgatgccctag

SEQ ID NO: 75058 - DNA, 25 bp, Mus musculus
aatatgagctgaatgaagtcactgc

SEQ ID NO: 75059 - DNA, 25 bp, Mus musculus
aatatgatcacaggcactgcccccc

SEQ ID NO: 75060 - DNA, 25 bp, Mus musculus
aatatgatgagaggccgatactgcc

SEQ ID NO: 75061 - DNA, 25 bp, Mus musculus
aatatgatgagctgattgtgcgccg

SEQ ID NO: 75062 - DNA, 25 bp, Mus musculus
aatatgcagggagtcgtgtacgagc

SEQ ID NO: 75063 - DNA, 25 bp, Mus musculus
aatatgcccaacctggatgctgtgg

SEQ ID NO: 75064 - DNA, 25 bp, Mus musculus
aatatggatagttgtggccacctgc

SEQ ID NO: 75065 - DNA, 25 bp, Mus musculus
aatatgttcggcgaccttcggtcca

SEQ ID NO: 75066 - DNA, 25 bp, Mus musculus
aatattaagacttctagacccctgg

SEQ ID NO: 75067 - DNA, 25 bp, Mus musculus
aatattaccagacaccacggctatg

SEQ ID NO: 75068 - DNA, 25 bp, Mus musculus
aatattcacggaaccattctggcca

SEQ ID NO: 75069 - DNA, 25 bp, Mus musculus
aatattcggtcagtgcggcgaagcc

SEQ ID NO: 75070 - DNA, 25 bp, Mus musculus
aatattgacccctctcgcttcgaag

SEQ ID NO: 75071 - DNA, 25 bp, Mus musculus
aatattgacggtgagaacgcgggca

SEQ ID NO: 75072 - DNA, 25 bp, Mus musculus
aatattgtatacaaagactcttgat

SEQ ID NO: 75073 - DNA, 25 bp, Mus musculus
aatattgtcaggcttgagttgtctt

SEQ ID NO: 75074 - DNA, 25 bp, Mus musculus
aatatttgcaagaagagcccaggcc

SEQ ID NO: 75075 - DNA, 25 bp, Mus musculus
aatatttgggctgtacgggcagacc

SEQ ID NO: 75076 - DNA, 25 bp, Mus musculus
aatattttatgtgaccgagaaggcg

SEQ ID NO: 75077 - DNA, 25 bp, Mus musculus
aatcaaacagctggacatcgagacc

SEQ ID NO: 75078 - DNA, 25 bp, Mus musculus
aatcaaactgcagaacaaggtgttc

SEQ ID NO: 75079 - DNA, 25 bp, Mus musculus
aatcaaaggagttcccctgagatgg

SEQ ID NO: 75080 - DNA, 25 bp, Mus musculus
aatcaaatctctcatgacccggcag

SEQ ID NO: 75081 - DNA, 25 bp, Mus musculus
aatcaacagactacagcaggaggcc

SEQ ID NO: 75082 - DNA, 25 bp, Mus musculus
aatcaacatgatctgggcctgctgg

SEQ ID NO: 75083 - DNA, 25 bp, Mus musculus
aatcaacctgatcgcttaccgggaa

SEQ ID NO: 75084 - DNA, 25 bp, Mus musculus
aatcaacgctttggcggtgacgggc

SEQ ID NO: 75085 - DNA, 25 bp, Mus musculus
aatcaaggcacaggaggacgaggcc

SEQ ID NO: 75086 - DNA, 25 bp, Mus musculus
aatcaagttcttgcccaccagctgg

SEQ ID NO: 75087 - DNA, 25 bp, Mus musculus
aatcaatgagcatgtttcaggccct

SEQ ID NO: 75088 - DNA, 25 bp, Mus musculus
aatcacattgcctgcttggaaagaa

SEQ ID NO: 75089 - DNA, 25 bp, Mus musculus
aatcaccgtcttctccccagatgga

SEQ ID NO: 75090 - DNA, 25 bp, Mus musculus
aatcacctccggcttcttgcaggaa

SEQ ID NO: 75091 - DNA, 25 bp, Mus musculus
aatcacgttctggacaactcgggcg

SEQ ID NO: 75092 - DNA, 25 bp, Mus musculus
aatcactccactcgtaggcgggtcg

SEQ ID NO: 75093 - DNA, 25 bp, Mus musculus
aatcagaaacgagaagggacatgcc

SEQ ID NO: 75094 - DNA, 25 bp, Mus musculus
aatcagacagttcaaccgggtcagc

SEQ ID NO: 75095 - DNA, 25 bp, Mus musculus
aatcagagagagaggtttctttgcc

SEQ ID NO: 75096 - DNA, 25 bp, Mus musculus
aatcagaggcctgggcagacaatcg

SEQ ID NO: 75097 - DNA, 25 bp, Mus musculus
aatcagatgggtgtgtctgccaagc

SEQ ID NO: 75098 - DNA, 25 bp, Mus musculus
aatcagattctcagctatggagccg

SEQ ID NO: 75099 - DNA, 25 bp, Mus musculus
aatcagcaacatcgtcttcaccagc

SEQ ID NO: 75100 - DNA, 25 bp, Mus musculus
aatcagcagctgaattccagaagcc

SEQ ID NO: 75101 - DNA, 25 bp, Mus musculus
aatcagctcagccaagaggccaaac

SEQ ID NO: 75102 - DNA, 25 bp, Mus musculus
aatcaggacagagtggctaggaagc

SEQ ID NO: 75103 - DNA, 25 bp, Mus musculus
aatcaggactttcccagcgtggtgc

SEQ ID NO: 75104 - DNA, 25 bp, Mus musculus
aatcaggagatcttaagaaagccaa

SEQ ID NO: 75105 - DNA, 25 bp, Mus musculus
aatcagtacgttgtccgggaggtgc

SEQ ID NO: 75106 - DNA, 25 bp, Mus musculus
aatcagtagcaccaccgcactgcag

SEQ ID NO: 75107 - DNA, 25 bp, Mus musculus
aatcagtgccgtggacgtggaccgt

SEQ ID NO: 75108 - DNA, 25 bp, Mus musculus
aatcagttccaggagcgtgtcaagc

SEQ ID NO: 75109 - DNA, 25 bp, Mus musculus
aatcagttttgaggagttcgtgtcg

SEQ ID NO: 75110 - DNA, 25 bp, Mus musculus
aatcatagagattgcagcctgtcac

SEQ ID NO: 75111 - DNA, 25 bp, Mus musculus
aatcatcaacaataccttcaagggc

SEQ ID NO: 75112 - DNA, 25 bp, Mus musculus
aatcatcagcttgccgaatcaccag

SEQ ID NO: 75113 - DNA, 25 bp, Mus musculus
aatcatcattcaagacctgtcagaa

SEQ ID NO: 75114 - DNA, 25 bp, Mus musculus
aatcatcggtgtctttgtggacgca

SEQ ID NO: 75115 - DNA, 25 bp, Mus musculus
aatcatgcgatagtcctggctcagc

SEQ ID NO: 75116 - DNA, 25 bp, Mus musculus
aatcatgggatgtagagactgcaac

SEQ ID NO: 75117 - DNA, 25 bp, Mus musculus
aatcatgtcactgcgagactgccag

SEQ ID NO: 75118 - DNA, 25 bp, Mus musculus
aatcatgtcccgaggacttcctaag

SEQ ID NO: 75119 - DNA, 25 bp, Mus musculus
aatcattacaagttcgggagacacg

SEQ ID NO: 75120 - DNA, 25 bp, Mus musculus
aatcattggacggtggcttctcccc

SEQ ID NO: 75121 - DNA, 25 bp, Mus musculus
aatccaaagagaagggtgccataag

SEQ ID NO: 75122 - DNA, 25 bp, Mus musculus
aatccaagaagaagcgcagcggagt

SEQ ID NO: 75123 - DNA, 25 bp, Mus musculus
aatccaagggcatcgctgttacagc

SEQ ID NO: 75124 - DNA, 25 bp, Mus musculus
aatccaaggtcggacgggtgcagac

SEQ ID NO: 75125 - DNA, 25 bp, Mus musculus
aatccacagaaggagagcaggccgg

SEQ ID NO: 75126 - DNA, 25 bp, Mus musculus
aatccacaggtgcaagagagagcca

SEQ ID NO: 75127 - DNA, 25 bp, Mus musculus
aatccacctgcagttatgggacacg

SEQ ID NO: 75128 - DNA, 25 bp, Mus musculus
aatccactgggagatgacgacgcct

SEQ ID NO: 75129 - DNA, 25 bp, Mus musculus
aatccagaattcgtgcggaggcagg

SEQ ID NO: 75130 - DNA, 25 bp, Mus musculus
aatccagagggtggaaatgctggca

SEQ ID NO: 75131 - DNA, 25 bp, Mus musculus
aatccagatgtgtcctagtaagcag

SEQ ID NO: 75132 - DNA, 25 bp, Mus musculus
aatccagggaagcaaacagttctgc

SEQ ID NO: 75133 - DNA, 25 bp, Mus musculus
aatccaggtgggatgcctccgtacc

SEQ ID NO: 75134 - DNA, 25 bp, Mus musculus
aatccagtcgcagagaacttcaggg

SEQ ID NO: 75135 - DNA, 25 bp, Mus musculus
aatccagtgtttgctcgatacccag

SEQ ID NO: 75136 - DNA, 25 bp, Mus musculus
aatccagttgaagaatatagaaggc

SEQ ID NO: 75137 - DNA, 25 bp, Mus musculus
aatccatttggagatcctgactcag

SEQ ID NO: 75138 - DNA, 25 bp, Mus musculus
aatcccaacctgttagtcccagtag

SEQ ID NO: 75139 - DNA, 25 bp, Mus musculus
aatcccaggagcctatgcatccaga

SEQ ID NO: 75140 - DNA, 25 bp, Mus musculus
aatcccaggcttcctgagtgacgag

SEQ ID NO: 75141 - DNA, 25 bp, Mus musculus
aatcccattggtggagctgtcagca

SEQ ID NO: 75142 - DNA, 25 bp, Mus musculus
aatccccggtggctgtcagtcagag

SEQ ID NO: 75143 - DNA, 25 bp, Mus musculus
aatcccgagggctgaaatactgaca

SEQ ID NO: 75144 - DNA, 25 bp, Mus musculus
aatcccggctacatgtacgagaagg

SEQ ID NO: 75145 - DNA, 25 bp, Mus musculus
aatccctatgaagtcactatgccaa

SEQ ID NO: 75146 - DNA, 25 bp, Mus musculus
aatccctcaaagagaagcctccaag

SEQ ID NO: 75147 - DNA, 25 bp, Mus musculus
aatccctgtggtgcttctggcctgt

SEQ ID NO: 75148 - DNA, 25 bp, Mus musculus
aatcccttcaaggactggcctggag

SEQ ID NO: 75149 - DNA, 25 bp, Mus musculus
aatcccttggctttgttagtagaga

SEQ ID NO: 75150 - DNA, 25 bp, Mus musculus
aatcccttgggttgagcttgcatgc

SEQ ID NO: 75151 - DNA, 25 bp, Mus musculus
aatccgacaattaagatcctcctag

SEQ ID NO: 75152 - DNA, 25 bp, Mus musculus
aatccgtgacctagaagataaaaca

SEQ ID NO: 75153 - DNA, 25 bp, Mus musculus
aatccgtggcaggaatgtaacctcc

SEQ ID NO: 75154 - DNA, 25 bp, Mus musculus
aatccgtggttatgagctggcacac

SEQ ID NO: 75155 - DNA, 25 bp, Mus musculus
aatcctaaggagacaaccagcctgg

SEQ ID NO: 75156 - DNA, 25 bp, Mus musculus
aatcctatctttgtcacgagccggg

SEQ ID NO: 75157 - DNA, 25 bp, Mus musculus
aatcctatttacaggcaggtcccca

SEQ ID NO: 75158 - DNA, 25 bp, Mus musculus
aatcctcctcttcaagtcgggctag

SEQ ID NO: 75159 - DNA, 25 bp, Mus musculus
aatcctcttggatgtggctagaaca

SEQ ID NO: 75160 - DNA, 25 bp, Mus musculus
aatcctgaacttaagctctgacggc

SEQ ID NO: 75161 - DNA, 25 bp, Mus musculus
aatcctgcgcagcactgttccggag

SEQ ID NO: 75162 - DNA, 25 bp, Mus musculus
aatcctgcgtttgagtcgtcttggc

SEQ ID NO: 75163 - DNA, 25 bp, Mus musculus
aatcctgctgacattctggttatcg

SEQ ID NO: 75164 - DNA, 25 bp, Mus musculus
aatcctggaatgtgggtctccttgc

SEQ ID NO: 75165 - DNA, 25 bp, Mus musculus
aatcctgggccagctagataccggg

SEQ ID NO: 75166 - DNA, 25 bp, Mus musculus
aatcctgtggactttaacggcaagc

SEQ ID NO: 75167 - DNA, 25 bp, Mus musculus
aatccttgtggttaatgctgcctac

SEQ ID NO: 75168 - DNA, 25 bp, Mus musculus
aatcctttgattcgagccttggcag

SEQ ID NO: 75169 - DNA, 25 bp, Mus musculus
aatcgaggtcctctgcaaaggctac

SEQ ID NO: 75170 - DNA, 25 bp, Mus musculus
aatcgagtttatgacaagttctacc

SEQ ID NO: 75171 - DNA, 25 bp, Mus musculus
aatcgcatcgtaaaggtccggcggg

SEQ ID NO: 75172 - DNA, 25 bp, Mus musculus
aatcgccatgaggctgagcggacag

SEQ ID NO: 75173 - DNA, 25 bp, Mus musculus
aatcgcccaggtgtctatgccaagg

SEQ ID NO: 75174 - DNA, 25 bp, Mus musculus
aatcgcttacgtgagcagaagtagt

SEQ ID NO: 75175 - DNA, 25 bp, Mus musculus
aatcggaaacccaatccattgcacc

SEQ ID NO: 75176 - DNA, 25 bp, Mus musculus
aatcggacctgtattgctgaaaagc

SEQ ID NO: 75177 - DNA, 25 bp, Mus musculus
aatcggagcccctggagttgaagaa

SEQ ID NO: 75178 - DNA, 25 bp, Mus musculus
aatcgggccttcgtggctcagctgc

SEQ ID NO: 75179 - DNA, 25 bp, Mus musculus
aatcggtagatgctgaggaagtccc

SEQ ID NO: 75180 - DNA, 25 bp, Mus musculus
aatcggtgtggagcagctggcctac

SEQ ID NO: 75181 - DNA, 25 bp, Mus musculus
aatcggttctccactccagagcagg

SEQ ID NO: 75182 - DNA, 25 bp, Mus musculus
aatcgtccttctcatgggccagtgg

SEQ ID NO: 75183 - DNA, 25 bp, Mus musculus
aatcgtcggcgctgttcttcgggaa

SEQ ID NO: 75184 - DNA, 25 bp, Mus musculus
aatcgtgggagcctcaagtgatctc

SEQ ID NO: 75185 - DNA, 25 bp, Mus musculus
aatctaaagacggacctggtgcggc

SEQ ID NO: 75186 - DNA, 25 bp, Mus musculus
aatctacagaacgtccgggcttgcc

SEQ ID NO: 75187 - DNA, 25 bp, Mus musculus
aatctacagcgtggactggagccgg

SEQ ID NO: 75188 - DNA, 25 bp, Mus musculus
aatctaggcctagcaagcggagcga

SEQ ID NO: 75189 - DNA, 25 bp, Mus musculus
aatctattgaagagggatctgcttg

SEQ ID NO: 75190 - DNA, 25 bp, Mus musculus
aatctcaccctgctatgcatagagg

SEQ ID NO: 75191 - DNA, 25 bp, Mus musculus
aatctcagactttgctgtgggcggc

SEQ ID NO: 75192 - DNA, 25 bp, Mus musculus
aatctcagggaactacacgaagggc

SEQ ID NO: 75193 - DNA, 25 bp, Mus musculus
aatctccagaatgatgcccagtcag

SEQ ID NO: 75194 - DNA, 25 bp, Mus musculus
aatctcccaaccagaagcgtacgtg

SEQ ID NO: 75195 - DNA, 25 bp, Mus musculus
aatctcccattcagccaaaggaagg

SEQ ID NO: 75196 - DNA, 25 bp, Mus musculus
aatctccgcgggactggaacaaggc

SEQ ID NO: 75197 - DNA, 25 bp, Mus musculus
aatctctcatattggcaagtaaagg

SEQ ID NO: 75198 - DNA, 25 bp, Mus musculus
aatctctgggcagcgcagcgctacg

SEQ ID NO: 75199 - DNA, 25 bp, Mus musculus
aatctgaagttgcatcggaccctgg

SEQ ID NO: 75200 - DNA, 25 bp, Mus musculus
aatctgagggacctgaatcgctgca

SEQ ID NO: 75201 - DNA, 25 bp, Mus musculus
aatctgcaggtgtgtggtctgatcc

SEQ ID NO: 75202 - DNA, 25 bp, Mus musculus
aatctgcgcgcgcattgctcttggc

SEQ ID NO: 75203 - DNA, 25 bp, Mus musculus
aatctgctatgaggcttaactgctg

SEQ ID NO: 75204 - DNA, 25 bp, Mus musculus
aatctgcttcatcccgggcatggtg

SEQ ID NO: 75205 - DNA, 25 bp, Mus musculus
aatctggaagattggaatggagccc

SEQ ID NO: 75206 - DNA, 25 bp, Mus musculus
aatctggaagtggttcaagccaggc

SEQ ID NO: 75207 - DNA, 25 bp, Mus musculus
aatctggaggactgtgtggactcac

SEQ ID NO: 75208 - DNA, 25 bp, Mus musculus
aatctggatctagctcctgggctga

SEQ ID NO: 75209 - DNA, 25 bp, Mus musculus
aatctggtgatgaactctacacccg

SEQ ID NO: 75210 - DNA, 25 bp, Mus musculus
aatctgtaagacgatctctgtggcc

SEQ ID NO: 75211 - DNA, 25 bp, Mus musculus
aatctgtctaagtctggttcccggt

SEQ ID NO: 75212 - DNA, 25 bp, Mus musculus
aatctgtgccaagagtgagcgctac

SEQ ID NO: 75213 - DNA, 25 bp, Mus musculus
aatctgttaagaagatgcgcgagga

SEQ ID NO: 75214 - DNA, 25 bp, Mus musculus
aatctgttccgacgtcaggccgagg

SEQ ID NO: 75215 - DNA, 25 bp, Mus musculus
aatcttaccatgaggtccccgacgg

SEQ ID NO: 75216 - DNA, 25 bp, Mus musculus
aatcttacctgcaagcttgccatcg

SEQ ID NO: 75217 - DNA, 25 bp, Mus musculus
aatcttatgtgtgcggatgttttgc

SEQ ID NO: 75218 - DNA, 25 bp, Mus musculus
aatcttcggcccctgtctgggagga

SEQ ID NO: 75219 - DNA, 25 bp, Mus musculus
aatcttgggaagctaaaatgcggca

SEQ ID NO: 75220 - DNA, 25 bp, Mus musculus
aatgaaccgtcatggtggcactgga

SEQ ID NO: 75221 - DNA, 25 bp, Mus musculus
aatgaaccgtgcagtctatgaggac

SEQ ID NO: 75222 - DNA, 25 bp, Mus musculus
aatgaactcatgaagagatactgcc

SEQ ID NO: 75223 - DNA, 25 bp, Mus musculus
aatgaagacaaacgccactcacagg

SEQ ID NO: 75224 - DNA, 25 bp, Mus musculus
aatgaagacactaccaagtctcagg

SEQ ID NO: 75225 - DNA, 25 bp, Mus musculus
aatgaagagaagaaggacagacgca

SEQ ID NO: 75226 - DNA, 25 bp, Mus musculus
aatgaagagaccgacagcagtgacg

SEQ ID NO: 75227 - DNA, 25 bp, Mus musculus
aatgaagagagattgaaaggactgc

SEQ ID NO: 75228 - DNA, 25 bp, Mus musculus
aatgaagccaagtcagctggacgag

SEQ ID NO: 75229 - DNA, 25 bp, Mus musculus
aatgaagccctagtgaaggccctgg

SEQ ID NO: 75230 - DNA, 25 bp, Mus musculus
aatgaagccctctataatgcagaag

SEQ ID NO: 75231 - DNA, 25 bp, Mus musculus
aatgaagcctctctattggacaaga

SEQ ID NO: 75232 - DNA, 25 bp, Mus musculus
aatgaaggacatgacccggatggcg

SEQ ID NO: 75233 - DNA, 25 bp, Mus musculus
aatgaaggccgagctcctggaggct

SEQ ID NO: 75234 - DNA, 25 bp, Mus musculus
aatgaagggcctgatcctgttcctg

SEQ ID NO: 75235 - DNA, 25 bp, Mus musculus
aatgaagtcatggaggcccacctgc

SEQ ID NO: 75236 - DNA, 25 bp, Mus musculus
aatgaatactcgtccaagtgccagg

SEQ ID NO: 75237 - DNA, 25 bp, Mus musculus
aatgaatgacatgcgcccaaaggtg

SEQ ID NO: 75238 - DNA, 25 bp, Mus musculus
aatgaatggcagaatacagggttcc

SEQ ID NO: 75239 - DNA, 25 bp, Mus musculus
aatgaatggtgacactcgggccgca

SEQ ID NO: 75240 - DNA, 25 bp, Mus musculus
aatgacaaattcaggagctcctccg

SEQ ID NO: 75241 - DNA, 25 bp, Mus musculus
aatgacaccttcagcagagagccag

SEQ ID NO: 75242 - DNA, 25 bp, Mus musculus
aatgacagctgcttgctaccccagg

SEQ ID NO: 75243 - DNA, 25 bp, Mus musculus
aatgaccaaaagatccggttctggg

SEQ ID NO: 75244 - DNA, 25 bp, Mus musculus
aatgaccagcgcatgtgtgggagcc

SEQ ID NO: 75245 - DNA, 25 bp, Mus musculus
aatgacccagatgctgacaggctcg

SEQ ID NO: 75246 - DNA, 25 bp, Mus musculus
aatgacccatttgctcctggtggaa

SEQ ID NO: 75247 - DNA, 25 bp, Mus musculus
aatgacccgcccactttagaaactg

SEQ ID NO: 75248 - DNA, 25 bp, Mus musculus
aatgacctcttcctgacggcagtgc

SEQ ID NO: 75249 - DNA, 25 bp, Mus musculus
aatgacctgaggaagctaaaagatg

SEQ ID NO: 75250 - DNA, 25 bp, Mus musculus
aatgacctgatgctcctggaaccac

SEQ ID NO: 75251 - DNA, 25 bp, Mus musculus
aatgaccttcagaccttccatggag

SEQ ID NO: 75252 - DNA, 25 bp, Mus musculus
aatgacggccatttcttctcaggtg

SEQ ID NO: 75253 - DNA, 25 bp, Mus musculus
aatgacgtcagagtgccttaacagc

SEQ ID NO: 75254 - DNA, 25 bp, Mus musculus
aatgacgtcccgctgcaatgctgtg

SEQ ID NO: 75255 - DNA, 25 bp, Mus musculus
aatgacgttcaggaccgtttcgagg

SEQ ID NO: 75256 - DNA, 25 bp, Mus musculus
aatgactcctattgctacaactcag

SEQ ID NO: 75257 - DNA, 25 bp, Mus musculus
aatgactcggcagtggtccgccatg

SEQ ID NO: 75258 - DNA, 25 bp, Mus musculus
aatgactgtatagagagtgggcgcc

SEQ ID NO: 75259 - DNA, 25 bp, Mus musculus
aatgacttcatgaagaacttggagc

SEQ ID NO: 75260 - DNA, 25 bp, Mus musculus
aatgacttctactgtgcctgtgacg

SEQ ID NO: 75261 - DNA, 25 bp, Mus musculus
aatgagaaaacgctacagtgtggat

SEQ ID NO: 75262 - DNA, 25 bp, Mus musculus
aatgagaacttgctggacctgaacc

SEQ ID NO: 75263 - DNA, 25 bp, Mus musculus
aatgagaagagatttccctgaaggc

SEQ ID NO: 75264 - DNA, 25 bp, Mus musculus
aatgagaccaaagagctcctgctgg

SEQ ID NO: 75265 - DNA, 25 bp, Mus musculus
aatgagagcactcctttgccacggc

SEQ ID NO: 75266 - DNA, 25 bp, Mus musculus
aatgagaggttctgaggatgtagcc

SEQ ID NO: 75267 - DNA, 25 bp, Mus musculus
aatgagagtcccacatcgccttcag

SEQ ID NO: 75268 - DNA, 25 bp, Mus musculus
aatgagatagagttgcaccgagacc

SEQ ID NO: 75269 - DNA, 25 bp, Mus musculus
aatgagatggtgttcaagcggctgc

SEQ ID NO: 75270 - DNA, 25 bp, Mus musculus
aatgagcagctgattcccgagcctg

SEQ ID NO: 75271 - DNA, 25 bp, Mus musculus
aatgagcaggcagctattgtcgccc

SEQ ID NO: 75272 - DNA, 25 bp, Mus musculus
aatgagccagctcttagaaagcatg

SEQ ID NO: 75273 - DNA, 25 bp, Mus musculus
aatgagccccatccccaaatggtgc

SEQ ID NO: 75274 - DNA, 25 bp, Mus musculus
aatgagcctaaactgacaccgctgg

SEQ ID NO: 75275 - DNA, 25 bp, Mus musculus
aatgagcgaacaggtcagaatgacc

SEQ ID NO: 75276 - DNA, 25 bp, Mus musculus
aatgagctagagagggcactcacgc

SEQ ID NO: 75277 - DNA, 25 bp, Mus musculus
aatgagctcattgcccactgtcacg

SEQ ID NO: 75278 - DNA, 25 bp, Mus musculus
aatgagctggccgagtttgcccgct

SEQ ID NO: 75279 - DNA, 25 bp, Mus musculus
aatgaggaatacgacgtgatcgtgc

SEQ ID NO: 75280 - DNA, 25 bp, Mus musculus
aatgaggacatcgttggaaggctcg

SEQ ID NO: 75281 - DNA, 25 bp, Mus musculus
aatgaggcagaaggaagtgttagcc

SEQ ID NO: 75282 - DNA, 25 bp, Mus musculus
aatgaggctcctgcggatacagcga

SEQ ID NO: 75283 - DNA, 25 bp, Mus musculus
aatgaggtccgctgcttgctgggtc

SEQ ID NO: 75284 - DNA, 25 bp, Mus musculus
aatgagtcagtcttggcagggccag

SEQ ID NO: 75285 - DNA, 25 bp, Mus musculus
aatgagtcgggctaccagtggctcc

SEQ ID NO: 75286 - DNA, 25 bp, Mus musculus
aatgagtgcttccagtcgcggagca

SEQ ID NO: 75287 - DNA, 25 bp, Mus musculus
aatgagtgtcttctgcctgctgtcg

SEQ ID NO: 75288 - DNA, 25 bp, Mus musculus
aatgagtgtcttgagagcccaggca

SEQ ID NO: 75289 - DNA, 25 bp, Mus musculus
aatgagttaaaacagcagagaaagc

SEQ ID NO: 75290 - DNA, 25 bp, Mus musculus
aatgagttaagcgacatgagcagga

SEQ ID NO: 75291 - DNA, 25 bp, Mus musculus
aatgagttcacgctagcctttacga

SEQ ID NO: 75292 - DNA, 25 bp, Mus musculus
aatgagttcagccacgacagtcgca

SEQ ID NO: 75293 - DNA, 25 bp, Mus musculus
aatgatacccaagctaaaaacacgg

SEQ ID NO: 75294 - DNA, 25 bp, Mus musculus
aatgatattcagtggtgtttttctc

SEQ ID NO: 75295 - DNA, 25 bp, Mus musculus
aatgatcacacttttggtggcaaag

SEQ ID NO: 75296 - DNA, 25 bp, Mus musculus
aatgatcagatacagcgggccgact

SEQ ID NO: 75297 - DNA, 25 bp, Mus musculus
aatgatccactggaagcagcacgtg

SEQ ID NO: 75298 - DNA, 25 bp, Mus musculus
aatgatcccagggacaagccaaggc

SEQ ID NO: 75299 - DNA, 25 bp, Mus musculus
aatgatcgggattgcgtctgcaggc

SEQ ID NO: 75300 - DNA, 25 bp, Mus musculus
aatgatctacaaatgggagaatttc

SEQ ID NO: 75301 - DNA, 25 bp, Mus musculus
aatgatgcgactttccctttgctcc

SEQ ID NO: 75302 - DNA, 25 bp, Mus musculus
aatgatgctgctgatatgacacacc

SEQ ID NO: 75303 - DNA, 25 bp, Mus musculus
aatgatgggctttgtggtctggcac

SEQ ID NO: 75304 - DNA, 25 bp, Mus musculus
aatgatgtaccaggagccagcacga

SEQ ID NO: 75305 - DNA, 25 bp, Mus musculus
aatgatgtcagcagtttcctgttgg

SEQ ID NO: 75306 - DNA, 25 bp, Mus musculus
aatgatgtcattcccaccatggccc

SEQ ID NO: 75307 - DNA, 25 bp, Mus musculus
aatgatgtgaaacttgacttcaagg

SEQ ID NO: 75308 - DNA, 25 bp, Mus musculus
aatgatttgcctcgctctcctgcca

SEQ ID NO: 75309 - DNA, 25 bp, Mus musculus
aatgcaaagaactgcccggagcgag

SEQ ID NO: 75310 - DNA, 25 bp, Mus musculus
aatgcaaccttcacttgggccaggg

SEQ ID NO: 75311 - DNA, 25 bp, Mus musculus
aatgcaaggaacttcggccagaggc

SEQ ID NO: 75312 - DNA, 25 bp, Mus musculus
aatgcaaggacagctctccacactg

SEQ ID NO: 75313 - DNA, 25 bp, Mus musculus
aatgcaagggtgtcattgacctggc

SEQ ID NO: 75314 - DNA, 25 bp, Mus musculus
aatgcaagttcagacagaaacccag

SEQ ID NO: 75315 - DNA, 25 bp, Mus musculus
aatgcaatcgacacaaaccctggcg

SEQ ID NO: 75316 - DNA, 25 bp, Mus musculus
aatgcaatgcgatctggagttccca

SEQ ID NO: 75317 - DNA, 25 bp, Mus musculus
aatgcaattgatgggagcctgctgc

SEQ ID NO: 75318 - DNA, 25 bp, Mus musculus
aatgcacccagaaaataaactgacc

SEQ ID NO: 75319 - DNA, 25 bp, Mus musculus
aatgcagccaatgaaggactacgcc

SEQ ID NO: 75320 - DNA, 25 bp, Mus musculus
aatgcagcctgcagaacagccatgg

SEQ ID NO: 75321 - DNA, 25 bp, Mus musculus
aatgcaggtgctccaaactcagtcc

SEQ ID NO: 75322 - DNA, 25 bp, Mus musculus
aatgcagttcagttttccgtttcgg

SEQ ID NO: 75323 - DNA, 25 bp, Mus musculus
aatgcatcgccagagctccaagagt

SEQ ID NO: 75324 - DNA, 25 bp, Mus musculus
aatgcatcgtgctggaccgagtgcc

SEQ ID NO: 75325 - DNA, 25 bp, Mus musculus
aatgcatctatttggcctcaactgg

SEQ ID NO: 75326 - DNA, 25 bp, Mus musculus
aatgccaaggctaccttcttgctgc

SEQ ID NO: 75327 - DNA, 25 bp, Mus musculus
aatgccaatgcagctgcaggacttg

SEQ ID NO: 75328 - DNA, 25 bp, Mus musculus
aatgccaccgtggagagtgccagag

SEQ ID NO: 75329 - DNA, 25 bp, Mus musculus
aatgccagcatggactttgcagacc

SEQ ID NO: 75330 - DNA, 25 bp, Mus musculus
aatgccagctgggtcggcctttgca

SEQ ID NO: 75331 - DNA, 25 bp, Mus musculus
aatgccatgaacagggctttctgga

SEQ ID NO: 75332 - DNA, 25 bp, Mus musculus
aatgccatgctctttgccctgaaca

SEQ ID NO: 75333 - DNA, 25 bp, Mus musculus
aatgcccaagcctgcaagacgctga

SEQ ID NO: 75334 - DNA, 25 bp, Mus musculus
aatgcccagtaagtgtgtcttcagc

SEQ ID NO: 75335 - DNA, 25 bp, Mus musculus
aatgcccctagttaccgagcctgtg

SEQ ID NO: 75336 - DNA, 25 bp, Mus musculus
aatgcccgggacatgccagatagag

SEQ ID NO: 75337 - DNA, 25 bp, Mus musculus
aatgccctgcacgatgggagcctga

SEQ ID NO: 75338 - DNA, 25 bp, Mus musculus
aatgccctgccagcaagtgacgtga

SEQ ID NO: 75339 - DNA, 25 bp, Mus musculus
aatgccctggagtttgctgactgga

SEQ ID NO: 75340 - DNA, 25 bp, Mus musculus
aatgccgacgctttaggtacaccca

SEQ ID NO: 75341 - DNA, 25 bp, Mus musculus
aatgccggcgagttcttcagggacc

SEQ ID NO: 75342 - DNA, 25 bp, Mus musculus
aatgccgtggcttggtgcttctccg

SEQ ID NO: 75343 - DNA, 25 bp, Mus musculus
aatgccgtgggctgatcaacgtcaa

SEQ ID NO: 75344 - DNA, 25 bp, Mus musculus
aatgccgtgtcctcatcccatgggc

SEQ ID NO: 75345 - DNA, 25 bp, Mus musculus
aatgccgtttgagctccgcgtggaa

SEQ ID NO: 75346 - DNA, 25 bp, Mus musculus
aatgcctcggatgcagaactgtgtg

SEQ ID NO: 75347 - DNA, 25 bp, Mus musculus
aatgcctgaggctagggaatcccct

SEQ ID NO: 75348 - DNA, 25 bp, Mus musculus
aatgcctgcagatgctgtgggcgcc

SEQ ID NO: 75349 - DNA, 25 bp, Mus musculus
aatgcctgtgaagatggtcgcggtc

SEQ ID NO: 75350 - DNA, 25 bp, Mus musculus
aatgcgatggctgtggagcgggcac

SEQ ID NO: 75351 - DNA, 25 bp, Mus musculus
aatgcgccagatcttagctgctcgg

SEQ ID NO: 75352 - DNA, 25 bp, Mus musculus
aatgcgccatgagttggagcgagcc

SEQ ID NO: 75353 - DNA, 25 bp, Mus musculus
aatgcgctgtccgtgcacgtggtgc

SEQ ID NO: 75354 - DNA, 25 bp, Mus musculus
aatgcggaagatggtgagacagccc

SEQ ID NO: 75355 - DNA, 25 bp, Mus musculus
aatgctaaactctactgtaatcggg

SEQ ID NO: 75356 - DNA, 25 bp, Mus musculus
aatgctacgctttccggccttgaga

SEQ ID NO: 75357 - DNA, 25 bp, Mus musculus
aatgctagagcgagagaagtccctg

SEQ ID NO: 75358 - DNA, 25 bp, Mus musculus
aatgctaggcacagtcaagggagag

SEQ ID NO: 75359 - DNA, 25 bp, Mus musculus
aatgctaggcggaatgaagatggac

SEQ ID NO: 75360 - DNA, 25 bp, Mus musculus
aatgctaggctacatggcgggttca

SEQ ID NO: 75361 - DNA, 25 bp, Mus musculus
aatgctatatagtgtgcccggaatg

SEQ ID NO: 75362 - DNA, 25 bp, Mus musculus
aatgctcactatacggtatgtgcct

SEQ ID NO: 75363 - DNA, 25 bp, Mus musculus
aatgctcagatgttggcccagcgcc

SEQ ID NO: 75364 - DNA, 25 bp, Mus musculus
aatgctcagcttcgttttaagaaag

SEQ ID NO: 75365 - DNA, 25 bp, Mus musculus
aatgctcgctggcttgaggctcgca

SEQ ID NO: 75366 - DNA, 25 bp, Mus musculus
aatgctcggataacggtgacgggac

SEQ ID NO: 75367 - DNA, 25 bp, Mus musculus
aatgctcgtcggcttctgggtgatc

SEQ ID NO: 75368 - DNA, 25 bp, Mus musculus
aatgctctcatccttatcgggcaga

SEQ ID NO: 75369 - DNA, 25 bp, Mus musculus
aatgctgactttgcaaaatgacccg

SEQ ID NO: 75370 - DNA, 25 bp, Mus musculus
aatgctgatgctctgtatgtccggg

SEQ ID NO: 75371 - DNA, 25 bp, Mus musculus
aatgctggatctacagggtgctgcc

SEQ ID NO: 75372 - DNA, 25 bp, Mus musculus
aatgctggcatgacaagagtggacc

SEQ ID NO: 75373 - DNA, 25 bp, Mus musculus
aatgctgggccttggtgagacagac

SEQ ID NO: 75374 - DNA, 25 bp, Mus musculus
aatgctgtggcaagtatagggccca

SEQ ID NO: 75375 - DNA, 25 bp, Mus musculus
aatgctgtgggtgtcatttgggcaa

SEQ ID NO: 75376 - DNA, 25 bp, Mus musculus
aatgcttcaaggaacggcgagtcac

SEQ ID NO: 75377 - DNA, 25 bp, Mus musculus
aatgcttgaaagtccatgacctggc

SEQ ID NO: 75378 - DNA, 25 bp, Mus musculus
aatgctttaagttcgctctggggaa

SEQ ID NO: 75379 - DNA, 25 bp, Mus musculus
aatgctttgagagttctccggtggc

SEQ ID NO: 75380 - DNA, 25 bp, Mus musculus
aatggaaagaccacgataatgaaga

SEQ ID NO: 75381 - DNA, 25 bp, Mus musculus
aatggaaccacacccgaggagtgcc

SEQ ID NO: 75382 - DNA, 25 bp, Mus musculus
aatggaacccaacctgcagttctgg

SEQ ID NO: 75383 - DNA, 25 bp, Mus musculus
aatggaacctgagtggctgggaccc

SEQ ID NO: 75384 - DNA, 25 bp, Mus musculus
aatggaagatatggccgtcgtaaac

SEQ ID NO: 75385 - DNA, 25 bp, Mus musculus
aatggaagctgaacatacctgtccg

SEQ ID NO: 75386 - DNA, 25 bp, Mus musculus
aatggaatggctgttggcccctgca

SEQ ID NO: 75387 - DNA, 25 bp, Mus musculus
aatggacagcgatgcccttcttccc

SEQ ID NO: 75388 - DNA, 25 bp, Mus musculus
aatggacatgcaaggcttgtggaga

SEQ ID NO: 75389 - DNA, 25 bp, Mus musculus
aatggacatgtccatactgccgggc

SEQ ID NO: 75390 - DNA, 25 bp, Mus musculus
aatggacattcctttccttggtgaa

SEQ ID NO: 75391 - DNA, 25 bp, Mus musculus
aatggacatttggacttcccctgcg

SEQ ID NO: 75392 - DNA, 25 bp, Mus musculus
aatggacccgaaagccttatgtgcg

SEQ ID NO: 75393 - DNA, 25 bp, Mus musculus
aatggacccttgcagtggcttgaca

SEQ ID NO: 75394 - DNA, 25 bp, Mus musculus
aatggacgccctaaattctgagacg

SEQ ID NO: 75395 - DNA, 25 bp, Mus musculus
aatggactcgctacagaagcaggaa

SEQ ID NO: 75396 - DNA, 25 bp, Mus musculus
aatggactctggagcgcctcaaaag

SEQ ID NO: 75397 - DNA, 25 bp, Mus musculus
aatggactgacctcatcttcccgag

SEQ ID NO: 75398 - DNA, 25 bp, Mus musculus
aatggactgcgcttgctgtatttga

SEQ ID NO: 75399 - DNA, 25 bp, Mus musculus
aatggacttccatctgtgtgcatgc

SEQ ID NO: 75400 - DNA, 25 bp, Mus musculus
aatggagacgcggtcgccgctcagc

SEQ ID NO: 75401 - DNA, 25 bp, Mus musculus
aatggagagcacatatcccggtcgc

SEQ ID NO: 75402 - DNA, 25 bp, Mus musculus
aatggagcctgtgataacatgcgac

SEQ ID NO: 75403 - DNA, 25 bp, Mus musculus
aatggagctccagaagacgaagaga

SEQ ID NO: 75404 - DNA, 25 bp, Mus musculus
aatggaggcatgtagccccagctca

SEQ ID NO: 75405 - DNA, 25 bp, Mus musculus
aatggaggcctctgtattgacacgg

SEQ ID NO: 75406 - DNA, 25 bp, Mus musculus
aatggagggcttcttaccagtcaga

SEQ ID NO: 75407 - DNA, 25 bp, Mus musculus
aatggagtaccatgtagatgagcac

SEQ ID NO: 75408 - DNA, 25 bp, Mus musculus
aatggagtccggagctcgccccatt

SEQ ID NO: 75409 - DNA, 25 bp, Mus musculus
aatggatccaccgttcctgctcagg

SEQ ID NO: 75410 - DNA, 25 bp, Mus musculus
aatggatctccctgccatcatggtg

SEQ ID NO: 75411 - DNA, 25 bp, Mus musculus
aatggatctgcgaaccctgacctgt

SEQ ID NO: 75412 - DNA, 25 bp, Mus musculus
aatggatggagctggccgccccacc

SEQ ID NO: 75413 - DNA, 25 bp, Mus musculus
aatggattccggcacgatggttcga

SEQ ID NO: 75414 - DNA, 25 bp, Mus musculus
aatggattgcgtgatatattagctg

SEQ ID NO: 75415 - DNA, 25 bp, Mus musculus
aatggcaaccaagctgtatcgcacg

SEQ ID NO: 75416 - DNA, 25 bp, Mus musculus
aatggcaacgcgtacctaaacaccg

SEQ ID NO: 75417 - DNA, 25 bp, Mus musculus
aatggcaccgactggtacagcaggc

SEQ ID NO: 75418 - DNA, 25 bp, Mus musculus
aatggcagcaacgactcagacggta

SEQ ID NO: 75419 - DNA, 25 bp, Mus musculus
aatggcagcggctaggttgagtcat

SEQ ID NO: 75420 - DNA, 25 bp, Mus musculus
aatggcagctgtggatgacttacag

SEQ ID NO: 75421 - DNA, 25 bp, Mus musculus
aatggcagggcacctctcagagtca

SEQ ID NO: 75422 - DNA, 25 bp, Mus musculus
aatggcaggtgcctcttggcagcac

SEQ ID NO: 75423 - DNA, 25 bp, Mus musculus
aatggcatgacggacaagaaggctc

SEQ ID NO: 75424 - DNA, 25 bp, Mus musculus
aatggcatgccacttgacctccagg

SEQ ID NO: 75425 - DNA, 25 bp, Mus musculus
aatggccaagtgtgtcaaagctgtc

SEQ ID NO: 75426 - DNA, 25 bp, Mus musculus
aatggccatgcgcatcatagaccgg

SEQ ID NO: 75427 - DNA, 25 bp, Mus musculus
aatggcctggactgcactacactgt

SEQ ID NO: 75428 - DNA, 25 bp, Mus musculus
aatggcgacactgcaccgcaaagtg

SEQ ID NO: 75429 - DNA, 25 bp, Mus musculus
aatggcgaggtataccagaggaaga

SEQ ID NO: 75430 - DNA, 25 bp, Mus musculus
aatggcgcatgttgaagtaccggtc

SEQ ID NO: 75431 - DNA, 25 bp, Mus musculus
aatggcggcatctgccctatcacag

SEQ ID NO: 75432 - DNA, 25 bp, Mus musculus
aatggcggcgtccatgttctacggc

SEQ ID NO: 75433 - DNA, 25 bp, Mus musculus
aatggcgtgagtaggaaacaactgc

SEQ ID NO: 75434 - DNA, 25 bp, Mus musculus
aatggcgttcctgcatggtggtacc

SEQ ID NO: 75435 - DNA, 25 bp, Mus musculus
aatggctacaacacagactacggcg

SEQ ID NO: 75436 - DNA, 25 bp, Mus musculus
aatggctacagcgtgcctggcaaga

SEQ ID NO: 75437 - DNA, 25 bp, Mus musculus
aatggctaccaagaagtaaatgccc

SEQ ID NO: 75438 - DNA, 25 bp, Mus musculus
aatggctagttggaagagtaccctc

SEQ ID NO: 75439 - DNA, 25 bp, Mus musculus
aatggctccgttggcaaagtgcccg

SEQ ID NO: 75440 - DNA, 25 bp, Mus musculus
aatggctcgtttgcactcagtgtca

SEQ ID NO: 75441 - DNA, 25 bp, Mus musculus
aatggctgaccgcaacctggaccag

SEQ ID NO: 75442 - DNA, 25 bp, Mus musculus
aatggctggctaggaaattcttcgg

SEQ ID NO: 75443 - DNA, 25 bp, Mus musculus
aatggctgtccaaagaacagatcgc

SEQ ID NO: 75444 - DNA, 25 bp, Mus musculus
aatggcttgaagtccttggctgcgg

SEQ ID NO: 75445 - DNA, 25 bp, Mus musculus
aatgggaaatgcaccttaagacaaa

SEQ ID NO: 75446 - DNA, 25 bp, Mus musculus
aatgggaacatgaacttggccctcc

SEQ ID NO: 75447 - DNA, 25 bp, Mus musculus
aatgggacagcctcagtgacaaggg

SEQ ID NO: 75448 - DNA, 25 bp, Mus musculus
aatgggacagctacggtgatcctcc

SEQ ID NO: 75449 - DNA, 25 bp, Mus musculus
aatgggagcagcgtccttacttctt

SEQ ID NO: 75450 - DNA, 25 bp, Mus musculus
aatgggcacttaggactcttggcac

SEQ ID NO: 75451 - DNA, 25 bp, Mus musculus
aatgggcagacagtccaggtccatg

SEQ ID NO: 75452 - DNA, 25 bp, Mus musculus
aatgggcagtatcttccagcagaca

SEQ ID NO: 75453 - DNA, 25 bp, Mus musculus
aatgggccggctgctttggcatcaa

SEQ ID NO: 75454 - DNA, 25 bp, Mus musculus
aatgggcctgcctggactgaaccag

SEQ ID NO: 75455 - DNA, 25 bp, Mus musculus
aatgggctcctgatacgacttgctg

SEQ ID NO: 75456 - DNA, 25 bp, Mus musculus
aatgggctgcgtcctgaaatctcag

SEQ ID NO: 75457 - DNA, 25 bp, Mus musculus
aatgggtacgtatggtgcggccaaa

SEQ ID NO: 75458 - DNA, 25 bp, Mus musculus
aatgggtaggtcaacagaaagtgcc

SEQ ID NO: 75459 - DNA, 25 bp, Mus musculus
aatgggtcctgctccttacacaacg

SEQ ID NO: 75460 - DNA, 25 bp, Mus musculus
aatgggtcgcaacagcagccgaatc

SEQ ID NO: 75461 - DNA, 25 bp, Mus musculus
aatgggtctccagtcttaaccaacg

SEQ ID NO: 75462 - DNA, 25 bp, Mus musculus
aatgggtgactgtgggtgatacctc

SEQ ID NO: 75463 - DNA, 25 bp, Mus musculus
aatgggtggtagaaaagatgagcaa

SEQ ID NO: 75464 - DNA, 25 bp, Mus musculus
aatgggttctgagcgatccctggtg

SEQ ID NO: 75465 - DNA, 25 bp, Mus musculus
aatggtatacgatgagcagctgccc

SEQ ID NO: 75466 - DNA, 25 bp, Mus musculus
aatggtcttgttcccttgccggtca

SEQ ID NO: 75467 - DNA, 25 bp, Mus musculus
aatggtgcgcaacgacatgttctac

SEQ ID NO: 75468 - DNA, 25 bp, Mus musculus
aatggtggaccagcttcaaggaaca

SEQ ID NO: 75469 - DNA, 25 bp, Mus musculus
aatggtggcattccacatgataacc

SEQ ID NO: 75470 - DNA, 25 bp, Mus musculus
aatggtgtgggcaattctttctgcc

SEQ ID NO: 75471 - DNA, 25 bp, Mus musculus
aatggtgttgcagctcaaacacaaa

SEQ ID NO: 75472 - DNA, 25 bp, Mus musculus
aatgtaaacagaatgggagtgccca

SEQ ID NO: 75473 - DNA, 25 bp, Mus musculus
aatgtaacttggctccgctccgtgg

SEQ ID NO: 75474 - DNA, 25 bp, Mus musculus
aatgtaagctggtggtgaagcctcc

SEQ ID NO: 75475 - DNA, 25 bp, Mus musculus
aatgtaatcatcctaggacccacgg

SEQ ID NO: 75476 - DNA, 25 bp, Mus musculus
aatgtaccggaatgaggatggttcc

SEQ ID NO: 75477 - DNA, 25 bp, Mus musculus
aatgtacgagcaccttttccccgag

SEQ ID NO: 75478 - DNA, 25 bp, Mus musculus
aatgtacttcttacaggatctggcc

SEQ ID NO: 75479 - DNA, 25 bp, Mus musculus
aatgtagcggaactgaagaacttgg

SEQ ID NO: 75480 - DNA, 25 bp, Mus musculus
aatgtaggtcaggacaccgaggcca

SEQ ID NO: 75481 - DNA, 25 bp, Mus musculus
aatgtataacgatgcctcctgggag

SEQ ID NO: 75482 - DNA, 25 bp, Mus musculus
aatgtcaaccggaatgcagccgtgg

SEQ ID NO: 75483 - DNA, 25 bp, Mus musculus
aatgtcaagacctgttgctccggga

SEQ ID NO: 75484 - DNA, 25 bp, Mus musculus
aatgtcagcccaggacaattgggcc

SEQ ID NO: 75485 - DNA, 25 bp, Mus musculus
aatgtcagcgtggaccatgggcgcc

SEQ ID NO: 75486 - DNA, 25 bp, Mus musculus
aatgtcaggctgttgctttgtccaa

SEQ ID NO: 75487 - DNA, 25 bp, Mus musculus
aatgtcatcgagtgcacgctgtcgg

SEQ ID NO: 75488 - DNA, 25 bp, Mus musculus
aatgtccagaggaggcgtatgaccc

SEQ ID NO: 75489 - DNA, 25 bp, Mus musculus
aatgtcccgtttcctcaagttcagc

SEQ ID NO: 75490 - DNA, 25 bp, Mus musculus
aatgtccctgtgcttagttcggagg

SEQ ID NO: 75491 - DNA, 25 bp, Mus musculus
aatgtcctggcctgtgcttgtcgcg

SEQ ID NO: 75492 - DNA, 25 bp, Mus musculus
aatgtcgaagaagtggtaaatgaca

SEQ ID NO: 75493 - DNA, 25 bp, Mus musculus
aatgtcgacctcatcgctgcggcgt

SEQ ID NO: 75494 - DNA, 25 bp, Mus musculus
aatgtcgtgttcagttccagccggg

SEQ ID NO: 75495 - DNA, 25 bp, Mus musculus
aatgtctactgtgatacccaatcag

SEQ ID NO: 75496 - DNA, 25 bp, Mus musculus
aatgtctccaaagggctagctgacc

SEQ ID NO: 75497 - DNA, 25 bp, Mus musculus
aatgtctctgaagtgccagcgtcgg

SEQ ID NO: 75498 - DNA, 25 bp, Mus musculus
aatgtctgccggagcatcagtggga

SEQ ID NO: 75499 - DNA, 25 bp, Mus musculus
aatgtctgtcaacgtcaaccgcagc

SEQ ID NO: 75500 - DNA, 25 bp, Mus musculus
aatgtcttcagtgtgcaggtccagg

SEQ ID NO: 75501 - DNA, 25 bp, Mus musculus
aatgtctttgaaccccatgtggctg

SEQ ID NO: 75502 - DNA, 25 bp, Mus musculus
aatgtgaaccccacgaacactaggc

SEQ ID NO: 75503 - DNA, 25 bp, Mus musculus
aatgtgacaggattggacctttcag

SEQ ID NO: 75504 - DNA, 25 bp, Mus musculus
aatgtgacttcccagcatggcctca

SEQ ID NO: 75505 - DNA, 25 bp, Mus musculus
aatgtgagctcttccagaaaactgg

SEQ ID NO: 75506 - DNA, 25 bp, Mus musculus
aatgtgagtcatttacctgggcagg

SEQ ID NO: 75507 - DNA, 25 bp, Mus musculus
aatgtgccgatctgctgtgaggacc

SEQ ID NO: 75508 - DNA, 25 bp, Mus musculus
aatgtgcgcaggagtacctatcccg

SEQ ID NO: 75509 - DNA, 25 bp, Mus musculus
aatgtgcggaattccctgtggagac

SEQ ID NO: 75510 - DNA, 25 bp, Mus musculus
aatgtgctggcgcagatcctcaagc

SEQ ID NO: 75511 - DNA, 25 bp, Mus musculus
aatgtggacgctaacaatgacgggc

SEQ ID NO: 75512 - DNA, 25 bp, Mus musculus
aatgtggagcctcaataactggtcc

SEQ ID NO: 75513 - DNA, 25 bp, Mus musculus
aatgtggatcgattctaccccgtgc

SEQ ID NO: 75514 - DNA, 25 bp, Mus musculus
aatgtgggactgagcggcccagccg

SEQ ID NO: 75515 - DNA, 25 bp, Mus musculus
aatgtgggatgtgtcagcagcctca

SEQ ID NO: 75516 - DNA, 25 bp, Mus musculus
aatgtggttcctattcatgttccgc

SEQ ID NO: 75517 - DNA, 25 bp, Mus musculus
aatgtgtgtacatccttgagggccg

SEQ ID NO: 75518 - DNA, 25 bp, Mus musculus
aatgttaacctcatcgtcacgagcg

SEQ ID NO: 75519 - DNA, 25 bp, Mus musculus
aatgttacccttcaacttggccgag

SEQ ID NO: 75520 - DNA, 25 bp, Mus musculus
aatgttcaagcccatgagagaaatc

SEQ ID NO: 75521 - DNA, 25 bp, Mus musculus
aatgttccttcgcaagtagcctcgg

SEQ ID NO: 75522 - DNA, 25 bp, Mus musculus
aatgttcgaatcttaccacagacag

SEQ ID NO: 75523 - DNA, 25 bp, Mus musculus
aatgttcgggaacagctccagcagg

SEQ ID NO: 75524 - DNA, 25 bp, Mus musculus
aatgttcttcattgtcatgcctggc

SEQ ID NO: 75525 - DNA, 25 bp, Mus musculus
aatgttgagcatagcagtcacctag

SEQ ID NO: 75526 - DNA, 25 bp, Mus musculus
aatgttgcacctctggcgcggagct

SEQ ID NO: 75527 - DNA, 25 bp, Mus musculus
aatgttgctgcctttgagcgccggg

SEQ ID NO: 75528 - DNA, 25 bp, Mus musculus
aatgttgtttagttgatgacccaag

SEQ ID NO: 75529 - DNA, 25 bp, Mus musculus
aatgtttacgcaaagtgacactggg

SEQ ID NO: 75530 - DNA, 25 bp, Mus musculus
aatgtttcctgtcgccaaatgcaga

SEQ ID NO: 75531 - DNA, 25 bp, Mus musculus
aatgtttctcagactcagccaggag

SEQ ID NO: 75532 - DNA, 25 bp, Mus musculus
aatgtttgacactccgaaagactgg

SEQ ID NO: 75533 - DNA, 25 bp, Mus musculus
aattaaagccctgaaccagatccgg

SEQ ID NO: 75534 - DNA, 25 bp, Mus musculus
aattaaagttcacaggtgcctcctg

SEQ ID NO: 75535 - DNA, 25 bp, Mus musculus
aattaactacctttgacctacagag

SEQ ID NO: 75536 - DNA, 25 bp, Mus musculus
aattaagaacatgggctcctgggcc

SEQ ID NO: 75537 - DNA, 25 bp, Mus musculus
aattaagatccccaaggcacggaag

SEQ ID NO: 75538 - DNA, 25 bp, Mus musculus
aattaagtcctcctgggccgctagg

SEQ ID NO: 75539 - DNA, 25 bp, Mus musculus
aattaatgtcggagaaagaagcccg

SEQ ID NO: 75540 - DNA, 25 bp, Mus musculus
aattaattcggccatggtcctggat

SEQ ID NO: 75541 - DNA, 25 bp, Mus musculus
aattacaccggacccataagctagg

SEQ ID NO: 75542 - DNA, 25 bp, Mus musculus
aattacacctgcgagtttgccacgt

SEQ ID NO: 75543 - DNA, 25 bp, Mus musculus
aattacatctgtgacgagtgcgggc

SEQ ID NO: 75544 - DNA, 25 bp, Mus musculus
aattacccatcggtagcaagagggc

SEQ ID NO: 75545 - DNA, 25 bp, Mus musculus
aattacgcatatccattaccagagg

SEQ ID NO: 75546 - DNA, 25 bp, Mus musculus
aattactccggaagaaactagctgc

SEQ ID NO: 75547 - DNA, 25 bp, Mus musculus
aattacttgaaatagccaaagctaa

SEQ ID NO: 75548 - DNA, 25 bp, Mus musculus
aattagagaggtgtccagtggctcc

SEQ ID NO: 75549 - DNA, 25 bp, Mus musculus
aattagagctggtgttttgtgccac

SEQ ID NO: 75550 - DNA, 25 bp, Mus musculus
aattagatgctatgttcccagaagg

SEQ ID NO: 75551 - DNA, 25 bp, Mus musculus
aattagctacagatcagggcggccc

SEQ ID NO: 75552 - DNA, 25 bp, Mus musculus
aattagctcccagtgtcttgttaca

SEQ ID NO: 75553 - DNA, 25 bp, Mus musculus
aattaggtgccaacttgccctgtga

SEQ ID NO: 75554 - DNA, 25 bp, Mus musculus
aattagtcttgattcaagatgcgcc

SEQ ID NO: 75555 - DNA, 25 bp, Mus musculus
aattatagctgaaaccctgcagagg

SEQ ID NO: 75556 - DNA, 25 bp, Mus musculus
aattatcactttggctggaccgact

SEQ ID NO: 75557 - DNA, 25 bp, Mus musculus
aattatctcccagcgattaatggca

SEQ ID NO: 75558 - DNA, 25 bp, Mus musculus
aattatgacaatcttgtgttcctgg

SEQ ID NO: 75559 - DNA, 25 bp, Mus musculus
aattatgagtattatgtccaaggac

SEQ ID NO: 75560 - DNA, 25 bp, Mus musculus
aattatggacggatctttgtttagg

SEQ ID NO: 75561 - DNA, 25 bp, Mus musculus
aattatggcagggtggtgctcaacc

SEQ ID NO: 75562 - DNA, 25 bp, Mus musculus
aattatggcaggtttcttggcagcc

SEQ ID NO: 75563 - DNA, 25 bp, Mus musculus
aattatttcctcttgtgtcctactg

SEQ ID NO: 75564 - DNA, 25 bp, Mus musculus
aattcaacagtttgccccggagcag

SEQ ID NO: 75565 - DNA, 25 bp, Mus musculus
aattcaactccgttgcactgggcca

SEQ ID NO: 75566 - DNA, 25 bp, Mus musculus
aattcaaggtgctgtcctaaggcca

SEQ ID NO: 75567 - DNA, 25 bp, Mus musculus
aattcaattacaaagcggcagcagc

SEQ ID NO: 75568 - DNA, 25 bp, Mus musculus
aattcacagaagagcacaaaacaga

SEQ ID NO: 75569 - DNA, 25 bp, Mus musculus
aattcacagagctggttgcccgacg

SEQ ID NO: 75570 - DNA, 25 bp, Mus musculus
aattcaccccgcgtaagcatggagg

SEQ ID NO: 75571 - DNA, 25 bp, Mus musculus
aattcacggcgctgcccaagcggag

SEQ ID NO: 75572 - DNA, 25 bp, Mus musculus
aattcactaggtaggaggctcatca

SEQ ID NO: 75573 - DNA, 25 bp, Mus musculus
aattcagggagcttcgagaacagcc

SEQ ID NO: 75574 - DNA, 25 bp, Mus musculus
aattcagttgagtcatagttcttcc

SEQ ID NO: 75575 - DNA, 25 bp, Mus musculus
aattcatcctccatgagccacctgt

SEQ ID NO: 75576 - DNA, 25 bp, Mus musculus
aattcatccttcagagatgcccggg

SEQ ID NO: 75577 - DNA, 25 bp, Mus musculus
aattcattatacctgagtacagaag

SEQ ID NO: 75578 - DNA, 25 bp, Mus musculus
aattccaagatggatgatcaggacc

SEQ ID NO: 75579 - DNA, 25 bp, Mus musculus
aattccacaggagaacggcaatgcc

SEQ ID NO: 75580 - DNA, 25 bp, Mus musculus
aattccagaggcaagagagcgtccg

SEQ ID NO: 75581 - DNA, 25 bp, Mus musculus
aattccaggcatccacaggtgccgc

SEQ ID NO: 75582 - DNA, 25 bp, Mus musculus
aattccagggagacctgggcctcag

SEQ ID NO: 75583 - DNA, 25 bp, Mus musculus
aattccccatgctgaaaacacttga

SEQ ID NO: 75584 - DNA, 25 bp, Mus musculus
aattcccgccatttgcattaggcag

SEQ ID NO: 75585 - DNA, 25 bp, Mus musculus
aattccgctggactatgggtaaggc

SEQ ID NO: 75586 - DNA, 25 bp, Mus musculus
aattccggcatgtattcggtcagcc

SEQ ID NO: 75587 - DNA, 25 bp, Mus musculus
aattcctgccctgtggttacctgca

SEQ ID NO: 75588 - DNA, 25 bp, Mus musculus
aattcctggagcctgatagctggga

SEQ ID NO: 75589 - DNA, 25 bp, Mus musculus
aattcctgtcagagaatggcatccc

SEQ ID NO: 75590 - DNA, 25 bp, Mus musculus
aattccttgtctaccagctgctgcg

SEQ ID NO: 75591 - DNA, 25 bp, Mus musculus
aattcgagttcggttgcagagcgcg

SEQ ID NO: 75592 - DNA, 25 bp, Mus musculus
aattcgcaagggaactgtggccagg

SEQ ID NO: 75593 - DNA, 25 bp, Mus musculus
aattcgcaggccttctccaagcagg

SEQ ID NO: 75594 - DNA, 25 bp, Mus musculus
aattcggactagacattggccctgc

SEQ ID NO: 75595 - DNA, 25 bp, Mus musculus
aattcggctttctgtgtgactgcac

SEQ ID NO: 75596 - DNA, 25 bp, Mus musculus
aattcgggatgcaccttcaagcagc

SEQ ID NO: 75597 - DNA, 25 bp, Mus musculus
aattcgtacgcttcataggatggac

SEQ ID NO: 75598 - DNA, 25 bp, Mus musculus
aattctacttcctcgtgggctacag

SEQ ID NO: 75599 - DNA, 25 bp, Mus musculus
aattctattggcacacccttggacc

SEQ ID NO: 75600 - DNA, 25 bp, Mus musculus
aattctcaagaagcatccccaagag

SEQ ID NO: 75601 - DNA, 25 bp, Mus musculus
aattctcagggcagtaacagaagcc

SEQ ID NO: 75602 - DNA, 25 bp, Mus musculus
aattctcatcatcgccctggctgga

SEQ ID NO: 75603 - DNA, 25 bp, Mus musculus
aattctcatggaccgctttgggccc

SEQ ID NO: 75604 - DNA, 25 bp, Mus musculus
aattctccatggagctgatggcacc

SEQ ID NO: 75605 - DNA, 25 bp, Mus musculus
aattctcctaacaacataagtggca

SEQ ID NO: 75606 - DNA, 25 bp, Mus musculus
aattctcctagagggccgcgaagtg

SEQ ID NO: 75607 - DNA, 25 bp, Mus musculus
aattctcgtgtcagtcctgtccggg

SEQ ID NO: 75608 - DNA, 25 bp, Mus musculus
aattctctcttcgacgtggtgaccg

SEQ ID NO: 75609 - DNA, 25 bp, Mus musculus
aattctctgtggctgttacggtacg

SEQ ID NO: 75610 - DNA, 25 bp, Mus musculus
aattctgtcatgatccaaagaagac

SEQ ID NO: 75611 - DNA, 25 bp, Mus musculus
aattcttgaagtcatctgcaccgtc

SEQ ID NO: 75612 - DNA, 25 bp, Mus musculus
aattgaagtgaatggaacagaagcc

SEQ ID NO: 75613 - DNA, 25 bp, Mus musculus
aattgaataaagctagccgtgatcc

SEQ ID NO: 75614 - DNA, 25 bp, Mus musculus
aattgagaccaagaaacgagcagcg

SEQ ID NO: 75615 - DNA, 25 bp, Mus musculus
aattgagactcaaagcacctgtgtg

SEQ ID NO: 75616 - DNA, 25 bp, Mus musculus
aattgagcatcaggaacgtggaccc

SEQ ID NO: 75617 - DNA, 25 bp, Mus musculus
aattgagcgaagcttccaggaggcc

SEQ ID NO: 75618 - DNA, 25 bp, Mus musculus
aattgaggagcggtataggcccagc

SEQ ID NO: 75619 - DNA, 25 bp, Mus musculus
aattgaggcactacagaaggcaggc

SEQ ID NO: 75620 - DNA, 25 bp, Mus musculus
aattgagggtgatgccttcatcggc

SEQ ID NO: 75621 - DNA, 25 bp, Mus musculus
aattgaggttcccaccgctgtgttc

SEQ ID NO: 75622 - DNA, 25 bp, Mus musculus
aattgagtcgtctatcctggcccag

SEQ ID NO: 75623 - DNA, 25 bp, Mus musculus
aattgattgctgcagcacaggctgg

SEQ ID NO: 75624 - DNA, 25 bp, Mus musculus
aattgcactcttcaaatctccggga

SEQ ID NO: 75625 - DNA, 25 bp, Mus musculus
aattgccactgtccaggtctacgag

SEQ ID NO: 75626 - DNA, 25 bp, Mus musculus
aattgcgagcacagggtcggcacag

SEQ ID NO: 75627 - DNA, 25 bp, Mus musculus
aattgcgattaccagcaggaagccg

SEQ ID NO: 75628 - DNA, 25 bp, Mus musculus
aattgcggatgaaacgtcttggcca

SEQ ID NO: 75629 - DNA, 25 bp, Mus musculus
aattgcgttcccaactccgtgtgcg

SEQ ID NO: 75630 - DNA, 25 bp, Mus musculus
aattgctccctggacatcagagatg

SEQ ID NO: 75631 - DNA, 25 bp, Mus musculus
aattgctgcagtatgacaggagccc

SEQ ID NO: 75632 - DNA, 25 bp, Mus musculus
aattggacacttgaggataccctgc

SEQ ID NO: 75633 - DNA, 25 bp, Mus musculus
aattggagaaccctcaggagacggc

SEQ ID NO: 75634 - DNA, 25 bp, Mus musculus
aattggagcacttgtaattgtaaca

SEQ ID NO: 75635 - DNA, 25 bp, Mus musculus
aattggaggccactgcagccggata

SEQ ID NO: 75636 - DNA, 25 bp, Mus musculus
aattggaggccgagattcgaaagct

SEQ ID NO: 75637 - DNA, 25 bp, Mus musculus
aattggatgaaccttcgggatgccg

SEQ ID NO: 75638 - DNA, 25 bp, Mus musculus
aattggatgcttgcctttctggatc

SEQ ID NO: 75639 - DNA, 25 bp, Mus musculus
aattggcatcagagaaacagtagca

SEQ ID NO: 75640 - DNA, 25 bp, Mus musculus
aattggcattcttctgaccctgagg

SEQ ID NO: 75641 - DNA, 25 bp, Mus musculus
aattggccagcttgacacttgatca

SEQ ID NO: 75642 - DNA, 25 bp, Mus musculus
aattgggactctagcacatcttgac

SEQ ID NO: 75643 - DNA, 25 bp, Mus musculus
aattgggatgatctcttggcccgcc

SEQ ID NO: 75644 - DNA, 25 bp, Mus musculus
aattgggtccaaaacccctctgatg

SEQ ID NO: 75645 - DNA, 25 bp, Mus musculus
aattgggtcccacaaggagcagtgc

SEQ ID NO: 75646 - DNA, 25 bp, Mus musculus
aattggtccacagggcatcatggga

SEQ ID NO: 75647 - DNA, 25 bp, Mus musculus
aattggttagaatccaggtgacctg

SEQ ID NO: 75648 - DNA, 25 bp, Mus musculus
aattgtaagcaaactctgggccacg

SEQ ID NO: 75649 - DNA, 25 bp, Mus musculus
aattgtagcacactgacctgaaggc

SEQ ID NO: 75650 - DNA, 25 bp, Mus musculus
aattgtagtaactggagacttccgg

SEQ ID NO: 75651 - DNA, 25 bp, Mus musculus
aattgtcacctggagcagaatcggg

SEQ ID NO: 75652 - DNA, 25 bp, Mus musculus
aattgtcactgaggttgctgttggt

SEQ ID NO: 75653 - DNA, 25 bp, Mus musculus
aattgtccagcactagcagtctcag

SEQ ID NO: 75654 - DNA, 25 bp, Mus musculus
aattgtcctccacgcggcttggtcc

SEQ ID NO: 75655 - DNA, 25 bp, Mus musculus
aattgtctgctcctcggtccattgc

SEQ ID NO: 75656 - DNA, 25 bp, Mus musculus
aattgtctgttcacccgctcttggg

SEQ ID NO: 75657 - DNA, 25 bp, Mus musculus
aattgtgcaggacctgttggacgcc

SEQ ID NO: 75658 - DNA, 25 bp, Mus musculus
aattgtgctgccttagctagccaga

SEQ ID NO: 75659 - DNA, 25 bp, Mus musculus
aattgtggccgagccttctgtaacg

SEQ ID NO: 75660 - DNA, 25 bp, Mus musculus
aattgtgtaaaatggcaccgccagg

SEQ ID NO: 75661 - DNA, 25 bp, Mus musculus
aattgtgtgctaacaggtgggcctc

SEQ ID NO: 75662 - DNA, 25 bp, Mus musculus
aattgttcaggacttattgttcacc

SEQ ID NO: 75663 - DNA, 25 bp, Mus musculus
aatttaaggacgcacctgatgggcc

SEQ ID NO: 75664 - DNA, 25 bp, Mus musculus
aatttaccacatatgacatcccgag

SEQ ID NO: 75665 - DNA, 25 bp, Mus musculus
aatttagacagcacaacagtggcga

SEQ ID NO: 75666 - DNA, 25 bp, Mus musculus
aatttagccattccgaagctctggg

SEQ ID NO: 75667 - DNA, 25 bp, Mus musculus
aatttataacaagatcccagggacg

SEQ ID NO: 75668 - DNA, 25 bp, Mus musculus
aatttatgtagtggtcaaagagccc

SEQ ID NO: 75669 - DNA, 25 bp, Mus musculus
aatttcaacacctggataagagaaa

SEQ ID NO: 75670 - DNA, 25 bp, Mus musculus
aatttcatgaacgtgcccaggaggc

SEQ ID NO: 75671 - DNA, 25 bp, Mus musculus
aatttccctgggtaagagagaagct

SEQ ID NO: 75672 - DNA, 25 bp, Mus musculus
aatttcctcaagaggcgtggcaagc

SEQ ID NO: 75673 - DNA, 25 bp, Mus musculus
aatttcgaagcttgagaagaccacc

SEQ ID NO: 75674 - DNA, 25 bp, Mus musculus
aatttcgaatgtggcggcggtagct

SEQ ID NO: 75675 - DNA, 25 bp, Mus musculus
aatttctgaaaactcgggatgacct

SEQ ID NO: 75676 - DNA, 25 bp, Mus musculus
aatttctgcaacttctctctaactc

SEQ ID NO: 75677 - DNA, 25 bp, Mus musculus
aatttcttcggaacaaattagtcag

SEQ ID NO: 75678 - DNA, 25 bp, Mus musculus
aatttctttggcgtctacacccgtg

SEQ ID NO: 75679 - DNA, 25 bp, Mus musculus
aatttgaaccaaagcttgcctgttg

SEQ ID NO: 75680 - DNA, 25 bp, Mus musculus
aatttgagacaaaacgccgtgagca

SEQ ID NO: 75681 - DNA, 25 bp, Mus musculus
aatttgagctgaggaagcatgcccg

SEQ ID NO: 75682 - DNA, 25 bp, Mus musculus
aatttgagctgtgccttcctgacgg

SEQ ID NO: 75683 - DNA, 25 bp, Mus musculus
aatttgatacgcctcttcgatgcac

SEQ ID NO: 75684 - DNA, 25 bp, Mus musculus
aatttgcagccgtaggaacctgtgc

SEQ ID NO: 75685 - DNA, 25 bp, Mus musculus
aatttgccactgtgtgctgcacggc

SEQ ID NO: 75686 - DNA, 25 bp, Mus musculus
aatttgccatcgtgcgcaagtgcca

SEQ ID NO: 75687 - DNA, 25 bp, Mus musculus
aatttggagcagtttataccgcgac

SEQ ID NO: 75688 - DNA, 25 bp, Mus musculus
aatttggccgatgccttcctagcag

SEQ ID NO: 75689 - DNA, 25 bp, Mus musculus
aatttggcgctgtgatggaaggtca

SEQ ID NO: 75690 - DNA, 25 bp, Mus musculus
aatttggtccccaggcagacgtggt

SEQ ID NO: 75691 - DNA, 25 bp, Mus musculus
aatttgtaagaggatacgagctccc

SEQ ID NO: 75692 - DNA, 25 bp, Mus musculus
aatttgtcaagtcgatgcagctggc

SEQ ID NO: 75693 - DNA, 25 bp, Mus musculus
aatttgtccagtgccagtcagtccg

SEQ ID NO: 75694 - DNA, 25 bp, Mus musculus
aatttgtggaggaagagaatcagcc

SEQ ID NO: 75695 - DNA, 25 bp, Mus musculus
aatttgtggatgaccactgccccag

SEQ ID NO: 75696 - DNA, 25 bp, Mus musculus
aattttacctggagacgcaggccgg

SEQ ID NO: 75697 - DNA, 25 bp, Mus musculus
aattttagaccatcctcttcagggc

SEQ ID NO: 75698 - DNA, 25 bp, Mus musculus
aattttagcaatgatctccgagccc

SEQ ID NO: 75699 - DNA, 25 bp, Mus musculus
aattttcacggtcgcgtcacgcggg

SEQ ID NO: 75700 - DNA, 25 bp, Mus musculus
aattttccaaagcttggctcgcgcg

SEQ ID NO: 75701 - DNA, 25 bp, Mus musculus
aattttgtctgaccccagcagctga

SEQ ID NO: 75702 - DNA, 25 bp, Mus musculus
aatttttggattctactggctcacg

SEQ ID NO: 75703 - DNA, 25 bp, Mus musculus
acaaaacagtatgggaggtgccgca

SEQ ID NO: 75704 - DNA, 25 bp, Mus musculus
acaaaactgaggctgggaaatggac

SEQ ID NO: 75705 - DNA, 25 bp, Mus musculus
acaaaactgtttccgaaatgcagac

SEQ ID NO: 75706 - DNA, 25 bp, Mus musculus
acaaaagaacgggactcggagctct

SEQ ID NO: 75707 - DNA, 25 bp, Mus musculus
acaaaagaggtctccgccagtcaag

SEQ ID NO: 75708 - DNA, 25 bp, Mus musculus
acaaaagattaggaggcgcctggcc

SEQ ID NO: 75709 - DNA, 25 bp, Mus musculus
acaaaaggaccatgggtgggcgaca

SEQ ID NO: 75710 - DNA, 25 bp, Mus musculus
acaaaaggctcaggtacagcgtccg

SEQ ID NO: 75711 - DNA, 25 bp, Mus musculus
acaaaagttgttagccatggcagcc

SEQ ID NO: 75712 - DNA, 25 bp, Mus musculus
acaaaatatccacggtgatgcctgg

SEQ ID NO: 75713 - DNA, 25 bp, Mus musculus
acaaaatattctgagcctgggacgg

SEQ ID NO: 75714 - DNA, 25 bp, Mus musculus
acaaaattcattatacctgagtaca

SEQ ID NO: 75715 - DNA, 25 bp, Mus musculus
acaaacggatgtgccaaggatgcca

SEQ ID NO: 75716 - DNA, 25 bp, Mus musculus
acaaactgctcagcactgaaggagc

SEQ ID NO: 75717 - DNA, 25 bp, Mus musculus
acaaagaaagcaccctgaagagatg

SEQ ID NO: 75718 - DNA, 25 bp, Mus musculus
acaaagaagtctatggaggatgcca

SEQ ID NO: 75719 - DNA, 25 bp, Mus musculus
acaaagacaactaactattctgcag

SEQ ID NO: 75720 - DNA, 25 bp, Mus musculus
acaaagaggcctggttccctgcaag

SEQ ID NO: 75721 - DNA, 25 bp, Mus musculus
acaaagaggtactggagcaggccca

SEQ ID NO: 75722 - DNA, 25 bp, Mus musculus
acaaagcagaattggaaagtgatcc

SEQ ID NO: 75723 - DNA, 25 bp, Mus musculus
acaaaggcattgagacagacggttc

SEQ ID NO: 75724 - DNA, 25 bp, Mus musculus
acaaaggccagtgtttcagacccag

SEQ ID NO: 75725 - DNA, 25 bp, Mus musculus
acaaatacaacttctcctttgatta

SEQ ID NO: 75726 - DNA, 25 bp, Mus musculus
acaaatcctaaagccagcaggcggg

SEQ ID NO: 75727 - DNA, 25 bp, Mus musculus
acaaatgcggcggagagatgcacca

SEQ ID NO: 75728 - DNA, 25 bp, Mus musculus
acaaatgtggccgtggtttcaaccg

SEQ ID NO: 75729 - DNA, 25 bp, Mus musculus
acaacaaccttttggcggctcagcg

SEQ ID NO: 75730 - DNA, 25 bp, Mus musculus
acaacaattacgatgagaccctcag

SEQ ID NO: 75731 - DNA, 25 bp, Mus musculus
acaacactggtagccacacgttaca

SEQ ID NO: 75732 - DNA, 25 bp, Mus musculus
acaacagaggcggaacaggaagtcg

SEQ ID NO: 75733 - DNA, 25 bp, Mus musculus
acaacagatcaagcgaactgcccgg

SEQ ID NO: 75734 - DNA, 25 bp, Mus musculus
acaacagcaagaggaacaacaggag

SEQ ID NO: 75735 - DNA, 25 bp, Mus musculus
acaacatggctagcttcgtgcggca

SEQ ID NO: 75736 - DNA, 25 bp, Mus musculus
acaacatgggcaggaagcggaagca

SEQ ID NO: 75737 - DNA, 25 bp, Mus musculus
acaaccaagcccagggcgtgtggcc

SEQ ID NO: 75738 - DNA, 25 bp, Mus musculus
acaaccacaggaacctgggccgaga

SEQ ID NO: 75739 - DNA, 25 bp, Mus musculus
acaaccaggaggtgggacagaccat

SEQ ID NO: 75740 - DNA, 25 bp, Mus musculus
acaaccgctgtaaagacaccctggc

SEQ ID NO: 75741 - DNA, 25 bp, Mus musculus
acaaccggcccagcaatggcaatgg

SEQ ID NO: 75742 - DNA, 25 bp, Mus musculus
acaacctatgccaaagagggagaag

SEQ ID NO: 75743 - DNA, 25 bp, Mus musculus
acaacctccaagaagggtgtgctga

SEQ ID NO: 75744 - DNA, 25 bp, Mus musculus
acaaccttgatccagaaagccatcg

SEQ ID NO: 75745 - DNA, 25 bp, Mus musculus
acaacgcctcgaaagcactggaagg

SEQ ID NO: 75746 - DNA, 25 bp, Mus musculus
acaacggcagcacagagtacggact

SEQ ID NO: 75747 - DNA, 25 bp, Mus musculus
acaacggtgacaggtagctgggacc

SEQ ID NO: 75748 - DNA, 25 bp, Mus musculus
acaacggtgtaaagctggccctgca

SEQ ID NO: 75749 - DNA, 25 bp, Mus musculus
acaacgtctcggcttggtgactcgg

SEQ ID NO: 75750 - DNA, 25 bp, Mus musculus
acaactcacgttggtggcctgggcc

SEQ ID NO: 75751 - DNA, 25 bp, Mus musculus
acaactctgggaagaacatacggcc

SEQ ID NO: 75752 - DNA, 25 bp, Mus musculus
acaactgctgactaatcggcgggcg

SEQ ID NO: 75753 - DNA, 25 bp, Mus musculus
acaactggcacgttacctgggcgga

SEQ ID NO: 75754 - DNA, 25 bp, Mus musculus
acaactgtccatatgattacaaagc

SEQ ID NO: 75755 - DNA, 25 bp, Mus musculus
acaacttagaatagccccagtgccg

SEQ ID NO: 75756 - DNA, 25 bp, Mus musculus
acaacttgggcgaccagatcggcaa

SEQ ID NO: 75757 - DNA, 25 bp, Mus musculus
acaacttgtcttttcagccggctga

SEQ ID NO: 75758 - DNA, 25 bp, Mus musculus
acaagaaacctgagggaagcaccgc

SEQ ID NO: 75759 - DNA, 25 bp, Mus musculus
acaagaacacctgtcctggagaccg

SEQ ID NO: 75760 - DNA, 25 bp, Mus musculus
acaagaagatgccacccaagcgcat

SEQ ID NO: 75761 - DNA, 25 bp, Mus musculus
acaagacagtgacggcccgagaatg

SEQ ID NO: 75762 - DNA, 25 bp, Mus musculus
acaagactgccatggaagaaaatga

SEQ ID NO: 75763 - DNA, 25 bp, Mus musculus
acaagactgtgaagccctaggcgag

SEQ ID NO: 75764 - DNA, 25 bp, Mus musculus
acaagacttccagcttctgccggag

SEQ ID NO: 75765 - DNA, 25 bp, Mus musculus
acaagagagcctctttctcacgcaa

SEQ ID NO: 75766 - DNA, 25 bp, Mus musculus
acaagatggcgcttgtaggacgacg

SEQ ID NO: 75767 - DNA, 25 bp, Mus musculus
acaagatggctccaccggtttcggc

SEQ ID NO: 75768 - DNA, 25 bp, Mus musculus
acaagccaatcgcagccggagttta

SEQ ID NO: 75769 - DNA, 25 bp, Mus musculus
acaagcccagtgactgcggccgaag

SEQ ID NO: 75770 - DNA, 25 bp, Mus musculus
acaagccgccagtacaggcctcttg

SEQ ID NO: 75771 - DNA, 25 bp, Mus musculus
acaagccggcagatgcggtttgaag

SEQ ID NO: 75772 - DNA, 25 bp, Mus musculus
acaagcgaagggaaggcgaggccgg

SEQ ID NO: 75773 - DNA, 25 bp, Mus musculus
acaagcgacctgacatttggtgctc

SEQ ID NO: 75774 - DNA, 25 bp, Mus musculus
acaagctcagaccaagttcaccaag

SEQ ID NO: 75775 - DNA, 25 bp, Mus musculus
acaagctgggccctgtactcaaggc

SEQ ID NO: 75776 - DNA, 25 bp, Mus musculus
acaagctggtggacggctgctactc

SEQ ID NO: 75777 - DNA, 25 bp, Mus musculus
acaaggaagcagacagccgcctggg

SEQ ID NO: 75778 - DNA, 25 bp, Mus musculus
acaaggaaggttgtgaggagtctct

SEQ ID NO: 75779 - DNA, 25 bp, Mus musculus
acaaggaccgagaccgaaagcgacg

SEQ ID NO: 75780 - DNA, 25 bp, Mus musculus
acaaggagaagttggcaaagatggt

SEQ ID NO: 75781 - DNA, 25 bp, Mus musculus
acaaggagcctacgctgggcctcct

SEQ ID NO: 75782 - DNA, 25 bp, Mus musculus
acaaggagggcatttctgagcgcca

SEQ ID NO: 75783 - DNA, 25 bp, Mus musculus
acaagggcccactgccgtcaggctt

SEQ ID NO: 75784 - DNA, 25 bp, Mus musculus
acaagggtctgatgtggcaccgagc

SEQ ID NO: 75785 - DNA, 25 bp, Mus musculus
acaagtactccctgaaagaggccct

SEQ ID NO: 75786 - DNA, 25 bp, Mus musculus
acaagtagctaaggatgtcgccacc

SEQ ID NO: 75787 - DNA, 25 bp, Mus musculus
acaagtcccagaaccgcagtgaaga

SEQ ID NO: 75788 - DNA, 25 bp, Mus musculus
acaagtcgtgaagttctggaggcca

SEQ ID NO: 75789 - DNA, 25 bp, Mus musculus
acaagtgacaggtggcatcaaagcc

SEQ ID NO: 75790 - DNA, 25 bp, Mus musculus
acaagtgacatgaaaccccattggg

SEQ ID NO: 75791 - DNA, 25 bp, Mus musculus
acaagtggtccatccggtatccgca

SEQ ID NO: 75792 - DNA, 25 bp, Mus musculus
acaatacccagagaactcggagcgg

SEQ ID NO: 75793 - DNA, 25 bp, Mus musculus
acaatacggctggaggtagggcacc

SEQ ID NO: 75794 - DNA, 25 bp, Mus musculus
acaatcaatgagtacaccatccgcc

SEQ ID NO: 75795 - DNA, 25 bp, Mus musculus
acaatcatggccctgcagatggacc

SEQ ID NO: 75796 - DNA, 25 bp, Mus musculus
acaatctcgttgtcgggaagcctgg

SEQ ID NO: 75797 - DNA, 25 bp, Mus musculus
acaatgaagggtgaggaggcccaca

SEQ ID NO: 75798 - DNA, 25 bp, Mus musculus
acaatgatggccaacgggaggtcct

SEQ ID NO: 75799 - DNA, 25 bp, Mus musculus
acaatgatgtggaaaatgggacccc

SEQ ID NO: 75800 - DNA, 25 bp, Mus musculus
acaatgccaagctggagatggtgcc

SEQ ID NO: 75801 - DNA, 25 bp, Mus musculus
acaatgcctggtatctgtgcagaaa

SEQ ID NO: 75802 - DNA, 25 bp, Mus musculus
acaatgcggacgtcactgggaccaa

SEQ ID NO: 75803 - DNA, 25 bp, Mus musculus
acaatggtggcaggcgattcaggcc

SEQ ID NO: 75804 - DNA, 25 bp, Mus musculus
acaatgtgggactgagcggcccagc

SEQ ID NO: 75805 - DNA, 25 bp, Mus musculus
acaatgttgcctcgactggtctgca

SEQ ID NO: 75806 - DNA, 25 bp, Mus musculus
acacaaagctctccttttgcccggg

SEQ ID NO: 75807 - DNA, 25 bp, Mus musculus
acacaagacagcagcccttcgaggt

SEQ ID NO: 75808 - DNA, 25 bp, Mus musculus
acacaagcggtcaggcagtcaacaa

SEQ ID NO: 75809 - DNA, 25 bp, Mus musculus
acacacacgtggagggcttcaagga

SEQ ID NO: 75810 - DNA, 25 bp, Mus musculus
acacacagattcaggcagagtcgcc

SEQ ID NO: 75811 - DNA, 25 bp, Mus musculus
acacacttcagtcagcagaactcct

SEQ ID NO: 75812 - DNA, 25 bp, Mus musculus
acacagaaggcagggaccctctgac

SEQ ID NO: 75813 - DNA, 25 bp, Mus musculus
acacagagcctttggcgtatcccgt

SEQ ID NO: 75814 - DNA, 25 bp, Mus musculus
acacagagcgcaggatggagtccca

SEQ ID NO: 75815 - DNA, 25 bp, Mus musculus
acacagcaagatgcgcaggagttcc

SEQ ID NO: 75816 - DNA, 25 bp, Mus musculus
acacagctgagcttaggacgacgcc

SEQ ID NO: 75817 - DNA, 25 bp, Mus musculus
acacaggcggcgacaacggacgaag

SEQ ID NO: 75818 - DNA, 25 bp, Mus musculus
acacaggtctccagcatgggcgcat

SEQ ID NO: 75819 - DNA, 25 bp, Mus musculus
acacatcgacttcctcttttgggag

SEQ ID NO: 75820 - DNA, 25 bp, Mus musculus
acacatgtggtgatggaagggacct

SEQ ID NO: 75821 - DNA, 25 bp, Mus musculus
acacattaggctccacgtggtggaa

SEQ ID NO: 75822 - DNA, 25 bp, Mus musculus
acacattgcacactgtcacgggaca

SEQ ID NO: 75823 - DNA, 25 bp, Mus musculus
acaccaagtttgaagcgctgaccgt

SEQ ID NO: 75824 - DNA, 25 bp, Mus musculus
acaccaatggccgagtcaacgtgga

SEQ ID NO: 75825 - DNA, 25 bp, Mus musculus
acaccactggtaggagacttactgc

SEQ ID NO: 75826 - DNA, 25 bp, Mus musculus
acaccatgatggctctcaggctcag

SEQ ID NO: 75827 - DNA, 25 bp, Mus musculus
acaccatgggccctgagcgtatctt

SEQ ID NO: 75828 - DNA, 25 bp, Mus musculus
acacccaggttgtccgggaagtgca

SEQ ID NO: 75829 - DNA, 25 bp, Mus musculus
acaccgaagagggagcatggctagt

SEQ ID NO: 75830 - DNA, 25 bp, Mus musculus
acaccgagggctattcttctctgga

SEQ ID NO: 75831 - DNA, 25 bp, Mus musculus
acaccgggtggctctggatgagctc

SEQ ID NO: 75832 - DNA, 25 bp, Mus musculus
acaccgtgcgccagcctctgattca

SEQ ID NO: 75833 - DNA, 25 bp, Mus musculus
acaccgtggtatgtgagggccgtcc

SEQ ID NO: 75834 - DNA, 25 bp, Mus musculus
acacctcctttgtgggatgggaaga

SEQ ID NO: 75835 - DNA, 25 bp, Mus musculus
acacctcgggctcttgatcctggca

SEQ ID NO: 75836 - DNA, 25 bp, Mus musculus
acacctggaaagagcagtgtctgga

SEQ ID NO: 75837 - DNA, 25 bp, Mus musculus
acacctgtcctgacccgggaagtga

SEQ ID NO: 75838 - DNA, 25 bp, Mus musculus
acaccttctttgtgggcaatcctga

SEQ ID NO: 75839 - DNA, 25 bp, Mus musculus
acaccttgagcagggcatggtcttg

SEQ ID NO: 75840 - DNA, 25 bp, Mus musculus
acacctttcctgtgggtggccagaa

SEQ ID NO: 75841 - DNA, 25 bp, Mus musculus
acacgaaagtgggagaacgtttgcg

SEQ ID NO: 75842 - DNA, 25 bp, Mus musculus
acacgagtggctctggtaggaccca

SEQ ID NO: 75843 - DNA, 25 bp, Mus musculus
acacgcaagtgggagcaagatcggc

SEQ ID NO: 75844 - DNA, 25 bp, Mus musculus
acacgcgggcatgcggcccgtctct

SEQ ID NO: 75845 - DNA, 25 bp, Mus musculus
acacggaaatcgcacggctgctgct

SEQ ID NO: 75846 - DNA, 25 bp, Mus musculus
acacggacggctactctccaaacag

SEQ ID NO: 75847 - DNA, 25 bp, Mus musculus
acacggatgtgagaagccagtggaa

SEQ ID NO: 75848 - DNA, 25 bp, Mus musculus
acacgggcaccttctggctgactag

SEQ ID NO: 75849 - DNA, 25 bp, Mus musculus
acacgggcctcaccgactgttgcaa

SEQ ID NO: 75850 - DNA, 25 bp, Mus musculus
acacgtacctgctcatcagtgaaga

SEQ ID NO: 75851 - DNA, 25 bp, Mus musculus
acactactggtagaggtcagcaaca

SEQ ID NO: 75852 - DNA, 25 bp, Mus musculus
acactattgggagctacttctgcac

SEQ ID NO: 75853 - DNA, 25 bp, Mus musculus
acactccatctgttgggcctggccg

SEQ ID NO: 75854 - DNA, 25 bp, Mus musculus
acactcgtgggaggcgtggcaaact

SEQ ID NO: 75855 - DNA, 25 bp, Mus musculus
acactgaaaagtggcctgacgatgg

SEQ ID NO: 75856 - DNA, 25 bp, Mus musculus
acactgagagactgaagagcgccct

SEQ ID NO: 75857 - DNA, 25 bp, Mus musculus
acactgagagctcgcggtcgcgact

SEQ ID NO: 75858 - DNA, 25 bp, Mus musculus
acactgcaggacagggtggctacaa

SEQ ID NO: 75859 - DNA, 25 bp, Mus musculus
acactggaccttgtgcagagggcct

SEQ ID NO: 75860 - DNA, 25 bp, Mus musculus
acactggatggtgactacaacaaag

SEQ ID NO: 75861 - DNA, 25 bp, Mus musculus
acactggccattgcctgggtgctcg

SEQ ID NO: 75862 - DNA, 25 bp, Mus musculus
acactgtacaggcacggctatgacc

SEQ ID NO: 75863 - DNA, 25 bp, Mus musculus
acactgtttggcgtctttcacggag

SEQ ID NO: 75864 - DNA, 25 bp, Mus musculus
acacttctgtctgatggcagcagcc

SEQ ID NO: 75865 - DNA, 25 bp, Mus musculus
acacttgctgtgctccaggagccag

SEQ ID NO: 75866 - DNA, 25 bp, Mus musculus
acacttggagaggagcagcgacctg

SEQ ID NO: 75867 - DNA, 25 bp, Mus musculus
acactttctctttgtcggaggagct

SEQ ID NO: 75868 - DNA, 25 bp, Mus musculus
acagaaccccactgaggcggagctg

SEQ ID NO: 75869 - DNA, 25 bp, Mus musculus
acagaagcgctgtaccagggcaaca

SEQ ID NO: 75870 - DNA, 25 bp, Mus musculus
acagaagctgctcagttgcttacag

SEQ ID NO: 75871 - DNA, 25 bp, Mus musculus
acagaaggagagcaggccgggcagc

SEQ ID NO: 75872 - DNA, 25 bp, Mus musculus
acagaattgagcgagctggttccca

SEQ ID NO: 75873 - DNA, 25 bp, Mus musculus
acagacaatccatggcgtgcaagcc

SEQ ID NO: 75874 - DNA, 25 bp, Mus musculus
acagacacaaggagaagcggcactc

SEQ ID NO: 75875 - DNA, 25 bp, Mus musculus
acagacaggcgtcatcatccagcca

SEQ ID NO: 75876 - DNA, 25 bp, Mus musculus
acagacagtcacctctccatggcaa

SEQ ID NO: 75877 - DNA, 25 bp, Mus musculus
acagacatggggtatccatcgaggg

SEQ ID NO: 75878 - DNA, 25 bp, Mus musculus
acagaccagctagccctgtgggcaa

SEQ ID NO: 75879 - DNA, 25 bp, Mus musculus
acagaccccacctgagatgtcttct

SEQ ID NO: 75880 - DNA, 25 bp, Mus musculus
acagacggcaagaagatggcggaca

SEQ ID NO: 75881 - DNA, 25 bp, Mus musculus
acagactaactctagctcccaagca

SEQ ID NO: 75882 - DNA, 25 bp, Mus musculus
acagactaccagaatcgagcagctt

SEQ ID NO: 75883 - DNA, 25 bp, Mus musculus
acagactgaggcaccacagagggtc

SEQ ID NO: 75884 - DNA, 25 bp, Mus musculus
acagactgatggtggagaatgagca

SEQ ID NO: 75885 - DNA, 25 bp, Mus musculus
acagagacagactggcatgaggcag

SEQ ID NO: 75886 - DNA, 25 bp, Mus musculus
acagagacagcgtgccgcacaacca

SEQ ID NO: 75887 - DNA, 25 bp, Mus musculus
acagagcaagatgagttccgagaca

SEQ ID NO: 75888 - DNA, 25 bp, Mus musculus
acagagccgaaagcgaaggcggcat

SEQ ID NO: 75889 - DNA, 25 bp, Mus musculus
acagagcctgtaagcccaagtgcca

SEQ ID NO: 75890 - DNA, 25 bp, Mus musculus
acagagctctgcatgaagtagggac

SEQ ID NO: 75891 - DNA, 25 bp, Mus musculus
acagagctgtagctggagttccaca

SEQ ID NO: 75892 - DNA, 25 bp, Mus musculus
acagagctttgatagtcgtaccata

SEQ ID NO: 75893 - DNA, 25 bp, Mus musculus
acagaggcacgggaacggcgccttt

SEQ ID NO: 75894 - DNA, 25 bp, Mus musculus
acagaggccacactcgtcgaggcca

SEQ ID NO: 75895 - DNA, 25 bp, Mus musculus
acagaggcgtccttcttggccctga

SEQ ID NO: 75896 - DNA, 25 bp, Mus musculus
acagaggctcctgccgtgccaggga

SEQ ID NO: 75897 - DNA, 25 bp, Mus musculus
acagaggttgccgtggccgccatat

SEQ ID NO: 75898 - DNA, 25 bp, Mus musculus
acagagtgacgttccgtgggcagca

SEQ ID NO: 75899 - DNA, 25 bp, Mus musculus
acagatacgccttttctggggttgc

SEQ ID NO: 75900 - DNA, 25 bp, Mus musculus
acagatatcttcaagtgttccctgg

SEQ ID NO: 75901 - DNA, 25 bp, Mus musculus
acagatattgccgtggaggccagcc

SEQ ID NO: 75902 - DNA, 25 bp, Mus musculus
acagatcagtacaactcccggtggc

SEQ ID NO: 75903 - DNA, 25 bp, Mus musculus
acagatgacactgccatgaccaggg

SEQ ID NO: 75904 - DNA, 25 bp, Mus musculus
acagatgttgttcaccagactggtg

SEQ ID NO: 75905 - DNA, 25 bp, Mus musculus
acagattgcttcgtgtgtgtcccca

SEQ ID NO: 75906 - DNA, 25 bp, Mus musculus
acagcaaacgtatgggcagtcccgg

SEQ ID NO: 75907 - DNA, 25 bp, Mus musculus
acagcaacaatgtatgcgtataaac

SEQ ID NO: 75908 - DNA, 25 bp, Mus musculus
acagcaacatgtggctctgggaagc

SEQ ID NO: 75909 - DNA, 25 bp, Mus musculus
acagcaagaggaacaacaggagcag

SEQ ID NO: 75910 - DNA, 25 bp, Mus musculus
acagcaagtccgtgattctcgaggg

SEQ ID NO: 75911 - DNA, 25 bp, Mus musculus
acagcaagtcctgcaagggccaaga

SEQ ID NO: 75912 - DNA, 25 bp, Mus musculus
acagcacaatatcccccagagggag

SEQ ID NO: 75913 - DNA, 25 bp, Mus musculus
acagcacttacacgtatgtcagcag

SEQ ID NO: 75914 - DNA, 25 bp, Mus musculus
acagcagaacaagtgacaggtggca

SEQ ID NO: 75915 - DNA, 25 bp, Mus musculus
acagcagagccaacaccgtgttcgg

SEQ ID NO: 75916 - DNA, 25 bp, Mus musculus
acagcagcaccaaaaggcctgggct

SEQ ID NO: 75917 - DNA, 25 bp, Mus musculus
acagcagcggccgaaagtagtgacg

SEQ ID NO: 75918 - DNA, 25 bp, Mus musculus
acagcaggcttcgtgtgggatccgc

SEQ ID NO: 75919 - DNA, 25 bp, Mus musculus
acagcagggcctgtttgggcagaaa

SEQ ID NO: 75920 - DNA, 25 bp, Mus musculus
acagcagtgctgtagacatggtctc

SEQ ID NO: 75921 - DNA, 25 bp, Mus musculus
acagcatgaaccacggcaaggaagg

SEQ ID NO: 75922 - DNA, 25 bp, Mus musculus
acagcatgtggaccctcaggtgaca

SEQ ID NO: 75923 - DNA, 25 bp, Mus musculus
acagcattcaccagttagtcgtggg

SEQ ID NO: 75924 - DNA, 25 bp, Mus musculus
acagccaagggcaaagtcggtgggc

SEQ ID NO: 75925 - DNA, 25 bp, Mus musculus
acagccaattcatgaaccaacccgg

SEQ ID NO: 75926 - DNA, 25 bp, Mus musculus
acagccagctgatgtatttcccagg

SEQ ID NO: 75927 - DNA, 25 bp, Mus musculus
acagccatggatctacaggtgcaga

SEQ ID NO: 75928 - DNA, 25 bp, Mus musculus
acagcccaggcctagaaaccttggt

SEQ ID NO: 75929 - DNA, 25 bp, Mus musculus
acagccccactgagatcactgcagg

SEQ ID NO: 75930 - DNA, 25 bp, Mus musculus
acagccccggattatggccaaggga

SEQ ID NO: 75931 - DNA, 25 bp, Mus musculus
acagccctcggtacatgttgaatgg

SEQ ID NO: 75932 - DNA, 25 bp, Mus musculus
acagccctgaagacgccgacatctt

SEQ ID NO: 75933 - DNA, 25 bp, Mus musculus
acagccctggccatgggtgtccact

SEQ ID NO: 75934 - DNA, 25 bp, Mus musculus
acagccctggcgctgaacttggacc

SEQ ID NO: 75935 - DNA, 25 bp, Mus musculus
acagccgaggtgcagtacaacttca

SEQ ID NO: 75936 - DNA, 25 bp, Mus musculus
acagccgttcttctcagcccagtgg

SEQ ID NO: 75937 - DNA, 25 bp, Mus musculus
acagcctggtgatggacctgcgctg

SEQ ID NO: 75938 - DNA, 25 bp, Mus musculus
acagcctgtgtcctcgggagcccag

SEQ ID NO: 75939 - DNA, 25 bp, Mus musculus
acagcctgtgtgaccggaagtacca

SEQ ID NO: 75940 - DNA, 25 bp, Mus musculus
acagcgcaggagaagagggccttca

SEQ ID NO: 75941 - DNA, 25 bp, Mus musculus
acagcggaaagctttgaggacggcc

SEQ ID NO: 75942 - DNA, 25 bp, Mus musculus
acagcggcgttccaggttccaaaga

SEQ ID NO: 75943 - DNA, 25 bp, Mus musculus
acagcgggagaagcagcactctagc

SEQ ID NO: 75944 - DNA, 25 bp, Mus musculus
acagcggtgtcatacacagtggtat

SEQ ID NO: 75945 - DNA, 25 bp, Mus musculus
acagcgtccgccctcagcatgatgg

SEQ ID NO: 75946 - DNA, 25 bp, Mus musculus
acagctatgacccttactcctgagg

SEQ ID NO: 75947 - DNA, 25 bp, Mus musculus
acagctatgcccgttgtgcccaggg

SEQ ID NO: 75948 - DNA, 25 bp, Mus musculus
acagctcccagttggagaaaatgga

SEQ ID NO: 75949 - DNA, 25 bp, Mus musculus
acagctcccttcagtgcggaatggc

SEQ ID NO: 75950 - DNA, 25 bp, Mus musculus
acagctcctcgacatgcatttcaag

SEQ ID NO: 75951 - DNA, 25 bp, Mus musculus
acagctcgggagagggtatttatct

SEQ ID NO: 75952 - DNA, 25 bp, Mus musculus
acagctgaaggatgcacacagggcc

SEQ ID NO: 75953 - DNA, 25 bp, Mus musculus
acagctgaccgaggccaatgtggaa

SEQ ID NO: 75954 - DNA, 25 bp, Mus musculus
acagctgagcactgggaccttcaaa

SEQ ID NO: 75955 - DNA, 25 bp, Mus musculus
acagctgcttgccttaattttagag

SEQ ID NO: 75956 - DNA, 25 bp, Mus musculus
acagctggctactctgacccagagg

SEQ ID NO: 75957 - DNA, 25 bp, Mus musculus
acagctgtatgttttgacgaaggca

SEQ ID NO: 75958 - DNA, 25 bp, Mus musculus
acagcttcctggtagcgggctcaga

SEQ ID NO: 75959 - DNA, 25 bp, Mus musculus
acagcttcgggttcgatttgccaca

SEQ ID NO: 75960 - DNA, 25 bp, Mus musculus
acagcttgtgccaggaggagtagta

SEQ ID NO: 75961 - DNA, 25 bp, Mus musculus
acagctttacctgcgcctggtggag

SEQ ID NO: 75962 - DNA, 25 bp, Mus musculus
acagctttgagagtgaggcctaccc

SEQ ID NO: 75963 - DNA, 25 bp, Mus musculus
acaggaaccgaagagtgtaagaagg

SEQ ID NO: 75964 - DNA, 25 bp, Mus musculus
acaggaagacaggactgcggtcccc

SEQ ID NO: 75965 - DNA, 25 bp, Mus musculus
acaggaccgggcaactacgcgagcg

SEQ ID NO: 75966 - DNA, 25 bp, Mus musculus
acaggacttcacatactgtgtttcc

SEQ ID NO: 75967 - DNA, 25 bp, Mus musculus
acaggacttggccttagtagtagca

SEQ ID NO: 75968 - DNA, 25 bp, Mus musculus
acaggagccagcttctcagtgcgcg

SEQ ID NO: 75969 - DNA, 25 bp, Mus musculus
acaggagccatgtccttgctgcggc

SEQ ID NO: 75970 - DNA, 25 bp, Mus musculus
acaggagctctttctgcggatgaga

SEQ ID NO: 75971 - DNA, 25 bp, Mus musculus
acaggaggatcagcctcccgaggga

SEQ ID NO: 75972 - DNA, 25 bp, Mus musculus
acaggatctggagcccaggtggacc

SEQ ID NO: 75973 - DNA, 25 bp, Mus musculus
acaggcattgcagctgcctccatag

SEQ ID NO: 75974 - DNA, 25 bp, Mus musculus
acaggcccctttaagagccttcgcg

SEQ ID NO: 75975 - DNA, 25 bp, Mus musculus
acaggcctgcgcacttggagagcac

SEQ ID NO: 75976 - DNA, 25 bp, Mus musculus
acaggcctgctgatgagtacgacca

SEQ ID NO: 75977 - DNA, 25 bp, Mus musculus
acaggcgcaggaactcaagggtcat

SEQ ID NO: 75978 - DNA, 25 bp, Mus musculus
acaggcgcatctctgcaaggagcaa

SEQ ID NO: 75979 - DNA, 25 bp, Mus musculus
acaggcgctgctagctctggacaag

SEQ ID NO: 75980 - DNA, 25 bp, Mus musculus
acaggctcgggtcgctcccgcttct

SEQ ID NO: 75981 - DNA, 25 bp, Mus musculus
acaggctctgagcaggaaaaacaat

SEQ ID NO: 75982 - DNA, 25 bp, Mus musculus
acaggctcttctcagggttccaggc

SEQ ID NO: 75983 - DNA, 25 bp, Mus musculus
acaggcttctgaagagggagcagac

SEQ ID NO: 75984 - DNA, 25 bp, Mus musculus
acagggaagacgagaacgcgaaagc

SEQ ID NO: 75985 - DNA, 25 bp, Mus musculus
acagggaccaccaagaaggccagaa

SEQ ID NO: 75986 - DNA, 25 bp, Mus musculus
acagggacgacttctcatccgcggg

SEQ ID NO: 75987 - DNA, 25 bp, Mus musculus
acagggctcttcgagggccagcgca

SEQ ID NO: 75988 - DNA, 25 bp, Mus musculus
acagggctgtgtatgtccccagggc

SEQ ID NO: 75989 - DNA, 25 bp, Mus musculus
acagggtcggcagtagctatgctcc

SEQ ID NO: 75990 - DNA, 25 bp, Mus musculus
acagggtgccttctcactgagtggc

SEQ ID NO: 75991 - DNA, 25 bp, Mus musculus
acagggtggtggttactgagacaca

SEQ ID NO: 75992 - DNA, 25 bp, Mus musculus
acagggttcggcatccaggagatcc

SEQ ID NO: 75993 - DNA, 25 bp, Mus musculus
acaggtacaagggttccgagaggct

SEQ ID NO: 75994 - DNA, 25 bp, Mus musculus
acaggtaccgactgggccgcaagat

SEQ ID NO: 75995 - DNA, 25 bp, Mus musculus
acaggtggctacaagtggtcgacag

SEQ ID NO: 75996 - DNA, 25 bp, Mus musculus
acaggtgtatgcgagtgggcccaat

SEQ ID NO: 75997 - DNA, 25 bp, Mus musculus
acaggtgttttctactacgcacggg

SEQ ID NO: 75998 - DNA, 25 bp, Mus musculus
acaggttcgccctgaagtcgtcccg

SEQ ID NO: 75999 - DNA, 25 bp, Mus musculus
acagtaaagagtacgtggccgcgca

SEQ ID NO: 76000 - DNA, 25 bp, Mus musculus
acagtacatactaaaggaagccaga

SEQ ID NO: 76001 - DNA, 25 bp, Mus musculus
acagtaccggctccgcatgagggaa

SEQ ID NO: 76002 - DNA, 25 bp, Mus musculus
acagtatatattccaggcgggcgcg

SEQ ID NO: 76003 - DNA, 25 bp, Mus musculus
acagtattctaccagtgccaacagc

SEQ ID NO: 76004 - DNA, 25 bp, Mus musculus
acagtcagtgaacatggccgcagtc

SEQ ID NO: 76005 - DNA, 25 bp, Mus musculus
acagtgaaatatgggcttttgctcc

SEQ ID NO: 76006 - DNA, 25 bp, Mus musculus
acagtgactacgtcacagggtttag

SEQ ID NO: 76007 - DNA, 25 bp, Mus musculus
acagtgagggcaacagctgccgggc

SEQ ID NO: 76008 - DNA, 25 bp, Mus musculus
acagtgatccagcatggaccacccg

SEQ ID NO: 76009 - DNA, 25 bp, Mus musculus
acagtgattctctgctgagccagga

SEQ ID NO: 76010 - DNA, 25 bp, Mus musculus
acagtgcacagctctcgccgaagtt

SEQ ID NO: 76011 - DNA, 25 bp, Mus musculus
acagtgcccacgctcaaggagagca

SEQ ID NO: 76012 - DNA, 25 bp, Mus musculus
acagtgcctgtggtgcttgagtgac

SEQ ID NO: 76013 - DNA, 25 bp, Mus musculus
acagtgctgcttcattactcgtagg

SEQ ID NO: 76014 - DNA, 25 bp, Mus musculus
acagtgctggacttgctggaaaccc

SEQ ID NO: 76015 - DNA, 25 bp, Mus musculus
acagtggctcacataaatcaggttg

SEQ ID NO: 76016 - DNA, 25 bp, Mus musculus
acagtggtctccagtccgctctagc

SEQ ID NO: 76017 - DNA, 25 bp, Mus musculus
acagtgtcactctggatcctctttg

SEQ ID NO: 76018 - DNA, 25 bp, Mus musculus
acagtgtcaggtgcttccagagacc

SEQ ID NO: 76019 - DNA, 25 bp, Mus musculus
acagtgtcagttcggccctcagaag

SEQ ID NO: 76020 - DNA, 25 bp, Mus musculus
acagtgtctatcaatacccctgaga

SEQ ID NO: 76021 - DNA, 25 bp, Mus musculus
acagtgtcttcagattcagcagcag

SEQ ID NO: 76022 - DNA, 25 bp, Mus musculus
acagtgtggtttcaccggctgccgt

SEQ ID NO: 76023 - DNA, 25 bp, Mus musculus
acagtgtgtggaacagtgagccagc

SEQ ID NO: 76024 - DNA, 25 bp, Mus musculus
acagttaacagaaatgtggctatcc

SEQ ID NO: 76025 - DNA, 25 bp, Mus musculus
acagttcagaatcatgtcccccatt

SEQ ID NO: 76026 - DNA, 25 bp, Mus musculus
acagttccaagtcagagtcagccca

SEQ ID NO: 76027 - DNA, 25 bp, Mus musculus
acagttctgccccagagaccacaag

SEQ ID NO: 76028 - DNA, 25 bp, Mus musculus
acagttttggtggtctgggccctgc

SEQ ID NO: 76029 - DNA, 25 bp, Mus musculus
acagttttgtgggagcgctggcctt

SEQ ID NO: 76030 - DNA, 25 bp, Mus musculus
acataaacaaacaggccgatgtggg

SEQ ID NO: 76031 - DNA, 25 bp, Mus musculus
acataagctcccgaggaaggcgtcc

SEQ ID NO: 76032 - DNA, 25 bp, Mus musculus
acataattaacaccacacaggacgg

SEQ ID NO: 76033 - DNA, 25 bp, Mus musculus
acatacttgtgagtaggtgtgtgtg

SEQ ID NO: 76034 - DNA, 25 bp, Mus musculus
acatagagcacacacttcaggtgga

SEQ ID NO: 76035 - DNA, 25 bp, Mus musculus
acatagtgtagatccggctgggcct

SEQ ID NO: 76036 - DNA, 25 bp, Mus musculus
acatcaatgcggacgaagctgctgc

SEQ ID NO: 76037 - DNA, 25 bp, Mus musculus
acatcacactggtggcacccactga

SEQ ID NO: 76038 - DNA, 25 bp, Mus musculus
acatcagacaggaagagaggacacg

SEQ ID NO: 76039 - DNA, 25 bp, Mus musculus
acatcagccagtgtgaagacctccg

SEQ ID NO: 76040 - DNA, 25 bp, Mus musculus
acatcaggccgcatcgtgtcaggac

SEQ ID NO: 76041 - DNA, 25 bp, Mus musculus
acatcagtaccttcctgggctgagc

SEQ ID NO: 76042 - DNA, 25 bp, Mus musculus
acatcatggaaggtgtaaaggccac

SEQ ID NO: 76043 - DNA, 25 bp, Mus musculus
acatcatggcatgggaaaaagcggc

SEQ ID NO: 76044 - DNA, 25 bp, Mus musculus
acatcatggcgcagaaagggcagct

SEQ ID NO: 76045 - DNA, 25 bp, Mus musculus
acatccaggaaagttgtgaccggcc

SEQ ID NO: 76046 - DNA, 25 bp, Mus musculus
acatccctgcatcgctcctggtgga

SEQ ID NO: 76047 - DNA, 25 bp, Mus musculus
acatccgtgactacagggcggcggc

SEQ ID NO: 76048 - DNA, 25 bp, Mus musculus
acatcctcatctttcttactgggct

SEQ ID NO: 76049 - DNA, 25 bp, Mus musculus
acatcgaaattaggaggagcccacg

SEQ ID NO: 76050 - DNA, 25 bp, Mus musculus
acatcgaccgtattggagcagacca

SEQ ID NO: 76051 - DNA, 25 bp, Mus musculus
acatcgccccagctccaagaattaa

SEQ ID NO: 76052 - DNA, 25 bp, Mus musculus
acatcggcagccacacggtattgga

SEQ ID NO: 76053 - DNA, 25 bp, Mus musculus
acatcggctggctgcacaacttggg

SEQ ID NO: 76054 - DNA, 25 bp, Mus musculus
acatcggtgaatgcctgacggtgcc

SEQ ID NO: 76055 - DNA, 25 bp, Mus musculus
acatcgtggtgggaggacactccaa

SEQ ID NO: 76056 - DNA, 25 bp, Mus musculus
acatctaggttcctgggtgggacca

SEQ ID NO: 76057 - DNA, 25 bp, Mus musculus
acatctcccagaggttcacggtgga

SEQ ID NO: 76058 - DNA, 25 bp, Mus musculus
acatctccgcggagcagaagaggcg

SEQ ID NO: 76059 - DNA, 25 bp, Mus musculus
acatctccggaacatcgctgctcgg

SEQ ID NO: 76060 - DNA, 25 bp, Mus musculus
acatctgactagcaaaggccctggg

SEQ ID NO: 76061 - DNA, 25 bp, Mus musculus
acatctgatgctaacgttctgacta

SEQ ID NO: 76062 - DNA, 25 bp, Mus musculus
acatctgctcgcctgctcttcatgg

SEQ ID NO: 76063 - DNA, 25 bp, Mus musculus
acatcttactgttccgacggccact

SEQ ID NO: 76064 - DNA, 25 bp, Mus musculus
acatcttccattccagaggctggcg

SEQ ID NO: 76065 - DNA, 25 bp, Mus musculus
acatcttggaccccgggagaatccg

SEQ ID NO: 76066 - DNA, 25 bp, Mus musculus
acatctttctgggagaccgcgtgga

SEQ ID NO: 76067 - DNA, 25 bp, Mus musculus
acatgaacgcggatgctgagggcca

SEQ ID NO: 76068 - DNA, 25 bp, Mus musculus
acatgaagaagcacacagccgaggt

SEQ ID NO: 76069 - DNA, 25 bp, Mus musculus
acatgacccggttgcccttgaggag

SEQ ID NO: 76070 - DNA, 25 bp, Mus musculus
acatgacgctgtgcagcagccgtcg

SEQ ID NO: 76071 - DNA, 25 bp, Mus musculus
acatgatggctctgagtgcccagac

SEQ ID NO: 76072 - DNA, 25 bp, Mus musculus
acatgcatcagttcacgcccgtgag

SEQ ID NO: 76073 - DNA, 25 bp, Mus musculus
acatgccacgcctttgaccagagaa

SEQ ID NO: 76074 - DNA, 25 bp, Mus musculus
acatgcccaaactccgtcgtcagat

SEQ ID NO: 76075 - DNA, 25 bp, Mus musculus
acatgcctagcttcttaataaaaga

SEQ ID NO: 76076 - DNA, 25 bp, Mus musculus
acatgctatggccttcctgggaaag

SEQ ID NO: 76077 - DNA, 25 bp, Mus musculus
acatgctcaggtgtgcgaggcctca

SEQ ID NO: 76078 - DNA, 25 bp, Mus musculus
acatgctcatgtgcttaaggccggg

SEQ ID NO: 76079 - DNA, 25 bp, Mus musculus
acatgctccggtctccaggttcgat

SEQ ID NO: 76080 - DNA, 25 bp, Mus musculus
acatgctccgtgcacaaggcaaggc

SEQ ID NO: 76081 - DNA, 25 bp, Mus musculus
acatggacttccaggccactggaaa

SEQ ID NO: 76082 - DNA, 25 bp, Mus musculus
acatggagatgacttgattgtgacc

SEQ ID NO: 76083 - DNA, 25 bp, Mus musculus
acatggcggtggtcgaagtcagcac

SEQ ID NO: 76084 - DNA, 25 bp, Mus musculus
acatggcgttgctggtgcgagtcct

SEQ ID NO: 76085 - DNA, 25 bp, Mus musculus
acatggctctgtggttgtatgggac

SEQ ID NO: 76086 - DNA, 25 bp, Mus musculus
acatggctggcctgaaagtctacaa

SEQ ID NO: 76087 - DNA, 25 bp, Mus musculus
acatggggttctgtggacctgccca

SEQ ID NO: 76088 - DNA, 25 bp, Mus musculus
acatggtcgctgacgtgagctggca

SEQ ID NO: 76089 - DNA, 25 bp, Mus musculus
acatggttccgagctatggagcgac

SEQ ID NO: 76090 - DNA, 25 bp, Mus musculus
acatggttgacctgctagtgagccc

SEQ ID NO: 76091 - DNA, 25 bp, Mus musculus
acatgtaccttctgcctggcctgaa

SEQ ID NO: 76092 - DNA, 25 bp, Mus musculus
acatgtatccccatggacgcagcgg

SEQ ID NO: 76093 - DNA, 25 bp, Mus musculus
acatgtccatactgccgggcatacc

SEQ ID NO: 76094 - DNA, 25 bp, Mus musculus
acatgtctatgagggttcggcgcca

SEQ ID NO: 76095 - DNA, 25 bp, Mus musculus
acatgtgcaggcgttaggcttcccc

SEQ ID NO: 76096 - DNA, 25 bp, Mus musculus
acatgtgctgtcgaggccgtgctga

SEQ ID NO: 76097 - DNA, 25 bp, Mus musculus
acatgttcctggtgggtctcttccc

SEQ ID NO: 76098 - DNA, 25 bp, Mus musculus
acattcacggaagcgctgggaaaac

SEQ ID NO: 76099 - DNA, 25 bp, Mus musculus
acattccggtggactgtggtgaacc

SEQ ID NO: 76100 - DNA, 25 bp, Mus musculus
acattctgctctcgtctccgcagcg

SEQ ID NO: 76101 - DNA, 25 bp, Mus musculus
acattcttttggctttgttgcttag

SEQ ID NO: 76102 - DNA, 25 bp, Mus musculus
acattgaagtaacgctactccggga

SEQ ID NO: 76103 - DNA, 25 bp, Mus musculus
acattgacagcaggacgatggagcg

SEQ ID NO: 76104 - DNA, 25 bp, Mus musculus
acattgagaccggacagcagactac

SEQ ID NO: 76105 - DNA, 25 bp, Mus musculus
acattgccacatgcatagccctgag

SEQ ID NO: 76106 - DNA, 25 bp, Mus musculus
acattgcttggtgcgcgtggtagct

SEQ ID NO: 76107 - DNA, 25 bp, Mus musculus
acattggatcgtacacagtgagggc

SEQ ID NO: 76108 - DNA, 25 bp, Mus musculus
accaaaaggtgtaactagagttgca

SEQ ID NO: 76109 - DNA, 25 bp, Mus musculus
accaaagcctggagcagtcgtcggc

SEQ ID NO: 76110 - DNA, 25 bp, Mus musculus
accaaagggacctctggcctgttca

SEQ ID NO: 76111 - DNA, 25 bp, Mus musculus
accaaagtatctcaacctaaatcag

SEQ ID NO: 76112 - DNA, 25 bp, Mus musculus
accaaatggtggtgctgagtctcac

SEQ ID NO: 76113 - DNA, 25 bp, Mus musculus
accaacatgtggtggacgagaaggc

SEQ ID NO: 76114 - DNA, 25 bp, Mus musculus
accaactggcaatgtctgagagaca

SEQ ID NO: 76115 - DNA, 25 bp, Mus musculus
accaagagcggcatgatcctttgca

SEQ ID NO: 76116 - DNA, 25 bp, Mus musculus
accaagaggcgacaactggaggacc

SEQ ID NO: 76117 - DNA, 25 bp, Mus musculus
accaagatgacccatgacagttcca

SEQ ID NO: 76118 - DNA, 25 bp, Mus musculus
accaagcagctgcttcactgtatgg

SEQ ID NO: 76119 - DNA, 25 bp, Mus musculus
accaagcctacaacttgctggcaag

SEQ ID NO: 76120 - DNA, 25 bp, Mus musculus
accaagctgggtgcctgtaacgaca

SEQ ID NO: 76121 - DNA, 25 bp, Mus musculus
accaagctgtcggtagcgatctaca

SEQ ID NO: 76122 - DNA, 25 bp, Mus musculus
accaaggaggccagtgtccagtcag

SEQ ID NO: 76123 - DNA, 25 bp, Mus musculus
accaaggcgtgaagatgcggagcca

SEQ ID NO: 76124 - DNA, 25 bp, Mus musculus
accaagtggcgaggcttttgttgaa

SEQ ID NO: 76125 - DNA, 25 bp, Mus musculus
accaagtggtgggtatccaggagct

SEQ ID NO: 76126 - DNA, 25 bp, Mus musculus
accaagtgtttgctgtgaacggcga

SEQ ID NO: 76127 - DNA, 25 bp, Mus musculus
accaatgcgtcgctggatgccgcga

SEQ ID NO: 76128 - DNA, 25 bp, Mus musculus
accaatggaggcctgaacctgcaca

SEQ ID NO: 76129 - DNA, 25 bp, Mus musculus
accaatgtctgcgtggagcccgggc

SEQ ID NO: 76130 - DNA, 25 bp, Mus musculus
accacaccggagttgggcgctctat

SEQ ID NO: 76131 - DNA, 25 bp, Mus musculus
accacaggaaccgaagagtgtaaga

SEQ ID NO: 76132 - DNA, 25 bp, Mus musculus
accacagggtggacatgaaggcgat

SEQ ID NO: 76133 - DNA, 25 bp, Mus musculus
accacagtgcatggaggacaccctg

SEQ ID NO: 76134 - DNA, 25 bp, Mus musculus
accacatctcctgaagaagtttgca

SEQ ID NO: 76135 - DNA, 25 bp, Mus musculus
accaccaagtggctcgggatctgaa

SEQ ID NO: 76136 - DNA, 25 bp, Mus musculus
accaccaccacttgaactttgcagg

SEQ ID NO: 76137 - DNA, 25 bp, Mus musculus
accaccagaagtagcgagcacactg

SEQ ID NO: 76138 - DNA, 25 bp, Mus musculus
accaccccgccgtgtgaggctgaag

SEQ ID NO: 76139 - DNA, 25 bp, Mus musculus
accaccgtgggatgtcagcggccat

SEQ ID NO: 76140 - DNA, 25 bp, Mus musculus
accacgaccggagggatcctgatcg

SEQ ID NO: 76141 - DNA, 25 bp, Mus musculus
accacgtgaccagagagcggctgga

SEQ ID NO: 76142 - DNA, 25 bp, Mus musculus
accacgtggtggaggtgtgcttcca

SEQ ID NO: 76143 - DNA, 25 bp, Mus musculus
accactatggctgggaggtggccca

SEQ ID NO: 76144 - DNA, 25 bp, Mus musculus
accactcgctgatcccggaggagcg

SEQ ID NO: 76145 - DNA, 25 bp, Mus musculus
accactgacctcttgcggtgtagca

SEQ ID NO: 76146 - DNA, 25 bp, Mus musculus
accactgcccagatacgaggagagt

SEQ ID NO: 76147 - DNA, 25 bp, Mus musculus
accacttacgagaaaagatgcctgc

SEQ ID NO: 76148 - DNA, 25 bp, Mus musculus
accagaagaggagccttggcctgtg

SEQ ID NO: 76149 - DNA, 25 bp, Mus musculus
accagaagatgtaagtgatgtgccc

SEQ ID NO: 76150 - DNA, 25 bp, Mus musculus
accagaattaagaaaccgactacag

SEQ ID NO: 76151 - DNA, 25 bp, Mus musculus
accagacagtgtgtactcgggtgtg

SEQ ID NO: 76152 - DNA, 25 bp, Mus musculus
accagaccaggcgatagtgaagacg

SEQ ID NO: 76153 - DNA, 25 bp, Mus musculus
accagactgactcctcaatctcatt

SEQ ID NO: 76154 - DNA, 25 bp, Mus musculus
accagagagggtagcagagcctgct

SEQ ID NO: 76155 - DNA, 25 bp, Mus musculus
accagagctgcaataaaaagtcaca

SEQ ID NO: 76156 - DNA, 25 bp, Mus musculus
accagcaaagcaaggtggagcagga

SEQ ID NO: 76157 - DNA, 25 bp, Mus musculus
accagcaccttccatattttatcac

SEQ ID NO: 76158 - DNA, 25 bp, Mus musculus
accagcatcctttggacccctgagg

SEQ ID NO: 76159 - DNA, 25 bp, Mus musculus
accagccaaggcgaaggaagagtgt

SEQ ID NO: 76160 - DNA, 25 bp, Mus musculus
accagcggctgcgtctttactgagg

SEQ ID NO: 76161 - DNA, 25 bp, Mus musculus
accagcggtgcccagtggtcctgac

SEQ ID NO: 76162 - DNA, 25 bp, Mus musculus
accagctggcagattcgggaccgat

SEQ ID NO: 76163 - DNA, 25 bp, Mus musculus
accaggaacgcctggcacggctaga

SEQ ID NO: 76164 - DNA, 25 bp, Mus musculus
accaggaattggaatagtctcaaca

SEQ ID NO: 76165 - DNA, 25 bp, Mus musculus
accaggacgcggaggctgccatcaa

SEQ ID NO: 76166 - DNA, 25 bp, Mus musculus
accaggatctttgcgtgttcgagca

SEQ ID NO: 76167 - DNA, 25 bp, Mus musculus
accaggattggtgcacatgggcccc

SEQ ID NO: 76168 - DNA, 25 bp, Mus musculus
accaggctactcctacaaggtgtgg

SEQ ID NO: 76169 - DNA, 25 bp, Mus musculus
accaggctgtggagacctacgggct

SEQ ID NO: 76170 - DNA, 25 bp, Mus musculus
accagggaccgggagatctaccagc

SEQ ID NO: 76171 - DNA, 25 bp, Mus musculus
accagggagcgcattaaggaggcca

SEQ ID NO: 76172 - DNA, 25 bp, Mus musculus
accagggcagctactggaaggctgt

SEQ ID NO: 76173 - DNA, 25 bp, Mus musculus
accagtaccgcctggcaggacacta

SEQ ID NO: 76174 - DNA, 25 bp, Mus musculus
accagtcgtggcgtctgcatgtgca

SEQ ID NO: 76175 - DNA, 25 bp, Mus musculus
accagtctcaggctttgggtgcaaa

SEQ ID NO: 76176 - DNA, 25 bp, Mus musculus
accatacccgcaccttggtggacat

SEQ ID NO: 76177 - DNA, 25 bp, Mus musculus
accataccctacctatccaggatat

SEQ ID NO: 76178 - DNA, 25 bp, Mus musculus
accatcaagaaaggagacttgctgc

SEQ ID NO: 76179 - DNA, 25 bp, Mus musculus
accatcaagcaggagcaagtgcgca

SEQ ID NO: 76180 - DNA, 25 bp, Mus musculus
accatcacgttctggctgctcctga

SEQ ID NO: 76181 - DNA, 25 bp, Mus musculus
accatcagcagagagagagccggct

SEQ ID NO: 76182 - DNA, 25 bp, Mus musculus
accatcatgaatcccatcgggccgg

SEQ ID NO: 76183 - DNA, 25 bp, Mus musculus
accatcccacacagtgacagaggga

SEQ ID NO: 76184 - DNA, 25 bp, Mus musculus
accatccgtcgctgtgtgcctgtca

SEQ ID NO: 76185 - DNA, 25 bp, Mus musculus
accatcgtggacctgcggcttaacg

SEQ ID NO: 76186 - DNA, 25 bp, Mus musculus
accatctttgtggtgtttattgcca

SEQ ID NO: 76187 - DNA, 25 bp, Mus musculus
accatgactgtgctcgagccatagc

SEQ ID NO: 76188 - DNA, 25 bp, Mus musculus
accatgagtgcacttctgatcctag

SEQ ID NO: 76189 - DNA, 25 bp, Mus musculus
accatgatctactacgccgagagga

SEQ ID NO: 76190 - DNA, 25 bp, Mus musculus
accatgcagtgcgtatccgggagga

SEQ ID NO: 76191 - DNA, 25 bp, Mus musculus
accatgcctgctaccaatgtctcga

SEQ ID NO: 76192 - DNA, 25 bp, Mus musculus
accatgctgcagtggctgtcgggca

SEQ ID NO: 76193 - DNA, 25 bp, Mus musculus
accatgggatgtacgctgagcgcag

SEQ ID NO: 76194 - DNA, 25 bp, Mus musculus
accatggtgaatccgggcagcagct

SEQ ID NO: 76195 - DNA, 25 bp, Mus musculus
accatggtggcagtcgctcaggaca

SEQ ID NO: 76196 - DNA, 25 bp, Mus musculus
accatgtcgggcaggtcggttcgag

SEQ ID NO: 76197 - DNA, 25 bp, Mus musculus
accatgtgcgacgaagacgagacca

SEQ ID NO: 76198 - DNA, 25 bp, Mus musculus
accatgtgtcccctgtggctactca

SEQ ID NO: 76199 - DNA, 25 bp, Mus musculus
accatgttccgcaagaaaaagaaga

SEQ ID NO: 76200 - DNA, 25 bp, Mus musculus
accattagggtgtgagaggtagcca

SEQ ID NO: 76201 - DNA, 25 bp, Mus musculus
accattgtccagtcagtgagtagag

SEQ ID NO: 76202 - DNA, 25 bp, Mus musculus
accattttggctgtttagatcctcc

SEQ ID NO: 76203 - DNA, 25 bp, Mus musculus
acccaaaaatggtgagtttgtatgg

SEQ ID NO: 76204 - DNA, 25 bp, Mus musculus
acccaacggtgctgcagaagctctg

SEQ ID NO: 76205 - DNA, 25 bp, Mus musculus
acccaactgggcgattgctctggca

SEQ ID NO: 76206 - DNA, 25 bp, Mus musculus
acccaagagatgaagggtctcctca

SEQ ID NO: 76207 - DNA, 25 bp, Mus musculus
acccaagtggagtcgcagtggctgc

SEQ ID NO: 76208 - DNA, 25 bp, Mus musculus
acccacctgaaaacatcattgatgg

SEQ ID NO: 76209 - DNA, 25 bp, Mus musculus
acccacgagttcaagcaggcctgcc

SEQ ID NO: 76210 - DNA, 25 bp, Mus musculus
acccacggcgccctgttcaaagtgg

SEQ ID NO: 76211 - DNA, 25 bp, Mus musculus
acccagaggcgcaaggagatgctcg

SEQ ID NO: 76212 - DNA, 25 bp, Mus musculus
acccagagggcgagccagcttccag

SEQ ID NO: 76213 - DNA, 25 bp, Mus musculus
acccagcaggagaagaggcacagtt

SEQ ID NO: 76214 - DNA, 25 bp, Mus musculus
acccagctgacgtgatgagactcca

SEQ ID NO: 76215 - DNA, 25 bp, Mus musculus
acccaggattccatcgcggcgggag

SEQ ID NO: 76216 - DNA, 25 bp, Mus musculus
acccaggccgcagatggtccgtgat

SEQ ID NO: 76217 - DNA, 25 bp, Mus musculus
acccaggctctgagatgcgtccctg

SEQ ID NO: 76218 - DNA, 25 bp, Mus musculus
acccagtgttgagtagtgcccaggc

SEQ ID NO: 76219 - DNA, 25 bp, Mus musculus
acccatgtgccaggagaacttgcca

SEQ ID NO: 76220 - DNA, 25 bp, Mus musculus
acccatgtgggttgtactgttagaa

SEQ ID NO: 76221 - DNA, 25 bp, Mus musculus
accccagagtgtagagcggaagcaa

SEQ ID NO: 76222 - DNA, 25 bp, Mus musculus
accccagcagcagcgttgagagaca

SEQ ID NO: 76223 - DNA, 25 bp, Mus musculus
accccagctgagcagctgcgacgga

SEQ ID NO: 76224 - DNA, 25 bp, Mus musculus
accccatgcctgacgggtgcgagag

SEQ ID NO: 76225 - DNA, 25 bp, Mus musculus
accccatttcctgacttgctgaaga

SEQ ID NO: 76226 - DNA, 25 bp, Mus musculus
accccgaggacgaggatccggagca

SEQ ID NO: 76227 - DNA, 25 bp, Mus musculus
accccgcaggtgctggaaccagcag

SEQ ID NO: 76228 - DNA, 25 bp, Mus musculus
accccgcgcctgatcaagtagtttg

SEQ ID NO: 76229 - DNA, 25 bp, Mus musculus
accccggcacatcctgttagctgtg

SEQ ID NO: 76230 - DNA, 25 bp, Mus musculus
acccctcagtttaacagattttgca

SEQ ID NO: 76231 - DNA, 25 bp, Mus musculus
acccctgagatagaagctgaccgca

SEQ ID NO: 76232 - DNA, 25 bp, Mus musculus
acccctgccggagctgggctttgag

SEQ ID NO: 76233 - DNA, 25 bp, Mus musculus
acccgaaaccggaagatgtctagca

SEQ ID NO: 76234 - DNA, 25 bp, Mus musculus
acccgaacgacaaggagggccagca

SEQ ID NO: 76235 - DNA, 25 bp, Mus musculus
acccgatgctggctccctcattttc

SEQ ID NO: 76236 - DNA, 25 bp, Mus musculus
acccgcataggaagcttgtccagca

SEQ ID NO: 76237 - DNA, 25 bp, Mus musculus
acccgccggggccgcaggcctgtgc

SEQ ID NO: 76238 - DNA, 25 bp, Mus musculus
acccggagccagagaactacaacta

SEQ ID NO: 76239 - DNA, 25 bp, Mus musculus
acccggagtgaagacgaggagccaa

SEQ ID NO: 76240 - DNA, 25 bp, Mus musculus
acccggcggaggaacagtgccaccg

SEQ ID NO: 76241 - DNA, 25 bp, Mus musculus
acccggctgctgattctggctgaca

SEQ ID NO: 76242 - DNA, 25 bp, Mus musculus
acccgtacctgcagcgacggcggag

SEQ ID NO: 76243 - DNA, 25 bp, Mus musculus
accctagggcagaggtagctgtcca

SEQ ID NO: 76244 - DNA, 25 bp, Mus musculus
accctatcacagacgagctgctgga

SEQ ID NO: 76245 - DNA, 25 bp, Mus musculus
accctcctgggagtctgagacaaga

SEQ ID NO: 76246 - DNA, 25 bp, Mus musculus
accctctcaggcagcgggaggcaaa

SEQ ID NO: 76247 - DNA, 25 bp, Mus musculus
accctgaaacgagaaggcgtctgcg

SEQ ID NO: 76248 - DNA, 25 bp, Mus musculus
accctgaagacctggatatccctgg

SEQ ID NO: 76249 - DNA, 25 bp, Mus musculus
accctgaatggtggcagcggagcaa

SEQ ID NO: 76250 - DNA, 25 bp, Mus musculus
accctgaccagaggtggaaagcccg

SEQ ID NO: 76251 - DNA, 25 bp, Mus musculus
accctgattgggatgagtgttttag

SEQ ID NO: 76252 - DNA, 25 bp, Mus musculus
accctgcaaccatgagcagcaatgc

SEQ ID NO: 76253 - DNA, 25 bp, Mus musculus
accctgcacagttccctgagaagtc

SEQ ID NO: 76254 - DNA, 25 bp, Mus musculus
accctgccgctgttttggataatga

SEQ ID NO: 76255 - DNA, 25 bp, Mus musculus
accctgctgcctatggtcagattag

SEQ ID NO: 76256 - DNA, 25 bp, Mus musculus
accctgctggctgcggagtttctga

SEQ ID NO: 76257 - DNA, 25 bp, Mus musculus
accctggcgacgttgctgagttccg

SEQ ID NO: 76258 - DNA, 25 bp, Mus musculus
accctgggaacggagcaactcggtg

SEQ ID NO: 76259 - DNA, 25 bp, Mus musculus
accctgtaaactatggccggccctg

SEQ ID NO: 76260 - DNA, 25 bp, Mus musculus
accctgtacggcaccgctctctttt

SEQ ID NO: 76261 - DNA, 25 bp, Mus musculus
accctgtgggacgtgtttggagcaa

SEQ ID NO: 76262 - DNA, 25 bp, Mus musculus
accctgtgtagaatgactgccctga

SEQ ID NO: 76263 - DNA, 25 bp, Mus musculus
acccttggcggttggacgagcagaa

SEQ ID NO: 76264 - DNA, 25 bp, Mus musculus
acccttgtgcccaagtcacttcaga

SEQ ID NO: 76265 - DNA, 25 bp, Mus musculus
accctttggatgctaagctcgtgtc

SEQ ID NO: 76266 - DNA, 25 bp, Mus musculus
accgagaagattgtccttgaggcag

SEQ ID NO: 76267 - DNA, 25 bp, Mus musculus
accgagactgaaccctgtgtacaca

SEQ ID NO: 76268 - DNA, 25 bp, Mus musculus
accgagagcggcgagcgttatcaag

SEQ ID NO: 76269 - DNA, 25 bp, Mus musculus
accgagatcgcggtggccatagaca

SEQ ID NO: 76270 - DNA, 25 bp, Mus musculus
accgagcaccaacaggctacgacgt

SEQ ID NO: 76271 - DNA, 25 bp, Mus musculus
accgagcgctgcgagcaggcgatct

SEQ ID NO: 76272 - DNA, 25 bp, Mus musculus
accgatggacggcagctaagctaca

SEQ ID NO: 76273 - DNA, 25 bp, Mus musculus
accgcagagaagtggtgggacttct

SEQ ID NO: 76274 - DNA, 25 bp, Mus musculus
accgcagatggcaaacggctcttct

SEQ ID NO: 76275 - DNA, 25 bp, Mus musculus
accgcagccccaagcaggaaagaac

SEQ ID NO: 76276 - DNA, 25 bp, Mus musculus
accgcagttttgtgggatttctaag

SEQ ID NO: 76277 - DNA, 25 bp, Mus musculus
accgccaaggtcagggaggcccttg

SEQ ID NO: 76278 - DNA, 25 bp, Mus musculus
accgcccaccgcttacatcgacttt

SEQ ID NO: 76279 - DNA, 25 bp, Mus musculus
accgcctgctggacgtgcttctgaa

SEQ ID NO: 76280 - DNA, 25 bp, Mus musculus
accgcgcgaactctgccaacctcaa

SEQ ID NO: 76281 - DNA, 25 bp, Mus musculus
accgcggccagctatcctgtcgtga

SEQ ID NO: 76282 - DNA, 25 bp, Mus musculus
accgcggcggcgactttcagtttca

SEQ ID NO: 76283 - DNA, 25 bp, Mus musculus
accgcggtgagagactgggcatcaa

SEQ ID NO: 76284 - DNA, 25 bp, Mus musculus
accgctacgcggagctctcggagga

SEQ ID NO: 76285 - DNA, 25 bp, Mus musculus
accgctagacggacgacaacttctg

SEQ ID NO: 76286 - DNA, 25 bp, Mus musculus
accgctgagatttttcagagtgacc

SEQ ID NO: 76287 - DNA, 25 bp, Mus musculus
accgctggaggtgccatgtcttcca

SEQ ID NO: 76288 - DNA, 25 bp, Mus musculus
accgctgtacctgttctctatagca

SEQ ID NO: 76289 - DNA, 25 bp, Mus musculus
accgctgtgacgcaaaattccgatg

SEQ ID NO: 76290 - DNA, 25 bp, Mus musculus
accgctgtgggcaggcattgctgca

SEQ ID NO: 76291 - DNA, 25 bp, Mus musculus
accgcttcgtgattggactctagta

SEQ ID NO: 76292 - DNA, 25 bp, Mus musculus
accgctttgatggaattctggcaga

SEQ ID NO: 76293 - DNA, 25 bp, Mus musculus
accggagccccgagattagaagact

SEQ ID NO: 76294 - DNA, 25 bp, Mus musculus
accggattgtagtgagtggcgccca

SEQ ID NO: 76295 - DNA, 25 bp, Mus musculus
accggcaaacactacggagcctcga

SEQ ID NO: 76296 - DNA, 25 bp, Mus musculus
accggcagctgtcaacctcaaagtg

SEQ ID NO: 76297 - DNA, 25 bp, Mus musculus
accggcaggctttggtcaaaaagca

SEQ ID NO: 76298 - DNA, 25 bp, Mus musculus
accggccgcagactacgctgcgagc

SEQ ID NO: 76299 - DNA, 25 bp, Mus musculus
accgggaaccatcagaacaggagca

SEQ ID NO: 76300 - DNA, 25 bp, Mus musculus
accgggagaccgtgcgcgctctcag

SEQ ID NO: 76301 - DNA, 25 bp, Mus musculus
accgggagatctaccagctcaagac

SEQ ID NO: 76302 - DNA, 25 bp, Mus musculus
accgggagctgcagctagccaactc

SEQ ID NO: 76303 - DNA, 25 bp, Mus musculus
accgggatagtcctcgtgcacctag

SEQ ID NO: 76304 - DNA, 25 bp, Mus musculus
accgtacagagctgggcttcaaacc

SEQ ID NO: 76305 - DNA, 25 bp, Mus musculus
accgtacctgttacctcgtgacaag

SEQ ID NO: 76306 - DNA, 25 bp, Mus musculus
accgtcctgtttgagatcgagctga

SEQ ID NO: 76307 - DNA, 25 bp, Mus musculus
accgtgcctggatacctgcgtgtgg

SEQ ID NO: 76308 - DNA, 25 bp, Mus musculus
accgtgtggctgtggtcaaaggcac

SEQ ID NO: 76309 - DNA, 25 bp, Mus musculus
accgttagcctggagggtgcctgca

SEQ ID NO: 76310 - DNA, 25 bp, Mus musculus
acctaaaggagggagaacagcacgt

SEQ ID NO: 76311 - DNA, 25 bp, Mus musculus
acctaaccgggcagagacttgctga

SEQ ID NO: 76312 - DNA, 25 bp, Mus musculus
acctacagctgccaagcaggccagg

SEQ ID NO: 76313 - DNA, 25 bp, Mus musculus
acctagactgtgtgcaggacgtgct

SEQ ID NO: 76314 - DNA, 25 bp, Mus musculus
acctagagggacctagcctagccag

SEQ ID NO: 76315 - DNA, 25 bp, Mus musculus
acctagccggctacccttgagttcg

SEQ ID NO: 76316 - DNA, 25 bp, Mus musculus
acctaggaatctgctgccacatgaa

SEQ ID NO: 76317 - DNA, 25 bp, Mus musculus
acctaggacctaggctgagcccagt

SEQ ID NO: 76318 - DNA, 25 bp, Mus musculus
acctatgaagaatttctgagcactt

SEQ ID NO: 76319 - DNA, 25 bp, Mus musculus
acctatgattgttctgccagtctcc

SEQ ID NO: 76320 - DNA, 25 bp, Mus musculus
acctatgggccgaggagcccctcct

SEQ ID NO: 76321 - DNA, 25 bp, Mus musculus
acctatggtcgggagagccttgccc

SEQ ID NO: 76322 - DNA, 25 bp, Mus musculus
acctcaagagggagtgggaaacact

SEQ ID NO: 76323 - DNA, 25 bp, Mus musculus
acctcacacggctggagcgctttgc

SEQ ID NO: 76324 - DNA, 25 bp, Mus musculus
acctcagggtggatggcgcaaaccc

SEQ ID NO: 76325 - DNA, 25 bp, Mus musculus
acctcagtttgagatgccgctgcca

SEQ ID NO: 76326 - DNA, 25 bp, Mus musculus
acctccagcagccaagtaagccgtt

SEQ ID NO: 76327 - DNA, 25 bp, Mus musculus
acctcccccaggaatgcgcccacca

SEQ ID NO: 76328 - DNA, 25 bp, Mus musculus
acctccgagagaagcaccagatcat

SEQ ID NO: 76329 - DNA, 25 bp, Mus musculus
acctccgggaaatcagccaactggg

SEQ ID NO: 76330 - DNA, 25 bp, Mus musculus
acctccgtagtgtgctggtcacgag

SEQ ID NO: 76331 - DNA, 25 bp, Mus musculus
acctcctcgggacacatgattttag

SEQ ID NO: 76332 - DNA, 25 bp, Mus musculus
acctcgagttctgactgatatggac

SEQ ID NO: 76333 - DNA, 25 bp, Mus musculus
acctcgctcgggagttcgcagagcg

SEQ ID NO: 76334 - DNA, 25 bp, Mus musculus
acctcggagtctcaatccttactga

SEQ ID NO: 76335 - DNA, 25 bp, Mus musculus
acctcggcccagtgttcagcatctg

SEQ ID NO: 76336 - DNA, 25 bp, Mus musculus
acctcggcttcttcatcaacgacag

SEQ ID NO: 76337 - DNA, 25 bp, Mus musculus
acctcggtgtcctcttgctgtccag

SEQ ID NO: 76338 - DNA, 25 bp, Mus musculus
acctcgtcctcatcgggcggcaaga

SEQ ID NO: 76339 - DNA, 25 bp, Mus musculus
acctctgaaacctttctggtgggca

SEQ ID NO: 76340 - DNA, 25 bp, Mus musculus
acctctgtgaggaagtgcgagacat

SEQ ID NO: 76341 - DNA, 25 bp, Mus musculus
acctctgtttgtggagctgtatcag

SEQ ID NO: 76342 - DNA, 25 bp, Mus musculus
acctcttacaattaggtggctgacg

SEQ ID NO: 76343 - DNA, 25 bp, Mus musculus
acctcttgcgtataatctattgaag

SEQ ID NO: 76344 - DNA, 25 bp, Mus musculus
acctgaaagtggtgctggcagccgc

SEQ ID NO: 76345 - DNA, 25 bp, Mus musculus
acctgaactttgtacctgggcacca

SEQ ID NO: 76346 - DNA, 25 bp, Mus musculus
acctgaagatctgcatgtatgaccg

SEQ ID NO: 76347 - DNA, 25 bp, Mus musculus
acctgaagatgctggaaggcccgga

SEQ ID NO: 76348 - DNA, 25 bp, Mus musculus
acctgaaggctgaaattgacaagtt

SEQ ID NO: 76349 - DNA, 25 bp, Mus musculus
acctgacccgctagaactccgatgt

SEQ ID NO: 76350 - DNA, 25 bp, Mus musculus
acctgaccctgactcgggagcagac

SEQ ID NO: 76351 - DNA, 25 bp, Mus musculus
acctgactaactgccgcgagtggga

SEQ ID NO: 76352 - DNA, 25 bp, Mus musculus
acctgagggtgaggacaacctgtcc

SEQ ID NO: 76353 - DNA, 25 bp, Mus musculus
acctgcacacggaagctggactaac

SEQ ID NO: 76354 - DNA, 25 bp, Mus musculus
acctgcagggaaagggagtattacg

SEQ ID NO: 76355 - DNA, 25 bp, Mus musculus
acctgcagggatcagcggacagcat

SEQ ID NO: 76356 - DNA, 25 bp, Mus musculus
acctgcagggctggcactaggcaat

SEQ ID NO: 76357 - DNA, 25 bp, Mus musculus
acctgcaggtgctctagaaacttca

SEQ ID NO: 76358 - DNA, 25 bp, Mus musculus
acctgcataagaagggtggcaccca

SEQ ID NO: 76359 - DNA, 25 bp, Mus musculus
acctgccgctgtccatggatgagca

SEQ ID NO: 76360 - DNA, 25 bp, Mus musculus
acctgcctatgcctgggatccttca

SEQ ID NO: 76361 - DNA, 25 bp, Mus musculus
acctgcctgaggagcaccagatctc

SEQ ID NO: 76362 - DNA, 25 bp, Mus musculus
acctgcctggcattacaccgttgag

SEQ ID NO: 76363 - DNA, 25 bp, Mus musculus
acctgcgacgagaggaggcaatcca

SEQ ID NO: 76364 - DNA, 25 bp, Mus musculus
acctgcgccttcgtgggtgtggcca

SEQ ID NO: 76365 - DNA, 25 bp, Mus musculus
acctgcgggaacacacggaattcac

SEQ ID NO: 76366 - DNA, 25 bp, Mus musculus
acctgcgggcctttgcaatggagga

SEQ ID NO: 76367 - DNA, 25 bp, Mus musculus
acctgctgataaggagcatgaactc

SEQ ID NO: 76368 - DNA, 25 bp, Mus musculus
acctgctgggctgacttggctgctc

SEQ ID NO: 76369 - DNA, 25 bp, Mus musculus
acctgcttctgggactggtggtcag

SEQ ID NO: 76370 - DNA, 25 bp, Mus musculus
acctgctttggagtcgccgtgggaa

SEQ ID NO: 76371 - DNA, 25 bp, Mus musculus
acctggaactctcttaccgctgcga

SEQ ID NO: 76372 - DNA, 25 bp, Mus musculus
acctggaagagcacatggatacctg

SEQ ID NO: 76373 - DNA, 25 bp, Mus musculus
acctggaatgtctgtaacccgtgca

SEQ ID NO: 76374 - DNA, 25 bp, Mus musculus
acctggacaacgtgcaagcgctgca

SEQ ID NO: 76375 - DNA, 25 bp, Mus musculus
acctggagacagatcgtgagcggct

SEQ ID NO: 76376 - DNA, 25 bp, Mus musculus
acctggagccgagccaagttctggg

SEQ ID NO: 76377 - DNA, 25 bp, Mus musculus
acctggagctactgagaaagcataa

SEQ ID NO: 76378 - DNA, 25 bp, Mus musculus
acctggaggttatccagcccctggg

SEQ ID NO: 76379 - DNA, 25 bp, Mus musculus
acctggattccgttcctctgcaaga

SEQ ID NO: 76380 - DNA, 25 bp, Mus musculus
acctggcacccacacggtggatggt

SEQ ID NO: 76381 - DNA, 25 bp, Mus musculus
acctggccgggaagagctacatcat

SEQ ID NO: 76382 - DNA, 25 bp, Mus musculus
acctgggaatcctgtcagcagtgca

SEQ ID NO: 76383 - DNA, 25 bp, Mus musculus
acctgggagcccttgcagaactggg

SEQ ID NO: 76384 - DNA, 25 bp, Mus musculus
acctgggaggctgcaatgggacatc

SEQ ID NO: 76385 - DNA, 25 bp, Mus musculus
acctgggtgttctgagctgggctac

SEQ ID NO: 76386 - DNA, 25 bp, Mus musculus
acctggtgcccgagtgattgtgaca

SEQ ID NO: 76387 - DNA, 25 bp, Mus musculus
acctggtgggtgagccctccttata

SEQ ID NO: 76388 - DNA, 25 bp, Mus musculus
acctggtgtcgctgcagttcgcgga

SEQ ID NO: 76389 - DNA, 25 bp, Mus musculus
acctgtctcagcagtgccagggcga

SEQ ID NO: 76390 - DNA, 25 bp, Mus musculus
acctgtggagtacatgaacttatct

SEQ ID NO: 76391 - DNA, 25 bp, Mus musculus
acctgtgggactggaagcctctcaa

SEQ ID NO: 76392 - DNA, 25 bp, Mus musculus
acctgttactgtgacctcttctgca

SEQ ID NO: 76393 - DNA, 25 bp, Mus musculus
acctgttatcatggtgggccccggc

SEQ ID NO: 76394 - DNA, 25 bp, Mus musculus
acctgttggacccagtatagcggca

SEQ ID NO: 76395 - DNA, 25 bp, Mus musculus
acctgttggagctgtgggactccct

SEQ ID NO: 76396 - DNA, 25 bp, Mus musculus
accttagtgcagctgcccaatgggc

SEQ ID NO: 76397 - DNA, 25 bp, Mus musculus
accttcaacagtagaagttctagaa

SEQ ID NO: 76398 - DNA, 25 bp, Mus musculus
accttcagtgatgtggctcagctca

SEQ ID NO: 76399 - DNA, 25 bp, Mus musculus
accttcccttctcacagaggagcag

SEQ ID NO: 76400 - DNA, 25 bp, Mus musculus
accttcctgttgtcatgagattgca

SEQ ID NO: 76401 - DNA, 25 bp, Mus musculus
accttcgcacaaccggtgtgattga

SEQ ID NO: 76402 - DNA, 25 bp, Mus musculus
accttctacaatatcgccatgacgg

SEQ ID NO: 76403 - DNA, 25 bp, Mus musculus
accttgaggctctgcaactgcgagc

SEQ ID NO: 76404 - DNA, 25 bp, Mus musculus
accttgctggccgtgacacttattg

SEQ ID NO: 76405 - DNA, 25 bp, Mus musculus
accttgtctcgaagaggcacctcag

SEQ ID NO: 76406 - DNA, 25 bp, Mus musculus
accttgtggaagacctgcgtggatt

SEQ ID NO: 76407 - DNA, 25 bp, Mus musculus
acctttgagccaaggaacctcctca

SEQ ID NO: 76408 - DNA, 25 bp, Mus musculus
acgaaatgctgaagcgtgagctgga

SEQ ID NO: 76409 - DNA, 25 bp, Mus musculus
acgaacaggcgctggcgtctggcct

SEQ ID NO: 76410 - DNA, 25 bp, Mus musculus
acgaagcaacccgagacaccgtgtt

SEQ ID NO: 76411 - DNA, 25 bp, Mus musculus
acgaagttcactttctgcacgagga

SEQ ID NO: 76412 - DNA, 25 bp, Mus musculus
acgaatatgacgagaacagttcgtg

SEQ ID NO: 76413 - DNA, 25 bp, Mus musculus
acgaatgatgctgttctgaagaggc

SEQ ID NO: 76414 - DNA, 25 bp, Mus musculus
acgacatcgctggacactcgggaga

SEQ ID NO: 76415 - DNA, 25 bp, Mus musculus
acgacatgctggaacacggagggaa

SEQ ID NO: 76416 - DNA, 25 bp, Mus musculus
acgacccagccgaagcgttgactga

SEQ ID NO: 76417 - DNA, 25 bp, Mus musculus
acgaccgcgagctgctggaccttca

SEQ ID NO: 76418 - DNA, 25 bp, Mus musculus
acgaccgctaagttatccacagaca

SEQ ID NO: 76419 - DNA, 25 bp, Mus musculus
acgacctcgtgcgtgatcgtgtcac

SEQ ID NO: 76420 - DNA, 25 bp, Mus musculus
acgacgactacagcggcggcgacag

SEQ ID NO: 76421 - DNA, 25 bp, Mus musculus
acgacggtctagtgttggaggccaa

SEQ ID NO: 76422 - DNA, 25 bp, Mus musculus
acgacggttccggagctgaaacaga

SEQ ID NO: 76423 - DNA, 25 bp, Mus musculus
acgactttgaggaagcccaccgagt

SEQ ID NO: 76424 - DNA, 25 bp, Mus musculus
acgagaagcgagagaaaatggaagc

SEQ ID NO: 76425 - DNA, 25 bp, Mus musculus
acgagaagctggatatggtcaaggc

SEQ ID NO: 76426 - DNA, 25 bp, Mus musculus
acgagaccatcgaggtggaaaagga

SEQ ID NO: 76427 - DNA, 25 bp, Mus musculus
acgagacgccgctctgatggtgacc

SEQ ID NO: 76428 - DNA, 25 bp, Mus musculus
acgagagactgtatagccccgccgc

SEQ ID NO: 76429 - DNA, 25 bp, Mus musculus
acgagcaggagagcaccctgggtca

SEQ ID NO: 76430 - DNA, 25 bp, Mus musculus
acgagctacttcctttctgcgctct

SEQ ID NO: 76431 - DNA, 25 bp, Mus musculus
acgagctggagaagatccgcaaaca

SEQ ID NO: 76432 - DNA, 25 bp, Mus musculus
acgaggccttggtcggtccgcgact

SEQ ID NO: 76433 - DNA, 25 bp, Mus musculus
acgaggtggagatcgaggactttca

SEQ ID NO: 76434 - DNA, 25 bp, Mus musculus
acgagtcctcagacacgcagagtga

SEQ ID NO: 76435 - DNA, 25 bp, Mus musculus
acgagtcggtgcaacggcatggcca

SEQ ID NO: 76436 - DNA, 25 bp, Mus musculus
acgagtgagagatgagcctgagccc

SEQ ID NO: 76437 - DNA, 25 bp, Mus musculus
acgagtgtgccctgccctacctggg

SEQ ID NO: 76438 - DNA, 25 bp, Mus musculus
acgatactgccaggcccatgttgga

SEQ ID NO: 76439 - DNA, 25 bp, Mus musculus
acgatgctgcctgccgagtcattgc

SEQ ID NO: 76440 - DNA, 25 bp, Mus musculus
acgatgtgtatttgatgctgcccca

SEQ ID NO: 76441 - DNA, 25 bp, Mus musculus
acgatgttccggatgctgagcagca

SEQ ID NO: 76442 - DNA, 25 bp, Mus musculus
acgattacttcgaggtggtggctgc

SEQ ID NO: 76443 - DNA, 25 bp, Mus musculus
acgattctgaagacgcgcagcctgg

SEQ ID NO: 76444 - DNA, 25 bp, Mus musculus
acgattctgttgagcttggtagggc

SEQ ID NO: 76445 - DNA, 25 bp, Mus musculus
acgattgagtaggagcacacaggcg

SEQ ID NO: 76446 - DNA, 25 bp, Mus musculus
acgcaagatgcggagctgtcaccta

SEQ ID NO: 76447 - DNA, 25 bp, Mus musculus
acgcaagggccttcgctgaacagaa

SEQ ID NO: 76448 - DNA, 25 bp, Mus musculus
acgcaatactctttcttctaaggat

SEQ ID NO: 76449 - DNA, 25 bp, Mus musculus
acgccactgtggagacgagacggca

SEQ ID NO: 76450 - DNA, 25 bp, Mus musculus
acgccagctctgacggtcctgaaac

SEQ ID NO: 76451 - DNA, 25 bp, Mus musculus
acgccagggctttcgctcttgctga

SEQ ID NO: 76452 - DNA, 25 bp, Mus musculus
acgccatccttattggaatgagcca

SEQ ID NO: 76453 - DNA, 25 bp, Mus musculus
acgcccacggagcaagggtccacat

SEQ ID NO: 76454 - DNA, 25 bp, Mus musculus
acgcccatgctggaggtggcgctca

SEQ ID NO: 76455 - DNA, 25 bp, Mus musculus
acgcccgcagggacttcgagaaggc

SEQ ID NO: 76456 - DNA, 25 bp, Mus musculus
acgccgagagaggtggtcccatcct

SEQ ID NO: 76457 - DNA, 25 bp, Mus musculus
acgccgccgggaagcactttgttca

SEQ ID NO: 76458 - DNA, 25 bp, Mus musculus
acgccgcgcggactcctcggatttt

SEQ ID NO: 76459 - DNA, 25 bp, Mus musculus
acgccggcgcagtctacggaaccgc

SEQ ID NO: 76460 - DNA, 25 bp, Mus musculus
acgccgggactgtccagcgaacgag

SEQ ID NO: 76461 - DNA, 25 bp, Mus musculus
acgcgcgaagcaagcgggaagcagg

SEQ ID NO: 76462 - DNA, 25 bp, Mus musculus
acgcggagccccagttctgtcaagg

SEQ ID NO: 76463 - DNA, 25 bp, Mus musculus
acgcggcctcggaactctgaatgag

SEQ ID NO: 76464 - DNA, 25 bp, Mus musculus
acgcgggggaggcgcgcggcacggg

SEQ ID NO: 76465 - DNA, 25 bp, Mus musculus
acgctagtgacatgctggccgcggc

SEQ ID NO: 76466 - DNA, 25 bp, Mus musculus
acgctgacccgaagcctggacttga

SEQ ID NO: 76467 - DNA, 25 bp, Mus musculus
acgctgaggacatggtggccttgaa

SEQ ID NO: 76468 - DNA, 25 bp, Mus musculus
acgctgatgccaccggtcgggcggg

SEQ ID NO: 76469 - DNA, 25 bp, Mus musculus
acgctgcttgggaagtcaccgtctg

SEQ ID NO: 76470 - DNA, 25 bp, Mus musculus
acgctggctctgacgcccatgctgg

SEQ ID NO: 76471 - DNA, 25 bp, Mus musculus
acgctggttcccaagaggctgcaga

SEQ ID NO: 76472 - DNA, 25 bp, Mus musculus
acgctggttgctgtgaagccagatg

SEQ ID NO: 76473 - DNA, 25 bp, Mus musculus
acgctgtgcagaacacgggacctgc

SEQ ID NO: 76474 - DNA, 25 bp, Mus musculus
acgcttggccaagccagagagaggc

SEQ ID NO: 76475 - DNA, 25 bp, Mus musculus
acggaactggccaagcgcatcactg

SEQ ID NO: 76476 - DNA, 25 bp, Mus musculus
acggacaggtggtgagccctcgccc

SEQ ID NO: 76477 - DNA, 25 bp, Mus musculus
acggacatggtcatggtcatggaca

SEQ ID NO: 76478 - DNA, 25 bp, Mus musculus
acggacgccctagagtagggagaca

SEQ ID NO: 76479 - DNA, 25 bp, Mus musculus
acggacggcctggatggcacatcga

SEQ ID NO: 76480 - DNA, 25 bp, Mus musculus
acggagcgctggtgataaaaagaac

SEQ ID NO: 76481 - DNA, 25 bp, Mus musculus
acggagggaggctacaactgcacct

SEQ ID NO: 76482 - DNA, 25 bp, Mus musculus
acggaggtcccatgttcagtgagaa

SEQ ID NO: 76483 - DNA, 25 bp, Mus musculus
acggaggtgcaagttttcaagaaat

SEQ ID NO: 76484 - DNA, 25 bp, Mus musculus
acggatgtagcctcccgtgggctag

SEQ ID NO: 76485 - DNA, 25 bp, Mus musculus
acggatgtcatcactgttgctagga

SEQ ID NO: 76486 - DNA, 25 bp, Mus musculus
acggattgttcttgaaaaactgagc

SEQ ID NO: 76487 - DNA, 25 bp, Mus musculus
acggcaaccatgatgatcccacggg

SEQ ID NO: 76488 - DNA, 25 bp, Mus musculus
acggcagagcctgtcccaaagacat

SEQ ID NO: 76489 - DNA, 25 bp, Mus musculus
acggcatctcagctacccgtgtgga

SEQ ID NO: 76490 - DNA, 25 bp, Mus musculus
acggccacgaccctagaaaggctgg

SEQ ID NO: 76491 - DNA, 25 bp, Mus musculus
acggccaggagcaggcaccatggtt

SEQ ID NO: 76492 - DNA, 25 bp, Mus musculus
acggcccatctacttggctctgtgg

SEQ ID NO: 76493 - DNA, 25 bp, Mus musculus
acggccccgacaagatgcagatgga

SEQ ID NO: 76494 - DNA, 25 bp, Mus musculus
acggcccggaagaagcacaagtcat

SEQ ID NO: 76495 - DNA, 25 bp, Mus musculus
acggccgcgtgctcttcatcaagga

SEQ ID NO: 76496 - DNA, 25 bp, Mus musculus
acggccgggactatagagaaacaca

SEQ ID NO: 76497 - DNA, 25 bp, Mus musculus
acggccgtgacgtgcattggcttca

SEQ ID NO: 76498 - DNA, 25 bp, Mus musculus
acggcctacatcctcatctttctta

SEQ ID NO: 76499 - DNA, 25 bp, Mus musculus
acggcctgaagaccggcttctttag

SEQ ID NO: 76500 - DNA, 25 bp, Mus musculus
acggcgaagacaccggccgtcatct

SEQ ID NO: 76501 - DNA, 25 bp, Mus musculus
acggcgccctgttcaaagtggcgca

SEQ ID NO: 76502 - DNA, 25 bp, Mus musculus
acggcggacgctgtagctgctctga

SEQ ID NO: 76503 - DNA, 25 bp, Mus musculus
acggcgtctgggaccggagacccat

SEQ ID NO: 76504 - DNA, 25 bp, Mus musculus
acggcgtgacaaaagcgtgtccagc

SEQ ID NO: 76505 - DNA, 25 bp, Mus musculus
acggctacatctacccactgcgtga

SEQ ID NO: 76506 - DNA, 25 bp, Mus musculus
acggctgctcttcccggcactggtg

SEQ ID NO: 76507 - DNA, 25 bp, Mus musculus
acggctgggctttgcgacatcgtcg

SEQ ID NO: 76508 - DNA, 25 bp, Mus musculus
acggctgttaggtggttggactcaa

SEQ ID NO: 76509 - DNA, 25 bp, Mus musculus
acgggacgcccctgagtgaacgcca

SEQ ID NO: 76510 - DNA, 25 bp, Mus musculus
acgggatgtcggtgccccatggacc

SEQ ID NO: 76511 - DNA, 25 bp, Mus musculus
acgggcagctcggaagccgcgacat

SEQ ID NO: 76512 - DNA, 25 bp, Mus musculus
acgggcccgtgacctgagtatacaa

SEQ ID NO: 76513 - DNA, 25 bp, Mus musculus
acgggctacgcgttcgtggactgcc

SEQ ID NO: 76514 - DNA, 25 bp, Mus musculus
acgggctgagcgacgaggaactcaa

SEQ ID NO: 76515 - DNA, 25 bp, Mus musculus
acgggtggctgcgtgctcttacaca

SEQ ID NO: 76516 - DNA, 25 bp, Mus musculus
acgggttgagtggacaggcggccct

SEQ ID NO: 76517 - DNA, 25 bp, Mus musculus
acggtatcaccgacctggcctgcaa

SEQ ID NO: 76518 - DNA, 25 bp, Mus musculus
acggtccccagcctgctgatcccgg

SEQ ID NO: 76519 - DNA, 25 bp, Mus musculus
acggtcgacttgtggccacacggct

SEQ ID NO: 76520 - DNA, 25 bp, Mus musculus
acggtctccttgtgtcagcttacga

SEQ ID NO: 76521 - DNA, 25 bp, Mus musculus
acggtttgagtaccatgacagtcag

SEQ ID NO: 76522 - DNA, 25 bp, Mus musculus
acgtactccataggcaccgtgggca

SEQ ID NO: 76523 - DNA, 25 bp, Mus musculus
acgtactggcagctctttgcccggg

SEQ ID NO: 76524 - DNA, 25 bp, Mus musculus
acgtatggccattgagctttgagca

SEQ ID NO: 76525 - DNA, 25 bp, Mus musculus
acgtcatccatctccagcgagggca

SEQ ID NO: 76526 - DNA, 25 bp, Mus musculus
acgtcatgggtcacttccgctggga

SEQ ID NO: 76527 - DNA, 25 bp, Mus musculus
acgtccagcgatcagccttcctatt

SEQ ID NO: 76528 - DNA, 25 bp, Mus musculus
acgtccgttgcccagtagtatgggc

SEQ ID NO: 76529 - DNA, 25 bp, Mus musculus
acgtccttgatgtcagccgagagcc

SEQ ID NO: 76530 - DNA, 25 bp, Mus musculus
acgtcggtcacagatcttagtagca

SEQ ID NO: 76531 - DNA, 25 bp, Mus musculus
acgtgaagctgagtgggaagactaa

SEQ ID NO: 76532 - DNA, 25 bp, Mus musculus
acgtgacgagtcttgccatctgtgc

SEQ ID NO: 76533 - DNA, 25 bp, Mus musculus
acgtgaggcacgaggatggcatcaa

SEQ ID NO: 76534 - DNA, 25 bp, Mus musculus
acgtgatctggaaccggctgtgtcg

SEQ ID NO: 76535 - DNA, 25 bp, Mus musculus
acgtgatcttcgactgcagccatga

SEQ ID NO: 76536 - DNA, 25 bp, Mus musculus
acgtgcactctacttgcaggggtgc

SEQ ID NO: 76537 - DNA, 25 bp, Mus musculus
acgtgccagggtagttcaggagccc

SEQ ID NO: 76538 - DNA, 25 bp, Mus musculus
acgtgctcggcgtataagtagcggc

SEQ ID NO: 76539 - DNA, 25 bp, Mus musculus
acgtggaggtcctgcatgtgcgcaa

SEQ ID NO: 76540 - DNA, 25 bp, Mus musculus
acgtggagtatcgtcccgacctctg

SEQ ID NO: 76541 - DNA, 25 bp, Mus musculus
acgtggatggcgattggccgaaccc

SEQ ID NO: 76542 - DNA, 25 bp, Mus musculus
acgtggccgaggaactcatccagga

SEQ ID NO: 76543 - DNA, 25 bp, Mus musculus
acgtgggactgcagacggaagccat

SEQ ID NO: 76544 - DNA, 25 bp, Mus musculus
acgtggtaggctccacactgggcct

SEQ ID NO: 76545 - DNA, 25 bp, Mus musculus
acgtggtcgtcagcagccgcaaaca

SEQ ID NO: 76546 - DNA, 25 bp, Mus musculus
acgtggttctcagcatcgatgggat

SEQ ID NO: 76547 - DNA, 25 bp, Mus musculus
acgtgtcatgacaagcctgggacca

SEQ ID NO: 76548 - DNA, 25 bp, Mus musculus
acgtgttgactgagggagcccctga

SEQ ID NO: 76549 - DNA, 25 bp, Mus musculus
acgtgtttcagaacggatggcaggg

SEQ ID NO: 76550 - DNA, 25 bp, Mus musculus
acgttaaggtggttatgctgggcaa

SEQ ID NO: 76551 - DNA, 25 bp, Mus musculus
acgttggctctgcaggcctaagccc

SEQ ID NO: 76552 - DNA, 25 bp, Mus musculus
actaaagggcctgtctctgtgggca

SEQ ID NO: 76553 - DNA, 25 bp, Mus musculus
actaaccagttctccgtgaccaggc

SEQ ID NO: 76554 - DNA, 25 bp, Mus musculus
actaaccgggccctgtgctatctga

SEQ ID NO: 76555 - DNA, 25 bp, Mus musculus
actaagaatccaaagcatgcggctg

SEQ ID NO: 76556 - DNA, 25 bp, Mus musculus
actaagcatcctaatccctatgaag

SEQ ID NO: 76557 - DNA, 25 bp, Mus musculus
actaagccagtggtgctgatctggg

SEQ ID NO: 76558 - DNA, 25 bp, Mus musculus
actaagtgaccgcttcagcggtgag

SEQ ID NO: 76559 - DNA, 25 bp, Mus musculus
actaatgaagagctgagacgctgcc

SEQ ID NO: 76560 - DNA, 25 bp, Mus musculus
actaatgagctatgaagttccggaa

SEQ ID NO: 76561 - DNA, 25 bp, Mus musculus
actaatggagacttcagacgcagcc

SEQ ID NO: 76562 - DNA, 25 bp, Mus musculus
actaattggctttgctggtgctccg

SEQ ID NO: 76563 - DNA, 25 bp, Mus musculus
actacaagagttacgggacagtcca

SEQ ID NO: 76564 - DNA, 25 bp, Mus musculus
actacagtaatgtccgagggcaccc

SEQ ID NO: 76565 - DNA, 25 bp, Mus musculus
actacatcgcacaccgaaagggctg

SEQ ID NO: 76566 - DNA, 25 bp, Mus musculus
actaccagacttagcccgtcgggat

SEQ ID NO: 76567 - DNA, 25 bp, Mus musculus
actaccagctcaacggtggcggagg

SEQ ID NO: 76568 - DNA, 25 bp, Mus musculus
actacccagggtcccgcagagagaa

SEQ ID NO: 76569 - DNA, 25 bp, Mus musculus
actaccgctgtatcacttgtgaggg

SEQ ID NO: 76570 - DNA, 25 bp, Mus musculus
actacctggtgggacaggtcgccga

SEQ ID NO: 76571 - DNA, 25 bp, Mus musculus
actacgatatcaagtggacaatgcc

SEQ ID NO: 76572 - DNA, 25 bp, Mus musculus
actacgcgagcggagtgggcgctta

SEQ ID NO: 76573 - DNA, 25 bp, Mus musculus
actacgcgcgccctaagcagttcat

SEQ ID NO: 76574 - DNA, 25 bp, Mus musculus
actacgctgcgaaaggctgctggga

SEQ ID NO: 76575 - DNA, 25 bp, Mus musculus
actacgtgctggctgatccctggag

SEQ ID NO: 76576 - DNA, 25 bp, Mus musculus
actacgtggaacgagccgtgtctga

SEQ ID NO: 76577 - DNA, 25 bp, Mus musculus
actacgtgtttgctgagaatgggac

SEQ ID NO: 76578 - DNA, 25 bp, Mus musculus
actactggagtgtgtgcgcctacgc

SEQ ID NO: 76579 - DNA, 25 bp, Mus musculus
actactggtggagctgggttcagcc

SEQ ID NO: 76580 - DNA, 25 bp, Mus musculus
actactgtgtaagagcgagcggtgc

SEQ ID NO: 76581 - DNA, 25 bp, Mus musculus
actacttcgtagtgtgcggacccgg

SEQ ID NO: 76582 - DNA, 25 bp, Mus musculus
actagagcccgctttgttcccaaag

SEQ ID NO: 76583 - DNA, 25 bp, Mus musculus
actagcggatctgtgtcccaggaca

SEQ ID NO: 76584 - DNA, 25 bp, Mus musculus
actagctgggcccttaatggcggac

SEQ ID NO: 76585 - DNA, 25 bp, Mus musculus
actaggatcgatggcaacttggtca

SEQ ID NO: 76586 - DNA, 25 bp, Mus musculus
actaggcccctttgtctgtcagatg

SEQ ID NO: 76587 - DNA, 25 bp, Mus musculus
actaggcctgacacgtggaagatgc

SEQ ID NO: 76588 - DNA, 25 bp, Mus musculus
actagtgacgttcaaagacgtggcc

SEQ ID NO: 76589 - DNA, 25 bp, Mus musculus
actagttcttgtgaggtccgaggca

SEQ ID NO: 76590 - DNA, 25 bp, Mus musculus
actagtttgggatcggcttctccga

SEQ ID NO: 76591 - DNA, 25 bp, Mus musculus
actatacctgtctgccatctgcctg

SEQ ID NO: 76592 - DNA, 25 bp, Mus musculus
actatcatcatctgcttcacctgct

SEQ ID NO: 76593 - DNA, 25 bp, Mus musculus
actatcgccagtctgagggcccagt

SEQ ID NO: 76594 - DNA, 25 bp, Mus musculus
actatctcatcggaacctgctggga

SEQ ID NO: 76595 - DNA, 25 bp, Mus musculus
actatgaagaaaccatcgggaaagc

SEQ ID NO: 76596 - DNA, 25 bp, Mus musculus
actatgagcctagctggtcactgca

SEQ ID NO: 76597 - DNA, 25 bp, Mus musculus
actatgataatttgagacactttgc

SEQ ID NO: 76598 - DNA, 25 bp, Mus musculus
actatgatgagtccccgaaaggtcc

SEQ ID NO: 76599 - DNA, 25 bp, Mus musculus
actatgcagtgtccgtagagccgcc

SEQ ID NO: 76600 - DNA, 25 bp, Mus musculus
actatgcggcgcaggcgtctgcggc

SEQ ID NO: 76601 - DNA, 25 bp, Mus musculus
actatgctcgccctggcagaggaag

SEQ ID NO: 76602 - DNA, 25 bp, Mus musculus
actatgctgcgacggaaaccgaccc

SEQ ID NO: 76603 - DNA, 25 bp, Mus musculus
actatggaccgtgcttgggccccat

SEQ ID NO: 76604 - DNA, 25 bp, Mus musculus
actatgggacaaacagaactgggct

SEQ ID NO: 76605 - DNA, 25 bp, Mus musculus
actatgggacggaaatcagtgctgc

SEQ ID NO: 76606 - DNA, 25 bp, Mus musculus
actatgtatgtttgtggcggcagca

SEQ ID NO: 76607 - DNA, 25 bp, Mus musculus
actatgttggtcactctcagggcac

SEQ ID NO: 76608 - DNA, 25 bp, Mus musculus
actattcaaaggactgggctcgccg

SEQ ID NO: 76609 - DNA, 25 bp, Mus musculus
actattgacatcaggctcgtgggcc

SEQ ID NO: 76610 - DNA, 25 bp, Mus musculus
actatttggtgttctctggctggca

SEQ ID NO: 76611 - DNA, 25 bp, Mus musculus
actattttagactgtgaggttcacg

SEQ ID NO: 76612 - DNA, 25 bp, Mus musculus
actcaacccacaagagctgcagcgg

SEQ ID NO: 76613 - DNA, 25 bp, Mus musculus
actcaagcccggcttctggtggctg

SEQ ID NO: 76614 - DNA, 25 bp, Mus musculus
actcaagtgcgatgcctgctcgggc

SEQ ID NO: 76615 - DNA, 25 bp, Mus musculus
actcacagagatccggactaggcac

SEQ ID NO: 76616 - DNA, 25 bp, Mus musculus
actcacagggttggatgcagggcac

SEQ ID NO: 76617 - DNA, 25 bp, Mus musculus
actcacatggtgaaagccggcagcg

SEQ ID NO: 76618 - DNA, 25 bp, Mus musculus
actcacctgtggatgtgaagacgca

SEQ ID NO: 76619 - DNA, 25 bp, Mus musculus
actcactaggctgggaagagcggca

SEQ ID NO: 76620 - DNA, 25 bp, Mus musculus
actcagaacagggtggccggtgaac

SEQ ID NO: 76621 - DNA, 25 bp, Mus musculus
actcagaagagcgtcggagtgcccg

SEQ ID NO: 76622 - DNA, 25 bp, Mus musculus
actcagagcctcgtccggtgcagga

SEQ ID NO: 76623 - DNA, 25 bp, Mus musculus
actcagaggcaagtgacaggaatca

SEQ ID NO: 76624 - DNA, 25 bp, Mus musculus
actcagcgagcttcagattaaacag

SEQ ID NO: 76625 - DNA, 25 bp, Mus musculus
actcagctggaacgaccgatcggtg

SEQ ID NO: 76626 - DNA, 25 bp, Mus musculus
actcaggccgtggagctggatgctc

SEQ ID NO: 76627 - DNA, 25 bp, Mus musculus
actcaggcgagagcagcaagcgttg

SEQ ID NO: 76628 - DNA, 25 bp, Mus musculus
actcagggcccagggacaaccgcta

SEQ ID NO: 76629 - DNA, 25 bp, Mus musculus
actcagtctgcaccaatatcctggg

SEQ ID NO: 76630 - DNA, 25 bp, Mus musculus
actcatgcatatggctgggagagcg

SEQ ID NO: 76631 - DNA, 25 bp, Mus musculus
actcatgggtaggaagaatcgaaac

SEQ ID NO: 76632 - DNA, 25 bp, Mus musculus
actcatgtgcagagcagcgcatcgg

SEQ ID NO: 76633 - DNA, 25 bp, Mus musculus
actccaagcaagagctgcagcccta

SEQ ID NO: 76634 - DNA, 25 bp, Mus musculus
actccacagacctcatggaggccat

SEQ ID NO: 76635 - DNA, 25 bp, Mus musculus
actccagcgagcaggctatctccta

SEQ ID NO: 76636 - DNA, 25 bp, Mus musculus
actccaggcgctccaagcagtgaga

SEQ ID NO: 76637 - DNA, 25 bp, Mus musculus
actccatcttcttcctctcggttgc

SEQ ID NO: 76638 - DNA, 25 bp, Mus musculus
actccatgagctgtgatttccaagg

SEQ ID NO: 76639 - DNA, 25 bp, Mus musculus
actcccaagggtttaatgtctactg

SEQ ID NO: 76640 - DNA, 25 bp, Mus musculus
actccccggctgaagtgaagacgca

SEQ ID NO: 76641 - DNA, 25 bp, Mus musculus
actcccgacattggcagctgctggg

SEQ ID NO: 76642 - DNA, 25 bp, Mus musculus
actccgaaggagaggttccggctca

SEQ ID NO: 76643 - DNA, 25 bp, Mus musculus
actccgacaacccatctgaagaggg

SEQ ID NO: 76644 - DNA, 25 bp, Mus musculus
actcctaatcggtgctgacaatgtg

SEQ ID NO: 76645 - DNA, 25 bp, Mus musculus
actcctcattcctgatgatttcaag

SEQ ID NO: 76646 - DNA, 25 bp, Mus musculus
actcctccatccatgttgggcgcag

SEQ ID NO: 76647 - DNA, 25 bp, Mus musculus
actcctgggttggaagccagactgg

SEQ ID NO: 76648 - DNA, 25 bp, Mus musculus
actccttaaagtggccagctgaatg

SEQ ID NO: 76649 - DNA, 25 bp, Mus musculus
actcgaagagcgatgccctggagac

SEQ ID NO: 76650 - DNA, 25 bp, Mus musculus
actcgagggtggctggcaacattcc

SEQ ID NO: 76651 - DNA, 25 bp, Mus musculus
actcgatggtgaacttgctctgcag

SEQ ID NO: 76652 - DNA, 25 bp, Mus musculus
actcgcagatgacaaagcaagctct

SEQ ID NO: 76653 - DNA, 25 bp, Mus musculus
actcgcagccggagtgaccctgggt

SEQ ID NO: 76654 - DNA, 25 bp, Mus musculus
actcgctggccgaagttgaggagaa

SEQ ID NO: 76655 - DNA, 25 bp, Mus musculus
actcgctggtcccaggtacgcacac

SEQ ID NO: 76656 - DNA, 25 bp, Mus musculus
actcggaacccacttgtggcagtgt

SEQ ID NO: 76657 - DNA, 25 bp, Mus musculus
actcggatccgagaaaacatggcca

SEQ ID NO: 76658 - DNA, 25 bp, Mus musculus
actcggtttgcatctctcacatgga

SEQ ID NO: 76659 - DNA, 25 bp, Mus musculus
actcgtcccaggaaaaactgcccag

SEQ ID NO: 76660 - DNA, 25 bp, Mus musculus
actcgtcgagaaaaggcgtatgtcc

SEQ ID NO: 76661 - DNA, 25 bp, Mus musculus
actcgtcgccgcaggattctacttt

SEQ ID NO: 76662 - DNA, 25 bp, Mus musculus
actcgtgttcaaggtcgtgggcgcc

SEQ ID NO: 76663 - DNA, 25 bp, Mus musculus
actctcagaagcacatcgacttctc

SEQ ID NO: 76664 - DNA, 25 bp, Mus musculus
actctcaggtggacgacatggatgt

SEQ ID NO: 76665 - DNA, 25 bp, Mus musculus
actctccttgcctgctgaggctcag

SEQ ID NO: 76666 - DNA, 25 bp, Mus musculus
actctctgcgcaccggcatgaggga

SEQ ID NO: 76667 - DNA, 25 bp, Mus musculus
actctgaagagtttcggcagcggga

SEQ ID NO: 76668 - DNA, 25 bp, Mus musculus
actctgaaggatctgctgaaagcca

SEQ ID NO: 76669 - DNA, 25 bp, Mus musculus
actctgagctgggaggacgatccag

SEQ ID NO: 76670 - DNA, 25 bp, Mus musculus
actctgatttcacagccctgacttc

SEQ ID NO: 76671 - DNA, 25 bp, Mus musculus
actctgcggcgttctcaaagttcgg

SEQ ID NO: 76672 - DNA, 25 bp, Mus musculus
actctgctgcccagggagcaggcgt

SEQ ID NO: 76673 - DNA, 25 bp, Mus musculus
actctgctgccggatgtgtgagcca

SEQ ID NO: 76674 - DNA, 25 bp, Mus musculus
actctggacctggacaagggctgca

SEQ ID NO: 76675 - DNA, 25 bp, Mus musculus
actctggagggttttgtcaatcaaa

SEQ ID NO: 76676 - DNA, 25 bp, Mus musculus
actctggcactatggtcatggcgga

SEQ ID NO: 76677 - DNA, 25 bp, Mus musculus
actctggcgccatggaggagtacgc

SEQ ID NO: 76678 - DNA, 25 bp, Mus musculus
actctgggtcttgggagctcttgcc

SEQ ID NO: 76679 - DNA, 25 bp, Mus musculus
actctggtatttacgaaagtgcacc

SEQ ID NO: 76680 - DNA, 25 bp, Mus musculus
actctggtcaccgtcatggcaggca

SEQ ID NO: 76681 - DNA, 25 bp, Mus musculus
actctgtacgagtctgaggtgcgac

SEQ ID NO: 76682 - DNA, 25 bp, Mus musculus
actcttcagggtggtcgacatggtc

SEQ ID NO: 76683 - DNA, 25 bp, Mus musculus
actcttccgggcctgatgcctacga

SEQ ID NO: 76684 - DNA, 25 bp, Mus musculus
actgaaaagaatcaagcgcgccgac

SEQ ID NO: 76685 - DNA, 25 bp, Mus musculus
actgaaatcatctctaccccatttg

SEQ ID NO: 76686 - DNA, 25 bp, Mus musculus
actgaacaccgtctggtcctcacgg

SEQ ID NO: 76687 - DNA, 25 bp, Mus musculus
actgaactccgtggctcagggaggc

SEQ ID NO: 76688 - DNA, 25 bp, Mus musculus
actgaagaagtaccccgagaagctc

SEQ ID NO: 76689 - DNA, 25 bp, Mus musculus
actgaagatactaccccaaagggag

SEQ ID NO: 76690 - DNA, 25 bp, Mus musculus
actgaagatgtaccagaggcagtgc

SEQ ID NO: 76691 - DNA, 25 bp, Mus musculus
actgaagattgtcctggccgcgacc

SEQ ID NO: 76692 - DNA, 25 bp, Mus musculus
actgaagctaggcagcagcatccgg

SEQ ID NO: 76693 - DNA, 25 bp, Mus musculus
actgaaggaagctcaaggtcgattc

SEQ ID NO: 76694 - DNA, 25 bp, Mus musculus
actgaaggagcctgcagcgctcacc

SEQ ID NO: 76695 - DNA, 25 bp, Mus musculus
actgaagttagaggccagcgtgagc

SEQ ID NO: 76696 - DNA, 25 bp, Mus musculus
actgaagtttgggttgcgtacacaa

SEQ ID NO: 76697 - DNA, 25 bp, Mus musculus
actgacaaaattcattatacctgag

SEQ ID NO: 76698 - DNA, 25 bp, Mus musculus
actgacaccggaacagagtccagcc

SEQ ID NO: 76699 - DNA, 25 bp, Mus musculus
actgacatgcgggtcatatattgga

SEQ ID NO: 76700 - DNA, 25 bp, Mus musculus
actgaccattcgtgcataactccca

SEQ ID NO: 76701 - DNA, 25 bp, Mus musculus
actgacccgagtgttgccaaaagca

SEQ ID NO: 76702 - DNA, 25 bp, Mus musculus
actgactacatgactgcggattcgg

SEQ ID NO: 76703 - DNA, 25 bp, Mus musculus
actgactgtgcgcagcctgttggac

SEQ ID NO: 76704 - DNA, 25 bp, Mus musculus
actgagaagcaagtgtatgacgcgc

SEQ ID NO: 76705 - DNA, 25 bp, Mus musculus
actgagacacttcaagagctctggg

SEQ ID NO: 76706 - DNA, 25 bp, Mus musculus
actgagcgggagtcacccctacttc

SEQ ID NO: 76707 - DNA, 25 bp, Mus musculus
actgaggactcaagcgtggcgtctc

SEQ ID NO: 76708 - DNA, 25 bp, Mus musculus
actgaggatcgatccagtgccacca

SEQ ID NO: 76709 - DNA, 25 bp, Mus musculus
actgaggatggcctaaaacattagt

SEQ ID NO: 76710 - DNA, 25 bp, Mus musculus
actgagggcccacaaagagatctgc

SEQ ID NO: 76711 - DNA, 25 bp, Mus musculus
actgagggtccatcccgaagcccaa

SEQ ID NO: 76712 - DNA, 25 bp, Mus musculus
actgagttctcttgagtgcttggcc

SEQ ID NO: 76713 - DNA, 25 bp, Mus musculus
actgatagcttttgaaggtggtggc

SEQ ID NO: 76714 - DNA, 25 bp, Mus musculus
actgatatgtcaagctggtgaagcc

SEQ ID NO: 76715 - DNA, 25 bp, Mus musculus
actgatgcagaggataagcagcgca

SEQ ID NO: 76716 - DNA, 25 bp, Mus musculus
actgatgcctaacccagggccatcg

SEQ ID NO: 76717 - DNA, 25 bp, Mus musculus
actgatgctgtagagcaagtcgcca

SEQ ID NO: 76718 - DNA, 25 bp, Mus musculus
actgatgtcagggttcacagggcac

SEQ ID NO: 76719 - DNA, 25 bp, Mus musculus
actgcaacgccgatgtctgaggagc

SEQ ID NO: 76720 - DNA, 25 bp, Mus musculus
actgcaagccgcactgtgacaggaa

SEQ ID NO: 76721 - DNA, 25 bp, Mus musculus
actgcacaaggtaggccacatctcg

SEQ ID NO: 76722 - DNA, 25 bp, Mus musculus
actgcactgctggtgcaccgcgagg

SEQ ID NO: 76723 - DNA, 25 bp, Mus musculus
actgcagagccatgagaagcccttg

SEQ ID NO: 76724 - DNA, 25 bp, Mus musculus
actgcagatgccgtctgatagggca

SEQ ID NO: 76725 - DNA, 25 bp, Mus musculus
actgcagcggcaacctaatgcggct

SEQ ID NO: 76726 - DNA, 25 bp, Mus musculus
actgcagcggcagctcgtggtgctc

SEQ ID NO: 76727 - DNA, 25 bp, Mus musculus
actgcagctgtggaatgtaacccga

SEQ ID NO: 76728 - DNA, 25 bp, Mus musculus
actgcaggctttagagggagaaccc

SEQ ID NO: 76729 - DNA, 25 bp, Mus musculus
actgcagtggcatcttcaggagccc

SEQ ID NO: 76730 - DNA, 25 bp, Mus musculus
actgcatggcaggagtgactcgtgc

SEQ ID NO: 76731 - DNA, 25 bp, Mus musculus
actgccacccaaagatcatagatgc

SEQ ID NO: 76732 - DNA, 25 bp, Mus musculus
actgccagagagtatgaccatagcc

SEQ ID NO: 76733 - DNA, 25 bp, Mus musculus
actgccagcgaccaagcaactacag

SEQ ID NO: 76734 - DNA, 25 bp, Mus musculus
actgcccagacccatttgcaaatgg

SEQ ID NO: 76735 - DNA, 25 bp, Mus musculus
actgccctctggtggatggcctaca

SEQ ID NO: 76736 - DNA, 25 bp, Mus musculus
actgcccttctatgaagtctatggg

SEQ ID NO: 76737 - DNA, 25 bp, Mus musculus
actgccgccttccttgacgatcagt

SEQ ID NO: 76738 - DNA, 25 bp, Mus musculus
actgccggccgctatgaggtagaga

SEQ ID NO: 76739 - DNA, 25 bp, Mus musculus
actgccgtccagtccgcagagccac

SEQ ID NO: 76740 - DNA, 25 bp, Mus musculus
actgccgtgtgggaaaggcccagca

SEQ ID NO: 76741 - DNA, 25 bp, Mus musculus
actgcctagagatcacggtgcttgg

SEQ ID NO: 76742 - DNA, 25 bp, Mus musculus
actgcctgggcctgctgggattctg

SEQ ID NO: 76743 - DNA, 25 bp, Mus musculus
actgcctgttgagggtggtacccga

SEQ ID NO: 76744 - DNA, 25 bp, Mus musculus
actgcgaggaggaccaaaacgaacg

SEQ ID NO: 76745 - DNA, 25 bp, Mus musculus
actgcgagttccgtctgctgtgtga

SEQ ID NO: 76746 - DNA, 25 bp, Mus musculus
actgcgccgtcaacgggctcctggt

SEQ ID NO: 76747 - DNA, 25 bp, Mus musculus
actgcgcgggctcactcatggagga

SEQ ID NO: 76748 - DNA, 25 bp, Mus musculus
actgcgcgtgaggaccgtgtccttt

SEQ ID NO: 76749 - DNA, 25 bp, Mus musculus
actgcgctgcttggaaaaaggaaac

SEQ ID NO: 76750 - DNA, 25 bp, Mus musculus
actgcggacatgctgggaccctttg

SEQ ID NO: 76751 - DNA, 25 bp, Mus musculus
actgcggatactttaaatttatgac

SEQ ID NO: 76752 - DNA, 25 bp, Mus musculus
actgcggccgaagaacgcgcccctg

SEQ ID NO: 76753 - DNA, 25 bp, Mus musculus
actgcggtaatatggctcttcctta

SEQ ID NO: 76754 - DNA, 25 bp, Mus musculus
actgcgtgctacgtgtacaactaag

SEQ ID NO: 76755 - DNA, 25 bp, Mus musculus
actgcgttcccgcctgcttggcagg

SEQ ID NO: 76756 - DNA, 25 bp, Mus musculus
actgctaagaatctcccggaatggc

SEQ ID NO: 76757 - DNA, 25 bp, Mus musculus
actgctagatctacagccagcgcgg

SEQ ID NO: 76758 - DNA, 25 bp, Mus musculus
actgctcggctttggtcatgggact

SEQ ID NO: 76759 - DNA, 25 bp, Mus musculus
actgctgagcttgttgtttgtagaa

SEQ ID NO: 76760 - DNA, 25 bp, Mus musculus
actgctggaagtacctgagtgtgca

SEQ ID NO: 76761 - DNA, 25 bp, Mus musculus
actgctgggagtagcgggtcaaccc

SEQ ID NO: 76762 - DNA, 25 bp, Mus musculus
actgctggtgtctggcggagacagc

SEQ ID NO: 76763 - DNA, 25 bp, Mus musculus
actgctgtcaaaacccaatgtcaag

SEQ ID NO: 76764 - DNA, 25 bp, Mus musculus
actgctgtccgtgctcctgggcctg

SEQ ID NO: 76765 - DNA, 25 bp, Mus musculus
actgctgtggtctgaagaggcccgt

SEQ ID NO: 76766 - DNA, 25 bp, Mus musculus
actggaaaaataatggcgctttgtc

SEQ ID NO: 76767 - DNA, 25 bp, Mus musculus
actggaaagtcaacggagctgggca

SEQ ID NO: 76768 - DNA, 25 bp, Mus musculus
actggaaccgggagaaggtggagct

SEQ ID NO: 76769 - DNA, 25 bp, Mus musculus
actggaaggctgtgcgcgcctgcct

SEQ ID NO: 76770 - DNA, 25 bp, Mus musculus
actggacaaccaggcgcttccgaat

SEQ ID NO: 76771 - DNA, 25 bp, Mus musculus
actggaccccaacattcagagctgg

SEQ ID NO: 76772 - DNA, 25 bp, Mus musculus
actggacgctggagccaactttaac

SEQ ID NO: 76773 - DNA, 25 bp, Mus musculus
actggacggagtaagcaggcttgcc

SEQ ID NO: 76774 - DNA, 25 bp, Mus musculus
actggactgagagacctgggagcaa

SEQ ID NO: 76775 - DNA, 25 bp, Mus musculus
actggactggcattctcggcgacac

SEQ ID NO: 76776 - DNA, 25 bp, Mus musculus
actggagaatgatgaggtggaacca

SEQ ID NO: 76777 - DNA, 25 bp, Mus musculus
actggagagactggaggaccccttt

SEQ ID NO: 76778 - DNA, 25 bp, Mus musculus
actggagctatccaagaaaagtgcc

SEQ ID NO: 76779 - DNA, 25 bp, Mus musculus
actggaggagattctgctggacccc

SEQ ID NO: 76780 - DNA, 25 bp, Mus musculus
actggaggagtgagcttgacttccc

SEQ ID NO: 76781 - DNA, 25 bp, Mus musculus
actggaggtcagcagtcggctcggc

SEQ ID NO: 76782 - DNA, 25 bp, Mus musculus
actggatcacgagtttgctgcacaa

SEQ ID NO: 76783 - DNA, 25 bp, Mus musculus
actggcacgccggagggagcagcgg

SEQ ID NO: 76784 - DNA, 25 bp, Mus musculus
actggcacggcgcaaaacgatccaa

SEQ ID NO: 76785 - DNA, 25 bp, Mus musculus
actggcactggaaactagcggaggc

SEQ ID NO: 76786 - DNA, 25 bp, Mus musculus
actggcagcagcagtagcggtcgac

SEQ ID NO: 76787 - DNA, 25 bp, Mus musculus
actggcagtcccctttgcattgaag

SEQ ID NO: 76788 - DNA, 25 bp, Mus musculus
actggcctctctgcagcgattgctg

SEQ ID NO: 76789 - DNA, 25 bp, Mus musculus
actggcctggtagagaagaagcgcc

SEQ ID NO: 76790 - DNA, 25 bp, Mus musculus
actggctcgtgtgtacgaagctgcc

SEQ ID NO: 76791 - DNA, 25 bp, Mus musculus
actggctgaaccctgcccaagtggt

SEQ ID NO: 76792 - DNA, 25 bp, Mus musculus
actggctgtgatgaggtcctggaaa

SEQ ID NO: 76793 - DNA, 25 bp, Mus musculus
actggctttgaagactctgtccgaa

SEQ ID NO: 76794 - DNA, 25 bp, Mus musculus
actgggaagccaacgcctgcaaaat

SEQ ID NO: 76795 - DNA, 25 bp, Mus musculus
actgggaagtgggatccactttgcc

SEQ ID NO: 76796 - DNA, 25 bp, Mus musculus
actgggaatgtgactcgaagcggac

SEQ ID NO: 76797 - DNA, 25 bp, Mus musculus
actgggacaggcattgcagctgcct

SEQ ID NO: 76798 - DNA, 25 bp, Mus musculus
actgggactcccttaccttgttgcg

SEQ ID NO: 76799 - DNA, 25 bp, Mus musculus
actgggattgtgttcgggagcttcc

SEQ ID NO: 76800 - DNA, 25 bp, Mus musculus
actgggcagcatgacacaattgtac

SEQ ID NO: 76801 - DNA, 25 bp, Mus musculus
actgggcccacgcacactgtatgtg

SEQ ID NO: 76802 - DNA, 25 bp, Mus musculus
actgggccctgaagcatgagctgaa

SEQ ID NO: 76803 - DNA, 25 bp, Mus musculus
actgggcgtctgaaatgggcagcct

SEQ ID NO: 76804 - DNA, 25 bp, Mus musculus
actgggctctggactgttaggaaac

SEQ ID NO: 76805 - DNA, 25 bp, Mus musculus
actgggttcggaggcaactgctgca

SEQ ID NO: 76806 - DNA, 25 bp, Mus musculus
actgggttcttgtctggcaccatga

SEQ ID NO: 76807 - DNA, 25 bp, Mus musculus
actggtatgtcttgtcacgggagca

SEQ ID NO: 76808 - DNA, 25 bp, Mus musculus
actggtcagatgaggagagtccccg

SEQ ID NO: 76809 - DNA, 25 bp, Mus musculus
actggtcttggtggcggatacttgc

SEQ ID NO: 76810 - DNA, 25 bp, Mus musculus
actggtgactctgcagcgctctgga

SEQ ID NO: 76811 - DNA, 25 bp, Mus musculus
actggtgcccctctggacctctgtt

SEQ ID NO: 76812 - DNA, 25 bp, Mus musculus
actggtgcgacttttggcctgctga

SEQ ID NO: 76813 - DNA, 25 bp, Mus musculus
actggtgctcctacgtggtgacccg

SEQ ID NO: 76814 - DNA, 25 bp, Mus musculus
actggtgtgtcctccccttcagagt

SEQ ID NO: 76815 - DNA, 25 bp, Mus musculus
actggtgttttctgcgtcccctgat

SEQ ID NO: 76816 - DNA, 25 bp, Mus musculus
actggttttggctggcctctgctgc

SEQ ID NO: 76817 - DNA, 25 bp, Mus musculus
actgtaaagctgctggagtcccctg

SEQ ID NO: 76818 - DNA, 25 bp, Mus musculus
actgtacgttcgaccacatgggccg

SEQ ID NO: 76819 - DNA, 25 bp, Mus musculus
actgtacttcctgccacaatgtcac

SEQ ID NO: 76820 - DNA, 25 bp, Mus musculus
actgtagtacaggtgcttgccgtga

SEQ ID NO: 76821 - DNA, 25 bp, Mus musculus
actgtcaggacggtaccggcggcac

SEQ ID NO: 76822 - DNA, 25 bp, Mus musculus
actgtccatatgattacaaagcaga

SEQ ID NO: 76823 - DNA, 25 bp, Mus musculus
actgtccgagtagccagcacgatga

SEQ ID NO: 76824 - DNA, 25 bp, Mus musculus
actgtcctctgcctgtcgacactga

SEQ ID NO: 76825 - DNA, 25 bp, Mus musculus
actgtcctgaactcatctctcaaag

SEQ ID NO: 76826 - DNA, 25 bp, Mus musculus
actgtctaactttcgaggatgtggc

SEQ ID NO: 76827 - DNA, 25 bp, Mus musculus
actgtgaagattggccggaggcaca

SEQ ID NO: 76828 - DNA, 25 bp, Mus musculus
actgtgacccggaacgcatcgaggg

SEQ ID NO: 76829 - DNA, 25 bp, Mus musculus
actgtgatctagagaagagagagcc

SEQ ID NO: 76830 - DNA, 25 bp, Mus musculus
actgtgcatcactaaggccctgtcc

SEQ ID NO: 76831 - DNA, 25 bp, Mus musculus
actgtgcctcagactttcactacga

SEQ ID NO: 76832 - DNA, 25 bp, Mus musculus
actgtggagcccagtccacccctct

SEQ ID NO: 76833 - DNA, 25 bp, Mus musculus
actgtggagtgagaccttcgatgtg

SEQ ID NO: 76834 - DNA, 25 bp, Mus musculus
actgtggtcactgtcgaaggctgcc

SEQ ID NO: 76835 - DNA, 25 bp, Mus musculus
actgtggtccgccagcgctatctca

SEQ ID NO: 76836 - DNA, 25 bp, Mus musculus
actgtggttccgctggaagattcta

SEQ ID NO: 76837 - DNA, 25 bp, Mus musculus
actgtgtcgggcagctgcaggccct

SEQ ID NO: 76838 - DNA, 25 bp, Mus musculus
actgtgtcttcacatacgactgcag

SEQ ID NO: 76839 - DNA, 25 bp, Mus musculus
actgtgtgcagagcacgcttgctgc

SEQ ID NO: 76840 - DNA, 25 bp, Mus musculus
actgtgtgcccctgaagtgacccag

SEQ ID NO: 76841 - DNA, 25 bp, Mus musculus
actgtgttgtggtatcactgggccc

SEQ ID NO: 76842 - DNA, 25 bp, Mus musculus
actgttagagttgcagctgatgacc

SEQ ID NO: 76843 - DNA, 25 bp, Mus musculus
actgttatgtaaagaggagagcacc

SEQ ID NO: 76844 - DNA, 25 bp, Mus musculus
actgttccggagatcaacggcggcg

SEQ ID NO: 76845 - DNA, 25 bp, Mus musculus
acttaagcgggcaaaacctgcaggg

SEQ ID NO: 76846 - DNA, 25 bp, Mus musculus
acttaccagtccgtgaggagatggc

SEQ ID NO: 76847 - DNA, 25 bp, Mus musculus
acttacgctgtggtgcagaagcgtg

SEQ ID NO: 76848 - DNA, 25 bp, Mus musculus
acttacggtgcggtggacggtctct

SEQ ID NO: 76849 - DNA, 25 bp, Mus musculus
acttacgtggcttgactgttccatg

SEQ ID NO: 76850 - DNA, 25 bp, Mus musculus
acttactaatacaaggagttcctgc

SEQ ID NO: 76851 - DNA, 25 bp, Mus musculus
acttactgtatgagaggcccaccct

SEQ ID NO: 76852 - DNA, 25 bp, Mus musculus
acttagaggtttactggcgagcgac

SEQ ID NO: 76853 - DNA, 25 bp, Mus musculus
acttagcagtttgtgtgtcctcttc

SEQ ID NO: 76854 - DNA, 25 bp, Mus musculus
acttagcggcggactgacggagacc

SEQ ID NO: 76855 - DNA, 25 bp, Mus musculus
acttagttggaagcacaccctgggc

SEQ ID NO: 76856 - DNA, 25 bp, Mus musculus
acttatctgggagtttctactgata

SEQ ID NO: 76857 - DNA, 25 bp, Mus musculus
acttatgcagaactgctgtgaggac

SEQ ID NO: 76858 - DNA, 25 bp, Mus musculus
acttcaaatgttatgggcccttatt

SEQ ID NO: 76859 - DNA, 25 bp, Mus musculus
acttcaccgacttcatcagcaatga

SEQ ID NO: 76860 - DNA, 25 bp, Mus musculus
acttcaggacagacatcatggcctg

SEQ ID NO: 76861 - DNA, 25 bp, Mus musculus
acttcaggatgttcaactcacagag

SEQ ID NO: 76862 - DNA, 25 bp, Mus musculus
acttcaggcccagctagagtcagag

SEQ ID NO: 76863 - DNA, 25 bp, Mus musculus
acttcagggactgtcagcaagaaag

SEQ ID NO: 76864 - DNA, 25 bp, Mus musculus
acttcatagtagaaatgcagttagc

SEQ ID NO: 76865 - DNA, 25 bp, Mus musculus
acttcatccgggagcgaggactcag

SEQ ID NO: 76866 - DNA, 25 bp, Mus musculus
acttcatgagattccagccttttac

SEQ ID NO: 76867 - DNA, 25 bp, Mus musculus
acttcatttggagctttataggacc

SEQ ID NO: 76868 - DNA, 25 bp, Mus musculus
acttccaacgtttgagaggagggcg

SEQ ID NO: 76869 - DNA, 25 bp, Mus musculus
acttccctggatgccaaagtcctgg

SEQ ID NO: 76870 - DNA, 25 bp, Mus musculus
acttccgcccggcctagtgtggtgg

SEQ ID NO: 76871 - DNA, 25 bp, Mus musculus
acttccggaagattgagcctcatgg

SEQ ID NO: 76872 - DNA, 25 bp, Mus musculus
acttccgtcagggtcacaattgcca

SEQ ID NO: 76873 - DNA, 25 bp, Mus musculus
acttccgtgagcgaaagccttcaga

SEQ ID NO: 76874 - DNA, 25 bp, Mus musculus
acttcctggcatttgaaaggctcct

SEQ ID NO: 76875 - DNA, 25 bp, Mus musculus
acttccttacactcttgccagcatt

SEQ ID NO: 76876 - DNA, 25 bp, Mus musculus
acttccttaccgagcatcggagaaa

SEQ ID NO: 76877 - DNA, 25 bp, Mus musculus
acttccttggcgtgggtctgtgcac

SEQ ID NO: 76878 - DNA, 25 bp, Mus musculus
acttcgagaggcagagtgggacccc

SEQ ID NO: 76879 - DNA, 25 bp, Mus musculus
acttcgcgacggcttaaattgagga

SEQ ID NO: 76880 - DNA, 25 bp, Mus musculus
acttcggagctgtgaagcgctctcc

SEQ ID NO: 76881 - DNA, 25 bp, Mus musculus
acttcggaggccaaagattcatggg

SEQ ID NO: 76882 - DNA, 25 bp, Mus musculus
acttcggtcggcgataaaagcagga

SEQ ID NO: 76883 - DNA, 25 bp, Mus musculus
acttcggtgttggagtcttgtgtcc

SEQ ID NO: 76884 - DNA, 25 bp, Mus musculus
acttcgtggtgtccggctgctttca

SEQ ID NO: 76885 - DNA, 25 bp, Mus musculus
acttctagacccctggagaggacta

SEQ ID NO: 76886 - DNA, 25 bp, Mus musculus
acttctcgagcgacgaggagcgcga

SEQ ID NO: 76887 - DNA, 25 bp, Mus musculus
acttctgggttggtgggctacctgc

SEQ ID NO: 76888 - DNA, 25 bp, Mus musculus
acttcttcagggagagagtcctcag

SEQ ID NO: 76889 - DNA, 25 bp, Mus musculus
acttcttggacatcatcgatcctcg

SEQ ID NO: 76890 - DNA, 25 bp, Mus musculus
acttcttggcgcttgtgcttccggc

SEQ ID NO: 76891 - DNA, 25 bp, Mus musculus
acttgaaacatgaaatggcttgggc

SEQ ID NO: 76892 - DNA, 25 bp, Mus musculus
acttgaagcctgatgccgtcctgca

SEQ ID NO: 76893 - DNA, 25 bp, Mus musculus
acttgaatccaccagcgacctgctg

SEQ ID NO: 76894 - DNA, 25 bp, Mus musculus
acttgaattggttgctctcccaggc

SEQ ID NO: 76895 - DNA, 25 bp, Mus musculus
acttgacaagggtgccggagtgcct

SEQ ID NO: 76896 - DNA, 25 bp, Mus musculus
acttgaccggcatcgtgcgcagact

SEQ ID NO: 76897 - DNA, 25 bp, Mus musculus
acttgacgcaagaagctcgcagcgg

SEQ ID NO: 76898 - DNA, 25 bp, Mus musculus
acttgagtggccaatacgagagggc

SEQ ID NO: 76899 - DNA, 25 bp, Mus musculus
acttgatggacagacagccccagtg

SEQ ID NO: 76900 - DNA, 25 bp, Mus musculus
acttgattgaagtgttccgtccttg

SEQ ID NO: 76901 - DNA, 25 bp, Mus musculus
acttgcatcaaactgtaaaggaatt

SEQ ID NO: 76902 - DNA, 25 bp, Mus musculus
acttgcgcgagctagcccatgtgct

SEQ ID NO: 76903 - DNA, 25 bp, Mus musculus
acttgctcaacacggtgaagcagaa

SEQ ID NO: 76904 - DNA, 25 bp, Mus musculus
acttgcttttggagaggcctcggcc

SEQ ID NO: 76905 - DNA, 25 bp, Mus musculus
acttggaacagactgtccatctttc

SEQ ID NO: 76906 - DNA, 25 bp, Mus musculus
acttggaagaaaaccaggcgtgcct

SEQ ID NO: 76907 - DNA, 25 bp, Mus musculus
acttggacttttgcaatcagagata

SEQ ID NO: 76908 - DNA, 25 bp, Mus musculus
acttggagagtgagcttgatgaccc

SEQ ID NO: 76909 - DNA, 25 bp, Mus musculus
acttggagctggcagtaggtcacct

SEQ ID NO: 76910 - DNA, 25 bp, Mus musculus
acttggaggcttcctgtcaccggca

SEQ ID NO: 76911 - DNA, 25 bp, Mus musculus
acttggaggttgaagcgaagagccc

SEQ ID NO: 76912 - DNA, 25 bp, Mus musculus
acttggatagagaaacggcttgagc

SEQ ID NO: 76913 - DNA, 25 bp, Mus musculus
acttggatcagctggacctaaaccc

SEQ ID NO: 76914 - DNA, 25 bp, Mus musculus
acttggccactgtggtcacaggatg

SEQ ID NO: 76915 - DNA, 25 bp, Mus musculus
acttggcgtggtggcagctgactca

SEQ ID NO: 76916 - DNA, 25 bp, Mus musculus
acttggcttagtgagattgtagaca

SEQ ID NO: 76917 - DNA, 25 bp, Mus musculus
acttgggaaaggagtctgggctctc

SEQ ID NO: 76918 - DNA, 25 bp, Mus musculus
acttgggagctatgagaagtgccag

SEQ ID NO: 76919 - DNA, 25 bp, Mus musculus
acttgggcctggatcagtatataat

SEQ ID NO: 76920 - DNA, 25 bp, Mus musculus
acttgggtctggtagagccaggcac

SEQ ID NO: 76921 - DNA, 25 bp, Mus musculus
acttggttccatgtcgtctccgaga

SEQ ID NO: 76922 - DNA, 25 bp, Mus musculus
acttgtaccgggatggcgaaggcca

SEQ ID NO: 76923 - DNA, 25 bp, Mus musculus
acttgtcacacatgccggtcaccgg

SEQ ID NO: 76924 - DNA, 25 bp, Mus musculus
acttgtgacacctgggctgtgatcc

SEQ ID NO: 76925 - DNA, 25 bp, Mus musculus
acttgtgatggtgggatgcgcacaa

SEQ ID NO: 76926 - DNA, 25 bp, Mus musculus
acttgtgcggagcaggagcctcaac

SEQ ID NO: 76927 - DNA, 25 bp, Mus musculus
acttgtgtgtgttcagcgcctccga

SEQ ID NO: 76928 - DNA, 25 bp, Mus musculus
actttacgcacgtggaggtgctgca

SEQ ID NO: 76929 - DNA, 25 bp, Mus musculus
actttactgagatacgctgtggtgc

SEQ ID NO: 76930 - DNA, 25 bp, Mus musculus
actttatgcacaatgcccagcccgg

SEQ ID NO: 76931 - DNA, 25 bp, Mus musculus
actttatgtcgagaccactggccgg

SEQ ID NO: 76932 - DNA, 25 bp, Mus musculus
actttcaactgggacaggctagcca

SEQ ID NO: 76933 - DNA, 25 bp, Mus musculus
actttccagccgttccagaggagca

SEQ ID NO: 76934 - DNA, 25 bp, Mus musculus
actttccaggctgtgggcgtctgac

SEQ ID NO: 76935 - DNA, 25 bp, Mus musculus
actttcctaaacatgcagcctatag

SEQ ID NO: 76936 - DNA, 25 bp, Mus musculus
actttcctgagggtgagctatggcc

SEQ ID NO: 76937 - DNA, 25 bp, Mus musculus
actttccttagtgactaggtggcca

SEQ ID NO: 76938 - DNA, 25 bp, Mus musculus
actttcgccggcagctacagcgggc

SEQ ID NO: 76939 - DNA, 25 bp, Mus musculus
actttctctttgtcggaggagctct

SEQ ID NO: 76940 - DNA, 25 bp, Mus musculus
actttgaagatgaccccagagccct

SEQ ID NO: 76941 - DNA, 25 bp, Mus musculus
actttgacggcacccgagctcggtt

SEQ ID NO: 76942 - DNA, 25 bp, Mus musculus
actttgactgccatgagtgtagacc

SEQ ID NO: 76943 - DNA, 25 bp, Mus musculus
actttgagtctactgcgcaggcgtc

SEQ ID NO: 76944 - DNA, 25 bp, Mus musculus
actttgcaaagtagtagccagcggg

SEQ ID NO: 76945 - DNA, 25 bp, Mus musculus
actttgcagctaagagggactctcc

SEQ ID NO: 76946 - DNA, 25 bp, Mus musculus
actttgccagtatggagctgtctga

SEQ ID NO: 76947 - DNA, 25 bp, Mus musculus
actttgctgatatcggctggagcga

SEQ ID NO: 76948 - DNA, 25 bp, Mus musculus
actttgctgggttggtgtttgctca

SEQ ID NO: 76949 - DNA, 25 bp, Mus musculus
actttggaagcatctcccagtcctg

SEQ ID NO: 76950 - DNA, 25 bp, Mus musculus
actttggagagagtcctgcggctca

SEQ ID NO: 76951 - DNA, 25 bp, Mus musculus
actttggcagctgggagagacacac

SEQ ID NO: 76952 - DNA, 25 bp, Mus musculus
actttggccggagccactgggacct

SEQ ID NO: 76953 - DNA, 25 bp, Mus musculus
actttggctggaccgactaatgcca

SEQ ID NO: 76954 - DNA, 25 bp, Mus musculus
actttgggctagcacgccaggctga

SEQ ID NO: 76955 - DNA, 25 bp, Mus musculus
actttgtcaatgctcagtttccacg

SEQ ID NO: 76956 - DNA, 25 bp, Mus musculus
actttgtccctgctgcctttgtctg

SEQ ID NO: 76957 - DNA, 25 bp, Mus musculus
actttgtggcgaggaacagcagcga

SEQ ID NO: 76958 - DNA, 25 bp, Mus musculus
actttgtggcgctgctgacaggacc

SEQ ID NO: 76959 - DNA, 25 bp, Mus musculus
actttgtgtgcacccactgccagga

SEQ ID NO: 76960 - DNA, 25 bp, Mus musculus
actttgttcagtggtgtgcgctcag

SEQ ID NO: 76961 - DNA, 25 bp, Mus musculus
acttttccagagagggtgatgatca

SEQ ID NO: 76962 - DNA, 25 bp, Mus musculus
acttttggagggatcaatggctacc

SEQ ID NO: 76963 - DNA, 25 bp, Mus musculus
acttttgttaaagcctgagactcag

SEQ ID NO: 76964 - DNA, 25 bp, Mus musculus
actttttcctgcgtgtggaccttgg

SEQ ID NO: 76965 - DNA, 25 bp, Mus musculus
actttttgggagagaactatgttca

SEQ ID NO: 76966 - DNA, 25 bp, Mus musculus
agaaaaacatggctcggaccttgga

SEQ ID NO: 76967 - DNA, 25 bp, Mus musculus
agaaaaagagacaaaggccctggca

SEQ ID NO: 76968 - DNA, 25 bp, Mus musculus
agaaaacaaactgcacataaataaa

SEQ ID NO: 76969 - DNA, 25 bp, Mus musculus
agaaaacatggaaggctactcgggt

SEQ ID NO: 76970 - DNA, 25 bp, Mus musculus
agaaaacattctcttggactgccag

SEQ ID NO: 76971 - DNA, 25 bp, Mus musculus
agaaaacctatgacctcacccgcta

SEQ ID NO: 76972 - DNA, 25 bp, Mus musculus
agaaaacgtgttcaagctcctgccc

SEQ ID NO: 76973 - DNA, 25 bp, Mus musculus
agaaaactggccctccaaccactga

SEQ ID NO: 76974 - DNA, 25 bp, Mus musculus
agaaaagaggcagctaggatagcag

SEQ ID NO: 76975 - DNA, 25 bp, Mus musculus
agaaaagcctgtgtgtggaacaacc

SEQ ID NO: 76976 - DNA, 25 bp, Mus musculus
agaaaagtctcttccagcgtccggc

SEQ ID NO: 76977 - DNA, 25 bp, Mus musculus
agaaaatcctgtgcaagggcctgcc

SEQ ID NO: 76978 - DNA, 25 bp, Mus musculus
agaaacaaccttgggcagaccctga

SEQ ID NO: 76979 - DNA, 25 bp, Mus musculus
agaaacatgttcagtcccagcgcct

SEQ ID NO: 76980 - DNA, 25 bp, Mus musculus
agaaaccaacaggttgccagcccgg

SEQ ID NO: 76981 - DNA, 25 bp, Mus musculus
agaaaccagtgacatccgcgcctgt

SEQ ID NO: 76982 - DNA, 25 bp, Mus musculus
agaaaccatgactcgtctcagccca

SEQ ID NO: 76983 - DNA, 25 bp, Mus musculus
agaaaccccatttcctgacttgctg

SEQ ID NO: 76984 - DNA, 25 bp, Mus musculus
agaaacccgggaagaacgcatggag

SEQ ID NO: 76985 - DNA, 25 bp, Mus musculus
agaaaccctggaggatgggctcccg

SEQ ID NO: 76986 - DNA, 25 bp, Mus musculus
agaaaccgcttttggaactatgagt

SEQ ID NO: 76987 - DNA, 25 bp, Mus musculus
agaaaccggctcctgcggctaagtg

SEQ ID NO: 76988 - DNA, 25 bp, Mus musculus
agaaaccttccttctaagattccag

SEQ ID NO: 76989 - DNA, 25 bp, Mus musculus
agaaacggccgtgtccaggctgcag

SEQ ID NO: 76990 - DNA, 25 bp, Mus musculus
agaaacgtgggcgaccccgcactat

SEQ ID NO: 76991 - DNA, 25 bp, Mus musculus
agaaactatctacccccaaacagct

SEQ ID NO: 76992 - DNA, 25 bp, Mus musculus
agaaactcagctggaggaggcctcc

SEQ ID NO: 76993 - DNA, 25 bp, Mus musculus
agaaactccctgaaagcctgatgcc

SEQ ID NO: 76994 - DNA, 25 bp, Mus musculus
agaaactcttctatataccctggcg

SEQ ID NO: 76995 - DNA, 25 bp, Mus musculus
agaaactttgagtctactgcgcagg

SEQ ID NO: 76996 - DNA, 25 bp, Mus musculus
agaaagacagccatatatagacaca

SEQ ID NO: 76997 - DNA, 25 bp, Mus musculus
agaaagactcctaccagcctgtgtg

SEQ ID NO: 76998 - DNA, 25 bp, Mus musculus
agaaagactgcgtcagaaggaagcc

SEQ ID NO: 76999 - DNA, 25 bp, Mus musculus
agaaagactggagggccacctctag

SEQ ID NO: 77000 - DNA, 25 bp, Mus musculus
agaaagagatcactcagctgcaggc

SEQ ID NO: 77001 - DNA, 25 bp, Mus musculus
agaaagaggtgttcctgccgtcgac

SEQ ID NO: 77002 - DNA, 25 bp, Mus musculus
agaaagatgagtcacacgcgggcaa

SEQ ID NO: 77003 - DNA, 25 bp, Mus musculus
agaaagcatattttaccctcaatgg

SEQ ID NO: 77004 - DNA, 25 bp, Mus musculus
agaaagccaccccaaaagacagtgc

SEQ ID NO: 77005 - DNA, 25 bp, Mus musculus
agaaagcccacccaatctggccgta

SEQ ID NO: 77006 - DNA, 25 bp, Mus musculus
agaaagccccatccagtcaaacaga

SEQ ID NO: 77007 - DNA, 25 bp, Mus musculus
agaaagccttcatgggcagccctct

SEQ ID NO: 77008 - DNA, 25 bp, Mus musculus
agaaagctgctcatgccaaaaccaa

SEQ ID NO: 77009 - DNA, 25 bp, Mus musculus
agaaagctgtggctgcggcacacac

SEQ ID NO: 77010 - DNA, 25 bp, Mus musculus
agaaagctttttgccgccctcacag

SEQ ID NO: 77011 - DNA, 25 bp, Mus musculus
agaaaggaaagcgcgaggagacgcc

SEQ ID NO: 77012 - DNA, 25 bp, Mus musculus
agaaaggagcggagagaaggccaca

SEQ ID NO: 77013 - DNA, 25 bp, Mus musculus
agaaaggccccacgctgagcagcag

SEQ ID NO: 77014 - DNA, 25 bp, Mus musculus
agaaaggcctcactgccgagcaggt

SEQ ID NO: 77015 - DNA, 25 bp, Mus musculus
agaaaggcctttgatccccgagccg

SEQ ID NO: 77016 - DNA, 25 bp, Mus musculus
agaaagggtctcatggcgctaacag

SEQ ID NO: 77017 - DNA, 25 bp, Mus musculus
agaaaggtccacaaggcccagctgg

SEQ ID NO: 77018 - DNA, 25 bp, Mus musculus
agaaaggtggactgtcatggcctct

SEQ ID NO: 77019 - DNA, 25 bp, Mus musculus
agaaagttcgaggtgtggacatcgt

SEQ ID NO: 77020 - DNA, 25 bp, Mus musculus
agaaataaaagaccactgctgcctc

SEQ ID NO: 77021 - DNA, 25 bp, Mus musculus
agaaatactccaactgccctacaga

SEQ ID NO: 77022 - DNA, 25 bp, Mus musculus
agaaatcaacatgctatcaagaacc

SEQ ID NO: 77023 - DNA, 25 bp, Mus musculus
agaaatcactcaaggccggcctgtg

SEQ ID NO: 77024 - DNA, 25 bp, Mus musculus
agaaatcgccgtgtggaccaacctt

SEQ ID NO: 77025 - DNA, 25 bp, Mus musculus
agaaatgctttaagttcgctctggg

SEQ ID NO: 77026 - DNA, 25 bp, Mus musculus
agaaattagtgtgagtcgccatggg

SEQ ID NO: 77027 - DNA, 25 bp, Mus musculus
agaaattgccgacactgaccttaag

SEQ ID NO: 77028 - DNA, 25 bp, Mus musculus
agaaatttggtaccatcacggccca

SEQ ID NO: 77029 - DNA, 25 bp, Mus musculus
agaaattttcctcggcactgcagcc

SEQ ID NO: 77030 - DNA, 25 bp, Mus musculus
agaacaagtttgctagatccacacg

SEQ ID NO: 77031 - DNA, 25 bp, Mus musculus
agaacacaagagctagcccacagga

SEQ ID NO: 77032 - DNA, 25 bp, Mus musculus
agaacacagttcagcgacacgcttg

SEQ ID NO: 77033 - DNA, 25 bp, Mus musculus
agaacacgctcctctcggtggccat

SEQ ID NO: 77034 - DNA, 25 bp, Mus musculus
agaacacttcagctctggaggccca

SEQ ID NO: 77035 - DNA, 25 bp, Mus musculus
agaacacttgtgaggacatcgccca

SEQ ID NO: 77036 - DNA, 25 bp, Mus musculus
agaacagactgttggagcggacaca

SEQ ID NO: 77037 - DNA, 25 bp, Mus musculus
agaacagctcatcaaccccttcggg

SEQ ID NO: 77038 - DNA, 25 bp, Mus musculus
agaacagctgcagggacagtgacag

SEQ ID NO: 77039 - DNA, 25 bp, Mus musculus
agaacagctgtgcagccacgctgga

SEQ ID NO: 77040 - DNA, 25 bp, Mus musculus
agaacatcccgcagccaaagttctg

SEQ ID NO: 77041 - DNA, 25 bp, Mus musculus
agaacatgtcgcagcgcatcggagg

SEQ ID NO: 77042 - DNA, 25 bp, Mus musculus
agaaccacaacctcgctgacacggt

SEQ ID NO: 77043 - DNA, 25 bp, Mus musculus
agaaccacacttgggagccagcgaa

SEQ ID NO: 77044 - DNA, 25 bp, Mus musculus
agaaccagacgctgctgcatgcaca

SEQ ID NO: 77045 - DNA, 25 bp, Mus musculus
agaaccagctcatttacgccaacga

SEQ ID NO: 77046 - DNA, 25 bp, Mus musculus
agaaccagcttgtgtactaccccag

SEQ ID NO: 77047 - DNA, 25 bp, Mus musculus
agaacccagccgagtgcaagcagca

SEQ ID NO: 77048 - DNA, 25 bp, Mus musculus
agaacccgttctgtcgcgtcaggaa

SEQ ID NO: 77049 - DNA, 25 bp, Mus musculus
agaaccctgctgtgtatgcccgcat

SEQ ID NO: 77050 - DNA, 25 bp, Mus musculus
agaaccgagcagaagatgggcacct

SEQ ID NO: 77051 - DNA, 25 bp, Mus musculus
agaacctaaggaggctgtgaaccgc

SEQ ID NO: 77052 - DNA, 25 bp, Mus musculus
agaacctcgtgggactgctggagcc

SEQ ID NO: 77053 - DNA, 25 bp, Mus musculus
agaacctgaagatccacaaccgctc

SEQ ID NO: 77054 - DNA, 25 bp, Mus musculus
agaacctgacgggtctaaaccagcg

SEQ ID NO: 77055 - DNA, 25 bp, Mus musculus
agaacctgggcatattaactggacc

SEQ ID NO: 77056 - DNA, 25 bp, Mus musculus
agaacctgtggagtacatgaactta

SEQ ID NO: 77057 - DNA, 25 bp, Mus musculus
agaaccttcgcagggactgaaaaca

SEQ ID NO: 77058 - DNA, 25 bp, Mus musculus
agaacctttgtcctcaagccaggaa

SEQ ID NO: 77059 - DNA, 25 bp, Mus musculus
agaacgagaagcttgaatgggcagt

SEQ ID NO: 77060 - DNA, 25 bp, Mus musculus
agaacgcacgcatcgtccgcttggt

SEQ ID NO: 77061 - DNA, 25 bp, Mus musculus
agaacgcccagacttacctcctgta

SEQ ID NO: 77062 - DNA, 25 bp, Mus musculus
agaacgctgtggagctggaactcgc

SEQ ID NO: 77063 - DNA, 25 bp, Mus musculus
agaacgtatacctctgtgggcccca

SEQ ID NO: 77064 - DNA, 25 bp, Mus musculus
agaacgtccagaaaaagtaccagat

SEQ ID NO: 77065 - DNA, 25 bp, Mus musculus
agaacgtgagcccttgtgacgcgca

SEQ ID NO: 77066 - DNA, 25 bp, Mus musculus
agaacgtggttctgccttggccaaa

SEQ ID NO: 77067 - DNA, 25 bp, Mus musculus
agaactaacaggtggaggctgccca

SEQ ID NO: 77068 - DNA, 25 bp, Mus musculus
agaactcaaaggtggagggccctgc

SEQ ID NO: 77069 - DNA, 25 bp, Mus musculus
agaactcctcaaaagtttctagcca

SEQ ID NO: 77070 - DNA, 25 bp, Mus musculus
agaactcggcttcctggtacccaag

SEQ ID NO: 77071 - DNA, 25 bp, Mus musculus
agaactctccatcttgcactgagga

SEQ ID NO: 77072 - DNA, 25 bp, Mus musculus
agaactctgtctgggcatcatgggc

SEQ ID NO: 77073 - DNA, 25 bp, Mus musculus
agaactctgttgaagctcgatcctc

SEQ ID NO: 77074 - DNA, 25 bp, Mus musculus
agaactcttgcctggtgaccgggaa

SEQ ID NO: 77075 - DNA, 25 bp, Mus musculus
agaactgatacaggagcagggcccc

SEQ ID NO: 77076 - DNA, 25 bp, Mus musculus
agaactgcatccactgggctggcca

SEQ ID NO: 77077 - DNA, 25 bp, Mus musculus
agaactgctcggcaaagtcggacac

SEQ ID NO: 77078 - DNA, 25 bp, Mus musculus
agaactggaacgtcagcaagccgga

SEQ ID NO: 77079 - DNA, 25 bp, Mus musculus
agaactggacgctcacctggaaaac

SEQ ID NO: 77080 - DNA, 25 bp, Mus musculus
agaactggagagacagtctttccca

SEQ ID NO: 77081 - DNA, 25 bp, Mus musculus
agaactggcaaagctccgacaggag

SEQ ID NO: 77082 - DNA, 25 bp, Mus musculus
agaactgggctaggagcatcgagct

SEQ ID NO: 77083 - DNA, 25 bp, Mus musculus
agaactgtggttgcaggagtcagcc

SEQ ID NO: 77084 - DNA, 25 bp, Mus musculus
agaacttatagacagcggccaccgt

SEQ ID NO: 77085 - DNA, 25 bp, Mus musculus
agaacttcaccctgcccctgatctc

SEQ ID NO: 77086 - DNA, 25 bp, Mus musculus
agaacttccagcatcgtgtccacac

SEQ ID NO: 77087 - DNA, 25 bp, Mus musculus
agaacttcccgcaacagacgcatgc

SEQ ID NO: 77088 - DNA, 25 bp, Mus musculus
agaacttgcgggatctgttgactga

SEQ ID NO: 77089 - DNA, 25 bp, Mus musculus
agaacttggagcaaagcccctgcag

SEQ ID NO: 77090 - DNA, 25 bp, Mus musculus
agaactttcagattgtgcacgctga

SEQ ID NO: 77091 - DNA, 25 bp, Mus musculus
agaactttgccaggaccgtggcccg

SEQ ID NO: 77092 - DNA, 25 bp, Mus musculus
agaagaaacctgcagccctagctgg

SEQ ID NO: 77093 - DNA, 25 bp, Mus musculus
agaagaaaggcaaagtgaaagagga

SEQ ID NO: 77094 - DNA, 25 bp, Mus musculus
agaagaaccggcacttttggagccg

SEQ ID NO: 77095 - DNA, 25 bp, Mus musculus
agaagaaccgggaagcagagcagct

SEQ ID NO: 77096 - DNA, 25 bp, Mus musculus
agaagaacctgtgactgcctgggcc

SEQ ID NO: 77097 - DNA, 25 bp, Mus musculus
agaagaactcatctcctggcgggag

SEQ ID NO: 77098 - DNA, 25 bp, Mus musculus
agaagaactctgtccatcgctggtg

SEQ ID NO: 77099 - DNA, 25 bp, Mus musculus
agaagaaggcttccatcggctacac

SEQ ID NO: 77100 - DNA, 25 bp, Mus musculus
agaagaaggtggaccaactgaatgc

SEQ ID NO: 77101 - DNA, 25 bp, Mus musculus
agaagaatacttccaagccctggca

SEQ ID NO: 77102 - DNA, 25 bp, Mus musculus
agaagaattaagaatccttgcaggg

SEQ ID NO: 77103 - DNA, 25 bp, Mus musculus
agaagacaagtctgaggcccaaggc

SEQ ID NO: 77104 - DNA, 25 bp, Mus musculus
agaagacatgcaagcgctgacccta

SEQ ID NO: 77105 - DNA, 25 bp, Mus musculus
agaagaccacgtctccatgggagga

SEQ ID NO: 77106 - DNA, 25 bp, Mus musculus
agaagaccccaagttcaaggagttg

SEQ ID NO: 77107 - DNA, 25 bp, Mus musculus
agaagacctttctgtgccaagcagt

SEQ ID NO: 77108 - DNA, 25 bp, Mus musculus
agaagacgggtacatcggtgccact

SEQ ID NO: 77109 - DNA, 25 bp, Mus musculus
agaagactctgaacatctgattcgg

SEQ ID NO: 77110 - DNA, 25 bp, Mus musculus
agaagagaaggtgttccgccgagca

SEQ ID NO: 77111 - DNA, 25 bp, Mus musculus
agaagaggactttctgcgcctgcca

SEQ ID NO: 77112 - DNA, 25 bp, Mus musculus
agaagaggtgactgtcctgggccgc

SEQ ID NO: 77113 - DNA, 25 bp, Mus musculus
agaagagtgcagaaggagacgtggc

SEQ ID NO: 77114 - DNA, 25 bp, Mus musculus
agaagataggacatccccacgggct

SEQ ID NO: 77115 - DNA, 25 bp, Mus musculus
agaagatcgcccctaccgagttcgt

SEQ ID NO: 77116 - DNA, 25 bp, Mus musculus
agaagatctggttccctacacaggg

SEQ ID NO: 77117 - DNA, 25 bp, Mus musculus
agaagcacatggacggactccgcac

SEQ ID NO: 77118 - DNA, 25 bp, Mus musculus
agaagcaccttgacctggagcggaa

SEQ ID NO: 77119 - DNA, 25 bp, Mus musculus
agaagcagatgaatatgagtccacc

SEQ ID NO: 77120 - DNA, 25 bp, Mus musculus
agaagccatggatcccgggtcctga

SEQ ID NO: 77121 - DNA, 25 bp, Mus musculus
agaagcccacagagatcgacgagca

SEQ ID NO: 77122 - DNA, 25 bp, Mus musculus
agaagccgcagaagaacaagccgct

SEQ ID NO: 77123 - DNA, 25 bp, Mus musculus
agaagccttttactgaggttatccg

SEQ ID NO: 77124 - DNA, 25 bp, Mus musculus
agaagcgcgagcaggaggagtccag

SEQ ID NO: 77125 - DNA, 25 bp, Mus musculus
agaagcggccctttgctgtcaccag

SEQ ID NO: 77126 - DNA, 25 bp, Mus musculus
agaagcggctctcgcagtccgatga

SEQ ID NO: 77127 - DNA, 25 bp, Mus musculus
agaagctagctctccgcactgggaa

SEQ ID NO: 77128 - DNA, 25 bp, Mus musculus
agaagctattacacccagagccctc

SEQ ID NO: 77129 - DNA, 25 bp, Mus musculus
agaagctcctggagtggcaccgcgc

SEQ ID NO: 77130 - DNA, 25 bp, Mus musculus
agaagctgaacgaactggcggacca

SEQ ID NO: 77131 - DNA, 25 bp, Mus musculus
agaagctgagcaagggcggctggga

SEQ ID NO: 77132 - DNA, 25 bp, Mus musculus
agaagctggcagtgctccgggaact

SEQ ID NO: 77133 - DNA, 25 bp, Mus musculus
agaagctggccagatttgtggctca

SEQ ID NO: 77134 - DNA, 25 bp, Mus musculus
agaagctgggctgccgcttggtcaa

SEQ ID NO: 77135 - DNA, 25 bp, Mus musculus
agaagctgggcttggagatcccgcc

SEQ ID NO: 77136 - DNA, 25 bp, Mus musculus
agaagcttctggtcctgaagacaca

SEQ ID NO: 77137 - DNA, 25 bp, Mus musculus
agaaggaacccctgccactgaggtg

SEQ ID NO: 77138 - DNA, 25 bp, Mus musculus
agaaggaacttagcagtcatcttgg

SEQ ID NO: 77139 - DNA, 25 bp, Mus musculus
agaaggacaaactccagcatgctgg

SEQ ID NO: 77140 - DNA, 25 bp, Mus musculus
agaaggagaagcacctcgatgagga

SEQ ID NO: 77141 - DNA, 25 bp, Mus musculus
agaaggagagcaggccgggcagccc

SEQ ID NO: 77142 - DNA, 25 bp, Mus musculus
agaaggaggcgaccgactgatctct

SEQ ID NO: 77143 - DNA, 25 bp, Mus musculus
agaaggcagccgagtacctgaagcg

SEQ ID NO: 77144 - DNA, 25 bp, Mus musculus
agaaggcccatatccctctgtgtgg

SEQ ID NO: 77145 - DNA, 25 bp, Mus musculus
agaaggcgcacaaggactcagagtc

SEQ ID NO: 77146 - DNA, 25 bp, Mus musculus
agaaggcgcagggaaccttgaccac

SEQ ID NO: 77147 - DNA, 25 bp, Mus musculus
agaaggctccaccaaagttcccgag

SEQ ID NO: 77148 - DNA, 25 bp, Mus musculus
agaaggctctgcagtggcacccaga

SEQ ID NO: 77149 - DNA, 25 bp, Mus musculus
agaaggctctggcatctagaagtaa

SEQ ID NO: 77150 - DNA, 25 bp, Mus musculus
agaagggcaaaggatgctagcagac

SEQ ID NO: 77151 - DNA, 25 bp, Mus musculus
agaagggccttccagacccagtgct

SEQ ID NO: 77152 - DNA, 25 bp, Mus musculus
agaagggtctccaggcataccaggg

SEQ ID NO: 77153 - DNA, 25 bp, Mus musculus
agaaggtcagtagccaacaggtctc

SEQ ID NO: 77154 - DNA, 25 bp, Mus musculus
agaaggtcccaagcccagtagtgac

SEQ ID NO: 77155 - DNA, 25 bp, Mus musculus
agaaggttatttcctgctgacccag

SEQ ID NO: 77156 - DNA, 25 bp, Mus musculus
agaaggttgtgtggagcccaccgca

SEQ ID NO: 77157 - DNA, 25 bp, Mus musculus
agaagtacagctacccataaaggca

SEQ ID NO: 77158 - DNA, 25 bp, Mus musculus
agaagtacatcactgcccacggact

SEQ ID NO: 77159 - DNA, 25 bp, Mus musculus
agaagtaccggctcaccagcttgca

SEQ ID NO: 77160 - DNA, 25 bp, Mus musculus
agaagtacgcaacggaagaggccct

SEQ ID NO: 77161 - DNA, 25 bp, Mus musculus
agaagtacttagcaccctcggagca

SEQ ID NO: 77162 - DNA, 25 bp, Mus musculus
agaagtacttcagtgctggctcggg

SEQ ID NO: 77163 - DNA, 25 bp, Mus musculus
agaagtacttcctcccgctgcagaa

SEQ ID NO: 77164 - DNA, 25 bp, Mus musculus
agaagtccgccgaggttgtgccaaa

SEQ ID NO: 77165 - DNA, 25 bp, Mus musculus
agaagtccgggcagcagctcttgtc

SEQ ID NO: 77166 - DNA, 25 bp, Mus musculus
agaagtcctgaatcccgtcctggtg

SEQ ID NO: 77167 - DNA, 25 bp, Mus musculus
agaagtccttctggcggcagctgaa

SEQ ID NO: 77168 - DNA, 25 bp, Mus musculus
agaagtcgctgctgtgcatccgctg

SEQ ID NO: 77169 - DNA, 25 bp, Mus musculus
agaagtctccacagcagctgcggct

SEQ ID NO: 77170 - DNA, 25 bp, Mus musculus
agaagtcttggataagtttgtcaac

SEQ ID NO: 77171 - DNA, 25 bp, Mus musculus
agaagtgccaatcccctagcaaatg

SEQ ID NO: 77172 - DNA, 25 bp, Mus musculus
agaagtgctcctgcgcctttcagag

SEQ ID NO: 77173 - DNA, 25 bp, Mus musculus
agaagtgctgaggaaggacccgtac

SEQ ID NO: 77174 - DNA, 25 bp, Mus musculus
agaagtggatgcctgtaccccagca

SEQ ID NO: 77175 - DNA, 25 bp, Mus musculus
agaagtggcagctgctatccgggcc

SEQ ID NO: 77176 - DNA, 25 bp, Mus musculus
agaagtgttccttgccgtggagtgc

SEQ ID NO: 77177 - DNA, 25 bp, Mus musculus
agaagttccgcagcaagccacaact

SEQ ID NO: 77178 - DNA, 25 bp, Mus musculus
agaagttccttctctgccggagcag

SEQ ID NO: 77179 - DNA, 25 bp, Mus musculus
agaagttgcacggtccagacagcga

SEQ ID NO: 77180 - DNA, 25 bp, Mus musculus
agaagttgggcatcaggcaccccaa

SEQ ID NO: 77181 - DNA, 25 bp, Mus musculus
agaagtttcgaaaggagcagattgg

SEQ ID NO: 77182 - DNA, 25 bp, Mus musculus
agaatatgaccatccgctgctgcga

SEQ ID NO: 77183 - DNA, 25 bp, Mus musculus
agaatatgatgaccctccaggcctg

SEQ ID NO: 77184 - DNA, 25 bp, Mus musculus
agaatatttccctggcaacccttgg

SEQ ID NO: 77185 - DNA, 25 bp, Mus musculus
agaatctcagtcagaatcccgggcc

SEQ ID NO: 77186 - DNA, 25 bp, Mus musculus
agaatgaagctcttgtcgccctggc

SEQ ID NO: 77187 - DNA, 25 bp, Mus musculus
agaatgaccgcaatctctgccagca

SEQ ID NO: 77188 - DNA, 25 bp, Mus musculus
agaatgacctaagggacacatttgc

SEQ ID NO: 77189 - DNA, 25 bp, Mus musculus
agaatgagttcatcgacgcctcccg

SEQ ID NO: 77190 - DNA, 25 bp, Mus musculus
agaatgatgccttgtagcttaagcc

SEQ ID NO: 77191 - DNA, 25 bp, Mus musculus
agaatgcacagtatgatcagctcag

SEQ ID NO: 77192 - DNA, 25 bp, Mus musculus
agaatgccatcctgcaagccatgcg

SEQ ID NO: 77193 - DNA, 25 bp, Mus musculus
agaatgcgctcatccggaggcagga

SEQ ID NO: 77194 - DNA, 25 bp, Mus musculus
agaatgcttactgtgtgtcgggcgc

SEQ ID NO: 77195 - DNA, 25 bp, Mus musculus
agaatgtacacaacgctagctgccc

SEQ ID NO: 77196 - DNA, 25 bp, Mus musculus
agaatgtcgggaccacccacgatct

SEQ ID NO: 77197 - DNA, 25 bp, Mus musculus
agaatgtctcatgttcgagtctggg

SEQ ID NO: 77198 - DNA, 25 bp, Mus musculus
agaatgtggcatggccttcaccggt

SEQ ID NO: 77199 - DNA, 25 bp, Mus musculus
agaatgttgcttctggtcccgcccc

SEQ ID NO: 77200 - DNA, 25 bp, Mus musculus
agaattatcactttggctggaccga

SEQ ID NO: 77201 - DNA, 25 bp, Mus musculus
agaattcacccgaaactggcagcca

SEQ ID NO: 77202 - DNA, 25 bp, Mus musculus
agaattcctgcctgacaacccgtgt

SEQ ID NO: 77203 - DNA, 25 bp, Mus musculus
agacaaaaacagagatggcgggccc

SEQ ID NO: 77204 - DNA, 25 bp, Mus musculus
agacaacatcatggctggatccgcg

SEQ ID NO: 77205 - DNA, 25 bp, Mus musculus
agacaactgccaacgtcactgaggg

SEQ ID NO: 77206 - DNA, 25 bp, Mus musculus
agacaagatgtctatgggccccagc

SEQ ID NO: 77207 - DNA, 25 bp, Mus musculus
agacaagattaaagagctggaggcc

SEQ ID NO: 77208 - DNA, 25 bp, Mus musculus
agacaagtggaacagccctaacggg

SEQ ID NO: 77209 - DNA, 25 bp, Mus musculus
agacacaaagctcctcgtgtctggg

SEQ ID NO: 77210 - DNA, 25 bp, Mus musculus
agacaccctggccaactgtaccaag

SEQ ID NO: 77211 - DNA, 25 bp, Mus musculus
agacactagggtaatccggaggcgc

SEQ ID NO: 77212 - DNA, 25 bp, Mus musculus
agacactgccgcctctactcagagg

SEQ ID NO: 77213 - DNA, 25 bp, Mus musculus
agacactgctctttggtgccctgca

SEQ ID NO: 77214 - DNA, 25 bp, Mus musculus
agacagacagctgcagtaagtgctg

SEQ ID NO: 77215 - DNA, 25 bp, Mus musculus
agacagaccggttcctgagccaggt

SEQ ID NO: 77216 - DNA, 25 bp, Mus musculus
agacagagttccactaccagcagcg

SEQ ID NO: 77217 - DNA, 25 bp, Mus musculus
agacagataaacttggatgcccacc

SEQ ID NO: 77218 - DNA, 25 bp, Mus musculus
agacagatcctgtgttacccggcaa

SEQ ID NO: 77219 - DNA, 25 bp, Mus musculus
agacagatggacatgggaagccaga

SEQ ID NO: 77220 - DNA, 25 bp, Mus musculus
agacagccgacctgctaaatggtag

SEQ ID NO: 77221 - DNA, 25 bp, Mus musculus
agacagccggcacattcaagcagag

SEQ ID NO: 77222 - DNA, 25 bp, Mus musculus
agacagcctcaacaagctggctctc

SEQ ID NO: 77223 - DNA, 25 bp, Mus musculus
agacagcgagcgctactctcgtaga

SEQ ID NO: 77224 - DNA, 25 bp, Mus musculus
agacagctccggttcttgcaggcca

SEQ ID NO: 77225 - DNA, 25 bp, Mus musculus
agacagtgatcccaatctggacccg

SEQ ID NO: 77226 - DNA, 25 bp, Mus musculus
agacagtggccaagagtacctcggg

SEQ ID NO: 77227 - DNA, 25 bp, Mus musculus
agacatcaatgggttgcggcgcgtc

SEQ ID NO: 77228 - DNA, 25 bp, Mus musculus
agacatcacgttccagatgctggag

SEQ ID NO: 77229 - DNA, 25 bp, Mus musculus
agacatccaaaagcgacagataaag

SEQ ID NO: 77230 - DNA, 25 bp, Mus musculus
agacatccgtgagtgttcatcctga

SEQ ID NO: 77231 - DNA, 25 bp, Mus musculus
agacatgcgcaaaaaggagaagaac

SEQ ID NO: 77232 - DNA, 25 bp, Mus musculus
agacatggggtatccatcgagggac

SEQ ID NO: 77233 - DNA, 25 bp, Mus musculus
agacattctacccacaggacctcag

SEQ ID NO: 77234 - DNA, 25 bp, Mus musculus
agaccaagcgtgtggcggcacaagt

SEQ ID NO: 77235 - DNA, 25 bp, Mus musculus
agaccacacaccctagatggccgaa

SEQ ID NO: 77236 - DNA, 25 bp, Mus musculus
agaccacgataatgaagaatattgt

SEQ ID NO: 77237 - DNA, 25 bp, Mus musculus
agaccacggctgaggcggattctcg

SEQ ID NO: 77238 - DNA, 25 bp, Mus musculus
agaccagcatcctttggacccctga

SEQ ID NO: 77239 - DNA, 25 bp, Mus musculus
agaccagctgtgatgttcgaagaca

SEQ ID NO: 77240 - DNA, 25 bp, Mus musculus
agaccatccccgagaacaggtccga

SEQ ID NO: 77241 - DNA, 25 bp, Mus musculus
agaccatcgtcgtccaggctgaagg

SEQ ID NO: 77242 - DNA, 25 bp, Mus musculus
agaccatctgctacccttctgggaa

SEQ ID NO: 77243 - DNA, 25 bp, Mus musculus
agaccatgccgaagtccatcttggg

SEQ ID NO: 77244 - DNA, 25 bp, Mus musculus
agacccaatgttcaggacgacgcag

SEQ ID NO: 77245 - DNA, 25 bp, Mus musculus
agacccagcgcgtccattgcaaggt

SEQ ID NO: 77246 - DNA, 25 bp, Mus musculus
agaccccaaggtatcgagactgcgg

SEQ ID NO: 77247 - DNA, 25 bp, Mus musculus
agaccccaatgtgtgtagccactgg

SEQ ID NO: 77248 - DNA, 25 bp, Mus musculus
agaccccgaagatctacctgaagaa

SEQ ID NO: 77249 - DNA, 25 bp, Mus musculus
agaccccgtggctgcctccatcatg

SEQ ID NO: 77250 - DNA, 25 bp, Mus musculus
agacccctgattgtagccaccgagg

SEQ ID NO: 77251 - DNA, 25 bp, Mus musculus
agacccgagccatgaacccgggcgg

SEQ ID NO: 77252 - DNA, 25 bp, Mus musculus
agacccggcggagattcgaagctga

SEQ ID NO: 77253 - DNA, 25 bp, Mus musculus
agaccctggccgagctaaatcgcta

SEQ ID NO: 77254 - DNA, 25 bp, Mus musculus
agaccctgtcaccttggcagactgg

SEQ ID NO: 77255 - DNA, 25 bp, Mus musculus
agaccgagctgcgagactggcaccg

SEQ ID NO: 77256 - DNA, 25 bp, Mus musculus
agaccgcgtggtgtatgacttagac

SEQ ID NO: 77257 - DNA, 25 bp, Mus musculus
agaccggtgtgatgcttcccagggc

SEQ ID NO: 77258 - DNA, 25 bp, Mus musculus
agacctacaaaatcagttcggcaga

SEQ ID NO: 77259 - DNA, 25 bp, Mus musculus
agacctcgtcagtgctgttgccgag

SEQ ID NO: 77260 - DNA, 25 bp, Mus musculus
agacctctgatctgtctctcccaga

SEQ ID NO: 77261 - DNA, 25 bp, Mus musculus
agacctctgtagcagcgaccaggag

SEQ ID NO: 77262 - DNA, 25 bp, Mus musculus
agacctgcgaagtggacgggctacc

SEQ ID NO: 77263 - DNA, 25 bp, Mus musculus
agacctgctgcgctcctcttggaat

SEQ ID NO: 77264 - DNA, 25 bp, Mus musculus
agacctgggcttcgagcactctgag

SEQ ID NO: 77265 - DNA, 25 bp, Mus musculus
agaccttcaaagtgctcctcgtgga

SEQ ID NO: 77266 - DNA, 25 bp, Mus musculus
agacgaagaccctacactgctgtgg

SEQ ID NO: 77267 - DNA, 25 bp, Mus musculus
agacgacagaggagattcggcagat

SEQ ID NO: 77268 - DNA, 25 bp, Mus musculus
agacgagaaggaccggcaacaccga

SEQ ID NO: 77269 - DNA, 25 bp, Mus musculus
agacgaggctctggccatcttccta

SEQ ID NO: 77270 - DNA, 25 bp, Mus musculus
agacgattgcctggccgcttcaacg

SEQ ID NO: 77271 - DNA, 25 bp, Mus musculus
agacgcggttctgcaggtacccagt

SEQ ID NO: 77272 - DNA, 25 bp, Mus musculus
agacgcgtcttccttggccagcagt

SEQ ID NO: 77273 - DNA, 25 bp, Mus musculus
agacgctgagccctcagacactgca

SEQ ID NO: 77274 - DNA, 25 bp, Mus musculus
agacgctgggaagtaccgctgcatg

SEQ ID NO: 77275 - DNA, 25 bp, Mus musculus
agacgctttagggtcggccgagcaa

SEQ ID NO: 77276 - DNA, 25 bp, Mus musculus
agacggaacatcacccactaggagt

SEQ ID NO: 77277 - DNA, 25 bp, Mus musculus
agacggagagttcggtggagcccgg

SEQ ID NO: 77278 - DNA, 25 bp, Mus musculus
agacggagccccttggttccaggca

SEQ ID NO: 77279 - DNA, 25 bp, Mus musculus
agacggccgagacacctatgaggaa

SEQ ID NO: 77280 - DNA, 25 bp, Mus musculus
agacggcgttggttcgagaagacct

SEQ ID NO: 77281 - DNA, 25 bp, Mus musculus
agacggctctgctcccttatgaaag

SEQ ID NO: 77282 - DNA, 25 bp, Mus musculus
agacgggacggtgactgacaaccag

SEQ ID NO: 77283 - DNA, 25 bp, Mus musculus
agacgggcgacagctgtggtccttc

SEQ ID NO: 77284 - DNA, 25 bp, Mus musculus
agacggtactggtctcccggctgaa

SEQ ID NO: 77285 - DNA, 25 bp, Mus musculus
agacggtccattcgcctgccagaga

SEQ ID NO: 77286 - DNA, 25 bp, Mus musculus
agacgtacctgtgagctcgcctagg

SEQ ID NO: 77287 - DNA, 25 bp, Mus musculus
agacgtccataagggcatgtttgcc

SEQ ID NO: 77288 - DNA, 25 bp, Mus musculus
agacgtgaagaagcccgctgctgcg

SEQ ID NO: 77289 - DNA, 25 bp, Mus musculus
agacgtgcacgtgcttcgtgagaga

SEQ ID NO: 77290 - DNA, 25 bp, Mus musculus
agacgtggagctatttcctatgaca

SEQ ID NO: 77291 - DNA, 25 bp, Mus musculus
agacgtgtttcagaacggatggcag

SEQ ID NO: 77292 - DNA, 25 bp, Mus musculus
agacgttgtgttcctccccttgagc

SEQ ID NO: 77293 - DNA, 25 bp, Mus musculus
agactaaaggacactggctggacag

SEQ ID NO: 77294 - DNA, 25 bp, Mus musculus
agactaacggcacggacagcaatgg

SEQ ID NO: 77295 - DNA, 25 bp, Mus musculus
agactaccagaatcgagcagctttc

SEQ ID NO: 77296 - DNA, 25 bp, Mus musculus
agactagccgctgttgtcctggtaa

SEQ ID NO: 77297 - DNA, 25 bp, Mus musculus
agactagtccctggcatgctacaga

SEQ ID NO: 77298 - DNA, 25 bp, Mus musculus
agactatggctgatcccctgcagga

SEQ ID NO: 77299 - DNA, 25 bp, Mus musculus
agactcacagatggcaacactgaca

SEQ ID NO: 77300 - DNA, 25 bp, Mus musculus
agactccttgaacaactaagacaag

SEQ ID NO: 77301 - DNA, 25 bp, Mus musculus
agactcgcccgctttctcctgggag

SEQ ID NO: 77302 - DNA, 25 bp, Mus musculus
agactcggtcatctcatcgcctggg

SEQ ID NO: 77303 - DNA, 25 bp, Mus musculus
agactgaccctgttccctatgtgag

SEQ ID NO: 77304 - DNA, 25 bp, Mus musculus
agactgcagcttgcctgtcggagca

SEQ ID NO: 77305 - DNA, 25 bp, Mus musculus
agactgcatgtatcctaacttgaag

SEQ ID NO: 77306 - DNA, 25 bp, Mus musculus
agactgccgagcttgcgaggacgct

SEQ ID NO: 77307 - DNA, 25 bp, Mus musculus
agactgctactacaacctcgggcgg

SEQ ID NO: 77308 - DNA, 25 bp, Mus musculus
agactgctctcgctgacccttttgg

SEQ ID NO: 77309 - DNA, 25 bp, Mus musculus
agactgggaccaactgagactgctg

SEQ ID NO: 77310 - DNA, 25 bp, Mus musculus
agactgggagcctatggagcaagcc

SEQ ID NO: 77311 - DNA, 25 bp, Mus musculus
agactgtgctcaacaaggcccagga

SEQ ID NO: 77312 - DNA, 25 bp, Mus musculus
agactgttcgcatctgggtacccaa

SEQ ID NO: 77313 - DNA, 25 bp, Mus musculus
agacttggtgacctcagaacccgga

SEQ ID NO: 77314 - DNA, 25 bp, Mus musculus
agacttgttgtaccctatggcctca

SEQ ID NO: 77315 - DNA, 25 bp, Mus musculus
agactttaccacctgaaactgctgc

SEQ ID NO: 77316 - DNA, 25 bp, Mus musculus
agactttctccactgaccctttgaa

SEQ ID NO: 77317 - DNA, 25 bp, Mus musculus
agacttttgggcagcaatgccgccg

SEQ ID NO: 77318 - DNA, 25 bp, Mus musculus
agagaaaaacctgtacgggcgcctg

SEQ ID NO: 77319 - DNA, 25 bp, Mus musculus
agagaaaacggtgcccttgctgtca

SEQ ID NO: 77320 - DNA, 25 bp, Mus musculus
agagaaaacgtctgtccccaagagc

SEQ ID NO: 77321 - DNA, 25 bp, Mus musculus
agagaaaagagcgttgaccgcccag

SEQ ID NO: 77322 - DNA, 25 bp, Mus musculus
agagaaaggaaagcgcgaggagacg

SEQ ID NO: 77323 - DNA, 25 bp, Mus musculus
agagaaaggttctcctggaacgaga

SEQ ID NO: 77324 - DNA, 25 bp, Mus musculus
agagaacacaatcgcctagccgctg

SEQ ID NO: 77325 - DNA, 25 bp, Mus musculus
agagaacatcgtgcacggcagtgga

SEQ ID NO: 77326 - DNA, 25 bp, Mus musculus
agagaacttctcacagggcatatgg

SEQ ID NO: 77327 - DNA, 25 bp, Mus musculus
agagaagagcagaccagcggcgaca

SEQ ID NO: 77328 - DNA, 25 bp, Mus musculus
agagaagatggtcgccaagcagcac

SEQ ID NO: 77329 - DNA, 25 bp, Mus musculus
agagaagctgctccgatgctccaga

SEQ ID NO: 77330 - DNA, 25 bp, Mus musculus
agagaaggcagagctcaagcagcgc

SEQ ID NO: 77331 - DNA, 25 bp, Mus musculus
agagaaggctgtgctcgagtcccag

SEQ ID NO: 77332 - DNA, 25 bp, Mus musculus
agagaagtggatgggccctgtaccc

SEQ ID NO: 77333 - DNA, 25 bp, Mus musculus
agagaatcccctaccggcttggtcg

SEQ ID NO: 77334 - DNA, 25 bp, Mus musculus
agagaatccttaaggctctccacac

SEQ ID NO: 77335 - DNA, 25 bp, Mus musculus
agagaatccttacgccaatgcaggg

SEQ ID NO: 77336 - DNA, 25 bp, Mus musculus
agagaatcgtgacgtcaggcctcgc

SEQ ID NO: 77337 - DNA, 25 bp, Mus musculus
agagaatttaagtcctcacgagcag

SEQ ID NO: 77338 - DNA, 25 bp, Mus musculus
agagacaccgcttccttctccggga

SEQ ID NO: 77339 - DNA, 25 bp, Mus musculus
agagacagacctatacctgcctatc

SEQ ID NO: 77340 - DNA, 25 bp, Mus musculus
agagacatcggccagcactgagagc

SEQ ID NO: 77341 - DNA, 25 bp, Mus musculus
agagacatctcctgcacgcgctggt

SEQ ID NO: 77342 - DNA, 25 bp, Mus musculus
agagaccgccctgtaccgaaagatg

SEQ ID NO: 77343 - DNA, 25 bp, Mus musculus
agagacctttcggagccgcttcagc

SEQ ID NO: 77344 - DNA, 25 bp, Mus musculus
agagagaaactcctgctcagcgcag

SEQ ID NO: 77345 - DNA, 25 bp, Mus musculus
agagagaatgcttccccagcccctg

SEQ ID NO: 77346 - DNA, 25 bp, Mus musculus
agagagacagaagcgcgagcaggag

SEQ ID NO: 77347 - DNA, 25 bp, Mus musculus
agagagacagactcgagtgacagag

SEQ ID NO: 77348 - DNA, 25 bp, Mus musculus
agagagaccctaaagcccacagatt

SEQ ID NO: 77349 - DNA, 25 bp, Mus musculus
agagagacttagagagcacagggct

SEQ ID NO: 77350 - DNA, 25 bp, Mus musculus
agagagagctcagcccgcagctgga

SEQ ID NO: 77351 - DNA, 25 bp, Mus musculus
agagagcactcgatcctacagacgg

SEQ ID NO: 77352 - DNA, 25 bp, Mus musculus
agagagcggccggtttatcagcagc

SEQ ID NO: 77353 - DNA, 25 bp, Mus musculus
agagagcttttacccctatgtagag

SEQ ID NO: 77354 - DNA, 25 bp, Mus musculus
agagaggaagctttccgaggcctga

SEQ ID NO: 77355 - DNA, 25 bp, Mus musculus
agagaggatgggactcctggaccca

SEQ ID NO: 77356 - DNA, 25 bp, Mus musculus
agagaggcaagatgagagtgcacaa

SEQ ID NO: 77357 - DNA, 25 bp, Mus musculus
agagaggccacccatctcaggagag

SEQ ID NO: 77358 - DNA, 25 bp, Mus musculus
agagaggccgcgacacggtttcctg

SEQ ID NO: 77359 - DNA, 25 bp, Mus musculus
agagaggcttctggctaattcacca

SEQ ID NO: 77360 - DNA, 25 bp, Mus musculus
agagagggctctgcgcgctatgctt

SEQ ID NO: 77361 - DNA, 25 bp, Mus musculus
agagaggtctgtgccacgtggtccc

SEQ ID NO: 77362 - DNA, 25 bp, Mus musculus
agagagtcttggatacagccgccga

SEQ ID NO: 77363 - DNA, 25 bp, Mus musculus
agagatacttcagcatctgcagaac

SEQ ID NO: 77364 - DNA, 25 bp, Mus musculus
agagatcagccaccgaatcctgtgc

SEQ ID NO: 77365 - DNA, 25 bp, Mus musculus
agagatcgcgatagagaccgggacc

SEQ ID NO: 77366 - DNA, 25 bp, Mus musculus
agagatgaagggtctcctcacactg

SEQ ID NO: 77367 - DNA, 25 bp, Mus musculus
agagatgacacctcctacctcctgg

SEQ ID NO: 77368 - DNA, 25 bp, Mus musculus
agagatgttgctgttggccgctgcc

SEQ ID NO: 77369 - DNA, 25 bp, Mus musculus
agagcaaagtcttaccacccatgag

SEQ ID NO: 77370 - DNA, 25 bp, Mus musculus
agagcaacctggactgtgccactgc

SEQ ID NO: 77371 - DNA, 25 bp, Mus musculus
agagcaataacacagcctgccagga

SEQ ID NO: 77372 - DNA, 25 bp, Mus musculus
agagcaatctcatcgtgcaccggcg

SEQ ID NO: 77373 - DNA, 25 bp, Mus musculus
agagcaatggaatcttggctgggca

SEQ ID NO: 77374 - DNA, 25 bp, Mus musculus
agagcacagggcagaaagtctgctg

SEQ ID NO: 77375 - DNA, 25 bp, Mus musculus
agagcaccaacaggatctgccggga

SEQ ID NO: 77376 - DNA, 25 bp, Mus musculus
agagcaccggagagcttgggaaaat

SEQ ID NO: 77377 - DNA, 25 bp, Mus musculus
agagcagatgaattgggtcagccct

SEQ ID NO: 77378 - DNA, 25 bp, Mus musculus
agagcagatgcctcatttgtaagga

SEQ ID NO: 77379 - DNA, 25 bp, Mus musculus
agagcagcagagtgcaaccggagac

SEQ ID NO: 77380 - DNA, 25 bp, Mus musculus
agagcaggaaaagccgtgttgcccg

SEQ ID NO: 77381 - DNA, 25 bp, Mus musculus
agagcagtcaccattgccaagcagg

SEQ ID NO: 77382 - DNA, 25 bp, Mus musculus
agagcagtcctttgtccggaccgag

SEQ ID NO: 77383 - DNA, 25 bp, Mus musculus
agagcagtctgtgccgtacccttaa

SEQ ID NO: 77384 - DNA, 25 bp, Mus musculus
agagcagttagctggaccactccga

SEQ ID NO: 77385 - DNA, 25 bp, Mus musculus
agagcatcatgcttcccctggactg

SEQ ID NO: 77386 - DNA, 25 bp, Mus musculus
agagcatccagtgaagcaggaactg

SEQ ID NO: 77387 - DNA, 25 bp, Mus musculus
agagccaagcgagacgagaaggacc

SEQ ID NO: 77388 - DNA, 25 bp, Mus musculus
agagccagcgctcaggttccttgtg

SEQ ID NO: 77389 - DNA, 25 bp, Mus musculus
agagccaggtaagagggacgtaaca

SEQ ID NO: 77390 - DNA, 25 bp, Mus musculus
agagccatagctcccaaggtgcaaa

SEQ ID NO: 77391 - DNA, 25 bp, Mus musculus
agagccatgcacctgccgaagaggt

SEQ ID NO: 77392 - DNA, 25 bp, Mus musculus
agagccatgggccaccactttatgg

SEQ ID NO: 77393 - DNA, 25 bp, Mus musculus
agagcccgcaagagacaaggtacac

SEQ ID NO: 77394 - DNA, 25 bp, Mus musculus
agagccctacagaagccccgagtag

SEQ ID NO: 77395 - DNA, 25 bp, Mus musculus
agagccctcccactagacatggctt

SEQ ID NO: 77396 - DNA, 25 bp, Mus musculus
agagccctctgtggtggagcgacca

SEQ ID NO: 77397 - DNA, 25 bp, Mus musculus
agagcctacagagatgacattgatc

SEQ ID NO: 77398 - DNA, 25 bp, Mus musculus
agagcctccggctggagtacctgca

SEQ ID NO: 77399 - DNA, 25 bp, Mus musculus
agagcctctgcctacaacaaccgag

SEQ ID NO: 77400 - DNA, 25 bp, Mus musculus
agagcctgtcccacaccattgagtg

SEQ ID NO: 77401 - DNA, 25 bp, Mus musculus
agagccttcgagcacgtgtttgaga

SEQ ID NO: 77402 - DNA, 25 bp, Mus musculus
agagcgacatctttctgggagaccg

SEQ ID NO: 77403 - DNA, 25 bp, Mus musculus
agagcgacttttattctgtgtaact

SEQ ID NO: 77404 - DNA, 25 bp, Mus musculus
agagcgagcccggacggtgccccta

SEQ ID NO: 77405 - DNA, 25 bp, Mus musculus
agagcgaggacttctccagtgtcag

SEQ ID NO: 77406 - DNA, 25 bp, Mus musculus
agagcgatccttctcaattcacaag

SEQ ID NO: 77407 - DNA, 25 bp, Mus musculus
agagcgcagtgttctaagggccaca

SEQ ID NO: 77408 - DNA, 25 bp, Mus musculus
agagcgcccactgcctaacggagag

SEQ ID NO: 77409 - DNA, 25 bp, Mus musculus
agagcgcccgactcaggtattgagt

SEQ ID NO: 77410 - DNA, 25 bp, Mus musculus
agagcgcccgggaatctgcaagcct

SEQ ID NO: 77411 - DNA, 25 bp, Mus musculus
agagcgctccagtaacccatgaagg

SEQ ID NO: 77412 - DNA, 25 bp, Mus musculus
agagcgctgtgacgccctcgctgca

SEQ ID NO: 77413 - DNA, 25 bp, Mus musculus
agagcggctgcttctctcgcgagga

SEQ ID NO: 77414 - DNA, 25 bp, Mus musculus
agagcgtgagatccaccctgttcgg

SEQ ID NO: 77415 - DNA, 25 bp, Mus musculus
agagcgtgctgcaggacttactgag

SEQ ID NO: 77416 - DNA, 25 bp, Mus musculus
agagctccggttcgctcctcttcgg

SEQ ID NO: 77417 - DNA, 25 bp, Mus musculus
agagctcgctgcctacctggagaac

SEQ ID NO: 77418 - DNA, 25 bp, Mus musculus
agagctcggagctccggcctgcagt

SEQ ID NO: 77419 - DNA, 25 bp, Mus musculus
agagctctgaaagggggaagctccc

SEQ ID NO: 77420 - DNA, 25 bp, Mus musculus
agagctctgctatggctcagatggc

SEQ ID NO: 77421 - DNA, 25 bp, Mus musculus
agagctcttagaaatcactgtgggc

SEQ ID NO: 77422 - DNA, 25 bp, Mus musculus
agagctgaagcacacggtctggcaa

SEQ ID NO: 77423 - DNA, 25 bp, Mus musculus
agagctgaccagtttgccaatgagt

SEQ ID NO: 77424 - DNA, 25 bp, Mus musculus
agagctgcccgaactgaccttactg

SEQ ID NO: 77425 - DNA, 25 bp, Mus musculus
agagctgcctgtcggatgcctgacc

SEQ ID NO: 77426 - DNA, 25 bp, Mus musculus
agagctgcgcccatttccatccgcg

SEQ ID NO: 77427 - DNA, 25 bp, Mus musculus
agagctggtagacccatcattccaa

SEQ ID NO: 77428 - DNA, 25 bp, Mus musculus
agagctgtagtctcatcgctgaagg

SEQ ID NO: 77429 - DNA, 25 bp, Mus musculus
agagcttcgggctgagcttgctaag

SEQ ID NO: 77430 - DNA, 25 bp, Mus musculus
agagcttggctctgagtacggccca

SEQ ID NO: 77431 - DNA, 25 bp, Mus musculus
agagcttgtcaggaccgcagaagga

SEQ ID NO: 77432 - DNA, 25 bp, Mus musculus
agagctttgccatcctgtacctgga

SEQ ID NO: 77433 - DNA, 25 bp, Mus musculus
agaggaaactagagctggcagaaag

SEQ ID NO: 77434 - DNA, 25 bp, Mus musculus
agaggaaagactgtccccgaggagc

SEQ ID NO: 77435 - DNA, 25 bp, Mus musculus
agaggaaagcgctgctgctgcagac

SEQ ID NO: 77436 - DNA, 25 bp, Mus musculus
agaggaaatgccaaagacagccaag

SEQ ID NO: 77437 - DNA, 25 bp, Mus musculus
agaggaacgccaggaatttgaagca

SEQ ID NO: 77438 - DNA, 25 bp, Mus musculus
agaggaagccattacccactgctgc

SEQ ID NO: 77439 - DNA, 25 bp, Mus musculus
agaggaagcttcattttaggtgacc

SEQ ID NO: 77440 - DNA, 25 bp, Mus musculus
agaggacagagatcccaaaggcaga

SEQ ID NO: 77441 - DNA, 25 bp, Mus musculus
agaggacagcaacctgaagctccac

SEQ ID NO: 77442 - DNA, 25 bp, Mus musculus
agaggaccaacgctgcttgtgccgc

SEQ ID NO: 77443 - DNA, 25 bp, Mus musculus
agaggaccacatcgcccagaaacga

SEQ ID NO: 77444 - DNA, 25 bp, Mus musculus
agaggaccatcaaacccctgagcag

SEQ ID NO: 77445 - DNA, 25 bp, Mus musculus
agaggaccattctggccggctagga

SEQ ID NO: 77446 - DNA, 25 bp, Mus musculus
agaggactcggcatcagtgtgctcg

SEQ ID NO: 77447 - DNA, 25 bp, Mus musculus
agaggacttccagggccactcgggc

SEQ ID NO: 77448 - DNA, 25 bp, Mus musculus
agaggagacggagggcagcaacagc

SEQ ID NO: 77449 - DNA, 25 bp, Mus musculus
agaggagatctatggtggactgtca

SEQ ID NO: 77450 - DNA, 25 bp, Mus musculus
agaggagccacatctggacgtccag

SEQ ID NO: 77451 - DNA, 25 bp, Mus musculus
agaggagccagtgaagaagataatg

SEQ ID NO: 77452 - DNA, 25 bp, Mus musculus
agaggaggcacttggaggcaaatca

SEQ ID NO: 77453 - DNA, 25 bp, Mus musculus
agaggatgtctctctcagactggca

SEQ ID NO: 77454 - DNA, 25 bp, Mus musculus
agaggatttctaccgctccacggcg

SEQ ID NO: 77455 - DNA, 25 bp, Mus musculus
agaggatttgaattcactcttatgg

SEQ ID NO: 77456 - DNA, 25 bp, Mus musculus
agaggcatcggcacggaacttggac

SEQ ID NO: 77457 - DNA, 25 bp, Mus musculus
agaggccccatacagggagccactt

SEQ ID NO: 77458 - DNA, 25 bp, Mus musculus
agaggcccgggagcttatgtactca

SEQ ID NO: 77459 - DNA, 25 bp, Mus musculus
agaggcctggcttccatacggcaga

SEQ ID NO: 77460 - DNA, 25 bp, Mus musculus
agaggcgatctcattccggtggaca

SEQ ID NO: 77461 - DNA, 25 bp, Mus musculus
agaggcgatctctggacatccgaaa

SEQ ID NO: 77462 - DNA, 25 bp, Mus musculus
agaggcgccgccttagcggccggga

SEQ ID NO: 77463 - DNA, 25 bp, Mus musculus
agaggcgcctagaaggacacggacc

SEQ ID NO: 77464 - DNA, 25 bp, Mus musculus
agaggcggaagtccttatcaaaggc

SEQ ID NO: 77465 - DNA, 25 bp, Mus musculus
agaggcgtctttcctattgcatacg

SEQ ID NO: 77466 - DNA, 25 bp, Mus musculus
agaggctcatcacccggctggagaa

SEQ ID NO: 77467 - DNA, 25 bp, Mus musculus
agaggctccaccaggcggagacccg

SEQ ID NO: 77468 - DNA, 25 bp, Mus musculus
agaggctcctagtacgcttgcgcgg

SEQ ID NO: 77469 - DNA, 25 bp, Mus musculus
agaggctctgtcttactatctgcgc

SEQ ID NO: 77470 - DNA, 25 bp, Mus musculus
agaggctcttcgtgtaccacccgaa

SEQ ID NO: 77471 - DNA, 25 bp, Mus musculus
agaggctgacttgcccaaaccaact

SEQ ID NO: 77472 - DNA, 25 bp, Mus musculus
agaggctgccatcctgctttgacta

SEQ ID NO: 77473 - DNA, 25 bp, Mus musculus
agagggaaccatgggaatatttctt

SEQ ID NO: 77474 - DNA, 25 bp, Mus musculus
agagggcaatcaccgaagcttcaca

SEQ ID NO: 77475 - DNA, 25 bp, Mus musculus
agagggcgagccagcttccaggcct

SEQ ID NO: 77476 - DNA, 25 bp, Mus musculus
agagggctcgccacagttcaggcac

SEQ ID NO: 77477 - DNA, 25 bp, Mus musculus
agagggctcggcttgcacatagacg

SEQ ID NO: 77478 - DNA, 25 bp, Mus musculus
agagggctgcatctcttgttcccaa

SEQ ID NO: 77479 - DNA, 25 bp, Mus musculus
agaggggaaatatgatgaataaaga

SEQ ID NO: 77480 - DNA, 25 bp, Mus musculus
agagggtcagcagcaagtcccagat

SEQ ID NO: 77481 - DNA, 25 bp, Mus musculus
agagggtgccaacgcctatggttcc

SEQ ID NO: 77482 - DNA, 25 bp, Mus musculus
agagggtgccacctcactgggccca

SEQ ID NO: 77483 - DNA, 25 bp, Mus musculus
agaggtcttgcctagaacttgtgtt

SEQ ID NO: 77484 - DNA, 25 bp, Mus musculus
agaggtgaacttgccagagccaaaa

SEQ ID NO: 77485 - DNA, 25 bp, Mus musculus
agaggtgagcgctcgcgggctgcgc

SEQ ID NO: 77486 - DNA, 25 bp, Mus musculus
agaggtgcaactcgccatcgagcag

SEQ ID NO: 77487 - DNA, 25 bp, Mus musculus
agaggtttctttgcctacccagagg

SEQ ID NO: 77488 - DNA, 25 bp, Mus musculus
agaggttttgcacggtgacgcacca

SEQ ID NO: 77489 - DNA, 25 bp, Mus musculus
agagtaagcagtccagatagccgcc

SEQ ID NO: 77490 - DNA, 25 bp, Mus musculus
agagtagctttcaagcctctctgct

SEQ ID NO: 77491 - DNA, 25 bp, Mus musculus
agagtatcaacaggctgatgcaggc

SEQ ID NO: 77492 - DNA, 25 bp, Mus musculus
agagtatcaataggctgatgcaggc

SEQ ID NO: 77493 - DNA, 25 bp, Mus musculus
agagtatgccccaatcaacaggagg

SEQ ID NO: 77494 - DNA, 25 bp, Mus musculus
agagtattccctcttccctggacag

SEQ ID NO: 77495 - DNA, 25 bp, Mus musculus
agagtcacggtctcgcgtctcggtc

SEQ ID NO: 77496 - DNA, 25 bp, Mus musculus
agagtcatcatcagtcccacagcag

SEQ ID NO: 77497 - DNA, 25 bp, Mus musculus
agagtccccggaaagttgccactgg

SEQ ID NO: 77498 - DNA, 25 bp, Mus musculus
agagtcctatgtaccgaatgcccga

SEQ ID NO: 77499 - DNA, 25 bp, Mus musculus
agagtcgccagcactcacgggctgg

SEQ ID NO: 77500 - DNA, 25 bp, Mus musculus
agagtcgccgcggtttcctgcttca

SEQ ID NO: 77501 - DNA, 25 bp, Mus musculus
agagtgaagggctgagtccacgccc

SEQ ID NO: 77502 - DNA, 25 bp, Mus musculus
agagtgactctattatgagttcggc

SEQ ID NO: 77503 - DNA, 25 bp, Mus musculus
agagtgatctctccggcgcttctcc

SEQ ID NO: 77504 - DNA, 25 bp, Mus musculus
agagtgccgcttcctattaatgaca

SEQ ID NO: 77505 - DNA, 25 bp, Mus musculus
agagtgctgctgaagtcctccacgg

SEQ ID NO: 77506 - DNA, 25 bp, Mus musculus
agagtggaccactcccagaggaagg

SEQ ID NO: 77507 - DNA, 25 bp, Mus musculus
agagtggccgctactattgtctcaa

SEQ ID NO: 77508 - DNA, 25 bp, Mus musculus
agagtggtacgtggccctgaacaag

SEQ ID NO: 77509 - DNA, 25 bp, Mus musculus
agagtgtaataaccctgcgccacag

SEQ ID NO: 77510 - DNA, 25 bp, Mus musculus
agagtgttcagaattcaatcacgca

SEQ ID NO: 77511 - DNA, 25 bp, Mus musculus
agagttatactgacggatatccggc

SEQ ID NO: 77512 - DNA, 25 bp, Mus musculus
agagttatgtgagctcccagcccag

SEQ ID NO: 77513 - DNA, 25 bp, Mus musculus
agagttcaagaagctcgcgctcgca

SEQ ID NO: 77514 - DNA, 25 bp, Mus musculus
agagttctaagcctcctgttccaga

SEQ ID NO: 77515 - DNA, 25 bp, Mus musculus
agagttctacaaagtcaccaccgag

SEQ ID NO: 77516 - DNA, 25 bp, Mus musculus
agagttggcctagctgtgcgcgcac

SEQ ID NO: 77517 - DNA, 25 bp, Mus musculus
agagttggcgttcgagggctgaaag

SEQ ID NO: 77518 - DNA, 25 bp, Mus musculus
agagttgtcctcaagctccacagaa

SEQ ID NO: 77519 - DNA, 25 bp, Mus musculus
agagttgtctatcccatcaaccaga

SEQ ID NO: 77520 - DNA, 25 bp, Mus musculus
agagtttcaccctttgaagctgtta

SEQ ID NO: 77521 - DNA, 25 bp, Mus musculus
agagtttgtggacgcatttctatcg

SEQ ID NO: 77522 - DNA, 25 bp, Mus musculus
agataaaactcagggctctgccacg

SEQ ID NO: 77523 - DNA, 25 bp, Mus musculus
agataagctcttccccgtcgtggag

SEQ ID NO: 77524 - DNA, 25 bp, Mus musculus
agataattgacttagaagtgaagcc

SEQ ID NO: 77525 - DNA, 25 bp, Mus musculus
agatacatcctccagggtcatccag

SEQ ID NO: 77526 - DNA, 25 bp, Mus musculus
agataccggctgagctgctcgctcc

SEQ ID NO: 77527 - DNA, 25 bp, Mus musculus
agatacctagtgctctccaaggccc

SEQ ID NO: 77528 - DNA, 25 bp, Mus musculus
agatagaaatgctttaagttcgctc

SEQ ID NO: 77529 - DNA, 25 bp, Mus musculus
agatagatctcactcattcagggca

SEQ ID NO: 77530 - DNA, 25 bp, Mus musculus
agatagctacctgtctaagtgtggg

SEQ ID NO: 77531 - DNA, 25 bp, Mus musculus
agatagtgagatttatgttaaaagc

SEQ ID NO: 77532 - DNA, 25 bp, Mus musculus
agatatgcgggtaccagtgtcggca

SEQ ID NO: 77533 - DNA, 25 bp, Mus musculus
agatatggagttggctgatgattac

SEQ ID NO: 77534 - DNA, 25 bp, Mus musculus
agatcaaatggcacaggaagcagct

SEQ ID NO: 77535 - DNA, 25 bp, Mus musculus
agatcaaggacatgggctcgtatga

SEQ ID NO: 77536 - DNA, 25 bp, Mus musculus
agatcaaggcgctggaacagatgct

SEQ ID NO: 77537 - DNA, 25 bp, Mus musculus
agatcaccgaggagaagccgctgtt

SEQ ID NO: 77538 - DNA, 25 bp, Mus musculus
agatcacctacctggacggattcga

SEQ ID NO: 77539 - DNA, 25 bp, Mus musculus
agatcacgaagatgttgggcgccga

SEQ ID NO: 77540 - DNA, 25 bp, Mus musculus
agatcactggagactatgcctcggg

SEQ ID NO: 77541 - DNA, 25 bp, Mus musculus
agatcagcgagatccggcagatgtc

SEQ ID NO: 77542 - DNA, 25 bp, Mus musculus
agatcagctactatgaccagctgtg

SEQ ID NO: 77543 - DNA, 25 bp, Mus musculus
agatcagtagacaccggaaggcagg

SEQ ID NO: 77544 - DNA, 25 bp, Mus musculus
agatcatcgcagacgtgtcccagga

SEQ ID NO: 77545 - DNA, 25 bp, Mus musculus
agatcatctaccgacgctacgctgg

SEQ ID NO: 77546 - DNA, 25 bp, Mus musculus
agatcattgctggacgtgccctgcg

SEQ ID NO: 77547 - DNA, 25 bp, Mus musculus
agatccaagctgtcccctctcagag

SEQ ID NO: 77548 - DNA, 25 bp, Mus musculus
agatccatcatgagcttaaccagtt

SEQ ID NO: 77549 - DNA, 25 bp, Mus musculus
agatcccagcagcatccatagccat

SEQ ID NO: 77550 - DNA, 25 bp, Mus musculus
agatcccgcagattctccagctcgg

SEQ ID NO: 77551 - DNA, 25 bp, Mus musculus
agatcccggatcagccctgctggag

SEQ ID NO: 77552 - DNA, 25 bp, Mus musculus
agatcccggcgctacggcgtccgag

SEQ ID NO: 77553 - DNA, 25 bp, Mus musculus
agatccctgcctcggtacagacaca

SEQ ID NO: 77554 - DNA, 25 bp, Mus musculus
agatccgcactcgaagtttcctggg

SEQ ID NO: 77555 - DNA, 25 bp, Mus musculus
agatccgcctcacagacagctgcgt

SEQ ID NO: 77556 - DNA, 25 bp, Mus musculus
agatccggagctgaacaaccaaggg

SEQ ID NO: 77557 - DNA, 25 bp, Mus musculus
agatccggagtcacagctacctgag

SEQ ID NO: 77558 - DNA, 25 bp, Mus musculus
agatccggcagaaggtcgggacctt

SEQ ID NO: 77559 - DNA, 25 bp, Mus musculus
agatcctgacgtggcaggcaccaga

SEQ ID NO: 77560 - DNA, 25 bp, Mus musculus
agatcgaccccactacaaagcggaa

SEQ ID NO: 77561 - DNA, 25 bp, Mus musculus
agatcgactcgaggccttctggaag

SEQ ID NO: 77562 - DNA, 25 bp, Mus musculus
agatcgcagacctgtcacctggaga

SEQ ID NO: 77563 - DNA, 25 bp, Mus musculus
agatcgctgcccagaggcgccctgg

SEQ ID NO: 77564 - DNA, 25 bp, Mus musculus
agatctacctgacggacaacccaga

SEQ ID NO: 77565 - DNA, 25 bp, Mus musculus
agatctatgagaacctgaggccacg

SEQ ID NO: 77566 - DNA, 25 bp, Mus musculus
agatctgggcaatgtccgggctgaa

SEQ ID NO: 77567 - DNA, 25 bp, Mus musculus
agatctgggcgggaactacatcacc

SEQ ID NO: 77568 - DNA, 25 bp, Mus musculus
agatctggtggcacagctccgagct

SEQ ID NO: 77569 - DNA, 25 bp, Mus musculus
agatctgtatgtccgcctcatagat

SEQ ID NO: 77570 - DNA, 25 bp, Mus musculus
agatctgtgacttcgaggaggccca

SEQ ID NO: 77571 - DNA, 25 bp, Mus musculus
agatcttctgcgtctcctgcgggca

SEQ ID NO: 77572 - DNA, 25 bp, Mus musculus
agatctttgacgaggctgccctgga

SEQ ID NO: 77573 - DNA, 25 bp, Mus musculus
agatgaaactgaaacgacggcgtga

SEQ ID NO: 77574 - DNA, 25 bp, Mus musculus
agatgacaggtgcaggccagcacac

SEQ ID NO: 77575 - DNA, 25 bp, Mus musculus
agatgacatccttgtggcctcggca

SEQ ID NO: 77576 - DNA, 25 bp, Mus musculus
agatgaccggatatgtggccacacg

SEQ ID NO: 77577 - DNA, 25 bp, Mus musculus
agatgactgactcgttacctgggca

SEQ ID NO: 77578 - DNA, 25 bp, Mus musculus
agatgacttgattgtgaccccgttt

SEQ ID NO: 77579 - DNA, 25 bp, Mus musculus
agatgagcccacaccgaaacagttc

SEQ ID NO: 77580 - DNA, 25 bp, Mus musculus
agatgatgatgttcgcagccttgca

SEQ ID NO: 77581 - DNA, 25 bp, Mus musculus
agatgatgggctcccggcaagacca

SEQ ID NO: 77582 - DNA, 25 bp, Mus musculus
agatgcagcgcaagcgtcgcgatga

SEQ ID NO: 77583 - DNA, 25 bp, Mus musculus
agatgcagcgccccgcattgcgcag

SEQ ID NO: 77584 - DNA, 25 bp, Mus musculus
agatgccccggtgccaaatggcgaa

SEQ ID NO: 77585 - DNA, 25 bp, Mus musculus
agatgccggagttcctagaggaccc

SEQ ID NO: 77586 - DNA, 25 bp, Mus musculus
agatgcctcaactccttcgagtcca

SEQ ID NO: 77587 - DNA, 25 bp, Mus musculus
agatgcctgtggacaggatcctgga

SEQ ID NO: 77588 - DNA, 25 bp, Mus musculus
agatgcgccacggcttcggtagcga

SEQ ID NO: 77589 - DNA, 25 bp, Mus musculus
agatgcgcggcctcatgctggtctg

SEQ ID NO: 77590 - DNA, 25 bp, Mus musculus
agatgcgggccctgttggaccagct

SEQ ID NO: 77591 - DNA, 25 bp, Mus musculus
agatgctaaagaactggacggcccc

SEQ ID NO: 77592 - DNA, 25 bp, Mus musculus
agatgctaggcctggcccgcagcct

SEQ ID NO: 77593 - DNA, 25 bp, Mus musculus
agatgctgttacgtgtgctggccaa

SEQ ID NO: 77594 - DNA, 25 bp, Mus musculus
agatggagaaagtcccgagccgcct

SEQ ID NO: 77595 - DNA, 25 bp, Mus musculus
agatggagcagcacactagtaaccc

SEQ ID NO: 77596 - DNA, 25 bp, Mus musculus
agatggagggactcccgacattggc

SEQ ID NO: 77597 - DNA, 25 bp, Mus musculus
agatggatggacacctcaacaagga

SEQ ID NO: 77598 - DNA, 25 bp, Mus musculus
agatggcacctatgagttcaacccc

SEQ ID NO: 77599 - DNA, 25 bp, Mus musculus
agatggcagcatacctcctggacag

SEQ ID NO: 77600 - DNA, 25 bp, Mus musculus
agatggccacgaaggagaagctgca

SEQ ID NO: 77601 - DNA, 25 bp, Mus musculus
agatggccgctgaggatagctgacc

SEQ ID NO: 77602 - DNA, 25 bp, Mus musculus
agatggcgtccctgctgcagtcgga

SEQ ID NO: 77603 - DNA, 25 bp, Mus musculus
agatggcgtgcctgttggagacccc

SEQ ID NO: 77604 - DNA, 25 bp, Mus musculus
agatgggacacaggccttccaggaa

SEQ ID NO: 77605 - DNA, 25 bp, Mus musculus
agatgggcagccaccagctttacca

SEQ ID NO: 77606 - DNA, 25 bp, Mus musculus
agatgggcttgaccccgatggccat

SEQ ID NO: 77607 - DNA, 25 bp, Mus musculus
agatggtgctccacggcgccaagta

SEQ ID NO: 77608 - DNA, 25 bp, Mus musculus
agatggtgtgcgtttcagttggaac

SEQ ID NO: 77609 - DNA, 25 bp, Mus musculus
agatgtagaaaacgctcccggtgtc

SEQ ID NO: 77610 - DNA, 25 bp, Mus musculus
agatgtatggcagaggtccttccgc

SEQ ID NO: 77611 - DNA, 25 bp, Mus musculus
agatgtcatcatctccctgctgagc

SEQ ID NO: 77612 - DNA, 25 bp, Mus musculus
agatgtccctggagaatggcacccg

SEQ ID NO: 77613 - DNA, 25 bp, Mus musculus
agatgtccttgctataattcctgcc

SEQ ID NO: 77614 - DNA, 25 bp, Mus musculus
agatgtgaagccaccggtcttaggg

SEQ ID NO: 77615 - DNA, 25 bp, Mus musculus
agatgtgacacacatccccggcggg

SEQ ID NO: 77616 - DNA, 25 bp, Mus musculus
agatgtgggacggaagcctcctact

SEQ ID NO: 77617 - DNA, 25 bp, Mus musculus
agatgttcactcacctctaccagcg

SEQ ID NO: 77618 - DNA, 25 bp, Mus musculus
agatgttccgcagcgacgggaccca

SEQ ID NO: 77619 - DNA, 25 bp, Mus musculus
agatgttgtggttcctgggctgcaa

SEQ ID NO: 77620 - DNA, 25 bp, Mus musculus
agatgtttccaatttaaatagacag

SEQ ID NO: 77621 - DNA, 25 bp, Mus musculus
agattaagaaggtcctgctgctggt

SEQ ID NO: 77622 - DNA, 25 bp, Mus musculus
agattactgatagtggtctcagtag

SEQ ID NO: 77623 - DNA, 25 bp, Mus musculus
agattcacaccatccacgccaatgg

SEQ ID NO: 77624 - DNA, 25 bp, Mus musculus
agattcagtcggtaaccccggcgca

SEQ ID NO: 77625 - DNA, 25 bp, Mus musculus
agattcggagtcgcctggaacacag

SEQ ID NO: 77626 - DNA, 25 bp, Mus musculus
agattctccagctcggctgcacacg

SEQ ID NO: 77627 - DNA, 25 bp, Mus musculus
agattgagttagtcttcaggcccca

SEQ ID NO: 77628 - DNA, 25 bp, Mus musculus
agattgatgcctacagccatgcccg

SEQ ID NO: 77629 - DNA, 25 bp, Mus musculus
agattgcagctgtagtcgctccggc

SEQ ID NO: 77630 - DNA, 25 bp, Mus musculus
agattgcccagacccactactatag

SEQ ID NO: 77631 - DNA, 25 bp, Mus musculus
agattgctcagctgaggaccctgaa

SEQ ID NO: 77632 - DNA, 25 bp, Mus musculus
agattgctcgtatcgcccggaggct

SEQ ID NO: 77633 - DNA, 25 bp, Mus musculus
agattgtagaagaaggaagtatacc

SEQ ID NO: 77634 - DNA, 25 bp, Mus musculus
agattgtgctcatctccgttgctgc

SEQ ID NO: 77635 - DNA, 25 bp, Mus musculus
agattgtggaggagaacgggacagc

SEQ ID NO: 77636 - DNA, 25 bp, Mus musculus
agatttcaggatgaagagcttcctc

SEQ ID NO: 77637 - DNA, 25 bp, Mus musculus
agatttccaggagccggattccccg

SEQ ID NO: 77638 - DNA, 25 bp, Mus musculus
agatttccggaatcctggcccagga

SEQ ID NO: 77639 - DNA, 25 bp, Mus musculus
agatttccggtacttcctgtggcca

SEQ ID NO: 77640 - DNA, 25 bp, Mus musculus
agatttcttaactcgcctgctcacg

SEQ ID NO: 77641 - DNA, 25 bp, Mus musculus
agatttggcccctgttgacgtcgag

SEQ ID NO: 77642 - DNA, 25 bp, Mus musculus
agcaaaaagcgctgatccggcagag

SEQ ID NO: 77643 - DNA, 25 bp, Mus musculus
agcaaaacatcggtcctgggcagca

SEQ ID NO: 77644 - DNA, 25 bp, Mus musculus
agcaaacagaaaggccccacgctga

SEQ ID NO: 77645 - DNA, 25 bp, Mus musculus
agcaaaccgcccaatcgctgctgga

SEQ ID NO: 77646 - DNA, 25 bp, Mus musculus
agcaaactgtgaccaccgggctgaa

SEQ ID NO: 77647 - DNA, 25 bp, Mus musculus
agcaaactgtgcaaagctaaagcag

SEQ ID NO: 77648 - DNA, 25 bp, Mus musculus
agcaaactttgtaggcgcgtctccc

SEQ ID NO: 77649 - DNA, 25 bp, Mus musculus
agcaaagcccctgcatcgctgaaga

SEQ ID NO: 77650 - DNA, 25 bp, Mus musculus
agcaaagcccgtgtgtagagcctcc

SEQ ID NO: 77651 - DNA, 25 bp, Mus musculus
agcaacaagcgatggctccctgctg

SEQ ID NO: 77652 - DNA, 25 bp, Mus musculus
agcaacaatgtatgcgtataaacaa

SEQ ID NO: 77653 - DNA, 25 bp, Mus musculus
agcaacagctggaagagcggaaccg

SEQ ID NO: 77654 - DNA, 25 bp, Mus musculus
agcaaccagggagcagcatctagct

SEQ ID NO: 77655 - DNA, 25 bp, Mus musculus
agcaacgtggactccctgccgggct

SEQ ID NO: 77656 - DNA, 25 bp, Mus musculus
agcaactctagtctgtccggctcct

SEQ ID NO: 77657 - DNA, 25 bp, Mus musculus
agcaactgccatcctaatagactga

SEQ ID NO: 77658 - DNA, 25 bp, Mus musculus
agcaactggctaccccgaaggttcg

SEQ ID NO: 77659 - DNA, 25 bp, Mus musculus
agcaagaaggagtgcctgagctacg

SEQ ID NO: 77660 - DNA, 25 bp, Mus musculus
agcaagaccttggtggatggctacg

SEQ ID NO: 77661 - DNA, 25 bp, Mus musculus
agcaagatgaatggcctcagcaggc

SEQ ID NO: 77662 - DNA, 25 bp, Mus musculus
agcaagcaagccaacgtgtcggaag

SEQ ID NO: 77663 - DNA, 25 bp, Mus musculus
agcaagcacccgctagccaccttca

SEQ ID NO: 77664 - DNA, 25 bp, Mus musculus
agcaagcccttacctgccttcggaa

SEQ ID NO: 77665 - DNA, 25 bp, Mus musculus
agcaagcgggccagagcgtcttccg

SEQ ID NO: 77666 - DNA, 25 bp, Mus musculus
agcaagctttgcaggaggcacggaa

SEQ ID NO: 77667 - DNA, 25 bp, Mus musculus
agcaatacaattggccggacacctt

SEQ ID NO: 77668 - DNA, 25 bp, Mus musculus
agcaatatgtgttcatgacggagcg

SEQ ID NO: 77669 - DNA, 25 bp, Mus musculus
agcaatctagatccacagcccgctg

SEQ ID NO: 77670 - DNA, 25 bp, Mus musculus
agcaatgcctgcgagaagacgtcat

SEQ ID NO: 77671 - DNA, 25 bp, Mus musculus
agcaatttggacaccctgctgtggg

SEQ ID NO: 77672 - DNA, 25 bp, Mus musculus
agcacaaagcggagagacagcaaac

SEQ ID NO: 77673 - DNA, 25 bp, Mus musculus
agcacaacagacagtcttcaccatc

SEQ ID NO: 77674 - DNA, 25 bp, Mus musculus
agcacaagaaactcctggctgcaat

SEQ ID NO: 77675 - DNA, 25 bp, Mus musculus
agcacaagagcgctcatgcgggcac

SEQ ID NO: 77676 - DNA, 25 bp, Mus musculus
agcacacaaaatgggtcaggttggg

SEQ ID NO: 77677 - DNA, 25 bp, Mus musculus
agcacagaacagctgggcccagtat

SEQ ID NO: 77678 - DNA, 25 bp, Mus musculus
agcacagtgggacttcgagcagcaa

SEQ ID NO: 77679 - DNA, 25 bp, Mus musculus
agcacatgctggctgcctctacagg

SEQ ID NO: 77680 - DNA, 25 bp, Mus musculus
agcacattcatggttcagtcaaaga

SEQ ID NO: 77681 - DNA, 25 bp, Mus musculus
agcaccactgacttgctggcccaag

SEQ ID NO: 77682 - DNA, 25 bp, Mus musculus
agcaccatcactagtgtggcgctgt

SEQ ID NO: 77683 - DNA, 25 bp, Mus musculus
agcacccagaaacccttcgcaagat

SEQ ID NO: 77684 - DNA, 25 bp, Mus musculus
agcaccgcaccgtgagacgagaggt

SEQ ID NO: 77685 - DNA, 25 bp, Mus musculus
agcaccttaggtggtgttaacatga

SEQ ID NO: 77686 - DNA, 25 bp, Mus musculus
agcaccttatcgagtgtggcgccca

SEQ ID NO: 77687 - DNA, 25 bp, Mus musculus
agcaccttccatattttatcactgc

SEQ ID NO: 77688 - DNA, 25 bp, Mus musculus
agcacgctacccctcattaagacaa

SEQ ID NO: 77689 - DNA, 25 bp, Mus musculus
agcacggaagctttcctgcctgcca

SEQ ID NO: 77690 - DNA, 25 bp, Mus musculus
agcacggaggagtgcagccgcctac

SEQ ID NO: 77691 - DNA, 25 bp, Mus musculus
agcacgtgacactgtctccacacgg

SEQ ID NO: 77692 - DNA, 25 bp, Mus musculus
agcacgtggcctgtttcctcttgag

SEQ ID NO: 77693 - DNA, 25 bp, Mus musculus
agcactcctgctgttcctactgaaa

SEQ ID NO: 77694 - DNA, 25 bp, Mus musculus
agcactgaaggagcctgcagcgctc

SEQ ID NO: 77695 - DNA, 25 bp, Mus musculus
agcactggtcccaggagaggcgcct

SEQ ID NO: 77696 - DNA, 25 bp, Mus musculus
agcacttacccactctgaacgaacg

SEQ ID NO: 77697 - DNA, 25 bp, Mus musculus
agcacttcgggaaattgccctccag

SEQ ID NO: 77698 - DNA, 25 bp, Mus musculus
agcacttgtctcactttggcatcga

SEQ ID NO: 77699 - DNA, 25 bp, Mus musculus
agcagaagaagccatgtcccgaggc

SEQ ID NO: 77700 - DNA, 25 bp, Mus musculus
agcagaagggccagctgacgagttc

SEQ ID NO: 77701 - DNA, 25 bp, Mus musculus
agcagaatctttgcaggctggttca

SEQ ID NO: 77702 - DNA, 25 bp, Mus musculus
agcagacaggccagtggattggaat

SEQ ID NO: 77703 - DNA, 25 bp, Mus musculus
agcagaccagacagtattaccagga

SEQ ID NO: 77704 - DNA, 25 bp, Mus musculus
agcagacctgcggaaggagtttgca

SEQ ID NO: 77705 - DNA, 25 bp, Mus musculus
agcagactacgaccttcacgggaca

SEQ ID NO: 77706 - DNA, 25 bp, Mus musculus
agcagactctgaacccgacctcaga

SEQ ID NO: 77707 - DNA, 25 bp, Mus musculus
agcagacttaccatctcccagagca

SEQ ID NO: 77708 - DNA, 25 bp, Mus musculus
agcagagagagagccggctgccttt

SEQ ID NO: 77709 - DNA, 25 bp, Mus musculus
agcagagctacccacaggaggtgca

SEQ ID NO: 77710 - DNA, 25 bp, Mus musculus
agcagaggactcacgaggacgctga

SEQ ID NO: 77711 - DNA, 25 bp, Mus musculus
agcagaggcgtcacctgcagaagag

SEQ ID NO: 77712 - DNA, 25 bp, Mus musculus
agcagaggtaaagaagctcatcccc

SEQ ID NO: 77713 - DNA, 25 bp, Mus musculus
agcagagttcagatctgtggagtgt

SEQ ID NO: 77714 - DNA, 25 bp, Mus musculus
agcagatcaaatggcacaggaagca

SEQ ID NO: 77715 - DNA, 25 bp, Mus musculus
agcagatcttccagcttgcgcggga

SEQ ID NO: 77716 - DNA, 25 bp, Mus musculus
agcagatgttctctggaattcccag

SEQ ID NO: 77717 - DNA, 25 bp, Mus musculus
agcagcaactttgagcaggtgatcc

SEQ ID NO: 77718 - DNA, 25 bp, Mus musculus
agcagcaatgatgaggaggacccca

SEQ ID NO: 77719 - DNA, 25 bp, Mus musculus
agcagcagagcaagcccatggagtc

SEQ ID NO: 77720 - DNA, 25 bp, Mus musculus
agcagcagctcatgacccagataag

SEQ ID NO: 77721 - DNA, 25 bp, Mus musculus
agcagcatcagagagaaggaacccc

SEQ ID NO: 77722 - DNA, 25 bp, Mus musculus
agcagcatggctttgcagtgtcaca

SEQ ID NO: 77723 - DNA, 25 bp, Mus musculus
agcagccaattccggcccgaggacg

SEQ ID NO: 77724 - DNA, 25 bp, Mus musculus
agcagccgaatacatgaatcaggat

SEQ ID NO: 77725 - DNA, 25 bp, Mus musculus
agcagccgggcagccatgagactgc

SEQ ID NO: 77726 - DNA, 25 bp, Mus musculus
agcagcctgaatactcggtgagtcg

SEQ ID NO: 77727 - DNA, 25 bp, Mus musculus
agcagccttcaggtccagacaatga

SEQ ID NO: 77728 - DNA, 25 bp, Mus musculus
agcagcgcgtgcgtaaacgaccacg

SEQ ID NO: 77729 - DNA, 25 bp, Mus musculus
agcagcggaggaaagctctctacga

SEQ ID NO: 77730 - DNA, 25 bp, Mus musculus
agcagcggcggtgactgtggcgggc

SEQ ID NO: 77731 - DNA, 25 bp, Mus musculus
agcagctacagcacatgggattccc

SEQ ID NO: 77732 - DNA, 25 bp, Mus musculus
agcagctcagaggattcggacaccg

SEQ ID NO: 77733 - DNA, 25 bp, Mus musculus
agcagctggaattgcagatcctttc

SEQ ID NO: 77734 - DNA, 25 bp, Mus musculus
agcaggaaccccaccgaaacagctg

SEQ ID NO: 77735 - DNA, 25 bp, Mus musculus
agcaggagggatatggaaacaagcc

SEQ ID NO: 77736 - DNA, 25 bp, Mus musculus
agcaggccagcccttcctgtcaagt

SEQ ID NO: 77737 - DNA, 25 bp, Mus musculus
agcaggccgagctgatctcacggca

SEQ ID NO: 77738 - DNA, 25 bp, Mus musculus
agcaggcctttatcaaagccacggg

SEQ ID NO: 77739 - DNA, 25 bp, Mus musculus
agcaggcgcgacgacgactacagcg

SEQ ID NO: 77740 - DNA, 25 bp, Mus musculus
agcagggccccatttctgacaacta

SEQ ID NO: 77741 - DNA, 25 bp, Mus musculus
agcagggcgcaatcttttcttcaaa

SEQ ID NO: 77742 - DNA, 25 bp, Mus musculus
agcaggtaggtgctaaatgctacac

SEQ ID NO: 77743 - DNA, 25 bp, Mus musculus
agcaggtccaccagctgtacgatga

SEQ ID NO: 77744 - DNA, 25 bp, Mus musculus
agcaggtcctgcttcgttatcagca

SEQ ID NO: 77745 - DNA, 25 bp, Mus musculus
agcaggtgagacgactagcctttca

SEQ ID NO: 77746 - DNA, 25 bp, Mus musculus
agcaggtgtgggatatcttctccga

SEQ ID NO: 77747 - DNA, 25 bp, Mus musculus
agcaggttcctgacccatctggacc

SEQ ID NO: 77748 - DNA, 25 bp, Mus musculus
agcaggttggagaccgagctttccg

SEQ ID NO: 77749 - DNA, 25 bp, Mus musculus
agcagtaccgcgagcgcttcattcc

SEQ ID NO: 77750 - DNA, 25 bp, Mus musculus
agcagtcaagtgtccgccgtgaaac

SEQ ID NO: 77751 - DNA, 25 bp, Mus musculus
agcagtcggccatttatcatgcggg

SEQ ID NO: 77752 - DNA, 25 bp, Mus musculus
agcagtctctggtgcggtctcgagc

SEQ ID NO: 77753 - DNA, 25 bp, Mus musculus
agcagtgaccctctgtacgtgccag

SEQ ID NO: 77754 - DNA, 25 bp, Mus musculus
agcagtgcctgctccccggcagaga

SEQ ID NO: 77755 - DNA, 25 bp, Mus musculus
agcagtgctgctgagaccggagacc

SEQ ID NO: 77756 - DNA, 25 bp, Mus musculus
agcagttcagcctcttgtggtacaa

SEQ ID NO: 77757 - DNA, 25 bp, Mus musculus
agcagtttgtgtactcatcgcccca

SEQ ID NO: 77758 - DNA, 25 bp, Mus musculus
agcagtttttactcccagcggctgg

SEQ ID NO: 77759 - DNA, 25 bp, Mus musculus
agcataattggtttgccctgctggg

SEQ ID NO: 77760 - DNA, 25 bp, Mus musculus
agcatagttgcctgctacagtctga

SEQ ID NO: 77761 - DNA, 25 bp, Mus musculus
agcatatggccccaggagatcctgg

SEQ ID NO: 77762 - DNA, 25 bp, Mus musculus
agcatcactggtctcctgcaagagt

SEQ ID NO: 77763 - DNA, 25 bp, Mus musculus
agcatcagacagaccggacggaact

SEQ ID NO: 77764 - DNA, 25 bp, Mus musculus
agcatcatgcacttgaaccacacag

SEQ ID NO: 77765 - DNA, 25 bp, Mus musculus
agcatccaggctcaaagttttcaga

SEQ ID NO: 77766 - DNA, 25 bp, Mus musculus
agcatccctctaccgcttggatctt

SEQ ID NO: 77767 - DNA, 25 bp, Mus musculus
agcatcctttggacccctgaggcct

SEQ ID NO: 77768 - DNA, 25 bp, Mus musculus
agcatcggctgaaacgctaccacag

SEQ ID NO: 77769 - DNA, 25 bp, Mus musculus
agcatcttgggctgtcaggtgcaga

SEQ ID NO: 77770 - DNA, 25 bp, Mus musculus
agcatgaacttcactccgacacgga

SEQ ID NO: 77771 - DNA, 25 bp, Mus musculus
agcatgatccgcaagtccctggaga

SEQ ID NO: 77772 - DNA, 25 bp, Mus musculus
agcatgcagtcaagtcaacgccggc

SEQ ID NO: 77773 - DNA, 25 bp, Mus musculus
agcatgccagctgtgggagcgctct

SEQ ID NO: 77774 - DNA, 25 bp, Mus musculus
agcatgcggtcaacctacagcgacg

SEQ ID NO: 77775 - DNA, 25 bp, Mus musculus
agcatggagaacgtggaggtcttca

SEQ ID NO: 77776 - DNA, 25 bp, Mus musculus
agcatgggtcctcgcccgcggcttc

SEQ ID NO: 77777 - DNA, 25 bp, Mus musculus
agcatggtaccaagaccagtatgcg

SEQ ID NO: 77778 - DNA, 25 bp, Mus musculus
agcatgtgacttctcctgcgcagag

SEQ ID NO: 77779 - DNA, 25 bp, Mus musculus
agcatgtgtccatcctgtcacctgc

SEQ ID NO: 77780 - DNA, 25 bp, Mus musculus
agcatgtttgggagcacaaccacag

SEQ ID NO: 77781 - DNA, 25 bp, Mus musculus
agcattcccatgaccaggaacacgg

SEQ ID NO: 77782 - DNA, 25 bp, Mus musculus
agcattccgtacttccagcagaccg

SEQ ID NO: 77783 - DNA, 25 bp, Mus musculus
agcattctgaggtaaggaggtatcc

SEQ ID NO: 77784 - DNA, 25 bp, Mus musculus
agcattcttctagcggagctggctg

SEQ ID NO: 77785 - DNA, 25 bp, Mus musculus
agcattgagaacacgctgtgggccg

SEQ ID NO: 77786 - DNA, 25 bp, Mus musculus
agcattggattactgggcccggcca

SEQ ID NO: 77787 - DNA, 25 bp, Mus musculus
agcatttcacctttgccctcactga

SEQ ID NO: 77788 - DNA, 25 bp, Mus musculus
agcatttggaagacgggagcgactc

SEQ ID NO: 77789 - DNA, 25 bp, Mus musculus
agcatttgtcaaggcccaaggtcac

SEQ ID NO: 77790 - DNA, 25 bp, Mus musculus
agccaaaccaaacaggaatgccagt

SEQ ID NO: 77791 - DNA, 25 bp, Mus musculus
agccaagagcacagtcagggatatt

SEQ ID NO: 77792 - DNA, 25 bp, Mus musculus
agccaagagcttgcattgatcacag

SEQ ID NO: 77793 - DNA, 25 bp, Mus musculus
agccaagcaagccaaagtcaagctg

SEQ ID NO: 77794 - DNA, 25 bp, Mus musculus
agccaagcctaccagcagaacagct

SEQ ID NO: 77795 - DNA, 25 bp, Mus musculus
agccaagctcaagcggagtccagga

SEQ ID NO: 77796 - DNA, 25 bp, Mus musculus
agccaagctgggtatgcctcagttc

SEQ ID NO: 77797 - DNA, 25 bp, Mus musculus
agccaaggcattcccaggcaaggca

SEQ ID NO: 77798 - DNA, 25 bp, Mus musculus
agccaaggccgctacgaaagcgcag

SEQ ID NO: 77799 - DNA, 25 bp, Mus musculus
agccaatggaacagggaagtcaagc

SEQ ID NO: 77800 - DNA, 25 bp, Mus musculus
agccacacgagaggactgccagaat

SEQ ID NO: 77801 - DNA, 25 bp, Mus musculus
agccacagaagaccatgccagcaac

SEQ ID NO: 77802 - DNA, 25 bp, Mus musculus
agccaccagggaccgggagatctac

SEQ ID NO: 77803 - DNA, 25 bp, Mus musculus
agccacccaggtgttccgagaacag

SEQ ID NO: 77804 - DNA, 25 bp, Mus musculus
agccacctaacaaagttcttcagga

SEQ ID NO: 77805 - DNA, 25 bp, Mus musculus
agccagaggaaaaggcccaaccacg

SEQ ID NO: 77806 - DNA, 25 bp, Mus musculus
agccagagttgtttatgccagtgcc

SEQ ID NO: 77807 - DNA, 25 bp, Mus musculus
agccagatatggtagttcacacctg

SEQ ID NO: 77808 - DNA, 25 bp, Mus musculus
agccagccctacgcggtgttgcgga

SEQ ID NO: 77809 - DNA, 25 bp, Mus musculus
agccagcgacgcctgagctagtcga

SEQ ID NO: 77810 - DNA, 25 bp, Mus musculus
agccagcgctgcacatttgccggtc

SEQ ID NO: 77811 - DNA, 25 bp, Mus musculus
agccagggaaacatactgagacctt

SEQ ID NO: 77812 - DNA, 25 bp, Mus musculus
agccagtacctggacgagacgtgca

SEQ ID NO: 77813 - DNA, 25 bp, Mus musculus
agccagtcgctagctctgggcactg

SEQ ID NO: 77814 - DNA, 25 bp, Mus musculus
agccatcagatccagcagcggttcg

SEQ ID NO: 77815 - DNA, 25 bp, Mus musculus
agccatcgagagagccaagcaggtc

SEQ ID NO: 77816 - DNA, 25 bp, Mus musculus
agccatcgtgttctccagcgcgaac

SEQ ID NO: 77817 - DNA, 25 bp, Mus musculus
agccatgacgagcactctggacctg

SEQ ID NO: 77818 - DNA, 25 bp, Mus musculus
agccatgcacagactgtggttcttt

SEQ ID NO: 77819 - DNA, 25 bp, Mus musculus
agccatggtctggagattcacgcca

SEQ ID NO: 77820 - DNA, 25 bp, Mus musculus
agccatgtatgtaggtcacagtttg

SEQ ID NO: 77821 - DNA, 25 bp, Mus musculus
agccatttctgcctcgaccagggca

SEQ ID NO: 77822 - DNA, 25 bp, Mus musculus
agcccaagcgagtggccttaacaca

SEQ ID NO: 77823 - DNA, 25 bp, Mus musculus
agcccacagcagacgagctgcgctt

SEQ ID NO: 77824 - DNA, 25 bp, Mus musculus
agcccaggcctagaaaccttggtgt

SEQ ID NO: 77825 - DNA, 25 bp, Mus musculus
agcccagtgactgcggccgaagaac

SEQ ID NO: 77826 - DNA, 25 bp, Mus musculus
agcccagtgcctagtgtctgtaccg

SEQ ID NO: 77827 - DNA, 25 bp, Mus musculus
agcccatagtacctcccaggaagcg

SEQ ID NO: 77828 - DNA, 25 bp, Mus musculus
agcccatccacttggacagtgcaca

SEQ ID NO: 77829 - DNA, 25 bp, Mus musculus
agcccatgagagaaatcacactgga

SEQ ID NO: 77830 - DNA, 25 bp, Mus musculus
agcccatgtggatgtgaagtttcaa

SEQ ID NO: 77831 - DNA, 25 bp, Mus musculus
agccccgaggacgaagcacatatct

SEQ ID NO: 77832 - DNA, 25 bp, Mus musculus
agcccctgccgtggtattgcatgga

SEQ ID NO: 77833 - DNA, 25 bp, Mus musculus
agccccttctttgtagcacttctag

SEQ ID NO: 77834 - DNA, 25 bp, Mus musculus
agcccgatccagagtccgcgcatgg

SEQ ID NO: 77835 - DNA, 25 bp, Mus musculus
agcccgccccggcagtagcgaagat

SEQ ID NO: 77836 - DNA, 25 bp, Mus musculus
agcccgccggctcagttctctatga

SEQ ID NO: 77837 - DNA, 25 bp, Mus musculus
agcccgcctcccacagaatccacag

SEQ ID NO: 77838 - DNA, 25 bp, Mus musculus
agcccgcgaagaagacgaggaccga

SEQ ID NO: 77839 - DNA, 25 bp, Mus musculus
agcccgcgggaacagctcagaaaaa

SEQ ID NO: 77840 - DNA, 25 bp, Mus musculus
agcccgctggcgtctaataggtctg

SEQ ID NO: 77841 - DNA, 25 bp, Mus musculus
agcccgggaatggactagaaccaag

SEQ ID NO: 77842 - DNA, 25 bp, Mus musculus
agcccgggcacctcagcttgcgggt

SEQ ID NO: 77843 - DNA, 25 bp, Mus musculus
agcccgtgatctcacgcattttggg

SEQ ID NO: 77844 - DNA, 25 bp, Mus musculus
agccctacgcggtgttgcggaggca

SEQ ID NO: 77845 - DNA, 25 bp, Mus musculus
agccctagctctccctattctgtgg

SEQ ID NO: 77846 - DNA, 25 bp, Mus musculus
agccctaggttctatccatatcaca

SEQ ID NO: 77847 - DNA, 25 bp, Mus musculus
agccctcaggcatcacgtgcggaga

SEQ ID NO: 77848 - DNA, 25 bp, Mus musculus
agccctcgcttctggaatacttaag

SEQ ID NO: 77849 - DNA, 25 bp, Mus musculus
agccctcggagggactgctggaccg

SEQ ID NO: 77850 - DNA, 25 bp, Mus musculus
agccctcgtgtgcgcgggacccagc

SEQ ID NO: 77851 - DNA, 25 bp, Mus musculus
agccctcttggcaaggcctgggcct

SEQ ID NO: 77852 - DNA, 25 bp, Mus musculus
agccctgggccaacaaacgtgtgga

SEQ ID NO: 77853 - DNA, 25 bp, Mus musculus
agccctgggtaaccacggcctcgag

SEQ ID NO: 77854 - DNA, 25 bp, Mus musculus
agccctgtccacctgatttctgaag

SEQ ID NO: 77855 - DNA, 25 bp, Mus musculus
agccctgtgcggactgttctacctg

SEQ ID NO: 77856 - DNA, 25 bp, Mus musculus
agcccttcattctgagctgtaggcc

SEQ ID NO: 77857 - DNA, 25 bp, Mus musculus
agcccttctggagcaatgcctggaa

SEQ ID NO: 77858 - DNA, 25 bp, Mus musculus
agccctttgccatgaaccactcagc

SEQ ID NO: 77859 - DNA, 25 bp, Mus musculus
agccgaagcagccaggacaccatgc

SEQ ID NO: 77860 - DNA, 25 bp, Mus musculus
agccgatactccttggtgcccgtgg

SEQ ID NO: 77861 - DNA, 25 bp, Mus musculus
agccgccagcgccaagaatcttctt

SEQ ID NO: 77862 - DNA, 25 bp, Mus musculus
agccgcgggctgaaggctcccttgt

SEQ ID NO: 77863 - DNA, 25 bp, Mus musculus
agccgcgtcagagctcgcttgctgg

SEQ ID NO: 77864 - DNA, 25 bp, Mus musculus
agccgctccaaagatcgtggccaga

SEQ ID NO: 77865 - DNA, 25 bp, Mus musculus
agccggagcggcctcggcgtacaca

SEQ ID NO: 77866 - DNA, 25 bp, Mus musculus
agccggagtcagtccatggatgcca

SEQ ID NO: 77867 - DNA, 25 bp, Mus musculus
agccggatctcgatgacaatgagga

SEQ ID NO: 77868 - DNA, 25 bp, Mus musculus
agccggcagcctggttggtcgcttc

SEQ ID NO: 77869 - DNA, 25 bp, Mus musculus
agccggcttcgaggtgtgtccctgc

SEQ ID NO: 77870 - DNA, 25 bp, Mus musculus
agccgggacgctgtgaaagactttg

SEQ ID NO: 77871 - DNA, 25 bp, Mus musculus
agccgggcggcaaagcttgatgccc

SEQ ID NO: 77872 - DNA, 25 bp, Mus musculus
agccggtctgggtctcgtagtccat

SEQ ID NO: 77873 - DNA, 25 bp, Mus musculus
agccggtgtgtagtcctgtgcccga

SEQ ID NO: 77874 - DNA, 25 bp, Mus musculus
agccgtatcctaacacactgtgcag

SEQ ID NO: 77875 - DNA, 25 bp, Mus musculus
agccgtcaatgcctttgtgctccca

SEQ ID NO: 77876 - DNA, 25 bp, Mus musculus
agccgtgacccctctgtctgctgta

SEQ ID NO: 77877 - DNA, 25 bp, Mus musculus
agccgtgcagtccttcatcgccaag

SEQ ID NO: 77878 - DNA, 25 bp, Mus musculus
agccgtggcagcaatggcccttgaa

SEQ ID NO: 77879 - DNA, 25 bp, Mus musculus
agccgtggctcctaggactccttgc

SEQ ID NO: 77880 - DNA, 25 bp, Mus musculus
agccgttatccaggattctaccatc

SEQ ID NO: 77881 - DNA, 25 bp, Mus musculus
agcctaccaaatctggagccaggag

SEQ ID NO: 77882 - DNA, 25 bp, Mus musculus
agcctacgggacactggctctcaag

SEQ ID NO: 77883 - DNA, 25 bp, Mus musculus
agcctagaaagaaggatccttcgtc

SEQ ID NO: 77884 - DNA, 25 bp, Mus musculus
agcctaggcccagtgagactcctga

SEQ ID NO: 77885 - DNA, 25 bp, Mus musculus
agcctcatcaagtacttcctcttcg

SEQ ID NO: 77886 - DNA, 25 bp, Mus musculus
agcctccggcgctcgactgctggtg

SEQ ID NO: 77887 - DNA, 25 bp, Mus musculus
agcctcctcctgagatggctggaca

SEQ ID NO: 77888 - DNA, 25 bp, Mus musculus
agcctcgagtccacgcgggacgcag

SEQ ID NO: 77889 - DNA, 25 bp, Mus musculus
agcctcgcacggttttgaagccacg

SEQ ID NO: 77890 - DNA, 25 bp, Mus musculus
agcctcggaggcttcacctcgtggt

SEQ ID NO: 77891 - DNA, 25 bp, Mus musculus
agcctcggatccggctgcagaaagg

SEQ ID NO: 77892 - DNA, 25 bp, Mus musculus
agcctcgtccggtgcaggactgcgc

SEQ ID NO: 77893 - DNA, 25 bp, Mus musculus
agcctgaggatcccatgttcctgat

SEQ ID NO: 77894 - DNA, 25 bp, Mus musculus
agcctgaggctgcacgactccgttt

SEQ ID NO: 77895 - DNA, 25 bp, Mus musculus
agcctgcagcgatccagtctctggc

SEQ ID NO: 77896 - DNA, 25 bp, Mus musculus
agcctgcaggcatgggattgaatcc

SEQ ID NO: 77897 - DNA, 25 bp, Mus musculus
agcctgcccggactctgtggtacga

SEQ ID NO: 77898 - DNA, 25 bp, Mus musculus
agcctgcctgtcaagcattagtgac

SEQ ID NO: 77899 - DNA, 25 bp, Mus musculus
agcctggcagagcacttgtctcact

SEQ ID NO: 77900 - DNA, 25 bp, Mus musculus
agcctggcccgggtcgaatcacgtg

SEQ ID NO: 77901 - DNA, 25 bp, Mus musculus
agcctggtgcaactctcatcttcgg

SEQ ID NO: 77902 - DNA, 25 bp, Mus musculus
agcctgtgaagaagcgtagccgaaa

SEQ ID NO: 77903 - DNA, 25 bp, Mus musculus
agcctgtgatggagcagtgtcccag

SEQ ID NO: 77904 - DNA, 25 bp, Mus musculus
agcctgttggtctcgaacactcaac

SEQ ID NO: 77905 - DNA, 25 bp, Mus musculus
agccttcacgcccaggcatctttgg

SEQ ID NO: 77906 - DNA, 25 bp, Mus musculus
agccttgcgagcgcgcctaacggag

SEQ ID NO: 77907 - DNA, 25 bp, Mus musculus
agcctttggtccagcatgtgccgca

SEQ ID NO: 77908 - DNA, 25 bp, Mus musculus
agcgaacgagcaagccagcgagtga

SEQ ID NO: 77909 - DNA, 25 bp, Mus musculus
agcgaacgctgagccctggctatat

SEQ ID NO: 77910 - DNA, 25 bp, Mus musculus
agcgacaagagagcggcgctccagc

SEQ ID NO: 77911 - DNA, 25 bp, Mus musculus
agcgacgatgccatcttcacatggc

SEQ ID NO: 77912 - DNA, 25 bp, Mus musculus
agcgagacgagaaggaccggcaaca

SEQ ID NO: 77913 - DNA, 25 bp, Mus musculus
agcgagagctcaccctgaaggagaa

SEQ ID NO: 77914 - DNA, 25 bp, Mus musculus
agcgagcaggccacggtggcttccc

SEQ ID NO: 77915 - DNA, 25 bp, Mus musculus
agcgagcccggacggtgcccctagg

SEQ ID NO: 77916 - DNA, 25 bp, Mus musculus
agcgagccgcctttcagacacaaag

SEQ ID NO: 77917 - DNA, 25 bp, Mus musculus
agcgagctgcccgatgagattgaca

SEQ ID NO: 77918 - DNA, 25 bp, Mus musculus
agcgaggatggcacggatatgacaa

SEQ ID NO: 77919 - DNA, 25 bp, Mus musculus
agcgaggctgcccaaaaagcagtca

SEQ ID NO: 77920 - DNA, 25 bp, Mus musculus
agcgaggtcctagctctgcgggtcc

SEQ ID NO: 77921 - DNA, 25 bp, Mus musculus
agcgaggtcgcgcaggcgcagacgg

SEQ ID NO: 77922 - DNA, 25 bp, Mus musculus
agcgatacttggtgttcattaacaa

SEQ ID NO: 77923 - DNA, 25 bp, Mus musculus
agcgattcagagagcgccagagaac

SEQ ID NO: 77924 - DNA, 25 bp, Mus musculus
agcgcaagctggagtattacctgta

SEQ ID NO: 77925 - DNA, 25 bp, Mus musculus
agcgcactggtgcacctgagactgc

SEQ ID NO: 77926 - DNA, 25 bp, Mus musculus
agcgcagctgttttcccgacgggaa

SEQ ID NO: 77927 - DNA, 25 bp, Mus musculus
agcgcatagctaagagaaggtcacc

SEQ ID NO: 77928 - DNA, 25 bp, Mus musculus
agcgcattctcgcttcccgggcagg

SEQ ID NO: 77929 - DNA, 25 bp, Mus musculus
agcgccatcgatccccaaggagaat

SEQ ID NO: 77930 - DNA, 25 bp, Mus musculus
agcgccatttctgggtgggactgct

SEQ ID NO: 77931 - DNA, 25 bp, Mus musculus
agcgcccactgcctaacggagagac

SEQ ID NO: 77932 - DNA, 25 bp, Mus musculus
agcgcctacttcgagctgccagaga

SEQ ID NO: 77933 - DNA, 25 bp, Mus musculus
agcgcctgcgcgttgtaggtttcgg

SEQ ID NO: 77934 - DNA, 25 bp, Mus musculus
agcgcctttctagccaagctgatga

SEQ ID NO: 77935 - DNA, 25 bp, Mus musculus
agcgcgatccgctgtgaccaagaga

SEQ ID NO: 77936 - DNA, 25 bp, Mus musculus
agcgcgcgaagacacaggagcatac

SEQ ID NO: 77937 - DNA, 25 bp, Mus musculus
agcgcgcgcgggtcgtttcagccac

SEQ ID NO: 77938 - DNA, 25 bp, Mus musculus
agcgcggtccgcacgaccgggaatt

SEQ ID NO: 77939 - DNA, 25 bp, Mus musculus
agcgctacagcctcatccgggaatt

SEQ ID NO: 77940 - DNA, 25 bp, Mus musculus
agcgctagcgctcggcaactttgaa

SEQ ID NO: 77941 - DNA, 25 bp, Mus musculus
agcgctatctcaacctgttcattga

SEQ ID NO: 77942 - DNA, 25 bp, Mus musculus
agcgctatgaggacggcatgactgt

SEQ ID NO: 77943 - DNA, 25 bp, Mus musculus
agcgctcggaggcttagctgacaaa

SEQ ID NO: 77944 - DNA, 25 bp, Mus musculus
agcgctcgggctgcttgctggaaac

SEQ ID NO: 77945 - DNA, 25 bp, Mus musculus
agcgctctagcctgatgcagccaat

SEQ ID NO: 77946 - DNA, 25 bp, Mus musculus
agcgctgcacatttgccggtccggg

SEQ ID NO: 77947 - DNA, 25 bp, Mus musculus
agcgctgccgccgtgtcctttacga

SEQ ID NO: 77948 - DNA, 25 bp, Mus musculus
agcgctggcaaatcggtgggaccca

SEQ ID NO: 77949 - DNA, 25 bp, Mus musculus
agcgcttcctgtttagactctggga

SEQ ID NO: 77950 - DNA, 25 bp, Mus musculus
agcgctttacgttaacagcgctcgg

SEQ ID NO: 77951 - DNA, 25 bp, Mus musculus
agcggaagaacctggctgccattca

SEQ ID NO: 77952 - DNA, 25 bp, Mus musculus
agcggaagctcatgatgatgtttac

SEQ ID NO: 77953 - DNA, 25 bp, Mus musculus
agcggacgccgcactgttttcagag

SEQ ID NO: 77954 - DNA, 25 bp, Mus musculus
agcggactctctagcccttgtgggt

SEQ ID NO: 77955 - DNA, 25 bp, Mus musculus
agcggactgagtgtgctgagacccc

SEQ ID NO: 77956 - DNA, 25 bp, Mus musculus
agcggagcctgtacgaccagtatgg

SEQ ID NO: 77957 - DNA, 25 bp, Mus musculus
agcggagtcgtcaccagtacggacc

SEQ ID NO: 77958 - DNA, 25 bp, Mus musculus
agcggcaagagtgagatttctgagc

SEQ ID NO: 77959 - DNA, 25 bp, Mus musculus
agcggcacgtgaggaacatccacaa

SEQ ID NO: 77960 - DNA, 25 bp, Mus musculus
agcggcacttcagtggcgcgctcag

SEQ ID NO: 77961 - DNA, 25 bp, Mus musculus
agcggccgccatttcagggagctag

SEQ ID NO: 77962 - DNA, 25 bp, Mus musculus
agcggcctcggcgtacacagcccgc

SEQ ID NO: 77963 - DNA, 25 bp, Mus musculus
agcggcggcgtattcattgctggaa

SEQ ID NO: 77964 - DNA, 25 bp, Mus musculus
agcggcggtgactgtggcgggcgct

SEQ ID NO: 77965 - DNA, 25 bp, Mus musculus
agcgggaacaccgagaacgaagcca

SEQ ID NO: 77966 - DNA, 25 bp, Mus musculus
agcgggaacacctcgccgcctggtt

SEQ ID NO: 77967 - DNA, 25 bp, Mus musculus
agcgggagaatcttggtgtcgctca

SEQ ID NO: 77968 - DNA, 25 bp, Mus musculus
agcgggagcaacctcggcgcaaaca

SEQ ID NO: 77969 - DNA, 25 bp, Mus musculus
agcgggatgccaccatttggtccaa

SEQ ID NO: 77970 - DNA, 25 bp, Mus musculus
agcgggccagcttctgcatgcacaa

SEQ ID NO: 77971 - DNA, 25 bp, Mus musculus
agcgggcgggcggccattttgtgaa

SEQ ID NO: 77972 - DNA, 25 bp, Mus musculus
agcgggtcctcgcttaacgcacacg

SEQ ID NO: 77973 - DNA, 25 bp, Mus musculus
agcggtgccagcagctgcgctctga

SEQ ID NO: 77974 - DNA, 25 bp, Mus musculus
agcggttgacttgtgtgcagcccca

SEQ ID NO: 77975 - DNA, 25 bp, Mus musculus
agcggttgtaggagacgatgattac

SEQ ID NO: 77976 - DNA, 25 bp, Mus musculus
agcgtagcaaggacaaggaccgaga

SEQ ID NO: 77977 - DNA, 25 bp, Mus musculus
agcgtattgacgcaatactctttct

SEQ ID NO: 77978 - DNA, 25 bp, Mus musculus
agcgtcatggatgcctgtcagtaga

SEQ ID NO: 77979 - DNA, 25 bp, Mus musculus
agcgtctaccggattccgccgcggg

SEQ ID NO: 77980 - DNA, 25 bp, Mus musculus
agcgtctcactcaaccccgcagatt

SEQ ID NO: 77981 - DNA, 25 bp, Mus musculus
agcgtctcagacaataccctagtgg

SEQ ID NO: 77982 - DNA, 25 bp, Mus musculus
agcgtcttttagaaggactgccagg

SEQ ID NO: 77983 - DNA, 25 bp, Mus musculus
agcgtgcgccccttcgagtttgaga

SEQ ID NO: 77984 - DNA, 25 bp, Mus musculus
agcgtgctcgagtgggacttgcacc

SEQ ID NO: 77985 - DNA, 25 bp, Mus musculus
agcgtgctgcaggacttactgaggg

SEQ ID NO: 77986 - DNA, 25 bp, Mus musculus
agcgtggatgccatgacaacattca

SEQ ID NO: 77987 - DNA, 25 bp, Mus musculus
agcgtggctgccagttaacactcac

SEQ ID NO: 77988 - DNA, 25 bp, Mus musculus
agcgtgttaccatctccttctgaga

SEQ ID NO: 77989 - DNA, 25 bp, Mus musculus
agcgttcagtgtgccggtaacccga

SEQ ID NO: 77990 - DNA, 25 bp, Mus musculus
agcgttccatgttcggtggccccag

SEQ ID NO: 77991 - DNA, 25 bp, Mus musculus
agcgttccgcgacccttctgtgtgc

SEQ ID NO: 77992 - DNA, 25 bp, Mus musculus
agcgttgggaaccacggctgttaca

SEQ ID NO: 77993 - DNA, 25 bp, Mus musculus
agcgtttccccaccagcatgattgg

SEQ ID NO: 77994 - DNA, 25 bp, Mus musculus
agctacaagcgaaaaatgggaaggg

SEQ ID NO: 77995 - DNA, 25 bp, Mus musculus
agctacacatatgggcctgggcaca

SEQ ID NO: 77996 - DNA, 25 bp, Mus musculus
agctacagcagatcaaatggcacag

SEQ ID NO: 77997 - DNA, 25 bp, Mus musculus
agctaccagtggtgttggaacagca

SEQ ID NO: 77998 - DNA, 25 bp, Mus musculus
agctaccccagtggttcctgtccag

SEQ ID NO: 77999 - DNA, 25 bp, Mus musculus
agctacctgaacatcgtgggcctgg

SEQ ID NO: 78000 - DNA, 25 bp, Mus musculus
agctacctggagcagatcgagaaag

SEQ ID NO: 78001 - DNA, 25 bp, Mus musculus
agctactgatgagaccccatgcctg

SEQ ID NO: 78002 - DNA, 25 bp, Mus musculus
agctacttacaaccaggctgcccag

SEQ ID NO: 78003 - DNA, 25 bp, Mus musculus
agctacttgctgactccgatcggtg

SEQ ID NO: 78004 - DNA, 25 bp, Mus musculus
agctagacccagagggagtggcctt

SEQ ID NO: 78005 - DNA, 25 bp, Mus musculus
agctagaggcacaggcccagcacat

SEQ ID NO: 78006 - DNA, 25 bp, Mus musculus
agctagcccctcttcgcaagttgag

SEQ ID NO: 78007 - DNA, 25 bp, Mus musculus
agctagctcgggagagcagccatca

SEQ ID NO: 78008 - DNA, 25 bp, Mus musculus
agctagcttatgctgttcgaggcaa

SEQ ID NO: 78009 - DNA, 25 bp, Mus musculus
agctagctttgtggctgtggacacg

SEQ ID NO: 78010 - DNA, 25 bp, Mus musculus
agctagtgctgctcaacccgtacgc

SEQ ID NO: 78011 - DNA, 25 bp, Mus musculus
agctatagctactgttacgtgggaa

SEQ ID NO: 78012 - DNA, 25 bp, Mus musculus
agctatgaagttccggaatttgtgt

SEQ ID NO: 78013 - DNA, 25 bp, Mus musculus
agctatggctactcacggtcgcggt

SEQ ID NO: 78014 - DNA, 25 bp, Mus musculus
agctatttggccgtgcagacccata

SEQ ID NO: 78015 - DNA, 25 bp, Mus musculus
agctcacactggatgctctgctgga

SEQ ID NO: 78016 - DNA, 25 bp, Mus musculus
agctcacgtgtgtgctgggctctca

SEQ ID NO: 78017 - DNA, 25 bp, Mus musculus
agctcagcatggtggagttcgcccc

SEQ ID NO: 78018 - DNA, 25 bp, Mus musculus
agctcatagcgaagaacgacgtgcg

SEQ ID NO: 78019 - DNA, 25 bp, Mus musculus
agctcatgctgctctggacctcgtc

SEQ ID NO: 78020 - DNA, 25 bp, Mus musculus
agctcattgcgtctgtggccggctc

SEQ ID NO: 78021 - DNA, 25 bp, Mus musculus
agctccagagtgcaggtccagaatg

SEQ ID NO: 78022 - DNA, 25 bp, Mus musculus
agctccagtcccgaagccggagaag

SEQ ID NO: 78023 - DNA, 25 bp, Mus musculus
agctccatgcatggcggcaccgaat

SEQ ID NO: 78024 - DNA, 25 bp, Mus musculus
agctcccgcctgagctgctcgtgga

SEQ ID NO: 78025 - DNA, 25 bp, Mus musculus
agctcccggtgtacgagtggcccga

SEQ ID NO: 78026 - DNA, 25 bp, Mus musculus
agctccgggtcatttcgtgcctcca

SEQ ID NO: 78027 - DNA, 25 bp, Mus musculus
agctcctgatccaccagccggagga

SEQ ID NO: 78028 - DNA, 25 bp, Mus musculus
agctcctggagtggcaccgcgcgaa

SEQ ID NO: 78029 - DNA, 25 bp, Mus musculus
agctcgaggctagaccatcatggga

SEQ ID NO: 78030 - DNA, 25 bp, Mus musculus
agctcgagtggcagaaatacgcaga

SEQ ID NO: 78031 - DNA, 25 bp, Mus musculus
agctcgcccgtctcttgcacagtgt

SEQ ID NO: 78032 - DNA, 25 bp, Mus musculus
agctcgcgtctgtgctctcgcatct

SEQ ID NO: 78033 - DNA, 25 bp, Mus musculus
agctcggctggagacacctgggctt

SEQ ID NO: 78034 - DNA, 25 bp, Mus musculus
agctcgttgccccagatctcctggg

SEQ ID NO: 78035 - DNA, 25 bp, Mus musculus
agctctacaaagagttcaaaggaga

SEQ ID NO: 78036 - DNA, 25 bp, Mus musculus
agctctagcgggtgcgagcttccct

SEQ ID NO: 78037 - DNA, 25 bp, Mus musculus
agctctatgtgtaccgcctgaaccg

SEQ ID NO: 78038 - DNA, 25 bp, Mus musculus
agctctcaacctacgacaactcaga

SEQ ID NO: 78039 - DNA, 25 bp, Mus musculus
agctctcagcagacccgcacatggg

SEQ ID NO: 78040 - DNA, 25 bp, Mus musculus
agctctccggaagaaggctcttgaa

SEQ ID NO: 78041 - DNA, 25 bp, Mus musculus
agctctgaaagggggaagctccctc

SEQ ID NO: 78042 - DNA, 25 bp, Mus musculus
agctctggacaaagtattccgacca

SEQ ID NO: 78043 - DNA, 25 bp, Mus musculus
agctctgtcatcttcgtgctggtgg

SEQ ID NO: 78044 - DNA, 25 bp, Mus musculus
agctctgtgcagtggctcgatagca

SEQ ID NO: 78045 - DNA, 25 bp, Mus musculus
agctctgtgtcgtggccgtactgcc

SEQ ID NO: 78046 - DNA, 25 bp, Mus musculus
agctcttactggcagatggcgcagc

SEQ ID NO: 78047 - DNA, 25 bp, Mus musculus
agctcttgttagaccctcatcctga

SEQ ID NO: 78048 - DNA, 25 bp, Mus musculus
agctgaaactgaaggcccgctaggg

SEQ ID NO: 78049 - DNA, 25 bp, Mus musculus
agctgaagcacaccacatccggttc

SEQ ID NO: 78050 - DNA, 25 bp, Mus musculus
agctgaagtcggcttttgaggaaac

SEQ ID NO: 78051 - DNA, 25 bp, Mus musculus
agctgacataggtgagtgctggccc

SEQ ID NO: 78052 - DNA, 25 bp, Mus musculus
agctgaccagccctttgagaatgga

SEQ ID NO: 78053 - DNA, 25 bp, Mus musculus
agctgacgtgatgagactccacagc

SEQ ID NO: 78054 - DNA, 25 bp, Mus musculus
agctgagagtgccttcctgagaaga

SEQ ID NO: 78055 - DNA, 25 bp, Mus musculus
agctgagcatcatcttacttgccaa

SEQ ID NO: 78056 - DNA, 25 bp, Mus musculus
agctgagcgcggaagccccacggca

SEQ ID NO: 78057 - DNA, 25 bp, Mus musculus
agctgatccgctgtatcgtggagta

SEQ ID NO: 78058 - DNA, 25 bp, Mus musculus
agctgatcggcatccctttccctaa

SEQ ID NO: 78059 - DNA, 25 bp, Mus musculus
agctgattgagctcaccgaggccag

SEQ ID NO: 78060 - DNA, 25 bp, Mus musculus
agctgcaagccgatggcgatgctcc

SEQ ID NO: 78061 - DNA, 25 bp, Mus musculus
agctgcagcagacgcagcaaccaga

SEQ ID NO: 78062 - DNA, 25 bp, Mus musculus
agctgcagtccgatgctcagcagct

SEQ ID NO: 78063 - DNA, 25 bp, Mus musculus
agctgccaactgaatcgccacctag

SEQ ID NO: 78064 - DNA, 25 bp, Mus musculus
agctgccgcctgaacatggactctg

SEQ ID NO: 78065 - DNA, 25 bp, Mus musculus
agctgcgagcgggaggaaagcctgc

SEQ ID NO: 78066 - DNA, 25 bp, Mus musculus
agctgcgctagcaccaggcacagca

SEQ ID NO: 78067 - DNA, 25 bp, Mus musculus
agctgcggacggtttgcccgagccc

SEQ ID NO: 78068 - DNA, 25 bp, Mus musculus
agctgcggctcagcgttaaggccaa

SEQ ID NO: 78069 - DNA, 25 bp, Mus musculus
agctgctcatgacccacggtgtgct

SEQ ID NO: 78070 - DNA, 25 bp, Mus musculus
agctgctgacctctatggattttca

SEQ ID NO: 78071 - DNA, 25 bp, Mus musculus
agctgctggccctcacattatggaa

SEQ ID NO: 78072 - DNA, 25 bp, Mus musculus
agctgcttgcactgtatgggtacga

SEQ ID NO: 78073 - DNA, 25 bp, Mus musculus
agctggacgggcagtctgtgaaggc

SEQ ID NO: 78074 - DNA, 25 bp, Mus musculus
agctggagagccgagacctgatcct

SEQ ID NO: 78075 - DNA, 25 bp, Mus musculus
agctggaggaggattgctttgctca

SEQ ID NO: 78076 - DNA, 25 bp, Mus musculus
agctggagtcgcctttgaagttgtc

SEQ ID NO: 78077 - DNA, 25 bp, Mus musculus
agctggatcctgaggaagaagaatc

SEQ ID NO: 78078 - DNA, 25 bp, Mus musculus
agctggatgagctcaagcgacagga

SEQ ID NO: 78079 - DNA, 25 bp, Mus musculus
agctggcgccactgcaatgtcaagg

SEQ ID NO: 78080 - DNA, 25 bp, Mus musculus
agctgggaactaactgcacatggcc

SEQ ID NO: 78081 - DNA, 25 bp, Mus musculus
agctgggaagcctcaagtccaactc

SEQ ID NO: 78082 - DNA, 25 bp, Mus musculus
agctgggacagccacgtgacccacg

SEQ ID NO: 78083 - DNA, 25 bp, Mus musculus
agctgggcatgctgctggacctgca

SEQ ID NO: 78084 - DNA, 25 bp, Mus musculus
agctgggtccagtggcggaggagac

SEQ ID NO: 78085 - DNA, 25 bp, Mus musculus
agctgggtcccaagctagcacacct

SEQ ID NO: 78086 - DNA, 25 bp, Mus musculus
agctgggtgcctgaaggagccggga

SEQ ID NO: 78087 - DNA, 25 bp, Mus musculus
agctgggtgtccgtactcctctggg

SEQ ID NO: 78088 - DNA, 25 bp, Mus musculus
agctgggtgtggatactatcgccaa

SEQ ID NO: 78089 - DNA, 25 bp, Mus musculus
agctggtcctagagcacttcctgca

SEQ ID NO: 78090 - DNA, 25 bp, Mus musculus
agctggtcctccctgtgctgccagg

SEQ ID NO: 78091 - DNA, 25 bp, Mus musculus
agctggtgcacaacaacctgcgagg

SEQ ID NO: 78092 - DNA, 25 bp, Mus musculus
agctggtggaaagacgtcatgatca

SEQ ID NO: 78093 - DNA, 25 bp, Mus musculus
agctgtacaatagcgggctcctcgg

SEQ ID NO: 78094 - DNA, 25 bp, Mus musculus
agctgtagtcgctccggccggtcaa

SEQ ID NO: 78095 - DNA, 25 bp, Mus musculus
agctgtccagccacgtacagtgacg

SEQ ID NO: 78096 - DNA, 25 bp, Mus musculus
agctgtcccgaccatgtagatgcca

SEQ ID NO: 78097 - DNA, 25 bp, Mus musculus
agctgtcccggtgtcggaaggacct

SEQ ID NO: 78098 - DNA, 25 bp, Mus musculus
agctgtccgggacagactctgagca

SEQ ID NO: 78099 - DNA, 25 bp, Mus musculus
agctgtcctgcatcagctcaatgag

SEQ ID NO: 78100 - DNA, 25 bp, Mus musculus
agctgtctaagacccaacctgtggc

SEQ ID NO: 78101 - DNA, 25 bp, Mus musculus
agctgtgaagtatcagagcaaggcc

SEQ ID NO: 78102 - DNA, 25 bp, Mus musculus
agctgtggcggctgctcctgtaccg

SEQ ID NO: 78103 - DNA, 25 bp, Mus musculus
agctgtgggcctccgcttttggtgg

SEQ ID NO: 78104 - DNA, 25 bp, Mus musculus
agctgtgtccagtgtgtggtgacaa

SEQ ID NO: 78105 - DNA, 25 bp, Mus musculus
agctgtgtctggtcactccggcagg

SEQ ID NO: 78106 - DNA, 25 bp, Mus musculus
agctgtgtgcctcttatgccgggaa

SEQ ID NO: 78107 - DNA, 25 bp, Mus musculus
agctgttaagcacccatgaccagcc

SEQ ID NO: 78108 - DNA, 25 bp, Mus musculus
agctgttcgtgttgaatgcggccca

SEQ ID NO: 78109 - DNA, 25 bp, Mus musculus
agctgttctcctcccgggagcactt

SEQ ID NO: 78110 - DNA, 25 bp, Mus musculus
agctgttgatcctgaagaaccacta

SEQ ID NO: 78111 - DNA, 25 bp, Mus musculus
agcttaacagccacgggatgtcggt

SEQ ID NO: 78112 - DNA, 25 bp, Mus musculus
agcttacgctgcctcaacggtggta

SEQ ID NO: 78113 - DNA, 25 bp, Mus musculus
agcttaggattctccaggcttctgc

SEQ ID NO: 78114 - DNA, 25 bp, Mus musculus
agcttatgaccaacctggccctggg

SEQ ID NO: 78115 - DNA, 25 bp, Mus musculus
agcttcaaggataccccgctggagg

SEQ ID NO: 78116 - DNA, 25 bp, Mus musculus
agcttcatgagcacggagccgctgt

SEQ ID NO: 78117 - DNA, 25 bp, Mus musculus
agcttcccacgggagtctgtcagag

SEQ ID NO: 78118 - DNA, 25 bp, Mus musculus
agcttccggaagactcctcccggag

SEQ ID NO: 78119 - DNA, 25 bp, Mus musculus
agcttcggctgcacgctctcttctg

SEQ ID NO: 78120 - DNA, 25 bp, Mus musculus
agcttcgggccggttgtgccgttgc

SEQ ID NO: 78121 - DNA, 25 bp, Mus musculus
agcttctgagcccatagagccgagg

SEQ ID NO: 78122 - DNA, 25 bp, Mus musculus
agcttctgtctgacattgagtccca

SEQ ID NO: 78123 - DNA, 25 bp, Mus musculus
agcttgaaaggagcggctgtccaga

SEQ ID NO: 78124 - DNA, 25 bp, Mus musculus
agcttgcagacgtttcagggacccc

SEQ ID NO: 78125 - DNA, 25 bp, Mus musculus
agcttgcctgccgtcttggcgaaac

SEQ ID NO: 78126 - DNA, 25 bp, Mus musculus
agcttgcctttcaggcagggtactt

SEQ ID NO: 78127 - DNA, 25 bp, Mus musculus
agcttgcgcgggacgtcgttctcct

SEQ ID NO: 78128 - DNA, 25 bp, Mus musculus
agcttgcgggtctcctcgaggcttg

SEQ ID NO: 78129 - DNA, 25 bp, Mus musculus
agcttgctcggcaccgcaagtccag

SEQ ID NO: 78130 - DNA, 25 bp, Mus musculus
agcttggcaatgtgacgcctccaaa

SEQ ID NO: 78131 - DNA, 25 bp, Mus musculus
agcttgtggcttcgagactggtcaa

SEQ ID NO: 78132 - DNA, 25 bp, Mus musculus
agctttatgcagtgcccctcatcca

SEQ ID NO: 78133 - DNA, 25 bp, Mus musculus
agctttccggaccttggagcaggcc

SEQ ID NO: 78134 - DNA, 25 bp, Mus musculus
agctttcgtgcccttcgcgatggcg

SEQ ID NO: 78135 - DNA, 25 bp, Mus musculus
agctttggcccagtgtctgacacgg

SEQ ID NO: 78136 - DNA, 25 bp, Mus musculus
agcttttgtgaggtgttgtgacagc

SEQ ID NO: 78137 - DNA, 25 bp, Mus musculus
agctttttagacaacctcacaggga

SEQ ID NO: 78138 - DNA, 25 bp, Mus musculus
agctttttgcattgactggagtcca

SEQ ID NO: 78139 - DNA, 25 bp, Mus musculus
aggaaacgcggctgaccctgatgga

SEQ ID NO: 78140 - DNA, 25 bp, Mus musculus
aggaaactggactaggccacggcgt

SEQ ID NO: 78141 - DNA, 25 bp, Mus musculus
aggaaactgggctgtctggcaaagc

SEQ ID NO: 78142 - DNA, 25 bp, Mus musculus
aggaaagcgcatgtgcagcgcctgt

SEQ ID NO: 78143 - DNA, 25 bp, Mus musculus
aggaaagcgcgaggagacgccgccg

SEQ ID NO: 78144 - DNA, 25 bp, Mus musculus
aggaaaggagctgcgactagccgcc

SEQ ID NO: 78145 - DNA, 25 bp, Mus musculus
aggaaatgaatctgctgccgacgcc

SEQ ID NO: 78146 - DNA, 25 bp, Mus musculus
aggaaattcattgaggccgcccaga

SEQ ID NO: 78147 - DNA, 25 bp, Mus musculus
aggaacagcaatggcgacactgcac

SEQ ID NO: 78148 - DNA, 25 bp, Mus musculus
aggaacagcgaaccgtccagtggct

SEQ ID NO: 78149 - DNA, 25 bp, Mus musculus
aggaacagctgcacactaagggccg

SEQ ID NO: 78150 - DNA, 25 bp, Mus musculus
aggaacaggaagagggcactggcga

SEQ ID NO: 78151 - DNA, 25 bp, Mus musculus
aggaacagtattcccaccacaggag

SEQ ID NO: 78152 - DNA, 25 bp, Mus musculus
aggaaccagcacaggaaaccaaggg

SEQ ID NO: 78153 - DNA, 25 bp, Mus musculus
aggaaccagctcaaggacctgcaga

SEQ ID NO: 78154 - DNA, 25 bp, Mus musculus
aggaaccttttcagctggccaccga

SEQ ID NO: 78155 - DNA, 25 bp, Mus musculus
aggaactcattgagttgcgcgtgcg

SEQ ID NO: 78156 - DNA, 25 bp, Mus musculus
aggaagaagcaaacaccactcaggg

SEQ ID NO: 78157 - DNA, 25 bp, Mus musculus
aggaagacgactccacctgcacctt

SEQ ID NO: 78158 - DNA, 25 bp, Mus musculus
aggaagaggagaccactgatgaccc

SEQ ID NO: 78159 - DNA, 25 bp, Mus musculus
aggaagatctttttggtcgcccaag

SEQ ID NO: 78160 - DNA, 25 bp, Mus musculus
aggaagatggcagcaaatccttcag

SEQ ID NO: 78161 - DNA, 25 bp, Mus musculus
aggaagcagaagaattgggccgccc

SEQ ID NO: 78162 - DNA, 25 bp, Mus musculus
aggaagcagctactggaagacatcc

SEQ ID NO: 78163 - DNA, 25 bp, Mus musculus
aggaagcccggttcaggaccttgca

SEQ ID NO: 78164 - DNA, 25 bp, Mus musculus
aggaagcggttacggctgtacagaa

SEQ ID NO: 78165 - DNA, 25 bp, Mus musculus
aggaaggctgcttctacacccatga

SEQ ID NO: 78166 - DNA, 25 bp, Mus musculus
aggaagtcctctgtccactgagcag

SEQ ID NO: 78167 - DNA, 25 bp, Mus musculus
aggaatatcccaaagcagacgtgcg

SEQ ID NO: 78168 - DNA, 25 bp, Mus musculus
aggaatccctccaagaccgtgtgta

SEQ ID NO: 78169 - DNA, 25 bp, Mus musculus
aggaatccggcctgcctgggtgacc

SEQ ID NO: 78170 - DNA, 25 bp, Mus musculus
aggaatgattctgcgggcagtctgc

SEQ ID NO: 78171 - DNA, 25 bp, Mus musculus
aggaatggcttgactccctagagtg

SEQ ID NO: 78172 - DNA, 25 bp, Mus musculus
aggaatttggtgacgacaaggtgca

SEQ ID NO: 78173 - DNA, 25 bp, Mus musculus
aggacaaccgccagcatcaatggga

SEQ ID NO: 78174 - DNA, 25 bp, Mus musculus
aggacaaccggagccaagtggagac

SEQ ID NO: 78175 - DNA, 25 bp, Mus musculus
aggacaactctcagccggatgcagg

SEQ ID NO: 78176 - DNA, 25 bp, Mus musculus
aggacaagatctccctcccagcaaa

SEQ ID NO: 78177 - DNA, 25 bp, Mus musculus
aggacaaggagaagccgaagcccag

SEQ ID NO: 78178 - DNA, 25 bp, Mus musculus
aggacaaggccttccagacgatggc

SEQ ID NO: 78179 - DNA, 25 bp, Mus musculus
aggacacagccaatcgcctgcgcat

SEQ ID NO: 78180 - DNA, 25 bp, Mus musculus
aggacagatccgctggcctctggcc

SEQ ID NO: 78181 - DNA, 25 bp, Mus musculus
aggacagtgtcggagatccgctcgc

SEQ ID NO: 78182 - DNA, 25 bp, Mus musculus
aggacatgtacagacctcacccagg

SEQ ID NO: 78183 - DNA, 25 bp, Mus musculus
aggacatgtggctcagcgtggtcaa

SEQ ID NO: 78184 - DNA, 25 bp, Mus musculus
aggaccacaacagcgcacacggagg

SEQ ID NO: 78185 - DNA, 25 bp, Mus musculus
aggaccacccttgaggagcctgagg

SEQ ID NO: 78186 - DNA, 25 bp, Mus musculus
aggaccccagtggtccaagacctgg

SEQ ID NO: 78187 - DNA, 25 bp, Mus musculus
aggacccgtggagggctgccaaaat

SEQ ID NO: 78188 - DNA, 25 bp, Mus musculus
aggaccgctacgtgttcttgcagga

SEQ ID NO: 78189 - DNA, 25 bp, Mus musculus
aggaccggcaacaccgagaccgaga

SEQ ID NO: 78190 - DNA, 25 bp, Mus musculus
aggaccggcccatcactatcaaaga

SEQ ID NO: 78191 - DNA, 25 bp, Mus musculus
aggaccgtgggtgcgctcaatgtac

SEQ ID NO: 78192 - DNA, 25 bp, Mus musculus
aggacctgcgggaacacacggaatt

SEQ ID NO: 78193 - DNA, 25 bp, Mus musculus
aggacctgggagcacggtcatggag

SEQ ID NO: 78194 - DNA, 25 bp, Mus musculus
aggacgcccagatggtgcacagcaa

SEQ ID NO: 78195 - DNA, 25 bp, Mus musculus
aggacgcgctacgtagggccagctc

SEQ ID NO: 78196 - DNA, 25 bp, Mus musculus
aggacggaagcccagtcatcacctt

SEQ ID NO: 78197 - DNA, 25 bp, Mus musculus
aggacggtaccggcggcactgcggc

SEQ ID NO: 78198 - DNA, 25 bp, Mus musculus
aggacggtgcccacagcgacgaaga

SEQ ID NO: 78199 - DNA, 25 bp, Mus musculus
aggactaaagtctacccctccacat

SEQ ID NO: 78200 - DNA, 25 bp, Mus musculus
aggactccctagtgctggcttcaga

SEQ ID NO: 78201 - DNA, 25 bp, Mus musculus
aggactcctggaattcctctcatgt

SEQ ID NO: 78202 - DNA, 25 bp, Mus musculus
aggactctcctctattgccagcgta

SEQ ID NO: 78203 - DNA, 25 bp, Mus musculus
aggactgagcacaagagagggcccc

SEQ ID NO: 78204 - DNA, 25 bp, Mus musculus
aggactggccgaggaaactggacta

SEQ ID NO: 78205 - DNA, 25 bp, Mus musculus
aggactggttcatcccagcacgaga

SEQ ID NO: 78206 - DNA, 25 bp, Mus musculus
aggacttcaggacccgtctcagtca

SEQ ID NO: 78207 - DNA, 25 bp, Mus musculus
aggacttccgcagtttccggtcaga

SEQ ID NO: 78208 - DNA, 25 bp, Mus musculus
aggagaacgacccttccaacgtgct

SEQ ID NO: 78209 - DNA, 25 bp, Mus musculus
aggagaagaacctgctggctctgtg

SEQ ID NO: 78210 - DNA, 25 bp, Mus musculus
aggagaagatgatccgtgacatgga

SEQ ID NO: 78211 - DNA, 25 bp, Mus musculus
aggagaagcagctgacaacagatgc

SEQ ID NO: 78212 - DNA, 25 bp, Mus musculus
aggagaaggcacagatggaattaca

SEQ ID NO: 78213 - DNA, 25 bp, Mus musculus
aggagaagggccacctctcatcaca

SEQ ID NO: 78214 - DNA, 25 bp, Mus musculus
aggagaagtccccaccaggacagaa

SEQ ID NO: 78215 - DNA, 25 bp, Mus musculus
aggagaatttccagcaggagcacag

SEQ ID NO: 78216 - DNA, 25 bp, Mus musculus
aggagacctacgtgcacatcgtgca

SEQ ID NO: 78217 - DNA, 25 bp, Mus musculus
aggagacgctgtccctgtgtttgac

SEQ ID NO: 78218 - DNA, 25 bp, Mus musculus
aggagagccctgtacccttgctggg

SEQ ID NO: 78219 - DNA, 25 bp, Mus musculus
aggagatgatgtactgggacccagc

SEQ ID NO: 78220 - DNA, 25 bp, Mus musculus
aggagattccggacgagaccatggt

SEQ ID NO: 78221 - DNA, 25 bp, Mus musculus
aggagattgtggactgtatgtaccc

SEQ ID NO: 78222 - DNA, 25 bp, Mus musculus
aggagcaaagagaccgggcgaagct

SEQ ID NO: 78223 - DNA, 25 bp, Mus musculus
aggagcaagagtaccgaacacaccg

SEQ ID NO: 78224 - DNA, 25 bp, Mus musculus
aggagcaagcgcagcctcgttcctg

SEQ ID NO: 78225 - DNA, 25 bp, Mus musculus
aggagcaatctcagtccggaccgag

SEQ ID NO: 78226 - DNA, 25 bp, Mus musculus
aggagcactcctatggcgcgcagat

SEQ ID NO: 78227 - DNA, 25 bp, Mus musculus
aggagcagccttttgtttccagcag

SEQ ID NO: 78228 - DNA, 25 bp, Mus musculus
aggagcagttgcagacggagaaaca

SEQ ID NO: 78229 - DNA, 25 bp, Mus musculus
aggagcatctggaccatcgacctgg

SEQ ID NO: 78230 - DNA, 25 bp, Mus musculus
aggagccagtcgacctccttcacgg

SEQ ID NO: 78231 - DNA, 25 bp, Mus musculus
aggagcccagagacctcgttcttca

SEQ ID NO: 78232 - DNA, 25 bp, Mus musculus
aggagcccggctgtggcctcaggac

SEQ ID NO: 78233 - DNA, 25 bp, Mus musculus
aggagccggaagaagcagacccaga

SEQ ID NO: 78234 - DNA, 25 bp, Mus musculus
aggagcctcggatccggctgcagaa

SEQ ID NO: 78235 - DNA, 25 bp, Mus musculus
aggagcctgaccatggtgcattgct

SEQ ID NO: 78236 - DNA, 25 bp, Mus musculus
aggagcctgattgcctgtcaccaga

SEQ ID NO: 78237 - DNA, 25 bp, Mus musculus
aggagcctgcatggaactgcgacgc

SEQ ID NO: 78238 - DNA, 25 bp, Mus musculus
aggagcgcgccatggcggtgtccga

SEQ ID NO: 78239 - DNA, 25 bp, Mus musculus
aggagcgctcgcagccttgtgactg

SEQ ID NO: 78240 - DNA, 25 bp, Mus musculus
aggagcggccacgaagcctagtgtc

SEQ ID NO: 78241 - DNA, 25 bp, Mus musculus
aggagctcaccaacgccctggaaat

SEQ ID NO: 78242 - DNA, 25 bp, Mus musculus
aggagctcagcaaggtcaacaagga

SEQ ID NO: 78243 - DNA, 25 bp, Mus musculus
aggagctgagcaacgacctggacgc

SEQ ID NO: 78244 - DNA, 25 bp, Mus musculus
aggagctgcgactagccgcccagag

SEQ ID NO: 78245 - DNA, 25 bp, Mus musculus
aggagctgcgcttggccttgaagca

SEQ ID NO: 78246 - DNA, 25 bp, Mus musculus
aggagcttagcccttttcgaggacg

SEQ ID NO: 78247 - DNA, 25 bp, Mus musculus
aggagcttgccaccgagaaggaggc

SEQ ID NO: 78248 - DNA, 25 bp, Mus musculus
aggaggaaacggatcgcttggccca

SEQ ID NO: 78249 - DNA, 25 bp, Mus musculus
aggaggaaccatttcccatgcccct

SEQ ID NO: 78250 - DNA, 25 bp, Mus musculus
aggaggacaccccacagttgatgcg

SEQ ID NO: 78251 - DNA, 25 bp, Mus musculus
aggaggacatcctgcggaacaaggc

SEQ ID NO: 78252 - DNA, 25 bp, Mus musculus
aggaggagagcagcacaaggttcat

SEQ ID NO: 78253 - DNA, 25 bp, Mus musculus
aggaggagtaagtttgccaacctgg

SEQ ID NO: 78254 - DNA, 25 bp, Mus musculus
aggaggagtccaggcgggtgctgca

SEQ ID NO: 78255 - DNA, 25 bp, Mus musculus
aggaggcactttttcagcgggacgc

SEQ ID NO: 78256 - DNA, 25 bp, Mus musculus
aggaggccgccatcgtggacccagt

SEQ ID NO: 78257 - DNA, 25 bp, Mus musculus
aggaggcgaccgactgatctcttca

SEQ ID NO: 78258 - DNA, 25 bp, Mus musculus
aggaggcgccagagagaaaccactc

SEQ ID NO: 78259 - DNA, 25 bp, Mus musculus
aggaggctgactataaacggctgca

SEQ ID NO: 78260 - DNA, 25 bp, Mus musculus
aggagggagcggctgctgccgccac

SEQ ID NO: 78261 - DNA, 25 bp, Mus musculus
aggagggctcagaacctggtcaagc

SEQ ID NO: 78262 - DNA, 25 bp, Mus musculus
aggagggggagctcagatttcttct

SEQ ID NO: 78263 - DNA, 25 bp, Mus musculus
aggaggtggtgacggtggcaacggc

SEQ ID NO: 78264 - DNA, 25 bp, Mus musculus
aggagtatcatgaagaactggcagc

SEQ ID NO: 78265 - DNA, 25 bp, Mus musculus
aggagtgaagataccaggacaggaa

SEQ ID NO: 78266 - DNA, 25 bp, Mus musculus
aggagtgctcctccctagtcacggg

SEQ ID NO: 78267 - DNA, 25 bp, Mus musculus
aggagtggttcatggagtgacaaca

SEQ ID NO: 78268 - DNA, 25 bp, Mus musculus
aggagttccccttcgagaggaggca

SEQ ID NO: 78269 - DNA, 25 bp, Mus musculus
aggagttcgctttggcagcccagaa

SEQ ID NO: 78270 - DNA, 25 bp, Mus musculus
aggagttgaggaggtgccacccacc

SEQ ID NO: 78271 - DNA, 25 bp, Mus musculus
aggagtttgaccacctgctggagga

SEQ ID NO: 78272 - DNA, 25 bp, Mus musculus
aggagttttatgctcgtctccggca

SEQ ID NO: 78273 - DNA, 25 bp, Mus musculus
aggataaactgctgctcggccactc

SEQ ID NO: 78274 - DNA, 25 bp, Mus musculus
aggataatacagcacacggacaccg

SEQ ID NO: 78275 - DNA, 25 bp, Mus musculus
aggataccccgctggagggcttaga

SEQ ID NO: 78276 - DNA, 25 bp, Mus musculus
aggatcagaacccagccgagtgcaa

SEQ ID NO: 78277 - DNA, 25 bp, Mus musculus
aggatccagaagctactcgcccagc

SEQ ID NO: 78278 - DNA, 25 bp, Mus musculus
aggatcctgctgcactcagcttccg

SEQ ID NO: 78279 - DNA, 25 bp, Mus musculus
aggatcgacacggacctcagcaaag

SEQ ID NO: 78280 - DNA, 25 bp, Mus musculus
aggatcggctcaaacctcacgtcca

SEQ ID NO: 78281 - DNA, 25 bp, Mus musculus
aggatctccggactctcctcaagcg

SEQ ID NO: 78282 - DNA, 25 bp, Mus musculus
aggatctggactccgttccctgcct

SEQ ID NO: 78283 - DNA, 25 bp, Mus musculus
aggatcttcgggtgtgaaaagccaa

SEQ ID NO: 78284 - DNA, 25 bp, Mus musculus
aggatgactgagacgttatgggcca

SEQ ID NO: 78285 - DNA, 25 bp, Mus musculus
aggatgatgcccagacgggtgaaaa

SEQ ID NO: 78286 - DNA, 25 bp, Mus musculus
aggatgccgttgactgtgccacaca

SEQ ID NO: 78287 - DNA, 25 bp, Mus musculus
aggatgccttccaccgcaagacaag

SEQ ID NO: 78288 - DNA, 25 bp, Mus musculus
aggatgctgacctgtggaacggccc

SEQ ID NO: 78289 - DNA, 25 bp, Mus musculus
aggatgctgggcatgtacgtaccag

SEQ ID NO: 78290 - DNA, 25 bp, Mus musculus
aggatgcttaggtatccccggtaca

SEQ ID NO: 78291 - DNA, 25 bp, Mus musculus
aggatggcccaggacctcagtgaga

SEQ ID NO: 78292 - DNA, 25 bp, Mus musculus
aggatggctccctgtggcaccagga

SEQ ID NO: 78293 - DNA, 25 bp, Mus musculus
aggatgggcgactcagcttcgaaag

SEQ ID NO: 78294 - DNA, 25 bp, Mus musculus
aggatggtcccctgaaactccgagg

SEQ ID NO: 78295 - DNA, 25 bp, Mus musculus
aggatgtagaacctgccctccggaa

SEQ ID NO: 78296 - DNA, 25 bp, Mus musculus
aggatgtcatcctgcaactgagaaa

SEQ ID NO: 78297 - DNA, 25 bp, Mus musculus
aggatgtggagctctaccgccagaa

SEQ ID NO: 78298 - DNA, 25 bp, Mus musculus
aggattcacatagcatggtggctgc

SEQ ID NO: 78299 - DNA, 25 bp, Mus musculus
aggattccccaccagctcgttggag

SEQ ID NO: 78300 - DNA, 25 bp, Mus musculus
aggattccgaagacctcacaggcac

SEQ ID NO: 78301 - DNA, 25 bp, Mus musculus
aggattgacaccagtcgccccagtt

SEQ ID NO: 78302 - DNA, 25 bp, Mus musculus
aggattgtccttgatggctgcacca

SEQ ID NO: 78303 - DNA, 25 bp, Mus musculus
aggatttgaagaggcctgacccagc

SEQ ID NO: 78304 - DNA, 25 bp, Mus musculus
aggcaaccatgacgtcttcccagag

SEQ ID NO: 78305 - DNA, 25 bp, Mus musculus
aggcaatcttcagtggcgacccaga

SEQ ID NO: 78306 - DNA, 25 bp, Mus musculus
aggcacactgcgcagagtccctgtg

SEQ ID NO: 78307 - DNA, 25 bp, Mus musculus
aggcaccactctcacagtctcctca

SEQ ID NO: 78308 - DNA, 25 bp, Mus musculus
aggcaccatctcaggagcggaagaa

SEQ ID NO: 78309 - DNA, 25 bp, Mus musculus
aggcaccatggttctgctgcagcgg

SEQ ID NO: 78310 - DNA, 25 bp, Mus musculus
aggcactgccgagaagcccaagaga

SEQ ID NO: 78311 - DNA, 25 bp, Mus musculus
aggcacttcaccacccgttttgttg

SEQ ID NO: 78312 - DNA, 25 bp, Mus musculus
aggcagaacttctgcaaggaggaga

SEQ ID NO: 78313 - DNA, 25 bp, Mus musculus
aggcagagctaaacccagagctgga

SEQ ID NO: 78314 - DNA, 25 bp, Mus musculus
aggcagcacgctgagcccaagatga

SEQ ID NO: 78315 - DNA, 25 bp, Mus musculus
aggcagccatccacgcactctttgg

SEQ ID NO: 78316 - DNA, 25 bp, Mus musculus
aggcagcgcagcttccgcgttctcg

SEQ ID NO: 78317 - DNA, 25 bp, Mus musculus
aggcagctgcagctatcgagccctg

SEQ ID NO: 78318 - DNA, 25 bp, Mus musculus
aggcaggaacgtgtgctttacctca

SEQ ID NO: 78319 - DNA, 25 bp, Mus musculus
aggcagggcaatcttgtgagttcta

SEQ ID NO: 78320 - DNA, 25 bp, Mus musculus
aggcaggttggagttctgtttctga

SEQ ID NO: 78321 - DNA, 25 bp, Mus musculus
aggcagtccacggagctggtctcca

SEQ ID NO: 78322 - DNA, 25 bp, Mus musculus
aggcatccactaagctcgttctctc

SEQ ID NO: 78323 - DNA, 25 bp, Mus musculus
aggcatccaggctgtggtcgaagtc

SEQ ID NO: 78324 - DNA, 25 bp, Mus musculus
aggcattccggcgtaaggagcacct

SEQ ID NO: 78325 - DNA, 25 bp, Mus musculus
aggccaacctggtgagggacctgca

SEQ ID NO: 78326 - DNA, 25 bp, Mus musculus
aggccaagtcaaaatattctccaga

SEQ ID NO: 78327 - DNA, 25 bp, Mus musculus
aggccacgggtcctggaaacagcaa

SEQ ID NO: 78328 - DNA, 25 bp, Mus musculus
aggccactgctctgtgaatggtgtc

SEQ ID NO: 78329 - DNA, 25 bp, Mus musculus
aggccagatcccctcgagtcatcta

SEQ ID NO: 78330 - DNA, 25 bp, Mus musculus
aggccatcgcgctgctacagtccat

SEQ ID NO: 78331 - DNA, 25 bp, Mus musculus
aggccattggtgtttccaggagagc

SEQ ID NO: 78332 - DNA, 25 bp, Mus musculus
aggcccagcgcctcatgcaacttat

SEQ ID NO: 78333 - DNA, 25 bp, Mus musculus
aggcccagttccctatgtccatgga

SEQ ID NO: 78334 - DNA, 25 bp, Mus musculus
aggcccattgaactgatgttgtgta

SEQ ID NO: 78335 - DNA, 25 bp, Mus musculus
aggcccctggtgtctacgtgtttgg

SEQ ID NO: 78336 - DNA, 25 bp, Mus musculus
aggccctgcagatgatccatcccat

SEQ ID NO: 78337 - DNA, 25 bp, Mus musculus
aggccctgccctagtttctgatctc

SEQ ID NO: 78338 - DNA, 25 bp, Mus musculus
aggccctgggctggaacatttacgc

SEQ ID NO: 78339 - DNA, 25 bp, Mus musculus
aggccctgtcgctgcaagtggagca

SEQ ID NO: 78340 - DNA, 25 bp, Mus musculus
aggcccttctgaaccttgccaggaa

SEQ ID NO: 78341 - DNA, 25 bp, Mus musculus
aggccgaccctaaaccagatgcgta

SEQ ID NO: 78342 - DNA, 25 bp, Mus musculus
aggccgcccgctcctggtcatgaga

SEQ ID NO: 78343 - DNA, 25 bp, Mus musculus
aggccgcgttcagtggcactctgca

SEQ ID NO: 78344 - DNA, 25 bp, Mus musculus
aggccgggcgtcacaggtcctgaca

SEQ ID NO: 78345 - DNA, 25 bp, Mus musculus
aggccgtggaactcttgtcatctag

SEQ ID NO: 78346 - DNA, 25 bp, Mus musculus
aggcctccggaagacaatgctgttg

SEQ ID NO: 78347 - DNA, 25 bp, Mus musculus
aggccttagggtctccggctgccac

SEQ ID NO: 78348 - DNA, 25 bp, Mus musculus
aggccttgggtaccactcctgacaa

SEQ ID NO: 78349 - DNA, 25 bp, Mus musculus
aggcgacccgttcgacgtcatcact

SEQ ID NO: 78350 - DNA, 25 bp, Mus musculus
aggcgagctcagcaaccgcgccatg

SEQ ID NO: 78351 - DNA, 25 bp, Mus musculus
aggcgcaccgtgacacgcgtggctt

SEQ ID NO: 78352 - DNA, 25 bp, Mus musculus
aggcgcctgaatccccactggagtg

SEQ ID NO: 78353 - DNA, 25 bp, Mus musculus
aggcgcgcggcacggggagcggcca

SEQ ID NO: 78354 - DNA, 25 bp, Mus musculus
aggcgcgtggcctcattcagatcct

SEQ ID NO: 78355 - DNA, 25 bp, Mus musculus
aggcgctgcgccaagcggcgcggga

SEQ ID NO: 78356 - DNA, 25 bp, Mus musculus
aggcggcgcccatgaaagaagtaaa

SEQ ID NO: 78357 - DNA, 25 bp, Mus musculus
aggcggctttctgcacggccgtgac

SEQ ID NO: 78358 - DNA, 25 bp, Mus musculus
aggcgggctacctggactaccttga

SEQ ID NO: 78359 - DNA, 25 bp, Mus musculus
aggcggtagctcgtgctcgagtctc

SEQ ID NO: 78360 - DNA, 25 bp, Mus musculus
aggcggtcccactcggaagtcatca

SEQ ID NO: 78361 - DNA, 25 bp, Mus musculus
aggcgtacacaaacactccgatggt

SEQ ID NO: 78362 - DNA, 25 bp, Mus musculus
aggcgtatcgcagccggcggagttg

SEQ ID NO: 78363 - DNA, 25 bp, Mus musculus
aggcgtctatctgtccatcgaggca

SEQ ID NO: 78364 - DNA, 25 bp, Mus musculus
aggcgtgctgcctgctcatggctct

SEQ ID NO: 78365 - DNA, 25 bp, Mus musculus
aggcgtttgacccaccagaggagtc

SEQ ID NO: 78366 - DNA, 25 bp, Mus musculus
aggctaagcctccacggtgctgtga

SEQ ID NO: 78367 - DNA, 25 bp, Mus musculus
aggctaccccgcacctggaggttat

SEQ ID NO: 78368 - DNA, 25 bp, Mus musculus
aggctacgggatctcggacaccaac

SEQ ID NO: 78369 - DNA, 25 bp, Mus musculus
aggctactcaggcttgattagggaa

SEQ ID NO: 78370 - DNA, 25 bp, Mus musculus
aggctatcctcctttctgggttgga

SEQ ID NO: 78371 - DNA, 25 bp, Mus musculus
aggctccaggctccgttccgaagct

SEQ ID NO: 78372 - DNA, 25 bp, Mus musculus
aggctcccgccaagaaagacgtcaa

SEQ ID NO: 78373 - DNA, 25 bp, Mus musculus
aggctccggagcacgattaccccta

SEQ ID NO: 78374 - DNA, 25 bp, Mus musculus
aggctccttagaatccttaccacag

SEQ ID NO: 78375 - DNA, 25 bp, Mus musculus
aggctcgagtggacaaaggcccaga

SEQ ID NO: 78376 - DNA, 25 bp, Mus musculus
aggctctgcagtggcacccagacaa

SEQ ID NO: 78377 - DNA, 25 bp, Mus musculus
aggctctgtgggagcccagcctgat

SEQ ID NO: 78378 - DNA, 25 bp, Mus musculus
aggctcttcatctggccagtccaca

SEQ ID NO: 78379 - DNA, 25 bp, Mus musculus
aggctgagccagtgcaagaacccga

SEQ ID NO: 78380 - DNA, 25 bp, Mus musculus
aggctgcaaccgcaagatcaaggac

SEQ ID NO: 78381 - DNA, 25 bp, Mus musculus
aggctgcagatcatccagggctgcc

SEQ ID NO: 78382 - DNA, 25 bp, Mus musculus
aggctgcatccaaaccccagtaggg

SEQ ID NO: 78383 - DNA, 25 bp, Mus musculus
aggctgccccacgttgagtctgaga

SEQ ID NO: 78384 - DNA, 25 bp, Mus musculus
aggctgcggcttgcgcttctcctgg

SEQ ID NO: 78385 - DNA, 25 bp, Mus musculus
aggctgctctgaaaaacccccctat

SEQ ID NO: 78386 - DNA, 25 bp, Mus musculus
aggctggccatctgcacaggaggaa

SEQ ID NO: 78387 - DNA, 25 bp, Mus musculus
aggctggcctctgcggagattccag

SEQ ID NO: 78388 - DNA, 25 bp, Mus musculus
aggctgggggcaccttaccctctcg

SEQ ID NO: 78389 - DNA, 25 bp, Mus musculus
aggctgttggcctcaagctcctaga

SEQ ID NO: 78390 - DNA, 25 bp, Mus musculus
aggctttggagccactgcccatcgt

SEQ ID NO: 78391 - DNA, 25 bp, Mus musculus
aggctttggaggagttcgcagaaat

SEQ ID NO: 78392 - DNA, 25 bp, Mus musculus
aggcttttcaaatctgctttctgga

SEQ ID NO: 78393 - DNA, 25 bp, Mus musculus
agggaacgagctggagcccctcaac

SEQ ID NO: 78394 - DNA, 25 bp, Mus musculus
agggaagcaccgctgtacctgttct

SEQ ID NO: 78395 - DNA, 25 bp, Mus musculus
agggaagtatctgtaaacgcgcgcc

SEQ ID NO: 78396 - DNA, 25 bp, Mus musculus
agggaagtattcagtcagctcgtca

SEQ ID NO: 78397 - DNA, 25 bp, Mus musculus
agggaatgatcctcaccaaccacga

SEQ ID NO: 78398 - DNA, 25 bp, Mus musculus
agggaatgccttgatcctgctcagt

SEQ ID NO: 78399 - DNA, 25 bp, Mus musculus
agggaattcttgctgacctccggga

SEQ ID NO: 78400 - DNA, 25 bp, Mus musculus
agggacaaccgctacctccaggcaa

SEQ ID NO: 78401 - DNA, 25 bp, Mus musculus
agggacaagagattctggaaagtga

SEQ ID NO: 78402 - DNA, 25 bp, Mus musculus
agggacaccctgagaacgcctatga

SEQ ID NO: 78403 - DNA, 25 bp, Mus musculus
agggacatctgtagcctgtcagctc

SEQ ID NO: 78404 - DNA, 25 bp, Mus musculus
agggaccagagcatgatggtgaaca

SEQ ID NO: 78405 - DNA, 25 bp, Mus musculus
agggacccagcacaaccagatttct

SEQ ID NO: 78406 - DNA, 25 bp, Mus musculus
agggacccctacttcagagcatctg

SEQ ID NO: 78407 - DNA, 25 bp, Mus musculus
agggaccgcagtgccagcataaagc

SEQ ID NO: 78408 - DNA, 25 bp, Mus musculus
agggaccgggagatctaccagctca

SEQ ID NO: 78409 - DNA, 25 bp, Mus musculus
agggacctgcctcattttgttcgaa

SEQ ID NO: 78410 - DNA, 25 bp, Mus musculus
agggactcgggctacaagagtaggg

SEQ ID NO: 78411 - DNA, 25 bp, Mus musculus
agggacttcaggtgaccctccaggg

SEQ ID NO: 78412 - DNA, 25 bp, Mus musculus
agggagaaaccccacacgaatgctg

SEQ ID NO: 78413 - DNA, 25 bp, Mus musculus
agggagaccaccgatactgagcaga

SEQ ID NO: 78414 - DNA, 25 bp, Mus musculus
agggagctctcaattgtgcctgcct

SEQ ID NO: 78415 - DNA, 25 bp, Mus musculus
agggagtatgattttgaggacgact

SEQ ID NO: 78416 - DNA, 25 bp, Mus musculus
agggatatctctgcaaagagaaaca

SEQ ID NO: 78417 - DNA, 25 bp, Mus musculus
agggatctgcttgcgcaaattattg

SEQ ID NO: 78418 - DNA, 25 bp, Mus musculus
agggatcttagggctctctcggcag

SEQ ID NO: 78419 - DNA, 25 bp, Mus musculus
agggcaacgcatcacggacaggtct

SEQ ID NO: 78420 - DNA, 25 bp, Mus musculus
agggcaagaactcctcatggaccag

SEQ ID NO: 78421 - DNA, 25 bp, Mus musculus
agggcacattcaccagcgactacag

SEQ ID NO: 78422 - DNA, 25 bp, Mus musculus
agggcactcctgagcgtttcgggaa

SEQ ID NO: 78423 - DNA, 25 bp, Mus musculus
agggcagcctgtccggtggcggagc

SEQ ID NO: 78424 - DNA, 25 bp, Mus musculus
agggcaggcccatgtactactttga

SEQ ID NO: 78425 - DNA, 25 bp, Mus musculus
agggcagggctcacagactccaaaa

SEQ ID NO: 78426 - DNA, 25 bp, Mus musculus
agggcagtcgcgtgtacagccagct

SEQ ID NO: 78427 - DNA, 25 bp, Mus musculus
agggcatggacatggaacctggcgc

SEQ ID NO: 78428 - DNA, 25 bp, Mus musculus
agggccaaggattcaccattcaaga

SEQ ID NO: 78429 - DNA, 25 bp, Mus musculus
agggcccctggaagcgggcacgatg

SEQ ID NO: 78430 - DNA, 25 bp, Mus musculus
agggccccttattccagctctgcac

SEQ ID NO: 78431 - DNA, 25 bp, Mus musculus
agggccgttcacagaggacaaagtg

SEQ ID NO: 78432 - DNA, 25 bp, Mus musculus
agggcctgtctcctgcggtcagaaa

SEQ ID NO: 78433 - DNA, 25 bp, Mus musculus
agggccttgtccctaactgccgagg

SEQ ID NO: 78434 - DNA, 25 bp, Mus musculus
agggcgcctccaagaagccagtgcc

SEQ ID NO: 78435 - DNA, 25 bp, Mus musculus
agggcgcggcgctgcagaactacaa

SEQ ID NO: 78436 - DNA, 25 bp, Mus musculus
agggcgcgtgtctacctggatgaaa

SEQ ID NO: 78437 - DNA, 25 bp, Mus musculus
agggcgctccttagtacttctcaga

SEQ ID NO: 78438 - DNA, 25 bp, Mus musculus
agggcgctgccatgtttggctgcct

SEQ ID NO: 78439 - DNA, 25 bp, Mus musculus
agggctaaaactggctggctttccg

SEQ ID NO: 78440 - DNA, 25 bp, Mus musculus
agggctaccttttctcactctggag

SEQ ID NO: 78441 - DNA, 25 bp, Mus musculus
agggctcagtcccagtgacgctaga

SEQ ID NO: 78442 - DNA, 25 bp, Mus musculus
agggctccagagcagcaagaactgc

SEQ ID NO: 78443 - DNA, 25 bp, Mus musculus
agggctccagtcaggccgagccgct

SEQ ID NO: 78444 - DNA, 25 bp, Mus musculus
agggctgtccacaggctcaccaaac

SEQ ID NO: 78445 - DNA, 25 bp, Mus musculus
agggctgtgaaagggtcaaagtctt

SEQ ID NO: 78446 - DNA, 25 bp, Mus musculus
agggcttcagcacccgggatctgct

SEQ ID NO: 78447 - DNA, 25 bp, Mus musculus
agggcttgccccactcagaggatta

SEQ ID NO: 78448 - DNA, 25 bp, Mus musculus
agggctttagcctgagcgatgtgcc

SEQ ID NO: 78449 - DNA, 25 bp, Mus musculus
aggggacttgcttgtggatggcacc

SEQ ID NO: 78450 - DNA, 25 bp, Mus musculus
agggtagagcatacgccgcggaaaa

SEQ ID NO: 78451 - DNA, 25 bp, Mus musculus
agggtccagttcacctctgtcccag

SEQ ID NO: 78452 - DNA, 25 bp, Mus musculus
agggtcctcgccgagccgtgatgag

SEQ ID NO: 78453 - DNA, 25 bp, Mus musculus
agggtctctgttctgtcatgcctca

SEQ ID NO: 78454 - DNA, 25 bp, Mus musculus
agggtcttggctggaaaggacactt

SEQ ID NO: 78455 - DNA, 25 bp, Mus musculus
agggtggaaacagacttcatccagc

SEQ ID NO: 78456 - DNA, 25 bp, Mus musculus
agggtggacacaactcccgaggaca

SEQ ID NO: 78457 - DNA, 25 bp, Mus musculus
agggtggcatctgcagaaggaccaa

SEQ ID NO: 78458 - DNA, 25 bp, Mus musculus
agggtgtactgagggcagccacaca

SEQ ID NO: 78459 - DNA, 25 bp, Mus musculus
agggtgtccctctccaaacgtggct

SEQ ID NO: 78460 - DNA, 25 bp, Mus musculus
agggttcgactaccatcagcctggg

SEQ ID NO: 78461 - DNA, 25 bp, Mus musculus
agggttctctctgacgcgggacccg

SEQ ID NO: 78462 - DNA, 25 bp, Mus musculus
agggttgtgtctggaggatctccta

SEQ ID NO: 78463 - DNA, 25 bp, Mus musculus
aggtacatctgcagcatccctggat

SEQ ID NO: 78464 - DNA, 25 bp, Mus musculus
aggtaccacaccgatgccagagtgg

SEQ ID NO: 78465 - DNA, 25 bp, Mus musculus
aggtactccgctccctgcgtctgga

SEQ ID NO: 78466 - DNA, 25 bp, Mus musculus
aggtagatgacctccaactggtgag

SEQ ID NO: 78467 - DNA, 25 bp, Mus musculus
aggtagatgccccaaaggcctggtc

SEQ ID NO: 78468 - DNA, 25 bp, Mus musculus
aggtagcagtagcaccctcccatgg

SEQ ID NO: 78469 - DNA, 25 bp, Mus musculus
aggtagccgcatctcagtctcaggg

SEQ ID NO: 78470 - DNA, 25 bp, Mus musculus
aggtagtacaccaggagcagcaggc

SEQ ID NO: 78471 - DNA, 25 bp, Mus musculus
aggtatttgagatggccactcgggc

SEQ ID NO: 78472 - DNA, 25 bp, Mus musculus
aggtcaactgttctggctatgtgca

SEQ ID NO: 78473 - DNA, 25 bp, Mus musculus
aggtcatcgtgctgcccaaggacga

SEQ ID NO: 78474 - DNA, 25 bp, Mus musculus
aggtcattaaattcgccaccgcgca

SEQ ID NO: 78475 - DNA, 25 bp, Mus musculus
aggtccccgtttctgttggcgtgca

SEQ ID NO: 78476 - DNA, 25 bp, Mus musculus
aggtccctgagcgtttcttcccgag

SEQ ID NO: 78477 - DNA, 25 bp, Mus musculus
aggtccgtaaagagggccgctacag

SEQ ID NO: 78478 - DNA, 25 bp, Mus musculus
aggtcctctacctgaaaactgggag

SEQ ID NO: 78479 - DNA, 25 bp, Mus musculus
aggtcctggctcgtgtgtggttcct

SEQ ID NO: 78480 - DNA, 25 bp, Mus musculus
aggtcgccggcccagatgcgttcct

SEQ ID NO: 78481 - DNA, 25 bp, Mus musculus
aggtctccccaacacaggacatcag

SEQ ID NO: 78482 - DNA, 25 bp, Mus musculus
aggtctcgggtcatgccctacggaa

SEQ ID NO: 78483 - DNA, 25 bp, Mus musculus
aggtcttccaagaacacacacaggg

SEQ ID NO: 78484 - DNA, 25 bp, Mus musculus
aggtcttcctcaagccggacgagcc

SEQ ID NO: 78485 - DNA, 25 bp, Mus musculus
aggtctttctggtcctcagctgtct

SEQ ID NO: 78486 - DNA, 25 bp, Mus musculus
aggtctttgctaccaacctgttcaa

SEQ ID NO: 78487 - DNA, 25 bp, Mus musculus
aggtgaacagctgccagtacccagg

SEQ ID NO: 78488 - DNA, 25 bp, Mus musculus
aggtgacagacagtgcatatatggg

SEQ ID NO: 78489 - DNA, 25 bp, Mus musculus
aggtgaccaacgtgtctccgagcgc

SEQ ID NO: 78490 - DNA, 25 bp, Mus musculus
aggtgaccccacaaatccctgatgc

SEQ ID NO: 78491 - DNA, 25 bp, Mus musculus
aggtgaccccacactgcgggaccag

SEQ ID NO: 78492 - DNA, 25 bp, Mus musculus
aggtgaccgttaaggaccagcccag

SEQ ID NO: 78493 - DNA, 25 bp, Mus musculus
aggtgacggacctactgcgagcaga

SEQ ID NO: 78494 - DNA, 25 bp, Mus musculus
aggtgacggccgtagaccagtctga

SEQ ID NO: 78495 - DNA, 25 bp, Mus musculus
aggtgaggactccatcaagggccca

SEQ ID NO: 78496 - DNA, 25 bp, Mus musculus
aggtgatcctaggtgctggccagca

SEQ ID NO: 78497 - DNA, 25 bp, Mus musculus
aggtgatgctccttccgcggtgctg

SEQ ID NO: 78498 - DNA, 25 bp, Mus musculus
aggtgcagcagaaaacggaccggct

SEQ ID NO: 78499 - DNA, 25 bp, Mus musculus
aggtgcaggttatgctggcggccca

SEQ ID NO: 78500 - DNA, 25 bp, Mus musculus
aggtgcccacgcaaatgtccttcct

SEQ ID NO: 78501 - DNA, 25 bp, Mus musculus
aggtgcccagggtgcctgaccccag

SEQ ID NO: 78502 - DNA, 25 bp, Mus musculus
aggtgcccgtagacatccgcaggct

SEQ ID NO: 78503 - DNA, 25 bp, Mus musculus
aggtgctcgtgtcccgctgcccagt

SEQ ID NO: 78504 - DNA, 25 bp, Mus musculus
aggtgctctcactccagcccagtga

SEQ ID NO: 78505 - DNA, 25 bp, Mus musculus
aggtgctgcggggacttcaagagga

SEQ ID NO: 78506 - DNA, 25 bp, Mus musculus
aggtgcttcgggtcagacgtgccaa

SEQ ID NO: 78507 - DNA, 25 bp, Mus musculus
aggtggactcggcagacgccggtgg

SEQ ID NO: 78508 - DNA, 25 bp, Mus musculus
aggtggaggttcagcattggatctt

SEQ ID NO: 78509 - DNA, 25 bp, Mus musculus
aggtggatcctgcagagctcttcag

SEQ ID NO: 78510 - DNA, 25 bp, Mus musculus
aggtgggacctctctgcttcatgga

SEQ ID NO: 78511 - DNA, 25 bp, Mus musculus
aggtgggtccgcgcgtgatcgcggg

SEQ ID NO: 78512 - DNA, 25 bp, Mus musculus
aggtggtacccttgtgacgatggcc

SEQ ID NO: 78513 - DNA, 25 bp, Mus musculus
aggtggtcgatgtcacaggcctgaa

SEQ ID NO: 78514 - DNA, 25 bp, Mus musculus
aggtggtttgtgcaccgcccaccgc

SEQ ID NO: 78515 - DNA, 25 bp, Mus musculus
aggtgtgcccctcctcacagaagac

SEQ ID NO: 78516 - DNA, 25 bp, Mus musculus
aggtgttcattgaagtccaggtgcc

SEQ ID NO: 78517 - DNA, 25 bp, Mus musculus
aggtgtttgtgacctcggagaacca

SEQ ID NO: 78518 - DNA, 25 bp, Mus musculus
aggttaaaaccatcagccccgcatc

SEQ ID NO: 78519 - DNA, 25 bp, Mus musculus
aggttaatcatttgcagctggctgc

SEQ ID NO: 78520 - DNA, 25 bp, Mus musculus
aggttaccataagccagatcagcag

SEQ ID NO: 78521 - DNA, 25 bp, Mus musculus
aggttacgggcggtcagcttcccag

SEQ ID NO: 78522 - DNA, 25 bp, Mus musculus
aggttccagaggctcgctgcttcta

SEQ ID NO: 78523 - DNA, 25 bp, Mus musculus
aggttccgccgaatcttgcacacgg

SEQ ID NO: 78524 - DNA, 25 bp, Mus musculus
aggttctaggcggagcacaggtcca

SEQ ID NO: 78525 - DNA, 25 bp, Mus musculus
aggttgaccggctgcgctcctggca

SEQ ID NO: 78526 - DNA, 25 bp, Mus musculus
aggttgacgactgaagaatcacaga

SEQ ID NO: 78527 - DNA, 25 bp, Mus musculus
aggttgcgggtttcgcgcctgcgca

SEQ ID NO: 78528 - DNA, 25 bp, Mus musculus
aggttgtatcagtgaagacagccac

SEQ ID NO: 78529 - DNA, 25 bp, Mus musculus
aggtttcaaggcacggacgccacaa

SEQ ID NO: 78530 - DNA, 25 bp, Mus musculus
aggttttccggcagcgcttcaggca

SEQ ID NO: 78531 - DNA, 25 bp, Mus musculus
agtaaaaactgctcagtgcccaggg

SEQ ID NO: 78532 - DNA, 25 bp, Mus musculus
agtaaaagtgtcaatgatgtccagg

SEQ ID NO: 78533 - DNA, 25 bp, Mus musculus
agtaaaatggcggacctggcgaacg

SEQ ID NO: 78534 - DNA, 25 bp, Mus musculus
agtaaacagtgcagaccccggtgtg

SEQ ID NO: 78535 - DNA, 25 bp, Mus musculus
agtaaagaagactctgaacatctga

SEQ ID NO: 78536 - DNA, 25 bp, Mus musculus
agtaaagagcacctagcatcgggcc

SEQ ID NO: 78537 - DNA, 25 bp, Mus musculus
agtaaagcttgtgtaggccctgcct

SEQ ID NO: 78538 - DNA, 25 bp, Mus musculus
agtaaatggtttcatcgccctcgcc

SEQ ID NO: 78539 - DNA, 25 bp, Mus musculus
agtaacgctactccgggacaatctt

SEQ ID NO: 78540 - DNA, 25 bp, Mus musculus
agtaacgggacgtcgccgcgaagct

SEQ ID NO: 78541 - DNA, 25 bp, Mus musculus
agtaagcgcattcttagccacaggg

SEQ ID NO: 78542 - DNA, 25 bp, Mus musculus
agtaagtagcggctccctcgagccc

SEQ ID NO: 78543 - DNA, 25 bp, Mus musculus
agtaagtatagcctgcccactgtga

SEQ ID NO: 78544 - DNA, 25 bp, Mus musculus
agtaagtgcccttctcatgttagag

SEQ ID NO: 78545 - DNA, 25 bp, Mus musculus
agtaagttgggcctcctatagagag

SEQ ID NO: 78546 - DNA, 25 bp, Mus musculus
agtaatcccatcacaagctttcagg

SEQ ID NO: 78547 - DNA, 25 bp, Mus musculus
agtaatctccatgtcccacaggcag

SEQ ID NO: 78548 - DNA, 25 bp, Mus musculus
agtaatgagtgagatcaagaaagaa

SEQ ID NO: 78549 - DNA, 25 bp, Mus musculus
agtaatgcccgggaaactcctctgg

SEQ ID NO: 78550 - DNA, 25 bp, Mus musculus
agtacaaaaactgccggcgattctg

SEQ ID NO: 78551 - DNA, 25 bp, Mus musculus
agtacaatgaggatgaagacccagc

SEQ ID NO: 78552 - DNA, 25 bp, Mus musculus
agtacacacgaaggagcagctggca

SEQ ID NO: 78553 - DNA, 25 bp, Mus musculus
agtacagcaccgacgaggacgaggt

SEQ ID NO: 78554 - DNA, 25 bp, Mus musculus
agtacagccgcttttctctggagaa

SEQ ID NO: 78555 - DNA, 25 bp, Mus musculus
agtacatcatccacatgcccaaggg

SEQ ID NO: 78556 - DNA, 25 bp, Mus musculus
agtacatgggcctcctgccgggact

SEQ ID NO: 78557 - DNA, 25 bp, Mus musculus
agtacattctgaacccgcggcaggt

SEQ ID NO: 78558 - DNA, 25 bp, Mus musculus
agtacattgaagagcagttgctgga

SEQ ID NO: 78559 - DNA, 25 bp, Mus musculus
agtaccaagtgaaaaagccccgcag

SEQ ID NO: 78560 - DNA, 25 bp, Mus musculus
agtaccaccaccatttctcgggagg

SEQ ID NO: 78561 - DNA, 25 bp, Mus musculus
agtaccaggccacttataaccagag

SEQ ID NO: 78562 - DNA, 25 bp, Mus musculus
agtacccagcctgcaagcaacgtgg

SEQ ID NO: 78563 - DNA, 25 bp, Mus musculus
agtaccgagtacctggctgggccct

SEQ ID NO: 78564 - DNA, 25 bp, Mus musculus
agtaccggcaggtggcatcccatgt

SEQ ID NO: 78565 - DNA, 25 bp, Mus musculus
agtaccggtctttcctgggctccat

SEQ ID NO: 78566 - DNA, 25 bp, Mus musculus
agtaccgtcgagaagcctatcaccg

SEQ ID NO: 78567 - DNA, 25 bp, Mus musculus
agtacctccgcaagcgctttggtgg

SEQ ID NO: 78568 - DNA, 25 bp, Mus musculus
agtacctctacaccctccagctttg

SEQ ID NO: 78569 - DNA, 25 bp, Mus musculus
agtacctggaattccctgaccacag

SEQ ID NO: 78570 - DNA, 25 bp, Mus musculus
agtacgagacccgattcctgtgcaa

SEQ ID NO: 78571 - DNA, 25 bp, Mus musculus
agtacgcaacgtgcttcaacagcgg

SEQ ID NO: 78572 - DNA, 25 bp, Mus musculus
agtacgccatgatgtacacaggaag

SEQ ID NO: 78573 - DNA, 25 bp, Mus musculus
agtacgcggcgcatcatcaagttga

SEQ ID NO: 78574 - DNA, 25 bp, Mus musculus
agtacgcggtgactgatgactacca

SEQ ID NO: 78575 - DNA, 25 bp, Mus musculus
agtacggcgacgacatgtacgggcc

SEQ ID NO: 78576 - DNA, 25 bp, Mus musculus
agtacgtggtccctcagtcaagaag

SEQ ID NO: 78577 - DNA, 25 bp, Mus musculus
agtacgttaacgtgggagatctagc

SEQ ID NO: 78578 - DNA, 25 bp, Mus musculus
agtactcctgcatggtgggccacga

SEQ ID NO: 78579 - DNA, 25 bp, Mus musculus
agtactcgcgcaagcttggaggcca

SEQ ID NO: 78580 - DNA, 25 bp, Mus musculus
agtactcgtgggacatcatggagcc

SEQ ID NO: 78581 - DNA, 25 bp, Mus musculus
agtactgagaaaagaattggcccag

SEQ ID NO: 78582 - DNA, 25 bp, Mus musculus
agtactgatgttcactttgctttgt

SEQ ID NO: 78583 - DNA, 25 bp, Mus musculus
agtacttaacccctatgcgccagga

SEQ ID NO: 78584 - DNA, 25 bp, Mus musculus
agtacttcaggcagaggaaccgggc

SEQ ID NO: 78585 - DNA, 25 bp, Mus musculus
agtacttggtcgagcccaggagcct

SEQ ID NO: 78586 - DNA, 25 bp, Mus musculus
agtacttttgccactgttctgcctg

SEQ ID NO: 78587 - DNA, 25 bp, Mus musculus
agtagaaccagcctcaagaacgccc

SEQ ID NO: 78588 - DNA, 25 bp, Mus musculus
agtagacagaacagcctgagccagg

SEQ ID NO: 78589 - DNA, 25 bp, Mus musculus
agtagactatctgagctccctgggc

SEQ ID NO: 78590 - DNA, 25 bp, Mus musculus
agtagcagcctcagcactttcaaag

SEQ ID NO: 78591 - DNA, 25 bp, Mus musculus
agtagcatcatggagcggaccagcc

SEQ ID NO: 78592 - DNA, 25 bp, Mus musculus
agtagcccaccacgtcaagagctgg

SEQ ID NO: 78593 - DNA, 25 bp, Mus musculus
agtagcctgacctgagtgttagtgc

SEQ ID NO: 78594 - DNA, 25 bp, Mus musculus
agtagcgcggcaccgattcctctcg

SEQ ID NO: 78595 - DNA, 25 bp, Mus musculus
agtagctgacagagcgaacccgagg

SEQ ID NO: 78596 - DNA, 25 bp, Mus musculus
agtagctgggtaggcagagtatcat

SEQ ID NO: 78597 - DNA, 25 bp, Mus musculus
agtagcttgttgctgaacgcggcca

SEQ ID NO: 78598 - DNA, 25 bp, Mus musculus
agtaggagggaaagacagaagtcct

SEQ ID NO: 78599 - DNA, 25 bp, Mus musculus
agtaggcacatttctctattccgcg

SEQ ID NO: 78600 - DNA, 25 bp, Mus musculus
agtaggctttgtcagggactcctcc

SEQ ID NO: 78601 - DNA, 25 bp, Mus musculus
agtaggtcaggcagctccagtagcg

SEQ ID NO: 78602 - DNA, 25 bp, Mus musculus
agtagtagccacgaagacatgcccg

SEQ ID NO: 78603 - DNA, 25 bp, Mus musculus
agtagtcaccgcagcagcggtggca

SEQ ID NO: 78604 - DNA, 25 bp, Mus musculus
agtagtctccatgggcagctcaagg

SEQ ID NO: 78605 - DNA, 25 bp, Mus musculus
agtagttcagaaggcaaatgtcagc

SEQ ID NO: 78606 - DNA, 25 bp, Mus musculus
agtataagaccagctatgcccggaa

SEQ ID NO: 78607 - DNA, 25 bp, Mus musculus
agtatactgtgttggcacgctccca

SEQ ID NO: 78608 - DNA, 25 bp, Mus musculus
agtatagtgcccctgagcatgtgaa

SEQ ID NO: 78609 - DNA, 25 bp, Mus musculus
agtatcaaggaatcccggcgtgggc

SEQ ID NO: 78610 - DNA, 25 bp, Mus musculus
agtatcatgtcttatactcttgtag

SEQ ID NO: 78611 - DNA, 25 bp, Mus musculus
agtatccggagccagacagcctctt

SEQ ID NO: 78612 - DNA, 25 bp, Mus musculus
agtatctatggtcgcccgggagctt

SEQ ID NO: 78613 - DNA, 25 bp, Mus musculus
agtatgattttgaggacgactgtga

SEQ ID NO: 78614 - DNA, 25 bp, Mus musculus
agtatgcccctccaccagatttctg

SEQ ID NO: 78615 - DNA, 25 bp, Mus musculus
agtatgccgacttcccgcacatgga

SEQ ID NO: 78616 - DNA, 25 bp, Mus musculus
agtatgctcattgtgctccccaagg

SEQ ID NO: 78617 - DNA, 25 bp, Mus musculus
agtatgtgaggatgttgcaatggcc

SEQ ID NO: 78618 - DNA, 25 bp, Mus musculus
agtatgtggactcactgttgccgga

SEQ ID NO: 78619 - DNA, 25 bp, Mus musculus
agtatgtgggctttgcaaccctccc

SEQ ID NO: 78620 - DNA, 25 bp, Mus musculus
agtattcaacacctccttggagacg

SEQ ID NO: 78621 - DNA, 25 bp, Mus musculus
agtattccgaccagaaaccaaggag

SEQ ID NO: 78622 - DNA, 25 bp, Mus musculus
agtatttcgcttctggaggctccga

SEQ ID NO: 78623 - DNA, 25 bp, Mus musculus
agtatttgcgcacccctcaggaagt

SEQ ID NO: 78624 - DNA, 25 bp, Mus musculus
agtattttgtcaactgtgccgggca

SEQ ID NO: 78625 - DNA, 25 bp, Mus musculus
agtcaaagaacctatattccatcag

SEQ ID NO: 78626 - DNA, 25 bp, Mus musculus
agtcaaagtgctgtgtacctggtca

SEQ ID NO: 78627 - DNA, 25 bp, Mus musculus
agtcaaatgacagtgtatccaacag

SEQ ID NO: 78628 - DNA, 25 bp, Mus musculus
agtcaagagctgttcacgagtcatt

SEQ ID NO: 78629 - DNA, 25 bp, Mus musculus
agtcaagaggacagatataacattg

SEQ ID NO: 78630 - DNA, 25 bp, Mus musculus
agtcaattccaacctctaagtcggg

SEQ ID NO: 78631 - DNA, 25 bp, Mus musculus
agtcaatttggaccctgccctgaag

SEQ ID NO: 78632 - DNA, 25 bp, Mus musculus
agtcaccattctttggtccccaggg

SEQ ID NO: 78633 - DNA, 25 bp, Mus musculus
agtcaccgtctgtggacatgcgccc

SEQ ID NO: 78634 - DNA, 25 bp, Mus musculus
agtcacctgtgagtcagccgcagag

SEQ ID NO: 78635 - DNA, 25 bp, Mus musculus
agtcacggaagatgatgggagaccc

SEQ ID NO: 78636 - DNA, 25 bp, Mus musculus
agtcagaaaacacgagactcaagct

SEQ ID NO: 78637 - DNA, 25 bp, Mus musculus
agtcagaacgttgcagccatccagg

SEQ ID NO: 78638 - DNA, 25 bp, Mus musculus
agtcagatacagaaggaagccaccg

SEQ ID NO: 78639 - DNA, 25 bp, Mus musculus
agtcagatgtacagtccgcagggca

SEQ ID NO: 78640 - DNA, 25 bp, Mus musculus
agtcagattccacaatagtctatta

SEQ ID NO: 78641 - DNA, 25 bp, Mus musculus
agtcagcacttgaggatccacaccg

SEQ ID NO: 78642 - DNA, 25 bp, Mus musculus
agtcagcagacccaattacccaggg

SEQ ID NO: 78643 - DNA, 25 bp, Mus musculus
agtcagcagccccagacgttgtgca

SEQ ID NO: 78644 - DNA, 25 bp, Mus musculus
agtcagcatccctgcggtgatcatg

SEQ ID NO: 78645 - DNA, 25 bp, Mus musculus
agtcagcctgtgtgtatccgatgtc

SEQ ID NO: 78646 - DNA, 25 bp, Mus musculus
agtcagctggactggagaacctgtg

SEQ ID NO: 78647 - DNA, 25 bp, Mus musculus
agtcagtgacactccagatgaaggg

SEQ ID NO: 78648 - DNA, 25 bp, Mus musculus
agtcatacagaggagctggccacga

SEQ ID NO: 78649 - DNA, 25 bp, Mus musculus
agtcatatttgttgatgctgaccag

SEQ ID NO: 78650 - DNA, 25 bp, Mus musculus
agtcatcctcggtgcggccgctgtg

SEQ ID NO: 78651 - DNA, 25 bp, Mus musculus
agtcatctacttttgtctgcaagaa

SEQ ID NO: 78652 - DNA, 25 bp, Mus musculus
agtcattcccgagccctgagtgacc

SEQ ID NO: 78653 - DNA, 25 bp, Mus musculus
agtccaagatgttttcctgggagag

SEQ ID NO: 78654 - DNA, 25 bp, Mus musculus
agtccaccaaagagccaaacctagg

SEQ ID NO: 78655 - DNA, 25 bp, Mus musculus
agtccacccatctcagtgtgtgcgg

SEQ ID NO: 78656 - DNA, 25 bp, Mus musculus
agtccactctgaacggcacgtgctc

SEQ ID NO: 78657 - DNA, 25 bp, Mus musculus
agtccagagtgtagagcagatcccg

SEQ ID NO: 78658 - DNA, 25 bp, Mus musculus
agtccagcacttcccatagccaaag

SEQ ID NO: 78659 - DNA, 25 bp, Mus musculus
agtccagctctagcaggccagggtt

SEQ ID NO: 78660 - DNA, 25 bp, Mus musculus
agtccaggtccatggcgttatccag

SEQ ID NO: 78661 - DNA, 25 bp, Mus musculus
agtccatcatttcaccgcagctgaa

SEQ ID NO: 78662 - DNA, 25 bp, Mus musculus
agtccatggtgcagaacttagcggc

SEQ ID NO: 78663 - DNA, 25 bp, Mus musculus
agtcccagtccagtgcacaaagatg

SEQ ID NO: 78664 - DNA, 25 bp, Mus musculus
agtcccatcactccaaggagagaag

SEQ ID NO: 78665 - DNA, 25 bp, Mus musculus
agtccccaatgtgaaatctgtccag

SEQ ID NO: 78666 - DNA, 25 bp, Mus musculus
agtccccgtacacacactggaagca

SEQ ID NO: 78667 - DNA, 25 bp, Mus musculus
agtcccctgggatcctagtgtccct

SEQ ID NO: 78668 - DNA, 25 bp, Mus musculus
agtcccgctcggcttgtcactgtag

SEQ ID NO: 78669 - DNA, 25 bp, Mus musculus
agtccctcctggtcataaagtcagg

SEQ ID NO: 78670 - DNA, 25 bp, Mus musculus
agtccctgggtgtgtcttgtcgata

SEQ ID NO: 78671 - DNA, 25 bp, Mus musculus
agtccctttcatccgggacagtagc

SEQ ID NO: 78672 - DNA, 25 bp, Mus musculus
agtccgaagccacccatgagataat

SEQ ID NO: 78673 - DNA, 25 bp, Mus musculus
agtccgagcttcaggtgccatgggc

SEQ ID NO: 78674 - DNA, 25 bp, Mus musculus
agtccgatggctgcagaggacaacc

SEQ ID NO: 78675 - DNA, 25 bp, Mus musculus
agtccgcggtagctgccccgttctg

SEQ ID NO: 78676 - DNA, 25 bp, Mus musculus
agtccgcggtcagaaactggcccag

SEQ ID NO: 78677 - DNA, 25 bp, Mus musculus
agtccggacgccaaggtctgcttct

SEQ ID NO: 78678 - DNA, 25 bp, Mus musculus
agtccgggattggttggcttcaact

SEQ ID NO: 78679 - DNA, 25 bp, Mus musculus
agtccgtggatctctggagcctgaa

SEQ ID NO: 78680 - DNA, 25 bp, Mus musculus
agtcctctggcaaatctagtagtgg

SEQ ID NO: 78681 - DNA, 25 bp, Mus musculus
agtcctgaggaacccgcgctgcgca

SEQ ID NO: 78682 - DNA, 25 bp, Mus musculus
agtcctgcccaagaagatgtttccg

SEQ ID NO: 78683 - DNA, 25 bp, Mus musculus
agtcctgccgctgcctggaattcag

SEQ ID NO: 78684 - DNA, 25 bp, Mus musculus
agtccttcttctccggcctctttgg

SEQ ID NO: 78685 - DNA, 25 bp, Mus musculus
agtcgaagcttccagcactccgtga

SEQ ID NO: 78686 - DNA, 25 bp, Mus musculus
agtcgatgactcctggctccaacac

SEQ ID NO: 78687 - DNA, 25 bp, Mus musculus
agtcgcccggcacctaaaactgtgg

SEQ ID NO: 78688 - DNA, 25 bp, Mus musculus
agtcgccgcggtttcctgcttcaac

SEQ ID NO: 78689 - DNA, 25 bp, Mus musculus
agtcgcgccgatgcacgggcaacaa

SEQ ID NO: 78690 - DNA, 25 bp, Mus musculus
agtcgcgcgctgctgcatccacgga

SEQ ID NO: 78691 - DNA, 25 bp, Mus musculus
agtcgctcgccatgtccgctatgga

SEQ ID NO: 78692 - DNA, 25 bp, Mus musculus
agtcgcttcgactatgacgatgagc

SEQ ID NO: 78693 - DNA, 25 bp, Mus musculus
agtcggaagatttggcggtgcatct

SEQ ID NO: 78694 - DNA, 25 bp, Mus musculus
agtcggactccctgttcctaggaag

SEQ ID NO: 78695 - DNA, 25 bp, Mus musculus
agtcggagctggtacgccgcctcgc

SEQ ID NO: 78696 - DNA, 25 bp, Mus musculus
agtcggaggcatggctggtgtgtcc

SEQ ID NO: 78697 - DNA, 25 bp, Mus musculus
agtcggcctcgggagaaactcttca

SEQ ID NO: 78698 - DNA, 25 bp, Mus musculus
agtcggcctgtcagccggcttcgag

SEQ ID NO: 78699 - DNA, 25 bp, Mus musculus
agtcgtcccttctggctgtgcttcc

SEQ ID NO: 78700 - DNA, 25 bp, Mus musculus
agtcgtcgctggagaaaatatcttc

SEQ ID NO: 78701 - DNA, 25 bp, Mus musculus
agtcgtggcgtagtctgtgatcgct

SEQ ID NO: 78702 - DNA, 25 bp, Mus musculus
agtctaccgagtatcctgcgcaggg

SEQ ID NO: 78703 - DNA, 25 bp, Mus musculus
agtctactcggatggtcgctttaga

SEQ ID NO: 78704 - DNA, 25 bp, Mus musculus
agtctactgcgcaggcgtcctcctg

SEQ ID NO: 78705 - DNA, 25 bp, Mus musculus
agtctatttctggtgctgttcaagg

SEQ ID NO: 78706 - DNA, 25 bp, Mus musculus
agtctcatcgcccacaacttggtcc

SEQ ID NO: 78707 - DNA, 25 bp, Mus musculus
agtctccagcactccgggtgggaac

SEQ ID NO: 78708 - DNA, 25 bp, Mus musculus
agtctccaggatcgagcctctcagc

SEQ ID NO: 78709 - DNA, 25 bp, Mus musculus
agtctcccggagaggtgatggaccc

SEQ ID NO: 78710 - DNA, 25 bp, Mus musculus
agtctcctaaacaaacaggctatgg

SEQ ID NO: 78711 - DNA, 25 bp, Mus musculus
agtctcctgagcatgtgaaccggcc

SEQ ID NO: 78712 - DNA, 25 bp, Mus musculus
agtctcgacgtgcaccaagggcaca

SEQ ID NO: 78713 - DNA, 25 bp, Mus musculus
agtctcggatgcacgaacttcccgc

SEQ ID NO: 78714 - DNA, 25 bp, Mus musculus
agtctcgtgagaaacgccatcgcca

SEQ ID NO: 78715 - DNA, 25 bp, Mus musculus
agtctctgctatggaagtttattaa

SEQ ID NO: 78716 - DNA, 25 bp, Mus musculus
agtctctgtataggccacagcctcg

SEQ ID NO: 78717 - DNA, 25 bp, Mus musculus
agtctgaaacgtcctattcttaaag

SEQ ID NO: 78718 - DNA, 25 bp, Mus musculus
agtctgaatgccgacagcccgggat

SEQ ID NO: 78719 - DNA, 25 bp, Mus musculus
agtctgagttccaggcatggaggca

SEQ ID NO: 78720 - DNA, 25 bp, Mus musculus
agtctgattactgcaccgccaaggg

SEQ ID NO: 78721 - DNA, 25 bp, Mus musculus
agtctggagactctgacaaaggagc

SEQ ID NO: 78722 - DNA, 25 bp, Mus musculus
agtctggcattctaagggcttaccg

SEQ ID NO: 78723 - DNA, 25 bp, Mus musculus
agtctggccgccaccttggagagtg

SEQ ID NO: 78724 - DNA, 25 bp, Mus musculus
agtctgtacttgctccctcctaggg

SEQ ID NO: 78725 - DNA, 25 bp, Mus musculus
agtcttgcgctcaggtagtgtgccc

SEQ ID NO: 78726 - DNA, 25 bp, Mus musculus
agtgaaaccgcgcatgcacactggg

SEQ ID NO: 78727 - DNA, 25 bp, Mus musculus
agtgaaagtggagcctgagaagaaa

SEQ ID NO: 78728 - DNA, 25 bp, Mus musculus
agtgaaatgccctcctggtgcacca

SEQ ID NO: 78729 - DNA, 25 bp, Mus musculus
agtgaaatttcatgggctctacccc

SEQ ID NO: 78730 - DNA, 25 bp, Mus musculus
agtgaacagtcagctcgagccagga

SEQ ID NO: 78731 - DNA, 25 bp, Mus musculus
agtgaaccctgtctatctctggtag

SEQ ID NO: 78732 - DNA, 25 bp, Mus musculus
agtgaagaaaatccgtccgcatcgc

SEQ ID NO: 78733 - DNA, 25 bp, Mus musculus
agtgaagatgcgatgtacgttttct

SEQ ID NO: 78734 - DNA, 25 bp, Mus musculus
agtgaagcaccctggttgtcccaca

SEQ ID NO: 78735 - DNA, 25 bp, Mus musculus
agtgaaggccctgtaccaagtgagc

SEQ ID NO: 78736 - DNA, 25 bp, Mus musculus
agtgaagggctgagtccacgcccct

SEQ ID NO: 78737 - DNA, 25 bp, Mus musculus
agtgaagggctgtcatgacgatgac

SEQ ID NO: 78738 - DNA, 25 bp, Mus musculus
agtgaagtctttcggctctgcgccc

SEQ ID NO: 78739 - DNA, 25 bp, Mus musculus
agtgaatagcactgccctctggtgg

SEQ ID NO: 78740 - DNA, 25 bp, Mus musculus
agtgaatgtggcgagtcaacccctg

SEQ ID NO: 78741 - DNA, 25 bp, Mus musculus
agtgacacctactaagacttgttgg

SEQ ID NO: 78742 - DNA, 25 bp, Mus musculus
agtgacactggcctctagtctggtg

SEQ ID NO: 78743 - DNA, 25 bp, Mus musculus
agtgacagacgacaacggagccatg

SEQ ID NO: 78744 - DNA, 25 bp, Mus musculus
agtgacatgccacatctaagccacg

SEQ ID NO: 78745 - DNA, 25 bp, Mus musculus
agtgacccctacctcgaaactgtgg

SEQ ID NO: 78746 - DNA, 25 bp, Mus musculus
agtgacgactacctacacatggtgc

SEQ ID NO: 78747 - DNA, 25 bp, Mus musculus
agtgacgtggacgaagactcgcagc

SEQ ID NO: 78748 - DNA, 25 bp, Mus musculus
agtgactatattcgcctcctggcca

SEQ ID NO: 78749 - DNA, 25 bp, Mus musculus
agtgactggttcgagagccttgccc

SEQ ID NO: 78750 - DNA, 25 bp, Mus musculus
agtgagaccacacagctgcacggaa

SEQ ID NO: 78751 - DNA, 25 bp, Mus musculus
agtgagagccaagtacttcatttac

SEQ ID NO: 78752 - DNA, 25 bp, Mus musculus
agtgagagggaaaggcactcccagc

SEQ ID NO: 78753 - DNA, 25 bp, Mus musculus
agtgagagttcagataagtgaggcc

SEQ ID NO: 78754 - DNA, 25 bp, Mus musculus
agtgagatgccgtccttcccgttgg

SEQ ID NO: 78755 - DNA, 25 bp, Mus musculus
agtgagccagcctaccttgcagggc

SEQ ID NO: 78756 - DNA, 25 bp, Mus musculus
agtgagccatacatagtccagacct

SEQ ID NO: 78757 - DNA, 25 bp, Mus musculus
agtgagccccttcccatcgtggatt

SEQ ID NO: 78758 - DNA, 25 bp, Mus musculus
agtgagcctgattttcctttccggg

SEQ ID NO: 78759 - DNA, 25 bp, Mus musculus
agtgagcctgtcgtgtcaccgggcc

SEQ ID NO: 78760 - DNA, 25 bp, Mus musculus
agtgagctaggcaccaactggaaga

SEQ ID NO: 78761 - DNA, 25 bp, Mus musculus
agtgagcttccccttcgcatagagg

SEQ ID NO: 78762 - DNA, 25 bp, Mus musculus
agtgaggaggacatcctgcggaaca

SEQ ID NO: 78763 - DNA, 25 bp, Mus musculus
agtgagtgcaaagcccaggtggacc

SEQ ID NO: 78764 - DNA, 25 bp, Mus musculus
agtgagttcacttgccattcgggca

SEQ ID NO: 78765 - DNA, 25 bp, Mus musculus
agtgatcaagtcctacagcccagag

SEQ ID NO: 78766 - DNA, 25 bp, Mus musculus
agtgatctcagtgcacgtggcccaa

SEQ ID NO: 78767 - DNA, 25 bp, Mus musculus
agtgatgccagcaagaaacggctga

SEQ ID NO: 78768 - DNA, 25 bp, Mus musculus
agtgatggcaggaaaaaccccgagg

SEQ ID NO: 78769 - DNA, 25 bp, Mus musculus
agtgattcacactgtgggccagcga

SEQ ID NO: 78770 - DNA, 25 bp, Mus musculus
agtgattcggacagcgaagttgaaa

SEQ ID NO: 78771 - DNA, 25 bp, Mus musculus
agtgattctgcagggacagggccca

SEQ ID NO: 78772 - DNA, 25 bp, Mus musculus
agtgcagacgactcggccgtgtttc

SEQ ID NO: 78773 - DNA, 25 bp, Mus musculus
agtgcagagctatcctccttaccag

SEQ ID NO: 78774 - DNA, 25 bp, Mus musculus
agtgcatccctgtgcttgagccccg

SEQ ID NO: 78775 - DNA, 25 bp, Mus musculus
agtgcatgcatctctggcccagtga

SEQ ID NO: 78776 - DNA, 25 bp, Mus musculus
agtgcatttgaagctccgacggcca

SEQ ID NO: 78777 - DNA, 25 bp, Mus musculus
agtgccaaaccccacatcacgatgg

SEQ ID NO: 78778 - DNA, 25 bp, Mus musculus
agtgccacacgtgaagaaacttgct

SEQ ID NO: 78779 - DNA, 25 bp, Mus musculus
agtgccaccacatgctgtcgaaggg

SEQ ID NO: 78780 - DNA, 25 bp, Mus musculus
agtgccacccggacaccaagaagtt

SEQ ID NO: 78781 - DNA, 25 bp, Mus musculus
agtgccagagctacgccaagctccg

SEQ ID NO: 78782 - DNA, 25 bp, Mus musculus
agtgccattagagcgccttccagag

SEQ ID NO: 78783 - DNA, 25 bp, Mus musculus
agtgcccaatggacagcccaggcct

SEQ ID NO: 78784 - DNA, 25 bp, Mus musculus
agtgcccagcattatacagagacag

SEQ ID NO: 78785 - DNA, 25 bp, Mus musculus
agtgcccgttgcttatgagccccag

SEQ ID NO: 78786 - DNA, 25 bp, Mus musculus
agtgccctgtggagacttgccgcaa

SEQ ID NO: 78787 - DNA, 25 bp, Mus musculus
agtgccggccgtgggcggtgagctt

SEQ ID NO: 78788 - DNA, 25 bp, Mus musculus
agtgcctctcgggataggagacgac

SEQ ID NO: 78789 - DNA, 25 bp, Mus musculus
agtgccttcaaagaaccttccaggg

SEQ ID NO: 78790 - DNA, 25 bp, Mus musculus
agtgcctttctgaccacacgtggga

SEQ ID NO: 78791 - DNA, 25 bp, Mus musculus
agtgcgacgagagcaacctgcggct

SEQ ID NO: 78792 - DNA, 25 bp, Mus musculus
agtgcgatcacaaccactgtcaacc

SEQ ID NO: 78793 - DNA, 25 bp, Mus musculus
agtgcgcctgccgaagaagatgaca

SEQ ID NO: 78794 - DNA, 25 bp, Mus musculus
agtgcgcgccgctacattctggaga

SEQ ID NO: 78795 - DNA, 25 bp, Mus musculus
agtgcgtcctcgagccggactgacc

SEQ ID NO: 78796 - DNA, 25 bp, Mus musculus
agtgctagtggttctttgccactac

SEQ ID NO: 78797 - DNA, 25 bp, Mus musculus
agtgctccagcaaacccgtgccgaa

SEQ ID NO: 78798 - DNA, 25 bp, Mus musculus
agtgctcccacgaagattgctccag

SEQ ID NO: 78799 - DNA, 25 bp, Mus musculus
agtgctgaggtgagcagtccagcaa

SEQ ID NO: 78800 - DNA, 25 bp, Mus musculus
agtgctgcacccactgtccaggagg

SEQ ID NO: 78801 - DNA, 25 bp, Mus musculus
agtgctggaactggcaaatcatgtc

SEQ ID NO: 78802 - DNA, 25 bp, Mus musculus
agtgctggagatcccagatcgagac

SEQ ID NO: 78803 - DNA, 25 bp, Mus musculus
agtgctggcctcactgccagcctgt

SEQ ID NO: 78804 - DNA, 25 bp, Mus musculus
agtgctgtcaccaagacactcgctg

SEQ ID NO: 78805 - DNA, 25 bp, Mus musculus
agtggaaaaccgactctccctctcg

SEQ ID NO: 78806 - DNA, 25 bp, Mus musculus
agtggaagcacctatcctcggaagg

SEQ ID NO: 78807 - DNA, 25 bp, Mus musculus
agtggaagcgccattccatgtggga

SEQ ID NO: 78808 - DNA, 25 bp, Mus musculus
agtggacacacccagtgaacacgca

SEQ ID NO: 78809 - DNA, 25 bp, Mus musculus
agtggaccaagtctgtcacctgcac

SEQ ID NO: 78810 - DNA, 25 bp, Mus musculus
agtggactcctgctccaaagtgaag

SEQ ID NO: 78811 - DNA, 25 bp, Mus musculus
agtggacttacacgctgggccaagc

SEQ ID NO: 78812 - DNA, 25 bp, Mus musculus
agtggacttgcaccgtcccggcgtt

SEQ ID NO: 78813 - DNA, 25 bp, Mus musculus
agtggagcgttgactggagctgtgc

SEQ ID NO: 78814 - DNA, 25 bp, Mus musculus
agtggatctcacatttctggccggg

SEQ ID NO: 78815 - DNA, 25 bp, Mus musculus
agtggatggagcagctgaacagact

SEQ ID NO: 78816 - DNA, 25 bp, Mus musculus
agtggattcctcttcttccacgagg

SEQ ID NO: 78817 - DNA, 25 bp, Mus musculus
agtggcaagtctccaagcccaagga

SEQ ID NO: 78818 - DNA, 25 bp, Mus musculus
agtggcacaaacacagaacgcccgg

SEQ ID NO: 78819 - DNA, 25 bp, Mus musculus
agtggcacaagacgaccaaaatgag

SEQ ID NO: 78820 - DNA, 25 bp, Mus musculus
agtggcacaagttccctgtatgggt

SEQ ID NO: 78821 - DNA, 25 bp, Mus musculus
agtggcaccctatgctactgtggca

SEQ ID NO: 78822 - DNA, 25 bp, Mus musculus
agtggcaccgcgcgaactctgccaa

SEQ ID NO: 78823 - DNA, 25 bp, Mus musculus
agtggcagaccctgtgctcgttccc

SEQ ID NO: 78824 - DNA, 25 bp, Mus musculus
agtggccactgatcctgaaccgtct

SEQ ID NO: 78825 - DNA, 25 bp, Mus musculus
agtggccttaacacatggattttcc

SEQ ID NO: 78826 - DNA, 25 bp, Mus musculus
agtggcgagggcttcaatgtcaacg

SEQ ID NO: 78827 - DNA, 25 bp, Mus musculus
agtggcgcctcagcagggactacta

SEQ ID NO: 78828 - DNA, 25 bp, Mus musculus
agtggctccgcgacctgactaactg

SEQ ID NO: 78829 - DNA, 25 bp, Mus musculus
agtggctgcggaattcctggtgtcc

SEQ ID NO: 78830 - DNA, 25 bp, Mus musculus
agtgggaaaagaggctctctacatc

SEQ ID NO: 78831 - DNA, 25 bp, Mus musculus
agtgggaagcaaccacctgagagcc

SEQ ID NO: 78832 - DNA, 25 bp, Mus musculus
agtgggaatgtagccgaactggcac

SEQ ID NO: 78833 - DNA, 25 bp, Mus musculus
agtgggacccagacatgcaggactc

SEQ ID NO: 78834 - DNA, 25 bp, Mus musculus
agtgggaggagagccgcagcgccga

SEQ ID NO: 78835 - DNA, 25 bp, Mus musculus
agtgggccctgacggccatacctgt

SEQ ID NO: 78836 - DNA, 25 bp, Mus musculus
agtgggcctccacaagtcattaggg

SEQ ID NO: 78837 - DNA, 25 bp, Mus musculus
agtgggctcatcatcttcatagggc

SEQ ID NO: 78838 - DNA, 25 bp, Mus musculus
agtgggtaccaggactagtggcgag

SEQ ID NO: 78839 - DNA, 25 bp, Mus musculus
agtgggtcttcccttgccctgcgag

SEQ ID NO: 78840 - DNA, 25 bp, Mus musculus
agtgggttttcggatcatgtctggt

SEQ ID NO: 78841 - DNA, 25 bp, Mus musculus
agtggtgaactttggctccctgcca

SEQ ID NO: 78842 - DNA, 25 bp, Mus musculus
agtggtgcttcagttaaggtccatc

SEQ ID NO: 78843 - DNA, 25 bp, Mus musculus
agtggtgggagtatcacgtcccctc

SEQ ID NO: 78844 - DNA, 25 bp, Mus musculus
agtgtaaagcctgctcaggagtctg

SEQ ID NO: 78845 - DNA, 25 bp, Mus musculus
agtgtaaccggcaggccttccagaa

SEQ ID NO: 78846 - DNA, 25 bp, Mus musculus
agtgtacacgcaagagcccaccaga

SEQ ID NO: 78847 - DNA, 25 bp, Mus musculus
agtgtacaggccacgggaacacagt

SEQ ID NO: 78848 - DNA, 25 bp, Mus musculus
agtgtagatcccatccgagacatag

SEQ ID NO: 78849 - DNA, 25 bp, Mus musculus
agtgtagcagatgccagcagggtcc

SEQ ID NO: 78850 - DNA, 25 bp, Mus musculus
agtgtattgagcttggccggcaccg

SEQ ID NO: 78851 - DNA, 25 bp, Mus musculus
agtgtcaccgagaataaactcttgg

SEQ ID NO: 78852 - DNA, 25 bp, Mus musculus
agtgtcactccctgaagatgaagca

SEQ ID NO: 78853 - DNA, 25 bp, Mus musculus
agtgtcagaggaaggtgacgcggaa

SEQ ID NO: 78854 - DNA, 25 bp, Mus musculus
agtgtcgagccctcagcgtggactg

SEQ ID NO: 78855 - DNA, 25 bp, Mus musculus
agtgtcggacccaccacgatgtcat

SEQ ID NO: 78856 - DNA, 25 bp, Mus musculus
agtgtctagtgttgctccgcctgcc

SEQ ID NO: 78857 - DNA, 25 bp, Mus musculus
agtgtctccccacagctgagactga

SEQ ID NO: 78858 - DNA, 25 bp, Mus musculus
agtgtgaacttcaggctgctctaga

SEQ ID NO: 78859 - DNA, 25 bp, Mus musculus
agtgtgagaccctcagggacactgt

SEQ ID NO: 78860 - DNA, 25 bp, Mus musculus
agtgtgatgctccagatagcggcca

SEQ ID NO: 78861 - DNA, 25 bp, Mus musculus
agtgtgcaccgcagcccggtcacta

SEQ ID NO: 78862 - DNA, 25 bp, Mus musculus
agtgtgccagcctaagcctgcggag

SEQ ID NO: 78863 - DNA, 25 bp, Mus musculus
agtgtgcccaccacggtagctgtgt

SEQ ID NO: 78864 - DNA, 25 bp, Mus musculus
agtgtgcgcatcagcttcgccaagg

SEQ ID NO: 78865 - DNA, 25 bp, Mus musculus
agtgtgcgtcaaagccgggtaccac

SEQ ID NO: 78866 - DNA, 25 bp, Mus musculus
agtgtggccaggtgtgacctgaaca

SEQ ID NO: 78867 - DNA, 25 bp, Mus musculus
agtgtgggtcagacccagaggagaa

SEQ ID NO: 78868 - DNA, 25 bp, Mus musculus
agtgtgtccactctaaatctcgcgg

SEQ ID NO: 78869 - DNA, 25 bp, Mus musculus
agtgtgtccatctccaggctccttg

SEQ ID NO: 78870 - DNA, 25 bp, Mus musculus
agtgtgtcgccttgagcctgtgacg

SEQ ID NO: 78871 - DNA, 25 bp, Mus musculus
agtgtgtcgtccctttctgagcaga

SEQ ID NO: 78872 - DNA, 25 bp, Mus musculus
agtgtgtgccttatgctgtcatcga

SEQ ID NO: 78873 - DNA, 25 bp, Mus musculus
agtgttaaccatatccctgtcccag

SEQ ID NO: 78874 - DNA, 25 bp, Mus musculus
agtgttactgccgacccatgtggtg

SEQ ID NO: 78875 - DNA, 25 bp, Mus musculus
agtgttctggccgatcctggtgatg

SEQ ID NO: 78876 - DNA, 25 bp, Mus musculus
agtgttgagtagtgcccaggcccag

SEQ ID NO: 78877 - DNA, 25 bp, Mus musculus
agtgttgcaggttccgctactgccg

SEQ ID NO: 78878 - DNA, 25 bp, Mus musculus
agtgttgtcactacagccctgtgga

SEQ ID NO: 78879 - DNA, 25 bp, Mus musculus
agtgttgtgctaccgccttctgaag

SEQ ID NO: 78880 - DNA, 25 bp, Mus musculus
agtgtttgggagtgattctgatgac

SEQ ID NO: 78881 - DNA, 25 bp, Mus musculus
agtgttttactgatcctctggccaa

SEQ ID NO: 78882 - DNA, 25 bp, Mus musculus
agtgttttcctcaaagcctgtgggc

SEQ ID NO: 78883 - DNA, 25 bp, Mus musculus
agttaaccagcttatccagagaggc

SEQ ID NO: 78884 - DNA, 25 bp, Mus musculus
agttaacctggctatccttgggcgc

SEQ ID NO: 78885 - DNA, 25 bp, Mus musculus
agttaagatggcgtctacagcggac

SEQ ID NO: 78886 - DNA, 25 bp, Mus musculus
agttaagcaactctgccctgagtga

SEQ ID NO: 78887 - DNA, 25 bp, Mus musculus
agttaattagcctcgcgagcggcga

SEQ ID NO: 78888 - DNA, 25 bp, Mus musculus
agttacaaatgctcgaagtcctggg

SEQ ID NO: 78889 - DNA, 25 bp, Mus musculus
agttacactgcctgagaccttgttg

SEQ ID NO: 78890 - DNA, 25 bp, Mus musculus
agttactatgcaacccatcatgagc

SEQ ID NO: 78891 - DNA, 25 bp, Mus musculus
agttactcacccgttgagcgtcgac

SEQ ID NO: 78892 - DNA, 25 bp, Mus musculus
agttactgtggcacctacctggcca

SEQ ID NO: 78893 - DNA, 25 bp, Mus musculus
agttagcagggcatcgatatgagct

SEQ ID NO: 78894 - DNA, 25 bp, Mus musculus
agttagccgtgcctgtggtccatga

SEQ ID NO: 78895 - DNA, 25 bp, Mus musculus
agttagttggcctccggtttgcaca

SEQ ID NO: 78896 - DNA, 25 bp, Mus musculus
agttatcatggagaaccccgacggg

SEQ ID NO: 78897 - DNA, 25 bp, Mus musculus
agttatccacggtgcgccatcagcc

SEQ ID NO: 78898 - DNA, 25 bp, Mus musculus
agttattgacagttgcgagccccca

SEQ ID NO: 78899 - DNA, 25 bp, Mus musculus
agttcaaagggcaccagtcggccag

SEQ ID NO: 78900 - DNA, 25 bp, Mus musculus
agttcaactagatgtggctccccag

SEQ ID NO: 78901 - DNA, 25 bp, Mus musculus
agttcacacttgagccttctttggg

SEQ ID NO: 78902 - DNA, 25 bp, Mus musculus
agttcacagcagttcctgcaccggg

SEQ ID NO: 78903 - DNA, 25 bp, Mus musculus
agttcaccggtgagcagcacttgca

SEQ ID NO: 78904 - DNA, 25 bp, Mus musculus
agttcacctgtgagacctgcggcaa

SEQ ID NO: 78905 - DNA, 25 bp, Mus musculus
agttcaccttgcatggccgggctat

SEQ ID NO: 78906 - DNA, 25 bp, Mus musculus
agttcacgacagagaagcagccaat

SEQ ID NO: 78907 - DNA, 25 bp, Mus musculus
agttcagactcttgatcccacagcc

SEQ ID NO: 78908 - DNA, 25 bp, Mus musculus
agttccaatggcacactcttccgga

SEQ ID NO: 78909 - DNA, 25 bp, Mus musculus
agttccagactcacgctgaggccca

SEQ ID NO: 78910 - DNA, 25 bp, Mus musculus
agttcccagtctccaccagctgttg

SEQ ID NO: 78911 - DNA, 25 bp, Mus musculus
agttccctggatggtccaggatgca

SEQ ID NO: 78912 - DNA, 25 bp, Mus musculus
agttccgcggcctctgtgagcagaa

SEQ ID NO: 78913 - DNA, 25 bp, Mus musculus
agttccgggactttgggctcagaca

SEQ ID NO: 78914 - DNA, 25 bp, Mus musculus
agttccggtatttcagggcggagca

SEQ ID NO: 78915 - DNA, 25 bp, Mus musculus
agttcctaaggacgataccactgag

SEQ ID NO: 78916 - DNA, 25 bp, Mus musculus
agttcctgccttggggttccgcaat

SEQ ID NO: 78917 - DNA, 25 bp, Mus musculus
agttcctggagggtctactgcagcc

SEQ ID NO: 78918 - DNA, 25 bp, Mus musculus
agttcctggcgcgagacatgtctga

SEQ ID NO: 78919 - DNA, 25 bp, Mus musculus
agttcgagtgcccatgctgagtagc

SEQ ID NO: 78920 - DNA, 25 bp, Mus musculus
agttcgagttcaggaccccagggtg

SEQ ID NO: 78921 - DNA, 25 bp, Mus musculus
agttcgcccagacgctttagggtcg

SEQ ID NO: 78922 - DNA, 25 bp, Mus musculus
agttcgctgaacacgtcttcccgca

SEQ ID NO: 78923 - DNA, 25 bp, Mus musculus
agttcggctactgtctcctcgtggg

SEQ ID NO: 78924 - DNA, 25 bp, Mus musculus
agttctaggtatccgccgctgtggc

SEQ ID NO: 78925 - DNA, 25 bp, Mus musculus
agttctcaagctccaggactgcccg

SEQ ID NO: 78926 - DNA, 25 bp, Mus musculus
agttctccagccgtataaagacagg

SEQ ID NO: 78927 - DNA, 25 bp, Mus musculus
agttctcccagtttggacctcatga

SEQ ID NO: 78928 - DNA, 25 bp, Mus musculus
agttctcccatctcaataggcccgg

SEQ ID NO: 78929 - DNA, 25 bp, Mus musculus
agttctccgctgctcggactagcca

SEQ ID NO: 78930 - DNA, 25 bp, Mus musculus
agttctctagcaataagcctcctgg

SEQ ID NO: 78931 - DNA, 25 bp, Mus musculus
agttctctctctggttcccattcag

SEQ ID NO: 78932 - DNA, 25 bp, Mus musculus
agttctgacaccagggatggaccac

SEQ ID NO: 78933 - DNA, 25 bp, Mus musculus
agttctgtagaaagcctcctgagtc

SEQ ID NO: 78934 - DNA, 25 bp, Mus musculus
agttctgttacgtcacccataaggg

SEQ ID NO: 78935 - DNA, 25 bp, Mus musculus
agttcttcaggaagctgagccgcga

SEQ ID NO: 78936 - DNA, 25 bp, Mus musculus
agttcttcgcctcctggtgtggcca

SEQ ID NO: 78937 - DNA, 25 bp, Mus musculus
agttcttctgctacgacctgtccca

SEQ ID NO: 78938 - DNA, 25 bp, Mus musculus
agttctttacggaggatgtgggcca

SEQ ID NO: 78939 - DNA, 25 bp, Mus musculus
agttctttgtcccaggcagccaggt

SEQ ID NO: 78940 - DNA, 25 bp, Mus musculus
agttgaacattctgacaagacccag

SEQ ID NO: 78941 - DNA, 25 bp, Mus musculus
agttgaaccagggtgtgacccttgt

SEQ ID NO: 78942 - DNA, 25 bp, Mus musculus
agttgaacccagatgaatcccgtgc

SEQ ID NO: 78943 - DNA, 25 bp, Mus musculus
agttgaagtctaaggtgcgtcacca

SEQ ID NO: 78944 - DNA, 25 bp, Mus musculus
agttgaatcattacttgactaacag

SEQ ID NO: 78945 - DNA, 25 bp, Mus musculus
agttgaatctctcctgccagcagca

SEQ ID NO: 78946 - DNA, 25 bp, Mus musculus
agttgaccgcagttgtccagaagcg

SEQ ID NO: 78947 - DNA, 25 bp, Mus musculus
agttgacggcattgcctggagccca

SEQ ID NO: 78948 - DNA, 25 bp, Mus musculus
agttgaggacctcttgtcgtggtca

SEQ ID NO: 78949 - DNA, 25 bp, Mus musculus
agttgagttcccgatgcccgcatgt

SEQ ID NO: 78950 - DNA, 25 bp, Mus musculus
agttgatgctgaaagagagctccgc

SEQ ID NO: 78951 - DNA, 25 bp, Mus musculus
agttgatggcatttgatacccgcgc

SEQ ID NO: 78952 - DNA, 25 bp, Mus musculus
agttgcagtcctagcttctgacagg

SEQ ID NO: 78953 - DNA, 25 bp, Mus musculus
agttgccaccgccaggactacagtc

SEQ ID NO: 78954 - DNA, 25 bp, Mus musculus
agttgccccaaagctgtcatcagga

SEQ ID NO: 78955 - DNA, 25 bp, Mus musculus
agttgcctccggaaaagatctcggg

SEQ ID NO: 78956 - DNA, 25 bp, Mus musculus
agttgcgccggcgtcctggtctgag

SEQ ID NO: 78957 - DNA, 25 bp, Mus musculus
agttgcgcggcgaagttgagtccca

SEQ ID NO: 78958 - DNA, 25 bp, Mus musculus
agttgctcaacccagctcaggtgtt

SEQ ID NO: 78959 - DNA, 25 bp, Mus musculus
agttgctgttgctgcacttccgctt

SEQ ID NO: 78960 - DNA, 25 bp, Mus musculus
agttgcttgttaacctcccagggag

SEQ ID NO: 78961 - DNA, 25 bp, Mus musculus
agttggaccatggttctgaagttcg

SEQ ID NO: 78962 - DNA, 25 bp, Mus musculus
agttggcagctaatgacttcttcag

SEQ ID NO: 78963 - DNA, 25 bp, Mus musculus
agttggcccacaattgcttgaggag

SEQ ID NO: 78964 - DNA, 25 bp, Mus musculus
agttggcccgcgtcaacgagaacct

SEQ ID NO: 78965 - DNA, 25 bp, Mus musculus
agttggcctagctgtgcgcgcaccg

SEQ ID NO: 78966 - DNA, 25 bp, Mus musculus
agttggcgttcgagggctgaaagtc

SEQ ID NO: 78967 - DNA, 25 bp, Mus musculus
agttggctccatgggtcaccttgac

SEQ ID NO: 78968 - DNA, 25 bp, Mus musculus
agttggctgatgattaccaatcccc

SEQ ID NO: 78969 - DNA, 25 bp, Mus musculus
agttgggtaccatggactgcatcca

SEQ ID NO: 78970 - DNA, 25 bp, Mus musculus
agttggtcgccaacaacgtgacgct

SEQ ID NO: 78971 - DNA, 25 bp, Mus musculus
agttggtgacacacatgagggacca

SEQ ID NO: 78972 - DNA, 25 bp, Mus musculus
agttggtgacattaaggcttctaca

SEQ ID NO: 78973 - DNA, 25 bp, Mus musculus
agttgtactgcgagaagcatgcccg

SEQ ID NO: 78974 - DNA, 25 bp, Mus musculus
agttgtccccaacgtcatgggcatg

SEQ ID NO: 78975 - DNA, 25 bp, Mus musculus
agttgtgctatggagcctgctggcc

SEQ ID NO: 78976 - DNA, 25 bp, Mus musculus
agttgtgtggccacccatgagccga

SEQ ID NO: 78977 - DNA, 25 bp, Mus musculus
agtttaaagccaaacctgtgcctcg

SEQ ID NO: 78978 - DNA, 25 bp, Mus musculus
agtttaatcagtctcttgggcagcc

SEQ ID NO: 78979 - DNA, 25 bp, Mus musculus
agtttcagcgtctcgctgcagcccg

SEQ ID NO: 78980 - DNA, 25 bp, Mus musculus
agtttcagttgcagatccagcccca

SEQ ID NO: 78981 - DNA, 25 bp, Mus musculus
agtttcatgagcgaagccacactgg

SEQ ID NO: 78982 - DNA, 25 bp, Mus musculus
agtttccacagacggtcagctgttg

SEQ ID NO: 78983 - DNA, 25 bp, Mus musculus
agtttcctgagctgacactgaatgg

SEQ ID NO: 78984 - DNA, 25 bp, Mus musculus
agtttcggactctctctacgcagcg

SEQ ID NO: 78985 - DNA, 25 bp, Mus musculus
agtttctacagacatggggtatcca

SEQ ID NO: 78986 - DNA, 25 bp, Mus musculus
agtttctctgagagccacggccgag

SEQ ID NO: 78987 - DNA, 25 bp, Mus musculus
agtttctctgccagtgggaaccgcc

SEQ ID NO: 78988 - DNA, 25 bp, Mus musculus
agtttctgctcatctacacagccgg

SEQ ID NO: 78989 - DNA, 25 bp, Mus musculus
agtttcttcaacctggcagccagag

SEQ ID NO: 78990 - DNA, 25 bp, Mus musculus
agtttgaagagaggagccgagccgc

SEQ ID NO: 78991 - DNA, 25 bp, Mus musculus
agtttgacggcctcgaagctctacg

SEQ ID NO: 78992 - DNA, 25 bp, Mus musculus
agtttgattcccaggcgagaccagc

SEQ ID NO: 78993 - DNA, 25 bp, Mus musculus
agtttggacaattctgtaccgtagg

SEQ ID NO: 78994 - DNA, 25 bp, Mus musculus
agtttggacgaatcctaccttgaag

SEQ ID NO: 78995 - DNA, 25 bp, Mus musculus
agtttggagaatcagagaagtgccc

SEQ ID NO: 78996 - DNA, 25 bp, Mus musculus
agtttgttgcagagctccgcgcctg

SEQ ID NO: 78997 - DNA, 25 bp, Mus musculus
agttttagatgggtacttcagccga

SEQ ID NO: 78998 - DNA, 25 bp, Mus musculus
agttttcttcccacacagaggccca

SEQ ID NO: 78999 - DNA, 25 bp, Mus musculus
agttttcttggctctcctaacccat

SEQ ID NO: 79000 - DNA, 25 bp, Mus musculus
agttttgaatcccagctctgccagt

SEQ ID NO: 79001 - DNA, 25 bp, Mus musculus
agttttggtcctgttctagagaagc

SEQ ID NO: 79002 - DNA, 25 bp, Mus musculus
ataaaaacttggctgctgctttgct

SEQ ID NO: 79003 - DNA, 25 bp, Mus musculus
ataaaatcagaatccagccctcctc

SEQ ID NO: 79004 - DNA, 25 bp, Mus musculus
ataaaccacagcaggtgccgtcatg

SEQ ID NO: 79005 - DNA, 25 bp, Mus musculus
ataaaccaggtgttgcagcgctcca

SEQ ID NO: 79006 - DNA, 25 bp, Mus musculus
ataaagtaatgagtgagatcaagaa

SEQ ID NO: 79007 - DNA, 25 bp, Mus musculus
ataaattagcccctcctggtctggt

SEQ ID NO: 79008 - DNA, 25 bp, Mus musculus
ataacaggtgcgcacaaggccttcg

SEQ ID NO: 79009 - DNA, 25 bp, Mus musculus
ataagaacatcgatccccggcagaa

SEQ ID NO: 79010 - DNA, 25 bp, Mus musculus
ataagaacgtcttggctgccagcag

SEQ ID NO: 79011 - DNA, 25 bp, Mus musculus
ataagaagctgaacgcaggagccgc

SEQ ID NO: 79012 - DNA, 25 bp, Mus musculus
ataaggacactctctagcagccggc

SEQ ID NO: 79013 - DNA, 25 bp, Mus musculus
ataaggagccgcatccgcccaagtg

SEQ ID NO: 79014 - DNA, 25 bp, Mus musculus
ataaggatctgcacacctatgggcc

SEQ ID NO: 79015 - DNA, 25 bp, Mus musculus
ataaggcctctgtgctcgggcagct

SEQ ID NO: 79016 - DNA, 25 bp, Mus musculus
ataagtatcacctccaagcaccggg

SEQ ID NO: 79017 - DNA, 25 bp, Mus musculus
ataagtcagagggaggcaagcgcaa

SEQ ID NO: 79018 - DNA, 25 bp, Mus musculus
ataagtgcttacaaaacgccccgcg

SEQ ID NO: 79019 - DNA, 25 bp, Mus musculus
ataagtggagagtcagagggcacct

SEQ ID NO: 79020 - DNA, 25 bp, Mus musculus
ataatccgcagcaagtatgggtggc

SEQ ID NO: 79021 - DNA, 25 bp, Mus musculus
ataatggagctcgaggcacccttgg

SEQ ID NO: 79022 - DNA, 25 bp, Mus musculus
ataattagaggtgggcagagctgcc

SEQ ID NO: 79023 - DNA, 25 bp, Mus musculus
ataattagcaccatggagcctcagg

SEQ ID NO: 79024 - DNA, 25 bp, Mus musculus
atacaacttctcctttgattaccat

SEQ ID NO: 79025 - DNA, 25 bp, Mus musculus
atacactgaggagcctgctacacac

SEQ ID NO: 79026 - DNA, 25 bp, Mus musculus
atacagacacgccactggagaagcc

SEQ ID NO: 79027 - DNA, 25 bp, Mus musculus
atacagcatccagtaagaagttctg

SEQ ID NO: 79028 - DNA, 25 bp, Mus musculus
atacagttttattccgagcgtccgg

SEQ ID NO: 79029 - DNA, 25 bp, Mus musculus
ataccagcagtcagaggcctacaag

SEQ ID NO: 79030 - DNA, 25 bp, Mus musculus
ataccagtaactgagaatggcccgg

SEQ ID NO: 79031 - DNA, 25 bp, Mus musculus
ataccgcaactcaaagacccactgg

SEQ ID NO: 79032 - DNA, 25 bp, Mus musculus
ataccgggtgtttattgggccacag

SEQ ID NO: 79033 - DNA, 25 bp, Mus musculus
atacctctccccagaagtgctgagg

SEQ ID NO: 79034 - DNA, 25 bp, Mus musculus
atacctgctcagaatccagcgctgg

SEQ ID NO: 79035 - DNA, 25 bp, Mus musculus
atacgacgggcgtggtcacctgcat

SEQ ID NO: 79036 - DNA, 25 bp, Mus musculus
atacgctgacatccgcaacattggg

SEQ ID NO: 79037 - DNA, 25 bp, Mus musculus
atacgggcacagctggaccaggccc

SEQ ID NO: 79038 - DNA, 25 bp, Mus musculus
atacgtcttcctgcggttgcccgga

SEQ ID NO: 79039 - DNA, 25 bp, Mus musculus
atactcaagcccatcccggtggcaa

SEQ ID NO: 79040 - DNA, 25 bp, Mus musculus
atactctgggcagggatggaagcct

SEQ ID NO: 79041 - DNA, 25 bp, Mus musculus
atactttggtcgtctggcagcccct

SEQ ID NO: 79042 - DNA, 25 bp, Mus musculus
atagaaagttagctggcccgtggcc

SEQ ID NO: 79043 - DNA, 25 bp, Mus musculus
atagaaatgctttaagttcgctctg

SEQ ID NO: 79044 - DNA, 25 bp, Mus musculus
atagcaagttccacagcaccctgca

SEQ ID NO: 79045 - DNA, 25 bp, Mus musculus
atagcactcacttgtacggccgcag

SEQ ID NO: 79046 - DNA, 25 bp, Mus musculus
atagcagtccacatgcaaccccaga

SEQ ID NO: 79047 - DNA, 25 bp, Mus musculus
atagccaccagtcttagcagaacag

SEQ ID NO: 79048 - DNA, 25 bp, Mus musculus
atagcccgggctgcgctactgaaga

SEQ ID NO: 79049 - DNA, 25 bp, Mus musculus
atagccctggcctgagcaagactgt

SEQ ID NO: 79050 - DNA, 25 bp, Mus musculus
atagcgaaacctgggcagcacgcgg

SEQ ID NO: 79051 - DNA, 25 bp, Mus musculus
atagcgccgctatgtggcccccgga

SEQ ID NO: 79052 - DNA, 25 bp, Mus musculus
atagcggcggcttccagatggtgtc

SEQ ID NO: 79053 - DNA, 25 bp, Mus musculus
atagctaggacttgcactcggcgcg

SEQ ID NO: 79054 - DNA, 25 bp, Mus musculus
atagctgtgcccactgccgtgctca

SEQ ID NO: 79055 - DNA, 25 bp, Mus musculus
atagcttcttggacacgggccctcg

SEQ ID NO: 79056 - DNA, 25 bp, Mus musculus
ataggaagtgacgtctgggcccgaa

SEQ ID NO: 79057 - DNA, 25 bp, Mus musculus
ataggacacaccgactcaacagagg

SEQ ID NO: 79058 - DNA, 25 bp, Mus musculus
ataggacagatagcatatagagacc

SEQ ID NO: 79059 - DNA, 25 bp, Mus musculus
ataggaccgcggagcagttctagcc

SEQ ID NO: 79060 - DNA, 25 bp, Mus musculus
ataggagacgccagcaccttgcaaa

SEQ ID NO: 79061 - DNA, 25 bp, Mus musculus
ataggagtggcaccgtggatcccca

SEQ ID NO: 79062 - DNA, 25 bp, Mus musculus
ataggccgtcgtcagctgcttcagc

SEQ ID NO: 79063 - DNA, 25 bp, Mus musculus
atagtcacgtgccttcaaacaagag

SEQ ID NO: 79064 - DNA, 25 bp, Mus musculus
atagtctgagacctgagcacgtgcg

SEQ ID NO: 79065 - DNA, 25 bp, Mus musculus
atagtgctgcggaggcacgagctac

SEQ ID NO: 79066 - DNA, 25 bp, Mus musculus
atagttgagagccaccccgaggatg

SEQ ID NO: 79067 - DNA, 25 bp, Mus musculus
atatatcgccggacgcctccaaaag

SEQ ID NO: 79068 - DNA, 25 bp, Mus musculus
atatcataccagctcccactgtcat

SEQ ID NO: 79069 - DNA, 25 bp, Mus musculus
atatccgatacataagtggttctag

SEQ ID NO: 79070 - DNA, 25 bp, Mus musculus
atatcgcctactagatcacagcggg

SEQ ID NO: 79071 - DNA, 25 bp, Mus musculus
atatcgctgcgctggtcgtcgacaa

SEQ ID NO: 79072 - DNA, 25 bp, Mus musculus
atatctcccatgtgcctatgatgtg

SEQ ID NO: 79073 - DNA, 25 bp, Mus musculus
atatgaatatggctatgccttcttg

SEQ ID NO: 79074 - DNA, 25 bp, Mus musculus
atatgaggatgtcgccattccactg

SEQ ID NO: 79075 - DNA, 25 bp, Mus musculus
atatgatcaagtgcaccatccccgg

SEQ ID NO: 79076 - DNA, 25 bp, Mus musculus
atatgatggccatgaaccacgggcg

SEQ ID NO: 79077 - DNA, 25 bp, Mus musculus
atatgccaagcagagggcagaatga

SEQ ID NO: 79078 - DNA, 25 bp, Mus musculus
atatggaaggaaaccggtgggcact

SEQ ID NO: 79079 - DNA, 25 bp, Mus musculus
atatggggagcctaccctccgtcgc

SEQ ID NO: 79080 - DNA, 25 bp, Mus musculus
atatgtctgaggagggccacggtcc

SEQ ID NO: 79081 - DNA, 25 bp, Mus musculus
atattaatgtgcaagagagagaccc

SEQ ID NO: 79082 - DNA, 25 bp, Mus musculus
atattccacttcaacagctatgaga

SEQ ID NO: 79083 - DNA, 25 bp, Mus musculus
atattcctctttacacctaacccag

SEQ ID NO: 79084 - DNA, 25 bp, Mus musculus
atattgattgtccttttaataccca

SEQ ID NO: 79085 - DNA, 25 bp, Mus musculus
atattgccgtgtttggcgctggcca

SEQ ID NO: 79086 - DNA, 25 bp, Mus musculus
atattgcggccctcagcggtcgcca

SEQ ID NO: 79087 - DNA, 25 bp, Mus musculus
atattggctcagaacgcctcccgga

SEQ ID NO: 79088 - DNA, 25 bp, Mus musculus
atatttggcagccttcagggcccca

SEQ ID NO: 79089 - DNA, 25 bp, Mus musculus
atcaaaagggatctctaccacggcc

SEQ ID NO: 79090 - DNA, 25 bp, Mus musculus
atcaaacagctggacatcgagaccc

SEQ ID NO: 79091 - DNA, 25 bp, Mus musculus
atcaaagacttgttcctccagggag

SEQ ID NO: 79092 - DNA, 25 bp, Mus musculus
atcaaagttgtccaagcccgggctc

SEQ ID NO: 79093 - DNA, 25 bp, Mus musculus
atcaacatcatcagagaccccgtca

SEQ ID NO: 79094 - DNA, 25 bp, Mus musculus
atcaaccgcctttggcacacacggg

SEQ ID NO: 79095 - DNA, 25 bp, Mus musculus
atcaagagggtcatggcggctatcg

SEQ ID NO: 79096 - DNA, 25 bp, Mus musculus
atcaaggcctacagctctcccagta

SEQ ID NO: 79097 - DNA, 25 bp, Mus musculus
atcaaggctgcccacagatgggtca

SEQ ID NO: 79098 - DNA, 25 bp, Mus musculus
atcaagtcggcagaggtgacgcgca

SEQ ID NO: 79099 - DNA, 25 bp, Mus musculus
atcaatacttgctgaccgccctgga

SEQ ID NO: 79100 - DNA, 25 bp, Mus musculus
atcaatcgcttacgtgagcagaagt

SEQ ID NO: 79101 - DNA, 25 bp, Mus musculus
atcaatgactgtgggcaaagatgtc

SEQ ID NO: 79102 - DNA, 25 bp, Mus musculus
atcaccagtgtgtggagcctgccgc

SEQ ID NO: 79103 - DNA, 25 bp, Mus musculus
atcacccgagcggaagtggcgcgtc

SEQ ID NO: 79104 - DNA, 25 bp, Mus musculus
atcacctccgcgttctggctcggag

SEQ ID NO: 79105 - DNA, 25 bp, Mus musculus
atcacgctgacagtagacggccgag

SEQ ID NO: 79106 - DNA, 25 bp, Mus musculus
atcactgtcattccccacgcggtag

SEQ ID NO: 79107 - DNA, 25 bp, Mus musculus
atcagaaacccgagcaatgccgacg

SEQ ID NO: 79108 - DNA, 25 bp, Mus musculus
atcagaagatccgagagggatggca

SEQ ID NO: 79109 - DNA, 25 bp, Mus musculus
atcagaaggccctgcacgaggaagt

SEQ ID NO: 79110 - DNA, 25 bp, Mus musculus
atcagacaggagcatcgcagcaagc

SEQ ID NO: 79111 - DNA, 25 bp, Mus musculus
atcagagctctcctgttcttttgga

SEQ ID NO: 79112 - DNA, 25 bp, Mus musculus
atcagcaacctgaaggaccccagga

SEQ ID NO: 79113 - DNA, 25 bp, Mus musculus
atcagcagcggatcacctgggtcag

SEQ ID NO: 79114 - DNA, 25 bp, Mus musculus
atcagcccggaggactacatcacag

SEQ ID NO: 79115 - DNA, 25 bp, Mus musculus
atcagccgctacagatccctggagg

SEQ ID NO: 79116 - DNA, 25 bp, Mus musculus
atcagcctaggtgacggagactcca

SEQ ID NO: 79117 - DNA, 25 bp, Mus musculus
atcagcctcgggtgccctgaggacg

SEQ ID NO: 79118 - DNA, 25 bp, Mus musculus
atcagctagaaaccctgaagcgaga

SEQ ID NO: 79119 - DNA, 25 bp, Mus musculus
atcaggagggtcctgcgcccgctac

SEQ ID NO: 79120 - DNA, 25 bp, Mus musculus
atcaggattctgtggccgcgccttc

SEQ ID NO: 79121 - DNA, 25 bp, Mus musculus
atcagtgactcaggctccatccagt

SEQ ID NO: 79122 - DNA, 25 bp, Mus musculus
atcatagagaccgtgtaccgtggcg

SEQ ID NO: 79123 - DNA, 25 bp, Mus musculus
atcatcaagcgctacgtgcaccagc

SEQ ID NO: 79124 - DNA, 25 bp, Mus musculus
atcatcgaggagacgctcgcgctca

SEQ ID NO: 79125 - DNA, 25 bp, Mus musculus
atcatctgctgactggcctatgtgt

SEQ ID NO: 79126 - DNA, 25 bp, Mus musculus
atcatgaactggtgacgaggcccct

SEQ ID NO: 79127 - DNA, 25 bp, Mus musculus
atcatgcacggaggcctattcagcg

SEQ ID NO: 79128 - DNA, 25 bp, Mus musculus
atcatgggccggaccaagcaggcac

SEQ ID NO: 79129 - DNA, 25 bp, Mus musculus
atcatgtactgaaatcctggaattg

SEQ ID NO: 79130 - DNA, 25 bp, Mus musculus
atcatgtctggctaccgatgcccca

SEQ ID NO: 79131 - DNA, 25 bp, Mus musculus
atccaagggaacgagctggagcccc

SEQ ID NO: 79132 - DNA, 25 bp, Mus musculus
atccaatacttgcacaacactcagc

SEQ ID NO: 79133 - DNA, 25 bp, Mus musculus
atccacacaggagaatcgatatcag

SEQ ID NO: 79134 - DNA, 25 bp, Mus musculus
atccacgctgtaccctcctgagccg

SEQ ID NO: 79135 - DNA, 25 bp, Mus musculus
atccagagctggttccgagggtgcc

SEQ ID NO: 79136 - DNA, 25 bp, Mus musculus
atccagcccgacctgcgacgagagg

SEQ ID NO: 79137 - DNA, 25 bp, Mus musculus
atccaggaacaaagggccaggctca

SEQ ID NO: 79138 - DNA, 25 bp, Mus musculus
atccaggagtgctacgacagacgac

SEQ ID NO: 79139 - DNA, 25 bp, Mus musculus
atccaggattctaccatccatccat

SEQ ID NO: 79140 - DNA, 25 bp, Mus musculus
atccaggcccaggttgacacagcaa

SEQ ID NO: 79141 - DNA, 25 bp, Mus musculus
atccagtccgccttagcgccgcggg

SEQ ID NO: 79142 - DNA, 25 bp, Mus musculus
atccatacagcatccagtaagaagt

SEQ ID NO: 79143 - DNA, 25 bp, Mus musculus
atccatactggcatgaaaccctaca

SEQ ID NO: 79144 - DNA, 25 bp, Mus musculus
atccatcgctgccaagtactcgggc

SEQ ID NO: 79145 - DNA, 25 bp, Mus musculus
atccatttgggcttacagcattacc

SEQ ID NO: 79146 - DNA, 25 bp, Mus musculus
atcccacacagtgacagagggacca

SEQ ID NO: 79147 - DNA, 25 bp, Mus musculus
atcccacccgggagggagacctgct

SEQ ID NO: 79148 - DNA, 25 bp, Mus musculus
atcccaggctggctgcatggtacca

SEQ ID NO: 79149 - DNA, 25 bp, Mus musculus
atccccaagcccgtatttctcccag

SEQ ID NO: 79150 - DNA, 25 bp, Mus musculus
atccccaaggaggacggcgtgatca

SEQ ID NO: 79151 - DNA, 25 bp, Mus musculus
atccccgatgaccagatggcgcaca

SEQ ID NO: 79152 - DNA, 25 bp, Mus musculus
atccctccggcgtcgccgaggtcga

SEQ ID NO: 79153 - DNA, 25 bp, Mus musculus
atccctgacgcagcgagaggatggt

SEQ ID NO: 79154 - DNA, 25 bp, Mus musculus
atccctgcgcgtacggctctgtgac

SEQ ID NO: 79155 - DNA, 25 bp, Mus musculus
atccctggccagtgacgacggcgga

SEQ ID NO: 79156 - DNA, 25 bp, Mus musculus
atccctggcgcgatgtcgtccgcat

SEQ ID NO: 79157 - DNA, 25 bp, Mus musculus
atccgcaggctcatcgtcagcaggc

SEQ ID NO: 79158 - DNA, 25 bp, Mus musculus
atccgcatttgcgaccggcggcggt

SEQ ID NO: 79159 - DNA, 25 bp, Mus musculus
atccggcacatcctggacaatggca

SEQ ID NO: 79160 - DNA, 25 bp, Mus musculus
atccggcagcgagggaagcccggcg

SEQ ID NO: 79161 - DNA, 25 bp, Mus musculus
atccgtgctatgaaggccgagatcc

SEQ ID NO: 79162 - DNA, 25 bp, Mus musculus
atcctcggaaggcagtgcacgtctg

SEQ ID NO: 79163 - DNA, 25 bp, Mus musculus
atcctcttggtggtgcgaaggctgc

SEQ ID NO: 79164 - DNA, 25 bp, Mus musculus
atcctgcttcgggaggaggacctca

SEQ ID NO: 79165 - DNA, 25 bp, Mus musculus
atcctggagcacagaccgacaggca

SEQ ID NO: 79166 - DNA, 25 bp, Mus musculus
atccttaacttggaggcgccgcggg

SEQ ID NO: 79167 - DNA, 25 bp, Mus musculus
atccttaagcgggagaccatgcggc

SEQ ID NO: 79168 - DNA, 25 bp, Mus musculus
atccttcgggctcacccaggaggct

SEQ ID NO: 79169 - DNA, 25 bp, Mus musculus
atccttctacggtcgcttcaggcac

SEQ ID NO: 79170 - DNA, 25 bp, Mus musculus
atccttgagactcatctgctctgag

SEQ ID NO: 79171 - DNA, 25 bp, Mus musculus
atccttgaggcgctgtactgcacgg

SEQ ID NO: 79172 - DNA, 25 bp, Mus musculus
atcctttttactgggcctggctgcc

SEQ ID NO: 79173 - DNA, 25 bp, Mus musculus
atcgaagtgacatcttctcctgatg

SEQ ID NO: 79174 - DNA, 25 bp, Mus musculus
atcgaggaaagtgtggagacgcccc

SEQ ID NO: 79175 - DNA, 25 bp, Mus musculus
atcgagggactcatggccagaccag

SEQ ID NO: 79176 - DNA, 25 bp, Mus musculus
atcgcagccactagcgcttctgcag

SEQ ID NO: 79177 - DNA, 25 bp, Mus musculus
atcgcaggtgtgatcgccatccagg

SEQ ID NO: 79178 - DNA, 25 bp, Mus musculus
atcgccaacagcaacgcggcaggcg

SEQ ID NO: 79179 - DNA, 25 bp, Mus musculus
atcgcccacaacttggtccacctcc

SEQ ID NO: 79180 - DNA, 25 bp, Mus musculus
atcgcccagcgtctgaaggaagccc

SEQ ID NO: 79181 - DNA, 25 bp, Mus musculus
atcgcgcacaggatcgaggctggca

SEQ ID NO: 79182 - DNA, 25 bp, Mus musculus
atcgcggcgcagaacctgggtcccg

SEQ ID NO: 79183 - DNA, 25 bp, Mus musculus
atcgctgccaagtactcgggctccc

SEQ ID NO: 79184 - DNA, 25 bp, Mus musculus
atcgctgcgctggtcgtcgacaacg

SEQ ID NO: 79185 - DNA, 25 bp, Mus musculus
atcgcttacacttgagaagaactac

SEQ ID NO: 79186 - DNA, 25 bp, Mus musculus
atcgcttggaccaggcgccattgca

SEQ ID NO: 79187 - DNA, 25 bp, Mus musculus
atcggaaggagcaagatcgggccaa

SEQ ID NO: 79188 - DNA, 25 bp, Mus musculus
atcggaatccgacttaccgcccgag

SEQ ID NO: 79189 - DNA, 25 bp, Mus musculus
atcggacagcgtttttacatcaaag

SEQ ID NO: 79190 - DNA, 25 bp, Mus musculus
atcggccgcaactcgtcgcagggct

SEQ ID NO: 79191 - DNA, 25 bp, Mus musculus
atcgggaaccaagcggagggtgctg

SEQ ID NO: 79192 - DNA, 25 bp, Mus musculus
atcgggagcacggtctacagcaagc

SEQ ID NO: 79193 - DNA, 25 bp, Mus musculus
atcgggcacaggagcgcctggctac

SEQ ID NO: 79194 - DNA, 25 bp, Mus musculus
atcgtgatcgctgccctgctggcta

SEQ ID NO: 79195 - DNA, 25 bp, Mus musculus
atcgtgatggacaagggcccactgc

SEQ ID NO: 79196 - DNA, 25 bp, Mus musculus
atcgtgcccgctttcagtctcttgg

SEQ ID NO: 79197 - DNA, 25 bp, Mus musculus
atcgtgcgcagactccagaacggcg

SEQ ID NO: 79198 - DNA, 25 bp, Mus musculus
atcgtggcgcgatcatgctccgggt

SEQ ID NO: 79199 - DNA, 25 bp, Mus musculus
atcgtggtgggaggacactccaaca

SEQ ID NO: 79200 - DNA, 25 bp, Mus musculus
atcgtgtcacctggaggctacgcgc

SEQ ID NO: 79201 - DNA, 25 bp, Mus musculus
atctaccagctcaagacccctacag

SEQ ID NO: 79202 - DNA, 25 bp, Mus musculus
atctaccgggcagcttcaaggacca

SEQ ID NO: 79203 - DNA, 25 bp, Mus musculus
atctactctgagttccgtgagattt

SEQ ID NO: 79204 - DNA, 25 bp, Mus musculus
atctagacacacaggccggagaggg

SEQ ID NO: 79205 - DNA, 25 bp, Mus musculus
atctcagtgtgtgcggatgccaggc

SEQ ID NO: 79206 - DNA, 25 bp, Mus musculus
atctcataccgcttccagcgaggcg

SEQ ID NO: 79207 - DNA, 25 bp, Mus musculus
atctcatctctgtgtgccctgcagc

SEQ ID NO: 79208 - DNA, 25 bp, Mus musculus
atctccccaggagagcaagtctaag

SEQ ID NO: 79209 - DNA, 25 bp, Mus musculus
atctctcagtagttccccgggtgga

SEQ ID NO: 79210 - DNA, 25 bp, Mus musculus
atctgacctaggatccctggccttg

SEQ ID NO: 79211 - DNA, 25 bp, Mus musculus
atctgacctcattaaagcaaccggg

SEQ ID NO: 79212 - DNA, 25 bp, Mus musculus
atctgaggccacgggcagccagacg

SEQ ID NO: 79213 - DNA, 25 bp, Mus musculus
atctgcctgtagcagcccagggacg

SEQ ID NO: 79214 - DNA, 25 bp, Mus musculus
atctgcgccctcatcgtgctgctgg

SEQ ID NO: 79215 - DNA, 25 bp, Mus musculus
atctgcggagtgacccaggactacg

SEQ ID NO: 79216 - DNA, 25 bp, Mus musculus
atctgctctgtggagcgggtgctcc

SEQ ID NO: 79217 - DNA, 25 bp, Mus musculus
atctggagagtctgataccatcagc

SEQ ID NO: 79218 - DNA, 25 bp, Mus musculus
atctggaggagcctgagcccctttt

SEQ ID NO: 79219 - DNA, 25 bp, Mus musculus
atctggcacttcaacatcctctggg

SEQ ID NO: 79220 - DNA, 25 bp, Mus musculus
atctgggattgtgtcttgagctgaa

SEQ ID NO: 79221 - DNA, 25 bp, Mus musculus
atctgttaaagacgtggctgacttc

SEQ ID NO: 79222 - DNA, 25 bp, Mus musculus
atcttaagaacatttcagaaaatag

SEQ ID NO: 79223 - DNA, 25 bp, Mus musculus
atcttccagcttgcgcgggacgtcg

SEQ ID NO: 79224 - DNA, 25 bp, Mus musculus
atcttcggtgccaccggcaggaccg

SEQ ID NO: 79225 - DNA, 25 bp, Mus musculus
atcttgctgctacatcgggctctgc

SEQ ID NO: 79226 - DNA, 25 bp, Mus musculus
atcttggaccccgggagaatccgcg

SEQ ID NO: 79227 - DNA, 25 bp, Mus musculus
atctttcctgttccgttatgccgac

SEQ ID NO: 79228 - DNA, 25 bp, Mus musculus
atctttggcagcctccccattggag

SEQ ID NO: 79229 - DNA, 25 bp, Mus musculus
atgaaacgaatgcataaagctgttc

SEQ ID NO: 79230 - DNA, 25 bp, Mus musculus
atgaacaggccgatccaggtcaagc

SEQ ID NO: 79231 - DNA, 25 bp, Mus musculus
atgaagacactggtcccaggcccga

SEQ ID NO: 79232 - DNA, 25 bp, Mus musculus
atgaagactatgagcggcgccgcag

SEQ ID NO: 79233 - DNA, 25 bp, Mus musculus
atgaagaggctctgcgaaggtcaag

SEQ ID NO: 79234 - DNA, 25 bp, Mus musculus
atgaaggagtcccaacaagtgccag

SEQ ID NO: 79235 - DNA, 25 bp, Mus musculus
atgaagtgccgccacctcctaacat

SEQ ID NO: 79236 - DNA, 25 bp, Mus musculus
atgaatatgggcacaacctggaccg

SEQ ID NO: 79237 - DNA, 25 bp, Mus musculus
atgaatccaggtggcaaccccatgg

SEQ ID NO: 79238 - DNA, 25 bp, Mus musculus
atgaatctcgcgaccacgtcagctg

SEQ ID NO: 79239 - DNA, 25 bp, Mus musculus
atgacaacattcaaggacctctgtg

SEQ ID NO: 79240 - DNA, 25 bp, Mus musculus
atgacaagatccagacccgggaagg

SEQ ID NO: 79241 - DNA, 25 bp, Mus musculus
atgacaagtacatccgacccgaggg

SEQ ID NO: 79242 - DNA, 25 bp, Mus musculus
atgacaccggtgaagacccagtgct

SEQ ID NO: 79243 - DNA, 25 bp, Mus musculus
atgacatccgtgactacagggcggc

SEQ ID NO: 79244 - DNA, 25 bp, Mus musculus
atgacatctactccagagacattgc

SEQ ID NO: 79245 - DNA, 25 bp, Mus musculus
atgacattcacctgctgtactcggg

SEQ ID NO: 79246 - DNA, 25 bp, Mus musculus
atgacccaaggttaactcagttggg

SEQ ID NO: 79247 - DNA, 25 bp, Mus musculus
atgaccgtgcgggagctcttcgact

SEQ ID NO: 79248 - DNA, 25 bp, Mus musculus
atgacctcgctgacccagcggagct

SEQ ID NO: 79249 - DNA, 25 bp, Mus musculus
atgacgacgctgaacacaggctccg

SEQ ID NO: 79250 - DNA, 25 bp, Mus musculus
atgacgacgtggaactgcggcctcg

SEQ ID NO: 79251 - DNA, 25 bp, Mus musculus
atgacgatatcgctgcgctggtcgt

SEQ ID NO: 79252 - DNA, 25 bp, Mus musculus
atgacgatcccagactggctccagg

SEQ ID NO: 79253 - DNA, 25 bp, Mus musculus
atgacgatgacgacaccgagcagag

SEQ ID NO: 79254 - DNA, 25 bp, Mus musculus
atgacgccctggacggagatgacga

SEQ ID NO: 79255 - DNA, 25 bp, Mus musculus
atgacggtcgtcagcttccaccagg

SEQ ID NO: 79256 - DNA, 25 bp, Mus musculus
atgactgtgtcttcacatacgactg

SEQ ID NO: 79257 - DNA, 25 bp, Mus musculus
atgactttctggcttccattgcttc

SEQ ID NO: 79258 - DNA, 25 bp, Mus musculus
atgagaaaacgctacagtgtggata

SEQ ID NO: 79259 - DNA, 25 bp, Mus musculus
atgagaacagccacatcatcctgtg

SEQ ID NO: 79260 - DNA, 25 bp, Mus musculus
atgagaagagtagctcacggagcgc

SEQ ID NO: 79261 - DNA, 25 bp, Mus musculus
atgagacggccctcccatgggcatg

SEQ ID NO: 79262 - DNA, 25 bp, Mus musculus
atgagatcgcacacgcagtcctggg

SEQ ID NO: 79263 - DNA, 25 bp, Mus musculus
atgagatctggcaccggaggcatga

SEQ ID NO: 79264 - DNA, 25 bp, Mus musculus
atgagcacgtcgctgaatgtcaaag

SEQ ID NO: 79265 - DNA, 25 bp, Mus musculus
atgagccccaccaaacgatgagtcc

SEQ ID NO: 79266 - DNA, 25 bp, Mus musculus
atgagcctgcaagcgccctgatgga

SEQ ID NO: 79267 - DNA, 25 bp, Mus musculus
atgagcgagggcagcgcgggcgacc

SEQ ID NO: 79268 - DNA, 25 bp, Mus musculus
atgagctcagccaagagtgcccgct

SEQ ID NO: 79269 - DNA, 25 bp, Mus musculus
atgagctgaccgtgggcctgtccag

SEQ ID NO: 79270 - DNA, 25 bp, Mus musculus
atgagctgacttgcatccccgaggg

SEQ ID NO: 79271 - DNA, 25 bp, Mus musculus
atgaggccgacttccgggacaagct

SEQ ID NO: 79272 - DNA, 25 bp, Mus musculus
atgagggcactcacctctgggaagg

SEQ ID NO: 79273 - DNA, 25 bp, Mus musculus
atgaggtccaaacacgcctgcaggc

SEQ ID NO: 79274 - DNA, 25 bp, Mus musculus
atgaggttgctacgaaggcgccaca

SEQ ID NO: 79275 - DNA, 25 bp, Mus musculus
atgatatcaagagggtcatggcggc

SEQ ID NO: 79276 - DNA, 25 bp, Mus musculus
atgatccatcccattcccgccgact

SEQ ID NO: 79277 - DNA, 25 bp, Mus musculus
atgatccccgcatcaagaaccagcg

SEQ ID NO: 79278 - DNA, 25 bp, Mus musculus
atgatgacggcgaagtgcaccggtc

SEQ ID NO: 79279 - DNA, 25 bp, Mus musculus
atgatgcctgggacctacgggcagc

SEQ ID NO: 79280 - DNA, 25 bp, Mus musculus
atgatgctgcctcccatgaagctgg

SEQ ID NO: 79281 - DNA, 25 bp, Mus musculus
atgatggtgtggattactgggccaa

SEQ ID NO: 79282 - DNA, 25 bp, Mus musculus
atgatgtatcccgtcccagtgagcc

SEQ ID NO: 79283 - DNA, 25 bp, Mus musculus
atgatgtgaggagacgcttggccca

SEQ ID NO: 79284 - DNA, 25 bp, Mus musculus
atgattacggcgaagaccctacggt

SEQ ID NO: 79285 - DNA, 25 bp, Mus musculus
atgattccccagcaacagagagaag

SEQ ID NO: 79286 - DNA, 25 bp, Mus musculus
atgatttgccgcaggacttgggaga

SEQ ID NO: 79287 - DNA, 25 bp, Mus musculus
atgcaacgggacatcgaacgcgagg

SEQ ID NO: 79288 - DNA, 25 bp, Mus musculus
atgcacgaacttcccgcgggacgtc

SEQ ID NO: 79289 - DNA, 25 bp, Mus musculus
atgcacgggtacatgctgaagctgg

SEQ ID NO: 79290 - DNA, 25 bp, Mus musculus
atgcactcaccagcaggaatgaaag

SEQ ID NO: 79291 - DNA, 25 bp, Mus musculus
atgcagaactgctgtgaggacctgg

SEQ ID NO: 79292 - DNA, 25 bp, Mus musculus
atgcagattccagtcagctcagccg

SEQ ID NO: 79293 - DNA, 25 bp, Mus musculus
atgcagtacactgctacaaaggaag

SEQ ID NO: 79294 - DNA, 25 bp, Mus musculus
atgcatgttaaaagactcctgaata

SEQ ID NO: 79295 - DNA, 25 bp, Mus musculus
atgccaagcagagggcagaatgaag

SEQ ID NO: 79296 - DNA, 25 bp, Mus musculus
atgccagcgaggtgctcatcacacc

SEQ ID NO: 79297 - DNA, 25 bp, Mus musculus
atgccagggctcagatccggaacct

SEQ ID NO: 79298 - DNA, 25 bp, Mus musculus
atgccatcatgccgactgccagcag

SEQ ID NO: 79299 - DNA, 25 bp, Mus musculus
atgcccatggtcactcggcggctga

SEQ ID NO: 79300 - DNA, 25 bp, Mus musculus
atgccccgagccagggcctggcagc

SEQ ID NO: 79301 - DNA, 25 bp, Mus musculus
atgccccggacactgactgcctccg

SEQ ID NO: 79302 - DNA, 25 bp, Mus musculus
atgccctggctcttgcctggacctt

SEQ ID NO: 79303 - DNA, 25 bp, Mus musculus
atgccctggtgaccccaactgtgtg

SEQ ID NO: 79304 - DNA, 25 bp, Mus musculus
atgccgaccaattgcgccgcggcgg

SEQ ID NO: 79305 - DNA, 25 bp, Mus musculus
atgccgctgctgatccttaccatca

SEQ ID NO: 79306 - DNA, 25 bp, Mus musculus
atgcctccaccttgttgccctgaaa

SEQ ID NO: 79307 - DNA, 25 bp, Mus musculus
atgcctgaatcctgggtgcctgccg

SEQ ID NO: 79308 - DNA, 25 bp, Mus musculus
atgccttggagagaaccactcacgc

SEQ ID NO: 79309 - DNA, 25 bp, Mus musculus
atgcgaaaagcaatggctgaggagc

SEQ ID NO: 79310 - DNA, 25 bp, Mus musculus
atgcgactctgttctcgtaatgacc

SEQ ID NO: 79311 - DNA, 25 bp, Mus musculus
atgcgagagcctgcgaggcccagca

SEQ ID NO: 79312 - DNA, 25 bp, Mus musculus
atgcgcaaagcgctctgccttcttt

SEQ ID NO: 79313 - DNA, 25 bp, Mus musculus
atgcgcaggtgctccccgtaaaatc

SEQ ID NO: 79314 - DNA, 25 bp, Mus musculus
atgcggatcatccacggccaggact

SEQ ID NO: 79315 - DNA, 25 bp, Mus musculus
atgcggcccgtctctcgccaggcgt

SEQ ID NO: 79316 - DNA, 25 bp, Mus musculus
atgcgggaggactgcccacctggcc

SEQ ID NO: 79317 - DNA, 25 bp, Mus musculus
atgcgttccgactcgctggtcccag

SEQ ID NO: 79318 - DNA, 25 bp, Mus musculus
atgctacgcagcctgttccgggcca

SEQ ID NO: 79319 - DNA, 25 bp, Mus musculus
atgctcacagtgctgctataccttg

SEQ ID NO: 79320 - DNA, 25 bp, Mus musculus
atgctcagcgaggaacctgccgcgg

SEQ ID NO: 79321 - DNA, 25 bp, Mus musculus
atgctcctgccgatggcctgaggcg

SEQ ID NO: 79322 - DNA, 25 bp, Mus musculus
atgctcgacatgctgacggaccgtt

SEQ ID NO: 79323 - DNA, 25 bp, Mus musculus
atgctgaactacagccatatctgga

SEQ ID NO: 79324 - DNA, 25 bp, Mus musculus
atgctgagacacatgcaccgctctg

SEQ ID NO: 79325 - DNA, 25 bp, Mus musculus
atgctgagcctgaggaccagccagc

SEQ ID NO: 79326 - DNA, 25 bp, Mus musculus
atgctgaggaagctgcggccgagaa

SEQ ID NO: 79327 - DNA, 25 bp, Mus musculus
atgctgccggcgaaagcgaagagcc

SEQ ID NO: 79328 - DNA, 25 bp, Mus musculus
atgctgcgacggaaaccgacccgct

SEQ ID NO: 79329 - DNA, 25 bp, Mus musculus
atgctgtccgccacacaggtctaca

SEQ ID NO: 79330 - DNA, 25 bp, Mus musculus
atgctgtggcgctgaaggctgcaat

SEQ ID NO: 79331 - DNA, 25 bp, Mus musculus
atgctgttcccgaaggagagcccgt

SEQ ID NO: 79332 - DNA, 25 bp, Mus musculus
atgctgttctggcacacgcagcccg

SEQ ID NO: 79333 - DNA, 25 bp, Mus musculus
atgcttaccgcggaggctccctgaa

SEQ ID NO: 79334 - DNA, 25 bp, Mus musculus
atgcttcctatcctctgtccttcag

SEQ ID NO: 79335 - DNA, 25 bp, Mus musculus
atggaaagaattgggaacagtggcc

SEQ ID NO: 79336 - DNA, 25 bp, Mus musculus
atggaaagaccacgataatgaagaa

SEQ ID NO: 79337 - DNA, 25 bp, Mus musculus
atggaaggaagcacaggagccggag

SEQ ID NO: 79338 - DNA, 25 bp, Mus musculus
atggacagccgctcggccgcgtggt

SEQ ID NO: 79339 - DNA, 25 bp, Mus musculus
atggacccgcaggacccaaaggtgc

SEQ ID NO: 79340 - DNA, 25 bp, Mus musculus
atggacgagaacgagaggacacctg

SEQ ID NO: 79341 - DNA, 25 bp, Mus musculus
atggagaaggaaggcgtactgaccc

SEQ ID NO: 79342 - DNA, 25 bp, Mus musculus
atggagagccaacctccctcgcggg

SEQ ID NO: 79343 - DNA, 25 bp, Mus musculus
atggagatgacttgattgtgacccc

SEQ ID NO: 79344 - DNA, 25 bp, Mus musculus
atggagattagtctttgaaaggagc

SEQ ID NO: 79345 - DNA, 25 bp, Mus musculus
atggagcaacacgtagaggcaggct

SEQ ID NO: 79346 - DNA, 25 bp, Mus musculus
atggagcacggactcaggagcatcc

SEQ ID NO: 79347 - DNA, 25 bp, Mus musculus
atggagccacaccacgtgaacggat

SEQ ID NO: 79348 - DNA, 25 bp, Mus musculus
atggagcctggatcagctggacccc

SEQ ID NO: 79349 - DNA, 25 bp, Mus musculus
atggagctccaggaaaccatcaaag

SEQ ID NO: 79350 - DNA, 25 bp, Mus musculus
atggaggccgagaggatccttccag

SEQ ID NO: 79351 - DNA, 25 bp, Mus musculus
atggaggcggcggatgttttccaca

SEQ ID NO: 79352 - DNA, 25 bp, Mus musculus
atggagtccccgagggaacacagct

SEQ ID NO: 79353 - DNA, 25 bp, Mus musculus
atggatgtaggtcatggttgtttca

SEQ ID NO: 79354 - DNA, 25 bp, Mus musculus
atggatgtccctctgcactgccgga

SEQ ID NO: 79355 - DNA, 25 bp, Mus musculus
atggatttggaagccctgtagaaac

SEQ ID NO: 79356 - DNA, 25 bp, Mus musculus
atggcaccaaccttggtttctacca

SEQ ID NO: 79357 - DNA, 25 bp, Mus musculus
atggcagtcgtggtcttactaggac

SEQ ID NO: 79358 - DNA, 25 bp, Mus musculus
atggccaagcgccactcaaaggctg

SEQ ID NO: 79359 - DNA, 25 bp, Mus musculus
atggccatgaggcagcaacccacac

SEQ ID NO: 79360 - DNA, 25 bp, Mus musculus
atggccatggttacccgctgcacac

SEQ ID NO: 79361 - DNA, 25 bp, Mus musculus
atggcccccgaagtggcaggacagt

SEQ ID NO: 79362 - DNA, 25 bp, Mus musculus
atggccccggacgagcaagttccta

SEQ ID NO: 79363 - DNA, 25 bp, Mus musculus
atggcctcggccgagctggattaca

SEQ ID NO: 79364 - DNA, 25 bp, Mus musculus
atggcgactccagtggtaagtcttt

SEQ ID NO: 79365 - DNA, 25 bp, Mus musculus
atggcgcgactggtggcagtgtgca

SEQ ID NO: 79366 - DNA, 25 bp, Mus musculus
atggcgcttgtaggacgacggccaa

SEQ ID NO: 79367 - DNA, 25 bp, Mus musculus
atggcggcggccgtccaggccgagt

SEQ ID NO: 79368 - DNA, 25 bp, Mus musculus
atggcgtggcccgtgttcctgcaga

SEQ ID NO: 79369 - DNA, 25 bp, Mus musculus
atggctctgcggctggtcactcact

SEQ ID NO: 79370 - DNA, 25 bp, Mus musculus
atggctgtgctctttgccaaactcg

SEQ ID NO: 79371 - DNA, 25 bp, Mus musculus
atggcttcggtggtccccgggcaat

SEQ ID NO: 79372 - DNA, 25 bp, Mus musculus
atgggaaatacctggccagcggagc

SEQ ID NO: 79373 - DNA, 25 bp, Mus musculus
atgggaccgcctccggcagctgttt

SEQ ID NO: 79374 - DNA, 25 bp, Mus musculus
atgggatccgcctgaagccagactc

SEQ ID NO: 79375 - DNA, 25 bp, Mus musculus
atgggccagccattacactctaggg

SEQ ID NO: 79376 - DNA, 25 bp, Mus musculus
atgggccggaccaactggagtgacc

SEQ ID NO: 79377 - DNA, 25 bp, Mus musculus
atgggcctgcaagggctgtatatca

SEQ ID NO: 79378 - DNA, 25 bp, Mus musculus
atgggcgggagctttactggacaca

SEQ ID NO: 79379 - DNA, 25 bp, Mus musculus
atgggctgctgcttcactaagagga

SEQ ID NO: 79380 - DNA, 25 bp, Mus musculus
atggggtatccatcgagggacagag

SEQ ID NO: 79381 - DNA, 25 bp, Mus musculus
atggtacaggtctggtggcctccca

SEQ ID NO: 79382 - DNA, 25 bp, Mus musculus
atggtaccaagaccagtatgcgcag

SEQ ID NO: 79383 - DNA, 25 bp, Mus musculus
atggtatccattcacagcctctctg

SEQ ID NO: 79384 - DNA, 25 bp, Mus musculus
atggtcatggtcacggacatggtca

SEQ ID NO: 79385 - DNA, 25 bp, Mus musculus
atggtctccacaccacaggcgtcca

SEQ ID NO: 79386 - DNA, 25 bp, Mus musculus
atggtgactacaacaaaggatccag

SEQ ID NO: 79387 - DNA, 25 bp, Mus musculus
atggtgagaagacgccagcggctcc

SEQ ID NO: 79388 - DNA, 25 bp, Mus musculus
atggtgatgctcctccagaccggct

SEQ ID NO: 79389 - DNA, 25 bp, Mus musculus
atggtgcagtcactgggctttgcca

SEQ ID NO: 79390 - DNA, 25 bp, Mus musculus
atggtgctccccatacaagatggcg

SEQ ID NO: 79391 - DNA, 25 bp, Mus musculus
atggtggaagtcaccctgcacccag

SEQ ID NO: 79392 - DNA, 25 bp, Mus musculus
atggttcccggagtgccgctcccgc

SEQ ID NO: 79393 - DNA, 25 bp, Mus musculus
atggtttcatggcaagatctccggc

SEQ ID NO: 79394 - DNA, 25 bp, Mus musculus
atggtttgctccacggctgccaaga

SEQ ID NO: 79395 - DNA, 25 bp, Mus musculus
atgtaaacgtgtccaaaataacgag

SEQ ID NO: 79396 - DNA, 25 bp, Mus musculus
atgtaacagaccaagagcgccgaag

SEQ ID NO: 79397 - DNA, 25 bp, Mus musculus
atgtaaggcaaatagccccggccgg

SEQ ID NO: 79398 - DNA, 25 bp, Mus musculus
atgtacaacccaaaaatggtgagtt

SEQ ID NO: 79399 - DNA, 25 bp, Mus musculus
atgtaccggcggaggtcccaatgct

SEQ ID NO: 79400 - DNA, 25 bp, Mus musculus
atgtagaggcccaagcagggacaga
